United States Patent 8,178,503 (RIBONUCLEIC ACID INTERFERENCE MOLECULES AND BINDING SITES DERIVED BY ANALYZING INTERGENIC AND INTRONIC REGIONS OF GENOMES) - sequence listing, part 16

SEQ ID NO: 677827 - DNA, 13 bp, D. melanogaster
tttgggccaactt

SEQ ID NO: 677828 - DNA, 13 bp, D. melanogaster
tttgggccaagtc

SEQ ID NO: 677829 - DNA, 13 bp, D. melanogaster
tttgggccaagtt

SEQ ID NO: 677830 - DNA, 13 bp, D. melanogaster
tttgggccaattt

SEQ ID NO: 677831 - DNA, 13 bp, D. melanogaster
tttgggccagatt

SEQ ID NO: 677832 - DNA, 13 bp, D. melanogaster
tttgggccagcaa

SEQ ID NO: 677833 - DNA, 14 bp, D. melanogaster
tttgggccaggcca

SEQ ID NO: 677834 - DNA, 13 bp, D. melanogaster
tttgggccataaa

SEQ ID NO: 677835 - DNA, 13 bp, D. melanogaster
tttgggccatctt

SEQ ID NO: 677836 - DNA, 14 bp, D. melanogaster
tttgggcctgcttt

SEQ ID NO: 677837 - DNA, 13 bp, D. melanogaster
tttgggcctggcc

SEQ ID NO: 677838 - DNA, 13 bp, D. melanogaster
tttgggcctggct

SEQ ID NO: 677839 - DNA, 13 bp, D. melanogaster
tttgggcgtggca

SEQ ID NO: 677840 - DNA, 13 bp, D. melanogaster
tttgggctccgtt

SEQ ID NO: 677841 - DNA, 13 bp, D. melanogaster
tttggggaaaaat

SEQ ID NO: 677842 - DNA, 13 bp, D. melanogaster
tttggggaaaaca

SEQ ID NO: 677843 - DNA, 13 bp, D. melanogaster
tttggggaaaatg

SEQ ID NO: 677844 - DNA, 13 bp, D. melanogaster
tttggggcaaaaa

SEQ ID NO: 677845 - DNA, 13 bp, D. melanogaster
tttggggcaactt

SEQ ID NO: 677846 - DNA, 13 bp, D. melanogaster
tttggggcagttt

SEQ ID NO: 677847 - DNA, 14 bp, D. melanogaster
tttggggcatttac

SEQ ID NO: 677848 - DNA, 13 bp, D. melanogaster
tttggggccaatg

SEQ ID NO: 677849 - DNA, 13 bp, D. melanogaster
tttggggcgtggc

SEQ ID NO: 677850 - DNA, 13 bp, D. melanogaster
tttggggttatta

SEQ ID NO: 677851 - DNA, 13 bp, D. melanogaster
tttgggtcaagtt

SEQ ID NO: 677852 - DNA, 13 bp, D. melanogaster
tttgggtcaattt

SEQ ID NO: 677853 - DNA, 13 bp, D. melanogaster
tttgggtcgattt

SEQ ID NO: 677854 - DNA, 13 bp, D. melanogaster
tttgggtggcaaa

SEQ ID NO: 677855 - DNA, 13 bp, D. melanogaster
tttgggtggcttc

SEQ ID NO: 677856 - DNA, 13 bp, D. melanogaster
tttgggtggtcca

SEQ ID NO: 677857 - DNA, 13 bp, D. melanogaster
tttgggtttcaaa

SEQ ID NO: 677858 - DNA, 14 bp, D. melanogaster
tttgggtttcattt

SEQ ID NO: 677859 - DNA, 13 bp, D. melanogaster
tttggtaaaaaat

SEQ ID NO: 677860 - DNA, 13 bp, D. melanogaster
tttggtaacattt

SEQ ID NO: 677861 - DNA, 13 bp, D. melanogaster
tttggtaattgaa

SEQ ID NO: 677862 - DNA, 13 bp, D. melanogaster
tttggtacatgtt

SEQ ID NO: 677863 - DNA, 13 bp, D. melanogaster
tttggtataaaat

SEQ ID NO: 677864 - DNA, 13 bp, D. melanogaster
tttggtatatata

SEQ ID NO: 677865 - DNA, 13 bp, D. melanogaster
tttggtatgcaaa

SEQ ID NO: 677866 - DNA, 13 bp, D. melanogaster
tttggtatttcaa

SEQ ID NO: 677867 - DNA, 13 bp, D. melanogaster
tttggtatttcat

SEQ ID NO: 677868 - DNA, 13 bp, D. melanogaster
tttggtatttggc

SEQ ID NO: 677869 - DNA, 13 bp, D. melanogaster
tttggtcaaaaat

SEQ ID NO: 677870 - DNA, 13 bp, D. melanogaster
tttggtcaataaa

SEQ ID NO: 677871 - DNA, 13 bp, D. melanogaster
tttggtcaatttg

SEQ ID NO: 677872 - DNA, 13 bp, D. melanogaster
tttggtcaatttt

SEQ ID NO: 677873 - DNA, 13 bp, D. melanogaster
tttggtcatatct

SEQ ID NO: 677874 - DNA, 13 bp, D. melanogaster
tttggtcatttgg

SEQ ID NO: 677875 - DNA, 14 bp, D. melanogaster
tttggtccttcgag

SEQ ID NO: 677876 - DNA, 14 bp, D. melanogaster
tttggtcgaaagct

SEQ ID NO: 677877 - DNA, 13 bp, D. melanogaster
tttggtctaaaaa

SEQ ID NO: 677878 - DNA, 14 bp, D. melanogaster
tttggtctaattat

SEQ ID NO: 677879 - DNA, 13 bp, D. melanogaster
tttggtctataat

SEQ ID NO: 677880 - DNA, 13 bp, D. melanogaster
tttggtgaaaaat

SEQ ID NO: 677881 - DNA, 13 bp, D. melanogaster
tttggtgcaactg

SEQ ID NO: 677882 - DNA, 13 bp, D. melanogaster
tttggtgcaattt

SEQ ID NO: 677883 - DNA, 13 bp, D. melanogaster
tttggtggaaaat

SEQ ID NO: 677884 - DNA, 14 bp, D. melanogaster
tttggtggacatca

SEQ ID NO: 677885 - DNA, 13 bp, D. melanogaster
tttggtggccatg

SEQ ID NO: 677886 - DNA, 13 bp, D. melanogaster
tttggtgtttgaa

SEQ ID NO: 677887 - DNA, 13 bp, D. melanogaster
tttggttaaaaat

SEQ ID NO: 677888 - DNA, 13 bp, D. melanogaster
tttggttaataat

SEQ ID NO: 677889 - DNA, 13 bp, D. melanogaster
tttggttacaatt

SEQ ID NO: 677890 - DNA, 14 bp, D. melanogaster
tttggttaccacct

SEQ ID NO: 677891 - DNA, 13 bp, D. melanogaster
tttggttagcaaa

SEQ ID NO: 677892 - DNA, 13 bp, D. melanogaster
tttggttagcttt

SEQ ID NO: 677893 - DNA, 13 bp, D. melanogaster
tttggttataaat

SEQ ID NO: 677894 - DNA, 13 bp, D. melanogaster
tttggttattcat

SEQ ID NO: 677895 - DNA, 13 bp, D. melanogaster
tttggttatttgc

SEQ ID NO: 677896 - DNA, 13 bp, D. melanogaster
tttggttcattaa

SEQ ID NO: 677897 - DNA, 13 bp, D. melanogaster
tttggttccattt

SEQ ID NO: 677898 - DNA, 13 bp, D. melanogaster
tttggttcgcttc

SEQ ID NO: 677899 - DNA, 14 bp, D. melanogaster
tttggttcggttcg

SEQ ID NO: 677900 - DNA, 13 bp, D. melanogaster
tttggttgaaaag

SEQ ID NO: 677901 - DNA, 13 bp, D. melanogaster
tttggttgcattt

SEQ ID NO: 677902 - DNA, 13 bp, D. melanogaster
tttggttgggaat

SEQ ID NO: 677903 - DNA, 13 bp, D. melanogaster
tttggtttaataa

SEQ ID NO: 677904 - DNA, 13 bp, D. melanogaster
tttggtttcaatt

SEQ ID NO: 677905 - DNA, 13 bp, D. melanogaster
tttggtttcagtt

SEQ ID NO: 677906 - DNA, 14 bp, D. melanogaster
tttggtttcagttt

SEQ ID NO: 677907 - DNA, 14 bp, D. melanogaster
tttggtttcatttc

SEQ ID NO: 677908 - DNA, 13 bp, D. melanogaster
tttggtttccatt

SEQ ID NO: 677909 - DNA, 14 bp, D. melanogaster
tttggtttcgattt

SEQ ID NO: 677910 - DNA, 13 bp, D. melanogaster
tttggtttgaaaa

SEQ ID NO: 677911 - DNA, 13 bp, D. melanogaster
tttggtttgaata

SEQ ID NO: 677912 - DNA, 13 bp, D. melanogaster
tttggtttggaaa

SEQ ID NO: 677913 - DNA, 13 bp, D. melanogaster
tttggttttaaaa

SEQ ID NO: 677914 - DNA, 14 bp, D. melanogaster
tttggttttaaaaa

SEQ ID NO: 677915 - DNA, 13 bp, D. melanogaster
tttggttttaaga

SEQ ID NO: 677916 - DNA, 13 bp, D. melanogaster
tttggttttcaaa

SEQ ID NO: 677917 - DNA, 13 bp, D. melanogaster
tttggttttcagt

SEQ ID NO: 677918 - DNA, 13 bp, D. melanogaster
tttggttttccaa

SEQ ID NO: 677919 - DNA, 13 bp, D. melanogaster
tttggttttccat

SEQ ID NO: 677920 - DNA, 13 bp, D. melanogaster
tttggttttgcca

SEQ ID NO: 677921 - DNA, 13 bp, D. melanogaster
tttggttttggca

SEQ ID NO: 677922 - DNA, 14 bp, D. melanogaster
tttggtttttggca

SEQ ID NO: 677923 - DNA, 13 bp, D. melanogaster
tttgtaaaaacta

SEQ ID NO: 677924 - DNA, 14 bp, D. melanogaster
tttgtaaaaactaa

SEQ ID NO: 677925 - DNA, 13 bp, D. melanogaster
tttgtaaaaagaa

SEQ ID NO: 677926 - DNA, 13 bp, D. melanogaster
tttgtaaaaatgt

SEQ ID NO: 677927 - DNA, 13 bp, D. melanogaster
tttgtaaaacaaa

SEQ ID NO: 677928 - DNA, 14 bp, D. melanogaster
tttgtaaaacaaaa

SEQ ID NO: 677929 - DNA, 14 bp, D. melanogaster
tttgtaaaagtggt

SEQ ID NO: 677930 - DNA, 13 bp, D. melanogaster
tttgtaaacaaaa

SEQ ID NO: 677931 - DNA, 14 bp, D. melanogaster
tttgtaaacaaaaa

SEQ ID NO: 677932 - DNA, 14 bp, D. melanogaster
tttgtaaacaaaat

SEQ ID NO: 677933 - DNA, 14 bp, D. melanogaster
tttgtaaacaaaca

SEQ ID NO: 677934 - DNA, 13 bp, D. melanogaster
tttgtaaacagtt

SEQ ID NO: 677935 - DNA, 13 bp, D. melanogaster
tttgtaaacattt

SEQ ID NO: 677936 - DNA, 14 bp, D. melanogaster
tttgtaaacattta

SEQ ID NO: 677937 - DNA, 14 bp, D. melanogaster
tttgtaaacatttt

SEQ ID NO: 677938 - DNA, 13 bp, D. melanogaster
tttgtaaacgttt

SEQ ID NO: 677939 - DNA, 13 bp, D. melanogaster
tttgtaaactatt

SEQ ID NO: 677940 - DNA, 13 bp, D. melanogaster
tttgtaaacttga

SEQ ID NO: 677941 - DNA, 13 bp, D. melanogaster
tttgtaaagtatt

SEQ ID NO: 677942 - DNA, 13 bp, D. melanogaster
tttgtaaagtccg

SEQ ID NO: 677943 - DNA, 13 bp, D. melanogaster
tttgtaaatactt

SEQ ID NO: 677944 - DNA, 13 bp, D. melanogaster
tttgtaaatggat

SEQ ID NO: 677945 - DNA, 13 bp, D. melanogaster
tttgtaaatgtta

SEQ ID NO: 677946 - DNA, 14 bp, D. melanogaster
tttgtaaatgttaa

SEQ ID NO: 677947 - DNA, 13 bp, D. melanogaster
tttgtaaattaca

SEQ ID NO: 677948 - DNA, 13 bp, D. melanogaster
tttgtaaattact

SEQ ID NO: 677949 - DNA, 14 bp, D. melanogaster
tttgtaaattgaaa

SEQ ID NO: 677950 - DNA, 13 bp, D. melanogaster
tttgtaaatttct

SEQ ID NO: 677951 - DNA, 14 bp, D. melanogaster
tttgtaaatttcta

SEQ ID NO: 677952 - DNA, 13 bp, D. melanogaster
tttgtaaccaaaa

SEQ ID NO: 677953 - DNA, 13 bp, D. melanogaster
tttgtaactaaat

SEQ ID NO: 677954 - DNA, 13 bp, D. melanogaster
tttgtaagcaaaa

SEQ ID NO: 677955 - DNA, 13 bp, D. melanogaster
tttgtaagcattt

SEQ ID NO: 677956 - DNA, 13 bp, D. melanogaster
tttgtaagccaaa

SEQ ID NO: 677957 - DNA, 13 bp, D. melanogaster
tttgtaataaact

SEQ ID NO: 677958 - DNA, 13 bp, D. melanogaster
tttgtaataactt

SEQ ID NO: 677959 - DNA, 13 bp, D. melanogaster
tttgtaataatgt

SEQ ID NO: 677960 - DNA, 13 bp, D. melanogaster
tttgtaatatttc

SEQ ID NO: 677961 - DNA, 13 bp, D. melanogaster
tttgtaatcattt

SEQ ID NO: 677962 - DNA, 13 bp, D. melanogaster
tttgtaatgatca

SEQ ID NO: 677963 - DNA, 13 bp, D. melanogaster
tttgtaatgcatt

SEQ ID NO: 677964 - DNA, 13 bp, D. melanogaster
tttgtaatggaat

SEQ ID NO: 677965 - DNA, 13 bp, D. melanogaster
tttgtaatgtaat

SEQ ID NO: 677966 - DNA, 13 bp, D. melanogaster
tttgtaattcatt

SEQ ID NO: 677967 - DNA, 13 bp, D. melanogaster
tttgtaattgaaa

SEQ ID NO: 677968 - DNA, 13 bp, D. melanogaster
tttgtaattgata

SEQ ID NO: 677969 - DNA, 13 bp, D. melanogaster
tttgtaattttca

SEQ ID NO: 677970 - DNA, 13 bp, D. melanogaster
tttgtacaacatt

SEQ ID NO: 677971 - DNA, 13 bp, D. melanogaster
tttgtacaataat

SEQ ID NO: 677972 - DNA, 13 bp, D. melanogaster
tttgtacaatata

SEQ ID NO: 677973 - DNA, 13 bp, D. melanogaster
tttgtacaattta

SEQ ID NO: 677974 - DNA, 13 bp, D. melanogaster
tttgtacaatttt

SEQ ID NO: 677975 - DNA, 13 bp, D. melanogaster
tttgtacacatgt

SEQ ID NO: 677976 - DNA, 13 bp, D. melanogaster
tttgtacacattt

SEQ ID NO: 677977 - DNA, 13 bp, D. melanogaster
tttgtacaccaca

SEQ ID NO: 677978 - DNA, 13 bp, D. melanogaster
tttgtacagactg

SEQ ID NO: 677979 - DNA, 14 bp, D. melanogaster
tttgtacatacata

SEQ ID NO: 677980 - DNA, 13 bp, D. melanogaster
tttgtacatatat

SEQ ID NO: 677981 - DNA, 14 bp, D. melanogaster
tttgtacatatgta

SEQ ID NO: 677982 - DNA, 14 bp, D. melanogaster
tttgtacatatttt

SEQ ID NO: 677983 - DNA, 13 bp, D. melanogaster
tttgtacattaaa

SEQ ID NO: 677984 - DNA, 13 bp, D. melanogaster
tttgtacattatt

SEQ ID NO: 677985 - DNA, 14 bp, D. melanogaster
tttgtacattttat

SEQ ID NO: 677986 - DNA, 13 bp, D. melanogaster
tttgtacattttc

SEQ ID NO: 677987 - DNA, 13 bp, D. melanogaster
tttgtacgatttt

SEQ ID NO: 677988 - DNA, 13 bp, D. melanogaster
tttgtactcattt

SEQ ID NO: 677989 - DNA, 13 bp, D. melanogaster
tttgtagaaaaaa

SEQ ID NO: 677990 - DNA, 13 bp, D. melanogaster
tttgtagaaaaat

SEQ ID NO: 677991 - DNA, 13 bp, D. melanogaster
tttgtagaattta

SEQ ID NO: 677992 - DNA, 13 bp, D. melanogaster
tttgtagatcaat

SEQ ID NO: 677993 - DNA, 13 bp, D. melanogaster
tttgtagcatact

SEQ ID NO: 677994 - DNA, 13 bp, D. melanogaster
tttgtagtagtgc

SEQ ID NO: 677995 - DNA, 13 bp, D. melanogaster
tttgtagtccagt

SEQ ID NO: 677996 - DNA, 13 bp, D. melanogaster
tttgtagttttcc

SEQ ID NO: 677997 - DNA, 13 bp, D. melanogaster
tttgtataaaatg

SEQ ID NO: 677998 - DNA, 13 bp, D. melanogaster
tttgtataaatct

SEQ ID NO: 677999 - DNA, 13 bp, D. melanogaster
tttgtataaattc

SEQ ID NO: 678000 - DNA, 13 bp, D. melanogaster
tttgtataacaat

SEQ ID NO: 678001 - DNA, 13 bp, D. melanogaster
tttgtataacttt

SEQ ID NO: 678002 - DNA, 13 bp, D. melanogaster
tttgtatacaaaa

SEQ ID NO: 678003 - DNA, 13 bp, D. melanogaster
tttgtatacatat

SEQ ID NO: 678004 - DNA, 13 bp, D. melanogaster
tttgtatacattt

SEQ ID NO: 678005 - DNA, 14 bp, D. melanogaster
tttgtatacatttt

SEQ ID NO: 678006 - DNA, 13 bp, D. melanogaster
tttgtatactaaa

SEQ ID NO: 678007 - DNA, 13 bp, D. melanogaster
tttgtatatatct

SEQ ID NO: 678008 - DNA, 13 bp, D. melanogaster
tttgtatatcaaa

SEQ ID NO: 678009 - DNA, 13 bp, D. melanogaster
tttgtatatcctt

SEQ ID NO: 678010 - DNA, 13 bp, D. melanogaster
tttgtatatgcat

SEQ ID NO: 678011 - DNA, 13 bp, D. melanogaster
tttgtatatttcc

SEQ ID NO: 678012 - DNA, 13 bp, D. melanogaster
tttgtatcaaaat

SEQ ID NO: 678013 - DNA, 13 bp, D. melanogaster
tttgtatccgtat

SEQ ID NO: 678014 - DNA, 13 bp, D. melanogaster
tttgtatctaatt

SEQ ID NO: 678015 - DNA, 14 bp, D. melanogaster
tttgtatctaattg

SEQ ID NO: 678016 - DNA, 13 bp, D. melanogaster
tttgtatctctat

SEQ ID NO: 678017 - DNA, 13 bp, D. melanogaster
tttgtatctgcaa

SEQ ID NO: 678018 - DNA, 13 bp, D. melanogaster
tttgtatctgcat

SEQ ID NO: 678019 - DNA, 13 bp, D. melanogaster
tttgtatctgtaa

SEQ ID NO: 678020 - DNA, 13 bp, D. melanogaster
tttgtatctgtgt

SEQ ID NO: 678021 - DNA, 14 bp, D. melanogaster
tttgtatctgtgtg

SEQ ID NO: 678022 - DNA, 13 bp, D. melanogaster
tttgtatcttaaa

SEQ ID NO: 678023 - DNA, 13 bp, D. melanogaster
tttgtatgaatgg

SEQ ID NO: 678024 - DNA, 13 bp, D. melanogaster
tttgtatgcattt

SEQ ID NO: 678025 - DNA, 13 bp, D. melanogaster
tttgtatgcgggc

SEQ ID NO: 678026 - DNA, 13 bp, D. melanogaster
tttgtatgctaat

SEQ ID NO: 678027 - DNA, 13 bp, D. melanogaster
tttgtatgtaaat

SEQ ID NO: 678028 - DNA, 13 bp, D. melanogaster
tttgtatgtgaat

SEQ ID NO: 678029 - DNA, 13 bp, D. melanogaster
tttgtatgttatc

SEQ ID NO: 678030 - DNA, 14 bp, D. melanogaster
tttgtattatttcc

SEQ ID NO: 678031 - DNA, 14 bp, D. melanogaster
tttgtattcaaatt

SEQ ID NO: 678032 - DNA, 13 bp, D. melanogaster
tttgtattcaatt

SEQ ID NO: 678033 - DNA, 13 bp, D. melanogaster
tttgtattccatt

SEQ ID NO: 678034 - DNA, 13 bp, D. melanogaster
tttgtattcgatt

SEQ ID NO: 678035 - DNA, 13 bp, D. melanogaster
tttgtattcgtgt

SEQ ID NO: 678036 - DNA, 13 bp, D. melanogaster
tttgtattgcctt

SEQ ID NO: 678037 - DNA, 13 bp, D. melanogaster
tttgtatttaact

SEQ ID NO: 678038 - DNA, 13 bp, D. melanogaster
tttgtatttacat

SEQ ID NO: 678039 - DNA, 13 bp, D. melanogaster
tttgtatttagcc

SEQ ID NO: 678040 - DNA, 13 bp, D. melanogaster
tttgtatttgcac

SEQ ID NO: 678041 - DNA, 13 bp, D. melanogaster
tttgtatttgcca

SEQ ID NO: 678042 - DNA, 13 bp, D. melanogaster
tttgtcaaaaaac

SEQ ID NO: 678043 - DNA, 13 bp, D. melanogaster
tttgtcaaaaatt

SEQ ID NO: 678044 - DNA, 13 bp, D. melanogaster
tttgtcaaaacaa

SEQ ID NO: 678045 - DNA, 13 bp, D. melanogaster
tttgtcaaaattg

SEQ ID NO: 678046 - DNA, 14 bp, D. melanogaster
tttgtcaaaattgt

SEQ ID NO: 678047 - DNA, 13 bp, D. melanogaster
tttgtcaaaattt

SEQ ID NO: 678048 - DNA, 13 bp, D. melanogaster
tttgtcaaacaaa

SEQ ID NO: 678049 - DNA, 13 bp, D. melanogaster
tttgtcaaatatt

SEQ ID NO: 678050 - DNA, 14 bp, D. melanogaster
tttgtcaaatattt

SEQ ID NO: 678051 - DNA, 13 bp, D. melanogaster
tttgtcaaatgca

SEQ ID NO: 678052 - DNA, 13 bp, D. melanogaster
tttgtcaaattat

SEQ ID NO: 678053 - DNA, 13 bp, D. melanogaster
tttgtcaaattga

SEQ ID NO: 678054 - DNA, 13 bp, D. melanogaster
tttgtcaacaatt

SEQ ID NO: 678055 - DNA, 13 bp, D. melanogaster
tttgtcaacagtt

SEQ ID NO: 678056 - DNA, 13 bp, D. melanogaster
tttgtcaactttt

SEQ ID NO: 678057 - DNA, 14 bp, D. melanogaster
tttgtcaacttttt

SEQ ID NO: 678058 - DNA, 13 bp, D. melanogaster
tttgtcaagaaac

SEQ ID NO: 678059 - DNA, 13 bp, D. melanogaster
tttgtcaataaaa

SEQ ID NO: 678060 - DNA, 13 bp, D. melanogaster
tttgtcaatgttt

SEQ ID NO: 678061 - DNA, 13 bp, D. melanogaster
tttgtcacagccc

SEQ ID NO: 678062 - DNA, 13 bp, D. melanogaster
tttgtcacatttt

SEQ ID NO: 678063 - DNA, 13 bp, D. melanogaster
tttgtcagccatt

SEQ ID NO: 678064 - DNA, 13 bp, D. melanogaster
tttgtcagctaaa

SEQ ID NO: 678065 - DNA, 13 bp, D. melanogaster
tttgtcagctgct

SEQ ID NO: 678066 - DNA, 13 bp, D. melanogaster
tttgtcagtttgt

SEQ ID NO: 678067 - DNA, 14 bp, D. melanogaster
tttgtcataatttt

SEQ ID NO: 678068 - DNA, 13 bp, D. melanogaster
tttgtcatatttc

SEQ ID NO: 678069 - DNA, 13 bp, D. melanogaster
tttgtcatccggc

SEQ ID NO: 678070 - DNA, 13 bp, D. melanogaster
tttgtcatgcaaa

SEQ ID NO: 678071 - DNA, 13 bp, D. melanogaster
tttgtcattaaaa

SEQ ID NO: 678072 - DNA, 13 bp, D. melanogaster
tttgtcattaaat

SEQ ID NO: 678073 - DNA, 13 bp, D. melanogaster
tttgtcattgtca

SEQ ID NO: 678074 - DNA, 13 bp, D. melanogaster
tttgtcatttgat

SEQ ID NO: 678075 - DNA, 13 bp, D. melanogaster
tttgtcatttgca

SEQ ID NO: 678076 - DNA, 13 bp, D. melanogaster
tttgtcatttggc

SEQ ID NO: 678077 - DNA, 13 bp, D. melanogaster
tttgtcatttgtg

SEQ ID NO: 678078 - DNA, 13 bp, D. melanogaster
tttgtcattttaa

SEQ ID NO: 678079 - DNA, 13 bp, D. melanogaster
tttgtccaaaatt

SEQ ID NO: 678080 - DNA, 13 bp, D. melanogaster
tttgtccactttg

SEQ ID NO: 678081 - DNA, 13 bp, D. melanogaster
tttgtccactttt

SEQ ID NO: 678082 - DNA, 13 bp, D. melanogaster
tttgtccgtttcc

SEQ ID NO: 678083 - DNA, 13 bp, D. melanogaster
tttgtcgccattt

SEQ ID NO: 678084 - DNA, 13 bp, D. melanogaster
tttgtcggaaaat

SEQ ID NO: 678085 - DNA, 13 bp, D. melanogaster
tttgtcggtacat

SEQ ID NO: 678086 - DNA, 13 bp, D. melanogaster
tttgtcgtttgcc

SEQ ID NO: 678087 - DNA, 13 bp, D. melanogaster
tttgtctaatttg

SEQ ID NO: 678088 - DNA, 13 bp, D. melanogaster
tttgtctactttg

SEQ ID NO: 678089 - DNA, 14 bp, D. melanogaster
tttgtctactttga

SEQ ID NO: 678090 - DNA, 13 bp, D. melanogaster
tttgtctatatat

SEQ ID NO: 678091 - DNA, 13 bp, D. melanogaster
tttgtctatttgc

SEQ ID NO: 678092 - DNA, 13 bp, D. melanogaster
tttgtctcaatgc

SEQ ID NO: 678093 - DNA, 13 bp, D. melanogaster
tttgtctgcagct

SEQ ID NO: 678094 - DNA, 13 bp, D. melanogaster
tttgtctgcattt

SEQ ID NO: 678095 - DNA, 13 bp, D. melanogaster
tttgtctgccatt

SEQ ID NO: 678096 - DNA, 13 bp, D. melanogaster
tttgtctgcgact

SEQ ID NO: 678097 - DNA, 13 bp, D. melanogaster
tttgtctgcgatt

SEQ ID NO: 678098 - DNA, 13 bp, D. melanogaster
tttgtctgctgct

SEQ ID NO: 678099 - DNA, 13 bp, D. melanogaster
tttgtctgcttta

SEQ ID NO: 678100 - DNA, 13 bp, D. melanogaster
tttgtctggccaa

SEQ ID NO: 678101 - DNA, 13 bp, D. melanogaster
tttgtctgtctgc

SEQ ID NO: 678102 - DNA, 13 bp, D. melanogaster
tttgtcttaatat

SEQ ID NO: 678103 - DNA, 14 bp, D. melanogaster
tttgtcttcccatt

SEQ ID NO: 678104 - DNA, 13 bp, D. melanogaster
tttgtcttgccaa

SEQ ID NO: 678105 - DNA, 13 bp, D. melanogaster
tttgtcttgtaaa

SEQ ID NO: 678106 - DNA, 13 bp, D. melanogaster
tttgtgaaaaaaa

SEQ ID NO: 678107 - DNA, 13 bp, D. melanogaster
tttgtgaaaaatt

SEQ ID NO: 678108 - DNA, 13 bp, D. melanogaster
tttgtgaaaatat

SEQ ID NO: 678109 - DNA, 13 bp, D. melanogaster
tttgtgaaaatca

SEQ ID NO: 678110 - DNA, 13 bp, D. melanogaster
tttgtgaaaatgt

SEQ ID NO: 678111 - DNA, 14 bp, D. melanogaster
tttgtgaaaattta

SEQ ID NO: 678112 - DNA, 13 bp, D. melanogaster
tttgtgaaacaaa

SEQ ID NO: 678113 - DNA, 14 bp, D. melanogaster
tttgtgaaactgat

SEQ ID NO: 678114 - DNA, 13 bp, D. melanogaster
tttgtgaaatatt

SEQ ID NO: 678115 - DNA, 13 bp, D. melanogaster
tttgtgaagaaga

SEQ ID NO: 678116 - DNA, 14 bp, D. melanogaster
tttgtgaagaagag

SEQ ID NO: 678117 - DNA, 13 bp, D. melanogaster
tttgtgaagacgg

SEQ ID NO: 678118 - DNA, 13 bp, D. melanogaster
tttgtgaataatt

SEQ ID NO: 678119 - DNA, 13 bp, D. melanogaster
tttgtgaatgaaa

SEQ ID NO: 678120 - DNA, 13 bp, D. melanogaster
tttgtgaatgtgc

SEQ ID NO: 678121 - DNA, 13 bp, D. melanogaster
tttgtgaattttc

SEQ ID NO: 678122 - DNA, 13 bp, D. melanogaster
tttgtgacttttc

SEQ ID NO: 678123 - DNA, 13 bp, D. melanogaster
tttgtgagaaaat

SEQ ID NO: 678124 - DNA, 13 bp, D. melanogaster
tttgtgagttgga

SEQ ID NO: 678125 - DNA, 13 bp, D. melanogaster
tttgtgataatat

SEQ ID NO: 678126 - DNA, 13 bp, D. melanogaster
tttgtgatggcat

SEQ ID NO: 678127 - DNA, 13 bp, D. melanogaster
tttgtgcaaaaac

SEQ ID NO: 678128 - DNA, 13 bp, D. melanogaster
tttgtgcaaaaat

SEQ ID NO: 678129 - DNA, 13 bp, D. melanogaster
tttgtgcaaaatt

SEQ ID NO: 678130 - DNA, 13 bp, D. melanogaster
tttgtgcaaatat

SEQ ID NO: 678131 - DNA, 13 bp, D. melanogaster
tttgtgcaacaat

SEQ ID NO: 678132 - DNA, 14 bp, D. melanogaster
tttgtgcaacattt

SEQ ID NO: 678133 - DNA, 13 bp, D. melanogaster
tttgtgcaatggt

SEQ ID NO: 678134 - DNA, 13 bp, D. melanogaster
tttgtgcacaaaa

SEQ ID NO: 678135 - DNA, 13 bp, D. melanogaster
tttgtgcagctgc

SEQ ID NO: 678136 - DNA, 13 bp, D. melanogaster
tttgtgcagtgca

SEQ ID NO: 678137 - DNA, 13 bp, D. melanogaster
tttgtgcagtgta

SEQ ID NO: 678138 - DNA, 13 bp, D. melanogaster
tttgtgcataaat

SEQ ID NO: 678139 - DNA, 13 bp, D. melanogaster
tttgtgcataata

SEQ ID NO: 678140 - DNA, 13 bp, D. melanogaster
tttgtgcatattt

SEQ ID NO: 678141 - DNA, 13 bp, D. melanogaster
tttgtgcatttcg

SEQ ID NO: 678142 - DNA, 13 bp, D. melanogaster
tttgtgcatttga

SEQ ID NO: 678143 - DNA, 13 bp, D. melanogaster
tttgtgcatttta

SEQ ID NO: 678144 - DNA, 13 bp, D. melanogaster
tttgtgcattttg

SEQ ID NO: 678145 - DNA, 14 bp, D. melanogaster
tttgtgcattttta

SEQ ID NO: 678146 - DNA, 14 bp, D. melanogaster
tttgtgcatttttc

SEQ ID NO: 678147 - DNA, 13 bp, D. melanogaster
tttgtgccaaaaa

SEQ ID NO: 678148 - DNA, 13 bp, D. melanogaster
tttgtgccacttt

SEQ ID NO: 678149 - DNA, 13 bp, D. melanogaster
tttgtgccagcag

SEQ ID NO: 678150 - DNA, 14 bp, D. melanogaster
tttgtgccagcaga

SEQ ID NO: 678151 - DNA, 13 bp, D. melanogaster
tttgtgccatttt

SEQ ID NO: 678152 - DNA, 14 bp, D. melanogaster
tttgtgccattttg

SEQ ID NO: 678153 - DNA, 13 bp, D. melanogaster
tttgtgcccattt

SEQ ID NO: 678154 - DNA, 13 bp, D. melanogaster
tttgtgcgaaaaa

SEQ ID NO: 678155 - DNA, 13 bp, D. melanogaster
tttgtgcgatttg

SEQ ID NO: 678156 - DNA, 13 bp, D. melanogaster
tttgtgcgctatt

SEQ ID NO: 678157 - DNA, 13 bp, D. melanogaster
tttgtgcgctgca

SEQ ID NO: 678158 - DNA, 13 bp, D. melanogaster
tttgtgcggagca

SEQ ID NO: 678159 - DNA, 14 bp, D. melanogaster
tttgtgcggagcac

SEQ ID NO: 678160 - DNA, 13 bp, D. melanogaster
tttgtgcggcatt

SEQ ID NO: 678161 - DNA, 13 bp, D. melanogaster
tttgtgcggctcc

SEQ ID NO: 678162 - DNA, 13 bp, D. melanogaster
tttgtgcggcttt

SEQ ID NO: 678163 - DNA, 13 bp, D. melanogaster
tttgtgcgtaaaa

SEQ ID NO: 678164 - DNA, 13 bp, D. melanogaster
tttgtgcgtttgc

SEQ ID NO: 678165 - DNA, 13 bp, D. melanogaster
tttgtgctaaaaa

SEQ ID NO: 678166 - DNA, 13 bp, D. melanogaster
tttgtgctaattt

SEQ ID NO: 678167 - DNA, 13 bp, D. melanogaster
tttgtgctcgcgt

SEQ ID NO: 678168 - DNA, 14 bp, D. melanogaster
tttgtgctcgcgtc

SEQ ID NO: 678169 - DNA, 13 bp, D. melanogaster
tttgtgctgcaca

SEQ ID NO: 678170 - DNA, 13 bp, D. melanogaster
tttgtgctgcact

SEQ ID NO: 678171 - DNA, 13 bp, D. melanogaster
tttgtgctgccaa

SEQ ID NO: 678172 - DNA, 13 bp, D. melanogaster
tttgtgctgctgc

SEQ ID NO: 678173 - DNA, 14 bp, D. melanogaster
tttgtgctgctgct

SEQ ID NO: 678174 - DNA, 13 bp, D. melanogaster
tttgtgctggcca

SEQ ID NO: 678175 - DNA, 13 bp, D. melanogaster
tttgtgcttatta

SEQ ID NO: 678176 - DNA, 13 bp, D. melanogaster
tttgtgcttgtgc

SEQ ID NO: 678177 - DNA, 13 bp, D. melanogaster
tttgtggaaagtt

SEQ ID NO: 678178 - DNA, 13 bp, D. melanogaster
tttgtggcaaaca

SEQ ID NO: 678179 - DNA, 13 bp, D. melanogaster
tttgtggcaaatg

SEQ ID NO: 678180 - DNA, 13 bp, D. melanogaster
tttgtggcacttg

SEQ ID NO: 678181 - DNA, 13 bp, D. melanogaster
tttgtggcacttt

SEQ ID NO: 678182 - DNA, 13 bp, D. melanogaster
tttgtggcagcca

SEQ ID NO: 678183 - DNA, 13 bp, D. melanogaster
tttgtggcagctg

SEQ ID NO: 678184 - DNA, 13 bp, D. melanogaster
tttgtggcatcaa

SEQ ID NO: 678185 - DNA, 13 bp, D. melanogaster
tttgtggcattgt

SEQ ID NO: 678186 - DNA, 13 bp, D. melanogaster
tttgtggcatttg

SEQ ID NO: 678187 - DNA, 14 bp, D. melanogaster
tttgtggcatttgt

SEQ ID NO: 678188 - DNA, 13 bp, D. melanogaster
tttgtggcatttt

SEQ ID NO: 678189 - DNA, 13 bp, D. melanogaster
tttgtggccaaag

SEQ ID NO: 678190 - DNA, 13 bp, D. melanogaster
tttgtggccaaca

SEQ ID NO: 678191 - DNA, 13 bp, D. melanogaster
tttgtggccaact

SEQ ID NO: 678192 - DNA, 14 bp, D. melanogaster
tttgtggccaataa

SEQ ID NO: 678193 - DNA, 13 bp, D. melanogaster
tttgtggccacaa

SEQ ID NO: 678194 - DNA, 13 bp, D. melanogaster
tttgtggccagca

SEQ ID NO: 678195 - DNA, 13 bp, D. melanogaster
tttgtggccataa

SEQ ID NO: 678196 - DNA, 13 bp, D. melanogaster
tttgtggcccaaa

SEQ ID NO: 678197 - DNA, 14 bp, D. melanogaster
tttgtggcccaaac

SEQ ID NO: 678198 - DNA, 13 bp, D. melanogaster
tttgtggcccact

SEQ ID NO: 678199 - DNA, 14 bp, D. melanogaster
tttgtggccttcga

SEQ ID NO: 678200 - DNA, 13 bp, D. melanogaster
tttgtggctcgtt

SEQ ID NO: 678201 - DNA, 13 bp, D. melanogaster
tttgtggctgcca

SEQ ID NO: 678202 - DNA, 13 bp, D. melanogaster
tttgtggctggca

SEQ ID NO: 678203 - DNA, 13 bp, D. melanogaster
tttgtggctttca

SEQ ID NO: 678204 - DNA, 13 bp, D. melanogaster
tttgtgggaaaaa

SEQ ID NO: 678205 - DNA, 13 bp, D. melanogaster
tttgtgggccaaa

SEQ ID NO: 678206 - DNA, 13 bp, D. melanogaster
tttgtgggtggca

SEQ ID NO: 678207 - DNA, 13 bp, D. melanogaster
tttgtggtaaatt

SEQ ID NO: 678208 - DNA, 13 bp, D. melanogaster
tttgtggttggcc

SEQ ID NO: 678209 - DNA, 14 bp, D. melanogaster
tttgtggttggcca

SEQ ID NO: 678210 - DNA, 13 bp, D. melanogaster
tttgtgtaaaatg

SEQ ID NO: 678211 - DNA, 13 bp, D. melanogaster
tttgtgtaaatat

SEQ ID NO: 678212 - DNA, 13 bp, D. melanogaster
tttgtgtaataaa

SEQ ID NO: 678213 - DNA, 13 bp, D. melanogaster
tttgtgtaatctt

SEQ ID NO: 678214 - DNA, 14 bp, D. melanogaster
tttgtgtaatcttt

SEQ ID NO: 678215 - DNA, 13 bp, D. melanogaster
tttgtgtacataa

SEQ ID NO: 678216 - DNA, 13 bp, D. melanogaster
tttgtgtacatat

SEQ ID NO: 678217 - DNA, 13 bp, D. melanogaster
tttgtgtacattt

SEQ ID NO: 678218 - DNA, 13 bp, D. melanogaster
tttgtgtatctat

SEQ ID NO: 678219 - DNA, 13 bp, D. melanogaster
tttgtgtatctgt

SEQ ID NO: 678220 - DNA, 13 bp, D. melanogaster
tttgtgtattaaa

SEQ ID NO: 678221 - DNA, 13 bp, D. melanogaster
tttgtgtcacatt

SEQ ID NO: 678222 - DNA, 13 bp, D. melanogaster
tttgtgtgaaatt

SEQ ID NO: 678223 - DNA, 13 bp, D. melanogaster
tttgtgtgacttt

SEQ ID NO: 678224 - DNA, 13 bp, D. melanogaster
tttgtgtgagctt

SEQ ID NO: 678225 - DNA, 13 bp, D. melanogaster
tttgtgtgcaaaa

SEQ ID NO: 678226 - DNA, 13 bp, D. melanogaster
tttgtgtgcactt

SEQ ID NO: 678227 - DNA, 14 bp, D. melanogaster
tttgtgtgcacttc

SEQ ID NO: 678228 - DNA, 13 bp, D. melanogaster
tttgtgtgcatgt

SEQ ID NO: 678229 - DNA, 13 bp, D. melanogaster
tttgtgtgcattt

SEQ ID NO: 678230 - DNA, 13 bp, D. melanogaster
tttgtgtgcgagt

SEQ ID NO: 678231 - DNA, 13 bp, D. melanogaster
tttgtgtgcgatt

SEQ ID NO: 678232 - DNA, 13 bp, D. melanogaster
tttgtgtgcgcaa

SEQ ID NO: 678233 - DNA, 13 bp, D. melanogaster
tttgtgtgcgtgc

SEQ ID NO: 678234 - DNA, 13 bp, D. melanogaster
tttgtgtgctggc

SEQ ID NO: 678235 - DNA, 13 bp, D. melanogaster
tttgtgtggcaaa

SEQ ID NO: 678236 - DNA, 13 bp, D. melanogaster
tttgtgtgttgca

SEQ ID NO: 678237 - DNA, 13 bp, D. melanogaster
tttgtgttcaatt

SEQ ID NO: 678238 - DNA, 13 bp, D. melanogaster
tttgtgttccatt

SEQ ID NO: 678239 - DNA, 13 bp, D. melanogaster
tttgtgttcgatt

SEQ ID NO: 678240 - DNA, 13 bp, D. melanogaster
tttgtgttgccaa

SEQ ID NO: 678241 - DNA, 13 bp, D. melanogaster
tttgtgtttaact

SEQ ID NO: 678242 - DNA, 14 bp, D. melanogaster
tttgtgtttaactt

SEQ ID NO: 678243 - DNA, 13 bp, D. melanogaster
tttgtgtttgcaa

SEQ ID NO: 678244 - DNA, 13 bp, D. melanogaster
tttgtgttttgca

SEQ ID NO: 678245 - DNA, 13 bp, D. melanogaster
tttgttaaaaagt

SEQ ID NO: 678246 - DNA, 13 bp, D. melanogaster
tttgttaaaacaa

SEQ ID NO: 678247 - DNA, 13 bp, D. melanogaster
tttgttaaaattc

SEQ ID NO: 678248 - DNA, 13 bp, D. melanogaster
tttgttaaacttt

SEQ ID NO: 678249 - DNA, 13 bp, D. melanogaster
tttgttaaaggtt

SEQ ID NO: 678250 - DNA, 13 bp, D. melanogaster
tttgttaaatcgc

SEQ ID NO: 678251 - DNA, 13 bp, D. melanogaster
tttgttaaattca

SEQ ID NO: 678252 - DNA, 14 bp, D. melanogaster
tttgttaacaaaat

SEQ ID NO: 678253 - DNA, 13 bp, D. melanogaster
tttgttaacaaat

SEQ ID NO: 678254 - DNA, 14 bp, D. melanogaster
tttgttaacaattt

SEQ ID NO: 678255 - DNA, 13 bp, D. melanogaster
tttgttaacacca

SEQ ID NO: 678256 - DNA, 14 bp, D. melanogaster
tttgttaacatttt

SEQ ID NO: 678257 - DNA, 13 bp, D. melanogaster
tttgttaactttg

SEQ ID NO: 678258 - DNA, 13 bp, D. melanogaster
tttgttaatcaaa

SEQ ID NO: 678259 - DNA, 13 bp, D. melanogaster
tttgttaatcact

SEQ ID NO: 678260 - DNA, 13 bp, D. melanogaster
tttgttaatcatt

SEQ ID NO: 678261 - DNA, 13 bp, D. melanogaster
tttgttaatgaaa

SEQ ID NO: 678262 - DNA, 14 bp, D. melanogaster
tttgttaatttgac

SEQ ID NO: 678263 - DNA, 13 bp, D. melanogaster
tttgttacaattt

SEQ ID NO: 678264 - DNA, 13 bp, D. melanogaster
tttgttacgaatt

SEQ ID NO: 678265 - DNA, 13 bp, D. melanogaster
tttgttactatta

SEQ ID NO: 678266 - DNA, 13 bp, D. melanogaster
tttgttagaaaaa

SEQ ID NO: 678267 - DNA, 13 bp, D. melanogaster
tttgttagccagc

SEQ ID NO: 678268 - DNA, 13 bp, D. melanogaster
tttgttatcaaaa

SEQ ID NO: 678269 - DNA, 13 bp, D. melanogaster
tttgttatcaata

SEQ ID NO: 678270 - DNA, 13 bp, D. melanogaster
tttgttatcataa

SEQ ID NO: 678271 - DNA, 13 bp, D. melanogaster
tttgttatcctgc

SEQ ID NO: 678272 - DNA, 13 bp, D. melanogaster
tttgttatgcaaa

SEQ ID NO: 678273 - DNA, 14 bp, D. melanogaster
tttgttatgcaaat

SEQ ID NO: 678274 - DNA, 13 bp, D. melanogaster
tttgttatgcact

SEQ ID NO: 678275 - DNA, 13 bp, D. melanogaster
tttgttatgcatt

SEQ ID NO: 678276 - DNA, 13 bp, D. melanogaster
tttgttatggaaa

SEQ ID NO: 678277 - DNA, 13 bp, D. melanogaster
tttgttatggcca

SEQ ID NO: 678278 - DNA, 13 bp, D. melanogaster
tttgttatgtact

SEQ ID NO: 678279 - DNA, 13 bp, D. melanogaster
tttgttattaaac

SEQ ID NO: 678280 - DNA, 13 bp, D. melanogaster
tttgttattaact

SEQ ID NO: 678281 - DNA, 13 bp, D. melanogaster
tttgttatttaca

SEQ ID NO: 678282 - DNA, 13 bp, D. melanogaster
tttgttcaaaagt

SEQ ID NO: 678283 - DNA, 13 bp, D. melanogaster
tttgttcaaatat

SEQ ID NO: 678284 - DNA, 13 bp, D. melanogaster
tttgttcaaattt

SEQ ID NO: 678285 - DNA, 13 bp, D. melanogaster
tttgttcaacaaa

SEQ ID NO: 678286 - DNA, 13 bp, D. melanogaster
tttgttcaagttt

SEQ ID NO: 678287 - DNA, 13 bp, D. melanogaster
tttgttcaatata

SEQ ID NO: 678288 - DNA, 13 bp, D. melanogaster
tttgttcacaatt

SEQ ID NO: 678289 - DNA, 13 bp, D. melanogaster
tttgttcacacat

SEQ ID NO: 678290 - DNA, 13 bp, D. melanogaster
tttgttcacgttg

SEQ ID NO: 678291 - DNA, 13 bp, D. melanogaster
tttgttcacttta

SEQ ID NO: 678292 - DNA, 13 bp, D. melanogaster
tttgttcagcttt

SEQ ID NO: 678293 - DNA, 13 bp, D. melanogaster
tttgttcagtgca

SEQ ID NO: 678294 - DNA, 14 bp, D. melanogaster
tttgttcagtgcac

SEQ ID NO: 678295 - DNA, 13 bp, D. melanogaster
tttgttcatttaa

SEQ ID NO: 678296 - DNA, 13 bp, D. melanogaster
tttgttcgaattt

SEQ ID NO: 678297 - DNA, 13 bp, D. melanogaster
tttgttcgagtgt

SEQ ID NO: 678298 - DNA, 13 bp, D. melanogaster
tttgttcgcattt

SEQ ID NO: 678299 - DNA, 13 bp, D. melanogaster
tttgttcgtacat

SEQ ID NO: 678300 - DNA, 13 bp, D. melanogaster
tttgttctaaaat

SEQ ID NO: 678301 - DNA, 13 bp, D. melanogaster
tttgttctatata

SEQ ID NO: 678302 - DNA, 13 bp, D. melanogaster
tttgttctgctgc

SEQ ID NO: 678303 - DNA, 13 bp, D. melanogaster
tttgttcttaaat

SEQ ID NO: 678304 - DNA, 13 bp, D. melanogaster
tttgttgaaaagt

SEQ ID NO: 678305 - DNA, 14 bp, D. melanogaster
tttgttgaaaagta

SEQ ID NO: 678306 - DNA, 13 bp, D. melanogaster
tttgttgaaatat

SEQ ID NO: 678307 - DNA, 13 bp, D. melanogaster
tttgttgaacaaa

SEQ ID NO: 678308 - DNA, 14 bp, D. melanogaster
tttgttgaactttt

SEQ ID NO: 678309 - DNA, 13 bp, D. melanogaster
tttgttgaataaa

SEQ ID NO: 678310 - DNA, 13 bp, D. melanogaster
tttgttgaatttc

SEQ ID NO: 678311 - DNA, 14 bp, D. melanogaster
tttgttgacatttt

SEQ ID NO: 678312 - DNA, 13 bp, D. melanogaster
tttgttgacttct

SEQ ID NO: 678313 - DNA, 13 bp, D. melanogaster
tttgttgacttta

SEQ ID NO: 678314 - DNA, 13 bp, D. melanogaster
tttgttgactttg

SEQ ID NO: 678315 - DNA, 13 bp, D. melanogaster
tttgttgattaaa

SEQ ID NO: 678316 - DNA, 13 bp, D. melanogaster
tttgttgattgaa

SEQ ID NO: 678317 - DNA, 13 bp, D. melanogaster
tttgttgcaaaac

SEQ ID NO: 678318 - DNA, 13 bp, D. melanogaster
tttgttgcaaaat

SEQ ID NO: 678319 - DNA, 13 bp, D. melanogaster
tttgttgcaaatt

SEQ ID NO: 678320 - DNA, 13 bp, D. melanogaster
tttgttgcaatca

SEQ ID NO: 678321 - DNA, 14 bp, D. melanogaster
tttgttgcatattt

SEQ ID NO: 678322 - DNA, 13 bp, D. melanogaster
tttgttgcatgca

SEQ ID NO: 678323 - DNA, 14 bp, D. melanogaster
tttgttgcattttg

SEQ ID NO: 678324 - DNA, 14 bp, D. melanogaster
tttgttgccaaaaa

SEQ ID NO: 678325 - DNA, 13 bp, D. melanogaster
tttgttgccacaa

SEQ ID NO: 678326 - DNA, 13 bp, D. melanogaster
tttgttgccattt

SEQ ID NO: 678327 - DNA, 14 bp, D. melanogaster
tttgttgccatttc

SEQ ID NO: 678328 - DNA, 14 bp, D. melanogaster
tttgttgccatttg

SEQ ID NO: 678329 - DNA, 13 bp, D. melanogaster
tttgttgccctgc

SEQ ID NO: 678330 - DNA, 13 bp, D. melanogaster
tttgttgcggaat

SEQ ID NO: 678331 - DNA, 13 bp, D. melanogaster
tttgttgctactt

SEQ ID NO: 678332 - DNA, 13 bp, D. melanogaster
tttgttgctattg

SEQ ID NO: 678333 - DNA, 13 bp, D. melanogaster
tttgttgctctgc

SEQ ID NO: 678334 - DNA, 14 bp, D. melanogaster
tttgttgctgccgc

SEQ ID NO: 678335 - DNA, 13 bp, D. melanogaster
tttgttgctgctg

SEQ ID NO: 678336 - DNA, 14 bp, D. melanogaster
tttgttgctgctgc

SEQ ID NO: 678337 - DNA, 13 bp, D. melanogaster
tttgttgctgtgc

SEQ ID NO: 678338 - DNA, 13 bp, D. melanogaster
tttgttggaaaat

SEQ ID NO: 678339 - DNA, 13 bp, D. melanogaster
tttgttggatttc

SEQ ID NO: 678340 - DNA, 13 bp, D. melanogaster
tttgttggcaaaa

SEQ ID NO: 678341 - DNA, 13 bp, D. melanogaster
tttgttggcaaca

SEQ ID NO: 678342 - DNA, 13 bp, D. melanogaster
tttgttggcaatt

SEQ ID NO: 678343 - DNA, 13 bp, D. melanogaster
tttgttggcagca

SEQ ID NO: 678344 - DNA, 13 bp, D. melanogaster
tttgttggccaac

SEQ ID NO: 678345 - DNA, 13 bp, D. melanogaster
tttgttggccaag

SEQ ID NO: 678346 - DNA, 13 bp, D. melanogaster
tttgttgggaatt

SEQ ID NO: 678347 - DNA, 13 bp, D. melanogaster
tttgttggtaaaa

SEQ ID NO: 678348 - DNA, 13 bp, D. melanogaster
tttgttggtaaat

SEQ ID NO: 678349 - DNA, 13 bp, D. melanogaster
tttgttggttaaa

SEQ ID NO: 678350 - DNA, 13 bp, D. melanogaster
tttgttgtcaaaa

SEQ ID NO: 678351 - DNA, 13 bp, D. melanogaster
tttgttgtctgcc

SEQ ID NO: 678352 - DNA, 13 bp, D. melanogaster
tttgttgtgcaat

SEQ ID NO: 678353 - DNA, 13 bp, D. melanogaster
tttgttgtgtaaa

SEQ ID NO: 678354 - DNA, 13 bp, D. melanogaster
tttgttgttactc

SEQ ID NO: 678355 - DNA, 14 bp, D. melanogaster
tttgttgttattgc

SEQ ID NO: 678356 - DNA, 13 bp, D. melanogaster
tttgttgttcaaa

SEQ ID NO: 678357 - DNA, 13 bp, D. melanogaster
tttgttgttgcag

SEQ ID NO: 678358 - DNA, 13 bp, D. melanogaster
tttgttgttgccg

SEQ ID NO: 678359 - DNA, 13 bp, D. melanogaster
tttgttgttggcc

SEQ ID NO: 678360 - DNA, 14 bp, D. melanogaster
tttgttgttggcca

SEQ ID NO: 678361 - DNA, 14 bp, D. melanogaster
tttgttgttgtaaa

SEQ ID NO: 678362 - DNA, 13 bp, D. melanogaster
tttgtttaaacaa

SEQ ID NO: 678363 - DNA, 14 bp, D. melanogaster
tttgtttaaactac

SEQ ID NO: 678364 - DNA, 14 bp, D. melanogaster
tttgtttaaacttt

SEQ ID NO: 678365 - DNA, 13 bp, D. melanogaster
tttgtttaaatgc

SEQ ID NO: 678366 - DNA, 14 bp, D. melanogaster
tttgtttaacaaat

SEQ ID NO: 678367 - DNA, 13 bp, D. melanogaster
tttgtttaacatt

SEQ ID NO: 678368 - DNA, 14 bp, D. melanogaster
tttgtttaacattt

SEQ ID NO: 678369 - DNA, 13 bp, D. melanogaster
tttgtttaactta

SEQ ID NO: 678370 - DNA, 13 bp, D. melanogaster
tttgtttaagaaa

SEQ ID NO: 678371 - DNA, 14 bp, D. melanogaster
tttgtttaatgaaa

SEQ ID NO: 678372 - DNA, 13 bp, D. melanogaster
tttgtttaatgct

SEQ ID NO: 678373 - DNA, 13 bp, D. melanogaster
tttgtttaatggc

SEQ ID NO: 678374 - DNA, 13 bp, D. melanogaster
tttgtttaattcg

SEQ ID NO: 678375 - DNA, 13 bp, D. melanogaster
tttgtttacaatg

SEQ ID NO: 678376 - DNA, 13 bp, D. melanogaster
tttgtttacaatt

SEQ ID NO: 678377 - DNA, 14 bp, D. melanogaster
tttgtttacaattt

SEQ ID NO: 678378 - DNA, 13 bp, D. melanogaster
tttgtttacacat

SEQ ID NO: 678379 - DNA, 13 bp, D. melanogaster
tttgtttaccaat

SEQ ID NO: 678380 - DNA, 13 bp, D. melanogaster
tttgtttacccca

SEQ ID NO: 678381 - DNA, 13 bp, D. melanogaster
tttgtttacctat

SEQ ID NO: 678382 - DNA, 13 bp, D. melanogaster
tttgtttacctct

SEQ ID NO: 678383 - DNA, 13 bp, D. melanogaster
tttgtttaccttg

SEQ ID NO: 678384 - DNA, 14 bp, D. melanogaster
tttgtttacctttg

SEQ ID NO: 678385 - DNA, 13 bp, D. melanogaster
tttgtttacgaaa

SEQ ID NO: 678386 - DNA, 13 bp, D. melanogaster
tttgtttacgcaa

SEQ ID NO: 678387 - DNA, 13 bp, D. melanogaster
tttgtttacggtt

SEQ ID NO: 678388 - DNA, 13 bp, D. melanogaster
tttgtttactcaa

SEQ ID NO: 678389 - DNA, 13 bp, D. melanogaster
tttgtttactgct

SEQ ID NO: 678390 - DNA, 13 bp, D. melanogaster
tttgtttagaaaa

SEQ ID NO: 678391 - DNA, 13 bp, D. melanogaster
tttgtttagacaa

SEQ ID NO: 678392 - DNA, 13 bp, D. melanogaster
tttgtttataaac

SEQ ID NO: 678393 - DNA, 14 bp, D. melanogaster
tttgtttataaaca

SEQ ID NO: 678394 - DNA, 13 bp, D. melanogaster
tttgtttatacga

SEQ ID NO: 678395 - DNA, 13 bp, D. melanogaster
tttgtttatagaa

SEQ ID NO: 678396 - DNA, 14 bp, D. melanogaster
tttgtttatagaaa

SEQ ID NO: 678397 - DNA, 13 bp, D. melanogaster
tttgtttatatgc

SEQ ID NO: 678398 - DNA, 14 bp, D. melanogaster
tttgtttatgcaaa

SEQ ID NO: 678399 - DNA, 14 bp, D. melanogaster
tttgtttatgcatt

SEQ ID NO: 678400 - DNA, 13 bp, D. melanogaster
tttgtttatgccc

SEQ ID NO: 678401 - DNA, 14 bp, D. melanogaster
tttgtttatggcca

SEQ ID NO: 678402 - DNA, 13 bp, D. melanogaster
tttgtttattcaa

SEQ ID NO: 678403 - DNA, 14 bp, D. melanogaster
tttgtttatttaca

SEQ ID NO: 678404 - DNA, 13 bp, D. melanogaster
tttgtttcagtgt

SEQ ID NO: 678405 - DNA, 13 bp, D. melanogaster
tttgtttccaaaa

SEQ ID NO: 678406 - DNA, 13 bp, D. melanogaster
tttgtttccaaat

SEQ ID NO: 678407 - DNA, 13 bp, D. melanogaster
tttgtttccaatt

SEQ ID NO: 678408 - DNA, 13 bp, D. melanogaster
tttgtttccagtg

SEQ ID NO: 678409 - DNA, 13 bp, D. melanogaster
tttgtttccatta

SEQ ID NO: 678410 - DNA, 13 bp, D. melanogaster
tttgtttcccatt

SEQ ID NO: 678411 - DNA, 13 bp, D. melanogaster
tttgtttccgcag

SEQ ID NO: 678412 - DNA, 13 bp, D. melanogaster
tttgtttcgagtg

SEQ ID NO: 678413 - DNA, 13 bp, D. melanogaster
tttgtttcgcctg

SEQ ID NO: 678414 - DNA, 13 bp, D. melanogaster
tttgtttcgtcac

SEQ ID NO: 678415 - DNA, 13 bp, D. melanogaster
tttgtttctccga

SEQ ID NO: 678416 - DNA, 14 bp, D. melanogaster
tttgtttctccgaa

SEQ ID NO: 678417 - DNA, 13 bp, D. melanogaster
tttgtttctgcaa

SEQ ID NO: 678418 - DNA, 13 bp, D. melanogaster
tttgtttgaaaaa

SEQ ID NO: 678419 - DNA, 13 bp, D. melanogaster
tttgtttgaaaac

SEQ ID NO: 678420 - DNA, 13 bp, D. melanogaster
tttgtttgaaaat

SEQ ID NO: 678421 - DNA, 13 bp, D. melanogaster
tttgtttgaaatg

SEQ ID NO: 678422 - DNA, 13 bp, D. melanogaster
tttgtttgaactc

SEQ ID NO: 678423 - DNA, 13 bp, D. melanogaster
tttgtttgagttc

SEQ ID NO: 678424 - DNA, 13 bp, D. melanogaster
tttgtttgcaaaa

SEQ ID NO: 678425 - DNA, 13 bp, D. melanogaster
tttgtttgcaaat

SEQ ID NO: 678426 - DNA, 13 bp, D. melanogaster
tttgtttgcaatt

SEQ ID NO: 678427 - DNA, 14 bp, D. melanogaster
tttgtttgcaattt

SEQ ID NO: 678428 - DNA, 13 bp, D. melanogaster
tttgtttgcactt

SEQ ID NO: 678429 - DNA, 13 bp, D. melanogaster
tttgtttgcatgc

SEQ ID NO: 678430 - DNA, 13 bp, D. melanogaster
tttgtttgcattc

SEQ ID NO: 678431 - DNA, 14 bp, D. melanogaster
tttgtttgcatttc

SEQ ID NO: 678432 - DNA, 13 bp, D. melanogaster
tttgtttgccaaa

SEQ ID NO: 678433 - DNA, 14 bp, D. melanogaster
tttgtttgccaaaa

SEQ ID NO: 678434 - DNA, 14 bp, D. melanogaster
tttgtttgccaaat

SEQ ID NO: 678435 - DNA, 13 bp, D. melanogaster
tttgtttgccaag

SEQ ID NO: 678436 - DNA, 13 bp, D. melanogaster
tttgtttgccaat

SEQ ID NO: 678437 - DNA, 13 bp, D. melanogaster
tttgtttgccagc

SEQ ID NO: 678438 - DNA, 14 bp, D. melanogaster
tttgtttgccagct

SEQ ID NO: 678439 - DNA, 13 bp, D. melanogaster
tttgtttgccata

SEQ ID NO: 678440 - DNA, 14 bp, D. melanogaster
tttgtttgccattg

SEQ ID NO: 678441 - DNA, 14 bp, D. melanogaster
tttgtttgccattt

SEQ ID NO: 678442 - DNA, 13 bp, D. melanogaster
tttgtttgcccaa

SEQ ID NO: 678443 - DNA, 14 bp, D. melanogaster
tttgtttgcccagc

SEQ ID NO: 678444 - DNA, 14 bp, D. melanogaster
tttgtttgcccatt

SEQ ID NO: 678445 - DNA, 13 bp, D. melanogaster
tttgtttgcctgc

SEQ ID NO: 678446 - DNA, 14 bp, D. melanogaster
tttgtttgcctgct

SEQ ID NO: 678447 - DNA, 14 bp, D. melanogaster
tttgtttgccttgc

SEQ ID NO: 678448 - DNA, 13 bp, D. melanogaster
tttgtttgcgaaa

SEQ ID NO: 678449 - DNA, 13 bp, D. melanogaster
tttgtttgcgatt

SEQ ID NO: 678450 - DNA, 13 bp, D. melanogaster
tttgtttgcggca

SEQ ID NO: 678451 - DNA, 13 bp, D. melanogaster
tttgtttgcggct

SEQ ID NO: 678452 - DNA, 13 bp, D. melanogaster
tttgtttgctcaa

SEQ ID NO: 678453 - DNA, 13 bp, D. melanogaster
tttgtttgctcgc

SEQ ID NO: 678454 - DNA, 13 bp, D. melanogaster
tttgtttgctgat

SEQ ID NO: 678455 - DNA, 13 bp, D. melanogaster
tttgtttgctggc

SEQ ID NO: 678456 - DNA, 14 bp, D. melanogaster
tttgtttgctttaa

SEQ ID NO: 678457 - DNA, 13 bp, D. melanogaster
tttgtttggactt

SEQ ID NO: 678458 - DNA, 14 bp, D. melanogaster
tttgtttggcaaaa

SEQ ID NO: 678459 - DNA, 13 bp, D. melanogaster
tttgtttggcaac

SEQ ID NO: 678460 - DNA, 13 bp, D. melanogaster
tttgtttggcatt

SEQ ID NO: 678461 - DNA, 13 bp, D. melanogaster
tttgtttggccaa

SEQ ID NO: 678462 - DNA, 14 bp, D. melanogaster
tttgtttggccaaa

SEQ ID NO: 678463 - DNA, 14 bp, D. melanogaster
tttgtttggccaac

SEQ ID NO: 678464 - DNA, 13 bp, D. melanogaster
tttgtttggccag

SEQ ID NO: 678465 - DNA, 13 bp, D. melanogaster
tttgtttggccat

SEQ ID NO: 678466 - DNA, 13 bp, D. melanogaster
tttgtttggctaa

SEQ ID NO: 678467 - DNA, 13 bp, D. melanogaster
tttgtttggtcaa

SEQ ID NO: 678468 - DNA, 13 bp, D. melanogaster
tttgtttgtaaaa

SEQ ID NO: 678469 - DNA, 14 bp, D. melanogaster
tttgtttgtaaaca

SEQ ID NO: 678470 - DNA, 13 bp, D. melanogaster
tttgtttgtaact

SEQ ID NO: 678471 - DNA, 13 bp, D. melanogaster
tttgtttgtacat

SEQ ID NO: 678472 - DNA, 13 bp, D. melanogaster
tttgtttgtcggc

SEQ ID NO: 678473 - DNA, 13 bp, D. melanogaster
tttgtttgtgccc

SEQ ID NO: 678474 - DNA, 13 bp, D. melanogaster
tttgtttgtggaa

SEQ ID NO: 678475 - DNA, 13 bp, D. melanogaster
tttgtttgttcaa

SEQ ID NO: 678476 - DNA, 13 bp, D. melanogaster
tttgttttaaact

SEQ ID NO: 678477 - DNA, 13 bp, D. melanogaster
tttgttttaagcc

SEQ ID NO: 678478 - DNA, 15 bp, D. melanogaster
tttgttttacccatt

SEQ ID NO: 678479 - DNA, 13 bp, D. melanogaster
tttgttttatgca

SEQ ID NO: 678480 - DNA, 13 bp, D. melanogaster
tttgttttcaaag

SEQ ID NO: 678481 - DNA, 13 bp, D. melanogaster
tttgttttcaagt

SEQ ID NO: 678482 - DNA, 13 bp, D. melanogaster
tttgttttcaata

SEQ ID NO: 678483 - DNA, 13 bp, D. melanogaster
tttgttttcagct

SEQ ID NO: 678484 - DNA, 13 bp, D. melanogaster
tttgttttcagtg

SEQ ID NO: 678485 - DNA, 14 bp, D. melanogaster
tttgttttcagtgc

SEQ ID NO: 678486 - DNA, 14 bp, D. melanogaster
tttgttttcattaa

SEQ ID NO: 678487 - DNA, 13 bp, D. melanogaster
tttgttttccaac

SEQ ID NO: 678488 - DNA, 14 bp, D. melanogaster
tttgttttccaatt

SEQ ID NO: 678489 - DNA, 13 bp, D. melanogaster
tttgttttccact

SEQ ID NO: 678490 - DNA, 13 bp, D. melanogaster
tttgttttcctca

SEQ ID NO: 678491 - DNA, 14 bp, D. melanogaster
tttgttttcgctgc

SEQ ID NO: 678492 - DNA, 13 bp, D. melanogaster
tttgttttcggcc

SEQ ID NO: 678493 - DNA, 13 bp, D. melanogaster
tttgttttcgggc

SEQ ID NO: 678494 - DNA, 13 bp, D. melanogaster
tttgttttgaaaa

SEQ ID NO: 678495 - DNA, 13 bp, D. melanogaster
tttgttttgaaag

SEQ ID NO: 678496 - DNA, 13 bp, D. melanogaster
tttgttttgactg

SEQ ID NO: 678497 - DNA, 13 bp, D. melanogaster
tttgttttgcaat

SEQ ID NO: 678498 - DNA, 14 bp, D. melanogaster
tttgttttgcaatt

SEQ ID NO: 678499 - DNA, 13 bp, D. melanogaster
tttgttttgcact

SEQ ID NO: 678500 - DNA, 13 bp, D. melanogaster
tttgttttgccaa

SEQ ID NO: 678501 - DNA, 14 bp, D. melanogaster
tttgttttgccatt

SEQ ID NO: 678502 - DNA, 13 bp, D. melanogaster
tttgttttggcca

SEQ ID NO: 678503 - DNA, 14 bp, D. melanogaster
tttgttttgggaaa

SEQ ID NO: 678504 - DNA, 13 bp, D. melanogaster
tttgttttggtca

SEQ ID NO: 678505 - DNA, 13 bp, D. melanogaster
tttgtttttaaac

SEQ ID NO: 678506 - DNA, 13 bp, D. melanogaster
tttgtttttcaag

SEQ ID NO: 678507 - DNA, 14 bp, D. melanogaster
tttgtttttcacat

SEQ ID NO: 678508 - DNA, 13 bp, D. melanogaster
tttgtttttccaa

SEQ ID NO: 678509 - DNA, 13 bp, D. melanogaster
tttgtttttgcaa

SEQ ID NO: 678510 - DNA, 13 bp, D. melanogaster
tttgtttttgcca

SEQ ID NO: 678511 - DNA, 14 bp, D. melanogaster
tttgtttttgccat

SEQ ID NO: 678512 - DNA, 14 bp, D. melanogaster
tttgtttttggaaa

SEQ ID NO: 678513 - DNA, 13 bp, D. melanogaster
ttttaaaaacaag

SEQ ID NO: 678514 - DNA, 13 bp, D. melanogaster
ttttaaaaacaca

SEQ ID NO: 678515 - DNA, 13 bp, D. melanogaster
ttttaaaaacact

SEQ ID NO: 678516 - DNA, 13 bp, D. melanogaster
ttttaaaaaccaa

SEQ ID NO: 678517 - DNA, 13 bp, D. melanogaster
ttttaaaaactac

SEQ ID NO: 678518 - DNA, 13 bp, D. melanogaster
ttttaaaaagctt

SEQ ID NO: 678519 - DNA, 13 bp, D. melanogaster
ttttaaaaaggta

SEQ ID NO: 678520 - DNA, 13 bp, D. melanogaster
ttttaaaaagtgt

SEQ ID NO: 678521 - DNA, 13 bp, D. melanogaster
ttttaaaaatgag

SEQ ID NO: 678522 - DNA, 13 bp, D. melanogaster
ttttaaaacaaca

SEQ ID NO: 678523 - DNA, 14 bp, D. melanogaster
ttttaaaacacttt

SEQ ID NO: 678524 - DNA, 13 bp, D. melanogaster
ttttaaaacatgt

SEQ ID NO: 678525 - DNA, 13 bp, D. melanogaster
ttttaaaacattg

SEQ ID NO: 678526 - DNA, 14 bp, D. melanogaster
ttttaaaaccattt

SEQ ID NO: 678527 - DNA, 13 bp, D. melanogaster
ttttaaaacccaa

SEQ ID NO: 678528 - DNA, 13 bp, D. melanogaster
ttttaaaaccgaa

SEQ ID NO: 678529 - DNA, 13 bp, D. melanogaster
ttttaaaacctaa

SEQ ID NO: 678530 - DNA, 13 bp, D. melanogaster
ttttaaaacggaa

SEQ ID NO: 678531 - DNA, 14 bp, D. melanogaster
ttttaaaacgtttt

SEQ ID NO: 678532 - DNA, 13 bp, D. melanogaster
ttttaaaactgat

SEQ ID NO: 678533 - DNA, 14 bp, D. melanogaster
ttttaaaactgttc

SEQ ID NO: 678534 - DNA, 13 bp, D. melanogaster
ttttaaaacttgt

SEQ ID NO: 678535 - DNA, 13 bp, D. melanogaster
ttttaaaagaaac

SEQ ID NO: 678536 - DNA, 13 bp, D. melanogaster
ttttaaaagactt

SEQ ID NO: 678537 - DNA, 13 bp, D. melanogaster
ttttaaaagagtt

SEQ ID NO: 678538 - DNA, 13 bp, D. melanogaster
ttttaaaagcaaa

SEQ ID NO: 678539 - DNA, 13 bp, D. melanogaster
ttttaaaagcatt

SEQ ID NO: 678540 - DNA, 14 bp, D. melanogaster
ttttaaaagcattt

SEQ ID NO: 678541 - DNA, 13 bp, D. melanogaster
ttttaaaagctaa

SEQ ID NO: 678542 - DNA, 13 bp, D. melanogaster
ttttaaaaggtat

SEQ ID NO: 678543 - DNA, 13 bp, D. melanogaster
ttttaaaaggttt

SEQ ID NO: 678544 - DNA, 13 bp, D. melanogaster
ttttaaaagtact

SEQ ID NO: 678545 - DNA, 13 bp, D. melanogaster
ttttaaaagtgca

SEQ ID NO: 678546 - DNA, 13 bp, D. melanogaster
ttttaaaatagct

SEQ ID NO: 678547 - DNA, 13 bp, D. melanogaster
ttttaaaatatgc

SEQ ID NO: 678548 - DNA, 13 bp, D. melanogaster
ttttaaaatctct

SEQ ID NO: 678549 - DNA, 13 bp, D. melanogaster
ttttaaaatgcaa

SEQ ID NO: 678550 - DNA, 13 bp, D. melanogaster
ttttaaaatgctg

SEQ ID NO: 678551 - DNA, 13 bp, D. melanogaster
ttttaaaatggaa

SEQ ID NO: 678552 - DNA, 13 bp, D. melanogaster
ttttaaaatggct

SEQ ID NO: 678553 - DNA, 13 bp, D. melanogaster
ttttaaaattgct

SEQ ID NO: 678554 - DNA, 13 bp, D. melanogaster
ttttaaaattgtg

SEQ ID NO: 678555 - DNA, 13 bp, D. melanogaster
ttttaaacaaaag

SEQ ID NO: 678556 - DNA, 13 bp, D. melanogaster
ttttaaacaaact

SEQ ID NO: 678557 - DNA, 14 bp, D. melanogaster
ttttaaacaacctt

SEQ ID NO: 678558 - DNA, 13 bp, D. melanogaster
ttttaaacacaaa

SEQ ID NO: 678559 - DNA, 13 bp, D. melanogaster
ttttaaacacaat

SEQ ID NO: 678560 - DNA, 13 bp, D. melanogaster
ttttaaacacata

SEQ ID NO: 678561 - DNA, 13 bp, D. melanogaster
ttttaaacactta

SEQ ID NO: 678562 - DNA, 13 bp, D. melanogaster
ttttaaacagctt

SEQ ID NO: 678563 - DNA, 13 bp, D. melanogaster
ttttaaacagtaa

SEQ ID NO: 678564 - DNA, 13 bp, D. melanogaster
ttttaaacatgtt

SEQ ID NO: 678565 - DNA, 13 bp, D. melanogaster
ttttaaacattag

SEQ ID NO: 678566 - DNA, 13 bp, D. melanogaster
ttttaaaccaaaa

SEQ ID NO: 678567 - DNA, 13 bp, D. melanogaster
ttttaaaccaaat

SEQ ID NO: 678568 - DNA, 13 bp, D. melanogaster
ttttaaaccatta

SEQ ID NO: 678569 - DNA, 13 bp, D. melanogaster
ttttaaacgaata

SEQ ID NO: 678570 - DNA, 13 bp, D. melanogaster
ttttaaacgattt

SEQ ID NO: 678571 - DNA, 14 bp, D. melanogaster
ttttaaacgatttt

SEQ ID NO: 678572 - DNA, 13 bp, D. melanogaster
ttttaaacggatt

SEQ ID NO: 678573 - DNA, 13 bp, D. melanogaster
ttttaaacgtttt

SEQ ID NO: 678574 - DNA, 13 bp, D. melanogaster
ttttaaactacaa

SEQ ID NO: 678575 - DNA, 13 bp, D. melanogaster
ttttaaactcaaa

SEQ ID NO: 678576 - DNA, 13 bp, D. melanogaster
ttttaaacttcaa

SEQ ID NO: 678577 - DNA, 14 bp, D. melanogaster
ttttaaagaaactt

SEQ ID NO: 678578 - DNA, 13 bp, D. melanogaster
ttttaaagaacaa

SEQ ID NO: 678579 - DNA, 14 bp, D. melanogaster
ttttaaagacttaa

SEQ ID NO: 678580 - DNA, 13 bp, D. melanogaster
ttttaaagagaaa

SEQ ID NO: 678581 - DNA, 13 bp, D. melanogaster
ttttaaagagctt

SEQ ID NO: 678582 - DNA, 13 bp, D. melanogaster
ttttaaagagttt

SEQ ID NO: 678583 - DNA, 13 bp, D. melanogaster
ttttaaagcaaac

SEQ ID NO: 678584 - DNA, 14 bp, D. melanogaster
ttttaaagcaaatt

SEQ ID NO: 678585 - DNA, 13 bp, D. melanogaster
ttttaaagcaagt

SEQ ID NO: 678586 - DNA, 14 bp, D. melanogaster
ttttaaagcaattt

SEQ ID NO: 678587 - DNA, 13 bp, D. melanogaster
ttttaaagcactt

SEQ ID NO: 678588 - DNA, 13 bp, D. melanogaster
ttttaaagcatat

SEQ ID NO: 678589 - DNA, 13 bp, D. melanogaster
ttttaaagcattt

SEQ ID NO: 678590 - DNA, 14 bp, D. melanogaster
ttttaaagcatttt

SEQ ID NO: 678591 - DNA, 13 bp, D. melanogaster
ttttaaagccaaa

SEQ ID NO: 678592 - DNA, 13 bp, D. melanogaster
ttttaaagccttt

SEQ ID NO: 678593 - DNA, 13 bp, D. melanogaster
ttttaaagcgttg

SEQ ID NO: 678594 - DNA, 13 bp, D. melanogaster
ttttaaagcgttt

SEQ ID NO: 678595 - DNA, 14 bp, D. melanogaster
ttttaaagcgtttt

SEQ ID NO: 678596 - DNA, 13 bp, D. melanogaster
ttttaaagcttat

SEQ ID NO: 678597 - DNA, 13 bp, D. melanogaster
ttttaaagctttt

SEQ ID NO: 678598 - DNA, 13 bp, D. melanogaster
ttttaaaggaaat

SEQ ID NO: 678599 - DNA, 14 bp, D. melanogaster
ttttaaaggaaatt

SEQ ID NO: 678600 - DNA, 13 bp, D. melanogaster
ttttaaagtacac

SEQ ID NO: 678601 - DNA, 13 bp, D. melanogaster
ttttaaagtactt

SEQ ID NO: 678602 - DNA, 13 bp, D. melanogaster
ttttaaagtgata

SEQ ID NO: 678603 - DNA, 13 bp, D. melanogaster
ttttaaagtgctt

SEQ ID NO: 678604 - DNA, 13 bp, D. melanogaster
ttttaaagttcaa

SEQ ID NO: 678605 - DNA, 13 bp, D. melanogaster
ttttaaagttctt

SEQ ID NO: 678606 - DNA, 13 bp, D. melanogaster
ttttaaagttgat

SEQ ID NO: 678607 - DNA, 13 bp, D. melanogaster
ttttaaagttttc

SEQ ID NO: 678608 - DNA, 13 bp, D. melanogaster
ttttaaatactct

SEQ ID NO: 678609 - DNA, 13 bp, D. melanogaster
ttttaaatactga

SEQ ID NO: 678610 - DNA, 13 bp, D. melanogaster
ttttaaatagcaa

SEQ ID NO: 678611 - DNA, 13 bp, D. melanogaster
ttttaaataggat

SEQ ID NO: 678612 - DNA, 13 bp, D. melanogaster
ttttaaatatgct

SEQ ID NO: 678613 - DNA, 13 bp, D. melanogaster
ttttaaatccaat

SEQ ID NO: 678614 - DNA, 13 bp, D. melanogaster
ttttaaatccatt

SEQ ID NO: 678615 - DNA, 13 bp, D. melanogaster
ttttaaatcgaaa

SEQ ID NO: 678616 - DNA, 14 bp, D. melanogaster
ttttaaatcgaaat

SEQ ID NO: 678617 - DNA, 14 bp, D. melanogaster
ttttaaatgaaatg

SEQ ID NO: 678618 - DNA, 14 bp, D. melanogaster
ttttaaatgaactt

SEQ ID NO: 678619 - DNA, 13 bp, D. melanogaster
ttttaaatgatga

SEQ ID NO: 678620 - DNA, 13 bp, D. melanogaster
ttttaaatgcaaa

SEQ ID NO: 678621 - DNA, 14 bp, D. melanogaster
ttttaaatgcaatt

SEQ ID NO: 678622 - DNA, 13 bp, D. melanogaster
ttttaaatgctac

SEQ ID NO: 678623 - DNA, 13 bp, D. melanogaster
ttttaaatgcttt

SEQ ID NO: 678624 - DNA, 14 bp, D. melanogaster
ttttaaatgctttt

SEQ ID NO: 678625 - DNA, 14 bp, D. melanogaster
ttttaaatggaatt

SEQ ID NO: 678626 - DNA, 13 bp, D. melanogaster
ttttaaatggatt

SEQ ID NO: 678627 - DNA, 13 bp, D. melanogaster
ttttaaatggctt

SEQ ID NO: 678628 - DNA, 13 bp, D. melanogaster
ttttaaatgtaca

SEQ ID NO: 678629 - DNA, 13 bp, D. melanogaster
ttttaaatgtgaa

SEQ ID NO: 678630 - DNA, 14 bp, D. melanogaster
ttttaaatgtgaaa

SEQ ID NO: 678631 - DNA, 13 bp, D. melanogaster
ttttaaatgtgat

SEQ ID NO: 678632 - DNA, 13 bp, D. melanogaster
ttttaaatgtggc

SEQ ID NO: 678633 - DNA, 13 bp, D. melanogaster
ttttaaatgttca

SEQ ID NO: 678634 - DNA, 13 bp, D. melanogaster
ttttaaattaagc

SEQ ID NO: 678635 - DNA, 13 bp, D. melanogaster
ttttaaattacca

SEQ ID NO: 678636 - DNA, 14 bp, D. melanogaster
ttttaaattccaat

SEQ ID NO: 678637 - DNA, 13 bp, D. melanogaster
ttttaaattccgc

SEQ ID NO: 678638 - DNA, 13 bp, D. melanogaster
ttttaaatttagc

SEQ ID NO: 678639 - DNA, 13 bp, D. melanogaster
ttttaaatttccc

SEQ ID NO: 678640 - DNA, 13 bp, D. melanogaster
ttttaacaaattg

SEQ ID NO: 678641 - DNA, 13 bp, D. melanogaster
ttttaacaacaat

SEQ ID NO: 678642 - DNA, 13 bp, D. melanogaster
ttttaacaacttt

SEQ ID NO: 678643 - DNA, 13 bp, D. melanogaster
ttttaacaagaat

SEQ ID NO: 678644 - DNA, 13 bp, D. melanogaster
ttttaacaatgtt

SEQ ID NO: 678645 - DNA, 13 bp, D. melanogaster
ttttaacaattgc

SEQ ID NO: 678646 - DNA, 13 bp, D. melanogaster
ttttaacacaatt

SEQ ID NO: 678647 - DNA, 13 bp, D. melanogaster
ttttaacacattt

SEQ ID NO: 678648 - DNA, 13 bp, D. melanogaster
ttttaacacttaa

SEQ ID NO: 678649 - DNA, 13 bp, D. melanogaster
ttttaacagattt

SEQ ID NO: 678650 - DNA, 13 bp, D. melanogaster
ttttaacataaca

SEQ ID NO: 678651 - DNA, 13 bp, D. melanogaster
ttttaacatcaaa

SEQ ID NO: 678652 - DNA, 14 bp, D. melanogaster
ttttaacattttcc

SEQ ID NO: 678653 - DNA, 13 bp, D. melanogaster
ttttaaccaaaat

SEQ ID NO: 678654 - DNA, 14 bp, D. melanogaster
ttttaaccaaaatt

SEQ ID NO: 678655 - DNA, 13 bp, D. melanogaster
ttttaaccaagtt

SEQ ID NO: 678656 - DNA, 13 bp, D. melanogaster
ttttaaccaattc

SEQ ID NO: 678657 - DNA, 13 bp, D. melanogaster
ttttaaccacaga

SEQ ID NO: 678658 - DNA, 13 bp, D. melanogaster
ttttaaccttaaa

SEQ ID NO: 678659 - DNA, 14 bp, D. melanogaster
ttttaacgaaatca

SEQ ID NO: 678660 - DNA, 13 bp, D. melanogaster
ttttaacgaaatt

SEQ ID NO: 678661 - DNA, 13 bp, D. melanogaster
ttttaacgaatct

SEQ ID NO: 678662 - DNA, 13 bp, D. melanogaster
ttttaacgactgc

SEQ ID NO: 678663 - DNA, 13 bp, D. melanogaster
ttttaacgatttt

SEQ ID NO: 678664 - DNA, 13 bp, D. melanogaster
ttttaacgctttt

SEQ ID NO: 678665 - DNA, 13 bp, D. melanogaster
ttttaacggattt

SEQ ID NO: 678666 - DNA, 13 bp, D. melanogaster
ttttaacgtattt

SEQ ID NO: 678667 - DNA, 13 bp, D. melanogaster
ttttaacgtttgc

SEQ ID NO: 678668 - DNA, 13 bp, D. melanogaster
ttttaactatttg

SEQ ID NO: 678669 - DNA, 13 bp, D. melanogaster
ttttaactcaaaa

SEQ ID NO: 678670 - DNA, 14 bp, D. melanogaster
ttttaactcaaaac

SEQ ID NO: 678671 - DNA, 13 bp, D. melanogaster
ttttaactcctta

SEQ ID NO: 678672 - DNA, 13 bp, D. melanogaster
ttttaactgaatt

SEQ ID NO: 678673 - DNA, 13 bp, D. melanogaster
ttttaactgcatt

SEQ ID NO: 678674 - DNA, 13 bp, D. melanogaster
ttttaactgcttt

SEQ ID NO: 678675 - DNA, 14 bp, D. melanogaster
ttttaacttaagtg

SEQ ID NO: 678676 - DNA, 13 bp, D. melanogaster
ttttaacttttga

SEQ ID NO: 678677 - DNA, 13 bp, D. melanogaster
ttttaagaaattg

SEQ ID NO: 678678 - DNA, 13 bp, D. melanogaster
ttttaagaacaaa

SEQ ID NO: 678679 - DNA, 13 bp, D. melanogaster
ttttaagaactca

SEQ ID NO: 678680 - DNA, 13 bp, D. melanogaster
ttttaagaagcta

SEQ ID NO: 678681 - DNA, 13 bp, D. melanogaster
ttttaagagcttt

SEQ ID NO: 678682 - DNA, 13 bp, D. melanogaster
ttttaagagtatt

SEQ ID NO: 678683 - DNA, 13 bp, D. melanogaster
ttttaagattcaa

SEQ ID NO: 678684 - DNA, 13 bp, D. melanogaster
ttttaagcaaaat

SEQ ID NO: 678685 - DNA, 14 bp, D. melanogaster
ttttaagcaaacaa

SEQ ID NO: 678686 - DNA, 13 bp, D. melanogaster
ttttaagcaatat

SEQ ID NO: 678687 - DNA, 13 bp, D. melanogaster
ttttaagcaattt

SEQ ID NO: 678688 - DNA, 14 bp, D. melanogaster
ttttaagcaattta

SEQ ID NO: 678689 - DNA, 13 bp, D. melanogaster
ttttaagcacatt

SEQ ID NO: 678690 - DNA, 13 bp, D. melanogaster
ttttaagcactca

SEQ ID NO: 678691 - DNA, 13 bp, D. melanogaster
ttttaagcagatt

SEQ ID NO: 678692 - DNA, 13 bp, D. melanogaster
ttttaagcagctg

SEQ ID NO: 678693 - DNA, 13 bp, D. melanogaster
ttttaagcagttt

SEQ ID NO: 678694 - DNA, 13 bp, D. melanogaster
ttttaagcatttc

SEQ ID NO: 678695 - DNA, 13 bp, D. melanogaster
ttttaagccaaaa

SEQ ID NO: 678696 - DNA, 13 bp, D. melanogaster
ttttaagccaaat

SEQ ID NO: 678697 - DNA, 14 bp, D. melanogaster
ttttaagccaaatg

SEQ ID NO: 678698 - DNA, 14 bp, D. melanogaster
ttttaagccaattt

SEQ ID NO: 678699 - DNA, 13 bp, D. melanogaster
ttttaagccacaa

SEQ ID NO: 678700 - DNA, 13 bp, D. melanogaster
ttttaagccattt

SEQ ID NO: 678701 - DNA, 13 bp, D. melanogaster
ttttaagcccact

SEQ ID NO: 678702 - DNA, 13 bp, D. melanogaster
ttttaagcgaaat

SEQ ID NO: 678703 - DNA, 13 bp, D. melanogaster
ttttaagcgaatt

SEQ ID NO: 678704 - DNA, 13 bp, D. melanogaster
ttttaagcgattt

SEQ ID NO: 678705 - DNA, 13 bp, D. melanogaster
ttttaagctattt

SEQ ID NO: 678706 - DNA, 13 bp, D. melanogaster
ttttaagctttaa

SEQ ID NO: 678707 - DNA, 13 bp, D. melanogaster
ttttaaggaaaaa

SEQ ID NO: 678708 - DNA, 14 bp, D. melanogaster
ttttaaggaaaaat

SEQ ID NO: 678709 - DNA, 13 bp, D. melanogaster
ttttaaggaaaac

SEQ ID NO: 678710 - DNA, 13 bp, D. melanogaster
ttttaaggaatat

SEQ ID NO: 678711 - DNA, 13 bp, D. melanogaster
ttttaaggattta

SEQ ID NO: 678712 - DNA, 13 bp, D. melanogaster
ttttaaggcactt

SEQ ID NO: 678713 - DNA, 14 bp, D. melanogaster
ttttaaggctttaa

SEQ ID NO: 678714 - DNA, 13 bp, D. melanogaster
ttttaagggaaaa

SEQ ID NO: 678715 - DNA, 13 bp, D. melanogaster
ttttaagtacatt

SEQ ID NO: 678716 - DNA, 13 bp, D. melanogaster
ttttaagtcaaat

SEQ ID NO: 678717 - DNA, 13 bp, D. melanogaster
ttttaagtcaatt

SEQ ID NO: 678718 - DNA, 13 bp, D. melanogaster
ttttaagtccaaa

SEQ ID NO: 678719 - DNA, 13 bp, D. melanogaster
ttttaagtgaaaa

SEQ ID NO: 678720 - DNA, 14 bp, D. melanogaster
ttttaagtgaaaat

SEQ ID NO: 678721 - DNA, 13 bp, D. melanogaster
ttttaagtgaaat

SEQ ID NO: 678722 - DNA, 13 bp, D. melanogaster
ttttaagtgcaaa

SEQ ID NO: 678723 - DNA, 13 bp, D. melanogaster
ttttaagtgcaac

SEQ ID NO: 678724 - DNA, 13 bp, D. melanogaster
ttttaagtgcatt

SEQ ID NO: 678725 - DNA, 13 bp, D. melanogaster
ttttaagtgctct

SEQ ID NO: 678726 - DNA, 13 bp, D. melanogaster
ttttaagtggaat

SEQ ID NO: 678727 - DNA, 13 bp, D. melanogaster
ttttaagtgtaaa

SEQ ID NO: 678728 - DNA, 13 bp, D. melanogaster
ttttaagtgtaca

SEQ ID NO: 678729 - DNA, 14 bp, D. melanogaster
ttttaagttaaaag

SEQ ID NO: 678730 - DNA, 13 bp, D. melanogaster
ttttaagttacct

SEQ ID NO: 678731 - DNA, 15 bp, D. melanogaster
ttttaagttatttca

SEQ ID NO: 678732 - DNA, 13 bp, D. melanogaster
ttttaagttctgc

SEQ ID NO: 678733 - DNA, 13 bp, D. melanogaster
ttttaagttgaag

SEQ ID NO: 678734 - DNA, 13 bp, D. melanogaster
ttttaagtttacc

SEQ ID NO: 678735 - DNA, 13 bp, D. melanogaster
ttttaagtttagg

SEQ ID NO: 678736 - DNA, 13 bp, D. melanogaster
ttttaagtttcag

SEQ ID NO: 678737 - DNA, 14 bp, D. melanogaster
ttttaagttttacc

SEQ ID NO: 678738 - DNA, 13 bp, D. melanogaster
ttttaataaccaa

SEQ ID NO: 678739 - DNA, 13 bp, D. melanogaster
ttttaataccaat

SEQ ID NO: 678740 - DNA, 13 bp, D. melanogaster
ttttaatacgttt

SEQ ID NO: 678741 - DNA, 13 bp, D. melanogaster
ttttaataggaat

SEQ ID NO: 678742 - DNA, 13 bp, D. melanogaster
ttttaatatgcct

SEQ ID NO: 678743 - DNA, 13 bp, D. melanogaster
ttttaatcaaact

SEQ ID NO: 678744 - DNA, 13 bp, D. melanogaster
ttttaatcaaaga

SEQ ID NO: 678745 - DNA, 13 bp, D. melanogaster
ttttaatcaactt

SEQ ID NO: 678746 - DNA, 13 bp, D. melanogaster
ttttaatcagttt

SEQ ID NO: 678747 - DNA, 14 bp, D. melanogaster
ttttaatcagtttt

SEQ ID NO: 678748 - DNA, 13 bp, D. melanogaster
ttttaatcgaaaa

SEQ ID NO: 678749 - DNA, 13 bp, D. melanogaster
ttttaatcgattt

SEQ ID NO: 678750 - DNA, 13 bp, D. melanogaster
ttttaatcgcatt

SEQ ID NO: 678751 - DNA, 13 bp, D. melanogaster
ttttaatcgcttt

SEQ ID NO: 678752 - DNA, 13 bp, D. melanogaster
ttttaatctcaac

SEQ ID NO: 678753 - DNA, 13 bp, D. melanogaster
ttttaatctcatc

SEQ ID NO: 678754 - DNA, 13 bp, D. melanogaster
ttttaatgaaatc

SEQ ID NO: 678755 - DNA, 13 bp, D. melanogaster
ttttaatgaagcc

SEQ ID NO: 678756 - DNA, 13 bp, D. melanogaster
ttttaatgacatt

SEQ ID NO: 678757 - DNA, 13 bp, D. melanogaster
ttttaatgacttt

SEQ ID NO: 678758 - DNA, 13 bp, D. melanogaster
ttttaatgagatt

SEQ ID NO: 678759 - DNA, 13 bp, D. melanogaster
ttttaatgagttg

SEQ ID NO: 678760 - DNA, 13 bp, D. melanogaster
ttttaatgatttc

SEQ ID NO: 678761 - DNA, 13 bp, D. melanogaster
ttttaatgcaaaa

SEQ ID NO: 678762 - DNA, 13 bp, D. melanogaster
ttttaatgcaatt

SEQ ID NO: 678763 - DNA, 14 bp, D. melanogaster
ttttaatgcaattt

SEQ ID NO: 678764 - DNA, 13 bp, D. melanogaster
ttttaatgcactc

SEQ ID NO: 678765 - DNA, 13 bp, D. melanogaster
ttttaatgcatat

SEQ ID NO: 678766 - DNA, 14 bp, D. melanogaster
ttttaatgcatatt

SEQ ID NO: 678767 - DNA, 13 bp, D. melanogaster
ttttaatgcatgt

SEQ ID NO: 678768 - DNA, 13 bp, D. melanogaster
ttttaatgcattt

SEQ ID NO: 678769 - DNA, 14 bp, D. melanogaster
ttttaatgcattta

SEQ ID NO: 678770 - DNA, 14 bp, D. melanogaster
ttttaatgcatttc

SEQ ID NO: 678771 - DNA, 14 bp, D. melanogaster
ttttaatgcatttt

SEQ ID NO: 678772 - DNA, 13 bp, D. melanogaster
ttttaatgccaac

SEQ ID NO: 678773 - DNA, 13 bp, D. melanogaster
ttttaatgccaag

SEQ ID NO: 678774 - DNA, 13 bp, D. melanogaster
ttttaatgccgca

SEQ ID NO: 678775 - DNA, 13 bp, D. melanogaster
ttttaatgcgctt

SEQ ID NO: 678776 - DNA, 13 bp, D. melanogaster
ttttaatgctaat

SEQ ID NO: 678777 - DNA, 13 bp, D. melanogaster
ttttaatgcttaa

SEQ ID NO: 678778 - DNA, 13 bp, D. melanogaster
ttttaatgcttat

SEQ ID NO: 678779 - DNA, 14 bp, D. melanogaster
ttttaatggaaatt

SEQ ID NO: 678780 - DNA, 13 bp, D. melanogaster
ttttaatggaata

SEQ ID NO: 678781 - DNA, 13 bp, D. melanogaster
ttttaatggatat

SEQ ID NO: 678782 - DNA, 13 bp, D. melanogaster
ttttaatggcaaa

SEQ ID NO: 678783 - DNA, 13 bp, D. melanogaster
ttttaatggcaca

SEQ ID NO: 678784 - DNA, 13 bp, D. melanogaster
ttttaatggccaa

SEQ ID NO: 678785 - DNA, 14 bp, D. melanogaster
ttttaatggccaaa

SEQ ID NO: 678786 - DNA, 13 bp, D. melanogaster
ttttaatggccca

SEQ ID NO: 678787 - DNA, 13 bp, D. melanogaster
ttttaatggctct

SEQ ID NO: 678788 - DNA, 13 bp, D. melanogaster
ttttaatgggaaa

SEQ ID NO: 678789 - DNA, 14 bp, D. melanogaster
ttttaatgggaaat

SEQ ID NO: 678790 - DNA, 13 bp, D. melanogaster
ttttaatgggctt

SEQ ID NO: 678791 - DNA, 13 bp, D. melanogaster
ttttaatggtaaa

SEQ ID NO: 678792 - DNA, 13 bp, D. melanogaster
ttttaatgtcaat

SEQ ID NO: 678793 - DNA, 13 bp, D. melanogaster
ttttaatgtgcca

SEQ ID NO: 678794 - DNA, 13 bp, D. melanogaster
ttttaatgtgctt

SEQ ID NO: 678795 - DNA, 13 bp, D. melanogaster
ttttaatgtggcc

SEQ ID NO: 678796 - DNA, 13 bp, D. melanogaster
ttttaatgtgtgc

SEQ ID NO: 678797 - DNA, 13 bp, D. melanogaster
ttttaatgttcat

SEQ ID NO: 678798 - DNA, 14 bp, D. melanogaster
ttttaattaaacac

SEQ ID NO: 678799 - DNA, 14 bp, D. melanogaster
ttttaattaacttg

SEQ ID NO: 678800 - DNA, 13 bp, D. melanogaster
ttttaattaagtc

SEQ ID NO: 678801 - DNA, 13 bp, D. melanogaster
ttttaattacatc

SEQ ID NO: 678802 - DNA, 13 bp, D. melanogaster
ttttaattaccac

SEQ ID NO: 678803 - DNA, 13 bp, D. melanogaster
ttttaattacccc

SEQ ID NO: 678804 - DNA, 13 bp, D. melanogaster
ttttaattacgca

SEQ ID NO: 678805 - DNA, 13 bp, D. melanogaster
ttttaattagcga

SEQ ID NO: 678806 - DNA, 13 bp, D. melanogaster
ttttaattcaaca

SEQ ID NO: 678807 - DNA, 14 bp, D. melanogaster
ttttaattcaacaa

SEQ ID NO: 678808 - DNA, 14 bp, D. melanogaster
ttttaattcgaaat

SEQ ID NO: 678809 - DNA, 13 bp, D. melanogaster
ttttaattcgatt

SEQ ID NO: 678810 - DNA, 14 bp, D. melanogaster
ttttaattcgattt

SEQ ID NO: 678811 - DNA, 13 bp, D. melanogaster
ttttaattcttga

SEQ ID NO: 678812 - DNA, 14 bp, D. melanogaster
ttttaattgaaaac

SEQ ID NO: 678813 - DNA, 13 bp, D. melanogaster
ttttaattgaact

SEQ ID NO: 678814 - DNA, 14 bp, D. melanogaster
ttttaattgaactt

SEQ ID NO: 678815 - DNA, 13 bp, D. melanogaster
ttttaattgaagc

SEQ ID NO: 678816 - DNA, 13 bp, D. melanogaster
ttttaattgactt

SEQ ID NO: 678817 - DNA, 13 bp, D. melanogaster
ttttaattgcaaa

SEQ ID NO: 678818 - DNA, 13 bp, D. melanogaster
ttttaattgcact

SEQ ID NO: 678819 - DNA, 13 bp, D. melanogaster
ttttaattgcatg

SEQ ID NO: 678820 - DNA, 14 bp, D. melanogaster
ttttaattgcattt

SEQ ID NO: 678821 - DNA, 13 bp, D. melanogaster
ttttaattgccaa

SEQ ID NO: 678822 - DNA, 13 bp, D. melanogaster
ttttaattgccac

SEQ ID NO: 678823 - DNA, 13 bp, D. melanogaster
ttttaattgccgc

SEQ ID NO: 678824 - DNA, 13 bp, D. melanogaster
ttttaattgccta

SEQ ID NO: 678825 - DNA, 14 bp, D. melanogaster
ttttaattgcgatt

SEQ ID NO: 678826 - DNA, 13 bp, D. melanogaster
ttttaattgctat

SEQ ID NO: 678827 - DNA, 13 bp, D. melanogaster
ttttaattgctgc

SEQ ID NO: 678828 - DNA, 13 bp, D. melanogaster
ttttaattggaaa

SEQ ID NO: 678829 - DNA, 13 bp, D. melanogaster
ttttaattggcaa

SEQ ID NO: 678830 - DNA, 13 bp, D. melanogaster
ttttaattggctt

SEQ ID NO: 678831 - DNA, 14 bp, D. melanogaster
ttttaattggcttt

SEQ ID NO: 678832 - DNA, 13 bp, D. melanogaster
ttttaattgtgct

SEQ ID NO: 678833 - DNA, 14 bp, D. melanogaster
ttttaatttattgc

SEQ ID NO: 678834 - DNA, 13 bp, D. melanogaster
ttttaatttcaac

SEQ ID NO: 678835 - DNA, 13 bp, D. melanogaster
ttttaatttccaa

SEQ ID NO: 678836 - DNA, 13 bp, D. melanogaster
ttttaatttccac

SEQ ID NO: 678837 - DNA, 13 bp, D. melanogaster
ttttaatttcgat

SEQ ID NO: 678838 - DNA, 13 bp, D. melanogaster
ttttaatttcgct

SEQ ID NO: 678839 - DNA, 14 bp, D. melanogaster
ttttaatttggcat

SEQ ID NO: 678840 - DNA, 13 bp, D. melanogaster
ttttacaaacatt

SEQ ID NO: 678841 - DNA, 13 bp, D. melanogaster
ttttacaaactta

SEQ ID NO: 678842 - DNA, 13 bp, D. melanogaster
ttttacaaagcct

SEQ ID NO: 678843 - DNA, 13 bp, D. melanogaster
ttttacaaataca

SEQ ID NO: 678844 - DNA, 13 bp, D. melanogaster
ttttacaaattag

SEQ ID NO: 678845 - DNA, 13 bp, D. melanogaster
ttttacaacaaaa

SEQ ID NO: 678846 - DNA, 13 bp, D. melanogaster
ttttacaacaatt

SEQ ID NO: 678847 - DNA, 13 bp, D. melanogaster
ttttacaacacca

SEQ ID NO: 678848 - DNA, 13 bp, D. melanogaster
ttttacaaccaaa

SEQ ID NO: 678849 - DNA, 13 bp, D. melanogaster
ttttacaacgctt

SEQ ID NO: 678850 - DNA, 13 bp, D. melanogaster
ttttacaacttaa

SEQ ID NO: 678851 - DNA, 13 bp, D. melanogaster
ttttacaactttg

SEQ ID NO: 678852 - DNA, 13 bp, D. melanogaster
ttttacaagcaat

SEQ ID NO: 678853 - DNA, 13 bp, D. melanogaster
ttttacaatggta

SEQ ID NO: 678854 - DNA, 13 bp, D. melanogaster
ttttacaatgtgt

SEQ ID NO: 678855 - DNA, 13 bp, D. melanogaster
ttttacaattacc

SEQ ID NO: 678856 - DNA, 13 bp, D. melanogaster
ttttacaatttgt

SEQ ID NO: 678857 - DNA, 13 bp, D. melanogaster
ttttacacaaaaa

SEQ ID NO: 678858 - DNA, 14 bp, D. melanogaster
ttttacacaaaaac

SEQ ID NO: 678859 - DNA, 13 bp, D. melanogaster
ttttacacaaatt

SEQ ID NO: 678860 - DNA, 13 bp, D. melanogaster
ttttacacaagac

SEQ ID NO: 678861 - DNA, 13 bp, D. melanogaster
ttttacacacaaa

SEQ ID NO: 678862 - DNA, 13 bp, D. melanogaster
ttttacacatata

SEQ ID NO: 678863 - DNA, 13 bp, D. melanogaster
ttttacacatatt

SEQ ID NO: 678864 - DNA, 13 bp, D. melanogaster
ttttacagaattt

SEQ ID NO: 678865 - DNA, 13 bp, D. melanogaster
ttttacagtttat

SEQ ID NO: 678866 - DNA, 13 bp, D. melanogaster
ttttacataacaa

SEQ ID NO: 678867 - DNA, 13 bp, D. melanogaster
ttttacataatct

SEQ ID NO: 678868 - DNA, 13 bp, D. melanogaster
ttttacatattca

SEQ ID NO: 678869 - DNA, 13 bp, D. melanogaster
ttttacatccatt

SEQ ID NO: 678870 - DNA, 13 bp, D. melanogaster
ttttacatttaca

SEQ ID NO: 678871 - DNA, 13 bp, D. melanogaster
ttttacatttcca

SEQ ID NO: 678872 - DNA, 13 bp, D. melanogaster
ttttacatttgca

SEQ ID NO: 678873 - DNA, 13 bp, D. melanogaster
ttttacatttggt

SEQ ID NO: 678874 - DNA, 13 bp, D. melanogaster
ttttaccaaaaaa

SEQ ID NO: 678875 - DNA, 13 bp, D. melanogaster
ttttaccaaaata

SEQ ID NO: 678876 - DNA, 13 bp, D. melanogaster
ttttaccaaataa

SEQ ID NO: 678877 - DNA, 13 bp, D. melanogaster
ttttaccaaatta

SEQ ID NO: 678878 - DNA, 13 bp, D. melanogaster
ttttaccaacaaa

SEQ ID NO: 678879 - DNA, 13 bp, D. melanogaster
ttttaccaacatt

SEQ ID NO: 678880 - DNA, 13 bp, D. melanogaster
ttttaccaagttt

SEQ ID NO: 678881 - DNA, 13 bp, D. melanogaster
ttttaccaatatt

SEQ ID NO: 678882 - DNA, 14 bp, D. melanogaster
ttttaccagcatca

SEQ ID NO: 678883 - DNA, 13 bp, D. melanogaster
ttttaccaggaca

SEQ ID NO: 678884 - DNA, 13 bp, D. melanogaster
ttttaccagtttt

SEQ ID NO: 678885 - DNA, 13 bp, D. melanogaster
ttttacccaaaaa

SEQ ID NO: 678886 - DNA, 13 bp, D. melanogaster
ttttacccaaaat

SEQ ID NO: 678887 - DNA, 13 bp, D. melanogaster
ttttacccaagca

SEQ ID NO: 678888 - DNA, 13 bp, D. melanogaster
ttttacccagaga

SEQ ID NO: 678889 - DNA, 14 bp, D. melanogaster
ttttacccagagat

SEQ ID NO: 678890 - DNA, 13 bp, D. melanogaster
ttttaccgaaata

SEQ ID NO: 678891 - DNA, 13 bp, D. melanogaster
ttttacctataaa

SEQ ID NO: 678892 - DNA, 13 bp, D. melanogaster
ttttacgaatttt

SEQ ID NO: 678893 - DNA, 13 bp, D. melanogaster
ttttacgactttt

SEQ ID NO: 678894 - DNA, 13 bp, D. melanogaster
ttttacgatattt

SEQ ID NO: 678895 - DNA, 13 bp, D. melanogaster
ttttacgattttg

SEQ ID NO: 678896 - DNA, 13 bp, D. melanogaster
ttttacgttaatt

SEQ ID NO: 678897 - DNA, 13 bp, D. melanogaster
ttttacgtttaaa

SEQ ID NO: 678898 - DNA, 13 bp, D. melanogaster
ttttacgttttca

SEQ ID NO: 678899 - DNA, 13 bp, D. melanogaster
ttttactaacaat

SEQ ID NO: 678900 - DNA, 13 bp, D. melanogaster
ttttactaagaaa

SEQ ID NO: 678901 - DNA, 14 bp, D. melanogaster
ttttactaagaaat

SEQ ID NO: 678902 - DNA, 13 bp, D. melanogaster
ttttactcaaaaa

SEQ ID NO: 678903 - DNA, 13 bp, D. melanogaster
ttttactcacaca

SEQ ID NO: 678904 - DNA, 13 bp, D. melanogaster
ttttactcctaat

SEQ ID NO: 678905 - DNA, 13 bp, D. melanogaster
ttttactgaaaaa

SEQ ID NO: 678906 - DNA, 13 bp, D. melanogaster
ttttactgcattt

SEQ ID NO: 678907 - DNA, 13 bp, D. melanogaster
ttttactgcttgt

SEQ ID NO: 678908 - DNA, 13 bp, D. melanogaster
ttttacttacaaa

SEQ ID NO: 678909 - DNA, 13 bp, D. melanogaster
ttttacttcaaag

SEQ ID NO: 678910 - DNA, 13 bp, D. melanogaster
ttttacttggctt

SEQ ID NO: 678911 - DNA, 13 bp, D. melanogaster
ttttacttgtaaa

SEQ ID NO: 678912 - DNA, 13 bp, D. melanogaster
ttttactttcaaa

SEQ ID NO: 678913 - DNA, 13 bp, D. melanogaster
ttttactttccca

SEQ ID NO: 678914 - DNA, 13 bp, D. melanogaster
ttttactttcggc

SEQ ID NO: 678915 - DNA, 13 bp, D. melanogaster
ttttactttctgc

SEQ ID NO: 678916 - DNA, 13 bp, D. melanogaster
ttttactttgcaa

SEQ ID NO: 678917 - DNA, 13 bp, D. melanogaster
ttttacttttgaa

SEQ ID NO: 678918 - DNA, 13 bp, D. melanogaster
ttttacttttgca

SEQ ID NO: 678919 - DNA, 13 bp, D. melanogaster
ttttagaaaaatg

SEQ ID NO: 678920 - DNA, 14 bp, D. melanogaster
ttttagaaaaatgc

SEQ ID NO: 678921 - DNA, 13 bp, D. melanogaster
ttttagaaaatct

SEQ ID NO: 678922 - DNA, 13 bp, D. melanogaster
ttttagaaaatgt

SEQ ID NO: 678923 - DNA, 13 bp, D. melanogaster
ttttagaaaattc

SEQ ID NO: 678924 - DNA, 13 bp, D. melanogaster
ttttagaaacttt

SEQ ID NO: 678925 - DNA, 13 bp, D. melanogaster
ttttagaaatgtt

SEQ ID NO: 678926 - DNA, 13 bp, D. melanogaster
ttttagaaatttc

SEQ ID NO: 678927 - DNA, 13 bp, D. melanogaster
ttttagaacaaac

SEQ ID NO: 678928 - DNA, 24 bp, D. melanogaster
ttttagaacttgctattcgtagct

SEQ ID NO: 678929 - DNA, 13 bp, D. melanogaster
ttttagaagagtt

SEQ ID NO: 678930 - DNA, 13 bp, D. melanogaster
ttttagaatttct

SEQ ID NO: 678931 - DNA, 13 bp, D. melanogaster
ttttagacaagtt

SEQ ID NO: 678932 - DNA, 14 bp, D. melanogaster
ttttagatatgcaa

SEQ ID NO: 678933 - DNA, 13 bp, D. melanogaster
ttttagattttca

SEQ ID NO: 678934 - DNA, 13 bp, D. melanogaster
ttttagcaacaaa

SEQ ID NO: 678935 - DNA, 13 bp, D. melanogaster
ttttagcaataaa

SEQ ID NO: 678936 - DNA, 14 bp, D. melanogaster
ttttagcaatgaaa

SEQ ID NO: 678937 - DNA, 13 bp, D. melanogaster
ttttagcaattta

SEQ ID NO: 678938 - DNA, 13 bp, D. melanogaster
ttttagcataatt

SEQ ID NO: 678939 - DNA, 14 bp, D. melanogaster
ttttagcatatttt

SEQ ID NO: 678940 - DNA, 13 bp, D. melanogaster
ttttagccaaaaa

SEQ ID NO: 678941 - DNA, 13 bp, D. melanogaster
ttttagccaaaat

SEQ ID NO: 678942 - DNA, 13 bp, D. melanogaster
ttttagccaaatt

SEQ ID NO: 678943 - DNA, 13 bp, D. melanogaster
ttttagccaactg

SEQ ID NO: 678944 - DNA, 13 bp, D. melanogaster
ttttagccaattt

SEQ ID NO: 678945 - DNA, 13 bp, D. melanogaster
ttttagccacttt

SEQ ID NO: 678946 - DNA, 13 bp, D. melanogaster
ttttagccagctt

SEQ ID NO: 678947 - DNA, 13 bp, D. melanogaster
ttttagccagttt

SEQ ID NO: 678948 - DNA, 13 bp, D. melanogaster
ttttagccatttg

SEQ ID NO: 678949 - DNA, 13 bp, D. melanogaster
ttttagcccactt

SEQ ID NO: 678950 - DNA, 13 bp, D. melanogaster
ttttagccgaaaa

SEQ ID NO: 678951 - DNA, 13 bp, D. melanogaster
ttttagctaattt

SEQ ID NO: 678952 - DNA, 13 bp, D. melanogaster
ttttagctcttaa

SEQ ID NO: 678953 - DNA, 13 bp, D. melanogaster
ttttagctgattt

SEQ ID NO: 678954 - DNA, 14 bp, D. melanogaster
ttttagctggaaat

SEQ ID NO: 678955 - DNA, 13 bp, D. melanogaster
ttttagctggcat

SEQ ID NO: 678956 - DNA, 13 bp, D. melanogaster
ttttagcttaatt

SEQ ID NO: 678957 - DNA, 13 bp, D. melanogaster
ttttagctttaat

SEQ ID NO: 678958 - DNA, 13 bp, D. melanogaster
ttttaggcaaatt

SEQ ID NO: 678959 - DNA, 13 bp, D. melanogaster
ttttaggcacttt

SEQ ID NO: 678960 - DNA, 13 bp, D. melanogaster
ttttaggcatttt

SEQ ID NO: 678961 - DNA, 13 bp, D. melanogaster
ttttaggctttaa

SEQ ID NO: 678962 - DNA, 13 bp, D. melanogaster
ttttaggtccacc

SEQ ID NO: 678963 - DNA, 13 bp, D. melanogaster
ttttagtaactat

SEQ ID NO: 678964 - DNA, 13 bp, D. melanogaster
ttttagtaagaaa

SEQ ID NO: 678965 - DNA, 13 bp, D. melanogaster
ttttagtcctaaa

SEQ ID NO: 678966 - DNA, 13 bp, D. melanogaster
ttttagtcttaag

SEQ ID NO: 678967 - DNA, 13 bp, D. melanogaster
ttttagtgcaatt

SEQ ID NO: 678968 - DNA, 13 bp, D. melanogaster
ttttagtgcactt

SEQ ID NO: 678969 - DNA, 13 bp, D. melanogaster
ttttagttaacta

SEQ ID NO: 678970 - DNA, 13 bp, D. melanogaster
ttttagttgaaat

SEQ ID NO: 678971 - DNA, 13 bp, D. melanogaster
ttttagttgtaac

SEQ ID NO: 678972 - DNA, 13 bp, D. melanogaster
ttttagtttacaa

SEQ ID NO: 678973 - DNA, 13 bp, D. melanogaster
ttttagtttcgct

SEQ ID NO: 678974 - DNA, 13 bp, D. melanogaster
ttttagtttcggc

SEQ ID NO: 678975 - DNA, 13 bp, D. melanogaster
ttttagtttgcaa

SEQ ID NO: 678976 - DNA, 13 bp, D. melanogaster
ttttagtttgcgt

SEQ ID NO: 678977 - DNA, 14 bp, D. melanogaster
ttttagtttgcgtt

SEQ ID NO: 678978 - DNA, 13 bp, D. melanogaster
ttttataaaagca

SEQ ID NO: 678979 - DNA, 13 bp, D. melanogaster
ttttataaactct

SEQ ID NO: 678980 - DNA, 13 bp, D. melanogaster
ttttataaagtgc

SEQ ID NO: 678981 - DNA, 13 bp, D. melanogaster
ttttataaatgtg

SEQ ID NO: 678982 - DNA, 13 bp, D. melanogaster
ttttataaccaaa

SEQ ID NO: 678983 - DNA, 13 bp, D. melanogaster
ttttataacttca

SEQ ID NO: 678984 - DNA, 13 bp, D. melanogaster
ttttataagccaa

SEQ ID NO: 678985 - DNA, 13 bp, D. melanogaster
ttttataagctat

SEQ ID NO: 678986 - DNA, 14 bp, D. melanogaster
ttttataatgcaaa

SEQ ID NO: 678987 - DNA, 13 bp, D. melanogaster
ttttataatggaa

SEQ ID NO: 678988 - DNA, 13 bp, D. melanogaster
ttttataatttcg

SEQ ID NO: 678989 - DNA, 14 bp, D. melanogaster
ttttataatttcgt

SEQ ID NO: 678990 - DNA, 13 bp, D. melanogaster
ttttatacaacaa

SEQ ID NO: 678991 - DNA, 13 bp, D. melanogaster
ttttatacacatt

SEQ ID NO: 678992 - DNA, 13 bp, D. melanogaster
ttttataccaaaa

SEQ ID NO: 678993 - DNA, 13 bp, D. melanogaster
ttttataccagtt

SEQ ID NO: 678994 - DNA, 13 bp, D. melanogaster
ttttatacgattt

SEQ ID NO: 678995 - DNA, 14 bp, D. melanogaster
ttttatacgatttt

SEQ ID NO: 678996 - DNA, 13 bp, D. melanogaster
ttttatagatttc

SEQ ID NO: 678997 - DNA, 13 bp, D. melanogaster
ttttatagcaata

SEQ ID NO: 678998 - DNA, 13 bp, D. melanogaster
ttttatagcatac

SEQ ID NO: 678999 - DNA, 13 bp, D. melanogaster
ttttatagccaaa

SEQ ID NO: 679000 - DNA, 13 bp, D. melanogaster
ttttatagccaac

SEQ ID NO: 679001 - DNA, 13 bp, D. melanogaster
ttttatatagacc

SEQ ID NO: 679002 - DNA, 13 bp, D. melanogaster
ttttatatatcga

SEQ ID NO: 679003 - DNA, 13 bp, D. melanogaster
ttttatatctgtg

SEQ ID NO: 679004 - DNA, 14 bp, D. melanogaster
ttttatatgcaaat

SEQ ID NO: 679005 - DNA, 14 bp, D. melanogaster
ttttatatgcattt

SEQ ID NO: 679006 - DNA, 13 bp, D. melanogaster
ttttatatggaat

SEQ ID NO: 679007 - DNA, 13 bp, D. melanogaster
ttttatatgtaga

SEQ ID NO: 679008 - DNA, 13 bp, D. melanogaster
ttttatattccca

SEQ ID NO: 679009 - DNA, 13 bp, D. melanogaster
ttttatattgcaa

SEQ ID NO: 679010 - DNA, 13 bp, D. melanogaster
ttttatattgcat

SEQ ID NO: 679011 - DNA, 13 bp, D. melanogaster
ttttatcaacatt

SEQ ID NO: 679012 - DNA, 13 bp, D. melanogaster
ttttatcaagaaa

SEQ ID NO: 679013 - DNA, 13 bp, D. melanogaster
ttttatcataact

SEQ ID NO: 679014 - DNA, 14 bp, D. melanogaster
ttttatcgatttgc

SEQ ID NO: 679015 - DNA, 13 bp, D. melanogaster
ttttatcgcattt

SEQ ID NO: 679016 - DNA, 13 bp, D. melanogaster
ttttatctgctgc

SEQ ID NO: 679017 - DNA, 13 bp, D. melanogaster
ttttatctggcca

SEQ ID NO: 679018 - DNA, 13 bp, D. melanogaster
ttttatctgtata

SEQ ID NO: 679019 - DNA, 14 bp, D. melanogaster
ttttatgaaaaacc

SEQ ID NO: 679020 - DNA, 13 bp, D. melanogaster
ttttatgaaaact

SEQ ID NO: 679021 - DNA, 13 bp, D. melanogaster
ttttatgaaaatc

SEQ ID NO: 679022 - DNA, 13 bp, D. melanogaster
ttttatgaaagtt

SEQ ID NO: 679023 - DNA, 13 bp, D. melanogaster
ttttatgaacaat

SEQ ID NO: 679024 - DNA, 13 bp, D. melanogaster
ttttatgaatgaa

SEQ ID NO: 679025 - DNA, 14 bp, D. melanogaster
ttttatgaatgaat

SEQ ID NO: 679026 - DNA, 13 bp, D. melanogaster
ttttatgacaatt

SEQ ID NO: 679027 - DNA, 13 bp, D. melanogaster
ttttatgacagcc

SEQ ID NO: 679028 - DNA, 13 bp, D. melanogaster
ttttatgacattt

SEQ ID NO: 679029 - DNA, 14 bp, D. melanogaster
ttttatgacatttt

SEQ ID NO: 679030 - DNA, 13 bp, D. melanogaster
ttttatgaccaac

SEQ ID NO: 679031 - DNA, 13 bp, D. melanogaster
ttttatgacggaa

SEQ ID NO: 679032 - DNA, 13 bp, D. melanogaster
ttttatgactgcc

SEQ ID NO: 679033 - DNA, 13 bp, D. melanogaster
ttttatgacttta

SEQ ID NO: 679034 - DNA, 13 bp, D. melanogaster
ttttatgagcatt

SEQ ID NO: 679035 - DNA, 13 bp, D. melanogaster
ttttatgatgaat

SEQ ID NO: 679036 - DNA, 13 bp, D. melanogaster
ttttatgatttcc

SEQ ID NO: 679037 - DNA, 14 bp, D. melanogaster
ttttatgattttcg

SEQ ID NO: 679038 - DNA, 13 bp, D. melanogaster
ttttatgcaaaca

SEQ ID NO: 679039 - DNA, 13 bp, D. melanogaster
ttttatgcaaatc

SEQ ID NO: 679040 - DNA, 14 bp, D. melanogaster
ttttatgcaaatca

SEQ ID NO: 679041 - DNA, 13 bp, D. melanogaster
ttttatgcaaatt

SEQ ID NO: 679042 - DNA, 14 bp, D. melanogaster
ttttatgcaaatta

SEQ ID NO: 679043 - DNA, 14 bp, D. melanogaster
ttttatgcaaattt

SEQ ID NO: 679044 - DNA, 13 bp, D. melanogaster
ttttatgcacaaa

SEQ ID NO: 679045 - DNA, 13 bp, D. melanogaster
ttttatgcacttg

SEQ ID NO: 679046 - DNA, 13 bp, D. melanogaster
ttttatgcagcca

SEQ ID NO: 679047 - DNA, 13 bp, D. melanogaster
ttttatgcatata

SEQ ID NO: 679048 - DNA, 13 bp, D. melanogaster
ttttatgcattat

SEQ ID NO: 679049 - DNA, 13 bp, D. melanogaster
ttttatgcattcc

SEQ ID NO: 679050 - DNA, 14 bp, D. melanogaster
ttttatgcattccg

SEQ ID NO: 679051 - DNA, 13 bp, D. melanogaster
ttttatgccaaaa

SEQ ID NO: 679052 - DNA, 13 bp, D. melanogaster
ttttatgccaaat

SEQ ID NO: 679053 - DNA, 13 bp, D. melanogaster
ttttatgccacac

SEQ ID NO: 679054 - DNA, 14 bp, D. melanogaster
ttttatgccataaa

SEQ ID NO: 679055 - DNA, 13 bp, D. melanogaster
ttttatgccattt

SEQ ID NO: 679056 - DNA, 13 bp, D. melanogaster
ttttatgcgattt

SEQ ID NO: 679057 - DNA, 13 bp, D. melanogaster
ttttatgcgcatt

SEQ ID NO: 679058 - DNA, 13 bp, D. melanogaster
ttttatgcgcttt

SEQ ID NO: 679059 - DNA, 13 bp, D. melanogaster
ttttatgctaaaa

SEQ ID NO: 679060 - DNA, 13 bp, D. melanogaster
ttttatgcttaat

SEQ ID NO: 679061 - DNA, 13 bp, D. melanogaster
ttttatgcttagc

SEQ ID NO: 679062 - DNA, 14 bp, D. melanogaster
ttttatgcttagca

SEQ ID NO: 679063 - DNA, 13 bp, D. melanogaster
ttttatggaatta

SEQ ID NO: 679064 - DNA, 13 bp, D. melanogaster
ttttatggcaaat

SEQ ID NO: 679065 - DNA, 14 bp, D. melanogaster
ttttatggcaaatt

SEQ ID NO: 679066 - DNA, 13 bp, D. melanogaster
ttttatggcaatt

SEQ ID NO: 679067 - DNA, 13 bp, D. melanogaster
ttttatggcagcc

SEQ ID NO: 679068 - DNA, 13 bp, D. melanogaster
ttttatggcattt

SEQ ID NO: 679069 - DNA, 14 bp, D. melanogaster
ttttatggccaaaa

SEQ ID NO: 679070 - DNA, 13 bp, D. melanogaster
ttttatggccaac

SEQ ID NO: 679071 - DNA, 13 bp, D. melanogaster
ttttatggccaag

SEQ ID NO: 679072 - DNA, 13 bp, D. melanogaster
ttttatggccaat

SEQ ID NO: 679073 - DNA, 13 bp, D. melanogaster
ttttatggccatc

SEQ ID NO: 679074 - DNA, 13 bp, D. melanogaster
ttttatggccatg

SEQ ID NO: 679075 - DNA, 14 bp, D. melanogaster
ttttatggccattt

SEQ ID NO: 679076 - DNA, 14 bp, D. melanogaster
ttttatggcccaaa

SEQ ID NO: 679077 - DNA, 13 bp, D. melanogaster
ttttatggcccca

SEQ ID NO: 679078 - DNA, 13 bp, D. melanogaster
ttttatggccgag

SEQ ID NO: 679079 - DNA, 14 bp, D. melanogaster
ttttatggccgcca

SEQ ID NO: 679080 - DNA, 13 bp, D. melanogaster
ttttatggcctgt

SEQ ID NO: 679081 - DNA, 13 bp, D. melanogaster
ttttatggctact

SEQ ID NO: 679082 - DNA, 13 bp, D. melanogaster
ttttatggctgca

SEQ ID NO: 679083 - DNA, 13 bp, D. melanogaster
ttttatggcttat

SEQ ID NO: 679084 - DNA, 13 bp, D. melanogaster
ttttatggcttgt

SEQ ID NO: 679085 - DNA, 13 bp, D. melanogaster
ttttatgggaaaa

SEQ ID NO: 679086 - DNA, 13 bp, D. melanogaster
ttttatgggccat

SEQ ID NO: 679087 - DNA, 13 bp, D. melanogaster
ttttatgtaagca

SEQ ID NO: 679088 - DNA, 13 bp, D. melanogaster
ttttatgtacaaa

SEQ ID NO: 679089 - DNA, 14 bp, D. melanogaster
ttttatgtacatat

SEQ ID NO: 679090 - DNA, 13 bp, D. melanogaster
ttttatgtacatg

SEQ ID NO: 679091 - DNA, 14 bp, D. melanogaster
ttttatgtatttac

SEQ ID NO: 679092 - DNA, 13 bp, D. melanogaster
ttttatgtgcaat

SEQ ID NO: 679093 - DNA, 13 bp, D. melanogaster
ttttatgtgcaca

SEQ ID NO: 679094 - DNA, 13 bp, D. melanogaster
ttttatgtgcatt

SEQ ID NO: 679095 - DNA, 14 bp, D. melanogaster
ttttatgtgcattt

SEQ ID NO: 679096 - DNA, 13 bp, D. melanogaster
ttttatgtgccac

SEQ ID NO: 679097 - DNA, 13 bp, D. melanogaster
ttttatgtggcaa

SEQ ID NO: 679098 - DNA, 13 bp, D. melanogaster
ttttatgttaatc

SEQ ID NO: 679099 - DNA, 13 bp, D. melanogaster
ttttatgttcaaa

SEQ ID NO: 679100 - DNA, 14 bp, D. melanogaster
ttttatgttcactt

SEQ ID NO: 679101 - DNA, 13 bp, D. melanogaster
ttttatgttcata

SEQ ID NO: 679102 - DNA, 13 bp, D. melanogaster
ttttattaaaagc

SEQ ID NO: 679103 - DNA, 13 bp, D. melanogaster
ttttattaaagca

SEQ ID NO: 679104 - DNA, 13 bp, D. melanogaster
ttttattaaatgc

SEQ ID NO: 679105 - DNA, 13 bp, D. melanogaster
ttttattaactgc

SEQ ID NO: 679106 - DNA, 13 bp, D. melanogaster
ttttattaagccc

SEQ ID NO: 679107 - DNA, 13 bp, D. melanogaster
ttttattacaact

SEQ ID NO: 679108 - DNA, 13 bp, D. melanogaster
ttttattacaagt

SEQ ID NO: 679109 - DNA, 13 bp, D. melanogaster
ttttattaccaaa

SEQ ID NO: 679110 - DNA, 13 bp, D. melanogaster
ttttattaccaat

SEQ ID NO: 679111 - DNA, 13 bp, D. melanogaster
ttttattaccaca

SEQ ID NO: 679112 - DNA, 14 bp, D. melanogaster
ttttattacgaatt

SEQ ID NO: 679113 - DNA, 13 bp, D. melanogaster
ttttattagcaaa

SEQ ID NO: 679114 - DNA, 13 bp, D. melanogaster
ttttattagcaat

SEQ ID NO: 679115 - DNA, 13 bp, D. melanogaster
ttttattagcatt

SEQ ID NO: 679116 - DNA, 13 bp, D. melanogaster
ttttattagctat

SEQ ID NO: 679117 - DNA, 14 bp, D. melanogaster
ttttattagtcttg

SEQ ID NO: 679118 - DNA, 13 bp, D. melanogaster
ttttattatccaa

SEQ ID NO: 679119 - DNA, 13 bp, D. melanogaster
ttttattatgaca

SEQ ID NO: 679120 - DNA, 13 bp, D. melanogaster
ttttattattggc

SEQ ID NO: 679121 - DNA, 14 bp, D. melanogaster
ttttattatttgcc

SEQ ID NO: 679122 - DNA, 13 bp, D. melanogaster
ttttattcaaatg

SEQ ID NO: 679123 - DNA, 14 bp, D. melanogaster
ttttattcaaattg

SEQ ID NO: 679124 - DNA, 13 bp, D. melanogaster
ttttattcaacgt

SEQ ID NO: 679125 - DNA, 13 bp, D. melanogaster
ttttattcaagtt

SEQ ID NO: 679126 - DNA, 13 bp, D. melanogaster
ttttattcaatca

SEQ ID NO: 679127 - DNA, 13 bp, D. melanogaster
ttttattccgctt

SEQ ID NO: 679128 - DNA, 13 bp, D. melanogaster
ttttattcgcatt

SEQ ID NO: 679129 - DNA, 13 bp, D. melanogaster
ttttattcgccag

SEQ ID NO: 679130 - DNA, 13 bp, D. melanogaster
ttttattcgcctt

SEQ ID NO: 679131 - DNA, 13 bp, D. melanogaster
ttttattgaaagt

SEQ ID NO: 679132 - DNA, 13 bp, D. melanogaster
ttttattgatgac

SEQ ID NO: 679133 - DNA, 13 bp, D. melanogaster
ttttattgcaaat

SEQ ID NO: 679134 - DNA, 14 bp, D. melanogaster
ttttattgcaaata

SEQ ID NO: 679135 - DNA, 13 bp, D. melanogaster
ttttattgcaact

SEQ ID NO: 679136 - DNA, 14 bp, D. melanogaster
ttttattgcaattt

SEQ ID NO: 679137 - DNA, 13 bp, D. melanogaster
ttttattgcacaa

SEQ ID NO: 679138 - DNA, 13 bp, D. melanogaster
ttttattgcagaa

SEQ ID NO: 679139 - DNA, 13 bp, D. melanogaster
ttttattgccaaa

SEQ ID NO: 679140 - DNA, 13 bp, D. melanogaster
ttttattgccaac

SEQ ID NO: 679141 - DNA, 13 bp, D. melanogaster
ttttattgccaat

SEQ ID NO: 679142 - DNA, 13 bp, D. melanogaster
ttttattgccagc

SEQ ID NO: 679143 - DNA, 13 bp, D. melanogaster
ttttattgccgca

SEQ ID NO: 679144 - DNA, 13 bp, D. melanogaster
ttttattgccgct

SEQ ID NO: 679145 - DNA, 13 bp, D. melanogaster
ttttattgcgcat

SEQ ID NO: 679146 - DNA, 13 bp, D. melanogaster
ttttattgctaaa

SEQ ID NO: 679147 - DNA, 13 bp, D. melanogaster
ttttattgctctc

SEQ ID NO: 679148 - DNA, 13 bp, D. melanogaster
ttttattgctgat

SEQ ID NO: 679149 - DNA, 13 bp, D. melanogaster
ttttattgctggc

SEQ ID NO: 679150 - DNA, 13 bp, D. melanogaster
ttttattgctgtg

SEQ ID NO: 679151 - DNA, 13 bp, D. melanogaster
ttttattggaaat

SEQ ID NO: 679152 - DNA, 13 bp, D. melanogaster
ttttattggcaaa

SEQ ID NO: 679153 - DNA, 13 bp, D. melanogaster
ttttattggccat

SEQ ID NO: 679154 - DNA, 13 bp, D. melanogaster
ttttattggccca

SEQ ID NO: 679155 - DNA, 14 bp, D. melanogaster
ttttattgggcatt

SEQ ID NO: 679156 - DNA, 13 bp, D. melanogaster
ttttattggtcga

SEQ ID NO: 679157 - DNA, 14 bp, D. melanogaster
ttttattgtactta

SEQ ID NO: 679158 - DNA, 13 bp, D. melanogaster
ttttattgtcgcc

SEQ ID NO: 679159 - DNA, 13 bp, D. melanogaster
ttttattgtgcaa

SEQ ID NO: 679160 - DNA, 13 bp, D. melanogaster
ttttattgtggcc

SEQ ID NO: 679161 - DNA, 13 bp, D. melanogaster
ttttattgtgtgc

SEQ ID NO: 679162 - DNA, 13 bp, D. melanogaster
ttttatttaccaa

SEQ ID NO: 679163 - DNA, 13 bp, D. melanogaster
ttttatttatgcc

SEQ ID NO: 679164 - DNA, 13 bp, D. melanogaster
ttttatttcaaac

SEQ ID NO: 679165 - DNA, 13 bp, D. melanogaster
ttttatttcaaca

SEQ ID NO: 679166 - DNA, 14 bp, D. melanogaster
ttttatttcacaaa

SEQ ID NO: 679167 - DNA, 13 bp, D. melanogaster
ttttatttcagat

SEQ ID NO: 679168 - DNA, 13 bp, D. melanogaster
ttttatttcagct

SEQ ID NO: 679169 - DNA, 14 bp, D. melanogaster
ttttatttcagctt

SEQ ID NO: 679170 - DNA, 13 bp, D. melanogaster
ttttatttccagt

SEQ ID NO: 679171 - DNA, 13 bp, D. melanogaster
ttttatttcccca

SEQ ID NO: 679172 - DNA, 14 bp, D. melanogaster
ttttatttcgaaat

SEQ ID NO: 679173 - DNA, 13 bp, D. melanogaster
ttttatttcgaat

SEQ ID NO: 679174 - DNA, 13 bp, D. melanogaster
ttttatttcgagc

SEQ ID NO: 679175 - DNA, 13 bp, D. melanogaster
ttttatttcgcat

SEQ ID NO: 679176 - DNA, 14 bp, D. melanogaster
ttttatttcgcatt

SEQ ID NO: 679177 - DNA, 14 bp, D. melanogaster
ttttatttcgcctt

SEQ ID NO: 679178 - DNA, 13 bp, D. melanogaster
ttttatttgatca

SEQ ID NO: 679179 - DNA, 13 bp, D. melanogaster
ttttatttgcact

SEQ ID NO: 679180 - DNA, 13 bp, D. melanogaster
ttttatttgcagc

SEQ ID NO: 679181 - DNA, 13 bp, D. melanogaster
ttttatttgcatg

SEQ ID NO: 679182 - DNA, 13 bp, D. melanogaster
ttttatttgccac

SEQ ID NO: 679183 - DNA, 13 bp, D. melanogaster
ttttatttgccat

SEQ ID NO: 679184 - DNA, 13 bp, D. melanogaster
ttttatttgccca

SEQ ID NO: 679185 - DNA, 13 bp, D. melanogaster
ttttatttgcccg

SEQ ID NO: 679186 - DNA, 13 bp, D. melanogaster
ttttatttgccgc

SEQ ID NO: 679187 - DNA, 13 bp, D. melanogaster
ttttatttgcgat

SEQ ID NO: 679188 - DNA, 13 bp, D. melanogaster
ttttatttgcgcc

SEQ ID NO: 679189 - DNA, 13 bp, D. melanogaster
ttttatttgcgct

SEQ ID NO: 679190 - DNA, 13 bp, D. melanogaster
ttttattttcgaa

SEQ ID NO: 679191 - DNA, 14 bp, D. melanogaster
ttttattttcgaaa

SEQ ID NO: 679192 - DNA, 13 bp, D. melanogaster
ttttattttcgag

SEQ ID NO: 679193 - DNA, 13 bp, D. melanogaster
ttttattttgagc

SEQ ID NO: 679194 - DNA, 14 bp, D. melanogaster
ttttattttgcaat

SEQ ID NO: 679195 - DNA, 13 bp, D. melanogaster
ttttattttgcag

SEQ ID NO: 679196 - DNA, 13 bp, D. melanogaster
ttttattttgcca

SEQ ID NO: 679197 - DNA, 14 bp, D. melanogaster
ttttattttgccat

SEQ ID NO: 679198 - DNA, 13 bp, D. melanogaster
ttttattttgcgc

SEQ ID NO: 679199 - DNA, 14 bp, D. melanogaster
ttttattttgctgc

SEQ ID NO: 679200 - DNA, 13 bp, D. melanogaster
ttttattttggcc

SEQ ID NO: 679201 - DNA, 14 bp, D. melanogaster
ttttatttttagcc

SEQ ID NO: 679202 - DNA, 13 bp, D. melanogaster
ttttcaaaaacag

SEQ ID NO: 679203 - DNA, 13 bp, D. melanogaster
ttttcaaaaacat

SEQ ID NO: 679204 - DNA, 14 bp, D. melanogaster
ttttcaaaaaccca

SEQ ID NO: 679205 - DNA, 13 bp, D. melanogaster
ttttcaaaaactt

SEQ ID NO: 679206 - DNA, 14 bp, D. melanogaster
ttttcaaaaacttt

SEQ ID NO: 679207 - DNA, 13 bp, D. melanogaster
ttttcaaaaagtt

SEQ ID NO: 679208 - DNA, 13 bp, D. melanogaster
ttttcaaaaatct

SEQ ID NO: 679209 - DNA, 13 bp, D. melanogaster
ttttcaaaaatgt

SEQ ID NO: 679210 - DNA, 14 bp, D. melanogaster
ttttcaaaaatgtg

SEQ ID NO: 679211 - DNA, 14 bp, D. melanogaster
ttttcaaaaatgtt

SEQ ID NO: 679212 - DNA, 13 bp, D. melanogaster
ttttcaaaacaat

SEQ ID NO: 679213 - DNA, 13 bp, D. melanogaster
ttttcaaaacatt

SEQ ID NO: 679214 - DNA, 13 bp, D. melanogaster
ttttcaaaactaa

SEQ ID NO: 679215 - DNA, 13 bp, D. melanogaster
ttttcaaaactgt

SEQ ID NO: 679216 - DNA, 13 bp, D. melanogaster
ttttcaaaagaaa

SEQ ID NO: 679217 - DNA, 13 bp, D. melanogaster
ttttcaaaagtgt

SEQ ID NO: 679218 - DNA, 14 bp, D. melanogaster
ttttcaaaagtttt

SEQ ID NO: 679219 - DNA, 13 bp, D. melanogaster
ttttcaaaataca

SEQ ID NO: 679220 - DNA, 13 bp, D. melanogaster
ttttcaaaatgat

SEQ ID NO: 679221 - DNA, 13 bp, D. melanogaster
ttttcaaaatgta

SEQ ID NO: 679222 - DNA, 13 bp, D. melanogaster
ttttcaaaattga

SEQ ID NO: 679223 - DNA, 13 bp, D. melanogaster
ttttcaaaattgt

SEQ ID NO: 679224 - DNA, 13 bp, D. melanogaster
ttttcaaaatttc

SEQ ID NO: 679225 - DNA, 13 bp, D. melanogaster
ttttcaaaatttg

SEQ ID NO: 679226 - DNA, 14 bp, D. melanogaster
ttttcaaaatttgt

SEQ ID NO: 679227 - DNA, 13 bp, D. melanogaster
ttttcaaacaaat

SEQ ID NO: 679228 - DNA, 13 bp, D. melanogaster
ttttcaaacaatt

SEQ ID NO: 679229 - DNA, 13 bp, D. melanogaster
ttttcaaacacaa

SEQ ID NO: 679230 - DNA, 13 bp, D. melanogaster
ttttcaaacagct

SEQ ID NO: 679231 - DNA, 14 bp, D. melanogaster
ttttcaaacagctt

SEQ ID NO: 679232 - DNA, 13 bp, D. melanogaster
ttttcaaacgtga

SEQ ID NO: 679233 - DNA, 13 bp, D. melanogaster
ttttcaaacgttt

SEQ ID NO: 679234 - DNA, 13 bp, D. melanogaster
ttttcaaactatt

SEQ ID NO: 679235 - DNA, 13 bp, D. melanogaster
ttttcaaactgaa

SEQ ID NO: 679236 - DNA, 13 bp, D. melanogaster
ttttcaaagattt

SEQ ID NO: 679237 - DNA, 13 bp, D. melanogaster
ttttcaaagcatt

SEQ ID NO: 679238 - DNA, 13 bp, D. melanogaster
ttttcaaagcttt

SEQ ID NO: 679239 - DNA, 13 bp, D. melanogaster
ttttcaaaggttt

SEQ ID NO: 679240 - DNA, 13 bp, D. melanogaster
ttttcaaataact

SEQ ID NO: 679241 - DNA, 13 bp, D. melanogaster
ttttcaaatacaa

SEQ ID NO: 679242 - DNA, 13 bp, D. melanogaster
ttttcaaatactt

SEQ ID NO: 679243 - DNA, 13 bp, D. melanogaster
ttttcaaatcaaa

SEQ ID NO: 679244 - DNA, 13 bp, D. melanogaster
ttttcaaatcatt

SEQ ID NO: 679245 - DNA, 13 bp, D. melanogaster
ttttcaaatgcaa

SEQ ID NO: 679246 - DNA, 14 bp, D. melanogaster
ttttcaaatgcaaa

SEQ ID NO: 679247 - DNA, 13 bp, D. melanogaster
ttttcaaatgtca

SEQ ID NO: 679248 - DNA, 13 bp, D. melanogaster
ttttcaaatgttc

SEQ ID NO: 679249 - DNA, 13 bp, D. melanogaster
ttttcaaatgttt

SEQ ID NO: 679250 - DNA, 13 bp, D. melanogaster
ttttcaaattcaa

SEQ ID NO: 679251 - DNA, 13 bp, D. melanogaster
ttttcaaattcat

SEQ ID NO: 679252 - DNA, 13 bp, D. melanogaster
ttttcaaattcca

SEQ ID NO: 679253 - DNA, 14 bp, D. melanogaster
ttttcaaattgaaa

SEQ ID NO: 679254 - DNA, 14 bp, D. melanogaster
ttttcaaattgatt

SEQ ID NO: 679255 - DNA, 13 bp, D. melanogaster
ttttcaaattgtt

SEQ ID NO: 679256 - DNA, 13 bp, D. melanogaster
ttttcaaatttac

SEQ ID NO: 679257 - DNA, 13 bp, D. melanogaster
ttttcaaatttca

SEQ ID NO: 679258 - DNA, 13 bp, D. melanogaster
ttttcaaatttga

SEQ ID NO: 679259 - DNA, 14 bp, D. melanogaster
ttttcaaatttgtt

SEQ ID NO: 679260 - DNA, 13 bp, D. melanogaster
ttttcaacaaaaa

SEQ ID NO: 679261 - DNA, 13 bp, D. melanogaster
ttttcaacaaaca

SEQ ID NO: 679262 - DNA, 14 bp, D. melanogaster
ttttcaacaaacac

SEQ ID NO: 679263 - DNA, 14 bp, D. melanogaster
ttttcaacaaattt

SEQ ID NO: 679264 - DNA, 13 bp, D. melanogaster
ttttcaacaacaa

SEQ ID NO: 679265 - DNA, 13 bp, D. melanogaster
ttttcaacaactt

SEQ ID NO: 679266 - DNA, 13 bp, D. melanogaster
ttttcaacaagaa

SEQ ID NO: 679267 - DNA, 13 bp, D. melanogaster
ttttcaacacaca

SEQ ID NO: 679268 - DNA, 13 bp, D. melanogaster
ttttcaacacatt

SEQ ID NO: 679269 - DNA, 13 bp, D. melanogaster
ttttcaacactcc

SEQ ID NO: 679270 - DNA, 13 bp, D. melanogaster
ttttcaacacttt

SEQ ID NO: 679271 - DNA, 14 bp, D. melanogaster
ttttcaacactttt

SEQ ID NO: 679272 - DNA, 14 bp, D. melanogaster
ttttcaacagccaa

SEQ ID NO: 679273 - DNA, 14 bp, D. melanogaster
ttttcaacagtttt

SEQ ID NO: 679274 - DNA, 13 bp, D. melanogaster
ttttcaacatatt

SEQ ID NO: 679275 - DNA, 13 bp, D. melanogaster
ttttcaacatccc

SEQ ID NO: 679276 - DNA, 13 bp, D. melanogaster
ttttcaaccaaaa

SEQ ID NO: 679277 - DNA, 14 bp, D. melanogaster
ttttcaaccatttt

SEQ ID NO: 679278 - DNA, 13 bp, D. melanogaster
ttttcaacccgaa

SEQ ID NO: 679279 - DNA, 13 bp, D. melanogaster
ttttcaacgaaaa

SEQ ID NO: 679280 - DNA, 13 bp, D. melanogaster
ttttcaacgaaat

SEQ ID NO: 679281 - DNA, 13 bp, D. melanogaster
ttttcaacgaatt

SEQ ID NO: 679282 - DNA, 14 bp, D. melanogaster
ttttcaacgaattt

SEQ ID NO: 679283 - DNA, 13 bp, D. melanogaster
ttttcaactaatt

SEQ ID NO: 679284 - DNA, 13 bp, D. melanogaster
ttttcaactatat

SEQ ID NO: 679285 - DNA, 13 bp, D. melanogaster
ttttcaactgttt

SEQ ID NO: 679286 - DNA, 13 bp, D. melanogaster
ttttcaactttga

SEQ ID NO: 679287 - DNA, 14 bp, D. melanogaster
ttttcaacttttca

SEQ ID NO: 679288 - DNA, 13 bp, D. melanogaster
ttttcaacttttg

SEQ ID NO: 679289 - DNA, 13 bp, D. melanogaster
ttttcaagaaaaa

SEQ ID NO: 679290 - DNA, 13 bp, D. melanogaster
ttttcaagaaaat

SEQ ID NO: 679291 - DNA, 13 bp, D. melanogaster
ttttcaagaaatt

SEQ ID NO: 679292 - DNA, 13 bp, D. melanogaster
ttttcaagaatca

SEQ ID NO: 679293 - DNA, 13 bp, D. melanogaster
ttttcaagagttt

SEQ ID NO: 679294 - DNA, 13 bp, D. melanogaster
ttttcaagcaaat

SEQ ID NO: 679295 - DNA, 13 bp, D. melanogaster
ttttcaagcaatt

SEQ ID NO: 679296 - DNA, 13 bp, D. melanogaster
ttttcaagcacaa

SEQ ID NO: 679297 - DNA, 13 bp, D. melanogaster
ttttcaagcacct

SEQ ID NO: 679298 - DNA, 13 bp, D. melanogaster
ttttcaagccaaa

SEQ ID NO: 679299 - DNA, 13 bp, D. melanogaster
ttttcaagctgaa

SEQ ID NO: 679300 - DNA, 13 bp, D. melanogaster
ttttcaagctttt

SEQ ID NO: 679301 - DNA, 13 bp, D. melanogaster
ttttcaaggatat

SEQ ID NO: 679302 - DNA, 13 bp, D. melanogaster
ttttcaagtagtt

SEQ ID NO: 679303 - DNA, 13 bp, D. melanogaster
ttttcaagtcaaa

SEQ ID NO: 679304 - DNA, 13 bp, D. melanogaster
ttttcaagtgaaa

SEQ ID NO: 679305 - DNA, 13 bp, D. melanogaster
ttttcaagtgcat

SEQ ID NO: 679306 - DNA, 14 bp, D. melanogaster
ttttcaagtgcatt

SEQ ID NO: 679307 - DNA, 13 bp, D. melanogaster
ttttcaagtgcca

SEQ ID NO: 679308 - DNA, 13 bp, D. melanogaster
ttttcaagtgctt

SEQ ID NO: 679309 - DNA, 13 bp, D. melanogaster
ttttcaagtgtca

SEQ ID NO: 679310 - DNA, 14 bp, D. melanogaster
ttttcaagtgtttt

SEQ ID NO: 679311 - DNA, 13 bp, D. melanogaster
ttttcaagttaaa

SEQ ID NO: 679312 - DNA, 13 bp, D. melanogaster
ttttcaagttcaa

SEQ ID NO: 679313 - DNA, 13 bp, D. melanogaster
ttttcaagttctt

SEQ ID NO: 679314 - DNA, 13 bp, D. melanogaster
ttttcaagtttaa

SEQ ID NO: 679315 - DNA, 13 bp, D. melanogaster
ttttcaagtttat

SEQ ID NO: 679316 - DNA, 13 bp, D. melanogaster
ttttcaagtttgt

SEQ ID NO: 679317 - DNA, 13 bp, D. melanogaster
ttttcaagtttta

SEQ ID NO: 679318 - DNA, 13 bp, D. melanogaster
ttttcaagttttg

SEQ ID NO: 679319 - DNA, 13 bp, D. melanogaster
ttttcaataccat

SEQ ID NO: 679320 - DNA, 13 bp, D. melanogaster
ttttcaatagctg

SEQ ID NO: 679321 - DNA, 13 bp, D. melanogaster
ttttcaatataca

SEQ ID NO: 679322 - DNA, 13 bp, D. melanogaster
ttttcaatatgca

SEQ ID NO: 679323 - DNA, 13 bp, D. melanogaster
ttttcaatatgct

SEQ ID NO: 679324 - DNA, 13 bp, D. melanogaster
ttttcaatatttg

SEQ ID NO: 679325 - DNA, 13 bp, D. melanogaster
ttttcaatcaaaa

SEQ ID NO: 679326 - DNA, 13 bp, D. melanogaster
ttttcaatcaaag

SEQ ID NO: 679327 - DNA, 13 bp, D. melanogaster
ttttcaatcaata

SEQ ID NO: 679328 - DNA, 13 bp, D. melanogaster
ttttcaatcgatt

SEQ ID NO: 679329 - DNA, 13 bp, D. melanogaster
ttttcaatgaaaa

SEQ ID NO: 679330 - DNA, 14 bp, D. melanogaster
ttttcaatgaaaat

SEQ ID NO: 679331 - DNA, 13 bp, D. melanogaster
ttttcaatgaaat

SEQ ID NO: 679332 - DNA, 13 bp, D. melanogaster
ttttcaatgaatc

SEQ ID NO: 679333 - DNA, 13 bp, D. melanogaster
ttttcaatgaatt

SEQ ID NO: 679334 - DNA, 13 bp, D. melanogaster
ttttcaatgactt

SEQ ID NO: 679335 - DNA, 13 bp, D. melanogaster
ttttcaatgattt

SEQ ID NO: 679336 - DNA, 13 bp, D. melanogaster
ttttcaatgcaaa

SEQ ID NO: 679337 - DNA, 13 bp, D. melanogaster
ttttcaatgccaa

SEQ ID NO: 679338 - DNA, 13 bp, D. melanogaster
ttttcaatgcttt

SEQ ID NO: 679339 - DNA, 14 bp, D. melanogaster
ttttcaatgtattt

SEQ ID NO: 679340 - DNA, 13 bp, D. melanogaster
ttttcaatgttaa

SEQ ID NO: 679341 - DNA, 13 bp, D. melanogaster
ttttcaattaatg

SEQ ID NO: 679342 - DNA, 13 bp, D. melanogaster
ttttcaattacca

SEQ ID NO: 679343 - DNA, 13 bp, D. melanogaster
ttttcaattagca

SEQ ID NO: 679344 - DNA, 13 bp, D. melanogaster
ttttcaattagcc

SEQ ID NO: 679345 - DNA, 14 bp, D. melanogaster
ttttcaattagcca

SEQ ID NO: 679346 - DNA, 13 bp, D. melanogaster
ttttcaattatgc

SEQ ID NO: 679347 - DNA, 13 bp, D. melanogaster
ttttcaattcaca

SEQ ID NO: 679348 - DNA, 13 bp, D. melanogaster
ttttcaattccaa

SEQ ID NO: 679349 - DNA, 13 bp, D. melanogaster
ttttcaattcgaa

SEQ ID NO: 679350 - DNA, 13 bp, D. melanogaster
ttttcaattgaaa

SEQ ID NO: 679351 - DNA, 14 bp, D. melanogaster
ttttcaattgattt

SEQ ID NO: 679352 - DNA, 13 bp, D. melanogaster
ttttcaattgcaa

SEQ ID NO: 679353 - DNA, 13 bp, D. melanogaster
ttttcaattgcca

SEQ ID NO: 679354 - DNA, 14 bp, D. melanogaster
ttttcaattggaaa

SEQ ID NO: 679355 - DNA, 14 bp, D. melanogaster
ttttcaattggttt

SEQ ID NO: 679356 - DNA, 13 bp, D. melanogaster
ttttcaattgtaa

SEQ ID NO: 679357 - DNA, 13 bp, D. melanogaster
ttttcaatttcaa

SEQ ID NO: 679358 - DNA, 13 bp, D. melanogaster
ttttcaatttcca

SEQ ID NO: 679359 - DNA, 14 bp, D. melanogaster
ttttcaatttgatt

SEQ ID NO: 679360 - DNA, 13 bp, D. melanogaster
ttttcaatttgca

SEQ ID NO: 679361 - DNA, 13 bp, D. melanogaster
ttttcaatttgct

SEQ ID NO: 679362 - DNA, 13 bp, D. melanogaster
ttttcaatttggc

SEQ ID NO: 679363 - DNA, 13 bp, D. melanogaster
ttttcacaaaaaa

SEQ ID NO: 679364 - DNA, 13 bp, D. melanogaster
ttttcacaaaaat

SEQ ID NO: 679365 - DNA, 13 bp, D. melanogaster
ttttcacaaaact

SEQ ID NO: 679366 - DNA, 13 bp, D. melanogaster
ttttcacaaaata

SEQ ID NO: 679367 - DNA, 13 bp, D. melanogaster
ttttcacaaattt

SEQ ID NO: 679368 - DNA, 13 bp, D. melanogaster
ttttcacaacttt

SEQ ID NO: 679369 - DNA, 13 bp, D. melanogaster
ttttcacaatatt

SEQ ID NO: 679370 - DNA, 14 bp, D. melanogaster
ttttcacaatcttt

SEQ ID NO: 679371 - DNA, 13 bp, D. melanogaster
ttttcacaatttg

SEQ ID NO: 679372 - DNA, 14 bp, D. melanogaster
ttttcacaattttc

SEQ ID NO: 679373 - DNA, 13 bp, D. melanogaster
ttttcacacagca

SEQ ID NO: 679374 - DNA, 13 bp, D. melanogaster
ttttcacactcaa

SEQ ID NO: 679375 - DNA, 13 bp, D. melanogaster
ttttcacactctt

SEQ ID NO: 679376 - DNA, 13 bp, D. melanogaster
ttttcacagaatt

SEQ ID NO: 679377 - DNA, 13 bp, D. melanogaster
ttttcacagattt

SEQ ID NO: 679378 - DNA, 13 bp, D. melanogaster
ttttcacagctgc

SEQ ID NO: 679379 - DNA, 13 bp, D. melanogaster
ttttcacagtttt

SEQ ID NO: 679380 - DNA, 13 bp, D. melanogaster
ttttcacatcatt

SEQ ID NO: 679381 - DNA, 14 bp, D. melanogaster
ttttcacattttca

SEQ ID NO: 679382 - DNA, 13 bp, D. melanogaster
ttttcaccaaact

SEQ ID NO: 679383 - DNA, 13 bp, D. melanogaster
ttttcaccaccac

SEQ ID NO: 679384 - DNA, 13 bp, D. melanogaster
ttttcacccattt

SEQ ID NO: 679385 - DNA, 13 bp, D. melanogaster
ttttcaccgcttt

SEQ ID NO: 679386 - DNA, 13 bp, D. melanogaster
ttttcacgctttt

SEQ ID NO: 679387 - DNA, 13 bp, D. melanogaster
ttttcactaaaaa

SEQ ID NO: 679388 - DNA, 13 bp, D. melanogaster
ttttcactcactt

SEQ ID NO: 679389 - DNA, 13 bp, D. melanogaster
ttttcactgagaa

SEQ ID NO: 679390 - DNA, 13 bp, D. melanogaster
ttttcactgattt

SEQ ID NO: 679391 - DNA, 13 bp, D. melanogaster
ttttcactgctct

SEQ ID NO: 679392 - DNA, 13 bp, D. melanogaster
ttttcacttcaat

SEQ ID NO: 679393 - DNA, 13 bp, D. melanogaster
ttttcacttgatt

SEQ ID NO: 679394 - DNA, 13 bp, D. melanogaster
ttttcacttggca

SEQ ID NO: 679395 - DNA, 14 bp, D. melanogaster
ttttcactttcaat

SEQ ID NO: 679396 - DNA, 14 bp, D. melanogaster
ttttcactttcgtt

SEQ ID NO: 679397 - DNA, 13 bp, D. melanogaster
ttttcactttgat

SEQ ID NO: 679398 - DNA, 13 bp, D. melanogaster
ttttcagaacagc

SEQ ID NO: 679399 - DNA, 13 bp, D. melanogaster
ttttcagaataat

SEQ ID NO: 679400 - DNA, 13 bp, D. melanogaster
ttttcagaatttt

SEQ ID NO: 679401 - DNA, 14 bp, D. melanogaster
ttttcagatatttt

SEQ ID NO: 679402 - DNA, 13 bp, D. melanogaster
ttttcagcaaata

SEQ ID NO: 679403 - DNA, 13 bp, D. melanogaster
ttttcagcaaatt

SEQ ID NO: 679404 - DNA, 13 bp, D. melanogaster
ttttcagcacatt

SEQ ID NO: 679405 - DNA, 13 bp, D. melanogaster
ttttcagcagttt

SEQ ID NO: 679406 - DNA, 13 bp, D. melanogaster
ttttcagcatttc

SEQ ID NO: 679407 - DNA, 13 bp, D. melanogaster
ttttcagcatttt

SEQ ID NO: 679408 - DNA, 14 bp, D. melanogaster
ttttcagcattttt

SEQ ID NO: 679409 - DNA, 13 bp, D. melanogaster
ttttcagccaagt

SEQ ID NO: 679410 - DNA, 13 bp, D. melanogaster
ttttcagccactt

SEQ ID NO: 679411 - DNA, 13 bp, D. melanogaster
ttttcagccagct

SEQ ID NO: 679412 - DNA, 13 bp, D. melanogaster
ttttcagcgattt

SEQ ID NO: 679413 - DNA, 13 bp, D. melanogaster
ttttcagcgcatt

SEQ ID NO: 679414 - DNA, 13 bp, D. melanogaster
ttttcagcgcttt

SEQ ID NO: 679415 - DNA, 13 bp, D. melanogaster
ttttcagctattt

SEQ ID NO: 679416 - DNA, 13 bp, D. melanogaster
ttttcagctgcca

SEQ ID NO: 679417 - DNA, 13 bp, D. melanogaster
ttttcagctgctg

SEQ ID NO: 679418 - DNA, 13 bp, D. melanogaster
ttttcagctggct

SEQ ID NO: 679419 - DNA, 13 bp, D. melanogaster
ttttcagctgttt

SEQ ID NO: 679420 - DNA, 13 bp, D. melanogaster
ttttcagctttat

SEQ ID NO: 679421 - DNA, 13 bp, D. melanogaster
ttttcagcttttc

SEQ ID NO: 679422 - DNA, 14 bp, D. melanogaster
ttttcagctttttg

SEQ ID NO: 679423 - DNA, 13 bp, D. melanogaster
ttttcaggctttt

SEQ ID NO: 679424 - DNA, 13 bp, D. melanogaster
ttttcagtaattt

SEQ ID NO: 679425 - DNA, 13 bp, D. melanogaster
ttttcagtatttg

SEQ ID NO: 679426 - DNA, 13 bp, D. melanogaster
ttttcagtgaaat

SEQ ID NO: 679427 - DNA, 13 bp, D. melanogaster
ttttcagtgcacc

SEQ ID NO: 679428 - DNA, 13 bp, D. melanogaster
ttttcagtgcata

SEQ ID NO: 679429 - DNA, 13 bp, D. melanogaster
ttttcagtgcatg

SEQ ID NO: 679430 - DNA, 13 bp, D. melanogaster
ttttcagtgtatt

SEQ ID NO: 679431 - DNA, 13 bp, D. melanogaster
ttttcagtgtgct

SEQ ID NO: 679432 - DNA, 13 bp, D. melanogaster
ttttcagttaatt

SEQ ID NO: 679433 - DNA, 14 bp, D. melanogaster
ttttcagttatttc

SEQ ID NO: 679434 - DNA, 13 bp, D. melanogaster
ttttcagttcaaa

SEQ ID NO: 679435 - DNA, 13 bp, D. melanogaster
ttttcagttcatt

SEQ ID NO: 679436 - DNA, 13 bp, D. melanogaster
ttttcagtttcag

SEQ ID NO: 679437 - DNA, 13 bp, D. melanogaster
ttttcagtttgca

SEQ ID NO: 679438 - DNA, 14 bp, D. melanogaster
ttttcagttttaaa

SEQ ID NO: 679439 - DNA, 13 bp, D. melanogaster
ttttcagttttac

SEQ ID NO: 679440 - DNA, 14 bp, D. melanogaster
ttttcagttttact

SEQ ID NO: 679441 - DNA, 14 bp, D. melanogaster
ttttcagtttttca

SEQ ID NO: 679442 - DNA, 14 bp, D. melanogaster
ttttcagtttttcc

SEQ ID NO: 679443 - DNA, 13 bp, D. melanogaster
ttttcataattca

SEQ ID NO: 679444 - DNA, 15 bp, D. melanogaster
ttttcataattctgt

SEQ ID NO: 679445 - DNA, 13 bp, D. melanogaster
ttttcatagaatt

SEQ ID NO: 679446 - DNA, 13 bp, D. melanogaster
ttttcatagattt

SEQ ID NO: 679447 - DNA, 13 bp, D. melanogaster
ttttcatagtttc

SEQ ID NO: 679448 - DNA, 13 bp, D. melanogaster
ttttcatatcaaa

SEQ ID NO: 679449 - DNA, 13 bp, D. melanogaster
ttttcatatcaat

SEQ ID NO: 679450 - DNA, 13 bp, D. melanogaster
ttttcatattgta

SEQ ID NO: 679451 - DNA, 13 bp, D. melanogaster
ttttcatcaactt

SEQ ID NO: 679452 - DNA, 13 bp, D. melanogaster
ttttcatcatcat

SEQ ID NO: 679453 - DNA, 13 bp, D. melanogaster
ttttcatcgaatc

SEQ ID NO: 679454 - DNA, 13 bp, D. melanogaster
ttttcatctagtg

SEQ ID NO: 679455 - DNA, 13 bp, D. melanogaster
ttttcatgaaatt

SEQ ID NO: 679456 - DNA, 13 bp, D. melanogaster
ttttcatgagcaa

SEQ ID NO: 679457 - DNA, 13 bp, D. melanogaster
ttttcatgcaaat

SEQ ID NO: 679458 - DNA, 13 bp, D. melanogaster
ttttcatgcacga

SEQ ID NO: 679459 - DNA, 13 bp, D. melanogaster
ttttcatgccttg

SEQ ID NO: 679460 - DNA, 13 bp, D. melanogaster
ttttcatgcgaaa

SEQ ID NO: 679461 - DNA, 13 bp, D. melanogaster
ttttcatgctcat

SEQ ID NO: 679462 - DNA, 13 bp, D. melanogaster
ttttcatgctgct

SEQ ID NO: 679463 - DNA, 13 bp, D. melanogaster
ttttcatggaaat

SEQ ID NO: 679464 - DNA, 13 bp, D. melanogaster
ttttcatggcttt

SEQ ID NO: 679465 - DNA, 13 bp, D. melanogaster
ttttcatgttcat

SEQ ID NO: 679466 - DNA, 13 bp, D. melanogaster
ttttcatgtttac

SEQ ID NO: 679467 - DNA, 13 bp, D. melanogaster
ttttcatgtttgc

SEQ ID NO: 679468 - DNA, 13 bp, D. melanogaster
ttttcattaaaac

SEQ ID NO: 679469 - DNA, 14 bp, D. melanogaster
ttttcattaaaatg

SEQ ID NO: 679470 - DNA, 13 bp, D. melanogaster
ttttcattaattg

SEQ ID NO: 679471 - DNA, 13 bp, D. melanogaster
ttttcattagatt

SEQ ID NO: 679472 - DNA, 13 bp, D. melanogaster
ttttcattagctt

SEQ ID NO: 679473 - DNA, 14 bp, D. melanogaster
ttttcattcattca

SEQ ID NO: 679474 - DNA, 13 bp, D. melanogaster
ttttcattcgatt

SEQ ID NO: 679475 - DNA, 14 bp, D. melanogaster
ttttcattcgattt

SEQ ID NO: 679476 - DNA, 13 bp, D. melanogaster
ttttcattcgctt

SEQ ID NO: 679477 - DNA, 14 bp, D. melanogaster
ttttcattctagtt

SEQ ID NO: 679478 - DNA, 13 bp, D. melanogaster
ttttcattctgat

SEQ ID NO: 679479 - DNA, 13 bp, D. melanogaster
ttttcattctgct

SEQ ID NO: 679480 - DNA, 13 bp, D. melanogaster
ttttcattgaaaa

SEQ ID NO: 679481 - DNA, 13 bp, D. melanogaster
ttttcattgcata

SEQ ID NO: 679482 - DNA, 14 bp, D. melanogaster
ttttcattgcatac

SEQ ID NO: 679483 - DNA, 13 bp, D. melanogaster
ttttcattgcatt

SEQ ID NO: 679484 - DNA, 13 bp, D. melanogaster
ttttcattgcctt

SEQ ID NO: 679485 - DNA, 13 bp, D. melanogaster
ttttcattggatt

SEQ ID NO: 679486 - DNA, 13 bp, D. melanogaster
ttttcattggcat

SEQ ID NO: 679487 - DNA, 13 bp, D. melanogaster
ttttcatttacag

SEQ ID NO: 679488 - DNA, 13 bp, D. melanogaster
ttttcatttacca

SEQ ID NO: 679489 - DNA, 13 bp, D. melanogaster
ttttcatttccaa

SEQ ID NO: 679490 - DNA, 14 bp, D. melanogaster
ttttcatttccaat

SEQ ID NO: 679491 - DNA, 13 bp, D. melanogaster
ttttcatttcgcc

SEQ ID NO: 679492 - DNA, 14 bp, D. melanogaster
ttttcatttcggcc

SEQ ID NO: 679493 - DNA, 13 bp, D. melanogaster
ttttcatttctgg

SEQ ID NO: 679494 - DNA, 14 bp, D. melanogaster
ttttcatttgaatt

SEQ ID NO: 679495 - DNA, 13 bp, D. melanogaster
ttttcatttgcca

SEQ ID NO: 679496 - DNA, 14 bp, D. melanogaster
ttttcatttgccaa

SEQ ID NO: 679497 - DNA, 13 bp, D. melanogaster
ttttcatttgcct

SEQ ID NO: 679498 - DNA, 13 bp, D. melanogaster
ttttcatttgctg

SEQ ID NO: 679499 - DNA, 13 bp, D. melanogaster
ttttcatttggcc

SEQ ID NO: 679500 - DNA, 13 bp, D. melanogaster
ttttcatttgggc

SEQ ID NO: 679501 - DNA, 14 bp, D. melanogaster
ttttcattttcaca

SEQ ID NO: 679502 - DNA, 13 bp, D. melanogaster
ttttcattttcag

SEQ ID NO: 679503 - DNA, 13 bp, D. melanogaster
ttttcattttgaa

SEQ ID NO: 679504 - DNA, 14 bp, D. melanogaster
ttttcattttgaaa

SEQ ID NO: 679505 - DNA, 14 bp, D. melanogaster
ttttcattttgaat

SEQ ID NO: 679506 - DNA, 13 bp, D. melanogaster
ttttcattttggc

SEQ ID NO: 679507 - DNA, 13 bp, D. melanogaster
ttttccaaaaaag

SEQ ID NO: 679508 - DNA, 13 bp, D. melanogaster
ttttccaaaaact

SEQ ID NO: 679509 - DNA, 13 bp, D. melanogaster
ttttccaaaaaga

SEQ ID NO: 679510 - DNA, 14 bp, D. melanogaster
ttttccaaaaagaa

SEQ ID NO: 679511 - DNA, 13 bp, D. melanogaster
ttttccaaaaata

SEQ ID NO: 679512 - DNA, 13 bp, D. melanogaster
ttttccaaaaatt

SEQ ID NO: 679513 - DNA, 14 bp, D. melanogaster
ttttccaaaaattt

SEQ ID NO: 679514 - DNA, 13 bp, D. melanogaster
ttttccaaaacaa

SEQ ID NO: 679515 - DNA, 13 bp, D. melanogaster
ttttccaaaacat

SEQ ID NO: 679516 - DNA, 13 bp, D. melanogaster
ttttccaaaactg

SEQ ID NO: 679517 - DNA, 13 bp, D. melanogaster
ttttccaaaactt

SEQ ID NO: 679518 - DNA, 13 bp, D. melanogaster
ttttccaaaagcc

SEQ ID NO: 679519 - DNA, 13 bp, D. melanogaster
ttttccaaaagtg

SEQ ID NO: 679520 - DNA, 13 bp, D. melanogaster
ttttccaaaatta

SEQ ID NO: 679521 - DNA, 13 bp, D. melanogaster
ttttccaaaattt

SEQ ID NO: 679522 - DNA, 13 bp, D. melanogaster
ttttccaaacaaa

SEQ ID NO: 679523 - DNA, 13 bp, D. melanogaster
ttttccaaacaat

SEQ ID NO: 679524 - DNA, 13 bp, D. melanogaster
ttttccaaacatt

SEQ ID NO: 679525 - DNA, 13 bp, D. melanogaster
ttttccaaacttt

SEQ ID NO: 679526 - DNA, 13 bp, D. melanogaster
ttttccaaagcat

SEQ ID NO: 679527 - DNA, 13 bp, D. melanogaster
ttttccaaagttt

SEQ ID NO: 679528 - DNA, 13 bp, D. melanogaster
ttttccaaatcaa

SEQ ID NO: 679529 - DNA, 13 bp, D. melanogaster
ttttccaaattaa

SEQ ID NO: 679530 - DNA, 13 bp, D. melanogaster
ttttccaaattct

SEQ ID NO: 679531 - DNA, 14 bp, D. melanogaster
ttttccaaattctt

SEQ ID NO: 679532 - DNA, 13 bp, D. melanogaster
ttttccaaattga

SEQ ID NO: 679533 - DNA, 13 bp, D. melanogaster
ttttccaaatttc

SEQ ID NO: 679534 - DNA, 13 bp, D. melanogaster
ttttccaacactt

SEQ ID NO: 679535 - DNA, 13 bp, D. melanogaster
ttttccaacagct

SEQ ID NO: 679536 - DNA, 14 bp, D. melanogaster
ttttccaacatttt

SEQ ID NO: 679537 - DNA, 13 bp, D. melanogaster
ttttccaaccatt

SEQ ID NO: 679538 - DNA, 14 bp, D. melanogaster
ttttccaaccattt

SEQ ID NO: 679539 - DNA, 13 bp, D. melanogaster
ttttccaacgaat

SEQ ID NO: 679540 - DNA, 13 bp, D. melanogaster
ttttccaacgttt

SEQ ID NO: 679541 - DNA, 13 bp, D. melanogaster
ttttccaactgca

SEQ ID NO: 679542 - DNA, 13 bp, D. melanogaster
ttttccaactgcc

SEQ ID NO: 679543 - DNA, 13 bp, D. melanogaster
ttttccaactgct

SEQ ID NO: 679544 - DNA, 13 bp, D. melanogaster
ttttccaactgtt

SEQ ID NO: 679545 - DNA, 13 bp, D. melanogaster
ttttccaacttat

SEQ ID NO: 679546 - DNA, 13 bp, D. melanogaster
ttttccaagaaat

SEQ ID NO: 679547 - DNA, 13 bp, D. melanogaster
ttttccaagccaa

SEQ ID NO: 679548 - DNA, 13 bp, D. melanogaster
ttttccaaggctt

SEQ ID NO: 679549 - DNA, 13 bp, D. melanogaster
ttttccaagtgca

SEQ ID NO: 679550 - DNA, 14 bp, D. melanogaster
ttttccaagtgcat

SEQ ID NO: 679551 - DNA, 13 bp, D. melanogaster
ttttccaagtgcc

SEQ ID NO: 679552 - DNA, 13 bp, D. melanogaster
ttttccaatcatt

SEQ ID NO: 679553 - DNA, 13 bp, D. melanogaster
ttttccaatgcaa

SEQ ID NO: 679554 - DNA, 13 bp, D. melanogaster
ttttccaatttaa

SEQ ID NO: 679555 - DNA, 13 bp, D. melanogaster
ttttccaatttca

SEQ ID NO: 679556 - DNA, 14 bp, D. melanogaster
ttttccaatttcaa

SEQ ID NO: 679557 - DNA, 13 bp, D. melanogaster
ttttccaatttcc

SEQ ID NO: 679558 - DNA, 13 bp, D. melanogaster
ttttccaatttgt

SEQ ID NO: 679559 - DNA, 14 bp, D. melanogaster
ttttccaatttgtt

SEQ ID NO: 679560 - DNA, 13 bp, D. melanogaster
ttttccacaaaaa

SEQ ID NO: 679561 - DNA, 13 bp, D. melanogaster
ttttccacaaaat

SEQ ID NO: 679562 - DNA, 13 bp, D. melanogaster
ttttccacaaatc

SEQ ID NO: 679563 - DNA, 13 bp, D. melanogaster
ttttccacaattt

SEQ ID NO: 679564 - DNA, 13 bp, D. melanogaster
ttttccacacaaa

SEQ ID NO: 679565 - DNA, 13 bp, D. melanogaster
ttttccacaccca

SEQ ID NO: 679566 - DNA, 13 bp, D. melanogaster
ttttccacagcat

SEQ ID NO: 679567 - DNA, 13 bp, D. melanogaster
ttttccacagttt

SEQ ID NO: 679568 - DNA, 13 bp, D. melanogaster
ttttccacatttc

SEQ ID NO: 679569 - DNA, 13 bp, D. melanogaster
ttttccaccattt

SEQ ID NO: 679570 - DNA, 13 bp, D. melanogaster
ttttccacccaaa

SEQ ID NO: 679571 - DNA, 13 bp, D. melanogaster
ttttccacccaca

SEQ ID NO: 679572 - DNA, 13 bp, D. melanogaster
ttttccacccagc

SEQ ID NO: 679573 - DNA, 13 bp, D. melanogaster
ttttccacccatt

SEQ ID NO: 679574 - DNA, 13 bp, D. melanogaster
ttttccacccgct

SEQ ID NO: 679575 - DNA, 13 bp, D. melanogaster
ttttccaccgccc

SEQ ID NO: 679576 - DNA, 13 bp, D. melanogaster
ttttccaccgcct

SEQ ID NO: 679577 - DNA, 13 bp, D. melanogaster
ttttccaccgctt

SEQ ID NO: 679578 - DNA, 13 bp, D. melanogaster
ttttccacctgcc

SEQ ID NO: 679579 - DNA, 13 bp, D. melanogaster
ttttccacctgtt

SEQ ID NO: 679580 - DNA, 13 bp, D. melanogaster
ttttccacctttg

SEQ ID NO: 679581 - DNA, 13 bp, D. melanogaster
ttttccacgccca

SEQ ID NO: 679582 - DNA, 13 bp, D. melanogaster
ttttccacgcttt

SEQ ID NO: 679583 - DNA, 13 bp, D. melanogaster
ttttccacgtttt

SEQ ID NO: 679584 - DNA, 13 bp, D. melanogaster
ttttccactcatt

SEQ ID NO: 679585 - DNA, 13 bp, D. melanogaster
ttttccactgcaa

SEQ ID NO: 679586 - DNA, 13 bp, D. melanogaster
ttttccactgcct

SEQ ID NO: 679587 - DNA, 13 bp, D. melanogaster
ttttccactggct

SEQ ID NO: 679588 - DNA, 13 bp, D. melanogaster
ttttccactgtct

SEQ ID NO: 679589 - DNA, 13 bp, D. melanogaster
ttttccacttctg

SEQ ID NO: 679590 - DNA, 13 bp, D. melanogaster
ttttccacttggc

SEQ ID NO: 679591 - DNA, 14 bp, D. melanogaster
ttttccacttgttt

SEQ ID NO: 679592 - DNA, 13 bp, D. melanogaster
ttttccacttttg

SEQ ID NO: 679593 - DNA, 13 bp, D. melanogaster
ttttccagatttt

SEQ ID NO: 679594 - DNA, 14 bp, D. melanogaster
ttttccagattttc

SEQ ID NO: 679595 - DNA, 13 bp, D. melanogaster
ttttccagcactt

SEQ ID NO: 679596 - DNA, 13 bp, D. melanogaster
ttttccagcattt

SEQ ID NO: 679597 - DNA, 14 bp, D. melanogaster
ttttccagcatttt

SEQ ID NO: 679598 - DNA, 13 bp, D. melanogaster
ttttccagccaag

SEQ ID NO: 679599 - DNA, 13 bp, D. melanogaster
ttttccagccacc

SEQ ID NO: 679600 - DNA, 13 bp, D. melanogaster
ttttccagccagc

SEQ ID NO: 679601 - DNA, 13 bp, D. melanogaster
ttttccagcccaa

SEQ ID NO: 679602 - DNA, 13 bp, D. melanogaster
ttttccagcccac

SEQ ID NO: 679603 - DNA, 13 bp, D. melanogaster
ttttccagcccca

SEQ ID NO: 679604 - DNA, 13 bp, D. melanogaster
ttttccagcgatt

SEQ ID NO: 679605 - DNA, 13 bp, D. melanogaster
ttttccagcgctt

SEQ ID NO: 679606 - DNA, 13 bp, D. melanogaster
ttttccagcgttt

SEQ ID NO: 679607 - DNA, 13 bp, D. melanogaster
ttttccagctcat

SEQ ID NO: 679608 - DNA, 13 bp, D. melanogaster
ttttccagctccc

SEQ ID NO: 679609 - DNA, 13 bp, D. melanogaster
ttttccagctgcc

SEQ ID NO: 679610 - DNA, 13 bp, D. melanogaster
ttttccagctgct

SEQ ID NO: 679611 - DNA, 13 bp, D. melanogaster
ttttccagcttat

SEQ ID NO: 679612 - DNA, 13 bp, D. melanogaster
ttttccagcttgt

SEQ ID NO: 679613 - DNA, 13 bp, D. melanogaster
ttttccagctttc

SEQ ID NO: 679614 - DNA, 14 bp, D. melanogaster
ttttccagctttcc

SEQ ID NO: 679615 - DNA, 13 bp, D. melanogaster
ttttccagctttt

SEQ ID NO: 679616 - DNA, 14 bp, D. melanogaster
ttttccagcttttc

SEQ ID NO: 679617 - DNA, 14 bp, D. melanogaster
ttttccagcttttt

SEQ ID NO: 679618 - DNA, 13 bp, D. melanogaster
ttttccaggaaaa

SEQ ID NO: 679619 - DNA, 13 bp, D. melanogaster
ttttccagggtat

SEQ ID NO: 679620 - DNA, 13 bp, D. melanogaster
ttttccagtgaaa

SEQ ID NO: 679621 - DNA, 13 bp, D. melanogaster
ttttccagtgcat

SEQ ID NO: 679622 - DNA, 13 bp, D. melanogaster
ttttccagtgctt

SEQ ID NO: 679623 - DNA, 13 bp, D. melanogaster
ttttccagtgtag

SEQ ID NO: 679624 - DNA, 13 bp, D. melanogaster
ttttccagttcga

SEQ ID NO: 679625 - DNA, 13 bp, D. melanogaster
ttttccagttctt

SEQ ID NO: 679626 - DNA, 13 bp, D. melanogaster
ttttccagttgct

SEQ ID NO: 679627 - DNA, 13 bp, D. melanogaster
ttttccagttggc

SEQ ID NO: 679628 - DNA, 13 bp, D. melanogaster
ttttccagtttgt

SEQ ID NO: 679629 - DNA, 13 bp, D. melanogaster
ttttccataaaaa

SEQ ID NO: 679630 - DNA, 13 bp, D. melanogaster
ttttccatatata

SEQ ID NO: 679631 - DNA, 13 bp, D. melanogaster
ttttccatcaatt

SEQ ID NO: 679632 - DNA, 13 bp, D. melanogaster
ttttccatcgaat

SEQ ID NO: 679633 - DNA, 13 bp, D. melanogaster
ttttccatctcca

SEQ ID NO: 679634 - DNA, 13 bp, D. melanogaster
ttttccatctgaa

SEQ ID NO: 679635 - DNA, 13 bp, D. melanogaster
ttttccatctgca

SEQ ID NO: 679636 - DNA, 13 bp, D. melanogaster
ttttccatgaatt

SEQ ID NO: 679637 - DNA, 13 bp, D. melanogaster
ttttccatgcatt

SEQ ID NO: 679638 - DNA, 13 bp, D. melanogaster
ttttccatggaaa

SEQ ID NO: 679639 - DNA, 13 bp, D. melanogaster
ttttccatgtctg

SEQ ID NO: 679640 - DNA, 13 bp, D. melanogaster
ttttccatgtgtt

SEQ ID NO: 679641 - DNA, 13 bp, D. melanogaster
ttttccatgttaa

SEQ ID NO: 679642 - DNA, 13 bp, D. melanogaster
ttttccattaaat

SEQ ID NO: 679643 - DNA, 13 bp, D. melanogaster
ttttccattcaaa

SEQ ID NO: 679644 - DNA, 13 bp, D. melanogaster
ttttccattcagc

SEQ ID NO: 679645 - DNA, 13 bp, D. melanogaster
ttttccattctgt

SEQ ID NO: 679646 - DNA, 13 bp, D. melanogaster
ttttccattgcca

SEQ ID NO: 679647 - DNA, 13 bp, D. melanogaster
ttttccattgccc

SEQ ID NO: 679648 - DNA, 13 bp, D. melanogaster
ttttccatttcaa

SEQ ID NO: 679649 - DNA, 13 bp, D. melanogaster
ttttccatttcca

SEQ ID NO: 679650 - DNA, 14 bp, D. melanogaster
ttttccatttccac

SEQ ID NO: 679651 - DNA, 13 bp, D. melanogaster
ttttccatttgat

SEQ ID NO: 679652 - DNA, 13 bp, D. melanogaster
ttttccatttgcc

SEQ ID NO: 679653 - DNA, 14 bp, D. melanogaster
ttttccatttgcca

SEQ ID NO: 679654 - DNA, 14 bp, D. melanogaster
ttttccattttccg

SEQ ID NO: 679655 - DNA, 14 bp, D. melanogaster
ttttccatttttgc

SEQ ID NO: 679656 - DNA, 13 bp, D. melanogaster
ttttcccaaaaaa

SEQ ID NO: 679657 - DNA, 13 bp, D. melanogaster
ttttcccaaaaac

SEQ ID NO: 679658 - DNA, 13 bp, D. melanogaster
ttttcccaaatgc

SEQ ID NO: 679659 - DNA, 13 bp, D. melanogaster
ttttcccaaattt

SEQ ID NO: 679660 - DNA, 13 bp, D. melanogaster
ttttcccaactcc

SEQ ID NO: 679661 - DNA, 13 bp, D. melanogaster
ttttcccaactgg

SEQ ID NO: 679662 - DNA, 13 bp, D. melanogaster
ttttcccaacttt

SEQ ID NO: 679663 - DNA, 13 bp, D. melanogaster
ttttcccaagtgt

SEQ ID NO: 679664 - DNA, 13 bp, D. melanogaster
ttttcccaataaa

SEQ ID NO: 679665 - DNA, 13 bp, D. melanogaster
ttttcccaattcc

SEQ ID NO: 679666 - DNA, 13 bp, D. melanogaster
ttttcccacaatt

SEQ ID NO: 679667 - DNA, 13 bp, D. melanogaster
ttttcccacagct

SEQ ID NO: 679668 - DNA, 13 bp, D. melanogaster
ttttcccacagtg

SEQ ID NO: 679669 - DNA, 13 bp, D. melanogaster
ttttcccacattt

SEQ ID NO: 679670 - DNA, 13 bp, D. melanogaster
ttttcccacccac

SEQ ID NO: 679671 - DNA, 13 bp, D. melanogaster
ttttcccaccgcc

SEQ ID NO: 679672 - DNA, 13 bp, D. melanogaster
ttttcccactcca

SEQ ID NO: 679673 - DNA, 14 bp, D. melanogaster
ttttcccactccac

SEQ ID NO: 679674 - DNA, 13 bp, D. melanogaster
ttttcccactgcc

SEQ ID NO: 679675 - DNA, 13 bp, D. melanogaster
ttttcccagaaaa

SEQ ID NO: 679676 - DNA, 13 bp, D. melanogaster
ttttcccagccac

SEQ ID NO: 679677 - DNA, 13 bp, D. melanogaster
ttttcccagccat

SEQ ID NO: 679678 - DNA, 13 bp, D. melanogaster
ttttcccagctgc

SEQ ID NO: 679679 - DNA, 13 bp, D. melanogaster
ttttcccagcttg

SEQ ID NO: 679680 - DNA, 13 bp, D. melanogaster
ttttcccagcttt

SEQ ID NO: 679681 - DNA, 13 bp, D. melanogaster
ttttcccaggcaa

SEQ ID NO: 679682 - DNA, 13 bp, D. melanogaster
ttttcccagtgcc

SEQ ID NO: 679683 - DNA, 13 bp, D. melanogaster
ttttcccagtgtt

SEQ ID NO: 679684 - DNA, 13 bp, D. melanogaster
ttttcccagtttc

SEQ ID NO: 679685 - DNA, 14 bp, D. melanogaster
ttttcccatcacac

SEQ ID NO: 679686 - DNA, 13 bp, D. melanogaster
ttttcccatctcg

SEQ ID NO: 679687 - DNA, 13 bp, D. melanogaster
ttttcccatctta

SEQ ID NO: 679688 - DNA, 13 bp, D. melanogaster
ttttcccattgcc

SEQ ID NO: 679689 - DNA, 13 bp, D. melanogaster
ttttcccattgtt

SEQ ID NO: 679690 - DNA, 13 bp, D. melanogaster
ttttccccaaaaa

SEQ ID NO: 679691 - DNA, 13 bp, D. melanogaster
ttttccccaaatt

SEQ ID NO: 679692 - DNA, 13 bp, D. melanogaster
ttttccccaacca

SEQ ID NO: 679693 - DNA, 13 bp, D. melanogaster
ttttccccaactc

SEQ ID NO: 679694 - DNA, 13 bp, D. melanogaster
ttttccccaactt

SEQ ID NO: 679695 - DNA, 13 bp, D. melanogaster
ttttccccaattt

SEQ ID NO: 679696 - DNA, 13 bp, D. melanogaster
ttttccccacatt

SEQ ID NO: 679697 - DNA, 13 bp, D. melanogaster
ttttccccaccca

SEQ ID NO: 679698 - DNA, 13 bp, D. melanogaster
ttttccccagcca

SEQ ID NO: 679699 - DNA, 13 bp, D. melanogaster
ttttcccccaaaa

SEQ ID NO: 679700 - DNA, 13 bp, D. melanogaster
ttttccccccaaa

SEQ ID NO: 679701 - DNA, 13 bp, D. melanogaster
ttttccccccaat

SEQ ID NO: 679702 - DNA, 13 bp, D. melanogaster
ttttcccccgcca

SEQ ID NO: 679703 - DNA, 13 bp, D. melanogaster
ttttccccgaaaa

SEQ ID NO: 679704 - DNA, 13 bp, D. melanogaster
ttttccccgaaat

SEQ ID NO: 679705 - DNA, 14 bp, D. melanogaster
ttttccccgatttt

SEQ ID NO: 679706 - DNA, 14 bp, D. melanogaster
ttttccccgcattt

SEQ ID NO: 679707 - DNA, 13 bp, D. melanogaster
ttttccccgtcta

SEQ ID NO: 679708 - DNA, 13 bp, D. melanogaster
ttttcccgacttc

SEQ ID NO: 679709 - DNA, 13 bp, D. melanogaster
ttttcccgacttt

SEQ ID NO: 679710 - DNA, 13 bp, D. melanogaster
ttttcccgcactt

SEQ ID NO: 679711 - DNA, 13 bp, D. melanogaster
ttttcccgcagtg

SEQ ID NO: 679712 - DNA, 13 bp, D. melanogaster
ttttcccgccact

SEQ ID NO: 679713 - DNA, 13 bp, D. melanogaster
ttttcccgccgct

SEQ ID NO: 679714 - DNA, 13 bp, D. melanogaster
ttttcccggaaaa

SEQ ID NO: 679715 - DNA, 13 bp, D. melanogaster
ttttcccgggaaa

SEQ ID NO: 679716 - DNA, 13 bp, D. melanogaster
ttttccctgattt

SEQ ID NO: 679717 - DNA, 13 bp, D. melanogaster
ttttccctgccat

SEQ ID NO: 679718 - DNA, 13 bp, D. melanogaster
ttttccctggcca

SEQ ID NO: 679719 - DNA, 13 bp, D. melanogaster
ttttccctggctt

SEQ ID NO: 679720 - DNA, 13 bp, D. melanogaster
ttttcccttaaat

SEQ ID NO: 679721 - DNA, 13 bp, D. melanogaster
ttttccctttgaa

SEQ ID NO: 679722 - DNA, 13 bp, D. melanogaster
ttttccgaaataa

SEQ ID NO: 679723 - DNA, 13 bp, D. melanogaster
ttttccgaaatta

SEQ ID NO: 679724 - DNA, 13 bp, D. melanogaster
ttttccgaatttc

SEQ ID NO: 679725 - DNA, 13 bp, D. melanogaster
ttttccgacattt

SEQ ID NO: 679726 - DNA, 13 bp, D. melanogaster
ttttccgacccca

SEQ ID NO: 679727 - DNA, 13 bp, D. melanogaster
ttttccgactttt

SEQ ID NO: 679728 - DNA, 14 bp, D. melanogaster
ttttccgacttttc

SEQ ID NO: 679729 - DNA, 13 bp, D. melanogaster
ttttccgagtgca

SEQ ID NO: 679730 - DNA, 13 bp, D. melanogaster
ttttccgagtttt

SEQ ID NO: 679731 - DNA, 13 bp, D. melanogaster
ttttccgatttcc

SEQ ID NO: 679732 - DNA, 13 bp, D. melanogaster
ttttccgattttc

SEQ ID NO: 679733 - DNA, 14 bp, D. melanogaster
ttttccgattttcc

SEQ ID NO: 679734 - DNA, 13 bp, D. melanogaster
ttttccgcaattt

SEQ ID NO: 679735 - DNA, 13 bp, D. melanogaster
ttttccgcacatt

SEQ ID NO: 679736 - DNA, 13 bp, D. melanogaster
ttttccgcagtgc

SEQ ID NO: 679737 - DNA, 13 bp, D. melanogaster
ttttccgcatttc

SEQ ID NO: 679738 - DNA, 13 bp, D. melanogaster
ttttccgcatttt

SEQ ID NO: 679739 - DNA, 14 bp, D. melanogaster
ttttccgcattttc

SEQ ID NO: 679740 - DNA, 13 bp, D. melanogaster
ttttccgccaccc

SEQ ID NO: 679741 - DNA, 13 bp, D. melanogaster
ttttccgcccaac

SEQ ID NO: 679742 - DNA, 14 bp, D. melanogaster
ttttccgcccactt

SEQ ID NO: 679743 - DNA, 13 bp, D. melanogaster
ttttccgcccatc

SEQ ID NO: 679744 - DNA, 13 bp, D. melanogaster
ttttccgcccgcc

SEQ ID NO: 679745 - DNA, 13 bp, D. melanogaster
ttttccgccgcct

SEQ ID NO: 679746 - DNA, 13 bp, D. melanogaster
ttttccgcctgca

SEQ ID NO: 679747 - DNA, 13 bp, D. melanogaster
ttttccgctattt

SEQ ID NO: 679748 - DNA, 13 bp, D. melanogaster
ttttccgctcgtt

SEQ ID NO: 679749 - DNA, 13 bp, D. melanogaster
ttttccgctgctt

SEQ ID NO: 679750 - DNA, 13 bp, D. melanogaster
ttttccgctggca

SEQ ID NO: 679751 - DNA, 13 bp, D. melanogaster
ttttccgctggcc

SEQ ID NO: 679752 - DNA, 13 bp, D. melanogaster
ttttccgctggct

SEQ ID NO: 679753 - DNA, 13 bp, D. melanogaster
ttttccgcttctg

SEQ ID NO: 679754 - DNA, 13 bp, D. melanogaster
ttttccgcttgca

SEQ ID NO: 679755 - DNA, 13 bp, D. melanogaster
ttttccgcttggc

SEQ ID NO: 679756 - DNA, 14 bp, D. melanogaster
ttttccgctttcca

SEQ ID NO: 679757 - DNA, 13 bp, D. melanogaster
ttttccggaattt

SEQ ID NO: 679758 - DNA, 13 bp, D. melanogaster
ttttccggacttt

SEQ ID NO: 679759 - DNA, 13 bp, D. melanogaster
ttttccggcattt

SEQ ID NO: 679760 - DNA, 13 bp, D. melanogaster
ttttccggctgct

SEQ ID NO: 679761 - DNA, 13 bp, D. melanogaster
ttttccgggaaaa

SEQ ID NO: 679762 - DNA, 13 bp, D. melanogaster
ttttccggggctg

SEQ ID NO: 679763 - DNA, 13 bp, D. melanogaster
ttttccgtaattt

SEQ ID NO: 679764 - DNA, 13 bp, D. melanogaster
ttttccgtttgcc

SEQ ID NO: 679765 - DNA, 13 bp, D. melanogaster
ttttccgttttaa

SEQ ID NO: 679766 - DNA, 13 bp, D. melanogaster
ttttcctaaaaaa

SEQ ID NO: 679767 - DNA, 13 bp, D. melanogaster
ttttcctaaaaac

SEQ ID NO: 679768 - DNA, 13 bp, D. melanogaster
ttttcctaaattc

SEQ ID NO: 679769 - DNA, 15 bp, D. melanogaster
ttttcctaaggttgt

SEQ ID NO: 679770 - DNA, 13 bp, D. melanogaster
ttttcctacaaat

SEQ ID NO: 679771 - DNA, 13 bp, D. melanogaster
ttttcctatcaat

SEQ ID NO: 679772 - DNA, 13 bp, D. melanogaster
ttttcctcaaaaa

SEQ ID NO: 679773 - DNA, 14 bp, D. melanogaster
ttttcctcaaaaaa

SEQ ID NO: 679774 - DNA, 14 bp, D. melanogaster
ttttcctcagtgca

SEQ ID NO: 679775 - DNA, 13 bp, D. melanogaster
ttttcctcattgt

SEQ ID NO: 679776 - DNA, 13 bp, D. melanogaster
ttttcctcgattt

SEQ ID NO: 679777 - DNA, 14 bp, D. melanogaster
ttttcctcgcattt

SEQ ID NO: 679778 - DNA, 13 bp, D. melanogaster
ttttcctgatctg

SEQ ID NO: 679779 - DNA, 14 bp, D. melanogaster
ttttcctgattttc

SEQ ID NO: 679780 - DNA, 13 bp, D. melanogaster
ttttcctgcaaaa

SEQ ID NO: 679781 - DNA, 13 bp, D. melanogaster
ttttcctgcaatt

SEQ ID NO: 679782 - DNA, 13 bp, D. melanogaster
ttttcctgcactt

SEQ ID NO: 679783 - DNA, 14 bp, D. melanogaster
ttttcctgccattt

SEQ ID NO: 679784 - DNA, 13 bp, D. melanogaster
ttttcctgccgta

SEQ ID NO: 679785 - DNA, 13 bp, D. melanogaster
ttttcctgcgctt

SEQ ID NO: 679786 - DNA, 13 bp, D. melanogaster
ttttcctgctgct

SEQ ID NO: 679787 - DNA, 13 bp, D. melanogaster
ttttcctggaaaa

SEQ ID NO: 679788 - DNA, 13 bp, D. melanogaster
ttttcctggaatt

SEQ ID NO: 679789 - DNA, 14 bp, D. melanogaster
ttttcctggaatta

SEQ ID NO: 679790 - DNA, 13 bp, D. melanogaster
ttttcctggcatt

SEQ ID NO: 679791 - DNA, 13 bp, D. melanogaster
ttttcctggccat

SEQ ID NO: 679792 - DNA, 13 bp, D. melanogaster
ttttcctggctgc

SEQ ID NO: 679793 - DNA, 14 bp, D. melanogaster
ttttcctggctttg

SEQ ID NO: 679794 - DNA, 13 bp, D. melanogaster
ttttcctgtgcaa

SEQ ID NO: 679795 - DNA, 13 bp, D. melanogaster
ttttcctgtgcag

SEQ ID NO: 679796 - DNA, 13 bp, D. melanogaster
ttttcctgtgcat

SEQ ID NO: 679797 - DNA, 13 bp, D. melanogaster
ttttcctgttgcc

SEQ ID NO: 679798 - DNA, 13 bp, D. melanogaster
ttttccttaatca

SEQ ID NO: 679799 - DNA, 13 bp, D. melanogaster
ttttccttgcaaa

SEQ ID NO: 679800 - DNA, 13 bp, D. melanogaster
ttttccttgcagt

SEQ ID NO: 679801 - DNA, 13 bp, D. melanogaster
ttttccttgccac

SEQ ID NO: 679802 - DNA, 13 bp, D. melanogaster
ttttccttgcgtg

SEQ ID NO: 679803 - DNA, 13 bp, D. melanogaster
ttttccttggcca

SEQ ID NO: 679804 - DNA, 13 bp, D. melanogaster
ttttccttggcct

SEQ ID NO: 679805 - DNA, 13 bp, D. melanogaster
ttttccttggctg

SEQ ID NO: 679806 - DNA, 13 bp, D. melanogaster
ttttcctttcggc

SEQ ID NO: 679807 - DNA, 13 bp, D. melanogaster
ttttcctttggat

SEQ ID NO: 679808 - DNA, 14 bp, D. melanogaster
ttttcctttggatt

SEQ ID NO: 679809 - DNA, 14 bp, D. melanogaster
ttttccttttgcca

SEQ ID NO: 679810 - DNA, 13 bp, D. melanogaster
ttttcgaaaaaat

SEQ ID NO: 679811 - DNA, 13 bp, D. melanogaster
ttttcgaaaaagt

SEQ ID NO: 679812 - DNA, 14 bp, D. melanogaster
ttttcgaaaaagtt

SEQ ID NO: 679813 - DNA, 13 bp, D. melanogaster
ttttcgaaaaatc

SEQ ID NO: 679814 - DNA, 14 bp, D. melanogaster
ttttcgaaaaatca

SEQ ID NO: 679815 - DNA, 13 bp, D. melanogaster
ttttcgaaaacta

SEQ ID NO: 679816 - DNA, 14 bp, D. melanogaster
ttttcgaaaacttt

SEQ ID NO: 679817 - DNA, 13 bp, D. melanogaster
ttttcgaaaatca

SEQ ID NO: 679818 - DNA, 13 bp, D. melanogaster
ttttcgaaaatta

SEQ ID NO: 679819 - DNA, 13 bp, D. melanogaster
ttttcgaaaattc

SEQ ID NO: 679820 - DNA, 14 bp, D. melanogaster
ttttcgaaaattca

SEQ ID NO: 679821 - DNA, 13 bp, D. melanogaster
ttttcgaaaattg

SEQ ID NO: 679822 - DNA, 13 bp, D. melanogaster
ttttcgaaacgaa

SEQ ID NO: 679823 - DNA, 13 bp, D. melanogaster
ttttcgaaacttg

SEQ ID NO: 679824 - DNA, 13 bp, D. melanogaster
ttttcgaaacttt

SEQ ID NO: 679825 - DNA, 13 bp, D. melanogaster
ttttcgaaagaaa

SEQ ID NO: 679826 - DNA, 13 bp, D. melanogaster
ttttcgaaagctt

SEQ ID NO: 679827 - DNA, 14 bp, D. melanogaster
ttttcgaaatattt

SEQ ID NO: 679828 - DNA, 13 bp, D. melanogaster
ttttcgaaatgtt

SEQ ID NO: 679829 - DNA, 13 bp, D. melanogaster
ttttcgaaattcg

SEQ ID NO: 679830 - DNA, 13 bp, D. melanogaster
ttttcgaaattta

SEQ ID NO: 679831 - DNA, 13 bp, D. melanogaster
ttttcgaaatttt

SEQ ID NO: 679832 - DNA, 14 bp, D. melanogaster
ttttcgaaattttc

SEQ ID NO: 679833 - DNA, 13 bp, D. melanogaster
ttttcgaataaat

SEQ ID NO: 679834 - DNA, 13 bp, D. melanogaster
ttttcgaatattt

SEQ ID NO: 679835 - DNA, 14 bp, D. melanogaster
ttttcgaatatttt

SEQ ID NO: 679836 - DNA, 13 bp, D. melanogaster
ttttcgaatgttt

SEQ ID NO: 679837 - DNA, 13 bp, D. melanogaster
ttttcgaattttc

SEQ ID NO: 679838 - DNA, 13 bp, D. melanogaster
ttttcgacaattt

SEQ ID NO: 679839 - DNA, 13 bp, D. melanogaster
ttttcgactatat

SEQ ID NO: 679840 - DNA, 13 bp, D. melanogaster
ttttcgacttcaa

SEQ ID NO: 679841 - DNA, 13 bp, D. melanogaster
ttttcgactttaa

SEQ ID NO: 679842 - DNA, 13 bp, D. melanogaster
ttttcgagaattt

SEQ ID NO: 679843 - DNA, 13 bp, D. melanogaster
ttttcgagcgaat

SEQ ID NO: 679844 - DNA, 13 bp, D. melanogaster
ttttcgagcgcaa

SEQ ID NO: 679845 - DNA, 13 bp, D. melanogaster
ttttcgagtattt

SEQ ID NO: 679846 - DNA, 13 bp, D. melanogaster
ttttcgagtgcaa

SEQ ID NO: 679847 - DNA, 13 bp, D. melanogaster
ttttcgagtgggt

SEQ ID NO: 679848 - DNA, 13 bp, D. melanogaster
ttttcgagttttc

SEQ ID NO: 679849 - DNA, 13 bp, D. melanogaster
ttttcgattaaaa

SEQ ID NO: 679850 - DNA, 14 bp, D. melanogaster
ttttcgattcacaa

SEQ ID NO: 679851 - DNA, 13 bp, D. melanogaster
ttttcgattcgat

SEQ ID NO: 679852 - DNA, 14 bp, D. melanogaster
ttttcgattcgatt

SEQ ID NO: 679853 - DNA, 13 bp, D. melanogaster
ttttcgattcgtt

SEQ ID NO: 679854 - DNA, 13 bp, D. melanogaster
ttttcgattgaat

SEQ ID NO: 679855 - DNA, 13 bp, D. melanogaster
ttttcgatttaaa

SEQ ID NO: 679856 - DNA, 13 bp, D. melanogaster
ttttcgatttaat

SEQ ID NO: 679857 - DNA, 13 bp, D. melanogaster
ttttcgatttcaa

SEQ ID NO: 679858 - DNA, 14 bp, D. melanogaster
ttttcgatttcgaa

SEQ ID NO: 679859 - DNA, 13 bp, D. melanogaster
ttttcgattttca

SEQ ID NO: 679860 - DNA, 13 bp, D. melanogaster
ttttcgattttcc

SEQ ID NO: 679861 - DNA, 14 bp, D. melanogaster
ttttcgattttcca

SEQ ID NO: 679862 - DNA, 13 bp, D. melanogaster
ttttcgattttcg

SEQ ID NO: 679863 - DNA, 14 bp, D. melanogaster
ttttcgatttttcc

SEQ ID NO: 679864 - DNA, 14 bp, D. melanogaster
ttttcgcaaaaaat

SEQ ID NO: 679865 - DNA, 13 bp, D. melanogaster
ttttcgcaaaaat

SEQ ID NO: 679866 - DNA, 13 bp, D. melanogaster
ttttcgcaaaact

SEQ ID NO: 679867 - DNA, 13 bp, D. melanogaster
ttttcgcaaaata

SEQ ID NO: 679868 - DNA, 13 bp, D. melanogaster
ttttcgcaaagaa

SEQ ID NO: 679869 - DNA, 13 bp, D. melanogaster
ttttcgcaaattt

SEQ ID NO: 679870 - DNA, 13 bp, D. melanogaster
ttttcgcaacatt

SEQ ID NO: 679871 - DNA, 13 bp, D. melanogaster
ttttcgcaattgt

SEQ ID NO: 679872 - DNA, 13 bp, D. melanogaster
ttttcgcaatttg

SEQ ID NO: 679873 - DNA, 13 bp, D. melanogaster
ttttcgcacactt

SEQ ID NO: 679874 - DNA, 13 bp, D. melanogaster
ttttcgcacattt

SEQ ID NO: 679875 - DNA, 13 bp, D. melanogaster
ttttcgcagtgca

SEQ ID NO: 679876 - DNA, 14 bp, D. melanogaster
ttttcgcagtgcac

SEQ ID NO: 679877 - DNA, 13 bp, D. melanogaster
ttttcgcataaaa

SEQ ID NO: 679878 - DNA, 14 bp, D. melanogaster
ttttcgcataaatt

SEQ ID NO: 679879 - DNA, 13 bp, D. melanogaster
ttttcgcataaca

SEQ ID NO: 679880 - DNA, 13 bp, D. melanogaster
ttttcgcatattt

SEQ ID NO: 679881 - DNA, 13 bp, D. melanogaster
ttttcgcatgcaa

SEQ ID NO: 679882 - DNA, 13 bp, D. melanogaster
ttttcgcatgggg

SEQ ID NO: 679883 - DNA, 13 bp, D. melanogaster
ttttcgcattatt

SEQ ID NO: 679884 - DNA, 13 bp, D. melanogaster
ttttcgcattcaa

SEQ ID NO: 679885 - DNA, 13 bp, D. melanogaster
ttttcgcattcgc

SEQ ID NO: 679886 - DNA, 13 bp, D. melanogaster
ttttcgcattgcc

SEQ ID NO: 679887 - DNA, 14 bp, D. melanogaster
ttttcgcatttttg

SEQ ID NO: 679888 - DNA, 13 bp, D. melanogaster
ttttcgccaagtg

SEQ ID NO: 679889 - DNA, 13 bp, D. melanogaster
ttttcgccaattt

SEQ ID NO: 679890 - DNA, 13 bp, D. melanogaster
ttttcgccacttt

SEQ ID NO: 679891 - DNA, 13 bp, D. melanogaster
ttttcgccagcaa

SEQ ID NO: 679892 - DNA, 13 bp, D. melanogaster
ttttcgcccattt

SEQ ID NO: 679893 - DNA, 13 bp, D. melanogaster
ttttcgccgctgc

SEQ ID NO: 679894 - DNA, 13 bp, D. melanogaster
ttttcgcctgctg

SEQ ID NO: 679895 - DNA, 13 bp, D. melanogaster
ttttcgcctggca

SEQ ID NO: 679896 - DNA, 13 bp, D. melanogaster
ttttcgctcaatt

SEQ ID NO: 679897 - DNA, 13 bp, D. melanogaster
ttttcgctcacat

SEQ ID NO: 679898 - DNA, 13 bp, D. melanogaster
ttttcgctcagtg

SEQ ID NO: 679899 - DNA, 13 bp, D. melanogaster
ttttcgctgacaa

SEQ ID NO: 679900 - DNA, 13 bp, D. melanogaster
ttttcgctgagtg

SEQ ID NO: 679901 - DNA, 13 bp, D. melanogaster
ttttcgctgcaaa

SEQ ID NO: 679902 - DNA, 13 bp, D. melanogaster
ttttcgctgcact

SEQ ID NO: 679903 - DNA, 13 bp, D. melanogaster
ttttcgctgcctt

SEQ ID NO: 679904 - DNA, 13 bp, D. melanogaster
ttttcgctgcgtt

SEQ ID NO: 679905 - DNA, 13 bp, D. melanogaster
ttttcgctgctgc

SEQ ID NO: 679906 - DNA, 13 bp, D. melanogaster
ttttcgctggaaa

SEQ ID NO: 679907 - DNA, 13 bp, D. melanogaster
ttttcgctggcag

SEQ ID NO: 679908 - DNA, 13 bp, D. melanogaster
ttttcgctggcca

SEQ ID NO: 679909 - DNA, 13 bp, D. melanogaster
ttttcgctggctt

SEQ ID NO: 679910 - DNA, 13 bp, D. melanogaster
ttttcgcttagtg

SEQ ID NO: 679911 - DNA, 13 bp, D. melanogaster
ttttcgcttgcca

SEQ ID NO: 679912 - DNA, 13 bp, D. melanogaster
ttttcgcttggcc

SEQ ID NO: 679913 - DNA, 13 bp, D. melanogaster
ttttcgctttgat

SEQ ID NO: 679914 - DNA, 13 bp, D. melanogaster
ttttcgctttgca

SEQ ID NO: 679915 - DNA, 13 bp, D. melanogaster
ttttcgcttttca

SEQ ID NO: 679916 - DNA, 13 bp, D. melanogaster
ttttcggacaacc

SEQ ID NO: 679917 - DNA, 13 bp, D. melanogaster
ttttcggacattt

SEQ ID NO: 679918 - DNA, 13 bp, D. melanogaster
ttttcggagaatt

SEQ ID NO: 679919 - DNA, 13 bp, D. melanogaster
ttttcggattttc

SEQ ID NO: 679920 - DNA, 13 bp, D. melanogaster
ttttcggcatttc

SEQ ID NO: 679921 - DNA, 13 bp, D. melanogaster
ttttcggcatttt

SEQ ID NO: 679922 - DNA, 13 bp, D. melanogaster
ttttcggccaaaa

SEQ ID NO: 679923 - DNA, 13 bp, D. melanogaster
ttttcggccaact

SEQ ID NO: 679924 - DNA, 13 bp, D. melanogaster
ttttcggccaatt

SEQ ID NO: 679925 - DNA, 13 bp, D. melanogaster
ttttcggccagca

SEQ ID NO: 679926 - DNA, 13 bp, D. melanogaster
ttttcggctatgt

SEQ ID NO: 679927 - DNA, 13 bp, D. melanogaster
ttttcggctattt

SEQ ID NO: 679928 - DNA, 13 bp, D. melanogaster
ttttcggctcttc

SEQ ID NO: 679929 - DNA, 13 bp, D. melanogaster
ttttcggctgcca

SEQ ID NO: 679930 - DNA, 13 bp, D. melanogaster
ttttcggctgcct

SEQ ID NO: 679931 - DNA, 13 bp, D. melanogaster
ttttcggcttggg

SEQ ID NO: 679932 - DNA, 13 bp, D. melanogaster
ttttcgggcaaat

SEQ ID NO: 679933 - DNA, 14 bp, D. melanogaster
ttttcgggctgaga

SEQ ID NO: 679934 - DNA, 13 bp, D. melanogaster
ttttcgggggcaa

SEQ ID NO: 679935 - DNA, 15 bp, D. melanogaster
ttttcgggttgaaaa

SEQ ID NO: 679936 - DNA, 13 bp, D. melanogaster
ttttcggtattat

SEQ ID NO: 679937 - DNA, 13 bp, D. melanogaster
ttttcggtgtaaa

SEQ ID NO: 679938 - DNA, 13 bp, D. melanogaster
ttttcggttcgct

SEQ ID NO: 679939 - DNA, 13 bp, D. melanogaster
ttttcggttgatt

SEQ ID NO: 679940 - DNA, 13 bp, D. melanogaster
ttttcggttgcca

SEQ ID NO: 679941 - DNA, 13 bp, D. melanogaster
ttttcggttggct

SEQ ID NO: 679942 - DNA, 13 bp, D. melanogaster
ttttcggtttggc

SEQ ID NO: 679943 - DNA, 13 bp, D. melanogaster
ttttcgtacaaat

SEQ ID NO: 679944 - DNA, 13 bp, D. melanogaster
ttttcgtacattt

SEQ ID NO: 679945 - DNA, 14 bp, D. melanogaster
ttttcgtacatttt

SEQ ID NO: 679946 - DNA, 13 bp, D. melanogaster
ttttcgtataaat

SEQ ID NO: 679947 - DNA, 14 bp, D. melanogaster
ttttcgtatcactt

SEQ ID NO: 679948 - DNA, 13 bp, D. melanogaster
ttttcgtatgtgt

SEQ ID NO: 679949 - DNA, 14 bp, D. melanogaster
ttttcgtatgtgtt

SEQ ID NO: 679950 - DNA, 13 bp, D. melanogaster
ttttcgtatttaa

SEQ ID NO: 679951 - DNA, 13 bp, D. melanogaster
ttttcgtcacttt

SEQ ID NO: 679952 - DNA, 13 bp, D. melanogaster
ttttcgtcctggc

SEQ ID NO: 679953 - DNA, 13 bp, D. melanogaster
ttttcgtgaattt

SEQ ID NO: 679954 - DNA, 13 bp, D. melanogaster
ttttcgtgcaatt

SEQ ID NO: 679955 - DNA, 13 bp, D. melanogaster
ttttcgttaaaaa

SEQ ID NO: 679956 - DNA, 13 bp, D. melanogaster
ttttcgttcccga

SEQ ID NO: 679957 - DNA, 13 bp, D. melanogaster
ttttcgttgaaaa

SEQ ID NO: 679958 - DNA, 13 bp, D. melanogaster
ttttcgttgcata

SEQ ID NO: 679959 - DNA, 13 bp, D. melanogaster
ttttcgttgccat

SEQ ID NO: 679960 - DNA, 13 bp, D. melanogaster
ttttcgttgctgc

SEQ ID NO: 679961 - DNA, 13 bp, D. melanogaster
ttttcgttggcat

SEQ ID NO: 679962 - DNA, 13 bp, D. melanogaster
ttttcgttggcca

SEQ ID NO: 679963 - DNA, 13 bp, D. melanogaster
ttttcgttgtgca

SEQ ID NO: 679964 - DNA, 13 bp, D. melanogaster
ttttcgtttcact

SEQ ID NO: 679965 - DNA, 13 bp, D. melanogaster
ttttcgtttcggc

SEQ ID NO: 679966 - DNA, 13 bp, D. melanogaster
ttttcgtttgcat

SEQ ID NO: 679967 - DNA, 13 bp, D. melanogaster
ttttcgtttggaa

SEQ ID NO: 679968 - DNA, 14 bp, D. melanogaster
ttttcgttttcaat

SEQ ID NO: 679969 - DNA, 13 bp, D. melanogaster
ttttcgttttcca

SEQ ID NO: 679970 - DNA, 13 bp, D. melanogaster
ttttctaaaaaac

SEQ ID NO: 679971 - DNA, 13 bp, D. melanogaster
ttttctaaaacaa

SEQ ID NO: 679972 - DNA, 13 bp, D. melanogaster
ttttctaaaacta

SEQ ID NO: 679973 - DNA, 13 bp, D. melanogaster
ttttctaaaagtt

SEQ ID NO: 679974 - DNA, 13 bp, D. melanogaster
ttttctaaaatac

SEQ ID NO: 679975 - DNA, 13 bp, D. melanogaster
ttttctaaagtat

SEQ ID NO: 679976 - DNA, 13 bp, D. melanogaster
ttttctaaagttt

SEQ ID NO: 679977 - DNA, 13 bp, D. melanogaster
ttttctaacgatt

SEQ ID NO: 679978 - DNA, 13 bp, D. melanogaster
ttttctaacttaa

SEQ ID NO: 679979 - DNA, 13 bp, D. melanogaster
ttttctaagaaat

SEQ ID NO: 679980 - DNA, 13 bp, D. melanogaster
ttttctaagaact

SEQ ID NO: 679981 - DNA, 13 bp, D. melanogaster
ttttctaagtgca

SEQ ID NO: 679982 - DNA, 13 bp, D. melanogaster
ttttctaatgaaa

SEQ ID NO: 679983 - DNA, 13 bp, D. melanogaster
ttttctaattgaa

SEQ ID NO: 679984 - DNA, 13 bp, D. melanogaster
ttttctaattgca

SEQ ID NO: 679985 - DNA, 13 bp, D. melanogaster
ttttctacaaaat

SEQ ID NO: 679986 - DNA, 13 bp, D. melanogaster
ttttctaccaaat

SEQ ID NO: 679987 - DNA, 13 bp, D. melanogaster
ttttctacgtgta

SEQ ID NO: 679988 - DNA, 13 bp, D. melanogaster
ttttctagcattt

SEQ ID NO: 679989 - DNA, 13 bp, D. melanogaster
ttttctagtttaa

SEQ ID NO: 679990 - DNA, 13 bp, D. melanogaster
ttttctagtttca

SEQ ID NO: 679991 - DNA, 13 bp, D. melanogaster
ttttctatatgca

SEQ ID NO: 679992 - DNA, 13 bp, D. melanogaster
ttttctatgcaaa

SEQ ID NO: 679993 - DNA, 13 bp, D. melanogaster
ttttctatggaaa

SEQ ID NO: 679994 - DNA, 13 bp, D. melanogaster
ttttctatggctt

SEQ ID NO: 679995 - DNA, 13 bp, D. melanogaster
ttttctatgtaaa

SEQ ID NO: 679996 - DNA, 13 bp, D. melanogaster
ttttctatgtgca

SEQ ID NO: 679997 - DNA, 13 bp, D. melanogaster
ttttctatttgaa

SEQ ID NO: 679998 - DNA, 13 bp, D. melanogaster
ttttctcaaaaat

SEQ ID NO: 679999 - DNA, 13 bp, D. melanogaster
ttttctcaacctc

SEQ ID NO: 680000 - DNA, 13 bp, D. melanogaster
ttttctcacagtg

SEQ ID NO: 680001 - DNA, 14 bp, D. melanogaster
ttttctcacagtgc

SEQ ID NO: 680002 - DNA, 13 bp, D. melanogaster
ttttctcacccac

SEQ ID NO: 680003 - DNA, 13 bp, D. melanogaster
ttttctcactgtg

SEQ ID NO: 680004 - DNA, 13 bp, D. melanogaster
ttttctcagcttt

SEQ ID NO: 680005 - DNA, 13 bp, D. melanogaster
ttttctcagtgcc

SEQ ID NO: 680006 - DNA, 13 bp, D. melanogaster
ttttctcagtgct

SEQ ID NO: 680007 - DNA, 13 bp, D. melanogaster
ttttctcccagtg

SEQ ID NO: 680008 - DNA, 14 bp, D. melanogaster
ttttctcccagtgt

SEQ ID NO: 680009 - DNA, 13 bp, D. melanogaster
ttttctccgagtg

SEQ ID NO: 680010 - DNA, 13 bp, D. melanogaster
ttttctccgtgca

SEQ ID NO: 680011 - DNA, 13 bp, D. melanogaster
ttttctcctgcga

SEQ ID NO: 680012 - DNA, 13 bp, D. melanogaster
ttttctcgaaagc

SEQ ID NO: 680013 - DNA, 13 bp, D. melanogaster
ttttctcgcagtg

SEQ ID NO: 680014 - DNA, 13 bp, D. melanogaster
ttttctcgccgtg

SEQ ID NO: 680015 - DNA, 13 bp, D. melanogaster
ttttctcgctgtg

SEQ ID NO: 680016 - DNA, 14 bp, D. melanogaster
ttttctcgctgtgc

SEQ ID NO: 680017 - DNA, 14 bp, D. melanogaster
ttttctcgctgtgt

SEQ ID NO: 680018 - DNA, 13 bp, D. melanogaster
ttttctctaagtg

SEQ ID NO: 680019 - DNA, 13 bp, D. melanogaster
ttttctctcagtg

SEQ ID NO: 680020 - DNA, 14 bp, D. melanogaster
ttttctctcagtgc

SEQ ID NO: 680021 - DNA, 14 bp, D. melanogaster
ttttctctcagtgt

SEQ ID NO: 680022 - DNA, 13 bp, D. melanogaster
ttttctctccgtg

SEQ ID NO: 680023 - DNA, 13 bp, D. melanogaster
ttttctctggcaa

SEQ ID NO: 680024 - DNA, 13 bp, D. melanogaster
ttttctctgtgca

SEQ ID NO: 680025 - DNA, 13 bp, D. melanogaster
ttttctctgtgta

SEQ ID NO: 680026 - DNA, 14 bp, D. melanogaster
ttttctctgtgtaa

SEQ ID NO: 680027 - DNA, 13 bp, D. melanogaster
ttttctcttgcaa

SEQ ID NO: 680028 - DNA, 13 bp, D. melanogaster
ttttctgaaaatt

SEQ ID NO: 680029 - DNA, 13 bp, D. melanogaster
ttttctgaaattt

SEQ ID NO: 680030 - DNA, 14 bp, D. melanogaster
ttttctgaaatttt

SEQ ID NO: 680031 - DNA, 13 bp, D. melanogaster
ttttctgaataat

SEQ ID NO: 680032 - DNA, 13 bp, D. melanogaster
ttttctgactttc

SEQ ID NO: 680033 - DNA, 13 bp, D. melanogaster
ttttctgagtgta

SEQ ID NO: 680034 - DNA, 13 bp, D. melanogaster
ttttctgatcaac

SEQ ID NO: 680035 - DNA, 13 bp, D. melanogaster
ttttctgattaaa

SEQ ID NO: 680036 - DNA, 13 bp, D. melanogaster
ttttctgcaaaaa

SEQ ID NO: 680037 - DNA, 13 bp, D. melanogaster
ttttctgcaaatt

SEQ ID NO: 680038 - DNA, 13 bp, D. melanogaster
ttttctgcaagtg

SEQ ID NO: 680039 - DNA, 14 bp, D. melanogaster
ttttctgcaatttt

SEQ ID NO: 680040 - DNA, 13 bp, D. melanogaster
ttttctgcagcga

SEQ ID NO: 680041 - DNA, 13 bp, D. melanogaster
ttttctgcagtaa

SEQ ID NO: 680042 - DNA, 13 bp, D. melanogaster
ttttctgcagttt

SEQ ID NO: 680043 - DNA, 13 bp, D. melanogaster
ttttctgccaatt

SEQ ID NO: 680044 - DNA, 13 bp, D. melanogaster
ttttctgccattt

SEQ ID NO: 680045 - DNA, 13 bp, D. melanogaster
ttttctgccgctg

SEQ ID NO: 680046 - DNA, 13 bp, D. melanogaster
ttttctgcggctg

SEQ ID NO: 680047 - DNA, 13 bp, D. melanogaster
ttttctgctcact

SEQ ID NO: 680048 - DNA, 13 bp, D. melanogaster
ttttctgctctgc

SEQ ID NO: 680049 - DNA, 13 bp, D. melanogaster
ttttctgctgccg

SEQ ID NO: 680050 - DNA, 13 bp, D. melanogaster
ttttctgctgctg

SEQ ID NO: 680051 - DNA, 14 bp, D. melanogaster
ttttctgctgctgc

SEQ ID NO: 680052 - DNA, 13 bp, D. melanogaster
ttttctgcttaaa

SEQ ID NO: 680053 - DNA, 14 bp, D. melanogaster
ttttctggaatatc

SEQ ID NO: 680054 - DNA, 13 bp, D. melanogaster
ttttctggataat

SEQ ID NO: 680055 - DNA, 13 bp, D. melanogaster
ttttctggcagtg

SEQ ID NO: 680056 - DNA, 13 bp, D. melanogaster
ttttctggcatat

SEQ ID NO: 680057 - DNA, 13 bp, D. melanogaster
ttttctggccaaa

SEQ ID NO: 680058 - DNA, 14 bp, D. melanogaster
ttttctggccaaaa

SEQ ID NO: 680059 - DNA, 13 bp, D. melanogaster
ttttctggccaag

SEQ ID NO: 680060 - DNA, 13 bp, D. melanogaster
ttttctggtatat

SEQ ID NO: 680061 - DNA, 13 bp, D. melanogaster
ttttctgtaaata

SEQ ID NO: 680062 - DNA, 13 bp, D. melanogaster
ttttctgtgcaca

SEQ ID NO: 680063 - DNA, 13 bp, D. melanogaster
ttttctgtgcatt

SEQ ID NO: 680064 - DNA, 13 bp, D. melanogaster
ttttctgtgtaca

SEQ ID NO: 680065 - DNA, 13 bp, D. melanogaster
ttttctgtgtgta

SEQ ID NO: 680066 - DNA, 13 bp, D. melanogaster
ttttcttaaagaa

SEQ ID NO: 680067 - DNA, 13 bp, D. melanogaster
ttttcttaagcaa

SEQ ID NO: 680068 - DNA, 14 bp, D. melanogaster
ttttcttacaaaaa

SEQ ID NO: 680069 - DNA, 13 bp, D. melanogaster
ttttcttacagtg

SEQ ID NO: 680070 - DNA, 13 bp, D. melanogaster
ttttcttagccat

SEQ ID NO: 680071 - DNA, 13 bp, D. melanogaster
ttttcttattgaa

SEQ ID NO: 680072 - DNA, 13 bp, D. melanogaster
ttttcttcaaaat

SEQ ID NO: 680073 - DNA, 13 bp, D. melanogaster
ttttcttcaagtt

SEQ ID NO: 680074 - DNA, 13 bp, D. melanogaster
ttttcttcagctt

SEQ ID NO: 680075 - DNA, 13 bp, D. melanogaster
ttttcttcagtgt

SEQ ID NO: 680076 - DNA, 13 bp, D. melanogaster
ttttcttccaaaa

SEQ ID NO: 680077 - DNA, 13 bp, D. melanogaster
ttttcttgaaaac

SEQ ID NO: 680078 - DNA, 13 bp, D. melanogaster
ttttcttgaaatt

SEQ ID NO: 680079 - DNA, 13 bp, D. melanogaster
ttttcttgacttg

SEQ ID NO: 680080 - DNA, 13 bp, D. melanogaster
ttttcttgccatt

SEQ ID NO: 680081 - DNA, 13 bp, D. melanogaster
ttttcttgctgcc

SEQ ID NO: 680082 - DNA, 13 bp, D. melanogaster
ttttcttggccaa

SEQ ID NO: 680083 - DNA, 13 bp, D. melanogaster
ttttcttggccat

SEQ ID NO: 680084 - DNA, 13 bp, D. melanogaster
ttttcttggcctg

SEQ ID NO: 680085 - DNA, 13 bp, D. melanogaster
ttttcttggctgc

SEQ ID NO: 680086 - DNA, 14 bp, D. melanogaster
ttttctttaaacaa

SEQ ID NO: 680087 - DNA, 13 bp, D. melanogaster
ttttctttaaaga

SEQ ID NO: 680088 - DNA, 13 bp, D. melanogaster
ttttctttaagaa

SEQ ID NO: 680089 - DNA, 13 bp, D. melanogaster
ttttctttaagtg

SEQ ID NO: 680090 - DNA, 13 bp, D. melanogaster
ttttctttagaaa

SEQ ID NO: 680091 - DNA, 13 bp, D. melanogaster
ttttctttatggc

SEQ ID NO: 680092 - DNA, 13 bp, D. melanogaster
ttttctttcaagt

SEQ ID NO: 680093 - DNA, 13 bp, D. melanogaster
ttttctttcacaa

SEQ ID NO: 680094 - DNA, 13 bp, D. melanogaster
ttttctttcagtg

SEQ ID NO: 680095 - DNA, 14 bp, D. melanogaster
ttttctttcagtgt

SEQ ID NO: 680096 - DNA, 14 bp, D. melanogaster
ttttctttcggtgc

SEQ ID NO: 680097 - DNA, 13 bp, D. melanogaster
ttttctttgaaga

SEQ ID NO: 680098 - DNA, 13 bp, D. melanogaster
ttttctttgaata

SEQ ID NO: 680099 - DNA, 13 bp, D. melanogaster
ttttctttgccac

SEQ ID NO: 680100 - DNA, 13 bp, D. melanogaster
ttttctttgggac

SEQ ID NO: 680101 - DNA, 13 bp, D. melanogaster
ttttcttttcgaa

SEQ ID NO: 680102 - DNA, 13 bp, D. melanogaster
ttttcttttgcaa

SEQ ID NO: 680103 - DNA, 13 bp, D. melanogaster
ttttgaaaaaaga

SEQ ID NO: 680104 - DNA, 13 bp, D. melanogaster
ttttgaaaaaagt

SEQ ID NO: 680105 - DNA, 14 bp, D. melanogaster
ttttgaaaaaagtt

SEQ ID NO: 680106 - DNA, 13 bp, D. melanogaster
ttttgaaaaacaa

SEQ ID NO: 680107 - DNA, 13 bp, D. melanogaster
ttttgaaaaacac

SEQ ID NO: 680108 - DNA, 13 bp, D. melanogaster
ttttgaaaaacat

SEQ ID NO: 680109 - DNA, 13 bp, D. melanogaster
ttttgaaaaacta

SEQ ID NO: 680110 - DNA, 13 bp, D. melanogaster
ttttgaaaaactt

SEQ ID NO: 680111 - DNA, 13 bp, D. melanogaster
ttttgaaaaagaa

SEQ ID NO: 680112 - DNA, 13 bp, D. melanogaster
ttttgaaaaatgt

SEQ ID NO: 680113 - DNA, 13 bp, D. melanogaster
ttttgaaaaattc

SEQ ID NO: 680114 - DNA, 13 bp, D. melanogaster
ttttgaaaaattg

SEQ ID NO: 680115 - DNA, 13 bp, D. melanogaster
ttttgaaaacatt

SEQ ID NO: 680116 - DNA, 14 bp, D. melanogaster
ttttgaaaacgaaa

SEQ ID NO: 680117 - DNA, 13 bp, D. melanogaster
ttttgaaaactca

SEQ ID NO: 680118 - DNA, 13 bp, D. melanogaster
ttttgaaaacttt

SEQ ID NO: 680119 - DNA, 13 bp, D. melanogaster
ttttgaaaaggtt

SEQ ID NO: 680120 - DNA, 13 bp, D. melanogaster
ttttgaaaagtgt

SEQ ID NO: 680121 - DNA, 13 bp, D. melanogaster
ttttgaaaagttt

SEQ ID NO: 680122 - DNA, 13 bp, D. melanogaster
ttttgaaaatact

SEQ ID NO: 680123 - DNA, 13 bp, D. melanogaster
ttttgaaaatcaa

SEQ ID NO: 680124 - DNA, 13 bp, D. melanogaster
ttttgaaaatcat

SEQ ID NO: 680125 - DNA, 13 bp, D. melanogaster
ttttgaaaatgtt

SEQ ID NO: 680126 - DNA, 13 bp, D. melanogaster
ttttgaaaattcg

SEQ ID NO: 680127 - DNA, 13 bp, D. melanogaster
ttttgaaaattgt

SEQ ID NO: 680128 - DNA, 13 bp, D. melanogaster
ttttgaaaatttc

SEQ ID NO: 680129 - DNA, 13 bp, D. melanogaster
ttttgaaaatttg

SEQ ID NO: 680130 - DNA, 13 bp, D. melanogaster
ttttgaaacaaaa

SEQ ID NO: 680131 - DNA, 14 bp, D. melanogaster
ttttgaaacacttt

SEQ ID NO: 680132 - DNA, 13 bp, D. melanogaster
ttttgaaaccaat

SEQ ID NO: 680133 - DNA, 13 bp, D. melanogaster
ttttgaaacgttt

SEQ ID NO: 680134 - DNA, 13 bp, D. melanogaster
ttttgaaacttaa

SEQ ID NO: 680135 - DNA, 13 bp, D. melanogaster
ttttgaaacttat

SEQ ID NO: 680136 - DNA, 13 bp, D. melanogaster
ttttgaaagattt

SEQ ID NO: 680137 - DNA, 13 bp, D. melanogaster
ttttgaaagcaaa

SEQ ID NO: 680138 - DNA, 13 bp, D. melanogaster
ttttgaaagctta

SEQ ID NO: 680139 - DNA, 13 bp, D. melanogaster
ttttgaaagcttt

SEQ ID NO: 680140 - DNA, 13 bp, D. melanogaster
ttttgaaaggaaa

SEQ ID NO: 680141 - DNA, 13 bp, D. melanogaster
ttttgaaagtgaa

SEQ ID NO: 680142 - DNA, 14 bp, D. melanogaster
ttttgaaataagcc

SEQ ID NO: 680143 - DNA, 14 bp, D. melanogaster
ttttgaaatacttt

SEQ ID NO: 680144 - DNA, 13 bp, D. melanogaster
ttttgaaatatct

SEQ ID NO: 680145 - DNA, 14 bp, D. melanogaster
ttttgaaatatttc

SEQ ID NO: 680146 - DNA, 13 bp, D. melanogaster
ttttgaaatcgaa

SEQ ID NO: 680147 - DNA, 13 bp, D. melanogaster
ttttgaaatcttt

SEQ ID NO: 680148 - DNA, 14 bp, D. melanogaster
ttttgaaatgaaaa

SEQ ID NO: 680149 - DNA, 14 bp, D. melanogaster
ttttgaaatgcaaa

SEQ ID NO: 680150 - DNA, 14 bp, D. melanogaster
ttttgaaatggaaa

SEQ ID NO: 680151 - DNA, 14 bp, D. melanogaster
ttttgaaattcttt

SEQ ID NO: 680152 - DNA, 13 bp, D. melanogaster
ttttgaaattgaa

SEQ ID NO: 680153 - DNA, 13 bp, D. melanogaster
ttttgaaattgat

SEQ ID NO: 680154 - DNA, 13 bp, D. melanogaster
ttttgaaatttga

SEQ ID NO: 680155 - DNA, 14 bp, D. melanogaster
ttttgaaatttgaa

SEQ ID NO: 680156 - DNA, 14 bp, D. melanogaster
ttttgaaattttca

SEQ ID NO: 680157 - DNA, 13 bp, D. melanogaster
ttttgaacaagtt

SEQ ID NO: 680158 - DNA, 13 bp, D. melanogaster
ttttgaacaatat

SEQ ID NO: 680159 - DNA, 14 bp, D. melanogaster
ttttgaacaatttt

SEQ ID NO: 680160 - DNA, 13 bp, D. melanogaster
ttttgaacattta

SEQ ID NO: 680161 - DNA, 13 bp, D. melanogaster
ttttgaactattt

SEQ ID NO: 680162 - DNA, 13 bp, D. melanogaster
ttttgaacttcaa

SEQ ID NO: 680163 - DNA, 13 bp, D. melanogaster
ttttgaagaaaaa

SEQ ID NO: 680164 - DNA, 13 bp, D. melanogaster
ttttgaagaaaac

SEQ ID NO: 680165 - DNA, 13 bp, D. melanogaster
ttttgaagataca

SEQ ID NO: 680166 - DNA, 13 bp, D. melanogaster
ttttgaagcactt

SEQ ID NO: 680167 - DNA, 13 bp, D. melanogaster
ttttgaagctcat

SEQ ID NO: 680168 - DNA, 14 bp, D. melanogaster
ttttgaagttattc

SEQ ID NO: 680169 - DNA, 13 bp, D. melanogaster
ttttgaagttcat

SEQ ID NO: 680170 - DNA, 15 bp, D. melanogaster
ttttgaataaaaagt

SEQ ID NO: 680171 - DNA, 13 bp, D. melanogaster
ttttgaatacaca

SEQ ID NO: 680172 - DNA, 13 bp, D. melanogaster
ttttgaatattca

SEQ ID NO: 680173 - DNA, 13 bp, D. melanogaster
ttttgaatcaaaa

SEQ ID NO: 680174 - DNA, 13 bp, D. melanogaster
ttttgaatgaaaa

SEQ ID NO: 680175 - DNA, 13 bp, D. melanogaster
ttttgaatgaatt

SEQ ID NO: 680176 - DNA, 14 bp, D. melanogaster
ttttgaatgcaaat

SEQ ID NO: 680177 - DNA, 13 bp, D. melanogaster
ttttgaatgcaat

SEQ ID NO: 680178 - DNA, 13 bp, D. melanogaster
ttttgaatgcatt

SEQ ID NO: 680179 - DNA, 13 bp, D. melanogaster
ttttgaatgctct

SEQ ID NO: 680180 - DNA, 13 bp, D. melanogaster
ttttgaatggatt

SEQ ID NO: 680181 - DNA, 13 bp, D. melanogaster
ttttgaatgggaa

SEQ ID NO: 680182 - DNA, 13 bp, D. melanogaster
ttttgaatgtcct

SEQ ID NO: 680183 - DNA, 14 bp, D. melanogaster
ttttgaattcattt

SEQ ID NO: 680184 - DNA, 13 bp, D. melanogaster
ttttgaattctaa

SEQ ID NO: 680185 - DNA, 13 bp, D. melanogaster
ttttgaattgctt

SEQ ID NO: 680186 - DNA, 13 bp, D. melanogaster
ttttgaattgtaa

SEQ ID NO: 680187 - DNA, 13 bp, D. melanogaster
ttttgacaaaatt

SEQ ID NO: 680188 - DNA, 13 bp, D. melanogaster
ttttgacaacaaa

SEQ ID NO: 680189 - DNA, 13 bp, D. melanogaster
ttttgacaataat

SEQ ID NO: 680190 - DNA, 14 bp, D. melanogaster
ttttgacaataatt

SEQ ID NO: 680191 - DNA, 13 bp, D. melanogaster
ttttgacaatttt

SEQ ID NO: 680192 - DNA, 13 bp, D. melanogaster
ttttgacacaacc

SEQ ID NO: 680193 - DNA, 13 bp, D. melanogaster
ttttgacacttgc

SEQ ID NO: 680194 - DNA, 13 bp, D. melanogaster
ttttgacactttt

SEQ ID NO: 680195 - DNA, 13 bp, D. melanogaster
ttttgacagctgc

SEQ ID NO: 680196 - DNA, 13 bp, D. melanogaster
ttttgacagctgt

SEQ ID NO: 680197 - DNA, 14 bp, D. melanogaster
ttttgacattatta

SEQ ID NO: 680198 - DNA, 13 bp, D. melanogaster
ttttgacatttgc

SEQ ID NO: 680199 - DNA, 13 bp, D. melanogaster
ttttgaccaaaac

SEQ ID NO: 680200 - DNA, 13 bp, D. melanogaster
ttttgaccaagtt

SEQ ID NO: 680201 - DNA, 13 bp, D. melanogaster
ttttgaccaattt

SEQ ID NO: 680202 - DNA, 13 bp, D. melanogaster
ttttgaccacaaa

SEQ ID NO: 680203 - DNA, 13 bp, D. melanogaster
ttttgaccaccaa

SEQ ID NO: 680204 - DNA, 13 bp, D. melanogaster
ttttgacccactg

SEQ ID NO: 680205 - DNA, 13 bp, D. melanogaster
ttttgacccttaa

SEQ ID NO: 680206 - DNA, 13 bp, D. melanogaster
ttttgacgaactt

SEQ ID NO: 680207 - DNA, 13 bp, D. melanogaster
ttttgacttaatg

SEQ ID NO: 680208 - DNA, 13 bp, D. melanogaster
ttttgacttacga

SEQ ID NO: 680209 - DNA, 13 bp, D. melanogaster
ttttgactttaat

SEQ ID NO: 680210 - DNA, 13 bp, D. melanogaster
ttttgactttctg

SEQ ID NO: 680211 - DNA, 13 bp, D. melanogaster
ttttgactttgcc

SEQ ID NO: 680212 - DNA, 13 bp, D. melanogaster
ttttgactttgct

SEQ ID NO: 680213 - DNA, 13 bp, D. melanogaster
ttttgacttttcg

SEQ ID NO: 680214 - DNA, 13 bp, D. melanogaster
ttttgagaaattt

SEQ ID NO: 680215 - DNA, 13 bp, D. melanogaster
ttttgagaacttt

SEQ ID NO: 680216 - DNA, 15 bp, D. melanogaster
ttttgagactttatt

SEQ ID NO: 680217 - DNA, 13 bp, D. melanogaster
ttttgagatatga

SEQ ID NO: 680218 - DNA, 13 bp, D. melanogaster
ttttgagatattc

SEQ ID NO: 680219 - DNA, 13 bp, D. melanogaster
ttttgagcaaata

SEQ ID NO: 680220 - DNA, 13 bp, D. melanogaster
ttttgagcagcta

SEQ ID NO: 680221 - DNA, 13 bp, D. melanogaster
ttttgagcagctt

SEQ ID NO: 680222 - DNA, 13 bp, D. melanogaster
ttttgagctgatt

SEQ ID NO: 680223 - DNA, 13 bp, D. melanogaster
ttttgaggccaaa

SEQ ID NO: 680224 - DNA, 13 bp, D. melanogaster
ttttgagtaaaca

SEQ ID NO: 680225 - DNA, 13 bp, D. melanogaster
ttttgagtgagtt

SEQ ID NO: 680226 - DNA, 13 bp, D. melanogaster
ttttgagtgcatt

SEQ ID NO: 680227 - DNA, 14 bp, D. melanogaster
ttttgagtgcattt

SEQ ID NO: 680228 - DNA, 13 bp, D. melanogaster
ttttgagttaaaa

SEQ ID NO: 680229 - DNA, 13 bp, D. melanogaster
ttttgagttcatt

SEQ ID NO: 680230 - DNA, 13 bp, D. melanogaster
ttttgagtttgaa

SEQ ID NO: 680231 - DNA, 13 bp, D. melanogaster
ttttgagtttgct

SEQ ID NO: 680232 - DNA, 13 bp, D. melanogaster
ttttgagttttca

SEQ ID NO: 680233 - DNA, 13 bp, D. melanogaster
ttttgagttttcc

SEQ ID NO: 680234 - DNA, 13 bp, D. melanogaster
ttttgataaactc

SEQ ID NO: 680235 - DNA, 13 bp, D. melanogaster
ttttgataaatgt

SEQ ID NO: 680236 - DNA, 13 bp, D. melanogaster
ttttgataaattg

SEQ ID NO: 680237 - DNA, 13 bp, D. melanogaster
ttttgataagaaa

SEQ ID NO: 680238 - DNA, 13 bp, D. melanogaster
ttttgataattgc

SEQ ID NO: 680239 - DNA, 13 bp, D. melanogaster
ttttgatacaaat

SEQ ID NO: 680240 - DNA, 16 bp, D. melanogaster
ttttgatacaaatgct

SEQ ID NO: 680241 - DNA, 14 bp, D. melanogaster
ttttgatacatttt

SEQ ID NO: 680242 - DNA, 14 bp, D. melanogaster
ttttgatatacaaa

SEQ ID NO: 680243 - DNA, 13 bp, D. melanogaster
ttttgatatcatt

SEQ ID NO: 680244 - DNA, 14 bp, D. melanogaster
ttttgatattaaag

SEQ ID NO: 680245 - DNA, 13 bp, D. melanogaster
ttttgatatttgc

SEQ ID NO: 680246 - DNA, 13 bp, D. melanogaster
ttttgatcaaaat

SEQ ID NO: 680247 - DNA, 14 bp, D. melanogaster
ttttgatcaaaata

SEQ ID NO: 680248 - DNA, 14 bp, D. melanogaster
ttttgatcaataaa

SEQ ID NO: 680249 - DNA, 13 bp, D. melanogaster
ttttgatcaattt

SEQ ID NO: 680250 - DNA, 13 bp, D. melanogaster
ttttgatcaggat

SEQ ID NO: 680251 - DNA, 13 bp, D. melanogaster
ttttgatcataaa

SEQ ID NO: 680252 - DNA, 13 bp, D. melanogaster
ttttgatcatttg

SEQ ID NO: 680253 - DNA, 13 bp, D. melanogaster
ttttgatgaaaat

SEQ ID NO: 680254 - DNA, 13 bp, D. melanogaster
ttttgatgaaatt

SEQ ID NO: 680255 - DNA, 13 bp, D. melanogaster
ttttgatgaatca

SEQ ID NO: 680256 - DNA, 13 bp, D. melanogaster
ttttgatgatact

SEQ ID NO: 680257 - DNA, 13 bp, D. melanogaster
ttttgatgcattt

SEQ ID NO: 680258 - DNA, 13 bp, D. melanogaster
ttttgatggaaat

SEQ ID NO: 680259 - DNA, 14 bp, D. melanogaster
ttttgatggcaaaa

SEQ ID NO: 680260 - DNA, 13 bp, D. melanogaster
ttttgatggcatt

SEQ ID NO: 680261 - DNA, 13 bp, D. melanogaster
ttttgatggcttt

SEQ ID NO: 680262 - DNA, 13 bp, D. melanogaster
ttttgatggtcaa

SEQ ID NO: 680263 - DNA, 13 bp, D. melanogaster
ttttgattaaagt

SEQ ID NO: 680264 - DNA, 13 bp, D. melanogaster
ttttgattaatga

SEQ ID NO: 680265 - DNA, 13 bp, D. melanogaster
ttttgattaatgc

SEQ ID NO: 680266 - DNA, 13 bp, D. melanogaster
ttttgattcaaaa

SEQ ID NO: 680267 - DNA, 13 bp, D. melanogaster
ttttgattcactt

SEQ ID NO: 680268 - DNA, 13 bp, D. melanogaster
ttttgattcagtt

SEQ ID NO: 680269 - DNA, 13 bp, D. melanogaster
ttttgattgaaaa

SEQ ID NO: 680270 - DNA, 13 bp, D. melanogaster
ttttgattgataa

SEQ ID NO: 680271 - DNA, 13 bp, D. melanogaster
ttttgattgcatt

SEQ ID NO: 680272 - DNA, 13 bp, D. melanogaster
ttttgattgccag

SEQ ID NO: 680273 - DNA, 13 bp, D. melanogaster
ttttgattgccat

SEQ ID NO: 680274 - DNA, 13 bp, D. melanogaster
ttttgattgccgc

SEQ ID NO: 680275 - DNA, 13 bp, D. melanogaster
ttttgattgcctt

SEQ ID NO: 680276 - DNA, 13 bp, D. melanogaster
ttttgattgcttg

SEQ ID NO: 680277 - DNA, 13 bp, D. melanogaster
ttttgattggcat

SEQ ID NO: 680278 - DNA, 13 bp, D. melanogaster
ttttgattggctt

SEQ ID NO: 680279 - DNA, 13 bp, D. melanogaster
ttttgattgtgaa

SEQ ID NO: 680280 - DNA, 13 bp, D. melanogaster
ttttgatttacaa

SEQ ID NO: 680281 - DNA, 13 bp, D. melanogaster
ttttgatttatgc

SEQ ID NO: 680282 - DNA, 14 bp, D. melanogaster
ttttgatttcaatt

SEQ ID NO: 680283 - DNA, 14 bp, D. melanogaster
ttttgatttcgatt

SEQ ID NO: 680284 - DNA, 13 bp, D. melanogaster
ttttgatttcgca

SEQ ID NO: 680285 - DNA, 13 bp, D. melanogaster
ttttgatttcgct

SEQ ID NO: 680286 - DNA, 14 bp, D. melanogaster
ttttgatttgcatt

SEQ ID NO: 680287 - DNA, 13 bp, D. melanogaster
ttttgatttgcct

SEQ ID NO: 680288 - DNA, 13 bp, D. melanogaster
ttttgatttggct

SEQ ID NO: 680289 - DNA, 14 bp, D. melanogaster
ttttgatttggctg

SEQ ID NO: 680290 - DNA, 13 bp, D. melanogaster
ttttgattttcga

SEQ ID NO: 680291 - DNA, 13 bp, D. melanogaster
ttttgcaaaaata

SEQ ID NO: 680292 - DNA, 14 bp, D. melanogaster
ttttgcaaaacaaa

SEQ ID NO: 680293 - DNA, 13 bp, D. melanogaster
ttttgcaaaactt

SEQ ID NO: 680294 - DNA, 13 bp, D. melanogaster
ttttgcaaaaggg

SEQ ID NO: 680295 - DNA, 14 bp, D. melanogaster
ttttgcaaaataaa

SEQ ID NO: 680296 - DNA, 13 bp, D. melanogaster
ttttgcaaaatga

SEQ ID NO: 680297 - DNA, 13 bp, D. melanogaster
ttttgcaaacaaa

SEQ ID NO: 680298 - DNA, 13 bp, D. melanogaster
ttttgcaaagcaa

SEQ ID NO: 680299 - DNA, 14 bp, D. melanogaster
ttttgcaaataaat

SEQ ID NO: 680300 - DNA, 13 bp, D. melanogaster
ttttgcaaatata

SEQ ID NO: 680301 - DNA, 14 bp, D. melanogaster
ttttgcaaatccaa

SEQ ID NO: 680302 - DNA, 13 bp, D. melanogaster
ttttgcaaattgt

SEQ ID NO: 680303 - DNA, 13 bp, D. melanogaster
ttttgcaacaaat

SEQ ID NO: 680304 - DNA, 13 bp, D. melanogaster
ttttgcaacattt

SEQ ID NO: 680305 - DNA, 14 bp, D. melanogaster
ttttgcaacatttt

SEQ ID NO: 680306 - DNA, 13 bp, D. melanogaster
ttttgcaactaag

SEQ ID NO: 680307 - DNA, 13 bp, D. melanogaster
ttttgcaactggc

SEQ ID NO: 680308 - DNA, 13 bp, D. melanogaster
ttttgcaactgtt

SEQ ID NO: 680309 - DNA, 13 bp, D. melanogaster
ttttgcaactttc

SEQ ID NO: 680310 - DNA, 13 bp, D. melanogaster
ttttgcaactttt

SEQ ID NO: 680311 - DNA, 13 bp, D. melanogaster
ttttgcaataaaa

SEQ ID NO: 680312 - DNA, 13 bp, D. melanogaster
ttttgcaataaac

SEQ ID NO: 680313 - DNA, 14 bp, D. melanogaster
ttttgcaataaaca

SEQ ID NO: 680314 - DNA, 13 bp, D. melanogaster
ttttgcaataatt

SEQ ID NO: 680315 - DNA, 13 bp, D. melanogaster
ttttgcaatatat

SEQ ID NO: 680316 - DNA, 13 bp, D. melanogaster
ttttgcaatattc

SEQ ID NO: 680317 - DNA, 13 bp, D. melanogaster
ttttgcaatcttc

SEQ ID NO: 680318 - DNA, 13 bp, D. melanogaster
ttttgcaatgcaa

SEQ ID NO: 680319 - DNA, 13 bp, D. melanogaster
ttttgcaatgcca

SEQ ID NO: 680320 - DNA, 13 bp, D. melanogaster
ttttgcaattatt

SEQ ID NO: 680321 - DNA, 14 bp, D. melanogaster
ttttgcaattatta

SEQ ID NO: 680322 - DNA, 14 bp, D. melanogaster
ttttgcaattgcaa

SEQ ID NO: 680323 - DNA, 14 bp, D. melanogaster
ttttgcaatttaaa

SEQ ID NO: 680324 - DNA, 13 bp, D. melanogaster
ttttgcaatttga

SEQ ID NO: 680325 - DNA, 14 bp, D. melanogaster
ttttgcaatttgca

SEQ ID NO: 680326 - DNA, 13 bp, D. melanogaster
ttttgcaatttta

SEQ ID NO: 680327 - DNA, 13 bp, D. melanogaster
ttttgcaattttc

SEQ ID NO: 680328 - DNA, 13 bp, D. melanogaster
ttttgcacaaatt

SEQ ID NO: 680329 - DNA, 13 bp, D. melanogaster
ttttgcacaactt

SEQ ID NO: 680330 - DNA, 14 bp, D. melanogaster
ttttgcacacacac

SEQ ID NO: 680331 - DNA, 13 bp, D. melanogaster
ttttgcacacatt

SEQ ID NO: 680332 - DNA, 14 bp, D. melanogaster
ttttgcacactttt

SEQ ID NO: 680333 - DNA, 13 bp, D. melanogaster
ttttgcacattta

SEQ ID NO: 680334 - DNA, 13 bp, D. melanogaster
ttttgcacatttc

SEQ ID NO: 680335 - DNA, 13 bp, D. melanogaster
ttttgcacatttg

SEQ ID NO: 680336 - DNA, 13 bp, D. melanogaster
ttttgcacatttt

SEQ ID NO: 680337 - DNA, 13 bp, D. melanogaster
ttttgcacctgcc

SEQ ID NO: 680338 - DNA, 13 bp, D. melanogaster
ttttgcacgtttt

SEQ ID NO: 680339 - DNA, 13 bp, D. melanogaster
ttttgcactaatg

SEQ ID NO: 680340 - DNA, 13 bp, D. melanogaster
ttttgcactattt

SEQ ID NO: 680341 - DNA, 13 bp, D. melanogaster
ttttgcactgcaa

SEQ ID NO: 680342 - DNA, 13 bp, D. melanogaster
ttttgcacttgaa

SEQ ID NO: 680343 - DNA, 13 bp, D. melanogaster
ttttgcacttgtt

SEQ ID NO: 680344 - DNA, 13 bp, D. melanogaster
ttttgcactttaa

SEQ ID NO: 680345 - DNA, 13 bp, D. melanogaster
ttttgcactttgc

SEQ ID NO: 680346 - DNA, 13 bp, D. melanogaster
ttttgcagaattt

SEQ ID NO: 680347 - DNA, 13 bp, D. melanogaster
ttttgcagacggc

SEQ ID NO: 680348 - DNA, 13 bp, D. melanogaster
ttttgcagcagct

SEQ ID NO: 680349 - DNA, 13 bp, D. melanogaster
ttttgcagccaaa

SEQ ID NO: 680350 - DNA, 13 bp, D. melanogaster
ttttgcagccatt

SEQ ID NO: 680351 - DNA, 13 bp, D. melanogaster
ttttgcagcgttt

SEQ ID NO: 680352 - DNA, 13 bp, D. melanogaster
ttttgcagctctt

SEQ ID NO: 680353 - DNA, 13 bp, D. melanogaster
ttttgcagctgca

SEQ ID NO: 680354 - DNA, 13 bp, D. melanogaster
ttttgcagctgcc

SEQ ID NO: 680355 - DNA, 13 bp, D. melanogaster
ttttgcagctttg

SEQ ID NO: 680356 - DNA, 13 bp, D. melanogaster
ttttgcagtgcca

SEQ ID NO: 680357 - DNA, 13 bp, D. melanogaster
ttttgcagtgtac

SEQ ID NO: 680358 - DNA, 13 bp, D. melanogaster
ttttgcagtgtat

SEQ ID NO: 680359 - DNA, 13 bp, D. melanogaster
ttttgcagttaaa

SEQ ID NO: 680360 - DNA, 15 bp, D. melanogaster
ttttgcagttccatt

SEQ ID NO: 680361 - DNA, 13 bp, D. melanogaster
ttttgcagttcct

SEQ ID NO: 680362 - DNA, 14 bp, D. melanogaster
ttttgcagttcctc

SEQ ID NO: 680363 - DNA, 14 bp, D. melanogaster
ttttgcagttgggg

SEQ ID NO: 680364 - DNA, 13 bp, D. melanogaster
ttttgcagtttgc

SEQ ID NO: 680365 - DNA, 13 bp, D. melanogaster
ttttgcataaaat

SEQ ID NO: 680366 - DNA, 13 bp, D. melanogaster
ttttgcataacaa

SEQ ID NO: 680367 - DNA, 14 bp, D. melanogaster
ttttgcataattaa

SEQ ID NO: 680368 - DNA, 13 bp, D. melanogaster
ttttgcataattt

SEQ ID NO: 680369 - DNA, 14 bp, D. melanogaster
ttttgcataatttt

SEQ ID NO: 680370 - DNA, 13 bp, D. melanogaster
ttttgcatacatt

SEQ ID NO: 680371 - DNA, 13 bp, D. melanogaster
ttttgcatactct

SEQ ID NO: 680372 - DNA, 13 bp, D. melanogaster
ttttgcatagttt

SEQ ID NO: 680373 - DNA, 14 bp, D. melanogaster
ttttgcatagtttt

SEQ ID NO: 680374 - DNA, 13 bp, D. melanogaster
ttttgcatattaa

SEQ ID NO: 680375 - DNA, 13 bp, D. melanogaster
ttttgcatattga

SEQ ID NO: 680376 - DNA, 13 bp, D. melanogaster
ttttgcatattta

SEQ ID NO: 680377 - DNA, 14 bp, D. melanogaster
ttttgcatatttat

SEQ ID NO: 680378 - DNA, 13 bp, D. melanogaster
ttttgcatccttt

SEQ ID NO: 680379 - DNA, 13 bp, D. melanogaster
ttttgcattaact

SEQ ID NO: 680380 - DNA, 14 bp, D. melanogaster
ttttgcattaattt

SEQ ID NO: 680381 - DNA, 13 bp, D. melanogaster
ttttgcattcaaa

SEQ ID NO: 680382 - DNA, 13 bp, D. melanogaster
ttttgcattcatt

SEQ ID NO: 680383 - DNA, 13 bp, D. melanogaster
ttttgcattccgt

SEQ ID NO: 680384 - DNA, 13 bp, D. melanogaster
ttttgcattcggc

SEQ ID NO: 680385 - DNA, 13 bp, D. melanogaster
ttttgcattgaat

SEQ ID NO: 680386 - DNA, 13 bp, D. melanogaster
ttttgcattgcct

SEQ ID NO: 680387 - DNA, 14 bp, D. melanogaster
ttttgcattgcctt

SEQ ID NO: 680388 - DNA, 13 bp, D. melanogaster
ttttgcattggaa

SEQ ID NO: 680389 - DNA, 13 bp, D. melanogaster
ttttgcattgtga

SEQ ID NO: 680390 - DNA, 13 bp, D. melanogaster
ttttgcatttaac

SEQ ID NO: 680391 - DNA, 13 bp, D. melanogaster
ttttgcatttaca

SEQ ID NO: 680392 - DNA, 13 bp, D. melanogaster
ttttgcatttagc

SEQ ID NO: 680393 - DNA, 13 bp, D. melanogaster
ttttgcatttcaa

SEQ ID NO: 680394 - DNA, 14 bp, D. melanogaster
ttttgcatttcaaa

SEQ ID NO: 680395 - DNA, 13 bp, D. melanogaster
ttttgcatttcat

SEQ ID NO: 680396 - DNA, 13 bp, D. melanogaster
ttttgcatttgcc

SEQ ID NO: 680397 - DNA, 14 bp, D. melanogaster
ttttgcatttgctt

SEQ ID NO: 680398 - DNA, 13 bp, D. melanogaster
ttttgcattttcc

SEQ ID NO: 680399 - DNA, 14 bp, D. melanogaster
ttttgcattttctg

SEQ ID NO: 680400 - DNA, 13 bp, D. melanogaster
ttttgcattttgc

SEQ ID NO: 680401 - DNA, 14 bp, D. melanogaster
ttttgcattttgca

SEQ ID NO: 680402 - DNA, 14 bp, D. melanogaster
ttttgcatttttga

SEQ ID NO: 680403 - DNA, 13 bp, D. melanogaster
ttttgccaaaaat

SEQ ID NO: 680404 - DNA, 14 bp, D. melanogaster
ttttgccaaaaatt

SEQ ID NO: 680405 - DNA, 13 bp, D. melanogaster
ttttgccaaaagt

SEQ ID NO: 680406 - DNA, 13 bp, D. melanogaster
ttttgccaaaata

SEQ ID NO: 680407 - DNA, 14 bp, D. melanogaster
ttttgccaaaataa

SEQ ID NO: 680408 - DNA, 13 bp, D. melanogaster
ttttgccaaaatc

SEQ ID NO: 680409 - DNA, 13 bp, D. melanogaster
ttttgccaaaatg

SEQ ID NO: 680410 - DNA, 13 bp, D. melanogaster
ttttgccaaagtt

SEQ ID NO: 680411 - DNA, 14 bp, D. melanogaster
ttttgccaaataaa

SEQ ID NO: 680412 - DNA, 13 bp, D. melanogaster
ttttgccaaattc

SEQ ID NO: 680413 - DNA, 13 bp, D. melanogaster
ttttgccaacaca

SEQ ID NO: 680414 - DNA, 13 bp, D. melanogaster
ttttgccaacatg

SEQ ID NO: 680415 - DNA, 13 bp, D. melanogaster
ttttgccaacatt

SEQ ID NO: 680416 - DNA, 14 bp, D. melanogaster
ttttgccaacattt

SEQ ID NO: 680417 - DNA, 13 bp, D. melanogaster
ttttgccaagcca

SEQ ID NO: 680418 - DNA, 14 bp, D. melanogaster
ttttgccaatattt

SEQ ID NO: 680419 - DNA, 13 bp, D. melanogaster
ttttgccaatttc

SEQ ID NO: 680420 - DNA, 14 bp, D. melanogaster
ttttgccaatttcc

SEQ ID NO: 680421 - DNA, 14 bp, D. melanogaster
ttttgccaattttt

SEQ ID NO: 680422 - DNA, 13 bp, D. melanogaster
ttttgccacaaat

SEQ ID NO: 680423 - DNA, 13 bp, D. melanogaster
ttttgccacagtt

SEQ ID NO: 680424 - DNA, 13 bp, D. melanogaster
ttttgccaccaaa

SEQ ID NO: 680425 - DNA, 13 bp, D. melanogaster
ttttgccaccttc

SEQ ID NO: 680426 - DNA, 13 bp, D. melanogaster
ttttgccactgcc

SEQ ID NO: 680427 - DNA, 14 bp, D. melanogaster
ttttgccactgcca

SEQ ID NO: 680428 - DNA, 13 bp, D. melanogaster
ttttgccactttc

SEQ ID NO: 680429 - DNA, 13 bp, D. melanogaster
ttttgccactttt

SEQ ID NO: 680430 - DNA, 13 bp, D. melanogaster
ttttgccagattg

SEQ ID NO: 680431 - DNA, 13 bp, D. melanogaster
ttttgccagcaaa

SEQ ID NO: 680432 - DNA, 13 bp, D. melanogaster
ttttgccagcatt

SEQ ID NO: 680433 - DNA, 13 bp, D. melanogaster
ttttgccagcgaa

SEQ ID NO: 680434 - DNA, 13 bp, D. melanogaster
ttttgccagctct

SEQ ID NO: 680435 - DNA, 13 bp, D. melanogaster
ttttgccagcttg

SEQ ID NO: 680436 - DNA, 13 bp, D. melanogaster
ttttgccagtttt

SEQ ID NO: 680437 - DNA, 13 bp, D. melanogaster
ttttgccataaaa

SEQ ID NO: 680438 - DNA, 14 bp, D. melanogaster
ttttgccatacttt

SEQ ID NO: 680439 - DNA, 13 bp, D. melanogaster
ttttgccatattt

SEQ ID NO: 680440 - DNA, 13 bp, D. melanogaster
ttttgccatcaaa

SEQ ID NO: 680441 - DNA, 13 bp, D. melanogaster
ttttgccatcctt

SEQ ID NO: 680442 - DNA, 13 bp, D. melanogaster
ttttgccattctt

SEQ ID NO: 680443 - DNA, 13 bp, D. melanogaster
ttttgccatttgt

SEQ ID NO: 680444 - DNA, 13 bp, D. melanogaster
ttttgccattttc

SEQ ID NO: 680445 - DNA, 14 bp, D. melanogaster
ttttgccattttct

SEQ ID NO: 680446 - DNA, 14 bp, D. melanogaster
ttttgccattttgc

SEQ ID NO: 680447 - DNA, 13 bp, D. melanogaster
ttttgcccaaaat

SEQ ID NO: 680448 - DNA, 14 bp, D. melanogaster
ttttgcccaaggag

SEQ ID NO: 680449 - DNA, 13 bp, D. melanogaster
ttttgcccaattt

SEQ ID NO: 680450 - DNA, 13 bp, D. melanogaster
ttttgcccagtgt

SEQ ID NO: 680451 - DNA, 13 bp, D. melanogaster
ttttgcccatttc

SEQ ID NO: 680452 - DNA, 13 bp, D. melanogaster
ttttgccccaaaa

SEQ ID NO: 680453 - DNA, 14 bp, D. melanogaster
ttttgccccactgt

SEQ ID NO: 680454 - DNA, 13 bp, D. melanogaster
ttttgccccattt

SEQ ID NO: 680455 - DNA, 13 bp, D. melanogaster
ttttgccgaattt

SEQ ID NO: 680456 - DNA, 13 bp, D. melanogaster
ttttgccgatttt

SEQ ID NO: 680457 - DNA, 13 bp, D. melanogaster
ttttgccgcgccc

SEQ ID NO: 680458 - DNA, 13 bp, D. melanogaster
ttttgccgctgct

SEQ ID NO: 680459 - DNA, 13 bp, D. melanogaster
ttttgccgctggc

SEQ ID NO: 680460 - DNA, 13 bp, D. melanogaster
ttttgccgctttg

SEQ ID NO: 680461 - DNA, 13 bp, D. melanogaster
ttttgcctaaaaa

SEQ ID NO: 680462 - DNA, 13 bp, D. melanogaster
ttttgcctcagtg

SEQ ID NO: 680463 - DNA, 13 bp, D. melanogaster
ttttgccttgcca

SEQ ID NO: 680464 - DNA, 13 bp, D. melanogaster
ttttgccttggct

SEQ ID NO: 680465 - DNA, 13 bp, D. melanogaster
ttttgcctttcaa

SEQ ID NO: 680466 - DNA, 13 bp, D. melanogaster
ttttgcctttgcc

SEQ ID NO: 680467 - DNA, 14 bp, D. melanogaster
ttttgccttttggc

SEQ ID NO: 680468 - DNA, 13 bp, D. melanogaster
ttttgcgaaaaaa

SEQ ID NO: 680469 - DNA, 13 bp, D. melanogaster
ttttgcgaaaaat

SEQ ID NO: 680470 - DNA, 13 bp, D. melanogaster
ttttgcgaaaagt

SEQ ID NO: 680471 - DNA, 13 bp, D. melanogaster
ttttgcgaagtta

SEQ ID NO: 680472 - DNA, 13 bp, D. melanogaster
ttttgcgaatatt

SEQ ID NO: 680473 - DNA, 13 bp, D. melanogaster
ttttgcgaatttt

SEQ ID NO: 680474 - DNA, 13 bp, D. melanogaster
ttttgcgactgtt

SEQ ID NO: 680475 - DNA, 13 bp, D. melanogaster
ttttgcgcatttt

SEQ ID NO: 680476 - DNA, 13 bp, D. melanogaster
ttttgcgctcggc

SEQ ID NO: 680477 - DNA, 13 bp, D. melanogaster
ttttgcggctgcc

SEQ ID NO: 680478 - DNA, 13 bp, D. melanogaster
ttttgcggctttc

SEQ ID NO: 680479 - DNA, 13 bp, D. melanogaster
ttttgcgtttgaa

SEQ ID NO: 680480 - DNA, 13 bp, D. melanogaster
ttttgcgtttgca

SEQ ID NO: 680481 - DNA, 13 bp, D. melanogaster
ttttgctaaaaaa

SEQ ID NO: 680482 - DNA, 13 bp, D. melanogaster
ttttgctaaacaa

SEQ ID NO: 680483 - DNA, 13 bp, D. melanogaster
ttttgctaaattt

SEQ ID NO: 680484 - DNA, 13 bp, D. melanogaster
ttttgctaccttt

SEQ ID NO: 680485 - DNA, 13 bp, D. melanogaster
ttttgctactata

SEQ ID NO: 680486 - DNA, 13 bp, D. melanogaster
ttttgctagcgtt

SEQ ID NO: 680487 - DNA, 13 bp, D. melanogaster
ttttgctagctat

SEQ ID NO: 680488 - DNA, 14 bp, D. melanogaster
ttttgctataacaa

SEQ ID NO: 680489 - DNA, 14 bp, D. melanogaster
ttttgctatgtctg

SEQ ID NO: 680490 - DNA, 13 bp, D. melanogaster
ttttgctatttac

SEQ ID NO: 680491 - DNA, 13 bp, D. melanogaster
ttttgctatttgc

SEQ ID NO: 680492 - DNA, 13 bp, D. melanogaster
ttttgctcaaaat

SEQ ID NO: 680493 - DNA, 13 bp, D. melanogaster
ttttgctcaaatt

SEQ ID NO: 680494 - DNA, 13 bp, D. melanogaster
ttttgctcaattt

SEQ ID NO: 680495 - DNA, 13 bp, D. melanogaster
ttttgctccttgg

SEQ ID NO: 680496 - DNA, 13 bp, D. melanogaster
ttttgctcgattt

SEQ ID NO: 680497 - DNA, 13 bp, D. melanogaster
ttttgctcggctt

SEQ ID NO: 680498 - DNA, 13 bp, D. melanogaster
ttttgctctgctg

SEQ ID NO: 680499 - DNA, 13 bp, D. melanogaster
ttttgctctgtga

SEQ ID NO: 680500 - DNA, 13 bp, D. melanogaster
ttttgctgaaatg

SEQ ID NO: 680501 - DNA, 13 bp, D. melanogaster
ttttgctgaattt

SEQ ID NO: 680502 - DNA, 13 bp, D. melanogaster
ttttgctgacttt

SEQ ID NO: 680503 - DNA, 13 bp, D. melanogaster
ttttgctgattgc

SEQ ID NO: 680504 - DNA, 13 bp, D. melanogaster
ttttgctgcaatt

SEQ ID NO: 680505 - DNA, 13 bp, D. melanogaster
ttttgctgcattt

SEQ ID NO: 680506 - DNA, 13 bp, D. melanogaster
ttttgctgccaac

SEQ ID NO: 680507 - DNA, 13 bp, D. melanogaster
ttttgctgccaca

SEQ ID NO: 680508 - DNA, 13 bp, D. melanogaster
ttttgctgccatt

SEQ ID NO: 680509 - DNA, 13 bp, D. melanogaster
ttttgctgccgcc

SEQ ID NO: 680510 - DNA, 13 bp, D. melanogaster
ttttgctgctcct

SEQ ID NO: 680511 - DNA, 13 bp, D. melanogaster
ttttgctgctgct

SEQ ID NO: 680512 - DNA, 13 bp, D. melanogaster
ttttgctgctggt

SEQ ID NO: 680513 - DNA, 13 bp, D. melanogaster
ttttgctggcaaa

SEQ ID NO: 680514 - DNA, 13 bp, D. melanogaster
ttttgctggcata

SEQ ID NO: 680515 - DNA, 13 bp, D. melanogaster
ttttgctggccaa

SEQ ID NO: 680516 - DNA, 13 bp, D. melanogaster
ttttgctggccat

SEQ ID NO: 680517 - DNA, 13 bp, D. melanogaster
ttttgctgttgac

SEQ ID NO: 680518 - DNA, 13 bp, D. melanogaster
ttttgctgttgca

SEQ ID NO: 680519 - DNA, 13 bp, D. melanogaster
ttttgcttaaaat

SEQ ID NO: 680520 - DNA, 13 bp, D. melanogaster
ttttgcttattgc

SEQ ID NO: 680521 - DNA, 14 bp, D. melanogaster
ttttgcttatttaa

SEQ ID NO: 680522 - DNA, 13 bp, D. melanogaster
ttttgcttcaatt

SEQ ID NO: 680523 - DNA, 13 bp, D. melanogaster
ttttgcttgaatt

SEQ ID NO: 680524 - DNA, 13 bp, D. melanogaster
ttttgcttgcaaa

SEQ ID NO: 680525 - DNA, 13 bp, D. melanogaster
ttttgcttgccaa

SEQ ID NO: 680526 - DNA, 13 bp, D. melanogaster
ttttgcttggcca

SEQ ID NO: 680527 - DNA, 13 bp, D. melanogaster
ttttgcttgtggc

SEQ ID NO: 680528 - DNA, 13 bp, D. melanogaster
ttttgctttcaat

SEQ ID NO: 680529 - DNA, 14 bp, D. melanogaster
ttttgctttcaatt

SEQ ID NO: 680530 - DNA, 13 bp, D. melanogaster
ttttgctttgaga

SEQ ID NO: 680531 - DNA, 13 bp, D. melanogaster
ttttgctttgatg

SEQ ID NO: 680532 - DNA, 13 bp, D. melanogaster
ttttgctttgcaa

SEQ ID NO: 680533 - DNA, 13 bp, D. melanogaster
ttttgctttgcca

SEQ ID NO: 680534 - DNA, 14 bp, D. melanogaster
ttttgcttttggcc

SEQ ID NO: 680535 - DNA, 13 bp, D. melanogaster
ttttggaaaaaaa

SEQ ID NO: 680536 - DNA, 13 bp, D. melanogaster
ttttggaaaaaag

SEQ ID NO: 680537 - DNA, 13 bp, D. melanogaster
ttttggaaaaata

SEQ ID NO: 680538 - DNA, 14 bp, D. melanogaster
ttttggaaaaataa

SEQ ID NO: 680539 - DNA, 13 bp, D. melanogaster
ttttggaaaactt

SEQ ID NO: 680540 - DNA, 13 bp, D. melanogaster
ttttggaaaagtg

SEQ ID NO: 680541 - DNA, 14 bp, D. melanogaster
ttttggaaaagttt

SEQ ID NO: 680542 - DNA, 14 bp, D. melanogaster
ttttggaaaataaa

SEQ ID NO: 680543 - DNA, 13 bp, D. melanogaster
ttttggaaaatat

SEQ ID NO: 680544 - DNA, 14 bp, D. melanogaster
ttttggaaaatata

SEQ ID NO: 680545 - DNA, 13 bp, D. melanogaster
ttttggaaaatgc

SEQ ID NO: 680546 - DNA, 13 bp, D. melanogaster
ttttggaaaatgt

SEQ ID NO: 680547 - DNA, 14 bp, D. melanogaster
ttttggaaaattaa

SEQ ID NO: 680548 - DNA, 13 bp, D. melanogaster
ttttggaaaattc

SEQ ID NO: 680549 - DNA, 13 bp, D. melanogaster
ttttggaaaattg

SEQ ID NO: 680550 - DNA, 13 bp, D. melanogaster
ttttggaaaattt

SEQ ID NO: 680551 - DNA, 13 bp, D. melanogaster
ttttggaaagttt

SEQ ID NO: 680552 - DNA, 13 bp, D. melanogaster
ttttggaaatata

SEQ ID NO: 680553 - DNA, 13 bp, D. melanogaster
ttttggaaattgt

SEQ ID NO: 680554 - DNA, 13 bp, D. melanogaster
ttttggaaattta

SEQ ID NO: 680555 - DNA, 13 bp, D. melanogaster
ttttggaagagtt

SEQ ID NO: 680556 - DNA, 13 bp, D. melanogaster
ttttggaatgggt

SEQ ID NO: 680557 - DNA, 13 bp, D. melanogaster
ttttggaatttcc

SEQ ID NO: 680558 - DNA, 13 bp, D. melanogaster
ttttggacaattt

SEQ ID NO: 680559 - DNA, 13 bp, D. melanogaster
ttttggacacagt

SEQ ID NO: 680560 - DNA, 14 bp, D. melanogaster
ttttggaccacttt

SEQ ID NO: 680561 - DNA, 13 bp, D. melanogaster
ttttggactgcga

SEQ ID NO: 680562 - DNA, 13 bp, D. melanogaster
ttttggagattgt

SEQ ID NO: 680563 - DNA, 13 bp, D. melanogaster
ttttggagctgcc

SEQ ID NO: 680564 - DNA, 13 bp, D. melanogaster
ttttggataagtc

SEQ ID NO: 680565 - DNA, 13 bp, D. melanogaster
ttttggatatata

SEQ ID NO: 680566 - DNA, 13 bp, D. melanogaster
ttttggatggaaa

SEQ ID NO: 680567 - DNA, 13 bp, D. melanogaster
ttttggatttggc

SEQ ID NO: 680568 - DNA, 13 bp, D. melanogaster
ttttggattttca

SEQ ID NO: 680569 - DNA, 13 bp, D. melanogaster
ttttggcaaaaga

SEQ ID NO: 680570 - DNA, 13 bp, D. melanogaster
ttttggcaaaatc

SEQ ID NO: 680571 - DNA, 13 bp, D. melanogaster
ttttggcaaaatg

SEQ ID NO: 680572 - DNA, 13 bp, D. melanogaster
ttttggcaaaatt

SEQ ID NO: 680573 - DNA, 14 bp, D. melanogaster
ttttggcaaacaaa

SEQ ID NO: 680574 - DNA, 13 bp, D. melanogaster
ttttggcaaacat

SEQ ID NO: 680575 - DNA, 13 bp, D. melanogaster
ttttggcaaacga

SEQ ID NO: 680576 - DNA, 13 bp, D. melanogaster
ttttggcaaactt

SEQ ID NO: 680577 - DNA, 14 bp, D. melanogaster
ttttggcaaacttt

SEQ ID NO: 680578 - DNA, 14 bp, D. melanogaster
ttttggcaaataaa

SEQ ID NO: 680579 - DNA, 14 bp, D. melanogaster
ttttggcaaatcga

SEQ ID NO: 680580 - DNA, 13 bp, D. melanogaster
ttttggcaaatgt

SEQ ID NO: 680581 - DNA, 13 bp, D. melanogaster
ttttggcaaattt

SEQ ID NO: 680582 - DNA, 14 bp, D. melanogaster
ttttggcaacaaaa

SEQ ID NO: 680583 - DNA, 13 bp, D. melanogaster
ttttggcaacagc

SEQ ID NO: 680584 - DNA, 13 bp, D. melanogaster
ttttggcaacatt

SEQ ID NO: 680585 - DNA, 13 bp, D. melanogaster
ttttggcaactga

SEQ ID NO: 680586 - DNA, 13 bp, D. melanogaster
ttttggcaagcca

SEQ ID NO: 680587 - DNA, 13 bp, D. melanogaster
ttttggcaataat

SEQ ID NO: 680588 - DNA, 13 bp, D. melanogaster
ttttggcaattaa

SEQ ID NO: 680589 - DNA, 13 bp, D. melanogaster
ttttggcaattat

SEQ ID NO: 680590 - DNA, 13 bp, D. melanogaster
ttttggcaatttt

SEQ ID NO: 680591 - DNA, 14 bp, D. melanogaster
ttttggcaattttg

SEQ ID NO: 680592 - DNA, 13 bp, D. melanogaster
ttttggcacaaaa

SEQ ID NO: 680593 - DNA, 13 bp, D. melanogaster
ttttggcacaaat

SEQ ID NO: 680594 - DNA, 13 bp, D. melanogaster
ttttggcacgttt

SEQ ID NO: 680595 - DNA, 13 bp, D. melanogaster
ttttggcacttgc

SEQ ID NO: 680596 - DNA, 13 bp, D. melanogaster
ttttggcactttg

SEQ ID NO: 680597 - DNA, 13 bp, D. melanogaster
ttttggcactttt

SEQ ID NO: 680598 - DNA, 13 bp, D. melanogaster
ttttggcagccaa

SEQ ID NO: 680599 - DNA, 13 bp, D. melanogaster
ttttggcagctgc

SEQ ID NO: 680600 - DNA, 13 bp, D. melanogaster
ttttggcagcttt

SEQ ID NO: 680601 - DNA, 13 bp, D. melanogaster
ttttggcagtttt

SEQ ID NO: 680602 - DNA, 13 bp, D. melanogaster
ttttggcataaaa

SEQ ID NO: 680603 - DNA, 13 bp, D. melanogaster
ttttggcatatac

SEQ ID NO: 680604 - DNA, 13 bp, D. melanogaster
ttttggcatattt

SEQ ID NO: 680605 - DNA, 13 bp, D. melanogaster
ttttggcatcaat

SEQ ID NO: 680606 - DNA, 13 bp, D. melanogaster
ttttggcatgtgc

SEQ ID NO: 680607 - DNA, 13 bp, D. melanogaster
ttttggcattaaa

SEQ ID NO: 680608 - DNA, 13 bp, D. melanogaster
ttttggcattgaa

SEQ ID NO: 680609 - DNA, 13 bp, D. melanogaster
ttttggcattgcc

SEQ ID NO: 680610 - DNA, 13 bp, D. melanogaster
ttttggcattggc

SEQ ID NO: 680611 - DNA, 13 bp, D. melanogaster
ttttggcattgtg

SEQ ID NO: 680612 - DNA, 14 bp, D. melanogaster
ttttggcattgttt

SEQ ID NO: 680613 - DNA, 14 bp, D. melanogaster
ttttggcatttaaa

SEQ ID NO: 680614 - DNA, 14 bp, D. melanogaster
ttttggcatttatg

SEQ ID NO: 680615 - DNA, 13 bp, D. melanogaster
ttttggcatttca

SEQ ID NO: 680616 - DNA, 14 bp, D. melanogaster
ttttggcatttggc

SEQ ID NO: 680617 - DNA, 13 bp, D. melanogaster
ttttggcatttta

SEQ ID NO: 680618 - DNA, 13 bp, D. melanogaster
ttttggcattttc

SEQ ID NO: 680619 - DNA, 14 bp, D. melanogaster
ttttggcattttca

SEQ ID NO: 680620 - DNA, 14 bp, D. melanogaster
ttttggcatttttc

SEQ ID NO: 680621 - DNA, 13 bp, D. melanogaster
ttttggccaaaaa

SEQ ID NO: 680622 - DNA, 14 bp, D. melanogaster
ttttggccaaaaaa

SEQ ID NO: 680623 - DNA, 14 bp, D. melanogaster
ttttggccaaaaag

SEQ ID NO: 680624 - DNA, 14 bp, D. melanogaster
ttttggccaaaaat

SEQ ID NO: 680625 - DNA, 13 bp, D. melanogaster
ttttggccaaaac

SEQ ID NO: 680626 - DNA, 13 bp, D. melanogaster
ttttggccaaaag

SEQ ID NO: 680627 - DNA, 14 bp, D. melanogaster
ttttggccaaaagt

SEQ ID NO: 680628 - DNA, 13 bp, D. melanogaster
ttttggccaaaat

SEQ ID NO: 680629 - DNA, 14 bp, D. melanogaster
ttttggccaaaata

SEQ ID NO: 680630 - DNA, 13 bp, D. melanogaster
ttttggccaaaca

SEQ ID NO: 680631 - DNA, 13 bp, D. melanogaster
ttttggccaaagc

SEQ ID NO: 680632 - DNA, 13 bp, D. melanogaster
ttttggccaaatt

SEQ ID NO: 680633 - DNA, 14 bp, D. melanogaster
ttttggccaaattt

SEQ ID NO: 680634 - DNA, 13 bp, D. melanogaster
ttttggccaacaa

SEQ ID NO: 680635 - DNA, 14 bp, D. melanogaster
ttttggccaacaaa

SEQ ID NO: 680636 - DNA, 13 bp, D. melanogaster
ttttggccaacac

SEQ ID NO: 680637 - DNA, 14 bp, D. melanogaster
ttttggccaacagc

SEQ ID NO: 680638 - DNA, 13 bp, D. melanogaster
ttttggccaacgt

SEQ ID NO: 680639 - DNA, 13 bp, D. melanogaster
ttttggccaactg

SEQ ID NO: 680640 - DNA, 14 bp, D. melanogaster
ttttggccaactgc

SEQ ID NO: 680641 - DNA, 13 bp, D. melanogaster
ttttggccaactt

SEQ ID NO: 680642 - DNA, 14 bp, D. melanogaster
ttttggccaacttc

SEQ ID NO: 680643 - DNA, 14 bp, D. melanogaster
ttttggccaacttt

SEQ ID NO: 680644 - DNA, 13 bp, D. melanogaster
ttttggccaagaa

SEQ ID NO: 680645 - DNA, 14 bp, D. melanogaster
ttttggccaagagc

SEQ ID NO: 680646 - DNA, 13 bp, D. melanogaster
ttttggccaagat

SEQ ID NO: 680647 - DNA, 13 bp, D. melanogaster
ttttggccaagct

SEQ ID NO: 680648 - DNA, 13 bp, D. melanogaster
ttttggccaagtc

SEQ ID NO: 680649 - DNA, 13 bp, D. melanogaster
ttttggccaagtg

SEQ ID NO: 680650 - DNA, 14 bp, D. melanogaster
ttttggccaagtgc

SEQ ID NO: 680651 - DNA, 13 bp, D. melanogaster
ttttggccaagtt

SEQ ID NO: 680652 - DNA, 14 bp, D. melanogaster
ttttggccaagtta

SEQ ID NO: 680653 - DNA, 14 bp, D. melanogaster
ttttggccaagttg

SEQ ID NO: 680654 - DNA, 14 bp, D. melanogaster
ttttggccaagttt

SEQ ID NO: 680655 - DNA, 13 bp, D. melanogaster
ttttggccaatgt

SEQ ID NO: 680656 - DNA, 13 bp, D. melanogaster
ttttggccaattc

SEQ ID NO: 680657 - DNA, 13 bp, D. melanogaster
ttttggccaattt

SEQ ID NO: 680658 - DNA, 14 bp, D. melanogaster
ttttggccaatttt

SEQ ID NO: 680659 - DNA, 13 bp, D. melanogaster
ttttggccacaaa

SEQ ID NO: 680660 - DNA, 14 bp, D. melanogaster
ttttggccacaaaa

SEQ ID NO: 680661 - DNA, 13 bp, D. melanogaster
ttttggccacaac

SEQ ID NO: 680662 - DNA, 13 bp, D. melanogaster
ttttggccacaat

SEQ ID NO: 680663 - DNA, 13 bp, D. melanogaster
ttttggccacatt

SEQ ID NO: 680664 - DNA, 13 bp, D. melanogaster
ttttggccaccaa

SEQ ID NO: 680665 - DNA, 13 bp, D. melanogaster
ttttggccaccat

SEQ ID NO: 680666 - DNA, 13 bp, D. melanogaster
ttttggccacgat

SEQ ID NO: 680667 - DNA, 13 bp, D. melanogaster
ttttggccacgcc

SEQ ID NO: 680668 - DNA, 13 bp, D. melanogaster
ttttggccacgtt

SEQ ID NO: 680669 - DNA, 13 bp, D. melanogaster
ttttggccactga

SEQ ID NO: 680670 - DNA, 13 bp, D. melanogaster
ttttggccactgc

SEQ ID NO: 680671 - DNA, 13 bp, D. melanogaster
ttttggccacttc

SEQ ID NO: 680672 - DNA, 13 bp, D. melanogaster
ttttggccacttg

SEQ ID NO: 680673 - DNA, 13 bp, D. melanogaster
ttttggccacttt

SEQ ID NO: 680674 - DNA, 13 bp, D. melanogaster
ttttggccagaaa

SEQ ID NO: 680675 - DNA, 14 bp, D. melanogaster
ttttggccagaaaa

SEQ ID NO: 680676 - DNA, 14 bp, D. melanogaster
ttttggccagaaac

SEQ ID NO: 680677 - DNA, 13 bp, D. melanogaster
ttttggccagagc

SEQ ID NO: 680678 - DNA, 13 bp, D. melanogaster
ttttggccagagt

SEQ ID NO: 680679 - DNA, 14 bp, D. melanogaster
ttttggccagagtt

SEQ ID NO: 680680 - DNA, 13 bp, D. melanogaster
ttttggccagatt

SEQ ID NO: 680681 - DNA, 14 bp, D. melanogaster
ttttggccagcaaa

SEQ ID NO: 680682 - DNA, 13 bp, D. melanogaster
ttttggccagcac

SEQ ID NO: 680683 - DNA, 14 bp, D. melanogaster
ttttggccagcagc

SEQ ID NO: 680684 - DNA, 13 bp, D. melanogaster
ttttggccaggaa

SEQ ID NO: 680685 - DNA, 14 bp, D. melanogaster
ttttggccaggcca

SEQ ID NO: 680686 - DNA, 13 bp, D. melanogaster
ttttggccaggtc

SEQ ID NO: 680687 - DNA, 13 bp, D. melanogaster
ttttggccaggtt

SEQ ID NO: 680688 - DNA, 13 bp, D. melanogaster
ttttggccagtgc

SEQ ID NO: 680689 - DNA, 13 bp, D. melanogaster
ttttggccagttt

SEQ ID NO: 680690 - DNA, 13 bp, D. melanogaster
ttttggccataaa

SEQ ID NO: 680691 - DNA, 13 bp, D. melanogaster
ttttggccataat

SEQ ID NO: 680692 - DNA, 14 bp, D. melanogaster
ttttggccataatt

SEQ ID NO: 680693 - DNA, 13 bp, D. melanogaster
ttttggccatatt

SEQ ID NO: 680694 - DNA, 13 bp, D. melanogaster
ttttggccatcat

SEQ ID NO: 680695 - DNA, 13 bp, D. melanogaster
ttttggccatcgc

SEQ ID NO: 680696 - DNA, 13 bp, D. melanogaster
ttttggccatcgt

SEQ ID NO: 680697 - DNA, 13 bp, D. melanogaster
ttttggccatctc

SEQ ID NO: 680698 - DNA, 13 bp, D. melanogaster
ttttggccatgaa

SEQ ID NO: 680699 - DNA, 13 bp, D. melanogaster
ttttggccatgat

SEQ ID NO: 680700 - DNA, 13 bp, D. melanogaster
ttttggccatggc

SEQ ID NO: 680701 - DNA, 13 bp, D. melanogaster
ttttggccatgtc

SEQ ID NO: 680702 - DNA, 13 bp, D. melanogaster
ttttggccatgtg

SEQ ID NO: 680703 - DNA, 14 bp, D. melanogaster
ttttggccatgttt

SEQ ID NO: 680704 - DNA, 13 bp, D. melanogaster
ttttggccattga

SEQ ID NO: 680705 - DNA, 14 bp, D. melanogaster
ttttggccatttaa

SEQ ID NO: 680706 - DNA, 13 bp, D. melanogaster
ttttggccatttt

SEQ ID NO: 680707 - DNA, 14 bp, D. melanogaster
ttttggccattttc

SEQ ID NO: 680708 - DNA, 14 bp, D. melanogaster
ttttggccattttg

SEQ ID NO: 680709 - DNA, 14 bp, D. melanogaster
ttttggccattttt

SEQ ID NO: 680710 - DNA, 13 bp, D. melanogaster
ttttggcccaaaa

SEQ ID NO: 680711 - DNA, 13 bp, D. melanogaster
ttttggcccaatt

SEQ ID NO: 680712 - DNA, 13 bp, D. melanogaster
ttttggcccactg

SEQ ID NO: 680713 - DNA, 13 bp, D. melanogaster
ttttggcccactt

SEQ ID NO: 680714 - DNA, 13 bp, D. melanogaster
ttttggcccagaa

SEQ ID NO: 680715 - DNA, 13 bp, D. melanogaster
ttttggcccagct

SEQ ID NO: 680716 - DNA, 13 bp, D. melanogaster
ttttggcccattt

SEQ ID NO: 680717 - DNA, 13 bp, D. melanogaster
ttttggccccaaa

SEQ ID NO: 680718 - DNA, 13 bp, D. melanogaster
ttttggcccgact

SEQ ID NO: 680719 - DNA, 13 bp, D. melanogaster
ttttggcccgctt

SEQ ID NO: 680720 - DNA, 13 bp, D. melanogaster
ttttggcccggcc

SEQ ID NO: 680721 - DNA, 13 bp, D. melanogaster
ttttggcccggtt

SEQ ID NO: 680722 - DNA, 13 bp, D. melanogaster
ttttggccctgtt

SEQ ID NO: 680723 - DNA, 13 bp, D. melanogaster
ttttggccgaaaa

SEQ ID NO: 680724 - DNA, 13 bp, D. melanogaster
ttttggccgcatt

SEQ ID NO: 680725 - DNA, 13 bp, D. melanogaster
ttttggccgctgc

SEQ ID NO: 680726 - DNA, 13 bp, D. melanogaster
ttttggccgcttg

SEQ ID NO: 680727 - DNA, 22 bp, D. melanogaster
ttttggccgtcaccaaaaaagt

SEQ ID NO: 680728 - DNA, 13 bp, D. melanogaster
ttttggccgtggc

SEQ ID NO: 680729 - DNA, 15 bp, D. melanogaster
ttttggccgtggctc

SEQ ID NO: 680730 - DNA, 13 bp, D. melanogaster
ttttggccgtgtt

SEQ ID NO: 680731 - DNA, 13 bp, D. melanogaster
ttttggcctaatg

SEQ ID NO: 680732 - DNA, 13 bp, D. melanogaster
ttttggcctctct

SEQ ID NO: 680733 - DNA, 13 bp, D. melanogaster
ttttggcctgcaa

SEQ ID NO: 680734 - DNA, 13 bp, D. melanogaster
ttttggcctgcag

SEQ ID NO: 680735 - DNA, 13 bp, D. melanogaster
ttttggcctgcca

SEQ ID NO: 680736 - DNA, 13 bp, D. melanogaster
ttttggcctggcc

SEQ ID NO: 680737 - DNA, 14 bp, D. melanogaster
ttttggcctggcca

SEQ ID NO: 680738 - DNA, 13 bp, D. melanogaster
ttttggcctggct

SEQ ID NO: 680739 - DNA, 14 bp, D. melanogaster
ttttggcctggctt

SEQ ID NO: 680740 - DNA, 13 bp, D. melanogaster
ttttggcctggtc

SEQ ID NO: 680741 - DNA, 13 bp, D. melanogaster
ttttggccttatt

SEQ ID NO: 680742 - DNA, 13 bp, D. melanogaster
ttttggcgaaaaa

SEQ ID NO: 680743 - DNA, 13 bp, D. melanogaster
ttttggcgccaaa

SEQ ID NO: 680744 - DNA, 14 bp, D. melanogaster
ttttggcgccaaaa

SEQ ID NO: 680745 - DNA, 13 bp, D. melanogaster
ttttggcgcccaa

SEQ ID NO: 680746 - DNA, 13 bp, D. melanogaster
ttttggcggcaac

SEQ ID NO: 680747 - DNA, 13 bp, D. melanogaster
ttttggctaaaac

SEQ ID NO: 680748 - DNA, 13 bp, D. melanogaster
ttttggctaataa

SEQ ID NO: 680749 - DNA, 13 bp, D. melanogaster
ttttggctaattt

SEQ ID NO: 680750 - DNA, 13 bp, D. melanogaster
ttttggctacttt

SEQ ID NO: 680751 - DNA, 13 bp, D. melanogaster
ttttggctataac

SEQ ID NO: 680752 - DNA, 13 bp, D. melanogaster
ttttggctatctg

SEQ ID NO: 680753 - DNA, 14 bp, D. melanogaster
ttttggctattttc

SEQ ID NO: 680754 - DNA, 13 bp, D. melanogaster
ttttggctgaaaa

SEQ ID NO: 680755 - DNA, 13 bp, D. melanogaster
ttttggctgagct

SEQ ID NO: 680756 - DNA, 13 bp, D. melanogaster
ttttggctgcatt

SEQ ID NO: 680757 - DNA, 13 bp, D. melanogaster
ttttggctgctca

SEQ ID NO: 680758 - DNA, 13 bp, D. melanogaster
ttttggctgctcg

SEQ ID NO: 680759 - DNA, 13 bp, D. melanogaster
ttttggctgctgc

SEQ ID NO: 680760 - DNA, 13 bp, D. melanogaster
ttttggctgctgg

SEQ ID NO: 680761 - DNA, 13 bp, D. melanogaster
ttttggctgttca

SEQ ID NO: 680762 - DNA, 13 bp, D. melanogaster
ttttggcttaaat

SEQ ID NO: 680763 - DNA, 13 bp, D. melanogaster
ttttggcttcaat

SEQ ID NO: 680764 - DNA, 13 bp, D. melanogaster
ttttggcttctgg

SEQ ID NO: 680765 - DNA, 13 bp, D. melanogaster
ttttggcttggca

SEQ ID NO: 680766 - DNA, 13 bp, D. melanogaster
ttttggcttggcc

SEQ ID NO: 680767 - DNA, 13 bp, D. melanogaster
ttttggcttggct

SEQ ID NO: 680768 - DNA, 14 bp, D. melanogaster
ttttggcttgttga

SEQ ID NO: 680769 - DNA, 13 bp, D. melanogaster
ttttggctttcag

SEQ ID NO: 680770 - DNA, 13 bp, D. melanogaster
ttttggctttcgc

SEQ ID NO: 680771 - DNA, 13 bp, D. melanogaster
ttttggctttgca

SEQ ID NO: 680772 - DNA, 13 bp, D. melanogaster
ttttggctttggc

SEQ ID NO: 680773 - DNA, 13 bp, D. melanogaster
ttttgggaaaact

SEQ ID NO: 680774 - DNA, 13 bp, D. melanogaster
ttttgggaaactt

SEQ ID NO: 680775 - DNA, 13 bp, D. melanogaster
ttttgggaaattt

SEQ ID NO: 680776 - DNA, 13 bp, D. melanogaster
ttttgggaacttt

SEQ ID NO: 680777 - DNA, 13 bp, D. melanogaster
ttttgggaatggg

SEQ ID NO: 680778 - DNA, 13 bp, D. melanogaster
ttttgggaatttc

SEQ ID NO: 680779 - DNA, 13 bp, D. melanogaster
ttttgggacacaa

SEQ ID NO: 680780 - DNA, 13 bp, D. melanogaster
ttttgggagaata

SEQ ID NO: 680781 - DNA, 13 bp, D. melanogaster
ttttgggatttct

SEQ ID NO: 680782 - DNA, 13 bp, D. melanogaster
ttttgggcaaaaa

SEQ ID NO: 680783 - DNA, 13 bp, D. melanogaster
ttttgggcaagtt

SEQ ID NO: 680784 - DNA, 13 bp, D. melanogaster
ttttgggcaatta

SEQ ID NO: 680785 - DNA, 13 bp, D. melanogaster
ttttgggcacttg

SEQ ID NO: 680786 - DNA, 13 bp, D. melanogaster
ttttgggcattta

SEQ ID NO: 680787 - DNA, 13 bp, D. melanogaster
ttttgggcatttt

SEQ ID NO: 680788 - DNA, 13 bp, D. melanogaster
ttttgggccaaaa

SEQ ID NO: 680789 - DNA, 13 bp, D. melanogaster
ttttgggccaaac

SEQ ID NO: 680790 - DNA, 13 bp, D. melanogaster
ttttgggccactt

SEQ ID NO: 680791 - DNA, 13 bp, D. melanogaster
ttttgggccagca

SEQ ID NO: 680792 - DNA, 13 bp, D. melanogaster
ttttgggccagga

SEQ ID NO: 680793 - DNA, 13 bp, D. melanogaster
ttttgggccataa

SEQ ID NO: 680794 - DNA, 14 bp, D. melanogaster
ttttgggccatctt

SEQ ID NO: 680795 - DNA, 13 bp, D. melanogaster
ttttgggcctcaa

SEQ ID NO: 680796 - DNA, 14 bp, D. melanogaster
ttttgggcctcaaa

SEQ ID NO: 680797 - DNA, 13 bp, D. melanogaster
ttttgggcgatgt

SEQ ID NO: 680798 - DNA, 13 bp, D. melanogaster
ttttgggcggctt

SEQ ID NO: 680799 - DNA, 14 bp, D. melanogaster
ttttgggctccgtt

SEQ ID NO: 680800 - DNA, 13 bp, D. melanogaster
ttttgggctgcct

SEQ ID NO: 680801 - DNA, 13 bp, D. melanogaster
ttttgggctggaa

SEQ ID NO: 680802 - DNA, 14 bp, D. melanogaster
ttttgggcttagct

SEQ ID NO: 680803 - DNA, 13 bp, D. melanogaster
ttttggggaattt

SEQ ID NO: 680804 - DNA, 13 bp, D. melanogaster
ttttggggcaaaa

SEQ ID NO: 680805 - DNA, 13 bp, D. melanogaster
ttttggggcaaca

SEQ ID NO: 680806 - DNA, 14 bp, D. melanogaster
ttttggggcaacag

SEQ ID NO: 680807 - DNA, 13 bp, D. melanogaster
ttttggggcaact

SEQ ID NO: 680808 - DNA, 13 bp, D. melanogaster
ttttggggcaggg

SEQ ID NO: 680809 - DNA, 13 bp, D. melanogaster
ttttggggcagtt

SEQ ID NO: 680810 - DNA, 13 bp, D. melanogaster
ttttgggggaaaa

SEQ ID NO: 680811 - DNA, 13 bp, D. melanogaster
ttttgggggaaat

SEQ ID NO: 680812 - DNA, 13 bp, D. melanogaster
ttttgggggcaag

SEQ ID NO: 680813 - DNA, 13 bp, D. melanogaster
ttttgggggcatt

SEQ ID NO: 680814 - DNA, 13 bp, D. melanogaster
ttttggggtctaa

SEQ ID NO: 680815 - DNA, 13 bp, D. melanogaster
ttttgggtaaaaa

SEQ ID NO: 680816 - DNA, 13 bp, D. melanogaster
ttttgggtaaaat

SEQ ID NO: 680817 - DNA, 13 bp, D. melanogaster
ttttgggtaaata

SEQ ID NO: 680818 - DNA, 13 bp, D. melanogaster
ttttgggtataac

SEQ ID NO: 680819 - DNA, 13 bp, D. melanogaster
ttttgggtatact

SEQ ID NO: 680820 - DNA, 13 bp, D. melanogaster
ttttgggtcattt

SEQ ID NO: 680821 - DNA, 13 bp, D. melanogaster
ttttgggtctgct

SEQ ID NO: 680822 - DNA, 13 bp, D. melanogaster
ttttgggtgaacc

SEQ ID NO: 680823 - DNA, 13 bp, D. melanogaster
ttttgggtggcaa

SEQ ID NO: 680824 - DNA, 13 bp, D. melanogaster
ttttgggttactt

SEQ ID NO: 680825 - DNA, 13 bp, D. melanogaster
ttttggtaaaaat

SEQ ID NO: 680826 - DNA, 13 bp, D. melanogaster
ttttggtaaatat

SEQ ID NO: 680827 - DNA, 13 bp, D. melanogaster
ttttggtaaatgc

SEQ ID NO: 680828 - DNA, 14 bp, D. melanogaster
ttttggtaaatgca

SEQ ID NO: 680829 - DNA, 13 bp, D. melanogaster
ttttggtaacttt

SEQ ID NO: 680830 - DNA, 13 bp, D. melanogaster
ttttggtagccac

SEQ ID NO: 680831 - DNA, 13 bp, D. melanogaster
ttttggtagcttt

SEQ ID NO: 680832 - DNA, 13 bp, D. melanogaster
ttttggtataaaa

SEQ ID NO: 680833 - DNA, 13 bp, D. melanogaster
ttttggtataaat

SEQ ID NO: 680834 - DNA, 13 bp, D. melanogaster
ttttggtcaaaaa

SEQ ID NO: 680835 - DNA, 13 bp, D. melanogaster
ttttggtcaaaat

SEQ ID NO: 680836 - DNA, 13 bp, D. melanogaster
ttttggtcaataa

SEQ ID NO: 680837 - DNA, 13 bp, D. melanogaster
ttttggtcataaa

SEQ ID NO: 680838 - DNA, 13 bp, D. melanogaster
ttttggtcgattt

SEQ ID NO: 680839 - DNA, 13 bp, D. melanogaster
ttttggtctataa

SEQ ID NO: 680840 - DNA, 13 bp, D. melanogaster
ttttggtcttgaa

SEQ ID NO: 680841 - DNA, 13 bp, D. melanogaster
ttttggtgaaaaa

SEQ ID NO: 680842 - DNA, 14 bp, D. melanogaster
ttttggtgacggcc

SEQ ID NO: 680843 - DNA, 13 bp, D. melanogaster
ttttggtgctgca

SEQ ID NO: 680844 - DNA, 13 bp, D. melanogaster
ttttggtggcaaa

SEQ ID NO: 680845 - DNA, 13 bp, D. melanogaster
ttttggtggccaa

SEQ ID NO: 680846 - DNA, 13 bp, D. melanogaster
ttttggttaaatg

SEQ ID NO: 680847 - DNA, 13 bp, D. melanogaster
ttttggttaccac

SEQ ID NO: 680848 - DNA, 13 bp, D. melanogaster
ttttggttataaa

SEQ ID NO: 680849 - DNA, 13 bp, D. melanogaster
ttttggttcccct

SEQ ID NO: 680850 - DNA, 13 bp, D. melanogaster
ttttggttgaaaa

SEQ ID NO: 680851 - DNA, 13 bp, D. melanogaster
ttttggttgcact

SEQ ID NO: 680852 - DNA, 13 bp, D. melanogaster
ttttggttgccaa

SEQ ID NO: 680853 - DNA, 13 bp, D. melanogaster
ttttggtttaaca

SEQ ID NO: 680854 - DNA, 13 bp, D. melanogaster
ttttggtttcaat

SEQ ID NO: 680855 - DNA, 13 bp, D. melanogaster
ttttggtttcgat

SEQ ID NO: 680856 - DNA, 13 bp, D. melanogaster
ttttggtttcggc

SEQ ID NO: 680857 - DNA, 13 bp, D. melanogaster
ttttggttttcga

SEQ ID NO: 680858 - DNA, 13 bp, D. melanogaster
ttttgtaaaaatg

SEQ ID NO: 680859 - DNA, 13 bp, D. melanogaster
ttttgtaaaacat

SEQ ID NO: 680860 - DNA, 13 bp, D. melanogaster
ttttgtaaaagtt

SEQ ID NO: 680861 - DNA, 13 bp, D. melanogaster
ttttgtaaacaaa

SEQ ID NO: 680862 - DNA, 13 bp, D. melanogaster
ttttgtaaacgaa

SEQ ID NO: 680863 - DNA, 13 bp, D. melanogaster
ttttgtaaactat

SEQ ID NO: 680864 - DNA, 13 bp, D. melanogaster
ttttgtaaacttt

SEQ ID NO: 680865 - DNA, 13 bp, D. melanogaster
ttttgtaaataag

SEQ ID NO: 680866 - DNA, 13 bp, D. melanogaster
ttttgtaaatact

SEQ ID NO: 680867 - DNA, 13 bp, D. melanogaster
ttttgtaaatatc

SEQ ID NO: 680868 - DNA, 14 bp, D. melanogaster
ttttgtaaatatgt

SEQ ID NO: 680869 - DNA, 13 bp, D. melanogaster
ttttgtaaatcaa

SEQ ID NO: 680870 - DNA, 13 bp, D. melanogaster
ttttgtaaatgaa

SEQ ID NO: 680871 - DNA, 13 bp, D. melanogaster
ttttgtaaatggt

SEQ ID NO: 680872 - DNA, 13 bp, D. melanogaster
ttttgtaaatgta

SEQ ID NO: 680873 - DNA, 13 bp, D. melanogaster
ttttgtaaattct

SEQ ID NO: 680874 - DNA, 13 bp, D. melanogaster
ttttgtaacttta

SEQ ID NO: 680875 - DNA, 14 bp, D. melanogaster
ttttgtaagaaact

SEQ ID NO: 680876 - DNA, 13 bp, D. melanogaster
ttttgtaagcaaa

SEQ ID NO: 680877 - DNA, 13 bp, D. melanogaster
ttttgtaataaag

SEQ ID NO: 680878 - DNA, 13 bp, D. melanogaster
ttttgtaataacc

SEQ ID NO: 680879 - DNA, 13 bp, D. melanogaster
ttttgtaatcaat

SEQ ID NO: 680880 - DNA, 13 bp, D. melanogaster
ttttgtaatgcct

SEQ ID NO: 680881 - DNA, 13 bp, D. melanogaster
ttttgtaattagc

SEQ ID NO: 680882 - DNA, 13 bp, D. melanogaster
ttttgtaattgaa

SEQ ID NO: 680883 - DNA, 13 bp, D. melanogaster
ttttgtaatttcc

SEQ ID NO: 680884 - DNA, 13 bp, D. melanogaster
ttttgtacaaaat

SEQ ID NO: 680885 - DNA, 13 bp, D. melanogaster
ttttgtacaataa

SEQ ID NO: 680886 - DNA, 13 bp, D. melanogaster
ttttgtacaattt

SEQ ID NO: 680887 - DNA, 13 bp, D. melanogaster
ttttgtacacttt

SEQ ID NO: 680888 - DNA, 13 bp, D. melanogaster
ttttgtacataaa

SEQ ID NO: 680889 - DNA, 13 bp, D. melanogaster
ttttgtacatttc

SEQ ID NO: 680890 - DNA, 13 bp, D. melanogaster
ttttgtactgcca

SEQ ID NO: 680891 - DNA, 13 bp, D. melanogaster
ttttgtactgcta

SEQ ID NO: 680892 - DNA, 13 bp, D. melanogaster
ttttgtacttaaa

SEQ ID NO: 680893 - DNA, 13 bp, D. melanogaster
ttttgtagctgct

SEQ ID NO: 680894 - DNA, 13 bp, D. melanogaster
ttttgtataaaag

SEQ ID NO: 680895 - DNA, 13 bp, D. melanogaster
ttttgtataacaa

SEQ ID NO: 680896 - DNA, 13 bp, D. melanogaster
ttttgtataagaa

SEQ ID NO: 680897 - DNA, 13 bp, D. melanogaster
ttttgtataatga

SEQ ID NO: 680898 - DNA, 13 bp, D. melanogaster
ttttgtatataca

SEQ ID NO: 680899 - DNA, 14 bp, D. melanogaster
ttttgtatatcaaa

SEQ ID NO: 680900 - DNA, 13 bp, D. melanogaster
ttttgtatatgaa

SEQ ID NO: 680901 - DNA, 13 bp, D. melanogaster
ttttgtatattgc

SEQ ID NO: 680902 - DNA, 13 bp, D. melanogaster
ttttgtatctgta

SEQ ID NO: 680903 - DNA, 14 bp, D. melanogaster
ttttgtatctgtat

SEQ ID NO: 680904 - DNA, 14 bp, D. melanogaster
ttttgtatctgtgt

SEQ ID NO: 680905 - DNA, 13 bp, D. melanogaster
ttttgtatgaatg

SEQ ID NO: 680906 - DNA, 13 bp, D. melanogaster
ttttgtatgcatt

SEQ ID NO: 680907 - DNA, 13 bp, D. melanogaster
ttttgtatgccaa

SEQ ID NO: 680908 - DNA, 13 bp, D. melanogaster
ttttgtatgcctt

SEQ ID NO: 680909 - DNA, 13 bp, D. melanogaster
ttttgtatgtgaa

SEQ ID NO: 680910 - DNA, 14 bp, D. melanogaster
ttttgtatgtgaat

SEQ ID NO: 680911 - DNA, 14 bp, D. melanogaster
ttttgtatgttatc

SEQ ID NO: 680912 - DNA, 13 bp, D. melanogaster
ttttgtattcagt

SEQ ID NO: 680913 - DNA, 13 bp, D. melanogaster
ttttgtatttgac

SEQ ID NO: 680914 - DNA, 13 bp, D. melanogaster
ttttgtcaaaaat

SEQ ID NO: 680915 - DNA, 13 bp, D. melanogaster
ttttgtcaaaatt

SEQ ID NO: 680916 - DNA, 14 bp, D. melanogaster
ttttgtcaaaattt

SEQ ID NO: 680917 - DNA, 13 bp, D. melanogaster
ttttgtcaaattt

SEQ ID NO: 680918 - DNA, 14 bp, D. melanogaster
ttttgtcaaattta

SEQ ID NO: 680919 - DNA, 13 bp, D. melanogaster
ttttgtcaacaga

SEQ ID NO: 680920 - DNA, 13 bp, D. melanogaster
ttttgtcacattt

SEQ ID NO: 680921 - DNA, 13 bp, D. melanogaster
ttttgtcagatct

SEQ ID NO: 680922 - DNA, 13 bp, D. melanogaster
ttttgtcagcagc

SEQ ID NO: 680923 - DNA, 13 bp, D. melanogaster
ttttgtcagctgc

SEQ ID NO: 680924 - DNA, 13 bp, D. melanogaster
ttttgtcattaat

SEQ ID NO: 680925 - DNA, 13 bp, D. melanogaster
ttttgtcatttaa

SEQ ID NO: 680926 - DNA, 13 bp, D. melanogaster
ttttgtccaattt

SEQ ID NO: 680927 - DNA, 13 bp, D. melanogaster
ttttgtcctggcc

SEQ ID NO: 680928 - DNA, 13 bp, D. melanogaster
ttttgtcgaaaaa

SEQ ID NO: 680929 - DNA, 13 bp, D. melanogaster
ttttgtcgcagtg

SEQ ID NO: 680930 - DNA, 13 bp, D. melanogaster
ttttgtcgcattt

SEQ ID NO: 680931 - DNA, 13 bp, D. melanogaster
ttttgtcgctgcc

SEQ ID NO: 680932 - DNA, 14 bp, D. melanogaster
ttttgtcgttttga

SEQ ID NO: 680933 - DNA, 13 bp, D. melanogaster
ttttgtctaaaat

SEQ ID NO: 680934 - DNA, 13 bp, D. melanogaster
ttttgtctataga

SEQ ID NO: 680935 - DNA, 13 bp, D. melanogaster
ttttgtctgctga

SEQ ID NO: 680936 - DNA, 13 bp, D. melanogaster
ttttgtctggctg

SEQ ID NO: 680937 - DNA, 13 bp, D. melanogaster
ttttgtgaaaatt

SEQ ID NO: 680938 - DNA, 13 bp, D. melanogaster
ttttgtgaaactg

SEQ ID NO: 680939 - DNA, 13 bp, D. melanogaster
ttttgtgaaagtt

SEQ ID NO: 680940 - DNA, 13 bp, D. melanogaster
ttttgtgaaatat

SEQ ID NO: 680941 - DNA, 13 bp, D. melanogaster
ttttgtgaaatca

SEQ ID NO: 680942 - DNA, 13 bp, D. melanogaster
ttttgtgaagaag

SEQ ID NO: 680943 - DNA, 14 bp, D. melanogaster
ttttgtgaatgaaa

SEQ ID NO: 680944 - DNA, 13 bp, D. melanogaster
ttttgtgaatttc

SEQ ID NO: 680945 - DNA, 13 bp, D. melanogaster
ttttgtgacaaat

SEQ ID NO: 680946 - DNA, 13 bp, D. melanogaster
ttttgtgactttg

SEQ ID NO: 680947 - DNA, 13 bp, D. melanogaster
ttttgtgcaaaaa

SEQ ID NO: 680948 - DNA, 13 bp, D. melanogaster
ttttgtgcaaaca

SEQ ID NO: 680949 - DNA, 13 bp, D. melanogaster
ttttgtgcaaatt

SEQ ID NO: 680950 - DNA, 13 bp, D. melanogaster
ttttgtgcaacaa

SEQ ID NO: 680951 - DNA, 13 bp, D. melanogaster
ttttgtgcaagtt

SEQ ID NO: 680952 - DNA, 13 bp, D. melanogaster
ttttgtgcaattt

SEQ ID NO: 680953 - DNA, 13 bp, D. melanogaster
ttttgtgcacaaa

SEQ ID NO: 680954 - DNA, 13 bp, D. melanogaster
ttttgtgcacatt

SEQ ID NO: 680955 - DNA, 13 bp, D. melanogaster
ttttgtgcagcta

SEQ ID NO: 680956 - DNA, 13 bp, D. melanogaster
ttttgtgccacac

SEQ ID NO: 680957 - DNA, 13 bp, D. melanogaster
ttttgtgccacat

SEQ ID NO: 680958 - DNA, 13 bp, D. melanogaster
ttttgtgccattt

SEQ ID NO: 680959 - DNA, 14 bp, D. melanogaster
ttttgtgccatttt

SEQ ID NO: 680960 - DNA, 13 bp, D. melanogaster
ttttgtgccggaa

SEQ ID NO: 680961 - DNA, 13 bp, D. melanogaster
ttttgtgcctggc

SEQ ID NO: 680962 - DNA, 13 bp, D. melanogaster
ttttgtgcgattt

SEQ ID NO: 680963 - DNA, 14 bp, D. melanogaster
ttttgtgcggagca

SEQ ID NO: 680964 - DNA, 13 bp, D. melanogaster
ttttgtgcggcag

SEQ ID NO: 680965 - DNA, 13 bp, D. melanogaster
ttttgtgctcaat

SEQ ID NO: 680966 - DNA, 13 bp, D. melanogaster
ttttgtgctgcca

SEQ ID NO: 680967 - DNA, 13 bp, D. melanogaster
ttttgtgctgcct

SEQ ID NO: 680968 - DNA, 13 bp, D. melanogaster
ttttgtgctttaa

SEQ ID NO: 680969 - DNA, 13 bp, D. melanogaster
ttttgtggaaaat

SEQ ID NO: 680970 - DNA, 13 bp, D. melanogaster
ttttgtggaaatg

SEQ ID NO: 680971 - DNA, 13 bp, D. melanogaster
ttttgtggaaatt

SEQ ID NO: 680972 - DNA, 13 bp, D. melanogaster
ttttgtggacttt

SEQ ID NO: 680973 - DNA, 13 bp, D. melanogaster
ttttgtggcaaaa

SEQ ID NO: 680974 - DNA, 13 bp, D. melanogaster
ttttgtggcaaat

SEQ ID NO: 680975 - DNA, 14 bp, D. melanogaster
ttttgtggcaaatt

SEQ ID NO: 680976 - DNA, 13 bp, D. melanogaster
ttttgtggcaact

SEQ ID NO: 680977 - DNA, 13 bp, D. melanogaster
ttttgtggcaagc

SEQ ID NO: 680978 - DNA, 13 bp, D. melanogaster
ttttgtggcaagt

SEQ ID NO: 680979 - DNA, 13 bp, D. melanogaster
ttttgtggcacgt

SEQ ID NO: 680980 - DNA, 13 bp, D. melanogaster
ttttgtggcactt

SEQ ID NO: 680981 - DNA, 13 bp, D. melanogaster
ttttgtggcattt

SEQ ID NO: 680982 - DNA, 14 bp, D. melanogaster
ttttgtggcatttt

SEQ ID NO: 680983 - DNA, 13 bp, D. melanogaster
ttttgtggccaaa

SEQ ID NO: 680984 - DNA, 13 bp, D. melanogaster
ttttgtggccaac

SEQ ID NO: 680985 - DNA, 13 bp, D. melanogaster
ttttgtggccaat

SEQ ID NO: 680986 - DNA, 13 bp, D. melanogaster
ttttgtggccaca

SEQ ID NO: 680987 - DNA, 13 bp, D. melanogaster
ttttgtggccagc

SEQ ID NO: 680988 - DNA, 13 bp, D. melanogaster
ttttgtggccagg

SEQ ID NO: 680989 - DNA, 13 bp, D. melanogaster
ttttgtggccagt

SEQ ID NO: 680990 - DNA, 13 bp, D. melanogaster
ttttgtggccatt

SEQ ID NO: 680991 - DNA, 14 bp, D. melanogaster
ttttgtggccattt

SEQ ID NO: 680992 - DNA, 14 bp, D. melanogaster
ttttgtggcccaaa

SEQ ID NO: 680993 - DNA, 13 bp, D. melanogaster
ttttgtggcccag

SEQ ID NO: 680994 - DNA, 13 bp, D. melanogaster
ttttgtggcgctt

SEQ ID NO: 680995 - DNA, 13 bp, D. melanogaster
ttttgtggctgtc

SEQ ID NO: 680996 - DNA, 13 bp, D. melanogaster
ttttgtgggaaat

SEQ ID NO: 680997 - DNA, 13 bp, D. melanogaster
ttttgtgggccaa

SEQ ID NO: 680998 - DNA, 13 bp, D. melanogaster
ttttgtgggctat

SEQ ID NO: 680999 - DNA, 13 bp, D. melanogaster
ttttgtggggaaa

SEQ ID NO: 681000 - DNA, 13 bp, D. melanogaster
ttttgtgggtcgc

SEQ ID NO: 681001 - DNA, 13 bp, D. melanogaster
ttttgtggtcaat

SEQ ID NO: 681002 - DNA, 13 bp, D. melanogaster
ttttgtgtaaaaa

SEQ ID NO: 681003 - DNA, 13 bp, D. melanogaster
ttttgtgtaaaca

SEQ ID NO: 681004 - DNA, 13 bp, D. melanogaster
ttttgtgtaaaga

SEQ ID NO: 681005 - DNA, 14 bp, D. melanogaster
ttttgtgtacattt

SEQ ID NO: 681006 - DNA, 13 bp, D. melanogaster
ttttgtgtgaata

SEQ ID NO: 681007 - DNA, 13 bp, D. melanogaster
ttttgtgtgtgca

SEQ ID NO: 681008 - DNA, 15 bp, D. melanogaster
ttttgtgttaagaaa

SEQ ID NO: 681009 - DNA, 13 bp, D. melanogaster
ttttgttaaaagt

SEQ ID NO: 681010 - DNA, 14 bp, D. melanogaster
ttttgttaaacaaa

SEQ ID NO: 681011 - DNA, 14 bp, D. melanogaster
ttttgttaaaggtt

SEQ ID NO: 681012 - DNA, 13 bp, D. melanogaster
ttttgttaaatca

SEQ ID NO: 681013 - DNA, 14 bp, D. melanogaster
ttttgttaaatttc

SEQ ID NO: 681014 - DNA, 13 bp, D. melanogaster
ttttgttaacatt

SEQ ID NO: 681015 - DNA, 13 bp, D. melanogaster
ttttgttaatgaa

SEQ ID NO: 681016 - DNA, 13 bp, D. melanogaster
ttttgttaccaac

SEQ ID NO: 681017 - DNA, 13 bp, D. melanogaster
ttttgttaccatt

SEQ ID NO: 681018 - DNA, 13 bp, D. melanogaster
ttttgttagccaa

SEQ ID NO: 681019 - DNA, 13 bp, D. melanogaster
ttttgttagctgt

SEQ ID NO: 681020 - DNA, 13 bp, D. melanogaster
ttttgttatctaa

SEQ ID NO: 681021 - DNA, 14 bp, D. melanogaster
ttttgttattcgta

SEQ ID NO: 681022 - DNA, 13 bp, D. melanogaster
ttttgttattgca

SEQ ID NO: 681023 - DNA, 13 bp, D. melanogaster
ttttgttcaaaaa

SEQ ID NO: 681024 - DNA, 13 bp, D. melanogaster
ttttgttcaaaat

SEQ ID NO: 681025 - DNA, 13 bp, D. melanogaster
ttttgttcaacaa

SEQ ID NO: 681026 - DNA, 14 bp, D. melanogaster
ttttgttcaatata

SEQ ID NO: 681027 - DNA, 13 bp, D. melanogaster
ttttgttcagtgt

SEQ ID NO: 681028 - DNA, 13 bp, D. melanogaster
ttttgttcgaaat

SEQ ID NO: 681029 - DNA, 13 bp, D. melanogaster
ttttgttcgcccc

SEQ ID NO: 681030 - DNA, 13 bp, D. melanogaster
ttttgttcgtaat

SEQ ID NO: 681031 - DNA, 14 bp, D. melanogaster
ttttgttgaaaaat

SEQ ID NO: 681032 - DNA, 13 bp, D. melanogaster
ttttgttgaaaat

SEQ ID NO: 681033 - DNA, 13 bp, D. melanogaster
ttttgttgacaat

SEQ ID NO: 681034 - DNA, 13 bp, D. melanogaster
ttttgttgcaact

SEQ ID NO: 681035 - DNA, 13 bp, D. melanogaster
ttttgttgcaata

SEQ ID NO: 681036 - DNA, 13 bp, D. melanogaster
ttttgttgcaatt

SEQ ID NO: 681037 - DNA, 13 bp, D. melanogaster
ttttgttgcactt

SEQ ID NO: 681038 - DNA, 14 bp, D. melanogaster
ttttgttgcacttt

SEQ ID NO: 681039 - DNA, 13 bp, D. melanogaster
ttttgttgcatac

SEQ ID NO: 681040 - DNA, 13 bp, D. melanogaster
ttttgttgccagc

SEQ ID NO: 681041 - DNA, 13 bp, D. melanogaster
ttttgttgccatt

SEQ ID NO: 681042 - DNA, 14 bp, D. melanogaster
ttttgttgccattt

SEQ ID NO: 681043 - DNA, 13 bp, D. melanogaster
ttttgttgcctgg

SEQ ID NO: 681044 - DNA, 13 bp, D. melanogaster
ttttgttgcgcaa

SEQ ID NO: 681045 - DNA, 14 bp, D. melanogaster
ttttgttgcggaat

SEQ ID NO: 681046 - DNA, 13 bp, D. melanogaster
ttttgttgctcgc

SEQ ID NO: 681047 - DNA, 13 bp, D. melanogaster
ttttgttgctgca

SEQ ID NO: 681048 - DNA, 14 bp, D. melanogaster
ttttgttgctgcca

SEQ ID NO: 681049 - DNA, 13 bp, D. melanogaster
ttttgttgcttaa

SEQ ID NO: 681050 - DNA, 13 bp, D. melanogaster
ttttgttggaaaa

SEQ ID NO: 681051 - DNA, 13 bp, D. melanogaster
ttttgttggccaa

SEQ ID NO: 681052 - DNA, 14 bp, D. melanogaster
ttttgttggccaac

SEQ ID NO: 681053 - DNA, 13 bp, D. melanogaster
ttttgttggccag

SEQ ID NO: 681054 - DNA, 13 bp, D. melanogaster
ttttgttggccat

SEQ ID NO: 681055 - DNA, 13 bp, D. melanogaster
ttttgttggccct

SEQ ID NO: 681056 - DNA, 13 bp, D. melanogaster
ttttgttgtactc

SEQ ID NO: 681057 - DNA, 13 bp, D. melanogaster
ttttgttgtgcaa

SEQ ID NO: 681058 - DNA, 14 bp, D. melanogaster
ttttgttgtttgca

SEQ ID NO: 681059 - DNA, 14 bp, D. melanogaster
ttttgtttacaatt

SEQ ID NO: 681060 - DNA, 13 bp, D. melanogaster
ttttgtttaccaa

SEQ ID NO: 681061 - DNA, 13 bp, D. melanogaster
ttttgtttaccca

SEQ ID NO: 681062 - DNA, 14 bp, D. melanogaster
ttttgtttacgaaa

SEQ ID NO: 681063 - DNA, 13 bp, D. melanogaster
ttttgtttactgc

SEQ ID NO: 681064 - DNA, 13 bp, D. melanogaster
ttttgtttagaaa

SEQ ID NO: 681065 - DNA, 13 bp, D. melanogaster
ttttgtttagcca

SEQ ID NO: 681066 - DNA, 13 bp, D. melanogaster
ttttgtttagctc

SEQ ID NO: 681067 - DNA, 13 bp, D. melanogaster
ttttgtttatgac

SEQ ID NO: 681068 - DNA, 13 bp, D. melanogaster
ttttgtttatgcc

SEQ ID NO: 681069 - DNA, 13 bp, D. melanogaster
ttttgtttcaagt

SEQ ID NO: 681070 - DNA, 13 bp, D. melanogaster
ttttgtttcagct

SEQ ID NO: 681071 - DNA, 13 bp, D. melanogaster
ttttgtttcagtg

SEQ ID NO: 681072 - DNA, 13 bp, D. melanogaster
ttttgtttcccat

SEQ ID NO: 681073 - DNA, 13 bp, D. melanogaster
ttttgtttcgagt

SEQ ID NO: 681074 - DNA, 13 bp, D. melanogaster
ttttgtttgaaaa

SEQ ID NO: 681075 - DNA, 13 bp, D. melanogaster
ttttgtttgccaa

SEQ ID NO: 681076 - DNA, 13 bp, D. melanogaster
ttttgtttgccac

SEQ ID NO: 681077 - DNA, 13 bp, D. melanogaster
ttttgtttgccca

SEQ ID NO: 681078 - DNA, 13 bp, D. melanogaster
ttttgtttggaaa

SEQ ID NO: 681079 - DNA, 13 bp, D. melanogaster
ttttgtttggcaa

SEQ ID NO: 681080 - DNA, 14 bp, D. melanogaster
ttttgtttggcatt

SEQ ID NO: 681081 - DNA, 14 bp, D. melanogaster
ttttgtttggccaa

SEQ ID NO: 681082 - DNA, 13 bp, D. melanogaster
ttttgtttgtcaa

SEQ ID NO: 681083 - DNA, 14 bp, D. melanogaster
ttttgtttgtcaaa

SEQ ID NO: 681084 - DNA, 13 bp, D. melanogaster
ttttgtttgtgca

SEQ ID NO: 681085 - DNA, 13 bp, D. melanogaster
ttttgttttaacc

SEQ ID NO: 681086 - DNA, 13 bp, D. melanogaster
ttttgttttacca

SEQ ID NO: 681087 - DNA, 14 bp, D. melanogaster
ttttgttttaccat

SEQ ID NO: 681088 - DNA, 13 bp, D. melanogaster
ttttgttttcagc

SEQ ID NO: 681089 - DNA, 14 bp, D. melanogaster
ttttgttttgcata

SEQ ID NO: 681090 - DNA, 13 bp, D. melanogaster
tttttaaaaacac

SEQ ID NO: 681091 - DNA, 14 bp, D. melanogaster
tttttaaaaacaca

SEQ ID NO: 681092 - DNA, 13 bp, D. melanogaster
tttttaaaaacct

SEQ ID NO: 681093 - DNA, 14 bp, D. melanogaster
tttttaaaaattcg

SEQ ID NO: 681094 - DNA, 13 bp, D. melanogaster
tttttaaaacgca

SEQ ID NO: 681095 - DNA, 13 bp, D. melanogaster
tttttaaaagcat

SEQ ID NO: 681096 - DNA, 13 bp, D. melanogaster
tttttaaaagtgt

SEQ ID NO: 681097 - DNA, 14 bp, D. melanogaster
tttttaaaagtgtg

SEQ ID NO: 681098 - DNA, 13 bp, D. melanogaster
tttttaaaatcct

SEQ ID NO: 681099 - DNA, 14 bp, D. melanogaster
tttttaaaatgcaa

SEQ ID NO: 681100 - DNA, 13 bp, D. melanogaster
tttttaaaattcg

SEQ ID NO: 681101 - DNA, 14 bp, D. melanogaster
tttttaaacaaaca

SEQ ID NO: 681102 - DNA, 13 bp, D. melanogaster
tttttaaacaaag

SEQ ID NO: 681103 - DNA, 13 bp, D. melanogaster
tttttaaacaacc

SEQ ID NO: 681104 - DNA, 14 bp, D. melanogaster
tttttaaacaacct

SEQ ID NO: 681105 - DNA, 13 bp, D. melanogaster
tttttaaacaact

SEQ ID NO: 681106 - DNA, 13 bp, D. melanogaster
tttttaaacactt

SEQ ID NO: 681107 - DNA, 13 bp, D. melanogaster
tttttaaacgaaa

SEQ ID NO: 681108 - DNA, 13 bp, D. melanogaster
tttttaaacgaat

SEQ ID NO: 681109 - DNA, 13 bp, D. melanogaster
tttttaaacgatt

SEQ ID NO: 681110 - DNA, 14 bp, D. melanogaster
tttttaaacgtttt

SEQ ID NO: 681111 - DNA, 14 bp, D. melanogaster
tttttaaactcaaa

SEQ ID NO: 681112 - DNA, 13 bp, D. melanogaster
tttttaaactgtt

SEQ ID NO: 681113 - DNA, 13 bp, D. melanogaster
tttttaaacttac

SEQ ID NO: 681114 - DNA, 13 bp, D. melanogaster
tttttaaacttca

SEQ ID NO: 681115 - DNA, 14 bp, D. melanogaster
tttttaaacttttg

SEQ ID NO: 681116 - DNA, 13 bp, D. melanogaster
tttttaaagaact

SEQ ID NO: 681117 - DNA, 13 bp, D. melanogaster
tttttaaagactt

SEQ ID NO: 681118 - DNA, 13 bp, D. melanogaster
tttttaaagcaca

SEQ ID NO: 681119 - DNA, 14 bp, D. melanogaster
tttttaaagcattt

SEQ ID NO: 681120 - DNA, 14 bp, D. melanogaster
tttttaaagccaaa

SEQ ID NO: 681121 - DNA, 13 bp, D. melanogaster
tttttaaagctat

SEQ ID NO: 681122 - DNA, 13 bp, D. melanogaster
tttttaaagctca

SEQ ID NO: 681123 - DNA, 13 bp, D. melanogaster
tttttaaagctta

SEQ ID NO: 681124 - DNA, 13 bp, D. melanogaster
tttttaaaggaat

SEQ ID NO: 681125 - DNA, 13 bp, D. melanogaster
tttttaaagggtg

SEQ ID NO: 681126 - DNA, 13 bp, D. melanogaster
tttttaaagtgtg

SEQ ID NO: 681127 - DNA, 13 bp, D. melanogaster
tttttaaagttac

SEQ ID NO: 681128 - DNA, 13 bp, D. melanogaster
tttttaaagtttc

SEQ ID NO: 681129 - DNA, 13 bp, D. melanogaster
tttttaaatccaa

SEQ ID NO: 681130 - DNA, 13 bp, D. melanogaster
tttttaaatccca

SEQ ID NO: 681131 - DNA, 13 bp, D. melanogaster
tttttaaatcgca

SEQ ID NO: 681132 - DNA, 14 bp, D. melanogaster
tttttaaatcgcaa

SEQ ID NO: 681133 - DNA, 13 bp, D. melanogaster
tttttaaatgact

SEQ ID NO: 681134 - DNA, 13 bp, D. melanogaster
tttttaaatgcaa

SEQ ID NO: 681135 - DNA, 14 bp, D. melanogaster
tttttaaatgcaat

SEQ ID NO: 681136 - DNA, 13 bp, D. melanogaster
tttttaaatgcag

SEQ ID NO: 681137 - DNA, 13 bp, D. melanogaster
tttttaaatgctt

SEQ ID NO: 681138 - DNA, 13 bp, D. melanogaster
tttttaaatgtac

SEQ ID NO: 681139 - DNA, 13 bp, D. melanogaster
tttttaaattcag

SEQ ID NO: 681140 - DNA, 13 bp, D. melanogaster
tttttaaattcca

SEQ ID NO: 681141 - DNA, 13 bp, D. melanogaster
tttttaaattgga

SEQ ID NO: 681142 - DNA, 13 bp, D. melanogaster
tttttaaatttcg

SEQ ID NO: 681143 - DNA, 13 bp, D. melanogaster
tttttaacaaact

SEQ ID NO: 681144 - DNA, 13 bp, D. melanogaster
tttttaacaatca

SEQ ID NO: 681145 - DNA, 13 bp, D. melanogaster
tttttaacaccaa

SEQ ID NO: 681146 - DNA, 14 bp, D. melanogaster
tttttaacacttaa

SEQ ID NO: 681147 - DNA, 13 bp, D. melanogaster
tttttaaccaaaa

SEQ ID NO: 681148 - DNA, 14 bp, D. melanogaster
tttttaaccaaaaa

SEQ ID NO: 681149 - DNA, 13 bp, D. melanogaster
tttttaaccaact

SEQ ID NO: 681150 - DNA, 13 bp, D. melanogaster
tttttaacccatt

SEQ ID NO: 681151 - DNA, 13 bp, D. melanogaster
tttttaacgaaaa

SEQ ID NO: 681152 - DNA, 13 bp, D. melanogaster
tttttaacgaatc

SEQ ID NO: 681153 - DNA, 13 bp, D. melanogaster
tttttaacgattt

SEQ ID NO: 681154 - DNA, 13 bp, D. melanogaster
tttttaactcaat

SEQ ID NO: 681155 - DNA, 13 bp, D. melanogaster
tttttaactgctt

SEQ ID NO: 681156 - DNA, 13 bp, D. melanogaster
tttttaactgtga

SEQ ID NO: 681157 - DNA, 13 bp, D. melanogaster
tttttaactttgc

SEQ ID NO: 681158 - DNA, 13 bp, D. melanogaster
tttttaagaaaca

SEQ ID NO: 681159 - DNA, 13 bp, D. melanogaster
tttttaagacatt

SEQ ID NO: 681160 - DNA, 13 bp, D. melanogaster
tttttaagagaaa

SEQ ID NO: 681161 - DNA, 14 bp, D. melanogaster
tttttaagcaattt

SEQ ID NO: 681162 - DNA, 13 bp, D. melanogaster
tttttaagcagtt

SEQ ID NO: 681163 - DNA, 13 bp, D. melanogaster
tttttaagcattt

SEQ ID NO: 681164 - DNA, 14 bp, D. melanogaster
tttttaagcatttc

SEQ ID NO: 681165 - DNA, 13 bp, D. melanogaster
tttttaagccaaa

SEQ ID NO: 681166 - DNA, 13 bp, D. melanogaster
tttttaagctaaa

SEQ ID NO: 681167 - DNA, 13 bp, D. melanogaster
tttttaagctatt

SEQ ID NO: 681168 - DNA, 13 bp, D. melanogaster
tttttaagctgat

SEQ ID NO: 681169 - DNA, 13 bp, D. melanogaster
tttttaagctgtt

SEQ ID NO: 681170 - DNA, 13 bp, D. melanogaster
tttttaagcttta

SEQ ID NO: 681171 - DNA, 13 bp, D. melanogaster
tttttaaggaaaa

SEQ ID NO: 681172 - DNA, 14 bp, D. melanogaster
tttttaaggaaaaa

SEQ ID NO: 681173 - DNA, 14 bp, D. melanogaster
tttttaagtgaatt

SEQ ID NO: 681174 - DNA, 13 bp, D. melanogaster
tttttaagtgtaa

SEQ ID NO: 681175 - DNA, 13 bp, D. melanogaster
tttttaagttgaa

SEQ ID NO: 681176 - DNA, 13 bp, D. melanogaster
tttttaagtttca

SEQ ID NO: 681177 - DNA, 13 bp, D. melanogaster
tttttaataacac

SEQ ID NO: 681178 - DNA, 13 bp, D. melanogaster
tttttaataagcc

SEQ ID NO: 681179 - DNA, 13 bp, D. melanogaster
tttttaataagct

SEQ ID NO: 681180 - DNA, 13 bp, D. melanogaster
tttttaatatgca

SEQ ID NO: 681181 - DNA, 13 bp, D. melanogaster
tttttaatcatgt

SEQ ID NO: 681182 - DNA, 13 bp, D. melanogaster
tttttaatcgctt

SEQ ID NO: 681183 - DNA, 13 bp, D. melanogaster
tttttaatgaact

SEQ ID NO: 681184 - DNA, 14 bp, D. melanogaster
tttttaatgcactt

SEQ ID NO: 681185 - DNA, 13 bp, D. melanogaster
tttttaatgcata

SEQ ID NO: 681186 - DNA, 14 bp, D. melanogaster
tttttaatgccaaa

SEQ ID NO: 681187 - DNA, 13 bp, D. melanogaster
tttttaatgcgct

SEQ ID NO: 681188 - DNA, 14 bp, D. melanogaster
tttttaatgctatt

SEQ ID NO: 681189 - DNA, 13 bp, D. melanogaster
tttttaatggaag

SEQ ID NO: 681190 - DNA, 14 bp, D. melanogaster
tttttaatggaagc

SEQ ID NO: 681191 - DNA, 13 bp, D. melanogaster
tttttaatggcac

SEQ ID NO: 681192 - DNA, 13 bp, D. melanogaster
tttttaatggctt

SEQ ID NO: 681193 - DNA, 13 bp, D. melanogaster
tttttaatgtcga

SEQ ID NO: 681194 - DNA, 14 bp, D. melanogaster
tttttaatgtcgag

SEQ ID NO: 681195 - DNA, 13 bp, D. melanogaster
tttttaattccgt

SEQ ID NO: 681196 - DNA, 13 bp, D. melanogaster
tttttaattgaca

SEQ ID NO: 681197 - DNA, 14 bp, D. melanogaster
tttttaattgacac

SEQ ID NO: 681198 - DNA, 13 bp, D. melanogaster
tttttaattgagc

SEQ ID NO: 681199 - DNA, 14 bp, D. melanogaster
tttttaattgcaaa

SEQ ID NO: 681200 - DNA, 13 bp, D. melanogaster
tttttaattggaa

SEQ ID NO: 681201 - DNA, 13 bp, D. melanogaster
tttttaatttagc

SEQ ID NO: 681202 - DNA, 14 bp, D. melanogaster
tttttaatttgcaa

SEQ ID NO: 681203 - DNA, 13 bp, D. melanogaster
tttttacaaagct

SEQ ID NO: 681204 - DNA, 13 bp, D. melanogaster
tttttacaagaaa

SEQ ID NO: 681205 - DNA, 13 bp, D. melanogaster
tttttacaagcaa

SEQ ID NO: 681206 - DNA, 13 bp, D. melanogaster
tttttacaagttt

SEQ ID NO: 681207 - DNA, 13 bp, D. melanogaster
tttttacaatggt

SEQ ID NO: 681208 - DNA, 13 bp, D. melanogaster
tttttacacaaaa

SEQ ID NO: 681209 - DNA, 13 bp, D. melanogaster
tttttacacacaa

SEQ ID NO: 681210 - DNA, 13 bp, D. melanogaster
tttttacagtgta

SEQ ID NO: 681211 - DNA, 13 bp, D. melanogaster
tttttacattaca

SEQ ID NO: 681212 - DNA, 13 bp, D. melanogaster
tttttaccaaaat

SEQ ID NO: 681213 - DNA, 13 bp, D. melanogaster
tttttaccaaacg

SEQ ID NO: 681214 - DNA, 13 bp, D. melanogaster
tttttaccaaatc

SEQ ID NO: 681215 - DNA, 13 bp, D. melanogaster
tttttaccaaatt

SEQ ID NO: 681216 - DNA, 13 bp, D. melanogaster
tttttacgattat

SEQ ID NO: 681217 - DNA, 13 bp, D. melanogaster
tttttacgcaaat

SEQ ID NO: 681218 - DNA, 13 bp, D. melanogaster
tttttactcacac

SEQ ID NO: 681219 - DNA, 13 bp, D. melanogaster
tttttactgtggg

SEQ ID NO: 681220 - DNA, 14 bp, D. melanogaster
tttttactgtgggg

SEQ ID NO: 681221 - DNA, 13 bp, D. melanogaster
tttttagaaatga

SEQ ID NO: 681222 - DNA, 13 bp, D. melanogaster
tttttagacaagt

SEQ ID NO: 681223 - DNA, 13 bp, D. melanogaster
tttttagaccaaa

SEQ ID NO: 681224 - DNA, 13 bp, D. melanogaster
tttttagagcaaa

SEQ ID NO: 681225 - DNA, 13 bp, D. melanogaster
tttttagatactt

SEQ ID NO: 681226 - DNA, 13 bp, D. melanogaster
tttttagcaaatc

SEQ ID NO: 681227 - DNA, 13 bp, D. melanogaster
tttttagcaattt

SEQ ID NO: 681228 - DNA, 13 bp, D. melanogaster
tttttagcacaaa

SEQ ID NO: 681229 - DNA, 13 bp, D. melanogaster
tttttagcagcac

SEQ ID NO: 681230 - DNA, 13 bp, D. melanogaster
tttttagcattca

SEQ ID NO: 681231 - DNA, 13 bp, D. melanogaster
tttttagccagca

SEQ ID NO: 681232 - DNA, 13 bp, D. melanogaster
tttttagccattt

SEQ ID NO: 681233 - DNA, 17 bp, D. melanogaster
tttttagccatttattt

SEQ ID NO: 681234 - DNA, 13 bp, D. melanogaster
tttttagctcttc

SEQ ID NO: 681235 - DNA, 13 bp, D. melanogaster
tttttagctttaa

SEQ ID NO: 681236 - DNA, 14 bp, D. melanogaster
tttttagctttaaa

SEQ ID NO: 681237 - DNA, 13 bp, D. melanogaster
tttttaggaaaaa

SEQ ID NO: 681238 - DNA, 13 bp, D. melanogaster
tttttagtacaaa

SEQ ID NO: 681239 - DNA, 13 bp, D. melanogaster
tttttagtcaagt

SEQ ID NO: 681240 - DNA, 14 bp, D. melanogaster
tttttagtcactgc

SEQ ID NO: 681241 - DNA, 13 bp, D. melanogaster
tttttagtgaaaa

SEQ ID NO: 681242 - DNA, 13 bp, D. melanogaster
tttttagtttcac

SEQ ID NO: 681243 - DNA, 13 bp, D. melanogaster
tttttataaaacc

SEQ ID NO: 681244 - DNA, 14 bp, D. melanogaster
tttttataaaacca

SEQ ID NO: 681245 - DNA, 14 bp, D. melanogaster
tttttataaaccaa

SEQ ID NO: 681246 - DNA, 13 bp, D. melanogaster
tttttataaccga

SEQ ID NO: 681247 - DNA, 13 bp, D. melanogaster
tttttataagaac

SEQ ID NO: 681248 - DNA, 14 bp, D. melanogaster
tttttatacaacaa

SEQ ID NO: 681249 - DNA, 13 bp, D. melanogaster
tttttatacacac

SEQ ID NO: 681250 - DNA, 13 bp, D. melanogaster
tttttatacacat

SEQ ID NO: 681251 - DNA, 14 bp, D. melanogaster
tttttatacccatt

SEQ ID NO: 681252 - DNA, 13 bp, D. melanogaster
tttttatacccgt

SEQ ID NO: 681253 - DNA, 13 bp, D. melanogaster
tttttatacctga

SEQ ID NO: 681254 - DNA, 13 bp, D. melanogaster
tttttatactcgt

SEQ ID NO: 681255 - DNA, 13 bp, D. melanogaster
tttttatagcttc

SEQ ID NO: 681256 - DNA, 14 bp, D. melanogaster
tttttatatagacc

SEQ ID NO: 681257 - DNA, 14 bp, D. melanogaster
tttttatatagggt

SEQ ID NO: 681258 - DNA, 13 bp, D. melanogaster
tttttatatccgt

SEQ ID NO: 681259 - DNA, 13 bp, D. melanogaster
tttttatatcgaa

SEQ ID NO: 681260 - DNA, 14 bp, D. melanogaster
tttttatatgcaaa

SEQ ID NO: 681261 - DNA, 14 bp, D. melanogaster
tttttatatgcatt

SEQ ID NO: 681262 - DNA, 13 bp, D. melanogaster
tttttatatgtac

SEQ ID NO: 681263 - DNA, 13 bp, D. melanogaster
tttttatcaaatc

SEQ ID NO: 681264 - DNA, 13 bp, D. melanogaster
tttttatcaacaa

SEQ ID NO: 681265 - DNA, 13 bp, D. melanogaster
tttttatcagtgt

SEQ ID NO: 681266 - DNA, 13 bp, D. melanogaster
tttttatcgtgct

SEQ ID NO: 681267 - DNA, 13 bp, D. melanogaster
tttttatgaaaac

SEQ ID NO: 681268 - DNA, 13 bp, D. melanogaster
tttttatgaaaca

SEQ ID NO: 681269 - DNA, 13 bp, D. melanogaster
tttttatgaaatc

SEQ ID NO: 681270 - DNA, 14 bp, D. melanogaster
tttttatgaaatct

SEQ ID NO: 681271 - DNA, 13 bp, D. melanogaster
tttttatgaactt

SEQ ID NO: 681272 - DNA, 13 bp, D. melanogaster
tttttatgacaac

SEQ ID NO: 681273 - DNA, 13 bp, D. melanogaster
tttttatgacaat

SEQ ID NO: 681274 - DNA, 13 bp, D. melanogaster
tttttatgaccca

SEQ ID NO: 681275 - DNA, 13 bp, D. melanogaster
tttttatgagctc

SEQ ID NO: 681276 - DNA, 13 bp, D. melanogaster
tttttatgagctg

SEQ ID NO: 681277 - DNA, 13 bp, D. melanogaster
tttttatgagctt

SEQ ID NO: 681278 - DNA, 13 bp, D. melanogaster
tttttatgatcat

SEQ ID NO: 681279 - DNA, 13 bp, D. melanogaster
tttttatgattgc

SEQ ID NO: 681280 - DNA, 14 bp, D. melanogaster
tttttatgcaaaaa

SEQ ID NO: 681281 - DNA, 13 bp, D. melanogaster
tttttatgcaaca

SEQ ID NO: 681282 - DNA, 13 bp, D. melanogaster
tttttatgcactt

SEQ ID NO: 681283 - DNA, 14 bp, D. melanogaster
tttttatgcacttt

SEQ ID NO: 681284 - DNA, 13 bp, D. melanogaster
tttttatgcatat

SEQ ID NO: 681285 - DNA, 14 bp, D. melanogaster
tttttatgcatatt

SEQ ID NO: 681286 - DNA, 13 bp, D. melanogaster
tttttatgccaaa

SEQ ID NO: 681287 - DNA, 13 bp, D. melanogaster
tttttatgccaca

SEQ ID NO: 681288 - DNA, 14 bp, D. melanogaster
tttttatgccattt

SEQ ID NO: 681289 - DNA, 13 bp, D. melanogaster
tttttatgcccgc

SEQ ID NO: 681290 - DNA, 13 bp, D. melanogaster
tttttatgccctt

SEQ ID NO: 681291 - DNA, 13 bp, D. melanogaster
tttttatgccgca

SEQ ID NO: 681292 - DNA, 13 bp, D. melanogaster
tttttatgcgcca

SEQ ID NO: 681293 - DNA, 13 bp, D. melanogaster
tttttatggaata

SEQ ID NO: 681294 - DNA, 13 bp, D. melanogaster
tttttatggcact

SEQ ID NO: 681295 - DNA, 13 bp, D. melanogaster
tttttatggcata

SEQ ID NO: 681296 - DNA, 13 bp, D. melanogaster
tttttatggcatc

SEQ ID NO: 681297 - DNA, 13 bp, D. melanogaster
tttttatggcatt

SEQ ID NO: 681298 - DNA, 13 bp, D. melanogaster
tttttatggccat

SEQ ID NO: 681299 - DNA, 13 bp, D. melanogaster
tttttatggccgc

SEQ ID NO: 681300 - DNA, 13 bp, D. melanogaster
tttttatggctct

SEQ ID NO: 681301 - DNA, 13 bp, D. melanogaster
tttttatggtgca

SEQ ID NO: 681302 - DNA, 13 bp, D. melanogaster
tttttatgtacat

SEQ ID NO: 681303 - DNA, 14 bp, D. melanogaster
tttttatgtattcg

SEQ ID NO: 681304 - DNA, 13 bp, D. melanogaster
tttttatgtcctg

SEQ ID NO: 681305 - DNA, 13 bp, D. melanogaster
tttttatgtgaaa

SEQ ID NO: 681306 - DNA, 13 bp, D. melanogaster
tttttatgtgctc

SEQ ID NO: 681307 - DNA, 13 bp, D. melanogaster
tttttatgtgtgc

SEQ ID NO: 681308 - DNA, 13 bp, D. melanogaster
tttttattaactg

SEQ ID NO: 681309 - DNA, 14 bp, D. melanogaster
tttttattaagcga

SEQ ID NO: 681310 - DNA, 13 bp, D. melanogaster
tttttattaatgc

SEQ ID NO: 681311 - DNA, 13 bp, D. melanogaster
tttttattagcca

SEQ ID NO: 681312 - DNA, 13 bp, D. melanogaster
tttttattatggc

SEQ ID NO: 681313 - DNA, 13 bp, D. melanogaster
tttttattccaaa

SEQ ID NO: 681314 - DNA, 13 bp, D. melanogaster
tttttattcccaa

SEQ ID NO: 681315 - DNA, 13 bp, D. melanogaster
tttttattctgca

SEQ ID NO: 681316 - DNA, 13 bp, D. melanogaster
tttttattgccaa

SEQ ID NO: 681317 - DNA, 13 bp, D. melanogaster
tttttattgccca

SEQ ID NO: 681318 - DNA, 13 bp, D. melanogaster
tttttattgcgaa

SEQ ID NO: 681319 - DNA, 13 bp, D. melanogaster
tttttattgcgtg

SEQ ID NO: 681320 - DNA, 13 bp, D. melanogaster
tttttattggaaa

SEQ ID NO: 681321 - DNA, 13 bp, D. melanogaster
tttttattggcaa

SEQ ID NO: 681322 - DNA, 13 bp, D. melanogaster
tttttatttgcaa

SEQ ID NO: 681323 - DNA, 14 bp, D. melanogaster
tttttattttagca

SEQ ID NO: 681324 - DNA, 14 bp, D. melanogaster
tttttattttgcca

SEQ ID NO: 681325 - DNA, 13 bp, D. melanogaster
tttttcaaaaaca

SEQ ID NO: 681326 - DNA, 14 bp, D. melanogaster
tttttcaaaaacat

SEQ ID NO: 681327 - DNA, 13 bp, D. melanogaster
tttttcaaaaact

SEQ ID NO: 681328 - DNA, 14 bp, D. melanogaster
tttttcaaaaactt

SEQ ID NO: 681329 - DNA, 13 bp, D. melanogaster
tttttcaaaaagt

SEQ ID NO: 681330 - DNA, 14 bp, D. melanogaster
tttttcaaaaggag

SEQ ID NO: 681331 - DNA, 13 bp, D. melanogaster
tttttcaaaagtt

SEQ ID NO: 681332 - DNA, 13 bp, D. melanogaster
tttttcaaaatct

SEQ ID NO: 681333 - DNA, 13 bp, D. melanogaster
tttttcaaaatga

SEQ ID NO: 681334 - DNA, 13 bp, D. melanogaster
tttttcaaaatgc

SEQ ID NO: 681335 - DNA, 13 bp, D. melanogaster
tttttcaaaatgt

SEQ ID NO: 681336 - DNA, 13 bp, D. melanogaster
tttttcaaacaac

SEQ ID NO: 681337 - DNA, 14 bp, D. melanogaster
tttttcaaacaaca

SEQ ID NO: 681338 - DNA, 13 bp, D. melanogaster
tttttcaaactaa

SEQ ID NO: 681339 - DNA, 13 bp, D. melanogaster
tttttcaaagttt

SEQ ID NO: 681340 - DNA, 13 bp, D. melanogaster
tttttcaacaaca

SEQ ID NO: 681341 - DNA, 13 bp, D. melanogaster
tttttcaacaagc

SEQ ID NO: 681342 - DNA, 13 bp, D. melanogaster
tttttcaacatcc

SEQ ID NO: 681343 - DNA, 13 bp, D. melanogaster
tttttcaaccacc

SEQ ID NO: 681344 - DNA, 13 bp, D. melanogaster
tttttcaacgaat

SEQ ID NO: 681345 - DNA, 13 bp, D. melanogaster
tttttcaactaaa

SEQ ID NO: 681346 - DNA, 13 bp, D. melanogaster
tttttcaactgct

SEQ ID NO: 681347 - DNA, 13 bp, D. melanogaster
tttttcaacttaa

SEQ ID NO: 681348 - DNA, 13 bp, D. melanogaster
tttttcaagaaaa

SEQ ID NO: 681349 - DNA, 13 bp, D. melanogaster
tttttcaagaact

SEQ ID NO: 681350 - DNA, 13 bp, D. melanogaster
tttttcaagagcc

SEQ ID NO: 681351 - DNA, 13 bp, D. melanogaster
tttttcaagccaa

SEQ ID NO: 681352 - DNA, 13 bp, D. melanogaster
tttttcaagtgca

SEQ ID NO: 681353 - DNA, 14 bp, D. melanogaster
tttttcaagtgcac

SEQ ID NO: 681354 - DNA, 13 bp, D. melanogaster
tttttcaagtgcc

SEQ ID NO: 681355 - DNA, 13 bp, D. melanogaster
tttttcaatagct

SEQ ID NO: 681356 - DNA, 13 bp, D. melanogaster
tttttcaatgcat

SEQ ID NO: 681357 - DNA, 13 bp, D. melanogaster
tttttcaatggca

SEQ ID NO: 681358 - DNA, 13 bp, D. melanogaster
tttttcaattgta

SEQ ID NO: 681359 - DNA, 13 bp, D. melanogaster
tttttcacaaaaa

SEQ ID NO: 681360 - DNA, 13 bp, D. melanogaster
tttttcacaagta

SEQ ID NO: 681361 - DNA, 13 bp, D. melanogaster
tttttcacattgc

SEQ ID NO: 681362 - DNA, 13 bp, D. melanogaster
tttttcacattgt

SEQ ID NO: 681363 - DNA, 13 bp, D. melanogaster
tttttcaccaaaa

SEQ ID NO: 681364 - DNA, 13 bp, D. melanogaster
tttttcacccaca

SEQ ID NO: 681365 - DNA, 13 bp, D. melanogaster
tttttcaccgctt

SEQ ID NO: 681366 - DNA, 13 bp, D. melanogaster
tttttcactaaaa

SEQ ID NO: 681367 - DNA, 13 bp, D. melanogaster
tttttcactccac

SEQ ID NO: 681368 - DNA, 13 bp, D. melanogaster
tttttcactgtgc

SEQ ID NO: 681369 - DNA, 13 bp, D. melanogaster
tttttcactgtgt

SEQ ID NO: 681370 - DNA, 13 bp, D. melanogaster
tttttcacttcaa

SEQ ID NO: 681371 - DNA, 13 bp, D. melanogaster
tttttcagaaatt

SEQ ID NO: 681372 - DNA, 13 bp, D. melanogaster
tttttcagatatt

SEQ ID NO: 681373 - DNA, 13 bp, D. melanogaster
tttttcagcaatt

SEQ ID NO: 681374 - DNA, 14 bp, D. melanogaster
tttttcagcatttt

SEQ ID NO: 681375 - DNA, 13 bp, D. melanogaster
tttttcagccaaa

SEQ ID NO: 681376 - DNA, 13 bp, D. melanogaster
tttttcagctctt

SEQ ID NO: 681377 - DNA, 14 bp, D. melanogaster
tttttcagtgcacc

SEQ ID NO: 681378 - DNA, 13 bp, D. melanogaster
tttttcagtgcag

SEQ ID NO: 681379 - DNA, 13 bp, D. melanogaster
tttttcagtgtag

SEQ ID NO: 681380 - DNA, 13 bp, D. melanogaster
tttttcagttaaa

SEQ ID NO: 681381 - DNA, 13 bp, D. melanogaster
tttttcatatgca

SEQ ID NO: 681382 - DNA, 13 bp, D. melanogaster
tttttcatgaaat

SEQ ID NO: 681383 - DNA, 13 bp, D. melanogaster
tttttcatgaatt

SEQ ID NO: 681384 - DNA, 13 bp, D. melanogaster
tttttcatgccac

SEQ ID NO: 681385 - DNA, 13 bp, D. melanogaster
tttttcattaaca

SEQ ID NO: 681386 - DNA, 13 bp, D. melanogaster
tttttcattcatg

SEQ ID NO: 681387 - DNA, 14 bp, D. melanogaster
tttttcatttgaaa

SEQ ID NO: 681388 - DNA, 13 bp, D. melanogaster
tttttcatttgca

SEQ ID NO: 681389 - DNA, 13 bp, D. melanogaster
tttttccaaaaat

SEQ ID NO: 681390 - DNA, 13 bp, D. melanogaster
tttttccaaaaca

SEQ ID NO: 681391 - DNA, 13 bp, D. melanogaster
tttttccaaatat

SEQ ID NO: 681392 - DNA, 13 bp, D. melanogaster
tttttccaaatga

SEQ ID NO: 681393 - DNA, 13 bp, D. melanogaster
tttttccaaatgg

SEQ ID NO: 681394 - DNA, 13 bp, D. melanogaster
tttttccaaatta

SEQ ID NO: 681395 - DNA, 13 bp, D. melanogaster
tttttccaacaaa

SEQ ID NO: 681396 - DNA, 13 bp, D. melanogaster
tttttccaaccaa

SEQ ID NO: 681397 - DNA, 13 bp, D. melanogaster
tttttccaattaa

SEQ ID NO: 681398 - DNA, 13 bp, D. melanogaster
tttttccaattgt

SEQ ID NO: 681399 - DNA, 13 bp, D. melanogaster
tttttccacaaaa

SEQ ID NO: 681400 - DNA, 13 bp, D. melanogaster
tttttccacaact

SEQ ID NO: 681401 - DNA, 13 bp, D. melanogaster
tttttccacaatt

SEQ ID NO: 681402 - DNA, 13 bp, D. melanogaster
tttttccaccagc

SEQ ID NO: 681403 - DNA, 13 bp, D. melanogaster
tttttccaccatt

SEQ ID NO: 681404 - DNA, 13 bp, D. melanogaster
tttttccactcat

SEQ ID NO: 681405 - DNA, 13 bp, D. melanogaster
tttttccactgca

SEQ ID NO: 681406 - DNA, 13 bp, D. melanogaster
tttttccactgct

SEQ ID NO: 681407 - DNA, 13 bp, D. melanogaster
tttttccactgta

SEQ ID NO: 681408 - DNA, 13 bp, D. melanogaster
tttttccacttgc

SEQ ID NO: 681409 - DNA, 13 bp, D. melanogaster
tttttccagaaat

SEQ ID NO: 681410 - DNA, 13 bp, D. melanogaster
tttttccagattt

SEQ ID NO: 681411 - DNA, 13 bp, D. melanogaster
tttttccagcaaa

SEQ ID NO: 681412 - DNA, 13 bp, D. melanogaster
tttttccagcagc

SEQ ID NO: 681413 - DNA, 13 bp, D. melanogaster
tttttccagccag

SEQ ID NO: 681414 - DNA, 13 bp, D. melanogaster
tttttccagccat

SEQ ID NO: 681415 - DNA, 13 bp, D. melanogaster
tttttccagccgc

SEQ ID NO: 681416 - DNA, 13 bp, D. melanogaster
tttttccagctcg

SEQ ID NO: 681417 - DNA, 13 bp, D. melanogaster
tttttccaggagt

SEQ ID NO: 681418 - DNA, 13 bp, D. melanogaster
tttttccagtgca

SEQ ID NO: 681419 - DNA, 14 bp, D. melanogaster
tttttccagtgcag

SEQ ID NO: 681420 - DNA, 13 bp, D. melanogaster
tttttccagtgtc

SEQ ID NO: 681421 - DNA, 13 bp, D. melanogaster
tttttccataaaa

SEQ ID NO: 681422 - DNA, 13 bp, D. melanogaster
tttttccatccat

SEQ ID NO: 681423 - DNA, 13 bp, D. melanogaster
tttttccatcgaa

SEQ ID NO: 681424 - DNA, 13 bp, D. melanogaster
tttttccattaac

SEQ ID NO: 681425 - DNA, 13 bp, D. melanogaster
tttttccattgcc

SEQ ID NO: 681426 - DNA, 13 bp, D. melanogaster
tttttcccaaaac

SEQ ID NO: 681427 - DNA, 13 bp, D. melanogaster
tttttcccaaaca

SEQ ID NO: 681428 - DNA, 13 bp, D. melanogaster
tttttcccactca

SEQ ID NO: 681429 - DNA, 13 bp, D. melanogaster
tttttcccagtgt

SEQ ID NO: 681430 - DNA, 13 bp, D. melanogaster
tttttccccaatt

SEQ ID NO: 681431 - DNA, 13 bp, D. melanogaster
tttttccccagct

SEQ ID NO: 681432 - DNA, 13 bp, D. melanogaster
tttttcccccaaa

SEQ ID NO: 681433 - DNA, 13 bp, D. melanogaster
tttttcccccaca

SEQ ID NO: 681434 - DNA, 13 bp, D. melanogaster
tttttcccgcccg

SEQ ID NO: 681435 - DNA, 13 bp, D. melanogaster
tttttccctgcca

SEQ ID NO: 681436 - DNA, 13 bp, D. melanogaster
tttttccgaaaaa

SEQ ID NO: 681437 - DNA, 13 bp, D. melanogaster
tttttccgaattt

SEQ ID NO: 681438 - DNA, 13 bp, D. melanogaster
tttttccgcctgc

SEQ ID NO: 681439 - DNA, 13 bp, D. melanogaster
tttttccgctgca

SEQ ID NO: 681440 - DNA, 13 bp, D. melanogaster
tttttccgtggaa

SEQ ID NO: 681441 - DNA, 13 bp, D. melanogaster
tttttccgtgtgc

SEQ ID NO: 681442 - DNA, 13 bp, D. melanogaster
tttttcctaaaat

SEQ ID NO: 681443 - DNA, 13 bp, D. melanogaster
tttttcctacaaa

SEQ ID NO: 681444 - DNA, 13 bp, D. melanogaster
tttttcctcagtg

SEQ ID NO: 681445 - DNA, 13 bp, D. melanogaster
tttttcctgccaa

SEQ ID NO: 681446 - DNA, 13 bp, D. melanogaster
tttttcctgccca

SEQ ID NO: 681447 - DNA, 13 bp, D. melanogaster
tttttcctggcca

SEQ ID NO: 681448 - DNA, 14 bp, D. melanogaster
tttttccttaaaaa

SEQ ID NO: 681449 - DNA, 13 bp, D. melanogaster
tttttcgaaaaaa

SEQ ID NO: 681450 - DNA, 13 bp, D. melanogaster
tttttcgaaaaat

SEQ ID NO: 681451 - DNA, 13 bp, D. melanogaster
tttttcgaaaact

SEQ ID NO: 681452 - DNA, 13 bp, D. melanogaster
tttttcgaaacaa

SEQ ID NO: 681453 - DNA, 13 bp, D. melanogaster
tttttcgaaagtt

SEQ ID NO: 681454 - DNA, 13 bp, D. melanogaster
tttttcgaaatgt

SEQ ID NO: 681455 - DNA, 13 bp, D. melanogaster
tttttcgaaattt

SEQ ID NO: 681456 - DNA, 13 bp, D. melanogaster
tttttcgaacttt

SEQ ID NO: 681457 - DNA, 13 bp, D. melanogaster
tttttcgaataaa

SEQ ID NO: 681458 - DNA, 13 bp, D. melanogaster
tttttcgaatagt

SEQ ID NO: 681459 - DNA, 14 bp, D. melanogaster
tttttcgaatattt

SEQ ID NO: 681460 - DNA, 13 bp, D. melanogaster
tttttcgaattta

SEQ ID NO: 681461 - DNA, 13 bp, D. melanogaster
tttttcgaatttc

SEQ ID NO: 681462 - DNA, 13 bp, D. melanogaster
tttttcgactgca

SEQ ID NO: 681463 - DNA, 13 bp, D. melanogaster
tttttcgagtgca

SEQ ID NO: 681464 - DNA, 14 bp, D. melanogaster
tttttcgagtgcac

SEQ ID NO: 681465 - DNA, 13 bp, D. melanogaster
tttttcgagtgtg

SEQ ID NO: 681466 - DNA, 13 bp, D. melanogaster
tttttcgagtttc

SEQ ID NO: 681467 - DNA, 13 bp, D. melanogaster
tttttcgattgca

SEQ ID NO: 681468 - DNA, 13 bp, D. melanogaster
tttttcgcaaaaa

SEQ ID NO: 681469 - DNA, 14 bp, D. melanogaster
tttttcgcaaaaaa

SEQ ID NO: 681470 - DNA, 13 bp, D. melanogaster
tttttcgcaactt

SEQ ID NO: 681471 - DNA, 13 bp, D. melanogaster
tttttcgcaattt

SEQ ID NO: 681472 - DNA, 13 bp, D. melanogaster
tttttcgcacagt

SEQ ID NO: 681473 - DNA, 13 bp, D. melanogaster
tttttcgcacatt

SEQ ID NO: 681474 - DNA, 13 bp, D. melanogaster
tttttcgcagtgc

SEQ ID NO: 681475 - DNA, 13 bp, D. melanogaster
tttttcgcagtgt

SEQ ID NO: 681476 - DNA, 13 bp, D. melanogaster
tttttcgccattc

SEQ ID NO: 681477 - DNA, 13 bp, D. melanogaster
tttttcgcccagt

SEQ ID NO: 681478 - DNA, 13 bp, D. melanogaster
tttttcgccgctg

SEQ ID NO: 681479 - DNA, 13 bp, D. melanogaster
tttttcgctcagt

SEQ ID NO: 681480 - DNA, 13 bp, D. melanogaster
tttttcgctgctc

SEQ ID NO: 681481 - DNA, 13 bp, D. melanogaster
tttttcgctgtgc

SEQ ID NO: 681482 - DNA, 13 bp, D. melanogaster
tttttcgcttatc

SEQ ID NO: 681483 - DNA, 13 bp, D. melanogaster
tttttcgcttggc

SEQ ID NO: 681484 - DNA, 13 bp, D. melanogaster
tttttcggaattt

SEQ ID NO: 681485 - DNA, 13 bp, D. melanogaster
tttttcggcactt

SEQ ID NO: 681486 - DNA, 13 bp, D. melanogaster
tttttcggccagc

SEQ ID NO: 681487 - DNA, 13 bp, D. melanogaster
tttttcggcgtcc

SEQ ID NO: 681488 - DNA, 13 bp, D. melanogaster
tttttcggctgca

SEQ ID NO: 681489 - DNA, 13 bp, D. melanogaster
tttttcggctgcc

SEQ ID NO: 681490 - DNA, 13 bp, D. melanogaster
tttttcgggccaa

SEQ ID NO: 681491 - DNA, 13 bp, D. melanogaster
tttttcggtggct

SEQ ID NO: 681492 - DNA, 13 bp, D. melanogaster
tttttcgtaaatt

SEQ ID NO: 681493 - DNA, 13 bp, D. melanogaster
tttttcgtacatt

SEQ ID NO: 681494 - DNA, 13 bp, D. melanogaster
tttttcgttcaat

SEQ ID NO: 681495 - DNA, 14 bp, D. melanogaster
tttttctaaaagtt

SEQ ID NO: 681496 - DNA, 14 bp, D. melanogaster
tttttctaaatatg

SEQ ID NO: 681497 - DNA, 13 bp, D. melanogaster
tttttctaaatgt

SEQ ID NO: 681498 - DNA, 14 bp, D. melanogaster
tttttctaacacca

SEQ ID NO: 681499 - DNA, 13 bp, D. melanogaster
tttttctaagtgc

SEQ ID NO: 681500 - DNA, 13 bp, D. melanogaster
tttttctacaaat

SEQ ID NO: 681501 - DNA, 13 bp, D. melanogaster
tttttctatactg

SEQ ID NO: 681502 - DNA, 13 bp, D. melanogaster
tttttctcaaaca

SEQ ID NO: 681503 - DNA, 13 bp, D. melanogaster
tttttctcaatgt

SEQ ID NO: 681504 - DNA, 13 bp, D. melanogaster
tttttctcagtgc

SEQ ID NO: 681505 - DNA, 14 bp, D. melanogaster
tttttctcagtgca

SEQ ID NO: 681506 - DNA, 13 bp, D. melanogaster
tttttctcagtgt

SEQ ID NO: 681507 - DNA, 13 bp, D. melanogaster
tttttctccagat

SEQ ID NO: 681508 - DNA, 13 bp, D. melanogaster
tttttctcgaaaa

SEQ ID NO: 681509 - DNA, 13 bp, D. melanogaster
tttttctcgactt

SEQ ID NO: 681510 - DNA, 14 bp, D. melanogaster
tttttctcgctgtg

SEQ ID NO: 681511 - DNA, 14 bp, D. melanogaster
tttttctcggtgca

SEQ ID NO: 681512 - DNA, 13 bp, D. melanogaster
tttttctctcagt

SEQ ID NO: 681513 - DNA, 14 bp, D. melanogaster
tttttctctcagtg

SEQ ID NO: 681514 - DNA, 13 bp, D. melanogaster
tttttctgcactc

SEQ ID NO: 681515 - DNA, 13 bp, D. melanogaster
tttttctgccagc

SEQ ID NO: 681516 - DNA, 13 bp, D. melanogaster
tttttctgctgcc

SEQ ID NO: 681517 - DNA, 13 bp, D. melanogaster
tttttctgctggc

SEQ ID NO: 681518 - DNA, 14 bp, D. melanogaster
tttttctggccaaa

SEQ ID NO: 681519 - DNA, 14 bp, D. melanogaster
tttttctggccatt

SEQ ID NO: 681520 - DNA, 13 bp, D. melanogaster
tttttctgggctg

SEQ ID NO: 681521 - DNA, 13 bp, D. melanogaster
tttttctgtgcag

SEQ ID NO: 681522 - DNA, 13 bp, D. melanogaster
tttttctgtgtaa

SEQ ID NO: 681523 - DNA, 14 bp, D. melanogaster
tttttctgtgtgca

SEQ ID NO: 681524 - DNA, 14 bp, D. melanogaster
tttttctgtgtgta

SEQ ID NO: 681525 - DNA, 14 bp, D. melanogaster
tttttcttagaaaa

SEQ ID NO: 681526 - DNA, 13 bp, D. melanogaster
tttttcttagtgc

SEQ ID NO: 681527 - DNA, 13 bp, D. melanogaster
tttttcttcagtg

SEQ ID NO: 681528 - DNA, 13 bp, D. melanogaster
tttttcttgacaa

SEQ ID NO: 681529 - DNA, 13 bp, D. melanogaster
tttttctttgcaa

SEQ ID NO: 681530 - DNA, 13 bp, D. melanogaster
tttttctttgcca

SEQ ID NO: 681531 - DNA, 13 bp, D. melanogaster
tttttctttggca

SEQ ID NO: 681532 - DNA, 14 bp, D. melanogaster
tttttgaaaaactt

SEQ ID NO: 681533 - DNA, 13 bp, D. melanogaster
tttttgaaaacat

SEQ ID NO: 681534 - DNA, 14 bp, D. melanogaster
tttttgaaaacttt

SEQ ID NO: 681535 - DNA, 13 bp, D. melanogaster
tttttgaaaagaa

SEQ ID NO: 681536 - DNA, 13 bp, D. melanogaster
tttttgaaaagca

SEQ ID NO: 681537 - DNA, 13 bp, D. melanogaster
tttttgaaaatgt

SEQ ID NO: 681538 - DNA, 13 bp, D. melanogaster
tttttgaaaattg

SEQ ID NO: 681539 - DNA, 13 bp, D. melanogaster
tttttgaaactaa

SEQ ID NO: 681540 - DNA, 13 bp, D. melanogaster
tttttgaaagaat

SEQ ID NO: 681541 - DNA, 13 bp, D. melanogaster
tttttgaaatact

SEQ ID NO: 681542 - DNA, 13 bp, D. melanogaster
tttttgaaatcga

SEQ ID NO: 681543 - DNA, 13 bp, D. melanogaster
tttttgaaatgca

SEQ ID NO: 681544 - DNA, 13 bp, D. melanogaster
tttttgaacattt

SEQ ID NO: 681545 - DNA, 13 bp, D. melanogaster
tttttgaatacat

SEQ ID NO: 681546 - DNA, 13 bp, D. melanogaster
tttttgaatcaaa

SEQ ID NO: 681547 - DNA, 14 bp, D. melanogaster
tttttgaatgctct

SEQ ID NO: 681548 - DNA, 13 bp, D. melanogaster
tttttgaatggct

SEQ ID NO: 681549 - DNA, 13 bp, D. melanogaster
tttttgaatgtcc

SEQ ID NO: 681550 - DNA, 13 bp, D. melanogaster
tttttgacaaaac

SEQ ID NO: 681551 - DNA, 13 bp, D. melanogaster
tttttgacaaatt

SEQ ID NO: 681552 - DNA, 13 bp, D. melanogaster
tttttgacaacaa

SEQ ID NO: 681553 - DNA, 13 bp, D. melanogaster
tttttgacaattt

SEQ ID NO: 681554 - DNA, 14 bp, D. melanogaster
tttttgacaatttt

SEQ ID NO: 681555 - DNA, 13 bp, D. melanogaster
tttttgacacttg

SEQ ID NO: 681556 - DNA, 13 bp, D. melanogaster
tttttgacattca

SEQ ID NO: 681557 - DNA, 13 bp, D. melanogaster
tttttgacatttg

SEQ ID NO: 681558 - DNA, 14 bp, D. melanogaster
tttttgagcaatgc

SEQ ID NO: 681559 - DNA, 13 bp, D. melanogaster
tttttgaggaaaa

SEQ ID NO: 681560 - DNA, 14 bp, D. melanogaster
tttttgaggaaaag

SEQ ID NO: 681561 - DNA, 13 bp, D. melanogaster
tttttgaggccaa

SEQ ID NO: 681562 - DNA, 13 bp, D. melanogaster
tttttgagtataa

SEQ ID NO: 681563 - DNA, 13 bp, D. melanogaster
tttttgagtgaat

SEQ ID NO: 681564 - DNA, 13 bp, D. melanogaster
tttttgagtgcag

SEQ ID NO: 681565 - DNA, 13 bp, D. melanogaster
tttttgagtgcat

SEQ ID NO: 681566 - DNA, 13 bp, D. melanogaster
tttttgataaaac

SEQ ID NO: 681567 - DNA, 13 bp, D. melanogaster
tttttgataacaa

SEQ ID NO: 681568 - DNA, 13 bp, D. melanogaster
tttttgatataga

SEQ ID NO: 681569 - DNA, 14 bp, D. melanogaster
tttttgatatcatt

SEQ ID NO: 681570 - DNA, 13 bp, D. melanogaster
tttttgatcaaac

SEQ ID NO: 681571 - DNA, 13 bp, D. melanogaster
tttttgatcaatt

SEQ ID NO: 681572 - DNA, 14 bp, D. melanogaster
tttttgatcaggat

SEQ ID NO: 681573 - DNA, 13 bp, D. melanogaster
tttttgatcgaca

SEQ ID NO: 681574 - DNA, 13 bp, D. melanogaster
tttttgatggaaa

SEQ ID NO: 681575 - DNA, 13 bp, D. melanogaster
tttttgatggcca

SEQ ID NO: 681576 - DNA, 13 bp, D. melanogaster
tttttgatggttc

SEQ ID NO: 681577 - DNA, 14 bp, D. melanogaster
tttttgattgcatt

SEQ ID NO: 681578 - DNA, 13 bp, D. melanogaster
tttttgattgccc

SEQ ID NO: 681579 - DNA, 13 bp, D. melanogaster
tttttgatttcca

SEQ ID NO: 681580 - DNA, 13 bp, D. melanogaster
tttttgcaaaaat

SEQ ID NO: 681581 - DNA, 14 bp, D. melanogaster
tttttgcaaaatat

SEQ ID NO: 681582 - DNA, 13 bp, D. melanogaster
tttttgcaaactt

SEQ ID NO: 681583 - DNA, 13 bp, D. melanogaster
tttttgcaaatca

SEQ ID NO: 681584 - DNA, 13 bp, D. melanogaster
tttttgcaaattt

SEQ ID NO: 681585 - DNA, 14 bp, D. melanogaster
tttttgcaaatttt

SEQ ID NO: 681586 - DNA, 13 bp, D. melanogaster
tttttgcaacaac

SEQ ID NO: 681587 - DNA, 13 bp, D. melanogaster
tttttgcaactgc

SEQ ID NO: 681588 - DNA, 14 bp, D. melanogaster
tttttgcaagtgta

SEQ ID NO: 681589 - DNA, 13 bp, D. melanogaster
tttttgcaattaa

SEQ ID NO: 681590 - DNA, 13 bp, D. melanogaster
tttttgcacaaat

SEQ ID NO: 681591 - DNA, 13 bp, D. melanogaster
tttttgcacaatt

SEQ ID NO: 681592 - DNA, 13 bp, D. melanogaster
tttttgcacacac

SEQ ID NO: 681593 - DNA, 13 bp, D. melanogaster
tttttgcacatgt

SEQ ID NO: 681594 - DNA, 13 bp, D. melanogaster
tttttgcacattt

SEQ ID NO: 681595 - DNA, 14 bp, D. melanogaster
tttttgcacatttt

SEQ ID NO: 681596 - DNA, 14 bp, D. melanogaster
tttttgcacgtttt

SEQ ID NO: 681597 - DNA, 13 bp, D. melanogaster
tttttgcactgct

SEQ ID NO: 681598 - DNA, 13 bp, D. melanogaster
tttttgcacttca

SEQ ID NO: 681599 - DNA, 13 bp, D. melanogaster
tttttgcactttg

SEQ ID NO: 681600 - DNA, 14 bp, D. melanogaster
tttttgcactttgc

SEQ ID NO: 681601 - DNA, 13 bp, D. melanogaster
tttttgcagattt

SEQ ID NO: 681602 - DNA, 13 bp, D. melanogaster
tttttgcagcaca

SEQ ID NO: 681603 - DNA, 13 bp, D. melanogaster
tttttgcagcact

SEQ ID NO: 681604 - DNA, 13 bp, D. melanogaster
tttttgcagccaa

SEQ ID NO: 681605 - DNA, 13 bp, D. melanogaster
tttttgcagccac

SEQ ID NO: 681606 - DNA, 13 bp, D. melanogaster
tttttgcagctga

SEQ ID NO: 681607 - DNA, 13 bp, D. melanogaster
tttttgcagctgc

SEQ ID NO: 681608 - DNA, 14 bp, D. melanogaster
tttttgcagctgct

SEQ ID NO: 681609 - DNA, 13 bp, D. melanogaster
tttttgcagcttt

SEQ ID NO: 681610 - DNA, 14 bp, D. melanogaster
tttttgcagctttt

SEQ ID NO: 681611 - DNA, 13 bp, D. melanogaster
tttttgcagtgtg

SEQ ID NO: 681612 - DNA, 13 bp, D. melanogaster
tttttgcagttcc

SEQ ID NO: 681613 - DNA, 13 bp, D. melanogaster
tttttgcagttgt

SEQ ID NO: 681614 - DNA, 13 bp, D. melanogaster
tttttgcataaca

SEQ ID NO: 681615 - DNA, 13 bp, D. melanogaster
tttttgcatactt

SEQ ID NO: 681616 - DNA, 13 bp, D. melanogaster
tttttgcatagtt

SEQ ID NO: 681617 - DNA, 13 bp, D. melanogaster
tttttgcatatca

SEQ ID NO: 681618 - DNA, 13 bp, D. melanogaster
tttttgcatgcca

SEQ ID NO: 681619 - DNA, 13 bp, D. melanogaster
tttttgcattaat

SEQ ID NO: 681620 - DNA, 13 bp, D. melanogaster
tttttgcattccg

SEQ ID NO: 681621 - DNA, 14 bp, D. melanogaster
tttttgcatttata

SEQ ID NO: 681622 - DNA, 13 bp, D. melanogaster
tttttgcatttca

SEQ ID NO: 681623 - DNA, 14 bp, D. melanogaster
tttttgcatttcat

SEQ ID NO: 681624 - DNA, 14 bp, D. melanogaster
tttttgccaaaaaa

SEQ ID NO: 681625 - DNA, 13 bp, D. melanogaster
tttttgccaaaat

SEQ ID NO: 681626 - DNA, 13 bp, D. melanogaster
tttttgccaaagt

SEQ ID NO: 681627 - DNA, 13 bp, D. melanogaster
tttttgccaaatt

SEQ ID NO: 681628 - DNA, 14 bp, D. melanogaster
tttttgccaaattt

SEQ ID NO: 681629 - DNA, 13 bp, D. melanogaster
tttttgccaactt

SEQ ID NO: 681630 - DNA, 13 bp, D. melanogaster
tttttgccaatgc

SEQ ID NO: 681631 - DNA, 13 bp, D. melanogaster
tttttgccaattt

SEQ ID NO: 681632 - DNA, 14 bp, D. melanogaster
tttttgccaatttc

SEQ ID NO: 681633 - DNA, 13 bp, D. melanogaster
tttttgccacctt

SEQ ID NO: 681634 - DNA, 13 bp, D. melanogaster
tttttgccacgcc

SEQ ID NO: 681635 - DNA, 13 bp, D. melanogaster
tttttgccagcca

SEQ ID NO: 681636 - DNA, 13 bp, D. melanogaster
tttttgccagcct

SEQ ID NO: 681637 - DNA, 13 bp, D. melanogaster
tttttgccagctc

SEQ ID NO: 681638 - DNA, 13 bp, D. melanogaster
tttttgccagctt

SEQ ID NO: 681639 - DNA, 13 bp, D. melanogaster
tttttgccagtgc

SEQ ID NO: 681640 - DNA, 14 bp, D. melanogaster
tttttgccagtgca

SEQ ID NO: 681641 - DNA, 13 bp, D. melanogaster
tttttgccagttt

SEQ ID NO: 681642 - DNA, 14 bp, D. melanogaster
tttttgccatattt

SEQ ID NO: 681643 - DNA, 13 bp, D. melanogaster
tttttgccatgcc

SEQ ID NO: 681644 - DNA, 13 bp, D. melanogaster
tttttgccattat

SEQ ID NO: 681645 - DNA, 13 bp, D. melanogaster
tttttgccattga

SEQ ID NO: 681646 - DNA, 13 bp, D. melanogaster
tttttgccattgt

SEQ ID NO: 681647 - DNA, 13 bp, D. melanogaster
tttttgccatttc

SEQ ID NO: 681648 - DNA, 13 bp, D. melanogaster
tttttgcccaaca

SEQ ID NO: 681649 - DNA, 13 bp, D. melanogaster
tttttgcccaagg

SEQ ID NO: 681650 - DNA, 13 bp, D. melanogaster
tttttgcccagct

SEQ ID NO: 681651 - DNA, 13 bp, D. melanogaster
tttttgcccatgt

SEQ ID NO: 681652 - DNA, 13 bp, D. melanogaster
tttttgcccattt

SEQ ID NO: 681653 - DNA, 14 bp, D. melanogaster
tttttgcccatttt

SEQ ID NO: 681654 - DNA, 13 bp, D. melanogaster
tttttgccccaaa

SEQ ID NO: 681655 - DNA, 13 bp, D. melanogaster
tttttgcccgcct

SEQ ID NO: 681656 - DNA, 13 bp, D. melanogaster
tttttgcccgctc

SEQ ID NO: 681657 - DNA, 13 bp, D. melanogaster
tttttgccgattt

SEQ ID NO: 681658 - DNA, 13 bp, D. melanogaster
tttttgccgcctt

SEQ ID NO: 681659 - DNA, 13 bp, D. melanogaster
tttttgccgtgca

SEQ ID NO: 681660 - DNA, 13 bp, D. melanogaster
tttttgcctcagt

SEQ ID NO: 681661 - DNA, 13 bp, D. melanogaster
tttttgcctgccc

SEQ ID NO: 681662 - DNA, 13 bp, D. melanogaster
tttttgcctgctc

SEQ ID NO: 681663 - DNA, 13 bp, D. melanogaster
tttttgcctggcc

SEQ ID NO: 681664 - DNA, 13 bp, D. melanogaster
tttttgcctggct

SEQ ID NO: 681665 - DNA, 13 bp, D. melanogaster
tttttgccttcga

SEQ ID NO: 681666 - DNA, 13 bp, D. melanogaster
tttttgccttgcc

SEQ ID NO: 681667 - DNA, 13 bp, D. melanogaster
tttttgcctttaa

SEQ ID NO: 681668 - DNA, 14 bp, D. melanogaster
tttttgcgaaaaat

SEQ ID NO: 681669 - DNA, 13 bp, D. melanogaster
tttttgcgaattt

SEQ ID NO: 681670 - DNA, 13 bp, D. melanogaster
tttttgcgagtgt

SEQ ID NO: 681671 - DNA, 13 bp, D. melanogaster
tttttgcgccaaa

SEQ ID NO: 681672 - DNA, 13 bp, D. melanogaster
tttttgcgcgatt

SEQ ID NO: 681673 - DNA, 13 bp, D. melanogaster
tttttgcgctgcg

SEQ ID NO: 681674 - DNA, 13 bp, D. melanogaster
tttttgcgctgct

SEQ ID NO: 681675 - DNA, 14 bp, D. melanogaster
tttttgcgctttta

SEQ ID NO: 681676 - DNA, 13 bp, D. melanogaster
tttttgcggtggc

SEQ ID NO: 681677 - DNA, 13 bp, D. melanogaster
tttttgcggttgc

SEQ ID NO: 681678 - DNA, 13 bp, D. melanogaster
tttttgctaaatt

SEQ ID NO: 681679 - DNA, 13 bp, D. melanogaster
tttttgctagcgt

SEQ ID NO: 681680 - DNA, 13 bp, D. melanogaster
tttttgctcaatt

SEQ ID NO: 681681 - DNA, 13 bp, D. melanogaster
tttttgctcactt

SEQ ID NO: 681682 - DNA, 13 bp, D. melanogaster
tttttgctcggct

SEQ ID NO: 681683 - DNA, 13 bp, D. melanogaster
tttttgctctgca

SEQ ID NO: 681684 - DNA, 14 bp, D. melanogaster
tttttgctctgtga

SEQ ID NO: 681685 - DNA, 13 bp, D. melanogaster
tttttgctgaaaa

SEQ ID NO: 681686 - DNA, 13 bp, D. melanogaster
tttttgctgaagc

SEQ ID NO: 681687 - DNA, 13 bp, D. melanogaster
tttttgctgccct

SEQ ID NO: 681688 - DNA, 13 bp, D. melanogaster
tttttgctgccga

SEQ ID NO: 681689 - DNA, 13 bp, D. melanogaster
tttttgctgccgc

SEQ ID NO: 681690 - DNA, 13 bp, D. melanogaster
tttttgctgccgt

SEQ ID NO: 681691 - DNA, 13 bp, D. melanogaster
tttttgctgctgc

SEQ ID NO: 681692 - DNA, 13 bp, D. melanogaster
tttttgctggaat

SEQ ID NO: 681693 - DNA, 13 bp, D. melanogaster
tttttgctggcaa

SEQ ID NO: 681694 - DNA, 13 bp, D. melanogaster
tttttgctggctg

SEQ ID NO: 681695 - DNA, 13 bp, D. melanogaster
tttttgctgtgta

SEQ ID NO: 681696 - DNA, 13 bp, D. melanogaster
tttttgcttaaaa

SEQ ID NO: 681697 - DNA, 13 bp, D. melanogaster
tttttgcttcgga

SEQ ID NO: 681698 - DNA, 13 bp, D. melanogaster
tttttgctttaaa

SEQ ID NO: 681699 - DNA, 14 bp, D. melanogaster
tttttgctttgatc

SEQ ID NO: 681700 - DNA, 13 bp, D. melanogaster
tttttgctttgca

SEQ ID NO: 681701 - DNA, 13 bp, D. melanogaster
tttttggaaaaaa

SEQ ID NO: 681702 - DNA, 13 bp, D. melanogaster
tttttggaaaaat

SEQ ID NO: 681703 - DNA, 13 bp, D. melanogaster
tttttggaaaatc

SEQ ID NO: 681704 - DNA, 13 bp, D. melanogaster
tttttggaaaatt

SEQ ID NO: 681705 - DNA, 13 bp, D. melanogaster
tttttggaaacac

SEQ ID NO: 681706 - DNA, 13 bp, D. melanogaster
tttttggaaatat

SEQ ID NO: 681707 - DNA, 13 bp, D. melanogaster
tttttggacaaaa

SEQ ID NO: 681708 - DNA, 13 bp, D. melanogaster
tttttggacaaat

SEQ ID NO: 681709 - DNA, 14 bp, D. melanogaster
tttttggacaagga

SEQ ID NO: 681710 - DNA, 13 bp, D. melanogaster
tttttggacacag

SEQ ID NO: 681711 - DNA, 13 bp, D. melanogaster
tttttggactgcg

SEQ ID NO: 681712 - DNA, 13 bp, D. melanogaster
tttttggagctgc

SEQ ID NO: 681713 - DNA, 13 bp, D. melanogaster
tttttggataagt

SEQ ID NO: 681714 - DNA, 13 bp, D. melanogaster
tttttggatttcg

SEQ ID NO: 681715 - DNA, 13 bp, D. melanogaster
tttttggcaaaca

SEQ ID NO: 681716 - DNA, 13 bp, D. melanogaster
tttttggcaaatc

SEQ ID NO: 681717 - DNA, 13 bp, D. melanogaster
tttttggcaaatg

SEQ ID NO: 681718 - DNA, 13 bp, D. melanogaster
tttttggcaacaa

SEQ ID NO: 681719 - DNA, 14 bp, D. melanogaster
tttttggcaacaaa

SEQ ID NO: 681720 - DNA, 13 bp, D. melanogaster
tttttggcaacat

SEQ ID NO: 681721 - DNA, 13 bp, D. melanogaster
tttttggcaactg

SEQ ID NO: 681722 - DNA, 13 bp, D. melanogaster
tttttggcaactt

SEQ ID NO: 681723 - DNA, 13 bp, D. melanogaster
tttttggcaagca

SEQ ID NO: 681724 - DNA, 13 bp, D. melanogaster
tttttggcaatca

SEQ ID NO: 681725 - DNA, 13 bp, D. melanogaster
tttttggcaatga

SEQ ID NO: 681726 - DNA, 14 bp, D. melanogaster
tttttggcaattaa

SEQ ID NO: 681727 - DNA, 13 bp, D. melanogaster
tttttggcaattt

SEQ ID NO: 681728 - DNA, 13 bp, D. melanogaster
tttttggcagcat

SEQ ID NO: 681729 - DNA, 13 bp, D. melanogaster
tttttggcataaa

SEQ ID NO: 681730 - DNA, 14 bp, D. melanogaster
tttttggcatattt

SEQ ID NO: 681731 - DNA, 13 bp, D. melanogaster
tttttggcattcc

SEQ ID NO: 681732 - DNA, 13 bp, D. melanogaster
tttttggcatttc

SEQ ID NO: 681733 - DNA, 14 bp, D. melanogaster
tttttggcattttg

SEQ ID NO: 681734 - DNA, 14 bp, D. melanogaster
tttttggccaaaaa

SEQ ID NO: 681735 - DNA, 14 bp, D. melanogaster
tttttggccaaaat

SEQ ID NO: 681736 - DNA, 14 bp, D. melanogaster
tttttggccaaatt

SEQ ID NO: 681737 - DNA, 13 bp, D. melanogaster
tttttggccaact

SEQ ID NO: 681738 - DNA, 13 bp, D. melanogaster
tttttggccaaga

SEQ ID NO: 681739 - DNA, 13 bp, D. melanogaster
tttttggccaagc

SEQ ID NO: 681740 - DNA, 13 bp, D. melanogaster
tttttggccaata

SEQ ID NO: 681741 - DNA, 13 bp, D. melanogaster
tttttggccacaa

SEQ ID NO: 681742 - DNA, 13 bp, D. melanogaster
tttttggccacga

SEQ ID NO: 681743 - DNA, 13 bp, D. melanogaster
tttttggccagaa

SEQ ID NO: 681744 - DNA, 13 bp, D. melanogaster
tttttggccagca

SEQ ID NO: 681745 - DNA, 14 bp, D. melanogaster
tttttggccagcaa

SEQ ID NO: 681746 - DNA, 13 bp, D. melanogaster
tttttggccagcg

SEQ ID NO: 681747 - DNA, 13 bp, D. melanogaster
tttttggccagct

SEQ ID NO: 681748 - DNA, 13 bp, D. melanogaster
tttttggccaggt

SEQ ID NO: 681749 - DNA, 13 bp, D. melanogaster
tttttggccagtc

SEQ ID NO: 681750 - DNA, 13 bp, D. melanogaster
tttttggccatgc

SEQ ID NO: 681751 - DNA, 13 bp, D. melanogaster
tttttggccattg

SEQ ID NO: 681752 - DNA, 13 bp, D. melanogaster
tttttggccattt

SEQ ID NO: 681753 - DNA, 14 bp, D. melanogaster
tttttggccatttc

SEQ ID NO: 681754 - DNA, 14 bp, D. melanogaster
tttttggccatttg

SEQ ID NO: 681755 - DNA, 14 bp, D. melanogaster
tttttggcccaaaa

SEQ ID NO: 681756 - DNA, 13 bp, D. melanogaster
tttttggcccaca

SEQ ID NO: 681757 - DNA, 13 bp, D. melanogaster
tttttggccccaa

SEQ ID NO: 681758 - DNA, 13 bp, D. melanogaster
tttttggccgtgg

SEQ ID NO: 681759 - DNA, 13 bp, D. melanogaster
tttttggcgaatt

SEQ ID NO: 681760 - DNA, 13 bp, D. melanogaster
tttttggcgcatt

SEQ ID NO: 681761 - DNA, 13 bp, D. melanogaster
tttttggcgccca

SEQ ID NO: 681762 - DNA, 13 bp, D. melanogaster
tttttggcgcgca

SEQ ID NO: 681763 - DNA, 13 bp, D. melanogaster
tttttggcgctgc

SEQ ID NO: 681764 - DNA, 13 bp, D. melanogaster
tttttggcggctt

SEQ ID NO: 681765 - DNA, 13 bp, D. melanogaster
tttttggctaaat

SEQ ID NO: 681766 - DNA, 13 bp, D. melanogaster
tttttggctaatt

SEQ ID NO: 681767 - DNA, 13 bp, D. melanogaster
tttttggctatct

SEQ ID NO: 681768 - DNA, 13 bp, D. melanogaster
tttttggctgcaa

SEQ ID NO: 681769 - DNA, 13 bp, D. melanogaster
tttttggctgcag

SEQ ID NO: 681770 - DNA, 13 bp, D. melanogaster
tttttggctgcca

SEQ ID NO: 681771 - DNA, 13 bp, D. melanogaster
tttttggctgcga

SEQ ID NO: 681772 - DNA, 13 bp, D. melanogaster
tttttggctgctg

SEQ ID NO: 681773 - DNA, 13 bp, D. melanogaster
tttttggctggca

SEQ ID NO: 681774 - DNA, 13 bp, D. melanogaster
tttttggctggct

SEQ ID NO: 681775 - DNA, 13 bp, D. melanogaster
tttttggcttaaa

SEQ ID NO: 681776 - DNA, 14 bp, D. melanogaster
tttttggcttcaat

SEQ ID NO: 681777 - DNA, 13 bp, D. melanogaster
tttttggctttaa

SEQ ID NO: 681778 - DNA, 13 bp, D. melanogaster
tttttgggacatt

SEQ ID NO: 681779 - DNA, 13 bp, D. melanogaster
tttttgggatatc

SEQ ID NO: 681780 - DNA, 13 bp, D. melanogaster
tttttgggcaaac

SEQ ID NO: 681781 - DNA, 13 bp, D. melanogaster
tttttgggcaaat

SEQ ID NO: 681782 - DNA, 13 bp, D. melanogaster
tttttgggcaact

SEQ ID NO: 681783 - DNA, 13 bp, D. melanogaster
tttttgggcagca

SEQ ID NO: 681784 - DNA, 13 bp, D. melanogaster
tttttgggcagtg

SEQ ID NO: 681785 - DNA, 13 bp, D. melanogaster
tttttgggcatta

SEQ ID NO: 681786 - DNA, 13 bp, D. melanogaster
tttttgggcattc

SEQ ID NO: 681787 - DNA, 13 bp, D. melanogaster
tttttgggcattt

SEQ ID NO: 681788 - DNA, 14 bp, D. melanogaster
tttttgggcatttt

SEQ ID NO: 681789 - DNA, 13 bp, D. melanogaster
tttttgggctaat

SEQ ID NO: 681790 - DNA, 13 bp, D. melanogaster
tttttggggccaa

SEQ ID NO: 681791 - DNA, 13 bp, D. melanogaster
tttttggggccat

SEQ ID NO: 681792 - DNA, 13 bp, D. melanogaster
tttttggggccgc

SEQ ID NO: 681793 - DNA, 13 bp, D. melanogaster
tttttggggcttc

SEQ ID NO: 681794 - DNA, 14 bp, D. melanogaster
tttttgggggaaaa

SEQ ID NO: 681795 - DNA, 13 bp, D. melanogaster
tttttggggtcat

SEQ ID NO: 681796 - DNA, 13 bp, D. melanogaster
tttttgggtaaat

SEQ ID NO: 681797 - DNA, 13 bp, D. melanogaster
tttttgggtgcca

SEQ ID NO: 681798 - DNA, 13 bp, D. melanogaster
tttttgggtggca

SEQ ID NO: 681799 - DNA, 13 bp, D. melanogaster
tttttggtaaaaa

SEQ ID NO: 681800 - DNA, 13 bp, D. melanogaster
tttttggtaaatg

SEQ ID NO: 681801 - DNA, 13 bp, D. melanogaster
tttttggtacaat

SEQ ID NO: 681802 - DNA, 13 bp, D. melanogaster
tttttggtcaaaa

SEQ ID NO: 681803 - DNA, 13 bp, D. melanogaster
tttttggtcaaat

SEQ ID NO: 681804 - DNA, 13 bp, D. melanogaster
tttttggtcaact

SEQ ID NO: 681805 - DNA, 13 bp, D. melanogaster
tttttggtcattg

SEQ ID NO: 681806 - DNA, 13 bp, D. melanogaster
tttttggtgaaat

SEQ ID NO: 681807 - DNA, 13 bp, D. melanogaster
tttttggtgacgg

SEQ ID NO: 681808 - DNA, 13 bp, D. melanogaster
tttttggtggaaa

SEQ ID NO: 681809 - DNA, 14 bp, D. melanogaster
tttttggtggaaag

SEQ ID NO: 681810 - DNA, 14 bp, D. melanogaster
tttttggttgaaaa

SEQ ID NO: 681811 - DNA, 13 bp, D. melanogaster
tttttgtaaaaca

SEQ ID NO: 681812 - DNA, 13 bp, D. melanogaster
tttttgtaaaagt

SEQ ID NO: 681813 - DNA, 13 bp, D. melanogaster
tttttgtaaaatg

SEQ ID NO: 681814 - DNA, 13 bp, D. melanogaster
tttttgtaaactt

SEQ ID NO: 681815 - DNA, 14 bp, D. melanogaster
tttttgtaaacttt

SEQ ID NO: 681816 - DNA, 13 bp, D. melanogaster
tttttgtaagaaa

SEQ ID NO: 681817 - DNA, 14 bp, D. melanogaster
tttttgtaagaaaa

SEQ ID NO: 681818 - DNA, 13 bp, D. melanogaster
tttttgtaagcca

SEQ ID NO: 681819 - DNA, 13 bp, D. melanogaster
tttttgtaagtgc

SEQ ID NO: 681820 - DNA, 14 bp, D. melanogaster
tttttgtaatgcct

SEQ ID NO: 681821 - DNA, 13 bp, D. melanogaster
tttttgtacatat

SEQ ID NO: 681822 - DNA, 13 bp, D. melanogaster
tttttgtacatta

SEQ ID NO: 681823 - DNA, 13 bp, D. melanogaster
tttttgtaccatt

SEQ ID NO: 681824 - DNA, 13 bp, D. melanogaster
tttttgtacgcct

SEQ ID NO: 681825 - DNA, 13 bp, D. melanogaster
tttttgtagcata

SEQ ID NO: 681826 - DNA, 13 bp, D. melanogaster
tttttgtagcatt

SEQ ID NO: 681827 - DNA, 13 bp, D. melanogaster
tttttgtagctgc

SEQ ID NO: 681828 - DNA, 13 bp, D. melanogaster
tttttgtagtaca

SEQ ID NO: 681829 - DNA, 13 bp, D. melanogaster
tttttgtatacaa

SEQ ID NO: 681830 - DNA, 13 bp, D. melanogaster
tttttgtatgcca

SEQ ID NO: 681831 - DNA, 13 bp, D. melanogaster
tttttgtattaac

SEQ ID NO: 681832 - DNA, 13 bp, D. melanogaster
tttttgtattaca

SEQ ID NO: 681833 - DNA, 13 bp, D. melanogaster
tttttgtcaaatt

SEQ ID NO: 681834 - DNA, 13 bp, D. melanogaster
tttttgtcaactt

SEQ ID NO: 681835 - DNA, 13 bp, D. melanogaster
tttttgtcacaaa

SEQ ID NO: 681836 - DNA, 13 bp, D. melanogaster
tttttgtcacatt

SEQ ID NO: 681837 - DNA, 13 bp, D. melanogaster
tttttgtcagtgc

SEQ ID NO: 681838 - DNA, 13 bp, D. melanogaster
tttttgtcagtgt

SEQ ID NO: 681839 - DNA, 14 bp, D. melanogaster
tttttgtcagtgta

SEQ ID NO: 681840 - DNA, 14 bp, D. melanogaster
tttttgtccacttt

SEQ ID NO: 681841 - DNA, 13 bp, D. melanogaster
tttttgtcgagtg

SEQ ID NO: 681842 - DNA, 13 bp, D. melanogaster
tttttgtctaaca

SEQ ID NO: 681843 - DNA, 13 bp, D. melanogaster
tttttgtctataa

SEQ ID NO: 681844 - DNA, 13 bp, D. melanogaster
tttttgtgaaaac

SEQ ID NO: 681845 - DNA, 13 bp, D. melanogaster
tttttgtgaataa

SEQ ID NO: 681846 - DNA, 14 bp, D. melanogaster
tttttgtgcaaatt

SEQ ID NO: 681847 - DNA, 13 bp, D. melanogaster
tttttgtgcaact

SEQ ID NO: 681848 - DNA, 13 bp, D. melanogaster
tttttgtgcaatt

SEQ ID NO: 681849 - DNA, 14 bp, D. melanogaster
tttttgtgcaattt

SEQ ID NO: 681850 - DNA, 13 bp, D. melanogaster
tttttgtgccatt

SEQ ID NO: 681851 - DNA, 14 bp, D. melanogaster
tttttgtgccattt

SEQ ID NO: 681852 - DNA, 13 bp, D. melanogaster
tttttgtgcccat

SEQ ID NO: 681853 - DNA, 13 bp, D. melanogaster
tttttgtgccctc

SEQ ID NO: 681854 - DNA, 13 bp, D. melanogaster
tttttgtgcgagt

SEQ ID NO: 681855 - DNA, 13 bp, D. melanogaster
tttttgtgcggcg

SEQ ID NO: 681856 - DNA, 13 bp, D. melanogaster
tttttgtgctcat

SEQ ID NO: 681857 - DNA, 13 bp, D. melanogaster
tttttgtgctgcc

SEQ ID NO: 681858 - DNA, 13 bp, D. melanogaster
tttttgtggagaa

SEQ ID NO: 681859 - DNA, 13 bp, D. melanogaster
tttttgtggcaaa

SEQ ID NO: 681860 - DNA, 13 bp, D. melanogaster
tttttgtggcaca

SEQ ID NO: 681861 - DNA, 13 bp, D. melanogaster
tttttgtggcact

SEQ ID NO: 681862 - DNA, 13 bp, D. melanogaster
tttttgtggccaa

SEQ ID NO: 681863 - DNA, 13 bp, D. melanogaster
tttttgtggccat

SEQ ID NO: 681864 - DNA, 14 bp, D. melanogaster
tttttgtggccatt

SEQ ID NO: 681865 - DNA, 13 bp, D. melanogaster
tttttgtggcccc

SEQ ID NO: 681866 - DNA, 13 bp, D. melanogaster
tttttgtgggcca

SEQ ID NO: 681867 - DNA, 13 bp, D. melanogaster
tttttgtggtcaa

SEQ ID NO: 681868 - DNA, 13 bp, D. melanogaster
tttttgtgtaaaa

SEQ ID NO: 681869 - DNA, 14 bp, D. melanogaster
tttttgtgtaaaaa

SEQ ID NO: 681870 - DNA, 13 bp, D. melanogaster
tttttgtgtcaaa

SEQ ID NO: 681871 - DNA, 13 bp, D. melanogaster
tttttgtgtgaaa

SEQ ID NO: 681872 - DNA, 13 bp, D. melanogaster
tttttgtgtgcag

SEQ ID NO: 681873 - DNA, 13 bp, D. melanogaster
tttttgtgtgcga

SEQ ID NO: 681874 - DNA, 13 bp, D. melanogaster
tttttgtgtggcc

SEQ ID NO: 681875 - DNA, 13 bp, D. melanogaster
tttttgtgttagc

SEQ ID NO: 681876 - DNA, 13 bp, D. melanogaster
tttttgtgttgac

SEQ ID NO: 681877 - DNA, 13 bp, D. melanogaster
tttttgttcaaca

SEQ ID NO: 681878 - DNA, 13 bp, D. melanogaster
tttttgttcaaga

SEQ ID NO: 681879 - DNA, 13 bp, D. melanogaster
tttttgttcaagt

SEQ ID NO: 681880 - DNA, 13 bp, D. melanogaster
tttttgttcagtg

SEQ ID NO: 681881 - DNA, 14 bp, D. melanogaster
tttttgttcagtgc

SEQ ID NO: 681882 - DNA, 14 bp, D. melanogaster
tttttgttcagtgt

SEQ ID NO: 681883 - DNA, 14 bp, D. melanogaster
tttttgttgaactt

SEQ ID NO: 681884 - DNA, 13 bp, D. melanogaster
tttttgttgcata

SEQ ID NO: 681885 - DNA, 14 bp, D. melanogaster
tttttgttgcatac

SEQ ID NO: 681886 - DNA, 13 bp, D. melanogaster
tttttgttgccac

SEQ ID NO: 681887 - DNA, 14 bp, D. melanogaster
tttttgttgccact

SEQ ID NO: 681888 - DNA, 13 bp, D. melanogaster
tttttgttggcaa

SEQ ID NO: 681889 - DNA, 13 bp, D. melanogaster
tttttgttggcca

SEQ ID NO: 681890 - DNA, 13 bp, D. melanogaster
tttttgtttaaac

SEQ ID NO: 681891 - DNA, 14 bp, D. melanogaster
tttttgtttaaaca

SEQ ID NO: 681892 - DNA, 13 bp, D. melanogaster
tttttgtttaagc

SEQ ID NO: 681893 - DNA, 13 bp, D. melanogaster
tttttgtttagca

SEQ ID NO: 681894 - DNA, 13 bp, D. melanogaster
tttttgtttcaaa

SEQ ID NO: 681895 - DNA, 13 bp, D. melanogaster
tttttgtttccaa

SEQ ID NO: 681896 - DNA, 14 bp, D. melanogaster
tttttgtttgcaaa

SEQ ID NO: 681897 - DNA, 14 bp, D. melanogaster
tttttgttttccac

SEQ ID NO: 681898 - DNA, 14 bp, D. melanogaster
tttttgttttggca

SEQ ID NO: 681899 - DNA, 13 bp, D. melanogaster
ttttttaaaacac

SEQ ID NO: 681900 - DNA, 13 bp, D. melanogaster
ttttttaaaagcg

SEQ ID NO: 681901 - DNA, 14 bp, D. melanogaster
ttttttaaatccca

SEQ ID NO: 681902 - DNA, 13 bp, D. melanogaster
ttttttaacaaca

SEQ ID NO: 681903 - DNA, 13 bp, D. melanogaster
ttttttaacagca

SEQ ID NO: 681904 - DNA, 13 bp, D. melanogaster
ttttttaactcaa

SEQ ID NO: 681905 - DNA, 13 bp, D. melanogaster
ttttttaactgca

SEQ ID NO: 681906 - DNA, 13 bp, D. melanogaster
ttttttaagaact

SEQ ID NO: 681907 - DNA, 13 bp, D. melanogaster
ttttttaagatag

SEQ ID NO: 681908 - DNA, 13 bp, D. melanogaster
ttttttaagattc

SEQ ID NO: 681909 - DNA, 13 bp, D. melanogaster
ttttttaagcaaa

SEQ ID NO: 681910 - DNA, 13 bp, D. melanogaster
ttttttaagctga

SEQ ID NO: 681911 - DNA, 14 bp, D. melanogaster
ttttttaaggaaaa

SEQ ID NO: 681912 - DNA, 13 bp, D. melanogaster
ttttttaagtgca

SEQ ID NO: 681913 - DNA, 14 bp, D. melanogaster
ttttttaagtgcat

SEQ ID NO: 681914 - DNA, 13 bp, D. melanogaster
ttttttaatcaca

SEQ ID NO: 681915 - DNA, 13 bp, D. melanogaster
ttttttaatgact

SEQ ID NO: 681916 - DNA, 13 bp, D. melanogaster
ttttttaatgctc

SEQ ID NO: 681917 - DNA, 13 bp, D. melanogaster
ttttttacaaatc

SEQ ID NO: 681918 - DNA, 13 bp, D. melanogaster
ttttttacaatgg

SEQ ID NO: 681919 - DNA, 13 bp, D. melanogaster
ttttttacacaat

SEQ ID NO: 681920 - DNA, 13 bp, D. melanogaster
ttttttacagctt

SEQ ID NO: 681921 - DNA, 13 bp, D. melanogaster
ttttttaccaaat

SEQ ID NO: 681922 - DNA, 13 bp, D. melanogaster
ttttttacccaaa

SEQ ID NO: 681923 - DNA, 13 bp, D. melanogaster
ttttttacgatta

SEQ ID NO: 681924 - DNA, 13 bp, D. melanogaster
ttttttagaaatg

SEQ ID NO: 681925 - DNA, 13 bp, D. melanogaster
ttttttagaattc

SEQ ID NO: 681926 - DNA, 13 bp, D. melanogaster
ttttttagagtgc

SEQ ID NO: 681927 - DNA, 13 bp, D. melanogaster
ttttttagcaaaa

SEQ ID NO: 681928 - DNA, 14 bp, D. melanogaster
ttttttagccattt

SEQ ID NO: 681929 - DNA, 13 bp, D. melanogaster
ttttttagttggc

SEQ ID NO: 681930 - DNA, 13 bp, D. melanogaster
ttttttataaacc

SEQ ID NO: 681931 - DNA, 13 bp, D. melanogaster
ttttttatagcaa

SEQ ID NO: 681932 - DNA, 13 bp, D. melanogaster
ttttttatcacaa

SEQ ID NO: 681933 - DNA, 13 bp, D. melanogaster
ttttttatgaaga

SEQ ID NO: 681934 - DNA, 13 bp, D. melanogaster
ttttttatgcgac

SEQ ID NO: 681935 - DNA, 13 bp, D. melanogaster
ttttttatggcct

SEQ ID NO: 681936 - DNA, 13 bp, D. melanogaster
ttttttattcagc

SEQ ID NO: 681937 - DNA, 13 bp, D. melanogaster
ttttttattgcca

SEQ ID NO: 681938 - DNA, 14 bp, D. melanogaster
ttttttcaaaactg

SEQ ID NO: 681939 - DNA, 13 bp, D. melanogaster
ttttttcaaattg

SEQ ID NO: 681940 - DNA, 13 bp, D. melanogaster
ttttttcaataca

SEQ ID NO: 681941 - DNA, 13 bp, D. melanogaster
ttttttcaatgag

SEQ ID NO: 681942 - DNA, 13 bp, D. melanogaster
ttttttcaatgtg

SEQ ID NO: 681943 - DNA, 14 bp, D. melanogaster
ttttttcaatttgc

SEQ ID NO: 681944 - DNA, 13 bp, D. melanogaster
ttttttcacaaaa

SEQ ID NO: 681945 - DNA, 13 bp, D. melanogaster
ttttttcacaaat

SEQ ID NO: 681946 - DNA, 14 bp, D. melanogaster
ttttttcactgtgc

SEQ ID NO: 681947 - DNA, 13 bp, D. melanogaster
ttttttcagtgca

SEQ ID NO: 681948 - DNA, 14 bp, D. melanogaster
ttttttcagtgcac

SEQ ID NO: 681949 - DNA, 14 bp, D. melanogaster
ttttttcagtgtag

SEQ ID NO: 681950 - DNA, 13 bp, D. melanogaster
ttttttccaaata

SEQ ID NO: 681951 - DNA, 13 bp, D. melanogaster
ttttttccaacaa

SEQ ID NO: 681952 - DNA, 13 bp, D. melanogaster
ttttttccaactc

SEQ ID NO: 681953 - DNA, 13 bp, D. melanogaster
ttttttccaagtg

SEQ ID NO: 681954 - DNA, 13 bp, D. melanogaster
ttttttccaccat

SEQ ID NO: 681955 - DNA, 13 bp, D. melanogaster
ttttttccaccgc

SEQ ID NO: 681956 - DNA, 13 bp, D. melanogaster
ttttttccagccc

SEQ ID NO: 681957 - DNA, 14 bp, D. melanogaster
ttttttccagtgca

SEQ ID NO: 681958 - DNA, 13 bp, D. melanogaster
ttttttccatcaa

SEQ ID NO: 681959 - DNA, 13 bp, D. melanogaster
ttttttcccaaat

SEQ ID NO: 681960 - DNA, 13 bp, D. melanogaster
ttttttccccaat

SEQ ID NO: 681961 - DNA, 13 bp, D. melanogaster
ttttttccccagc

SEQ ID NO: 681962 - DNA, 13 bp, D. melanogaster
ttttttcccccag

SEQ ID NO: 681963 - DNA, 13 bp, D. melanogaster
ttttttccgtgga

SEQ ID NO: 681964 - DNA, 13 bp, D. melanogaster
ttttttccgtgta

SEQ ID NO: 681965 - DNA, 13 bp, D. melanogaster
ttttttcctggca

SEQ ID NO: 681966 - DNA, 13 bp, D. melanogaster
ttttttcgaaaac

SEQ ID NO: 681967 - DNA, 13 bp, D. melanogaster
ttttttcgaaaag

SEQ ID NO: 681968 - DNA, 13 bp, D. melanogaster
ttttttcgaactt

SEQ ID NO: 681969 - DNA, 13 bp, D. melanogaster
ttttttcgacatt

SEQ ID NO: 681970 - DNA, 13 bp, D. melanogaster
ttttttcgaccgc

SEQ ID NO: 681971 - DNA, 14 bp, D. melanogaster
ttttttcgagtgca

SEQ ID NO: 681972 - DNA, 13 bp, D. melanogaster
ttttttcgagtgt

SEQ ID NO: 681973 - DNA, 13 bp, D. melanogaster
ttttttcgatctc

SEQ ID NO: 681974 - DNA, 13 bp, D. melanogaster
ttttttcgcattg

SEQ ID NO: 681975 - DNA, 13 bp, D. melanogaster
ttttttcgccgct

SEQ ID NO: 681976 - DNA, 14 bp, D. melanogaster
ttttttcggctgcc

SEQ ID NO: 681977 - DNA, 13 bp, D. melanogaster
ttttttcggtgca

SEQ ID NO: 681978 - DNA, 13 bp, D. melanogaster
ttttttcggtggc

SEQ ID NO: 681979 - DNA, 13 bp, D. melanogaster
ttttttcggtgta

SEQ ID NO: 681980 - DNA, 13 bp, D. melanogaster
ttttttcggttga

SEQ ID NO: 681981 - DNA, 13 bp, D. melanogaster
ttttttcgtatca

SEQ ID NO: 681982 - DNA, 13 bp, D. melanogaster
ttttttcgtcact

SEQ ID NO: 681983 - DNA, 13 bp, D. melanogaster
ttttttctcaaaa

SEQ ID NO: 681984 - DNA, 13 bp, D. melanogaster
ttttttctcagct

SEQ ID NO: 681985 - DNA, 13 bp, D. melanogaster
ttttttctctgag

SEQ ID NO: 681986 - DNA, 13 bp, D. melanogaster
ttttttctgaaaa

SEQ ID NO: 681987 - DNA, 13 bp, D. melanogaster
ttttttctgcaat

SEQ ID NO: 681988 - DNA, 13 bp, D. melanogaster
ttttttctgccca

SEQ ID NO: 681989 - DNA, 13 bp, D. melanogaster
ttttttctgctga

SEQ ID NO: 681990 - DNA, 13 bp, D. melanogaster
ttttttctggcca

SEQ ID NO: 681991 - DNA, 13 bp, D. melanogaster
ttttttctgtgaa

SEQ ID NO: 681992 - DNA, 14 bp, D. melanogaster
ttttttgaaaacac

SEQ ID NO: 681993 - DNA, 13 bp, D. melanogaster
ttttttgaaacac

SEQ ID NO: 681994 - DNA, 13 bp, D. melanogaster
ttttttgacaaat

SEQ ID NO: 681995 - DNA, 14 bp, D. melanogaster
ttttttgacaaatt

SEQ ID NO: 681996 - DNA, 13 bp, D. melanogaster
ttttttgacaatt

SEQ ID NO: 681997 - DNA, 13 bp, D. melanogaster
ttttttgacacat

SEQ ID NO: 681998 - DNA, 13 bp, D. melanogaster
ttttttgagaaaa

SEQ ID NO: 681999 - DNA, 13 bp, D. melanogaster
ttttttgagaaat

SEQ ID NO: 682000 - DNA, 13 bp, D. melanogaster
ttttttgataagc

SEQ ID NO: 682001 - DNA, 13 bp, D. melanogaster
ttttttgatgctg

SEQ ID NO: 682002 - DNA, 14 bp, D. melanogaster
ttttttgcaaaatt

SEQ ID NO: 682003 - DNA, 13 bp, D. melanogaster
ttttttgcaaaca

SEQ ID NO: 682004 - DNA, 13 bp, D. melanogaster
ttttttgcaaact

SEQ ID NO: 682005 - DNA, 13 bp, D. melanogaster
ttttttgcaaatc

SEQ ID NO: 682006 - DNA, 13 bp, D. melanogaster
ttttttgcaataa

SEQ ID NO: 682007 - DNA, 13 bp, D. melanogaster
ttttttgcaattc

SEQ ID NO: 682008 - DNA, 13 bp, D. melanogaster
ttttttgcacacc

SEQ ID NO: 682009 - DNA, 13 bp, D. melanogaster
ttttttgcacaga

SEQ ID NO: 682010 - DNA, 13 bp, D. melanogaster
ttttttgcacagc

SEQ ID NO: 682011 - DNA, 13 bp, D. melanogaster
ttttttgcacatc

SEQ ID NO: 682012 - DNA, 13 bp, D. melanogaster
ttttttgcacatt

SEQ ID NO: 682013 - DNA, 13 bp, D. melanogaster
ttttttgcagcac

SEQ ID NO: 682014 - DNA, 13 bp, D. melanogaster
ttttttgcagtgc

SEQ ID NO: 682015 - DNA, 13 bp, D. melanogaster
ttttttgcataaa

SEQ ID NO: 682016 - DNA, 13 bp, D. melanogaster
ttttttgcataat

SEQ ID NO: 682017 - DNA, 14 bp, D. melanogaster
ttttttgcatttca

SEQ ID NO: 682018 - DNA, 13 bp, D. melanogaster
ttttttgccaacg

SEQ ID NO: 682019 - DNA, 14 bp, D. melanogaster
ttttttgccaattt

SEQ ID NO: 682020 - DNA, 13 bp, D. melanogaster
ttttttgccagtt

SEQ ID NO: 682021 - DNA, 13 bp, D. melanogaster
ttttttgccatat

SEQ ID NO: 682022 - DNA, 14 bp, D. melanogaster
ttttttgccatatt

SEQ ID NO: 682023 - DNA, 13 bp, D. melanogaster
ttttttgccatcc

SEQ ID NO: 682024 - DNA, 13 bp, D. melanogaster
ttttttgcccaac

SEQ ID NO: 682025 - DNA, 13 bp, D. melanogaster
ttttttgcccacg

SEQ ID NO: 682026 - DNA, 13 bp, D. melanogaster
ttttttgcccagc

SEQ ID NO: 682027 - DNA, 14 bp, D. melanogaster
ttttttgcccatgt

SEQ ID NO: 682028 - DNA, 13 bp, D. melanogaster
ttttttgcctgca

SEQ ID NO: 682029 - DNA, 13 bp, D. melanogaster
ttttttgcgactg

SEQ ID NO: 682030 - DNA, 13 bp, D. melanogaster
ttttttgctgata

SEQ ID NO: 682031 - DNA, 14 bp, D. melanogaster
ttttttgctgcatt

SEQ ID NO: 682032 - DNA, 13 bp, D. melanogaster
ttttttgctgcca

SEQ ID NO: 682033 - DNA, 13 bp, D. melanogaster
ttttttgctgccc

SEQ ID NO: 682034 - DNA, 14 bp, D. melanogaster
ttttttgctgctgc

SEQ ID NO: 682035 - DNA, 13 bp, D. melanogaster
ttttttgctgtga

SEQ ID NO: 682036 - DNA, 14 bp, D. melanogaster
ttttttgctgtgta

SEQ ID NO: 682037 - DNA, 13 bp, D. melanogaster
ttttttggaaaat

SEQ ID NO: 682038 - DNA, 13 bp, D. melanogaster
ttttttggacaca

SEQ ID NO: 682039 - DNA, 13 bp, D. melanogaster
ttttttggaccac

SEQ ID NO: 682040 - DNA, 13 bp, D. melanogaster
ttttttggaccga

SEQ ID NO: 682041 - DNA, 13 bp, D. melanogaster
ttttttggcaaaa

SEQ ID NO: 682042 - DNA, 14 bp, D. melanogaster
ttttttggcaaaaa

SEQ ID NO: 682043 - DNA, 13 bp, D. melanogaster
ttttttggcaaca

SEQ ID NO: 682044 - DNA, 14 bp, D. melanogaster
ttttttggcaattt

SEQ ID NO: 682045 - DNA, 13 bp, D. melanogaster
ttttttggcagca

SEQ ID NO: 682046 - DNA, 13 bp, D. melanogaster
ttttttggcagcc

SEQ ID NO: 682047 - DNA, 14 bp, D. melanogaster
ttttttggcagcca

SEQ ID NO: 682048 - DNA, 14 bp, D. melanogaster
ttttttggcatttc

SEQ ID NO: 682049 - DNA, 14 bp, D. melanogaster
ttttttggccaact

SEQ ID NO: 682050 - DNA, 14 bp, D. melanogaster
ttttttggccacaa

SEQ ID NO: 682051 - DNA, 13 bp, D. melanogaster
ttttttggccacg

SEQ ID NO: 682052 - DNA, 14 bp, D. melanogaster
ttttttggccaggt

SEQ ID NO: 682053 - DNA, 13 bp, D. melanogaster
ttttttggccata

SEQ ID NO: 682054 - DNA, 14 bp, D. melanogaster
ttttttggccataa

SEQ ID NO: 682055 - DNA, 13 bp, D. melanogaster
ttttttggcccac

SEQ ID NO: 682056 - DNA, 13 bp, D. melanogaster
ttttttggccgcc

SEQ ID NO: 682057 - DNA, 13 bp, D. melanogaster
ttttttggcgaaa

SEQ ID NO: 682058 - DNA, 13 bp, D. melanogaster
ttttttggctgcc

SEQ ID NO: 682059 - DNA, 14 bp, D. melanogaster
ttttttggctgcca

SEQ ID NO: 682060 - DNA, 13 bp, D. melanogaster
ttttttggctggc

SEQ ID NO: 682061 - DNA, 13 bp, D. melanogaster
ttttttgggaaag

SEQ ID NO: 682062 - DNA, 13 bp, D. melanogaster
ttttttgggaaat

SEQ ID NO: 682063 - DNA, 13 bp, D. melanogaster
ttttttgggcaaa

SEQ ID NO: 682064 - DNA, 13 bp, D. melanogaster
ttttttggggaaa

SEQ ID NO: 682065 - DNA, 13 bp, D. melanogaster
ttttttggggtca

SEQ ID NO: 682066 - DNA, 13 bp, D. melanogaster
ttttttggtggca

SEQ ID NO: 682067 - DNA, 13 bp, D. melanogaster
ttttttggttgca

SEQ ID NO: 682068 - DNA, 13 bp, D. melanogaster
ttttttgtaaaca

SEQ ID NO: 682069 - DNA, 13 bp, D. melanogaster
ttttttgtacaca

SEQ ID NO: 682070 - DNA, 13 bp, D. melanogaster
ttttttgtacata

SEQ ID NO: 682071 - DNA, 13 bp, D. melanogaster
ttttttgtagctg

SEQ ID NO: 682072 - DNA, 14 bp, D. melanogaster
ttttttgtataaca

SEQ ID NO: 682073 - DNA, 13 bp, D. melanogaster
ttttttgtcaact

SEQ ID NO: 682074 - DNA, 13 bp, D. melanogaster
ttttttgtccaaa

SEQ ID NO: 682075 - DNA, 13 bp, D. melanogaster
ttttttgtgcact

SEQ ID NO: 682076 - DNA, 13 bp, D. melanogaster
ttttttgtgcagc

SEQ ID NO: 682077 - DNA, 13 bp, D. melanogaster
ttttttgtgccat

SEQ ID NO: 682078 - DNA, 13 bp, D. melanogaster
ttttttgtgctca

SEQ ID NO: 682079 - DNA, 13 bp, D. melanogaster
ttttttgtggcag

SEQ ID NO: 682080 - DNA, 14 bp, D. melanogaster
ttttttgtggccaa

SEQ ID NO: 682081 - DNA, 13 bp, D. melanogaster
ttttttgtgggca

SEQ ID NO: 682082 - DNA, 13 bp, D. melanogaster
ttttttgtggtca

SEQ ID NO: 682083 - DNA, 13 bp, D. melanogaster
ttttttgtgtacc

SEQ ID NO: 682084 - DNA, 13 bp, D. melanogaster
ttttttgttagcc

SEQ ID NO: 682085 - DNA, 14 bp, D. melanogaster
ttttttgttggcca

SEQ ID NO: 682086 - DNA, 13 bp, D. melanogaster
tttttttaaacac

SEQ ID NO: 682087 - DNA, 13 bp, D. melanogaster
tttttttacaaca

SEQ ID NO: 682088 - DNA, 13 bp, D. melanogaster
tttttttacccca

SEQ ID NO: 682089 - DNA, 13 bp, D. melanogaster
tttttttatgaca

SEQ ID NO: 682090 - DNA, 13 bp, D. melanogaster
tttttttatgccc

SEQ ID NO: 682091 - DNA, 14 bp, D. melanogaster
tttttttatgtgca

SEQ ID NO: 682092 - DNA, 14 bp, D. melanogaster
tttttttcaaaaac

SEQ ID NO: 682093 - DNA, 14 bp, D. melanogaster
tttttttcacaaaa

SEQ ID NO: 682094 - DNA, 13 bp, D. melanogaster
tttttttcacagt

SEQ ID NO: 682095 - DNA, 13 bp, D. melanogaster
tttttttcagtgc

SEQ ID NO: 682096 - DNA, 14 bp, D. melanogaster
tttttttcagtgta

SEQ ID NO: 682097 - DNA, 13 bp, D. melanogaster
tttttttccaaaa

SEQ ID NO: 682098 - DNA, 14 bp, D. melanogaster
tttttttccaagtg

SEQ ID NO: 682099 - DNA, 13 bp, D. melanogaster
tttttttccacca

SEQ ID NO: 682100 - DNA, 13 bp, D. melanogaster
tttttttccagct

SEQ ID NO: 682101 - DNA, 13 bp, D. melanogaster
tttttttccagtg

SEQ ID NO: 682102 - DNA, 14 bp, D. melanogaster
tttttttccagtgc

SEQ ID NO: 682103 - DNA, 13 bp, D. melanogaster
tttttttccgact

SEQ ID NO: 682104 - DNA, 13 bp, D. melanogaster
tttttttcgaaat

SEQ ID NO: 682105 - DNA, 13 bp, D. melanogaster
tttttttcgagtg

SEQ ID NO: 682106 - DNA, 14 bp, D. melanogaster
tttttttcgagtgt

SEQ ID NO: 682107 - DNA, 13 bp, D. melanogaster
tttttttcgcaca

SEQ ID NO: 682108 - DNA, 13 bp, D. melanogaster
tttttttcgccag

SEQ ID NO: 682109 - DNA, 13 bp, D. melanogaster
tttttttcgccgc

SEQ ID NO: 682110 - DNA, 13 bp, D. melanogaster
tttttttcgctga

SEQ ID NO: 682111 - DNA, 13 bp, D. melanogaster
tttttttcggcaa

SEQ ID NO: 682112 - DNA, 13 bp, D. melanogaster
tttttttcggcca

SEQ ID NO: 682113 - DNA, 13 bp, D. melanogaster
tttttttcggcta

SEQ ID NO: 682114 - DNA, 13 bp, D. melanogaster
tttttttcggggc

SEQ ID NO: 682115 - DNA, 13 bp, D. melanogaster
tttttttcgtaaa

SEQ ID NO: 682116 - DNA, 13 bp, D. melanogaster
tttttttgaaaag

SEQ ID NO: 682117 - DNA, 13 bp, D. melanogaster
tttttttgaaaca

SEQ ID NO: 682118 - DNA, 13 bp, D. melanogaster
tttttttgacaat

SEQ ID NO: 682119 - DNA, 13 bp, D. melanogaster
tttttttgacacc

SEQ ID NO: 682120 - DNA, 13 bp, D. melanogaster
tttttttgagcag

SEQ ID NO: 682121 - DNA, 14 bp, D. melanogaster
tttttttgagtgca

SEQ ID NO: 682122 - DNA, 14 bp, D. melanogaster
tttttttgcaaatc

SEQ ID NO: 682123 - DNA, 13 bp, D. melanogaster
tttttttgcactg

SEQ ID NO: 682124 - DNA, 14 bp, D. melanogaster
tttttttgcataaa

SEQ ID NO: 682125 - DNA, 13 bp, D. melanogaster
tttttttgccatc

SEQ ID NO: 682126 - DNA, 13 bp, D. melanogaster
tttttttgcccag

SEQ ID NO: 682127 - DNA, 13 bp, D. melanogaster
tttttttgccgaa

SEQ ID NO: 682128 - DNA, 13 bp, D. melanogaster
tttttttgccgcc

SEQ ID NO: 682129 - DNA, 13 bp, D. melanogaster
tttttttgccggc

SEQ ID NO: 682130 - DNA, 13 bp, D. melanogaster
tttttttgcgagt

SEQ ID NO: 682131 - DNA, 13 bp, D. melanogaster
tttttttggaaaa

SEQ ID NO: 682132 - DNA, 13 bp, D. melanogaster
tttttttggaaag

SEQ ID NO: 682133 - DNA, 13 bp, D. melanogaster
tttttttggaagc

SEQ ID NO: 682134 - DNA, 13 bp, D. melanogaster
tttttttggagga

SEQ ID NO: 682135 - DNA, 13 bp, D. melanogaster
tttttttggcaac

SEQ ID NO: 682136 - DNA, 13 bp, D. melanogaster
tttttttggcaat

SEQ ID NO: 682137 - DNA, 14 bp, D. melanogaster
tttttttggcaatt

SEQ ID NO: 682138 - DNA, 13 bp, D. melanogaster
tttttttggcacg

SEQ ID NO: 682139 - DNA, 13 bp, D. melanogaster
tttttttggcact

SEQ ID NO: 682140 - DNA, 13 bp, D. melanogaster
tttttttggccac

SEQ ID NO: 682141 - DNA, 13 bp, D. melanogaster
tttttttggcccc

SEQ ID NO: 682142 - DNA, 13 bp, D. melanogaster
tttttttggccga

SEQ ID NO: 682143 - DNA, 13 bp, D. melanogaster
tttttttgggaaa

SEQ ID NO: 682144 - DNA, 13 bp, D. melanogaster
tttttttgggcaa

SEQ ID NO: 682145 - DNA, 14 bp, D. melanogaster
tttttttgggcaaa

SEQ ID NO: 682146 - DNA, 13 bp, D. melanogaster
tttttttgggcca

SEQ ID NO: 682147 - DNA, 13 bp, D. melanogaster
tttttttggggaa

SEQ ID NO: 682148 - DNA, 13 bp, D. melanogaster
tttttttggggcc

SEQ ID NO: 682149 - DNA, 13 bp, D. melanogaster
tttttttggtgac

SEQ ID NO: 682150 - DNA, 13 bp, D. melanogaster
tttttttgtacaa

SEQ ID NO: 682151 - DNA, 13 bp, D. melanogaster
tttttttgtacca

SEQ ID NO: 682152 - DNA, 13 bp, D. melanogaster
tttttttgtcaca

SEQ ID NO: 682153 - DNA, 13 bp, D. melanogaster
tttttttgtgcaa

SEQ ID NO: 682154 - DNA, 14 bp, D. melanogaster
tttttttgttacca

SEQ ID NO: 682155 - DNA, 13 bp, D. melanogaster
ttttttttaaagc

SEQ ID NO: 682156 - DNA, 14 bp, D. melanogaster
ttttttttacaatg

SEQ ID NO: 682157 - DNA, 13 bp, D. melanogaster
ttttttttacgaa

SEQ ID NO: 682158 - DNA, 13 bp, D. melanogaster
ttttttttagccg

SEQ ID NO: 682159 - DNA, 13 bp, D. melanogaster
ttttttttagcga

SEQ ID NO: 682160 - DNA, 14 bp, D. melanogaster
ttttttttatcagc

SEQ ID NO: 682161 - DNA, 13 bp, D. melanogaster
ttttttttcaaag

SEQ ID NO: 682162 - DNA, 14 bp, D. melanogaster
ttttttttcaagtg

SEQ ID NO: 682163 - DNA, 13 bp, D. melanogaster
ttttttttcagaa

SEQ ID NO: 682164 - DNA, 13 bp, D. melanogaster
ttttttttcagcc

SEQ ID NO: 682165 - DNA, 14 bp, D. melanogaster
ttttttttcagtgc

SEQ ID NO: 682166 - DNA, 14 bp, D. melanogaster
ttttttttccagtg

SEQ ID NO: 682167 - DNA, 13 bp, D. melanogaster
ttttttttcgaaa

SEQ ID NO: 682168 - DNA, 14 bp, D. melanogaster
ttttttttcgaaat

SEQ ID NO: 682169 - DNA, 13 bp, D. melanogaster
ttttttttcgcac

SEQ ID NO: 682170 - DNA, 14 bp, D. melanogaster
ttttttttcgcaca

SEQ ID NO: 682171 - DNA, 14 bp, D. melanogaster
ttttttttcggaat

SEQ ID NO: 682172 - DNA, 13 bp, D. melanogaster
ttttttttcggac

SEQ ID NO: 682173 - DNA, 13 bp, D. melanogaster
ttttttttgacag

SEQ ID NO: 682174 - DNA, 13 bp, D. melanogaster
ttttttttgcaaa

SEQ ID NO: 682175 - DNA, 14 bp, D. melanogaster
ttttttttgcaaaa

SEQ ID NO: 682176 - DNA, 13 bp, D. melanogaster
ttttttttgcaca

SEQ ID NO: 682177 - DNA, 14 bp, D. melanogaster
ttttttttgcacag

SEQ ID NO: 682178 - DNA, 13 bp, D. melanogaster
ttttttttgcaga

SEQ ID NO: 682179 - DNA, 13 bp, D. melanogaster
ttttttttgccca

SEQ ID NO: 682180 - DNA, 14 bp, D. melanogaster
ttttttttgcccag

SEQ ID NO: 682181 - DNA, 13 bp, D. melanogaster
ttttttttgcgaa

SEQ ID NO: 682182 - DNA, 14 bp, D. melanogaster
ttttttttgcgaac

SEQ ID NO: 682183 - DNA, 14 bp, D. melanogaster
ttttttttgctgaa

SEQ ID NO: 682184 - DNA, 13 bp, D. melanogaster
ttttttttggaac

SEQ ID NO: 682185 - DNA, 13 bp, D. melanogaster
ttttttttggcaa

SEQ ID NO: 682186 - DNA, 14 bp, D. melanogaster
ttttttttggcata

SEQ ID NO: 682187 - DNA, 13 bp, D. melanogaster
ttttttttggcca

SEQ ID NO: 682188 - DNA, 14 bp, D. melanogaster
ttttttttggccac

SEQ ID NO: 682189 - DNA, 14 bp, D. melanogaster
ttttttttggccca

SEQ ID NO: 682190 - DNA, 14 bp, D. melanogaster
ttttttttggcccg

SEQ ID NO: 682191 - DNA, 14 bp, D. melanogaster
tttttttttaaagc

SEQ ID NO: 682192 - DNA, 14 bp, D. melanogaster
tttttttttagcca

SEQ ID NO: 682193 - DNA, 14 bp, D. melanogaster
tttttttttccaag

SEQ ID NO: 682194 - DNA, 14 bp, D. melanogaster
tttttttttcgaaa

SEQ ID NO: 682195 - DNA, 14 bp, D. melanogaster
tttttttttcggca

SEQ ID NO: 682196 - DNA, 14 bp, D. melanogaster
tttttttttgaagc

SEQ ID NO: 682197 - DNA, 14 bp, D. melanogaster
tttttttttgacaa

SEQ ID NO: 682198 - DNA, 14 bp, D. melanogaster
tttttttttgcaaa

SEQ ID NO: 682199 - DNA, 14 bp, D. melanogaster
tttttttttgcaga

SEQ ID NO: 682200 - DNA, 14 bp, D. melanogaster
tttttttttgccaa

SEQ ID NO: 682201 - DNA, 14 bp, D. melanogaster
tttttttttgccca

SEQ ID NO: 682202 - DNA, 14 bp, D. melanogaster
tttttttttgccga

SEQ ID NO: 682203 - DNA, 14 bp, D. melanogaster
tttttttttgcgaa

SEQ ID NO: 682204 - DNA, 14 bp, D. melanogaster
tttttttttggaac

SEQ ID NO: 682205 - DNA, 14 bp, D. melanogaster
tttttttttggcaa

SEQ ID NO: 682206 - DNA, 14 bp, D. melanogaster
tttttttttggcca

SEQ ID NO: 682207 - DNA, 13 bp, C. elegans
aaaaaaaactgtc

SEQ ID NO: 682208 - DNA, 13 bp, C. elegans
aaaaaaaactgtt

SEQ ID NO: 682209 - DNA, 13 bp, C. elegans
aaaaaaaacttgc

SEQ ID NO: 682210 - DNA, 13 bp, C. elegans
aaaaaaaacttgt

SEQ ID NO: 682211 - DNA, 13 bp, C. elegans
aaaaaaaagttcg

SEQ ID NO: 682212 - DNA, 13 bp, C. elegans
aaaaaaaagtttc

SEQ ID NO: 682213 - DNA, 13 bp, C. elegans
aaaaaaaatcggt

SEQ ID NO: 682214 - DNA, 13 bp, C. elegans
aaaaaaaatttcg

SEQ ID NO: 682215 - DNA, 13 bp, C. elegans
aaaaaaacagtgt

SEQ ID NO: 682216 - DNA, 13 bp, C. elegans
aaaaaaacatgct

SEQ ID NO: 682217 - DNA, 13 bp, C. elegans
aaaaaaacctctc

SEQ ID NO: 682218 - DNA, 13 bp, C. elegans
aaaaaaacgattg

SEQ ID NO: 682219 - DNA, 13 bp, C. elegans
aaaaaaacgtatt

SEQ ID NO: 682220 - DNA, 13 bp, C. elegans
aaaaaaacgtttt

SEQ ID NO: 682221 - DNA, 13 bp, C. elegans
aaaaaaactgtca

SEQ ID NO: 682222 - DNA, 13 bp, C. elegans
aaaaaaactgtga

SEQ ID NO: 682223 - DNA, 13 bp, C. elegans
aaaaaaacttcag

SEQ ID NO: 682224 - DNA, 13 bp, C. elegans
aaaaaaacttgcc

SEQ ID NO: 682225 - DNA, 13 bp, C. elegans
aaaaaaactttga

SEQ ID NO: 682226 - DNA, 13 bp, C. elegans
aaaaaaacttttc

SEQ ID NO: 682227 - DNA, 13 bp, C. elegans
aaaaaaagacttt

SEQ ID NO: 682228 - DNA, 13 bp, C. elegans
aaaaaaagcttga

SEQ ID NO: 682229 - DNA, 13 bp, C. elegans
aaaaaaagggttc

SEQ ID NO: 682230 - DNA, 13 bp, C. elegans
aaaaaaaggtttc

SEQ ID NO: 682231 - DNA, 13 bp, C. elegans
aaaaaaagtccca

SEQ ID NO: 682232 - DNA, 13 bp, C. elegans
aaaaaaagtcgat

SEQ ID NO: 682233 - DNA, 13 bp, C. elegans
aaaaaaagtcgtg

SEQ ID NO: 682234 - DNA, 13 bp, C. elegans
aaaaaaagtgttc

SEQ ID NO: 682235 - DNA, 13 bp, C. elegans
aaaaaaagttact

SEQ ID NO: 682236 - DNA, 13 bp, C. elegans
aaaaaaagttgtt

SEQ ID NO: 682237 - DNA, 13 bp, C. elegans
aaaaaaagtttct

SEQ ID NO: 682238 - DNA, 13 bp, C. elegans
aaaaaaagttttc

SEQ ID NO: 682239 - DNA, 13 bp, C. elegans
aaaaaaagttttg

SEQ ID NO: 682240 - DNA, 14 bp, C. elegans
aaaaaaatcagttt

SEQ ID NO: 682241 - DNA, 13 bp, C. elegans
aaaaaaatccgat

SEQ ID NO: 682242 - DNA, 13 bp, C. elegans
aaaaaaatccttc

SEQ ID NO: 682243 - DNA, 13 bp, C. elegans
aaaaaaatcgagt

SEQ ID NO: 682244 - DNA, 13 bp, C. elegans
aaaaaaatcggga

SEQ ID NO: 682245 - DNA, 13 bp, C. elegans
aaaaaaatcggtg

SEQ ID NO: 682246 - DNA, 13 bp, C. elegans
aaaaaaatcgtat

SEQ ID NO: 682247 - DNA, 13 bp, C. elegans
aaaaaaatcgttt

SEQ ID NO: 682248 - DNA, 13 bp, C. elegans
aaaaaaatctcga

SEQ ID NO: 682249 - DNA, 13 bp, C. elegans
aaaaaaatgccca

SEQ ID NO: 682250 - DNA, 13 bp, C. elegans
aaaaaaatgcggg

SEQ ID NO: 682251 - DNA, 13 bp, C. elegans
aaaaaaatggtgg

SEQ ID NO: 682252 - DNA, 13 bp, C. elegans
aaaaaaatggttt

SEQ ID NO: 682253 - DNA, 13 bp, C. elegans
aaaaaaatgtcca

SEQ ID NO: 682254 - DNA, 13 bp, C. elegans
aaaaaaatgttca

SEQ ID NO: 682255 - DNA, 13 bp, C. elegans
aaaaaaatgttct

SEQ ID NO: 682256 - DNA, 13 bp, C. elegans
aaaaaaattcagg

SEQ ID NO: 682257 - DNA, 13 bp, C. elegans
aaaaaaattggca

SEQ ID NO: 682258 - DNA, 13 bp, C. elegans
aaaaaaattgtcc

SEQ ID NO: 682259 - DNA, 13 bp, C. elegans
aaaaaaattgtcg

SEQ ID NO: 682260 - DNA, 13 bp, C. elegans
aaaaaaattgtct

SEQ ID NO: 682261 - DNA, 13 bp, C. elegans
aaaaaaatttctg

SEQ ID NO: 682262 - DNA, 13 bp, C. elegans
aaaaaaattttgg

SEQ ID NO: 682263 - DNA, 13 bp, C. elegans
aaaaaacaactgg

SEQ ID NO: 682264 - DNA, 13 bp, C. elegans
aaaaaacaagttc

SEQ ID NO: 682265 - DNA, 13 bp, C. elegans
aaaaaacaagttt

SEQ ID NO: 682266 - DNA, 13 bp, C. elegans
aaaaaacacattg

SEQ ID NO: 682267 - DNA, 13 bp, C. elegans
aaaaaacacgttt

SEQ ID NO: 682268 - DNA, 13 bp, C. elegans
aaaaaacactgat

SEQ ID NO: 682269 - DNA, 13 bp, C. elegans
aaaaaacagttat

SEQ ID NO: 682270 - DNA, 13 bp, C. elegans
aaaaaacatcgta

SEQ ID NO: 682271 - DNA, 13 bp, C. elegans
aaaaaacatgtat

SEQ ID NO: 682272 - DNA, 13 bp, C. elegans
aaaaaacatgtga

SEQ ID NO: 682273 - DNA, 13 bp, C. elegans
aaaaaacattttc

SEQ ID NO: 682274 - DNA, 13 bp, C. elegans
aaaaaaccaattg

SEQ ID NO: 682275 - DNA, 13 bp, C. elegans
aaaaaaccacgtg

SEQ ID NO: 682276 - DNA, 13 bp, C. elegans
aaaaaaccattga

SEQ ID NO: 682277 - DNA, 13 bp, C. elegans
aaaaaaccatttt

SEQ ID NO: 682278 - DNA, 13 bp, C. elegans
aaaaaacccattt

SEQ ID NO: 682279 - DNA, 13 bp, C. elegans
aaaaaaccgtgtt

SEQ ID NO: 682280 - DNA, 13 bp, C. elegans
aaaaaacctgaac

SEQ ID NO: 682281 - DNA, 13 bp, C. elegans
aaaaaaccttcca

SEQ ID NO: 682282 - DNA, 13 bp, C. elegans
aaaaaacctttta

SEQ ID NO: 682283 - DNA, 13 bp, C. elegans
aaaaaacgagtta

SEQ ID NO: 682284 - DNA, 13 bp, C. elegans
aaaaaacgattgt

SEQ ID NO: 682285 - DNA, 13 bp, C. elegans
aaaaaacgatttt

SEQ ID NO: 682286 - DNA, 13 bp, C. elegans
aaaaaacgcaatt

SEQ ID NO: 682287 - DNA, 13 bp, C. elegans
aaaaaacgcggga

SEQ ID NO: 682288 - DNA, 13 bp, C. elegans
aaaaaacgcgttt

SEQ ID NO: 682289 - DNA, 13 bp, C. elegans
aaaaaacggattt

SEQ ID NO: 682290 - DNA, 13 bp, C. elegans
aaaaaacgggttt

SEQ ID NO: 682291 - DNA, 13 bp, C. elegans
aaaaaacggtcaa

SEQ ID NO: 682292 - DNA, 13 bp, C. elegans
aaaaaacgttcca

SEQ ID NO: 682293 - DNA, 13 bp, C. elegans
aaaaaacgttctc

SEQ ID NO: 682294 - DNA, 13 bp, C. elegans
aaaaaactattga

SEQ ID NO: 682295 - DNA, 13 bp, C. elegans
aaaaaactctgaa

SEQ ID NO: 682296 - DNA, 13 bp, C. elegans
aaaaaactgaatc

SEQ ID NO: 682297 - DNA, 13 bp, C. elegans
aaaaaactgcgtg

SEQ ID NO: 682298 - DNA, 13 bp, C. elegans
aaaaaactgctga

SEQ ID NO: 682299 - DNA, 13 bp, C. elegans
aaaaaactgtaca

SEQ ID NO: 682300 - DNA, 13 bp, C. elegans
aaaaaactgtata

SEQ ID NO: 682301 - DNA, 13 bp, C. elegans
aaaaaactgtatt

SEQ ID NO: 682302 - DNA, 13 bp, C. elegans
aaaaaactgtcaa

SEQ ID NO: 682303 - DNA, 13 bp, C. elegans
aaaaaactgttta

SEQ ID NO: 682304 - DNA, 13 bp, C. elegans
aaaaaactgtttc

SEQ ID NO: 682305 - DNA, 13 bp, C. elegans
aaaaaacttattc

SEQ ID NO: 682306 - DNA, 13 bp, C. elegans
aaaaaacttcatt

SEQ ID NO: 682307 - DNA, 13 bp, C. elegans
aaaaaacttgaat

SEQ ID NO: 682308 - DNA, 13 bp, C. elegans
aaaaaacttggaa

SEQ ID NO: 682309 - DNA, 13 bp, C. elegans
aaaaaactttaga

SEQ ID NO: 682310 - DNA, 13 bp, C. elegans
aaaaaacttttgt

SEQ ID NO: 682311 - DNA, 13 bp, C. elegans
aaaaaagaactgt

SEQ ID NO: 682312 - DNA, 13 bp, C. elegans
aaaaaagaattct

SEQ ID NO: 682313 - DNA, 13 bp, C. elegans
aaaaaagagttgt

SEQ ID NO: 682314 - DNA, 13 bp, C. elegans
aaaaaagagtttg

SEQ ID NO: 682315 - DNA, 13 bp, C. elegans
aaaaaagatgtgt

SEQ ID NO: 682316 - DNA, 13 bp, C. elegans
aaaaaagattgca

SEQ ID NO: 682317 - DNA, 13 bp, C. elegans
aaaaaagatttca

SEQ ID NO: 682318 - DNA, 13 bp, C. elegans
aaaaaagatttct

SEQ ID NO: 682319 - DNA, 13 bp, C. elegans
aaaaaagattttc

SEQ ID NO: 682320 - DNA, 13 bp, C. elegans
aaaaaagcacatg

SEQ ID NO: 682321 - DNA, 13 bp, C. elegans
aaaaaagctccaa

SEQ ID NO: 682322 - DNA, 13 bp, C. elegans
aaaaaagctctaa

SEQ ID NO: 682323 - DNA, 13 bp, C. elegans
aaaaaagctgtaa

SEQ ID NO: 682324 - DNA, 13 bp, C. elegans
aaaaaagcttgaa

SEQ ID NO: 682325 - DNA, 13 bp, C. elegans
aaaaaagctttaa

SEQ ID NO: 682326 - DNA, 13 bp, C. elegans
aaaaaagctttat

SEQ ID NO: 682327 - DNA, 13 bp, C. elegans
aaaaaagcttttt

SEQ ID NO: 682328 - DNA, 13 bp, C. elegans
aaaaaaggatttt

SEQ ID NO: 682329 - DNA, 13 bp, C. elegans
aaaaaaggcaatt

SEQ ID NO: 682330 - DNA, 13 bp, C. elegans
aaaaaaggtccaa

SEQ ID NO: 682331 - DNA, 13 bp, C. elegans
aaaaaaggtgatt

SEQ ID NO: 682332 - DNA, 13 bp, C. elegans
aaaaaaggtgtgt

SEQ ID NO: 682333 - DNA, 13 bp, C. elegans
aaaaaaggttatg

SEQ ID NO: 682334 - DNA, 13 bp, C. elegans
aaaaaaggtttta

SEQ ID NO: 682335 - DNA, 13 bp, C. elegans
aaaaaaggttttg

SEQ ID NO: 682336 - DNA, 13 bp, C. elegans
aaaaaaggttttt

SEQ ID NO: 682337 - DNA, 13 bp, C. elegans
aaaaaagtaactt

SEQ ID NO: 682338 - DNA, 13 bp, C. elegans
aaaaaagtagctc

SEQ ID NO: 682339 - DNA, 13 bp, C. elegans
aaaaaagtatggt

SEQ ID NO: 682340 - DNA, 13 bp, C. elegans
aaaaaagtcggct

SEQ ID NO: 682341 - DNA, 13 bp, C. elegans
aaaaaagtcgttc

SEQ ID NO: 682342 - DNA, 13 bp, C. elegans
aaaaaagtgtcaa

SEQ ID NO: 682343 - DNA, 13 bp, C. elegans
aaaaaagtgtcta

SEQ ID NO: 682344 - DNA, 13 bp, C. elegans
aaaaaagtgtgcg

SEQ ID NO: 682345 - DNA, 13 bp, C. elegans
aaaaaagtgttta

SEQ ID NO: 682346 - DNA, 13 bp, C. elegans
aaaaaagtgtttc

SEQ ID NO: 682347 - DNA, 13 bp, C. elegans
aaaaaagtgtttt

SEQ ID NO: 682348 - DNA, 13 bp, C. elegans
aaaaaagttatct

SEQ ID NO: 682349 - DNA, 13 bp, C. elegans
aaaaaagttcaac

SEQ ID NO: 682350 - DNA, 13 bp, C. elegans
aaaaaagttcaat

SEQ ID NO: 682351 - DNA, 13 bp, C. elegans
aaaaaagttcaga

SEQ ID NO: 682352 - DNA, 13 bp, C. elegans
aaaaaagttcagc

SEQ ID NO: 682353 - DNA, 13 bp, C. elegans
aaaaaagttcagt

SEQ ID NO: 682354 - DNA, 13 bp, C. elegans
aaaaaagttcata

SEQ ID NO: 682355 - DNA, 13 bp, C. elegans
aaaaaagttcgaa

SEQ ID NO: 682356 - DNA, 13 bp, C. elegans
aaaaaagttgact

SEQ ID NO: 682357 - DNA, 13 bp, C. elegans
aaaaaagttggag

SEQ ID NO: 682358 - DNA, 13 bp, C. elegans
aaaaaagtttatg

SEQ ID NO: 682359 - DNA, 13 bp, C. elegans
aaaaaagtttcaa

SEQ ID NO: 682360 - DNA, 13 bp, C. elegans
aaaaaagtttctt

SEQ ID NO: 682361 - DNA, 13 bp, C. elegans
aaaaaagtttgag

SEQ ID NO: 682362 - DNA, 13 bp, C. elegans
aaaaaagtttgct

SEQ ID NO: 682363 - DNA, 13 bp, C. elegans
aaaaaagtttgga

SEQ ID NO: 682364 - DNA, 13 bp, C. elegans
aaaaaagttttga

SEQ ID NO: 682365 - DNA, 13 bp, C. elegans
aaaaaagtttttg

SEQ ID NO: 682366 - DNA, 13 bp, C. elegans
aaaaaataacttg

SEQ ID NO: 682367 - DNA, 13 bp, C. elegans
aaaaaataccatg

SEQ ID NO: 682368 - DNA, 13 bp, C. elegans
aaaaaataccgat

SEQ ID NO: 682369 - DNA, 13 bp, C. elegans
aaaaaatactgga

SEQ ID NO: 682370 - DNA, 13 bp, C. elegans
aaaaaatacttcg

SEQ ID NO: 682371 - DNA, 13 bp, C. elegans
aaaaaatatcgga

SEQ ID NO: 682372 - DNA, 13 bp, C. elegans
aaaaaatatctga

SEQ ID NO: 682373 - DNA, 13 bp, C. elegans
aaaaaatatggtg

SEQ ID NO: 682374 - DNA, 13 bp, C. elegans
aaaaaatatgtgt

SEQ ID NO: 682375 - DNA, 13 bp, C. elegans
aaaaaatatgttc

SEQ ID NO: 682376 - DNA, 13 bp, C. elegans
aaaaaatattccg

SEQ ID NO: 682377 - DNA, 13 bp, C. elegans
aaaaaatcaagtc

SEQ ID NO: 682378 - DNA, 13 bp, C. elegans
aaaaaatcacgtt

SEQ ID NO: 682379 - DNA, 13 bp, C. elegans
aaaaaatcactga

SEQ ID NO: 682380 - DNA, 13 bp, C. elegans
aaaaaatcagatt

SEQ ID NO: 682381 - DNA, 13 bp, C. elegans
aaaaaatcagctt

SEQ ID NO: 682382 - DNA, 13 bp, C. elegans
aaaaaatcatcga

SEQ ID NO: 682383 - DNA, 13 bp, C. elegans
aaaaaatcatgtt

SEQ ID NO: 682384 - DNA, 13 bp, C. elegans
aaaaaatccattt

SEQ ID NO: 682385 - DNA, 13 bp, C. elegans
aaaaaatcccgca

SEQ ID NO: 682386 - DNA, 13 bp, C. elegans
aaaaaatccctct

SEQ ID NO: 682387 - DNA, 13 bp, C. elegans
aaaaaatccgaat

SEQ ID NO: 682388 - DNA, 13 bp, C. elegans
aaaaaatccgcta

SEQ ID NO: 682389 - DNA, 13 bp, C. elegans
aaaaaatcgaatt

SEQ ID NO: 682390 - DNA, 13 bp, C. elegans
aaaaaatcgatga

SEQ ID NO: 682391 - DNA, 13 bp, C. elegans
aaaaaatcgcatt

SEQ ID NO: 682392 - DNA, 13 bp, C. elegans
aaaaaatcgcgat

SEQ ID NO: 682393 - DNA, 13 bp, C. elegans
aaaaaatcggaga

SEQ ID NO: 682394 - DNA, 13 bp, C. elegans
aaaaaatcgggtt

SEQ ID NO: 682395 - DNA, 13 bp, C. elegans
aaaaaatcgtcag

SEQ ID NO: 682396 - DNA, 13 bp, C. elegans
aaaaaatcgtgtt

SEQ ID NO: 682397 - DNA, 13 bp, C. elegans
aaaaaatctaggt

SEQ ID NO: 682398 - DNA, 13 bp, C. elegans
aaaaaatctatga

SEQ ID NO: 682399 - DNA, 13 bp, C. elegans
aaaaaatctgaat

SEQ ID NO: 682400 - DNA, 13 bp, C. elegans
aaaaaatctgcct

SEQ ID NO: 682401 - DNA, 13 bp, C. elegans
aaaaaatctggaa

SEQ ID NO: 682402 - DNA, 13 bp, C. elegans
aaaaaatctggat

SEQ ID NO: 682403 - DNA, 13 bp, C. elegans
aaaaaatctgtat

SEQ ID NO: 682404 - DNA, 13 bp, C. elegans
aaaaaatcttctt

SEQ ID NO: 682405 - DNA, 14 bp, C. elegans
aaaaaatcttcttt

SEQ ID NO: 682406 - DNA, 13 bp, C. elegans
aaaaaatctttca

SEQ ID NO: 682407 - DNA, 13 bp, C. elegans
aaaaaatgaatct

SEQ ID NO: 682408 - DNA, 13 bp, C. elegans
aaaaaatgacatt

SEQ ID NO: 682409 - DNA, 13 bp, C. elegans
aaaaaatgatgac

SEQ ID NO: 682410 - DNA, 13 bp, C. elegans
aaaaaatgatgca

SEQ ID NO: 682411 - DNA, 13 bp, C. elegans
aaaaaatgattca

SEQ ID NO: 682412 - DNA, 13 bp, C. elegans
aaaaaatgcaatt

SEQ ID NO: 682413 - DNA, 13 bp, C. elegans
aaaaaatgcactg

SEQ ID NO: 682414 - DNA, 13 bp, C. elegans
aaaaaatgcattt

SEQ ID NO: 682415 - DNA, 13 bp, C. elegans
aaaaaatgcccaa

SEQ ID NO: 682416 - DNA, 13 bp, C. elegans
aaaaaatgccgaa

SEQ ID NO: 682417 - DNA, 13 bp, C. elegans
aaaaaatgcgacg

SEQ ID NO: 682418 - DNA, 13 bp, C. elegans
aaaaaatgcggaa

SEQ ID NO: 682419 - DNA, 13 bp, C. elegans
aaaaaatgcgggt

SEQ ID NO: 682420 - DNA, 13 bp, C. elegans
aaaaaatgctcca

SEQ ID NO: 682421 - DNA, 13 bp, C. elegans
aaaaaatgctcga

SEQ ID NO: 682422 - DNA, 13 bp, C. elegans
aaaaaatgctgaa

SEQ ID NO: 682423 - DNA, 13 bp, C. elegans
aaaaaatgcttca

SEQ ID NO: 682424 - DNA, 13 bp, C. elegans
aaaaaatgctttt

SEQ ID NO: 682425 - DNA, 13 bp, C. elegans
aaaaaatggcatt

SEQ ID NO: 682426 - DNA, 13 bp, C. elegans
aaaaaatggcgaa

SEQ ID NO: 682427 - DNA, 13 bp, C. elegans
aaaaaatgggaca

SEQ ID NO: 682428 - DNA, 13 bp, C. elegans
aaaaaatggttga

SEQ ID NO: 682429 - DNA, 13 bp, C. elegans
aaaaaatgtatac

SEQ ID NO: 682430 - DNA, 13 bp, C. elegans
aaaaaatgtatgc

SEQ ID NO: 682431 - DNA, 13 bp, C. elegans
aaaaaatgtgagg

SEQ ID NO: 682432 - DNA, 13 bp, C. elegans
aaaaaatgtgtga

SEQ ID NO: 682433 - DNA, 13 bp, C. elegans
aaaaaatgttcaa

SEQ ID NO: 682434 - DNA, 13 bp, C. elegans
aaaaaatgttcag

SEQ ID NO: 682435 - DNA, 13 bp, C. elegans
aaaaaatgttcta

SEQ ID NO: 682436 - DNA, 13 bp, C. elegans
aaaaaatgttgat

SEQ ID NO: 682437 - DNA, 13 bp, C. elegans
aaaaaatgttgtg

SEQ ID NO: 682438 - DNA, 13 bp, C. elegans
aaaaaatgtttca

SEQ ID NO: 682439 - DNA, 13 bp, C. elegans
aaaaaatgtttga

SEQ ID NO: 682440 - DNA, 13 bp, C. elegans
aaaaaatgttttc

SEQ ID NO: 682441 - DNA, 14 bp, C. elegans
aaaaaatgttttca

SEQ ID NO: 682442 - DNA, 13 bp, C. elegans
aaaaaattatcag

SEQ ID NO: 682443 - DNA, 13 bp, C. elegans
aaaaaattatcga

SEQ ID NO: 682444 - DNA, 13 bp, C. elegans
aaaaaattcaacg

SEQ ID NO: 682445 - DNA, 13 bp, C. elegans
aaaaaattcagat

SEQ ID NO: 682446 - DNA, 13 bp, C. elegans
aaaaaattcattc

SEQ ID NO: 682447 - DNA, 13 bp, C. elegans
aaaaaattccaga

SEQ ID NO: 682448 - DNA, 13 bp, C. elegans
aaaaaattcccat

SEQ ID NO: 682449 - DNA, 13 bp, C. elegans
aaaaaattccgca

SEQ ID NO: 682450 - DNA, 13 bp, C. elegans
aaaaaattccgta

SEQ ID NO: 682451 - DNA, 13 bp, C. elegans
aaaaaattcgaat

SEQ ID NO: 682452 - DNA, 13 bp, C. elegans
aaaaaattcgact

SEQ ID NO: 682453 - DNA, 13 bp, C. elegans
aaaaaattcggga

SEQ ID NO: 682454 - DNA, 13 bp, C. elegans
aaaaaattcgtta

SEQ ID NO: 682455 - DNA, 13 bp, C. elegans
aaaaaattctgaa

SEQ ID NO: 682456 - DNA, 13 bp, C. elegans
aaaaaattgccaa

SEQ ID NO: 682457 - DNA, 13 bp, C. elegans
aaaaaattgccga

SEQ ID NO: 682458 - DNA, 13 bp, C. elegans
aaaaaattgctac

SEQ ID NO: 682459 - DNA, 13 bp, C. elegans
aaaaaattggcaa

SEQ ID NO: 682460 - DNA, 13 bp, C. elegans
aaaaaattggcca

SEQ ID NO: 682461 - DNA, 13 bp, C. elegans
aaaaaattgtcaa

SEQ ID NO: 682462 - DNA, 13 bp, C. elegans
aaaaaattgtgca

SEQ ID NO: 682463 - DNA, 13 bp, C. elegans
aaaaaattgtttc

SEQ ID NO: 682464 - DNA, 13 bp, C. elegans
aaaaaatttacag

SEQ ID NO: 682465 - DNA, 13 bp, C. elegans
aaaaaatttcaga

SEQ ID NO: 682466 - DNA, 13 bp, C. elegans
aaaaaatttcgaa

SEQ ID NO: 682467 - DNA, 13 bp, C. elegans
aaaaaatttcgga

SEQ ID NO: 682468 - DNA, 13 bp, C. elegans
aaaaaatttctcg

SEQ ID NO: 682469 - DNA, 13 bp, C. elegans
aaaaaatttctgt

SEQ ID NO: 682470 - DNA, 13 bp, C. elegans
aaaaaatttcttc

SEQ ID NO: 682471 - DNA, 13 bp, C. elegans
aaaaaatttgttc

SEQ ID NO: 682472 - DNA, 13 bp, C. elegans
aaaaaatttgttg

SEQ ID NO: 682473 - DNA, 13 bp, C. elegans
aaaaaattttcag

SEQ ID NO: 682474 - DNA, 13 bp, C. elegans
aaaaaattttccg

SEQ ID NO: 682475 - DNA, 13 bp, C. elegans
aaaaaatttttgc

SEQ ID NO: 682476 - DNA, 13 bp, C. elegans
aaaaacaaagttc

SEQ ID NO: 682477 - DNA, 13 bp, C. elegans
aaaaacaaatgtt

SEQ ID NO: 682478 - DNA, 13 bp, C. elegans
aaaaacaaattgg

SEQ ID NO: 682479 - DNA, 13 bp, C. elegans
aaaaacaaattgt

SEQ ID NO: 682480 - DNA, 13 bp, C. elegans
aaaaacaacgatg

SEQ ID NO: 682481 - DNA, 13 bp, C. elegans
aaaaacaaggagt

SEQ ID NO: 682482 - DNA, 13 bp, C. elegans
aaaaacaaggtga

SEQ ID NO: 682483 - DNA, 13 bp, C. elegans
aaaaacaagtttt

SEQ ID NO: 682484 - DNA, 13 bp, C. elegans
aaaaacaatgatt

SEQ ID NO: 682485 - DNA, 13 bp, C. elegans
aaaaacaatgttt

SEQ ID NO: 682486 - DNA, 13 bp, C. elegans
aaaaacaattctc

SEQ ID NO: 682487 - DNA, 13 bp, C. elegans
aaaaacaattgct

SEQ ID NO: 682488 - DNA, 13 bp, C. elegans
aaaaacaattgga

SEQ ID NO: 682489 - DNA, 13 bp, C. elegans
aaaaacaattgtt

SEQ ID NO: 682490 - DNA, 13 bp, C. elegans
aaaaacaatttct

SEQ ID NO: 682491 - DNA, 13 bp, C. elegans
aaaaacaatttgc

SEQ ID NO: 682492 - DNA, 13 bp, C. elegans
aaaaacacaattg

SEQ ID NO: 682493 - DNA, 13 bp, C. elegans
aaaaacacacttt

SEQ ID NO: 682494 - DNA, 13 bp, C. elegans
aaaaacacatttt

SEQ ID NO: 682495 - DNA, 13 bp, C. elegans
aaaaacaccattt

SEQ ID NO: 682496 - DNA, 13 bp, C. elegans
aaaaacacctttt

SEQ ID NO: 682497 - DNA, 13 bp, C. elegans
aaaaacacgaatt

SEQ ID NO: 682498 - DNA, 13 bp, C. elegans
aaaaacacgtgta

SEQ ID NO: 682499 - DNA, 13 bp, C. elegans
aaaaacacgttta

SEQ ID NO: 682500 - DNA, 13 bp, C. elegans
aaaaacactcgaa

SEQ ID NO: 682501 - DNA, 13 bp, C. elegans
aaaaacactgttt

SEQ ID NO: 682502 - DNA, 13 bp, C. elegans
aaaaacactttat

SEQ ID NO: 682503 - DNA, 13 bp, C. elegans
aaaaacactttga

SEQ ID NO: 682504 - DNA, 13 bp, C. elegans
aaaaacacttttt

SEQ ID NO: 682505 - DNA, 13 bp, C. elegans
aaaaacagaattt

SEQ ID NO: 682506 - DNA, 13 bp, C. elegans
aaaaacagagttt

SEQ ID NO: 682507 - DNA, 13 bp, C. elegans
aaaaacagatttt

SEQ ID NO: 682508 - DNA, 13 bp, C. elegans
aaaaacagctaca

SEQ ID NO: 682509 - DNA, 13 bp, C. elegans
aaaaacagggttt

SEQ ID NO: 682510 - DNA, 13 bp, C. elegans
aaaaacagtaatt

SEQ ID NO: 682511 - DNA, 13 bp, C. elegans
aaaaacagtcaac

SEQ ID NO: 682512 - DNA, 13 bp, C. elegans
aaaaacagtgaat

SEQ ID NO: 682513 - DNA, 13 bp, C. elegans
aaaaacagttttt

SEQ ID NO: 682514 - DNA, 13 bp, C. elegans
aaaaacatcgtag

SEQ ID NO: 682515 - DNA, 13 bp, C. elegans
aaaaacatctgaa

SEQ ID NO: 682516 - DNA, 13 bp, C. elegans
aaaaacatctgga

SEQ ID NO: 682517 - DNA, 13 bp, C. elegans
aaaaacatcttca

SEQ ID NO: 682518 - DNA, 13 bp, C. elegans
aaaaacatgcaca

SEQ ID NO: 682519 - DNA, 13 bp, C. elegans
aaaaacatgcgaa

SEQ ID NO: 682520 - DNA, 13 bp, C. elegans
aaaaacatgctca

SEQ ID NO: 682521 - DNA, 13 bp, C. elegans
aaaaacatgtgaa

SEQ ID NO: 682522 - DNA, 13 bp, C. elegans
aaaaacatgttca

SEQ ID NO: 682523 - DNA, 13 bp, C. elegans
aaaaacatgttta

SEQ ID NO: 682524 - DNA, 13 bp, C. elegans
aaaaacatgtttt

SEQ ID NO: 682525 - DNA, 13 bp, C. elegans
aaaaacattattg

SEQ ID NO: 682526 - DNA, 13 bp, C. elegans
aaaaacattccac

SEQ ID NO: 682527 - DNA, 13 bp, C. elegans
aaaaacattctga

SEQ ID NO: 682528 - DNA, 13 bp, C. elegans
aaaaacattgaat

SEQ ID NO: 682529 - DNA, 13 bp, C. elegans
aaaaacattgaca

SEQ ID NO: 682530 - DNA, 13 bp, C. elegans
aaaaacattgcaa

SEQ ID NO: 682531 - DNA, 13 bp, C. elegans
aaaaacatttcca

SEQ ID NO: 682532 - DNA, 13 bp, C. elegans
aaaaacatttccc

SEQ ID NO: 682533 - DNA, 13 bp, C. elegans
aaaaacatttgaa

SEQ ID NO: 682534 - DNA, 13 bp, C. elegans
aaaaacatttttc

SEQ ID NO: 682535 - DNA, 13 bp, C. elegans
aaaaacatttttg

SEQ ID NO: 682536 - DNA, 13 bp, C. elegans
aaaaaccaaatgt

SEQ ID NO: 682537 - DNA, 13 bp, C. elegans
aaaaaccaaattg

SEQ ID NO: 682538 - DNA, 13 bp, C. elegans
aaaaaccaatctg

SEQ ID NO: 682539 - DNA, 13 bp, C. elegans
aaaaaccaattct

SEQ ID NO: 682540 - DNA, 13 bp, C. elegans
aaaaaccaatttc

SEQ ID NO: 682541 - DNA, 13 bp, C. elegans
aaaaaccaatttg

SEQ ID NO: 682542 - DNA, 13 bp, C. elegans
aaaaaccaatttt

SEQ ID NO: 682543 - DNA, 13 bp, C. elegans
aaaaaccacgtgg

SEQ ID NO: 682544 - DNA, 13 bp, C. elegans
aaaaaccactcct

SEQ ID NO: 682545 - DNA, 13 bp, C. elegans
aaaaaccactctt

SEQ ID NO: 682546 - DNA, 13 bp, C. elegans
aaaaaccactgaa

SEQ ID NO: 682547 - DNA, 13 bp, C. elegans
aaaaaccagaact

SEQ ID NO: 682548 - DNA, 13 bp, C. elegans
aaaaaccagtttt

SEQ ID NO: 682549 - DNA, 13 bp, C. elegans
aaaaaccatcatc

SEQ ID NO: 682550 - DNA, 13 bp, C. elegans
aaaaaccatcgaa

SEQ ID NO: 682551 - DNA, 13 bp, C. elegans
aaaaaccattatt

SEQ ID NO: 682552 - DNA, 13 bp, C. elegans
aaaaaccatttat

SEQ ID NO: 682553 - DNA, 13 bp, C. elegans
aaaaaccatttct

SEQ ID NO: 682554 - DNA, 13 bp, C. elegans
aaaaaccattttc

SEQ ID NO: 682555 - DNA, 13 bp, C. elegans
aaaaaccccaatt

SEQ ID NO: 682556 - DNA, 13 bp, C. elegans
aaaaaccccgatt

SEQ ID NO: 682557 - DNA, 13 bp, C. elegans
aaaaacccctatt

SEQ ID NO: 682558 - DNA, 13 bp, C. elegans
aaaaacccgaaat

SEQ ID NO: 682559 - DNA, 14 bp, C. elegans
aaaaaccctgaaaa

SEQ ID NO: 682560 - DNA, 13 bp, C. elegans
aaaaaccgaaatt

SEQ ID NO: 682561 - DNA, 13 bp, C. elegans
aaaaaccgataat

SEQ ID NO: 682562 - DNA, 13 bp, C. elegans
aaaaaccgatgaa

SEQ ID NO: 682563 - DNA, 13 bp, C. elegans
aaaaaccgatttc

SEQ ID NO: 682564 - DNA, 13 bp, C. elegans
aaaaaccgcatca

SEQ ID NO: 682565 - DNA, 13 bp, C. elegans
aaaaaccgctaaa

SEQ ID NO: 682566 - DNA, 13 bp, C. elegans
aaaaaccggaaat

SEQ ID NO: 682567 - DNA, 13 bp, C. elegans
aaaaaccggagtt

SEQ ID NO: 682568 - DNA, 13 bp, C. elegans
aaaaaccgtattt

SEQ ID NO: 682569 - DNA, 13 bp, C. elegans
aaaaaccgtcaaa

SEQ ID NO: 682570 - DNA, 13 bp, C. elegans
aaaaaccgttgaa

SEQ ID NO: 682571 - DNA, 13 bp, C. elegans
aaaaaccgttttt

SEQ ID NO: 682572 - DNA, 13 bp, C. elegans
aaaaacctgattt

SEQ ID NO: 682573 - DNA, 13 bp, C. elegans
aaaaacctggaaa

SEQ ID NO: 682574 - DNA, 13 bp, C. elegans
aaaaaccttattt

SEQ ID NO: 682575 - DNA, 13 bp, C. elegans
aaaaaccttcaga

SEQ ID NO: 682576 - DNA, 13 bp, C. elegans
aaaaaccttcttg

SEQ ID NO: 682577 - DNA, 13 bp, C. elegans
aaaaacctttatt

SEQ ID NO: 682578 - DNA, 13 bp, C. elegans
aaaaaccttttga

SEQ ID NO: 682579 - DNA, 13 bp, C. elegans
aaaaaccttttta

SEQ ID NO: 682580 - DNA, 13 bp, C. elegans
aaaaacctttttt

SEQ ID NO: 682581 - DNA, 14 bp, C. elegans
aaaaaccttttttt

SEQ ID NO: 682582 - DNA, 13 bp, C. elegans
aaaaacgaaattt

SEQ ID NO: 682583 - DNA, 13 bp, C. elegans
aaaaacgaagttt

SEQ ID NO: 682584 - DNA, 13 bp, C. elegans
aaaaacgaatagt

SEQ ID NO: 682585 - DNA, 13 bp, C. elegans
aaaaacgaattca

SEQ ID NO: 682586 - DNA, 13 bp, C. elegans
aaaaacgaattct

SEQ ID NO: 682587 - DNA, 13 bp, C. elegans
aaaaacgaatttc

SEQ ID NO: 682588 - DNA, 13 bp, C. elegans
aaaaacgaatttt

SEQ ID NO: 682589 - DNA, 13 bp, C. elegans
aaaaacgagaatt

SEQ ID NO: 682590 - DNA, 13 bp, C. elegans
aaaaacgagagat

SEQ ID NO: 682591 - DNA, 13 bp, C. elegans
aaaaacgagatga

SEQ ID NO: 682592 - DNA, 13 bp, C. elegans
aaaaacgagtatt

SEQ ID NO: 682593 - DNA, 13 bp, C. elegans
aaaaacgatttga

SEQ ID NO: 682594 - DNA, 13 bp, C. elegans
aaaaacgattttc

SEQ ID NO: 682595 - DNA, 13 bp, C. elegans
aaaaacgattttt

SEQ ID NO: 682596 - DNA, 13 bp, C. elegans
aaaaacgcatgca

SEQ ID NO: 682597 - DNA, 13 bp, C. elegans
aaaaacgcgattt

SEQ ID NO: 682598 - DNA, 13 bp, C. elegans
aaaaacgcgtttt

SEQ ID NO: 682599 - DNA, 13 bp, C. elegans
aaaaacgctgaaa

SEQ ID NO: 682600 - DNA, 13 bp, C. elegans
aaaaacgctgtaa

SEQ ID NO: 682601 - DNA, 13 bp, C. elegans
aaaaacggatttt

SEQ ID NO: 682602 - DNA, 13 bp, C. elegans
aaaaacggcaatt

SEQ ID NO: 682603 - DNA, 13 bp, C. elegans
aaaaacggtgttt

SEQ ID NO: 682604 - DNA, 13 bp, C. elegans
aaaaacgtagaga

SEQ ID NO: 682605 - DNA, 13 bp, C. elegans
aaaaacgtatgaa

SEQ ID NO: 682606 - DNA, 13 bp, C. elegans
aaaaacgtatttt

SEQ ID NO: 682607 - DNA, 13 bp, C. elegans
aaaaacgtcaaga

SEQ ID NO: 682608 - DNA, 13 bp, C. elegans
aaaaacgtcaatt

SEQ ID NO: 682609 - DNA, 13 bp, C. elegans
aaaaacgtcttaa

SEQ ID NO: 682610 - DNA, 13 bp, C. elegans
aaaaacgtgaaat

SEQ ID NO: 682611 - DNA, 13 bp, C. elegans
aaaaacgtgaatt

SEQ ID NO: 682612 - DNA, 13 bp, C. elegans
aaaaacgtgcaaa

SEQ ID NO: 682613 - DNA, 13 bp, C. elegans
aaaaacgtgctga

SEQ ID NO: 682614 - DNA, 13 bp, C. elegans
aaaaacgtgtgga

SEQ ID NO: 682615 - DNA, 13 bp, C. elegans
aaaaacgtgtttt

SEQ ID NO: 682616 - DNA, 13 bp, C. elegans
aaaaacgttaaat

SEQ ID NO: 682617 - DNA, 13 bp, C. elegans
aaaaacgttaaga

SEQ ID NO: 682618 - DNA, 13 bp, C. elegans
aaaaacgttagaa

SEQ ID NO: 682619 - DNA, 13 bp, C. elegans
aaaaacgttccat

SEQ ID NO: 682620 - DNA, 13 bp, C. elegans
aaaaacgttgaac

SEQ ID NO: 682621 - DNA, 13 bp, C. elegans
aaaaacgttgtga

SEQ ID NO: 682622 - DNA, 13 bp, C. elegans
aaaaacgtttaat

SEQ ID NO: 682623 - DNA, 13 bp, C. elegans
aaaaacgtttatt

SEQ ID NO: 682624 - DNA, 13 bp, C. elegans
aaaaacgtttcca

SEQ ID NO: 682625 - DNA, 13 bp, C. elegans
aaaaacgtttttt

SEQ ID NO: 682626 - DNA, 13 bp, C. elegans
aaaaactaagttt

SEQ ID NO: 682627 - DNA, 13 bp, C. elegans
aaaaactaatttc

SEQ ID NO: 682628 - DNA, 13 bp, C. elegans
aaaaactacagta

SEQ ID NO: 682629 - DNA, 13 bp, C. elegans
aaaaactacatga

SEQ ID NO: 682630 - DNA, 13 bp, C. elegans
aaaaactacattt

SEQ ID NO: 682631 - DNA, 13 bp, C. elegans
aaaaactactgaa

SEQ ID NO: 682632 - DNA, 13 bp, C. elegans
aaaaactactgat

SEQ ID NO: 682633 - DNA, 13 bp, C. elegans
aaaaactacttct

SEQ ID NO: 682634 - DNA, 13 bp, C. elegans
aaaaactagaatt

SEQ ID NO: 682635 - DNA, 13 bp, C. elegans
aaaaactagcaat

SEQ ID NO: 682636 - DNA, 13 bp, C. elegans
aaaaactaggatg

SEQ ID NO: 682637 - DNA, 13 bp, C. elegans
aaaaactagtaga

SEQ ID NO: 682638 - DNA, 13 bp, C. elegans
aaaaactatcgaa

SEQ ID NO: 682639 - DNA, 13 bp, C. elegans
aaaaactatgaat

SEQ ID NO: 682640 - DNA, 13 bp, C. elegans
aaaaactatgcaa

SEQ ID NO: 682641 - DNA, 13 bp, C. elegans
aaaaactatgtaa

SEQ ID NO: 682642 - DNA, 13 bp, C. elegans
aaaaactattatc

SEQ ID NO: 682643 - DNA, 13 bp, C. elegans
aaaaactattgaa

SEQ ID NO: 682644 - DNA, 13 bp, C. elegans
aaaaactattggt

SEQ ID NO: 682645 - DNA, 13 bp, C. elegans
aaaaactattgta

SEQ ID NO: 682646 - DNA, 13 bp, C. elegans
aaaaactatttca

SEQ ID NO: 682647 - DNA, 13 bp, C. elegans
aaaaactatttct

SEQ ID NO: 682648 - DNA, 13 bp, C. elegans
aaaaactattttc

SEQ ID NO: 682649 - DNA, 13 bp, C. elegans
aaaaactcaattt

SEQ ID NO: 682650 - DNA, 13 bp, C. elegans
aaaaactcactga

SEQ ID NO: 682651 - DNA, 13 bp, C. elegans
aaaaactcacttt

SEQ ID NO: 682652 - DNA, 13 bp, C. elegans
aaaaactcagcaa

SEQ ID NO: 682653 - DNA, 13 bp, C. elegans
aaaaactcagtaa

SEQ ID NO: 682654 - DNA, 13 bp, C. elegans
aaaaactcatttt

SEQ ID NO: 682655 - DNA, 13 bp, C. elegans
aaaaactccaatt

SEQ ID NO: 682656 - DNA, 13 bp, C. elegans
aaaaactccagaa

SEQ ID NO: 682657 - DNA, 13 bp, C. elegans
aaaaactcctgaa

SEQ ID NO: 682658 - DNA, 13 bp, C. elegans
aaaaactcgaaat

SEQ ID NO: 682659 - DNA, 13 bp, C. elegans
aaaaactcgaatt

SEQ ID NO: 682660 - DNA, 13 bp, C. elegans
aaaaactcgagaa

SEQ ID NO: 682661 - DNA, 13 bp, C. elegans
aaaaactctaatt

SEQ ID NO: 682662 - DNA, 13 bp, C. elegans
aaaaactctcatt

SEQ ID NO: 682663 - DNA, 13 bp, C. elegans
aaaaactcttcca

SEQ ID NO: 682664 - DNA, 13 bp, C. elegans
aaaaactcttgaa

SEQ ID NO: 682665 - DNA, 13 bp, C. elegans
aaaaactgaaatt

SEQ ID NO: 682666 - DNA, 13 bp, C. elegans
aaaaactgataat

SEQ ID NO: 682667 - DNA, 13 bp, C. elegans
aaaaactgatatt

SEQ ID NO: 682668 - DNA, 13 bp, C. elegans
aaaaactgatcaa

SEQ ID NO: 682669 - DNA, 13 bp, C. elegans
aaaaactgatgaa

SEQ ID NO: 682670 - DNA, 13 bp, C. elegans
aaaaactgcacaa

SEQ ID NO: 682671 - DNA, 13 bp, C. elegans
aaaaactgcggaa

SEQ ID NO: 682672 - DNA, 13 bp, C. elegans
aaaaactgctgat

SEQ ID NO: 682673 - DNA, 13 bp, C. elegans
aaaaactggaaag

SEQ ID NO: 682674 - DNA, 13 bp, C. elegans
aaaaactggaaga

SEQ ID NO: 682675 - DNA, 13 bp, C. elegans
aaaaactggaata

SEQ ID NO: 682676 - DNA, 13 bp, C. elegans
aaaaactggagtt

SEQ ID NO: 682677 - DNA, 13 bp, C. elegans
aaaaactggataa

SEQ ID NO: 682678 - DNA, 13 bp, C. elegans
aaaaactggattt

SEQ ID NO: 682679 - DNA, 13 bp, C. elegans
aaaaactgggctt

SEQ ID NO: 682680 - DNA, 13 bp, C. elegans
aaaaactgtaact

SEQ ID NO: 682681 - DNA, 13 bp, C. elegans
aaaaactgtaatt

SEQ ID NO: 682682 - DNA, 13 bp, C. elegans
aaaaactgtagtt

SEQ ID NO: 682683 - DNA, 13 bp, C. elegans
aaaaactgtcaat

SEQ ID NO: 682684 - DNA, 13 bp, C. elegans
aaaaactgtctca

SEQ ID NO: 682685 - DNA, 13 bp, C. elegans
aaaaactgtgaaa

SEQ ID NO: 682686 - DNA, 13 bp, C. elegans
aaaaactgtgcaa

SEQ ID NO: 682687 - DNA, 13 bp, C. elegans
aaaaactgttaat

SEQ ID NO: 682688 - DNA, 13 bp, C. elegans
aaaaactgttgga

SEQ ID NO: 682689 - DNA, 13 bp, C. elegans
aaaaactgtttaa

SEQ ID NO: 682690 - DNA, 13 bp, C. elegans
aaaaactgtttca

SEQ ID NO: 682691 - DNA, 13 bp, C. elegans
aaaaactgtttga

SEQ ID NO: 682692 - DNA, 13 bp, C. elegans
aaaaactgtttgt

SEQ ID NO: 682693 - DNA, 13 bp, C. elegans
aaaaactgttttc

SEQ ID NO: 682694 - DNA, 13 bp, C. elegans
aaaaactgttttt

SEQ ID NO: 682695 - DNA, 13 bp, C. elegans
aaaaacttattca

SEQ ID NO: 682696 - DNA, 13 bp, C. elegans
aaaaacttcaagt

SEQ ID NO: 682697 - DNA, 13 bp, C. elegans
aaaaacttcaatt

SEQ ID NO: 682698 - DNA, 13 bp, C. elegans
aaaaacttcagtt

SEQ ID NO: 682699 - DNA, 13 bp, C. elegans
aaaaacttcatat

SEQ ID NO: 682700 - DNA, 13 bp, C. elegans
aaaaacttccaac

SEQ ID NO: 682701 - DNA, 13 bp, C. elegans
aaaaacttccggc

SEQ ID NO: 682702 - DNA, 13 bp, C. elegans
aaaaacttcgaaa

SEQ ID NO: 682703 - DNA, 13 bp, C. elegans
aaaaacttctgaa

SEQ ID NO: 682704 - DNA, 13 bp, C. elegans
aaaaacttgattt

SEQ ID NO: 682705 - DNA, 13 bp, C. elegans
aaaaacttgcttt

SEQ ID NO: 682706 - DNA, 13 bp, C. elegans
aaaaacttggatt

SEQ ID NO: 682707 - DNA, 13 bp, C. elegans
aaaaacttggcaa

SEQ ID NO: 682708 - DNA, 13 bp, C. elegans
aaaaacttgtaaa

SEQ ID NO: 682709 - DNA, 13 bp, C. elegans
aaaaacttgtcgt

SEQ ID NO: 682710 - DNA, 13 bp, C. elegans
aaaaacttgttaa

SEQ ID NO: 682711 - DNA, 13 bp, C. elegans
aaaaacttgtttc

SEQ ID NO: 682712 - DNA, 13 bp, C. elegans
aaaaactttacga

SEQ ID NO: 682713 - DNA, 13 bp, C. elegans
aaaaactttcaac

SEQ ID NO: 682714 - DNA, 13 bp, C. elegans
aaaaactttccaa

SEQ ID NO: 682715 - DNA, 13 bp, C. elegans
aaaaactttcgaa

SEQ ID NO: 682716 - DNA, 13 bp, C. elegans
aaaaactttgaaa

SEQ ID NO: 682717 - DNA, 13 bp, C. elegans
aaaaactttgatt

SEQ ID NO: 682718 - DNA, 13 bp, C. elegans
aaaaactttgcat

SEQ ID NO: 682719 - DNA, 13 bp, C. elegans
aaaaacttttgag

SEQ ID NO: 682720 - DNA, 13 bp, C. elegans
aaaaacttttgga

SEQ ID NO: 682721 - DNA, 13 bp, C. elegans
aaaaactttttga

SEQ ID NO: 682722 - DNA, 13 bp, C. elegans
aaaaactttttgt

SEQ ID NO: 682723 - DNA, 13 bp, C. elegans
aaaaagaaacttg

SEQ ID NO: 682724 - DNA, 13 bp, C. elegans
aaaaagaaacttt

SEQ ID NO: 682725 - DNA, 13 bp, C. elegans
aaaaagaaagttc

SEQ ID NO: 682726 - DNA, 13 bp, C. elegans
aaaaagaacattt

SEQ ID NO: 682727 - DNA, 13 bp, C. elegans
aaaaagaacttta

SEQ ID NO: 682728 - DNA, 13 bp, C. elegans
aaaaagaagtttg

SEQ ID NO: 682729 - DNA, 13 bp, C. elegans
aaaaagaattcga

SEQ ID NO: 682730 - DNA, 13 bp, C. elegans
aaaaagaattctc

SEQ ID NO: 682731 - DNA, 13 bp, C. elegans
aaaaagaatttca

SEQ ID NO: 682732 - DNA, 13 bp, C. elegans
aaaaagaatttcc

SEQ ID NO: 682733 - DNA, 13 bp, C. elegans
aaaaagaatttct

SEQ ID NO: 682734 - DNA, 13 bp, C. elegans
aaaaagacaattt

SEQ ID NO: 682735 - DNA, 13 bp, C. elegans
aaaaagagatttc

SEQ ID NO: 682736 - DNA, 13 bp, C. elegans
aaaaagagatttg

SEQ ID NO: 682737 - DNA, 13 bp, C. elegans
aaaaagagcaatt

SEQ ID NO: 682738 - DNA, 13 bp, C. elegans
aaaaagagcacat

SEQ ID NO: 682739 - DNA, 13 bp, C. elegans
aaaaagagcattt

SEQ ID NO: 682740 - DNA, 13 bp, C. elegans
aaaaagagctcaa

SEQ ID NO: 682741 - DNA, 13 bp, C. elegans
aaaaagagctttt

SEQ ID NO: 682742 - DNA, 13 bp, C. elegans
aaaaagagttcaa

SEQ ID NO: 682743 - DNA, 13 bp, C. elegans
aaaaagagtttct

SEQ ID NO: 682744 - DNA, 13 bp, C. elegans
aaaaagagtttgc

SEQ ID NO: 682745 - DNA, 13 bp, C. elegans
aaaaagagtttta

SEQ ID NO: 682746 - DNA, 13 bp, C. elegans
aaaaagatgttcc

SEQ ID NO: 682747 - DNA, 13 bp, C. elegans
aaaaagatgttta

SEQ ID NO: 682748 - DNA, 13 bp, C. elegans
aaaaagattattg

SEQ ID NO: 682749 - DNA, 13 bp, C. elegans
aaaaagattctaa

SEQ ID NO: 682750 - DNA, 13 bp, C. elegans
aaaaagattcttc

SEQ ID NO: 682751 - DNA, 13 bp, C. elegans
aaaaagattgttt

SEQ ID NO: 682752 - DNA, 13 bp, C. elegans
aaaaagatttatg

SEQ ID NO: 682753 - DNA, 13 bp, C. elegans
aaaaagatttgtt

SEQ ID NO: 682754 - DNA, 13 bp, C. elegans
aaaaagattttct

SEQ ID NO: 682755 - DNA, 13 bp, C. elegans
aaaaagatttttg

SEQ ID NO: 682756 - DNA, 13 bp, C. elegans
aaaaagcaaactt

SEQ ID NO: 682757 - DNA, 13 bp, C. elegans
aaaaagcaagagt

SEQ ID NO: 682758 - DNA, 13 bp, C. elegans
aaaaagcaatgtt

SEQ ID NO: 682759 - DNA, 13 bp, C. elegans
aaaaagcaatttg

SEQ ID NO: 682760 - DNA, 13 bp, C. elegans
aaaaagcaatttt

SEQ ID NO: 682761 - DNA, 13 bp, C. elegans
aaaaagcacagtt

SEQ ID NO: 682762 - DNA, 13 bp, C. elegans
aaaaagcacattt

SEQ ID NO: 682763 - DNA, 13 bp, C. elegans
aaaaagcagcgtc

SEQ ID NO: 682764 - DNA, 13 bp, C. elegans
aaaaagcagtttt

SEQ ID NO: 682765 - DNA, 13 bp, C. elegans
aaaaagcattaat

SEQ ID NO: 682766 - DNA, 13 bp, C. elegans
aaaaagcatttca

SEQ ID NO: 682767 - DNA, 13 bp, C. elegans
aaaaagcctgaaa

SEQ ID NO: 682768 - DNA, 13 bp, C. elegans
aaaaagcggattt

SEQ ID NO: 682769 - DNA, 13 bp, C. elegans
aaaaagctatttt

SEQ ID NO: 682770 - DNA, 13 bp, C. elegans
aaaaagctcaaga

SEQ ID NO: 682771 - DNA, 13 bp, C. elegans
aaaaagctcgaat

SEQ ID NO: 682772 - DNA, 13 bp, C. elegans
aaaaagctgaact

SEQ ID NO: 682773 - DNA, 13 bp, C. elegans
aaaaagctgagaa

SEQ ID NO: 682774 - DNA, 13 bp, C. elegans
aaaaagctggaaa

SEQ ID NO: 682775 - DNA, 13 bp, C. elegans
aaaaagctgtgaa

SEQ ID NO: 682776 - DNA, 13 bp, C. elegans
aaaaagcttaatt

SEQ ID NO: 682777 - DNA, 13 bp, C. elegans
aaaaagcttcaaa

SEQ ID NO: 682778 - DNA, 13 bp, C. elegans
aaaaagcttgaga

SEQ ID NO: 682779 - DNA, 13 bp, C. elegans
aaaaagcttggaa

SEQ ID NO: 682780 - DNA, 13 bp, C. elegans
aaaaagctttatt

SEQ ID NO: 682781 - DNA, 13 bp, C. elegans
aaaaagctttttt

SEQ ID NO: 682782 - DNA, 13 bp, C. elegans
aaaaaggaagttt

SEQ ID NO: 682783 - DNA, 13 bp, C. elegans
aaaaaggactttt

SEQ ID NO: 682784 - DNA, 13 bp, C. elegans
aaaaaggatattt

SEQ ID NO: 682785 - DNA, 13 bp, C. elegans
aaaaaggatttca

SEQ ID NO: 682786 - DNA, 13 bp, C. elegans
aaaaaggatttta

SEQ ID NO: 682787 - DNA, 13 bp, C. elegans
aaaaaggattttt

SEQ ID NO: 682788 - DNA, 13 bp, C. elegans
aaaaaggcacact

SEQ ID NO: 682789 - DNA, 13 bp, C. elegans
aaaaaggctgaaa

SEQ ID NO: 682790 - DNA, 13 bp, C. elegans
aaaaaggcttttt

SEQ ID NO: 682791 - DNA, 13 bp, C. elegans
aaaaagggcaatt

SEQ ID NO: 682792 - DNA, 13 bp, C. elegans
aaaaaggtccaaa

SEQ ID NO: 682793 - DNA, 13 bp, C. elegans
aaaaaggtgattt

SEQ ID NO: 682794 - DNA, 13 bp, C. elegans
aaaaaggttattt

SEQ ID NO: 682795 - DNA, 13 bp, C. elegans
aaaaaggttcaaa

SEQ ID NO: 682796 - DNA, 13 bp, C. elegans
aaaaagtaaactt

SEQ ID NO: 682797 - DNA, 13 bp, C. elegans
aaaaagtaaatct

SEQ ID NO: 682798 - DNA, 13 bp, C. elegans
aaaaagtaatgtt

SEQ ID NO: 682799 - DNA, 13 bp, C. elegans
aaaaagtacactt

SEQ ID NO: 682800 - DNA, 13 bp, C. elegans
aaaaagtactgta

SEQ ID NO: 682801 - DNA, 13 bp, C. elegans
aaaaagtacttga

SEQ ID NO: 682802 - DNA, 13 bp, C. elegans
aaaaagtagatgt

SEQ ID NO: 682803 - DNA, 13 bp, C. elegans
aaaaagtagtttt

SEQ ID NO: 682804 - DNA, 13 bp, C. elegans
aaaaagtatacat

SEQ ID NO: 682805 - DNA, 13 bp, C. elegans
aaaaagtatcatt

SEQ ID NO: 682806 - DNA, 13 bp, C. elegans
aaaaagtatccaa

SEQ ID NO: 682807 - DNA, 13 bp, C. elegans
aaaaagtatttca

SEQ ID NO: 682808 - DNA, 13 bp, C. elegans
aaaaagtatttga

SEQ ID NO: 682809 - DNA, 13 bp, C. elegans
aaaaagtcaatga

SEQ ID NO: 682810 - DNA, 13 bp, C. elegans
aaaaagtcactga

SEQ ID NO: 682811 - DNA, 13 bp, C. elegans
aaaaagtcagttt

SEQ ID NO: 682812 - DNA, 13 bp, C. elegans
aaaaagtcatcaa

SEQ ID NO: 682813 - DNA, 13 bp, C. elegans
aaaaagtcatttt

SEQ ID NO: 682814 - DNA, 13 bp, C. elegans
aaaaagtccagaa

SEQ ID NO: 682815 - DNA, 13 bp, C. elegans
aaaaagtcgataa

SEQ ID NO: 682816 - DNA, 13 bp, C. elegans
aaaaagtcggaaa

SEQ ID NO: 682817 - DNA, 13 bp, C. elegans
aaaaagtctcata

SEQ ID NO: 682818 - DNA, 13 bp, C. elegans
aaaaagtctggaa

SEQ ID NO: 682819 - DNA, 13 bp, C. elegans
aaaaagtcttgaa

SEQ ID NO: 682820 - DNA, 13 bp, C. elegans
aaaaagtgaagtt

SEQ ID NO: 682821 - DNA, 13 bp, C. elegans
aaaaagtgaattt

SEQ ID NO: 682822 - DNA, 13 bp, C. elegans
aaaaagtgaccaa

SEQ ID NO: 682823 - DNA, 13 bp, C. elegans
aaaaagtgacgaa

SEQ ID NO: 682824 - DNA, 13 bp, C. elegans
aaaaagtgagatg

SEQ ID NO: 682825 - DNA, 13 bp, C. elegans
aaaaagtgatcaa

SEQ ID NO: 682826 - DNA, 13 bp, C. elegans
aaaaagtgcaaat

SEQ ID NO: 682827 - DNA, 13 bp, C. elegans
aaaaagtgcaaca

SEQ ID NO: 682828 - DNA, 13 bp, C. elegans
aaaaagtgcagtt

SEQ ID NO: 682829 - DNA, 13 bp, C. elegans
aaaaagtgcataa

SEQ ID NO: 682830 - DNA, 13 bp, C. elegans
aaaaagtgcattt

SEQ ID NO: 682831 - DNA, 13 bp, C. elegans
aaaaagtgctcaa

SEQ ID NO: 682832 - DNA, 13 bp, C. elegans
aaaaagtgctctt

SEQ ID NO: 682833 - DNA, 13 bp, C. elegans
aaaaagtggaaca

SEQ ID NO: 682834 - DNA, 13 bp, C. elegans
aaaaagtggcaaa

SEQ ID NO: 682835 - DNA, 13 bp, C. elegans
aaaaagtggtgtt

SEQ ID NO: 682836 - DNA, 13 bp, C. elegans
aaaaagtggttct

SEQ ID NO: 682837 - DNA, 13 bp, C. elegans
aaaaagtggtttc

SEQ ID NO: 682838 - DNA, 13 bp, C. elegans
aaaaagtgtagtt

SEQ ID NO: 682839 - DNA, 13 bp, C. elegans
aaaaagtgtcaca

SEQ ID NO: 682840 - DNA, 13 bp, C. elegans
aaaaagtgtctca

SEQ ID NO: 682841 - DNA, 13 bp, C. elegans
aaaaagtgtgata

SEQ ID NO: 682842 - DNA, 13 bp, C. elegans
aaaaagtgtgctt

SEQ ID NO: 682843 - DNA, 13 bp, C. elegans
aaaaagtgtggaa

SEQ ID NO: 682844 - DNA, 13 bp, C. elegans
aaaaagtgtgtct

SEQ ID NO: 682845 - DNA, 13 bp, C. elegans
aaaaagtgttcaa

SEQ ID NO: 682846 - DNA, 13 bp, C. elegans
aaaaagtgttcag

SEQ ID NO: 682847 - DNA, 13 bp, C. elegans
aaaaagtgttctc

SEQ ID NO: 682848 - DNA, 13 bp, C. elegans
aaaaagtgttgtt

SEQ ID NO: 682849 - DNA, 13 bp, C. elegans
aaaaagtgtttca

SEQ ID NO: 682850 - DNA, 13 bp, C. elegans
aaaaagtgtttct

SEQ ID NO: 682851 - DNA, 13 bp, C. elegans
aaaaagttacaat

SEQ ID NO: 682852 - DNA, 13 bp, C. elegans
aaaaagttacttt

SEQ ID NO: 682853 - DNA, 13 bp, C. elegans
aaaaagttagttt

SEQ ID NO: 682854 - DNA, 13 bp, C. elegans
aaaaagttatcaa

SEQ ID NO: 682855 - DNA, 13 bp, C. elegans
aaaaagttatcag

SEQ ID NO: 682856 - DNA, 13 bp, C. elegans
aaaaagttatttg

SEQ ID NO: 682857 - DNA, 13 bp, C. elegans
aaaaagttcaata

SEQ ID NO: 682858 - DNA, 13 bp, C. elegans
aaaaagttcaatt

SEQ ID NO: 682859 - DNA, 13 bp, C. elegans
aaaaagttcacaa

SEQ ID NO: 682860 - DNA, 13 bp, C. elegans
aaaaagttcacca

SEQ ID NO: 682861 - DNA, 13 bp, C. elegans
aaaaagttcagga

SEQ ID NO: 682862 - DNA, 13 bp, C. elegans
aaaaagttcatat

SEQ ID NO: 682863 - DNA, 13 bp, C. elegans
aaaaagttcatgt

SEQ ID NO: 682864 - DNA, 13 bp, C. elegans
aaaaagttcgaaa

SEQ ID NO: 682865 - DNA, 13 bp, C. elegans
aaaaagttcgaca

SEQ ID NO: 682866 - DNA, 13 bp, C. elegans
aaaaagttcgcaa

SEQ ID NO: 682867 - DNA, 13 bp, C. elegans
aaaaagttctcaa

SEQ ID NO: 682868 - DNA, 13 bp, C. elegans
aaaaagttctgaa

SEQ ID NO: 682869 - DNA, 13 bp, C. elegans
aaaaagttcttct

SEQ ID NO: 682870 - DNA, 13 bp, C. elegans
aaaaagttgaaca

SEQ ID NO: 682871 - DNA, 13 bp, C. elegans
aaaaagttgaact

SEQ ID NO: 682872 - DNA, 13 bp, C. elegans
aaaaagttgattg

SEQ ID NO: 682873 - DNA, 13 bp, C. elegans
aaaaagttgccaa

SEQ ID NO: 682874 - DNA, 13 bp, C. elegans
aaaaagttgccta

SEQ ID NO: 682875 - DNA, 13 bp, C. elegans
aaaaagttggaat

SEQ ID NO: 682876 - DNA, 13 bp, C. elegans
aaaaagttggttt

SEQ ID NO: 682877 - DNA, 13 bp, C. elegans
aaaaagttgtcaa

SEQ ID NO: 682878 - DNA, 13 bp, C. elegans
aaaaagttgtcac

SEQ ID NO: 682879 - DNA, 13 bp, C. elegans
aaaaagttgtggg

SEQ ID NO: 682880 - DNA, 13 bp, C. elegans
aaaaagttgttaa

SEQ ID NO: 682881 - DNA, 13 bp, C. elegans
aaaaagttgttga

SEQ ID NO: 682882 - DNA, 13 bp, C. elegans
aaaaagttgttgt

SEQ ID NO: 682883 - DNA, 13 bp, C. elegans
aaaaagttgtttc

SEQ ID NO: 682884 - DNA, 13 bp, C. elegans
aaaaagttgtttt

SEQ ID NO: 682885 - DNA, 13 bp, C. elegans
aaaaagtttaact

SEQ ID NO: 682886 - DNA, 13 bp, C. elegans
aaaaagtttactt

SEQ ID NO: 682887 - DNA, 13 bp, C. elegans
aaaaagtttagca

SEQ ID NO: 682888 - DNA, 13 bp, C. elegans
aaaaagtttaggt

SEQ ID NO: 682889 - DNA, 13 bp, C. elegans
aaaaagtttatgg

SEQ ID NO: 682890 - DNA, 13 bp, C. elegans
aaaaagtttcaaa

SEQ ID NO: 682891 - DNA, 13 bp, C. elegans
aaaaagtttcact

SEQ ID NO: 682892 - DNA, 13 bp, C. elegans
aaaaagtttccaa

SEQ ID NO: 682893 - DNA, 13 bp, C. elegans
aaaaagtttccca

SEQ ID NO: 682894 - DNA, 13 bp, C. elegans
aaaaagtttcgga

SEQ ID NO: 682895 - DNA, 13 bp, C. elegans
aaaaagtttctcc

SEQ ID NO: 682896 - DNA, 13 bp, C. elegans
aaaaagtttctga

SEQ ID NO: 682897 - DNA, 13 bp, C. elegans
aaaaagtttgaag

SEQ ID NO: 682898 - DNA, 13 bp, C. elegans
aaaaagtttgata

SEQ ID NO: 682899 - DNA, 13 bp, C. elegans
aaaaagtttgccg

SEQ ID NO: 682900 - DNA, 13 bp, C. elegans
aaaaagtttggaa

SEQ ID NO: 682901 - DNA, 13 bp, C. elegans
aaaaagtttgttt

SEQ ID NO: 682902 - DNA, 13 bp, C. elegans
aaaaagttttaca

SEQ ID NO: 682903 - DNA, 13 bp, C. elegans
aaaaagttttcaa

SEQ ID NO: 682904 - DNA, 13 bp, C. elegans
aaaaagttttgga

SEQ ID NO: 682905 - DNA, 13 bp, C. elegans
aaaaagttttgta

SEQ ID NO: 682906 - DNA, 13 bp, C. elegans
aaaaataaatccg

SEQ ID NO: 682907 - DNA, 13 bp, C. elegans
aaaaataattgca

SEQ ID NO: 682908 - DNA, 13 bp, C. elegans
aaaaataattgtg

SEQ ID NO: 682909 - DNA, 13 bp, C. elegans
aaaaatacaagtt

SEQ ID NO: 682910 - DNA, 13 bp, C. elegans
aaaaatacagttt

SEQ ID NO: 682911 - DNA, 13 bp, C. elegans
aaaaatacattgt

SEQ ID NO: 682912 - DNA, 13 bp, C. elegans
aaaaatacatttc

SEQ ID NO: 682913 - DNA, 13 bp, C. elegans
aaaaataccgatt

SEQ ID NO: 682914 - DNA, 13 bp, C. elegans
aaaaatacgagtt

SEQ ID NO: 682915 - DNA, 13 bp, C. elegans
aaaaatacggtac

SEQ ID NO: 682916 - DNA, 13 bp, C. elegans
aaaaatacggtat

SEQ ID NO: 682917 - DNA, 13 bp, C. elegans
aaaaatacgtttt

SEQ ID NO: 682918 - DNA, 13 bp, C. elegans
aaaaatactgttt

SEQ ID NO: 682919 - DNA, 13 bp, C. elegans
aaaaatactttgt

SEQ ID NO: 682920 - DNA, 13 bp, C. elegans
aaaaatagagttt

SEQ ID NO: 682921 - DNA, 15 bp, C. elegans
aaaaatagattgtta

SEQ ID NO: 682922 - DNA, 13 bp, C. elegans
aaaaatagcaatt

SEQ ID NO: 682923 - DNA, 13 bp, C. elegans
aaaaatagcttta

SEQ ID NO: 682924 - DNA, 13 bp, C. elegans
aaaaatagtattg

SEQ ID NO: 682925 - DNA, 13 bp, C. elegans
aaaaatagtctaa

SEQ ID NO: 682926 - DNA, 13 bp, C. elegans
aaaaatagttatg

SEQ ID NO: 682927 - DNA, 13 bp, C. elegans
aaaaatagttgtt

SEQ ID NO: 682928 - DNA, 13 bp, C. elegans
aaaaatatcagtt

SEQ ID NO: 682929 - DNA, 13 bp, C. elegans
aaaaatatcgatt

SEQ ID NO: 682930 - DNA, 13 bp, C. elegans
aaaaatatctgaa

SEQ ID NO: 682931 - DNA, 13 bp, C. elegans
aaaaatatctgca

SEQ ID NO: 682932 - DNA, 13 bp, C. elegans
aaaaatatgaagc

SEQ ID NO: 682933 - DNA, 13 bp, C. elegans
aaaaatatgccat

SEQ ID NO: 682934 - DNA, 13 bp, C. elegans
aaaaatatgtgat

SEQ ID NO: 682935 - DNA, 13 bp, C. elegans
aaaaatatgttca

SEQ ID NO: 682936 - DNA, 13 bp, C. elegans
aaaaatattcgaa

SEQ ID NO: 682937 - DNA, 13 bp, C. elegans
aaaaatattctga

SEQ ID NO: 682938 - DNA, 13 bp, C. elegans
aaaaatattgatg

SEQ ID NO: 682939 - DNA, 13 bp, C. elegans
aaaaatattgcca

SEQ ID NO: 682940 - DNA, 13 bp, C. elegans
aaaaatattggtt

SEQ ID NO: 682941 - DNA, 13 bp, C. elegans
aaaaatattgtgt

SEQ ID NO: 682942 - DNA, 13 bp, C. elegans
aaaaatatttcca

SEQ ID NO: 682943 - DNA, 13 bp, C. elegans
aaaaatatttcct

SEQ ID NO: 682944 - DNA, 13 bp, C. elegans
aaaaatatttgct

SEQ ID NO: 682945 - DNA, 13 bp, C. elegans
aaaaatattttcc

SEQ ID NO: 682946 - DNA, 13 bp, C. elegans
aaaaatcaaagct

SEQ ID NO: 682947 - DNA, 13 bp, C. elegans
aaaaatcaacagt

SEQ ID NO: 682948 - DNA, 13 bp, C. elegans
aaaaatcaagttt

SEQ ID NO: 682949 - DNA, 13 bp, C. elegans
aaaaatcacagtt

SEQ ID NO: 682950 - DNA, 13 bp, C. elegans
aaaaatcacatga

SEQ ID NO: 682951 - DNA, 13 bp, C. elegans
aaaaatcacttga

SEQ ID NO: 682952 - DNA, 13 bp, C. elegans
aaaaatcagatga

SEQ ID NO: 682953 - DNA, 13 bp, C. elegans
aaaaatcagccaa

SEQ ID NO: 682954 - DNA, 13 bp, C. elegans
aaaaatcagtaat

SEQ ID NO: 682955 - DNA, 13 bp, C. elegans
aaaaatcagtgat

SEQ ID NO: 682956 - DNA, 13 bp, C. elegans
aaaaatcagtgct

SEQ ID NO: 682957 - DNA, 13 bp, C. elegans
aaaaatcagttat

SEQ ID NO: 682958 - DNA, 13 bp, C. elegans
aaaaatcagtttc

SEQ ID NO: 682959 - DNA, 13 bp, C. elegans
aaaaatcagtttt

SEQ ID NO: 682960 - DNA, 13 bp, C. elegans
aaaaatcatgcaa

SEQ ID NO: 682961 - DNA, 13 bp, C. elegans
aaaaatcatggaa

SEQ ID NO: 682962 - DNA, 13 bp, C. elegans
aaaaatcatttct

SEQ ID NO: 682963 - DNA, 13 bp, C. elegans
aaaaatcatttga

SEQ ID NO: 682964 - DNA, 13 bp, C. elegans
aaaaatccacgtg

SEQ ID NO: 682965 - DNA, 13 bp, C. elegans
aaaaatccatttt

SEQ ID NO: 682966 - DNA, 13 bp, C. elegans
aaaaatcccatta

SEQ ID NO: 682967 - DNA, 13 bp, C. elegans
aaaaatccccatt

SEQ ID NO: 682968 - DNA, 13 bp, C. elegans
aaaaatcccctta

SEQ ID NO: 682969 - DNA, 13 bp, C. elegans
aaaaatcccgaat

SEQ ID NO: 682970 - DNA, 13 bp, C. elegans
aaaaatccctcca

SEQ ID NO: 682971 - DNA, 13 bp, C. elegans
aaaaatcccttta

SEQ ID NO: 682972 - DNA, 13 bp, C. elegans
aaaaatccgaata

SEQ ID NO: 682973 - DNA, 13 bp, C. elegans
aaaaatcctgaaa

SEQ ID NO: 682974 - DNA, 13 bp, C. elegans
aaaaatcgaaact

SEQ ID NO: 682975 - DNA, 13 bp, C. elegans
aaaaatcgaaatt

SEQ ID NO: 682976 - DNA, 13 bp, C. elegans
aaaaatcgaacat

SEQ ID NO: 682977 - DNA, 13 bp, C. elegans
aaaaatcgaatat

SEQ ID NO: 682978 - DNA, 13 bp, C. elegans
aaaaatcgaattt

SEQ ID NO: 682979 - DNA, 13 bp, C. elegans
aaaaatcgacatt

SEQ ID NO: 682980 - DNA, 13 bp, C. elegans
aaaaatcgagcaa

SEQ ID NO: 682981 - DNA, 13 bp, C. elegans
aaaaatcgataat

SEQ ID NO: 682982 - DNA, 13 bp, C. elegans
aaaaatcgatact

SEQ ID NO: 682983 - DNA, 13 bp, C. elegans
aaaaatcgatatt

SEQ ID NO: 682984 - DNA, 13 bp, C. elegans
aaaaatcgattaa

SEQ ID NO: 682985 - DNA, 13 bp, C. elegans
aaaaatcgatttt

SEQ ID NO: 682986 - DNA, 13 bp, C. elegans
aaaaatcgcattt

SEQ ID NO: 682987 - DNA, 13 bp, C. elegans
aaaaatcgccatt

SEQ ID NO: 682988 - DNA, 13 bp, C. elegans
aaaaatcgcgaaa

SEQ ID NO: 682989 - DNA, 13 bp, C. elegans
aaaaatcggaaag

SEQ ID NO: 682990 - DNA, 13 bp, C. elegans
aaaaatcggacaa

SEQ ID NO: 682991 - DNA, 13 bp, C. elegans
aaaaatcggagaa

SEQ ID NO: 682992 - DNA, 13 bp, C. elegans
aaaaatcggattt

SEQ ID NO: 682993 - DNA, 13 bp, C. elegans
aaaaatcggctga

SEQ ID NO: 682994 - DNA, 13 bp, C. elegans
aaaaatcgggaaa

SEQ ID NO: 682995 - DNA, 13 bp, C. elegans
aaaaatcggtggc

SEQ ID NO: 682996 - DNA, 13 bp, C. elegans
aaaaatcggtttt

SEQ ID NO: 682997 - DNA, 13 bp, C. elegans
aaaaatcgtatat

SEQ ID NO: 682998 - DNA, 13 bp, C. elegans
aaaaatcgtcaga

SEQ ID NO: 682999 - DNA, 13 bp, C. elegans
aaaaatcgtggaa

SEQ ID NO: 683000 - DNA, 13 bp, C. elegans
aaaaatcgtgtaa

SEQ ID NO: 683001 - DNA, 13 bp, C. elegans
aaaaatcgttatt

SEQ ID NO: 683002 - DNA, 13 bp, C. elegans
aaaaatcgttcaa

SEQ ID NO: 683003 - DNA, 13 bp, C. elegans
aaaaatcgttgaa

SEQ ID NO: 683004 - DNA, 13 bp, C. elegans
aaaaatcgtttga

SEQ ID NO: 683005 - DNA, 13 bp, C. elegans
aaaaatcgtttgc

SEQ ID NO: 683006 - DNA, 13 bp, C. elegans
aaaaatctacagt

SEQ ID NO: 683007 - DNA, 13 bp, C. elegans
aaaaatctactca

SEQ ID NO: 683008 - DNA, 13 bp, C. elegans
aaaaatctacttg

SEQ ID NO: 683009 - DNA, 13 bp, C. elegans
aaaaatctagtga

SEQ ID NO: 683010 - DNA, 13 bp, C. elegans
aaaaatctatctg

SEQ ID NO: 683011 - DNA, 13 bp, C. elegans
aaaaatctcagat

SEQ ID NO: 683012 - DNA, 13 bp, C. elegans
aaaaatctcagtt

SEQ ID NO: 683013 - DNA, 13 bp, C. elegans
aaaaatctcatta

SEQ ID NO: 683014 - DNA, 13 bp, C. elegans
aaaaatctcattt

SEQ ID NO: 683015 - DNA, 13 bp, C. elegans
aaaaatctcgccg

SEQ ID NO: 683016 - DNA, 13 bp, C. elegans
aaaaatctcgtga

SEQ ID NO: 683017 - DNA, 13 bp, C. elegans
aaaaatctctcca

SEQ ID NO: 683018 - DNA, 13 bp, C. elegans
aaaaatctcttca

SEQ ID NO: 683019 - DNA, 13 bp, C. elegans
aaaaatctctttt

SEQ ID NO: 683020 - DNA, 13 bp, C. elegans
aaaaatctgaaac

SEQ ID NO: 683021 - DNA, 13 bp, C. elegans
aaaaatctggaaa

SEQ ID NO: 683022 - DNA, 13 bp, C. elegans
aaaaatctggtca

SEQ ID NO: 683023 - DNA, 13 bp, C. elegans
aaaaatctggttt

SEQ ID NO: 683024 - DNA, 13 bp, C. elegans
aaaaatctgtaaa

SEQ ID NO: 683025 - DNA, 13 bp, C. elegans
aaaaatctgtaat

SEQ ID NO: 683026 - DNA, 13 bp, C. elegans
aaaaatctgtatt

SEQ ID NO: 683027 - DNA, 13 bp, C. elegans
aaaaatctgtctt

SEQ ID NO: 683028 - DNA, 13 bp, C. elegans
aaaaatctgtgaa

SEQ ID NO: 683029 - DNA, 13 bp, C. elegans
aaaaatctgtttt

SEQ ID NO: 683030 - DNA, 13 bp, C. elegans
aaaaatcttcgaa

SEQ ID NO: 683031 - DNA, 13 bp, C. elegans
aaaaatcttctat

SEQ ID NO: 683032 - DNA, 13 bp, C. elegans
aaaaatcttgaaa

SEQ ID NO: 683033 - DNA, 13 bp, C. elegans
aaaaatcttgaat

SEQ ID NO: 683034 - DNA, 13 bp, C. elegans
aaaaatcttgaca

SEQ ID NO: 683035 - DNA, 13 bp, C. elegans
aaaaatcttgttt

SEQ ID NO: 683036 - DNA, 13 bp, C. elegans
aaaaatctttaac

SEQ ID NO: 683037 - DNA, 13 bp, C. elegans
aaaaatctttcct

SEQ ID NO: 683038 - DNA, 13 bp, C. elegans
aaaaatgaaactg

SEQ ID NO: 683039 - DNA, 13 bp, C. elegans
aaaaatgaaattc

SEQ ID NO: 683040 - DNA, 13 bp, C. elegans
aaaaatgaacttt

SEQ ID NO: 683041 - DNA, 13 bp, C. elegans
aaaaatgaagttt

SEQ ID NO: 683042 - DNA, 13 bp, C. elegans
aaaaatgaattgt

SEQ ID NO: 683043 - DNA, 13 bp, C. elegans
aaaaatgacatca

SEQ ID NO: 683044 - DNA, 13 bp, C. elegans
aaaaatgacattt

SEQ ID NO: 683045 - DNA, 13 bp, C. elegans
aaaaatgacgtta

SEQ ID NO: 683046 - DNA, 13 bp, C. elegans
aaaaatgactcac

SEQ ID NO: 683047 - DNA, 13 bp, C. elegans
aaaaatgactgaa

SEQ ID NO: 683048 - DNA, 13 bp, C. elegans
aaaaatgactttt

SEQ ID NO: 683049 - DNA, 13 bp, C. elegans
aaaaatgagcgaa

SEQ ID NO: 683050 - DNA, 13 bp, C. elegans
aaaaatgagtcag

SEQ ID NO: 683051 - DNA, 13 bp, C. elegans
aaaaatgatcata

SEQ ID NO: 683052 - DNA, 13 bp, C. elegans
aaaaatgatgttt

SEQ ID NO: 683053 - DNA, 13 bp, C. elegans
aaaaatgattcga

SEQ ID NO: 683054 - DNA, 13 bp, C. elegans
aaaaatgattgtt

SEQ ID NO: 683055 - DNA, 13 bp, C. elegans
aaaaatgcaatat

SEQ ID NO: 683056 - DNA, 13 bp, C. elegans
aaaaatgcaatgt

SEQ ID NO: 683057 - DNA, 13 bp, C. elegans
aaaaatgcaattt

SEQ ID NO: 683058 - DNA, 13 bp, C. elegans
aaaaatgcagaat

SEQ ID NO: 683059 - DNA, 13 bp, C. elegans
aaaaatgcatact

SEQ ID NO: 683060 - DNA, 13 bp, C. elegans
aaaaatgcattaa

SEQ ID NO: 683061 - DNA, 13 bp, C. elegans
aaaaatgcattta

SEQ ID NO: 683062 - DNA, 13 bp, C. elegans
aaaaatgcatttt

SEQ ID NO: 683063 - DNA, 14 bp, C. elegans
aaaaatgccagaaa

SEQ ID NO: 683064 - DNA, 13 bp, C. elegans
aaaaatgccattt

SEQ ID NO: 683065 - DNA, 13 bp, C. elegans
aaaaatgccccaa

SEQ ID NO: 683066 - DNA, 13 bp, C. elegans
aaaaatgccgttt

SEQ ID NO: 683067 - DNA, 13 bp, C. elegans
aaaaatgcgagaa

SEQ ID NO: 683068 - DNA, 13 bp, C. elegans
aaaaatgcggaat

SEQ ID NO: 683069 - DNA, 13 bp, C. elegans
aaaaatgcggatt

SEQ ID NO: 683070 - DNA, 13 bp, C. elegans
aaaaatgcgggaa

SEQ ID NO: 683071 - DNA, 13 bp, C. elegans
aaaaatgctcatt

SEQ ID NO: 683072 - DNA, 13 bp, C. elegans
aaaaatgctccaa

SEQ ID NO: 683073 - DNA, 13 bp, C. elegans
aaaaatgctcgaa

SEQ ID NO: 683074 - DNA, 15 bp, C. elegans
aaaaatgctctgaaa

SEQ ID NO: 683075 - DNA, 13 bp, C. elegans
aaaaatgctgaaa

SEQ ID NO: 683076 - DNA, 13 bp, C. elegans
aaaaatgctgatt

SEQ ID NO: 683077 - DNA, 13 bp, C. elegans
aaaaatgctgcaa

SEQ ID NO: 683078 - DNA, 13 bp, C. elegans
aaaaatgcttcaa

SEQ ID NO: 683079 - DNA, 13 bp, C. elegans
aaaaatgcttgaa

SEQ ID NO: 683080 - DNA, 13 bp, C. elegans
aaaaatgcttgtt

SEQ ID NO: 683081 - DNA, 13 bp, C. elegans
aaaaatgctttaa

SEQ ID NO: 683082 - DNA, 13 bp, C. elegans
aaaaatggaaacg

SEQ ID NO: 683083 - DNA, 13 bp, C. elegans
aaaaatggaaact

SEQ ID NO: 683084 - DNA, 13 bp, C. elegans
aaaaatggaacga

SEQ ID NO: 683085 - DNA, 13 bp, C. elegans
aaaaatggaattt

SEQ ID NO: 683086 - DNA, 13 bp, C. elegans
aaaaatggactca

SEQ ID NO: 683087 - DNA, 13 bp, C. elegans
aaaaatggagcaa

SEQ ID NO: 683088 - DNA, 13 bp, C. elegans
aaaaatggagttt

SEQ ID NO: 683089 - DNA, 13 bp, C. elegans
aaaaatggatttt

SEQ ID NO: 683090 - DNA, 13 bp, C. elegans
aaaaatggcaaga

SEQ ID NO: 683091 - DNA, 13 bp, C. elegans
aaaaatggccgaa

SEQ ID NO: 683092 - DNA, 13 bp, C. elegans
aaaaatggcctaa

SEQ ID NO: 683093 - DNA, 13 bp, C. elegans
aaaaatggcgaaa

SEQ ID NO: 683094 - DNA, 13 bp, C. elegans
aaaaatggcgatt

SEQ ID NO: 683095 - DNA, 13 bp, C. elegans
aaaaatggcgttt

SEQ ID NO: 683096 - DNA, 13 bp, C. elegans
aaaaatggctgaa

SEQ ID NO: 683097 - DNA, 13 bp, C. elegans
aaaaatgggaaac

SEQ ID NO: 683098 - DNA, 13 bp, C. elegans
aaaaatgggacat

SEQ ID NO: 683099 - DNA, 13 bp, C. elegans
aaaaatgggattt

SEQ ID NO: 683100 - DNA, 13 bp, C. elegans
aaaaatgggcatt

SEQ ID NO: 683101 - DNA, 13 bp, C. elegans
aaaaatgggctca

SEQ ID NO: 683102 - DNA, 13 bp, C. elegans
aaaaatggggatt

SEQ ID NO: 683103 - DNA, 13 bp, C. elegans
aaaaatgggtcaa

SEQ ID NO: 683104 - DNA, 13 bp, C. elegans
aaaaatgggtgga

SEQ ID NO: 683105 - DNA, 13 bp, C. elegans
aaaaatggtattt

SEQ ID NO: 683106 - DNA, 13 bp, C. elegans
aaaaatggtgatt

SEQ ID NO: 683107 - DNA, 13 bp, C. elegans
aaaaatggttgaa

SEQ ID NO: 683108 - DNA, 13 bp, C. elegans
aaaaatggtttat

SEQ ID NO: 683109 - DNA, 13 bp, C. elegans
aaaaatggttttc

SEQ ID NO: 683110 - DNA, 13 bp, C. elegans
aaaaatggttttt

SEQ ID NO: 683111 - DNA, 13 bp, C. elegans
aaaaatgtaccta

SEQ ID NO: 683112 - DNA, 13 bp, C. elegans
aaaaatgtactca

SEQ ID NO: 683113 - DNA, 13 bp, C. elegans
aaaaatgtagatt

SEQ ID NO: 683114 - DNA, 13 bp, C. elegans
aaaaatgtatagt

SEQ ID NO: 683115 - DNA, 13 bp, C. elegans
aaaaatgtatcca

SEQ ID NO: 683116 - DNA, 13 bp, C. elegans
aaaaatgtatcta

SEQ ID NO: 683117 - DNA, 13 bp, C. elegans
aaaaatgtatgca

SEQ ID NO: 683118 - DNA, 13 bp, C. elegans
aaaaatgtatgga

SEQ ID NO: 683119 - DNA, 13 bp, C. elegans
aaaaatgtattca

SEQ ID NO: 683120 - DNA, 13 bp, C. elegans
aaaaatgtattcc

SEQ ID NO: 683121 - DNA, 13 bp, C. elegans
aaaaatgtcaaat

SEQ ID NO: 683122 - DNA, 13 bp, C. elegans
aaaaatgtcaatt

SEQ ID NO: 683123 - DNA, 13 bp, C. elegans
aaaaatgtcagtt

SEQ ID NO: 683124 - DNA, 13 bp, C. elegans
aaaaatgtcatat

SEQ ID NO: 683125 - DNA, 13 bp, C. elegans
aaaaatgtcatgt

SEQ ID NO: 683126 - DNA, 13 bp, C. elegans
aaaaatgtcattt

SEQ ID NO: 683127 - DNA, 13 bp, C. elegans
aaaaatgtccaaa

SEQ ID NO: 683128 - DNA, 13 bp, C. elegans
aaaaatgtcgatt

SEQ ID NO: 683129 - DNA, 13 bp, C. elegans
aaaaatgtcgttt

SEQ ID NO: 683130 - DNA, 13 bp, C. elegans
aaaaatgtctgga

SEQ ID NO: 683131 - DNA, 13 bp, C. elegans
aaaaatgtcttct

SEQ ID NO: 683132 - DNA, 13 bp, C. elegans
aaaaatgtctttt

SEQ ID NO: 683133 - DNA, 13 bp, C. elegans
aaaaatgtgaatt

SEQ ID NO: 683134 - DNA, 13 bp, C. elegans
aaaaatgtgacgt

SEQ ID NO: 683135 - DNA, 13 bp, C. elegans
aaaaatgtgattt

SEQ ID NO: 683136 - DNA, 14 bp, C. elegans
aaaaatgtgcaaac

SEQ ID NO: 683137 - DNA, 13 bp, C. elegans
aaaaatgtgcaat

SEQ ID NO: 683138 - DNA, 13 bp, C. elegans
aaaaatgtgcaca

SEQ ID NO: 683139 - DNA, 13 bp, C. elegans
aaaaatgtgccaa

SEQ ID NO: 683140 - DNA, 13 bp, C. elegans
aaaaatgtgcctt

SEQ ID NO: 683141 - DNA, 13 bp, C. elegans
aaaaatgtggaat

SEQ ID NO: 683142 - DNA, 13 bp, C. elegans
aaaaatgtggcaa

SEQ ID NO: 683143 - DNA, 13 bp, C. elegans
aaaaatgtgtcaa

SEQ ID NO: 683144 - DNA, 13 bp, C. elegans
aaaaatgtgtcga

SEQ ID NO: 683145 - DNA, 13 bp, C. elegans
aaaaatgtgtgaa

SEQ ID NO: 683146 - DNA, 13 bp, C. elegans
aaaaatgtgtgcg

SEQ ID NO: 683147 - DNA, 13 bp, C. elegans
aaaaatgtgtgga

SEQ ID NO: 683148 - DNA, 13 bp, C. elegans
aaaaatgttatca

SEQ ID NO: 683149 - DNA, 13 bp, C. elegans
aaaaatgttcaat

SEQ ID NO: 683150 - DNA, 13 bp, C. elegans
aaaaatgttcgaa

SEQ ID NO: 683151 - DNA, 13 bp, C. elegans
aaaaatgttctaa

SEQ ID NO: 683152 - DNA, 13 bp, C. elegans
aaaaatgttctct

SEQ ID NO: 683153 - DNA, 13 bp, C. elegans
aaaaatgttgatt

SEQ ID NO: 683154 - DNA, 13 bp, C. elegans
aaaaatgttgcaa

SEQ ID NO: 683155 - DNA, 13 bp, C. elegans
aaaaatgttgtaa

SEQ ID NO: 683156 - DNA, 13 bp, C. elegans
aaaaatgtttaac

SEQ ID NO: 683157 - DNA, 13 bp, C. elegans
aaaaatgtttcag

SEQ ID NO: 683158 - DNA, 13 bp, C. elegans
aaaaatgttttac

SEQ ID NO: 683159 - DNA, 13 bp, C. elegans
aaaaatgttttct

SEQ ID NO: 683160 - DNA, 13 bp, C. elegans
aaaaatgttttgt

SEQ ID NO: 683161 - DNA, 13 bp, C. elegans
aaaaatgtttttc

SEQ ID NO: 683162 - DNA, 13 bp, C. elegans
aaaaattaatctc

SEQ ID NO: 683163 - DNA, 13 bp, C. elegans
aaaaattacgtgt

SEQ ID NO: 683164 - DNA, 13 bp, C. elegans
aaaaattactgaa

SEQ ID NO: 683165 - DNA, 13 bp, C. elegans
aaaaattactgtt

SEQ ID NO: 683166 - DNA, 13 bp, C. elegans
aaaaattacttga

SEQ ID NO: 683167 - DNA, 13 bp, C. elegans
aaaaattagagct

SEQ ID NO: 683168 - DNA, 13 bp, C. elegans
aaaaattaggtca

SEQ ID NO: 683169 - DNA, 13 bp, C. elegans
aaaaattatcatg

SEQ ID NO: 683170 - DNA, 13 bp, C. elegans
aaaaattatcttc

SEQ ID NO: 683171 - DNA, 13 bp, C. elegans
aaaaattatgctg

SEQ ID NO: 683172 - DNA, 13 bp, C. elegans
aaaaattatgtac

SEQ ID NO: 683173 - DNA, 13 bp, C. elegans
aaaaattattcct

SEQ ID NO: 683174 - DNA, 13 bp, C. elegans
aaaaattattctc

SEQ ID NO: 683175 - DNA, 13 bp, C. elegans
aaaaattcaaccg

SEQ ID NO: 683176 - DNA, 13 bp, C. elegans
aaaaattcaactg

SEQ ID NO: 683177 - DNA, 13 bp, C. elegans
aaaaattcaagtt

SEQ ID NO: 683178 - DNA, 13 bp, C. elegans
aaaaattcaatct

SEQ ID NO: 683179 - DNA, 13 bp, C. elegans
aaaaattcaatga

SEQ ID NO: 683180 - DNA, 13 bp, C. elegans
aaaaattcaatgt

SEQ ID NO: 683181 - DNA, 13 bp, C. elegans
aaaaattcagatt

SEQ ID NO: 683182 - DNA, 13 bp, C. elegans
aaaaattcagcac

SEQ ID NO: 683183 - DNA, 13 bp, C. elegans
aaaaattcaggaa

SEQ ID NO: 683184 - DNA, 13 bp, C. elegans
aaaaattcagttt

SEQ ID NO: 683185 - DNA, 13 bp, C. elegans
aaaaattccatca

SEQ ID NO: 683186 - DNA, 13 bp, C. elegans
aaaaattccccaa

SEQ ID NO: 683187 - DNA, 13 bp, C. elegans
aaaaattccgaaa

SEQ ID NO: 683188 - DNA, 13 bp, C. elegans
aaaaattccgaat

SEQ ID NO: 683189 - DNA, 13 bp, C. elegans
aaaaattcctaat

SEQ ID NO: 683190 - DNA, 13 bp, C. elegans
aaaaattcgaaag

SEQ ID NO: 683191 - DNA, 13 bp, C. elegans
aaaaattcgaata

SEQ ID NO: 683192 - DNA, 13 bp, C. elegans
aaaaattcgattg

SEQ ID NO: 683193 - DNA, 13 bp, C. elegans
aaaaattcgattt

SEQ ID NO: 683194 - DNA, 13 bp, C. elegans
aaaaattcgcaaa

SEQ ID NO: 683195 - DNA, 13 bp, C. elegans
aaaaattcgcaat

SEQ ID NO: 683196 - DNA, 13 bp, C. elegans
aaaaattcgcaga

SEQ ID NO: 683197 - DNA, 13 bp, C. elegans
aaaaattcgcgtt

SEQ ID NO: 683198 - DNA, 13 bp, C. elegans
aaaaattcggaaa

SEQ ID NO: 683199 - DNA, 13 bp, C. elegans
aaaaattcgtcaa

SEQ ID NO: 683200 - DNA, 13 bp, C. elegans
aaaaattcgtgat

SEQ ID NO: 683201 - DNA, 13 bp, C. elegans
aaaaattctccca

SEQ ID NO: 683202 - DNA, 13 bp, C. elegans
aaaaattctcgaa

SEQ ID NO: 683203 - DNA, 13 bp, C. elegans
aaaaattctgata

SEQ ID NO: 683204 - DNA, 13 bp, C. elegans
aaaaattctgcga

SEQ ID NO: 683205 - DNA, 13 bp, C. elegans
aaaaattcttgaa

SEQ ID NO: 683206 - DNA, 13 bp, C. elegans
aaaaattcttgat

SEQ ID NO: 683207 - DNA, 13 bp, C. elegans
aaaaattcttgca

SEQ ID NO: 683208 - DNA, 13 bp, C. elegans
aaaaattctttca

SEQ ID NO: 683209 - DNA, 13 bp, C. elegans
aaaaattctttga

SEQ ID NO: 683210 - DNA, 13 bp, C. elegans
aaaaattgaattc

SEQ ID NO: 683211 - DNA, 14 bp, C. elegans
aaaaattgacgaaa

SEQ ID NO: 683212 - DNA, 13 bp, C. elegans
aaaaattgatatc

SEQ ID NO: 683213 - DNA, 13 bp, C. elegans
aaaaattgatcga

SEQ ID NO: 683214 - DNA, 13 bp, C. elegans
aaaaattgatgat

SEQ ID NO: 683215 - DNA, 13 bp, C. elegans
aaaaattgatgga

SEQ ID NO: 683216 - DNA, 13 bp, C. elegans
aaaaattgattga

SEQ ID NO: 683217 - DNA, 13 bp, C. elegans
aaaaattgatttc

SEQ ID NO: 683218 - DNA, 13 bp, C. elegans
aaaaattgcaaag

SEQ ID NO: 683219 - DNA, 13 bp, C. elegans
aaaaattgcaaat

SEQ ID NO: 683220 - DNA, 13 bp, C. elegans
aaaaattgcagaa

SEQ ID NO: 683221 - DNA, 13 bp, C. elegans
aaaaattgccgat

SEQ ID NO: 683222 - DNA, 13 bp, C. elegans
aaaaattgccggt

SEQ ID NO: 683223 - DNA, 13 bp, C. elegans
aaaaattgcggaa

SEQ ID NO: 683224 - DNA, 13 bp, C. elegans
aaaaattgctaat

SEQ ID NO: 683225 - DNA, 13 bp, C. elegans
aaaaattgcttga

SEQ ID NO: 683226 - DNA, 13 bp, C. elegans
aaaaattgcttta

SEQ ID NO: 683227 - DNA, 13 bp, C. elegans
aaaaattggagat

SEQ ID NO: 683228 - DNA, 13 bp, C. elegans
aaaaattggagtt

SEQ ID NO: 683229 - DNA, 13 bp, C. elegans
aaaaattggccaa

SEQ ID NO: 683230 - DNA, 13 bp, C. elegans
aaaaattggccca

SEQ ID NO: 683231 - DNA, 13 bp, C. elegans
aaaaattggctaa

SEQ ID NO: 683232 - DNA, 13 bp, C. elegans
aaaaattggctga

SEQ ID NO: 683233 - DNA, 13 bp, C. elegans
aaaaattggcttc

SEQ ID NO: 683234 - DNA, 13 bp, C. elegans
aaaaattgggaat

SEQ ID NO: 683235 - DNA, 13 bp, C. elegans
aaaaattggtttt

SEQ ID NO: 683236 - DNA, 13 bp, C. elegans
aaaaattgtaaca

SEQ ID NO: 683237 - DNA, 13 bp, C. elegans
aaaaattgtagat

SEQ ID NO: 683238 - DNA, 13 bp, C. elegans
aaaaattgtccga

SEQ ID NO: 683239 - DNA, 13 bp, C. elegans
aaaaattgtctaa

SEQ ID NO: 683240 - DNA, 13 bp, C. elegans
aaaaattgtcttt

SEQ ID NO: 683241 - DNA, 13 bp, C. elegans
aaaaattgtggtt

SEQ ID NO: 683242 - DNA, 13 bp, C. elegans
aaaaattgttcaa

SEQ ID NO: 683243 - DNA, 13 bp, C. elegans
aaaaattgttctt

SEQ ID NO: 683244 - DNA, 13 bp, C. elegans
aaaaattgttgaa

SEQ ID NO: 683245 - DNA, 13 bp, C. elegans
aaaaattgttgta

SEQ ID NO: 683246 - DNA, 13 bp, C. elegans
aaaaattgttgtt

SEQ ID NO: 683247 - DNA, 13 bp, C. elegans
aaaaattgtttcc

SEQ ID NO: 683248 - DNA, 13 bp, C. elegans
aaaaattgtttcg

SEQ ID NO: 683249 - DNA, 13 bp, C. elegans
aaaaattgtttct

SEQ ID NO: 683250 - DNA, 13 bp, C. elegans
aaaaattgttttc

SEQ ID NO: 683251 - DNA, 13 bp, C. elegans
aaaaattgttttg

SEQ ID NO: 683252 - DNA, 13 bp, C. elegans
aaaaatttacttg

SEQ ID NO: 683253 - DNA, 13 bp, C. elegans
aaaaatttagcaa

SEQ ID NO: 683254 - DNA, 13 bp, C. elegans
aaaaatttcaaag

SEQ ID NO: 683255 - DNA, 13 bp, C. elegans
aaaaatttcaact

SEQ ID NO: 683256 - DNA, 13 bp, C. elegans
aaaaatttcacgt

SEQ ID NO: 683257 - DNA, 13 bp, C. elegans
aaaaatttcagaa

SEQ ID NO: 683258 - DNA, 13 bp, C. elegans
aaaaatttcagct

SEQ ID NO: 683259 - DNA, 13 bp, C. elegans
aaaaatttccaat

SEQ ID NO: 683260 - DNA, 13 bp, C. elegans
aaaaatttccgaa

SEQ ID NO: 683261 - DNA, 13 bp, C. elegans
aaaaatttccgtt

SEQ ID NO: 683262 - DNA, 13 bp, C. elegans
aaaaatttcgaca

SEQ ID NO: 683263 - DNA, 13 bp, C. elegans
aaaaatttcgtta

SEQ ID NO: 683264 - DNA, 13 bp, C. elegans
aaaaatttcgttt

SEQ ID NO: 683265 - DNA, 13 bp, C. elegans
aaaaatttctagt

SEQ ID NO: 683266 - DNA, 13 bp, C. elegans
aaaaatttctcaa

SEQ ID NO: 683267 - DNA, 13 bp, C. elegans
aaaaatttctcat

SEQ ID NO: 683268 - DNA, 13 bp, C. elegans
aaaaatttctcta

SEQ ID NO: 683269 - DNA, 13 bp, C. elegans
aaaaatttcttca

SEQ ID NO: 683270 - DNA, 13 bp, C. elegans
aaaaatttgaaca

SEQ ID NO: 683271 - DNA, 13 bp, C. elegans
aaaaatttgagtt

SEQ ID NO: 683272 - DNA, 13 bp, C. elegans
aaaaatttgcaac

SEQ ID NO: 683273 - DNA, 13 bp, C. elegans
aaaaatttgcaat

SEQ ID NO: 683274 - DNA, 13 bp, C. elegans
aaaaatttggcgg

SEQ ID NO: 683275 - DNA, 13 bp, C. elegans
aaaaatttggctg

SEQ ID NO: 683276 - DNA, 13 bp, C. elegans
aaaaatttggtgg

SEQ ID NO: 683277 - DNA, 13 bp, C. elegans
aaaaatttgtcaa

SEQ ID NO: 683278 - DNA, 13 bp, C. elegans
aaaaatttgtcat

SEQ ID NO: 683279 - DNA, 13 bp, C. elegans
aaaaatttgtgaa

SEQ ID NO: 683280 - DNA, 13 bp, C. elegans
aaaaatttgttgg

SEQ ID NO: 683281 - DNA, 13 bp, C. elegans
aaaaattttcaga

SEQ ID NO: 683282 - DNA, 13 bp, C. elegans
aaaaattttcggc

SEQ ID NO: 683283 - DNA, 14 bp, C. elegans
aaaaattttctgaa

SEQ ID NO: 683284 - DNA, 13 bp, C. elegans
aaaaattttgaag

SEQ ID NO: 683285 - DNA, 13 bp, C. elegans
aaaaattttggcg

SEQ ID NO: 683286 - DNA, 13 bp, C. elegans
aaaaattttgtga

SEQ ID NO: 683287 - DNA, 13 bp, C. elegans
aaaaatttttgga

SEQ ID NO: 683288 - DNA, 13 bp, C. elegans
aaaacaaaagttt

SEQ ID NO: 683289 - DNA, 13 bp, C. elegans
aaaacaaaattgt

SEQ ID NO: 683290 - DNA, 13 bp, C. elegans
aaaacaaacagtt

SEQ ID NO: 683291 - DNA, 13 bp, C. elegans
aaaacaaacgttt

SEQ ID NO: 683292 - DNA, 13 bp, C. elegans
aaaacaaactgtt

SEQ ID NO: 683293 - DNA, 13 bp, C. elegans
aaaacaaactttc

SEQ ID NO: 683294 - DNA, 13 bp, C. elegans
aaaacaaagtttt

SEQ ID NO: 683295 - DNA, 13 bp, C. elegans
aaaacaaatctct

SEQ ID NO: 683296 - DNA, 13 bp, C. elegans
aaaacaaatgcac

SEQ ID NO: 683297 - DNA, 13 bp, C. elegans
aaaacaaatgttc

SEQ ID NO: 683298 - DNA, 13 bp, C. elegans
aaaacaaatgttt

SEQ ID NO: 683299 - DNA, 13 bp, C. elegans
aaaacaaattcct

SEQ ID NO: 683300 - DNA, 13 bp, C. elegans
aaaacaaattgat

SEQ ID NO: 683301 - DNA, 13 bp, C. elegans
aaaacaaattgta

SEQ ID NO: 683302 - DNA, 13 bp, C. elegans
aaaacaaattttc

SEQ ID NO: 683303 - DNA, 13 bp, C. elegans
aaaacaaattttg

SEQ ID NO: 683304 - DNA, 13 bp, C. elegans
aaaacaacaactg

SEQ ID NO: 683305 - DNA, 13 bp, C. elegans
aaaacaacaagtg

SEQ ID NO: 683306 - DNA, 13 bp, C. elegans
aaaacaacacttt

SEQ ID NO: 683307 - DNA, 13 bp, C. elegans
aaaacaacagtgg

SEQ ID NO: 683308 - DNA, 13 bp, C. elegans
aaaacaacatagt

SEQ ID NO: 683309 - DNA, 13 bp, C. elegans
aaaacaaccgaat

SEQ ID NO: 683310 - DNA, 13 bp, C. elegans
aaaacaacgaatt

SEQ ID NO: 683311 - DNA, 13 bp, C. elegans
aaaacaacgattt

SEQ ID NO: 683312 - DNA, 13 bp, C. elegans
aaaacaactgaat

SEQ ID NO: 683313 - DNA, 13 bp, C. elegans
aaaacaactgttt

SEQ ID NO: 683314 - DNA, 13 bp, C. elegans
aaaacaacttatt

SEQ ID NO: 683315 - DNA, 13 bp, C. elegans
aaaacaacttgaa

SEQ ID NO: 683316 - DNA, 13 bp, C. elegans
aaaacaacttgat

SEQ ID NO: 683317 - DNA, 13 bp, C. elegans
aaaacaactttca

SEQ ID NO: 683318 - DNA, 13 bp, C. elegans
aaaacaacttttg

SEQ ID NO: 683319 - DNA, 13 bp, C. elegans
aaaacaacttttt

SEQ ID NO: 683320 - DNA, 13 bp, C. elegans
aaaacaagaactt

SEQ ID NO: 683321 - DNA, 13 bp, C. elegans
aaaacaagatcta

SEQ ID NO: 683322 - DNA, 13 bp, C. elegans
aaaacaaggaatt

SEQ ID NO: 683323 - DNA, 13 bp, C. elegans
aaaacaagttcat

SEQ ID NO: 683324 - DNA, 13 bp, C. elegans
aaaacaagttgaa

SEQ ID NO: 683325 - DNA, 13 bp, C. elegans
aaaacaagtttta

SEQ ID NO: 683326 - DNA, 13 bp, C. elegans
aaaacaagttttc

SEQ ID NO: 683327 - DNA, 13 bp, C. elegans
aaaacaataagtt

SEQ ID NO: 683328 - DNA, 13 bp, C. elegans
aaaacaatatgtt

SEQ ID NO: 683329 - DNA, 13 bp, C. elegans
aaaacaatcgttt

SEQ ID NO: 683330 - DNA, 13 bp, C. elegans
aaaacaatgaatg

SEQ ID NO: 683331 - DNA, 13 bp, C. elegans
aaaacaatgtttc

SEQ ID NO: 683332 - DNA, 13 bp, C. elegans
aaaacaattattc

SEQ ID NO: 683333 - DNA, 13 bp, C. elegans
aaaacaattcaga

SEQ ID NO: 683334 - DNA, 13 bp, C. elegans
aaaacaattcatt

SEQ ID NO: 683335 - DNA, 13 bp, C. elegans
aaaacaattgaag

SEQ ID NO: 683336 - DNA, 13 bp, C. elegans
aaaacaattgcaa

SEQ ID NO: 683337 - DNA, 13 bp, C. elegans
aaaacaattgttg

SEQ ID NO: 683338 - DNA, 13 bp, C. elegans
aaaacaatttatg

SEQ ID NO: 683339 - DNA, 13 bp, C. elegans
aaaacaatttcca

SEQ ID NO: 683340 - DNA, 13 bp, C. elegans
aaaacaatttcta

SEQ ID NO: 683341 - DNA, 13 bp, C. elegans
aaaacaatttctt

SEQ ID NO: 683342 - DNA, 13 bp, C. elegans
aaaacaatttgaa

SEQ ID NO: 683343 - DNA, 13 bp, C. elegans
aaaacaatttggt

SEQ ID NO: 683344 - DNA, 13 bp, C. elegans
aaaacaatttgtg

SEQ ID NO: 683345 - DNA, 13 bp, C. elegans
aaaacaattttct

SEQ ID NO: 683346 - DNA, 13 bp, C. elegans
aaaacaatttttg

SEQ ID NO: 683347 - DNA, 13 bp, C. elegans
aaaacacaagttt

SEQ ID NO: 683348 - DNA, 13 bp, C. elegans
aaaacacaatttt

SEQ ID NO: 683349 - DNA, 15 bp, C. elegans
aaaacacaatttttc

SEQ ID NO: 683350 - DNA, 13 bp, C. elegans
aaaacacagtttc

SEQ ID NO: 683351 - DNA, 13 bp, C. elegans
aaaacacagtttt

SEQ ID NO: 683352 - DNA, 13 bp, C. elegans
aaaacacatttca

SEQ ID NO: 683353 - DNA, 13 bp, C. elegans
aaaacacattttt

SEQ ID NO: 683354 - DNA, 13 bp, C. elegans
aaaacaccaattt

SEQ ID NO: 683355 - DNA, 13 bp, C. elegans
aaaacaccgaaat

SEQ ID NO: 683356 - DNA, 13 bp, C. elegans
aaaacacgatttt

SEQ ID NO: 683357 - DNA, 13 bp, C. elegans
aaaacacgtggaa

SEQ ID NO: 683358 - DNA, 13 bp, C. elegans
aaaacacgtggtg

SEQ ID NO: 683359 - DNA, 13 bp, C. elegans
aaaacacgttttc

SEQ ID NO: 683360 - DNA, 13 bp, C. elegans
aaaacactaattt

SEQ ID NO: 683361 - DNA, 13 bp, C. elegans
aaaacactatatt

SEQ ID NO: 683362 - DNA, 13 bp, C. elegans
aaaacactatttt

SEQ ID NO: 683363 - DNA, 13 bp, C. elegans
aaaacactgataa

SEQ ID NO: 683364 - DNA, 13 bp, C. elegans
aaaacactgattt

SEQ ID NO: 683365 - DNA, 13 bp, C. elegans
aaaacacttgtaa

SEQ ID NO: 683366 - DNA, 13 bp, C. elegans
aaaacactttttc

SEQ ID NO: 683367 - DNA, 13 bp, C. elegans
aaaacactttttt

SEQ ID NO: 683368 - DNA, 13 bp, C. elegans
aaaacagaaactt

SEQ ID NO: 683369 - DNA, 13 bp, C. elegans
aaaacagagaatt

SEQ ID NO: 683370 - DNA, 13 bp, C. elegans
aaaacagagtttt

SEQ ID NO: 683371 - DNA, 13 bp, C. elegans
aaaacagatttat

SEQ ID NO: 683372 - DNA, 13 bp, C. elegans
aaaacagatttca

SEQ ID NO: 683373 - DNA, 13 bp, C. elegans
aaaacagattttc

SEQ ID NO: 683374 - DNA, 13 bp, C. elegans
aaaacagattttt

SEQ ID NO: 683375 - DNA, 13 bp, C. elegans
aaaacagcatttt

SEQ ID NO: 683376 - DNA, 13 bp, C. elegans
aaaacagctggaa

SEQ ID NO: 683377 - DNA, 13 bp, C. elegans
aaaacaggaaatt

SEQ ID NO: 683378 - DNA, 13 bp, C. elegans
aaaacaggaattt

SEQ ID NO: 683379 - DNA, 13 bp, C. elegans
aaaacagggtttt

SEQ ID NO: 683380 - DNA, 13 bp, C. elegans
aaaacaggtggaa

SEQ ID NO: 683381 - DNA, 13 bp, C. elegans
aaaacagtatttt

SEQ ID NO: 683382 - DNA, 13 bp, C. elegans
aaaacagtcattt

SEQ ID NO: 683383 - DNA, 13 bp, C. elegans
aaaacagtcgaaa

SEQ ID NO: 683384 - DNA, 13 bp, C. elegans
aaaacagttaaat

SEQ ID NO: 683385 - DNA, 13 bp, C. elegans
aaaacagttcaaa

SEQ ID NO: 683386 - DNA, 13 bp, C. elegans
aaaacagttcaat

SEQ ID NO: 683387 - DNA, 13 bp, C. elegans
aaaacagttgaaa

SEQ ID NO: 683388 - DNA, 13 bp, C. elegans
aaaacagttgttt

SEQ ID NO: 683389 - DNA, 13 bp, C. elegans
aaaacagtttgaa

SEQ ID NO: 683390 - DNA, 13 bp, C. elegans
aaaacagttttgt

SEQ ID NO: 683391 - DNA, 13 bp, C. elegans
aaaacataaagtt

SEQ ID NO: 683392 - DNA, 13 bp, C. elegans
aaaacataaatgt

SEQ ID NO: 683393 - DNA, 13 bp, C. elegans
aaaacataaattg

SEQ ID NO: 683394 - DNA, 13 bp, C. elegans
aaaacatatgttt

SEQ ID NO: 683395 - DNA, 13 bp, C. elegans
aaaacatattgaa

SEQ ID NO: 683396 - DNA, 13 bp, C. elegans
aaaacatattgtt

SEQ ID NO: 683397 - DNA, 13 bp, C. elegans
aaaacatatttcc

SEQ ID NO: 683398 - DNA, 13 bp, C. elegans
aaaacatatttct

SEQ ID NO: 683399 - DNA, 13 bp, C. elegans
aaaacatattttc

SEQ ID NO: 683400 - DNA, 13 bp, C. elegans
aaaacatcaactt

SEQ ID NO: 683401 - DNA, 13 bp, C. elegans
aaaacatcacttt

SEQ ID NO: 683402 - DNA, 13 bp, C. elegans
aaaacatcatcat

SEQ ID NO: 683403 - DNA, 13 bp, C. elegans
aaaacatcatttt

SEQ ID NO: 683404 - DNA, 13 bp, C. elegans
aaaacatctattt

SEQ ID NO: 683405 - DNA, 13 bp, C. elegans
aaaacatcttcaa

SEQ ID NO: 683406 - DNA, 13 bp, C. elegans
aaaacatcttgaa

SEQ ID NO: 683407 - DNA, 13 bp, C. elegans
aaaacatgaaatt

SEQ ID NO: 683408 - DNA, 13 bp, C. elegans
aaaacatgaatca

SEQ ID NO: 683409 - DNA, 13 bp, C. elegans
aaaacatgaattt

SEQ ID NO: 683410 - DNA, 13 bp, C. elegans
aaaacatgattca

SEQ ID NO: 683411 - DNA, 13 bp, C. elegans
aaaacatgatttt

SEQ ID NO: 683412 - DNA, 13 bp, C. elegans
aaaacatgcattt

SEQ ID NO: 683413 - DNA, 13 bp, C. elegans
aaaacatgcctat

SEQ ID NO: 683414 - DNA, 13 bp, C. elegans
aaaacatgtaatt

SEQ ID NO: 683415 - DNA, 13 bp, C. elegans
aaaacatgtgatt

SEQ ID NO: 683416 - DNA, 13 bp, C. elegans
aaaacatgtgcac

SEQ ID NO: 683417 - DNA, 13 bp, C. elegans
aaaacatgtttgt

SEQ ID NO: 683418 - DNA, 13 bp, C. elegans
aaaacattagttt

SEQ ID NO: 683419 - DNA, 13 bp, C. elegans
aaaacattatttc

SEQ ID NO: 683420 - DNA, 13 bp, C. elegans
aaaacattatttg

SEQ ID NO: 683421 - DNA, 13 bp, C. elegans
aaaacattcaact

SEQ ID NO: 683422 - DNA, 13 bp, C. elegans
aaaacattcaatt

SEQ ID NO: 683423 - DNA, 13 bp, C. elegans
aaaacattcagaa

SEQ ID NO: 683424 - DNA, 13 bp, C. elegans
aaaacattcgatt

SEQ ID NO: 683425 - DNA, 13 bp, C. elegans
aaaacattctcaa

SEQ ID NO: 683426 - DNA, 13 bp, C. elegans
aaaacattctgaa

SEQ ID NO: 683427 - DNA, 13 bp, C. elegans
aaaacattgaaat

SEQ ID NO: 683428 - DNA, 13 bp, C. elegans
aaaacattggaaa

SEQ ID NO: 683429 - DNA, 13 bp, C. elegans
aaaacattggaat

SEQ ID NO: 683430 - DNA, 13 bp, C. elegans
aaaacattggaga

SEQ ID NO: 683431 - DNA, 13 bp, C. elegans
aaaacattgtatt

SEQ ID NO: 683432 - DNA, 13 bp, C. elegans
aaaacattgtttt

SEQ ID NO: 683433 - DNA, 13 bp, C. elegans
aaaacatttcagt

SEQ ID NO: 683434 - DNA, 13 bp, C. elegans
aaaacatttgaaa

SEQ ID NO: 683435 - DNA, 13 bp, C. elegans
aaaacatttgaca

SEQ ID NO: 683436 - DNA, 13 bp, C. elegans
aaaacatttgatt

SEQ ID NO: 683437 - DNA, 13 bp, C. elegans
aaaacatttgcac

SEQ ID NO: 683438 - DNA, 13 bp, C. elegans
aaaacattttcaa

SEQ ID NO: 683439 - DNA, 13 bp, C. elegans
aaaacattttctc

SEQ ID NO: 683440 - DNA, 13 bp, C. elegans
aaaacattttgaa

SEQ ID NO: 683441 - DNA, 13 bp, C. elegans
aaaacattttgga

SEQ ID NO: 683442 - DNA, 13 bp, C. elegans
aaaacattttggc

SEQ ID NO: 683443 - DNA, 13 bp, C. elegans
aaaacatttttgg

SEQ ID NO: 683444 - DNA, 13 bp, C. elegans
aaaacatttttgt

SEQ ID NO: 683445 - DNA, 13 bp, C. elegans
aaaaccaaaagtt

SEQ ID NO: 683446 - DNA, 13 bp, C. elegans
aaaaccaaatgtt

SEQ ID NO: 683447 - DNA, 13 bp, C. elegans
aaaaccaaattcc

SEQ ID NO: 683448 - DNA, 13 bp, C. elegans
aaaaccaacattt

SEQ ID NO: 683449 - DNA, 13 bp, C. elegans
aaaaccaagaatt

SEQ ID NO: 683450 - DNA, 13 bp, C. elegans
aaaaccaagttca

SEQ ID NO: 683451 - DNA, 13 bp, C. elegans
aaaaccaatcgaa

SEQ ID NO: 683452 - DNA, 13 bp, C. elegans
aaaaccaatgaat

SEQ ID NO: 683453 - DNA, 13 bp, C. elegans
aaaaccaatgttt

SEQ ID NO: 683454 - DNA, 13 bp, C. elegans
aaaaccaattagt

SEQ ID NO: 683455 - DNA, 13 bp, C. elegans
aaaaccaattgaa

SEQ ID NO: 683456 - DNA, 13 bp, C. elegans
aaaaccaattgtt

SEQ ID NO: 683457 - DNA, 13 bp, C. elegans
aaaaccaatttat

SEQ ID NO: 683458 - DNA, 13 bp, C. elegans
aaaaccaatttca

SEQ ID NO: 683459 - DNA, 13 bp, C. elegans
aaaaccaattttt

SEQ ID NO: 683460 - DNA, 13 bp, C. elegans
aaaaccacaactt

SEQ ID NO: 683461 - DNA, 13 bp, C. elegans
aaaaccacaattt

SEQ ID NO: 683462 - DNA, 13 bp, C. elegans
aaaaccacacttt

SEQ ID NO: 683463 - DNA, 13 bp, C. elegans
aaaaccacatttt

SEQ ID NO: 683464 - DNA, 13 bp, C. elegans
aaaaccaccgaat

SEQ ID NO: 683465 - DNA, 13 bp, C. elegans
aaaaccacgaaat

SEQ ID NO: 683466 - DNA, 13 bp, C. elegans
aaaaccacgtttt

SEQ ID NO: 683467 - DNA, 13 bp, C. elegans
aaaaccactttaa

SEQ ID NO: 683468 - DNA, 13 bp, C. elegans
aaaaccagaattt

SEQ ID NO: 683469 - DNA, 13 bp, C. elegans
aaaaccagcaatt

SEQ ID NO: 683470 - DNA, 13 bp, C. elegans
aaaaccagtaatt

SEQ ID NO: 683471 - DNA, 13 bp, C. elegans
aaaaccagtgaaa

SEQ ID NO: 683472 - DNA, 13 bp, C. elegans
aaaaccatacttt

SEQ ID NO: 683473 - DNA, 13 bp, C. elegans
aaaaccatgaaac

SEQ ID NO: 683474 - DNA, 13 bp, C. elegans
aaaaccatgattt

SEQ ID NO: 683475 - DNA, 13 bp, C. elegans
aaaaccatggaaa

SEQ ID NO: 683476 - DNA, 13 bp, C. elegans
aaaaccatgtttt

SEQ ID NO: 683477 - DNA, 13 bp, C. elegans
aaaaccattccaa

SEQ ID NO: 683478 - DNA, 13 bp, C. elegans
aaaaccattgaaa

SEQ ID NO: 683479 - DNA, 13 bp, C. elegans
aaaaccatttcaa

SEQ ID NO: 683480 - DNA, 13 bp, C. elegans
aaaaccattttca

SEQ ID NO: 683481 - DNA, 13 bp, C. elegans
aaaaccattttcc

SEQ ID NO: 683482 - DNA, 13 bp, C. elegans
aaaaccatttttc

SEQ ID NO: 683483 - DNA, 13 bp, C. elegans
aaaacccaaattt

SEQ ID NO: 683484 - DNA, 13 bp, C. elegans
aaaacccaagttt

SEQ ID NO: 683485 - DNA, 13 bp, C. elegans
aaaacccaatttt

SEQ ID NO: 683486 - DNA, 13 bp, C. elegans
aaaacccacattt

SEQ ID NO: 683487 - DNA, 13 bp, C. elegans
aaaacccactttt

SEQ ID NO: 683488 - DNA, 13 bp, C. elegans
aaaacccatattt

SEQ ID NO: 683489 - DNA, 13 bp, C. elegans
aaaacccatgttt

SEQ ID NO: 683490 - DNA, 13 bp, C. elegans
aaaacccatttaa

SEQ ID NO: 683491 - DNA, 13 bp, C. elegans
aaaacccattttc

SEQ ID NO: 683492 - DNA, 13 bp, C. elegans
aaaacccccattt

SEQ ID NO: 683493 - DNA, 13 bp, C. elegans
aaaaccccctgtc

SEQ ID NO: 683494 - DNA, 13 bp, C. elegans
aaaaccccgtttt

SEQ ID NO: 683495 - DNA, 13 bp, C. elegans
aaaacccgaaaat

SEQ ID NO: 683496 - DNA, 13 bp, C. elegans
aaaacccgaattt

SEQ ID NO: 683497 - DNA, 13 bp, C. elegans
aaaacccgcattt

SEQ ID NO: 683498 - DNA, 13 bp, C. elegans
aaaaccctcgaaa

SEQ ID NO: 683499 - DNA, 13 bp, C. elegans
aaaacccttcaaa

SEQ ID NO: 683500 - DNA, 13 bp, C. elegans
aaaaccgaaaatc

SEQ ID NO: 683501 - DNA, 13 bp, C. elegans
aaaaccgaaaatt

SEQ ID NO: 683502 - DNA, 13 bp, C. elegans
aaaaccgaacaat

SEQ ID NO: 683503 - DNA, 13 bp, C. elegans
aaaaccgagaaat

SEQ ID NO: 683504 - DNA, 13 bp, C. elegans
aaaaccgagattt

SEQ ID NO: 683505 - DNA, 13 bp, C. elegans
aaaaccgatattt

SEQ ID NO: 683506 - DNA, 13 bp, C. elegans
aaaaccgattaaa

SEQ ID NO: 683507 - DNA, 13 bp, C. elegans
aaaaccgattatt

SEQ ID NO: 683508 - DNA, 13 bp, C. elegans
aaaaccgcaaatt

SEQ ID NO: 683509 - DNA, 13 bp, C. elegans
aaaaccgcaattt

SEQ ID NO: 683510 - DNA, 13 bp, C. elegans
aaaaccgcatttt

SEQ ID NO: 683511 - DNA, 13 bp, C. elegans
aaaaccgcgcctg

SEQ ID NO: 683512 - DNA, 13 bp, C. elegans
aaaaccgcttttt

SEQ ID NO: 683513 - DNA, 13 bp, C. elegans
aaaaccggatttt

SEQ ID NO: 683514 - DNA, 13 bp, C. elegans
aaaaccggttttc

SEQ ID NO: 683515 - DNA, 13 bp, C. elegans
aaaaccgtcaaaa

SEQ ID NO: 683516 - DNA, 13 bp, C. elegans
aaaaccgttaaaa

SEQ ID NO: 683517 - DNA, 13 bp, C. elegans
aaaaccgttcaaa

SEQ ID NO: 683518 - DNA, 13 bp, C. elegans
aaaacctaaattt

SEQ ID NO: 683519 - DNA, 13 bp, C. elegans
aaaacctaatatt

SEQ ID NO: 683520 - DNA, 13 bp, C. elegans
aaaacctacagta

SEQ ID NO: 683521 - DNA, 13 bp, C. elegans
aaaacctagattt

SEQ ID NO: 683522 - DNA, 13 bp, C. elegans
aaaacctataatt

SEQ ID NO: 683523 - DNA, 13 bp, C. elegans
aaaacctattttc

SEQ ID NO: 683524 - DNA, 13 bp, C. elegans
aaaacctcaagtt

SEQ ID NO: 683525 - DNA, 13 bp, C. elegans
aaaacctcaattt

SEQ ID NO: 683526 - DNA, 13 bp, C. elegans
aaaacctcatttt

SEQ ID NO: 683527 - DNA, 13 bp, C. elegans
aaaacctccgaaa

SEQ ID NO: 683528 - DNA, 13 bp, C. elegans
aaaacctcgaatt

SEQ ID NO: 683529 - DNA, 13 bp, C. elegans
aaaacctctcaaa

SEQ ID NO: 683530 - DNA, 13 bp, C. elegans
aaaacctgaaact

SEQ ID NO: 683531 - DNA, 13 bp, C. elegans
aaaacctgaaata

SEQ ID NO: 683532 - DNA, 13 bp, C. elegans
aaaacctgaacaa

SEQ ID NO: 683533 - DNA, 13 bp, C. elegans
aaaacctgaactt

SEQ ID NO: 683534 - DNA, 13 bp, C. elegans
aaaacctgaattt

SEQ ID NO: 683535 - DNA, 13 bp, C. elegans
aaaacctgatttt

SEQ ID NO: 683536 - DNA, 13 bp, C. elegans
aaaacctgcaaaa

SEQ ID NO: 683537 - DNA, 13 bp, C. elegans
aaaacctgcaatt

SEQ ID NO: 683538 - DNA, 13 bp, C. elegans
aaaacctggaaac

SEQ ID NO: 683539 - DNA, 13 bp, C. elegans
aaaacctggaaat

SEQ ID NO: 683540 - DNA, 13 bp, C. elegans
aaaacctggaatt

SEQ ID NO: 683541 - DNA, 13 bp, C. elegans
aaaacctggattt

SEQ ID NO: 683542 - DNA, 13 bp, C. elegans
aaaacctgtattt

SEQ ID NO: 683543 - DNA, 13 bp, C. elegans
aaaacctgttcga

SEQ ID NO: 683544 - DNA, 13 bp, C. elegans
aaaacctgtttca

SEQ ID NO: 683545 - DNA, 13 bp, C. elegans
aaaaccttaattt

SEQ ID NO: 683546 - DNA, 13 bp, C. elegans
aaaaccttcaaat

SEQ ID NO: 683547 - DNA, 13 bp, C. elegans
aaaaccttcatca

SEQ ID NO: 683548 - DNA, 13 bp, C. elegans
aaaaccttccaaa

SEQ ID NO: 683549 - DNA, 13 bp, C. elegans
aaaaccttcgaaa

SEQ ID NO: 683550 - DNA, 13 bp, C. elegans
aaaaccttgaaaa

SEQ ID NO: 683551 - DNA, 13 bp, C. elegans
aaaaccttgaata

SEQ ID NO: 683552 - DNA, 13 bp, C. elegans
aaaaccttggaaa

SEQ ID NO: 683553 - DNA, 13 bp, C. elegans
aaaacctttaaat

SEQ ID NO: 683554 - DNA, 13 bp, C. elegans
aaaacctttgaaa

SEQ ID NO: 683555 - DNA, 13 bp, C. elegans
aaaaccttttcaa

SEQ ID NO: 683556 - DNA, 13 bp, C. elegans
aaaacctttttgg

SEQ ID NO: 683557 - DNA, 13 bp, C. elegans
aaaacgaaaattt

SEQ ID NO: 683558 - DNA, 13 bp, C. elegans
aaaacgaaacatt

SEQ ID NO: 683559 - DNA, 13 bp, C. elegans
aaaacgaaattat

SEQ ID NO: 683560 - DNA, 13 bp, C. elegans
aaaacgaaattcg

SEQ ID NO: 683561 - DNA, 13 bp, C. elegans
aaaacgaagaatt

SEQ ID NO: 683562 - DNA, 13 bp, C. elegans
aaaacgaagtgaa

SEQ ID NO: 683563 - DNA, 13 bp, C. elegans
aaaacgaagtttt

SEQ ID NO: 683564 - DNA, 13 bp, C. elegans
aaaacgaatggaa

SEQ ID NO: 683565 - DNA, 13 bp, C. elegans
aaaacgaattctt

SEQ ID NO: 683566 - DNA, 13 bp, C. elegans
aaaacgaattgaa

SEQ ID NO: 683567 - DNA, 13 bp, C. elegans
aaaacgaattgat

SEQ ID NO: 683568 - DNA, 13 bp, C. elegans
aaaacgaattttt

SEQ ID NO: 683569 - DNA, 13 bp, C. elegans
aaaacgacaaatt

SEQ ID NO: 683570 - DNA, 13 bp, C. elegans
aaaacgacaattt

SEQ ID NO: 683571 - DNA, 13 bp, C. elegans
aaaacgacgacga

SEQ ID NO: 683572 - DNA, 13 bp, C. elegans
aaaacgagaattt

SEQ ID NO: 683573 - DNA, 13 bp, C. elegans
aaaacgagatttc

SEQ ID NO: 683574 - DNA, 13 bp, C. elegans
aaaacgagatttt

SEQ ID NO: 683575 - DNA, 13 bp, C. elegans
aaaacgaggaaat

SEQ ID NO: 683576 - DNA, 13 bp, C. elegans
aaaacgagtgatt

SEQ ID NO: 683577 - DNA, 13 bp, C. elegans
aaaacgagttgaa

SEQ ID NO: 683578 - DNA, 13 bp, C. elegans
aaaacgagtttaa

SEQ ID NO: 683579 - DNA, 13 bp, C. elegans
aaaacgagttttc

SEQ ID NO: 683580 - DNA, 13 bp, C. elegans
aaaacgatacgat

SEQ ID NO: 683581 - DNA, 13 bp, C. elegans
aaaacgatatatt

SEQ ID NO: 683582 - DNA, 13 bp, C. elegans
aaaacgatcaaat

SEQ ID NO: 683583 - DNA, 13 bp, C. elegans
aaaacgatgaatt

SEQ ID NO: 683584 - DNA, 13 bp, C. elegans
aaaacgattattt

SEQ ID NO: 683585 - DNA, 13 bp, C. elegans
aaaacgatttatt

SEQ ID NO: 683586 - DNA, 13 bp, C. elegans
aaaacgatttgaa

SEQ ID NO: 683587 - DNA, 13 bp, C. elegans
aaaacgattttct

SEQ ID NO: 683588 - DNA, 13 bp, C. elegans
aaaacgatttttt

SEQ ID NO: 683589 - DNA, 13 bp, C. elegans
aaaacgcaatttt

SEQ ID NO: 683590 - DNA, 13 bp, C. elegans
aaaacgcctgccg

SEQ ID NO: 683591 - DNA, 13 bp, C. elegans
aaaacgctaaaat

SEQ ID NO: 683592 - DNA, 13 bp, C. elegans
aaaacgctaaatt

SEQ ID NO: 683593 - DNA, 13 bp, C. elegans
aaaacgctccaaa

SEQ ID NO: 683594 - DNA, 13 bp, C. elegans
aaaacggaaaatc

SEQ ID NO: 683595 - DNA, 13 bp, C. elegans
aaaacggaaaatg

SEQ ID NO: 683596 - DNA, 14 bp, C. elegans
aaaacggaaaattg

SEQ ID NO: 683597 - DNA, 13 bp, C. elegans
aaaacggaaatga

SEQ ID NO: 683598 - DNA, 13 bp, C. elegans
aaaacggaagttt

SEQ ID NO: 683599 - DNA, 13 bp, C. elegans
aaaacggaatttt

SEQ ID NO: 683600 - DNA, 13 bp, C. elegans
aaaacggattttt

SEQ ID NO: 683601 - DNA, 13 bp, C. elegans
aaaacggcaaatt

SEQ ID NO: 683602 - DNA, 13 bp, C. elegans
aaaacggcaattg

SEQ ID NO: 683603 - DNA, 13 bp, C. elegans
aaaacggcagttt

SEQ ID NO: 683604 - DNA, 13 bp, C. elegans
aaaacggcttttt

SEQ ID NO: 683605 - DNA, 13 bp, C. elegans
aaaacgggaaaat

SEQ ID NO: 683606 - DNA, 13 bp, C. elegans
aaaacgggaattt

SEQ ID NO: 683607 - DNA, 13 bp, C. elegans
aaaacgggtaaaa

SEQ ID NO: 683608 - DNA, 13 bp, C. elegans
aaaacgggtttca

SEQ ID NO: 683609 - DNA, 13 bp, C. elegans
aaaacgggttttt

SEQ ID NO: 683610 - DNA, 13 bp, C. elegans
aaaacggtatttt

SEQ ID NO: 683611 - DNA, 13 bp, C. elegans
aaaacggtgaaaa

SEQ ID NO: 683612 - DNA, 13 bp, C. elegans
aaaacggttaaaa

SEQ ID NO: 683613 - DNA, 13 bp, C. elegans
aaaacggttattc

SEQ ID NO: 683614 - DNA, 13 bp, C. elegans
aaaacggtttttg

SEQ ID NO: 683615 - DNA, 13 bp, C. elegans
aaaacgtaaaatt

SEQ ID NO: 683616 - DNA, 13 bp, C. elegans
aaaacgtaaagtt

SEQ ID NO: 683617 - DNA, 13 bp, C. elegans
aaaacgtatttaa

SEQ ID NO: 683618 - DNA, 13 bp, C. elegans
aaaacgtatttat

SEQ ID NO: 683619 - DNA, 13 bp, C. elegans
aaaacgtatttct

SEQ ID NO: 683620 - DNA, 13 bp, C. elegans
aaaacgtattttc

SEQ ID NO: 683621 - DNA, 13 bp, C. elegans
aaaacgtcaaatt

SEQ ID NO: 683622 - DNA, 13 bp, C. elegans
aaaacgtcagaaa

SEQ ID NO: 683623 - DNA, 13 bp, C. elegans
aaaacgtccaaat

SEQ ID NO: 683624 - DNA, 13 bp, C. elegans
aaaacgtccaact

SEQ ID NO: 683625 - DNA, 13 bp, C. elegans
aaaacgtcgaaaa

SEQ ID NO: 683626 - DNA, 13 bp, C. elegans
aaaacgtcggaaa

SEQ ID NO: 683627 - DNA, 13 bp, C. elegans
aaaacgtctgaaa

SEQ ID NO: 683628 - DNA, 13 bp, C. elegans
aaaacgtgaaatt

SEQ ID NO: 683629 - DNA, 13 bp, C. elegans
aaaacgtgaactt

SEQ ID NO: 683630 - DNA, 13 bp, C. elegans
aaaacgtgaattt

SEQ ID NO: 683631 - DNA, 13 bp, C. elegans
aaaacgtgcaaaa

SEQ ID NO: 683632 - DNA, 13 bp, C. elegans
aaaacgtgcaagt

SEQ ID NO: 683633 - DNA, 13 bp, C. elegans
aaaacgtggaaaa

SEQ ID NO: 683634 - DNA, 13 bp, C. elegans
aaaacgtgtaatt

SEQ ID NO: 683635 - DNA, 13 bp, C. elegans
aaaacgtgtagtt

SEQ ID NO: 683636 - DNA, 13 bp, C. elegans
aaaacgtgtattt

SEQ ID NO: 683637 - DNA, 13 bp, C. elegans
aaaacgtgtttaa

SEQ ID NO: 683638 - DNA, 13 bp, C. elegans
aaaacgttattaa

SEQ ID NO: 683639 - DNA, 13 bp, C. elegans
aaaacgttcaaaa

SEQ ID NO: 683640 - DNA, 13 bp, C. elegans
aaaacgttcaaat

SEQ ID NO: 683641 - DNA, 13 bp, C. elegans
aaaacgttcaatt

SEQ ID NO: 683642 - DNA, 13 bp, C. elegans
aaaacgttcgaat

SEQ ID NO: 683643 - DNA, 13 bp, C. elegans
aaaacgttgaaaa

SEQ ID NO: 683644 - DNA, 13 bp, C. elegans
aaaacgttggaaa

SEQ ID NO: 683645 - DNA, 13 bp, C. elegans
aaaacgtttagtt

SEQ ID NO: 683646 - DNA, 13 bp, C. elegans
aaaacgtttattg

SEQ ID NO: 683647 - DNA, 13 bp, C. elegans
aaaacgtttccct

SEQ ID NO: 683648 - DNA, 13 bp, C. elegans
aaaacgtttgaaa

SEQ ID NO: 683649 - DNA, 13 bp, C. elegans
aaaacgtttgaac

SEQ ID NO: 683650 - DNA, 13 bp, C. elegans
aaaacgttttaaa

SEQ ID NO: 683651 - DNA, 13 bp, C. elegans
aaaacgttttatt

SEQ ID NO: 683652 - DNA, 13 bp, C. elegans
aaaacgttttcaa

SEQ ID NO: 683653 - DNA, 13 bp, C. elegans
aaaacgttttctg

SEQ ID NO: 683654 - DNA, 13 bp, C. elegans
aaaacgttttgtt

SEQ ID NO: 683655 - DNA, 13 bp, C. elegans
aaaacgtttttca

SEQ ID NO: 683656 - DNA, 13 bp, C. elegans
aaaacgtttttcc

SEQ ID NO: 683657 - DNA, 13 bp, C. elegans
aaaacgtttttct

SEQ ID NO: 683658 - DNA, 13 bp, C. elegans
aaaacgtttttgt

SEQ ID NO: 683659 - DNA, 13 bp, C. elegans
aaaacgtttttta

SEQ ID NO: 683660 - DNA, 13 bp, C. elegans
aaaactaaaattg

SEQ ID NO: 683661 - DNA, 13 bp, C. elegans
aaaactaaagttt

SEQ ID NO: 683662 - DNA, 13 bp, C. elegans
aaaactaacactt

SEQ ID NO: 683663 - DNA, 13 bp, C. elegans
aaaactaacattt

SEQ ID NO: 683664 - DNA, 13 bp, C. elegans
aaaactaactatt

SEQ ID NO: 683665 - DNA, 13 bp, C. elegans
aaaactaagattt

SEQ ID NO: 683666 - DNA, 13 bp, C. elegans
aaaactaatcgaa

SEQ ID NO: 683667 - DNA, 13 bp, C. elegans
aaaactaatcttt

SEQ ID NO: 683668 - DNA, 13 bp, C. elegans
aaaactaattcca

SEQ ID NO: 683669 - DNA, 13 bp, C. elegans
aaaactaattgaa

SEQ ID NO: 683670 - DNA, 13 bp, C. elegans
aaaactaattgta

SEQ ID NO: 683671 - DNA, 13 bp, C. elegans
aaaactaattttc

SEQ ID NO: 683672 - DNA, 13 bp, C. elegans
aaaactacaattt

SEQ ID NO: 683673 - DNA, 13 bp, C. elegans
aaaactacagtaa

SEQ ID NO: 683674 - DNA, 13 bp, C. elegans
aaaactacattca

SEQ ID NO: 683675 - DNA, 13 bp, C. elegans
aaaactaccattt

SEQ ID NO: 683676 - DNA, 13 bp, C. elegans
aaaactaccgaat

SEQ ID NO: 683677 - DNA, 14 bp, C. elegans
aaaactaccgaatt

SEQ ID NO: 683678 - DNA, 13 bp, C. elegans
aaaactaccgtac

SEQ ID NO: 683679 - DNA, 13 bp, C. elegans
aaaactacgattt

SEQ ID NO: 683680 - DNA, 13 bp, C. elegans
aaaactactgaaa

SEQ ID NO: 683681 - DNA, 13 bp, C. elegans
aaaactactgtaa

SEQ ID NO: 683682 - DNA, 13 bp, C. elegans
aaaactacttcaa

SEQ ID NO: 683683 - DNA, 13 bp, C. elegans
aaaactacttttt

SEQ ID NO: 683684 - DNA, 13 bp, C. elegans
aaaactagaaatt

SEQ ID NO: 683685 - DNA, 13 bp, C. elegans
aaaactagaagtt

SEQ ID NO: 683686 - DNA, 13 bp, C. elegans
aaaactagaatat

SEQ ID NO: 683687 - DNA, 13 bp, C. elegans
aaaactagaattt

SEQ ID NO: 683688 - DNA, 13 bp, C. elegans
aaaactagagttt

SEQ ID NO: 683689 - DNA, 13 bp, C. elegans
aaaactagataat

SEQ ID NO: 683690 - DNA, 13 bp, C. elegans
aaaactagatttt

SEQ ID NO: 683691 - DNA, 13 bp, C. elegans
aaaactagctaaa

SEQ ID NO: 683692 - DNA, 13 bp, C. elegans
aaaactagctttt

SEQ ID NO: 683693 - DNA, 13 bp, C. elegans
aaaactaggccac

SEQ ID NO: 683694 - DNA, 13 bp, C. elegans
aaaactagtaaat

SEQ ID NO: 683695 - DNA, 13 bp, C. elegans
aaaactagtcccc

SEQ ID NO: 683696 - DNA, 13 bp, C. elegans
aaaactagtgttt

SEQ ID NO: 683697 - DNA, 13 bp, C. elegans
aaaactagttatt

SEQ ID NO: 683698 - DNA, 13 bp, C. elegans
aaaactagtttct

SEQ ID NO: 683699 - DNA, 13 bp, C. elegans
aaaactagttttc

SEQ ID NO: 683700 - DNA, 13 bp, C. elegans
aaaactataagtt

SEQ ID NO: 683701 - DNA, 13 bp, C. elegans
aaaactatatttg

SEQ ID NO: 683702 - DNA, 13 bp, C. elegans
aaaactatcaact

SEQ ID NO: 683703 - DNA, 13 bp, C. elegans
aaaactatgagaa

SEQ ID NO: 683704 - DNA, 13 bp, C. elegans
aaaactatgattt

SEQ ID NO: 683705 - DNA, 13 bp, C. elegans
aaaactatgcaaa

SEQ ID NO: 683706 - DNA, 13 bp, C. elegans
aaaactatggatt

SEQ ID NO: 683707 - DNA, 14 bp, C. elegans
aaaactatgttttc

SEQ ID NO: 683708 - DNA, 13 bp, C. elegans
aaaactattctga

SEQ ID NO: 683709 - DNA, 13 bp, C. elegans
aaaactattgaaa

SEQ ID NO: 683710 - DNA, 13 bp, C. elegans
aaaactattgcaa

SEQ ID NO: 683711 - DNA, 13 bp, C. elegans
aaaactattggtt

SEQ ID NO: 683712 - DNA, 13 bp, C. elegans
aaaactattgtta

SEQ ID NO: 683713 - DNA, 13 bp, C. elegans
aaaactatttcaa

SEQ ID NO: 683714 - DNA, 13 bp, C. elegans
aaaactatttcag

SEQ ID NO: 683715 - DNA, 13 bp, C. elegans
aaaactatttctc

SEQ ID NO: 683716 - DNA, 13 bp, C. elegans
aaaactatttggt

SEQ ID NO: 683717 - DNA, 13 bp, C. elegans
aaaactatttgtt

SEQ ID NO: 683718 - DNA, 13 bp, C. elegans
aaaactattttct

SEQ ID NO: 683719 - DNA, 13 bp, C. elegans
aaaactattttga

SEQ ID NO: 683720 - DNA, 13 bp, C. elegans
aaaactcaaaagt

SEQ ID NO: 683721 - DNA, 13 bp, C. elegans
aaaactcaaaccg

SEQ ID NO: 683722 - DNA, 13 bp, C. elegans
aaaactcaaattt

SEQ ID NO: 683723 - DNA, 13 bp, C. elegans
aaaactcaagaat

SEQ ID NO: 683724 - DNA, 13 bp, C. elegans
aaaactcaatgaa

SEQ ID NO: 683725 - DNA, 13 bp, C. elegans
aaaactcaatgtt

SEQ ID NO: 683726 - DNA, 13 bp, C. elegans
aaaactcacaatt

SEQ ID NO: 683727 - DNA, 13 bp, C. elegans
aaaactcacttta

SEQ ID NO: 683728 - DNA, 13 bp, C. elegans
aaaactcagagaa

SEQ ID NO: 683729 - DNA, 13 bp, C. elegans
aaaactcatagaa

SEQ ID NO: 683730 - DNA, 13 bp, C. elegans
aaaactcattcaa

SEQ ID NO: 683731 - DNA, 13 bp, C. elegans
aaaactcattttt

SEQ ID NO: 683732 - DNA, 13 bp, C. elegans
aaaactccaaatt

SEQ ID NO: 683733 - DNA, 13 bp, C. elegans
aaaactccagaac

SEQ ID NO: 683734 - DNA, 13 bp, C. elegans
aaaactccatttt

SEQ ID NO: 683735 - DNA, 13 bp, C. elegans
aaaactcccaaat

SEQ ID NO: 683736 - DNA, 13 bp, C. elegans
aaaactccgaact

SEQ ID NO: 683737 - DNA, 13 bp, C. elegans
aaaactccgaatt

SEQ ID NO: 683738 - DNA, 13 bp, C. elegans
aaaactcctgaaa

SEQ ID NO: 683739 - DNA, 13 bp, C. elegans
aaaactcgaaaac

SEQ ID NO: 683740 - DNA, 13 bp, C. elegans
aaaactcgaaaat

SEQ ID NO: 683741 - DNA, 13 bp, C. elegans
aaaactcgaaact

SEQ ID NO: 683742 - DNA, 13 bp, C. elegans
aaaactcgaaata

SEQ ID NO: 683743 - DNA, 13 bp, C. elegans
aaaactcgagttt

SEQ ID NO: 683744 - DNA, 13 bp, C. elegans
aaaactcgataaa

SEQ ID NO: 683745 - DNA, 13 bp, C. elegans
aaaactcgatttt

SEQ ID NO: 683746 - DNA, 13 bp, C. elegans
aaaactcgccgag

SEQ ID NO: 683747 - DNA, 13 bp, C. elegans
aaaactcgctttt

SEQ ID NO: 683748 - DNA, 13 bp, C. elegans
aaaactcggaaaa

SEQ ID NO: 683749 - DNA, 13 bp, C. elegans
aaaactcggccac

SEQ ID NO: 683750 - DNA, 13 bp, C. elegans
aaaactcggtttt

SEQ ID NO: 683751 - DNA, 13 bp, C. elegans
aaaactcgttttc

SEQ ID NO: 683752 - DNA, 13 bp, C. elegans
aaaactctatgaa

SEQ ID NO: 683753 - DNA, 13 bp, C. elegans
aaaactctcattt

SEQ ID NO: 683754 - DNA, 13 bp, C. elegans
aaaactctctctc

SEQ ID NO: 683755 - DNA, 13 bp, C. elegans
aaaactctgaaaa

SEQ ID NO: 683756 - DNA, 13 bp, C. elegans
aaaactctgaaat

SEQ ID NO: 683757 - DNA, 13 bp, C. elegans
aaaactctgaata

SEQ ID NO: 683758 - DNA, 13 bp, C. elegans
aaaactctgcaaa

SEQ ID NO: 683759 - DNA, 13 bp, C. elegans
aaaactctgcgtc

SEQ ID NO: 683760 - DNA, 13 bp, C. elegans
aaaactctgtaaa

SEQ ID NO: 683761 - DNA, 13 bp, C. elegans
aaaactcttcaat

SEQ ID NO: 683762 - DNA, 13 bp, C. elegans
aaaactcttcata

SEQ ID NO: 683763 - DNA, 13 bp, C. elegans
aaaactctttcaa

SEQ ID NO: 683764 - DNA, 13 bp, C. elegans
aaaactgaaaatt

SEQ ID NO: 683765 - DNA, 13 bp, C. elegans
aaaactgaaactt

SEQ ID NO: 683766 - DNA, 13 bp, C. elegans
aaaactgaaagtt

SEQ ID NO: 683767 - DNA, 13 bp, C. elegans
aaaactgaaatta

SEQ ID NO: 683768 - DNA, 13 bp, C. elegans
aaaactgaaattt

SEQ ID NO: 683769 - DNA, 13 bp, C. elegans
aaaactgaactct

SEQ ID NO: 683770 - DNA, 13 bp, C. elegans
aaaactgaacttt

SEQ ID NO: 683771 - DNA, 13 bp, C. elegans
aaaactgaagaat

SEQ ID NO: 683772 - DNA, 13 bp, C. elegans
aaaactgaagtta

SEQ ID NO: 683773 - DNA, 13 bp, C. elegans
aaaactgaagttt

SEQ ID NO: 683774 - DNA, 13 bp, C. elegans
aaaactgaattca

SEQ ID NO: 683775 - DNA, 13 bp, C. elegans
aaaactgaatttc

SEQ ID NO: 683776 - DNA, 13 bp, C. elegans
aaaactgacaatt

SEQ ID NO: 683777 - DNA, 13 bp, C. elegans
aaaactgacgaaa

SEQ ID NO: 683778 - DNA, 13 bp, C. elegans
aaaactgagaatt

SEQ ID NO: 683779 - DNA, 13 bp, C. elegans
aaaactgaggaaa

SEQ ID NO: 683780 - DNA, 13 bp, C. elegans
aaaactgagtgat

SEQ ID NO: 683781 - DNA, 13 bp, C. elegans
aaaactgagtttc

SEQ ID NO: 683782 - DNA, 13 bp, C. elegans
aaaactgataatg

SEQ ID NO: 683783 - DNA, 13 bp, C. elegans
aaaactgatactt

SEQ ID NO: 683784 - DNA, 13 bp, C. elegans
aaaactgatgaaa

SEQ ID NO: 683785 - DNA, 13 bp, C. elegans
aaaactgatgaga

SEQ ID NO: 683786 - DNA, 13 bp, C. elegans
aaaactgatgtat

SEQ ID NO: 683787 - DNA, 13 bp, C. elegans
aaaactgattaga

SEQ ID NO: 683788 - DNA, 13 bp, C. elegans
aaaactgatttta

SEQ ID NO: 683789 - DNA, 13 bp, C. elegans
aaaactgattttc

SEQ ID NO: 683790 - DNA, 13 bp, C. elegans
aaaactgattttt

SEQ ID NO: 683791 - DNA, 13 bp, C. elegans
aaaactgcaactt

SEQ ID NO: 683792 - DNA, 13 bp, C. elegans
aaaactgcataaa

SEQ ID NO: 683793 - DNA, 13 bp, C. elegans
aaaactgccaaaa

SEQ ID NO: 683794 - DNA, 13 bp, C. elegans
aaaactgcgaaaa

SEQ ID NO: 683795 - DNA, 13 bp, C. elegans
aaaactgcgagaa

SEQ ID NO: 683796 - DNA, 31 bp, C. elegans
aaaactgcgtggcgtgtactgcagaaaacct

SEQ ID NO: 683797 - DNA, 13 bp, C. elegans
aaaactgctaaat

SEQ ID NO: 683798 - DNA, 13 bp, C. elegans
aaaactgctaatg

SEQ ID NO: 683799 - DNA, 13 bp, C. elegans
aaaactgctcaaa

SEQ ID NO: 683800 - DNA, 13 bp, C. elegans
aaaactgctccaa

SEQ ID NO: 683801 - DNA, 13 bp, C. elegans
aaaactgctttaa

SEQ ID NO: 683802 - DNA, 13 bp, C. elegans
aaaactggaaatt

SEQ ID NO: 683803 - DNA, 13 bp, C. elegans
aaaactggaagaa

SEQ ID NO: 683804 - DNA, 13 bp, C. elegans
aaaactggaataa

SEQ ID NO: 683805 - DNA, 13 bp, C. elegans
aaaactggaattc

SEQ ID NO: 683806 - DNA, 13 bp, C. elegans
aaaactggaattt

SEQ ID NO: 683807 - DNA, 13 bp, C. elegans
aaaactggagaaa

SEQ ID NO: 683808 - DNA, 13 bp, C. elegans
aaaactggatgaa

SEQ ID NO: 683809 - DNA, 13 bp, C. elegans
aaaactggatttt

SEQ ID NO: 683810 - DNA, 13 bp, C. elegans
aaaactggctttt

SEQ ID NO: 683811 - DNA, 13 bp, C. elegans
aaaactgggttga

SEQ ID NO: 683812 - DNA, 13 bp, C. elegans
aaaactggtaaaa

SEQ ID NO: 683813 - DNA, 13 bp, C. elegans
aaaactggttaaa

SEQ ID NO: 683814 - DNA, 13 bp, C. elegans
aaaactggttttt

SEQ ID NO: 683815 - DNA, 13 bp, C. elegans
aaaactgtaaaac

SEQ ID NO: 683816 - DNA, 13 bp, C. elegans
aaaactgtaaaat

SEQ ID NO: 683817 - DNA, 13 bp, C. elegans
aaaactgtattta

SEQ ID NO: 683818 - DNA, 13 bp, C. elegans
aaaactgtatttt

SEQ ID NO: 683819 - DNA, 13 bp, C. elegans
aaaactgtcaaaa

SEQ ID NO: 683820 - DNA, 13 bp, C. elegans
aaaactgtcattt

SEQ ID NO: 683821 - DNA, 13 bp, C. elegans
aaaactgtcgaaa

SEQ ID NO: 683822 - DNA, 13 bp, C. elegans
aaaactgtgaaaa

SEQ ID NO: 683823 - DNA, 13 bp, C. elegans
aaaactgtgaaat

SEQ ID NO: 683824 - DNA, 13 bp, C. elegans
aaaactgtgactt

SEQ ID NO: 683825 - DNA, 13 bp, C. elegans
aaaactgtgagaa

SEQ ID NO: 683826 - DNA, 13 bp, C. elegans
aaaactgtgttca

SEQ ID NO: 683827 - DNA, 13 bp, C. elegans
aaaactgttaaca

SEQ ID NO: 683828 - DNA, 13 bp, C. elegans
aaaactgttataa

SEQ ID NO: 683829 - DNA, 13 bp, C. elegans
aaaactgttattt

SEQ ID NO: 683830 - DNA, 14 bp, C. elegans
aaaactgttcagca

SEQ ID NO: 683831 - DNA, 13 bp, C. elegans
aaaactgttgaaa

SEQ ID NO: 683832 - DNA, 13 bp, C. elegans
aaaactgttgaat

SEQ ID NO: 683833 - DNA, 13 bp, C. elegans
aaaactgtttcag

SEQ ID NO: 683834 - DNA, 13 bp, C. elegans
aaaactgtttgca

SEQ ID NO: 683835 - DNA, 13 bp, C. elegans
aaaacttaacttt

SEQ ID NO: 683836 - DNA, 13 bp, C. elegans
aaaacttaattga

SEQ ID NO: 683837 - DNA, 13 bp, C. elegans
aaaacttagtttc

SEQ ID NO: 683838 - DNA, 13 bp, C. elegans
aaaacttatggga

SEQ ID NO: 683839 - DNA, 13 bp, C. elegans
aaaacttattcaa

SEQ ID NO: 683840 - DNA, 13 bp, C. elegans
aaaacttattgaa

SEQ ID NO: 683841 - DNA, 13 bp, C. elegans
aaaacttatttca

SEQ ID NO: 683842 - DNA, 13 bp, C. elegans
aaaacttcaaatt

SEQ ID NO: 683843 - DNA, 13 bp, C. elegans
aaaacttcaattt

SEQ ID NO: 683844 - DNA, 13 bp, C. elegans
aaaacttcagaaa

SEQ ID NO: 683845 - DNA, 13 bp, C. elegans
aaaacttcagtaa

SEQ ID NO: 683846 - DNA, 13 bp, C. elegans
aaaacttcatata

SEQ ID NO: 683847 - DNA, 13 bp, C. elegans
aaaacttcatcaa

SEQ ID NO: 683848 - DNA, 13 bp, C. elegans
aaaacttcatgat

SEQ ID NO: 683849 - DNA, 13 bp, C. elegans
aaaacttcatggt

SEQ ID NO: 683850 - DNA, 13 bp, C. elegans
aaaacttcatttt

SEQ ID NO: 683851 - DNA, 13 bp, C. elegans
aaaacttccaact

SEQ ID NO: 683852 - DNA, 13 bp, C. elegans
aaaacttccaatt

SEQ ID NO: 683853 - DNA, 13 bp, C. elegans
aaaacttccacaa

SEQ ID NO: 683854 - DNA, 13 bp, C. elegans
aaaacttccagca

SEQ ID NO: 683855 - DNA, 13 bp, C. elegans
aaaacttcgaaaa

SEQ ID NO: 683856 - DNA, 13 bp, C. elegans
aaaacttcgaatt

SEQ ID NO: 683857 - DNA, 13 bp, C. elegans
aaaacttcggcca

SEQ ID NO: 683858 - DNA, 13 bp, C. elegans
aaaacttctataa

SEQ ID NO: 683859 - DNA, 13 bp, C. elegans
aaaacttctcaaa

SEQ ID NO: 683860 - DNA, 13 bp, C. elegans
aaaacttctggaa

SEQ ID NO: 683861 - DNA, 13 bp, C. elegans
aaaacttctggga

SEQ ID NO: 683862 - DNA, 13 bp, C. elegans
aaaacttcttaga

SEQ ID NO: 683863 - DNA, 13 bp, C. elegans
aaaacttcttcaa

SEQ ID NO: 683864 - DNA, 13 bp, C. elegans
aaaacttcttctt

SEQ ID NO: 683865 - DNA, 13 bp, C. elegans
aaaacttctttaa

SEQ ID NO: 683866 - DNA, 13 bp, C. elegans
aaaacttgaagtt

SEQ ID NO: 683867 - DNA, 13 bp, C. elegans
aaaacttgaataa

SEQ ID NO: 683868 - DNA, 13 bp, C. elegans
aaaacttgaattt

SEQ ID NO: 683869 - DNA, 13 bp, C. elegans
aaaacttgagaaa

SEQ ID NO: 683870 - DNA, 13 bp, C. elegans
aaaacttgagatt

SEQ ID NO: 683871 - DNA, 13 bp, C. elegans
aaaacttgatcaa

SEQ ID NO: 683872 - DNA, 13 bp, C. elegans
aaaacttgattaa

SEQ ID NO: 683873 - DNA, 13 bp, C. elegans
aaaacttgattat

SEQ ID NO: 683874 - DNA, 13 bp, C. elegans
aaaacttgatttc

SEQ ID NO: 683875 - DNA, 13 bp, C. elegans
aaaacttgatttt

SEQ ID NO: 683876 - DNA, 13 bp, C. elegans
aaaacttgcaaaa

SEQ ID NO: 683877 - DNA, 13 bp, C. elegans
aaaacttgcaaac

SEQ ID NO: 683878 - DNA, 13 bp, C. elegans
aaaacttgcagaa

SEQ ID NO: 683879 - DNA, 13 bp, C. elegans
aaaacttgccaaa

SEQ ID NO: 683880 - DNA, 13 bp, C. elegans
aaaacttgcgaaa

SEQ ID NO: 683881 - DNA, 13 bp, C. elegans
aaaacttgctcaa

SEQ ID NO: 683882 - DNA, 13 bp, C. elegans
aaaacttgctttt

SEQ ID NO: 683883 - DNA, 13 bp, C. elegans
aaaacttggaaaa

SEQ ID NO: 683884 - DNA, 13 bp, C. elegans
aaaacttggaata

SEQ ID NO: 683885 - DNA, 13 bp, C. elegans
aaaacttggcaat

SEQ ID NO: 683886 - DNA, 13 bp, C. elegans
aaaacttggctaa

SEQ ID NO: 683887 - DNA, 13 bp, C. elegans
aaaacttggttta

SEQ ID NO: 683888 - DNA, 13 bp, C. elegans
aaaacttgtaaat

SEQ ID NO: 683889 - DNA, 13 bp, C. elegans
aaaacttgtagaa

SEQ ID NO: 683890 - DNA, 13 bp, C. elegans
aaaacttgtataa

SEQ ID NO: 683891 - DNA, 13 bp, C. elegans
aaaacttgtgaaa

SEQ ID NO: 683892 - DNA, 13 bp, C. elegans
aaaacttgttaaa

SEQ ID NO: 683893 - DNA, 13 bp, C. elegans
aaaactttaaact

SEQ ID NO: 683894 - DNA, 13 bp, C. elegans
aaaactttaacta

SEQ ID NO: 683895 - DNA, 13 bp, C. elegans
aaaactttaattc

SEQ ID NO: 683896 - DNA, 13 bp, C. elegans
aaaactttactgt

SEQ ID NO: 683897 - DNA, 13 bp, C. elegans
aaaactttagtgg

SEQ ID NO: 683898 - DNA, 13 bp, C. elegans
aaaactttattca

SEQ ID NO: 683899 - DNA, 13 bp, C. elegans
aaaactttattga

SEQ ID NO: 683900 - DNA, 13 bp, C. elegans
aaaactttcaatt

SEQ ID NO: 683901 - DNA, 13 bp, C. elegans
aaaactttcactg

SEQ ID NO: 683902 - DNA, 13 bp, C. elegans
aaaactttcactt

SEQ ID NO: 683903 - DNA, 13 bp, C. elegans
aaaactttcagca

SEQ ID NO: 683904 - DNA, 13 bp, C. elegans
aaaactttcataa

SEQ ID NO: 683905 - DNA, 13 bp, C. elegans
aaaactttcatat

SEQ ID NO: 683906 - DNA, 13 bp, C. elegans
aaaactttccaaa

SEQ ID NO: 683907 - DNA, 13 bp, C. elegans
aaaactttctatt

SEQ ID NO: 683908 - DNA, 13 bp, C. elegans
aaaactttctcaa

SEQ ID NO: 683909 - DNA, 13 bp, C. elegans
aaaactttctgat

SEQ ID NO: 683910 - DNA, 13 bp, C. elegans
aaaactttgaaaa

SEQ ID NO: 683911 - DNA, 13 bp, C. elegans
aaaactttgaaat

SEQ ID NO: 683912 - DNA, 13 bp, C. elegans
aaaactttgaact

SEQ ID NO: 683913 - DNA, 13 bp, C. elegans
aaaactttgaagc

SEQ ID NO: 683914 - DNA, 13 bp, C. elegans
aaaactttgacca

SEQ ID NO: 683915 - DNA, 13 bp, C. elegans
aaaactttgagag

SEQ ID NO: 683916 - DNA, 13 bp, C. elegans
aaaactttgagtt

SEQ ID NO: 683917 - DNA, 13 bp, C. elegans
aaaactttgattt

SEQ ID NO: 683918 - DNA, 14 bp, C. elegans
aaaactttggaaaa

SEQ ID NO: 683919 - DNA, 13 bp, C. elegans
aaaactttggcaa

SEQ ID NO: 683920 - DNA, 13 bp, C. elegans
aaaactttggctg

SEQ ID NO: 683921 - DNA, 13 bp, C. elegans
aaaactttggtaa

SEQ ID NO: 683922 - DNA, 13 bp, C. elegans
aaaactttgtatt

SEQ ID NO: 683923 - DNA, 13 bp, C. elegans
aaaactttgtcaa

SEQ ID NO: 683924 - DNA, 13 bp, C. elegans
aaaactttgtgat

SEQ ID NO: 683925 - DNA, 13 bp, C. elegans
aaaactttgttca

SEQ ID NO: 683926 - DNA, 13 bp, C. elegans
aaaactttgtttt

SEQ ID NO: 683927 - DNA, 13 bp, C. elegans
aaaacttttcaga

SEQ ID NO: 683928 - DNA, 13 bp, C. elegans
aaaacttttcatt

SEQ ID NO: 683929 - DNA, 13 bp, C. elegans
aaaacttttcgat

SEQ ID NO: 683930 - DNA, 13 bp, C. elegans
aaaacttttgtga

SEQ ID NO: 683931 - DNA, 13 bp, C. elegans
aaaactttttcag

SEQ ID NO: 683932 - DNA, 13 bp, C. elegans
aaaacttttttct

SEQ ID NO: 683933 - DNA, 13 bp, C. elegans
aaaacttttttga

SEQ ID NO: 683934 - DNA, 13 bp, C. elegans
aaaagaaaagctt

SEQ ID NO: 683935 - DNA, 13 bp, C. elegans
aaaagaaaccatt

SEQ ID NO: 683936 - DNA, 13 bp, C. elegans
aaaagaaactcac

SEQ ID NO: 683937 - DNA, 13 bp, C. elegans
aaaagaaactgat

SEQ ID NO: 683938 - DNA, 13 bp, C. elegans
aaaagaaacttta

SEQ ID NO: 683939 - DNA, 13 bp, C. elegans
aaaagaaagttct

SEQ ID NO: 683940 - DNA, 13 bp, C. elegans
aaaagaaattcag

SEQ ID NO: 683941 - DNA, 13 bp, C. elegans
aaaagaaattcca

SEQ ID NO: 683942 - DNA, 13 bp, C. elegans
aaaagaaattgca

SEQ ID NO: 683943 - DNA, 13 bp, C. elegans
aaaagaaatttca

SEQ ID NO: 683944 - DNA, 13 bp, C. elegans
aaaagaaatttgt

SEQ ID NO: 683945 - DNA, 13 bp, C. elegans
aaaagaacaactt

SEQ ID NO: 683946 - DNA, 13 bp, C. elegans
aaaagaacacatt

SEQ ID NO: 683947 - DNA, 13 bp, C. elegans
aaaagaacatttc

SEQ ID NO: 683948 - DNA, 13 bp, C. elegans
aaaagaactccaa

SEQ ID NO: 683949 - DNA, 13 bp, C. elegans
aaaagaacttcaa

SEQ ID NO: 683950 - DNA, 13 bp, C. elegans
aaaagaagaagct

SEQ ID NO: 683951 - DNA, 13 bp, C. elegans
aaaagaagacatt

SEQ ID NO: 683952 - DNA, 13 bp, C. elegans
aaaagaagacgtc

SEQ ID NO: 683953 - DNA, 13 bp, C. elegans
aaaagaagcaatt

SEQ ID NO: 683954 - DNA, 13 bp, C. elegans
aaaagaagtttga

SEQ ID NO: 683955 - DNA, 13 bp, C. elegans
aaaagaataattc

SEQ ID NO: 683956 - DNA, 13 bp, C. elegans
aaaagaatattct

SEQ ID NO: 683957 - DNA, 13 bp, C. elegans
aaaagaatcaatt

SEQ ID NO: 683958 - DNA, 13 bp, C. elegans
aaaagaatcagca

SEQ ID NO: 683959 - DNA, 13 bp, C. elegans
aaaagaatctcaa

SEQ ID NO: 683960 - DNA, 13 bp, C. elegans
aaaagaatgactt

SEQ ID NO: 683961 - DNA, 13 bp, C. elegans
aaaagaatgtttt

SEQ ID NO: 683962 - DNA, 13 bp, C. elegans
aaaagaattattg

SEQ ID NO: 683963 - DNA, 13 bp, C. elegans
aaaagaattctca

SEQ ID NO: 683964 - DNA, 13 bp, C. elegans
aaaagaatttcca

SEQ ID NO: 683965 - DNA, 13 bp, C. elegans
aaaagaatttgga

SEQ ID NO: 683966 - DNA, 13 bp, C. elegans
aaaagaattttag

SEQ ID NO: 683967 - DNA, 13 bp, C. elegans
aaaagacaacatt

SEQ ID NO: 683968 - DNA, 13 bp, C. elegans
aaaagacatttat

SEQ ID NO: 683969 - DNA, 13 bp, C. elegans
aaaagacatttgt

SEQ ID NO: 683970 - DNA, 13 bp, C. elegans
aaaagacgaattt

SEQ ID NO: 683971 - DNA, 13 bp, C. elegans
aaaagacgcagag

SEQ ID NO: 683972 - DNA, 13 bp, C. elegans
aaaagacgtttta

SEQ ID NO: 683973 - DNA, 13 bp, C. elegans
aaaagactttaga

SEQ ID NO: 683974 - DNA, 13 bp, C. elegans
aaaagactttttg

SEQ ID NO: 683975 - DNA, 13 bp, C. elegans
aaaagagaacatt

SEQ ID NO: 683976 - DNA, 13 bp, C. elegans
aaaagagaatttt

SEQ ID NO: 683977 - DNA, 13 bp, C. elegans
aaaagagacattt

SEQ ID NO: 683978 - DNA, 13 bp, C. elegans
aaaagagacgcag

SEQ ID NO: 683979 - DNA, 13 bp, C. elegans
aaaagagagttga

SEQ ID NO: 683980 - DNA, 13 bp, C. elegans
aaaagagatacat

SEQ ID NO: 683981 - DNA, 13 bp, C. elegans
aaaagagatacgt

SEQ ID NO: 683982 - DNA, 13 bp, C. elegans
aaaagagatttga

SEQ ID NO: 683983 - DNA, 13 bp, C. elegans
aaaagagcaattt

SEQ ID NO: 683984 - DNA, 13 bp, C. elegans
aaaagagcatttt

SEQ ID NO: 683985 - DNA, 13 bp, C. elegans
aaaagagccaatt

SEQ ID NO: 683986 - DNA, 13 bp, C. elegans
aaaagagctgaaa

SEQ ID NO: 683987 - DNA, 13 bp, C. elegans
aaaagagcttttt

SEQ ID NO: 683988 - DNA, 13 bp, C. elegans
aaaagagtttgaa

SEQ ID NO: 683989 - DNA, 13 bp, C. elegans
aaaagatacattt

SEQ ID NO: 683990 - DNA, 13 bp, C. elegans
aaaagatattttg

SEQ ID NO: 683991 - DNA, 13 bp, C. elegans
aaaagatccaatt

SEQ ID NO: 683992 - DNA, 13 bp, C. elegans
aaaagatctcaaa

SEQ ID NO: 683993 - DNA, 13 bp, C. elegans
aaaagatctgaaa

SEQ ID NO: 683994 - DNA, 13 bp, C. elegans
aaaagatgaagca

SEQ ID NO: 683995 - DNA, 13 bp, C. elegans
aaaagatgaagct

SEQ ID NO: 683996 - DNA, 13 bp, C. elegans
aaaagatgatatt

SEQ ID NO: 683997 - DNA, 13 bp, C. elegans
aaaagatgatgat

SEQ ID NO: 683998 - DNA, 13 bp, C. elegans
aaaagatgtttga

SEQ ID NO: 683999 - DNA, 13 bp, C. elegans
aaaagatgttttt

SEQ ID NO: 684000 - DNA, 13 bp, C. elegans
aaaagattatcaa

SEQ ID NO: 684001 - DNA, 13 bp, C. elegans
aaaagattatgat

SEQ ID NO: 684002 - DNA, 13 bp, C. elegans
aaaagattatttc

SEQ ID NO: 684003 - DNA, 13 bp, C. elegans
aaaagattcaaac

SEQ ID NO: 684004 - DNA, 13 bp, C. elegans
aaaagattcaaat

SEQ ID NO: 684005 - DNA, 13 bp, C. elegans
aaaagattcaatt

SEQ ID NO: 684006 - DNA, 13 bp, C. elegans
aaaagattcagaa

SEQ ID NO: 684007 - DNA, 13 bp, C. elegans
aaaagattcattt

SEQ ID NO: 684008 - DNA, 13 bp, C. elegans
aaaagattccaat

SEQ ID NO: 684009 - DNA, 13 bp, C. elegans
aaaagattcgaaa

SEQ ID NO: 684010 - DNA, 13 bp, C. elegans
aaaagattcgatt

SEQ ID NO: 684011 - DNA, 13 bp, C. elegans
aaaagattgaatg

SEQ ID NO: 684012 - DNA, 13 bp, C. elegans
aaaagattgaatt

SEQ ID NO: 684013 - DNA, 13 bp, C. elegans
aaaagattgatta

SEQ ID NO: 684014 - DNA, 13 bp, C. elegans
aaaagatttcaca

SEQ ID NO: 684015 - DNA, 13 bp, C. elegans
aaaagatttcttt

SEQ ID NO: 684016 - DNA, 13 bp, C. elegans
aaaagattttcaa

SEQ ID NO: 684017 - DNA, 13 bp, C. elegans
aaaagattttcag

SEQ ID NO: 684018 - DNA, 13 bp, C. elegans
aaaagattttgga

SEQ ID NO: 684019 - DNA, 13 bp, C. elegans
aaaagattttttg

SEQ ID NO: 684020 - DNA, 13 bp, C. elegans
aaaagcaaaatgt

SEQ ID NO: 684021 - DNA, 13 bp, C. elegans
aaaagcaaaattt

SEQ ID NO: 684022 - DNA, 13 bp, C. elegans
aaaagcaaatttt

SEQ ID NO: 684023 - DNA, 13 bp, C. elegans
aaaagcaagagtg

SEQ ID NO: 684024 - DNA, 13 bp, C. elegans
aaaagcaataatt

SEQ ID NO: 684025 - DNA, 13 bp, C. elegans
aaaagcaattatt

SEQ ID NO: 684026 - DNA, 13 bp, C. elegans
aaaagcacaattt

SEQ ID NO: 684027 - DNA, 13 bp, C. elegans
aaaagcacagttt

SEQ ID NO: 684028 - DNA, 13 bp, C. elegans
aaaagcactgaaa

SEQ ID NO: 684029 - DNA, 13 bp, C. elegans
aaaagcagatatt

SEQ ID NO: 684030 - DNA, 13 bp, C. elegans
aaaagcagtgaaa

SEQ ID NO: 684031 - DNA, 13 bp, C. elegans
aaaagcattcaaa

SEQ ID NO: 684032 - DNA, 13 bp, C. elegans
aaaagcattcaga

SEQ ID NO: 684033 - DNA, 13 bp, C. elegans
aaaagcattgaaa

SEQ ID NO: 684034 - DNA, 13 bp, C. elegans
aaaagcatttcta

SEQ ID NO: 684035 - DNA, 13 bp, C. elegans
aaaagcattttta

SEQ ID NO: 684036 - DNA, 13 bp, C. elegans
aaaagcatttttt

SEQ ID NO: 684037 - DNA, 13 bp, C. elegans
aaaagccaaaatt

SEQ ID NO: 684038 - DNA, 13 bp, C. elegans
aaaagccacgtgg

SEQ ID NO: 684039 - DNA, 13 bp, C. elegans
aaaagccagaaat

SEQ ID NO: 684040 - DNA, 13 bp, C. elegans
aaaagccagtttt

SEQ ID NO: 684041 - DNA, 13 bp, C. elegans
aaaagcctcaatt

SEQ ID NO: 684042 - DNA, 13 bp, C. elegans
aaaagccttgaaa

SEQ ID NO: 684043 - DNA, 13 bp, C. elegans
aaaagcgaatttt

SEQ ID NO: 684044 - DNA, 13 bp, C. elegans
aaaagcgattttt

SEQ ID NO: 684045 - DNA, 13 bp, C. elegans
aaaagcgcgtcag

SEQ ID NO: 684046 - DNA, 13 bp, C. elegans
aaaagcggaaatt

SEQ ID NO: 684047 - DNA, 13 bp, C. elegans
aaaagcgggacgg

SEQ ID NO: 684048 - DNA, 13 bp, C. elegans
aaaagcgttgaaa

SEQ ID NO: 684049 - DNA, 13 bp, C. elegans
aaaagctataatt

SEQ ID NO: 684050 - DNA, 13 bp, C. elegans
aaaagctattgaa

SEQ ID NO: 684051 - DNA, 13 bp, C. elegans
aaaagctcaaaat

SEQ ID NO: 684052 - DNA, 13 bp, C. elegans
aaaagctcaaatt

SEQ ID NO: 684053 - DNA, 13 bp, C. elegans
aaaagctcagaaa

SEQ ID NO: 684054 - DNA, 13 bp, C. elegans
aaaagctcataat

SEQ ID NO: 684055 - DNA, 13 bp, C. elegans
aaaagctctcaaa

SEQ ID NO: 684056 - DNA, 13 bp, C. elegans
aaaagctctgaaa

SEQ ID NO: 684057 - DNA, 13 bp, C. elegans
aaaagctcttttt

SEQ ID NO: 684058 - DNA, 13 bp, C. elegans
aaaagctgaaaag

SEQ ID NO: 684059 - DNA, 13 bp, C. elegans
aaaagctgaaaat

SEQ ID NO: 684060 - DNA, 13 bp, C. elegans
aaaagctgaaatt

SEQ ID NO: 684061 - DNA, 13 bp, C. elegans
aaaagctgaataa

SEQ ID NO: 684062 - DNA, 13 bp, C. elegans
aaaagctgaattt

SEQ ID NO: 684063 - DNA, 13 bp, C. elegans
aaaagctgacaaa

SEQ ID NO: 684064 - DNA, 13 bp, C. elegans
aaaagctgagaaa

SEQ ID NO: 684065 - DNA, 13 bp, C. elegans
aaaagctgatttt

SEQ ID NO: 684066 - DNA, 13 bp, C. elegans
aaaagctgcaaaa

SEQ ID NO: 684067 - DNA, 13 bp, C. elegans
aaaagctgcagaa

SEQ ID NO: 684068 - DNA, 13 bp, C. elegans
aaaagctggaaaa

SEQ ID NO: 684069 - DNA, 13 bp, C. elegans
aaaagctgttcaa

SEQ ID NO: 684070 - DNA, 13 bp, C. elegans
aaaagctgttttt

SEQ ID NO: 684071 - DNA, 13 bp, C. elegans
aaaagcttaattt

SEQ ID NO: 684072 - DNA, 13 bp, C. elegans
aaaagcttataaa

SEQ ID NO: 684073 - DNA, 13 bp, C. elegans
aaaagcttcaaaa

SEQ ID NO: 684074 - DNA, 13 bp, C. elegans
aaaagcttcaaga

SEQ ID NO: 684075 - DNA, 13 bp, C. elegans
aaaagcttcaata

SEQ ID NO: 684076 - DNA, 13 bp, C. elegans
aaaagcttctaaa

SEQ ID NO: 684077 - DNA, 13 bp, C. elegans
aaaagcttgaaaa

SEQ ID NO: 684078 - DNA, 13 bp, C. elegans
aaaagctttaaat

SEQ ID NO: 684079 - DNA, 13 bp, C. elegans
aaaagctttacaa

SEQ ID NO: 684080 - DNA, 13 bp, C. elegans
aaaagcttttaaa

SEQ ID NO: 684081 - DNA, 13 bp, C. elegans
aaaagcttttatt

SEQ ID NO: 684082 - DNA, 13 bp, C. elegans
aaaagcttttcag

SEQ ID NO: 684083 - DNA, 13 bp, C. elegans
aaaagctttttaa

SEQ ID NO: 684084 - DNA, 13 bp, C. elegans
aaaagcttttttt

SEQ ID NO: 684085 - DNA, 13 bp, C. elegans
aaaaggaaaacgt

SEQ ID NO: 684086 - DNA, 13 bp, C. elegans
aaaaggaaaactg

SEQ ID NO: 684087 - DNA, 13 bp, C. elegans
aaaaggaaaatct

SEQ ID NO: 684088 - DNA, 13 bp, C. elegans
aaaaggaaacttc

SEQ ID NO: 684089 - DNA, 13 bp, C. elegans
aaaaggaaattct

SEQ ID NO: 684090 - DNA, 13 bp, C. elegans
aaaaggaaatttg

SEQ ID NO: 684091 - DNA, 13 bp, C. elegans
aaaaggaacaatt

SEQ ID NO: 684092 - DNA, 13 bp, C. elegans
aaaaggaacagtt

SEQ ID NO: 684093 - DNA, 13 bp, C. elegans
aaaaggaactttt

SEQ ID NO: 684094 - DNA, 13 bp, C. elegans
aaaaggacaattt

SEQ ID NO: 684095 - DNA, 13 bp, C. elegans
aaaaggagatttt

SEQ ID NO: 684096 - DNA, 13 bp, C. elegans
aaaaggatttgaa

SEQ ID NO: 684097 - DNA, 13 bp, C. elegans
aaaaggattttat

SEQ ID NO: 684098 - DNA, 13 bp, C. elegans
aaaaggatttttt

SEQ ID NO: 684099 - DNA, 13 bp, C. elegans
aaaaggcgatttt

SEQ ID NO: 684100 - DNA, 13 bp, C. elegans
aaaaggctatttt

SEQ ID NO: 684101 - DNA, 13 bp, C. elegans
aaaaggctgaaaa

SEQ ID NO: 684102 - DNA, 13 bp, C. elegans
aaaaggcttcaaa

SEQ ID NO: 684103 - DNA, 13 bp, C. elegans
aaaagggaaattg

SEQ ID NO: 684104 - DNA, 13 bp, C. elegans
aaaagggcggagc

SEQ ID NO: 684105 - DNA, 13 bp, C. elegans
aaaaggggatctg

SEQ ID NO: 684106 - DNA, 13 bp, C. elegans
aaaagggtaaaac

SEQ ID NO: 684107 - DNA, 13 bp, C. elegans
aaaaggtccaaaa

SEQ ID NO: 684108 - DNA, 13 bp, C. elegans
aaaaggtgaaaac

SEQ ID NO: 684109 - DNA, 13 bp, C. elegans
aaaaggtgaaatt

SEQ ID NO: 684110 - DNA, 13 bp, C. elegans
aaaaggtgcaaaa

SEQ ID NO: 684111 - DNA, 13 bp, C. elegans
aaaaggtgtcaaa

SEQ ID NO: 684112 - DNA, 13 bp, C. elegans
aaaaggttatgaa

SEQ ID NO: 684113 - DNA, 13 bp, C. elegans
aaaaggttcaaaa

SEQ ID NO: 684114 - DNA, 13 bp, C. elegans
aaaaggtttcaaa

SEQ ID NO: 684115 - DNA, 13 bp, C. elegans
aaaaggtttcaat

SEQ ID NO: 684116 - DNA, 13 bp, C. elegans
aaaaggttttgat

SEQ ID NO: 684117 - DNA, 13 bp, C. elegans
aaaaggttttttg

SEQ ID NO: 684118 - DNA, 13 bp, C. elegans
aaaaggttttttt

SEQ ID NO: 684119 - DNA, 13 bp, C. elegans
aaaagtaaacatt

SEQ ID NO: 684120 - DNA, 13 bp, C. elegans
aaaagtaaacgtg

SEQ ID NO: 684121 - DNA, 13 bp, C. elegans
aaaagtaaagctt

SEQ ID NO: 684122 - DNA, 13 bp, C. elegans
aaaagtaacattt

SEQ ID NO: 684123 - DNA, 13 bp, C. elegans
aaaagtaagtttt

SEQ ID NO: 684124 - DNA, 13 bp, C. elegans
aaaagtaatacat

SEQ ID NO: 684125 - DNA, 13 bp, C. elegans
aaaagtaatagtt

SEQ ID NO: 684126 - DNA, 13 bp, C. elegans
aaaagtaatgcaa

SEQ ID NO: 684127 - DNA, 13 bp, C. elegans
aaaagtaattttg

SEQ ID NO: 684128 - DNA, 13 bp, C. elegans
aaaagtacaattt

SEQ ID NO: 684129 - DNA, 13 bp, C. elegans
aaaagtaccggaa

SEQ ID NO: 684130 - DNA, 13 bp, C. elegans
aaaagtacgagaa

SEQ ID NO: 684131 - DNA, 13 bp, C. elegans
aaaagtacggaaa

SEQ ID NO: 684132 - DNA, 13 bp, C. elegans
aaaagtactgcaa

SEQ ID NO: 684133 - DNA, 13 bp, C. elegans
aaaagtacttttt

SEQ ID NO: 684134 - DNA, 13 bp, C. elegans
aaaagtagacttt

SEQ ID NO: 684135 - DNA, 13 bp, C. elegans
aaaagtagagttt

SEQ ID NO: 684136 - DNA, 13 bp, C. elegans
aaaagtagatcaa

SEQ ID NO: 684137 - DNA, 13 bp, C. elegans
aaaagtagatttt

SEQ ID NO: 684138 - DNA, 13 bp, C. elegans
aaaagtagcaaat

SEQ ID NO: 684139 - DNA, 13 bp, C. elegans
aaaagtagcgaaa

SEQ ID NO: 684140 - DNA, 13 bp, C. elegans
aaaagtagttcaa

SEQ ID NO: 684141 - DNA, 13 bp, C. elegans
aaaagtatagatt

SEQ ID NO: 684142 - DNA, 13 bp, C. elegans
aaaagtatatttc

SEQ ID NO: 684143 - DNA, 13 bp, C. elegans
aaaagtatcaaat

SEQ ID NO: 684144 - DNA, 13 bp, C. elegans
aaaagtatctgaa

SEQ ID NO: 684145 - DNA, 13 bp, C. elegans
aaaagtatgcaaa

SEQ ID NO: 684146 - DNA, 13 bp, C. elegans
aaaagtatggtaa

SEQ ID NO: 684147 - DNA, 13 bp, C. elegans
aaaagtattcaaa

SEQ ID NO: 684148 - DNA, 13 bp, C. elegans
aaaagtattcaga

SEQ ID NO: 684149 - DNA, 13 bp, C. elegans
aaaagtattcatt

SEQ ID NO: 684150 - DNA, 13 bp, C. elegans
aaaagtattgata

SEQ ID NO: 684151 - DNA, 13 bp, C. elegans
aaaagtatttcaa

SEQ ID NO: 684152 - DNA, 13 bp, C. elegans
aaaagtatttcag

SEQ ID NO: 684153 - DNA, 13 bp, C. elegans
aaaagtatttgaa

SEQ ID NO: 684154 - DNA, 13 bp, C. elegans
aaaagtattttca

SEQ ID NO: 684155 - DNA, 13 bp, C. elegans
aaaagtattttcc

SEQ ID NO: 684156 - DNA, 13 bp, C. elegans
aaaagtcaaaagt

SEQ ID NO: 684157 - DNA, 13 bp, C. elegans
aaaagtcaaatca

SEQ ID NO: 684158 - DNA, 13 bp, C. elegans
aaaagtcaacatt

SEQ ID NO: 684159 - DNA, 13 bp, C. elegans
aaaagtcaagttt

SEQ ID NO: 684160 - DNA, 13 bp, C. elegans
aaaagtcaatgtt

SEQ ID NO: 684161 - DNA, 13 bp, C. elegans
aaaagtcaattaa

SEQ ID NO: 684162 - DNA, 13 bp, C. elegans
aaaagtcaatttt

SEQ ID NO: 684163 - DNA, 13 bp, C. elegans
aaaagtcacaaat

SEQ ID NO: 684164 - DNA, 13 bp, C. elegans
aaaagtcacaact

SEQ ID NO: 684165 - DNA, 13 bp, C. elegans
aaaagtcacgaaa

SEQ ID NO: 684166 - DNA, 13 bp, C. elegans
aaaagtcactgaa

SEQ ID NO: 684167 - DNA, 13 bp, C. elegans
aaaagtcactttt

SEQ ID NO: 684168 - DNA, 13 bp, C. elegans
aaaagtcagaaat

SEQ ID NO: 684169 - DNA, 13 bp, C. elegans
aaaagtcataaat

SEQ ID NO: 684170 - DNA, 13 bp, C. elegans
aaaagtcatcaac

SEQ ID NO: 684171 - DNA, 13 bp, C. elegans
aaaagtcattttt

SEQ ID NO: 684172 - DNA, 13 bp, C. elegans
aaaagtccaaaat

SEQ ID NO: 684173 - DNA, 13 bp, C. elegans
aaaagtccaaatt

SEQ ID NO: 684174 - DNA, 13 bp, C. elegans
aaaagtccagaaa

SEQ ID NO: 684175 - DNA, 13 bp, C. elegans
aaaagtcccaaaa

SEQ ID NO: 684176 - DNA, 13 bp, C. elegans
aaaagtcccaatt

SEQ ID NO: 684177 - DNA, 13 bp, C. elegans
aaaagtccgattt

SEQ ID NO: 684178 - DNA, 13 bp, C. elegans
aaaagtcgaaata

SEQ ID NO: 684179 - DNA, 13 bp, C. elegans
aaaagtcgaagaa

SEQ ID NO: 684180 - DNA, 13 bp, C. elegans
aaaagtcgaattt

SEQ ID NO: 684181 - DNA, 13 bp, C. elegans
aaaagtcgagaaa

SEQ ID NO: 684182 - DNA, 13 bp, C. elegans
aaaagtcggaaaa

SEQ ID NO: 684183 - DNA, 13 bp, C. elegans
aaaagtcggattt

SEQ ID NO: 684184 - DNA, 13 bp, C. elegans
aaaagtcgggaaa

SEQ ID NO: 684185 - DNA, 13 bp, C. elegans
aaaagtcggtcaa

SEQ ID NO: 684186 - DNA, 13 bp, C. elegans
aaaagtctatatt

SEQ ID NO: 684187 - DNA, 13 bp, C. elegans
aaaagtctcaaaa

SEQ ID NO: 684188 - DNA, 13 bp, C. elegans
aaaagtctcataa

SEQ ID NO: 684189 - DNA, 13 bp, C. elegans
aaaagtctcgaaa

SEQ ID NO: 684190 - DNA, 13 bp, C. elegans
aaaagtctgaaaa

SEQ ID NO: 684191 - DNA, 13 bp, C. elegans
aaaagtctgaaat

SEQ ID NO: 684192 - DNA, 13 bp, C. elegans
aaaagtctgcaaa

SEQ ID NO: 684193 - DNA, 13 bp, C. elegans
aaaagtctgtaat

SEQ ID NO: 684194 - DNA, 13 bp, C. elegans
aaaagtcttccaa

SEQ ID NO: 684195 - DNA, 13 bp, C. elegans
aaaagtcttgaaa

SEQ ID NO: 684196 - DNA, 13 bp, C. elegans
aaaagtgaaacat

SEQ ID NO: 684197 - DNA, 13 bp, C. elegans
aaaagtgaaactt

SEQ ID NO: 684198 - DNA, 13 bp, C. elegans
aaaagtgaaatgt

SEQ ID NO: 684199 - DNA, 13 bp, C. elegans
aaaagtgaaattt

SEQ ID NO: 684200 - DNA, 13 bp, C. elegans
aaaagtgaatatt

SEQ ID NO: 684201 - DNA, 13 bp, C. elegans
aaaagtgaattga

SEQ ID NO: 684202 - DNA, 13 bp, C. elegans
aaaagtgacaatt

SEQ ID NO: 684203 - DNA, 13 bp, C. elegans
aaaagtgacagtt

SEQ ID NO: 684204 - DNA, 13 bp, C. elegans
aaaagtgacatca

SEQ ID NO: 684205 - DNA, 13 bp, C. elegans
aaaagtgacattt

SEQ ID NO: 684206 - DNA, 13 bp, C. elegans
aaaagtgacgtca

SEQ ID NO: 684207 - DNA, 13 bp, C. elegans
aaaagtgactgaa

SEQ ID NO: 684208 - DNA, 13 bp, C. elegans
aaaagtgagaagt

SEQ ID NO: 684209 - DNA, 13 bp, C. elegans
aaaagtgagaatt

SEQ ID NO: 684210 - DNA, 13 bp, C. elegans
aaaagtgagagat

SEQ ID NO: 684211 - DNA, 13 bp, C. elegans
aaaagtgagcgaa

SEQ ID NO: 684212 - DNA, 13 bp, C. elegans
aaaagtgagtgaa

SEQ ID NO: 684213 - DNA, 13 bp, C. elegans
aaaagtgagtttt

SEQ ID NO: 684214 - DNA, 13 bp, C. elegans
aaaagtgataatt

SEQ ID NO: 684215 - DNA, 13 bp, C. elegans
aaaagtgatatat

SEQ ID NO: 684216 - DNA, 13 bp, C. elegans
aaaagtgatgtga

SEQ ID NO: 684217 - DNA, 13 bp, C. elegans
aaaagtgattcat

SEQ ID NO: 684218 - DNA, 13 bp, C. elegans
aaaagtgattttg

SEQ ID NO: 684219 - DNA, 13 bp, C. elegans
aaaagtgattttt

SEQ ID NO: 684220 - DNA, 13 bp, C. elegans
aaaagtgcaataa

SEQ ID NO: 684221 - DNA, 13 bp, C. elegans
aaaagtgcaattt

SEQ ID NO: 684222 - DNA, 13 bp, C. elegans
aaaagtgcacaaa

SEQ ID NO: 684223 - DNA, 13 bp, C. elegans
aaaagtgcacatt

SEQ ID NO: 684224 - DNA, 13 bp, C. elegans
aaaagtgcacttt

SEQ ID NO: 684225 - DNA, 13 bp, C. elegans
aaaagtgcagaaa

SEQ ID NO: 684226 - DNA, 13 bp, C. elegans
aaaagtgcatgaa

SEQ ID NO: 684227 - DNA, 13 bp, C. elegans
aaaagtgcatttt

SEQ ID NO: 684228 - DNA, 13 bp, C. elegans
aaaagtgccaaat

SEQ ID NO: 684229 - DNA, 13 bp, C. elegans
aaaagtgccgaaa

SEQ ID NO: 684230 - DNA, 13 bp, C. elegans
aaaagtgctcaaa

SEQ ID NO: 684231 - DNA, 13 bp, C. elegans
aaaagtgctgaaa

SEQ ID NO: 684232 - DNA, 13 bp, C. elegans
aaaagtggaaagt

SEQ ID NO: 684233 - DNA, 13 bp, C. elegans
aaaagtggaaatt

SEQ ID NO: 684234 - DNA, 13 bp, C. elegans
aaaagtggatatc

SEQ ID NO: 684235 - DNA, 13 bp, C. elegans
aaaagtggatttt

SEQ ID NO: 684236 - DNA, 13 bp, C. elegans
aaaagtggcaaaa

SEQ ID NO: 684237 - DNA, 13 bp, C. elegans
aaaagtggcaaag

SEQ ID NO: 684238 - DNA, 13 bp, C. elegans
aaaagtggccaaa

SEQ ID NO: 684239 - DNA, 13 bp, C. elegans
aaaagtggctatt

SEQ ID NO: 684240 - DNA, 13 bp, C. elegans
aaaagtggtgaaa

SEQ ID NO: 684241 - DNA, 13 bp, C. elegans
aaaagtggttcaa

SEQ ID NO: 684242 - DNA, 13 bp, C. elegans
aaaagtggtttca

SEQ ID NO: 684243 - DNA, 13 bp, C. elegans
aaaagtgtaaagt

SEQ ID NO: 684244 - DNA, 13 bp, C. elegans
aaaagtgtacttt

SEQ ID NO: 684245 - DNA, 13 bp, C. elegans
aaaagtgtattca

SEQ ID NO: 684246 - DNA, 13 bp, C. elegans
aaaagtgtatttt

SEQ ID NO: 684247 - DNA, 13 bp, C. elegans
aaaagtgtcaaaa

SEQ ID NO: 684248 - DNA, 13 bp, C. elegans
aaaagtgtcaaga

SEQ ID NO: 684249 - DNA, 13 bp, C. elegans
aaaagtgtcgtgt

SEQ ID NO: 684250 - DNA, 13 bp, C. elegans
aaaagtgtctaaa

SEQ ID NO: 684251 - DNA, 13 bp, C. elegans
aaaagtgtctgaa

SEQ ID NO: 684252 - DNA, 13 bp, C. elegans
aaaagtgtgaaga

SEQ ID NO: 684253 - DNA, 13 bp, C. elegans
aaaagtgtggaaa

SEQ ID NO: 684254 - DNA, 13 bp, C. elegans
aaaagtgtgtgtt

SEQ ID NO: 684255 - DNA, 13 bp, C. elegans
aaaagtgtgtttt

SEQ ID NO: 684256 - DNA, 13 bp, C. elegans
aaaagtgttaata

SEQ ID NO: 684257 - DNA, 13 bp, C. elegans
aaaagtgttaatt

SEQ ID NO: 684258 - DNA, 13 bp, C. elegans
aaaagtgttcaaa

SEQ ID NO: 684259 - DNA, 13 bp, C. elegans
aaaagtgttcaag

SEQ ID NO: 684260 - DNA, 13 bp, C. elegans
aaaagtgttcaga

SEQ ID NO: 684261 - DNA, 13 bp, C. elegans
aaaagtgttcctt

SEQ ID NO: 684262 - DNA, 13 bp, C. elegans
aaaagtgttggaa

SEQ ID NO: 684263 - DNA, 13 bp, C. elegans
aaaagtgtttaaa

SEQ ID NO: 684264 - DNA, 13 bp, C. elegans
aaaagtgtttatt

SEQ ID NO: 684265 - DNA, 13 bp, C. elegans
aaaagtgtttccc

SEQ ID NO: 684266 - DNA, 13 bp, C. elegans
aaaagtgtttggt

SEQ ID NO: 684267 - DNA, 13 bp, C. elegans
aaaagtgttttcc

SEQ ID NO: 684268 - DNA, 13 bp, C. elegans
aaaagtgtttttg

SEQ ID NO: 684269 - DNA, 13 bp, C. elegans
aaaagttaaagtt

SEQ ID NO: 684270 - DNA, 13 bp, C. elegans
aaaagttacaaga

SEQ ID NO: 684271 - DNA, 13 bp, C. elegans
aaaagttacaatg

SEQ ID NO: 684272 - DNA, 13 bp, C. elegans
aaaagttacaatt

SEQ ID NO: 684273 - DNA, 13 bp, C. elegans
aaaagttacactt

SEQ ID NO: 684274 - DNA, 13 bp, C. elegans
aaaagttacattt

SEQ ID NO: 684275 - DNA, 13 bp, C. elegans
aaaagttaccaaa

SEQ ID NO: 684276 - DNA, 13 bp, C. elegans
aaaagttagattt

SEQ ID NO: 684277 - DNA, 13 bp, C. elegans
aaaagttagcaaa

SEQ ID NO: 684278 - DNA, 13 bp, C. elegans
aaaagttaggcca

SEQ ID NO: 684279 - DNA, 13 bp, C. elegans
aaaagttatacta

SEQ ID NO: 684280 - DNA, 13 bp, C. elegans
aaaagttatcaaa

SEQ ID NO: 684281 - DNA, 13 bp, C. elegans
aaaagttatgacg

SEQ ID NO: 684282 - DNA, 13 bp, C. elegans
aaaagttatgata

SEQ ID NO: 684283 - DNA, 13 bp, C. elegans
aaaagttatgatg

SEQ ID NO: 684284 - DNA, 13 bp, C. elegans
aaaagttatggaa

SEQ ID NO: 684285 - DNA, 13 bp, C. elegans
aaaagttattgtt

SEQ ID NO: 684286 - DNA, 13 bp, C. elegans
aaaagttatttgt

SEQ ID NO: 684287 - DNA, 13 bp, C. elegans
aaaagttcaaaac

SEQ ID NO: 684288 - DNA, 13 bp, C. elegans
aaaagttcaaaat

SEQ ID NO: 684289 - DNA, 13 bp, C. elegans
aaaagttcaaagt

SEQ ID NO: 684290 - DNA, 13 bp, C. elegans
aaaagttcaaatg

SEQ ID NO: 684291 - DNA, 13 bp, C. elegans
aaaagttcaaatt

SEQ ID NO: 684292 - DNA, 13 bp, C. elegans
aaaagttcaacat

SEQ ID NO: 684293 - DNA, 13 bp, C. elegans
aaaagttcaacta

SEQ ID NO: 684294 - DNA, 13 bp, C. elegans
aaaagttcaagaa

SEQ ID NO: 684295 - DNA, 13 bp, C. elegans
aaaagttcaatat

SEQ ID NO: 684296 - DNA, 13 bp, C. elegans
aaaagttcaatca

SEQ ID NO: 684297 - DNA, 13 bp, C. elegans
aaaagttcacaac

SEQ ID NO: 684298 - DNA, 13 bp, C. elegans
aaaagttcacaat

SEQ ID NO: 684299 - DNA, 13 bp, C. elegans
aaaagttcacgtc

SEQ ID NO: 684300 - DNA, 13 bp, C. elegans
aaaagttcagaaa

SEQ ID NO: 684301 - DNA, 13 bp, C. elegans
aaaagttcagtat

SEQ ID NO: 684302 - DNA, 13 bp, C. elegans
aaaagttcatgaa

SEQ ID NO: 684303 - DNA, 13 bp, C. elegans
aaaagttcatgta

SEQ ID NO: 684304 - DNA, 13 bp, C. elegans
aaaagttcattct

SEQ ID NO: 684305 - DNA, 13 bp, C. elegans
aaaagttcattta

SEQ ID NO: 684306 - DNA, 13 bp, C. elegans
aaaagttccaatt

SEQ ID NO: 684307 - DNA, 13 bp, C. elegans
aaaagttccagaa

SEQ ID NO: 684308 - DNA, 13 bp, C. elegans
aaaagttccattt

SEQ ID NO: 684309 - DNA, 13 bp, C. elegans
aaaagttcccatt

SEQ ID NO: 684310 - DNA, 13 bp, C. elegans
aaaagttcccgca

SEQ ID NO: 684311 - DNA, 13 bp, C. elegans
aaaagttccgaaa

SEQ ID NO: 684312 - DNA, 13 bp, C. elegans
aaaagttcgaaaa

SEQ ID NO: 684313 - DNA, 13 bp, C. elegans
aaaagttcgaaag

SEQ ID NO: 684314 - DNA, 13 bp, C. elegans
aaaagttcgagaa

SEQ ID NO: 684315 - DNA, 13 bp, C. elegans
aaaagttcgagtt

SEQ ID NO: 684316 - DNA, 13 bp, C. elegans
aaaagttcggcaa

SEQ ID NO: 684317 - DNA, 13 bp, C. elegans
aaaagttcgtaaa

SEQ ID NO: 684318 - DNA, 13 bp, C. elegans
aaaagttctagaa

SEQ ID NO: 684319 - DNA, 13 bp, C. elegans
aaaagttctatga

SEQ ID NO: 684320 - DNA, 13 bp, C. elegans
aaaagttctgaaa

SEQ ID NO: 684321 - DNA, 13 bp, C. elegans
aaaagttcttatt

SEQ ID NO: 684322 - DNA, 13 bp, C. elegans
aaaagttcttcaa

SEQ ID NO: 684323 - DNA, 13 bp, C. elegans
aaaagttcttcga

SEQ ID NO: 684324 - DNA, 13 bp, C. elegans
aaaagttgaaagt

SEQ ID NO: 684325 - DNA, 13 bp, C. elegans
aaaagttgaacaa

SEQ ID NO: 684326 - DNA, 13 bp, C. elegans
aaaagttgaatga

SEQ ID NO: 684327 - DNA, 13 bp, C. elegans
aaaagttgaattt

SEQ ID NO: 684328 - DNA, 13 bp, C. elegans
aaaagttgacaat

SEQ ID NO: 684329 - DNA, 13 bp, C. elegans
aaaagttgacgaa

SEQ ID NO: 684330 - DNA, 13 bp, C. elegans
aaaagttgacttt

SEQ ID NO: 684331 - DNA, 13 bp, C. elegans
aaaagttgagaat

SEQ ID NO: 684332 - DNA, 13 bp, C. elegans
aaaagttgatatt

SEQ ID NO: 684333 - DNA, 13 bp, C. elegans
aaaagttgattta

SEQ ID NO: 684334 - DNA, 13 bp, C. elegans
aaaagttgatttc

SEQ ID NO: 684335 - DNA, 13 bp, C. elegans
aaaagttgatttt

SEQ ID NO: 684336 - DNA, 13 bp, C. elegans
aaaagttgcaaaa

SEQ ID NO: 684337 - DNA, 13 bp, C. elegans
aaaagttgcagaa

SEQ ID NO: 684338 - DNA, 13 bp, C. elegans
aaaagttgcattg

SEQ ID NO: 684339 - DNA, 13 bp, C. elegans
aaaagttgccggt

SEQ ID NO: 684340 - DNA, 13 bp, C. elegans
aaaagttgcgaaa

SEQ ID NO: 684341 - DNA, 13 bp, C. elegans
aaaagttggaatt

SEQ ID NO: 684342 - DNA, 13 bp, C. elegans
aaaagttggacaa

SEQ ID NO: 684343 - DNA, 13 bp, C. elegans
aaaagttggatta

SEQ ID NO: 684344 - DNA, 13 bp, C. elegans
aaaagttggattt

SEQ ID NO: 684345 - DNA, 13 bp, C. elegans
aaaagttgggaaa

SEQ ID NO: 684346 - DNA, 13 bp, C. elegans
aaaagttgggcaa

SEQ ID NO: 684347 - DNA, 13 bp, C. elegans
aaaagttgtagat

SEQ ID NO: 684348 - DNA, 13 bp, C. elegans
aaaagttgtattt

SEQ ID NO: 684349 - DNA, 13 bp, C. elegans
aaaagttgtcaaa

SEQ ID NO: 684350 - DNA, 13 bp, C. elegans
aaaagttgtcaat

SEQ ID NO: 684351 - DNA, 13 bp, C. elegans
aaaagttgtcaga

SEQ ID NO: 684352 - DNA, 13 bp, C. elegans
aaaagttgtccaa

SEQ ID NO: 684353 - DNA, 13 bp, C. elegans
aaaagttgtcgaa

SEQ ID NO: 684354 - DNA, 13 bp, C. elegans
aaaagttgtgaag

SEQ ID NO: 684355 - DNA, 13 bp, C. elegans
aaaagttgttaac

SEQ ID NO: 684356 - DNA, 13 bp, C. elegans
aaaagttgttatt

SEQ ID NO: 684357 - DNA, 13 bp, C. elegans
aaaagttgttcat

SEQ ID NO: 684358 - DNA, 13 bp, C. elegans
aaaagttgttgac

SEQ ID NO: 684359 - DNA, 13 bp, C. elegans
aaaagtttacaat

SEQ ID NO: 684360 - DNA, 13 bp, C. elegans
aaaagtttacagt

SEQ ID NO: 684361 - DNA, 13 bp, C. elegans
aaaagtttatggt

SEQ ID NO: 684362 - DNA, 13 bp, C. elegans
aaaagtttattga

SEQ ID NO: 684363 - DNA, 13 bp, C. elegans
aaaagtttcaaaa

SEQ ID NO: 684364 - DNA, 13 bp, C. elegans
aaaagtttcaaag

SEQ ID NO: 684365 - DNA, 13 bp, C. elegans
aaaagtttcaaca

SEQ ID NO: 684366 - DNA, 13 bp, C. elegans
aaaagtttcaact

SEQ ID NO: 684367 - DNA, 13 bp, C. elegans
aaaagtttcactt

SEQ ID NO: 684368 - DNA, 13 bp, C. elegans
aaaagtttcagaa

SEQ ID NO: 684369 - DNA, 13 bp, C. elegans
aaaagtttcattt

SEQ ID NO: 684370 - DNA, 13 bp, C. elegans
aaaagtttccaga

SEQ ID NO: 684371 - DNA, 13 bp, C. elegans
aaaagtttcgatt

SEQ ID NO: 684372 - DNA, 13 bp, C. elegans
aaaagtttctgaa

SEQ ID NO: 684373 - DNA, 13 bp, C. elegans
aaaagtttctgat

SEQ ID NO: 684374 - DNA, 13 bp, C. elegans
aaaagtttcttaa

SEQ ID NO: 684375 - DNA, 13 bp, C. elegans
aaaagtttctttg

SEQ ID NO: 684376 - DNA, 13 bp, C. elegans
aaaagtttgaaat

SEQ ID NO: 684377 - DNA, 13 bp, C. elegans
aaaagtttgaagc

SEQ ID NO: 684378 - DNA, 13 bp, C. elegans
aaaagtttgaatt

SEQ ID NO: 684379 - DNA, 13 bp, C. elegans
aaaagtttgacaa

SEQ ID NO: 684380 - DNA, 13 bp, C. elegans
aaaagtttgataa

SEQ ID NO: 684381 - DNA, 13 bp, C. elegans
aaaagtttgatct

SEQ ID NO: 684382 - DNA, 13 bp, C. elegans
aaaagtttgattt

SEQ ID NO: 684383 - DNA, 13 bp, C. elegans
aaaagtttgcaat

SEQ ID NO: 684384 - DNA, 13 bp, C. elegans
aaaagtttgcaga

SEQ ID NO: 684385 - DNA, 13 bp, C. elegans
aaaagtttggcac

SEQ ID NO: 684386 - DNA, 13 bp, C. elegans
aaaagtttggctt

SEQ ID NO: 684387 - DNA, 13 bp, C. elegans
aaaagtttgtgaa

SEQ ID NO: 684388 - DNA, 13 bp, C. elegans
aaaagtttgttat

SEQ ID NO: 684389 - DNA, 13 bp, C. elegans
aaaagttttacga

SEQ ID NO: 684390 - DNA, 13 bp, C. elegans
aaaagttttagaa

SEQ ID NO: 684391 - DNA, 13 bp, C. elegans
aaaagttttatca

SEQ ID NO: 684392 - DNA, 13 bp, C. elegans
aaaagttttatct

SEQ ID NO: 684393 - DNA, 13 bp, C. elegans
aaaagttttcaag

SEQ ID NO: 684394 - DNA, 13 bp, C. elegans
aaaagttttcatg

SEQ ID NO: 684395 - DNA, 13 bp, C. elegans
aaaagttttcatt

SEQ ID NO: 684396 - DNA, 13 bp, C. elegans
aaaagttttctag

SEQ ID NO: 684397 - DNA, 13 bp, C. elegans
aaaagttttctgt

SEQ ID NO: 684398 - DNA, 13 bp, C. elegans
aaaagttttgaaa

SEQ ID NO: 684399 - DNA, 13 bp, C. elegans
aaaagttttgacc

SEQ ID NO: 684400 - DNA, 13 bp, C. elegans
aaaagttttgaga

SEQ ID NO: 684401 - DNA, 13 bp, C. elegans
aaaagttttgagg

SEQ ID NO: 684402 - DNA, 13 bp, C. elegans
aaaagttttgcaa

SEQ ID NO: 684403 - DNA, 13 bp, C. elegans
aaaagttttgcta

SEQ ID NO: 684404 - DNA, 13 bp, C. elegans
aaaagttttggaa

SEQ ID NO: 684405 - DNA, 13 bp, C. elegans
aaaagttttggca

SEQ ID NO: 684406 - DNA, 13 bp, C. elegans
aaaagttttgtta

SEQ ID NO: 684407 - DNA, 13 bp, C. elegans
aaaagtttttcaa

SEQ ID NO: 684408 - DNA, 13 bp, C. elegans
aaaagtttttcat

SEQ ID NO: 684409 - DNA, 13 bp, C. elegans
aaaagtttttgaa

SEQ ID NO: 684410 - DNA, 13 bp, C. elegans
aaaagtttttgat

SEQ ID NO: 684411 - DNA, 14 bp, C. elegans
aaaagtttttggaa

SEQ ID NO: 684412 - DNA, 13 bp, C. elegans
aaaagttttttca

SEQ ID NO: 684413 - DNA, 13 bp, C. elegans
aaaagttttttga

SEQ ID NO: 684414 - DNA, 13 bp, C. elegans
aaaagttttttgg

SEQ ID NO: 684415 - DNA, 13 bp, C. elegans
aaaataaacttcc

SEQ ID NO: 684416 - DNA, 13 bp, C. elegans
aaaataaagtgca

SEQ ID NO: 684417 - DNA, 13 bp, C. elegans
aaaataaagtttg

SEQ ID NO: 684418 - DNA, 13 bp, C. elegans
aaaataaatctct

SEQ ID NO: 684419 - DNA, 13 bp, C. elegans
aaaataaatgcac

SEQ ID NO: 684420 - DNA, 13 bp, C. elegans
aaaataaatgctt

SEQ ID NO: 684421 - DNA, 13 bp, C. elegans
aaaataaattcga

SEQ ID NO: 684422 - DNA, 13 bp, C. elegans
aaaataaattgca

SEQ ID NO: 684423 - DNA, 13 bp, C. elegans
aaaataaatttcc

SEQ ID NO: 684424 - DNA, 13 bp, C. elegans
aaaataacacgat

SEQ ID NO: 684425 - DNA, 13 bp, C. elegans
aaaataacagttt

SEQ ID NO: 684426 - DNA, 13 bp, C. elegans
aaaataacgattt

SEQ ID NO: 684427 - DNA, 13 bp, C. elegans
aaaataacgtttt

SEQ ID NO: 684428 - DNA, 13 bp, C. elegans
aaaataactgtta

SEQ ID NO: 684429 - DNA, 13 bp, C. elegans
aaaataagaactt

SEQ ID NO: 684430 - DNA, 13 bp, C. elegans
aaaataagacatt

SEQ ID NO: 684431 - DNA, 13 bp, C. elegans
aaaataaggattt

SEQ ID NO: 684432 - DNA, 13 bp, C. elegans
aaaataaggtttt

SEQ ID NO: 684433 - DNA, 13 bp, C. elegans
aaaataagtgtat

SEQ ID NO: 684434 - DNA, 13 bp, C. elegans
aaaataattcaga

SEQ ID NO: 684435 - DNA, 13 bp, C. elegans
aaaataattcagt

SEQ ID NO: 684436 - DNA, 13 bp, C. elegans
aaaataattctga

SEQ ID NO: 684437 - DNA, 13 bp, C. elegans
aaaataattgaac

SEQ ID NO: 684438 - DNA, 13 bp, C. elegans
aaaataattgaca

SEQ ID NO: 684439 - DNA, 13 bp, C. elegans
aaaataattgtac

SEQ ID NO: 684440 - DNA, 13 bp, C. elegans
aaaataatttcca

SEQ ID NO: 684441 - DNA, 13 bp, C. elegans
aaaataatttggt

SEQ ID NO: 684442 - DNA, 13 bp, C. elegans
aaaatacaaatgt

SEQ ID NO: 684443 - DNA, 13 bp, C. elegans
aaaatacaaattg

SEQ ID NO: 684444 - DNA, 13 bp, C. elegans
aaaatacaagttg

SEQ ID NO: 684445 - DNA, 13 bp, C. elegans
aaaatacacattt

SEQ ID NO: 684446 - DNA, 13 bp, C. elegans
aaaatacactgaa

SEQ ID NO: 684447 - DNA, 13 bp, C. elegans
aaaatacagtttc

SEQ ID NO: 684448 - DNA, 13 bp, C. elegans
aaaatacattact

SEQ ID NO: 684449 - DNA, 13 bp, C. elegans
aaaatacatttca

SEQ ID NO: 684450 - DNA, 13 bp, C. elegans
aaaatacatttga

SEQ ID NO: 684451 - DNA, 13 bp, C. elegans
aaaataccatttt

SEQ ID NO: 684452 - DNA, 13 bp, C. elegans
aaaatacccagaa

SEQ ID NO: 684453 - DNA, 13 bp, C. elegans
aaaatacctgcct

SEQ ID NO: 684454 - DNA, 13 bp, C. elegans
aaaatacggaatt

SEQ ID NO: 684455 - DNA, 13 bp, C. elegans
aaaatacgggaaa

SEQ ID NO: 684456 - DNA, 13 bp, C. elegans
aaaatacggtttc

SEQ ID NO: 684457 - DNA, 13 bp, C. elegans
aaaatacgtgaaa

SEQ ID NO: 684458 - DNA, 13 bp, C. elegans
aaaatacgtgcaa

SEQ ID NO: 684459 - DNA, 13 bp, C. elegans
aaaatactacttt

SEQ ID NO: 684460 - DNA, 13 bp, C. elegans
aaaatactaggaa

SEQ ID NO: 684461 - DNA, 13 bp, C. elegans
aaaatactattca

SEQ ID NO: 684462 - DNA, 13 bp, C. elegans
aaaatactcagaa

SEQ ID NO: 684463 - DNA, 13 bp, C. elegans
aaaatactgcaaa

SEQ ID NO: 684464 - DNA, 13 bp, C. elegans
aaaatactgtaaa

SEQ ID NO: 684465 - DNA, 13 bp, C. elegans
aaaatactgtgaa

SEQ ID NO: 684466 - DNA, 13 bp, C. elegans
aaaatactgtttt

SEQ ID NO: 684467 - DNA, 13 bp, C. elegans
aaaatacttcatt

SEQ ID NO: 684468 - DNA, 13 bp, C. elegans
aaaatacttccaa

SEQ ID NO: 684469 - DNA, 13 bp, C. elegans
aaaatacttccgt

SEQ ID NO: 684470 - DNA, 13 bp, C. elegans
aaaatacttgaaa

SEQ ID NO: 684471 - DNA, 13 bp, C. elegans
aaaatactttctt

SEQ ID NO: 684472 - DNA, 13 bp, C. elegans
aaaatactttgca

SEQ ID NO: 684473 - DNA, 13 bp, C. elegans
aaaatactttgtt

SEQ ID NO: 684474 - DNA, 13 bp, C. elegans
aaaatacttttca

SEQ ID NO: 684475 - DNA, 13 bp, C. elegans
aaaatagaattgt

SEQ ID NO: 684476 - DNA, 13 bp, C. elegans
aaaatagagtttt

SEQ ID NO: 684477 - DNA, 13 bp, C. elegans
aaaatagatcgaa

SEQ ID NO: 684478 - DNA, 13 bp, C. elegans
aaaatagattgct

SEQ ID NO: 684479 - DNA, 13 bp, C. elegans
aaaatagattgtc

SEQ ID NO: 684480 - DNA, 13 bp, C. elegans
aaaatagatttca

SEQ ID NO: 684481 - DNA, 13 bp, C. elegans
aaaatagattttc

SEQ ID NO: 684482 - DNA, 13 bp, C. elegans
aaaatagcctaaa

SEQ ID NO: 684483 - DNA, 13 bp, C. elegans
aaaatagctgaaa

SEQ ID NO: 684484 - DNA, 13 bp, C. elegans
aaaatagcttgaa

SEQ ID NO: 684485 - DNA, 13 bp, C. elegans
aaaatagctttca

SEQ ID NO: 684486 - DNA, 13 bp, C. elegans
aaaataggatttt

SEQ ID NO: 684487 - DNA, 13 bp, C. elegans
aaaataggcaaat

SEQ ID NO: 684488 - DNA, 13 bp, C. elegans
aaaataggcgtgg

SEQ ID NO: 684489 - DNA, 13 bp, C. elegans
aaaatagggattt

SEQ ID NO: 684490 - DNA, 13 bp, C. elegans
aaaatagtatttc

SEQ ID NO: 684491 - DNA, 13 bp, C. elegans
aaaatagtcagaa

SEQ ID NO: 684492 - DNA, 13 bp, C. elegans
aaaatagtcattt

SEQ ID NO: 684493 - DNA, 13 bp, C. elegans
aaaatagtccaaa

SEQ ID NO: 684494 - DNA, 13 bp, C. elegans
aaaatagtctaaa

SEQ ID NO: 684495 - DNA, 13 bp, C. elegans
aaaatagtgaaca

SEQ ID NO: 684496 - DNA, 13 bp, C. elegans
aaaatagttgttc

SEQ ID NO: 684497 - DNA, 13 bp, C. elegans
aaaatagtttcaa

SEQ ID NO: 684498 - DNA, 13 bp, C. elegans
aaaatagtttcat

SEQ ID NO: 684499 - DNA, 13 bp, C. elegans
aaaatagtttcga

SEQ ID NO: 684500 - DNA, 13 bp, C. elegans
aaaatagtttgaa

SEQ ID NO: 684501 - DNA, 13 bp, C. elegans
aaaatagttttga

SEQ ID NO: 684502 - DNA, 13 bp, C. elegans
aaaatagttttgt

SEQ ID NO: 684503 - DNA, 13 bp, C. elegans
aaaatagtttttg

SEQ ID NO: 684504 - DNA, 13 bp, C. elegans
aaaatatagtttc

SEQ ID NO: 684505 - DNA, 13 bp, C. elegans
aaaatatatcagt

SEQ ID NO: 684506 - DNA, 13 bp, C. elegans
aaaatatattcca

SEQ ID NO: 684507 - DNA, 13 bp, C. elegans
aaaatatcacatt

SEQ ID NO: 684508 - DNA, 13 bp, C. elegans
aaaatatcatagt

SEQ ID NO: 684509 - DNA, 13 bp, C. elegans
aaaatatcatcat

SEQ ID NO: 684510 - DNA, 13 bp, C. elegans
aaaatatcatctt

SEQ ID NO: 684511 - DNA, 13 bp, C. elegans
aaaatatccgaaa

SEQ ID NO: 684512 - DNA, 13 bp, C. elegans
aaaatatcgaaac

SEQ ID NO: 684513 - DNA, 13 bp, C. elegans
aaaatatcgaaat

SEQ ID NO: 684514 - DNA, 13 bp, C. elegans
aaaatatcgaata

SEQ ID NO: 684515 - DNA, 13 bp, C. elegans
aaaatatcgaatt

SEQ ID NO: 684516 - DNA, 13 bp, C. elegans
aaaatatcgattt

SEQ ID NO: 684517 - DNA, 13 bp, C. elegans
aaaatatcggaaa

SEQ ID NO: 684518 - DNA, 13 bp, C. elegans
aaaatatctaaag

SEQ ID NO: 684519 - DNA, 13 bp, C. elegans
aaaatatctagat

SEQ ID NO: 684520 - DNA, 13 bp, C. elegans
aaaatatctcgta

SEQ ID NO: 684521 - DNA, 13 bp, C. elegans
aaaatatctgaaa

SEQ ID NO: 684522 - DNA, 13 bp, C. elegans
aaaatatctgcaa

SEQ ID NO: 684523 - DNA, 13 bp, C. elegans
aaaatatctggaa

SEQ ID NO: 684524 - DNA, 13 bp, C. elegans
aaaatatgaacac

SEQ ID NO: 684525 - DNA, 14 bp, C. elegans
aaaatatgactcta

SEQ ID NO: 684526 - DNA, 13 bp, C. elegans
aaaatatgacttt

SEQ ID NO: 684527 - DNA, 13 bp, C. elegans
aaaatatgaggga

SEQ ID NO: 684528 - DNA, 13 bp, C. elegans
aaaatatgatcaa

SEQ ID NO: 684529 - DNA, 13 bp, C. elegans
aaaatatgatgca

SEQ ID NO: 684530 - DNA, 13 bp, C. elegans
aaaatatgatttc

SEQ ID NO: 684531 - DNA, 13 bp, C. elegans
aaaatatgctcca

SEQ ID NO: 684532 - DNA, 13 bp, C. elegans
aaaatatgctgaa

SEQ ID NO: 684533 - DNA, 13 bp, C. elegans
aaaatatggaaca

SEQ ID NO: 684534 - DNA, 13 bp, C. elegans
aaaatatggtact

SEQ ID NO: 684535 - DNA, 13 bp, C. elegans
aaaatatggtcaa

SEQ ID NO: 684536 - DNA, 13 bp, C. elegans
aaaatatggtgaa

SEQ ID NO: 684537 - DNA, 13 bp, C. elegans
aaaatatggtttt

SEQ ID NO: 684538 - DNA, 13 bp, C. elegans
aaaatatgtacat

SEQ ID NO: 684539 - DNA, 13 bp, C. elegans
aaaatatgtagat

SEQ ID NO: 684540 - DNA, 13 bp, C. elegans
aaaatatgtcaaa

SEQ ID NO: 684541 - DNA, 13 bp, C. elegans
aaaatatgtcatt

SEQ ID NO: 684542 - DNA, 13 bp, C. elegans
aaaatatgtgatt

SEQ ID NO: 684543 - DNA, 13 bp, C. elegans
aaaatatgtgtca

SEQ ID NO: 684544 - DNA, 13 bp, C. elegans
aaaatatgttcaa

SEQ ID NO: 684545 - DNA, 13 bp, C. elegans
aaaatatgttgaa

SEQ ID NO: 684546 - DNA, 13 bp, C. elegans
aaaatatgtttcc

SEQ ID NO: 684547 - DNA, 13 bp, C. elegans
aaaatattactgt

SEQ ID NO: 684548 - DNA, 13 bp, C. elegans
aaaatattaggct

SEQ ID NO: 684549 - DNA, 13 bp, C. elegans
aaaatattcaaag

SEQ ID NO: 684550 - DNA, 13 bp, C. elegans
aaaatattcagat

SEQ ID NO: 684551 - DNA, 13 bp, C. elegans
aaaatattcatca

SEQ ID NO: 684552 - DNA, 13 bp, C. elegans
aaaatattcccat

SEQ ID NO: 684553 - DNA, 13 bp, C. elegans
aaaatattcgaaa

SEQ ID NO: 684554 - DNA, 13 bp, C. elegans
aaaatattcgaat

SEQ ID NO: 684555 - DNA, 14 bp, C. elegans
aaaatattcgtttt

SEQ ID NO: 684556 - DNA, 13 bp, C. elegans
aaaatattctaca

SEQ ID NO: 684557 - DNA, 13 bp, C. elegans
aaaatattgatga

SEQ ID NO: 684558 - DNA, 13 bp, C. elegans
aaaatattgattc

SEQ ID NO: 684559 - DNA, 13 bp, C. elegans
aaaatattgcaaa

SEQ ID NO: 684560 - DNA, 13 bp, C. elegans
aaaatattgcaag

SEQ ID NO: 684561 - DNA, 13 bp, C. elegans
aaaatattgcaca

SEQ ID NO: 684562 - DNA, 13 bp, C. elegans
aaaatattgccaa

SEQ ID NO: 684563 - DNA, 13 bp, C. elegans
aaaatattgctaa

SEQ ID NO: 684564 - DNA, 13 bp, C. elegans
aaaatattggcaa

SEQ ID NO: 684565 - DNA, 13 bp, C. elegans
aaaatattgtcaa

SEQ ID NO: 684566 - DNA, 13 bp, C. elegans
aaaatattgtgat

SEQ ID NO: 684567 - DNA, 13 bp, C. elegans
aaaatattgttgg

SEQ ID NO: 684568 - DNA, 13 bp, C. elegans
aaaatatttcaga

SEQ ID NO: 684569 - DNA, 13 bp, C. elegans
aaaatatttccaa

SEQ ID NO: 684570 - DNA, 13 bp, C. elegans
aaaatatttcgat

SEQ ID NO: 684571 - DNA, 13 bp, C. elegans
aaaatatttcgtt

SEQ ID NO: 684572 - DNA, 13 bp, C. elegans
aaaatatttctag

SEQ ID NO: 684573 - DNA, 13 bp, C. elegans
aaaatatttctcc

SEQ ID NO: 684574 - DNA, 13 bp, C. elegans
aaaatatttggca

SEQ ID NO: 684575 - DNA, 13 bp, C. elegans
aaaatatttggtg

SEQ ID NO: 684576 - DNA, 13 bp, C. elegans
aaaatattttcag

SEQ ID NO: 684577 - DNA, 13 bp, C. elegans
aaaatattttcca

SEQ ID NO: 684578 - DNA, 13 bp, C. elegans
aaaatattttgct

SEQ ID NO: 684579 - DNA, 13 bp, C. elegans
aaaatcaaaagtg

SEQ ID NO: 684580 - DNA, 13 bp, C. elegans
aaaatcaaaatgt

SEQ ID NO: 684581 - DNA, 13 bp, C. elegans
aaaatcaaacgtt

SEQ ID NO: 684582 - DNA, 13 bp, C. elegans
aaaatcaaacttc

SEQ ID NO: 684583 - DNA, 13 bp, C. elegans
aaaatcaaagctt

SEQ ID NO: 684584 - DNA, 13 bp, C. elegans
aaaatcaaagttt

SEQ ID NO: 684585 - DNA, 13 bp, C. elegans
aaaatcaaatgag

SEQ ID NO: 684586 - DNA, 13 bp, C. elegans
aaaatcaaattct

SEQ ID NO: 684587 - DNA, 13 bp, C. elegans
aaaatcaaatttc

SEQ ID NO: 684588 - DNA, 13 bp, C. elegans
aaaatcaacagat

SEQ ID NO: 684589 - DNA, 13 bp, C. elegans
aaaatcaacagtt

SEQ ID NO: 684590 - DNA, 13 bp, C. elegans
aaaatcaacattt

SEQ ID NO: 684591 - DNA, 13 bp, C. elegans
aaaatcaacggaa

SEQ ID NO: 684592 - DNA, 13 bp, C. elegans
aaaatcaactgaa

SEQ ID NO: 684593 - DNA, 13 bp, C. elegans
aaaatcaacttct

SEQ ID NO: 684594 - DNA, 13 bp, C. elegans
aaaatcaacttga

SEQ ID NO: 684595 - DNA, 13 bp, C. elegans
aaaatcaactttc

SEQ ID NO: 684596 - DNA, 13 bp, C. elegans
aaaatcaactttt

SEQ ID NO: 684597 - DNA, 13 bp, C. elegans
aaaatcaagaact

SEQ ID NO: 684598 - DNA, 13 bp, C. elegans
aaaatcaagatta

SEQ ID NO: 684599 - DNA, 13 bp, C. elegans
aaaatcaagattt

SEQ ID NO: 684600 - DNA, 13 bp, C. elegans
aaaatcaaggatt

SEQ ID NO: 684601 - DNA, 13 bp, C. elegans
aaaatcaagtttt

SEQ ID NO: 684602 - DNA, 13 bp, C. elegans
aaaatcaatactt

SEQ ID NO: 684603 - DNA, 13 bp, C. elegans
aaaatcaatagtt

SEQ ID NO: 684604 - DNA, 13 bp, C. elegans
aaaatcaatatga

SEQ ID NO: 684605 - DNA, 13 bp, C. elegans
aaaatcaatattc

SEQ ID NO: 684606 - DNA, 13 bp, C. elegans
aaaatcaatcatt

SEQ ID NO: 684607 - DNA, 13 bp, C. elegans
aaaatcaatctga

SEQ ID NO: 684608 - DNA, 13 bp, C. elegans
aaaatcaatgaat

SEQ ID NO: 684609 - DNA, 13 bp, C. elegans
aaaatcaatgtaa

SEQ ID NO: 684610 - DNA, 13 bp, C. elegans
aaaatcaatgttg

SEQ ID NO: 684611 - DNA, 13 bp, C. elegans
aaaatcaatgttt

SEQ ID NO: 684612 - DNA, 13 bp, C. elegans
aaaatcaattcca

SEQ ID NO: 684613 - DNA, 13 bp, C. elegans
aaaatcaatttca

SEQ ID NO: 684614 - DNA, 13 bp, C. elegans
aaaatcaatttct

SEQ ID NO: 684615 - DNA, 13 bp, C. elegans
aaaatcaatttga

SEQ ID NO: 684616 - DNA, 13 bp, C. elegans
aaaatcaatttgc

SEQ ID NO: 684617 - DNA, 13 bp, C. elegans
aaaatcaattttg

SEQ ID NO: 684618 - DNA, 13 bp, C. elegans
aaaatcacaaagt

SEQ ID NO: 684619 - DNA, 13 bp, C. elegans
aaaatcacaagtt

SEQ ID NO: 684620 - DNA, 13 bp, C. elegans
aaaatcacaatga

SEQ ID NO: 684621 - DNA, 13 bp, C. elegans
aaaatcacaattt

SEQ ID NO: 684622 - DNA, 13 bp, C. elegans
aaaatcacagaat

SEQ ID NO: 684623 - DNA, 13 bp, C. elegans
aaaatcacagctt

SEQ ID NO: 684624 - DNA, 13 bp, C. elegans
aaaatcacatgat

SEQ ID NO: 684625 - DNA, 13 bp, C. elegans
aaaatcacatttt

SEQ ID NO: 684626 - DNA, 13 bp, C. elegans
aaaatcaccaatt

SEQ ID NO: 684627 - DNA, 13 bp, C. elegans
aaaatcacgaaat

SEQ ID NO: 684628 - DNA, 13 bp, C. elegans
aaaatcacgacaa

SEQ ID NO: 684629 - DNA, 13 bp, C. elegans
aaaatcactattt

SEQ ID NO: 684630 - DNA, 13 bp, C. elegans
aaaatcactgaaa

SEQ ID NO: 684631 - DNA, 13 bp, C. elegans
aaaatcactgaat

SEQ ID NO: 684632 - DNA, 13 bp, C. elegans
aaaatcactggaa

SEQ ID NO: 684633 - DNA, 13 bp, C. elegans
aaaatcactgttt

SEQ ID NO: 684634 - DNA, 13 bp, C. elegans
aaaatcacttgtt

SEQ ID NO: 684635 - DNA, 13 bp, C. elegans
aaaatcagaaact

SEQ ID NO: 684636 - DNA, 13 bp, C. elegans
aaaatcagaaatt

SEQ ID NO: 684637 - DNA, 13 bp, C. elegans
aaaatcagaatct

SEQ ID NO: 684638 - DNA, 13 bp, C. elegans
aaaatcagaatgt

SEQ ID NO: 684639 - DNA, 13 bp, C. elegans
aaaatcagaattt

SEQ ID NO: 684640 - DNA, 13 bp, C. elegans
aaaatcagacatt

SEQ ID NO: 684641 - DNA, 13 bp, C. elegans
aaaatcagaggaa

SEQ ID NO: 684642 - DNA, 13 bp, C. elegans
aaaatcagatatt

SEQ ID NO: 684643 - DNA, 13 bp, C. elegans
aaaatcagatttt

SEQ ID NO: 684644 - DNA, 13 bp, C. elegans
aaaatcagcaaat

SEQ ID NO: 684645 - DNA, 13 bp, C. elegans
aaaatcagccaaa

SEQ ID NO: 684646 - DNA, 13 bp, C. elegans
aaaatcagcgaaa

SEQ ID NO: 684647 - DNA, 13 bp, C. elegans
aaaatcaggaatt

SEQ ID NO: 684648 - DNA, 13 bp, C. elegans
aaaatcaggattt

SEQ ID NO: 684649 - DNA, 13 bp, C. elegans
aaaatcagggaaa

SEQ ID NO: 684650 - DNA, 13 bp, C. elegans
aaaatcagtattt

SEQ ID NO: 684651 - DNA, 13 bp, C. elegans
aaaatcagtcaaa

SEQ ID NO: 684652 - DNA, 13 bp, C. elegans
aaaatcagtcaat

SEQ ID NO: 684653 - DNA, 13 bp, C. elegans
aaaatcagtctct

SEQ ID NO: 684654 - DNA, 13 bp, C. elegans
aaaatcagtgaaa

SEQ ID NO: 684655 - DNA, 13 bp, C. elegans
aaaatcagttcca

SEQ ID NO: 684656 - DNA, 13 bp, C. elegans
aaaatcagttgat

SEQ ID NO: 684657 - DNA, 13 bp, C. elegans
aaaatcagtttca

SEQ ID NO: 684658 - DNA, 13 bp, C. elegans
aaaatcagttttc

SEQ ID NO: 684659 - DNA, 13 bp, C. elegans
aaaatcagttttt

SEQ ID NO: 684660 - DNA, 13 bp, C. elegans
aaaatcatatgaa

SEQ ID NO: 684661 - DNA, 13 bp, C. elegans
aaaatcatcaact

SEQ ID NO: 684662 - DNA, 13 bp, C. elegans
aaaatcatcaatt

SEQ ID NO: 684663 - DNA, 13 bp, C. elegans
aaaatcatcactt

SEQ ID NO: 684664 - DNA, 13 bp, C. elegans
aaaatcatcagaa

SEQ ID NO: 684665 - DNA, 13 bp, C. elegans
aaaatcatccgaa

SEQ ID NO: 684666 - DNA, 13 bp, C. elegans
aaaatcatcgaaa

SEQ ID NO: 684667 - DNA, 13 bp, C. elegans
aaaatcatctaat

SEQ ID NO: 684668 - DNA, 13 bp, C. elegans
aaaatcatctgaa

SEQ ID NO: 684669 - DNA, 13 bp, C. elegans
aaaatcatgaata

SEQ ID NO: 684670 - DNA, 13 bp, C. elegans
aaaatcatgataa

SEQ ID NO: 684671 - DNA, 13 bp, C. elegans
aaaatcatggaaa

SEQ ID NO: 684672 - DNA, 13 bp, C. elegans
aaaatcatggttt

SEQ ID NO: 684673 - DNA, 13 bp, C. elegans
aaaatcatgtgaa

SEQ ID NO: 684674 - DNA, 13 bp, C. elegans
aaaatcatgtttt

SEQ ID NO: 684675 - DNA, 13 bp, C. elegans
aaaatcattcaat

SEQ ID NO: 684676 - DNA, 13 bp, C. elegans
aaaatcattcatt

SEQ ID NO: 684677 - DNA, 13 bp, C. elegans
aaaatcattccaa

SEQ ID NO: 684678 - DNA, 13 bp, C. elegans
aaaatcattcgaa

SEQ ID NO: 684679 - DNA, 13 bp, C. elegans
aaaatcattgaaa

SEQ ID NO: 684680 - DNA, 13 bp, C. elegans
aaaatcattgaat

SEQ ID NO: 684681 - DNA, 13 bp, C. elegans
aaaatcattgata

SEQ ID NO: 684682 - DNA, 13 bp, C. elegans
aaaatcattggaa

SEQ ID NO: 684683 - DNA, 13 bp, C. elegans
aaaatcattgtga

SEQ ID NO: 684684 - DNA, 13 bp, C. elegans
aaaatcatttcaa

SEQ ID NO: 684685 - DNA, 13 bp, C. elegans
aaaatcatttcct

SEQ ID NO: 684686 - DNA, 13 bp, C. elegans
aaaatcatttgat

SEQ ID NO: 684687 - DNA, 13 bp, C. elegans
aaaatcatttgca

SEQ ID NO: 684688 - DNA, 13 bp, C. elegans
aaaatcattttgt

SEQ ID NO: 684689 - DNA, 13 bp, C. elegans
aaaatcatttttc

SEQ ID NO: 684690 - DNA, 13 bp, C. elegans
aaaatcatttttg

SEQ ID NO: 684691 - DNA, 13 bp, C. elegans
aaaatccaaattt

SEQ ID NO: 684692 - DNA, 13 bp, C. elegans
aaaatccaacttt

SEQ ID NO: 684693 - DNA, 13 bp, C. elegans
aaaatccaagaat

SEQ ID NO: 684694 - DNA, 13 bp, C. elegans
aaaatccaagttt

SEQ ID NO: 684695 - DNA, 13 bp, C. elegans
aaaatccaattct

SEQ ID NO: 684696 - DNA, 13 bp, C. elegans
aaaatccaatttc

SEQ ID NO: 684697 - DNA, 13 bp, C. elegans
aaaatccaatttt

SEQ ID NO: 684698 - DNA, 13 bp, C. elegans
aaaatccacattt

SEQ ID NO: 684699 - DNA, 13 bp, C. elegans
aaaatccaccaat

SEQ ID NO: 684700 - DNA, 13 bp, C. elegans
aaaatccacgtag

SEQ ID NO: 684701 - DNA, 13 bp, C. elegans
aaaatccacgtgg

SEQ ID NO: 684702 - DNA, 13 bp, C. elegans
aaaatccactgtt

SEQ ID NO: 684703 - DNA, 13 bp, C. elegans
aaaatccactttt

SEQ ID NO: 684704 - DNA, 13 bp, C. elegans
aaaatccagaaat

SEQ ID NO: 684705 - DNA, 13 bp, C. elegans
aaaatccagattt

SEQ ID NO: 684706 - DNA, 13 bp, C. elegans
aaaatccagcagc

SEQ ID NO: 684707 - DNA, 13 bp, C. elegans
aaaatccagtaaa

SEQ ID NO: 684708 - DNA, 13 bp, C. elegans
aaaatccagtttt

SEQ ID NO: 684709 - DNA, 13 bp, C. elegans
aaaatccatattt

SEQ ID NO: 684710 - DNA, 13 bp, C. elegans
aaaatccatgaaa

SEQ ID NO: 684711 - DNA, 13 bp, C. elegans
aaaatccatggaa

SEQ ID NO: 684712 - DNA, 13 bp, C. elegans
aaaatccatgttt

SEQ ID NO: 684713 - DNA, 13 bp, C. elegans
aaaatccattatt

SEQ ID NO: 684714 - DNA, 13 bp, C. elegans
aaaatccatttaa

SEQ ID NO: 684715 - DNA, 13 bp, C. elegans
aaaatccatttct

SEQ ID NO: 684716 - DNA, 13 bp, C. elegans
aaaatccattttg

SEQ ID NO: 684717 - DNA, 13 bp, C. elegans
aaaatccattttt

SEQ ID NO: 684718 - DNA, 13 bp, C. elegans
aaaatcccaattt

SEQ ID NO: 684719 - DNA, 13 bp, C. elegans
aaaatcccactgc

SEQ ID NO: 684720 - DNA, 13 bp, C. elegans
aaaatcccagaaa

SEQ ID NO: 684721 - DNA, 13 bp, C. elegans
aaaatcccagttt

SEQ ID NO: 684722 - DNA, 13 bp, C. elegans
aaaatcccatttc

SEQ ID NO: 684723 - DNA, 13 bp, C. elegans
aaaatcccgaaaa

SEQ ID NO: 684724 - DNA, 13 bp, C. elegans
aaaatcccgaaat

SEQ ID NO: 684725 - DNA, 14 bp, C. elegans
aaaatcccgatttt

SEQ ID NO: 684726 - DNA, 13 bp, C. elegans
aaaatcccgcaaa

SEQ ID NO: 684727 - DNA, 13 bp, C. elegans
aaaatcccggaaa

SEQ ID NO: 684728 - DNA, 13 bp, C. elegans
aaaatccgaaaat

SEQ ID NO: 684729 - DNA, 13 bp, C. elegans
aaaatccgaaagt

SEQ ID NO: 684730 - DNA, 13 bp, C. elegans
aaaatccgaaata

SEQ ID NO: 684731 - DNA, 13 bp, C. elegans
aaaatccgaaatt

SEQ ID NO: 684732 - DNA, 13 bp, C. elegans
aaaatccgacaaa

SEQ ID NO: 684733 - DNA, 13 bp, C. elegans
aaaatccgagaaa

SEQ ID NO: 684734 - DNA, 13 bp, C. elegans
aaaatccgagttt

SEQ ID NO: 684735 - DNA, 13 bp, C. elegans
aaaatccgataaa

SEQ ID NO: 684736 - DNA, 13 bp, C. elegans
aaaatccgccaaa

SEQ ID NO: 684737 - DNA, 13 bp, C. elegans
aaaatccgctttt

SEQ ID NO: 684738 - DNA, 13 bp, C. elegans
aaaatccggattt

SEQ ID NO: 684739 - DNA, 13 bp, C. elegans
aaaatccgtcaaa

SEQ ID NO: 684740 - DNA, 13 bp, C. elegans
aaaatccgtgttt

SEQ ID NO: 684741 - DNA, 13 bp, C. elegans
aaaatccgttttt

SEQ ID NO: 684742 - DNA, 13 bp, C. elegans
aaaatcctacttt

SEQ ID NO: 684743 - DNA, 13 bp, C. elegans
aaaatcctagaaa

SEQ ID NO: 684744 - DNA, 13 bp, C. elegans
aaaatcctatttt

SEQ ID NO: 684745 - DNA, 13 bp, C. elegans
aaaatcctcaaat

SEQ ID NO: 684746 - DNA, 13 bp, C. elegans
aaaatcctctaaa

SEQ ID NO: 684747 - DNA, 13 bp, C. elegans
aaaatcctgcaaa

SEQ ID NO: 684748 - DNA, 13 bp, C. elegans
aaaatcctggaaa

SEQ ID NO: 684749 - DNA, 13 bp, C. elegans
aaaatcctggaag

SEQ ID NO: 684750 - DNA, 13 bp, C. elegans
aaaatccttattt

SEQ ID NO: 684751 - DNA, 13 bp, C. elegans
aaaatccttttta

SEQ ID NO: 684752 - DNA, 13 bp, C. elegans
aaaatcgaaaacg

SEQ ID NO: 684753 - DNA, 13 bp, C. elegans
aaaatcgaaaagt

SEQ ID NO: 684754 - DNA, 13 bp, C. elegans
aaaatcgaaaatt

SEQ ID NO: 684755 - DNA, 13 bp, C. elegans
aaaatcgaaagtt

SEQ ID NO: 684756 - DNA, 13 bp, C. elegans
aaaatcgaaattt

SEQ ID NO: 684757 - DNA, 13 bp, C. elegans
aaaatcgaacaac

SEQ ID NO: 684758 - DNA, 13 bp, C. elegans
aaaatcgaacaat

SEQ ID NO: 684759 - DNA, 13 bp, C. elegans
aaaatcgaagaat

SEQ ID NO: 684760 - DNA, 13 bp, C. elegans
aaaatcgaagatt

SEQ ID NO: 684761 - DNA, 13 bp, C. elegans
aaaatcgaagttt

SEQ ID NO: 684762 - DNA, 13 bp, C. elegans
aaaatcgaatatt

SEQ ID NO: 684763 - DNA, 13 bp, C. elegans
aaaatcgaatttt

SEQ ID NO: 684764 - DNA, 13 bp, C. elegans
aaaatcgacaatt

SEQ ID NO: 684765 - DNA, 13 bp, C. elegans
aaaatcgacattt

SEQ ID NO: 684766 - DNA, 13 bp, C. elegans
aaaatcgaccatt

SEQ ID NO: 684767 - DNA, 13 bp, C. elegans
aaaatcgacgaaa

SEQ ID NO: 684768 - DNA, 13 bp, C. elegans
aaaatcgacggaa

SEQ ID NO: 684769 - DNA, 13 bp, C. elegans
aaaatcgacttta

SEQ ID NO: 684770 - DNA, 13 bp, C. elegans
aaaatcgactttt

SEQ ID NO: 684771 - DNA, 13 bp, C. elegans
aaaatcgagagaa

SEQ ID NO: 684772 - DNA, 13 bp, C. elegans
aaaatcgaggaaa

SEQ ID NO: 684773 - DNA, 13 bp, C. elegans
aaaatcgagtgaa

SEQ ID NO: 684774 - DNA, 13 bp, C. elegans
aaaatcgagtttt

SEQ ID NO: 684775 - DNA, 13 bp, C. elegans
aaaatcgataaat

SEQ ID NO: 684776 - DNA, 13 bp, C. elegans
aaaatcgataaca

SEQ ID NO: 684777 - DNA, 13 bp, C. elegans
aaaatcgataatc

SEQ ID NO: 684778 - DNA, 13 bp, C. elegans
aaaatcgataatg

SEQ ID NO: 684779 - DNA, 13 bp, C. elegans
aaaatcgataatt

SEQ ID NO: 684780 - DNA, 15 bp, C. elegans
aaaatcgataatttt

SEQ ID NO: 684781 - DNA, 13 bp, C. elegans
aaaatcgatacat

SEQ ID NO: 684782 - DNA, 13 bp, C. elegans
aaaatcgatagtt

SEQ ID NO: 684783 - DNA, 13 bp, C. elegans
aaaatcgatatca

SEQ ID NO: 684784 - DNA, 13 bp, C. elegans
aaaatcgatatgt

SEQ ID NO: 684785 - DNA, 13 bp, C. elegans
aaaatcgatattt

SEQ ID NO: 684786 - DNA, 13 bp, C. elegans
aaaatcgatgaaa

SEQ ID NO: 684787 - DNA, 13 bp, C. elegans
aaaatcgatgatt

SEQ ID NO: 684788 - DNA, 13 bp, C. elegans
aaaatcgatggaa

SEQ ID NO: 684789 - DNA, 13 bp, C. elegans
aaaatcgatggcc

SEQ ID NO: 684790 - DNA, 13 bp, C. elegans
aaaatcgattaaa

SEQ ID NO: 684791 - DNA, 13 bp, C. elegans
aaaatcgattcaa

SEQ ID NO: 684792 - DNA, 13 bp, C. elegans
aaaatcgattgaa

SEQ ID NO: 684793 - DNA, 13 bp, C. elegans
aaaatcgattgtt

SEQ ID NO: 684794 - DNA, 13 bp, C. elegans
aaaatcgatttca

SEQ ID NO: 684795 - DNA, 13 bp, C. elegans
aaaatcgatttct

SEQ ID NO: 684796 - DNA, 13 bp, C. elegans
aaaatcgatttgc

SEQ ID NO: 684797 - DNA, 13 bp, C. elegans
aaaatcgatttta

SEQ ID NO: 684798 - DNA, 13 bp, C. elegans
aaaatcgattttc

SEQ ID NO: 684799 - DNA, 13 bp, C. elegans
aaaatcgattttt

SEQ ID NO: 684800 - DNA, 14 bp, C. elegans
aaaatcgatttttg

SEQ ID NO: 684801 - DNA, 13 bp, C. elegans
aaaatcgcaaaat

SEQ ID NO: 684802 - DNA, 13 bp, C. elegans
aaaatcgcaagaa

SEQ ID NO: 684803 - DNA, 13 bp, C. elegans
aaaatcgcaatat

SEQ ID NO: 684804 - DNA, 13 bp, C. elegans
aaaatcgcaattt

SEQ ID NO: 684805 - DNA, 13 bp, C. elegans
aaaatcgcagaaa

SEQ ID NO: 684806 - DNA, 13 bp, C. elegans
aaaatcgcataat

SEQ ID NO: 684807 - DNA, 13 bp, C. elegans
aaaatcgcatttt

SEQ ID NO: 684808 - DNA, 13 bp, C. elegans
aaaatcgccaaaa

SEQ ID NO: 684809 - DNA, 13 bp, C. elegans
aaaatcgcccaaa

SEQ ID NO: 684810 - DNA, 13 bp, C. elegans
aaaatcgccgaaa

SEQ ID NO: 684811 - DNA, 13 bp, C. elegans
aaaatcgccgttt

SEQ ID NO: 684812 - DNA, 13 bp, C. elegans
aaaatcgcgaatt

SEQ ID NO: 684813 - DNA, 13 bp, C. elegans
aaaatcgcgagaa

SEQ ID NO: 684814 - DNA, 13 bp, C. elegans
aaaatcgcgattt

SEQ ID NO: 684815 - DNA, 13 bp, C. elegans
aaaatcgctcaaa

SEQ ID NO: 684816 - DNA, 13 bp, C. elegans
aaaatcgctgaaa

SEQ ID NO: 684817 - DNA, 13 bp, C. elegans
aaaatcgctgatt

SEQ ID NO: 684818 - DNA, 13 bp, C. elegans
aaaatcgctggaa

SEQ ID NO: 684819 - DNA, 13 bp, C. elegans
aaaatcggaaaat

SEQ ID NO: 684820 - DNA, 13 bp, C. elegans
aaaatcggaaaga

SEQ ID NO: 684821 - DNA, 13 bp, C. elegans
aaaatcggaacaa

SEQ ID NO: 684822 - DNA, 13 bp, C. elegans
aaaatcggaacat

SEQ ID NO: 684823 - DNA, 13 bp, C. elegans
aaaatcggaattt

SEQ ID NO: 684824 - DNA, 13 bp, C. elegans
aaaatcggataaa

SEQ ID NO: 684825 - DNA, 13 bp, C. elegans
aaaatcggattct

SEQ ID NO: 684826 - DNA, 13 bp, C. elegans
aaaatcggattta

SEQ ID NO: 684827 - DNA, 13 bp, C. elegans
aaaatcggatttc

SEQ ID NO: 684828 - DNA, 13 bp, C. elegans
aaaatcggatttt

SEQ ID NO: 684829 - DNA, 13 bp, C. elegans
aaaatcggcaaat

SEQ ID NO: 684830 - DNA, 13 bp, C. elegans
aaaatcggcaact

SEQ ID NO: 684831 - DNA, 13 bp, C. elegans
aaaatcggcggaa

SEQ ID NO: 684832 - DNA, 13 bp, C. elegans
aaaatcggctgaa

SEQ ID NO: 684833 - DNA, 13 bp, C. elegans
aaaatcgggaaaa

SEQ ID NO: 684834 - DNA, 13 bp, C. elegans
aaaatcggtaaaa

SEQ ID NO: 684835 - DNA, 13 bp, C. elegans
aaaatcggtgaaa

SEQ ID NO: 684836 - DNA, 13 bp, C. elegans
aaaatcggtgatt

SEQ ID NO: 684837 - DNA, 13 bp, C. elegans
aaaatcggtggaa

SEQ ID NO: 684838 - DNA, 13 bp, C. elegans
aaaatcggttaaa

SEQ ID NO: 684839 - DNA, 13 bp, C. elegans
aaaatcggttatc

SEQ ID NO: 684840 - DNA, 13 bp, C. elegans
aaaatcggttcat

SEQ ID NO: 684841 - DNA, 13 bp, C. elegans
aaaatcgtaaaac

SEQ ID NO: 684842 - DNA, 13 bp, C. elegans
aaaatcgtagaaa

SEQ ID NO: 684843 - DNA, 13 bp, C. elegans
aaaatcgtagaag

SEQ ID NO: 684844 - DNA, 13 bp, C. elegans
aaaatcgtagaat

SEQ ID NO: 684845 - DNA, 13 bp, C. elegans
aaaatcgtatttt

SEQ ID NO: 684846 - DNA, 13 bp, C. elegans
aaaatcgtcaaaa

SEQ ID NO: 684847 - DNA, 13 bp, C. elegans
aaaatcgtcaatt

SEQ ID NO: 684848 - DNA, 13 bp, C. elegans
aaaatcgtctaaa

SEQ ID NO: 684849 - DNA, 13 bp, C. elegans
aaaatcgtgaaaa

SEQ ID NO: 684850 - DNA, 13 bp, C. elegans
aaaatcgtgcaaa

SEQ ID NO: 684851 - DNA, 13 bp, C. elegans
aaaatcgtggaaa

SEQ ID NO: 684852 - DNA, 13 bp, C. elegans
aaaatcgtggttt

SEQ ID NO: 684853 - DNA, 23 bp, C. elegans
aaaatcgtgttcagcgtactttt

SEQ ID NO: 684854 - DNA, 13 bp, C. elegans
aaaatcgtgtttt

SEQ ID NO: 684855 - DNA, 13 bp, C. elegans
aaaatcgttaaaa

SEQ ID NO: 684856 - DNA, 13 bp, C. elegans
aaaatcgttaatt

SEQ ID NO: 684857 - DNA, 13 bp, C. elegans
aaaatcgtttgaa

SEQ ID NO: 684858 - DNA, 13 bp, C. elegans
aaaatcgttttct

SEQ ID NO: 684859 - DNA, 13 bp, C. elegans
aaaatcgtttttc

SEQ ID NO: 684860 - DNA, 13 bp, C. elegans
aaaatcgtttttg

SEQ ID NO: 684861 - DNA, 13 bp, C. elegans
aaaatcgtttttt

SEQ ID NO: 684862 - DNA, 13 bp, C. elegans
aaaatctaaactt

SEQ ID NO: 684863 - DNA, 13 bp, C. elegans
aaaatctaaagca

SEQ ID NO: 684864 - DNA, 13 bp, C. elegans
aaaatctacactt

SEQ ID NO: 684865 - DNA, 13 bp, C. elegans
aaaatctacattt

SEQ ID NO: 684866 - DNA, 13 bp, C. elegans
aaaatctagaaca

SEQ ID NO: 684867 - DNA, 13 bp, C. elegans
aaaatctagaatc

SEQ ID NO: 684868 - DNA, 13 bp, C. elegans
aaaatctagaatt

SEQ ID NO: 684869 - DNA, 13 bp, C. elegans
aaaatctagatta

SEQ ID NO: 684870 - DNA, 13 bp, C. elegans
aaaatctaggaaa

SEQ ID NO: 684871 - DNA, 13 bp, C. elegans
aaaatctagtaaa

SEQ ID NO: 684872 - DNA, 13 bp, C. elegans
aaaatctataact

SEQ ID NO: 684873 - DNA, 13 bp, C. elegans
aaaatctatgaaa

SEQ ID NO: 684874 - DNA, 13 bp, C. elegans
aaaatctatgatt

SEQ ID NO: 684875 - DNA, 13 bp, C. elegans
aaaatctatggaa

SEQ ID NO: 684876 - DNA, 13 bp, C. elegans
aaaatctcaagaa

SEQ ID NO: 684877 - DNA, 14 bp, C. elegans
aaaatctcaatttt

SEQ ID NO: 684878 - DNA, 13 bp, C. elegans
aaaatctcagaaa

SEQ ID NO: 684879 - DNA, 13 bp, C. elegans
aaaatctcagttt

SEQ ID NO: 684880 - DNA, 13 bp, C. elegans
aaaatctcattta

SEQ ID NO: 684881 - DNA, 13 bp, C. elegans
aaaatctccaact

SEQ ID NO: 684882 - DNA, 13 bp, C. elegans
aaaatctccaatt

SEQ ID NO: 684883 - DNA, 13 bp, C. elegans
aaaatctcccaga

SEQ ID NO: 684884 - DNA, 13 bp, C. elegans
aaaatctccgaaa

SEQ ID NO: 684885 - DNA, 13 bp, C. elegans
aaaatctccgttt

SEQ ID NO: 684886 - DNA, 13 bp, C. elegans
aaaatctcgaaaa

SEQ ID NO: 684887 - DNA, 13 bp, C. elegans
aaaatctcgaatt

SEQ ID NO: 684888 - DNA, 13 bp, C. elegans
aaaatctcgagtt

SEQ ID NO: 684889 - DNA, 13 bp, C. elegans
aaaatctcgtgaa

SEQ ID NO: 684890 - DNA, 13 bp, C. elegans
aaaatctctattt

SEQ ID NO: 684891 - DNA, 13 bp, C. elegans
aaaatctctcgaa

SEQ ID NO: 684892 - DNA, 13 bp, C. elegans
aaaatctcttcat

SEQ ID NO: 684893 - DNA, 13 bp, C. elegans
aaaatctgaaaac

SEQ ID NO: 684894 - DNA, 13 bp, C. elegans
aaaatctgaaaat

SEQ ID NO: 684895 - DNA, 13 bp, C. elegans
aaaatctgaaact

SEQ ID NO: 684896 - DNA, 13 bp, C. elegans
aaaatctgaaagt

SEQ ID NO: 684897 - DNA, 13 bp, C. elegans
aaaatctgaaata

SEQ ID NO: 684898 - DNA, 13 bp, C. elegans
aaaatctgaaatc

SEQ ID NO: 684899 - DNA, 13 bp, C. elegans
aaaatctgaaatt

SEQ ID NO: 684900 - DNA, 13 bp, C. elegans
aaaatctgaatct

SEQ ID NO: 684901 - DNA, 13 bp, C. elegans
aaaatctgaatta

SEQ ID NO: 684902 - DNA, 13 bp, C. elegans
aaaatctgaattt

SEQ ID NO: 684903 - DNA, 13 bp, C. elegans
aaaatctgacaaa

SEQ ID NO: 684904 - DNA, 13 bp, C. elegans
aaaatctgacgat

SEQ ID NO: 684905 - DNA, 13 bp, C. elegans
aaaatctgagaaa

SEQ ID NO: 684906 - DNA, 13 bp, C. elegans
aaaatctgatttt

SEQ ID NO: 684907 - DNA, 13 bp, C. elegans
aaaatctgcaaaa

SEQ ID NO: 684908 - DNA, 13 bp, C. elegans
aaaatctgcagaa

SEQ ID NO: 684909 - DNA, 13 bp, C. elegans
aaaatctgcattt

SEQ ID NO: 684910 - DNA, 13 bp, C. elegans
aaaatctgctcaa

SEQ ID NO: 684911 - DNA, 13 bp, C. elegans
aaaatctgctgaa

SEQ ID NO: 684912 - DNA, 13 bp, C. elegans
aaaatctggaata

SEQ ID NO: 684913 - DNA, 13 bp, C. elegans
aaaatctggaatt

SEQ ID NO: 684914 - DNA, 13 bp, C. elegans
aaaatctggcatt

SEQ ID NO: 684915 - DNA, 13 bp, C. elegans
aaaatctgggaaa

SEQ ID NO: 684916 - DNA, 13 bp, C. elegans
aaaatctgtaaaa

SEQ ID NO: 684917 - DNA, 13 bp, C. elegans
aaaatctgtactt

SEQ ID NO: 684918 - DNA, 13 bp, C. elegans
aaaatctgtagtt

SEQ ID NO: 684919 - DNA, 13 bp, C. elegans
aaaatctgtcaaa

SEQ ID NO: 684920 - DNA, 13 bp, C. elegans
aaaatctgtgaaa

SEQ ID NO: 684921 - DNA, 13 bp, C. elegans
aaaatctgtgtaa

SEQ ID NO: 684922 - DNA, 13 bp, C. elegans
aaaatctgttatt

SEQ ID NO: 684923 - DNA, 13 bp, C. elegans
aaaatctgttttc

SEQ ID NO: 684924 - DNA, 13 bp, C. elegans
aaaatctgttttt

SEQ ID NO: 684925 - DNA, 13 bp, C. elegans
aaaatcttaactt

SEQ ID NO: 684926 - DNA, 13 bp, C. elegans
aaaatcttagaaa

SEQ ID NO: 684927 - DNA, 13 bp, C. elegans
aaaatcttcactt

SEQ ID NO: 684928 - DNA, 13 bp, C. elegans
aaaatcttcagaa

SEQ ID NO: 684929 - DNA, 13 bp, C. elegans
aaaatcttcgaaa

SEQ ID NO: 684930 - DNA, 13 bp, C. elegans
aaaatcttctaaa

SEQ ID NO: 684931 - DNA, 13 bp, C. elegans
aaaatcttctcaa

SEQ ID NO: 684932 - DNA, 13 bp, C. elegans
aaaatcttgaaaa

SEQ ID NO: 684933 - DNA, 13 bp, C. elegans
aaaatcttgaaac

SEQ ID NO: 684934 - DNA, 13 bp, C. elegans
aaaatcttgaaat

SEQ ID NO: 684935 - DNA, 13 bp, C. elegans
aaaatcttgattt

SEQ ID NO: 684936 - DNA, 13 bp, C. elegans
aaaatcttgcaaa

SEQ ID NO: 684937 - DNA, 13 bp, C. elegans
aaaatcttgtaaa

SEQ ID NO: 684938 - DNA, 13 bp, C. elegans
aaaatcttgtatt

SEQ ID NO: 684939 - DNA, 13 bp, C. elegans
aaaatcttgttga

SEQ ID NO: 684940 - DNA, 13 bp, C. elegans
aaaatctttcatt

SEQ ID NO: 684941 - DNA, 13 bp, C. elegans
aaaatctttcttt

SEQ ID NO: 684942 - DNA, 13 bp, C. elegans
aaaatctttgaaa

SEQ ID NO: 684943 - DNA, 13 bp, C. elegans
aaaatcttttgtt

SEQ ID NO: 684944 - DNA, 13 bp, C. elegans
aaaatctttttct

SEQ ID NO: 684945 - DNA, 13 bp, C. elegans
aaaatctttttga

SEQ ID NO: 684946 - DNA, 13 bp, C. elegans
aaaatcttttttg

SEQ ID NO: 684947 - DNA, 13 bp, C. elegans
aaaatgaaaatct

SEQ ID NO: 684948 - DNA, 13 bp, C. elegans
aaaatgaaacagt

SEQ ID NO: 684949 - DNA, 13 bp, C. elegans
aaaatgaaactat

SEQ ID NO: 684950 - DNA, 13 bp, C. elegans
aaaatgaaactgg

SEQ ID NO: 684951 - DNA, 13 bp, C. elegans
aaaatgaaatcat

SEQ ID NO: 684952 - DNA, 13 bp, C. elegans
aaaatgaaatcta

SEQ ID NO: 684953 - DNA, 13 bp, C. elegans
aaaatgaaatctg

SEQ ID NO: 684954 - DNA, 13 bp, C. elegans
aaaatgaaatgtt

SEQ ID NO: 684955 - DNA, 13 bp, C. elegans
aaaatgaaattgg

SEQ ID NO: 684956 - DNA, 13 bp, C. elegans
aaaatgaaatttc

SEQ ID NO: 684957 - DNA, 13 bp, C. elegans
aaaatgaacatca

SEQ ID NO: 684958 - DNA, 13 bp, C. elegans
aaaatgaacattt

SEQ ID NO: 684959 - DNA, 13 bp, C. elegans
aaaatgaacgttt

SEQ ID NO: 684960 - DNA, 13 bp, C. elegans
aaaatgaacttaa

SEQ ID NO: 684961 - DNA, 13 bp, C. elegans
aaaatgaactttt

SEQ ID NO: 684962 - DNA, 13 bp, C. elegans
aaaatgaagatca

SEQ ID NO: 684963 - DNA, 13 bp, C. elegans
aaaatgaagattt

SEQ ID NO: 684964 - DNA, 13 bp, C. elegans
aaaatgaagtatt

SEQ ID NO: 684965 - DNA, 13 bp, C. elegans
aaaatgaagttcc

SEQ ID NO: 684966 - DNA, 13 bp, C. elegans
aaaatgaagttga

SEQ ID NO: 684967 - DNA, 13 bp, C. elegans
aaaatgaagtttc

SEQ ID NO: 684968 - DNA, 13 bp, C. elegans
aaaatgaagtttt

SEQ ID NO: 684969 - DNA, 13 bp, C. elegans
aaaatgaatatca

SEQ ID NO: 684970 - DNA, 13 bp, C. elegans
aaaatgaatgatt

SEQ ID NO: 684971 - DNA, 13 bp, C. elegans
aaaatgaatgcaa

SEQ ID NO: 684972 - DNA, 13 bp, C. elegans
aaaatgaatgttt

SEQ ID NO: 684973 - DNA, 13 bp, C. elegans
aaaatgaattaca

SEQ ID NO: 684974 - DNA, 13 bp, C. elegans
aaaatgaattcga

SEQ ID NO: 684975 - DNA, 13 bp, C. elegans
aaaatgaattgag

SEQ ID NO: 684976 - DNA, 13 bp, C. elegans
aaaatgaatttca

SEQ ID NO: 684977 - DNA, 13 bp, C. elegans
aaaatgacaaatt

SEQ ID NO: 684978 - DNA, 13 bp, C. elegans
aaaatgacaattt

SEQ ID NO: 684979 - DNA, 13 bp, C. elegans
aaaatgacacttt

SEQ ID NO: 684980 - DNA, 13 bp, C. elegans
aaaatgaccaaat

SEQ ID NO: 684981 - DNA, 13 bp, C. elegans
aaaatgaccgaat

SEQ ID NO: 684982 - DNA, 13 bp, C. elegans
aaaatgaccggaa

SEQ ID NO: 684983 - DNA, 13 bp, C. elegans
aaaatgaccggca

SEQ ID NO: 684984 - DNA, 13 bp, C. elegans
aaaatgacgagga

SEQ ID NO: 684985 - DNA, 13 bp, C. elegans
aaaatgacgtcac

SEQ ID NO: 684986 - DNA, 13 bp, C. elegans
aaaatgactcaaa

SEQ ID NO: 684987 - DNA, 13 bp, C. elegans
aaaatgactgaaa

SEQ ID NO: 684988 - DNA, 13 bp, C. elegans
aaaatgactggaa

SEQ ID NO: 684989 - DNA, 13 bp, C. elegans
aaaatgactgttt

SEQ ID NO: 684990 - DNA, 13 bp, C. elegans
aaaatgacttttt

SEQ ID NO: 684991 - DNA, 13 bp, C. elegans
aaaatgagaattt

SEQ ID NO: 684992 - DNA, 13 bp, C. elegans
aaaatgagacctt

SEQ ID NO: 684993 - DNA, 13 bp, C. elegans
aaaatgagatttt

SEQ ID NO: 684994 - DNA, 13 bp, C. elegans
aaaatgagcaaat

SEQ ID NO: 684995 - DNA, 13 bp, C. elegans
aaaatgagcaaca

SEQ ID NO: 684996 - DNA, 13 bp, C. elegans
aaaatgagcaata

SEQ ID NO: 684997 - DNA, 13 bp, C. elegans
aaaatgagcaatt

SEQ ID NO: 684998 - DNA, 13 bp, C. elegans
aaaatgagcagaa

SEQ ID NO: 684999 - DNA, 13 bp, C. elegans
aaaatgagccaat

SEQ ID NO: 685000 - DNA, 13 bp, C. elegans
aaaatgagccagt

SEQ ID NO: 685001 - DNA, 13 bp, C. elegans
aaaatgagcgaaa

SEQ ID NO: 685002 - DNA, 13 bp, C. elegans
aaaatgagctcaa

SEQ ID NO: 685003 - DNA, 13 bp, C. elegans
aaaatgagctttt

SEQ ID NO: 685004 - DNA, 13 bp, C. elegans
aaaatgagtgatt

SEQ ID NO: 685005 - DNA, 13 bp, C. elegans
aaaatgagtggag

SEQ ID NO: 685006 - DNA, 13 bp, C. elegans
aaaatgataatgt

SEQ ID NO: 685007 - DNA, 13 bp, C. elegans
aaaatgatactaa

SEQ ID NO: 685008 - DNA, 13 bp, C. elegans
aaaatgatagatt

SEQ ID NO: 685009 - DNA, 13 bp, C. elegans
aaaatgatatcat

SEQ ID NO: 685010 - DNA, 13 bp, C. elegans
aaaatgatatttc

SEQ ID NO: 685011 - DNA, 13 bp, C. elegans
aaaatgatcaaat

SEQ ID NO: 685012 - DNA, 13 bp, C. elegans
aaaatgatcattt

SEQ ID NO: 685013 - DNA, 13 bp, C. elegans
aaaatgatccaaa

SEQ ID NO: 685014 - DNA, 13 bp, C. elegans
aaaatgatcgaaa

SEQ ID NO: 685015 - DNA, 13 bp, C. elegans
aaaatgatgaagt

SEQ ID NO: 685016 - DNA, 13 bp, C. elegans
aaaatgatgacaa

SEQ ID NO: 685017 - DNA, 13 bp, C. elegans
aaaatgatgactg

SEQ ID NO: 685018 - DNA, 13 bp, C. elegans
aaaatgatgatta

SEQ ID NO: 685019 - DNA, 13 bp, C. elegans
aaaatgatgggaa

SEQ ID NO: 685020 - DNA, 13 bp, C. elegans
aaaatgatgtgaa

SEQ ID NO: 685021 - DNA, 13 bp, C. elegans
aaaatgatgtttt

SEQ ID NO: 685022 - DNA, 13 bp, C. elegans
aaaatgattcaga

SEQ ID NO: 685023 - DNA, 13 bp, C. elegans
aaaatgattcgaa

SEQ ID NO: 685024 - DNA, 13 bp, C. elegans
aaaatgattgaga

SEQ ID NO: 685025 - DNA, 13 bp, C. elegans
aaaatgattgatt

SEQ ID NO: 685026 - DNA, 13 bp, C. elegans
aaaatgattggaa

SEQ ID NO: 685027 - DNA, 13 bp, C. elegans
aaaatgattgttt

SEQ ID NO: 685028 - DNA, 13 bp, C. elegans
aaaatgatttctt

SEQ ID NO: 685029 - DNA, 13 bp, C. elegans
aaaatgatttgaa

SEQ ID NO: 685030 - DNA, 13 bp, C. elegans
aaaatgatttgat

SEQ ID NO: 685031 - DNA, 13 bp, C. elegans
aaaatgatttgtt

SEQ ID NO: 685032 - DNA, 13 bp, C. elegans
aaaatgattttgc

SEQ ID NO: 685033 - DNA, 13 bp, C. elegans
aaaatgatttttc

SEQ ID NO: 685034 - DNA, 13 bp, C. elegans
aaaatgatttttg

SEQ ID NO: 685035 - DNA, 13 bp, C. elegans
aaaatgcaaaatc

SEQ ID NO: 685036 - DNA, 13 bp, C. elegans
aaaatgcaaatta

SEQ ID NO: 685037 - DNA, 13 bp, C. elegans
aaaatgcaaattt

SEQ ID NO: 685038 - DNA, 13 bp, C. elegans
aaaatgcaacagt

SEQ ID NO: 685039 - DNA, 13 bp, C. elegans
aaaatgcaacttc

SEQ ID NO: 685040 - DNA, 13 bp, C. elegans
aaaatgcaagaat

SEQ ID NO: 685041 - DNA, 13 bp, C. elegans
aaaatgcaatatt

SEQ ID NO: 685042 - DNA, 13 bp, C. elegans
aaaatgcaatcaa

SEQ ID NO: 685043 - DNA, 13 bp, C. elegans
aaaatgcaattat

SEQ ID NO: 685044 - DNA, 13 bp, C. elegans
aaaatgcaattta

SEQ ID NO: 685045 - DNA, 13 bp, C. elegans
aaaatgcaatttc

SEQ ID NO: 685046 - DNA, 13 bp, C. elegans
aaaatgcaatttt

SEQ ID NO: 685047 - DNA, 13 bp, C. elegans
aaaatgcacaatt

SEQ ID NO: 685048 - DNA, 15 bp, C. elegans
aaaatgcaccaagta

SEQ ID NO: 685049 - DNA, 13 bp, C. elegans
aaaatgcaccgaa

SEQ ID NO: 685050 - DNA, 13 bp, C. elegans
aaaatgcacggaa

SEQ ID NO: 685051 - DNA, 13 bp, C. elegans
aaaatgcactgac

SEQ ID NO: 685052 - DNA, 13 bp, C. elegans
aaaatgcactttt

SEQ ID NO: 685053 - DNA, 13 bp, C. elegans
aaaatgcagaatt

SEQ ID NO: 685054 - DNA, 13 bp, C. elegans
aaaatgcagcaaa

SEQ ID NO: 685055 - DNA, 13 bp, C. elegans
aaaatgcaggaat

SEQ ID NO: 685056 - DNA, 13 bp, C. elegans
aaaatgcataata

SEQ ID NO: 685057 - DNA, 13 bp, C. elegans
aaaatgcataatt

SEQ ID NO: 685058 - DNA, 13 bp, C. elegans
aaaatgcatcgaa

SEQ ID NO: 685059 - DNA, 13 bp, C. elegans
aaaatgcatctca

SEQ ID NO: 685060 - DNA, 13 bp, C. elegans
aaaatgcattagt

SEQ ID NO: 685061 - DNA, 13 bp, C. elegans
aaaatgcattcta

SEQ ID NO: 685062 - DNA, 13 bp, C. elegans
aaaatgcattctt

SEQ ID NO: 685063 - DNA, 13 bp, C. elegans
aaaatgcatttaa

SEQ ID NO: 685064 - DNA, 13 bp, C. elegans
aaaatgcatttat

SEQ ID NO: 685065 - DNA, 13 bp, C. elegans
aaaatgcatttta

SEQ ID NO: 685066 - DNA, 13 bp, C. elegans
aaaatgcattttt

SEQ ID NO: 685067 - DNA, 13 bp, C. elegans
aaaatgccaaaac

SEQ ID NO: 685068 - DNA, 13 bp, C. elegans
aaaatgccaaaat

SEQ ID NO: 685069 - DNA, 13 bp, C. elegans
aaaatgccaaaca

SEQ ID NO: 685070 - DNA, 13 bp, C. elegans
aaaatgccaaatt

SEQ ID NO: 685071 - DNA, 13 bp, C. elegans
aaaatgccaagtt

SEQ ID NO: 685072 - DNA, 13 bp, C. elegans
aaaatgccaatat

SEQ ID NO: 685073 - DNA, 13 bp, C. elegans
aaaatgccataaa

SEQ ID NO: 685074 - DNA, 13 bp, C. elegans
aaaatgcccaaaa

SEQ ID NO: 685075 - DNA, 13 bp, C. elegans
aaaatgcccagaa

SEQ ID NO: 685076 - DNA, 13 bp, C. elegans
aaaatgccgaaaa

SEQ ID NO: 685077 - DNA, 13 bp, C. elegans
aaaatgccgagaa

SEQ ID NO: 685078 - DNA, 13 bp, C. elegans
aaaatgccgattt

SEQ ID NO: 685079 - DNA, 13 bp, C. elegans
aaaatgccggaat

SEQ ID NO: 685080 - DNA, 13 bp, C. elegans
aaaatgccgtttt

SEQ ID NO: 685081 - DNA, 13 bp, C. elegans
aaaatgcctaatt

SEQ ID NO: 685082 - DNA, 13 bp, C. elegans
aaaatgcctgaaa

SEQ ID NO: 685083 - DNA, 13 bp, C. elegans
aaaatgcctgttt

SEQ ID NO: 685084 - DNA, 13 bp, C. elegans
aaaatgcgaattt

SEQ ID NO: 685085 - DNA, 13 bp, C. elegans
aaaatgcgacgtc

SEQ ID NO: 685086 - DNA, 13 bp, C. elegans
aaaatgcgagaga

SEQ ID NO: 685087 - DNA, 13 bp, C. elegans
aaaatgcgcaaaa

SEQ ID NO: 685088 - DNA, 13 bp, C. elegans
aaaatgcgcgaaa

SEQ ID NO: 685089 - DNA, 13 bp, C. elegans
aaaatgcgcggaa

SEQ ID NO: 685090 - DNA, 13 bp, C. elegans
aaaatgcgctgaa

SEQ ID NO: 685091 - DNA, 13 bp, C. elegans
aaaatgcggaaat

SEQ ID NO: 685092 - DNA, 13 bp, C. elegans
aaaatgcgggaag

SEQ ID NO: 685093 - DNA, 13 bp, C. elegans
aaaatgctaattt

SEQ ID NO: 685094 - DNA, 13 bp, C. elegans
aaaatgctagaaa

SEQ ID NO: 685095 - DNA, 13 bp, C. elegans
aaaatgctataaa

SEQ ID NO: 685096 - DNA, 13 bp, C. elegans
aaaatgctcaaaa

SEQ ID NO: 685097 - DNA, 13 bp, C. elegans
aaaatgctcaaat

SEQ ID NO: 685098 - DNA, 13 bp, C. elegans
aaaatgctcaata

SEQ ID NO: 685099 - DNA, 13 bp, C. elegans
aaaatgctcacaa

SEQ ID NO: 685100 - DNA, 13 bp, C. elegans
aaaatgctcagaa

SEQ ID NO: 685101 - DNA, 13 bp, C. elegans
aaaatgctcataa

SEQ ID NO: 685102 - DNA, 13 bp, C. elegans
aaaatgctccaaa

SEQ ID NO: 685103 - DNA, 13 bp, C. elegans
aaaatgctgaaaa

SEQ ID NO: 685104 - DNA, 13 bp, C. elegans
aaaatgctgcaaa

SEQ ID NO: 685105 - DNA, 13 bp, C. elegans
aaaatgcttaaaa

SEQ ID NO: 685106 - DNA, 13 bp, C. elegans
aaaatgcttaatt

SEQ ID NO: 685107 - DNA, 13 bp, C. elegans
aaaatgcttcaaa

SEQ ID NO: 685108 - DNA, 13 bp, C. elegans
aaaatgcttcttt

SEQ ID NO: 685109 - DNA, 13 bp, C. elegans
aaaatgcttgttt

SEQ ID NO: 685110 - DNA, 13 bp, C. elegans
aaaatgctttcta

SEQ ID NO: 685111 - DNA, 13 bp, C. elegans
aaaatgcttttaa

SEQ ID NO: 685112 - DNA, 13 bp, C. elegans
aaaatgcttttta

SEQ ID NO: 685113 - DNA, 13 bp, C. elegans
aaaatgctttttt

SEQ ID NO: 685114 - DNA, 13 bp, C. elegans
aaaatggaaacta

SEQ ID NO: 685115 - DNA, 13 bp, C. elegans
aaaatggaaagtt

SEQ ID NO: 685116 - DNA, 13 bp, C. elegans
aaaatggaaatca

SEQ ID NO: 685117 - DNA, 14 bp, C. elegans
aaaatggaaattga

SEQ ID NO: 685118 - DNA, 13 bp, C. elegans
aaaatggaaattt

SEQ ID NO: 685119 - DNA, 13 bp, C. elegans
aaaatggaataca

SEQ ID NO: 685120 - DNA, 14 bp, C. elegans
aaaatggaattgaa

SEQ ID NO: 685121 - DNA, 13 bp, C. elegans
aaaatggaattgt

SEQ ID NO: 685122 - DNA, 13 bp, C. elegans
aaaatggaatttc

SEQ ID NO: 685123 - DNA, 13 bp, C. elegans
aaaatggacaatt

SEQ ID NO: 685124 - DNA, 14 bp, C. elegans
aaaatggacatcac

SEQ ID NO: 685125 - DNA, 13 bp, C. elegans
aaaatggacattt

SEQ ID NO: 685126 - DNA, 13 bp, C. elegans
aaaatggacgaaa

SEQ ID NO: 685127 - DNA, 13 bp, C. elegans
aaaatggagaatt

SEQ ID NO: 685128 - DNA, 13 bp, C. elegans
aaaatggagagtt

SEQ ID NO: 685129 - DNA, 13 bp, C. elegans
aaaatggagatga

SEQ ID NO: 685130 - DNA, 13 bp, C. elegans
aaaatggagcaaa

SEQ ID NO: 685131 - DNA, 13 bp, C. elegans
aaaatggagcatt

SEQ ID NO: 685132 - DNA, 13 bp, C. elegans
aaaatggataatt

SEQ ID NO: 685133 - DNA, 13 bp, C. elegans
aaaatggatcaaa

SEQ ID NO: 685134 - DNA, 13 bp, C. elegans
aaaatggatgaga

SEQ ID NO: 685135 - DNA, 13 bp, C. elegans
aaaatggatttta

SEQ ID NO: 685136 - DNA, 13 bp, C. elegans
aaaatggcaaaac

SEQ ID NO: 685137 - DNA, 13 bp, C. elegans
aaaatggcaaaca

SEQ ID NO: 685138 - DNA, 13 bp, C. elegans
aaaatggcaactt

SEQ ID NO: 685139 - DNA, 13 bp, C. elegans
aaaatggcaagaa

SEQ ID NO: 685140 - DNA, 13 bp, C. elegans
aaaatggcacttt

SEQ ID NO: 685141 - DNA, 13 bp, C. elegans
aaaatggcattgc

SEQ ID NO: 685142 - DNA, 13 bp, C. elegans
aaaatggccaaaa

SEQ ID NO: 685143 - DNA, 13 bp, C. elegans
aaaatggccgaat

SEQ ID NO: 685144 - DNA, 13 bp, C. elegans
aaaatggcgaaaa

SEQ ID NO: 685145 - DNA, 13 bp, C. elegans
aaaatggcggaaa

SEQ ID NO: 685146 - DNA, 13 bp, C. elegans
aaaatggcgggaa

SEQ ID NO: 685147 - DNA, 13 bp, C. elegans
aaaatggctcaaa

SEQ ID NO: 685148 - DNA, 13 bp, C. elegans
aaaatggctccaa

SEQ ID NO: 685149 - DNA, 13 bp, C. elegans
aaaatggctgaaa

SEQ ID NO: 685150 - DNA, 13 bp, C. elegans
aaaatggctgaat

SEQ ID NO: 685151 - DNA, 13 bp, C. elegans
aaaatggcttgaa

SEQ ID NO: 685152 - DNA, 13 bp, C. elegans
aaaatggctttga

SEQ ID NO: 685153 - DNA, 13 bp, C. elegans
aaaatgggaattt

SEQ ID NO: 685154 - DNA, 13 bp, C. elegans
aaaatgggacact

SEQ ID NO: 685155 - DNA, 13 bp, C. elegans
aaaatgggatttt

SEQ ID NO: 685156 - DNA, 13 bp, C. elegans
aaaatgggcagaa

SEQ ID NO: 685157 - DNA, 13 bp, C. elegans
aaaatgggcgtgg

SEQ ID NO: 685158 - DNA, 13 bp, C. elegans
aaaatgggctcaa

SEQ ID NO: 685159 - DNA, 13 bp, C. elegans
aaaatgggtaatt

SEQ ID NO: 685160 - DNA, 13 bp, C. elegans
aaaatgggtatca

SEQ ID NO: 685161 - DNA, 13 bp, C. elegans
aaaatgggtcaaa

SEQ ID NO: 685162 - DNA, 13 bp, C. elegans
aaaatgggtttca

SEQ ID NO: 685163 - DNA, 13 bp, C. elegans
aaaatgggttttc

SEQ ID NO: 685164 - DNA, 13 bp, C. elegans
aaaatgggttttt

SEQ ID NO: 685165 - DNA, 13 bp, C. elegans
aaaatggtaaatt

SEQ ID NO: 685166 - DNA, 13 bp, C. elegans
aaaatggtaattt

SEQ ID NO: 685167 - DNA, 13 bp, C. elegans
aaaatggtcaaaa

SEQ ID NO: 685168 - DNA, 13 bp, C. elegans
aaaatggtcagaa

SEQ ID NO: 685169 - DNA, 13 bp, C. elegans
aaaatggtggaaa

SEQ ID NO: 685170 - DNA, 13 bp, C. elegans
aaaatggtggttt

SEQ ID NO: 685171 - DNA, 13 bp, C. elegans
aaaatggttattt

SEQ ID NO: 685172 - DNA, 13 bp, C. elegans
aaaatggttcaaa

SEQ ID NO: 685173 - DNA, 13 bp, C. elegans
aaaatggttcaat

SEQ ID NO: 685174 - DNA, 13 bp, C. elegans
aaaatggttggaa

SEQ ID NO: 685175 - DNA, 13 bp, C. elegans
aaaatggtttaaa

SEQ ID NO: 685176 - DNA, 13 bp, C. elegans
aaaatggtttaat

SEQ ID NO: 685177 - DNA, 13 bp, C. elegans
aaaatggtttaca

SEQ ID NO: 685178 - DNA, 13 bp, C. elegans
aaaatggtttgaa

SEQ ID NO: 685179 - DNA, 13 bp, C. elegans
aaaatggtttttt

SEQ ID NO: 685180 - DNA, 13 bp, C. elegans
aaaatgtaacaat

SEQ ID NO: 685181 - DNA, 13 bp, C. elegans
aaaatgtaatcaa

SEQ ID NO: 685182 - DNA, 13 bp, C. elegans
aaaatgtacaaac

SEQ ID NO: 685183 - DNA, 13 bp, C. elegans
aaaatgtacaaat

SEQ ID NO: 685184 - DNA, 13 bp, C. elegans
aaaatgtacaagt

SEQ ID NO: 685185 - DNA, 13 bp, C. elegans
aaaatgtacactt

SEQ ID NO: 685186 - DNA, 13 bp, C. elegans
aaaatgtaccttt

SEQ ID NO: 685187 - DNA, 13 bp, C. elegans
aaaatgtacgaaa

SEQ ID NO: 685188 - DNA, 13 bp, C. elegans
aaaatgtagagtt

SEQ ID NO: 685189 - DNA, 13 bp, C. elegans
aaaatgtagcaaa

SEQ ID NO: 685190 - DNA, 13 bp, C. elegans
aaaatgtagggaa

SEQ ID NO: 685191 - DNA, 13 bp, C. elegans
aaaatgtataaac

SEQ ID NO: 685192 - DNA, 13 bp, C. elegans
aaaatgtatatct

SEQ ID NO: 685193 - DNA, 13 bp, C. elegans
aaaatgtatattc

SEQ ID NO: 685194 - DNA, 13 bp, C. elegans
aaaatgtatcaaa

SEQ ID NO: 685195 - DNA, 13 bp, C. elegans
aaaatgtatcaat

SEQ ID NO: 685196 - DNA, 13 bp, C. elegans
aaaatgtatcgaa

SEQ ID NO: 685197 - DNA, 13 bp, C. elegans
aaaatgtatcttc

SEQ ID NO: 685198 - DNA, 13 bp, C. elegans
aaaatgtatggaa

SEQ ID NO: 685199 - DNA, 13 bp, C. elegans
aaaatgtatgttt

SEQ ID NO: 685200 - DNA, 13 bp, C. elegans
aaaatgtattcat

SEQ ID NO: 685201 - DNA, 13 bp, C. elegans
aaaatgtattcca

SEQ ID NO: 685202 - DNA, 13 bp, C. elegans
aaaatgtattctc

SEQ ID NO: 685203 - DNA, 14 bp, C. elegans
aaaatgtattttca

SEQ ID NO: 685204 - DNA, 13 bp, C. elegans
aaaatgtcaaaat

SEQ ID NO: 685205 - DNA, 13 bp, C. elegans
aaaatgtcaaaga

SEQ ID NO: 685206 - DNA, 13 bp, C. elegans
aaaatgtcaacaa

SEQ ID NO: 685207 - DNA, 13 bp, C. elegans
aaaatgtcaattt

SEQ ID NO: 685208 - DNA, 13 bp, C. elegans
aaaatgtcacaaa

SEQ ID NO: 685209 - DNA, 13 bp, C. elegans
aaaatgtcagatt

SEQ ID NO: 685210 - DNA, 13 bp, C. elegans
aaaatgtcagttt

SEQ ID NO: 685211 - DNA, 13 bp, C. elegans
aaaatgtcatatt

SEQ ID NO: 685212 - DNA, 13 bp, C. elegans
aaaatgtccaatt

SEQ ID NO: 685213 - DNA, 13 bp, C. elegans
aaaatgtcccaaa

SEQ ID NO: 685214 - DNA, 13 bp, C. elegans
aaaatgtcgattt

SEQ ID NO: 685215 - DNA, 13 bp, C. elegans
aaaatgtctaaaa

SEQ ID NO: 685216 - DNA, 13 bp, C. elegans
aaaatgtctcaaa

SEQ ID NO: 685217 - DNA, 13 bp, C. elegans
aaaatgtctgaaa

SEQ ID NO: 685218 - DNA, 13 bp, C. elegans
aaaatgtctgaat

SEQ ID NO: 685219 - DNA, 13 bp, C. elegans
aaaatgtctgatt

SEQ ID NO: 685220 - DNA, 13 bp, C. elegans
aaaatgtctgcct

SEQ ID NO: 685221 - DNA, 13 bp, C. elegans
aaaatgtctggaa

SEQ ID NO: 685222 - DNA, 13 bp, C. elegans
aaaatgtctgtaa

SEQ ID NO: 685223 - DNA, 13 bp, C. elegans
aaaatgtctttca

SEQ ID NO: 685224 - DNA, 13 bp, C. elegans
aaaatgtcttttt

SEQ ID NO: 685225 - DNA, 13 bp, C. elegans
aaaatgtgaacaa

SEQ ID NO: 685226 - DNA, 13 bp, C. elegans
aaaatgtgacaat

SEQ ID NO: 685227 - DNA, 13 bp, C. elegans
aaaatgtgacttt

SEQ ID NO: 685228 - DNA, 13 bp, C. elegans
aaaatgtgatatt

SEQ ID NO: 685229 - DNA, 13 bp, C. elegans
aaaatgtgatgat

SEQ ID NO: 685230 - DNA, 13 bp, C. elegans
aaaatgtgattca

SEQ ID NO: 685231 - DNA, 13 bp, C. elegans
aaaatgtgattta

SEQ ID NO: 685232 - DNA, 13 bp, C. elegans
aaaatgtgatttt

SEQ ID NO: 685233 - DNA, 13 bp, C. elegans
aaaatgtgcaaaa

SEQ ID NO: 685234 - DNA, 13 bp, C. elegans
aaaatgtgcaatt

SEQ ID NO: 685235 - DNA, 13 bp, C. elegans
aaaatgtgcagaa

SEQ ID NO: 685236 - DNA, 13 bp, C. elegans
aaaatgtgcagtt

SEQ ID NO: 685237 - DNA, 13 bp, C. elegans
aaaatgtgcataa

SEQ ID NO: 685238 - DNA, 13 bp, C. elegans
aaaatgtgcatat

SEQ ID NO: 685239 - DNA, 13 bp, C. elegans
aaaatgtgcattt

SEQ ID NO: 685240 - DNA, 13 bp, C. elegans
aaaatgtgccaaa

SEQ ID NO: 685241 - DNA, 13 bp, C. elegans
aaaatgtgctaaa

SEQ ID NO: 685242 - DNA, 13 bp, C. elegans
aaaatgtgctaat

SEQ ID NO: 685243 - DNA, 13 bp, C. elegans
aaaatgtgctctt

SEQ ID NO: 685244 - DNA, 13 bp, C. elegans
aaaatgtggaatt

SEQ ID NO: 685245 - DNA, 13 bp, C. elegans
aaaatgtggattt

SEQ ID NO: 685246 - DNA, 13 bp, C. elegans
aaaatgtggcaat

SEQ ID NO: 685247 - DNA, 13 bp, C. elegans
aaaatgtggccaa

SEQ ID NO: 685248 - DNA, 13 bp, C. elegans
aaaatgtggggtt

SEQ ID NO: 685249 - DNA, 13 bp, C. elegans
aaaatgtggtgaa

SEQ ID NO: 685250 - DNA, 13 bp, C. elegans
aaaatgtgtaaat

SEQ ID NO: 685251 - DNA, 13 bp, C. elegans
aaaatgtgtcaaa

SEQ ID NO: 685252 - DNA, 13 bp, C. elegans
aaaatgtgtcgat

SEQ ID NO: 685253 - DNA, 13 bp, C. elegans
aaaatgtgtgaaa

SEQ ID NO: 685254 - DNA, 13 bp, C. elegans
aaaatgtgtgcaa

SEQ ID NO: 685255 - DNA, 13 bp, C. elegans
aaaatgtgtgtaa

SEQ ID NO: 685256 - DNA, 13 bp, C. elegans
aaaatgtgttaaa

SEQ ID NO: 685257 - DNA, 13 bp, C. elegans
aaaatgtgttcat

SEQ ID NO: 685258 - DNA, 13 bp, C. elegans
aaaatgtgttctc

SEQ ID NO: 685259 - DNA, 13 bp, C. elegans
aaaatgtgttgaa

SEQ ID NO: 685260 - DNA, 13 bp, C. elegans
aaaatgtgtttaa

SEQ ID NO: 685261 - DNA, 13 bp, C. elegans
aaaatgtgtttcc

SEQ ID NO: 685262 - DNA, 13 bp, C. elegans
aaaatgtgtttga

SEQ ID NO: 685263 - DNA, 13 bp, C. elegans
aaaatgtgttttt

SEQ ID NO: 685264 - DNA, 13 bp, C. elegans
aaaatgttaaaac

SEQ ID NO: 685265 - DNA, 13 bp, C. elegans
aaaatgttaactg

SEQ ID NO: 685266 - DNA, 13 bp, C. elegans
aaaatgttaatgt

SEQ ID NO: 685267 - DNA, 13 bp, C. elegans
aaaatgttacaaa

SEQ ID NO: 685268 - DNA, 13 bp, C. elegans
aaaatgttactat

SEQ ID NO: 685269 - DNA, 13 bp, C. elegans
aaaatgttagttt

SEQ ID NO: 685270 - DNA, 13 bp, C. elegans
aaaatgttattgt

SEQ ID NO: 685271 - DNA, 13 bp, C. elegans
aaaatgttcaaaa

SEQ ID NO: 685272 - DNA, 13 bp, C. elegans
aaaatgttcaaat

SEQ ID NO: 685273 - DNA, 13 bp, C. elegans
aaaatgttcaaga

SEQ ID NO: 685274 - DNA, 13 bp, C. elegans
aaaatgttcaatt

SEQ ID NO: 685275 - DNA, 13 bp, C. elegans
aaaatgttcacta

SEQ ID NO: 685276 - DNA, 13 bp, C. elegans
aaaatgttcagaa

SEQ ID NO: 685277 - DNA, 13 bp, C. elegans
aaaatgttcagtg

SEQ ID NO: 685278 - DNA, 13 bp, C. elegans
aaaatgttcagtt

SEQ ID NO: 685279 - DNA, 13 bp, C. elegans
aaaatgttcatca

SEQ ID NO: 685280 - DNA, 13 bp, C. elegans
aaaatgttccaaa

SEQ ID NO: 685281 - DNA, 13 bp, C. elegans
aaaatgttccata

SEQ ID NO: 685282 - DNA, 13 bp, C. elegans
aaaatgttccttt

SEQ ID NO: 685283 - DNA, 13 bp, C. elegans
aaaatgttcgaaa

SEQ ID NO: 685284 - DNA, 13 bp, C. elegans
aaaatgttctaaa

SEQ ID NO: 685285 - DNA, 13 bp, C. elegans
aaaatgttctatt

SEQ ID NO: 685286 - DNA, 13 bp, C. elegans
aaaatgttctcaa

SEQ ID NO: 685287 - DNA, 13 bp, C. elegans
aaaatgttctctt

SEQ ID NO: 685288 - DNA, 13 bp, C. elegans
aaaatgttctgaa

SEQ ID NO: 685289 - DNA, 13 bp, C. elegans
aaaatgttctgtt

SEQ ID NO: 685290 - DNA, 13 bp, C. elegans
aaaatgttcttat

SEQ ID NO: 685291 - DNA, 13 bp, C. elegans
aaaatgttctttg

SEQ ID NO: 685292 - DNA, 13 bp, C. elegans
aaaatgttgaaat

SEQ ID NO: 685293 - DNA, 13 bp, C. elegans
aaaatgttgaatt

SEQ ID NO: 685294 - DNA, 13 bp, C. elegans
aaaatgttgagaa

SEQ ID NO: 685295 - DNA, 13 bp, C. elegans
aaaatgttgagca

SEQ ID NO: 685296 - DNA, 13 bp, C. elegans
aaaatgttgatat

SEQ ID NO: 685297 - DNA, 13 bp, C. elegans
aaaatgttgatga

SEQ ID NO: 685298 - DNA, 13 bp, C. elegans
aaaatgttgattc

SEQ ID NO: 685299 - DNA, 13 bp, C. elegans
aaaatgttgcaat

SEQ ID NO: 685300 - DNA, 13 bp, C. elegans
aaaatgttgccaa

SEQ ID NO: 685301 - DNA, 13 bp, C. elegans
aaaatgttggaaa

SEQ ID NO: 685302 - DNA, 13 bp, C. elegans
aaaatgttgtaaa

SEQ ID NO: 685303 - DNA, 13 bp, C. elegans
aaaatgttgtcaa

SEQ ID NO: 685304 - DNA, 13 bp, C. elegans
aaaatgttgtctt

SEQ ID NO: 685305 - DNA, 13 bp, C. elegans
aaaatgttgtgaa

SEQ ID NO: 685306 - DNA, 13 bp, C. elegans
aaaatgttgttaa

SEQ ID NO: 685307 - DNA, 13 bp, C. elegans
aaaatgttgttga

SEQ ID NO: 685308 - DNA, 13 bp, C. elegans
aaaatgttgtttg

SEQ ID NO: 685309 - DNA, 13 bp, C. elegans
aaaatgtttagag

SEQ ID NO: 685310 - DNA, 13 bp, C. elegans
aaaatgtttagct

SEQ ID NO: 685311 - DNA, 13 bp, C. elegans
aaaatgtttatca

SEQ ID NO: 685312 - DNA, 13 bp, C. elegans
aaaatgtttcaaa

SEQ ID NO: 685313 - DNA, 13 bp, C. elegans
aaaatgtttcaat

SEQ ID NO: 685314 - DNA, 13 bp, C. elegans
aaaatgtttcact

SEQ ID NO: 685315 - DNA, 13 bp, C. elegans
aaaatgtttcgat

SEQ ID NO: 685316 - DNA, 13 bp, C. elegans
aaaatgtttcgta

SEQ ID NO: 685317 - DNA, 13 bp, C. elegans
aaaatgtttctat

SEQ ID NO: 685318 - DNA, 13 bp, C. elegans
aaaatgtttgaaa

SEQ ID NO: 685319 - DNA, 13 bp, C. elegans
aaaatgtttgata

SEQ ID NO: 685320 - DNA, 13 bp, C. elegans
aaaatgtttgatt

SEQ ID NO: 685321 - DNA, 13 bp, C. elegans
aaaatgtttgcaa

SEQ ID NO: 685322 - DNA, 13 bp, C. elegans
aaaatgtttggaa

SEQ ID NO: 685323 - DNA, 13 bp, C. elegans
aaaatgtttgttt

SEQ ID NO: 685324 - DNA, 13 bp, C. elegans
aaaatgttttaag

SEQ ID NO: 685325 - DNA, 13 bp, C. elegans
aaaatgttttcaa

SEQ ID NO: 685326 - DNA, 13 bp, C. elegans
aaaatgttttcga

SEQ ID NO: 685327 - DNA, 13 bp, C. elegans
aaaatgttttcta

SEQ ID NO: 685328 - DNA, 13 bp, C. elegans
aaaatgtttttca

SEQ ID NO: 685329 - DNA, 14 bp, C. elegans
aaaatgttttttcc

SEQ ID NO: 685330 - DNA, 13 bp, C. elegans
aaaattaaatcga

SEQ ID NO: 685331 - DNA, 13 bp, C. elegans
aaaattaaattgc

SEQ ID NO: 685332 - DNA, 13 bp, C. elegans
aaaattaacgatt

SEQ ID NO: 685333 - DNA, 13 bp, C. elegans
aaaattaagctca

SEQ ID NO: 685334 - DNA, 13 bp, C. elegans
aaaattaatgtag

SEQ ID NO: 685335 - DNA, 13 bp, C. elegans
aaaattacaaagt

SEQ ID NO: 685336 - DNA, 13 bp, C. elegans
aaaattacactgt

SEQ ID NO: 685337 - DNA, 13 bp, C. elegans
aaaattacagatt

SEQ ID NO: 685338 - DNA, 13 bp, C. elegans
aaaattaccgatt

SEQ ID NO: 685339 - DNA, 13 bp, C. elegans
aaaattacctatt

SEQ ID NO: 685340 - DNA, 13 bp, C. elegans
aaaattacgagaa

SEQ ID NO: 685341 - DNA, 13 bp, C. elegans
aaaattacggaaa

SEQ ID NO: 685342 - DNA, 13 bp, C. elegans
aaaattactgaaa

SEQ ID NO: 685343 - DNA, 13 bp, C. elegans
aaaattactgtag

SEQ ID NO: 685344 - DNA, 13 bp, C. elegans
aaaattagagcaa

SEQ ID NO: 685345 - DNA, 13 bp, C. elegans
aaaattagcaatt

SEQ ID NO: 685346 - DNA, 13 bp, C. elegans
aaaattagcgaat

SEQ ID NO: 685347 - DNA, 13 bp, C. elegans
aaaattagctttt

SEQ ID NO: 685348 - DNA, 13 bp, C. elegans
aaaattaggattt

SEQ ID NO: 685349 - DNA, 13 bp, C. elegans
aaaattaggtgtt

SEQ ID NO: 685350 - DNA, 13 bp, C. elegans
aaaattaggttca

SEQ ID NO: 685351 - DNA, 13 bp, C. elegans
aaaattagtgaac

SEQ ID NO: 685352 - DNA, 13 bp, C. elegans
aaaattagtggaa

SEQ ID NO: 685353 - DNA, 13 bp, C. elegans
aaaattatcaaag

SEQ ID NO: 685354 - DNA, 13 bp, C. elegans
aaaattatcaact

SEQ ID NO: 685355 - DNA, 13 bp, C. elegans
aaaattatcgata

SEQ ID NO: 685356 - DNA, 13 bp, C. elegans
aaaattatctcaa

SEQ ID NO: 685357 - DNA, 13 bp, C. elegans
aaaattatgacat

SEQ ID NO: 685358 - DNA, 13 bp, C. elegans
aaaattatgacgg

SEQ ID NO: 685359 - DNA, 13 bp, C. elegans
aaaattatgagtg

SEQ ID NO: 685360 - DNA, 13 bp, C. elegans
aaaattatgcaaa

SEQ ID NO: 685361 - DNA, 13 bp, C. elegans
aaaattatgcttt

SEQ ID NO: 685362 - DNA, 13 bp, C. elegans
aaaattatgtgaa

SEQ ID NO: 685363 - DNA, 13 bp, C. elegans
aaaattattccga

SEQ ID NO: 685364 - DNA, 13 bp, C. elegans
aaaattattgaac

SEQ ID NO: 685365 - DNA, 13 bp, C. elegans
aaaattattgagt

SEQ ID NO: 685366 - DNA, 13 bp, C. elegans
aaaattattgtca

SEQ ID NO: 685367 - DNA, 13 bp, C. elegans
aaaattattgttc

SEQ ID NO: 685368 - DNA, 13 bp, C. elegans
aaaattatttcga

SEQ ID NO: 685369 - DNA, 13 bp, C. elegans
aaaattattttcc

SEQ ID NO: 685370 - DNA, 13 bp, C. elegans
aaaattcaaagag

SEQ ID NO: 685371 - DNA, 13 bp, C. elegans
aaaattcaaagtt

SEQ ID NO: 685372 - DNA, 13 bp, C. elegans
aaaattcaaatgt

SEQ ID NO: 685373 - DNA, 13 bp, C. elegans
aaaattcaaattc

SEQ ID NO: 685374 - DNA, 13 bp, C. elegans
aaaattcaaattg

SEQ ID NO: 685375 - DNA, 13 bp, C. elegans
aaaattcaacgtt

SEQ ID NO: 685376 - DNA, 13 bp, C. elegans
aaaattcaactta

SEQ ID NO: 685377 - DNA, 13 bp, C. elegans
aaaattcaagaat

SEQ ID NO: 685378 - DNA, 13 bp, C. elegans
aaaattcaagaga

SEQ ID NO: 685379 - DNA, 13 bp, C. elegans
aaaattcaagatt

SEQ ID NO: 685380 - DNA, 13 bp, C. elegans
aaaattcaaggtt

SEQ ID NO: 685381 - DNA, 13 bp, C. elegans
aaaattcaatctt

SEQ ID NO: 685382 - DNA, 13 bp, C. elegans
aaaattcaatgat

SEQ ID NO: 685383 - DNA, 13 bp, C. elegans
aaaattcaattga

SEQ ID NO: 685384 - DNA, 13 bp, C. elegans
aaaattcaattgt

SEQ ID NO: 685385 - DNA, 13 bp, C. elegans
aaaattcaatttg

SEQ ID NO: 685386 - DNA, 13 bp, C. elegans
aaaattcacaatt

SEQ ID NO: 685387 - DNA, 13 bp, C. elegans
aaaattcacagac

SEQ ID NO: 685388 - DNA, 13 bp, C. elegans
aaaattcacagat

SEQ ID NO: 685389 - DNA, 13 bp, C. elegans
aaaattcacattt

SEQ ID NO: 685390 - DNA, 13 bp, C. elegans
aaaattcaccaat

SEQ ID NO: 685391 - DNA, 13 bp, C. elegans
aaaattcacgaaa

SEQ ID NO: 685392 - DNA, 13 bp, C. elegans
aaaattcactgtt

SEQ ID NO: 685393 - DNA, 13 bp, C. elegans
aaaattcactttt

SEQ ID NO: 685394 - DNA, 13 bp, C. elegans
aaaattcagaaat

SEQ ID NO: 685395 - DNA, 13 bp, C. elegans
aaaattcagaaga

SEQ ID NO: 685396 - DNA, 13 bp, C. elegans
aaaattcagaatt

SEQ ID NO: 685397 - DNA, 13 bp, C. elegans
aaaattcagacta

SEQ ID NO: 685398 - DNA, 13 bp, C. elegans
aaaattcagagaa

SEQ ID NO: 685399 - DNA, 13 bp, C. elegans
aaaattcagataa

SEQ ID NO: 685400 - DNA, 13 bp, C. elegans
aaaattcagattc

SEQ ID NO: 685401 - DNA, 13 bp, C. elegans
aaaattcagtttt

SEQ ID NO: 685402 - DNA, 13 bp, C. elegans
aaaattcatagaa

SEQ ID NO: 685403 - DNA, 13 bp, C. elegans
aaaattcatagga

SEQ ID NO: 685404 - DNA, 13 bp, C. elegans
aaaattcatcaat

SEQ ID NO: 685405 - DNA, 13 bp, C. elegans
aaaattcatcaca

SEQ ID NO: 685406 - DNA, 13 bp, C. elegans
aaaattcatctat

SEQ ID NO: 685407 - DNA, 13 bp, C. elegans
aaaattcattcaa

SEQ ID NO: 685408 - DNA, 13 bp, C. elegans
aaaattcattgaa

SEQ ID NO: 685409 - DNA, 13 bp, C. elegans
aaaattcattgat

SEQ ID NO: 685410 - DNA, 13 bp, C. elegans
aaaattcatttgt

SEQ ID NO: 685411 - DNA, 13 bp, C. elegans
aaaattcattttc

SEQ ID NO: 685412 - DNA, 13 bp, C. elegans
aaaattccaactt

SEQ ID NO: 685413 - DNA, 14 bp, C. elegans
aaaattccaagaaa

SEQ ID NO: 685414 - DNA, 13 bp, C. elegans
aaaattccaagtt

SEQ ID NO: 685415 - DNA, 13 bp, C. elegans
aaaattccaatgt

SEQ ID NO: 685416 - DNA, 13 bp, C. elegans
aaaattccacgaa

SEQ ID NO: 685417 - DNA, 13 bp, C. elegans
aaaattccagaaa

SEQ ID NO: 685418 - DNA, 13 bp, C. elegans
aaaattccagaat

SEQ ID NO: 685419 - DNA, 13 bp, C. elegans
aaaattccagatt

SEQ ID NO: 685420 - DNA, 13 bp, C. elegans
aaaattccaggaa

SEQ ID NO: 685421 - DNA, 13 bp, C. elegans
aaaattccatata

SEQ ID NO: 685422 - DNA, 13 bp, C. elegans
aaaattccatctt

SEQ ID NO: 685423 - DNA, 13 bp, C. elegans
aaaattccatgtt

SEQ ID NO: 685424 - DNA, 13 bp, C. elegans
aaaattccatttt

SEQ ID NO: 685425 - DNA, 13 bp, C. elegans
aaaattcccaaat

SEQ ID NO: 685426 - DNA, 13 bp, C. elegans
aaaattcccaata

SEQ ID NO: 685427 - DNA, 13 bp, C. elegans
aaaattcccagtt

SEQ ID NO: 685428 - DNA, 13 bp, C. elegans
aaaattccccaaa

SEQ ID NO: 685429 - DNA, 13 bp, C. elegans
aaaattcccgaaa

SEQ ID NO: 685430 - DNA, 13 bp, C. elegans
aaaattcccgatt

SEQ ID NO: 685431 - DNA, 13 bp, C. elegans
aaaattccctttt

SEQ ID NO: 685432 - DNA, 13 bp, C. elegans
aaaattccgaaaa

SEQ ID NO: 685433 - DNA, 13 bp, C. elegans
aaaattccgattt

SEQ ID NO: 685434 - DNA, 13 bp, C. elegans
aaaattccgcgaa

SEQ ID NO: 685435 - DNA, 13 bp, C. elegans
aaaattccgcttt

SEQ ID NO: 685436 - DNA, 13 bp, C. elegans
aaaattccggaat

SEQ ID NO: 685437 - DNA, 13 bp, C. elegans
aaaattccgtaaa

SEQ ID NO: 685438 - DNA, 13 bp, C. elegans
aaaattccgttaa

SEQ ID NO: 685439 - DNA, 13 bp, C. elegans
aaaattcctaatt

SEQ ID NO: 685440 - DNA, 13 bp, C. elegans
aaaattcctattt

SEQ ID NO: 685441 - DNA, 13 bp, C. elegans
aaaattcctccaa

SEQ ID NO: 685442 - DNA, 13 bp, C. elegans
aaaattcctgaaa

SEQ ID NO: 685443 - DNA, 13 bp, C. elegans
aaaattcctgttt

SEQ ID NO: 685444 - DNA, 13 bp, C. elegans
aaaattccttgaa

SEQ ID NO: 685445 - DNA, 13 bp, C. elegans
aaaattccttttt

SEQ ID NO: 685446 - DNA, 13 bp, C. elegans
aaaattcgaaaat

SEQ ID NO: 685447 - DNA, 13 bp, C. elegans
aaaattcgaaaca

SEQ ID NO: 685448 - DNA, 13 bp, C. elegans
aaaattcgaactt

SEQ ID NO: 685449 - DNA, 13 bp, C. elegans
aaaattcgaagaa

SEQ ID NO: 685450 - DNA, 13 bp, C. elegans
aaaattcgaagca

SEQ ID NO: 685451 - DNA, 13 bp, C. elegans
aaaattcgaagtt

SEQ ID NO: 685452 - DNA, 13 bp, C. elegans
aaaattcgaattt

SEQ ID NO: 685453 - DNA, 13 bp, C. elegans
aaaattcgactac

SEQ ID NO: 685454 - DNA, 13 bp, C. elegans
aaaattcgagaaa

SEQ ID NO: 685455 - DNA, 13 bp, C. elegans
aaaattcgagttt

SEQ ID NO: 685456 - DNA, 13 bp, C. elegans
aaaattcgataaa

SEQ ID NO: 685457 - DNA, 13 bp, C. elegans
aaaattcgatcaa

SEQ ID NO: 685458 - DNA, 13 bp, C. elegans
aaaattcgattaa

SEQ ID NO: 685459 - DNA, 13 bp, C. elegans
aaaattcgattga

SEQ ID NO: 685460 - DNA, 13 bp, C. elegans
aaaattcgatttt

SEQ ID NO: 685461 - DNA, 13 bp, C. elegans
aaaattcgcaaaa

SEQ ID NO: 685462 - DNA, 13 bp, C. elegans
aaaattcgcaatt

SEQ ID NO: 685463 - DNA, 13 bp, C. elegans
aaaattcgcattt

SEQ ID NO: 685464 - DNA, 13 bp, C. elegans
aaaattcgccaaa

SEQ ID NO: 685465 - DNA, 13 bp, C. elegans
aaaattcgctaaa

SEQ ID NO: 685466 - DNA, 13 bp, C. elegans
aaaattcgctcaa

SEQ ID NO: 685467 - DNA, 13 bp, C. elegans
aaaattcgctgaa

SEQ ID NO: 685468 - DNA, 13 bp, C. elegans
aaaattcggaaaa

SEQ ID NO: 685469 - DNA, 13 bp, C. elegans
aaaattcggattt

SEQ ID NO: 685470 - DNA, 13 bp, C. elegans
aaaattcggtttc

SEQ ID NO: 685471 - DNA, 13 bp, C. elegans
aaaattcgtaaaa

SEQ ID NO: 685472 - DNA, 13 bp, C. elegans
aaaattcgtaatt

SEQ ID NO: 685473 - DNA, 13 bp, C. elegans
aaaattcgtattt

SEQ ID NO: 685474 - DNA, 13 bp, C. elegans
aaaattcgtccaa

SEQ ID NO: 685475 - DNA, 13 bp, C. elegans
aaaattcgttaaa

SEQ ID NO: 685476 - DNA, 13 bp, C. elegans
aaaattcgttttc

SEQ ID NO: 685477 - DNA, 13 bp, C. elegans
aaaattcgttttt

SEQ ID NO: 685478 - DNA, 13 bp, C. elegans
aaaattctacatt

SEQ ID NO: 685479 - DNA, 13 bp, C. elegans
aaaattctagaaa

SEQ ID NO: 685480 - DNA, 13 bp, C. elegans
aaaattctagaga

SEQ ID NO: 685481 - DNA, 13 bp, C. elegans
aaaattctcaatt

SEQ ID NO: 685482 - DNA, 13 bp, C. elegans
aaaattctcacat

SEQ ID NO: 685483 - DNA, 13 bp, C. elegans
aaaattctcagaa

SEQ ID NO: 685484 - DNA, 13 bp, C. elegans
aaaattctccaaa

SEQ ID NO: 685485 - DNA, 13 bp, C. elegans
aaaattctcgaat

SEQ ID NO: 685486 - DNA, 13 bp, C. elegans
aaaattctcgcat

SEQ ID NO: 685487 - DNA, 13 bp, C. elegans
aaaattctcggaa

SEQ ID NO: 685488 - DNA, 13 bp, C. elegans
aaaattctgaaaa

SEQ ID NO: 685489 - DNA, 13 bp, C. elegans
aaaattctgaatt

SEQ ID NO: 685490 - DNA, 13 bp, C. elegans
aaaattctgcaaa

SEQ ID NO: 685491 - DNA, 13 bp, C. elegans
aaaattctggaaa

SEQ ID NO: 685492 - DNA, 13 bp, C. elegans
aaaattctggaag

SEQ ID NO: 685493 - DNA, 13 bp, C. elegans
aaaattctgtaaa

SEQ ID NO: 685494 - DNA, 13 bp, C. elegans
aaaattcttaaca

SEQ ID NO: 685495 - DNA, 13 bp, C. elegans
aaaattcttacag

SEQ ID NO: 685496 - DNA, 13 bp, C. elegans
aaaattcttcaaa

SEQ ID NO: 685497 - DNA, 13 bp, C. elegans
aaaattcttccaa

SEQ ID NO: 685498 - DNA, 13 bp, C. elegans
aaaattcttccag

SEQ ID NO: 685499 - DNA, 13 bp, C. elegans
aaaattcttctat

SEQ ID NO: 685500 - DNA, 13 bp, C. elegans
aaaattcttgatt

SEQ ID NO: 685501 - DNA, 13 bp, C. elegans
aaaattctttcga

SEQ ID NO: 685502 - DNA, 13 bp, C. elegans
aaaattgaaaact

SEQ ID NO: 685503 - DNA, 13 bp, C. elegans
aaaattgaaaatc

SEQ ID NO: 685504 - DNA, 13 bp, C. elegans
aaaattgaaacat

SEQ ID NO: 685505 - DNA, 13 bp, C. elegans
aaaattgaaactt

SEQ ID NO: 685506 - DNA, 13 bp, C. elegans
aaaattgaaattc

SEQ ID NO: 685507 - DNA, 13 bp, C. elegans
aaaattgaaccgg

SEQ ID NO: 685508 - DNA, 13 bp, C. elegans
aaaattgaactaa

SEQ ID NO: 685509 - DNA, 13 bp, C. elegans
aaaattgaagctc

SEQ ID NO: 685510 - DNA, 13 bp, C. elegans
aaaattgaaggag

SEQ ID NO: 685511 - DNA, 13 bp, C. elegans
aaaattgaatctc

SEQ ID NO: 685512 - DNA, 13 bp, C. elegans
aaaattgaattga

SEQ ID NO: 685513 - DNA, 13 bp, C. elegans
aaaattgaatttg

SEQ ID NO: 685514 - DNA, 13 bp, C. elegans
aaaattgacaaac

SEQ ID NO: 685515 - DNA, 13 bp, C. elegans
aaaattgacaact

SEQ ID NO: 685516 - DNA, 13 bp, C. elegans
aaaattgacaatt

SEQ ID NO: 685517 - DNA, 13 bp, C. elegans
aaaattgacagaa

SEQ ID NO: 685518 - DNA, 13 bp, C. elegans
aaaattgaccaat

SEQ ID NO: 685519 - DNA, 13 bp, C. elegans
aaaattgacgaaa

SEQ ID NO: 685520 - DNA, 13 bp, C. elegans
aaaattgacttgt

SEQ ID NO: 685521 - DNA, 13 bp, C. elegans
aaaattgactttt

SEQ ID NO: 685522 - DNA, 13 bp, C. elegans
aaaattgagaatt

SEQ ID NO: 685523 - DNA, 13 bp, C. elegans
aaaattgagattt

SEQ ID NO: 685524 - DNA, 13 bp, C. elegans
aaaattgagcaaa

SEQ ID NO: 685525 - DNA, 13 bp, C. elegans
aaaattgagcttc

SEQ ID NO: 685526 - DNA, 13 bp, C. elegans
aaaattgagtatt

SEQ ID NO: 685527 - DNA, 13 bp, C. elegans
aaaattgagttat

SEQ ID NO: 685528 - DNA, 13 bp, C. elegans
aaaattgagtttt

SEQ ID NO: 685529 - DNA, 13 bp, C. elegans
aaaattgatggcc

SEQ ID NO: 685530 - DNA, 13 bp, C. elegans
aaaattgatgtca

SEQ ID NO: 685531 - DNA, 13 bp, C. elegans
aaaattgattgta

SEQ ID NO: 685532 - DNA, 13 bp, C. elegans
aaaattgatttca

SEQ ID NO: 685533 - DNA, 13 bp, C. elegans
aaaattgatttgt

SEQ ID NO: 685534 - DNA, 13 bp, C. elegans
aaaattgattttc

SEQ ID NO: 685535 - DNA, 13 bp, C. elegans
aaaattgcaaatg

SEQ ID NO: 685536 - DNA, 13 bp, C. elegans
aaaattgcaaatt

SEQ ID NO: 685537 - DNA, 13 bp, C. elegans
aaaattgcaactt

SEQ ID NO: 685538 - DNA, 13 bp, C. elegans
aaaattgcaagat

SEQ ID NO: 685539 - DNA, 13 bp, C. elegans
aaaattgcaataa

SEQ ID NO: 685540 - DNA, 13 bp, C. elegans
aaaattgcaatat

SEQ ID NO: 685541 - DNA, 13 bp, C. elegans
aaaattgcacaat

SEQ ID NO: 685542 - DNA, 13 bp, C. elegans
aaaattgcacgaa

SEQ ID NO: 685543 - DNA, 13 bp, C. elegans
aaaattgcagaaa

SEQ ID NO: 685544 - DNA, 13 bp, C. elegans
aaaattgcagctt

SEQ ID NO: 685545 - DNA, 13 bp, C. elegans
aaaattgcatctt

SEQ ID NO: 685546 - DNA, 13 bp, C. elegans
aaaattgcattga

SEQ ID NO: 685547 - DNA, 13 bp, C. elegans
aaaattgccaaaa

SEQ ID NO: 685548 - DNA, 13 bp, C. elegans
aaaattgccaaca

SEQ ID NO: 685549 - DNA, 13 bp, C. elegans
aaaattgccagaa

SEQ ID NO: 685550 - DNA, 14 bp, C. elegans
aaaattgccgaaat

SEQ ID NO: 685551 - DNA, 13 bp, C. elegans
aaaattgccgatt

SEQ ID NO: 685552 - DNA, 13 bp, C. elegans
aaaattgccggaa

SEQ ID NO: 685553 - DNA, 13 bp, C. elegans
aaaattgccggtt

SEQ ID NO: 685554 - DNA, 13 bp, C. elegans
aaaattgcgaaat

SEQ ID NO: 685555 - DNA, 13 bp, C. elegans
aaaattgcgattt

SEQ ID NO: 685556 - DNA, 13 bp, C. elegans
aaaattgcggcaa

SEQ ID NO: 685557 - DNA, 13 bp, C. elegans
aaaattgcgtcaa

SEQ ID NO: 685558 - DNA, 13 bp, C. elegans
aaaattgcgtgaa

SEQ ID NO: 685559 - DNA, 13 bp, C. elegans
aaaattgctaaaa

SEQ ID NO: 685560 - DNA, 13 bp, C. elegans
aaaattgctgaaa

SEQ ID NO: 685561 - DNA, 13 bp, C. elegans
aaaattgctggtt

SEQ ID NO: 685562 - DNA, 13 bp, C. elegans
aaaattgctttaa

SEQ ID NO: 685563 - DNA, 13 bp, C. elegans
aaaattgcttttt

SEQ ID NO: 685564 - DNA, 13 bp, C. elegans
aaaattggaaatt

SEQ ID NO: 685565 - DNA, 13 bp, C. elegans
aaaattggaacaa

SEQ ID NO: 685566 - DNA, 13 bp, C. elegans
aaaattggaactt

SEQ ID NO: 685567 - DNA, 13 bp, C. elegans
aaaattggaatac

SEQ ID NO: 685568 - DNA, 14 bp, C. elegans
aaaattggaattct

SEQ ID NO: 685569 - DNA, 13 bp, C. elegans
aaaattggaattt

SEQ ID NO: 685570 - DNA, 13 bp, C. elegans
aaaattggacaat

SEQ ID NO: 685571 - DNA, 13 bp, C. elegans
aaaattggaggaa

SEQ ID NO: 685572 - DNA, 13 bp, C. elegans
aaaattggattaa

SEQ ID NO: 685573 - DNA, 13 bp, C. elegans
aaaattggatttg

SEQ ID NO: 685574 - DNA, 13 bp, C. elegans
aaaattggatttt

SEQ ID NO: 685575 - DNA, 13 bp, C. elegans
aaaattggcaaaa

SEQ ID NO: 685576 - DNA, 13 bp, C. elegans
aaaattggcaaac

SEQ ID NO: 685577 - DNA, 13 bp, C. elegans
aaaattggcactt

SEQ ID NO: 685578 - DNA, 13 bp, C. elegans
aaaattggcctaa

SEQ ID NO: 685579 - DNA, 13 bp, C. elegans
aaaattggctcaa

SEQ ID NO: 685580 - DNA, 13 bp, C. elegans
aaaattgggaaat

SEQ ID NO: 685581 - DNA, 13 bp, C. elegans
aaaattgggaata

SEQ ID NO: 685582 - DNA, 13 bp, C. elegans
aaaattgggaatt

SEQ ID NO: 685583 - DNA, 13 bp, C. elegans
aaaattgggagaa

SEQ ID NO: 685584 - DNA, 13 bp, C. elegans
aaaattggggaaa

SEQ ID NO: 685585 - DNA, 13 bp, C. elegans
aaaattgggtttt

SEQ ID NO: 685586 - DNA, 13 bp, C. elegans
aaaattggtatta

SEQ ID NO: 685587 - DNA, 13 bp, C. elegans
aaaattggtgaaa

SEQ ID NO: 685588 - DNA, 13 bp, C. elegans
aaaattggtgcaa

SEQ ID NO: 685589 - DNA, 13 bp, C. elegans
aaaattggtggcc

SEQ ID NO: 685590 - DNA, 13 bp, C. elegans
aaaattggttcaa

SEQ ID NO: 685591 - DNA, 13 bp, C. elegans
aaaattggttgaa

SEQ ID NO: 685592 - DNA, 13 bp, C. elegans
aaaattggttgat

SEQ ID NO: 685593 - DNA, 13 bp, C. elegans
aaaattggttttt

SEQ ID NO: 685594 - DNA, 13 bp, C. elegans
aaaattgtaattc

SEQ ID NO: 685595 - DNA, 13 bp, C. elegans
aaaattgtacaaa

SEQ ID NO: 685596 - DNA, 14 bp, C. elegans
aaaattgtacaatt

SEQ ID NO: 685597 - DNA, 13 bp, C. elegans
aaaattgtacaca

SEQ ID NO: 685598 - DNA, 13 bp, C. elegans
aaaattgtatcat

SEQ ID NO: 685599 - DNA, 13 bp, C. elegans
aaaattgtatgtt

SEQ ID NO: 685600 - DNA, 13 bp, C. elegans
aaaattgtatttg

SEQ ID NO: 685601 - DNA, 13 bp, C. elegans
aaaattgtcaaaa

SEQ ID NO: 685602 - DNA, 13 bp, C. elegans
aaaattgtcacaa

SEQ ID NO: 685603 - DNA, 13 bp, C. elegans
aaaattgtcactt

SEQ ID NO: 685604 - DNA, 13 bp, C. elegans
aaaattgtcagaa

SEQ ID NO: 685605 - DNA, 13 bp, C. elegans
aaaattgtcattt

SEQ ID NO: 685606 - DNA, 13 bp, C. elegans
aaaattgtccaaa

SEQ ID NO: 685607 - DNA, 13 bp, C. elegans
aaaattgtccgaa

SEQ ID NO: 685608 - DNA, 13 bp, C. elegans
aaaattgtcgttt

SEQ ID NO: 685609 - DNA, 13 bp, C. elegans
aaaattgtcttaa

SEQ ID NO: 685610 - DNA, 13 bp, C. elegans
aaaattgtgaaca

SEQ ID NO: 685611 - DNA, 13 bp, C. elegans
aaaattgtgaact

SEQ ID NO: 685612 - DNA, 13 bp, C. elegans
aaaattgtgaagt

SEQ ID NO: 685613 - DNA, 13 bp, C. elegans
aaaattgtgaatt

SEQ ID NO: 685614 - DNA, 13 bp, C. elegans
aaaattgtgacaa

SEQ ID NO: 685615 - DNA, 13 bp, C. elegans
aaaattgtgcaat

SEQ ID NO: 685616 - DNA, 13 bp, C. elegans
aaaattgtgcatt

SEQ ID NO: 685617 - DNA, 13 bp, C. elegans
aaaattgtgcctt

SEQ ID NO: 685618 - DNA, 13 bp, C. elegans
aaaattgtggaaa

SEQ ID NO: 685619 - DNA, 13 bp, C. elegans
aaaattgtggaat

SEQ ID NO: 685620 - DNA, 13 bp, C. elegans
aaaattgtggaga

SEQ ID NO: 685621 - DNA, 13 bp, C. elegans
aaaattgtgtatt

SEQ ID NO: 685622 - DNA, 13 bp, C. elegans
aaaattgtgtcaa

SEQ ID NO: 685623 - DNA, 13 bp, C. elegans
aaaattgtgtttc

SEQ ID NO: 685624 - DNA, 13 bp, C. elegans
aaaattgtgtttt

SEQ ID NO: 685625 - DNA, 13 bp, C. elegans
aaaattgttacag

SEQ ID NO: 685626 - DNA, 13 bp, C. elegans
aaaattgttactt

SEQ ID NO: 685627 - DNA, 13 bp, C. elegans
aaaattgttagaa

SEQ ID NO: 685628 - DNA, 13 bp, C. elegans
aaaattgttcaac

SEQ ID NO: 685629 - DNA, 13 bp, C. elegans
aaaattgttcact

SEQ ID NO: 685630 - DNA, 13 bp, C. elegans
aaaattgttcaga

SEQ ID NO: 685631 - DNA, 13 bp, C. elegans
aaaattgttcatt

SEQ ID NO: 685632 - DNA, 13 bp, C. elegans
aaaattgttctat

SEQ ID NO: 685633 - DNA, 13 bp, C. elegans
aaaattgttgaat

SEQ ID NO: 685634 - DNA, 13 bp, C. elegans
aaaattgttgctc

SEQ ID NO: 685635 - DNA, 13 bp, C. elegans
aaaattgttgctt

SEQ ID NO: 685636 - DNA, 13 bp, C. elegans
aaaattgttggca

SEQ ID NO: 685637 - DNA, 13 bp, C. elegans
aaaattgtttact

SEQ ID NO: 685638 - DNA, 13 bp, C. elegans
aaaattgtttcag

SEQ ID NO: 685639 - DNA, 13 bp, C. elegans
aaaattgtttcat

SEQ ID NO: 685640 - DNA, 13 bp, C. elegans
aaaattgtttctt

SEQ ID NO: 685641 - DNA, 13 bp, C. elegans
aaaattgtttgaa

SEQ ID NO: 685642 - DNA, 13 bp, C. elegans
aaaattgttttca

SEQ ID NO: 685643 - DNA, 14 bp, C. elegans
aaaattgtttttca

SEQ ID NO: 685644 - DNA, 13 bp, C. elegans
aaaatttaacagt

SEQ ID NO: 685645 - DNA, 13 bp, C. elegans
aaaatttaatcac

SEQ ID NO: 685646 - DNA, 13 bp, C. elegans
aaaatttacagat

SEQ ID NO: 685647 - DNA, 13 bp, C. elegans
aaaatttactgaa

SEQ ID NO: 685648 - DNA, 13 bp, C. elegans
aaaatttactgtt

SEQ ID NO: 685649 - DNA, 13 bp, C. elegans
aaaatttagcttt

SEQ ID NO: 685650 - DNA, 13 bp, C. elegans
aaaatttagtgat

SEQ ID NO: 685651 - DNA, 13 bp, C. elegans
aaaatttagtgtt

SEQ ID NO: 685652 - DNA, 13 bp, C. elegans
aaaatttatcgga

SEQ ID NO: 685653 - DNA, 13 bp, C. elegans
aaaatttattgac

SEQ ID NO: 685654 - DNA, 13 bp, C. elegans
aaaatttcaaatc

SEQ ID NO: 685655 - DNA, 13 bp, C. elegans
aaaatttcaagat

SEQ ID NO: 685656 - DNA, 13 bp, C. elegans
aaaatttcaatgt

SEQ ID NO: 685657 - DNA, 13 bp, C. elegans
aaaatttcaattc

SEQ ID NO: 685658 - DNA, 13 bp, C. elegans
aaaatttcacgaa

SEQ ID NO: 685659 - DNA, 13 bp, C. elegans
aaaatttcacttc

SEQ ID NO: 685660 - DNA, 13 bp, C. elegans
aaaatttcacttt

SEQ ID NO: 685661 - DNA, 13 bp, C. elegans
aaaatttcagacc

SEQ ID NO: 685662 - DNA, 13 bp, C. elegans
aaaatttcagaga

SEQ ID NO: 685663 - DNA, 16 bp, C. elegans
aaaatttcagattttt

SEQ ID NO: 685664 - DNA, 13 bp, C. elegans
aaaatttcagtct

SEQ ID NO: 685665 - DNA, 13 bp, C. elegans
aaaatttcatagt

SEQ ID NO: 685666 - DNA, 13 bp, C. elegans
aaaatttccaagt

SEQ ID NO: 685667 - DNA, 13 bp, C. elegans
aaaatttccacag

SEQ ID NO: 685668 - DNA, 13 bp, C. elegans
aaaatttccagtc

SEQ ID NO: 685669 - DNA, 13 bp, C. elegans
aaaatttccgaaa

SEQ ID NO: 685670 - DNA, 13 bp, C. elegans
aaaatttcctaca

SEQ ID NO: 685671 - DNA, 13 bp, C. elegans
aaaatttcgaaac

SEQ ID NO: 685672 - DNA, 13 bp, C. elegans
aaaatttcgaatt

SEQ ID NO: 685673 - DNA, 13 bp, C. elegans
aaaatttcgagaa

SEQ ID NO: 685674 - DNA, 13 bp, C. elegans
aaaatttcgatca

SEQ ID NO: 685675 - DNA, 13 bp, C. elegans
aaaatttcggaaa

SEQ ID NO: 685676 - DNA, 13 bp, C. elegans
aaaatttcggcgg

SEQ ID NO: 685677 - DNA, 13 bp, C. elegans
aaaatttcggtaa

SEQ ID NO: 685678 - DNA, 14 bp, C. elegans
aaaatttcgttttt

SEQ ID NO: 685679 - DNA, 13 bp, C. elegans
aaaatttctagaa

SEQ ID NO: 685680 - DNA, 13 bp, C. elegans
aaaatttctagga

SEQ ID NO: 685681 - DNA, 13 bp, C. elegans
aaaatttctattc

SEQ ID NO: 685682 - DNA, 13 bp, C. elegans
aaaatttctcaaa

SEQ ID NO: 685683 - DNA, 13 bp, C. elegans
aaaatttctcaac

SEQ ID NO: 685684 - DNA, 13 bp, C. elegans
aaaatttctgcaa

SEQ ID NO: 685685 - DNA, 13 bp, C. elegans
aaaatttctgcca

SEQ ID NO: 685686 - DNA, 13 bp, C. elegans
aaaatttctggaa

SEQ ID NO: 685687 - DNA, 13 bp, C. elegans
aaaatttctgtgt

SEQ ID NO: 685688 - DNA, 13 bp, C. elegans
aaaatttcttgat

SEQ ID NO: 685689 - DNA, 13 bp, C. elegans
aaaatttgaaaac

SEQ ID NO: 685690 - DNA, 13 bp, C. elegans
aaaatttgaaaca

SEQ ID NO: 685691 - DNA, 13 bp, C. elegans
aaaatttgaaatg

SEQ ID NO: 685692 - DNA, 13 bp, C. elegans
aaaatttgaactt

SEQ ID NO: 685693 - DNA, 13 bp, C. elegans
aaaatttgacagt

SEQ ID NO: 685694 - DNA, 13 bp, C. elegans
aaaatttgaggtt

SEQ ID NO: 685695 - DNA, 13 bp, C. elegans
aaaatttgagtat

SEQ ID NO: 685696 - DNA, 13 bp, C. elegans
aaaatttgagttt

SEQ ID NO: 685697 - DNA, 13 bp, C. elegans
aaaatttgatgct

SEQ ID NO: 685698 - DNA, 13 bp, C. elegans
aaaatttgcaaaa

SEQ ID NO: 685699 - DNA, 13 bp, C. elegans
aaaatttgcaaat

SEQ ID NO: 685700 - DNA, 13 bp, C. elegans
aaaatttgcagaa

SEQ ID NO: 685701 - DNA, 13 bp, C. elegans
aaaatttgcataa

SEQ ID NO: 685702 - DNA, 13 bp, C. elegans
aaaatttgcattt

SEQ ID NO: 685703 - DNA, 13 bp, C. elegans
aaaatttgccaaa

SEQ ID NO: 685704 - DNA, 13 bp, C. elegans
aaaatttgccatt

SEQ ID NO: 685705 - DNA, 13 bp, C. elegans
aaaatttgccgaa

SEQ ID NO: 685706 - DNA, 13 bp, C. elegans
aaaatttgccgca

SEQ ID NO: 685707 - DNA, 13 bp, C. elegans
aaaatttgcgaaa

SEQ ID NO: 685708 - DNA, 13 bp, C. elegans
aaaatttgcgatt

SEQ ID NO: 685709 - DNA, 13 bp, C. elegans
aaaatttgcggaa

SEQ ID NO: 685710 - DNA, 13 bp, C. elegans
aaaatttgcgttt

SEQ ID NO: 685711 - DNA, 13 bp, C. elegans
aaaatttgctaaa

SEQ ID NO: 685712 - DNA, 13 bp, C. elegans
aaaatttgctcga

SEQ ID NO: 685713 - DNA, 13 bp, C. elegans
aaaatttgctgtt

SEQ ID NO: 685714 - DNA, 13 bp, C. elegans
aaaatttgctttt

SEQ ID NO: 685715 - DNA, 13 bp, C. elegans
aaaatttggaaat

SEQ ID NO: 685716 - DNA, 13 bp, C. elegans
aaaatttggaatt

SEQ ID NO: 685717 - DNA, 13 bp, C. elegans
aaaatttggagtt

SEQ ID NO: 685718 - DNA, 13 bp, C. elegans
aaaatttggatgg

SEQ ID NO: 685719 - DNA, 13 bp, C. elegans
aaaatttggattt

SEQ ID NO: 685720 - DNA, 13 bp, C. elegans
aaaatttggcaaa

SEQ ID NO: 685721 - DNA, 13 bp, C. elegans
aaaatttggcact

SEQ ID NO: 685722 - DNA, 13 bp, C. elegans
aaaatttgggaaa

SEQ ID NO: 685723 - DNA, 13 bp, C. elegans
aaaatttgggaat

SEQ ID NO: 685724 - DNA, 13 bp, C. elegans
aaaatttgggcag

SEQ ID NO: 685725 - DNA, 13 bp, C. elegans
aaaatttgggtct

SEQ ID NO: 685726 - DNA, 13 bp, C. elegans
aaaatttggtcaa

SEQ ID NO: 685727 - DNA, 13 bp, C. elegans
aaaatttggtgat

SEQ ID NO: 685728 - DNA, 13 bp, C. elegans
aaaatttggttga

SEQ ID NO: 685729 - DNA, 13 bp, C. elegans
aaaatttggttta

SEQ ID NO: 685730 - DNA, 13 bp, C. elegans
aaaatttggtttt

SEQ ID NO: 685731 - DNA, 13 bp, C. elegans
aaaatttgtcaaa

SEQ ID NO: 685732 - DNA, 13 bp, C. elegans
aaaatttgtcttt

SEQ ID NO: 685733 - DNA, 13 bp, C. elegans
aaaatttgtgaat

SEQ ID NO: 685734 - DNA, 13 bp, C. elegans
aaaatttgtgatg

SEQ ID NO: 685735 - DNA, 13 bp, C. elegans
aaaatttgtgcaa

SEQ ID NO: 685736 - DNA, 13 bp, C. elegans
aaaatttgtgttt

SEQ ID NO: 685737 - DNA, 13 bp, C. elegans
aaaatttgttcaa

SEQ ID NO: 685738 - DNA, 13 bp, C. elegans
aaaatttgttttc

SEQ ID NO: 685739 - DNA, 13 bp, C. elegans
aaaattttaagcg

SEQ ID NO: 685740 - DNA, 13 bp, C. elegans
aaaattttacaca

SEQ ID NO: 685741 - DNA, 13 bp, C. elegans
aaaattttacgca

SEQ ID NO: 685742 - DNA, 13 bp, C. elegans
aaaattttagctg

SEQ ID NO: 685743 - DNA, 13 bp, C. elegans
aaaattttcaaag

SEQ ID NO: 685744 - DNA, 13 bp, C. elegans
aaaattttcaact

SEQ ID NO: 685745 - DNA, 13 bp, C. elegans
aaaattttcacaa

SEQ ID NO: 685746 - DNA, 13 bp, C. elegans
aaaattttcagac

SEQ ID NO: 685747 - DNA, 13 bp, C. elegans
aaaattttcagat

SEQ ID NO: 685748 - DNA, 13 bp, C. elegans
aaaattttccaaa

SEQ ID NO: 685749 - DNA, 13 bp, C. elegans
aaaattttccact

SEQ ID NO: 685750 - DNA, 13 bp, C. elegans
aaaattttcccgt

SEQ ID NO: 685751 - DNA, 13 bp, C. elegans
aaaattttccttg

SEQ ID NO: 685752 - DNA, 13 bp, C. elegans
aaaattttcgaat

SEQ ID NO: 685753 - DNA, 13 bp, C. elegans
aaaattttcgatt

SEQ ID NO: 685754 - DNA, 13 bp, C. elegans
aaaattttcggaa

SEQ ID NO: 685755 - DNA, 13 bp, C. elegans
aaaattttcggca

SEQ ID NO: 685756 - DNA, 13 bp, C. elegans
aaaattttctcga

SEQ ID NO: 685757 - DNA, 13 bp, C. elegans
aaaattttctctg

SEQ ID NO: 685758 - DNA, 13 bp, C. elegans
aaaattttgaact

SEQ ID NO: 685759 - DNA, 13 bp, C. elegans
aaaattttgaccc

SEQ ID NO: 685760 - DNA, 13 bp, C. elegans
aaaattttgcaaa

SEQ ID NO: 685761 - DNA, 13 bp, C. elegans
aaaattttgccga

SEQ ID NO: 685762 - DNA, 13 bp, C. elegans
aaaattttggaag

SEQ ID NO: 685763 - DNA, 13 bp, C. elegans
aaaattttggaat

SEQ ID NO: 685764 - DNA, 13 bp, C. elegans
aaaattttggaga

SEQ ID NO: 685765 - DNA, 14 bp, C. elegans
aaaattttggagca

SEQ ID NO: 685766 - DNA, 13 bp, C. elegans
aaaattttggttt

SEQ ID NO: 685767 - DNA, 13 bp, C. elegans
aaaattttgtgaa

SEQ ID NO: 685768 - DNA, 13 bp, C. elegans
aaaattttgtgac

SEQ ID NO: 685769 - DNA, 13 bp, C. elegans
aaaatttttcaca

SEQ ID NO: 685770 - DNA, 13 bp, C. elegans
aaaatttttcaga

SEQ ID NO: 685771 - DNA, 13 bp, C. elegans
aaaatttttcagg

SEQ ID NO: 685772 - DNA, 13 bp, C. elegans
aaaatttttcccc

SEQ ID NO: 685773 - DNA, 13 bp, C. elegans
aaaatttttccgc

SEQ ID NO: 685774 - DNA, 13 bp, C. elegans
aaaatttttcgaa

SEQ ID NO: 685775 - DNA, 13 bp, C. elegans
aaaatttttctca

SEQ ID NO: 685776 - DNA, 13 bp, C. elegans
aaaatttttctga

SEQ ID NO: 685777 - DNA, 13 bp, C. elegans
aaaatttttgaag

SEQ ID NO: 685778 - DNA, 13 bp, C. elegans
aaaatttttgcag

SEQ ID NO: 685779 - DNA, 13 bp, C. elegans
aaaatttttgcat

SEQ ID NO: 685780 - DNA, 13 bp, C. elegans
aaaatttttggaa

SEQ ID NO: 685781 - DNA, 13 bp, C. elegans
aaaatttttggtt

SEQ ID NO: 685782 - DNA, 13 bp, C. elegans
aaaatttttgtgt

SEQ ID NO: 685783 - DNA, 13 bp, C. elegans
aaaattttttcca

SEQ ID NO: 685784 - DNA, 13 bp, C. elegans
aaaattttttgtc

SEQ ID NO: 685785 - DNA, 13 bp, C. elegans
aaaattttttgtg

SEQ ID NO: 685786 - DNA, 13 bp, C. elegans
aaaatttttttgg

SEQ ID NO: 685787 - DNA, 13 bp, C. elegans
aaacaaaaagttt

SEQ ID NO: 685788 - DNA, 13 bp, C. elegans
aaacaaaaatgtt

SEQ ID NO: 685789 - DNA, 13 bp, C. elegans
aaacaaaaattcg

SEQ ID NO: 685790 - DNA, 13 bp, C. elegans
aaacaaaacgtta

SEQ ID NO: 685791 - DNA, 13 bp, C. elegans
aaacaaaactagt

SEQ ID NO: 685792 - DNA, 13 bp, C. elegans
aaacaaaagcatt

SEQ ID NO: 685793 - DNA, 13 bp, C. elegans
aaacaaaagtgta

SEQ ID NO: 685794 - DNA, 13 bp, C. elegans
aaacaaaatgttt

SEQ ID NO: 685795 - DNA, 13 bp, C. elegans
aaacaaaatttga

SEQ ID NO: 685796 - DNA, 13 bp, C. elegans
aaacaaaatttgt

SEQ ID NO: 685797 - DNA, 13 bp, C. elegans
aaacaaaattttc

SEQ ID NO: 685798 - DNA, 13 bp, C. elegans
aaacaaacatttt

SEQ ID NO: 685799 - DNA, 13 bp, C. elegans
aaacaaacgaatt

SEQ ID NO: 685800 - DNA, 13 bp, C. elegans
aaacaaactttca

SEQ ID NO: 685801 - DNA, 13 bp, C. elegans
aaacaaacttttt

SEQ ID NO: 685802 - DNA, 13 bp, C. elegans
aaacaaagatatt

SEQ ID NO: 685803 - DNA, 13 bp, C. elegans
aaacaaagctgaa

SEQ ID NO: 685804 - DNA, 13 bp, C. elegans
aaacaaagttgtt

SEQ ID NO: 685805 - DNA, 13 bp, C. elegans
aaacaaatagttt

SEQ ID NO: 685806 - DNA, 13 bp, C. elegans
aaacaaatcattg

SEQ ID NO: 685807 - DNA, 13 bp, C. elegans
aaacaaatctgaa

SEQ ID NO: 685808 - DNA, 13 bp, C. elegans
aaacaaatggaac

SEQ ID NO: 685809 - DNA, 13 bp, C. elegans
aaacaaatgttca

SEQ ID NO: 685810 - DNA, 13 bp, C. elegans
aaacaaatgtttc

SEQ ID NO: 685811 - DNA, 13 bp, C. elegans
aaacaaattccat

SEQ ID NO: 685812 - DNA, 13 bp, C. elegans
aaacaaattggaa

SEQ ID NO: 685813 - DNA, 13 bp, C. elegans
aaacaaattgttg

SEQ ID NO: 685814 - DNA, 13 bp, C. elegans
aaacaaatttctt

SEQ ID NO: 685815 - DNA, 13 bp, C. elegans
aaacaaatttgaa

SEQ ID NO: 685816 - DNA, 13 bp, C. elegans
aaacaaatttgtt

SEQ ID NO: 685817 - DNA, 13 bp, C. elegans
aaacaaattttac

SEQ ID NO: 685818 - DNA, 13 bp, C. elegans
aaacaaattttca

SEQ ID NO: 685819 - DNA, 13 bp, C. elegans
aaacaacaacttt

SEQ ID NO: 685820 - DNA, 13 bp, C. elegans
aaacaacaagttt

SEQ ID NO: 685821 - DNA, 13 bp, C. elegans
aaacaacaattga

SEQ ID NO: 685822 - DNA, 13 bp, C. elegans
aaacaacaatttc

SEQ ID NO: 685823 - DNA, 13 bp, C. elegans
aaacaacaatttg

SEQ ID NO: 685824 - DNA, 13 bp, C. elegans
aaacaacaatttt

SEQ ID NO: 685825 - DNA, 13 bp, C. elegans
aaacaacagtttt

SEQ ID NO: 685826 - DNA, 13 bp, C. elegans
aaacaacatttca

SEQ ID NO: 685827 - DNA, 13 bp, C. elegans
aaacaacatttct

SEQ ID NO: 685828 - DNA, 13 bp, C. elegans
aaacaacattttg

SEQ ID NO: 685829 - DNA, 13 bp, C. elegans
aaacaacattttt

SEQ ID NO: 685830 - DNA, 13 bp, C. elegans
aaacaacggaaat

SEQ ID NO: 685831 - DNA, 13 bp, C. elegans
aaacaactattta

SEQ ID NO: 685832 - DNA, 13 bp, C. elegans
aaacaactcgaaa

SEQ ID NO: 685833 - DNA, 13 bp, C. elegans
aaacaactgaaag

SEQ ID NO: 685834 - DNA, 13 bp, C. elegans
aaacaactgaaat

SEQ ID NO: 685835 - DNA, 13 bp, C. elegans
aaacaactgaata

SEQ ID NO: 685836 - DNA, 13 bp, C. elegans
aaacaactggaaa

SEQ ID NO: 685837 - DNA, 13 bp, C. elegans
aaacaactggttt

SEQ ID NO: 685838 - DNA, 13 bp, C. elegans
aaacaacttctaa

SEQ ID NO: 685839 - DNA, 13 bp, C. elegans
aaacaacttgaaa

SEQ ID NO: 685840 - DNA, 13 bp, C. elegans
aaacaactttctt

SEQ ID NO: 685841 - DNA, 13 bp, C. elegans
aaacaactttggt

SEQ ID NO: 685842 - DNA, 13 bp, C. elegans
aaacaactttgtt

SEQ ID NO: 685843 - DNA, 13 bp, C. elegans
aaacaactttttt

SEQ ID NO: 685844 - DNA, 13 bp, C. elegans
aaacaagaaactg

SEQ ID NO: 685845 - DNA, 13 bp, C. elegans
aaacaagaaagtt

SEQ ID NO: 685846 - DNA, 13 bp, C. elegans
aaacaagaaatgt

SEQ ID NO: 685847 - DNA, 13 bp, C. elegans
aaacaagaaattg

SEQ ID NO: 685848 - DNA, 13 bp, C. elegans
aaacaagaaattt

SEQ ID NO: 685849 - DNA, 13 bp, C. elegans
aaacaagaacatt

SEQ ID NO: 685850 - DNA, 13 bp, C. elegans
aaacaagaattat

SEQ ID NO: 685851 - DNA, 13 bp, C. elegans
aaacaagatattt

SEQ ID NO: 685852 - DNA, 13 bp, C. elegans
aaacaagttaaat

SEQ ID NO: 685853 - DNA, 13 bp, C. elegans
aaacaagttgaat

SEQ ID NO: 685854 - DNA, 13 bp, C. elegans
aaacaagttgatt

SEQ ID NO: 685855 - DNA, 15 bp, C. elegans
aaacaagttttggcc

SEQ ID NO: 685856 - DNA, 13 bp, C. elegans
aaacaataatgga

SEQ ID NO: 685857 - DNA, 13 bp, C. elegans
aaacaataatttg

SEQ ID NO: 685858 - DNA, 13 bp, C. elegans
aaacaatactttt

SEQ ID NO: 685859 - DNA, 13 bp, C. elegans
aaacaatatgttt

SEQ ID NO: 685860 - DNA, 13 bp, C. elegans
aaacaatattctt

SEQ ID NO: 685861 - DNA, 13 bp, C. elegans
aaacaatcagttt

SEQ ID NO: 685862 - DNA, 13 bp, C. elegans
aaacaatctgaaa

SEQ ID NO: 685863 - DNA, 13 bp, C. elegans
aaacaatctggaa

SEQ ID NO: 685864 - DNA, 13 bp, C. elegans
aaacaatcttttt

SEQ ID NO: 685865 - DNA, 13 bp, C. elegans
aaacaatgatgat

SEQ ID NO: 685866 - DNA, 13 bp, C. elegans
aaacaatgttttt

SEQ ID NO: 685867 - DNA, 13 bp, C. elegans
aaacaattatgaa

SEQ ID NO: 685868 - DNA, 13 bp, C. elegans
aaacaattattgt

SEQ ID NO: 685869 - DNA, 13 bp, C. elegans
aaacaattcaatt

SEQ ID NO: 685870 - DNA, 13 bp, C. elegans
aaacaattccatt

SEQ ID NO: 685871 - DNA, 13 bp, C. elegans
aaacaattcgaaa

SEQ ID NO: 685872 - DNA, 13 bp, C. elegans
aaacaattctaca

SEQ ID NO: 685873 - DNA, 13 bp, C. elegans
aaacaattctcaa

SEQ ID NO: 685874 - DNA, 13 bp, C. elegans
aaacaattctgat

SEQ ID NO: 685875 - DNA, 13 bp, C. elegans
aaacaattgaaga

SEQ ID NO: 685876 - DNA, 13 bp, C. elegans
aaacaattgaata

SEQ ID NO: 685877 - DNA, 13 bp, C. elegans
aaacaattgacaa

SEQ ID NO: 685878 - DNA, 13 bp, C. elegans
aaacaattgattt

SEQ ID NO: 685879 - DNA, 13 bp, C. elegans
aaacaattgtaat

SEQ ID NO: 685880 - DNA, 13 bp, C. elegans
aaacaatttatcg

SEQ ID NO: 685881 - DNA, 13 bp, C. elegans
aaacaatttatga

SEQ ID NO: 685882 - DNA, 13 bp, C. elegans
aaacaatttcgca

SEQ ID NO: 685883 - DNA, 13 bp, C. elegans
aaacaatttctaa

SEQ ID NO: 685884 - DNA, 13 bp, C. elegans
aaacaatttctag

SEQ ID NO: 685885 - DNA, 13 bp, C. elegans
aaacaatttctga

SEQ ID NO: 685886 - DNA, 13 bp, C. elegans
aaacaatttctgt

SEQ ID NO: 685887 - DNA, 13 bp, C. elegans
aaacaatttgaaa

SEQ ID NO: 685888 - DNA, 13 bp, C. elegans
aaacaatttgaat

SEQ ID NO: 685889 - DNA, 13 bp, C. elegans
aaacaatttgtaa

SEQ ID NO: 685890 - DNA, 13 bp, C. elegans
aaacaattttaga

SEQ ID NO: 685891 - DNA, 13 bp, C. elegans
aaacaattttagg

SEQ ID NO: 685892 - DNA, 13 bp, C. elegans
aaacaattttcag

SEQ ID NO: 685893 - DNA, 13 bp, C. elegans
aaacaattttcgt

SEQ ID NO: 685894 - DNA, 13 bp, C. elegans
aaacaattttcta

SEQ ID NO: 685895 - DNA, 13 bp, C. elegans
aaacaattttctt

SEQ ID NO: 685896 - DNA, 13 bp, C. elegans
aaacaattttgat

SEQ ID NO: 685897 - DNA, 13 bp, C. elegans
aaacaattttgga

SEQ ID NO: 685898 - DNA, 13 bp, C. elegans
aaacaattttggc

SEQ ID NO: 685899 - DNA, 13 bp, C. elegans
aaacaattttgtt

SEQ ID NO: 685900 - DNA, 13 bp, C. elegans
aaacaatttttag

SEQ ID NO: 685901 - DNA, 13 bp, C. elegans
aaacaatttttga

SEQ ID NO: 685902 - DNA, 13 bp, C. elegans
aaacaatttttgt

SEQ ID NO: 685903 - DNA, 13 bp, C. elegans
aaacaattttttg

SEQ ID NO: 685904 - DNA, 13 bp, C. elegans
aaacacaattatt

SEQ ID NO: 685905 - DNA, 13 bp, C. elegans
aaacacaatttga

SEQ ID NO: 685906 - DNA, 13 bp, C. elegans
aaacacacaattt

SEQ ID NO: 685907 - DNA, 13 bp, C. elegans
aaacacactttca

SEQ ID NO: 685908 - DNA, 13 bp, C. elegans
aaacacagaattt

SEQ ID NO: 685909 - DNA, 13 bp, C. elegans
aaacacatatatt

SEQ ID NO: 685910 - DNA, 13 bp, C. elegans
aaacacatttctt

SEQ ID NO: 685911 - DNA, 13 bp, C. elegans
aaacacattttat

SEQ ID NO: 685912 - DNA, 13 bp, C. elegans
aaacaccattttt

SEQ ID NO: 685913 - DNA, 13 bp, C. elegans
aaacaccgaatct

SEQ ID NO: 685914 - DNA, 13 bp, C. elegans
aaacaccgaattt

SEQ ID NO: 685915 - DNA, 13 bp, C. elegans
aaacaccgatttt

SEQ ID NO: 685916 - DNA, 13 bp, C. elegans
aaacacgatttca

SEQ ID NO: 685917 - DNA, 13 bp, C. elegans
aaacacgattttt

SEQ ID NO: 685918 - DNA, 13 bp, C. elegans
aaacacgcggaaa

SEQ ID NO: 685919 - DNA, 13 bp, C. elegans
aaacacgtttttc

SEQ ID NO: 685920 - DNA, 13 bp, C. elegans
aaacactagaatt

SEQ ID NO: 685921 - DNA, 13 bp, C. elegans
aaacactctgaaa

SEQ ID NO: 685922 - DNA, 13 bp, C. elegans
aaacactgcaaaa

SEQ ID NO: 685923 - DNA, 13 bp, C. elegans
aaacacttcaatt

SEQ ID NO: 685924 - DNA, 13 bp, C. elegans
aaacactttaaat

SEQ ID NO: 685925 - DNA, 13 bp, C. elegans
aaacactttcaat

SEQ ID NO: 685926 - DNA, 13 bp, C. elegans
aaacactttccaa

SEQ ID NO: 685927 - DNA, 13 bp, C. elegans
aaacactttcttt

SEQ ID NO: 685928 - DNA, 13 bp, C. elegans
aaacactttttct

SEQ ID NO: 685929 - DNA, 13 bp, C. elegans
aaacactttttga

SEQ ID NO: 685930 - DNA, 13 bp, C. elegans
aaacagaaaagtt

SEQ ID NO: 685931 - DNA, 13 bp, C. elegans
aaacagaaaatgg

SEQ ID NO: 685932 - DNA, 13 bp, C. elegans
aaacagaaaattg

SEQ ID NO: 685933 - DNA, 13 bp, C. elegans
aaacagaaactat

SEQ ID NO: 685934 - DNA, 13 bp, C. elegans
aaacagaaatatt

SEQ ID NO: 685935 - DNA, 13 bp, C. elegans
aaacagaatttga

SEQ ID NO: 685936 - DNA, 13 bp, C. elegans
aaacagaattttc

SEQ ID NO: 685937 - DNA, 13 bp, C. elegans
aaacagacttttt

SEQ ID NO: 685938 - DNA, 13 bp, C. elegans
aaacagagatttt

SEQ ID NO: 685939 - DNA, 13 bp, C. elegans
aaacagatatttt

SEQ ID NO: 685940 - DNA, 13 bp, C. elegans
aaacagattttac

SEQ ID NO: 685941 - DNA, 13 bp, C. elegans
aaacagatttttt

SEQ ID NO: 685942 - DNA, 13 bp, C. elegans
aaacagcaaattt

SEQ ID NO: 685943 - DNA, 13 bp, C. elegans
aaacagctatatc

SEQ ID NO: 685944 - DNA, 13 bp, C. elegans
aaacagctcaaaa

SEQ ID NO: 685945 - DNA, 13 bp, C. elegans
aaacagctgaaat

SEQ ID NO: 685946 - DNA, 13 bp, C. elegans
aaacaggagaaat

SEQ ID NO: 685947 - DNA, 13 bp, C. elegans
aaacagggatttt

SEQ ID NO: 685948 - DNA, 13 bp, C. elegans
aaacaggtttcaa

SEQ ID NO: 685949 - DNA, 13 bp, C. elegans
aaacagtaacttt

SEQ ID NO: 685950 - DNA, 13 bp, C. elegans
aaacagtaattgt

SEQ ID NO: 685951 - DNA, 13 bp, C. elegans
aaacagtaatttt

SEQ ID NO: 685952 - DNA, 13 bp, C. elegans
aaacagtactttt

SEQ ID NO: 685953 - DNA, 13 bp, C. elegans
aaacagtagattt

SEQ ID NO: 685954 - DNA, 13 bp, C. elegans
aaacagtatcaaa

SEQ ID NO: 685955 - DNA, 13 bp, C. elegans
aaacagtattttt

SEQ ID NO: 685956 - DNA, 13 bp, C. elegans
aaacagtcatttt

SEQ ID NO: 685957 - DNA, 13 bp, C. elegans
aaacagtgaaaac

SEQ ID NO: 685958 - DNA, 13 bp, C. elegans
aaacagtgaagtt

SEQ ID NO: 685959 - DNA, 13 bp, C. elegans
aaacagtgatatt

SEQ ID NO: 685960 - DNA, 13 bp, C. elegans
aaacagtgatttt

SEQ ID NO: 685961 - DNA, 13 bp, C. elegans
aaacagtggaaaa

SEQ ID NO: 685962 - DNA, 13 bp, C. elegans
aaacagtggaatt

SEQ ID NO: 685963 - DNA, 13 bp, C. elegans
aaacagttatttt

SEQ ID NO: 685964 - DNA, 13 bp, C. elegans
aaacagttccaat

SEQ ID NO: 685965 - DNA, 13 bp, C. elegans
aaacagttgaaaa

SEQ ID NO: 685966 - DNA, 13 bp, C. elegans
aaacagttgaaac

SEQ ID NO: 685967 - DNA, 13 bp, C. elegans
aaacagtttaaaa

SEQ ID NO: 685968 - DNA, 13 bp, C. elegans
aaacagtttcaat

SEQ ID NO: 685969 - DNA, 13 bp, C. elegans
aaacagtttccaa

SEQ ID NO: 685970 - DNA, 13 bp, C. elegans
aaacagtttgaat

SEQ ID NO: 685971 - DNA, 13 bp, C. elegans
aaacagttttcaa

SEQ ID NO: 685972 - DNA, 13 bp, C. elegans
aaacagttttgat

SEQ ID NO: 685973 - DNA, 13 bp, C. elegans
aaacagtttttat

SEQ ID NO: 685974 - DNA, 13 bp, C. elegans
aaacagtttttgt

SEQ ID NO: 685975 - DNA, 13 bp, C. elegans
aaacagttttttg

SEQ ID NO: 685976 - DNA, 13 bp, C. elegans
aaacataaaagtt

SEQ ID NO: 685977 - DNA, 13 bp, C. elegans
aaacataaatttg

SEQ ID NO: 685978 - DNA, 13 bp, C. elegans
aaacataattgta

SEQ ID NO: 685979 - DNA, 13 bp, C. elegans
aaacatacatttt

SEQ ID NO: 685980 - DNA, 13 bp, C. elegans
aaacatagtgaaa

SEQ ID NO: 685981 - DNA, 13 bp, C. elegans
aaacatagtttca

SEQ ID NO: 685982 - DNA, 13 bp, C. elegans
aaacatagtttta

SEQ ID NO: 685983 - DNA, 13 bp, C. elegans
aaacatatcaatt

SEQ ID NO: 685984 - DNA, 13 bp, C. elegans
aaacatattcgaa

SEQ ID NO: 685985 - DNA, 13 bp, C. elegans
aaacatatttcaa

SEQ ID NO: 685986 - DNA, 13 bp, C. elegans
aaacatcaaagtt

SEQ ID NO: 685987 - DNA, 13 bp, C. elegans
aaacatcaaattt

SEQ ID NO: 685988 - DNA, 13 bp, C. elegans
aaacatcaatgaa

SEQ ID NO: 685989 - DNA, 13 bp, C. elegans
aaacatcaattat

SEQ ID NO: 685990 - DNA, 13 bp, C. elegans
aaacatcaatttc

SEQ ID NO: 685991 - DNA, 13 bp, C. elegans
aaacatcaatttt

SEQ ID NO: 685992 - DNA, 13 bp, C. elegans
aaacatcagaaat

SEQ ID NO: 685993 - DNA, 13 bp, C. elegans
aaacatcagtttt

SEQ ID NO: 685994 - DNA, 13 bp, C. elegans
aaacatcataatt

SEQ ID NO: 685995 - DNA, 13 bp, C. elegans
aaacatcattttc

SEQ ID NO: 685996 - DNA, 13 bp, C. elegans
aaacatccaaatt

SEQ ID NO: 685997 - DNA, 13 bp, C. elegans
aaacatccgattt

SEQ ID NO: 685998 - DNA, 13 bp, C. elegans
aaacatcgaaaat

SEQ ID NO: 685999 - DNA, 13 bp, C. elegans
aaacatcgaaatt

SEQ ID NO: 686000 - DNA, 13 bp, C. elegans
aaacatcgatttt

SEQ ID NO: 686001 - DNA, 13 bp, C. elegans
aaacatctcaatc

SEQ ID NO: 686002 - DNA, 13 bp, C. elegans
aaacatctcaatt

SEQ ID NO: 686003 - DNA, 13 bp, C. elegans
aaacatctcgaaa

SEQ ID NO: 686004 - DNA, 13 bp, C. elegans
aaacatctgaaat

SEQ ID NO: 686005 - DNA, 13 bp, C. elegans
aaacatctgagaa

SEQ ID NO: 686006 - DNA, 13 bp, C. elegans
aaacatctggaaa

SEQ ID NO: 686007 - DNA, 13 bp, C. elegans
aaacatcttcaat

SEQ ID NO: 686008 - DNA, 13 bp, C. elegans
aaacatcttgaaa

SEQ ID NO: 686009 - DNA, 13 bp, C. elegans
aaacatgaaatta

SEQ ID NO: 686010 - DNA, 13 bp, C. elegans
aaacatgaacttt

SEQ ID NO: 686011 - DNA, 13 bp, C. elegans
aaacatgacaaat

SEQ ID NO: 686012 - DNA, 13 bp, C. elegans
aaacatgcaattt

SEQ ID NO: 686013 - DNA, 13 bp, C. elegans
aaacatgcatttt

SEQ ID NO: 686014 - DNA, 13 bp, C. elegans
aaacatggatttt

SEQ ID NO: 686015 - DNA, 13 bp, C. elegans
aaacatggcaaaa

SEQ ID NO: 686016 - DNA, 13 bp, C. elegans
aaacatggttttt

SEQ ID NO: 686017 - DNA, 13 bp, C. elegans
aaacatgtatatt

SEQ ID NO: 686018 - DNA, 13 bp, C. elegans
aaacatgtatttc

SEQ ID NO: 686019 - DNA, 13 bp, C. elegans
aaacatgtcaaaa

SEQ ID NO: 686020 - DNA, 13 bp, C. elegans
aaacatgtgaaaa

SEQ ID NO: 686021 - DNA, 13 bp, C. elegans
aaacatgttaaaa

SEQ ID NO: 686022 - DNA, 13 bp, C. elegans
aaacatgttccat

SEQ ID NO: 686023 - DNA, 13 bp, C. elegans
aaacatgttgtca

SEQ ID NO: 686024 - DNA, 13 bp, C. elegans
aaacatgtttcat

SEQ ID NO: 686025 - DNA, 13 bp, C. elegans
aaacatgtttgat

SEQ ID NO: 686026 - DNA, 13 bp, C. elegans
aaacatgttttta

SEQ ID NO: 686027 - DNA, 13 bp, C. elegans
aaacatgtttttc

SEQ ID NO: 686028 - DNA, 13 bp, C. elegans
aaacattaatttc

SEQ ID NO: 686029 - DNA, 13 bp, C. elegans
aaacattacatga

SEQ ID NO: 686030 - DNA, 13 bp, C. elegans
aaacattactttt

SEQ ID NO: 686031 - DNA, 13 bp, C. elegans
aaacattatttca

SEQ ID NO: 686032 - DNA, 13 bp, C. elegans
aaacattatttcc

SEQ ID NO: 686033 - DNA, 13 bp, C. elegans
aaacattattttg

SEQ ID NO: 686034 - DNA, 13 bp, C. elegans
aaacattcaatga

SEQ ID NO: 686035 - DNA, 13 bp, C. elegans
aaacattcaattt

SEQ ID NO: 686036 - DNA, 13 bp, C. elegans
aaacattcataat

SEQ ID NO: 686037 - DNA, 13 bp, C. elegans
aaacattcatttt

SEQ ID NO: 686038 - DNA, 13 bp, C. elegans
aaacattccaaat

SEQ ID NO: 686039 - DNA, 13 bp, C. elegans
aaacattccgaaa

SEQ ID NO: 686040 - DNA, 13 bp, C. elegans
aaacattcgaaaa

SEQ ID NO: 686041 - DNA, 13 bp, C. elegans
aaacattcgaaat

SEQ ID NO: 686042 - DNA, 13 bp, C. elegans
aaacattcgattt

SEQ ID NO: 686043 - DNA, 13 bp, C. elegans
aaacattctacaa

SEQ ID NO: 686044 - DNA, 13 bp, C. elegans
aaacattctgaaa

SEQ ID NO: 686045 - DNA, 13 bp, C. elegans
aaacattcttatt

SEQ ID NO: 686046 - DNA, 13 bp, C. elegans
aaacattcttcaa

SEQ ID NO: 686047 - DNA, 13 bp, C. elegans
aaacattgaaagt

SEQ ID NO: 686048 - DNA, 13 bp, C. elegans
aaacattgaaatt

SEQ ID NO: 686049 - DNA, 13 bp, C. elegans
aaacattgaatta

SEQ ID NO: 686050 - DNA, 13 bp, C. elegans
aaacattgaattt

SEQ ID NO: 686051 - DNA, 13 bp, C. elegans
aaacattgacaaa

SEQ ID NO: 686052 - DNA, 13 bp, C. elegans
aaacattgagaaa

SEQ ID NO: 686053 - DNA, 13 bp, C. elegans
aaacattgatttt

SEQ ID NO: 686054 - DNA, 13 bp, C. elegans
aaacattgcaaaa

SEQ ID NO: 686055 - DNA, 13 bp, C. elegans
aaacattgcattt

SEQ ID NO: 686056 - DNA, 13 bp, C. elegans
aaacattgctcaa

SEQ ID NO: 686057 - DNA, 13 bp, C. elegans
aaacattggaaat

SEQ ID NO: 686058 - DNA, 13 bp, C. elegans
aaacattggtttt

SEQ ID NO: 686059 - DNA, 13 bp, C. elegans
aaacattgtaaaa

SEQ ID NO: 686060 - DNA, 13 bp, C. elegans
aaacattgtaaat

SEQ ID NO: 686061 - DNA, 13 bp, C. elegans
aaacattgtaggg

SEQ ID NO: 686062 - DNA, 13 bp, C. elegans
aaacattgttttc

SEQ ID NO: 686063 - DNA, 13 bp, C. elegans
aaacatttaatga

SEQ ID NO: 686064 - DNA, 13 bp, C. elegans
aaacatttagaaa

SEQ ID NO: 686065 - DNA, 13 bp, C. elegans
aaacatttatgaa

SEQ ID NO: 686066 - DNA, 13 bp, C. elegans
aaacatttattga

SEQ ID NO: 686067 - DNA, 13 bp, C. elegans
aaacatttcaaac

SEQ ID NO: 686068 - DNA, 13 bp, C. elegans
aaacatttcaata

SEQ ID NO: 686069 - DNA, 13 bp, C. elegans
aaacatttcacaa

SEQ ID NO: 686070 - DNA, 13 bp, C. elegans
aaacatttcagat

SEQ ID NO: 686071 - DNA, 13 bp, C. elegans
aaacatttccaaa

SEQ ID NO: 686072 - DNA, 13 bp, C. elegans
aaacatttcccaa

SEQ ID NO: 686073 - DNA, 13 bp, C. elegans
aaacatttcgatt

SEQ ID NO: 686074 - DNA, 13 bp, C. elegans
aaacatttctttt

SEQ ID NO: 686075 - DNA, 13 bp, C. elegans
aaacatttgaaaa

SEQ ID NO: 686076 - DNA, 13 bp, C. elegans
aaacatttgaaac

SEQ ID NO: 686077 - DNA, 13 bp, C. elegans
aaacatttgaaag

SEQ ID NO: 686078 - DNA, 13 bp, C. elegans
aaacatttgaagt

SEQ ID NO: 686079 - DNA, 13 bp, C. elegans
aaacatttgagaa

SEQ ID NO: 686080 - DNA, 13 bp, C. elegans
aaacatttgatct

SEQ ID NO: 686081 - DNA, 13 bp, C. elegans
aaacatttgatta

SEQ ID NO: 686082 - DNA, 13 bp, C. elegans
aaacatttgcatt

SEQ ID NO: 686083 - DNA, 13 bp, C. elegans
aaacatttggcaa

SEQ ID NO: 686084 - DNA, 13 bp, C. elegans
aaacatttggcgg

SEQ ID NO: 686085 - DNA, 13 bp, C. elegans
aaacatttggttt

SEQ ID NO: 686086 - DNA, 13 bp, C. elegans
aaacatttgtaat

SEQ ID NO: 686087 - DNA, 13 bp, C. elegans
aaacatttgtatt

SEQ ID NO: 686088 - DNA, 13 bp, C. elegans
aaacatttgtgaa

SEQ ID NO: 686089 - DNA, 13 bp, C. elegans
aaacatttgttca

SEQ ID NO: 686090 - DNA, 13 bp, C. elegans
aaacatttgtttg

SEQ ID NO: 686091 - DNA, 13 bp, C. elegans
aaacatttgtttt

SEQ ID NO: 686092 - DNA, 13 bp, C. elegans
aaacattttaaag

SEQ ID NO: 686093 - DNA, 13 bp, C. elegans
aaacattttcaaa

SEQ ID NO: 686094 - DNA, 13 bp, C. elegans
aaacattttcaat

SEQ ID NO: 686095 - DNA, 13 bp, C. elegans
aaacattttccta

SEQ ID NO: 686096 - DNA, 13 bp, C. elegans
aaacattttcgaa

SEQ ID NO: 686097 - DNA, 13 bp, C. elegans
aaacattttcgat

SEQ ID NO: 686098 - DNA, 13 bp, C. elegans
aaacattttcgtt

SEQ ID NO: 686099 - DNA, 13 bp, C. elegans
aaacattttgaaa

SEQ ID NO: 686100 - DNA, 13 bp, C. elegans
aaacattttgacc

SEQ ID NO: 686101 - DNA, 13 bp, C. elegans
aaacattttgcaa

SEQ ID NO: 686102 - DNA, 13 bp, C. elegans
aaacattttggaa

SEQ ID NO: 686103 - DNA, 13 bp, C. elegans
aaacattttggag

SEQ ID NO: 686104 - DNA, 13 bp, C. elegans
aaacattttgtag

SEQ ID NO: 686105 - DNA, 13 bp, C. elegans
aaacattttgtga

SEQ ID NO: 686106 - DNA, 13 bp, C. elegans
aaacattttgttt

SEQ ID NO: 686107 - DNA, 13 bp, C. elegans
aaacatttttaga

SEQ ID NO: 686108 - DNA, 13 bp, C. elegans
aaacatttttagg

SEQ ID NO: 686109 - DNA, 13 bp, C. elegans
aaacatttttcaa

SEQ ID NO: 686110 - DNA, 13 bp, C. elegans
aaacatttttcat

SEQ ID NO: 686111 - DNA, 13 bp, C. elegans
aaacatttttctg

SEQ ID NO: 686112 - DNA, 13 bp, C. elegans
aaacatttttgaa

SEQ ID NO: 686113 - DNA, 13 bp, C. elegans
aaacatttttgca

SEQ ID NO: 686114 - DNA, 13 bp, C. elegans
aaacattttttca

SEQ ID NO: 686115 - DNA, 13 bp, C. elegans
aaacattttttgg

SEQ ID NO: 686116 - DNA, 13 bp, C. elegans
aaacattttttgt

SEQ ID NO: 686117 - DNA, 13 bp, C. elegans
aaaccaaaaagtt

SEQ ID NO: 686118 - DNA, 13 bp, C. elegans
aaaccaaaaattg

SEQ ID NO: 686119 - DNA, 13 bp, C. elegans
aaaccaaaatgtt

SEQ ID NO: 686120 - DNA, 13 bp, C. elegans
aaaccaaaattga

SEQ ID NO: 686121 - DNA, 13 bp, C. elegans
aaaccaaacattt

SEQ ID NO: 686122 - DNA, 13 bp, C. elegans
aaaccaaactttc

SEQ ID NO: 686123 - DNA, 13 bp, C. elegans
aaaccaaatattt

SEQ ID NO: 686124 - DNA, 13 bp, C. elegans
aaaccaaatgttt

SEQ ID NO: 686125 - DNA, 13 bp, C. elegans
aaaccaaatttta

SEQ ID NO: 686126 - DNA, 13 bp, C. elegans
aaaccaacatttt

SEQ ID NO: 686127 - DNA, 13 bp, C. elegans
aaaccaagaattt

SEQ ID NO: 686128 - DNA, 13 bp, C. elegans
aaaccaagtgaaa

SEQ ID NO: 686129 - DNA, 13 bp, C. elegans
aaaccaagtttaa

SEQ ID NO: 686130 - DNA, 13 bp, C. elegans
aaaccaagttttg

SEQ ID NO: 686131 - DNA, 13 bp, C. elegans
aaaccaatgaaat

SEQ ID NO: 686132 - DNA, 13 bp, C. elegans
aaaccaattgaaa

SEQ ID NO: 686133 - DNA, 13 bp, C. elegans
aaaccaatttctt

SEQ ID NO: 686134 - DNA, 13 bp, C. elegans
aaaccaattttca

SEQ ID NO: 686135 - DNA, 13 bp, C. elegans
aaaccacgttttt

SEQ ID NO: 686136 - DNA, 13 bp, C. elegans
aaaccactgaaat

SEQ ID NO: 686137 - DNA, 13 bp, C. elegans
aaaccacttttaa

SEQ ID NO: 686138 - DNA, 13 bp, C. elegans
aaaccacttttca

SEQ ID NO: 686139 - DNA, 13 bp, C. elegans
aaaccacttttcc

SEQ ID NO: 686140 - DNA, 13 bp, C. elegans
aaaccagaaaatc

SEQ ID NO: 686141 - DNA, 13 bp, C. elegans
aaaccagaaattc

SEQ ID NO: 686142 - DNA, 13 bp, C. elegans
aaaccagaagttt

SEQ ID NO: 686143 - DNA, 13 bp, C. elegans
aaaccagattttt

SEQ ID NO: 686144 - DNA, 13 bp, C. elegans
aaaccagtttaaa

SEQ ID NO: 686145 - DNA, 13 bp, C. elegans
aaaccagtttcat

SEQ ID NO: 686146 - DNA, 13 bp, C. elegans
aaaccataacttt

SEQ ID NO: 686147 - DNA, 13 bp, C. elegans
aaaccatcaattc

SEQ ID NO: 686148 - DNA, 13 bp, C. elegans
aaaccattaattt

SEQ ID NO: 686149 - DNA, 13 bp, C. elegans
aaaccattcaaat

SEQ ID NO: 686150 - DNA, 13 bp, C. elegans
aaaccattgaatt

SEQ ID NO: 686151 - DNA, 13 bp, C. elegans
aaaccattgtcaa

SEQ ID NO: 686152 - DNA, 13 bp, C. elegans
aaaccatttcaaa

SEQ ID NO: 686153 - DNA, 13 bp, C. elegans
aaaccatttgaaa

SEQ ID NO: 686154 - DNA, 13 bp, C. elegans
aaaccatttttcg

SEQ ID NO: 686155 - DNA, 13 bp, C. elegans
aaacccaaatttt

SEQ ID NO: 686156 - DNA, 13 bp, C. elegans
aaacccacaaatt

SEQ ID NO: 686157 - DNA, 13 bp, C. elegans
aaacccagaaatt

SEQ ID NO: 686158 - DNA, 13 bp, C. elegans
aaacccataagta

SEQ ID NO: 686159 - DNA, 13 bp, C. elegans
aaacccattttct

SEQ ID NO: 686160 - DNA, 13 bp, C. elegans
aaaccccaatttt

SEQ ID NO: 686161 - DNA, 13 bp, C. elegans
aaaccccattttt

SEQ ID NO: 686162 - DNA, 13 bp, C. elegans
aaaccccgaattt

SEQ ID NO: 686163 - DNA, 13 bp, C. elegans
aaacccctaaaat

SEQ ID NO: 686164 - DNA, 13 bp, C. elegans
aaacccgaatttt

SEQ ID NO: 686165 - DNA, 13 bp, C. elegans
aaacccgattttc

SEQ ID NO: 686166 - DNA, 13 bp, C. elegans
aaacccttgaaaa

SEQ ID NO: 686167 - DNA, 13 bp, C. elegans
aaaccgaaaatcg

SEQ ID NO: 686168 - DNA, 13 bp, C. elegans
aaaccgaaaattc

SEQ ID NO: 686169 - DNA, 13 bp, C. elegans
aaaccgaaatggg

SEQ ID NO: 686170 - DNA, 13 bp, C. elegans
aaaccgaaattgg

SEQ ID NO: 686171 - DNA, 13 bp, C. elegans
aaaccgacattcc

SEQ ID NO: 686172 - DNA, 13 bp, C. elegans
aaaccgataattt

SEQ ID NO: 686173 - DNA, 13 bp, C. elegans
aaaccgatttcaa

SEQ ID NO: 686174 - DNA, 13 bp, C. elegans
aaaccgattttta

SEQ ID NO: 686175 - DNA, 13 bp, C. elegans
aaaccgatttttc

SEQ ID NO: 686176 - DNA, 13 bp, C. elegans
aaaccgcaaaaat

SEQ ID NO: 686177 - DNA, 14 bp, C. elegans
aaaccgcaatgaga

SEQ ID NO: 686178 - DNA, 14 bp, C. elegans
aaaccgcatcaaaa

SEQ ID NO: 686179 - DNA, 13 bp, C. elegans
aaaccgccaaatt

SEQ ID NO: 686180 - DNA, 13 bp, C. elegans
aaaccgccaattt

SEQ ID NO: 686181 - DNA, 13 bp, C. elegans
aaaccgctcaaaa

SEQ ID NO: 686182 - DNA, 13 bp, C. elegans
aaaccggaaaagt

SEQ ID NO: 686183 - DNA, 13 bp, C. elegans
aaaccggaatatt

SEQ ID NO: 686184 - DNA, 13 bp, C. elegans
aaaccggacgtcc

SEQ ID NO: 686185 - DNA, 13 bp, C. elegans
aaaccggcaaact

SEQ ID NO: 686186 - DNA, 13 bp, C. elegans
aaaccggcaaatt

SEQ ID NO: 686187 - DNA, 13 bp, C. elegans
aaaccggcacatt

SEQ ID NO: 686188 - DNA, 13 bp, C. elegans
aaaccggcgaatt

SEQ ID NO: 686189 - DNA, 13 bp, C. elegans
aaaccggtgaaaa

SEQ ID NO: 686190 - DNA, 13 bp, C. elegans
aaaccggtttttg

SEQ ID NO: 686191 - DNA, 13 bp, C. elegans
aaaccgtaatggg

SEQ ID NO: 686192 - DNA, 13 bp, C. elegans
aaaccgtataaaa

SEQ ID NO: 686193 - DNA, 13 bp, C. elegans
aaaccgtcataac

SEQ ID NO: 686194 - DNA, 13 bp, C. elegans
aaaccgtcgaaaa

SEQ ID NO: 686195 - DNA, 13 bp, C. elegans
aaaccgtgaaaaa

SEQ ID NO: 686196 - DNA, 13 bp, C. elegans
aaaccgtgttttt

SEQ ID NO: 686197 - DNA, 13 bp, C. elegans
aaaccgtttatta

SEQ ID NO: 686198 - DNA, 13 bp, C. elegans
aaacctaatttct

SEQ ID NO: 686199 - DNA, 13 bp, C. elegans
aaacctaattttt

SEQ ID NO: 686200 - DNA, 13 bp, C. elegans
aaacctacaaagt

SEQ ID NO: 686201 - DNA, 13 bp, C. elegans
aaacctagaaaac

SEQ ID NO: 686202 - DNA, 13 bp, C. elegans
aaacctagatttt

SEQ ID NO: 686203 - DNA, 13 bp, C. elegans
aaacctaggaaaa

SEQ ID NO: 686204 - DNA, 13 bp, C. elegans
aaacctatattgg

SEQ ID NO: 686205 - DNA, 13 bp, C. elegans
aaacctattaatt

SEQ ID NO: 686206 - DNA, 13 bp, C. elegans
aaacctattttca

SEQ ID NO: 686207 - DNA, 13 bp, C. elegans
aaacctattttta

SEQ ID NO: 686208 - DNA, 13 bp, C. elegans
aaacctatttttc

SEQ ID NO: 686209 - DNA, 15 bp, C. elegans
aaacctcaaaacttt

SEQ ID NO: 686210 - DNA, 13 bp, C. elegans
aaacctcaatttt

SEQ ID NO: 686211 - DNA, 13 bp, C. elegans
aaacctcattttt

SEQ ID NO: 686212 - DNA, 13 bp, C. elegans
aaacctccaaaat

SEQ ID NO: 686213 - DNA, 13 bp, C. elegans
aaacctcgaaaat

SEQ ID NO: 686214 - DNA, 13 bp, C. elegans
aaacctcggccac

SEQ ID NO: 686215 - DNA, 13 bp, C. elegans
aaacctctgattt

SEQ ID NO: 686216 - DNA, 13 bp, C. elegans
aaacctgaaaaat

SEQ ID NO: 686217 - DNA, 13 bp, C. elegans
aaacctgaaaaga

SEQ ID NO: 686218 - DNA, 13 bp, C. elegans
aaacctgaaattt

SEQ ID NO: 686219 - DNA, 13 bp, C. elegans
aaacctgaacttt

SEQ ID NO: 686220 - DNA, 13 bp, C. elegans
aaacctgaagaaa

SEQ ID NO: 686221 - DNA, 13 bp, C. elegans
aaacctgaatttt

SEQ ID NO: 686222 - DNA, 13 bp, C. elegans
aaacctgagaaaa

SEQ ID NO: 686223 - DNA, 13 bp, C. elegans
aaacctgcaaatt

SEQ ID NO: 686224 - DNA, 13 bp, C. elegans
aaaccttaatttt

SEQ ID NO: 686225 - DNA, 13 bp, C. elegans
aaaccttcaaaat

SEQ ID NO: 686226 - DNA, 13 bp, C. elegans
aaaccttcaaatt

SEQ ID NO: 686227 - DNA, 13 bp, C. elegans
aaaccttcaattt

SEQ ID NO: 686228 - DNA, 13 bp, C. elegans
aaaccttcttgta

SEQ ID NO: 686229 - DNA, 13 bp, C. elegans
aaaccttgggcaa

SEQ ID NO: 686230 - DNA, 13 bp, C. elegans
aaacctttcaaaa

SEQ ID NO: 686231 - DNA, 13 bp, C. elegans
aaacctttctttt

SEQ ID NO: 686232 - DNA, 13 bp, C. elegans
aaacctttggaaa

SEQ ID NO: 686233 - DNA, 13 bp, C. elegans
aaaccttttcaat

SEQ ID NO: 686234 - DNA, 13 bp, C. elegans
aaaccttttgtta

SEQ ID NO: 686235 - DNA, 13 bp, C. elegans
aaacctttttaat

SEQ ID NO: 686236 - DNA, 13 bp, C. elegans
aaacctttttcaa

SEQ ID NO: 686237 - DNA, 14 bp, C. elegans
aaaccttttttcaa

SEQ ID NO: 686238 - DNA, 13 bp, C. elegans
aaacgaaaaagtg

SEQ ID NO: 686239 - DNA, 13 bp, C. elegans
aaacgaaaaattc

SEQ ID NO: 686240 - DNA, 13 bp, C. elegans
aaacgaaaatcga

SEQ ID NO: 686241 - DNA, 13 bp, C. elegans
aaacgaaaattgc

SEQ ID NO: 686242 - DNA, 13 bp, C. elegans
aaacgaaacaatt

SEQ ID NO: 686243 - DNA, 13 bp, C. elegans
aaacgaaatgttt

SEQ ID NO: 686244 - DNA, 13 bp, C. elegans
aaacgaaattttc

SEQ ID NO: 686245 - DNA, 13 bp, C. elegans
aaacgaacaacgg

SEQ ID NO: 686246 - DNA, 13 bp, C. elegans
aaacgaacatttt

SEQ ID NO: 686247 - DNA, 13 bp, C. elegans
aaacgaacttttt

SEQ ID NO: 686248 - DNA, 13 bp, C. elegans
aaacgaataattt

SEQ ID NO: 686249 - DNA, 13 bp, C. elegans
aaacgaatatttt

SEQ ID NO: 686250 - DNA, 13 bp, C. elegans
aaacgaatttttt

SEQ ID NO: 686251 - DNA, 13 bp, C. elegans
aaacgacaaaact

SEQ ID NO: 686252 - DNA, 13 bp, C. elegans
aaacgacaactga

SEQ ID NO: 686253 - DNA, 13 bp, C. elegans
aaacgacgaaaat

SEQ ID NO: 686254 - DNA, 13 bp, C. elegans
aaacgactcaaaa

SEQ ID NO: 686255 - DNA, 13 bp, C. elegans
aaacgactgaaaa

SEQ ID NO: 686256 - DNA, 13 bp, C. elegans
aaacgagaaaact

SEQ ID NO: 686257 - DNA, 13 bp, C. elegans
aaacgagaaaatt

SEQ ID NO: 686258 - DNA, 13 bp, C. elegans
aaacgagaaattc

SEQ ID NO: 686259 - DNA, 13 bp, C. elegans
aaacgagaaattg

SEQ ID NO: 686260 - DNA, 13 bp, C. elegans
aaacgagaatttg

SEQ ID NO: 686261 - DNA, 13 bp, C. elegans
aaacgagacatcg

SEQ ID NO: 686262 - DNA, 13 bp, C. elegans
aaacgagagcgat

SEQ ID NO: 686263 - DNA, 13 bp, C. elegans
aaacgagcagccg

SEQ ID NO: 686264 - DNA, 13 bp, C. elegans
aaacgagccatcg

SEQ ID NO: 686265 - DNA, 13 bp, C. elegans
aaacgagtagaaa

SEQ ID NO: 686266 - DNA, 13 bp, C. elegans
aaacgagtgaaaa

SEQ ID NO: 686267 - DNA, 13 bp, C. elegans
aaacgagtttttc

SEQ ID NO: 686268 - DNA, 13 bp, C. elegans
aaacgataaaatt

SEQ ID NO: 686269 - DNA, 13 bp, C. elegans
aaacgatatttca

SEQ ID NO: 686270 - DNA, 13 bp, C. elegans
aaacgatattttc

SEQ ID NO: 686271 - DNA, 13 bp, C. elegans
aaacgatgctccg

SEQ ID NO: 686272 - DNA, 13 bp, C. elegans
aaacgatgtttca

SEQ ID NO: 686273 - DNA, 13 bp, C. elegans
aaacgattaattt

SEQ ID NO: 686274 - DNA, 13 bp, C. elegans
aaacgattgaaaa

SEQ ID NO: 686275 - DNA, 13 bp, C. elegans
aaacgattgaaat

SEQ ID NO: 686276 - DNA, 13 bp, C. elegans
aaacgatttattt

SEQ ID NO: 686277 - DNA, 13 bp, C. elegans
aaacgatttcaaa

SEQ ID NO: 686278 - DNA, 13 bp, C. elegans
aaacgatttgaaa

SEQ ID NO: 686279 - DNA, 13 bp, C. elegans
aaacgatttttcc

SEQ ID NO: 686280 - DNA, 13 bp, C. elegans
aaacgatttttct

SEQ ID NO: 686281 - DNA, 13 bp, C. elegans
aaacgcaaaaatg

SEQ ID NO: 686282 - DNA, 13 bp, C. elegans
aaacgcaaaattc

SEQ ID NO: 686283 - DNA, 13 bp, C. elegans
aaacgcaactttt

SEQ ID NO: 686284 - DNA, 13 bp, C. elegans
aaacgcattcact

SEQ ID NO: 686285 - DNA, 13 bp, C. elegans
aaacgccgaaaat

SEQ ID NO: 686286 - DNA, 13 bp, C. elegans
aaacgccgaattt

SEQ ID NO: 686287 - DNA, 13 bp, C. elegans
aaacgcctgaaaa

SEQ ID NO: 686288 - DNA, 13 bp, C. elegans
aaacgcctgccta

SEQ ID NO: 686289 - DNA, 13 bp, C. elegans
aaacgcgaaaatt

SEQ ID NO: 686290 - DNA, 13 bp, C. elegans
aaacgcgatattt

SEQ ID NO: 686291 - DNA, 13 bp, C. elegans
aaacgctattttt

SEQ ID NO: 686292 - DNA, 13 bp, C. elegans
aaacgctcgccaa

SEQ ID NO: 686293 - DNA, 13 bp, C. elegans
aaacgctgaaaaa

SEQ ID NO: 686294 - DNA, 13 bp, C. elegans
aaacgctgaaatt

SEQ ID NO: 686295 - DNA, 13 bp, C. elegans
aaacgctgattgg

SEQ ID NO: 686296 - DNA, 13 bp, C. elegans
aaacggaaaaatt

SEQ ID NO: 686297 - DNA, 13 bp, C. elegans
aaacggaaaacat

SEQ ID NO: 686298 - DNA, 13 bp, C. elegans
aaacggaaaactg

SEQ ID NO: 686299 - DNA, 13 bp, C. elegans
aaacggaaatgaa

SEQ ID NO: 686300 - DNA, 13 bp, C. elegans
aaacggaaattga

SEQ ID NO: 686301 - DNA, 13 bp, C. elegans
aaacggaactttt

SEQ ID NO: 686302 - DNA, 13 bp, C. elegans
aaacggaagctga

SEQ ID NO: 686303 - DNA, 13 bp, C. elegans
aaacggaatgaaa

SEQ ID NO: 686304 - DNA, 13 bp, C. elegans
aaacggaattatt

SEQ ID NO: 686305 - DNA, 13 bp, C. elegans
aaacggacaattt

SEQ ID NO: 686306 - DNA, 13 bp, C. elegans
aaacggagatttt

SEQ ID NO: 686307 - DNA, 13 bp, C. elegans
aaacggatttttc

SEQ ID NO: 686308 - DNA, 13 bp, C. elegans
aaacggcaaaccg

SEQ ID NO: 686309 - DNA, 13 bp, C. elegans
aaacggcaaatta

SEQ ID NO: 686310 - DNA, 13 bp, C. elegans
aaacggcaacttt

SEQ ID NO: 686311 - DNA, 13 bp, C. elegans
aaacggcatttca

SEQ ID NO: 686312 - DNA, 13 bp, C. elegans
aaacggcgaaaat

SEQ ID NO: 686313 - DNA, 13 bp, C. elegans
aaacggctgaaaa

SEQ ID NO: 686314 - DNA, 13 bp, C. elegans
aaacggcttaaaa

SEQ ID NO: 686315 - DNA, 14 bp, C. elegans
aaacgggacaacgg

SEQ ID NO: 686316 - DNA, 13 bp, C. elegans
aaacgggtaattt

SEQ ID NO: 686317 - DNA, 13 bp, C. elegans
aaacgggtttcaa

SEQ ID NO: 686318 - DNA, 14 bp, C. elegans
aaacggtaaaatag

SEQ ID NO: 686319 - DNA, 13 bp, C. elegans
aaacggtgttttt

SEQ ID NO: 686320 - DNA, 13 bp, C. elegans
aaacggttcaaat

SEQ ID NO: 686321 - DNA, 13 bp, C. elegans
aaacggttgaaat

SEQ ID NO: 686322 - DNA, 13 bp, C. elegans
aaacggtttttta

SEQ ID NO: 686323 - DNA, 13 bp, C. elegans
aaacgtaaatttt

SEQ ID NO: 686324 - DNA, 13 bp, C. elegans
aaacgtattcaat

SEQ ID NO: 686325 - DNA, 13 bp, C. elegans
aaacgtattttat

SEQ ID NO: 686326 - DNA, 13 bp, C. elegans
aaacgtccaaaaa

SEQ ID NO: 686327 - DNA, 13 bp, C. elegans
aaacgtcgaaaaa

SEQ ID NO: 686328 - DNA, 13 bp, C. elegans
aaacgtcgaaaat

SEQ ID NO: 686329 - DNA, 13 bp, C. elegans
aaacgtctgaaaa

SEQ ID NO: 686330 - DNA, 13 bp, C. elegans
aaacgtgatttta

SEQ ID NO: 686331 - DNA, 13 bp, C. elegans
aaacgtgcaaaac

SEQ ID NO: 686332 - DNA, 13 bp, C. elegans
aaacgtgccaaaa

SEQ ID NO: 686333 - DNA, 13 bp, C. elegans
aaacgtgctcaaa

SEQ ID NO: 686334 - DNA, 13 bp, C. elegans
aaacgtggaaaat

SEQ ID NO: 686335 - DNA, 13 bp, C. elegans
aaacgtggaaatt

SEQ ID NO: 686336 - DNA, 13 bp, C. elegans
aaacgtgtagttt

SEQ ID NO: 686337 - DNA, 13 bp, C. elegans
aaacgtgtgtttt

SEQ ID NO: 686338 - DNA, 13 bp, C. elegans
aaacgtgtttttt

SEQ ID NO: 686339 - DNA, 13 bp, C. elegans
aaacgttaaaaac

SEQ ID NO: 686340 - DNA, 13 bp, C. elegans
aaacgttaggttt

SEQ ID NO: 686341 - DNA, 13 bp, C. elegans
aaacgttatcaaa

SEQ ID NO: 686342 - DNA, 13 bp, C. elegans
aaacgttcaaaaa

SEQ ID NO: 686343 - DNA, 13 bp, C. elegans
aaacgttcaaagt

SEQ ID NO: 686344 - DNA, 13 bp, C. elegans
aaacgttcaattc

SEQ ID NO: 686345 - DNA, 13 bp, C. elegans
aaacgttccaaaa

SEQ ID NO: 686346 - DNA, 13 bp, C. elegans
aaacgtttaatta

SEQ ID NO: 686347 - DNA, 13 bp, C. elegans
aaacgtttaattt

SEQ ID NO: 686348 - DNA, 13 bp, C. elegans
aaacgtttatcaa

SEQ ID NO: 686349 - DNA, 13 bp, C. elegans
aaacgtttatttc

SEQ ID NO: 686350 - DNA, 13 bp, C. elegans
aaacgtttatttt

SEQ ID NO: 686351 - DNA, 13 bp, C. elegans
aaacgtttcgaaa

SEQ ID NO: 686352 - DNA, 13 bp, C. elegans
aaacgtttgaaaa

SEQ ID NO: 686353 - DNA, 13 bp, C. elegans
aaacgtttgaatt

SEQ ID NO: 686354 - DNA, 13 bp, C. elegans
aaacgtttgattt

SEQ ID NO: 686355 - DNA, 13 bp, C. elegans
aaacgttttaaaa

SEQ ID NO: 686356 - DNA, 13 bp, C. elegans
aaacgttttaaat

SEQ ID NO: 686357 - DNA, 13 bp, C. elegans
aaacgttttcaaa

SEQ ID NO: 686358 - DNA, 13 bp, C. elegans
aaacgttttcaag

SEQ ID NO: 686359 - DNA, 13 bp, C. elegans
aaacgttttcata

SEQ ID NO: 686360 - DNA, 13 bp, C. elegans
aaacgttttcatt

SEQ ID NO: 686361 - DNA, 13 bp, C. elegans
aaacgtttttaat

SEQ ID NO: 686362 - DNA, 13 bp, C. elegans
aaacgtttttcat

SEQ ID NO: 686363 - DNA, 13 bp, C. elegans
aaacgttttttgt

SEQ ID NO: 686364 - DNA, 13 bp, C. elegans
aaacgtttttttt

SEQ ID NO: 686365 - DNA, 13 bp, C. elegans
aaactaaaactgt

SEQ ID NO: 686366 - DNA, 13 bp, C. elegans
aaactaaactatt

SEQ ID NO: 686367 - DNA, 13 bp, C. elegans
aaactaaatattc

SEQ ID NO: 686368 - DNA, 13 bp, C. elegans
aaactaaattcat

SEQ ID NO: 686369 - DNA, 13 bp, C. elegans
aaactaaatttag

SEQ ID NO: 686370 - DNA, 13 bp, C. elegans
aaactaaattttc

SEQ ID NO: 686371 - DNA, 13 bp, C. elegans
aaactaactgaaa

SEQ ID NO: 686372 - DNA, 13 bp, C. elegans
aaactaagatttt

SEQ ID NO: 686373 - DNA, 13 bp, C. elegans
aaactaatatttc

SEQ ID NO: 686374 - DNA, 13 bp, C. elegans
aaactaatgaaat

SEQ ID NO: 686375 - DNA, 13 bp, C. elegans
aaactaatggaaa

SEQ ID NO: 686376 - DNA, 13 bp, C. elegans
aaactaattgtaa

SEQ ID NO: 686377 - DNA, 13 bp, C. elegans
aaactaattttca

SEQ ID NO: 686378 - DNA, 13 bp, C. elegans
aaactaattttct

SEQ ID NO: 686379 - DNA, 13 bp, C. elegans
aaactaattttga

SEQ ID NO: 686380 - DNA, 13 bp, C. elegans
aaactacaaactc

SEQ ID NO: 686381 - DNA, 13 bp, C. elegans
aaactacaaattc

SEQ ID NO: 686382 - DNA, 13 bp, C. elegans
aaactacaaattt

SEQ ID NO: 686383 - DNA, 13 bp, C. elegans
aaactacaacatt

SEQ ID NO: 686384 - DNA, 13 bp, C. elegans
aaactacaacttc

SEQ ID NO: 686385 - DNA, 13 bp, C. elegans
aaactacaatatt

SEQ ID NO: 686386 - DNA, 13 bp, C. elegans
aaactacaattgt

SEQ ID NO: 686387 - DNA, 13 bp, C. elegans
aaactacacaatt

SEQ ID NO: 686388 - DNA, 13 bp, C. elegans
aaactacacacta

SEQ ID NO: 686389 - DNA, 13 bp, C. elegans
aaactacagaaac

SEQ ID NO: 686390 - DNA, 13 bp, C. elegans
aaactacagaaat

SEQ ID NO: 686391 - DNA, 13 bp, C. elegans
aaactacagattt

SEQ ID NO: 686392 - DNA, 13 bp, C. elegans
aaactacagtaat

SEQ ID NO: 686393 - DNA, 13 bp, C. elegans
aaactacatattt

SEQ ID NO: 686394 - DNA, 13 bp, C. elegans
aaactacattttt

SEQ ID NO: 686395 - DNA, 13 bp, C. elegans
aaactaccaaatt

SEQ ID NO: 686396 - DNA, 13 bp, C. elegans
aaactaccaatat

SEQ ID NO: 686397 - DNA, 13 bp, C. elegans
aaactaccatcaa

SEQ ID NO: 686398 - DNA, 13 bp, C. elegans
aaactaccgaaaa

SEQ ID NO: 686399 - DNA, 13 bp, C. elegans
aaactaccgaaat

SEQ ID NO: 686400 - DNA, 13 bp, C. elegans
aaactaccgaatt

SEQ ID NO: 686401 - DNA, 13 bp, C. elegans
aaactaccgattt

SEQ ID NO: 686402 - DNA, 13 bp, C. elegans
aaactacgaaaac

SEQ ID NO: 686403 - DNA, 13 bp, C. elegans
aaactacgaaatt

SEQ ID NO: 686404 - DNA, 13 bp, C. elegans
aaactacgatttt

SEQ ID NO: 686405 - DNA, 13 bp, C. elegans
aaactactaacta

SEQ ID NO: 686406 - DNA, 13 bp, C. elegans
aaactactgaaaa

SEQ ID NO: 686407 - DNA, 13 bp, C. elegans
aaactacttattt

SEQ ID NO: 686408 - DNA, 13 bp, C. elegans
aaactacttcaaa

SEQ ID NO: 686409 - DNA, 13 bp, C. elegans
aaactacttgaaa

SEQ ID NO: 686410 - DNA, 13 bp, C. elegans
aaactagaacatt

SEQ ID NO: 686411 - DNA, 13 bp, C. elegans
aaactagctgaaa

SEQ ID NO: 686412 - DNA, 13 bp, C. elegans
aaactaggccatt

SEQ ID NO: 686413 - DNA, 13 bp, C. elegans
aaactagtttttc

SEQ ID NO: 686414 - DNA, 13 bp, C. elegans
aaactataaaagc

SEQ ID NO: 686415 - DNA, 13 bp, C. elegans
aaactataaactt

SEQ ID NO: 686416 - DNA, 13 bp, C. elegans
aaactatacaact

SEQ ID NO: 686417 - DNA, 13 bp, C. elegans
aaactatattcaa

SEQ ID NO: 686418 - DNA, 13 bp, C. elegans
aaactatatttca

SEQ ID NO: 686419 - DNA, 13 bp, C. elegans
aaactatcagaaa

SEQ ID NO: 686420 - DNA, 13 bp, C. elegans
aaactatcatttt

SEQ ID NO: 686421 - DNA, 13 bp, C. elegans
aaactatcgaatt

SEQ ID NO: 686422 - DNA, 13 bp, C. elegans
aaactatcgattt

SEQ ID NO: 686423 - DNA, 13 bp, C. elegans
aaactatcggaaa

SEQ ID NO: 686424 - DNA, 13 bp, C. elegans
aaactatgaaata

SEQ ID NO: 686425 - DNA, 13 bp, C. elegans
aaactatgaatca

SEQ ID NO: 686426 - DNA, 13 bp, C. elegans
aaactatgatttg

SEQ ID NO: 686427 - DNA, 13 bp, C. elegans
aaactattcaaat

SEQ ID NO: 686428 - DNA, 13 bp, C. elegans
aaactattcatat

SEQ ID NO: 686429 - DNA, 13 bp, C. elegans
aaactattctaat

SEQ ID NO: 686430 - DNA, 13 bp, C. elegans
aaactattgagag

SEQ ID NO: 686431 - DNA, 13 bp, C. elegans
aaactattggaaa

SEQ ID NO: 686432 - DNA, 13 bp, C. elegans
aaactatttattg

SEQ ID NO: 686433 - DNA, 13 bp, C. elegans
aaactatttctga

SEQ ID NO: 686434 - DNA, 13 bp, C. elegans
aaactatttgaaa

SEQ ID NO: 686435 - DNA, 13 bp, C. elegans
aaactatttgatt

SEQ ID NO: 686436 - DNA, 13 bp, C. elegans
aaactattttatg

SEQ ID NO: 686437 - DNA, 13 bp, C. elegans
aaactattttcaa

SEQ ID NO: 686438 - DNA, 13 bp, C. elegans
aaactattttcca

SEQ ID NO: 686439 - DNA, 13 bp, C. elegans
aaactattttcga

SEQ ID NO: 686440 - DNA, 13 bp, C. elegans
aaactattttgaa

SEQ ID NO: 686441 - DNA, 13 bp, C. elegans
aaactatttttct

SEQ ID NO: 686442 - DNA, 13 bp, C. elegans
aaactatttttga

SEQ ID NO: 686443 - DNA, 13 bp, C. elegans
aaactattttttc

SEQ ID NO: 686444 - DNA, 13 bp, C. elegans
aaactcaaaaagt

SEQ ID NO: 686445 - DNA, 14 bp, C. elegans
aaactcaaaaagtt

SEQ ID NO: 686446 - DNA, 13 bp, C. elegans
aaactcaaaaatg

SEQ ID NO: 686447 - DNA, 13 bp, C. elegans
aaactcaaaagtt

SEQ ID NO: 686448 - DNA, 13 bp, C. elegans
aaactcaaaatga

SEQ ID NO: 686449 - DNA, 13 bp, C. elegans
aaactcaaatatc

SEQ ID NO: 686450 - DNA, 13 bp, C. elegans
aaactcaaattca

SEQ ID NO: 686451 - DNA, 13 bp, C. elegans
aaactcaaatttt

SEQ ID NO: 686452 - DNA, 13 bp, C. elegans
aaactcaacattt

SEQ ID NO: 686453 - DNA, 13 bp, C. elegans
aaactcaagaaat

SEQ ID NO: 686454 - DNA, 13 bp, C. elegans
aaactcaagaatt

SEQ ID NO: 686455 - DNA, 13 bp, C. elegans
aaactcaattatt

SEQ ID NO: 686456 - DNA, 13 bp, C. elegans
aaactcacatttt

SEQ ID NO: 686457 - DNA, 13 bp, C. elegans
aaactcacttttt

SEQ ID NO: 686458 - DNA, 13 bp, C. elegans
aaactcagaaaac

SEQ ID NO: 686459 - DNA, 13 bp, C. elegans
aaactcagatttt

SEQ ID NO: 686460 - DNA, 13 bp, C. elegans
aaactcaggaaaa

SEQ ID NO: 686461 - DNA, 13 bp, C. elegans
aaactcagttttt

SEQ ID NO: 686462 - DNA, 13 bp, C. elegans
aaactcatatttt

SEQ ID NO: 686463 - DNA, 13 bp, C. elegans
aaactcatgaaaa

SEQ ID NO: 686464 - DNA, 14 bp, C. elegans
aaactcatgtgcaa

SEQ ID NO: 686465 - DNA, 13 bp, C. elegans
aaactcattttat

SEQ ID NO: 686466 - DNA, 13 bp, C. elegans
aaactcattttca

SEQ ID NO: 686467 - DNA, 13 bp, C. elegans
aaactcatttttc

SEQ ID NO: 686468 - DNA, 14 bp, C. elegans
aaactcattttttg

SEQ ID NO: 686469 - DNA, 13 bp, C. elegans
aaactccaaaatt

SEQ ID NO: 686470 - DNA, 13 bp, C. elegans
aaactccaaattt

SEQ ID NO: 686471 - DNA, 13 bp, C. elegans
aaactccaagttt

SEQ ID NO: 686472 - DNA, 13 bp, C. elegans
aaactccaataat

SEQ ID NO: 686473 - DNA, 13 bp, C. elegans
aaactccaatttt

SEQ ID NO: 686474 - DNA, 13 bp, C. elegans
aaactccagaaat

SEQ ID NO: 686475 - DNA, 13 bp, C. elegans
aaactccaggaaa

SEQ ID NO: 686476 - DNA, 13 bp, C. elegans
aaactccagtttt

SEQ ID NO: 686477 - DNA, 14 bp, C. elegans
aaactccattattt

SEQ ID NO: 686478 - DNA, 13 bp, C. elegans
aaactcccaaatt

SEQ ID NO: 686479 - DNA, 13 bp, C. elegans
aaactccgtatca

SEQ ID NO: 686480 - DNA, 13 bp, C. elegans
aaactcctgaaaa

SEQ ID NO: 686481 - DNA, 13 bp, C. elegans
aaactcgaaaaat

SEQ ID NO: 686482 - DNA, 13 bp, C. elegans
aaactcgaaattt

SEQ ID NO: 686483 - DNA, 13 bp, C. elegans
aaactcgaagaaa

SEQ ID NO: 686484 - DNA, 13 bp, C. elegans
aaactcgaatttt

SEQ ID NO: 686485 - DNA, 13 bp, C. elegans
aaactcgacaaaa

SEQ ID NO: 686486 - DNA, 13 bp, C. elegans
aaactcgagaaaa

SEQ ID NO: 686487 - DNA, 13 bp, C. elegans
aaactcgagattt

SEQ ID NO: 686488 - DNA, 13 bp, C. elegans
aaactcgattttc

SEQ ID NO: 686489 - DNA, 13 bp, C. elegans
aaactcgattttg

SEQ ID NO: 686490 - DNA, 13 bp, C. elegans
aaactcgattttt

SEQ ID NO: 686491 - DNA, 13 bp, C. elegans
aaactcggaaatt

SEQ ID NO: 686492 - DNA, 13 bp, C. elegans
aaactcggaattt

SEQ ID NO: 686493 - DNA, 13 bp, C. elegans
aaactcggcaaat

SEQ ID NO: 686494 - DNA, 13 bp, C. elegans
aaactcggccagc

SEQ ID NO: 686495 - DNA, 13 bp, C. elegans
aaactcgggaaaa

SEQ ID NO: 686496 - DNA, 13 bp, C. elegans
aaactcgtttttt

SEQ ID NO: 686497 - DNA, 13 bp, C. elegans
aaactctaaactt

SEQ ID NO: 686498 - DNA, 13 bp, C. elegans
aaactctaagaaa

SEQ ID NO: 686499 - DNA, 13 bp, C. elegans
aaactctaatttc

SEQ ID NO: 686500 - DNA, 13 bp, C. elegans
aaactctagaaac

SEQ ID NO: 686501 - DNA, 13 bp, C. elegans
aaactctagaatt

SEQ ID NO: 686502 - DNA, 13 bp, C. elegans
aaactctagtttt

SEQ ID NO: 686503 - DNA, 13 bp, C. elegans
aaactctcaaaat

SEQ ID NO: 686504 - DNA, 13 bp, C. elegans
aaactctcaaatc

SEQ ID NO: 686505 - DNA, 13 bp, C. elegans
aaactctcaattt

SEQ ID NO: 686506 - DNA, 13 bp, C. elegans
aaactctcacgat

SEQ ID NO: 686507 - DNA, 13 bp, C. elegans
aaactctgaaaac

SEQ ID NO: 686508 - DNA, 13 bp, C. elegans
aaactctgaaaat

SEQ ID NO: 686509 - DNA, 13 bp, C. elegans
aaactctgaaatt

SEQ ID NO: 686510 - DNA, 13 bp, C. elegans
aaactctgaataa

SEQ ID NO: 686511 - DNA, 13 bp, C. elegans
aaactctgaattt

SEQ ID NO: 686512 - DNA, 13 bp, C. elegans
aaactctgcaaaa

SEQ ID NO: 686513 - DNA, 13 bp, C. elegans
aaactctgccatt

SEQ ID NO: 686514 - DNA, 13 bp, C. elegans
aaactctggaaaa

SEQ ID NO: 686515 - DNA, 13 bp, C. elegans
aaactctggaaat

SEQ ID NO: 686516 - DNA, 13 bp, C. elegans
aaactctgttttt

SEQ ID NO: 686517 - DNA, 13 bp, C. elegans
aaactcttaaatt

SEQ ID NO: 686518 - DNA, 13 bp, C. elegans
aaactcttcaaaa

SEQ ID NO: 686519 - DNA, 13 bp, C. elegans
aaactcttcaaat

SEQ ID NO: 686520 - DNA, 13 bp, C. elegans
aaactcttcaatt

SEQ ID NO: 686521 - DNA, 13 bp, C. elegans
aaactcttccacc

SEQ ID NO: 686522 - DNA, 13 bp, C. elegans
aaactcttccacg

SEQ ID NO: 686523 - DNA, 13 bp, C. elegans
aaactcttgtttt

SEQ ID NO: 686524 - DNA, 13 bp, C. elegans
aaactctttcatt

SEQ ID NO: 686525 - DNA, 13 bp, C. elegans
aaactctttgaaa

SEQ ID NO: 686526 - DNA, 13 bp, C. elegans
aaactcttttatt

SEQ ID NO: 686527 - DNA, 13 bp, C. elegans
aaactgaaaaatg

SEQ ID NO: 686528 - DNA, 13 bp, C. elegans
aaactgaaaaatt

SEQ ID NO: 686529 - DNA, 13 bp, C. elegans
aaactgaaaagtt

SEQ ID NO: 686530 - DNA, 13 bp, C. elegans
aaactgaaaatat

SEQ ID NO: 686531 - DNA, 13 bp, C. elegans
aaactgaaaatga

SEQ ID NO: 686532 - DNA, 13 bp, C. elegans
aaactgaaaatta

SEQ ID NO: 686533 - DNA, 13 bp, C. elegans
aaactgaaacaat

SEQ ID NO: 686534 - DNA, 13 bp, C. elegans
aaactgaaactaa

SEQ ID NO: 686535 - DNA, 13 bp, C. elegans
aaactgaaactga

SEQ ID NO: 686536 - DNA, 13 bp, C. elegans
aaactgaaacttt

SEQ ID NO: 686537 - DNA, 13 bp, C. elegans
aaactgaaagatt

SEQ ID NO: 686538 - DNA, 13 bp, C. elegans
aaactgaaagttt

SEQ ID NO: 686539 - DNA, 13 bp, C. elegans
aaactgaaatcaa

SEQ ID NO: 686540 - DNA, 13 bp, C. elegans
aaactgaaattca

SEQ ID NO: 686541 - DNA, 13 bp, C. elegans
aaactgaagaaga

SEQ ID NO: 686542 - DNA, 13 bp, C. elegans
aaactgaagaatt

SEQ ID NO: 686543 - DNA, 13 bp, C. elegans
aaactgaaggaaa

SEQ ID NO: 686544 - DNA, 13 bp, C. elegans
aaactgaagtttt

SEQ ID NO: 686545 - DNA, 13 bp, C. elegans
aaactgaattttt

SEQ ID NO: 686546 - DNA, 13 bp, C. elegans
aaactgacaaaac

SEQ ID NO: 686547 - DNA, 13 bp, C. elegans
aaactgacaaaat

SEQ ID NO: 686548 - DNA, 13 bp, C. elegans
aaactgacaatca

SEQ ID NO: 686549 - DNA, 13 bp, C. elegans
aaactgacagttt

SEQ ID NO: 686550 - DNA, 13 bp, C. elegans
aaactgacccaaa

SEQ ID NO: 686551 - DNA, 13 bp, C. elegans
aaactgactcaaa

SEQ ID NO: 686552 - DNA, 13 bp, C. elegans
aaactgagaaagt

SEQ ID NO: 686553 - DNA, 13 bp, C. elegans
aaactgagaatca

SEQ ID NO: 686554 - DNA, 13 bp, C. elegans
aaactgagaattt

SEQ ID NO: 686555 - DNA, 13 bp, C. elegans
aaactgagatttt

SEQ ID NO: 686556 - DNA, 13 bp, C. elegans
aaactgagctcag

SEQ ID NO: 686557 - DNA, 13 bp, C. elegans
aaactgagtgaaa

SEQ ID NO: 686558 - DNA, 13 bp, C. elegans
aaactgataaaat

SEQ ID NO: 686559 - DNA, 13 bp, C. elegans
aaactgataaact

SEQ ID NO: 686560 - DNA, 13 bp, C. elegans
aaactgatagtga

SEQ ID NO: 686561 - DNA, 13 bp, C. elegans
aaactgatatttt

SEQ ID NO: 686562 - DNA, 13 bp, C. elegans
aaactgatcaaaa

SEQ ID NO: 686563 - DNA, 13 bp, C. elegans
aaactgatcattt

SEQ ID NO: 686564 - DNA, 13 bp, C. elegans
aaactgatggaaa

SEQ ID NO: 686565 - DNA, 13 bp, C. elegans
aaactgatgtttc

SEQ ID NO: 686566 - DNA, 13 bp, C. elegans
aaactgatgtttt

SEQ ID NO: 686567 - DNA, 13 bp, C. elegans
aaactgattcatt

SEQ ID NO: 686568 - DNA, 13 bp, C. elegans
aaactgatttaat

SEQ ID NO: 686569 - DNA, 13 bp, C. elegans
aaactgatttatt

SEQ ID NO: 686570 - DNA, 13 bp, C. elegans
aaactgatttcaa

SEQ ID NO: 686571 - DNA, 13 bp, C. elegans
aaactgattttaa

SEQ ID NO: 686572 - DNA, 13 bp, C. elegans
aaactgattttta

SEQ ID NO: 686573 - DNA, 13 bp, C. elegans
aaactgatttttg

SEQ ID NO: 686574 - DNA, 13 bp, C. elegans
aaactgcaacaaa

SEQ ID NO: 686575 - DNA, 13 bp, C. elegans
aaactgcaatttt

SEQ ID NO: 686576 - DNA, 13 bp, C. elegans
aaactgcagtaat

SEQ ID NO: 686577 - DNA, 13 bp, C. elegans
aaactgccaaaaa

SEQ ID NO: 686578 - DNA, 13 bp, C. elegans
aaactgccaaagt

SEQ ID NO: 686579 - DNA, 13 bp, C. elegans
aaactgccaattt

SEQ ID NO: 686580 - DNA, 13 bp, C. elegans
aaactgccgaaaa

SEQ ID NO: 686581 - DNA, 13 bp, C. elegans
aaactgcctaaaa

SEQ ID NO: 686582 - DNA, 13 bp, C. elegans
aaactgcctcaaa

SEQ ID NO: 686583 - DNA, 13 bp, C. elegans
aaactgcctgaaa

SEQ ID NO: 686584 - DNA, 13 bp, C. elegans
aaactgcgagaat

SEQ ID NO: 686585 - DNA, 13 bp, C. elegans
aaactgcgatttt

SEQ ID NO: 686586 - DNA, 13 bp, C. elegans
aaactgctaaaaa

SEQ ID NO: 686587 - DNA, 13 bp, C. elegans
aaactgctcaaaa

SEQ ID NO: 686588 - DNA, 13 bp, C. elegans
aaactgctcattt

SEQ ID NO: 686589 - DNA, 13 bp, C. elegans
aaactgctgaaaa

SEQ ID NO: 686590 - DNA, 13 bp, C. elegans
aaactgctggaaa

SEQ ID NO: 686591 - DNA, 13 bp, C. elegans
aaactgctggaat

SEQ ID NO: 686592 - DNA, 13 bp, C. elegans
aaactgcttcaaa

SEQ ID NO: 686593 - DNA, 13 bp, C. elegans
aaactggaaaaga

SEQ ID NO: 686594 - DNA, 13 bp, C. elegans
aaactggaaaatt

SEQ ID NO: 686595 - DNA, 13 bp, C. elegans
aaactggaaactt

SEQ ID NO: 686596 - DNA, 13 bp, C. elegans
aaactggaaatta

SEQ ID NO: 686597 - DNA, 13 bp, C. elegans
aaactggaaattc

SEQ ID NO: 686598 - DNA, 13 bp, C. elegans
aaactggaacttt

SEQ ID NO: 686599 - DNA, 13 bp, C. elegans
aaactggaccaac

SEQ ID NO: 686600 - DNA, 13 bp, C. elegans
aaactggataaaa

SEQ ID NO: 686601 - DNA, 13 bp, C. elegans
aaactggattttc

SEQ ID NO: 686602 - DNA, 13 bp, C. elegans
aaactggcaaaaa

SEQ ID NO: 686603 - DNA, 13 bp, C. elegans
aaactggcaaaac

SEQ ID NO: 686604 - DNA, 13 bp, C. elegans
aaactggcaaatt

SEQ ID NO: 686605 - DNA, 13 bp, C. elegans
aaactgggaaaat

SEQ ID NO: 686606 - DNA, 13 bp, C. elegans
aaactgggatgta

SEQ ID NO: 686607 - DNA, 13 bp, C. elegans
aaactgggcttga

SEQ ID NO: 686608 - DNA, 13 bp, C. elegans
aaactggtatttc

SEQ ID NO: 686609 - DNA, 14 bp, C. elegans
aaactggtatttct

SEQ ID NO: 686610 - DNA, 13 bp, C. elegans
aaactggtatttt

SEQ ID NO: 686611 - DNA, 13 bp, C. elegans
aaactggtgctac

SEQ ID NO: 686612 - DNA, 13 bp, C. elegans
aaactggttcaaa

SEQ ID NO: 686613 - DNA, 13 bp, C. elegans
aaactggttgaaa

SEQ ID NO: 686614 - DNA, 13 bp, C. elegans
aaactggtttttt

SEQ ID NO: 686615 - DNA, 13 bp, C. elegans
aaactgtaaaaat

SEQ ID NO: 686616 - DNA, 13 bp, C. elegans
aaactgtaattaa

SEQ ID NO: 686617 - DNA, 13 bp, C. elegans
aaactgtaattta

SEQ ID NO: 686618 - DNA, 13 bp, C. elegans
aaactgtaatttt

SEQ ID NO: 686619 - DNA, 13 bp, C. elegans
aaactgtacaaaa

SEQ ID NO: 686620 - DNA, 13 bp, C. elegans
aaactgtacattt

SEQ ID NO: 686621 - DNA, 13 bp, C. elegans
aaactgtatttaa

SEQ ID NO: 686622 - DNA, 13 bp, C. elegans
aaactgtatttca

SEQ ID NO: 686623 - DNA, 13 bp, C. elegans
aaactgtattttc

SEQ ID NO: 686624 - DNA, 13 bp, C. elegans
aaactgtattttt

SEQ ID NO: 686625 - DNA, 13 bp, C. elegans
aaactgtcaaaac

SEQ ID NO: 686626 - DNA, 13 bp, C. elegans
aaactgtcaaatt

SEQ ID NO: 686627 - DNA, 13 bp, C. elegans
aaactgtcatttt

SEQ ID NO: 686628 - DNA, 13 bp, C. elegans
aaactgtccaaaa

SEQ ID NO: 686629 - DNA, 13 bp, C. elegans
aaactgtcgattt

SEQ ID NO: 686630 - DNA, 13 bp, C. elegans
aaactgtgaaaaa

SEQ ID NO: 686631 - DNA, 13 bp, C. elegans
aaactgtgaaaag

SEQ ID NO: 686632 - DNA, 13 bp, C. elegans
aaactgtgaaaat

SEQ ID NO: 686633 - DNA, 13 bp, C. elegans
aaactgtgaattt

SEQ ID NO: 686634 - DNA, 13 bp, C. elegans
aaactgtgatatt

SEQ ID NO: 686635 - DNA, 13 bp, C. elegans
aaactgtgatttt

SEQ ID NO: 686636 - DNA, 13 bp, C. elegans
aaactgtgcattt

SEQ ID NO: 686637 - DNA, 13 bp, C. elegans
aaactgtggaaaa

SEQ ID NO: 686638 - DNA, 13 bp, C. elegans
aaactgtggattt

SEQ ID NO: 686639 - DNA, 13 bp, C. elegans
aaactgtgggctg

SEQ ID NO: 686640 - DNA, 13 bp, C. elegans
aaactgtgtattt

SEQ ID NO: 686641 - DNA, 13 bp, C. elegans
aaactgttaaaaa

SEQ ID NO: 686642 - DNA, 13 bp, C. elegans
aaactgttcaaca

SEQ ID NO: 686643 - DNA, 13 bp, C. elegans
aaactgttcgaaa

SEQ ID NO: 686644 - DNA, 13 bp, C. elegans
aaactgttgaaaa

SEQ ID NO: 686645 - DNA, 13 bp, C. elegans
aaactgttgattt

SEQ ID NO: 686646 - DNA, 13 bp, C. elegans
aaactgtttagca

SEQ ID NO: 686647 - DNA, 13 bp, C. elegans
aaactgtttcata

SEQ ID NO: 686648 - DNA, 13 bp, C. elegans
aaactgtttgaaa

SEQ ID NO: 686649 - DNA, 13 bp, C. elegans
aaactgttttaaa

SEQ ID NO: 686650 - DNA, 13 bp, C. elegans
aaactgttttatg

SEQ ID NO: 686651 - DNA, 13 bp, C. elegans
aaactgttttcaa

SEQ ID NO: 686652 - DNA, 13 bp, C. elegans
aaactgttttcat

SEQ ID NO: 686653 - DNA, 13 bp, C. elegans
aaactgttttcta

SEQ ID NO: 686654 - DNA, 13 bp, C. elegans
aaactgttttgaa

SEQ ID NO: 686655 - DNA, 13 bp, C. elegans
aaacttaaaatct

SEQ ID NO: 686656 - DNA, 13 bp, C. elegans
aaacttaagattt

SEQ ID NO: 686657 - DNA, 13 bp, C. elegans
aaacttacagttt

SEQ ID NO: 686658 - DNA, 13 bp, C. elegans
aaacttaccaata

SEQ ID NO: 686659 - DNA, 13 bp, C. elegans
aaacttatagaaa

SEQ ID NO: 686660 - DNA, 13 bp, C. elegans
aaacttatcaaat

SEQ ID NO: 686661 - DNA, 13 bp, C. elegans
aaacttatcgaaa

SEQ ID NO: 686662 - DNA, 13 bp, C. elegans
aaacttatgattt

SEQ ID NO: 686663 - DNA, 13 bp, C. elegans
aaacttatggaaa

SEQ ID NO: 686664 - DNA, 13 bp, C. elegans
aaacttattcaaa

SEQ ID NO: 686665 - DNA, 13 bp, C. elegans
aaacttattgaaa

SEQ ID NO: 686666 - DNA, 13 bp, C. elegans
aaacttattgact

SEQ ID NO: 686667 - DNA, 13 bp, C. elegans
aaacttattgatt

SEQ ID NO: 686668 - DNA, 13 bp, C. elegans
aaacttatttcaa

SEQ ID NO: 686669 - DNA, 13 bp, C. elegans
aaacttatttcag

SEQ ID NO: 686670 - DNA, 13 bp, C. elegans
aaacttatttctc

SEQ ID NO: 686671 - DNA, 13 bp, C. elegans
aaacttattttca

SEQ ID NO: 686672 - DNA, 13 bp, C. elegans
aaacttattttga

SEQ ID NO: 686673 - DNA, 13 bp, C. elegans
aaacttcaaaact

SEQ ID NO: 686674 - DNA, 13 bp, C. elegans
aaacttcaaaatt

SEQ ID NO: 686675 - DNA, 13 bp, C. elegans
aaacttcaaagaa

SEQ ID NO: 686676 - DNA, 13 bp, C. elegans
aaacttcaaatta

SEQ ID NO: 686677 - DNA, 13 bp, C. elegans
aaacttcaaattt

SEQ ID NO: 686678 - DNA, 13 bp, C. elegans
aaacttcaactaa

SEQ ID NO: 686679 - DNA, 13 bp, C. elegans
aaacttcaagatt

SEQ ID NO: 686680 - DNA, 13 bp, C. elegans
aaacttcaatatt

SEQ ID NO: 686681 - DNA, 13 bp, C. elegans
aaacttcaatcaa

SEQ ID NO: 686682 - DNA, 13 bp, C. elegans
aaacttcaatctc

SEQ ID NO: 686683 - DNA, 13 bp, C. elegans
aaacttcaattta

SEQ ID NO: 686684 - DNA, 13 bp, C. elegans
aaacttcaatttc

SEQ ID NO: 686685 - DNA, 13 bp, C. elegans
aaacttcaatttt

SEQ ID NO: 686686 - DNA, 13 bp, C. elegans
aaacttcacaaat

SEQ ID NO: 686687 - DNA, 13 bp, C. elegans
aaacttcacaatt

SEQ ID NO: 686688 - DNA, 13 bp, C. elegans
aaacttcaccaaa

SEQ ID NO: 686689 - DNA, 13 bp, C. elegans
aaacttcaccaca

SEQ ID NO: 686690 - DNA, 13 bp, C. elegans
aaacttcactttt

SEQ ID NO: 686691 - DNA, 13 bp, C. elegans
aaacttcagaata

SEQ ID NO: 686692 - DNA, 13 bp, C. elegans
aaacttcagtttt

SEQ ID NO: 686693 - DNA, 13 bp, C. elegans
aaacttcataact

SEQ ID NO: 686694 - DNA, 13 bp, C. elegans
aaacttcatcgat

SEQ ID NO: 686695 - DNA, 13 bp, C. elegans
aaacttcattaaa

SEQ ID NO: 686696 - DNA, 13 bp, C. elegans
aaacttcattaat

SEQ ID NO: 686697 - DNA, 13 bp, C. elegans
aaacttcattatt

SEQ ID NO: 686698 - DNA, 13 bp, C. elegans
aaacttcattttt

SEQ ID NO: 686699 - DNA, 13 bp, C. elegans
aaacttccaaact

SEQ ID NO: 686700 - DNA, 13 bp, C. elegans
aaacttccaaatg

SEQ ID NO: 686701 - DNA, 13 bp, C. elegans
aaacttccaataa

SEQ ID NO: 686702 - DNA, 13 bp, C. elegans
aaacttccaatta

SEQ ID NO: 686703 - DNA, 13 bp, C. elegans
aaacttccaattt

SEQ ID NO: 686704 - DNA, 13 bp, C. elegans
aaacttccagaaa

SEQ ID NO: 686705 - DNA, 13 bp, C. elegans
aaacttccagaag

SEQ ID NO: 686706 - DNA, 13 bp, C. elegans
aaacttccagttt

SEQ ID NO: 686707 - DNA, 13 bp, C. elegans
aaacttccgaatt

SEQ ID NO: 686708 - DNA, 13 bp, C. elegans
aaacttccgacaa

SEQ ID NO: 686709 - DNA, 13 bp, C. elegans
aaacttccggcaa

SEQ ID NO: 686710 - DNA, 13 bp, C. elegans
aaacttcctgaaa

SEQ ID NO: 686711 - DNA, 13 bp, C. elegans
aaacttcgaaaat

SEQ ID NO: 686712 - DNA, 13 bp, C. elegans
aaacttcgaaacc

SEQ ID NO: 686713 - DNA, 13 bp, C. elegans
aaacttcgaatta

SEQ ID NO: 686714 - DNA, 13 bp, C. elegans
aaacttcgaattt

SEQ ID NO: 686715 - DNA, 13 bp, C. elegans
aaacttcgagaat

SEQ ID NO: 686716 - DNA, 13 bp, C. elegans
aaacttcgatttt

SEQ ID NO: 686717 - DNA, 13 bp, C. elegans
aaacttcggaaaa

SEQ ID NO: 686718 - DNA, 13 bp, C. elegans
aaacttcgttttt

SEQ ID NO: 686719 - DNA, 13 bp, C. elegans
aaacttctaaaat

SEQ ID NO: 686720 - DNA, 13 bp, C. elegans
aaacttctaaatt

SEQ ID NO: 686721 - DNA, 13 bp, C. elegans
aaacttctacaaa

SEQ ID NO: 686722 - DNA, 13 bp, C. elegans
aaacttctacaat

SEQ ID NO: 686723 - DNA, 13 bp, C. elegans
aaacttctacatt

SEQ ID NO: 686724 - DNA, 13 bp, C. elegans
aaacttctagaac

SEQ ID NO: 686725 - DNA, 13 bp, C. elegans
aaacttctagttt

SEQ ID NO: 686726 - DNA, 13 bp, C. elegans
aaacttctatttt

SEQ ID NO: 686727 - DNA, 13 bp, C. elegans
aaacttctcaaaa

SEQ ID NO: 686728 - DNA, 14 bp, C. elegans
aaacttctcaaaat

SEQ ID NO: 686729 - DNA, 13 bp, C. elegans
aaacttctctcaa

SEQ ID NO: 686730 - DNA, 13 bp, C. elegans
aaacttctgaaaa

SEQ ID NO: 686731 - DNA, 13 bp, C. elegans
aaacttctgaatt

SEQ ID NO: 686732 - DNA, 13 bp, C. elegans
aaacttctggatt

SEQ ID NO: 686733 - DNA, 13 bp, C. elegans
aaacttcttagaa

SEQ ID NO: 686734 - DNA, 13 bp, C. elegans
aaacttcttcaaa

SEQ ID NO: 686735 - DNA, 13 bp, C. elegans
aaacttcttccaa

SEQ ID NO: 686736 - DNA, 13 bp, C. elegans
aaacttcttgaaa

SEQ ID NO: 686737 - DNA, 13 bp, C. elegans
aaacttcttgaat

SEQ ID NO: 686738 - DNA, 13 bp, C. elegans
aaacttcttgttt

SEQ ID NO: 686739 - DNA, 13 bp, C. elegans
aaacttctttcaa

SEQ ID NO: 686740 - DNA, 13 bp, C. elegans
aaacttctttgaa

SEQ ID NO: 686741 - DNA, 13 bp, C. elegans
aaacttgaaaact

SEQ ID NO: 686742 - DNA, 13 bp, C. elegans
aaacttgaaaata

SEQ ID NO: 686743 - DNA, 13 bp, C. elegans
aaacttgaaaatc

SEQ ID NO: 686744 - DNA, 13 bp, C. elegans
aaacttgaaaatg

SEQ ID NO: 686745 - DNA, 13 bp, C. elegans
aaacttgaaagtt

SEQ ID NO: 686746 - DNA, 13 bp, C. elegans
aaacttgaacatt

SEQ ID NO: 686747 - DNA, 13 bp, C. elegans
aaacttgaagaaa

SEQ ID NO: 686748 - DNA, 13 bp, C. elegans
aaacttgaagttt

SEQ ID NO: 686749 - DNA, 13 bp, C. elegans
aaacttgaataaa

SEQ ID NO: 686750 - DNA, 13 bp, C. elegans
aaacttgaatgtt

SEQ ID NO: 686751 - DNA, 13 bp, C. elegans
aaacttgaattaa

SEQ ID NO: 686752 - DNA, 13 bp, C. elegans
aaacttgaattcc

SEQ ID NO: 686753 - DNA, 13 bp, C. elegans
aaacttgactgaa

SEQ ID NO: 686754 - DNA, 13 bp, C. elegans
aaacttgataaaa

SEQ ID NO: 686755 - DNA, 13 bp, C. elegans
aaacttgataaac

SEQ ID NO: 686756 - DNA, 13 bp, C. elegans
aaacttgatgaaa

SEQ ID NO: 686757 - DNA, 13 bp, C. elegans
aaacttgattaaa

SEQ ID NO: 686758 - DNA, 13 bp, C. elegans
aaacttgatttga

SEQ ID NO: 686759 - DNA, 13 bp, C. elegans
aaacttgattttt

SEQ ID NO: 686760 - DNA, 13 bp, C. elegans
aaacttgcaataa

SEQ ID NO: 686761 - DNA, 13 bp, C. elegans
aaacttgcaattt

SEQ ID NO: 686762 - DNA, 13 bp, C. elegans
aaacttgcacatt

SEQ ID NO: 686763 - DNA, 13 bp, C. elegans
aaacttgcagttt

SEQ ID NO: 686764 - DNA, 13 bp, C. elegans
aaacttgccaaat

SEQ ID NO: 686765 - DNA, 13 bp, C. elegans
aaacttgccattt

SEQ ID NO: 686766 - DNA, 13 bp, C. elegans
aaacttgccgaaa

SEQ ID NO: 686767 - DNA, 13 bp, C. elegans
aaacttgctcaaa

SEQ ID NO: 686768 - DNA, 13 bp, C. elegans
aaacttgctgaaa

SEQ ID NO: 686769 - DNA, 13 bp, C. elegans
aaacttggaaaaa

SEQ ID NO: 686770 - DNA, 13 bp, C. elegans
aaacttggaaatt

SEQ ID NO: 686771 - DNA, 13 bp, C. elegans
aaacttggatttt

SEQ ID NO: 686772 - DNA, 13 bp, C. elegans
aaacttggcaaat

SEQ ID NO: 686773 - DNA, 13 bp, C. elegans
aaacttggcaatt

SEQ ID NO: 686774 - DNA, 13 bp, C. elegans
aaacttggcccaa

SEQ ID NO: 686775 - DNA, 13 bp, C. elegans
aaacttgggttaa

SEQ ID NO: 686776 - DNA, 13 bp, C. elegans
aaacttggtacat

SEQ ID NO: 686777 - DNA, 13 bp, C. elegans
aaacttggttttt

SEQ ID NO: 686778 - DNA, 13 bp, C. elegans
aaacttgtaaaaa

SEQ ID NO: 686779 - DNA, 13 bp, C. elegans
aaacttgtaattt

SEQ ID NO: 686780 - DNA, 13 bp, C. elegans
aaacttgtagttt

SEQ ID NO: 686781 - DNA, 13 bp, C. elegans
aaacttgtatttt

SEQ ID NO: 686782 - DNA, 13 bp, C. elegans
aaacttgtcaact

SEQ ID NO: 686783 - DNA, 13 bp, C. elegans
aaacttgtctgaa

SEQ ID NO: 686784 - DNA, 13 bp, C. elegans
aaacttgtgaaat

SEQ ID NO: 686785 - DNA, 13 bp, C. elegans
aaacttgttaatt

SEQ ID NO: 686786 - DNA, 13 bp, C. elegans
aaacttgttcagt

SEQ ID NO: 686787 - DNA, 13 bp, C. elegans
aaacttgttgaaa

SEQ ID NO: 686788 - DNA, 13 bp, C. elegans
aaacttgtttatt

SEQ ID NO: 686789 - DNA, 13 bp, C. elegans
aaacttgttttca

SEQ ID NO: 686790 - DNA, 13 bp, C. elegans
aaacttgttttct

SEQ ID NO: 686791 - DNA, 13 bp, C. elegans
aaacttgttttgt

SEQ ID NO: 686792 - DNA, 13 bp, C. elegans
aaacttgtttttt

SEQ ID NO: 686793 - DNA, 13 bp, C. elegans
aaactttaaaaag

SEQ ID NO: 686794 - DNA, 13 bp, C. elegans
aaactttaaaact

SEQ ID NO: 686795 - DNA, 13 bp, C. elegans
aaactttaaagta

SEQ ID NO: 686796 - DNA, 13 bp, C. elegans
aaactttaagatt

SEQ ID NO: 686797 - DNA, 13 bp, C. elegans
aaactttacacaa

SEQ ID NO: 686798 - DNA, 13 bp, C. elegans
aaactttagaaaa

SEQ ID NO: 686799 - DNA, 13 bp, C. elegans
aaactttatcaaa

SEQ ID NO: 686800 - DNA, 13 bp, C. elegans
aaactttatgttt

SEQ ID NO: 686801 - DNA, 13 bp, C. elegans
aaactttatttct

SEQ ID NO: 686802 - DNA, 13 bp, C. elegans
aaactttattttc

SEQ ID NO: 686803 - DNA, 13 bp, C. elegans
aaactttcaaaat

SEQ ID NO: 686804 - DNA, 13 bp, C. elegans
aaactttcaaatt

SEQ ID NO: 686805 - DNA, 13 bp, C. elegans
aaactttcaactt

SEQ ID NO: 686806 - DNA, 13 bp, C. elegans
aaactttcagaaa

SEQ ID NO: 686807 - DNA, 13 bp, C. elegans
aaactttcagatt

SEQ ID NO: 686808 - DNA, 13 bp, C. elegans
aaactttcatgtt

SEQ ID NO: 686809 - DNA, 13 bp, C. elegans
aaactttcatttt

SEQ ID NO: 686810 - DNA, 13 bp, C. elegans
aaactttccaaaa

SEQ ID NO: 686811 - DNA, 13 bp, C. elegans
aaactttccaatt

SEQ ID NO: 686812 - DNA, 13 bp, C. elegans
aaactttccagaa

SEQ ID NO: 686813 - DNA, 13 bp, C. elegans
aaactttcgaaaa

SEQ ID NO: 686814 - DNA, 13 bp, C. elegans
aaactttcgaaat

SEQ ID NO: 686815 - DNA, 13 bp, C. elegans
aaactttcgagaa

SEQ ID NO: 686816 - DNA, 13 bp, C. elegans
aaactttcgagag

SEQ ID NO: 686817 - DNA, 13 bp, C. elegans
aaactttcggaaa

SEQ ID NO: 686818 - DNA, 13 bp, C. elegans
aaactttcggaat

SEQ ID NO: 686819 - DNA, 13 bp, C. elegans
aaactttctatta

SEQ ID NO: 686820 - DNA, 13 bp, C. elegans
aaactttctgaat

SEQ ID NO: 686821 - DNA, 13 bp, C. elegans
aaactttctggaa

SEQ ID NO: 686822 - DNA, 13 bp, C. elegans
aaactttcttgtt

SEQ ID NO: 686823 - DNA, 13 bp, C. elegans
aaactttctttca

SEQ ID NO: 686824 - DNA, 13 bp, C. elegans
aaactttgaaaaa

SEQ ID NO: 686825 - DNA, 13 bp, C. elegans
aaactttgaaaat

SEQ ID NO: 686826 - DNA, 13 bp, C. elegans
aaactttgaaact

SEQ ID NO: 686827 - DNA, 13 bp, C. elegans
aaactttgaaatt

SEQ ID NO: 686828 - DNA, 13 bp, C. elegans
aaactttgaacaa

SEQ ID NO: 686829 - DNA, 13 bp, C. elegans
aaactttgaactt

SEQ ID NO: 686830 - DNA, 13 bp, C. elegans
aaactttgaagga

SEQ ID NO: 686831 - DNA, 13 bp, C. elegans
aaactttgaatat

SEQ ID NO: 686832 - DNA, 13 bp, C. elegans
aaactttgaattt

SEQ ID NO: 686833 - DNA, 13 bp, C. elegans
aaactttgacaat

SEQ ID NO: 686834 - DNA, 13 bp, C. elegans
aaactttgactgg

SEQ ID NO: 686835 - DNA, 13 bp, C. elegans
aaactttgagaaa

SEQ ID NO: 686836 - DNA, 13 bp, C. elegans
aaactttgagatt

SEQ ID NO: 686837 - DNA, 13 bp, C. elegans
aaactttgagttt

SEQ ID NO: 686838 - DNA, 13 bp, C. elegans
aaactttgattat

SEQ ID NO: 686839 - DNA, 13 bp, C. elegans
aaactttgattca

SEQ ID NO: 686840 - DNA, 13 bp, C. elegans
aaactttgatttt

SEQ ID NO: 686841 - DNA, 13 bp, C. elegans
aaactttgcaaat

SEQ ID NO: 686842 - DNA, 13 bp, C. elegans
aaactttggttta

SEQ ID NO: 686843 - DNA, 13 bp, C. elegans
aaactttgtaaat

SEQ ID NO: 686844 - DNA, 13 bp, C. elegans
aaactttgtaatt

SEQ ID NO: 686845 - DNA, 13 bp, C. elegans
aaactttgtagta

SEQ ID NO: 686846 - DNA, 13 bp, C. elegans
aaactttgtattt

SEQ ID NO: 686847 - DNA, 13 bp, C. elegans
aaactttgtcaaa

SEQ ID NO: 686848 - DNA, 13 bp, C. elegans
aaactttgtgaaa

SEQ ID NO: 686849 - DNA, 13 bp, C. elegans
aaactttgttaat

SEQ ID NO: 686850 - DNA, 13 bp, C. elegans
aaactttgtttta

SEQ ID NO: 686851 - DNA, 13 bp, C. elegans
aaactttgttttc

SEQ ID NO: 686852 - DNA, 13 bp, C. elegans
aaactttgttttt

SEQ ID NO: 686853 - DNA, 13 bp, C. elegans
aaacttttaaaac

SEQ ID NO: 686854 - DNA, 13 bp, C. elegans
aaacttttagaaa

SEQ ID NO: 686855 - DNA, 13 bp, C. elegans
aaacttttatgaa

SEQ ID NO: 686856 - DNA, 13 bp, C. elegans
aaacttttattca

SEQ ID NO: 686857 - DNA, 13 bp, C. elegans
aaacttttcaaaa

SEQ ID NO: 686858 - DNA, 13 bp, C. elegans
aaacttttcaaat

SEQ ID NO: 686859 - DNA, 13 bp, C. elegans
aaacttttcaata

SEQ ID NO: 686860 - DNA, 13 bp, C. elegans
aaacttttcagaa

SEQ ID NO: 686861 - DNA, 13 bp, C. elegans
aaacttttccaaa

SEQ ID NO: 686862 - DNA, 13 bp, C. elegans
aaacttttccaat

SEQ ID NO: 686863 - DNA, 13 bp, C. elegans
aaacttttcctcg

SEQ ID NO: 686864 - DNA, 13 bp, C. elegans
aaacttttccttt

SEQ ID NO: 686865 - DNA, 13 bp, C. elegans
aaacttttcgaaa

SEQ ID NO: 686866 - DNA, 13 bp, C. elegans
aaacttttgaaaa

SEQ ID NO: 686867 - DNA, 13 bp, C. elegans
aaacttttgaaat

SEQ ID NO: 686868 - DNA, 13 bp, C. elegans
aaacttttgaaca

SEQ ID NO: 686869 - DNA, 13 bp, C. elegans
aaacttttgataa

SEQ ID NO: 686870 - DNA, 13 bp, C. elegans
aaacttttgatga

SEQ ID NO: 686871 - DNA, 13 bp, C. elegans
aaacttttgattg

SEQ ID NO: 686872 - DNA, 13 bp, C. elegans
aaacttttgattt

SEQ ID NO: 686873 - DNA, 13 bp, C. elegans
aaacttttggaaa

SEQ ID NO: 686874 - DNA, 13 bp, C. elegans
aaacttttgggaa

SEQ ID NO: 686875 - DNA, 13 bp, C. elegans
aaacttttgtaaa

SEQ ID NO: 686876 - DNA, 13 bp, C. elegans
aaacttttgtaat

SEQ ID NO: 686877 - DNA, 13 bp, C. elegans
aaactttttacaa

SEQ ID NO: 686878 - DNA, 13 bp, C. elegans
aaactttttagaa

SEQ ID NO: 686879 - DNA, 13 bp, C. elegans
aaactttttatca

SEQ ID NO: 686880 - DNA, 13 bp, C. elegans
aaactttttcaaa

SEQ ID NO: 686881 - DNA, 13 bp, C. elegans
aaactttttcatt

SEQ ID NO: 686882 - DNA, 13 bp, C. elegans
aaactttttccca

SEQ ID NO: 686883 - DNA, 13 bp, C. elegans
aaactttttctgc

SEQ ID NO: 686884 - DNA, 13 bp, C. elegans
aaactttttctta

SEQ ID NO: 686885 - DNA, 14 bp, C. elegans
aaactttttgaaat

SEQ ID NO: 686886 - DNA, 13 bp, C. elegans
aaactttttgaat

SEQ ID NO: 686887 - DNA, 13 bp, C. elegans
aaactttttgagt

SEQ ID NO: 686888 - DNA, 13 bp, C. elegans
aaactttttgcaa

SEQ ID NO: 686889 - DNA, 13 bp, C. elegans
aaactttttgtcg

SEQ ID NO: 686890 - DNA, 13 bp, C. elegans
aaactttttgtta

SEQ ID NO: 686891 - DNA, 13 bp, C. elegans
aaactttttgttt

SEQ ID NO: 686892 - DNA, 13 bp, C. elegans
aaacttttttcaa

SEQ ID NO: 686893 - DNA, 13 bp, C. elegans
aaacttttttcta

SEQ ID NO: 686894 - DNA, 13 bp, C. elegans
aaacttttttctg

SEQ ID NO: 686895 - DNA, 13 bp, C. elegans
aaacttttttgaa

SEQ ID NO: 686896 - DNA, 13 bp, C. elegans
aaacttttttgca

SEQ ID NO: 686897 - DNA, 13 bp, C. elegans
aaacttttttgta

SEQ ID NO: 686898 - DNA, 13 bp, C. elegans
aaactttttttca

SEQ ID NO: 686899 - DNA, 13 bp, C. elegans
aaactttttttcg

SEQ ID NO: 686900 - DNA, 13 bp, C. elegans
aaactttttttgt

SEQ ID NO: 686901 - DNA, 13 bp, C. elegans
aaagaaaaagctc

SEQ ID NO: 686902 - DNA, 13 bp, C. elegans
aaagaaaaatctt

SEQ ID NO: 686903 - DNA, 13 bp, C. elegans
aaagaaaacagtt

SEQ ID NO: 686904 - DNA, 13 bp, C. elegans
aaagaaaacatct

SEQ ID NO: 686905 - DNA, 13 bp, C. elegans
aaagaaaacttac

SEQ ID NO: 686906 - DNA, 13 bp, C. elegans
aaagaaaaggtgt

SEQ ID NO: 686907 - DNA, 13 bp, C. elegans
aaagaaaagtttc

SEQ ID NO: 686908 - DNA, 13 bp, C. elegans
aaagaaaatcagt

SEQ ID NO: 686909 - DNA, 13 bp, C. elegans
aaagaaaatcgga

SEQ ID NO: 686910 - DNA, 13 bp, C. elegans
aaagaaaatctga

SEQ ID NO: 686911 - DNA, 13 bp, C. elegans
aaagaaaatctgt

SEQ ID NO: 686912 - DNA, 13 bp, C. elegans
aaagaaaatgtca

SEQ ID NO: 686913 - DNA, 13 bp, C. elegans
aaagaaaattatc

SEQ ID NO: 686914 - DNA, 13 bp, C. elegans
aaagaaaattgtt

SEQ ID NO: 686915 - DNA, 13 bp, C. elegans
aaagaaaatttca

SEQ ID NO: 686916 - DNA, 13 bp, C. elegans
aaagaaacaattt

SEQ ID NO: 686917 - DNA, 13 bp, C. elegans
aaagaaacacttt

SEQ ID NO: 686918 - DNA, 13 bp, C. elegans
aaagaaacatgat

SEQ ID NO: 686919 - DNA, 13 bp, C. elegans
aaagaaacttcaa

SEQ ID NO: 686920 - DNA, 13 bp, C. elegans
aaagaaactttca

SEQ ID NO: 686921 - DNA, 13 bp, C. elegans
aaagaaagagttt

SEQ ID NO: 686922 - DNA, 13 bp, C. elegans
aaagaaagtgtga

SEQ ID NO: 686923 - DNA, 13 bp, C. elegans
aaagaaagttttc

SEQ ID NO: 686924 - DNA, 13 bp, C. elegans
aaagaaataattc

SEQ ID NO: 686925 - DNA, 13 bp, C. elegans
aaagaaatcaact

SEQ ID NO: 686926 - DNA, 13 bp, C. elegans
aaagaaatcatat

SEQ ID NO: 686927 - DNA, 13 bp, C. elegans
aaagaaatctgaa

SEQ ID NO: 686928 - DNA, 13 bp, C. elegans
aaagaaatgccaa

SEQ ID NO: 686929 - DNA, 13 bp, C. elegans
aaagaaatgtcaa

SEQ ID NO: 686930 - DNA, 13 bp, C. elegans
aaagaaatgttga

SEQ ID NO: 686931 - DNA, 13 bp, C. elegans
aaagaaattcaac

SEQ ID NO: 686932 - DNA, 13 bp, C. elegans
aaagaaattcagt

SEQ ID NO: 686933 - DNA, 13 bp, C. elegans
aaagaaattgttt

SEQ ID NO: 686934 - DNA, 13 bp, C. elegans
aaagaaatttcaa

SEQ ID NO: 686935 - DNA, 13 bp, C. elegans
aaagaacaacttt

SEQ ID NO: 686936 - DNA, 13 bp, C. elegans
aaagaacaagttt

SEQ ID NO: 686937 - DNA, 13 bp, C. elegans
aaagaacaattat

SEQ ID NO: 686938 - DNA, 13 bp, C. elegans
aaagaacacattc

SEQ ID NO: 686939 - DNA, 13 bp, C. elegans
aaagaacatgttt

SEQ ID NO: 686940 - DNA, 13 bp, C. elegans
aaagaacattttt

SEQ ID NO: 686941 - DNA, 13 bp, C. elegans
aaagaaccacctt

SEQ ID NO: 686942 - DNA, 13 bp, C. elegans
aaagaacttacta

SEQ ID NO: 686943 - DNA, 13 bp, C. elegans
aaagaacttgaaa

SEQ ID NO: 686944 - DNA, 13 bp, C. elegans
aaagaagaagctt

SEQ ID NO: 686945 - DNA, 13 bp, C. elegans
aaagaagagacgc

SEQ ID NO: 686946 - DNA, 13 bp, C. elegans
aaagaagagtttt

SEQ ID NO: 686947 - DNA, 13 bp, C. elegans
aaagaagttaatt

SEQ ID NO: 686948 - DNA, 13 bp, C. elegans
aaagaagttatga

SEQ ID NO: 686949 - DNA, 13 bp, C. elegans
aaagaagttcaaa

SEQ ID NO: 686950 - DNA, 13 bp, C. elegans
aaagaagttgcta

SEQ ID NO: 686951 - DNA, 13 bp, C. elegans
aaagaagttttaa

SEQ ID NO: 686952 - DNA, 13 bp, C. elegans
aaagaagtttttt

SEQ ID NO: 686953 - DNA, 13 bp, C. elegans
aaagaatattcaa

SEQ ID NO: 686954 - DNA, 13 bp, C. elegans
aaagaatattgat

SEQ ID NO: 686955 - DNA, 13 bp, C. elegans
aaagaatctcaaa

SEQ ID NO: 686956 - DNA, 13 bp, C. elegans
aaagaatgtgcaa

SEQ ID NO: 686957 - DNA, 13 bp, C. elegans
aaagaattatcaa

SEQ ID NO: 686958 - DNA, 13 bp, C. elegans
aaagaattattga

SEQ ID NO: 686959 - DNA, 13 bp, C. elegans
aaagaattcagaa

SEQ ID NO: 686960 - DNA, 13 bp, C. elegans
aaagaattcgaaa

SEQ ID NO: 686961 - DNA, 13 bp, C. elegans
aaagaattcgatt

SEQ ID NO: 686962 - DNA, 13 bp, C. elegans
aaagaatttgaat

SEQ ID NO: 686963 - DNA, 13 bp, C. elegans
aaagaatttgcaa

SEQ ID NO: 686964 - DNA, 13 bp, C. elegans
aaagaattttcaa

SEQ ID NO: 686965 - DNA, 13 bp, C. elegans
aaagaattttgaa

SEQ ID NO: 686966 - DNA, 13 bp, C. elegans
aaagacacaattt

SEQ ID NO: 686967 - DNA, 13 bp, C. elegans
aaagaccatcgtt

SEQ ID NO: 686968 - DNA, 13 bp, C. elegans
aaagacgataatt

SEQ ID NO: 686969 - DNA, 13 bp, C. elegans
aaagactcaaatt

SEQ ID NO: 686970 - DNA, 13 bp, C. elegans
aaagagaaagttg

SEQ ID NO: 686971 - DNA, 13 bp, C. elegans
aaagagaaagttt

SEQ ID NO: 686972 - DNA, 13 bp, C. elegans
aaagagaaatcga

SEQ ID NO: 686973 - DNA, 13 bp, C. elegans
aaagagaatgtgt

SEQ ID NO: 686974 - DNA, 13 bp, C. elegans
aaagagaattttg

SEQ ID NO: 686975 - DNA, 13 bp, C. elegans
aaagagacgcaga

SEQ ID NO: 686976 - DNA, 13 bp, C. elegans
aaagagattttca

SEQ ID NO: 686977 - DNA, 13 bp, C. elegans
aaagagcaaaagt

SEQ ID NO: 686978 - DNA, 13 bp, C. elegans
aaagagcaaaatg

SEQ ID NO: 686979 - DNA, 13 bp, C. elegans
aaagagcaaatat

SEQ ID NO: 686980 - DNA, 13 bp, C. elegans
aaagagcatttga

SEQ ID NO: 686981 - DNA, 13 bp, C. elegans
aaagagcattttg

SEQ ID NO: 686982 - DNA, 13 bp, C. elegans
aaagagctcaaaa

SEQ ID NO: 686983 - DNA, 13 bp, C. elegans
aaagagctgaaat

SEQ ID NO: 686984 - DNA, 13 bp, C. elegans
aaagagcttaaaa

SEQ ID NO: 686985 - DNA, 13 bp, C. elegans
aaagagcttgaaa

SEQ ID NO: 686986 - DNA, 13 bp, C. elegans
aaagaggaaattg

SEQ ID NO: 686987 - DNA, 13 bp, C. elegans
aaagagtaaaacg

SEQ ID NO: 686988 - DNA, 13 bp, C. elegans
aaagagtactgta

SEQ ID NO: 686989 - DNA, 13 bp, C. elegans
aaagagttcaact

SEQ ID NO: 686990 - DNA, 13 bp, C. elegans
aaagagttcattt

SEQ ID NO: 686991 - DNA, 13 bp, C. elegans
aaagagttctcaa

SEQ ID NO: 686992 - DNA, 13 bp, C. elegans
aaagagtttcaaa

SEQ ID NO: 686993 - DNA, 13 bp, C. elegans
aaagagttttgaa

SEQ ID NO: 686994 - DNA, 13 bp, C. elegans
aaagataaatgtt

SEQ ID NO: 686995 - DNA, 13 bp, C. elegans
aaagatattcaaa

SEQ ID NO: 686996 - DNA, 13 bp, C. elegans
aaagatatttcaa

SEQ ID NO: 686997 - DNA, 13 bp, C. elegans
aaagatatttgaa

SEQ ID NO: 686998 - DNA, 13 bp, C. elegans
aaagatcaaaagt

SEQ ID NO: 686999 - DNA, 13 bp, C. elegans
aaagatcaattga

SEQ ID NO: 687000 - DNA, 13 bp, C. elegans
aaagatcactgaa

SEQ ID NO: 687001 - DNA, 14 bp, C. elegans
aaagatcggaagaa

SEQ ID NO: 687002 - DNA, 13 bp, C. elegans
aaagatctaaatg

SEQ ID NO: 687003 - DNA, 13 bp, C. elegans
aaagatctcacca

SEQ ID NO: 687004 - DNA, 13 bp, C. elegans
aaagatctgaaaa

SEQ ID NO: 687005 - DNA, 13 bp, C. elegans
aaagatctggaaa

SEQ ID NO: 687006 - DNA, 13 bp, C. elegans
aaagatgattttt

SEQ ID NO: 687007 - DNA, 13 bp, C. elegans
aaagatggaaaac

SEQ ID NO: 687008 - DNA, 13 bp, C. elegans
aaagatggaaaca

SEQ ID NO: 687009 - DNA, 13 bp, C. elegans
aaagatggaattg

SEQ ID NO: 687010 - DNA, 13 bp, C. elegans
aaagatggagtag

SEQ ID NO: 687011 - DNA, 13 bp, C. elegans
aaagatgttattt

SEQ ID NO: 687012 - DNA, 13 bp, C. elegans
aaagatgttcaaa

SEQ ID NO: 687013 - DNA, 13 bp, C. elegans
aaagatgtttttt

SEQ ID NO: 687014 - DNA, 13 bp, C. elegans
aaagattagtttt

SEQ ID NO: 687015 - DNA, 13 bp, C. elegans
aaagattcaataa

SEQ ID NO: 687016 - DNA, 13 bp, C. elegans
aaagattccaaaa

SEQ ID NO: 687017 - DNA, 13 bp, C. elegans
aaagattctgaaa

SEQ ID NO: 687018 - DNA, 13 bp, C. elegans
aaagattgatttt

SEQ ID NO: 687019 - DNA, 13 bp, C. elegans
aaagatttaaatg

SEQ ID NO: 687020 - DNA, 13 bp, C. elegans
aaagatttcaaat

SEQ ID NO: 687021 - DNA, 13 bp, C. elegans
aaagatttcaaga

SEQ ID NO: 687022 - DNA, 13 bp, C. elegans
aaagatttcattt

SEQ ID NO: 687023 - DNA, 13 bp, C. elegans
aaagatttccaaa

SEQ ID NO: 687024 - DNA, 13 bp, C. elegans
aaagatttcgaat

SEQ ID NO: 687025 - DNA, 13 bp, C. elegans
aaagatttgagaa

SEQ ID NO: 687026 - DNA, 13 bp, C. elegans
aaagatttggaaa

SEQ ID NO: 687027 - DNA, 13 bp, C. elegans
aaagattttattg

SEQ ID NO: 687028 - DNA, 13 bp, C. elegans
aaagattttcaga

SEQ ID NO: 687029 - DNA, 13 bp, C. elegans
aaagattttgaga

SEQ ID NO: 687030 - DNA, 13 bp, C. elegans
aaagattttgatt

SEQ ID NO: 687031 - DNA, 13 bp, C. elegans
aaagattttgcaa

SEQ ID NO: 687032 - DNA, 13 bp, C. elegans
aaagattttgtta

SEQ ID NO: 687033 - DNA, 13 bp, C. elegans
aaagatttttgca

SEQ ID NO: 687034 - DNA, 13 bp, C. elegans
aaagattttttag

SEQ ID NO: 687035 - DNA, 13 bp, C. elegans
aaagcaaaatatt

SEQ ID NO: 687036 - DNA, 13 bp, C. elegans
aaagcaaatattt

SEQ ID NO: 687037 - DNA, 13 bp, C. elegans
aaagcaagaaatt

SEQ ID NO: 687038 - DNA, 13 bp, C. elegans
aaagcaagtacaa

SEQ ID NO: 687039 - DNA, 13 bp, C. elegans
aaagcaataaatt

SEQ ID NO: 687040 - DNA, 13 bp, C. elegans
aaagcaatattta

SEQ ID NO: 687041 - DNA, 13 bp, C. elegans
aaagcaattattt

SEQ ID NO: 687042 - DNA, 13 bp, C. elegans
aaagcaattgaaa

SEQ ID NO: 687043 - DNA, 13 bp, C. elegans
aaagcaattttcc

SEQ ID NO: 687044 - DNA, 13 bp, C. elegans
aaagcaatttttc

SEQ ID NO: 687045 - DNA, 13 bp, C. elegans
aaagcacaaaatg

SEQ ID NO: 687046 - DNA, 13 bp, C. elegans
aaagcacttttga

SEQ ID NO: 687047 - DNA, 13 bp, C. elegans
aaagcagaaaact

SEQ ID NO: 687048 - DNA, 13 bp, C. elegans
aaagcagtggaaa

SEQ ID NO: 687049 - DNA, 13 bp, C. elegans
aaagcataatttt

SEQ ID NO: 687050 - DNA, 13 bp, C. elegans
aaagcatgaaaat

SEQ ID NO: 687051 - DNA, 13 bp, C. elegans
aaagcattgaaaa

SEQ ID NO: 687052 - DNA, 13 bp, C. elegans
aaagcatttgaaa

SEQ ID NO: 687053 - DNA, 13 bp, C. elegans
aaagcattttatt

SEQ ID NO: 687054 - DNA, 13 bp, C. elegans
aaagcattttctt

SEQ ID NO: 687055 - DNA, 13 bp, C. elegans
aaagccaaagcca

SEQ ID NO: 687056 - DNA, 13 bp, C. elegans
aaagccacgtggc

SEQ ID NO: 687057 - DNA, 13 bp, C. elegans
aaagccagaaaat

SEQ ID NO: 687058 - DNA, 13 bp, C. elegans
aaagcccataaat

SEQ ID NO: 687059 - DNA, 13 bp, C. elegans
aaagcctaaaaac

SEQ ID NO: 687060 - DNA, 13 bp, C. elegans
aaagcctaaaatt

SEQ ID NO: 687061 - DNA, 13 bp, C. elegans
aaagcctcaaaaa

SEQ ID NO: 687062 - DNA, 13 bp, C. elegans
aaagcctggaaaa

SEQ ID NO: 687063 - DNA, 13 bp, C. elegans
aaagccttcaaaa

SEQ ID NO: 687064 - DNA, 13 bp, C. elegans
aaagcctttttct

SEQ ID NO: 687065 - DNA, 13 bp, C. elegans
aaagcgaaaaatg

SEQ ID NO: 687066 - DNA, 13 bp, C. elegans
aaagcgaaaaatt

SEQ ID NO: 687067 - DNA, 13 bp, C. elegans
aaagcgaaatgtt

SEQ ID NO: 687068 - DNA, 13 bp, C. elegans
aaagcgaattttc

SEQ ID NO: 687069 - DNA, 13 bp, C. elegans
aaagcgaggaact

SEQ ID NO: 687070 - DNA, 13 bp, C. elegans
aaagcgatttttg

SEQ ID NO: 687071 - DNA, 13 bp, C. elegans
aaagcgatttttt

SEQ ID NO: 687072 - DNA, 13 bp, C. elegans
aaagcggaaaatg

SEQ ID NO: 687073 - DNA, 13 bp, C. elegans
aaagcggaaagtg

SEQ ID NO: 687074 - DNA, 13 bp, C. elegans
aaagctaaaattt

SEQ ID NO: 687075 - DNA, 13 bp, C. elegans
aaagctacaaact

SEQ ID NO: 687076 - DNA, 13 bp, C. elegans
aaagctatcaaga

SEQ ID NO: 687077 - DNA, 13 bp, C. elegans
aaagctattttaa

SEQ ID NO: 687078 - DNA, 13 bp, C. elegans
aaagctcaaaatt

SEQ ID NO: 687079 - DNA, 13 bp, C. elegans
aaagctcaataaa

SEQ ID NO: 687080 - DNA, 13 bp, C. elegans
aaagctcaatatt

SEQ ID NO: 687081 - DNA, 13 bp, C. elegans
aaagctcacaaaa

SEQ ID NO: 687082 - DNA, 13 bp, C. elegans
aaagctccaaatt

SEQ ID NO: 687083 - DNA, 13 bp, C. elegans
aaagctcgaaaat

SEQ ID NO: 687084 - DNA, 13 bp, C. elegans
aaagctgaaaaga

SEQ ID NO: 687085 - DNA, 13 bp, C. elegans
aaagctgaaaatt

SEQ ID NO: 687086 - DNA, 13 bp, C. elegans
aaagctgaaataa

SEQ ID NO: 687087 - DNA, 13 bp, C. elegans
aaagctgaaatct

SEQ ID NO: 687088 - DNA, 13 bp, C. elegans
aaagctgaaattt

SEQ ID NO: 687089 - DNA, 13 bp, C. elegans
aaagctgacaaaa

SEQ ID NO: 687090 - DNA, 13 bp, C. elegans
aaagctgagaaat

SEQ ID NO: 687091 - DNA, 13 bp, C. elegans
aaagctggaattt

SEQ ID NO: 687092 - DNA, 13 bp, C. elegans
aaagctgttcaaa

SEQ ID NO: 687093 - DNA, 13 bp, C. elegans
aaagcttaaaaat

SEQ ID NO: 687094 - DNA, 13 bp, C. elegans
aaagcttacaaaa

SEQ ID NO: 687095 - DNA, 13 bp, C. elegans
aaagcttacttcg

SEQ ID NO: 687096 - DNA, 13 bp, C. elegans
aaagcttcaaatt

SEQ ID NO: 687097 - DNA, 13 bp, C. elegans
aaagcttcagaaa

SEQ ID NO: 687098 - DNA, 13 bp, C. elegans
aaagcttctagaa

SEQ ID NO: 687099 - DNA, 13 bp, C. elegans
aaagcttctcaaa

SEQ ID NO: 687100 - DNA, 13 bp, C. elegans
aaagcttctgaaa

SEQ ID NO: 687101 - DNA, 13 bp, C. elegans
aaagcttgaaaaa

SEQ ID NO: 687102 - DNA, 13 bp, C. elegans
aaagcttgaaatt

SEQ ID NO: 687103 - DNA, 13 bp, C. elegans
aaagcttgaatcc

SEQ ID NO: 687104 - DNA, 13 bp, C. elegans
aaagcttgaattt

SEQ ID NO: 687105 - DNA, 13 bp, C. elegans
aaagctttaaaat

SEQ ID NO: 687106 - DNA, 13 bp, C. elegans
aaagctttaattt

SEQ ID NO: 687107 - DNA, 13 bp, C. elegans
aaagctttcaaaa

SEQ ID NO: 687108 - DNA, 13 bp, C. elegans
aaagctttgcaaa

SEQ ID NO: 687109 - DNA, 13 bp, C. elegans
aaagctttggaaa

SEQ ID NO: 687110 - DNA, 13 bp, C. elegans
aaagcttttaaaa

SEQ ID NO: 687111 - DNA, 13 bp, C. elegans
aaagcttttcaag

SEQ ID NO: 687112 - DNA, 13 bp, C. elegans
aaagcttttcgaa

SEQ ID NO: 687113 - DNA, 13 bp, C. elegans
aaagcttttgaaa

SEQ ID NO: 687114 - DNA, 13 bp, C. elegans
aaagcttttttgt

SEQ ID NO: 687115 - DNA, 13 bp, C. elegans
aaaggaaaacttt

SEQ ID NO: 687116 - DNA, 13 bp, C. elegans
aaaggaaaattgt

SEQ ID NO: 687117 - DNA, 13 bp, C. elegans
aaaggaaaatttt

SEQ ID NO: 687118 - DNA, 13 bp, C. elegans
aaaggaaactatt

SEQ ID NO: 687119 - DNA, 13 bp, C. elegans
aaaggaaatatgt

SEQ ID NO: 687120 - DNA, 13 bp, C. elegans
aaaggaaattgtg

SEQ ID NO: 687121 - DNA, 13 bp, C. elegans
aaaggaatttgaa

SEQ ID NO: 687122 - DNA, 13 bp, C. elegans
aaaggaattttat

SEQ ID NO: 687123 - DNA, 13 bp, C. elegans
aaaggacaatttt

SEQ ID NO: 687124 - DNA, 13 bp, C. elegans
aaaggagaagctg

SEQ ID NO: 687125 - DNA, 13 bp, C. elegans
aaaggagagtgta

SEQ ID NO: 687126 - DNA, 13 bp, C. elegans
aaaggagtactgt

SEQ ID NO: 687127 - DNA, 13 bp, C. elegans
aaaggcaaaaatg

SEQ ID NO: 687128 - DNA, 13 bp, C. elegans
aaaggccttcttc

SEQ ID NO: 687129 - DNA, 13 bp, C. elegans
aaaggcgcatatc

SEQ ID NO: 687130 - DNA, 13 bp, C. elegans
aaagggcggagcc

SEQ ID NO: 687131 - DNA, 13 bp, C. elegans
aaagggttcaaaa

SEQ ID NO: 687132 - DNA, 17 bp, C. elegans
aaagggttcccgttggc

SEQ ID NO: 687133 - DNA, 13 bp, C. elegans
aaaggttactgta

SEQ ID NO: 687134 - DNA, 13 bp, C. elegans
aaaggtttggaaa

SEQ ID NO: 687135 - DNA, 13 bp, C. elegans
aaaggtttgtttt

SEQ ID NO: 687136 - DNA, 13 bp, C. elegans
aaaggttttcaat

SEQ ID NO: 687137 - DNA, 13 bp, C. elegans
aaaggttttcttt

SEQ ID NO: 687138 - DNA, 13 bp, C. elegans
aaaggttttgaat

SEQ ID NO: 687139 - DNA, 13 bp, C. elegans
aaaggttttggaa

SEQ ID NO: 687140 - DNA, 13 bp, C. elegans
aaaggtttttatt

SEQ ID NO: 687141 - DNA, 13 bp, C. elegans
aaaggtttttgat

SEQ ID NO: 687142 - DNA, 13 bp, C. elegans
aaaggtttttgtg

SEQ ID NO: 687143 - DNA, 13 bp, C. elegans
aaagtaaaacttt

SEQ ID NO: 687144 - DNA, 13 bp, C. elegans
aaagtaaaagttg

SEQ ID NO: 687145 - DNA, 13 bp, C. elegans
aaagtaacatttt

SEQ ID NO: 687146 - DNA, 13 bp, C. elegans
aaagtaacttttt

SEQ ID NO: 687147 - DNA, 13 bp, C. elegans
aaagtaatgaatt

SEQ ID NO: 687148 - DNA, 13 bp, C. elegans
aaagtaatgattt

SEQ ID NO: 687149 - DNA, 13 bp, C. elegans
aaagtaatgtatt

SEQ ID NO: 687150 - DNA, 13 bp, C. elegans
aaagtacacattt

SEQ ID NO: 687151 - DNA, 13 bp, C. elegans
aaagtacagattt

SEQ ID NO: 687152 - DNA, 13 bp, C. elegans
aaagtacagtagt

SEQ ID NO: 687153 - DNA, 13 bp, C. elegans
aaagtacatttaa

SEQ ID NO: 687154 - DNA, 13 bp, C. elegans
aaagtacgagaaa

SEQ ID NO: 687155 - DNA, 13 bp, C. elegans
aaagtacgctgaa

SEQ ID NO: 687156 - DNA, 13 bp, C. elegans
aaagtacggtacc

SEQ ID NO: 687157 - DNA, 13 bp, C. elegans
aaagtactgcaaa

SEQ ID NO: 687158 - DNA, 13 bp, C. elegans
aaagtactttgaa

SEQ ID NO: 687159 - DNA, 13 bp, C. elegans
aaagtagaaattc

SEQ ID NO: 687160 - DNA, 13 bp, C. elegans
aaagtagagattt

SEQ ID NO: 687161 - DNA, 13 bp, C. elegans
aaagtagcatttt

SEQ ID NO: 687162 - DNA, 13 bp, C. elegans
aaagtagttgaaa

SEQ ID NO: 687163 - DNA, 13 bp, C. elegans
aaagtagttttta

SEQ ID NO: 687164 - DNA, 13 bp, C. elegans
aaagtataaaact

SEQ ID NO: 687165 - DNA, 13 bp, C. elegans
aaagtataatcat

SEQ ID NO: 687166 - DNA, 13 bp, C. elegans
aaagtatacaaat

SEQ ID NO: 687167 - DNA, 13 bp, C. elegans
aaagtatacaatt

SEQ ID NO: 687168 - DNA, 13 bp, C. elegans
aaagtatatattc

SEQ ID NO: 687169 - DNA, 13 bp, C. elegans
aaagtatatttct

SEQ ID NO: 687170 - DNA, 13 bp, C. elegans
aaagtatattttc

SEQ ID NO: 687171 - DNA, 13 bp, C. elegans
aaagtatcaaata

SEQ ID NO: 687172 - DNA, 13 bp, C. elegans
aaagtatcataaa

SEQ ID NO: 687173 - DNA, 13 bp, C. elegans
aaagtatcgattt

SEQ ID NO: 687174 - DNA, 13 bp, C. elegans
aaagtatcggaaa

SEQ ID NO: 687175 - DNA, 13 bp, C. elegans
aaagtattacaaa

SEQ ID NO: 687176 - DNA, 13 bp, C. elegans
aaagtattcagaa

SEQ ID NO: 687177 - DNA, 13 bp, C. elegans
aaagtattcgaaa

SEQ ID NO: 687178 - DNA, 13 bp, C. elegans
aaagtattcttca

SEQ ID NO: 687179 - DNA, 13 bp, C. elegans
aaagtattgaaat

SEQ ID NO: 687180 - DNA, 13 bp, C. elegans
aaagtattgcaaa

SEQ ID NO: 687181 - DNA, 13 bp, C. elegans
aaagtattggaaa

SEQ ID NO: 687182 - DNA, 13 bp, C. elegans
aaagtattgtaaa

SEQ ID NO: 687183 - DNA, 13 bp, C. elegans
aaagtattgtttt

SEQ ID NO: 687184 - DNA, 13 bp, C. elegans
aaagtatttattc

SEQ ID NO: 687185 - DNA, 13 bp, C. elegans
aaagtatttccaa

SEQ ID NO: 687186 - DNA, 13 bp, C. elegans
aaagtatttgaaa

SEQ ID NO: 687187 - DNA, 13 bp, C. elegans
aaagtatttgatt

SEQ ID NO: 687188 - DNA, 13 bp, C. elegans
aaagtattttcaa

SEQ ID NO: 687189 - DNA, 13 bp, C. elegans
aaagtattttgaa

SEQ ID NO: 687190 - DNA, 13 bp, C. elegans
aaagtattttgtt

SEQ ID NO: 687191 - DNA, 13 bp, C. elegans
aaagtatttttca

SEQ ID NO: 687192 - DNA, 13 bp, C. elegans
aaagtatttttga

SEQ ID NO: 687193 - DNA, 13 bp, C. elegans
aaagtcaaaactg

SEQ ID NO: 687194 - DNA, 13 bp, C. elegans
aaagtcaaaatta

SEQ ID NO: 687195 - DNA, 13 bp, C. elegans
aaagtcaaatatt

SEQ ID NO: 687196 - DNA, 13 bp, C. elegans
aaagtcaacaatt

SEQ ID NO: 687197 - DNA, 13 bp, C. elegans
aaagtcaatcaaa

SEQ ID NO: 687198 - DNA, 13 bp, C. elegans
aaagtcaattgaa

SEQ ID NO: 687199 - DNA, 13 bp, C. elegans
aaagtcaatttct

SEQ ID NO: 687200 - DNA, 13 bp, C. elegans
aaagtcaatttgt

SEQ ID NO: 687201 - DNA, 13 bp, C. elegans
aaagtcacaaaac

SEQ ID NO: 687202 - DNA, 13 bp, C. elegans
aaagtcatgaaaa

SEQ ID NO: 687203 - DNA, 13 bp, C. elegans
aaagtcattgaaa

SEQ ID NO: 687204 - DNA, 13 bp, C. elegans
aaagtccaatttt

SEQ ID NO: 687205 - DNA, 13 bp, C. elegans
aaagtcccatttc

SEQ ID NO: 687206 - DNA, 13 bp, C. elegans
aaagtccgaaaat

SEQ ID NO: 687207 - DNA, 13 bp, C. elegans
aaagtccgcaaaa

SEQ ID NO: 687208 - DNA, 13 bp, C. elegans
aaagtcgagaaaa

SEQ ID NO: 687209 - DNA, 13 bp, C. elegans
aaagtcgatattt

SEQ ID NO: 687210 - DNA, 13 bp, C. elegans
aaagtcggaaaaa

SEQ ID NO: 687211 - DNA, 13 bp, C. elegans
aaagtcgtaaaaa

SEQ ID NO: 687212 - DNA, 13 bp, C. elegans
aaagtcgttgaaa

SEQ ID NO: 687213 - DNA, 13 bp, C. elegans
aaagtctcattgc

SEQ ID NO: 687214 - DNA, 13 bp, C. elegans
aaagtctccaaaa

SEQ ID NO: 687215 - DNA, 13 bp, C. elegans
aaagtctcgaaaa

SEQ ID NO: 687216 - DNA, 13 bp, C. elegans
aaagtctgaaagt

SEQ ID NO: 687217 - DNA, 13 bp, C. elegans
aaagtctgaattt

SEQ ID NO: 687218 - DNA, 13 bp, C. elegans
aaagtctggaaat

SEQ ID NO: 687219 - DNA, 13 bp, C. elegans
aaagtctggaatg

SEQ ID NO: 687220 - DNA, 13 bp, C. elegans
aaagtcttcaaaa

SEQ ID NO: 687221 - DNA, 13 bp, C. elegans
aaagtcttcaatt

SEQ ID NO: 687222 - DNA, 13 bp, C. elegans
aaagtcttgccaa

SEQ ID NO: 687223 - DNA, 13 bp, C. elegans
aaagtctttgcaa

SEQ ID NO: 687224 - DNA, 13 bp, C. elegans
aaagtgaaaaacg

SEQ ID NO: 687225 - DNA, 13 bp, C. elegans
aaagtgaaaaatc

SEQ ID NO: 687226 - DNA, 13 bp, C. elegans
aaagtgaaaacga

SEQ ID NO: 687227 - DNA, 13 bp, C. elegans
aaagtgaaaattt

SEQ ID NO: 687228 - DNA, 13 bp, C. elegans
aaagtgaaacaat

SEQ ID NO: 687229 - DNA, 13 bp, C. elegans
aaagtgaacaatt

SEQ ID NO: 687230 - DNA, 13 bp, C. elegans
aaagtgaagcaaa

SEQ ID NO: 687231 - DNA, 13 bp, C. elegans
aaagtgaataatt

SEQ ID NO: 687232 - DNA, 13 bp, C. elegans
aaagtgaatttgt

SEQ ID NO: 687233 - DNA, 13 bp, C. elegans
aaagtgaattttg

SEQ ID NO: 687234 - DNA, 13 bp, C. elegans
aaagtgaattttt

SEQ ID NO: 687235 - DNA, 13 bp, C. elegans
aaagtgacaaaac

SEQ ID NO: 687236 - DNA, 13 bp, C. elegans
aaagtgacaattg

SEQ ID NO: 687237 - DNA, 13 bp, C. elegans
aaagtgacagaaa

SEQ ID NO: 687238 - DNA, 13 bp, C. elegans
aaagtgaccaaaa

SEQ ID NO: 687239 - DNA, 13 bp, C. elegans
aaagtgacgaaaa

SEQ ID NO: 687240 - DNA, 13 bp, C. elegans
aaagtgagaattg

SEQ ID NO: 687241 - DNA, 13 bp, C. elegans
aaagtgatcaact

SEQ ID NO: 687242 - DNA, 13 bp, C. elegans
aaagtgatcaatt

SEQ ID NO: 687243 - DNA, 13 bp, C. elegans
aaagtgattaact

SEQ ID NO: 687244 - DNA, 13 bp, C. elegans
aaagtgattttaa

SEQ ID NO: 687245 - DNA, 13 bp, C. elegans
aaagtgcaaaatt

SEQ ID NO: 687246 - DNA, 13 bp, C. elegans
aaagtgcaaacaa

SEQ ID NO: 687247 - DNA, 13 bp, C. elegans
aaagtgcaaataa

SEQ ID NO: 687248 - DNA, 13 bp, C. elegans
aaagtgcagattt

SEQ ID NO: 687249 - DNA, 13 bp, C. elegans
aaagtgcattgaa

SEQ ID NO: 687250 - DNA, 13 bp, C. elegans
aaagtgcccaaaa

SEQ ID NO: 687251 - DNA, 13 bp, C. elegans
aaagtgccgaatt

SEQ ID NO: 687252 - DNA, 13 bp, C. elegans
aaagtgcgctcca

SEQ ID NO: 687253 - DNA, 13 bp, C. elegans
aaagtgctcaaaa

SEQ ID NO: 687254 - DNA, 13 bp, C. elegans
aaagtgctcattt

SEQ ID NO: 687255 - DNA, 13 bp, C. elegans
aaagtgctccaaa

SEQ ID NO: 687256 - DNA, 13 bp, C. elegans
aaagtgctgaaat

SEQ ID NO: 687257 - DNA, 13 bp, C. elegans
aaagtggaaaatg

SEQ ID NO: 687258 - DNA, 13 bp, C. elegans
aaagtggagtttt

SEQ ID NO: 687259 - DNA, 30 bp, C. elegans
aaagtggatatctttttggccagcactgta

SEQ ID NO: 687260 - DNA, 13 bp, C. elegans
aaagtggcaaaaa

SEQ ID NO: 687261 - DNA, 13 bp, C. elegans
aaagtggcaaaga

SEQ ID NO: 687262 - DNA, 13 bp, C. elegans
aaagtggctcaag

SEQ ID NO: 687263 - DNA, 13 bp, C. elegans
aaagtgggcaaaa

SEQ ID NO: 687264 - DNA, 13 bp, C. elegans
aaagtgggcgtgg

SEQ ID NO: 687265 - DNA, 13 bp, C. elegans
aaagtggtatttt

SEQ ID NO: 687266 - DNA, 13 bp, C. elegans
aaagtggtgaaaa

SEQ ID NO: 687267 - DNA, 13 bp, C. elegans
aaagtggttgaaa

SEQ ID NO: 687268 - DNA, 13 bp, C. elegans
aaagtggttttcg

SEQ ID NO: 687269 - DNA, 13 bp, C. elegans
aaagtgtacaaaa

SEQ ID NO: 687270 - DNA, 13 bp, C. elegans
aaagtgtactgta

SEQ ID NO: 687271 - DNA, 13 bp, C. elegans
aaagtgtatattt

SEQ ID NO: 687272 - DNA, 13 bp, C. elegans
aaagtgtatcaaa

SEQ ID NO: 687273 - DNA, 13 bp, C. elegans
aaagtgtattcaa

SEQ ID NO: 687274 - DNA, 13 bp, C. elegans
aaagtgtcacaaa

SEQ ID NO: 687275 - DNA, 13 bp, C. elegans
aaagtgtcagaaa

SEQ ID NO: 687276 - DNA, 13 bp, C. elegans
aaagtgtgaataa

SEQ ID NO: 687277 - DNA, 13 bp, C. elegans
aaagtgtgaattt

SEQ ID NO: 687278 - DNA, 13 bp, C. elegans
aaagtgtgcaaaa

SEQ ID NO: 687279 - DNA, 13 bp, C. elegans
aaagtgtggtttt

SEQ ID NO: 687280 - DNA, 13 bp, C. elegans
aaagtgtgtgtgt

SEQ ID NO: 687281 - DNA, 13 bp, C. elegans
aaagtgttagaaa

SEQ ID NO: 687282 - DNA, 13 bp, C. elegans
aaagtgttcaaaa

SEQ ID NO: 687283 - DNA, 13 bp, C. elegans
aaagtgttcaact

SEQ ID NO: 687284 - DNA, 13 bp, C. elegans
aaagtgttcaatt

SEQ ID NO: 687285 - DNA, 13 bp, C. elegans
aaagtgttcattt

SEQ ID NO: 687286 - DNA, 13 bp, C. elegans
aaagtgttcgaaa

SEQ ID NO: 687287 - DNA, 13 bp, C. elegans
aaagtgtttagat

SEQ ID NO: 687288 - DNA, 13 bp, C. elegans
aaagtgtttattt

SEQ ID NO: 687289 - DNA, 13 bp, C. elegans
aaagtgttttgat

SEQ ID NO: 687290 - DNA, 13 bp, C. elegans
aaagtgttttgtg

SEQ ID NO: 687291 - DNA, 13 bp, C. elegans
aaagttaaacttt

SEQ ID NO: 687292 - DNA, 13 bp, C. elegans
aaagttaaagtat

SEQ ID NO: 687293 - DNA, 13 bp, C. elegans
aaagttacaagaa

SEQ ID NO: 687294 - DNA, 13 bp, C. elegans
aaagttacacaca

SEQ ID NO: 687295 - DNA, 15 bp, C. elegans
aaagttacacacaaa

SEQ ID NO: 687296 - DNA, 13 bp, C. elegans
aaagttaccaaat

SEQ ID NO: 687297 - DNA, 13 bp, C. elegans
aaagttactttga

SEQ ID NO: 687298 - DNA, 13 bp, C. elegans
aaagttagtttaa

SEQ ID NO: 687299 - DNA, 13 bp, C. elegans
aaagttatacaaa

SEQ ID NO: 687300 - DNA, 13 bp, C. elegans
aaagttatagagc

SEQ ID NO: 687301 - DNA, 13 bp, C. elegans
aaagttatattga

SEQ ID NO: 687302 - DNA, 13 bp, C. elegans
aaagttatcaaaa

SEQ ID NO: 687303 - DNA, 13 bp, C. elegans
aaagttatcaaat

SEQ ID NO: 687304 - DNA, 13 bp, C. elegans
aaagttatcaaca

SEQ ID NO: 687305 - DNA, 13 bp, C. elegans
aaagttatcattt

SEQ ID NO: 687306 - DNA, 13 bp, C. elegans
aaagttatgatgg

SEQ ID NO: 687307 - DNA, 13 bp, C. elegans
aaagttatgcaaa

SEQ ID NO: 687308 - DNA, 13 bp, C. elegans
aaagttatgtttt

SEQ ID NO: 687309 - DNA, 13 bp, C. elegans
aaagttattagaa

SEQ ID NO: 687310 - DNA, 13 bp, C. elegans
aaagttattcgaa

SEQ ID NO: 687311 - DNA, 13 bp, C. elegans
aaagttatttcag

SEQ ID NO: 687312 - DNA, 13 bp, C. elegans
aaagttcaaaaca

SEQ ID NO: 687313 - DNA, 13 bp, C. elegans
aaagttcaaaact

SEQ ID NO: 687314 - DNA, 13 bp, C. elegans
aaagttcaaaaga

SEQ ID NO: 687315 - DNA, 13 bp, C. elegans
aaagttcaaaatt

SEQ ID NO: 687316 - DNA, 13 bp, C. elegans
aaagttcaaacat

SEQ ID NO: 687317 - DNA, 13 bp, C. elegans
aaagttcaaagaa

SEQ ID NO: 687318 - DNA, 13 bp, C. elegans
aaagttcaaatca

SEQ ID NO: 687319 - DNA, 13 bp, C. elegans
aaagttcaaatga

SEQ ID NO: 687320 - DNA, 13 bp, C. elegans
aaagttcaaatgt

SEQ ID NO: 687321 - DNA, 13 bp, C. elegans
aaagttcaaattc

SEQ ID NO: 687322 - DNA, 13 bp, C. elegans
aaagttcaaattt

SEQ ID NO: 687323 - DNA, 13 bp, C. elegans
aaagttcaacaaa

SEQ ID NO: 687324 - DNA, 13 bp, C. elegans
aaagttcaacttt

SEQ ID NO: 687325 - DNA, 13 bp, C. elegans
aaagttcaagaaa

SEQ ID NO: 687326 - DNA, 13 bp, C. elegans
aaagttcaagttt

SEQ ID NO: 687327 - DNA, 13 bp, C. elegans
aaagttcaataga

SEQ ID NO: 687328 - DNA, 13 bp, C. elegans
aaagttcaatcaa

SEQ ID NO: 687329 - DNA, 13 bp, C. elegans
aaagttcaatgaa

SEQ ID NO: 687330 - DNA, 13 bp, C. elegans
aaagttcaattgt

SEQ ID NO: 687331 - DNA, 13 bp, C. elegans
aaagttcaatttc

SEQ ID NO: 687332 - DNA, 13 bp, C. elegans
aaagttcacaaaa

SEQ ID NO: 687333 - DNA, 13 bp, C. elegans
aaagttcacaaat

SEQ ID NO: 687334 - DNA, 13 bp, C. elegans
aaagttcacagaa

SEQ ID NO: 687335 - DNA, 13 bp, C. elegans
aaagttcacattt

SEQ ID NO: 687336 - DNA, 13 bp, C. elegans
aaagttcactttt

SEQ ID NO: 687337 - DNA, 13 bp, C. elegans
aaagttcagaaac

SEQ ID NO: 687338 - DNA, 13 bp, C. elegans
aaagttcagttca

SEQ ID NO: 687339 - DNA, 13 bp, C. elegans
aaagttcatcaat

SEQ ID NO: 687340 - DNA, 13 bp, C. elegans
aaagttcatttat

SEQ ID NO: 687341 - DNA, 13 bp, C. elegans
aaagttcatttct

SEQ ID NO: 687342 - DNA, 13 bp, C. elegans
aaagttcattttc

SEQ ID NO: 687343 - DNA, 13 bp, C. elegans
aaagttcattttt

SEQ ID NO: 687344 - DNA, 13 bp, C. elegans
aaagttccaaaaa

SEQ ID NO: 687345 - DNA, 14 bp, C. elegans
aaagttccaaaaaa

SEQ ID NO: 687346 - DNA, 13 bp, C. elegans
aaagttccaaaag

SEQ ID NO: 687347 - DNA, 13 bp, C. elegans
aaagttccaaatt

SEQ ID NO: 687348 - DNA, 13 bp, C. elegans
aaagttccaagaa

SEQ ID NO: 687349 - DNA, 13 bp, C. elegans
aaagttcctaaaa

SEQ ID NO: 687350 - DNA, 13 bp, C. elegans
aaagttcgaaaca

SEQ ID NO: 687351 - DNA, 13 bp, C. elegans
aaagttcgaaatt

SEQ ID NO: 687352 - DNA, 13 bp, C. elegans
aaagttcgaattt

SEQ ID NO: 687353 - DNA, 13 bp, C. elegans
aaagttcggaaaa

SEQ ID NO: 687354 - DNA, 13 bp, C. elegans
aaagttcggccat

SEQ ID NO: 687355 - DNA, 27 bp, C. elegans
aaagttcggtcaactcgttcctcacaa

SEQ ID NO: 687356 - DNA, 13 bp, C. elegans
aaagttcgttttt

SEQ ID NO: 687357 - DNA, 13 bp, C. elegans
aaagttctagaag

SEQ ID NO: 687358 - DNA, 13 bp, C. elegans
aaagttctcaaaa

SEQ ID NO: 687359 - DNA, 13 bp, C. elegans
aaagttctcaaat

SEQ ID NO: 687360 - DNA, 13 bp, C. elegans
aaagttctgaaat

SEQ ID NO: 687361 - DNA, 13 bp, C. elegans
aaagttctggaaa

SEQ ID NO: 687362 - DNA, 13 bp, C. elegans
aaagttctggaac

SEQ ID NO: 687363 - DNA, 13 bp, C. elegans
aaagttctggaat

SEQ ID NO: 687364 - DNA, 13 bp, C. elegans
aaagttctgtttt

SEQ ID NO: 687365 - DNA, 13 bp, C. elegans
aaagttgaaaaac

SEQ ID NO: 687366 - DNA, 13 bp, C. elegans
aaagttgaaaagt

SEQ ID NO: 687367 - DNA, 13 bp, C. elegans
aaagttgaaacat

SEQ ID NO: 687368 - DNA, 13 bp, C. elegans
aaagttgaaactt

SEQ ID NO: 687369 - DNA, 13 bp, C. elegans
aaagttgaaatta

SEQ ID NO: 687370 - DNA, 13 bp, C. elegans
aaagttgaaattg

SEQ ID NO: 687371 - DNA, 13 bp, C. elegans
aaagttgaacaat

SEQ ID NO: 687372 - DNA, 13 bp, C. elegans
aaagttgaagatt

SEQ ID NO: 687373 - DNA, 13 bp, C. elegans
aaagttgaaggaa

SEQ ID NO: 687374 - DNA, 13 bp, C. elegans
aaagttgaatata

SEQ ID NO: 687375 - DNA, 13 bp, C. elegans
aaagttgaatttt

SEQ ID NO: 687376 - DNA, 13 bp, C. elegans
aaagttgacagaa

SEQ ID NO: 687377 - DNA, 13 bp, C. elegans
aaagttgagaaga

SEQ ID NO: 687378 - DNA, 13 bp, C. elegans
aaagttgagagaa

SEQ ID NO: 687379 - DNA, 13 bp, C. elegans
aaagttgagcaag

SEQ ID NO: 687380 - DNA, 13 bp, C. elegans
aaagttgagcaat

SEQ ID NO: 687381 - DNA, 13 bp, C. elegans
aaagttgagtttt

SEQ ID NO: 687382 - DNA, 13 bp, C. elegans
aaagttgatattc

SEQ ID NO: 687383 - DNA, 13 bp, C. elegans
aaagttgatcaaa

SEQ ID NO: 687384 - DNA, 13 bp, C. elegans
aaagttgatgaaa

SEQ ID NO: 687385 - DNA, 13 bp, C. elegans
aaagttgatggaa

SEQ ID NO: 687386 - DNA, 13 bp, C. elegans
aaagttgattatt

SEQ ID NO: 687387 - DNA, 13 bp, C. elegans
aaagttgattttc

SEQ ID NO: 687388 - DNA, 13 bp, C. elegans
aaagttgcaacaa

SEQ ID NO: 687389 - DNA, 13 bp, C. elegans
aaagttgcaagaa

SEQ ID NO: 687390 - DNA, 13 bp, C. elegans
aaagttgcaatta

SEQ ID NO: 687391 - DNA, 13 bp, C. elegans
aaagttgcaattt

SEQ ID NO: 687392 - DNA, 13 bp, C. elegans
aaagttgcacaaa

SEQ ID NO: 687393 - DNA, 13 bp, C. elegans
aaagttgcatttt

SEQ ID NO: 687394 - DNA, 13 bp, C. elegans
aaagttgccaaaa

SEQ ID NO: 687395 - DNA, 13 bp, C. elegans
aaagttgccaact

SEQ ID NO: 687396 - DNA, 13 bp, C. elegans
aaagttgccaatt

SEQ ID NO: 687397 - DNA, 13 bp, C. elegans
aaagttgctccaa

SEQ ID NO: 687398 - DNA, 13 bp, C. elegans
aaagttggaaaga

SEQ ID NO: 687399 - DNA, 13 bp, C. elegans
aaagttggaaatt

SEQ ID NO: 687400 - DNA, 13 bp, C. elegans
aaagttggaactt

SEQ ID NO: 687401 - DNA, 13 bp, C. elegans
aaagttggagaaa

SEQ ID NO: 687402 - DNA, 13 bp, C. elegans
aaagttggagaat

SEQ ID NO: 687403 - DNA, 13 bp, C. elegans
aaagttggagatt

SEQ ID NO: 687404 - DNA, 13 bp, C. elegans
aaagttggagttt

SEQ ID NO: 687405 - DNA, 13 bp, C. elegans
aaagttggataat

SEQ ID NO: 687406 - DNA, 13 bp, C. elegans
aaagttggcaaaa

SEQ ID NO: 687407 - DNA, 13 bp, C. elegans
aaagttggcaaag

SEQ ID NO: 687408 - DNA, 13 bp, C. elegans
aaagttggcagaa

SEQ ID NO: 687409 - DNA, 13 bp, C. elegans
aaagttggctgaa

SEQ ID NO: 687410 - DNA, 13 bp, C. elegans
aaagttggttcaa

SEQ ID NO: 687411 - DNA, 13 bp, C. elegans
aaagttggttgag

SEQ ID NO: 687412 - DNA, 13 bp, C. elegans
aaagttgtaataa

SEQ ID NO: 687413 - DNA, 13 bp, C. elegans
aaagttgtagatt

SEQ ID NO: 687414 - DNA, 13 bp, C. elegans
aaagttgtagttt

SEQ ID NO: 687415 - DNA, 13 bp, C. elegans
aaagttgtatgaa

SEQ ID NO: 687416 - DNA, 13 bp, C. elegans
aaagttgtattat

SEQ ID NO: 687417 - DNA, 13 bp, C. elegans
aaagttgtcagaa

SEQ ID NO: 687418 - DNA, 13 bp, C. elegans
aaagttgtcgaaa

SEQ ID NO: 687419 - DNA, 14 bp, C. elegans
aaagttgtctcaat

SEQ ID NO: 687420 - DNA, 13 bp, C. elegans
aaagttgtctttt

SEQ ID NO: 687421 - DNA, 13 bp, C. elegans
aaagttgtgaaaa

SEQ ID NO: 687422 - DNA, 13 bp, C. elegans
aaagttgtgagaa

SEQ ID NO: 687423 - DNA, 13 bp, C. elegans
aaagttgttcaca

SEQ ID NO: 687424 - DNA, 13 bp, C. elegans
aaagttgttcact

SEQ ID NO: 687425 - DNA, 13 bp, C. elegans
aaagttgttccaa

SEQ ID NO: 687426 - DNA, 13 bp, C. elegans
aaagttgttcttt

SEQ ID NO: 687427 - DNA, 13 bp, C. elegans
aaagttgttgaaa

SEQ ID NO: 687428 - DNA, 13 bp, C. elegans
aaagttgttgact

SEQ ID NO: 687429 - DNA, 13 bp, C. elegans
aaagttgttggaa

SEQ ID NO: 687430 - DNA, 13 bp, C. elegans
aaagttgtttcaa

SEQ ID NO: 687431 - DNA, 13 bp, C. elegans
aaagttgtttctt

SEQ ID NO: 687432 - DNA, 13 bp, C. elegans
aaagtttaaagat

SEQ ID NO: 687433 - DNA, 13 bp, C. elegans
aaagtttaaagca

SEQ ID NO: 687434 - DNA, 13 bp, C. elegans
aaagtttaaatga

SEQ ID NO: 687435 - DNA, 13 bp, C. elegans
aaagtttaactgt

SEQ ID NO: 687436 - DNA, 13 bp, C. elegans
aaagtttacaaat

SEQ ID NO: 687437 - DNA, 13 bp, C. elegans
aaagtttacattt

SEQ ID NO: 687438 - DNA, 13 bp, C. elegans
aaagtttagaaat

SEQ ID NO: 687439 - DNA, 13 bp, C. elegans
aaagtttagagaa

SEQ ID NO: 687440 - DNA, 13 bp, C. elegans
aaagtttatagaa

SEQ ID NO: 687441 - DNA, 13 bp, C. elegans
aaagtttatgttt

SEQ ID NO: 687442 - DNA, 13 bp, C. elegans
aaagtttattgga

SEQ ID NO: 687443 - DNA, 13 bp, C. elegans
aaagtttatttca

SEQ ID NO: 687444 - DNA, 13 bp, C. elegans
aaagtttcaaaaa

SEQ ID NO: 687445 - DNA, 13 bp, C. elegans
aaagtttcaaaat

SEQ ID NO: 687446 - DNA, 13 bp, C. elegans
aaagtttcaatat

SEQ ID NO: 687447 - DNA, 13 bp, C. elegans
aaagtttcaatga

SEQ ID NO: 687448 - DNA, 13 bp, C. elegans
aaagtttcacaat

SEQ ID NO: 687449 - DNA, 13 bp, C. elegans
aaagtttcagaaa

SEQ ID NO: 687450 - DNA, 13 bp, C. elegans
aaagtttcagtca

SEQ ID NO: 687451 - DNA, 13 bp, C. elegans
aaagtttcataaa

SEQ ID NO: 687452 - DNA, 13 bp, C. elegans
aaagtttcattga

SEQ ID NO: 687453 - DNA, 13 bp, C. elegans
aaagtttccaata

SEQ ID NO: 687454 - DNA, 13 bp, C. elegans
aaagtttcgaaaa

SEQ ID NO: 687455 - DNA, 13 bp, C. elegans
aaagtttcgacaa

SEQ ID NO: 687456 - DNA, 13 bp, C. elegans
aaagtttcgtatt

SEQ ID NO: 687457 - DNA, 13 bp, C. elegans
aaagtttctaaaa

SEQ ID NO: 687458 - DNA, 13 bp, C. elegans
aaagtttctaaat

SEQ ID NO: 687459 - DNA, 13 bp, C. elegans
aaagtttctattt

SEQ ID NO: 687460 - DNA, 13 bp, C. elegans
aaagtttctcaaa

SEQ ID NO: 687461 - DNA, 13 bp, C. elegans
aaagtttctcatt

SEQ ID NO: 687462 - DNA, 13 bp, C. elegans
aaagtttctgaaa

SEQ ID NO: 687463 - DNA, 13 bp, C. elegans
aaagtttctggaa

SEQ ID NO: 687464 - DNA, 13 bp, C. elegans
aaagtttctggca

SEQ ID NO: 687465 - DNA, 13 bp, C. elegans
aaagtttcttgtt

SEQ ID NO: 687466 - DNA, 13 bp, C. elegans
aaagtttgaaaat

SEQ ID NO: 687467 - DNA, 13 bp, C. elegans
aaagtttgaaatc

SEQ ID NO: 687468 - DNA, 13 bp, C. elegans
aaagtttgaaatg

SEQ ID NO: 687469 - DNA, 13 bp, C. elegans
aaagtttgaaatt

SEQ ID NO: 687470 - DNA, 13 bp, C. elegans
aaagtttgaagaa

SEQ ID NO: 687471 - DNA, 13 bp, C. elegans
aaagtttgaagct

SEQ ID NO: 687472 - DNA, 13 bp, C. elegans
aaagtttgaatat

SEQ ID NO: 687473 - DNA, 13 bp, C. elegans
aaagtttgaatct

SEQ ID NO: 687474 - DNA, 13 bp, C. elegans
aaagtttgaattg

SEQ ID NO: 687475 - DNA, 13 bp, C. elegans
aaagtttgacaaa

SEQ ID NO: 687476 - DNA, 13 bp, C. elegans
aaagtttgaccaa

SEQ ID NO: 687477 - DNA, 13 bp, C. elegans
aaagtttgatctt

SEQ ID NO: 687478 - DNA, 13 bp, C. elegans
aaagtttgcaaaa

SEQ ID NO: 687479 - DNA, 13 bp, C. elegans
aaagtttgcaaca

SEQ ID NO: 687480 - DNA, 13 bp, C. elegans
aaagtttggaaaa

SEQ ID NO: 687481 - DNA, 13 bp, C. elegans
aaagtttggaaca

SEQ ID NO: 687482 - DNA, 13 bp, C. elegans
aaagtttggaatt

SEQ ID NO: 687483 - DNA, 13 bp, C. elegans
aaagtttggagaa

SEQ ID NO: 687484 - DNA, 13 bp, C. elegans
aaagtttggcaaa

SEQ ID NO: 687485 - DNA, 13 bp, C. elegans
aaagtttgggaat

SEQ ID NO: 687486 - DNA, 13 bp, C. elegans
aaagtttgtaaaa

SEQ ID NO: 687487 - DNA, 13 bp, C. elegans
aaagtttgtaaat

SEQ ID NO: 687488 - DNA, 13 bp, C. elegans
aaagtttgtaatt

SEQ ID NO: 687489 - DNA, 13 bp, C. elegans
aaagtttgtacat

SEQ ID NO: 687490 - DNA, 13 bp, C. elegans
aaagtttgtataa

SEQ ID NO: 687491 - DNA, 13 bp, C. elegans
aaagtttgtcagt

SEQ ID NO: 687492 - DNA, 13 bp, C. elegans
aaagtttgttaaa

SEQ ID NO: 687493 - DNA, 13 bp, C. elegans
aaagttttaaact

SEQ ID NO: 687494 - DNA, 13 bp, C. elegans
aaagttttaagaa

SEQ ID NO: 687495 - DNA, 13 bp, C. elegans
aaagttttaatgt

SEQ ID NO: 687496 - DNA, 13 bp, C. elegans
aaagttttatgaa

SEQ ID NO: 687497 - DNA, 13 bp, C. elegans
aaagttttatgag

SEQ ID NO: 687498 - DNA, 13 bp, C. elegans
aaagttttattgt

SEQ ID NO: 687499 - DNA, 13 bp, C. elegans
aaagttttcaaaa

SEQ ID NO: 687500 - DNA, 13 bp, C. elegans
aaagttttcagtt

SEQ ID NO: 687501 - DNA, 13 bp, C. elegans
aaagttttcatga

SEQ ID NO: 687502 - DNA, 13 bp, C. elegans
aaagttttcattt

SEQ ID NO: 687503 - DNA, 13 bp, C. elegans
aaagttttccgaa

SEQ ID NO: 687504 - DNA, 13 bp, C. elegans
aaagttttcgaaa

SEQ ID NO: 687505 - DNA, 13 bp, C. elegans
aaagttttcgaat

SEQ ID NO: 687506 - DNA, 13 bp, C. elegans
aaagttttgaaag

SEQ ID NO: 687507 - DNA, 13 bp, C. elegans
aaagttttgaatt

SEQ ID NO: 687508 - DNA, 13 bp, C. elegans
aaagttttgatgt

SEQ ID NO: 687509 - DNA, 13 bp, C. elegans
aaagttttgcaca

SEQ ID NO: 687510 - DNA, 13 bp, C. elegans
aaagttttggcaa

SEQ ID NO: 687511 - DNA, 13 bp, C. elegans
aaagttttggttt

SEQ ID NO: 687512 - DNA, 13 bp, C. elegans
aaagtttttattc

SEQ ID NO: 687513 - DNA, 13 bp, C. elegans
aaagtttttcaca

SEQ ID NO: 687514 - DNA, 13 bp, C. elegans
aaagtttttcgaa

SEQ ID NO: 687515 - DNA, 13 bp, C. elegans
aaagtttttctaa

SEQ ID NO: 687516 - DNA, 13 bp, C. elegans
aaagtttttcttg

SEQ ID NO: 687517 - DNA, 13 bp, C. elegans
aaagtttttgaaa

SEQ ID NO: 687518 - DNA, 13 bp, C. elegans
aaagtttttgcga

SEQ ID NO: 687519 - DNA, 13 bp, C. elegans
aaagtttttggca

SEQ ID NO: 687520 - DNA, 13 bp, C. elegans
aaagtttttttcc

SEQ ID NO: 687521 - DNA, 13 bp, C. elegans
aaagtttttttga

SEQ ID NO: 687522 - DNA, 13 bp, C. elegans
aaagtttttttgg

SEQ ID NO: 687523 - DNA, 13 bp, C. elegans
aaataaaaacggc

SEQ ID NO: 687524 - DNA, 13 bp, C. elegans
aaataaaaactgc

SEQ ID NO: 687525 - DNA, 13 bp, C. elegans
aaataaaacatgt

SEQ ID NO: 687526 - DNA, 13 bp, C. elegans
aaataaaaccgat

SEQ ID NO: 687527 - DNA, 13 bp, C. elegans
aaataaaacgttt

SEQ ID NO: 687528 - DNA, 13 bp, C. elegans
aaataaaacttgt

SEQ ID NO: 687529 - DNA, 13 bp, C. elegans
aaataaaagttgg

SEQ ID NO: 687530 - DNA, 13 bp, C. elegans
aaataaaatcttg

SEQ ID NO: 687531 - DNA, 13 bp, C. elegans
aaataaaattctg

SEQ ID NO: 687532 - DNA, 13 bp, C. elegans
aaataaaatttcc

SEQ ID NO: 687533 - DNA, 13 bp, C. elegans
aaataaacagatt

SEQ ID NO: 687534 - DNA, 13 bp, C. elegans
aaataaacctttt

SEQ ID NO: 687535 - DNA, 13 bp, C. elegans
aaataaacgtgat

SEQ ID NO: 687536 - DNA, 13 bp, C. elegans
aaataaacttgtt

SEQ ID NO: 687537 - DNA, 13 bp, C. elegans
aaataaagcatac

SEQ ID NO: 687538 - DNA, 13 bp, C. elegans
aaataaagtatgt

SEQ ID NO: 687539 - DNA, 13 bp, C. elegans
aaataaagtcgtt

SEQ ID NO: 687540 - DNA, 13 bp, C. elegans
aaataaagttcaa

SEQ ID NO: 687541 - DNA, 13 bp, C. elegans
aaataaagttcca

SEQ ID NO: 687542 - DNA, 13 bp, C. elegans
aaataaagttttg

SEQ ID NO: 687543 - DNA, 13 bp, C. elegans
aaataaatcgata

SEQ ID NO: 687544 - DNA, 13 bp, C. elegans
aaataaatctagt

SEQ ID NO: 687545 - DNA, 13 bp, C. elegans
aaataaatggatt

SEQ ID NO: 687546 - DNA, 13 bp, C. elegans
aaataaatgtgca

SEQ ID NO: 687547 - DNA, 13 bp, C. elegans
aaataaattggca

SEQ ID NO: 687548 - DNA, 13 bp, C. elegans
aaataaattgtgt

SEQ ID NO: 687549 - DNA, 13 bp, C. elegans
aaataaattgttg

SEQ ID NO: 687550 - DNA, 13 bp, C. elegans
aaataaatttgtg

SEQ ID NO: 687551 - DNA, 13 bp, C. elegans
aaataaattttgc

SEQ ID NO: 687552 - DNA, 13 bp, C. elegans
aaataacatcttt

SEQ ID NO: 687553 - DNA, 13 bp, C. elegans
aaataacatgtaa

SEQ ID NO: 687554 - DNA, 13 bp, C. elegans
aaataaccatttc

SEQ ID NO: 687555 - DNA, 13 bp, C. elegans
aaataaccgaata

SEQ ID NO: 687556 - DNA, 13 bp, C. elegans
aaataaccgaatt

SEQ ID NO: 687557 - DNA, 13 bp, C. elegans
aaataacgagaat

SEQ ID NO: 687558 - DNA, 13 bp, C. elegans
aaataactacttt

SEQ ID NO: 687559 - DNA, 13 bp, C. elegans
aaataactctgaa

SEQ ID NO: 687560 - DNA, 13 bp, C. elegans
aaataactgaaag

SEQ ID NO: 687561 - DNA, 13 bp, C. elegans
aaataacttccaa

SEQ ID NO: 687562 - DNA, 13 bp, C. elegans
aaataactttttc

SEQ ID NO: 687563 - DNA, 13 bp, C. elegans
aaataagaaatct

SEQ ID NO: 687564 - DNA, 13 bp, C. elegans
aaataagaatttg

SEQ ID NO: 687565 - DNA, 13 bp, C. elegans
aaataagacaatt

SEQ ID NO: 687566 - DNA, 13 bp, C. elegans
aaataagacattt

SEQ ID NO: 687567 - DNA, 13 bp, C. elegans
aaataagagtttt

SEQ ID NO: 687568 - DNA, 13 bp, C. elegans
aaataagcagttt

SEQ ID NO: 687569 - DNA, 13 bp, C. elegans
aaataagtttctc

SEQ ID NO: 687570 - DNA, 13 bp, C. elegans
aaataagttttca

SEQ ID NO: 687571 - DNA, 13 bp, C. elegans
aaataataattcc

SEQ ID NO: 687572 - DNA, 13 bp, C. elegans
aaataatactgaa

SEQ ID NO: 687573 - DNA, 13 bp, C. elegans
aaataatcagaat

SEQ ID NO: 687574 - DNA, 13 bp, C. elegans
aaataatcatcat

SEQ ID NO: 687575 - DNA, 13 bp, C. elegans
aaataatcatgtt

SEQ ID NO: 687576 - DNA, 13 bp, C. elegans
aaataatcattca

SEQ ID NO: 687577 - DNA, 13 bp, C. elegans
aaataatccgaaa

SEQ ID NO: 687578 - DNA, 13 bp, C. elegans
aaataatcgaatt

SEQ ID NO: 687579 - DNA, 13 bp, C. elegans
aaataatcgataa

SEQ ID NO: 687580 - DNA, 13 bp, C. elegans
aaataatcgattt

SEQ ID NO: 687581 - DNA, 13 bp, C. elegans
aaataatctcaat

SEQ ID NO: 687582 - DNA, 13 bp, C. elegans
aaataatctgaaa

SEQ ID NO: 687583 - DNA, 13 bp, C. elegans
aaataatctggaa

SEQ ID NO: 687584 - DNA, 13 bp, C. elegans
aaataatgaaatc

SEQ ID NO: 687585 - DNA, 13 bp, C. elegans
aaataatgaactt

SEQ ID NO: 687586 - DNA, 13 bp, C. elegans
aaataatgaagtt

SEQ ID NO: 687587 - DNA, 13 bp, C. elegans
aaataatgacgaa

SEQ ID NO: 687588 - DNA, 13 bp, C. elegans
aaataatgagatt

SEQ ID NO: 687589 - DNA, 13 bp, C. elegans
aaataatggaaca

SEQ ID NO: 687590 - DNA, 13 bp, C. elegans
aaataatgtcaat

SEQ ID NO: 687591 - DNA, 13 bp, C. elegans
aaataatgttttc

SEQ ID NO: 687592 - DNA, 13 bp, C. elegans
aaataattcgaaa

SEQ ID NO: 687593 - DNA, 13 bp, C. elegans
aaataattcgatt

SEQ ID NO: 687594 - DNA, 13 bp, C. elegans
aaataattctcaa

SEQ ID NO: 687595 - DNA, 13 bp, C. elegans
aaataattcttct

SEQ ID NO: 687596 - DNA, 13 bp, C. elegans
aaataattgaaca

SEQ ID NO: 687597 - DNA, 13 bp, C. elegans
aaataattgcaat

SEQ ID NO: 687598 - DNA, 13 bp, C. elegans
aaataattgggat

SEQ ID NO: 687599 - DNA, 13 bp, C. elegans
aaataattggttt

SEQ ID NO: 687600 - DNA, 13 bp, C. elegans
aaataattgtgta

SEQ ID NO: 687601 - DNA, 13 bp, C. elegans
aaataattgttga

SEQ ID NO: 687602 - DNA, 13 bp, C. elegans
aaataattgtttc

SEQ ID NO: 687603 - DNA, 13 bp, C. elegans
aaataatttcatc

SEQ ID NO: 687604 - DNA, 13 bp, C. elegans
aaataatttccaa

SEQ ID NO: 687605 - DNA, 13 bp, C. elegans
aaataatttccag

SEQ ID NO: 687606 - DNA, 13 bp, C. elegans
aaataatttcccg

SEQ ID NO: 687607 - DNA, 13 bp, C. elegans
aaataatttctca

SEQ ID NO: 687608 - DNA, 13 bp, C. elegans
aaataatttcttc

SEQ ID NO: 687609 - DNA, 13 bp, C. elegans
aaataatttgagt

SEQ ID NO: 687610 - DNA, 13 bp, C. elegans
aaataatttgggt

SEQ ID NO: 687611 - DNA, 13 bp, C. elegans
aaataatttgtgt

SEQ ID NO: 687612 - DNA, 13 bp, C. elegans
aaataattttccg

SEQ ID NO: 687613 - DNA, 13 bp, C. elegans
aaataattttgca

SEQ ID NO: 687614 - DNA, 13 bp, C. elegans
aaatacaaatgtt

SEQ ID NO: 687615 - DNA, 13 bp, C. elegans
aaatacaaattct

SEQ ID NO: 687616 - DNA, 13 bp, C. elegans
aaatacaacattt

SEQ ID NO: 687617 - DNA, 13 bp, C. elegans
aaatacaactatt

SEQ ID NO: 687618 - DNA, 13 bp, C. elegans
aaatacaatttca

SEQ ID NO: 687619 - DNA, 13 bp, C. elegans
aaatacaatttct

SEQ ID NO: 687620 - DNA, 13 bp, C. elegans
aaatacacaattc

SEQ ID NO: 687621 - DNA, 13 bp, C. elegans
aaatacacacttt

SEQ ID NO: 687622 - DNA, 13 bp, C. elegans
aaatacacagttt

SEQ ID NO: 687623 - DNA, 13 bp, C. elegans
aaatacacatttt

SEQ ID NO: 687624 - DNA, 13 bp, C. elegans
aaatacacttttt

SEQ ID NO: 687625 - DNA, 13 bp, C. elegans
aaatacagaaatt

SEQ ID NO: 687626 - DNA, 13 bp, C. elegans
aaatacagaattt

SEQ ID NO: 687627 - DNA, 13 bp, C. elegans
aaatacagatttt

SEQ ID NO: 687628 - DNA, 13 bp, C. elegans
aaatacaggaaat

SEQ ID NO: 687629 - DNA, 13 bp, C. elegans
aaatacagtattt

SEQ ID NO: 687630 - DNA, 13 bp, C. elegans
aaatacagtgttt

SEQ ID NO: 687631 - DNA, 13 bp, C. elegans
aaatacatacatt

SEQ ID NO: 687632 - DNA, 13 bp, C. elegans
aaatacatattct

SEQ ID NO: 687633 - DNA, 13 bp, C. elegans
aaatacatcaatt

SEQ ID NO: 687634 - DNA, 13 bp, C. elegans
aaatacatgtatt

SEQ ID NO: 687635 - DNA, 13 bp, C. elegans
aaatacatgttta

SEQ ID NO: 687636 - DNA, 13 bp, C. elegans
aaatacatgtttt

SEQ ID NO: 687637 - DNA, 13 bp, C. elegans
aaatacattgaaa

SEQ ID NO: 687638 - DNA, 13 bp, C. elegans
aaatacattgatt

SEQ ID NO: 687639 - DNA, 13 bp, C. elegans
aaatacatttgaa

SEQ ID NO: 687640 - DNA, 13 bp, C. elegans
aaataccagaaga

SEQ ID NO: 687641 - DNA, 13 bp, C. elegans
aaataccagattt

SEQ ID NO: 687642 - DNA, 13 bp, C. elegans
aaataccagcaaa

SEQ ID NO: 687643 - DNA, 13 bp, C. elegans
aaataccagttta

SEQ ID NO: 687644 - DNA, 13 bp, C. elegans
aaataccatttta

SEQ ID NO: 687645 - DNA, 13 bp, C. elegans
aaatacccatttt

SEQ ID NO: 687646 - DNA, 13 bp, C. elegans
aaatacccctttt

SEQ ID NO: 687647 - DNA, 13 bp, C. elegans
aaataccgaaaat

SEQ ID NO: 687648 - DNA, 13 bp, C. elegans
aaataccgatttt

SEQ ID NO: 687649 - DNA, 13 bp, C. elegans
aaataccgcaaaa

SEQ ID NO: 687650 - DNA, 13 bp, C. elegans
aaatacctgaaaa

SEQ ID NO: 687651 - DNA, 13 bp, C. elegans
aaatacctttttt

SEQ ID NO: 687652 - DNA, 13 bp, C. elegans
aaatacgaaaatt

SEQ ID NO: 687653 - DNA, 13 bp, C. elegans
aaatacgacgaaa

SEQ ID NO: 687654 - DNA, 13 bp, C. elegans
aaatacgaggaaa

SEQ ID NO: 687655 - DNA, 13 bp, C. elegans
aaatacgagtttt

SEQ ID NO: 687656 - DNA, 13 bp, C. elegans
aaatacgataatt

SEQ ID NO: 687657 - DNA, 13 bp, C. elegans
aaatacgcaattt

SEQ ID NO: 687658 - DNA, 13 bp, C. elegans
aaatacggatatt

SEQ ID NO: 687659 - DNA, 13 bp, C. elegans
aaatacggtatac

SEQ ID NO: 687660 - DNA, 13 bp, C. elegans
aaatacgtgaaaa

SEQ ID NO: 687661 - DNA, 13 bp, C. elegans
aaatacgtgtttt

SEQ ID NO: 687662 - DNA, 13 bp, C. elegans
aaatacgtttaaa

SEQ ID NO: 687663 - DNA, 13 bp, C. elegans
aaatacgttttca

SEQ ID NO: 687664 - DNA, 13 bp, C. elegans
aaatactcagttc

SEQ ID NO: 687665 - DNA, 13 bp, C. elegans
aaatactcgaaat

SEQ ID NO: 687666 - DNA, 13 bp, C. elegans
aaatactcgattt

SEQ ID NO: 687667 - DNA, 13 bp, C. elegans
aaatactcgtttt

SEQ ID NO: 687668 - DNA, 13 bp, C. elegans
aaatactctgaaa

SEQ ID NO: 687669 - DNA, 13 bp, C. elegans
aaatactgaaaac

SEQ ID NO: 687670 - DNA, 13 bp, C. elegans
aaatactgaaaga

SEQ ID NO: 687671 - DNA, 13 bp, C. elegans
aaatactgaaatt

SEQ ID NO: 687672 - DNA, 13 bp, C. elegans
aaatactgattca

SEQ ID NO: 687673 - DNA, 13 bp, C. elegans
aaatactggaaaa

SEQ ID NO: 687674 - DNA, 13 bp, C. elegans
aaatactgtaaat

SEQ ID NO: 687675 - DNA, 13 bp, C. elegans
aaatacttccaaa

SEQ ID NO: 687676 - DNA, 13 bp, C. elegans
aaatacttccctt

SEQ ID NO: 687677 - DNA, 13 bp, C. elegans
aaatacttgtttt

SEQ ID NO: 687678 - DNA, 13 bp, C. elegans
aaatactttagta

SEQ ID NO: 687679 - DNA, 13 bp, C. elegans
aaatactttcaaa

SEQ ID NO: 687680 - DNA, 13 bp, C. elegans
aaatactttcaca

SEQ ID NO: 687681 - DNA, 13 bp, C. elegans
aaatactttgaaa

SEQ ID NO: 687682 - DNA, 13 bp, C. elegans
aaatactttgtaa

SEQ ID NO: 687683 - DNA, 13 bp, C. elegans
aaatacttttcta

SEQ ID NO: 687684 - DNA, 13 bp, C. elegans
aaatacttttgaa

SEQ ID NO: 687685 - DNA, 13 bp, C. elegans
aaatagaaaactc

SEQ ID NO: 687686 - DNA, 13 bp, C. elegans
aaatagaaaactg

SEQ ID NO: 687687 - DNA, 13 bp, C. elegans
aaatagaaattct

SEQ ID NO: 687688 - DNA, 13 bp, C. elegans
aaatagaagagtt

SEQ ID NO: 687689 - DNA, 13 bp, C. elegans
aaatagaatatca

SEQ ID NO: 687690 - DNA, 13 bp, C. elegans
aaatagaattttg

SEQ ID NO: 687691 - DNA, 13 bp, C. elegans
aaatagacaattt

SEQ ID NO: 687692 - DNA, 13 bp, C. elegans
aaatagagttcaa

SEQ ID NO: 687693 - DNA, 13 bp, C. elegans
aaatagatttgaa

SEQ ID NO: 687694 - DNA, 13 bp, C. elegans
aaatagcaaaact

SEQ ID NO: 687695 - DNA, 13 bp, C. elegans
aaatagcaattaa

SEQ ID NO: 687696 - DNA, 13 bp, C. elegans
aaatagcaatttt

SEQ ID NO: 687697 - DNA, 13 bp, C. elegans
aaatagcacaaat

SEQ ID NO: 687698 - DNA, 13 bp, C. elegans
aaatagcattcaa

SEQ ID NO: 687699 - DNA, 13 bp, C. elegans
aaatagctggaaa

SEQ ID NO: 687700 - DNA, 13 bp, C. elegans
aaatagcttttca

SEQ ID NO: 687701 - DNA, 13 bp, C. elegans
aaatagctttttt

SEQ ID NO: 687702 - DNA, 13 bp, C. elegans
aaataggaaattt

SEQ ID NO: 687703 - DNA, 13 bp, C. elegans
aaataggaagttt

SEQ ID NO: 687704 - DNA, 13 bp, C. elegans
aaataggatattt

SEQ ID NO: 687705 - DNA, 13 bp, C. elegans
aaataggattttc

SEQ ID NO: 687706 - DNA, 13 bp, C. elegans
aaataggattttt

SEQ ID NO: 687707 - DNA, 13 bp, C. elegans
aaataggcacaaa

SEQ ID NO: 687708 - DNA, 13 bp, C. elegans
aaataggccgttt

SEQ ID NO: 687709 - DNA, 13 bp, C. elegans
aaataggttttct

SEQ ID NO: 687710 - DNA, 13 bp, C. elegans
aaataggtttttt

SEQ ID NO: 687711 - DNA, 13 bp, C. elegans
aaatagtaattga

SEQ ID NO: 687712 - DNA, 13 bp, C. elegans
aaatagtagattt

SEQ ID NO: 687713 - DNA, 13 bp, C. elegans
aaatagtagtttt

SEQ ID NO: 687714 - DNA, 13 bp, C. elegans
aaatagtcataaa

SEQ ID NO: 687715 - DNA, 13 bp, C. elegans
aaatagtgacaaa

SEQ ID NO: 687716 - DNA, 13 bp, C. elegans
aaatagtggaaat

SEQ ID NO: 687717 - DNA, 13 bp, C. elegans
aaatagtgggaag

SEQ ID NO: 687718 - DNA, 13 bp, C. elegans
aaatagttcaaaa

SEQ ID NO: 687719 - DNA, 13 bp, C. elegans
aaatagttgagaa

SEQ ID NO: 687720 - DNA, 13 bp, C. elegans
aaatagttgtatt

SEQ ID NO: 687721 - DNA, 13 bp, C. elegans
aaatagtttctca

SEQ ID NO: 687722 - DNA, 13 bp, C. elegans
aaatagttttaac

SEQ ID NO: 687723 - DNA, 13 bp, C. elegans
aaatagttttcat

SEQ ID NO: 687724 - DNA, 13 bp, C. elegans
aaatataacagtt

SEQ ID NO: 687725 - DNA, 13 bp, C. elegans
aaatataactgtt

SEQ ID NO: 687726 - DNA, 13 bp, C. elegans
aaatataatttcc

SEQ ID NO: 687727 - DNA, 13 bp, C. elegans
aaatatacacttt

SEQ ID NO: 687728 - DNA, 13 bp, C. elegans
aaatataccgaaa

SEQ ID NO: 687729 - DNA, 13 bp, C. elegans
aaatatacgattt

SEQ ID NO: 687730 - DNA, 13 bp, C. elegans
aaatatacggtga

SEQ ID NO: 687731 - DNA, 14 bp, C. elegans
aaatatagtgggaa

SEQ ID NO: 687732 - DNA, 13 bp, C. elegans
aaatatagtttct

SEQ ID NO: 687733 - DNA, 13 bp, C. elegans
aaatatatcattc

SEQ ID NO: 687734 - DNA, 13 bp, C. elegans
aaatatatcgatt

SEQ ID NO: 687735 - DNA, 13 bp, C. elegans
aaatatatcggaa

SEQ ID NO: 687736 - DNA, 13 bp, C. elegans
aaatatatgaaac

SEQ ID NO: 687737 - DNA, 13 bp, C. elegans
aaatatatggaga

SEQ ID NO: 687738 - DNA, 13 bp, C. elegans
aaatatattcaac

SEQ ID NO: 687739 - DNA, 13 bp, C. elegans
aaatatattcgaa

SEQ ID NO: 687740 - DNA, 13 bp, C. elegans
aaatatattgctt

SEQ ID NO: 687741 - DNA, 14 bp, C. elegans
aaatatattggcag

SEQ ID NO: 687742 - DNA, 13 bp, C. elegans
aaatatattgtga

SEQ ID NO: 687743 - DNA, 13 bp, C. elegans
aaatatatttgca

SEQ ID NO: 687744 - DNA, 13 bp, C. elegans
aaatatcaaagat

SEQ ID NO: 687745 - DNA, 13 bp, C. elegans
aaatatcaaattg

SEQ ID NO: 687746 - DNA, 13 bp, C. elegans
aaatatcaactta

SEQ ID NO: 687747 - DNA, 13 bp, C. elegans
aaatatcaagatt

SEQ ID NO: 687748 - DNA, 13 bp, C. elegans
aaatatcaagttt

SEQ ID NO: 687749 - DNA, 13 bp, C. elegans
aaatatcaataga

SEQ ID NO: 687750 - DNA, 13 bp, C. elegans
aaatatcaattgt

SEQ ID NO: 687751 - DNA, 13 bp, C. elegans
aaatatcaatttc

SEQ ID NO: 687752 - DNA, 13 bp, C. elegans
aaatatcacattt

SEQ ID NO: 687753 - DNA, 13 bp, C. elegans
aaatatcacgaaa

SEQ ID NO: 687754 - DNA, 13 bp, C. elegans
aaatatcactttt

SEQ ID NO: 687755 - DNA, 13 bp, C. elegans
aaatatcagaaat

SEQ ID NO: 687756 - DNA, 13 bp, C. elegans
aaatatcagaata

SEQ ID NO: 687757 - DNA, 13 bp, C. elegans
aaatatcagattt

SEQ ID NO: 687758 - DNA, 13 bp, C. elegans
aaatatcagtttt

SEQ ID NO: 687759 - DNA, 13 bp, C. elegans
aaatatcatcaat

SEQ ID NO: 687760 - DNA, 13 bp, C. elegans
aaatatcatcatt

SEQ ID NO: 687761 - DNA, 13 bp, C. elegans
aaatatcattgaa

SEQ ID NO: 687762 - DNA, 13 bp, C. elegans
aaatatcattgta

SEQ ID NO: 687763 - DNA, 13 bp, C. elegans
aaatatcattttc

SEQ ID NO: 687764 - DNA, 13 bp, C. elegans
aaatatccaagaa

SEQ ID NO: 687765 - DNA, 13 bp, C. elegans
aaatatccaattt

SEQ ID NO: 687766 - DNA, 13 bp, C. elegans
aaatatccagaaa

SEQ ID NO: 687767 - DNA, 13 bp, C. elegans
aaatatccatttt

SEQ ID NO: 687768 - DNA, 13 bp, C. elegans
aaatatccccatc

SEQ ID NO: 687769 - DNA, 13 bp, C. elegans
aaatatcgaaaac

SEQ ID NO: 687770 - DNA, 13 bp, C. elegans
aaatatcgaaaat

SEQ ID NO: 687771 - DNA, 13 bp, C. elegans
aaatatcgaaaga

SEQ ID NO: 687772 - DNA, 13 bp, C. elegans
aaatatcgaaata

SEQ ID NO: 687773 - DNA, 13 bp, C. elegans
aaatatcgatatt

SEQ ID NO: 687774 - DNA, 13 bp, C. elegans
aaatatcgattaa

SEQ ID NO: 687775 - DNA, 13 bp, C. elegans
aaatatcgatttt

SEQ ID NO: 687776 - DNA, 13 bp, C. elegans
aaatatcgcaaaa

SEQ ID NO: 687777 - DNA, 13 bp, C. elegans
aaatatcgctttt

SEQ ID NO: 687778 - DNA, 13 bp, C. elegans
aaatatcggaaat

SEQ ID NO: 687779 - DNA, 13 bp, C. elegans
aaatatcgttttt

SEQ ID NO: 687780 - DNA, 13 bp, C. elegans
aaatatctacagt

SEQ ID NO: 687781 - DNA, 13 bp, C. elegans
aaatatctcaatt

SEQ ID NO: 687782 - DNA, 13 bp, C. elegans
aaatatctcgaaa

SEQ ID NO: 687783 - DNA, 13 bp, C. elegans
aaatatctctttt

SEQ ID NO: 687784 - DNA, 13 bp, C. elegans
aaatatctgaaaa

SEQ ID NO: 687785 - DNA, 13 bp, C. elegans
aaatatctgaaga

SEQ ID NO: 687786 - DNA, 13 bp, C. elegans
aaatatctgaata

SEQ ID NO: 687787 - DNA, 13 bp, C. elegans
aaatatctgtaaa

SEQ ID NO: 687788 - DNA, 13 bp, C. elegans
aaatatcttactt

SEQ ID NO: 687789 - DNA, 13 bp, C. elegans
aaatatgaaaact

SEQ ID NO: 687790 - DNA, 13 bp, C. elegans
aaatatgaaacag

SEQ ID NO: 687791 - DNA, 13 bp, C. elegans
aaatatgaaagtt

SEQ ID NO: 687792 - DNA, 13 bp, C. elegans
aaatatgaaattg

SEQ ID NO: 687793 - DNA, 13 bp, C. elegans
aaatatgaagatt

SEQ ID NO: 687794 - DNA, 13 bp, C. elegans
aaatatgaatcat

SEQ ID NO: 687795 - DNA, 13 bp, C. elegans
aaatatgaatgtt

SEQ ID NO: 687796 - DNA, 13 bp, C. elegans
aaatatgaatttc

SEQ ID NO: 687797 - DNA, 13 bp, C. elegans
aaatatgacaatt

SEQ ID NO: 687798 - DNA, 13 bp, C. elegans
aaatatgacattt

SEQ ID NO: 687799 - DNA, 13 bp, C. elegans
aaatatgaccaaa

SEQ ID NO: 687800 - DNA, 13 bp, C. elegans
aaatatgacgaaa

SEQ ID NO: 687801 - DNA, 13 bp, C. elegans
aaatatgactaaa

SEQ ID NO: 687802 - DNA, 13 bp, C. elegans
aaatatgactatt

SEQ ID NO: 687803 - DNA, 13 bp, C. elegans
aaatatgagaatt

SEQ ID NO: 687804 - DNA, 13 bp, C. elegans
aaatatgagatta

SEQ ID NO: 687805 - DNA, 13 bp, C. elegans
aaatatgagattt

SEQ ID NO: 687806 - DNA, 13 bp, C. elegans
aaatatgagtttt

SEQ ID NO: 687807 - DNA, 13 bp, C. elegans
aaatatgataaca

SEQ ID NO: 687808 - DNA, 13 bp, C. elegans
aaatatgatgaat

SEQ ID NO: 687809 - DNA, 15 bp, C. elegans
aaatatgatgggaag

SEQ ID NO: 687810 - DNA, 13 bp, C. elegans
aaatatgatttca

SEQ ID NO: 687811 - DNA, 13 bp, C. elegans
aaatatgattttc

SEQ ID NO: 687812 - DNA, 13 bp, C. elegans
aaatatgcaatat

SEQ ID NO: 687813 - DNA, 13 bp, C. elegans
aaatatgcaatga

SEQ ID NO: 687814 - DNA, 13 bp, C. elegans
aaatatgcacaaa

SEQ ID NO: 687815 - DNA, 13 bp, C. elegans
aaatatgcagaaa

SEQ ID NO: 687816 - DNA, 13 bp, C. elegans
aaatatgcattat

SEQ ID NO: 687817 - DNA, 13 bp, C. elegans
aaatatgccaatt

SEQ ID NO: 687818 - DNA, 13 bp, C. elegans
aaatatgccagaa

SEQ ID NO: 687819 - DNA, 13 bp, C. elegans
aaatatgccgaat

SEQ ID NO: 687820 - DNA, 13 bp, C. elegans
aaatatgctcatt

SEQ ID NO: 687821 - DNA, 13 bp, C. elegans
aaatatgcttaaa

SEQ ID NO: 687822 - DNA, 13 bp, C. elegans
aaatatggatttt

SEQ ID NO: 687823 - DNA, 13 bp, C. elegans
aaatatggctgaa

SEQ ID NO: 687824 - DNA, 13 bp, C. elegans
aaatatggttgaa

SEQ ID NO: 687825 - DNA, 13 bp, C. elegans
aaatatggtttat

SEQ ID NO: 687826 - DNA, 13 bp, C. elegans
aaatatggttttt

SEQ ID NO: 687827 - DNA, 13 bp, C. elegans
aaatatgtacttt

SEQ ID NO: 687828 - DNA, 13 bp, C. elegans
aaatatgtcaaaa

SEQ ID NO: 687829 - DNA, 13 bp, C. elegans
aaatatgtcataa

SEQ ID NO: 687830 - DNA, 13 bp, C. elegans
aaatatgtgataa

SEQ ID NO: 687831 - DNA, 13 bp, C. elegans
aaatatgtgtatt

SEQ ID NO: 687832 - DNA, 13 bp, C. elegans
aaatatgttcaga

SEQ ID NO: 687833 - DNA, 13 bp, C. elegans
aaatatgttgaat

SEQ ID NO: 687834 - DNA, 13 bp, C. elegans
aaatatgttgcgt

SEQ ID NO: 687835 - DNA, 13 bp, C. elegans
aaatatgttgctc

SEQ ID NO: 687836 - DNA, 13 bp, C. elegans
aaatatgttgtgt

SEQ ID NO: 687837 - DNA, 13 bp, C. elegans
aaatatgttgttc

SEQ ID NO: 687838 - DNA, 13 bp, C. elegans
aaatatgtttctc

SEQ ID NO: 687839 - DNA, 13 bp, C. elegans
aaatatgtttgct

SEQ ID NO: 687840 - DNA, 13 bp, C. elegans
aaatattacgaaa

SEQ ID NO: 687841 - DNA, 13 bp, C. elegans
aaatattatgtga

SEQ ID NO: 687842 - DNA, 13 bp, C. elegans
aaatattattcca

SEQ ID NO: 687843 - DNA, 13 bp, C. elegans
aaatattatttgc

SEQ ID NO: 687844 - DNA, 13 bp, C. elegans
aaatattcaaagg

SEQ ID NO: 687845 - DNA, 13 bp, C. elegans
aaatattcaaatc

SEQ ID NO: 687846 - DNA, 13 bp, C. elegans
aaatattcaactg

SEQ ID NO: 687847 - DNA, 13 bp, C. elegans
aaatattcaatct

SEQ ID NO: 687848 - DNA, 13 bp, C. elegans
aaatattcaatgt

SEQ ID NO: 687849 - DNA, 13 bp, C. elegans
aaatattcacaat

SEQ ID NO: 687850 - DNA, 13 bp, C. elegans
aaatattcagaat

SEQ ID NO: 687851 - DNA, 13 bp, C. elegans
aaatattcagatg

SEQ ID NO: 687852 - DNA, 13 bp, C. elegans
aaatattcataca

SEQ ID NO: 687853 - DNA, 13 bp, C. elegans
aaatattccagaa

SEQ ID NO: 687854 - DNA, 13 bp, C. elegans
aaatattccgatt

SEQ ID NO: 687855 - DNA, 13 bp, C. elegans
aaatattcgaaaa

SEQ ID NO: 687856 - DNA, 13 bp, C. elegans
aaatattcgaaat

SEQ ID NO: 687857 - DNA, 13 bp, C. elegans
aaatattcgaaga

SEQ ID NO: 687858 - DNA, 13 bp, C. elegans
aaatattcgaatt

SEQ ID NO: 687859 - DNA, 13 bp, C. elegans
aaatattcggcaa

SEQ ID NO: 687860 - DNA, 13 bp, C. elegans
aaatattctcaca

SEQ ID NO: 687861 - DNA, 13 bp, C. elegans
aaatattctcact

SEQ ID NO: 687862 - DNA, 13 bp, C. elegans
aaatattctgaaa

SEQ ID NO: 687863 - DNA, 13 bp, C. elegans
aaatattctgatt

SEQ ID NO: 687864 - DNA, 13 bp, C. elegans
aaatattctggaa

SEQ ID NO: 687865 - DNA, 13 bp, C. elegans
aaatattcttgat

SEQ ID NO: 687866 - DNA, 13 bp, C. elegans
aaatattgaacaa

SEQ ID NO: 687867 - DNA, 13 bp, C. elegans
aaatattgaactt

SEQ ID NO: 687868 - DNA, 13 bp, C. elegans
aaatattgaagtt

SEQ ID NO: 687869 - DNA, 13 bp, C. elegans
aaatattgacgaa

SEQ ID NO: 687870 - DNA, 13 bp, C. elegans
aaatattgagaat

SEQ ID NO: 687871 - DNA, 13 bp, C. elegans
aaatattgataag

SEQ ID NO: 687872 - DNA, 13 bp, C. elegans
aaatattgatcaa

SEQ ID NO: 687873 - DNA, 13 bp, C. elegans
aaatattgatctt

SEQ ID NO: 687874 - DNA, 13 bp, C. elegans
aaatattgatgat

SEQ ID NO: 687875 - DNA, 13 bp, C. elegans
aaatattgcaaaa

SEQ ID NO: 687876 - DNA, 13 bp, C. elegans
aaatattgcaaat

SEQ ID NO: 687877 - DNA, 13 bp, C. elegans
aaatattgcacaa

SEQ ID NO: 687878 - DNA, 13 bp, C. elegans
aaatattgctttt

SEQ ID NO: 687879 - DNA, 13 bp, C. elegans
aaatattggaact

SEQ ID NO: 687880 - DNA, 13 bp, C. elegans
aaatattgtacat

SEQ ID NO: 687881 - DNA, 13 bp, C. elegans
aaatattgtagaa

SEQ ID NO: 687882 - DNA, 13 bp, C. elegans
aaatattgtcaaa

SEQ ID NO: 687883 - DNA, 13 bp, C. elegans
aaatattgtcaat

SEQ ID NO: 687884 - DNA, 13 bp, C. elegans
aaatattgtgaaa

SEQ ID NO: 687885 - DNA, 13 bp, C. elegans
aaatattgtggtc

SEQ ID NO: 687886 - DNA, 13 bp, C. elegans
aaatattgttctg

SEQ ID NO: 687887 - DNA, 13 bp, C. elegans
aaatattgttgaa

SEQ ID NO: 687888 - DNA, 13 bp, C. elegans
aaatattgtttga

SEQ ID NO: 687889 - DNA, 13 bp, C. elegans
aaatatttaaacc

SEQ ID NO: 687890 - DNA, 13 bp, C. elegans
aaatatttacagt

SEQ ID NO: 687891 - DNA, 13 bp, C. elegans
aaatatttagtga

SEQ ID NO: 687892 - DNA, 13 bp, C. elegans
aaatatttatcag

SEQ ID NO: 687893 - DNA, 13 bp, C. elegans
aaatatttatctc

SEQ ID NO: 687894 - DNA, 13 bp, C. elegans
aaatatttatgga

SEQ ID NO: 687895 - DNA, 13 bp, C. elegans
aaatatttattgg

SEQ ID NO: 687896 - DNA, 13 bp, C. elegans
aaatatttcaaag

SEQ ID NO: 687897 - DNA, 13 bp, C. elegans
aaatatttcacaa

SEQ ID NO: 687898 - DNA, 13 bp, C. elegans
aaatatttccaaa

SEQ ID NO: 687899 - DNA, 13 bp, C. elegans
aaatatttccaat

SEQ ID NO: 687900 - DNA, 13 bp, C. elegans
aaatatttcgaaa

SEQ ID NO: 687901 - DNA, 13 bp, C. elegans
aaatatttcgatc

SEQ ID NO: 687902 - DNA, 13 bp, C. elegans
aaatatttctcac

SEQ ID NO: 687903 - DNA, 13 bp, C. elegans
aaatatttctcta

SEQ ID NO: 687904 - DNA, 14 bp, C. elegans
aaatatttctgttt

SEQ ID NO: 687905 - DNA, 13 bp, C. elegans
aaatatttcttcg

SEQ ID NO: 687906 - DNA, 13 bp, C. elegans
aaatatttgattg

SEQ ID NO: 687907 - DNA, 13 bp, C. elegans
aaatatttgcaat

SEQ ID NO: 687908 - DNA, 13 bp, C. elegans
aaatatttggaaa

SEQ ID NO: 687909 - DNA, 13 bp, C. elegans
aaatatttggaag

SEQ ID NO: 687910 - DNA, 13 bp, C. elegans
aaatatttggttt

SEQ ID NO: 687911 - DNA, 13 bp, C. elegans
aaatatttgtgtg

SEQ ID NO: 687912 - DNA, 13 bp, C. elegans
aaatatttgttca

SEQ ID NO: 687913 - DNA, 13 bp, C. elegans
aaatattttacca

SEQ ID NO: 687914 - DNA, 13 bp, C. elegans
aaatattttcaac

SEQ ID NO: 687915 - DNA, 13 bp, C. elegans
aaatattttcgaa

SEQ ID NO: 687916 - DNA, 13 bp, C. elegans
aaatattttcgtt

SEQ ID NO: 687917 - DNA, 13 bp, C. elegans
aaatattttctca

SEQ ID NO: 687918 - DNA, 13 bp, C. elegans
aaatattttctct

SEQ ID NO: 687919 - DNA, 13 bp, C. elegans
aaatattttgcac

SEQ ID NO: 687920 - DNA, 13 bp, C. elegans
aaatattttggaa

SEQ ID NO: 687921 - DNA, 13 bp, C. elegans
aaatattttggag

SEQ ID NO: 687922 - DNA, 13 bp, C. elegans
aaatatttttcac

SEQ ID NO: 687923 - DNA, 13 bp, C. elegans
aaatatttttcag

SEQ ID NO: 687924 - DNA, 13 bp, C. elegans
aaatatttttcga

SEQ ID NO: 687925 - DNA, 13 bp, C. elegans
aaatatttttctc

SEQ ID NO: 687926 - DNA, 13 bp, C. elegans
aaatattttttgc

SEQ ID NO: 687927 - DNA, 13 bp, C. elegans
aaatcaaaaagtg

SEQ ID NO: 687928 - DNA, 13 bp, C. elegans
aaatcaaaaatgt

SEQ ID NO: 687929 - DNA, 13 bp, C. elegans
aaatcaaaacgtt

SEQ ID NO: 687930 - DNA, 13 bp, C. elegans
aaatcaaaacttc

SEQ ID NO: 687931 - DNA, 13 bp, C. elegans
aaatcaaaacttg

SEQ ID NO: 687932 - DNA, 13 bp, C. elegans
aaatcaaaacttt

SEQ ID NO: 687933 - DNA, 13 bp, C. elegans
aaatcaaaagatt

SEQ ID NO: 687934 - DNA, 13 bp, C. elegans
aaatcaaaagttt

SEQ ID NO: 687935 - DNA, 13 bp, C. elegans
aaatcaaaatgtt

SEQ ID NO: 687936 - DNA, 13 bp, C. elegans
aaatcaaaattgt

SEQ ID NO: 687937 - DNA, 13 bp, C. elegans
aaatcaaacagtt

SEQ ID NO: 687938 - DNA, 13 bp, C. elegans
aaatcaaacattc

SEQ ID NO: 687939 - DNA, 13 bp, C. elegans
aaatcaaacattt

SEQ ID NO: 687940 - DNA, 13 bp, C. elegans
aaatcaaacgttt

SEQ ID NO: 687941 - DNA, 13 bp, C. elegans
aaatcaaactttt

SEQ ID NO: 687942 - DNA, 13 bp, C. elegans
aaatcaaagattt

SEQ ID NO: 687943 - DNA, 13 bp, C. elegans
aaatcaaagtatt

SEQ ID NO: 687944 - DNA, 13 bp, C. elegans
aaatcaaatattg

SEQ ID NO: 687945 - DNA, 13 bp, C. elegans
aaatcaaatcagt

SEQ ID NO: 687946 - DNA, 13 bp, C. elegans
aaatcaaatggaa

SEQ ID NO: 687947 - DNA, 13 bp, C. elegans
aaatcaaattcca

SEQ ID NO: 687948 - DNA, 13 bp, C. elegans
aaatcaaattctc

SEQ ID NO: 687949 - DNA, 13 bp, C. elegans
aaatcaaattgaa

SEQ ID NO: 687950 - DNA, 13 bp, C. elegans
aaatcaaattgat

SEQ ID NO: 687951 - DNA, 13 bp, C. elegans
aaatcaaatttcc

SEQ ID NO: 687952 - DNA, 13 bp, C. elegans
aaatcaacaatct

SEQ ID NO: 687953 - DNA, 13 bp, C. elegans
aaatcaacattta

SEQ ID NO: 687954 - DNA, 13 bp, C. elegans
aaatcaaccaatt

SEQ ID NO: 687955 - DNA, 13 bp, C. elegans
aaatcaacgaaat

SEQ ID NO: 687956 - DNA, 13 bp, C. elegans
aaatcaacgaatt

SEQ ID NO: 687957 - DNA, 13 bp, C. elegans
aaatcaacgagaa

SEQ ID NO: 687958 - DNA, 13 bp, C. elegans
aaatcaacgattt

SEQ ID NO: 687959 - DNA, 13 bp, C. elegans
aaatcaacggaaa

SEQ ID NO: 687960 - DNA, 13 bp, C. elegans
aaatcaacgtttt

SEQ ID NO: 687961 - DNA, 13 bp, C. elegans
aaatcaactagaa

SEQ ID NO: 687962 - DNA, 13 bp, C. elegans
aaatcaactgaaa

SEQ ID NO: 687963 - DNA, 13 bp, C. elegans
aaatcaactgaat

SEQ ID NO: 687964 - DNA, 13 bp, C. elegans
aaatcaactgttt

SEQ ID NO: 687965 - DNA, 13 bp, C. elegans
aaatcaacttgaa

SEQ ID NO: 687966 - DNA, 13 bp, C. elegans
aaatcaacttttt

SEQ ID NO: 687967 - DNA, 13 bp, C. elegans
aaatcaagaaagg

SEQ ID NO: 687968 - DNA, 13 bp, C. elegans
aaatcaagaaatc

SEQ ID NO: 687969 - DNA, 13 bp, C. elegans
aaatcaagatatt

SEQ ID NO: 687970 - DNA, 13 bp, C. elegans
aaatcaaggaaac

SEQ ID NO: 687971 - DNA, 13 bp, C. elegans
aaatcaagttgtt

SEQ ID NO: 687972 - DNA, 13 bp, C. elegans
aaatcaagttttg

SEQ ID NO: 687973 - DNA, 13 bp, C. elegans
aaatcaagttttt

SEQ ID NO: 687974 - DNA, 13 bp, C. elegans
aaatcaataatgt

SEQ ID NO: 687975 - DNA, 13 bp, C. elegans
aaatcaatacttt

SEQ ID NO: 687976 - DNA, 13 bp, C. elegans
aaatcaatagaat

SEQ ID NO: 687977 - DNA, 13 bp, C. elegans
aaatcaatattga

SEQ ID NO: 687978 - DNA, 13 bp, C. elegans
aaatcaatatttc

SEQ ID NO: 687979 - DNA, 13 bp, C. elegans
aaatcaatatttg

SEQ ID NO: 687980 - DNA, 13 bp, C. elegans
aaatcaatcaatt

SEQ ID NO: 687981 - DNA, 13 bp, C. elegans
aaatcaatcagaa

SEQ ID NO: 687982 - DNA, 13 bp, C. elegans
aaatcaatcgatt

SEQ ID NO: 687983 - DNA, 13 bp, C. elegans
aaatcaatgaaac

SEQ ID NO: 687984 - DNA, 13 bp, C. elegans
aaatcaatgaaat

SEQ ID NO: 687985 - DNA, 13 bp, C. elegans
aaatcaatgaata

SEQ ID NO: 687986 - DNA, 13 bp, C. elegans
aaatcaatggaaa

SEQ ID NO: 687987 - DNA, 13 bp, C. elegans
aaatcaatggttt

SEQ ID NO: 687988 - DNA, 13 bp, C. elegans
aaatcaatgtaaa

SEQ ID NO: 687989 - DNA, 13 bp, C. elegans
aaatcaatgtatt

SEQ ID NO: 687990 - DNA, 13 bp, C. elegans
aaatcaatgtttt

SEQ ID NO: 687991 - DNA, 13 bp, C. elegans
aaatcaattcaat

SEQ ID NO: 687992 - DNA, 13 bp, C. elegans
aaatcaattccaa

SEQ ID NO: 687993 - DNA, 13 bp, C. elegans
aaatcaattcgaa

SEQ ID NO: 687994 - DNA, 13 bp, C. elegans
aaatcaattgaat

SEQ ID NO: 687995 - DNA, 13 bp, C. elegans
aaatcaattggtt

SEQ ID NO: 687996 - DNA, 13 bp, C. elegans
aaatcaatttatc

SEQ ID NO: 687997 - DNA, 13 bp, C. elegans
aaatcaatttcca

SEQ ID NO: 687998 - DNA, 13 bp, C. elegans
aaatcaatttgcc

SEQ ID NO: 687999 - DNA, 13 bp, C. elegans
aaatcaatttgta

SEQ ID NO: 688000 - DNA, 13 bp, C. elegans
aaatcaattttag

SEQ ID NO: 688001 - DNA, 13 bp, C. elegans
aaatcaattttct

SEQ ID NO: 688002 - DNA, 13 bp, C. elegans
aaatcacaaattg

SEQ ID NO: 688003 - DNA, 13 bp, C. elegans
aaatcacaaattt

SEQ ID NO: 688004 - DNA, 13 bp, C. elegans
aaatcacaacttt

SEQ ID NO: 688005 - DNA, 13 bp, C. elegans
aaatcacaagttt

SEQ ID NO: 688006 - DNA, 13 bp, C. elegans
aaatcacaatgtt

SEQ ID NO: 688007 - DNA, 13 bp, C. elegans
aaatcacaatttg

SEQ ID NO: 688008 - DNA, 13 bp, C. elegans
aaatcacaatttt

SEQ ID NO: 688009 - DNA, 13 bp, C. elegans
aaatcacactttt

SEQ ID NO: 688010 - DNA, 13 bp, C. elegans
aaatcacagattt

SEQ ID NO: 688011 - DNA, 13 bp, C. elegans
aaatcacattgaa

SEQ ID NO: 688012 - DNA, 13 bp, C. elegans
aaatcacatttta

SEQ ID NO: 688013 - DNA, 13 bp, C. elegans
aaatcacattttc

SEQ ID NO: 688014 - DNA, 13 bp, C. elegans
aaatcaccaaatt

SEQ ID NO: 688015 - DNA, 13 bp, C. elegans
aaatcaccgaaat

SEQ ID NO: 688016 - DNA, 13 bp, C. elegans
aaatcaccgattt

SEQ ID NO: 688017 - DNA, 13 bp, C. elegans
aaatcacctattt

SEQ ID NO: 688018 - DNA, 13 bp, C. elegans
aaatcaccttttt

SEQ ID NO: 688019 - DNA, 13 bp, C. elegans
aaatcacgaaatt

SEQ ID NO: 688020 - DNA, 13 bp, C. elegans
aaatcacgatttt

SEQ ID NO: 688021 - DNA, 13 bp, C. elegans
aaatcactaattt

SEQ ID NO: 688022 - DNA, 13 bp, C. elegans
aaatcactatttt

SEQ ID NO: 688023 - DNA, 13 bp, C. elegans
aaatcactcaaat

SEQ ID NO: 688024 - DNA, 13 bp, C. elegans
aaatcactctttt

SEQ ID NO: 688025 - DNA, 13 bp, C. elegans
aaatcactgaaaa

SEQ ID NO: 688026 - DNA, 13 bp, C. elegans
aaatcactgaaat

SEQ ID NO: 688027 - DNA, 13 bp, C. elegans
aaatcacttcaaa

SEQ ID NO: 688028 - DNA, 13 bp, C. elegans
aaatcacttgaaa

SEQ ID NO: 688029 - DNA, 13 bp, C. elegans
aaatcacttgttt

SEQ ID NO: 688030 - DNA, 13 bp, C. elegans
aaatcactttcaa

SEQ ID NO: 688031 - DNA, 13 bp, C. elegans
aaatcactttttt

SEQ ID NO: 688032 - DNA, 13 bp, C. elegans
aaatcagaaaacg

SEQ ID NO: 688033 - DNA, 13 bp, C. elegans
aaatcagaaaact

SEQ ID NO: 688034 - DNA, 13 bp, C. elegans
aaatcagaaatat

SEQ ID NO: 688035 - DNA, 13 bp, C. elegans
aaatcagaaatga

SEQ ID NO: 688036 - DNA, 13 bp, C. elegans
aaatcagataatt

SEQ ID NO: 688037 - DNA, 13 bp, C. elegans
aaatcagatattt

SEQ ID NO: 688038 - DNA, 13 bp, C. elegans
aaatcagatgaaa

SEQ ID NO: 688039 - DNA, 13 bp, C. elegans
aaatcagatgaga

SEQ ID NO: 688040 - DNA, 13 bp, C. elegans
aaatcagattatt

SEQ ID NO: 688041 - DNA, 13 bp, C. elegans
aaatcagatttca

SEQ ID NO: 688042 - DNA, 13 bp, C. elegans
aaatcagcatttt

SEQ ID NO: 688043 - DNA, 13 bp, C. elegans
aaatcagccaaaa

SEQ ID NO: 688044 - DNA, 13 bp, C. elegans
aaatcagccagag

SEQ ID NO: 688045 - DNA, 13 bp, C. elegans
aaatcagctgaaa

SEQ ID NO: 688046 - DNA, 13 bp, C. elegans
aaatcagcttttt

SEQ ID NO: 688047 - DNA, 13 bp, C. elegans
aaatcaggaaaac

SEQ ID NO: 688048 - DNA, 13 bp, C. elegans
aaatcaggaaaat

SEQ ID NO: 688049 - DNA, 13 bp, C. elegans
aaatcaggaaatt

SEQ ID NO: 688050 - DNA, 13 bp, C. elegans
aaatcaggaattt

SEQ ID NO: 688051 - DNA, 13 bp, C. elegans
aaatcaggagaaa

SEQ ID NO: 688052 - DNA, 13 bp, C. elegans
aaatcaggttttc

SEQ ID NO: 688053 - DNA, 13 bp, C. elegans
aaatcagtcaaaa

SEQ ID NO: 688054 - DNA, 13 bp, C. elegans
aaatcagtcaaat

SEQ ID NO: 688055 - DNA, 13 bp, C. elegans
aaatcagtgaaaa

SEQ ID NO: 688056 - DNA, 13 bp, C. elegans
aaatcagtgattt

SEQ ID NO: 688057 - DNA, 13 bp, C. elegans
aaatcagtgttct

SEQ ID NO: 688058 - DNA, 13 bp, C. elegans
aaatcagttaaaa

SEQ ID NO: 688059 - DNA, 13 bp, C. elegans
aaatcagttaatt

SEQ ID NO: 688060 - DNA, 13 bp, C. elegans
aaatcagttgaaa

SEQ ID NO: 688061 - DNA, 13 bp, C. elegans
aaatcagttgaat

SEQ ID NO: 688062 - DNA, 13 bp, C. elegans
aaatcagttgaga

SEQ ID NO: 688063 - DNA, 13 bp, C. elegans
aaatcagtttaaa

SEQ ID NO: 688064 - DNA, 13 bp, C. elegans
aaatcagtttagc

SEQ ID NO: 688065 - DNA, 13 bp, C. elegans
aaatcagttttgt

SEQ ID NO: 688066 - DNA, 13 bp, C. elegans
aaatcagttttta

SEQ ID NO: 688067 - DNA, 13 bp, C. elegans
aaatcagtttttg

SEQ ID NO: 688068 - DNA, 13 bp, C. elegans
aaatcagtttttt

SEQ ID NO: 688069 - DNA, 13 bp, C. elegans
aaatcataacttt

SEQ ID NO: 688070 - DNA, 13 bp, C. elegans
aaatcatagtttt

SEQ ID NO: 688071 - DNA, 17 bp, C. elegans
aaatcatatggagtcat

SEQ ID NO: 688072 - DNA, 13 bp, C. elegans
aaatcatatttct

SEQ ID NO: 688073 - DNA, 13 bp, C. elegans
aaatcatcaaaag

SEQ ID NO: 688074 - DNA, 13 bp, C. elegans
aaatcatcaaact

SEQ ID NO: 688075 - DNA, 13 bp, C. elegans
aaatcatcaatat

SEQ ID NO: 688076 - DNA, 13 bp, C. elegans
aaatcatcagaat

SEQ ID NO: 688077 - DNA, 13 bp, C. elegans
aaatcatcatcat

SEQ ID NO: 688078 - DNA, 13 bp, C. elegans
aaatcatcgaaaa

SEQ ID NO: 688079 - DNA, 13 bp, C. elegans
aaatcatcgagtt

SEQ ID NO: 688080 - DNA, 13 bp, C. elegans
aaatcatctattt

SEQ ID NO: 688081 - DNA, 13 bp, C. elegans
aaatcatctttaa

SEQ ID NO: 688082 - DNA, 13 bp, C. elegans
aaatcatgaattt

SEQ ID NO: 688083 - DNA, 13 bp, C. elegans
aaatcatgacaaa

SEQ ID NO: 688084 - DNA, 13 bp, C. elegans
aaatcatgagaaa

SEQ ID NO: 688085 - DNA, 13 bp, C. elegans
aaatcatgagaat

SEQ ID NO: 688086 - DNA, 13 bp, C. elegans
aaatcatgatttt

SEQ ID NO: 688087 - DNA, 13 bp, C. elegans
aaatcatggaaat

SEQ ID NO: 688088 - DNA, 13 bp, C. elegans
aaatcatggaatt

SEQ ID NO: 688089 - DNA, 13 bp, C. elegans
aaatcatgtattt

SEQ ID NO: 688090 - DNA, 13 bp, C. elegans
aaatcatgtttca

SEQ ID NO: 688091 - DNA, 13 bp, C. elegans
aaatcatgttttc

SEQ ID NO: 688092 - DNA, 13 bp, C. elegans
aaatcatgttttt

SEQ ID NO: 688093 - DNA, 13 bp, C. elegans
aaatcattagaaa

SEQ ID NO: 688094 - DNA, 13 bp, C. elegans
aaatcattcaaca

SEQ ID NO: 688095 - DNA, 13 bp, C. elegans
aaatcattcaact

SEQ ID NO: 688096 - DNA, 13 bp, C. elegans
aaatcattcaatt

SEQ ID NO: 688097 - DNA, 13 bp, C. elegans
aaatcattcattt

SEQ ID NO: 688098 - DNA, 13 bp, C. elegans
aaatcattctgaa

SEQ ID NO: 688099 - DNA, 13 bp, C. elegans
aaatcattgaaca

SEQ ID NO: 688100 - DNA, 13 bp, C. elegans
aaatcattgatga

SEQ ID NO: 688101 - DNA, 13 bp, C. elegans
aaatcatttcgat

SEQ ID NO: 688102 - DNA, 13 bp, C. elegans
aaatcatttctat

SEQ ID NO: 688103 - DNA, 13 bp, C. elegans
aaatcatttgcaa

SEQ ID NO: 688104 - DNA, 13 bp, C. elegans
aaatcattttcaa

SEQ ID NO: 688105 - DNA, 13 bp, C. elegans
aaatcattttgta

SEQ ID NO: 688106 - DNA, 13 bp, C. elegans
aaatcatttttca

SEQ ID NO: 688107 - DNA, 13 bp, C. elegans
aaatcatttttct

SEQ ID NO: 688108 - DNA, 13 bp, C. elegans
aaatccaaaaagt

SEQ ID NO: 688109 - DNA, 13 bp, C. elegans
aaatccaaaaatg

SEQ ID NO: 688110 - DNA, 13 bp, C. elegans
aaatccaaaattc

SEQ ID NO: 688111 - DNA, 13 bp, C. elegans
aaatccaaacatt

SEQ ID NO: 688112 - DNA, 13 bp, C. elegans
aaatccaaagttc

SEQ ID NO: 688113 - DNA, 13 bp, C. elegans
aaatccaaagttt

SEQ ID NO: 688114 - DNA, 13 bp, C. elegans
aaatccaaatcgc

SEQ ID NO: 688115 - DNA, 13 bp, C. elegans
aaatccaaattta

SEQ ID NO: 688116 - DNA, 13 bp, C. elegans
aaatccaagaaat

SEQ ID NO: 688117 - DNA, 13 bp, C. elegans
aaatccaagaatt

SEQ ID NO: 688118 - DNA, 13 bp, C. elegans
aaatccaagattt

SEQ ID NO: 688119 - DNA, 13 bp, C. elegans
aaatccaatattt

SEQ ID NO: 688120 - DNA, 13 bp, C. elegans
aaatccaattggc

SEQ ID NO: 688121 - DNA, 13 bp, C. elegans
aaatccaatttcg

SEQ ID NO: 688122 - DNA, 13 bp, C. elegans
aaatccacaattt

SEQ ID NO: 688123 - DNA, 13 bp, C. elegans
aaatccacatttc

SEQ ID NO: 688124 - DNA, 13 bp, C. elegans
aaatccaccaatt

SEQ ID NO: 688125 - DNA, 13 bp, C. elegans
aaatccactgaaa

SEQ ID NO: 688126 - DNA, 13 bp, C. elegans
aaatccacttttc

SEQ ID NO: 688127 - DNA, 13 bp, C. elegans
aaatccagaaaac

SEQ ID NO: 688128 - DNA, 13 bp, C. elegans
aaatccagaaaag

SEQ ID NO: 688129 - DNA, 13 bp, C. elegans
aaatccagaaaat

SEQ ID NO: 688130 - DNA, 13 bp, C. elegans
aaatccagaagtt

SEQ ID NO: 688131 - DNA, 13 bp, C. elegans
aaatccagcaatt

SEQ ID NO: 688132 - DNA, 13 bp, C. elegans
aaatccaggtttt

SEQ ID NO: 688133 - DNA, 13 bp, C. elegans
aaatccagtgcaa

SEQ ID NO: 688134 - DNA, 13 bp, C. elegans
aaatccatattgg

SEQ ID NO: 688135 - DNA, 13 bp, C. elegans
aaatccatattta

SEQ ID NO: 688136 - DNA, 13 bp, C. elegans
aaatccatccacc

SEQ ID NO: 688137 - DNA, 13 bp, C. elegans
aaatccattggat

SEQ ID NO: 688138 - DNA, 13 bp, C. elegans
aaatccatttatt

SEQ ID NO: 688139 - DNA, 13 bp, C. elegans
aaatccatttttt

SEQ ID NO: 688140 - DNA, 13 bp, C. elegans
aaatcccaaaagt

SEQ ID NO: 688141 - DNA, 13 bp, C. elegans
aaatcccaaaatt

SEQ ID NO: 688142 - DNA, 13 bp, C. elegans
aaatcccaaattt

SEQ ID NO: 688143 - DNA, 13 bp, C. elegans
aaatcccaatcca

SEQ ID NO: 688144 - DNA, 13 bp, C. elegans
aaatcccaatttt

SEQ ID NO: 688145 - DNA, 13 bp, C. elegans
aaatcccatttct

SEQ ID NO: 688146 - DNA, 13 bp, C. elegans
aaatcccattttc

SEQ ID NO: 688147 - DNA, 13 bp, C. elegans
aaatccccaattt

SEQ ID NO: 688148 - DNA, 13 bp, C. elegans
aaatccccgaaaa

SEQ ID NO: 688149 - DNA, 13 bp, C. elegans
aaatcccgaaaaa

SEQ ID NO: 688150 - DNA, 13 bp, C. elegans
aaatcccgaaaat

SEQ ID NO: 688151 - DNA, 13 bp, C. elegans
aaatcccgccaaa

SEQ ID NO: 688152 - DNA, 13 bp, C. elegans
aaatcccgttttt

SEQ ID NO: 688153 - DNA, 13 bp, C. elegans
aaatccctcaaaa

SEQ ID NO: 688154 - DNA, 13 bp, C. elegans
aaatccctccaaa

SEQ ID NO: 688155 - DNA, 13 bp, C. elegans
aaatccgaaaaat

SEQ ID NO: 688156 - DNA, 13 bp, C. elegans
aaatccgaaaagt

SEQ ID NO: 688157 - DNA, 13 bp, C. elegans
aaatccgaaaatt

SEQ ID NO: 688158 - DNA, 13 bp, C. elegans
aaatccgaataaa

SEQ ID NO: 688159 - DNA, 13 bp, C. elegans
aaatccgagaatt

SEQ ID NO: 688160 - DNA, 13 bp, C. elegans
aaatccgagtttt

SEQ ID NO: 688161 - DNA, 13 bp, C. elegans
aaatccgataatt

SEQ ID NO: 688162 - DNA, 13 bp, C. elegans
aaatccgcaaacc

SEQ ID NO: 688163 - DNA, 13 bp, C. elegans
aaatccgccaaaa

SEQ ID NO: 688164 - DNA, 15 bp, C. elegans
aaatccgccgcaatg

SEQ ID NO: 688165 - DNA, 13 bp, C. elegans
aaatccgcgaaaa

SEQ ID NO: 688166 - DNA, 13 bp, C. elegans
aaatccggaaaat

SEQ ID NO: 688167 - DNA, 13 bp, C. elegans
aaatccggcgaac

SEQ ID NO: 688168 - DNA, 13 bp, C. elegans
aaatccgtggaaa

SEQ ID NO: 688169 - DNA, 13 bp, C. elegans
aaatccgttcaaa

SEQ ID NO: 688170 - DNA, 13 bp, C. elegans
aaatcctaaattt

SEQ ID NO: 688171 - DNA, 13 bp, C. elegans
aaatcctaatttc

SEQ ID NO: 688172 - DNA, 13 bp, C. elegans
aaatcctaatttt

SEQ ID NO: 688173 - DNA, 13 bp, C. elegans
aaatcctatcaaa

SEQ ID NO: 688174 - DNA, 13 bp, C. elegans
aaatcctattttc

SEQ ID NO: 688175 - DNA, 13 bp, C. elegans
aaatcctcaaaat

SEQ ID NO: 688176 - DNA, 13 bp, C. elegans
aaatcctcatttt

SEQ ID NO: 688177 - DNA, 13 bp, C. elegans
aaatcctcgaaaa

SEQ ID NO: 688178 - DNA, 13 bp, C. elegans
aaatcctcgtttt

SEQ ID NO: 688179 - DNA, 13 bp, C. elegans
aaatcctgaaaaa

SEQ ID NO: 688180 - DNA, 13 bp, C. elegans
aaatcctgaaaat

SEQ ID NO: 688181 - DNA, 13 bp, C. elegans
aaatcctgaaatt

SEQ ID NO: 688182 - DNA, 13 bp, C. elegans
aaatcctgagaat

SEQ ID NO: 688183 - DNA, 13 bp, C. elegans
aaatcctggaaat

SEQ ID NO: 688184 - DNA, 13 bp, C. elegans
aaatccttggaaa

SEQ ID NO: 688185 - DNA, 13 bp, C. elegans
aaatcctttaaaa

SEQ ID NO: 688186 - DNA, 13 bp, C. elegans
aaatcgaaaaatg

SEQ ID NO: 688187 - DNA, 13 bp, C. elegans
aaatcgaaaaatt

SEQ ID NO: 688188 - DNA, 14 bp, C. elegans
aaatcgaaaaattc

SEQ ID NO: 688189 - DNA, 13 bp, C. elegans
aaatcgaaaactt

SEQ ID NO: 688190 - DNA, 13 bp, C. elegans
aaatcgaaaagtc

SEQ ID NO: 688191 - DNA, 13 bp, C. elegans
aaatcgaaaatat

SEQ ID NO: 688192 - DNA, 13 bp, C. elegans
aaatcgaaaatct

SEQ ID NO: 688193 - DNA, 13 bp, C. elegans
aaatcgaaaatga

SEQ ID NO: 688194 - DNA, 13 bp, C. elegans
aaatcgaaaatgg

SEQ ID NO: 688195 - DNA, 13 bp, C. elegans
aaatcgaaaattc

SEQ ID NO: 688196 - DNA, 13 bp, C. elegans
aaatcgaaaattg

SEQ ID NO: 688197 - DNA, 13 bp, C. elegans
aaatcgaaacatt

SEQ ID NO: 688198 - DNA, 13 bp, C. elegans
aaatcgaaacttt

SEQ ID NO: 688199 - DNA, 13 bp, C. elegans
aaatcgaaatatt

SEQ ID NO: 688200 - DNA, 13 bp, C. elegans
aaatcgaaatcgg

SEQ ID NO: 688201 - DNA, 13 bp, C. elegans
aaatcgaaatttc

SEQ ID NO: 688202 - DNA, 13 bp, C. elegans
aaatcgaacaatt

SEQ ID NO: 688203 - DNA, 13 bp, C. elegans
aaatcgaacattg

SEQ ID NO: 688204 - DNA, 13 bp, C. elegans
aaatcgaacgttt

SEQ ID NO: 688205 - DNA, 13 bp, C. elegans
aaatcgaagagaa

SEQ ID NO: 688206 - DNA, 13 bp, C. elegans
aaatcgaataaat

SEQ ID NO: 688207 - DNA, 13 bp, C. elegans
aaatcgaataatt

SEQ ID NO: 688208 - DNA, 13 bp, C. elegans
aaatcgaatattc

SEQ ID NO: 688209 - DNA, 13 bp, C. elegans
aaatcgaatgaaa

SEQ ID NO: 688210 - DNA, 13 bp, C. elegans
aaatcgaatggca

SEQ ID NO: 688211 - DNA, 13 bp, C. elegans
aaatcgaatgttt

SEQ ID NO: 688212 - DNA, 13 bp, C. elegans
aaatcgaatttag

SEQ ID NO: 688213 - DNA, 13 bp, C. elegans
aaatcgaatttct

SEQ ID NO: 688214 - DNA, 13 bp, C. elegans
aaatcgaattttg

SEQ ID NO: 688215 - DNA, 13 bp, C. elegans
aaatcgaattttt

SEQ ID NO: 688216 - DNA, 13 bp, C. elegans
aaatcgacaaatc

SEQ ID NO: 688217 - DNA, 13 bp, C. elegans
aaatcgacacaag

SEQ ID NO: 688218 - DNA, 13 bp, C. elegans
aaatcgacacaat

SEQ ID NO: 688219 - DNA, 13 bp, C. elegans
aaatcgacaccaa

SEQ ID NO: 688220 - DNA, 13 bp, C. elegans
aaatcgacaccag

SEQ ID NO: 688221 - DNA, 13 bp, C. elegans
aaatcgacagaag

SEQ ID NO: 688222 - DNA, 13 bp, C. elegans
aaatcgacagttt

SEQ ID NO: 688223 - DNA, 13 bp, C. elegans
aaatcgacatatt

SEQ ID NO: 688224 - DNA, 13 bp, C. elegans
aaatcgaccaaaa

SEQ ID NO: 688225 - DNA, 13 bp, C. elegans
aaatcgacgaaaa

SEQ ID NO: 688226 - DNA, 13 bp, C. elegans
aaatcgacgaaat

SEQ ID NO: 688227 - DNA, 13 bp, C. elegans
aaatcgacgattt

SEQ ID NO: 688228 - DNA, 14 bp, C. elegans
aaatcgacgttttt

SEQ ID NO: 688229 - DNA, 13 bp, C. elegans
aaatcgactgttt

SEQ ID NO: 688230 - DNA, 13 bp, C. elegans
aaatcgacttttc

SEQ ID NO: 688231 - DNA, 13 bp, C. elegans
aaatcgacttttt

SEQ ID NO: 688232 - DNA, 13 bp, C. elegans
aaatcgagaaaga

SEQ ID NO: 688233 - DNA, 13 bp, C. elegans
aaatcgagaaatc

SEQ ID NO: 688234 - DNA, 13 bp, C. elegans
aaatcgagaagaa

SEQ ID NO: 688235 - DNA, 13 bp, C. elegans
aaatcgagaataa

SEQ ID NO: 688236 - DNA, 13 bp, C. elegans
aaatcgagagttt

SEQ ID NO: 688237 - DNA, 13 bp, C. elegans
aaatcgagatccc

SEQ ID NO: 688238 - DNA, 13 bp, C. elegans
aaatcgagcaaaa

SEQ ID NO: 688239 - DNA, 13 bp, C. elegans
aaatcgaggaaat

SEQ ID NO: 688240 - DNA, 13 bp, C. elegans
aaatcgagttttt

SEQ ID NO: 688241 - DNA, 13 bp, C. elegans
aaatcgataaaat

SEQ ID NO: 688242 - DNA, 13 bp, C. elegans
aaatcgataaatg

SEQ ID NO: 688243 - DNA, 13 bp, C. elegans
aaatcgataacat

SEQ ID NO: 688244 - DNA, 13 bp, C. elegans
aaatcgataagtt

SEQ ID NO: 688245 - DNA, 13 bp, C. elegans
aaatcgataatat

SEQ ID NO: 688246 - DNA, 13 bp, C. elegans
aaatcgataatct

SEQ ID NO: 688247 - DNA, 13 bp, C. elegans
aaatcgataatgt

SEQ ID NO: 688248 - DNA, 13 bp, C. elegans
aaatcgatatgaa

SEQ ID NO: 688249 - DNA, 13 bp, C. elegans
aaatcgatattca

SEQ ID NO: 688250 - DNA, 13 bp, C. elegans
aaatcgatattct

SEQ ID NO: 688251 - DNA, 13 bp, C. elegans
aaatcgatatttc

SEQ ID NO: 688252 - DNA, 13 bp, C. elegans
aaatcgatcaaaa

SEQ ID NO: 688253 - DNA, 13 bp, C. elegans
aaatcgatcaaat

SEQ ID NO: 688254 - DNA, 13 bp, C. elegans
aaatcgatcgatt

SEQ ID NO: 688255 - DNA, 13 bp, C. elegans
aaatcgatgaaaa

SEQ ID NO: 688256 - DNA, 13 bp, C. elegans
aaatcgatgcaaa

SEQ ID NO: 688257 - DNA, 13 bp, C. elegans
aaatcgattaatt

SEQ ID NO: 688258 - DNA, 13 bp, C. elegans
aaatcgattattt

SEQ ID NO: 688259 - DNA, 13 bp, C. elegans
aaatcgattgatt

SEQ ID NO: 688260 - DNA, 13 bp, C. elegans
aaatcgattttca

SEQ ID NO: 688261 - DNA, 13 bp, C. elegans
aaatcgattttcc

SEQ ID NO: 688262 - DNA, 13 bp, C. elegans
aaatcgattttta

SEQ ID NO: 688263 - DNA, 13 bp, C. elegans
aaatcgatttttg

SEQ ID NO: 688264 - DNA, 13 bp, C. elegans
aaatcgcaaaatt

SEQ ID NO: 688265 - DNA, 13 bp, C. elegans
aaatcgcaacaaa

SEQ ID NO: 688266 - DNA, 13 bp, C. elegans
aaatcgcagaaaa

SEQ ID NO: 688267 - DNA, 13 bp, C. elegans
aaatcgcattttc

SEQ ID NO: 688268 - DNA, 13 bp, C. elegans
aaatcgccaaaat

SEQ ID NO: 688269 - DNA, 13 bp, C. elegans
aaatcgccaactt

SEQ ID NO: 688270 - DNA, 13 bp, C. elegans
aaatcgccaattt

SEQ ID NO: 688271 - DNA, 13 bp, C. elegans
aaatcgccagaaa

SEQ ID NO: 688272 - DNA, 13 bp, C. elegans
aaatcgccagaat

SEQ ID NO: 688273 - DNA, 13 bp, C. elegans
aaatcgccgaaaa

SEQ ID NO: 688274 - DNA, 13 bp, C. elegans
aaatcgccgattt

SEQ ID NO: 688275 - DNA, 13 bp, C. elegans
aaatcgccggaaa

SEQ ID NO: 688276 - DNA, 13 bp, C. elegans
aaatcgccggaat

SEQ ID NO: 688277 - DNA, 13 bp, C. elegans
aaatcgcggaaaa

SEQ ID NO: 688278 - DNA, 13 bp, C. elegans
aaatcgctaattt

SEQ ID NO: 688279 - DNA, 13 bp, C. elegans
aaatcgctatttt

SEQ ID NO: 688280 - DNA, 13 bp, C. elegans
aaatcggaaaaac

SEQ ID NO: 688281 - DNA, 13 bp, C. elegans
aaatcggaaaatt

SEQ ID NO: 688282 - DNA, 13 bp, C. elegans
aaatcggaaattt

SEQ ID NO: 688283 - DNA, 13 bp, C. elegans
aaatcggaatttg

SEQ ID NO: 688284 - DNA, 13 bp, C. elegans
aaatcggagaatt

SEQ ID NO: 688285 - DNA, 13 bp, C. elegans
aaatcggagattt

SEQ ID NO: 688286 - DNA, 13 bp, C. elegans
aaatcggatttct

SEQ ID NO: 688287 - DNA, 13 bp, C. elegans
aaatcggcaaaaa

SEQ ID NO: 688288 - DNA, 13 bp, C. elegans
aaatcggcaattc

SEQ ID NO: 688289 - DNA, 13 bp, C. elegans
aaatcggcaattt

SEQ ID NO: 688290 - DNA, 13 bp, C. elegans
aaatcggcagttt

SEQ ID NO: 688291 - DNA, 13 bp, C. elegans
aaatcggcgattt

SEQ ID NO: 688292 - DNA, 13 bp, C. elegans
aaatcggctaatt

SEQ ID NO: 688293 - DNA, 13 bp, C. elegans
aaatcggctgaaa

SEQ ID NO: 688294 - DNA, 13 bp, C. elegans
aaatcgggaaaaa

SEQ ID NO: 688295 - DNA, 13 bp, C. elegans
aaatcgggaattt

SEQ ID NO: 688296 - DNA, 13 bp, C. elegans
aaatcgggatttt

SEQ ID NO: 688297 - DNA, 13 bp, C. elegans
aaatcgggttttt

SEQ ID NO: 688298 - DNA, 13 bp, C. elegans
aaatcggttcaaa

SEQ ID NO: 688299 - DNA, 13 bp, C. elegans
aaatcggttttaa

SEQ ID NO: 688300 - DNA, 13 bp, C. elegans
aaatcggttttta

SEQ ID NO: 688301 - DNA, 13 bp, C. elegans
aaatcgtaaaaat

SEQ ID NO: 688302 - DNA, 13 bp, C. elegans
aaatcgtaaaatt

SEQ ID NO: 688303 - DNA, 13 bp, C. elegans
aaatcgtaaattt

SEQ ID NO: 688304 - DNA, 13 bp, C. elegans
aaatcgtcaaaaa

SEQ ID NO: 688305 - DNA, 13 bp, C. elegans
aaatcgtcaaaat

SEQ ID NO: 688306 - DNA, 13 bp, C. elegans
aaatcgtcgaaaa

SEQ ID NO: 688307 - DNA, 13 bp, C. elegans
aaatcgtcgtttt

SEQ ID NO: 688308 - DNA, 13 bp, C. elegans
aaatcgtctgaaa

SEQ ID NO: 688309 - DNA, 13 bp, C. elegans
aaatcgtgaaaaa

SEQ ID NO: 688310 - DNA, 13 bp, C. elegans
aaatcgtggccta

SEQ ID NO: 688311 - DNA, 13 bp, C. elegans
aaatcgtgtgaaa

SEQ ID NO: 688312 - DNA, 13 bp, C. elegans
aaatcgttaaaaa

SEQ ID NO: 688313 - DNA, 13 bp, C. elegans
aaatcgttatttt

SEQ ID NO: 688314 - DNA, 13 bp, C. elegans
aaatcgttgaaaa

SEQ ID NO: 688315 - DNA, 13 bp, C. elegans
aaatcgttgaatt

SEQ ID NO: 688316 - DNA, 13 bp, C. elegans
aaatcgttttatt

SEQ ID NO: 688317 - DNA, 14 bp, C. elegans
aaatcgttttattt

SEQ ID NO: 688318 - DNA, 13 bp, C. elegans
aaatcgttttcca

SEQ ID NO: 688319 - DNA, 13 bp, C. elegans
aaatctaaaaacg

SEQ ID NO: 688320 - DNA, 13 bp, C. elegans
aaatctaaaaatg

SEQ ID NO: 688321 - DNA, 13 bp, C. elegans
aaatctaaaactt

SEQ ID NO: 688322 - DNA, 13 bp, C. elegans
aaatctaaaagct

SEQ ID NO: 688323 - DNA, 13 bp, C. elegans
aaatctaaaagta

SEQ ID NO: 688324 - DNA, 13 bp, C. elegans
aaatctaaaattc

SEQ ID NO: 688325 - DNA, 13 bp, C. elegans
aaatctaaattga

SEQ ID NO: 688326 - DNA, 13 bp, C. elegans
aaatctaaatttc

SEQ ID NO: 688327 - DNA, 13 bp, C. elegans
aaatctaagttta

SEQ ID NO: 688328 - DNA, 13 bp, C. elegans
aaatctaatgttt

SEQ ID NO: 688329 - DNA, 13 bp, C. elegans
aaatctaattgaa

SEQ ID NO: 688330 - DNA, 14 bp, C. elegans
aaatctaatttcaa

SEQ ID NO: 688331 - DNA, 13 bp, C. elegans
aaatctaattttc

SEQ ID NO: 688332 - DNA, 13 bp, C. elegans
aaatctacaagaa

SEQ ID NO: 688333 - DNA, 13 bp, C. elegans
aaatctacaatgc

SEQ ID NO: 688334 - DNA, 13 bp, C. elegans
aaatctacaattt

SEQ ID NO: 688335 - DNA, 13 bp, C. elegans
aaatctacacaag

SEQ ID NO: 688336 - DNA, 13 bp, C. elegans
aaatctacacaat

SEQ ID NO: 688337 - DNA, 13 bp, C. elegans
aaatctacacgaa

SEQ ID NO: 688338 - DNA, 13 bp, C. elegans
aaatctacagaaa

SEQ ID NO: 688339 - DNA, 13 bp, C. elegans
aaatctacagtaa

SEQ ID NO: 688340 - DNA, 13 bp, C. elegans
aaatctacatttt

SEQ ID NO: 688341 - DNA, 13 bp, C. elegans
aaatctaccgtac

SEQ ID NO: 688342 - DNA, 13 bp, C. elegans
aaatctaccgtat

SEQ ID NO: 688343 - DNA, 13 bp, C. elegans
aaatctactaaat

SEQ ID NO: 688344 - DNA, 13 bp, C. elegans
aaatctactattt

SEQ ID NO: 688345 - DNA, 13 bp, C. elegans
aaatctacttttt

SEQ ID NO: 688346 - DNA, 13 bp, C. elegans
aaatctagaaaat

SEQ ID NO: 688347 - DNA, 13 bp, C. elegans
aaatctagaaatt

SEQ ID NO: 688348 - DNA, 13 bp, C. elegans
aaatctagagaaa

SEQ ID NO: 688349 - DNA, 13 bp, C. elegans
aaatctagtttta

SEQ ID NO: 688350 - DNA, 13 bp, C. elegans
aaatctatcaaat

SEQ ID NO: 688351 - DNA, 13 bp, C. elegans
aaatctatcaatt

SEQ ID NO: 688352 - DNA, 13 bp, C. elegans
aaatctatgaaaa

SEQ ID NO: 688353 - DNA, 13 bp, C. elegans
aaatctatgaaga

SEQ ID NO: 688354 - DNA, 13 bp, C. elegans
aaatctatggaaa

SEQ ID NO: 688355 - DNA, 13 bp, C. elegans
aaatctatgtttt

SEQ ID NO: 688356 - DNA, 13 bp, C. elegans
aaatctattttcc

SEQ ID NO: 688357 - DNA, 13 bp, C. elegans
aaatctattttga

SEQ ID NO: 688358 - DNA, 13 bp, C. elegans
aaatctatttttg

SEQ ID NO: 688359 - DNA, 13 bp, C. elegans
aaatctcaaaact

SEQ ID NO: 688360 - DNA, 13 bp, C. elegans
aaatctcaaaatt

SEQ ID NO: 688361 - DNA, 13 bp, C. elegans
aaatctcaaactt

SEQ ID NO: 688362 - DNA, 13 bp, C. elegans
aaatctcaaagaa

SEQ ID NO: 688363 - DNA, 13 bp, C. elegans
aaatctcaaatca

SEQ ID NO: 688364 - DNA, 13 bp, C. elegans
aaatctcaaattc

SEQ ID NO: 688365 - DNA, 13 bp, C. elegans
aaatctcaaattt

SEQ ID NO: 688366 - DNA, 13 bp, C. elegans
aaatctcaagaat

SEQ ID NO: 688367 - DNA, 13 bp, C. elegans
aaatctcaataat

SEQ ID NO: 688368 - DNA, 13 bp, C. elegans
aaatctcaatctt

SEQ ID NO: 688369 - DNA, 13 bp, C. elegans
aaatctcaattcc

SEQ ID NO: 688370 - DNA, 13 bp, C. elegans
aaatctcaattta

SEQ ID NO: 688371 - DNA, 13 bp, C. elegans
aaatctcaatttc

SEQ ID NO: 688372 - DNA, 13 bp, C. elegans
aaatctcaatttt

SEQ ID NO: 688373 - DNA, 13 bp, C. elegans
aaatctcactttt

SEQ ID NO: 688374 - DNA, 13 bp, C. elegans
aaatctcagaaat

SEQ ID NO: 688375 - DNA, 13 bp, C. elegans
aaatctcatttca

SEQ ID NO: 688376 - DNA, 13 bp, C. elegans
aaatctcattttt

SEQ ID NO: 688377 - DNA, 13 bp, C. elegans
aaatctccaagtt

SEQ ID NO: 688378 - DNA, 13 bp, C. elegans
aaatctccaattt

SEQ ID NO: 688379 - DNA, 13 bp, C. elegans
aaatctccagaaa

SEQ ID NO: 688380 - DNA, 13 bp, C. elegans
aaatctcgaaaaa

SEQ ID NO: 688381 - DNA, 13 bp, C. elegans
aaatctcgaaatt

SEQ ID NO: 688382 - DNA, 13 bp, C. elegans
aaatctcgaattt

SEQ ID NO: 688383 - DNA, 15 bp, C. elegans
aaatctcgacttttt

SEQ ID NO: 688384 - DNA, 13 bp, C. elegans
aaatctcgcaaaa

SEQ ID NO: 688385 - DNA, 13 bp, C. elegans
aaatctcgcattt

SEQ ID NO: 688386 - DNA, 13 bp, C. elegans
aaatctcggaaaa

SEQ ID NO: 688387 - DNA, 13 bp, C. elegans
aaatctcggccac

SEQ ID NO: 688388 - DNA, 13 bp, C. elegans
aaatctctacttt

SEQ ID NO: 688389 - DNA, 13 bp, C. elegans
aaatctctatttt

SEQ ID NO: 688390 - DNA, 13 bp, C. elegans
aaatctctcaaaa

SEQ ID NO: 688391 - DNA, 13 bp, C. elegans
aaatctctgaaaa

SEQ ID NO: 688392 - DNA, 14 bp, C. elegans
aaatctctgaaaat

SEQ ID NO: 688393 - DNA, 13 bp, C. elegans
aaatctctgaaac

SEQ ID NO: 688394 - DNA, 13 bp, C. elegans
aaatctctgaaat

SEQ ID NO: 688395 - DNA, 13 bp, C. elegans
aaatctctgattt

SEQ ID NO: 688396 - DNA, 13 bp, C. elegans
aaatctctgtttt

SEQ ID NO: 688397 - DNA, 13 bp, C. elegans
aaatctcttcaaa

SEQ ID NO: 688398 - DNA, 13 bp, C. elegans
aaatctcttcgtc

SEQ ID NO: 688399 - DNA, 13 bp, C. elegans
aaatctcttgaaa

SEQ ID NO: 688400 - DNA, 13 bp, C. elegans
aaatctctttgaa

SEQ ID NO: 688401 - DNA, 13 bp, C. elegans
aaatctgaaaaac

SEQ ID NO: 688402 - DNA, 13 bp, C. elegans
aaatctgaaaact

SEQ ID NO: 688403 - DNA, 13 bp, C. elegans
aaatctgaaacag

SEQ ID NO: 688404 - DNA, 13 bp, C. elegans
aaatctgaaacca

SEQ ID NO: 688405 - DNA, 13 bp, C. elegans
aaatctgaaactt

SEQ ID NO: 688406 - DNA, 13 bp, C. elegans
aaatctgaaagaa

SEQ ID NO: 688407 - DNA, 13 bp, C. elegans
aaatctgaaagtt

SEQ ID NO: 688408 - DNA, 13 bp, C. elegans
aaatctgaaatgt

SEQ ID NO: 688409 - DNA, 13 bp, C. elegans
aaatctgaaatta

SEQ ID NO: 688410 - DNA, 13 bp, C. elegans
aaatctgaaattt

SEQ ID NO: 688411 - DNA, 13 bp, C. elegans
aaatctgaacaaa

SEQ ID NO: 688412 - DNA, 13 bp, C. elegans
aaatctgaacttt

SEQ ID NO: 688413 - DNA, 13 bp, C. elegans
aaatctgaagaaa

SEQ ID NO: 688414 - DNA, 13 bp, C. elegans
aaatctgaatgtt

SEQ ID NO: 688415 - DNA, 13 bp, C. elegans
aaatctgaatttt

SEQ ID NO: 688416 - DNA, 13 bp, C. elegans
aaatctgacaagt

SEQ ID NO: 688417 - DNA, 13 bp, C. elegans
aaatctgacgatt

SEQ ID NO: 688418 - DNA, 13 bp, C. elegans
aaatctgagtttt

SEQ ID NO: 688419 - DNA, 13 bp, C. elegans
aaatctgataaat

SEQ ID NO: 688420 - DNA, 13 bp, C. elegans
aaatctgatattc

SEQ ID NO: 688421 - DNA, 13 bp, C. elegans
aaatctgatattt

SEQ ID NO: 688422 - DNA, 13 bp, C. elegans
aaatctgatcaaa

SEQ ID NO: 688423 - DNA, 13 bp, C. elegans
aaatctgcaaaaa

SEQ ID NO: 688424 - DNA, 13 bp, C. elegans
aaatctgcaaatt

SEQ ID NO: 688425 - DNA, 13 bp, C. elegans
aaatctgcaattt

SEQ ID NO: 688426 - DNA, 13 bp, C. elegans
aaatctgcatatt

SEQ ID NO: 688427 - DNA, 13 bp, C. elegans
aaatctgcatttt

SEQ ID NO: 688428 - DNA, 13 bp, C. elegans
aaatctgccaaaa

SEQ ID NO: 688429 - DNA, 13 bp, C. elegans
aaatctgcgactt

SEQ ID NO: 688430 - DNA, 13 bp, C. elegans
aaatctgcgattt

SEQ ID NO: 688431 - DNA, 13 bp, C. elegans
aaatctggaaaac

SEQ ID NO: 688432 - DNA, 13 bp, C. elegans
aaatctggaaatt

SEQ ID NO: 688433 - DNA, 13 bp, C. elegans
aaatctggcaaaa

SEQ ID NO: 688434 - DNA, 13 bp, C. elegans
aaatctggcaaat

SEQ ID NO: 688435 - DNA, 13 bp, C. elegans
aaatctggtattt

SEQ ID NO: 688436 - DNA, 13 bp, C. elegans
aaatctgtaaaac

SEQ ID NO: 688437 - DNA, 13 bp, C. elegans
aaatctgtagttt

SEQ ID NO: 688438 - DNA, 13 bp, C. elegans
aaatctgtgaaaa

SEQ ID NO: 688439 - DNA, 13 bp, C. elegans
aaatctgttcaaa

SEQ ID NO: 688440 - DNA, 13 bp, C. elegans
aaatctgttgatt

SEQ ID NO: 688441 - DNA, 13 bp, C. elegans
aaatcttaaactt

SEQ ID NO: 688442 - DNA, 13 bp, C. elegans
aaatcttagaaat

SEQ ID NO: 688443 - DNA, 13 bp, C. elegans
aaatcttatagtt

SEQ ID NO: 688444 - DNA, 13 bp, C. elegans
aaatcttcaaaag

SEQ ID NO: 688445 - DNA, 13 bp, C. elegans
aaatcttcaaact

SEQ ID NO: 688446 - DNA, 13 bp, C. elegans
aaatcttcaaatt

SEQ ID NO: 688447 - DNA, 13 bp, C. elegans
aaatcttcaactt

SEQ ID NO: 688448 - DNA, 13 bp, C. elegans
aaatcttcaattt

SEQ ID NO: 688449 - DNA, 13 bp, C. elegans
aaatcttcagttt

SEQ ID NO: 688450 - DNA, 13 bp, C. elegans
aaatcttcataaa

SEQ ID NO: 688451 - DNA, 13 bp, C. elegans
aaatcttcatatt

SEQ ID NO: 688452 - DNA, 13 bp, C. elegans
aaatcttccaaat

SEQ ID NO: 688453 - DNA, 13 bp, C. elegans
aaatcttccgaaa

SEQ ID NO: 688454 - DNA, 13 bp, C. elegans
aaatcttcgattt

SEQ ID NO: 688455 - DNA, 13 bp, C. elegans
aaatcttcgtttt

SEQ ID NO: 688456 - DNA, 13 bp, C. elegans
aaatcttctagaa

SEQ ID NO: 688457 - DNA, 14 bp, C. elegans
aaatcttctgttct

SEQ ID NO: 688458 - DNA, 13 bp, C. elegans
aaatcttcttcaa

SEQ ID NO: 688459 - DNA, 13 bp, C. elegans
aaatcttgaaaac

SEQ ID NO: 688460 - DNA, 13 bp, C. elegans
aaatcttgaaatt

SEQ ID NO: 688461 - DNA, 13 bp, C. elegans
aaatcttgaagaa

SEQ ID NO: 688462 - DNA, 13 bp, C. elegans
aaatcttgaattt

SEQ ID NO: 688463 - DNA, 13 bp, C. elegans
aaatcttgattat

SEQ ID NO: 688464 - DNA, 13 bp, C. elegans
aaatcttgatttt

SEQ ID NO: 688465 - DNA, 13 bp, C. elegans
aaatcttgccaaa

SEQ ID NO: 688466 - DNA, 13 bp, C. elegans
aaatcttgtttca

SEQ ID NO: 688467 - DNA, 13 bp, C. elegans
aaatcttgtttct

SEQ ID NO: 688468 - DNA, 13 bp, C. elegans
aaatcttgttttt

SEQ ID NO: 688469 - DNA, 13 bp, C. elegans
aaatctttaactt

SEQ ID NO: 688470 - DNA, 13 bp, C. elegans
aaatctttcaaaa

SEQ ID NO: 688471 - DNA, 13 bp, C. elegans
aaatctttcaaat

SEQ ID NO: 688472 - DNA, 13 bp, C. elegans
aaatctttcaatt

SEQ ID NO: 688473 - DNA, 13 bp, C. elegans
aaatctttcacaa

SEQ ID NO: 688474 - DNA, 13 bp, C. elegans
aaatctttcgaaa

SEQ ID NO: 688475 - DNA, 13 bp, C. elegans
aaatctttctaaa

SEQ ID NO: 688476 - DNA, 13 bp, C. elegans
aaatctttgaaaa

SEQ ID NO: 688477 - DNA, 13 bp, C. elegans
aaatctttgaaat

SEQ ID NO: 688478 - DNA, 13 bp, C. elegans
aaatctttgaatt

SEQ ID NO: 688479 - DNA, 13 bp, C. elegans
aaatctttggaaa

SEQ ID NO: 688480 - DNA, 13 bp, C. elegans
aaatctttgtaaa

SEQ ID NO: 688481 - DNA, 13 bp, C. elegans
aaatcttttcagt

SEQ ID NO: 688482 - DNA, 13 bp, C. elegans
aaatctttttgca

SEQ ID NO: 688483 - DNA, 13 bp, C. elegans
aaatcttttttca

SEQ ID NO: 688484 - DNA, 13 bp, C. elegans
aaatcttttttga

SEQ ID NO: 688485 - DNA, 13 bp, C. elegans
aaatgaaaacgac

SEQ ID NO: 688486 - DNA, 13 bp, C. elegans
aaatgaaaacgag

SEQ ID NO: 688487 - DNA, 13 bp, C. elegans
aaatgaaaactta

SEQ ID NO: 688488 - DNA, 13 bp, C. elegans
aaatgaaaacttc

SEQ ID NO: 688489 - DNA, 13 bp, C. elegans
aaatgaaaacttt

SEQ ID NO: 688490 - DNA, 13 bp, C. elegans
aaatgaaaatcca

SEQ ID NO: 688491 - DNA, 13 bp, C. elegans
aaatgaaaatgtt

SEQ ID NO: 688492 - DNA, 13 bp, C. elegans
aaatgaaaattgg

SEQ ID NO: 688493 - DNA, 13 bp, C. elegans
aaatgaaaatttg

SEQ ID NO: 688494 - DNA, 13 bp, C. elegans
aaatgaaacgttt

SEQ ID NO: 688495 - DNA, 13 bp, C. elegans
aaatgaaacttac

SEQ ID NO: 688496 - DNA, 14 bp, C. elegans
aaatgaaacttctt

SEQ ID NO: 688497 - DNA, 13 bp, C. elegans
aaatgaaagtatt

SEQ ID NO: 688498 - DNA, 13 bp, C. elegans
aaatgaaagttag

SEQ ID NO: 688499 - DNA, 13 bp, C. elegans
aaatgaaagtttt

SEQ ID NO: 688500 - DNA, 13 bp, C. elegans
aaatgaaatacat

SEQ ID NO: 688501 - DNA, 13 bp, C. elegans
aaatgaaatagtt

SEQ ID NO: 688502 - DNA, 13 bp, C. elegans
aaatgaaatgaac

SEQ ID NO: 688503 - DNA, 13 bp, C. elegans
aaatgaaatgatt

SEQ ID NO: 688504 - DNA, 13 bp, C. elegans
aaatgaaatgctt

SEQ ID NO: 688505 - DNA, 13 bp, C. elegans
aaatgaaattaca

SEQ ID NO: 688506 - DNA, 13 bp, C. elegans
aaatgaaattcaa

SEQ ID NO: 688507 - DNA, 13 bp, C. elegans
aaatgaaattgat

SEQ ID NO: 688508 - DNA, 13 bp, C. elegans
aaatgaaatttca

SEQ ID NO: 688509 - DNA, 13 bp, C. elegans
aaatgaaattttc

SEQ ID NO: 688510 - DNA, 13 bp, C. elegans
aaatgaacaaagt

SEQ ID NO: 688511 - DNA, 13 bp, C. elegans
aaatgaacaactt

SEQ ID NO: 688512 - DNA, 13 bp, C. elegans
aaatgaacattga

SEQ ID NO: 688513 - DNA, 13 bp, C. elegans
aaatgaacgattt

SEQ ID NO: 688514 - DNA, 13 bp, C. elegans
aaatgaactgaaa

SEQ ID NO: 688515 - DNA, 13 bp, C. elegans
aaatgaactttca

SEQ ID NO: 688516 - DNA, 13 bp, C. elegans
aaatgaactttta

SEQ ID NO: 688517 - DNA, 13 bp, C. elegans
aaatgaacttttt

SEQ ID NO: 688518 - DNA, 13 bp, C. elegans
aaatgaagaattc

SEQ ID NO: 688519 - DNA, 13 bp, C. elegans
aaatgaagagatt

SEQ ID NO: 688520 - DNA, 13 bp, C. elegans
aaatgaagatttt

SEQ ID NO: 688521 - DNA, 13 bp, C. elegans
aaatgaagctttt

SEQ ID NO: 688522 - DNA, 13 bp, C. elegans
aaatgaaggtttt

SEQ ID NO: 688523 - DNA, 13 bp, C. elegans
aaatgaagttatt

SEQ ID NO: 688524 - DNA, 13 bp, C. elegans
aaatgaagttgaa

SEQ ID NO: 688525 - DNA, 13 bp, C. elegans
aaatgaagtttca

SEQ ID NO: 688526 - DNA, 13 bp, C. elegans
aaatgaagtttta

SEQ ID NO: 688527 - DNA, 13 bp, C. elegans
aaatgaataaact

SEQ ID NO: 688528 - DNA, 13 bp, C. elegans
aaatgaatacttt

SEQ ID NO: 688529 - DNA, 13 bp, C. elegans
aaatgaatatcat

SEQ ID NO: 688530 - DNA, 13 bp, C. elegans
aaatgaatcaaat

SEQ ID NO: 688531 - DNA, 13 bp, C. elegans
aaatgaatcaatt

SEQ ID NO: 688532 - DNA, 13 bp, C. elegans
aaatgaatcatat

SEQ ID NO: 688533 - DNA, 13 bp, C. elegans
aaatgaatcattt

SEQ ID NO: 688534 - DNA, 13 bp, C. elegans
aaatgaatgacaa

SEQ ID NO: 688535 - DNA, 13 bp, C. elegans
aaatgaatgattt

SEQ ID NO: 688536 - DNA, 14 bp, C. elegans
aaatgaatgggaaa

SEQ ID NO: 688537 - DNA, 13 bp, C. elegans
aaatgaattaaac

SEQ ID NO: 688538 - DNA, 13 bp, C. elegans
aaatgaattcaaa

SEQ ID NO: 688539 - DNA, 13 bp, C. elegans
aaatgaattcatt

SEQ ID NO: 688540 - DNA, 13 bp, C. elegans
aaatgaattctaa

SEQ ID NO: 688541 - DNA, 13 bp, C. elegans
aaatgaattggaa

SEQ ID NO: 688542 - DNA, 13 bp, C. elegans
aaatgaatttctt

SEQ ID NO: 688543 - DNA, 13 bp, C. elegans
aaatgaatttgaa

SEQ ID NO: 688544 - DNA, 13 bp, C. elegans
aaatgaatttgca

SEQ ID NO: 688545 - DNA, 13 bp, C. elegans
aaatgaattttca

SEQ ID NO: 688546 - DNA, 13 bp, C. elegans
aaatgacaaactt

SEQ ID NO: 688547 - DNA, 13 bp, C. elegans
aaatgacaaagta

SEQ ID NO: 688548 - DNA, 13 bp, C. elegans
aaatgacaaatga

SEQ ID NO: 688549 - DNA, 13 bp, C. elegans
aaatgacaactgt

SEQ ID NO: 688550 - DNA, 13 bp, C. elegans
aaatgacaatatt

SEQ ID NO: 688551 - DNA, 13 bp, C. elegans
aaatgacaatttc

SEQ ID NO: 688552 - DNA, 13 bp, C. elegans
aaatgacacaata

SEQ ID NO: 688553 - DNA, 13 bp, C. elegans
aaatgacacttct

SEQ ID NO: 688554 - DNA, 13 bp, C. elegans
aaatgacattttt

SEQ ID NO: 688555 - DNA, 13 bp, C. elegans
aaatgaccaaatt

SEQ ID NO: 688556 - DNA, 13 bp, C. elegans
aaatgaccagaaa

SEQ ID NO: 688557 - DNA, 13 bp, C. elegans
aaatgaccgaaaa

SEQ ID NO: 688558 - DNA, 13 bp, C. elegans
aaatgacctagtt

SEQ ID NO: 688559 - DNA, 13 bp, C. elegans
aaatgacgagaaa

SEQ ID NO: 688560 - DNA, 13 bp, C. elegans
aaatgacggaaaa

SEQ ID NO: 688561 - DNA, 13 bp, C. elegans
aaatgacgtaaaa

SEQ ID NO: 688562 - DNA, 13 bp, C. elegans
aaatgacgtcaca

SEQ ID NO: 688563 - DNA, 13 bp, C. elegans
aaatgacgtcatt

SEQ ID NO: 688564 - DNA, 13 bp, C. elegans
aaatgacgtgaaa

SEQ ID NO: 688565 - DNA, 13 bp, C. elegans
aaatgactcaaaa

SEQ ID NO: 688566 - DNA, 13 bp, C. elegans
aaatgactccaaa

SEQ ID NO: 688567 - DNA, 13 bp, C. elegans
aaatgactgaaaa

SEQ ID NO: 688568 - DNA, 13 bp, C. elegans
aaatgacttgaaa

SEQ ID NO: 688569 - DNA, 13 bp, C. elegans
aaatgacttttta

SEQ ID NO: 688570 - DNA, 13 bp, C. elegans
aaatgagaaatgc

SEQ ID NO: 688571 - DNA, 13 bp, C. elegans
aaatgagaaattc

SEQ ID NO: 688572 - DNA, 13 bp, C. elegans
aaatgagaaattg

SEQ ID NO: 688573 - DNA, 13 bp, C. elegans
aaatgagaactgc

SEQ ID NO: 688574 - DNA, 13 bp, C. elegans
aaatgagaagatg

SEQ ID NO: 688575 - DNA, 13 bp, C. elegans
aaatgagaatgat

SEQ ID NO: 688576 - DNA, 13 bp, C. elegans
aaatgagagcaaa

SEQ ID NO: 688577 - DNA, 13 bp, C. elegans
aaatgagatattt

SEQ ID NO: 688578 - DNA, 13 bp, C. elegans
aaatgagatttat

SEQ ID NO: 688579 - DNA, 13 bp, C. elegans
aaatgagatttct

SEQ ID NO: 688580 - DNA, 13 bp, C. elegans
aaatgagcaaaga

SEQ ID NO: 688581 - DNA, 13 bp, C. elegans
aaatgagcaatat

SEQ ID NO: 688582 - DNA, 13 bp, C. elegans
aaatgagcaattt

SEQ ID NO: 688583 - DNA, 13 bp, C. elegans
aaatgagcacaaa

SEQ ID NO: 688584 - DNA, 13 bp, C. elegans
aaatgagcagaaa

SEQ ID NO: 688585 - DNA, 13 bp, C. elegans
aaatgagccaaat

SEQ ID NO: 688586 - DNA, 13 bp, C. elegans
aaatgagccattt

SEQ ID NO: 688587 - DNA, 13 bp, C. elegans
aaatgagctcaaa

SEQ ID NO: 688588 - DNA, 13 bp, C. elegans
aaatgagctgaaa

SEQ ID NO: 688589 - DNA, 13 bp, C. elegans
aaatgagcttttt

SEQ ID NO: 688590 - DNA, 13 bp, C. elegans
aaatgaggaaatt

SEQ ID NO: 688591 - DNA, 13 bp, C. elegans
aaatgaggagaat

SEQ ID NO: 688592 - DNA, 13 bp, C. elegans
aaatgaggatttt

SEQ ID NO: 688593 - DNA, 13 bp, C. elegans
aaatgaggcactc

SEQ ID NO: 688594 - DNA, 13 bp, C. elegans
aaatgagtcaaaa

SEQ ID NO: 688595 - DNA, 13 bp, C. elegans
aaatgagttttca

SEQ ID NO: 688596 - DNA, 13 bp, C. elegans
aaatgagttttct

SEQ ID NO: 688597 - DNA, 13 bp, C. elegans
aaatgagtttttc

SEQ ID NO: 688598 - DNA, 13 bp, C. elegans
aaatgataatcaa

SEQ ID NO: 688599 - DNA, 13 bp, C. elegans
aaatgataattga

SEQ ID NO: 688600 - DNA, 13 bp, C. elegans
aaatgatacaaat

SEQ ID NO: 688601 - DNA, 13 bp, C. elegans
aaatgatactgga

SEQ ID NO: 688602 - DNA, 13 bp, C. elegans
aaatgatatgttt

SEQ ID NO: 688603 - DNA, 13 bp, C. elegans
aaatgatcaattg

SEQ ID NO: 688604 - DNA, 13 bp, C. elegans
aaatgatcacaaa

SEQ ID NO: 688605 - DNA, 13 bp, C. elegans
aaatgatcagaat

SEQ ID NO: 688606 - DNA, 13 bp, C. elegans
aaatgatcgaaaa

SEQ ID NO: 688607 - DNA, 13 bp, C. elegans
aaatgatcttttt

SEQ ID NO: 688608 - DNA, 13 bp, C. elegans
aaatgatgaatga

SEQ ID NO: 688609 - DNA, 13 bp, C. elegans
aaatgatgaattt

SEQ ID NO: 688610 - DNA, 13 bp, C. elegans
aaatgatgatgaa

SEQ ID NO: 688611 - DNA, 13 bp, C. elegans
aaatgatgatgat

SEQ ID NO: 688612 - DNA, 13 bp, C. elegans
aaatgatgatttt

SEQ ID NO: 688613 - DNA, 13 bp, C. elegans
aaatgatgcaaat

SEQ ID NO: 688614 - DNA, 13 bp, C. elegans
aaatgatggaaat

SEQ ID NO: 688615 - DNA, 13 bp, C. elegans
aaatgatggaatt

SEQ ID NO: 688616 - DNA, 13 bp, C. elegans
aaatgatgggaaa

SEQ ID NO: 688617 - DNA, 13 bp, C. elegans
aaatgatgtgtaa

SEQ ID NO: 688618 - DNA, 13 bp, C. elegans
aaatgattacttt

SEQ ID NO: 688619 - DNA, 13 bp, C. elegans
aaatgattatgaa

SEQ ID NO: 688620 - DNA, 13 bp, C. elegans
aaatgattcaatt

SEQ ID NO: 688621 - DNA, 13 bp, C. elegans
aaatgattcagaa

SEQ ID NO: 688622 - DNA, 13 bp, C. elegans
aaatgattctgat

SEQ ID NO: 688623 - DNA, 13 bp, C. elegans
aaatgattgaaac

SEQ ID NO: 688624 - DNA, 13 bp, C. elegans
aaatgattgcaaa

SEQ ID NO: 688625 - DNA, 13 bp, C. elegans
aaatgattgtaaa

SEQ ID NO: 688626 - DNA, 13 bp, C. elegans
aaatgattgtttt

SEQ ID NO: 688627 - DNA, 13 bp, C. elegans
aaatgatttattc

SEQ ID NO: 688628 - DNA, 13 bp, C. elegans
aaatgatttattg

SEQ ID NO: 688629 - DNA, 13 bp, C. elegans
aaatgatttcaaa

SEQ ID NO: 688630 - DNA, 13 bp, C. elegans
aaatgatttcaat

SEQ ID NO: 688631 - DNA, 13 bp, C. elegans
aaatgatttcaga

SEQ ID NO: 688632 - DNA, 13 bp, C. elegans
aaatgatttgaag

SEQ ID NO: 688633 - DNA, 13 bp, C. elegans
aaatgattttatc

SEQ ID NO: 688634 - DNA, 13 bp, C. elegans
aaatgattttcaa

SEQ ID NO: 688635 - DNA, 13 bp, C. elegans
aaatgattttgat

SEQ ID NO: 688636 - DNA, 13 bp, C. elegans
aaatgatttttca

SEQ ID NO: 688637 - DNA, 13 bp, C. elegans
aaatgatttttcc

SEQ ID NO: 688638 - DNA, 13 bp, C. elegans
aaatgatttttga

SEQ ID NO: 688639 - DNA, 13 bp, C. elegans
aaatgattttttc

SEQ ID NO: 688640 - DNA, 13 bp, C. elegans
aaatgattttttg

SEQ ID NO: 688641 - DNA, 13 bp, C. elegans
aaatgcaaaaagg

SEQ ID NO: 688642 - DNA, 13 bp, C. elegans
aaatgcaaaaatc

SEQ ID NO: 688643 - DNA, 13 bp, C. elegans
aaatgcaaaacca

SEQ ID NO: 688644 - DNA, 13 bp, C. elegans
aaatgcaaaacct

SEQ ID NO: 688645 - DNA, 13 bp, C. elegans
aaatgcaaaagtg

SEQ ID NO: 688646 - DNA, 13 bp, C. elegans
aaatgcaaaattt

SEQ ID NO: 688647 - DNA, 13 bp, C. elegans
aaatgcaaacatt

SEQ ID NO: 688648 - DNA, 13 bp, C. elegans
aaatgcaaagaat

SEQ ID NO: 688649 - DNA, 13 bp, C. elegans
aaatgcaaagttt

SEQ ID NO: 688650 - DNA, 13 bp, C. elegans
aaatgcaaatatt

SEQ ID NO: 688651 - DNA, 13 bp, C. elegans
aaatgcaaatgtt

SEQ ID NO: 688652 - DNA, 13 bp, C. elegans
aaatgcaaattgt

SEQ ID NO: 688653 - DNA, 13 bp, C. elegans
aaatgcaaatttt

SEQ ID NO: 688654 - DNA, 13 bp, C. elegans
aaatgcaacattt

SEQ ID NO: 688655 - DNA, 13 bp, C. elegans
aaatgcaatcaaa

SEQ ID NO: 688656 - DNA, 13 bp, C. elegans
aaatgcaatgttt

SEQ ID NO: 688657 - DNA, 13 bp, C. elegans
aaatgcaattgtt

SEQ ID NO: 688658 - DNA, 13 bp, C. elegans
aaatgcaattttt

SEQ ID NO: 688659 - DNA, 13 bp, C. elegans
aaatgcacaactt

SEQ ID NO: 688660 - DNA, 13 bp, C. elegans
aaatgcacagaat

SEQ ID NO: 688661 - DNA, 13 bp, C. elegans
aaatgcacagatt

SEQ ID NO: 688662 - DNA, 13 bp, C. elegans
aaatgcacatttc

SEQ ID NO: 688663 - DNA, 13 bp, C. elegans
aaatgcacatttt

SEQ ID NO: 688664 - DNA, 13 bp, C. elegans
aaatgcactggag

SEQ ID NO: 688665 - DNA, 13 bp, C. elegans
aaatgcacttttt

SEQ ID NO: 688666 - DNA, 13 bp, C. elegans
aaatgcagaaatg

SEQ ID NO: 688667 - DNA, 13 bp, C. elegans
aaatgcagaaatt

SEQ ID NO: 688668 - DNA, 13 bp, C. elegans
aaatgcagagaaa

SEQ ID NO: 688669 - DNA, 13 bp, C. elegans
aaatgcagttttg

SEQ ID NO: 688670 - DNA, 13 bp, C. elegans
aaatgcataaaat

SEQ ID NO: 688671 - DNA, 13 bp, C. elegans
aaatgcataattg

SEQ ID NO: 688672 - DNA, 13 bp, C. elegans
aaatgcataattt

SEQ ID NO: 688673 - DNA, 13 bp, C. elegans
aaatgcatagaaa

SEQ ID NO: 688674 - DNA, 13 bp, C. elegans
aaatgcatatatt

SEQ ID NO: 688675 - DNA, 13 bp, C. elegans
aaatgcatatttt

SEQ ID NO: 688676 - DNA, 13 bp, C. elegans
aaatgcatcaaaa

SEQ ID NO: 688677 - DNA, 13 bp, C. elegans
aaatgcatctcaa

SEQ ID NO: 688678 - DNA, 13 bp, C. elegans
aaatgcatgaaaa

SEQ ID NO: 688679 - DNA, 13 bp, C. elegans
aaatgcatgaaat

SEQ ID NO: 688680 - DNA, 13 bp, C. elegans
aaatgcattcaaa

SEQ ID NO: 688681 - DNA, 13 bp, C. elegans
aaatgcattgaaa

SEQ ID NO: 688682 - DNA, 13 bp, C. elegans
aaatgcatttaat

SEQ ID NO: 688683 - DNA, 13 bp, C. elegans
aaatgcatttatt

SEQ ID NO: 688684 - DNA, 13 bp, C. elegans
aaatgcatttctt

SEQ ID NO: 688685 - DNA, 13 bp, C. elegans
aaatgcattttaa

SEQ ID NO: 688686 - DNA, 13 bp, C. elegans
aaatgccaaaaac

SEQ ID NO: 688687 - DNA, 13 bp, C. elegans
aaatgccaaaaat

SEQ ID NO: 688688 - DNA, 13 bp, C. elegans
aaatgccaaaagt

SEQ ID NO: 688689 - DNA, 13 bp, C. elegans
aaatgccaaagtt

SEQ ID NO: 688690 - DNA, 13 bp, C. elegans
aaatgccaacttt

SEQ ID NO: 688691 - DNA, 13 bp, C. elegans
aaatgccaatttt

SEQ ID NO: 688692 - DNA, 13 bp, C. elegans
aaatgccacaatt

SEQ ID NO: 688693 - DNA, 13 bp, C. elegans
aaatgccacgtgg

SEQ ID NO: 688694 - DNA, 13 bp, C. elegans
aaatgccagattt

SEQ ID NO: 688695 - DNA, 13 bp, C. elegans
aaatgccattttc

SEQ ID NO: 688696 - DNA, 13 bp, C. elegans
aaatgccattttg

SEQ ID NO: 688697 - DNA, 13 bp, C. elegans
aaatgccattttt

SEQ ID NO: 688698 - DNA, 13 bp, C. elegans
aaatgcccaaaat

SEQ ID NO: 688699 - DNA, 13 bp, C. elegans
aaatgccctaaaa

SEQ ID NO: 688700 - DNA, 13 bp, C. elegans
aaatgccgaaatt

SEQ ID NO: 688701 - DNA, 13 bp, C. elegans
aaatgccgagaaa

SEQ ID NO: 688702 - DNA, 13 bp, C. elegans
aaatgcctaaaat

SEQ ID NO: 688703 - DNA, 13 bp, C. elegans
aaatgcctagaaa

SEQ ID NO: 688704 - DNA, 13 bp, C. elegans
aaatgcctatttt

SEQ ID NO: 688705 - DNA, 13 bp, C. elegans
aaatgcctgaaaa

SEQ ID NO: 688706 - DNA, 13 bp, C. elegans
aaatgcgaaaaac

SEQ ID NO: 688707 - DNA, 13 bp, C. elegans
aaatgcgaaaatg

SEQ ID NO: 688708 - DNA, 13 bp, C. elegans
aaatgcgaaaatt

SEQ ID NO: 688709 - DNA, 13 bp, C. elegans
aaatgcgagaatt

SEQ ID NO: 688710 - DNA, 13 bp, C. elegans
aaatgcgattttg

SEQ ID NO: 688711 - DNA, 13 bp, C. elegans
aaatgcgattttt

SEQ ID NO: 688712 - DNA, 13 bp, C. elegans
aaatgcgcaaaaa

SEQ ID NO: 688713 - DNA, 13 bp, C. elegans
aaatgcgccaaaa

SEQ ID NO: 688714 - DNA, 13 bp, C. elegans
aaatgcgccagca

SEQ ID NO: 688715 - DNA, 13 bp, C. elegans
aaatgcgctcaaa

SEQ ID NO: 688716 - DNA, 13 bp, C. elegans
aaatgcgctctaa

SEQ ID NO: 688717 - DNA, 13 bp, C. elegans
aaatgcggaaaag

SEQ ID NO: 688718 - DNA, 13 bp, C. elegans
aaatgcggaagtt

SEQ ID NO: 688719 - DNA, 14 bp, C. elegans
aaatgcgggaattg

SEQ ID NO: 688720 - DNA, 13 bp, C. elegans
aaatgcgggattt

SEQ ID NO: 688721 - DNA, 13 bp, C. elegans
aaatgcggtaaaa

SEQ ID NO: 688722 - DNA, 13 bp, C. elegans
aaatgcgtcaaaa

SEQ ID NO: 688723 - DNA, 13 bp, C. elegans
aaatgcgtgaaaa

SEQ ID NO: 688724 - DNA, 13 bp, C. elegans
aaatgcgttaaaa

SEQ ID NO: 688725 - DNA, 13 bp, C. elegans
aaatgcgtttttt

SEQ ID NO: 688726 - DNA, 13 bp, C. elegans
aaatgctaaaatt

SEQ ID NO: 688727 - DNA, 13 bp, C. elegans
aaatgctaaattt

SEQ ID NO: 688728 - DNA, 13 bp, C. elegans
aaatgctagaatt

SEQ ID NO: 688729 - DNA, 13 bp, C. elegans
aaatgctattttt

SEQ ID NO: 688730 - DNA, 13 bp, C. elegans
aaatgctcaaaaa

SEQ ID NO: 688731 - DNA, 13 bp, C. elegans
aaatgctcaaaac

SEQ ID NO: 688732 - DNA, 13 bp, C. elegans
aaatgctcaaact

SEQ ID NO: 688733 - DNA, 13 bp, C. elegans
aaatgctcaaagt

SEQ ID NO: 688734 - DNA, 13 bp, C. elegans
aaatgctcaaatt

SEQ ID NO: 688735 - DNA, 13 bp, C. elegans
aaatgctcaataa

SEQ ID NO: 688736 - DNA, 13 bp, C. elegans
aaatgctcacttt

SEQ ID NO: 688737 - DNA, 13 bp, C. elegans
aaatgctcagaaa

SEQ ID NO: 688738 - DNA, 13 bp, C. elegans
aaatgctcagttt

SEQ ID NO: 688739 - DNA, 13 bp, C. elegans
aaatgctcatttt

SEQ ID NO: 688740 - DNA, 14 bp, C. elegans
aaatgctcattttc

SEQ ID NO: 688741 - DNA, 13 bp, C. elegans
aaatgctccaaaa

SEQ ID NO: 688742 - DNA, 13 bp, C. elegans
aaatgctccaatt

SEQ ID NO: 688743 - DNA, 13 bp, C. elegans
aaatgctccattt

SEQ ID NO: 688744 - DNA, 13 bp, C. elegans
aaatgctccgccc

SEQ ID NO: 688745 - DNA, 13 bp, C. elegans
aaatgctcctgtt

SEQ ID NO: 688746 - DNA, 13 bp, C. elegans
aaatgctctacaa

SEQ ID NO: 688747 - DNA, 13 bp, C. elegans
aaatgctctttga

SEQ ID NO: 688748 - DNA, 13 bp, C. elegans
aaatgctcttttg

SEQ ID NO: 688749 - DNA, 13 bp, C. elegans
aaatgctcttttt

SEQ ID NO: 688750 - DNA, 13 bp, C. elegans
aaatgctgaaaat

SEQ ID NO: 688751 - DNA, 13 bp, C. elegans
aaatgctgaaact

SEQ ID NO: 688752 - DNA, 13 bp, C. elegans
aaatgctgaaatt

SEQ ID NO: 688753 - DNA, 13 bp, C. elegans
aaatgctgatttt

SEQ ID NO: 688754 - DNA, 13 bp, C. elegans
aaatgctggaatt

SEQ ID NO: 688755 - DNA, 13 bp, C. elegans
aaatgcttaaaaa

SEQ ID NO: 688756 - DNA, 13 bp, C. elegans
aaatgcttatttt

SEQ ID NO: 688757 - DNA, 13 bp, C. elegans
aaatgcttgaaaa

SEQ ID NO: 688758 - DNA, 13 bp, C. elegans
aaatgcttgaaac

SEQ ID NO: 688759 - DNA, 13 bp, C. elegans
aaatgcttgaaat

SEQ ID NO: 688760 - DNA, 13 bp, C. elegans
aaatgctttaaat

SEQ ID NO: 688761 - DNA, 13 bp, C. elegans
aaatgctttcaaa

SEQ ID NO: 688762 - DNA, 13 bp, C. elegans
aaatggaaaacag

SEQ ID NO: 688763 - DNA, 13 bp, C. elegans
aaatggaaaactc

SEQ ID NO: 688764 - DNA, 13 bp, C. elegans
aaatggaaaactt

SEQ ID NO: 688765 - DNA, 13 bp, C. elegans
aaatggaaaagtt

SEQ ID NO: 688766 - DNA, 14 bp, C. elegans
aaatggaaaattga

SEQ ID NO: 688767 - DNA, 13 bp, C. elegans
aaatggaaacatt

SEQ ID NO: 688768 - DNA, 13 bp, C. elegans
aaatggaaactga

SEQ ID NO: 688769 - DNA, 13 bp, C. elegans
aaatggaaacttg

SEQ ID NO: 688770 - DNA, 13 bp, C. elegans
aaatggaaatgga

SEQ ID NO: 688771 - DNA, 13 bp, C. elegans
aaatggaaatgtt

SEQ ID NO: 688772 - DNA, 13 bp, C. elegans
aaatggaaattgt

SEQ ID NO: 688773 - DNA, 13 bp, C. elegans
aaatggaaattta

SEQ ID NO: 688774 - DNA, 13 bp, C. elegans
aaatggaaatttg

SEQ ID NO: 688775 - DNA, 13 bp, C. elegans
aaatggaacattt

SEQ ID NO: 688776 - DNA, 13 bp, C. elegans
aaatggaactgaa

SEQ ID NO: 688777 - DNA, 13 bp, C. elegans
aaatggaagaaac

SEQ ID NO: 688778 - DNA, 13 bp, C. elegans
aaatggaagaatg

SEQ ID NO: 688779 - DNA, 13 bp, C. elegans
aaatggaagaatt

SEQ ID NO: 688780 - DNA, 13 bp, C. elegans
aaatggaagagtt

SEQ ID NO: 688781 - DNA, 14 bp, C. elegans
aaatggaagagttt

SEQ ID NO: 688782 - DNA, 13 bp, C. elegans
aaatggaagtttc

SEQ ID NO: 688783 - DNA, 13 bp, C. elegans
aaatggaatattt

SEQ ID NO: 688784 - DNA, 13 bp, C. elegans
aaatggaattcaa

SEQ ID NO: 688785 - DNA, 13 bp, C. elegans
aaatggaatttta

SEQ ID NO: 688786 - DNA, 13 bp, C. elegans
aaatggaattttc

SEQ ID NO: 688787 - DNA, 13 bp, C. elegans
aaatggaattttg

SEQ ID NO: 688788 - DNA, 13 bp, C. elegans
aaatggaattttt

SEQ ID NO: 688789 - DNA, 13 bp, C. elegans
aaatggacaaatt

SEQ ID NO: 688790 - DNA, 13 bp, C. elegans
aaatggacagaaa

SEQ ID NO: 688791 - DNA, 13 bp, C. elegans
aaatggacatttt

SEQ ID NO: 688792 - DNA, 13 bp, C. elegans
aaatggacgaaaa

SEQ ID NO: 688793 - DNA, 13 bp, C. elegans
aaatggacgaatt

SEQ ID NO: 688794 - DNA, 13 bp, C. elegans
aaatggactgaaa

SEQ ID NO: 688795 - DNA, 13 bp, C. elegans
aaatggagaaaac

SEQ ID NO: 688796 - DNA, 13 bp, C. elegans
aaatggagaacaa

SEQ ID NO: 688797 - DNA, 13 bp, C. elegans
aaatggagaattt

SEQ ID NO: 688798 - DNA, 13 bp, C. elegans
aaatggagatgag

SEQ ID NO: 688799 - DNA, 13 bp, C. elegans
aaatggaggtttt

SEQ ID NO: 688800 - DNA, 13 bp, C. elegans
aaatggagtcatt

SEQ ID NO: 688801 - DNA, 13 bp, C. elegans
aaatggatacaac

SEQ ID NO: 688802 - DNA, 13 bp, C. elegans
aaatggattaatt

SEQ ID NO: 688803 - DNA, 13 bp, C. elegans
aaatggattttca

SEQ ID NO: 688804 - DNA, 13 bp, C. elegans
aaatggattttct

SEQ ID NO: 688805 - DNA, 13 bp, C. elegans
aaatggattttta

SEQ ID NO: 688806 - DNA, 13 bp, C. elegans
aaatggatttttg

SEQ ID NO: 688807 - DNA, 13 bp, C. elegans
aaatggatttttt

SEQ ID NO: 688808 - DNA, 13 bp, C. elegans
aaatggcaaaaat

SEQ ID NO: 688809 - DNA, 13 bp, C. elegans
aaatggcaaaata

SEQ ID NO: 688810 - DNA, 13 bp, C. elegans
aaatggcaaagtt

SEQ ID NO: 688811 - DNA, 13 bp, C. elegans
aaatggcaaattc

SEQ ID NO: 688812 - DNA, 13 bp, C. elegans
aaatggcaattgc

SEQ ID NO: 688813 - DNA, 13 bp, C. elegans
aaatggcagaaat

SEQ ID NO: 688814 - DNA, 13 bp, C. elegans
aaatggcagtttt

SEQ ID NO: 688815 - DNA, 13 bp, C. elegans
aaatggcccaaaa

SEQ ID NO: 688816 - DNA, 13 bp, C. elegans
aaatggcccgaaa

SEQ ID NO: 688817 - DNA, 13 bp, C. elegans
aaatggcctaaaa

SEQ ID NO: 688818 - DNA, 13 bp, C. elegans
aaatggcctgaaa

SEQ ID NO: 688819 - DNA, 13 bp, C. elegans
aaatggcgaaaaa

SEQ ID NO: 688820 - DNA, 13 bp, C. elegans
aaatggctcaaaa

SEQ ID NO: 688821 - DNA, 13 bp, C. elegans
aaatggctcaatt

SEQ ID NO: 688822 - DNA, 13 bp, C. elegans
aaatggctgaaaa

SEQ ID NO: 688823 - DNA, 13 bp, C. elegans
aaatggcttcaaa

SEQ ID NO: 688824 - DNA, 13 bp, C. elegans
aaatgggaaaaca

SEQ ID NO: 688825 - DNA, 13 bp, C. elegans
aaatgggaaaatt

SEQ ID NO: 688826 - DNA, 13 bp, C. elegans
aaatgggaaatta

SEQ ID NO: 688827 - DNA, 13 bp, C. elegans
aaatgggaagttt

SEQ ID NO: 688828 - DNA, 13 bp, C. elegans
aaatgggacactt

SEQ ID NO: 688829 - DNA, 13 bp, C. elegans
aaatgggagaaat

SEQ ID NO: 688830 - DNA, 13 bp, C. elegans
aaatgggatattt

SEQ ID NO: 688831 - DNA, 13 bp, C. elegans
aaatgggcaaaaa

SEQ ID NO: 688832 - DNA, 13 bp, C. elegans
aaatgggcatttt

SEQ ID NO: 688833 - DNA, 13 bp, C. elegans
aaatgggcgaatt

SEQ ID NO: 688834 - DNA, 13 bp, C. elegans
aaatgggcggagc

SEQ ID NO: 688835 - DNA, 13 bp, C. elegans
aaatgggctcaaa

SEQ ID NO: 688836 - DNA, 13 bp, C. elegans
aaatgggtatcac

SEQ ID NO: 688837 - DNA, 13 bp, C. elegans
aaatgggtgaaaa

SEQ ID NO: 688838 - DNA, 13 bp, C. elegans
aaatgggtgaaat

SEQ ID NO: 688839 - DNA, 13 bp, C. elegans
aaatgggttgaaa

SEQ ID NO: 688840 - DNA, 13 bp, C. elegans
aaatggtcaaaaa

SEQ ID NO: 688841 - DNA, 13 bp, C. elegans
aaatggtcatttt

SEQ ID NO: 688842 - DNA, 13 bp, C. elegans
aaatggtctcgcc

SEQ ID NO: 688843 - DNA, 13 bp, C. elegans
aaatggtgaaaac

SEQ ID NO: 688844 - DNA, 13 bp, C. elegans
aaatggtgaaatt

SEQ ID NO: 688845 - DNA, 13 bp, C. elegans
aaatggtgatttt

SEQ ID NO: 688846 - DNA, 13 bp, C. elegans
aaatggttcaaat

SEQ ID NO: 688847 - DNA, 13 bp, C. elegans
aaatggttcattt

SEQ ID NO: 688848 - DNA, 13 bp, C. elegans
aaatggttgaaaa

SEQ ID NO: 688849 - DNA, 13 bp, C. elegans
aaatggttgaaat

SEQ ID NO: 688850 - DNA, 13 bp, C. elegans
aaatggtttcaaa

SEQ ID NO: 688851 - DNA, 13 bp, C. elegans
aaatggttttctt

SEQ ID NO: 688852 - DNA, 13 bp, C. elegans
aaatggttttgga

SEQ ID NO: 688853 - DNA, 13 bp, C. elegans
aaatggtttttat

SEQ ID NO: 688854 - DNA, 13 bp, C. elegans
aaatggttttttc

SEQ ID NO: 688855 - DNA, 13 bp, C. elegans
aaatgtaaaacat

SEQ ID NO: 688856 - DNA, 13 bp, C. elegans
aaatgtaaaagtt

SEQ ID NO: 688857 - DNA, 13 bp, C. elegans
aaatgtaaatgta

SEQ ID NO: 688858 - DNA, 13 bp, C. elegans
aaatgtaaattct

SEQ ID NO: 688859 - DNA, 13 bp, C. elegans
aaatgtaaatttc

SEQ ID NO: 688860 - DNA, 13 bp, C. elegans
aaatgtaagaatt

SEQ ID NO: 688861 - DNA, 13 bp, C. elegans
aaatgtaattgtt

SEQ ID NO: 688862 - DNA, 13 bp, C. elegans
aaatgtacaaaac

SEQ ID NO: 688863 - DNA, 13 bp, C. elegans
aaatgtacaaact

SEQ ID NO: 688864 - DNA, 13 bp, C. elegans
aaatgtacaattt

SEQ ID NO: 688865 - DNA, 13 bp, C. elegans
aaatgtacacaaa

SEQ ID NO: 688866 - DNA, 13 bp, C. elegans
aaatgtacattaa

SEQ ID NO: 688867 - DNA, 13 bp, C. elegans
aaatgtaccgaaa

SEQ ID NO: 688868 - DNA, 13 bp, C. elegans
aaatgtactattt

SEQ ID NO: 688869 - DNA, 13 bp, C. elegans
aaatgtacttaaa

SEQ ID NO: 688870 - DNA, 13 bp, C. elegans
aaatgtactttat

SEQ ID NO: 688871 - DNA, 13 bp, C. elegans
aaatgtacttttt

SEQ ID NO: 688872 - DNA, 13 bp, C. elegans
aaatgtagaaatt

SEQ ID NO: 688873 - DNA, 13 bp, C. elegans
aaatgtagacaaa

SEQ ID NO: 688874 - DNA, 13 bp, C. elegans
aaatgtagagaat

SEQ ID NO: 688875 - DNA, 13 bp, C. elegans
aaatgtagattta

SEQ ID NO: 688876 - DNA, 13 bp, C. elegans
aaatgtagatttt

SEQ ID NO: 688877 - DNA, 13 bp, C. elegans
aaatgtagcaaaa

SEQ ID NO: 688878 - DNA, 13 bp, C. elegans
aaatgtagctttt

SEQ ID NO: 688879 - DNA, 13 bp, C. elegans
aaatgtagttttc

SEQ ID NO: 688880 - DNA, 13 bp, C. elegans
aaatgtatacatt

SEQ ID NO: 688881 - DNA, 13 bp, C. elegans
aaatgtatagaat

SEQ ID NO: 688882 - DNA, 13 bp, C. elegans
aaatgtatatctt

SEQ ID NO: 688883 - DNA, 13 bp, C. elegans
aaatgtatatttc

SEQ ID NO: 688884 - DNA, 13 bp, C. elegans
aaatgtatcaaaa

SEQ ID NO: 688885 - DNA, 13 bp, C. elegans
aaatgtatcagaa

SEQ ID NO: 688886 - DNA, 13 bp, C. elegans
aaatgtatcattt

SEQ ID NO: 688887 - DNA, 13 bp, C. elegans
aaatgtatccgaa

SEQ ID NO: 688888 - DNA, 13 bp, C. elegans
aaatgtatcgatt

SEQ ID NO: 688889 - DNA, 13 bp, C. elegans
aaatgtatctcaa

SEQ ID NO: 688890 - DNA, 13 bp, C. elegans
aaatgtatctttt

SEQ ID NO: 688891 - DNA, 13 bp, C. elegans
aaatgtatgtaga

SEQ ID NO: 688892 - DNA, 13 bp, C. elegans
aaatgtatgtata

SEQ ID NO: 688893 - DNA, 13 bp, C. elegans
aaatgtatgtgaa

SEQ ID NO: 688894 - DNA, 13 bp, C. elegans
aaatgtattagaa

SEQ ID NO: 688895 - DNA, 13 bp, C. elegans
aaatgtattcaaa

SEQ ID NO: 688896 - DNA, 13 bp, C. elegans
aaatgtattcttt

SEQ ID NO: 688897 - DNA, 13 bp, C. elegans
aaatgtattgaaa

SEQ ID NO: 688898 - DNA, 13 bp, C. elegans
aaatgtattgatt

SEQ ID NO: 688899 - DNA, 13 bp, C. elegans
aaatgtatttaga

SEQ ID NO: 688900 - DNA, 13 bp, C. elegans
aaatgtatttgaa

SEQ ID NO: 688901 - DNA, 13 bp, C. elegans
aaatgtattttgt

SEQ ID NO: 688902 - DNA, 13 bp, C. elegans
aaatgtcaaataa

SEQ ID NO: 688903 - DNA, 13 bp, C. elegans
aaatgtcaaatta

SEQ ID NO: 688904 - DNA, 13 bp, C. elegans
aaatgtcaagttt

SEQ ID NO: 688905 - DNA, 13 bp, C. elegans
aaatgtcaattaa

SEQ ID NO: 688906 - DNA, 13 bp, C. elegans
aaatgtcacaaat

SEQ ID NO: 688907 - DNA, 13 bp, C. elegans
aaatgtcactttt

SEQ ID NO: 688908 - DNA, 13 bp, C. elegans
aaatgtcagattt

SEQ ID NO: 688909 - DNA, 13 bp, C. elegans
aaatgtcatcaat

SEQ ID NO: 688910 - DNA, 13 bp, C. elegans
aaatgtcatgttt

SEQ ID NO: 688911 - DNA, 13 bp, C. elegans
aaatgtcattttt

SEQ ID NO: 688912 - DNA, 13 bp, C. elegans
aaatgtccaaatg

SEQ ID NO: 688913 - DNA, 13 bp, C. elegans
aaatgtccagaaa

SEQ ID NO: 688914 - DNA, 13 bp, C. elegans
aaatgtcccaaaa

SEQ ID NO: 688915 - DNA, 13 bp, C. elegans
aaatgtccgaatg

SEQ ID NO: 688916 - DNA, 13 bp, C. elegans
aaatgtccgctgc

SEQ ID NO: 688917 - DNA, 13 bp, C. elegans
aaatgtcgaaaaa

SEQ ID NO: 688918 - DNA, 13 bp, C. elegans
aaatgtcgaaaat

SEQ ID NO: 688919 - DNA, 13 bp, C. elegans
aaatgtctaaaaa

SEQ ID NO: 688920 - DNA, 13 bp, C. elegans
aaatgtctagaaa

SEQ ID NO: 688921 - DNA, 13 bp, C. elegans
aaatgtctcaaaa

SEQ ID NO: 688922 - DNA, 13 bp, C. elegans
aaatgtctcatta

SEQ ID NO: 688923 - DNA, 13 bp, C. elegans
aaatgtctcgaaa

SEQ ID NO: 688924 - DNA, 13 bp, C. elegans
aaatgtctgaaat

SEQ ID NO: 688925 - DNA, 13 bp, C. elegans
aaatgtctgaatt

SEQ ID NO: 688926 - DNA, 13 bp, C. elegans
aaatgtctgagaa

SEQ ID NO: 688927 - DNA, 13 bp, C. elegans
aaatgtcttattt

SEQ ID NO: 688928 - DNA, 13 bp, C. elegans
aaatgtcttcaaa

SEQ ID NO: 688929 - DNA, 13 bp, C. elegans
aaatgtctttaat

SEQ ID NO: 688930 - DNA, 13 bp, C. elegans
aaatgtctttttt

SEQ ID NO: 688931 - DNA, 13 bp, C. elegans
aaatgtgaaaagt

SEQ ID NO: 688932 - DNA, 13 bp, C. elegans
aaatgtgaaaatc

SEQ ID NO: 688933 - DNA, 13 bp, C. elegans
aaatgtgaaaatt

SEQ ID NO: 688934 - DNA, 13 bp, C. elegans
aaatgtgaaactt

SEQ ID NO: 688935 - DNA, 13 bp, C. elegans
aaatgtgaaagtt

SEQ ID NO: 688936 - DNA, 13 bp, C. elegans
aaatgtgaacaat

SEQ ID NO: 688937 - DNA, 13 bp, C. elegans
aaatgtgaatatt

SEQ ID NO: 688938 - DNA, 13 bp, C. elegans
aaatgtgaatgaa

SEQ ID NO: 688939 - DNA, 13 bp, C. elegans
aaatgtgaattat

SEQ ID NO: 688940 - DNA, 13 bp, C. elegans
aaatgtgaatttt

SEQ ID NO: 688941 - DNA, 13 bp, C. elegans
aaatgtgacaatt

SEQ ID NO: 688942 - DNA, 13 bp, C. elegans
aaatgtgactgaa

SEQ ID NO: 688943 - DNA, 13 bp, C. elegans
aaatgtgacttca

SEQ ID NO: 688944 - DNA, 13 bp, C. elegans
aaatgtgagtttt

SEQ ID NO: 688945 - DNA, 13 bp, C. elegans
aaatgtgatacat

SEQ ID NO: 688946 - DNA, 13 bp, C. elegans
aaatgtgatactt

SEQ ID NO: 688947 - DNA, 13 bp, C. elegans
aaatgtgatattt

SEQ ID NO: 688948 - DNA, 13 bp, C. elegans
aaatgtgatgttt

SEQ ID NO: 688949 - DNA, 13 bp, C. elegans
aaatgtgattgaa

SEQ ID NO: 688950 - DNA, 13 bp, C. elegans
aaatgtgatttaa

SEQ ID NO: 688951 - DNA, 13 bp, C. elegans
aaatgtgatttat

SEQ ID NO: 688952 - DNA, 13 bp, C. elegans
aaatgtgatttta

SEQ ID NO: 688953 - DNA, 13 bp, C. elegans
aaatgtgattttt

SEQ ID NO: 688954 - DNA, 14 bp, C. elegans
aaatgtgattttta

SEQ ID NO: 688955 - DNA, 13 bp, C. elegans
aaatgtgcaaaaa

SEQ ID NO: 688956 - DNA, 13 bp, C. elegans
aaatgtgcaaaga

SEQ ID NO: 688957 - DNA, 13 bp, C. elegans
aaatgtgcaataa

SEQ ID NO: 688958 - DNA, 13 bp, C. elegans
aaatgtgcaattt

SEQ ID NO: 688959 - DNA, 13 bp, C. elegans
aaatgtgcacaaa

SEQ ID NO: 688960 - DNA, 13 bp, C. elegans
aaatgtgcagaaa

SEQ ID NO: 688961 - DNA, 13 bp, C. elegans
aaatgtgcagaat

SEQ ID NO: 688962 - DNA, 13 bp, C. elegans
aaatgtgccaaaa

SEQ ID NO: 688963 - DNA, 13 bp, C. elegans
aaatgtgcctttt

SEQ ID NO: 688964 - DNA, 13 bp, C. elegans
aaatgtgctcaat

SEQ ID NO: 688965 - DNA, 13 bp, C. elegans
aaatgtgctctat

SEQ ID NO: 688966 - DNA, 13 bp, C. elegans
aaatgtgctttaa

SEQ ID NO: 688967 - DNA, 13 bp, C. elegans
aaatgtggaaaat

SEQ ID NO: 688968 - DNA, 13 bp, C. elegans
aaatgtggaaatg

SEQ ID NO: 688969 - DNA, 13 bp, C. elegans
aaatgtggaaatt

SEQ ID NO: 688970 - DNA, 13 bp, C. elegans
aaatgtggcaaaa

SEQ ID NO: 688971 - DNA, 13 bp, C. elegans
aaatgtggcaatt

SEQ ID NO: 688972 - DNA, 13 bp, C. elegans
aaatgtgggaaat

SEQ ID NO: 688973 - DNA, 13 bp, C. elegans
aaatgtgggaatt

SEQ ID NO: 688974 - DNA, 13 bp, C. elegans
aaatgtggggaaa

SEQ ID NO: 688975 - DNA, 13 bp, C. elegans
aaatgtggtaaaa

SEQ ID NO: 688976 - DNA, 13 bp, C. elegans
aaatgtggtgctt

SEQ ID NO: 688977 - DNA, 13 bp, C. elegans
aaatgtggttttt

SEQ ID NO: 688978 - DNA, 13 bp, C. elegans
aaatgtgtaattt

SEQ ID NO: 688979 - DNA, 13 bp, C. elegans
aaatgtgtacttt

SEQ ID NO: 688980 - DNA, 13 bp, C. elegans
aaatgtgtataaa

SEQ ID NO: 688981 - DNA, 13 bp, C. elegans
aaatgtgtatttt

SEQ ID NO: 688982 - DNA, 13 bp, C. elegans
aaatgtgtgaata

SEQ ID NO: 688983 - DNA, 13 bp, C. elegans
aaatgtgttaaaa

SEQ ID NO: 688984 - DNA, 13 bp, C. elegans
aaatgtgttatat

SEQ ID NO: 688985 - DNA, 13 bp, C. elegans
aaatgtgttatgt

SEQ ID NO: 688986 - DNA, 13 bp, C. elegans
aaatgtgttattt

SEQ ID NO: 688987 - DNA, 13 bp, C. elegans
aaatgtgttcaac

SEQ ID NO: 688988 - DNA, 13 bp, C. elegans
aaatgtgttcgaa

SEQ ID NO: 688989 - DNA, 13 bp, C. elegans
aaatgtgttctat

SEQ ID NO: 688990 - DNA, 13 bp, C. elegans
aaatgtgttgttt

SEQ ID NO: 688991 - DNA, 13 bp, C. elegans
aaatgtgtttcat

SEQ ID NO: 688992 - DNA, 13 bp, C. elegans
aaatgtgttttca

SEQ ID NO: 688993 - DNA, 13 bp, C. elegans
aaatgtgttttta

SEQ ID NO: 688994 - DNA, 13 bp, C. elegans
aaatgtgtttttg

SEQ ID NO: 688995 - DNA, 13 bp, C. elegans
aaatgttaaagtt

SEQ ID NO: 688996 - DNA, 13 bp, C. elegans
aaatgttaacaaa

SEQ ID NO: 688997 - DNA, 13 bp, C. elegans
aaatgttaagcat

SEQ ID NO: 688998 - DNA, 13 bp, C. elegans
aaatgttaatctt

SEQ ID NO: 688999 - DNA, 13 bp, C. elegans
aaatgttacaaaa

SEQ ID NO: 689000 - DNA, 13 bp, C. elegans
aaatgttagaatt

SEQ ID NO: 689001 - DNA, 13 bp, C. elegans
aaatgttagtttg

SEQ ID NO: 689002 - DNA, 13 bp, C. elegans
aaatgttatcaaa

SEQ ID NO: 689003 - DNA, 13 bp, C. elegans
aaatgttatcaac

SEQ ID NO: 689004 - DNA, 13 bp, C. elegans
aaatgttatcttt

SEQ ID NO: 689005 - DNA, 13 bp, C. elegans
aaatgttatgatt

SEQ ID NO: 689006 - DNA, 13 bp, C. elegans
aaatgttattcaa

SEQ ID NO: 689007 - DNA, 13 bp, C. elegans
aaatgttattgat

SEQ ID NO: 689008 - DNA, 13 bp, C. elegans
aaatgttatttga

SEQ ID NO: 689009 - DNA, 13 bp, C. elegans
aaatgttcaacat

SEQ ID NO: 689010 - DNA, 13 bp, C. elegans
aaatgttcaagat

SEQ ID NO: 689011 - DNA, 13 bp, C. elegans
aaatgttcaagtt

SEQ ID NO: 689012 - DNA, 13 bp, C. elegans
aaatgttcaattg

SEQ ID NO: 689013 - DNA, 13 bp, C. elegans
aaatgttcacaat

SEQ ID NO: 689014 - DNA, 13 bp, C. elegans
aaatgttcagaat

SEQ ID NO: 689015 - DNA, 13 bp, C. elegans
aaatgttcagctt

SEQ ID NO: 689016 - DNA, 13 bp, C. elegans
aaatgttcagtaa

SEQ ID NO: 689017 - DNA, 13 bp, C. elegans
aaatgttcataaa

SEQ ID NO: 689018 - DNA, 13 bp, C. elegans
aaatgttcatcaa

SEQ ID NO: 689019 - DNA, 13 bp, C. elegans
aaatgttcatctt

SEQ ID NO: 689020 - DNA, 13 bp, C. elegans
aaatgttcatgaa

SEQ ID NO: 689021 - DNA, 13 bp, C. elegans
aaatgttcatgtt

SEQ ID NO: 689022 - DNA, 13 bp, C. elegans
aaatgttcattaa

SEQ ID NO: 689023 - DNA, 13 bp, C. elegans
aaatgttcatttt

SEQ ID NO: 689024 - DNA, 13 bp, C. elegans
aaatgttccaaaa

SEQ ID NO: 689025 - DNA, 13 bp, C. elegans
aaatgttccagaa

SEQ ID NO: 689026 - DNA, 13 bp, C. elegans
aaatgttccattt

SEQ ID NO: 689027 - DNA, 13 bp, C. elegans
aaatgttccgttt

SEQ ID NO: 689028 - DNA, 13 bp, C. elegans
aaatgttcgaatt

SEQ ID NO: 689029 - DNA, 13 bp, C. elegans
aaatgttcgattt

SEQ ID NO: 689030 - DNA, 13 bp, C. elegans
aaatgttcggttt

SEQ ID NO: 689031 - DNA, 13 bp, C. elegans
aaatgttctactt

SEQ ID NO: 689032 - DNA, 13 bp, C. elegans
aaatgttctcaaa

SEQ ID NO: 689033 - DNA, 13 bp, C. elegans
aaatgttctcaat

SEQ ID NO: 689034 - DNA, 13 bp, C. elegans
aaatgttctcaga

SEQ ID NO: 689035 - DNA, 13 bp, C. elegans
aaatgttctcata

SEQ ID NO: 689036 - DNA, 13 bp, C. elegans
aaatgttctgttt

SEQ ID NO: 689037 - DNA, 13 bp, C. elegans
aaatgttctttga

SEQ ID NO: 689038 - DNA, 13 bp, C. elegans
aaatgttcttttg

SEQ ID NO: 689039 - DNA, 13 bp, C. elegans
aaatgttcttttt

SEQ ID NO: 689040 - DNA, 13 bp, C. elegans
aaatgttgaaaac

SEQ ID NO: 689041 - DNA, 13 bp, C. elegans
aaatgttgaacaa

SEQ ID NO: 689042 - DNA, 13 bp, C. elegans
aaatgttgaataa

SEQ ID NO: 689043 - DNA, 13 bp, C. elegans
aaatgttgaatta

SEQ ID NO: 689044 - DNA, 13 bp, C. elegans
aaatgttgaattt

SEQ ID NO: 689045 - DNA, 13 bp, C. elegans
aaatgttgataat

SEQ ID NO: 689046 - DNA, 13 bp, C. elegans
aaatgttgatatt

SEQ ID NO: 689047 - DNA, 13 bp, C. elegans
aaatgttgattta

SEQ ID NO: 689048 - DNA, 13 bp, C. elegans
aaatgttgatttt

SEQ ID NO: 689049 - DNA, 13 bp, C. elegans
aaatgttgcaatt

SEQ ID NO: 689050 - DNA, 13 bp, C. elegans
aaatgttgccatt

SEQ ID NO: 689051 - DNA, 13 bp, C. elegans
aaatgttgcgttt

SEQ ID NO: 689052 - DNA, 13 bp, C. elegans
aaatgttgctttt

SEQ ID NO: 689053 - DNA, 13 bp, C. elegans
aaatgttggaaaa

SEQ ID NO: 689054 - DNA, 13 bp, C. elegans
aaatgttggaaat

SEQ ID NO: 689055 - DNA, 13 bp, C. elegans
aaatgttggaaca

SEQ ID NO: 689056 - DNA, 13 bp, C. elegans
aaatgttggaatt

SEQ ID NO: 689057 - DNA, 13 bp, C. elegans
aaatgttgggaaa

SEQ ID NO: 689058 - DNA, 13 bp, C. elegans
aaatgttggtttt

SEQ ID NO: 689059 - DNA, 13 bp, C. elegans
aaatgttgtaata

SEQ ID NO: 689060 - DNA, 13 bp, C. elegans
aaatgttgtgaaa

SEQ ID NO: 689061 - DNA, 13 bp, C. elegans
aaatgttgtgaat

SEQ ID NO: 689062 - DNA, 13 bp, C. elegans
aaatgttgtggaa

SEQ ID NO: 689063 - DNA, 13 bp, C. elegans
aaatgttgttatt

SEQ ID NO: 689064 - DNA, 13 bp, C. elegans
aaatgttgtttaa

SEQ ID NO: 689065 - DNA, 13 bp, C. elegans
aaatgtttaaaga

SEQ ID NO: 689066 - DNA, 13 bp, C. elegans
aaatgtttaacat

SEQ ID NO: 689067 - DNA, 13 bp, C. elegans
aaatgtttacatt

SEQ ID NO: 689068 - DNA, 13 bp, C. elegans
aaatgtttagaaa

SEQ ID NO: 689069 - DNA, 13 bp, C. elegans
aaatgtttagaat

SEQ ID NO: 689070 - DNA, 13 bp, C. elegans
aaatgtttagttt

SEQ ID NO: 689071 - DNA, 13 bp, C. elegans
aaatgtttatgaa

SEQ ID NO: 689072 - DNA, 13 bp, C. elegans
aaatgtttatgtt

SEQ ID NO: 689073 - DNA, 13 bp, C. elegans
aaatgtttcaaga

SEQ ID NO: 689074 - DNA, 13 bp, C. elegans
aaatgtttcaagg

SEQ ID NO: 689075 - DNA, 13 bp, C. elegans
aaatgtttcaata

SEQ ID NO: 689076 - DNA, 13 bp, C. elegans
aaatgtttcaatt

SEQ ID NO: 689077 - DNA, 13 bp, C. elegans
aaatgtttcacta

SEQ ID NO: 689078 - DNA, 13 bp, C. elegans
aaatgtttcagaa

SEQ ID NO: 689079 - DNA, 13 bp, C. elegans
aaatgtttcagat

SEQ ID NO: 689080 - DNA, 13 bp, C. elegans
aaatgtttcagga

SEQ ID NO: 689081 - DNA, 13 bp, C. elegans
aaatgtttcagtt

SEQ ID NO: 689082 - DNA, 13 bp, C. elegans
aaatgtttcataa

SEQ ID NO: 689083 - DNA, 13 bp, C. elegans
aaatgtttcattg

SEQ ID NO: 689084 - DNA, 13 bp, C. elegans
aaatgtttcattt

SEQ ID NO: 689085 - DNA, 13 bp, C. elegans
aaatgtttccaaa

SEQ ID NO: 689086 - DNA, 13 bp, C. elegans
aaatgtttcgatt

SEQ ID NO: 689087 - DNA, 13 bp, C. elegans
aaatgtttctaaa

SEQ ID NO: 689088 - DNA, 13 bp, C. elegans
aaatgtttctaat

SEQ ID NO: 689089 - DNA, 13 bp, C. elegans
aaatgtttctcaa

SEQ ID NO: 689090 - DNA, 13 bp, C. elegans
aaatgtttctcta

SEQ ID NO: 689091 - DNA, 13 bp, C. elegans
aaatgtttctgtt

SEQ ID NO: 689092 - DNA, 13 bp, C. elegans
aaatgtttgaata

SEQ ID NO: 689093 - DNA, 13 bp, C. elegans
aaatgtttgaatt

SEQ ID NO: 689094 - DNA, 13 bp, C. elegans
aaatgtttgagct

SEQ ID NO: 689095 - DNA, 13 bp, C. elegans
aaatgtttgattt

SEQ ID NO: 689096 - DNA, 13 bp, C. elegans
aaatgtttgcttc

SEQ ID NO: 689097 - DNA, 13 bp, C. elegans
aaatgtttggaaa

SEQ ID NO: 689098 - DNA, 13 bp, C. elegans
aaatgtttggtaa

SEQ ID NO: 689099 - DNA, 13 bp, C. elegans
aaatgtttggtat

SEQ ID NO: 689100 - DNA, 13 bp, C. elegans
aaatgtttgtaaa

SEQ ID NO: 689101 - DNA, 13 bp, C. elegans
aaatgtttgtatt

SEQ ID NO: 689102 - DNA, 13 bp, C. elegans
aaatgtttgtcaa

SEQ ID NO: 689103 - DNA, 13 bp, C. elegans
aaatgtttgttat

SEQ ID NO: 689104 - DNA, 13 bp, C. elegans
aaatgtttgtttc

SEQ ID NO: 689105 - DNA, 13 bp, C. elegans
aaatgttttaact

SEQ ID NO: 689106 - DNA, 13 bp, C. elegans
aaatgttttattg

SEQ ID NO: 689107 - DNA, 13 bp, C. elegans
aaatgttttcaaa

SEQ ID NO: 689108 - DNA, 13 bp, C. elegans
aaatgttttcatt

SEQ ID NO: 689109 - DNA, 13 bp, C. elegans
aaatgttttccaa

SEQ ID NO: 689110 - DNA, 13 bp, C. elegans
aaatgttttcctc

SEQ ID NO: 689111 - DNA, 13 bp, C. elegans
aaatgttttcgaa

SEQ ID NO: 689112 - DNA, 13 bp, C. elegans
aaatgttttcgat

SEQ ID NO: 689113 - DNA, 13 bp, C. elegans
aaatgttttctca

SEQ ID NO: 689114 - DNA, 13 bp, C. elegans
aaatgttttctga

SEQ ID NO: 689115 - DNA, 13 bp, C. elegans
aaatgttttgact

SEQ ID NO: 689116 - DNA, 13 bp, C. elegans
aaatgttttgcaa

SEQ ID NO: 689117 - DNA, 13 bp, C. elegans
aaatgttttgctg

SEQ ID NO: 689118 - DNA, 13 bp, C. elegans
aaatgttttggaa

SEQ ID NO: 689119 - DNA, 13 bp, C. elegans
aaatgttttggtt

SEQ ID NO: 689120 - DNA, 13 bp, C. elegans
aaatgttttgtgt

SEQ ID NO: 689121 - DNA, 14 bp, C. elegans
aaatgtttttcaaa

SEQ ID NO: 689122 - DNA, 13 bp, C. elegans
aaatgtttttcat

SEQ ID NO: 689123 - DNA, 13 bp, C. elegans
aaatgtttttcct

SEQ ID NO: 689124 - DNA, 13 bp, C. elegans
aaatgtttttcta

SEQ ID NO: 689125 - DNA, 13 bp, C. elegans
aaatgtttttctc

SEQ ID NO: 689126 - DNA, 13 bp, C. elegans
aaatgtttttgaa

SEQ ID NO: 689127 - DNA, 13 bp, C. elegans
aaatgttttttga

SEQ ID NO: 689128 - DNA, 13 bp, C. elegans
aaatgtttttttc

SEQ ID NO: 689129 - DNA, 13 bp, C. elegans
aaattaaaaagtc

SEQ ID NO: 689130 - DNA, 13 bp, C. elegans
aaattaaaactgt

SEQ ID NO: 689131 - DNA, 13 bp, C. elegans
aaattaaacagtt

SEQ ID NO: 689132 - DNA, 13 bp, C. elegans
aaattaaagctaa

SEQ ID NO: 689133 - DNA, 13 bp, C. elegans
aaattaaatgttc

SEQ ID NO: 689134 - DNA, 13 bp, C. elegans
aaattaacaaagt

SEQ ID NO: 689135 - DNA, 13 bp, C. elegans
aaattaaccaatt

SEQ ID NO: 689136 - DNA, 13 bp, C. elegans
aaattaaccattt

SEQ ID NO: 689137 - DNA, 13 bp, C. elegans
aaattaacgaaat

SEQ ID NO: 689138 - DNA, 13 bp, C. elegans
aaattaactgatt

SEQ ID NO: 689139 - DNA, 13 bp, C. elegans
aaattaactgttt

SEQ ID NO: 689140 - DNA, 13 bp, C. elegans
aaattaagaagac

SEQ ID NO: 689141 - DNA, 13 bp, C. elegans
aaattaaggaaac

SEQ ID NO: 689142 - DNA, 13 bp, C. elegans
aaattaaggtttt

SEQ ID NO: 689143 - DNA, 13 bp, C. elegans
aaattaatactct

SEQ ID NO: 689144 - DNA, 13 bp, C. elegans
aaattaatcaaag

SEQ ID NO: 689145 - DNA, 13 bp, C. elegans
aaattaatcaatc

SEQ ID NO: 689146 - DNA, 13 bp, C. elegans
aaattaatcagtt

SEQ ID NO: 689147 - DNA, 13 bp, C. elegans
aaattaatctgaa

SEQ ID NO: 689148 - DNA, 13 bp, C. elegans
aaattaatgaaca

SEQ ID NO: 689149 - DNA, 13 bp, C. elegans
aaattaatggatt

SEQ ID NO: 689150 - DNA, 13 bp, C. elegans
aaattaatgtttc

SEQ ID NO: 689151 - DNA, 13 bp, C. elegans
aaattaatttcca

SEQ ID NO: 689152 - DNA, 13 bp, C. elegans
aaattaatttctc

SEQ ID NO: 689153 - DNA, 13 bp, C. elegans
aaattaatttctg

SEQ ID NO: 689154 - DNA, 13 bp, C. elegans
aaattaattttcc

SEQ ID NO: 689155 - DNA, 13 bp, C. elegans
aaattacaaaagt

SEQ ID NO: 689156 - DNA, 13 bp, C. elegans
aaattacaacact

SEQ ID NO: 689157 - DNA, 13 bp, C. elegans
aaattacaatttc

SEQ ID NO: 689158 - DNA, 13 bp, C. elegans
aaattacactttt

SEQ ID NO: 689159 - DNA, 13 bp, C. elegans
aaattacagaaag

SEQ ID NO: 689160 - DNA, 13 bp, C. elegans
aaattacagaata

SEQ ID NO: 689161 - DNA, 13 bp, C. elegans
aaattacagtaat

SEQ ID NO: 689162 - DNA, 13 bp, C. elegans
aaattacagtatt

SEQ ID NO: 689163 - DNA, 13 bp, C. elegans
aaattacagtttc

SEQ ID NO: 689164 - DNA, 13 bp, C. elegans
aaattacatgaaa

SEQ ID NO: 689165 - DNA, 13 bp, C. elegans
aaattacattttc

SEQ ID NO: 689166 - DNA, 13 bp, C. elegans
aaattaccaaatt

SEQ ID NO: 689167 - DNA, 13 bp, C. elegans
aaattaccacttt

SEQ ID NO: 689168 - DNA, 13 bp, C. elegans
aaattaccagaat

SEQ ID NO: 689169 - DNA, 13 bp, C. elegans
aaattacccgttt

SEQ ID NO: 689170 - DNA, 13 bp, C. elegans
aaattaccggaat

SEQ ID NO: 689171 - DNA, 13 bp, C. elegans
aaattaccggttt

SEQ ID NO: 689172 - DNA, 13 bp, C. elegans
aaattacctgaaa

SEQ ID NO: 689173 - DNA, 13 bp, C. elegans
aaattacgagaat

SEQ ID NO: 689174 - DNA, 13 bp, C. elegans
aaattacgatatt

SEQ ID NO: 689175 - DNA, 13 bp, C. elegans
aaattacgggcaa

SEQ ID NO: 689176 - DNA, 13 bp, C. elegans
aaattacggtttc

SEQ ID NO: 689177 - DNA, 13 bp, C. elegans
aaattacgtgaaa

SEQ ID NO: 689178 - DNA, 13 bp, C. elegans
aaattactacttt

SEQ ID NO: 689179 - DNA, 13 bp, C. elegans
aaattactcaatt

SEQ ID NO: 689180 - DNA, 13 bp, C. elegans
aaattactctgaa

SEQ ID NO: 689181 - DNA, 13 bp, C. elegans
aaattactgaaaa

SEQ ID NO: 689182 - DNA, 13 bp, C. elegans
aaattactggaaa

SEQ ID NO: 689183 - DNA, 13 bp, C. elegans
aaattactgtact

SEQ ID NO: 689184 - DNA, 13 bp, C. elegans
aaattactgtagt

SEQ ID NO: 689185 - DNA, 13 bp, C. elegans
aaattacttgaaa

SEQ ID NO: 689186 - DNA, 13 bp, C. elegans
aaattactttcaa

SEQ ID NO: 689187 - DNA, 13 bp, C. elegans
aaattactttttc

SEQ ID NO: 689188 - DNA, 13 bp, C. elegans
aaattagaaattc

SEQ ID NO: 689189 - DNA, 13 bp, C. elegans
aaattagaacttc

SEQ ID NO: 689190 - DNA, 13 bp, C. elegans
aaattagaagatt

SEQ ID NO: 689191 - DNA, 13 bp, C. elegans
aaattagaattag

SEQ ID NO: 689192 - DNA, 13 bp, C. elegans
aaattagacaaat

SEQ ID NO: 689193 - DNA, 13 bp, C. elegans
aaattagagtatt

SEQ ID NO: 689194 - DNA, 13 bp, C. elegans
aaattagatcaaa

SEQ ID NO: 689195 - DNA, 13 bp, C. elegans
aaattagatgttt

SEQ ID NO: 689196 - DNA, 13 bp, C. elegans
aaattagctcgaa

SEQ ID NO: 689197 - DNA, 13 bp, C. elegans
aaattaggaaaac

SEQ ID NO: 689198 - DNA, 13 bp, C. elegans
aaattaggaaatt

SEQ ID NO: 689199 - DNA, 13 bp, C. elegans
aaattaggatttt

SEQ ID NO: 689200 - DNA, 13 bp, C. elegans
aaattagggggca

SEQ ID NO: 689201 - DNA, 13 bp, C. elegans
aaattaggtgttt

SEQ ID NO: 689202 - DNA, 13 bp, C. elegans
aaattaggttatt

SEQ ID NO: 689203 - DNA, 13 bp, C. elegans
aaattagtagttt

SEQ ID NO: 689204 - DNA, 13 bp, C. elegans
aaattagtattac

SEQ ID NO: 689205 - DNA, 13 bp, C. elegans
aaattagtcagaa

SEQ ID NO: 689206 - DNA, 13 bp, C. elegans
aaattagtcgaaa

SEQ ID NO: 689207 - DNA, 13 bp, C. elegans
aaattagtgaaat

SEQ ID NO: 689208 - DNA, 13 bp, C. elegans
aaattagtgagaa

SEQ ID NO: 689209 - DNA, 13 bp, C. elegans
aaattagtgtcaa

SEQ ID NO: 689210 - DNA, 13 bp, C. elegans
aaattagttcaaa

SEQ ID NO: 689211 - DNA, 13 bp, C. elegans
aaattagttgaaa

SEQ ID NO: 689212 - DNA, 13 bp, C. elegans
aaattagtttaga

SEQ ID NO: 689213 - DNA, 13 bp, C. elegans
aaattagtttcca

SEQ ID NO: 689214 - DNA, 13 bp, C. elegans
aaattataattgc

SEQ ID NO: 689215 - DNA, 13 bp, C. elegans
aaattatactgaa

SEQ ID NO: 689216 - DNA, 13 bp, C. elegans
aaattatatgcaa

SEQ ID NO: 689217 - DNA, 13 bp, C. elegans
aaattatatggaa

SEQ ID NO: 689218 - DNA, 13 bp, C. elegans
aaattatattgtc

SEQ ID NO: 689219 - DNA, 13 bp, C. elegans
aaattatcaaact

SEQ ID NO: 689220 - DNA, 13 bp, C. elegans
aaattatcaagaa

SEQ ID NO: 689221 - DNA, 13 bp, C. elegans
aaattatcagaaa

SEQ ID NO: 689222 - DNA, 13 bp, C. elegans
aaattatcagatt

SEQ ID NO: 689223 - DNA, 13 bp, C. elegans
aaattatcagttt

SEQ ID NO: 689224 - DNA, 13 bp, C. elegans
aaattatcatctt

SEQ ID NO: 689225 - DNA, 13 bp, C. elegans
aaattatcatttg

SEQ ID NO: 689226 - DNA, 13 bp, C. elegans
aaattatccaatt

SEQ ID NO: 689227 - DNA, 13 bp, C. elegans
aaattatccgttt

SEQ ID NO: 689228 - DNA, 13 bp, C. elegans
aaattatcgaaaa

SEQ ID NO: 689229 - DNA, 13 bp, C. elegans
aaattatcgaaat

SEQ ID NO: 689230 - DNA, 13 bp, C. elegans
aaattatcgaata

SEQ ID NO: 689231 - DNA, 13 bp, C. elegans
aaattatcgacaa

SEQ ID NO: 689232 - DNA, 13 bp, C. elegans
aaattatcgagaa

SEQ ID NO: 689233 - DNA, 13 bp, C. elegans
aaattatcggttt

SEQ ID NO: 689234 - DNA, 13 bp, C. elegans
aaattatctatct

SEQ ID NO: 689235 - DNA, 13 bp, C. elegans
aaattatctcaaa

SEQ ID NO: 689236 - DNA, 13 bp, C. elegans
aaattatctcaag

SEQ ID NO: 689237 - DNA, 13 bp, C. elegans
aaattatctgtaa

SEQ ID NO: 689238 - DNA, 13 bp, C. elegans
aaattatcttgaa

SEQ ID NO: 689239 - DNA, 13 bp, C. elegans
aaattatcttgtt

SEQ ID NO: 689240 - DNA, 13 bp, C. elegans
aaattatctttca

SEQ ID NO: 689241 - DNA, 13 bp, C. elegans
aaattatgaaagt

SEQ ID NO: 689242 - DNA, 13 bp, C. elegans
aaattatgaacaa

SEQ ID NO: 689243 - DNA, 13 bp, C. elegans
aaattatgaatac

SEQ ID NO: 689244 - DNA, 13 bp, C. elegans
aaattatgacttt

SEQ ID NO: 689245 - DNA, 13 bp, C. elegans
aaattatgagaat

SEQ ID NO: 689246 - DNA, 13 bp, C. elegans
aaattatgagctt

SEQ ID NO: 689247 - DNA, 13 bp, C. elegans
aaattatggataa

SEQ ID NO: 689248 - DNA, 13 bp, C. elegans
aaattatgggaaa

SEQ ID NO: 689249 - DNA, 13 bp, C. elegans
aaattatgtgatt

SEQ ID NO: 689250 - DNA, 13 bp, C. elegans
aaattatgtgcat

SEQ ID NO: 689251 - DNA, 13 bp, C. elegans
aaattatgttcaa

SEQ ID NO: 689252 - DNA, 13 bp, C. elegans
aaattatgttttc

SEQ ID NO: 689253 - DNA, 13 bp, C. elegans
aaattattatgtg

SEQ ID NO: 689254 - DNA, 13 bp, C. elegans
aaattattattcc

SEQ ID NO: 689255 - DNA, 13 bp, C. elegans
aaattattcactt

SEQ ID NO: 689256 - DNA, 13 bp, C. elegans
aaattattcagaa

SEQ ID NO: 689257 - DNA, 13 bp, C. elegans
aaattattcatga

SEQ ID NO: 689258 - DNA, 13 bp, C. elegans
aaattattccaaa

SEQ ID NO: 689259 - DNA, 13 bp, C. elegans
aaattattccgaa

SEQ ID NO: 689260 - DNA, 13 bp, C. elegans
aaattattcgaaa

SEQ ID NO: 689261 - DNA, 13 bp, C. elegans
aaattattcgaga

SEQ ID NO: 689262 - DNA, 13 bp, C. elegans
aaattattcgatt

SEQ ID NO: 689263 - DNA, 13 bp, C. elegans
aaattattcggaa

SEQ ID NO: 689264 - DNA, 13 bp, C. elegans
aaattattcgttt

SEQ ID NO: 689265 - DNA, 13 bp, C. elegans
aaattattctcag

SEQ ID NO: 689266 - DNA, 13 bp, C. elegans
aaattattcttca

SEQ ID NO: 689267 - DNA, 13 bp, C. elegans
aaattattcttga

SEQ ID NO: 689268 - DNA, 13 bp, C. elegans
aaattattgactt

SEQ ID NO: 689269 - DNA, 13 bp, C. elegans
aaattattgatga

SEQ ID NO: 689270 - DNA, 13 bp, C. elegans
aaattattgcatt

SEQ ID NO: 689271 - DNA, 13 bp, C. elegans
aaattattggatt

SEQ ID NO: 689272 - DNA, 13 bp, C. elegans
aaattattggcaa

SEQ ID NO: 689273 - DNA, 13 bp, C. elegans
aaattattgtgaa

SEQ ID NO: 689274 - DNA, 13 bp, C. elegans
aaattattgttct

SEQ ID NO: 689275 - DNA, 13 bp, C. elegans
aaattattgtttg

SEQ ID NO: 689276 - DNA, 13 bp, C. elegans
aaattatttccag

SEQ ID NO: 689277 - DNA, 13 bp, C. elegans
aaattatttcgaa

SEQ ID NO: 689278 - DNA, 13 bp, C. elegans
aaattatttctag

SEQ ID NO: 689279 - DNA, 13 bp, C. elegans
aaattatttctca

SEQ ID NO: 689280 - DNA, 13 bp, C. elegans
aaattatttgaac

SEQ ID NO: 689281 - DNA, 13 bp, C. elegans
aaattatttgcag

SEQ ID NO: 689282 - DNA, 13 bp, C. elegans
aaattatttgctt

SEQ ID NO: 689283 - DNA, 13 bp, C. elegans
aaattatttgtca

SEQ ID NO: 689284 - DNA, 13 bp, C. elegans
aaattatttgtga

SEQ ID NO: 689285 - DNA, 13 bp, C. elegans
aaattattttcct

SEQ ID NO: 689286 - DNA, 13 bp, C. elegans
aaattattttcga

SEQ ID NO: 689287 - DNA, 13 bp, C. elegans
aaattattttctg

SEQ ID NO: 689288 - DNA, 13 bp, C. elegans
aaattattttgca

SEQ ID NO: 689289 - DNA, 13 bp, C. elegans
aaattattttgtc

SEQ ID NO: 689290 - DNA, 13 bp, C. elegans
aaattatttttgg

SEQ ID NO: 689291 - DNA, 13 bp, C. elegans
aaattcaaaaagt

SEQ ID NO: 689292 - DNA, 13 bp, C. elegans
aaattcaaaatgg

SEQ ID NO: 689293 - DNA, 13 bp, C. elegans
aaattcaaaatgt

SEQ ID NO: 689294 - DNA, 13 bp, C. elegans
aaattcaaaattc

SEQ ID NO: 689295 - DNA, 13 bp, C. elegans
aaattcaaacagg

SEQ ID NO: 689296 - DNA, 13 bp, C. elegans
aaattcaaacatt

SEQ ID NO: 689297 - DNA, 13 bp, C. elegans
aaattcaaacgaa

SEQ ID NO: 689298 - DNA, 13 bp, C. elegans
aaattcaaacgat

SEQ ID NO: 689299 - DNA, 13 bp, C. elegans
aaattcaaacttt

SEQ ID NO: 689300 - DNA, 13 bp, C. elegans
aaattcaaagatt

SEQ ID NO: 689301 - DNA, 13 bp, C. elegans
aaattcaaagtgc

SEQ ID NO: 689302 - DNA, 13 bp, C. elegans
aaattcaaagttt

SEQ ID NO: 689303 - DNA, 13 bp, C. elegans
aaattcaaatcta

SEQ ID NO: 689304 - DNA, 13 bp, C. elegans
aaattcaaatgtt

SEQ ID NO: 689305 - DNA, 13 bp, C. elegans
aaattcaaattcc

SEQ ID NO: 689306 - DNA, 13 bp, C. elegans
aaattcaaattct

SEQ ID NO: 689307 - DNA, 13 bp, C. elegans
aaattcaaattga

SEQ ID NO: 689308 - DNA, 15 bp, C. elegans
aaattcaaatttcca

SEQ ID NO: 689309 - DNA, 13 bp, C. elegans
aaattcaaatttg

SEQ ID NO: 689310 - DNA, 13 bp, C. elegans
aaattcaacattt

SEQ ID NO: 689311 - DNA, 13 bp, C. elegans
aaattcaaccaat

SEQ ID NO: 689312 - DNA, 13 bp, C. elegans
aaattcaactcaa

SEQ ID NO: 689313 - DNA, 13 bp, C. elegans
aaattcaactcac

SEQ ID NO: 689314 - DNA, 13 bp, C. elegans
aaattcaactgat

SEQ ID NO: 689315 - DNA, 13 bp, C. elegans
aaattcaactttt

SEQ ID NO: 689316 - DNA, 13 bp, C. elegans
aaattcaagaaat

SEQ ID NO: 689317 - DNA, 13 bp, C. elegans
aaattcaagattt

SEQ ID NO: 689318 - DNA, 13 bp, C. elegans
aaattcaaggatc

SEQ ID NO: 689319 - DNA, 13 bp, C. elegans
aaattcaagttca

SEQ ID NO: 689320 - DNA, 13 bp, C. elegans
aaattcaagtttg

SEQ ID NO: 689321 - DNA, 13 bp, C. elegans
aaattcaagtttt

SEQ ID NO: 689322 - DNA, 13 bp, C. elegans
aaattcaatacat

SEQ ID NO: 689323 - DNA, 13 bp, C. elegans
aaattcaatattc

SEQ ID NO: 689324 - DNA, 13 bp, C. elegans
aaattcaatcagt

SEQ ID NO: 689325 - DNA, 13 bp, C. elegans
aaattcaatgaca

SEQ ID NO: 689326 - DNA, 13 bp, C. elegans
aaattcaatgtga

SEQ ID NO: 689327 - DNA, 13 bp, C. elegans
aaattcaatgttc

SEQ ID NO: 689328 - DNA, 13 bp, C. elegans
aaattcaattatc

SEQ ID NO: 689329 - DNA, 13 bp, C. elegans
aaattcaattcag

SEQ ID NO: 689330 - DNA, 13 bp, C. elegans
aaattcaattggc

SEQ ID NO: 689331 - DNA, 13 bp, C. elegans
aaattcaatttca

SEQ ID NO: 689332 - DNA, 13 bp, C. elegans
aaattcaatttcc

SEQ ID NO: 689333 - DNA, 13 bp, C. elegans
aaattcaatttgc

SEQ ID NO: 689334 - DNA, 13 bp, C. elegans
aaattcaattttc

SEQ ID NO: 689335 - DNA, 13 bp, C. elegans
aaattcacaaagt

SEQ ID NO: 689336 - DNA, 13 bp, C. elegans
aaattcacaaatt

SEQ ID NO: 689337 - DNA, 13 bp, C. elegans
aaattcacacgtg

SEQ ID NO: 689338 - DNA, 13 bp, C. elegans
aaattcacagaaa

SEQ ID NO: 689339 - DNA, 13 bp, C. elegans
aaattcacagaat

SEQ ID NO: 689340 - DNA, 13 bp, C. elegans
aaattcacagatt

SEQ ID NO: 689341 - DNA, 13 bp, C. elegans
aaattcacagttt

SEQ ID NO: 689342 - DNA, 13 bp, C. elegans
aaattcacatttc

SEQ ID NO: 689343 - DNA, 13 bp, C. elegans
aaattcaccgaaa

SEQ ID NO: 689344 - DNA, 13 bp, C. elegans
aaattcacgattt

SEQ ID NO: 689345 - DNA, 13 bp, C. elegans
aaattcacggaaa

SEQ ID NO: 689346 - DNA, 13 bp, C. elegans
aaattcactaatt

SEQ ID NO: 689347 - DNA, 13 bp, C. elegans
aaattcactgaaa

SEQ ID NO: 689348 - DNA, 13 bp, C. elegans
aaattcacttcaa

SEQ ID NO: 689349 - DNA, 13 bp, C. elegans
aaattcacttgca

SEQ ID NO: 689350 - DNA, 13 bp, C. elegans
aaattcactttct

SEQ ID NO: 689351 - DNA, 13 bp, C. elegans
aaattcacttttt

SEQ ID NO: 689352 - DNA, 13 bp, C. elegans
aaattcagaaaag

SEQ ID NO: 689353 - DNA, 13 bp, C. elegans
aaattcagaaaat

SEQ ID NO: 689354 - DNA, 13 bp, C. elegans
aaattcagaaata

SEQ ID NO: 689355 - DNA, 13 bp, C. elegans
aaattcagaaatt

SEQ ID NO: 689356 - DNA, 13 bp, C. elegans
aaattcagaagaa

SEQ ID NO: 689357 - DNA, 13 bp, C. elegans
aaattcagaattt

SEQ ID NO: 689358 - DNA, 13 bp, C. elegans
aaattcagagttt

SEQ ID NO: 689359 - DNA, 13 bp, C. elegans
aaattcagatttc

SEQ ID NO: 689360 - DNA, 13 bp, C. elegans
aaattcagatttt

SEQ ID NO: 689361 - DNA, 13 bp, C. elegans
aaattcagcaaat

SEQ ID NO: 689362 - DNA, 13 bp, C. elegans
aaattcagccaaa

SEQ ID NO: 689363 - DNA, 13 bp, C. elegans
aaattcagcgaaa

SEQ ID NO: 689364 - DNA, 13 bp, C. elegans
aaattcagcgttt

SEQ ID NO: 689365 - DNA, 13 bp, C. elegans
aaattcaggaaat

SEQ ID NO: 689366 - DNA, 13 bp, C. elegans
aaattcaggcaaa

SEQ ID NO: 689367 - DNA, 13 bp, C. elegans
aaattcagtcttt

SEQ ID NO: 689368 - DNA, 13 bp, C. elegans
aaattcagtgttt

SEQ ID NO: 689369 - DNA, 13 bp, C. elegans
aaattcagttaaa

SEQ ID NO: 689370 - DNA, 13 bp, C. elegans
aaattcagtttaa

SEQ ID NO: 689371 - DNA, 13 bp, C. elegans
aaattcagttttt

SEQ ID NO: 689372 - DNA, 13 bp, C. elegans
aaattcataaatc

SEQ ID NO: 689373 - DNA, 13 bp, C. elegans
aaattcataagtt

SEQ ID NO: 689374 - DNA, 13 bp, C. elegans
aaattcatagaaa

SEQ ID NO: 689375 - DNA, 13 bp, C. elegans
aaattcatatcaa

SEQ ID NO: 689376 - DNA, 13 bp, C. elegans
aaattcatatgat

SEQ ID NO: 689377 - DNA, 13 bp, C. elegans
aaattcatatttc

SEQ ID NO: 689378 - DNA, 13 bp, C. elegans
aaattcatcaact

SEQ ID NO: 689379 - DNA, 13 bp, C. elegans
aaattcatcgaaa

SEQ ID NO: 689380 - DNA, 13 bp, C. elegans
aaattcatgaaaa

SEQ ID NO: 689381 - DNA, 13 bp, C. elegans
aaattcatgaaac

SEQ ID NO: 689382 - DNA, 13 bp, C. elegans
aaattcatgagaa

SEQ ID NO: 689383 - DNA, 13 bp, C. elegans
aaattcatggttt

SEQ ID NO: 689384 - DNA, 13 bp, C. elegans
aaattcatgtaaa

SEQ ID NO: 689385 - DNA, 13 bp, C. elegans
aaattcatgtttc

SEQ ID NO: 689386 - DNA, 13 bp, C. elegans
aaattcattaact

SEQ ID NO: 689387 - DNA, 13 bp, C. elegans
aaattcattacaa

SEQ ID NO: 689388 - DNA, 13 bp, C. elegans
aaattcattatca

SEQ ID NO: 689389 - DNA, 13 bp, C. elegans
aaattcattcaaa

SEQ ID NO: 689390 - DNA, 13 bp, C. elegans
aaattcattcaat

SEQ ID NO: 689391 - DNA, 13 bp, C. elegans
aaattcattcatt

SEQ ID NO: 689392 - DNA, 13 bp, C. elegans
aaattcattcgaa

SEQ ID NO: 689393 - DNA, 13 bp, C. elegans
aaattcattcttt

SEQ ID NO: 689394 - DNA, 13 bp, C. elegans
aaattcattgaaa

SEQ ID NO: 689395 - DNA, 13 bp, C. elegans
aaattcatttcaa

SEQ ID NO: 689396 - DNA, 13 bp, C. elegans
aaattcatttcat

SEQ ID NO: 689397 - DNA, 13 bp, C. elegans
aaattcatttcta

SEQ ID NO: 689398 - DNA, 13 bp, C. elegans
aaattcatttgtc

SEQ ID NO: 689399 - DNA, 13 bp, C. elegans
aaattcatttttc

SEQ ID NO: 689400 - DNA, 13 bp, C. elegans
aaattccaaaaag

SEQ ID NO: 689401 - DNA, 13 bp, C. elegans
aaattccaaaact

SEQ ID NO: 689402 - DNA, 13 bp, C. elegans
aaattccaaagaa

SEQ ID NO: 689403 - DNA, 13 bp, C. elegans
aaattccaaatca

SEQ ID NO: 689404 - DNA, 13 bp, C. elegans
aaattccaaattc

SEQ ID NO: 689405 - DNA, 13 bp, C. elegans
aaattccaaattt

SEQ ID NO: 689406 - DNA, 13 bp, C. elegans
aaattccaacaac

SEQ ID NO: 689407 - DNA, 13 bp, C. elegans
aaattccaactga

SEQ ID NO: 689408 - DNA, 13 bp, C. elegans
aaattccaagaga

SEQ ID NO: 689409 - DNA, 13 bp, C. elegans
aaattccaatata

SEQ ID NO: 689410 - DNA, 13 bp, C. elegans
aaattccaatatt

SEQ ID NO: 689411 - DNA, 13 bp, C. elegans
aaattccaatcat

SEQ ID NO: 689412 - DNA, 13 bp, C. elegans
aaattccaattat

SEQ ID NO: 689413 - DNA, 13 bp, C. elegans
aaattccaattcc

SEQ ID NO: 689414 - DNA, 13 bp, C. elegans
aaattccaattct

SEQ ID NO: 689415 - DNA, 13 bp, C. elegans
aaattccaattgt

SEQ ID NO: 689416 - DNA, 13 bp, C. elegans
aaattccaatttc

SEQ ID NO: 689417 - DNA, 13 bp, C. elegans
aaattccaatttt

SEQ ID NO: 689418 - DNA, 13 bp, C. elegans
aaattccacatct

SEQ ID NO: 689419 - DNA, 13 bp, C. elegans
aaattccactttt

SEQ ID NO: 689420 - DNA, 13 bp, C. elegans
aaattccagaaaa

SEQ ID NO: 689421 - DNA, 13 bp, C. elegans
aaattccagaaag

SEQ ID NO: 689422 - DNA, 13 bp, C. elegans
aaattccagaact

SEQ ID NO: 689423 - DNA, 13 bp, C. elegans
aaattccagaagt

SEQ ID NO: 689424 - DNA, 13 bp, C. elegans
aaattccagacat

SEQ ID NO: 689425 - DNA, 13 bp, C. elegans
aaattccagataa

SEQ ID NO: 689426 - DNA, 13 bp, C. elegans
aaattccagatat

SEQ ID NO: 689427 - DNA, 13 bp, C. elegans
aaattccagattt

SEQ ID NO: 689428 - DNA, 13 bp, C. elegans
aaattccagtaaa

SEQ ID NO: 689429 - DNA, 13 bp, C. elegans
aaattccagtcaa

SEQ ID NO: 689430 - DNA, 13 bp, C. elegans
aaattccagtttt

SEQ ID NO: 689431 - DNA, 13 bp, C. elegans
aaattccatattt

SEQ ID NO: 689432 - DNA, 13 bp, C. elegans
aaattccatcaaa

SEQ ID NO: 689433 - DNA, 13 bp, C. elegans
aaattccatgttt

SEQ ID NO: 689434 - DNA, 13 bp, C. elegans
aaattccattaaa

SEQ ID NO: 689435 - DNA, 13 bp, C. elegans
aaattccattcca

SEQ ID NO: 689436 - DNA, 13 bp, C. elegans
aaattccattttc

SEQ ID NO: 689437 - DNA, 13 bp, C. elegans
aaattccattttg

SEQ ID NO: 689438 - DNA, 13 bp, C. elegans
aaattccattttt

SEQ ID NO: 689439 - DNA, 13 bp, C. elegans
aaattcccaaatc

SEQ ID NO: 689440 - DNA, 13 bp, C. elegans
aaattcccaaatt

SEQ ID NO: 689441 - DNA, 13 bp, C. elegans
aaattcccaattc

SEQ ID NO: 689442 - DNA, 13 bp, C. elegans
aaattcccaattt

SEQ ID NO: 689443 - DNA, 13 bp, C. elegans
aaattcccacttt

SEQ ID NO: 689444 - DNA, 13 bp, C. elegans
aaattccccaaat

SEQ ID NO: 689445 - DNA, 13 bp, C. elegans
aaattccccaatt

SEQ ID NO: 689446 - DNA, 13 bp, C. elegans
aaattcccgccaa

SEQ ID NO: 689447 - DNA, 13 bp, C. elegans
aaattccgaaaat

SEQ ID NO: 689448 - DNA, 13 bp, C. elegans
aaattccgaattt

SEQ ID NO: 689449 - DNA, 13 bp, C. elegans
aaattccgacatt

SEQ ID NO: 689450 - DNA, 13 bp, C. elegans
aaattccggaaaa

SEQ ID NO: 689451 - DNA, 13 bp, C. elegans
aaattccggaaat

SEQ ID NO: 689452 - DNA, 13 bp, C. elegans
aaattccggcaaa

SEQ ID NO: 689453 - DNA, 13 bp, C. elegans
aaattccgtaaat

SEQ ID NO: 689454 - DNA, 13 bp, C. elegans
aaattccgtgaaa

SEQ ID NO: 689455 - DNA, 13 bp, C. elegans
aaattcctagttt

SEQ ID NO: 689456 - DNA, 13 bp, C. elegans
aaattcctcaaaa

SEQ ID NO: 689457 - DNA, 13 bp, C. elegans
aaattcctcaaat

SEQ ID NO: 689458 - DNA, 13 bp, C. elegans
aaattcctcgaaa

SEQ ID NO: 689459 - DNA, 13 bp, C. elegans
aaattcctctgaa

SEQ ID NO: 689460 - DNA, 13 bp, C. elegans
aaattcctgaaaa

SEQ ID NO: 689461 - DNA, 13 bp, C. elegans
aaattcctgaaat

SEQ ID NO: 689462 - DNA, 13 bp, C. elegans
aaattcctgcaaa

SEQ ID NO: 689463 - DNA, 13 bp, C. elegans
aaattccttaaaa

SEQ ID NO: 689464 - DNA, 13 bp, C. elegans
aaattccttcaaa

SEQ ID NO: 689465 - DNA, 13 bp, C. elegans
aaattccttgaaa

SEQ ID NO: 689466 - DNA, 13 bp, C. elegans
aaattcgaaaaag

SEQ ID NO: 689467 - DNA, 13 bp, C. elegans
aaattcgaaaagt

SEQ ID NO: 689468 - DNA, 14 bp, C. elegans
aaattcgaaaattc

SEQ ID NO: 689469 - DNA, 13 bp, C. elegans
aaattcgaaacat

SEQ ID NO: 689470 - DNA, 13 bp, C. elegans
aaattcgaaactg

SEQ ID NO: 689471 - DNA, 13 bp, C. elegans
aaattcgaaagaa

SEQ ID NO: 689472 - DNA, 13 bp, C. elegans
aaattcgaaatat

SEQ ID NO: 689473 - DNA, 13 bp, C. elegans
aaattcgaaattt

SEQ ID NO: 689474 - DNA, 13 bp, C. elegans
aaattcgaacaaa

SEQ ID NO: 689475 - DNA, 13 bp, C. elegans
aaattcgaacatt

SEQ ID NO: 689476 - DNA, 13 bp, C. elegans
aaattcgaactca

SEQ ID NO: 689477 - DNA, 13 bp, C. elegans
aaattcgaagaaa

SEQ ID NO: 689478 - DNA, 13 bp, C. elegans
aaattcgaagcaa

SEQ ID NO: 689479 - DNA, 13 bp, C. elegans
aaattcgaatatc

SEQ ID NO: 689480 - DNA, 13 bp, C. elegans
aaattcgaatatt

SEQ ID NO: 689481 - DNA, 13 bp, C. elegans
aaattcgaatgtt

SEQ ID NO: 689482 - DNA, 13 bp, C. elegans
aaattcgaatttc

SEQ ID NO: 689483 - DNA, 13 bp, C. elegans
aaattcgaatttt

SEQ ID NO: 689484 - DNA, 13 bp, C. elegans
aaattcgacaaat

SEQ ID NO: 689485 - DNA, 13 bp, C. elegans
aaattcgacattt

SEQ ID NO: 689486 - DNA, 13 bp, C. elegans
aaattcgacttct

SEQ ID NO: 689487 - DNA, 13 bp, C. elegans
aaattcgactttt

SEQ ID NO: 689488 - DNA, 13 bp, C. elegans
aaattcgagaaaa

SEQ ID NO: 689489 - DNA, 13 bp, C. elegans
aaattcgagaaat

SEQ ID NO: 689490 - DNA, 13 bp, C. elegans
aaattcgagaatt

SEQ ID NO: 689491 - DNA, 13 bp, C. elegans
aaattcgagatat

SEQ ID NO: 689492 - DNA, 13 bp, C. elegans
aaattcgagcaaa

SEQ ID NO: 689493 - DNA, 13 bp, C. elegans
aaattcgaggttt

SEQ ID NO: 689494 - DNA, 13 bp, C. elegans
aaattcgagtatg

SEQ ID NO: 689495 - DNA, 13 bp, C. elegans
aaattcgagtttt

SEQ ID NO: 689496 - DNA, 13 bp, C. elegans
aaattcgataaaa

SEQ ID NO: 689497 - DNA, 13 bp, C. elegans
aaattcgataata

SEQ ID NO: 689498 - DNA, 13 bp, C. elegans
aaattcgatatta

SEQ ID NO: 689499 - DNA, 13 bp, C. elegans
aaattcgatattt

SEQ ID NO: 689500 - DNA, 13 bp, C. elegans
aaattcgatgttt

SEQ ID NO: 689501 - DNA, 13 bp, C. elegans
aaattcgattatt

SEQ ID NO: 689502 - DNA, 13 bp, C. elegans
aaattcgatttta

SEQ ID NO: 689503 - DNA, 13 bp, C. elegans
aaattcgattttc

SEQ ID NO: 689504 - DNA, 13 bp, C. elegans
aaattcgattttt

SEQ ID NO: 689505 - DNA, 13 bp, C. elegans
aaattcgcaaaaa

SEQ ID NO: 689506 - DNA, 13 bp, C. elegans
aaattcgcaaatt

SEQ ID NO: 689507 - DNA, 13 bp, C. elegans
aaattcgcaatat

SEQ ID NO: 689508 - DNA, 13 bp, C. elegans
aaattcgcaattt

SEQ ID NO: 689509 - DNA, 13 bp, C. elegans
aaattcgccaaat

SEQ ID NO: 689510 - DNA, 13 bp, C. elegans
aaattcgcgtttt

SEQ ID NO: 689511 - DNA, 13 bp, C. elegans
aaattcggaaaga

SEQ ID NO: 689512 - DNA, 13 bp, C. elegans
aaattcggaaatt

SEQ ID NO: 689513 - DNA, 13 bp, C. elegans
aaattcggaagaa

SEQ ID NO: 689514 - DNA, 13 bp, C. elegans
aaattcggaagtt

SEQ ID NO: 689515 - DNA, 13 bp, C. elegans
aaattcggaatta

SEQ ID NO: 689516 - DNA, 13 bp, C. elegans
aaattcggattct

SEQ ID NO: 689517 - DNA, 13 bp, C. elegans
aaattcggatttt

SEQ ID NO: 689518 - DNA, 13 bp, C. elegans
aaattcggcgaaa

SEQ ID NO: 689519 - DNA, 13 bp, C. elegans
aaattcggcgaat

SEQ ID NO: 689520 - DNA, 13 bp, C. elegans
aaattcggcgttt

SEQ ID NO: 689521 - DNA, 13 bp, C. elegans
aaattcgggaaaa

SEQ ID NO: 689522 - DNA, 13 bp, C. elegans
aaattcgggaaat

SEQ ID NO: 689523 - DNA, 13 bp, C. elegans
aaattcgggagaa

SEQ ID NO: 689524 - DNA, 13 bp, C. elegans
aaattcggggaaa

SEQ ID NO: 689525 - DNA, 13 bp, C. elegans
aaattcggggttt

SEQ ID NO: 689526 - DNA, 13 bp, C. elegans
aaattcggtgaaa

SEQ ID NO: 689527 - DNA, 13 bp, C. elegans
aaattcggtgtat

SEQ ID NO: 689528 - DNA, 13 bp, C. elegans
aaattcgtaaaaa

SEQ ID NO: 689529 - DNA, 13 bp, C. elegans
aaattcgtattca

SEQ ID NO: 689530 - DNA, 13 bp, C. elegans
aaattcgtatttt

SEQ ID NO: 689531 - DNA, 13 bp, C. elegans
aaattcgtcaatt

SEQ ID NO: 689532 - DNA, 13 bp, C. elegans
aaattcgtcgaaa

SEQ ID NO: 689533 - DNA, 13 bp, C. elegans
aaattcgtgattt

SEQ ID NO: 689534 - DNA, 13 bp, C. elegans
aaattcgtgtttt

SEQ ID NO: 689535 - DNA, 14 bp, C. elegans
aaattcgttcattt

SEQ ID NO: 689536 - DNA, 13 bp, C. elegans
aaattcgtttatt

SEQ ID NO: 689537 - DNA, 13 bp, C. elegans
aaattcgttttat

SEQ ID NO: 689538 - DNA, 13 bp, C. elegans
aaattcgtttttg

SEQ ID NO: 689539 - DNA, 13 bp, C. elegans
aaattctaaaact

SEQ ID NO: 689540 - DNA, 13 bp, C. elegans
aaattctaaaaga

SEQ ID NO: 689541 - DNA, 13 bp, C. elegans
aaattctaaattc

SEQ ID NO: 689542 - DNA, 13 bp, C. elegans
aaattctaatttc

SEQ ID NO: 689543 - DNA, 13 bp, C. elegans
aaattctacaaca

SEQ ID NO: 689544 - DNA, 13 bp, C. elegans
aaattctacacaa

SEQ ID NO: 689545 - DNA, 13 bp, C. elegans
aaattctacattt

SEQ ID NO: 689546 - DNA, 13 bp, C. elegans
aaattctacgaaa

SEQ ID NO: 689547 - DNA, 13 bp, C. elegans
aaattctactgaa

SEQ ID NO: 689548 - DNA, 13 bp, C. elegans
aaattctactttt

SEQ ID NO: 689549 - DNA, 13 bp, C. elegans
aaattctagaagt

SEQ ID NO: 689550 - DNA, 13 bp, C. elegans
aaattctagaata

SEQ ID NO: 689551 - DNA, 13 bp, C. elegans
aaattctagaatt

SEQ ID NO: 689552 - DNA, 13 bp, C. elegans
aaattctagattt

SEQ ID NO: 689553 - DNA, 13 bp, C. elegans
aaattctagtgaa

SEQ ID NO: 689554 - DNA, 13 bp, C. elegans
aaattctagtttt

SEQ ID NO: 689555 - DNA, 13 bp, C. elegans
aaattctatgaaa

SEQ ID NO: 689556 - DNA, 13 bp, C. elegans
aaattctatgaat

SEQ ID NO: 689557 - DNA, 13 bp, C. elegans
aaattctatgatt

SEQ ID NO: 689558 - DNA, 13 bp, C. elegans
aaattctatgttt

SEQ ID NO: 689559 - DNA, 13 bp, C. elegans
aaattctattcaa

SEQ ID NO: 689560 - DNA, 13 bp, C. elegans
aaattctatttct

SEQ ID NO: 689561 - DNA, 13 bp, C. elegans
aaattctcaaaat

SEQ ID NO: 689562 - DNA, 13 bp, C. elegans
aaattctcaagaa

SEQ ID NO: 689563 - DNA, 13 bp, C. elegans
aaattctcaagtt

SEQ ID NO: 689564 - DNA, 13 bp, C. elegans
aaattctcaatat

SEQ ID NO: 689565 - DNA, 13 bp, C. elegans
aaattctcaattc

SEQ ID NO: 689566 - DNA, 13 bp, C. elegans
aaattctcaattt

SEQ ID NO: 689567 - DNA, 13 bp, C. elegans
aaattctcacaaa

SEQ ID NO: 689568 - DNA, 13 bp, C. elegans
aaattctcacaat

SEQ ID NO: 689569 - DNA, 13 bp, C. elegans
aaattctcataaa

SEQ ID NO: 689570 - DNA, 13 bp, C. elegans
aaattctcatatt

SEQ ID NO: 689571 - DNA, 13 bp, C. elegans
aaattctcatttc

SEQ ID NO: 689572 - DNA, 13 bp, C. elegans
aaattctcatttt

SEQ ID NO: 689573 - DNA, 13 bp, C. elegans
aaattctccaatt

SEQ ID NO: 689574 - DNA, 13 bp, C. elegans
aaattctccataa

SEQ ID NO: 689575 - DNA, 13 bp, C. elegans
aaattctccgaaa

SEQ ID NO: 689576 - DNA, 13 bp, C. elegans
aaattctcgaaaa

SEQ ID NO: 689577 - DNA, 13 bp, C. elegans
aaattctcgaaat

SEQ ID NO: 689578 - DNA, 13 bp, C. elegans
aaattctcgagaa

SEQ ID NO: 689579 - DNA, 13 bp, C. elegans
aaattctcggaaa

SEQ ID NO: 689580 - DNA, 13 bp, C. elegans
aaattctcgtttt

SEQ ID NO: 689581 - DNA, 13 bp, C. elegans
aaattctctaatt

SEQ ID NO: 689582 - DNA, 13 bp, C. elegans
aaattctctacaa

SEQ ID NO: 689583 - DNA, 13 bp, C. elegans
aaattctctacat

SEQ ID NO: 689584 - DNA, 13 bp, C. elegans
aaattctctattt

SEQ ID NO: 689585 - DNA, 13 bp, C. elegans
aaattctctgaaa

SEQ ID NO: 689586 - DNA, 13 bp, C. elegans
aaattctcttaaa

SEQ ID NO: 689587 - DNA, 13 bp, C. elegans
aaattctgaaaaa

SEQ ID NO: 689588 - DNA, 13 bp, C. elegans
aaattctgaacat

SEQ ID NO: 689589 - DNA, 13 bp, C. elegans
aaattctgaatat

SEQ ID NO: 689590 - DNA, 13 bp, C. elegans
aaattctgaattt

SEQ ID NO: 689591 - DNA, 13 bp, C. elegans
aaattctgatgaa

SEQ ID NO: 689592 - DNA, 13 bp, C. elegans
aaattctgatttc

SEQ ID NO: 689593 - DNA, 13 bp, C. elegans
aaattctgatttt

SEQ ID NO: 689594 - DNA, 13 bp, C. elegans
aaattctgcaatt

SEQ ID NO: 689595 - DNA, 13 bp, C. elegans
aaattctgctaaa

SEQ ID NO: 689596 - DNA, 13 bp, C. elegans
aaattctgctttt

SEQ ID NO: 689597 - DNA, 13 bp, C. elegans
aaattctggaaaa

SEQ ID NO: 689598 - DNA, 13 bp, C. elegans
aaattctggaaca

SEQ ID NO: 689599 - DNA, 13 bp, C. elegans
aaattctggaaga

SEQ ID NO: 689600 - DNA, 13 bp, C. elegans
aaattctggtttt

SEQ ID NO: 689601 - DNA, 13 bp, C. elegans
aaattctgtaatt

SEQ ID NO: 689602 - DNA, 13 bp, C. elegans
aaattctgtgaaa

SEQ ID NO: 689603 - DNA, 13 bp, C. elegans
aaattctgtgaat

SEQ ID NO: 689604 - DNA, 13 bp, C. elegans
aaattctgttaaa

SEQ ID NO: 689605 - DNA, 13 bp, C. elegans
aaattctgttcaa

SEQ ID NO: 689606 - DNA, 13 bp, C. elegans
aaattcttacatt

SEQ ID NO: 689607 - DNA, 13 bp, C. elegans
aaattcttagaaa

SEQ ID NO: 689608 - DNA, 13 bp, C. elegans
aaattcttcaaaa

SEQ ID NO: 689609 - DNA, 13 bp, C. elegans
aaattcttcaaag

SEQ ID NO: 689610 - DNA, 13 bp, C. elegans
aaattcttcaata

SEQ ID NO: 689611 - DNA, 13 bp, C. elegans
aaattcttcagaa

SEQ ID NO: 689612 - DNA, 13 bp, C. elegans
aaattcttcattt

SEQ ID NO: 689613 - DNA, 13 bp, C. elegans
aaattcttgaaat

SEQ ID NO: 689614 - DNA, 13 bp, C. elegans
aaattcttgaact

SEQ ID NO: 689615 - DNA, 13 bp, C. elegans
aaattcttgagaa

SEQ ID NO: 689616 - DNA, 13 bp, C. elegans
aaattcttgataa

SEQ ID NO: 689617 - DNA, 13 bp, C. elegans
aaattcttgcaaa

SEQ ID NO: 689618 - DNA, 13 bp, C. elegans
aaattcttggaat

SEQ ID NO: 689619 - DNA, 13 bp, C. elegans
aaattcttgtaaa

SEQ ID NO: 689620 - DNA, 13 bp, C. elegans
aaattcttgtcaa

SEQ ID NO: 689621 - DNA, 13 bp, C. elegans
aaattcttgttga

SEQ ID NO: 689622 - DNA, 13 bp, C. elegans
aaattctttcaaa

SEQ ID NO: 689623 - DNA, 13 bp, C. elegans
aaattctttcaat

SEQ ID NO: 689624 - DNA, 13 bp, C. elegans
aaattctttcaga

SEQ ID NO: 689625 - DNA, 13 bp, C. elegans
aaattctttcata

SEQ ID NO: 689626 - DNA, 13 bp, C. elegans
aaattctttcatt

SEQ ID NO: 689627 - DNA, 13 bp, C. elegans
aaattctttctaa

SEQ ID NO: 689628 - DNA, 13 bp, C. elegans
aaattctttgcaa

SEQ ID NO: 689629 - DNA, 13 bp, C. elegans
aaattctttggaa

SEQ ID NO: 689630 - DNA, 13 bp, C. elegans
aaattcttttgaa

SEQ ID NO: 689631 - DNA, 13 bp, C. elegans
aaattgaaaaatc

SEQ ID NO: 689632 - DNA, 13 bp, C. elegans
aaattgaaaactt

SEQ ID NO: 689633 - DNA, 13 bp, C. elegans
aaattgaaaagtg

SEQ ID NO: 689634 - DNA, 13 bp, C. elegans
aaattgaaaagtt

SEQ ID NO: 689635 - DNA, 13 bp, C. elegans
aaattgaaacata

SEQ ID NO: 689636 - DNA, 13 bp, C. elegans
aaattgaaactaa

SEQ ID NO: 689637 - DNA, 13 bp, C. elegans
aaattgaaactca

SEQ ID NO: 689638 - DNA, 13 bp, C. elegans
aaattgaaagtta

SEQ ID NO: 689639 - DNA, 13 bp, C. elegans
aaattgaaagttt

SEQ ID NO: 689640 - DNA, 13 bp, C. elegans
aaattgaaatcat

SEQ ID NO: 689641 - DNA, 13 bp, C. elegans
aaattgaaatcca

SEQ ID NO: 689642 - DNA, 13 bp, C. elegans
aaattgaaatgat

SEQ ID NO: 689643 - DNA, 13 bp, C. elegans
aaattgaaatgtt

SEQ ID NO: 689644 - DNA, 13 bp, C. elegans
aaattgaaattag

SEQ ID NO: 689645 - DNA, 13 bp, C. elegans
aaattgaaatttg

SEQ ID NO: 689646 - DNA, 13 bp, C. elegans
aaattgaacaaat

SEQ ID NO: 689647 - DNA, 13 bp, C. elegans
aaattgaacaaca

SEQ ID NO: 689648 - DNA, 13 bp, C. elegans
aaattgaacaact

SEQ ID NO: 689649 - DNA, 13 bp, C. elegans
aaattgaacatta

SEQ ID NO: 689650 - DNA, 13 bp, C. elegans
aaattgaacattt

SEQ ID NO: 689651 - DNA, 13 bp, C. elegans
aaattgaaccggc

SEQ ID NO: 689652 - DNA, 13 bp, C. elegans
aaattgaacgaat

SEQ ID NO: 689653 - DNA, 13 bp, C. elegans
aaattgaacgttt

SEQ ID NO: 689654 - DNA, 13 bp, C. elegans
aaattgaactaat

SEQ ID NO: 689655 - DNA, 13 bp, C. elegans
aaattgaactatt

SEQ ID NO: 689656 - DNA, 13 bp, C. elegans
aaattgaacttca

SEQ ID NO: 689657 - DNA, 13 bp, C. elegans
aaattgaacttga

SEQ ID NO: 689658 - DNA, 13 bp, C. elegans
aaattgaactttt

SEQ ID NO: 689659 - DNA, 13 bp, C. elegans
aaattgaagaaca

SEQ ID NO: 689660 - DNA, 13 bp, C. elegans
aaattgaagacaa

SEQ ID NO: 689661 - DNA, 13 bp, C. elegans
aaattgaagattt

SEQ ID NO: 689662 - DNA, 13 bp, C. elegans
aaattgaagcatt

SEQ ID NO: 689663 - DNA, 13 bp, C. elegans
aaattgaagccaa

SEQ ID NO: 689664 - DNA, 13 bp, C. elegans
aaattgaagctaa

SEQ ID NO: 689665 - DNA, 13 bp, C. elegans
aaattgaagttaa

SEQ ID NO: 689666 - DNA, 13 bp, C. elegans
aaattgaagtttg

SEQ ID NO: 689667 - DNA, 13 bp, C. elegans
aaattgaagtttt

SEQ ID NO: 689668 - DNA, 13 bp, C. elegans
aaattgaataaac

SEQ ID NO: 689669 - DNA, 13 bp, C. elegans
aaattgaatatcg

SEQ ID NO: 689670 - DNA, 13 bp, C. elegans
aaattgaatcatt

SEQ ID NO: 689671 - DNA, 13 bp, C. elegans
aaattgaatgaga

SEQ ID NO: 689672 - DNA, 13 bp, C. elegans
aaattgaatgtat

SEQ ID NO: 689673 - DNA, 13 bp, C. elegans
aaattgaattcct

SEQ ID NO: 689674 - DNA, 13 bp, C. elegans
aaattgaattctg

SEQ ID NO: 689675 - DNA, 13 bp, C. elegans
aaattgaattctt

SEQ ID NO: 689676 - DNA, 13 bp, C. elegans
aaattgaattgca

SEQ ID NO: 689677 - DNA, 13 bp, C. elegans
aaattgaattgtt

SEQ ID NO: 689678 - DNA, 13 bp, C. elegans
aaattgaatttca

SEQ ID NO: 689679 - DNA, 13 bp, C. elegans
aaattgaatttct

SEQ ID NO: 689680 - DNA, 13 bp, C. elegans
aaattgaatttgg

SEQ ID NO: 689681 - DNA, 13 bp, C. elegans
aaattgacaaaac

SEQ ID NO: 689682 - DNA, 13 bp, C. elegans
aaattgacaaaat

SEQ ID NO: 689683 - DNA, 13 bp, C. elegans
aaattgacaaacc

SEQ ID NO: 689684 - DNA, 13 bp, C. elegans
aaattgacaaatt

SEQ ID NO: 689685 - DNA, 13 bp, C. elegans
aaattgacaattt

SEQ ID NO: 689686 - DNA, 14 bp, C. elegans
aaattgacagaaaa

SEQ ID NO: 689687 - DNA, 13 bp, C. elegans
aaattgaccaaaa

SEQ ID NO: 689688 - DNA, 13 bp, C. elegans
aaattgaccaata

SEQ ID NO: 689689 - DNA, 13 bp, C. elegans
aaattgaccgaaa

SEQ ID NO: 689690 - DNA, 13 bp, C. elegans
aaattgacgattt

SEQ ID NO: 689691 - DNA, 13 bp, C. elegans
aaattgactaaaa

SEQ ID NO: 689692 - DNA, 13 bp, C. elegans
aaattgactcaaa

SEQ ID NO: 689693 - DNA, 13 bp, C. elegans
aaattgactgaaa

SEQ ID NO: 689694 - DNA, 13 bp, C. elegans
aaattgactgttt

SEQ ID NO: 689695 - DNA, 13 bp, C. elegans
aaattgagaaact

SEQ ID NO: 689696 - DNA, 13 bp, C. elegans
aaattgagaaatt

SEQ ID NO: 689697 - DNA, 13 bp, C. elegans
aaattgagaactt

SEQ ID NO: 689698 - DNA, 13 bp, C. elegans
aaattgagaatat

SEQ ID NO: 689699 - DNA, 13 bp, C. elegans
aaattgagaatta

SEQ ID NO: 689700 - DNA, 13 bp, C. elegans
aaattgagaattc

SEQ ID NO: 689701 - DNA, 13 bp, C. elegans
aaattgagacaaa

SEQ ID NO: 689702 - DNA, 13 bp, C. elegans
aaattgagagatg

SEQ ID NO: 689703 - DNA, 13 bp, C. elegans
aaattgagcaaaa

SEQ ID NO: 689704 - DNA, 13 bp, C. elegans
aaattgagcaatt

SEQ ID NO: 689705 - DNA, 13 bp, C. elegans
aaattgagcattt

SEQ ID NO: 689706 - DNA, 13 bp, C. elegans
aaattgagctgaa

SEQ ID NO: 689707 - DNA, 13 bp, C. elegans
aaattgagcttag

SEQ ID NO: 689708 - DNA, 13 bp, C. elegans
aaattgagcttct

SEQ ID NO: 689709 - DNA, 13 bp, C. elegans
aaattgagtaaga

SEQ ID NO: 689710 - DNA, 13 bp, C. elegans
aaattgagtgatt

SEQ ID NO: 689711 - DNA, 13 bp, C. elegans
aaattgagttgaa

SEQ ID NO: 689712 - DNA, 13 bp, C. elegans
aaattgatatgtt

SEQ ID NO: 689713 - DNA, 13 bp, C. elegans
aaattgatattcg

SEQ ID NO: 689714 - DNA, 13 bp, C. elegans
aaattgatattga

SEQ ID NO: 689715 - DNA, 13 bp, C. elegans
aaattgatcaaaa

SEQ ID NO: 689716 - DNA, 13 bp, C. elegans
aaattgatcaaat

SEQ ID NO: 689717 - DNA, 13 bp, C. elegans
aaattgatcaata

SEQ ID NO: 689718 - DNA, 13 bp, C. elegans
aaattgatcagaa

SEQ ID NO: 689719 - DNA, 13 bp, C. elegans
aaattgatcattt

SEQ ID NO: 689720 - DNA, 13 bp, C. elegans
aaattgatctaca

SEQ ID NO: 689721 - DNA, 13 bp, C. elegans
aaattgatctcaa

SEQ ID NO: 689722 - DNA, 13 bp, C. elegans
aaattgatctcca

SEQ ID NO: 689723 - DNA, 13 bp, C. elegans
aaattgatcttaa

SEQ ID NO: 689724 - DNA, 14 bp, C. elegans
aaattgatgaaatt

SEQ ID NO: 689725 - DNA, 13 bp, C. elegans
aaattgatgatga

SEQ ID NO: 689726 - DNA, 13 bp, C. elegans
aaattgatggaaa

SEQ ID NO: 689727 - DNA, 13 bp, C. elegans
aaattgatggaat

SEQ ID NO: 689728 - DNA, 13 bp, C. elegans
aaattgatggaga

SEQ ID NO: 689729 - DNA, 13 bp, C. elegans
aaattgatggatt

SEQ ID NO: 689730 - DNA, 13 bp, C. elegans
aaattgatgtaat

SEQ ID NO: 689731 - DNA, 13 bp, C. elegans
aaattgatgttaa

SEQ ID NO: 689732 - DNA, 13 bp, C. elegans
aaattgatgtttg

SEQ ID NO: 689733 - DNA, 13 bp, C. elegans
aaattgattcaga

SEQ ID NO: 689734 - DNA, 13 bp, C. elegans
aaattgattcatt

SEQ ID NO: 689735 - DNA, 13 bp, C. elegans
aaattgattgaaa

SEQ ID NO: 689736 - DNA, 13 bp, C. elegans
aaattgattgatt

SEQ ID NO: 689737 - DNA, 13 bp, C. elegans
aaattgattggaa

SEQ ID NO: 689738 - DNA, 13 bp, C. elegans
aaattgattgtat

SEQ ID NO: 689739 - DNA, 13 bp, C. elegans
aaattgattgttt

SEQ ID NO: 689740 - DNA, 13 bp, C. elegans
aaattgatttctg

SEQ ID NO: 689741 - DNA, 13 bp, C. elegans
aaattgatttgtt

SEQ ID NO: 689742 - DNA, 13 bp, C. elegans
aaattgattttcc

SEQ ID NO: 689743 - DNA, 13 bp, C. elegans
aaattgattttct

SEQ ID NO: 689744 - DNA, 13 bp, C. elegans
aaattgattttga

SEQ ID NO: 689745 - DNA, 13 bp, C. elegans
aaattgattttgc

SEQ ID NO: 689746 - DNA, 13 bp, C. elegans
aaattgcaaaaac

SEQ ID NO: 689747 - DNA, 13 bp, C. elegans
aaattgcaaaaat

SEQ ID NO: 689748 - DNA, 14 bp, C. elegans
aaattgcaaaaatt

SEQ ID NO: 689749 - DNA, 13 bp, C. elegans
aaattgcaaaatt

SEQ ID NO: 689750 - DNA, 13 bp, C. elegans
aaattgcaaagaa

SEQ ID NO: 689751 - DNA, 13 bp, C. elegans
aaattgcaaataa

SEQ ID NO: 689752 - DNA, 13 bp, C. elegans
aaattgcaaatgt

SEQ ID NO: 689753 - DNA, 13 bp, C. elegans
aaattgcaaatta

SEQ ID NO: 689754 - DNA, 13 bp, C. elegans
aaattgcaacaat

SEQ ID NO: 689755 - DNA, 13 bp, C. elegans
aaattgcaacttt

SEQ ID NO: 689756 - DNA, 13 bp, C. elegans
aaattgcaagttt

SEQ ID NO: 689757 - DNA, 13 bp, C. elegans
aaattgcaataaa

SEQ ID NO: 689758 - DNA, 13 bp, C. elegans
aaattgcaatatt

SEQ ID NO: 689759 - DNA, 13 bp, C. elegans
aaattgcaatcaa

SEQ ID NO: 689760 - DNA, 13 bp, C. elegans
aaattgcaattat

SEQ ID NO: 689761 - DNA, 13 bp, C. elegans
aaattgcacaaat

SEQ ID NO: 689762 - DNA, 13 bp, C. elegans
aaattgcagaaaa

SEQ ID NO: 689763 - DNA, 13 bp, C. elegans
aaattgcagattt

SEQ ID NO: 689764 - DNA, 13 bp, C. elegans
aaattgcagtgaa

SEQ ID NO: 689765 - DNA, 13 bp, C. elegans
aaattgcatattt

SEQ ID NO: 689766 - DNA, 13 bp, C. elegans
aaattgcatgttt

SEQ ID NO: 689767 - DNA, 13 bp, C. elegans
aaattgcattttt

SEQ ID NO: 689768 - DNA, 13 bp, C. elegans
aaattgccaaaaa

SEQ ID NO: 689769 - DNA, 13 bp, C. elegans
aaattgccaaata

SEQ ID NO: 689770 - DNA, 13 bp, C. elegans
aaattgccaaatt

SEQ ID NO: 689771 - DNA, 13 bp, C. elegans
aaattgccaacta

SEQ ID NO: 689772 - DNA, 13 bp, C. elegans
aaattgccaactg

SEQ ID NO: 689773 - DNA, 13 bp, C. elegans
aaattgccaagaa

SEQ ID NO: 689774 - DNA, 13 bp, C. elegans
aaattgccaatat

SEQ ID NO: 689775 - DNA, 13 bp, C. elegans
aaattgccaattt

SEQ ID NO: 689776 - DNA, 13 bp, C. elegans
aaattgccacaaa

SEQ ID NO: 689777 - DNA, 13 bp, C. elegans
aaattgccacatt

SEQ ID NO: 689778 - DNA, 13 bp, C. elegans
aaattgccagaaa

SEQ ID NO: 689779 - DNA, 13 bp, C. elegans
aaattgcccaaaa

SEQ ID NO: 689780 - DNA, 13 bp, C. elegans
aaattgcccaatt

SEQ ID NO: 689781 - DNA, 13 bp, C. elegans
aaattgcccgaaa

SEQ ID NO: 689782 - DNA, 13 bp, C. elegans
aaattgccgaacg

SEQ ID NO: 689783 - DNA, 13 bp, C. elegans
aaattgccgaatt

SEQ ID NO: 689784 - DNA, 13 bp, C. elegans
aaattgccgagtt

SEQ ID NO: 689785 - DNA, 13 bp, C. elegans
aaattgccgattt

SEQ ID NO: 689786 - DNA, 13 bp, C. elegans
aaattgccgcttt

SEQ ID NO: 689787 - DNA, 13 bp, C. elegans
aaattgccggcat

SEQ ID NO: 689788 - DNA, 13 bp, C. elegans
aaattgccggttt

SEQ ID NO: 689789 - DNA, 13 bp, C. elegans
aaattgcctattt

SEQ ID NO: 689790 - DNA, 13 bp, C. elegans
aaattgcctgaaa

SEQ ID NO: 689791 - DNA, 13 bp, C. elegans
aaattgcctgttt

SEQ ID NO: 689792 - DNA, 13 bp, C. elegans
aaattgccttaaa

SEQ ID NO: 689793 - DNA, 13 bp, C. elegans
aaattgccttttt

SEQ ID NO: 689794 - DNA, 13 bp, C. elegans
aaattgcgaaaac

SEQ ID NO: 689795 - DNA, 13 bp, C. elegans
aaattgcgaaaca

SEQ ID NO: 689796 - DNA, 13 bp, C. elegans
aaattgcgagaat

SEQ ID NO: 689797 - DNA, 13 bp, C. elegans
aaattgcggattt

SEQ ID NO: 689798 - DNA, 13 bp, C. elegans
aaattgcgggaaa

SEQ ID NO: 689799 - DNA, 13 bp, C. elegans
aaattgctaaagt

SEQ ID NO: 689800 - DNA, 13 bp, C. elegans
aaattgctaataa

SEQ ID NO: 689801 - DNA, 13 bp, C. elegans
aaattgctcaaaa

SEQ ID NO: 689802 - DNA, 13 bp, C. elegans
aaattgctcaaat

SEQ ID NO: 689803 - DNA, 13 bp, C. elegans
aaattgctcagaa

SEQ ID NO: 689804 - DNA, 13 bp, C. elegans
aaattgctcattt

SEQ ID NO: 689805 - DNA, 13 bp, C. elegans
aaattgctccaaa

SEQ ID NO: 689806 - DNA, 13 bp, C. elegans
aaattgctgaaaa

SEQ ID NO: 689807 - DNA, 13 bp, C. elegans
aaattgctgaaat

SEQ ID NO: 689808 - DNA, 13 bp, C. elegans
aaattgctgaaca

SEQ ID NO: 689809 - DNA, 13 bp, C. elegans
aaattgctgaatt

SEQ ID NO: 689810 - DNA, 13 bp, C. elegans
aaattgctgattt

SEQ ID NO: 689811 - DNA, 13 bp, C. elegans
aaattgctggaat

SEQ ID NO: 689812 - DNA, 13 bp, C. elegans
aaattgctgtttc

SEQ ID NO: 689813 - DNA, 13 bp, C. elegans
aaattgctgtttt

SEQ ID NO: 689814 - DNA, 13 bp, C. elegans
aaattgcttaaat

SEQ ID NO: 689815 - DNA, 13 bp, C. elegans
aaattgcttattt

SEQ ID NO: 689816 - DNA, 13 bp, C. elegans
aaattgcttcaaa

SEQ ID NO: 689817 - DNA, 13 bp, C. elegans
aaattgcttcttt

SEQ ID NO: 689818 - DNA, 13 bp, C. elegans
aaattgcttgaaa

SEQ ID NO: 689819 - DNA, 13 bp, C. elegans
aaattgcttgaat

SEQ ID NO: 689820 - DNA, 13 bp, C. elegans
aaattgctttaaa

SEQ ID NO: 689821 - DNA, 13 bp, C. elegans
aaattgctttttc

SEQ ID NO: 689822 - DNA, 13 bp, C. elegans
aaattggaaactt

SEQ ID NO: 689823 - DNA, 13 bp, C. elegans
aaattggaaattc

SEQ ID NO: 689824 - DNA, 13 bp, C. elegans
aaattggaacaaa

SEQ ID NO: 689825 - DNA, 13 bp, C. elegans
aaattggaagaag

SEQ ID NO: 689826 - DNA, 13 bp, C. elegans
aaattggaagaat

SEQ ID NO: 689827 - DNA, 13 bp, C. elegans
aaattggaagatt

SEQ ID NO: 689828 - DNA, 13 bp, C. elegans
aaattggaatata

SEQ ID NO: 689829 - DNA, 13 bp, C. elegans
aaattggaatatg

SEQ ID NO: 689830 - DNA, 13 bp, C. elegans
aaattggaatatt

SEQ ID NO: 689831 - DNA, 13 bp, C. elegans
aaattggaatcaa

SEQ ID NO: 689832 - DNA, 13 bp, C. elegans
aaattggaatgtt

SEQ ID NO: 689833 - DNA, 13 bp, C. elegans
aaattggaattaa

SEQ ID NO: 689834 - DNA, 13 bp, C. elegans
aaattggaatttc

SEQ ID NO: 689835 - DNA, 13 bp, C. elegans
aaattggaatttt

SEQ ID NO: 689836 - DNA, 13 bp, C. elegans
aaattggacaatt

SEQ ID NO: 689837 - DNA, 13 bp, C. elegans
aaattggactttt

SEQ ID NO: 689838 - DNA, 13 bp, C. elegans
aaattggagaatt

SEQ ID NO: 689839 - DNA, 13 bp, C. elegans
aaattggagattt

SEQ ID NO: 689840 - DNA, 13 bp, C. elegans
aaattggagcaaa

SEQ ID NO: 689841 - DNA, 13 bp, C. elegans
aaattggagtttt

SEQ ID NO: 689842 - DNA, 13 bp, C. elegans
aaattggataata

SEQ ID NO: 689843 - DNA, 13 bp, C. elegans
aaattggatatat

SEQ ID NO: 689844 - DNA, 13 bp, C. elegans
aaattggatgaaa

SEQ ID NO: 689845 - DNA, 13 bp, C. elegans
aaattggatgatt

SEQ ID NO: 689846 - DNA, 13 bp, C. elegans
aaattggattcaa

SEQ ID NO: 689847 - DNA, 13 bp, C. elegans
aaattggattctt

SEQ ID NO: 689848 - DNA, 13 bp, C. elegans
aaattggatttat

SEQ ID NO: 689849 - DNA, 13 bp, C. elegans
aaattggattttt

SEQ ID NO: 689850 - DNA, 13 bp, C. elegans
aaattggcaaaat

SEQ ID NO: 689851 - DNA, 13 bp, C. elegans
aaattggcaaatt

SEQ ID NO: 689852 - DNA, 13 bp, C. elegans
aaattggcaactt

SEQ ID NO: 689853 - DNA, 13 bp, C. elegans
aaattggcaatgt

SEQ ID NO: 689854 - DNA, 13 bp, C. elegans
aaattggcaattg

SEQ ID NO: 689855 - DNA, 13 bp, C. elegans
aaattggcaattt

SEQ ID NO: 689856 - DNA, 13 bp, C. elegans
aaattggcacaat

SEQ ID NO: 689857 - DNA, 13 bp, C. elegans
aaattggcataat

SEQ ID NO: 689858 - DNA, 13 bp, C. elegans
aaattggcatttg

SEQ ID NO: 689859 - DNA, 13 bp, C. elegans
aaattggcatttt

SEQ ID NO: 689860 - DNA, 13 bp, C. elegans
aaattggcgaatt

SEQ ID NO: 689861 - DNA, 13 bp, C. elegans
aaattggcgattt

SEQ ID NO: 689862 - DNA, 13 bp, C. elegans
aaattggcggaat

SEQ ID NO: 689863 - DNA, 13 bp, C. elegans
aaattggcggttt

SEQ ID NO: 689864 - DNA, 13 bp, C. elegans
aaattggctcaaa

SEQ ID NO: 689865 - DNA, 14 bp, C. elegans
aaattggctccgag

SEQ ID NO: 689866 - DNA, 13 bp, C. elegans
aaattggcttaaa

SEQ ID NO: 689867 - DNA, 13 bp, C. elegans
aaattggctttaa

SEQ ID NO: 689868 - DNA, 13 bp, C. elegans
aaattgggaaagt

SEQ ID NO: 689869 - DNA, 13 bp, C. elegans
aaattgggatatt

SEQ ID NO: 689870 - DNA, 13 bp, C. elegans
aaattgggcaaaa

SEQ ID NO: 689871 - DNA, 13 bp, C. elegans
aaattgggcaaat

SEQ ID NO: 689872 - DNA, 13 bp, C. elegans
aaattggtacttt

SEQ ID NO: 689873 - DNA, 13 bp, C. elegans
aaattggtagaaa

SEQ ID NO: 689874 - DNA, 13 bp, C. elegans
aaattggtagttt

SEQ ID NO: 689875 - DNA, 13 bp, C. elegans
aaattggtatttt

SEQ ID NO: 689876 - DNA, 13 bp, C. elegans
aaattggtcaaaa

SEQ ID NO: 689877 - DNA, 13 bp, C. elegans
aaattggtccaaa

SEQ ID NO: 689878 - DNA, 13 bp, C. elegans
aaattggtgaaat

SEQ ID NO: 689879 - DNA, 13 bp, C. elegans
aaattggtgataa

SEQ ID NO: 689880 - DNA, 13 bp, C. elegans
aaattggtttaaa

SEQ ID NO: 689881 - DNA, 13 bp, C. elegans
aaattggttttat

SEQ ID NO: 689882 - DNA, 13 bp, C. elegans
aaattggttttgt

SEQ ID NO: 689883 - DNA, 13 bp, C. elegans
aaattggttttta

SEQ ID NO: 689884 - DNA, 13 bp, C. elegans
aaattggtttttc

SEQ ID NO: 689885 - DNA, 13 bp, C. elegans
aaattgtaaacta

SEQ ID NO: 689886 - DNA, 13 bp, C. elegans
aaattgtaagatt

SEQ ID NO: 689887 - DNA, 13 bp, C. elegans
aaattgtaattgc

SEQ ID NO: 689888 - DNA, 13 bp, C. elegans
aaattgtaatttc

SEQ ID NO: 689889 - DNA, 13 bp, C. elegans
aaattgtacaaaa

SEQ ID NO: 689890 - DNA, 13 bp, C. elegans
aaattgtacaatt

SEQ ID NO: 689891 - DNA, 13 bp, C. elegans
aaattgtacactt

SEQ ID NO: 689892 - DNA, 13 bp, C. elegans
aaattgtacattt

SEQ ID NO: 689893 - DNA, 13 bp, C. elegans
aaattgtactttt

SEQ ID NO: 689894 - DNA, 13 bp, C. elegans
aaattgtagaaat

SEQ ID NO: 689895 - DNA, 13 bp, C. elegans
aaattgtagaatt

SEQ ID NO: 689896 - DNA, 13 bp, C. elegans
aaattgtagattt

SEQ ID NO: 689897 - DNA, 13 bp, C. elegans
aaattgtagcaaa

SEQ ID NO: 689898 - DNA, 13 bp, C. elegans
aaattgtatgaaa

SEQ ID NO: 689899 - DNA, 13 bp, C. elegans
aaattgtattaca

SEQ ID NO: 689900 - DNA, 13 bp, C. elegans
aaattgtattatg

SEQ ID NO: 689901 - DNA, 13 bp, C. elegans
aaattgtattctg

SEQ ID NO: 689902 - DNA, 13 bp, C. elegans
aaattgtatttca

SEQ ID NO: 689903 - DNA, 13 bp, C. elegans
aaattgtatttct

SEQ ID NO: 689904 - DNA, 13 bp, C. elegans
aaattgtattttg

SEQ ID NO: 689905 - DNA, 13 bp, C. elegans
aaattgtcaaaac

SEQ ID NO: 689906 - DNA, 13 bp, C. elegans
aaattgtcaaaca

SEQ ID NO: 689907 - DNA, 13 bp, C. elegans
aaattgtcaattt

SEQ ID NO: 689908 - DNA, 13 bp, C. elegans
aaattgtcacaaa

SEQ ID NO: 689909 - DNA, 13 bp, C. elegans
aaattgtcacttt

SEQ ID NO: 689910 - DNA, 13 bp, C. elegans
aaattgtcagatt

SEQ ID NO: 689911 - DNA, 13 bp, C. elegans
aaattgtcagcaa

SEQ ID NO: 689912 - DNA, 13 bp, C. elegans
aaattgtcagttt

SEQ ID NO: 689913 - DNA, 13 bp, C. elegans
aaattgtcatgtt

SEQ ID NO: 689914 - DNA, 13 bp, C. elegans
aaattgtcatttt

SEQ ID NO: 689915 - DNA, 13 bp, C. elegans
aaattgtccaaaa

SEQ ID NO: 689916 - DNA, 13 bp, C. elegans
aaattgtccattt

SEQ ID NO: 689917 - DNA, 15 bp, C. elegans
aaattgtccctcaca

SEQ ID NO: 689918 - DNA, 13 bp, C. elegans
aaattgtcgaaaa

SEQ ID NO: 689919 - DNA, 13 bp, C. elegans
aaattgtcgaatt

SEQ ID NO: 689920 - DNA, 13 bp, C. elegans
aaattgtcgattg

SEQ ID NO: 689921 - DNA, 13 bp, C. elegans
aaattgtcggatt

SEQ ID NO: 689922 - DNA, 13 bp, C. elegans
aaattgtcgtgcc

SEQ ID NO: 689923 - DNA, 13 bp, C. elegans
aaattgtcgtttt

SEQ ID NO: 689924 - DNA, 13 bp, C. elegans
aaattgtctaaaa

SEQ ID NO: 689925 - DNA, 13 bp, C. elegans
aaattgtctaaat

SEQ ID NO: 689926 - DNA, 13 bp, C. elegans
aaattgtctgaaa

SEQ ID NO: 689927 - DNA, 13 bp, C. elegans
aaattgtctggaa

SEQ ID NO: 689928 - DNA, 13 bp, C. elegans
aaattgtctgtaa

SEQ ID NO: 689929 - DNA, 13 bp, C. elegans
aaattgtcttaaa

SEQ ID NO: 689930 - DNA, 13 bp, C. elegans
aaattgtcttctt

SEQ ID NO: 689931 - DNA, 13 bp, C. elegans
aaattgtctttat

SEQ ID NO: 689932 - DNA, 13 bp, C. elegans
aaattgtctttta

SEQ ID NO: 689933 - DNA, 14 bp, C. elegans
aaattgtgaaaatt

SEQ ID NO: 689934 - DNA, 13 bp, C. elegans
aaattgtgaaatt

SEQ ID NO: 689935 - DNA, 13 bp, C. elegans
aaattgtgaataa

SEQ ID NO: 689936 - DNA, 13 bp, C. elegans
aaattgtgaatta

SEQ ID NO: 689937 - DNA, 13 bp, C. elegans
aaattgtgaattc

SEQ ID NO: 689938 - DNA, 13 bp, C. elegans
aaattgtgacaaa

SEQ ID NO: 689939 - DNA, 13 bp, C. elegans
aaattgtgataaa

SEQ ID NO: 689940 - DNA, 13 bp, C. elegans
aaattgtgataat

SEQ ID NO: 689941 - DNA, 13 bp, C. elegans
aaattgtgattga

SEQ ID NO: 689942 - DNA, 13 bp, C. elegans
aaattgtgatttt

SEQ ID NO: 689943 - DNA, 13 bp, C. elegans
aaattgtgcaaaa

SEQ ID NO: 689944 - DNA, 13 bp, C. elegans
aaattgtgcagtt

SEQ ID NO: 689945 - DNA, 13 bp, C. elegans
aaattgtgccaaa

SEQ ID NO: 689946 - DNA, 13 bp, C. elegans
aaattgtgctaaa

SEQ ID NO: 689947 - DNA, 13 bp, C. elegans
aaattgtgctcaa

SEQ ID NO: 689948 - DNA, 13 bp, C. elegans
aaattgtggaatt

SEQ ID NO: 689949 - DNA, 13 bp, C. elegans
aaattgtggagaa

SEQ ID NO: 689950 - DNA, 13 bp, C. elegans
aaattgtggattt

SEQ ID NO: 689951 - DNA, 13 bp, C. elegans
aaattgtgtaaat

SEQ ID NO: 689952 - DNA, 13 bp, C. elegans
aaattgtgtactt

SEQ ID NO: 689953 - DNA, 13 bp, C. elegans
aaattgtgtgaaa

SEQ ID NO: 689954 - DNA, 13 bp, C. elegans
aaattgtgttctg

SEQ ID NO: 689955 - DNA, 13 bp, C. elegans
aaattgtgttgta

SEQ ID NO: 689956 - DNA, 13 bp, C. elegans
aaattgtgtttga

SEQ ID NO: 689957 - DNA, 13 bp, C. elegans
aaattgtgttttc

SEQ ID NO: 689958 - DNA, 13 bp, C. elegans
aaattgttaattg

SEQ ID NO: 689959 - DNA, 13 bp, C. elegans
aaattgttagttt

SEQ ID NO: 689960 - DNA, 13 bp, C. elegans
aaattgttataga

SEQ ID NO: 689961 - DNA, 13 bp, C. elegans
aaattgttcaaaa

SEQ ID NO: 689962 - DNA, 13 bp, C. elegans
aaattgttcaaat

SEQ ID NO: 689963 - DNA, 13 bp, C. elegans
aaattgttcaaca

SEQ ID NO: 689964 - DNA, 13 bp, C. elegans
aaattgttcaatt

SEQ ID NO: 689965 - DNA, 13 bp, C. elegans
aaattgttcacaa

SEQ ID NO: 689966 - DNA, 13 bp, C. elegans
aaattgttcacat

SEQ ID NO: 689967 - DNA, 13 bp, C. elegans
aaattgttcactt

SEQ ID NO: 689968 - DNA, 13 bp, C. elegans
aaattgttcatat

SEQ ID NO: 689969 - DNA, 13 bp, C. elegans
aaattgttcatga

SEQ ID NO: 689970 - DNA, 13 bp, C. elegans
aaattgttcattt

SEQ ID NO: 689971 - DNA, 13 bp, C. elegans
aaattgttcgaat

SEQ ID NO: 689972 - DNA, 13 bp, C. elegans
aaattgttcgttt

SEQ ID NO: 689973 - DNA, 13 bp, C. elegans
aaattgttctcaa

SEQ ID NO: 689974 - DNA, 13 bp, C. elegans
aaattgttctcag

SEQ ID NO: 689975 - DNA, 13 bp, C. elegans
aaattgttctctg

SEQ ID NO: 689976 - DNA, 13 bp, C. elegans
aaattgttctgaa

SEQ ID NO: 689977 - DNA, 13 bp, C. elegans
aaattgttcttca

SEQ ID NO: 689978 - DNA, 13 bp, C. elegans
aaattgttcttta

SEQ ID NO: 689979 - DNA, 13 bp, C. elegans
aaattgttctttc

SEQ ID NO: 689980 - DNA, 13 bp, C. elegans
aaattgttctttg

SEQ ID NO: 689981 - DNA, 13 bp, C. elegans
aaattgttgaaaa

SEQ ID NO: 689982 - DNA, 13 bp, C. elegans
aaattgttgaaat

SEQ ID NO: 689983 - DNA, 13 bp, C. elegans
aaattgttgaaca

SEQ ID NO: 689984 - DNA, 13 bp, C. elegans
aaattgttgagaa

SEQ ID NO: 689985 - DNA, 13 bp, C. elegans
aaattgttgattt

SEQ ID NO: 689986 - DNA, 13 bp, C. elegans
aaattgttgcaaa

SEQ ID NO: 689987 - DNA, 13 bp, C. elegans
aaattgttggaaa

SEQ ID NO: 689988 - DNA, 13 bp, C. elegans
aaattgttggatt

SEQ ID NO: 689989 - DNA, 13 bp, C. elegans
aaattgttgtaaa

SEQ ID NO: 689990 - DNA, 13 bp, C. elegans
aaattgttgtgtt

SEQ ID NO: 689991 - DNA, 13 bp, C. elegans
aaattgttgtttc

SEQ ID NO: 689992 - DNA, 13 bp, C. elegans
aaattgtttagaa

SEQ ID NO: 689993 - DNA, 13 bp, C. elegans
aaattgtttattc

SEQ ID NO: 689994 - DNA, 13 bp, C. elegans
aaattgtttcaaa

SEQ ID NO: 689995 - DNA, 14 bp, C. elegans
aaattgtttcaaaa

SEQ ID NO: 689996 - DNA, 13 bp, C. elegans
aaattgtttcata

SEQ ID NO: 689997 - DNA, 13 bp, C. elegans
aaattgtttccag

SEQ ID NO: 689998 - DNA, 13 bp, C. elegans
aaattgtttccta

SEQ ID NO: 689999 - DNA, 13 bp, C. elegans
aaattgtttctat

SEQ ID NO: 690000 - DNA, 13 bp, C. elegans
aaattgtttgaaa

SEQ ID NO: 690001 - DNA, 13 bp, C. elegans
aaattgtttgata

SEQ ID NO: 690002 - DNA, 13 bp, C. elegans
aaattgtttgatc

SEQ ID NO: 690003 - DNA, 13 bp, C. elegans
aaattgttttact

SEQ ID NO: 690004 - DNA, 13 bp, C. elegans
aaattgttttagc

SEQ ID NO: 690005 - DNA, 13 bp, C. elegans
aaattgttttatc

SEQ ID NO: 690006 - DNA, 13 bp, C. elegans
aaattgttttcca

SEQ ID NO: 690007 - DNA, 13 bp, C. elegans
aaattgttttcta

SEQ ID NO: 690008 - DNA, 13 bp, C. elegans
aaattgttttctg

SEQ ID NO: 690009 - DNA, 13 bp, C. elegans
aaattgttttgat

SEQ ID NO: 690010 - DNA, 13 bp, C. elegans
aaattgttttgga

SEQ ID NO: 690011 - DNA, 13 bp, C. elegans
aaattgttttgta

SEQ ID NO: 690012 - DNA, 13 bp, C. elegans
aaatttaaaagct

SEQ ID NO: 690013 - DNA, 13 bp, C. elegans
aaatttaaacaga

SEQ ID NO: 690014 - DNA, 13 bp, C. elegans
aaatttaaacgaa

SEQ ID NO: 690015 - DNA, 13 bp, C. elegans
aaatttaaacttc

SEQ ID NO: 690016 - DNA, 13 bp, C. elegans
aaatttaacagtt

SEQ ID NO: 690017 - DNA, 13 bp, C. elegans
aaatttaactcaa

SEQ ID NO: 690018 - DNA, 13 bp, C. elegans
aaatttaactgtt

SEQ ID NO: 690019 - DNA, 13 bp, C. elegans
aaatttaatgcaa

SEQ ID NO: 690020 - DNA, 13 bp, C. elegans
aaatttaattctg

SEQ ID NO: 690021 - DNA, 13 bp, C. elegans
aaatttaatttcc

SEQ ID NO: 690022 - DNA, 13 bp, C. elegans
aaatttacagaaa

SEQ ID NO: 690023 - DNA, 13 bp, C. elegans
aaatttacagtaa

SEQ ID NO: 690024 - DNA, 13 bp, C. elegans
aaatttacatttc

SEQ ID NO: 690025 - DNA, 13 bp, C. elegans
aaatttacccaaa

SEQ ID NO: 690026 - DNA, 13 bp, C. elegans
aaatttaccgaat

SEQ ID NO: 690027 - DNA, 13 bp, C. elegans
aaatttacgattt

SEQ ID NO: 690028 - DNA, 13 bp, C. elegans
aaatttacggaaa

SEQ ID NO: 690029 - DNA, 13 bp, C. elegans
aaatttacggttt

SEQ ID NO: 690030 - DNA, 13 bp, C. elegans
aaatttactgttt

SEQ ID NO: 690031 - DNA, 13 bp, C. elegans
aaatttagaatca

SEQ ID NO: 690032 - DNA, 13 bp, C. elegans
aaatttagacttt

SEQ ID NO: 690033 - DNA, 13 bp, C. elegans
aaatttagcactt

SEQ ID NO: 690034 - DNA, 13 bp, C. elegans
aaatttagctcaa

SEQ ID NO: 690035 - DNA, 13 bp, C. elegans
aaatttagcttaa

SEQ ID NO: 690036 - DNA, 13 bp, C. elegans
aaatttaggtcaa

SEQ ID NO: 690037 - DNA, 13 bp, C. elegans
aaatttaggtttt

SEQ ID NO: 690038 - DNA, 13 bp, C. elegans
aaatttagtgact

SEQ ID NO: 690039 - DNA, 13 bp, C. elegans
aaatttataggaa

SEQ ID NO: 690040 - DNA, 13 bp, C. elegans
aaatttatcaaag

SEQ ID NO: 690041 - DNA, 13 bp, C. elegans
aaatttatcactt

SEQ ID NO: 690042 - DNA, 13 bp, C. elegans
aaatttatcagaa

SEQ ID NO: 690043 - DNA, 13 bp, C. elegans
aaatttatcatca

SEQ ID NO: 690044 - DNA, 13 bp, C. elegans
aaatttatcatga

SEQ ID NO: 690045 - DNA, 13 bp, C. elegans
aaatttatccaaa

SEQ ID NO: 690046 - DNA, 13 bp, C. elegans
aaatttatcgaaa

SEQ ID NO: 690047 - DNA, 13 bp, C. elegans
aaatttatcgaat

SEQ ID NO: 690048 - DNA, 14 bp, C. elegans
aaatttatcgattt

SEQ ID NO: 690049 - DNA, 13 bp, C. elegans
aaatttatcgcaa

SEQ ID NO: 690050 - DNA, 13 bp, C. elegans
aaatttatgagaa

SEQ ID NO: 690051 - DNA, 13 bp, C. elegans
aaatttatgcatt

SEQ ID NO: 690052 - DNA, 13 bp, C. elegans
aaatttatggaaa

SEQ ID NO: 690053 - DNA, 13 bp, C. elegans
aaatttatgtgca

SEQ ID NO: 690054 - DNA, 13 bp, C. elegans
aaatttattagct

SEQ ID NO: 690055 - DNA, 13 bp, C. elegans
aaatttattatcg

SEQ ID NO: 690056 - DNA, 13 bp, C. elegans
aaatttattcgaa

SEQ ID NO: 690057 - DNA, 13 bp, C. elegans
aaatttattgcaa

SEQ ID NO: 690058 - DNA, 13 bp, C. elegans
aaatttattggaa

SEQ ID NO: 690059 - DNA, 13 bp, C. elegans
aaatttattgtga

SEQ ID NO: 690060 - DNA, 13 bp, C. elegans
aaatttatttcag

SEQ ID NO: 690061 - DNA, 13 bp, C. elegans
aaatttcaaaaag

SEQ ID NO: 690062 - DNA, 13 bp, C. elegans
aaatttcaaactg

SEQ ID NO: 690063 - DNA, 13 bp, C. elegans
aaatttcaaagaa

SEQ ID NO: 690064 - DNA, 13 bp, C. elegans
aaatttcaaagct

SEQ ID NO: 690065 - DNA, 13 bp, C. elegans
aaatttcaaatcg

SEQ ID NO: 690066 - DNA, 13 bp, C. elegans
aaatttcaaatgt

SEQ ID NO: 690067 - DNA, 13 bp, C. elegans
aaatttcaaattg

SEQ ID NO: 690068 - DNA, 13 bp, C. elegans
aaatttcaacaga

SEQ ID NO: 690069 - DNA, 13 bp, C. elegans
aaatttcaacatt

SEQ ID NO: 690070 - DNA, 13 bp, C. elegans
aaatttcaacgtt

SEQ ID NO: 690071 - DNA, 13 bp, C. elegans
aaatttcaactct

SEQ ID NO: 690072 - DNA, 13 bp, C. elegans
aaatttcaacttt

SEQ ID NO: 690073 - DNA, 13 bp, C. elegans
aaatttcaagaaa

SEQ ID NO: 690074 - DNA, 13 bp, C. elegans
aaatttcaagcaa

SEQ ID NO: 690075 - DNA, 13 bp, C. elegans
aaatttcaagtta

SEQ ID NO: 690076 - DNA, 13 bp, C. elegans
aaatttcaagttt

SEQ ID NO: 690077 - DNA, 13 bp, C. elegans
aaatttcaatcat

SEQ ID NO: 690078 - DNA, 13 bp, C. elegans
aaatttcaatcta

SEQ ID NO: 690079 - DNA, 13 bp, C. elegans
aaatttcaatgaa

SEQ ID NO: 690080 - DNA, 13 bp, C. elegans
aaatttcaattac

SEQ ID NO: 690081 - DNA, 13 bp, C. elegans
aaatttcaattca

SEQ ID NO: 690082 - DNA, 13 bp, C. elegans
aaatttcaattct

SEQ ID NO: 690083 - DNA, 13 bp, C. elegans
aaatttcaatttc

SEQ ID NO: 690084 - DNA, 13 bp, C. elegans
aaatttcacagtt

SEQ ID NO: 690085 - DNA, 13 bp, C. elegans
aaatttcacattt

SEQ ID NO: 690086 - DNA, 13 bp, C. elegans
aaatttcactgaa

SEQ ID NO: 690087 - DNA, 13 bp, C. elegans
aaatttcacttca

SEQ ID NO: 690088 - DNA, 13 bp, C. elegans
aaatttcacttct

SEQ ID NO: 690089 - DNA, 13 bp, C. elegans
aaatttcagaaaa

SEQ ID NO: 690090 - DNA, 13 bp, C. elegans
aaatttcagaatt

SEQ ID NO: 690091 - DNA, 13 bp, C. elegans
aaatttcagactc

SEQ ID NO: 690092 - DNA, 13 bp, C. elegans
aaatttcagagtt

SEQ ID NO: 690093 - DNA, 13 bp, C. elegans
aaatttcagccaa

SEQ ID NO: 690094 - DNA, 13 bp, C. elegans
aaatttcaggaaa

SEQ ID NO: 690095 - DNA, 13 bp, C. elegans
aaatttcaggcaa

SEQ ID NO: 690096 - DNA, 13 bp, C. elegans
aaatttcagggtt

SEQ ID NO: 690097 - DNA, 13 bp, C. elegans
aaatttcaggttt

SEQ ID NO: 690098 - DNA, 13 bp, C. elegans
aaatttcagtcaa

SEQ ID NO: 690099 - DNA, 13 bp, C. elegans
aaatttcagtcgg

SEQ ID NO: 690100 - DNA, 13 bp, C. elegans
aaatttcagtttt

SEQ ID NO: 690101 - DNA, 13 bp, C. elegans
aaatttcatatca

SEQ ID NO: 690102 - DNA, 13 bp, C. elegans
aaatttcatgaaa

SEQ ID NO: 690103 - DNA, 13 bp, C. elegans
aaatttcatgaga

SEQ ID NO: 690104 - DNA, 13 bp, C. elegans
aaatttcatgatt

SEQ ID NO: 690105 - DNA, 13 bp, C. elegans
aaatttcatggtt

SEQ ID NO: 690106 - DNA, 13 bp, C. elegans
aaatttcatgtaa

SEQ ID NO: 690107 - DNA, 13 bp, C. elegans
aaatttcatgttt

SEQ ID NO: 690108 - DNA, 13 bp, C. elegans
aaatttcattcat

SEQ ID NO: 690109 - DNA, 13 bp, C. elegans
aaatttcattgtt

SEQ ID NO: 690110 - DNA, 13 bp, C. elegans
aaatttcatttca

SEQ ID NO: 690111 - DNA, 13 bp, C. elegans
aaatttcatttgt

SEQ ID NO: 690112 - DNA, 13 bp, C. elegans
aaatttcattttc

SEQ ID NO: 690113 - DNA, 13 bp, C. elegans
aaatttccaaaac

SEQ ID NO: 690114 - DNA, 13 bp, C. elegans
aaatttccaaaat

SEQ ID NO: 690115 - DNA, 13 bp, C. elegans
aaatttccaaact

SEQ ID NO: 690116 - DNA, 13 bp, C. elegans
aaatttccaaata

SEQ ID NO: 690117 - DNA, 13 bp, C. elegans
aaatttccaagaa

SEQ ID NO: 690118 - DNA, 13 bp, C. elegans
aaatttccaagtt

SEQ ID NO: 690119 - DNA, 13 bp, C. elegans
aaatttccaattc

SEQ ID NO: 690120 - DNA, 13 bp, C. elegans
aaatttccaattt

SEQ ID NO: 690121 - DNA, 13 bp, C. elegans
aaatttccacaat

SEQ ID NO: 690122 - DNA, 13 bp, C. elegans
aaatttccactga

SEQ ID NO: 690123 - DNA, 13 bp, C. elegans
aaatttccagaaa

SEQ ID NO: 690124 - DNA, 13 bp, C. elegans
aaatttccagaat

SEQ ID NO: 690125 - DNA, 13 bp, C. elegans
aaatttccagact

SEQ ID NO: 690126 - DNA, 13 bp, C. elegans
aaatttccagttt

SEQ ID NO: 690127 - DNA, 13 bp, C. elegans
aaatttccatgtt

SEQ ID NO: 690128 - DNA, 13 bp, C. elegans
aaatttccatttt

SEQ ID NO: 690129 - DNA, 13 bp, C. elegans
aaatttcccaatt

SEQ ID NO: 690130 - DNA, 13 bp, C. elegans
aaatttccgactt

SEQ ID NO: 690131 - DNA, 13 bp, C. elegans
aaatttccgagaa

SEQ ID NO: 690132 - DNA, 13 bp, C. elegans
aaatttccgattt

SEQ ID NO: 690133 - DNA, 13 bp, C. elegans
aaatttccgcaaa

SEQ ID NO: 690134 - DNA, 13 bp, C. elegans
aaatttccggcaa

SEQ ID NO: 690135 - DNA, 13 bp, C. elegans
aaatttccggtaa

SEQ ID NO: 690136 - DNA, 13 bp, C. elegans
aaatttccggttt

SEQ ID NO: 690137 - DNA, 13 bp, C. elegans
aaatttcctattt

SEQ ID NO: 690138 - DNA, 13 bp, C. elegans
aaatttcctgaaa

SEQ ID NO: 690139 - DNA, 13 bp, C. elegans
aaatttcctgttt

SEQ ID NO: 690140 - DNA, 13 bp, C. elegans
aaatttccttcaa

SEQ ID NO: 690141 - DNA, 13 bp, C. elegans
aaatttcgaaaaa

SEQ ID NO: 690142 - DNA, 13 bp, C. elegans
aaatttcgaaaag

SEQ ID NO: 690143 - DNA, 13 bp, C. elegans
aaatttcgaaaat

SEQ ID NO: 690144 - DNA, 13 bp, C. elegans
aaatttcgaaact

SEQ ID NO: 690145 - DNA, 13 bp, C. elegans
aaatttcgaaatt

SEQ ID NO: 690146 - DNA, 13 bp, C. elegans
aaatttcgaacgg

SEQ ID NO: 690147 - DNA, 13 bp, C. elegans
aaatttcgaagaa

SEQ ID NO: 690148 - DNA, 13 bp, C. elegans
aaatttcgaatca

SEQ ID NO: 690149 - DNA, 13 bp, C. elegans
aaatttcgaatta

SEQ ID NO: 690150 - DNA, 13 bp, C. elegans
aaatttcgaattt

SEQ ID NO: 690151 - DNA, 13 bp, C. elegans
aaatttcgagaaa

SEQ ID NO: 690152 - DNA, 13 bp, C. elegans
aaatttcgaggtc

SEQ ID NO: 690153 - DNA, 13 bp, C. elegans
aaatttcgagttt

SEQ ID NO: 690154 - DNA, 13 bp, C. elegans
aaatttcgatgga

SEQ ID NO: 690155 - DNA, 13 bp, C. elegans
aaatttcgattcc

SEQ ID NO: 690156 - DNA, 13 bp, C. elegans
aaatttcgatttt

SEQ ID NO: 690157 - DNA, 13 bp, C. elegans
aaatttcgcgaaa

SEQ ID NO: 690158 - DNA, 13 bp, C. elegans
aaatttcgctaaa

SEQ ID NO: 690159 - DNA, 13 bp, C. elegans
aaatttcggaaaa

SEQ ID NO: 690160 - DNA, 13 bp, C. elegans
aaatttcggcaat

SEQ ID NO: 690161 - DNA, 13 bp, C. elegans
aaatttcgtaaat

SEQ ID NO: 690162 - DNA, 13 bp, C. elegans
aaatttcgtcgaa

SEQ ID NO: 690163 - DNA, 13 bp, C. elegans
aaatttcgtgtaa

SEQ ID NO: 690164 - DNA, 13 bp, C. elegans
aaatttcgttcaa

SEQ ID NO: 690165 - DNA, 13 bp, C. elegans
aaatttctaaagt

SEQ ID NO: 690166 - DNA, 13 bp, C. elegans
aaatttctaagat

SEQ ID NO: 690167 - DNA, 13 bp, C. elegans
aaatttctatgaa

SEQ ID NO: 690168 - DNA, 13 bp, C. elegans
aaatttctattca

SEQ ID NO: 690169 - DNA, 13 bp, C. elegans
aaatttctcaatt

SEQ ID NO: 690170 - DNA, 13 bp, C. elegans
aaatttctcataa

SEQ ID NO: 690171 - DNA, 13 bp, C. elegans
aaatttctcgaac

SEQ ID NO: 690172 - DNA, 13 bp, C. elegans
aaatttctcgatt

SEQ ID NO: 690173 - DNA, 13 bp, C. elegans
aaatttctctaat

SEQ ID NO: 690174 - DNA, 13 bp, C. elegans
aaatttctctcaa

SEQ ID NO: 690175 - DNA, 13 bp, C. elegans
aaatttctgaaaa

SEQ ID NO: 690176 - DNA, 13 bp, C. elegans
aaatttctgacaa

SEQ ID NO: 690177 - DNA, 13 bp, C. elegans
aaatttctgactg

SEQ ID NO: 690178 - DNA, 13 bp, C. elegans
aaatttctgagaa

SEQ ID NO: 690179 - DNA, 13 bp, C. elegans
aaatttctgataa

SEQ ID NO: 690180 - DNA, 13 bp, C. elegans
aaatttctgcaat

SEQ ID NO: 690181 - DNA, 13 bp, C. elegans
aaatttctggcaa

SEQ ID NO: 690182 - DNA, 13 bp, C. elegans
aaatttctgtttt

SEQ ID NO: 690183 - DNA, 13 bp, C. elegans
aaatttcttacag

SEQ ID NO: 690184 - DNA, 13 bp, C. elegans
aaatttcttcaaa

SEQ ID NO: 690185 - DNA, 13 bp, C. elegans
aaatttcttcaat

SEQ ID NO: 690186 - DNA, 13 bp, C. elegans
aaatttcttcaga

SEQ ID NO: 690187 - DNA, 13 bp, C. elegans
aaatttcttccaa

SEQ ID NO: 690188 - DNA, 13 bp, C. elegans
aaatttcttgaaa

SEQ ID NO: 690189 - DNA, 13 bp, C. elegans
aaatttcttggaa

SEQ ID NO: 690190 - DNA, 13 bp, C. elegans
aaatttctttcta

SEQ ID NO: 690191 - DNA, 13 bp, C. elegans
aaatttgaaaaca

SEQ ID NO: 690192 - DNA, 13 bp, C. elegans
aaatttgaaaacc

SEQ ID NO: 690193 - DNA, 13 bp, C. elegans
aaatttgaaaact

SEQ ID NO: 690194 - DNA, 13 bp, C. elegans
aaatttgaaaatc

SEQ ID NO: 690195 - DNA, 13 bp, C. elegans
aaatttgaaacaa

SEQ ID NO: 690196 - DNA, 13 bp, C. elegans
aaatttgaaacat

SEQ ID NO: 690197 - DNA, 13 bp, C. elegans
aaatttgaaacta

SEQ ID NO: 690198 - DNA, 13 bp, C. elegans
aaatttgaaactc

SEQ ID NO: 690199 - DNA, 13 bp, C. elegans
aaatttgaaactt

SEQ ID NO: 690200 - DNA, 13 bp, C. elegans
aaatttgaaagat

SEQ ID NO: 690201 - DNA, 13 bp, C. elegans
aaatttgaaagta

SEQ ID NO: 690202 - DNA, 13 bp, C. elegans
aaatttgaaagtc

SEQ ID NO: 690203 - DNA, 13 bp, C. elegans
aaatttgaaagtt

SEQ ID NO: 690204 - DNA, 13 bp, C. elegans
aaatttgaaattg

SEQ ID NO: 690205 - DNA, 13 bp, C. elegans
aaatttgaactca

SEQ ID NO: 690206 - DNA, 13 bp, C. elegans
aaatttgaactgt

SEQ ID NO: 690207 - DNA, 13 bp, C. elegans
aaatttgaacttt

SEQ ID NO: 690208 - DNA, 13 bp, C. elegans
aaatttgaagcta

SEQ ID NO: 690209 - DNA, 13 bp, C. elegans
aaatttgaagtat

SEQ ID NO: 690210 - DNA, 13 bp, C. elegans
aaatttgaagtca

SEQ ID NO: 690211 - DNA, 13 bp, C. elegans
aaatttgaattca

SEQ ID NO: 690212 - DNA, 13 bp, C. elegans
aaatttgaattcc

SEQ ID NO: 690213 - DNA, 13 bp, C. elegans
aaatttgaattct

SEQ ID NO: 690214 - DNA, 13 bp, C. elegans
aaatttgacaaaa

SEQ ID NO: 690215 - DNA, 13 bp, C. elegans
aaatttgacaata

SEQ ID NO: 690216 - DNA, 13 bp, C. elegans
aaatttgacaatt

SEQ ID NO: 690217 - DNA, 13 bp, C. elegans
aaatttgacgatt

SEQ ID NO: 690218 - DNA, 13 bp, C. elegans
aaatttgactact

SEQ ID NO: 690219 - DNA, 13 bp, C. elegans
aaatttgactgca

SEQ ID NO: 690220 - DNA, 13 bp, C. elegans
aaatttgagaaac

SEQ ID NO: 690221 - DNA, 13 bp, C. elegans
aaatttgagaaat

SEQ ID NO: 690222 - DNA, 13 bp, C. elegans
aaatttgagaaga

SEQ ID NO: 690223 - DNA, 13 bp, C. elegans
aaatttgagaatt

SEQ ID NO: 690224 - DNA, 13 bp, C. elegans
aaatttgagatta

SEQ ID NO: 690225 - DNA, 13 bp, C. elegans
aaatttgagattc

SEQ ID NO: 690226 - DNA, 13 bp, C. elegans
aaatttgagattg

SEQ ID NO: 690227 - DNA, 13 bp, C. elegans
aaatttgagattt

SEQ ID NO: 690228 - DNA, 13 bp, C. elegans
aaatttgaggaaa

SEQ ID NO: 690229 - DNA, 13 bp, C. elegans
aaatttgagtatt

SEQ ID NO: 690230 - DNA, 13 bp, C. elegans
aaatttgagttca

SEQ ID NO: 690231 - DNA, 13 bp, C. elegans
aaatttgagtttc

SEQ ID NO: 690232 - DNA, 13 bp, C. elegans
aaatttgataact

SEQ ID NO: 690233 - DNA, 13 bp, C. elegans
aaatttgatagtt

SEQ ID NO: 690234 - DNA, 13 bp, C. elegans
aaatttgatattc

SEQ ID NO: 690235 - DNA, 13 bp, C. elegans
aaatttgatcaaa

SEQ ID NO: 690236 - DNA, 13 bp, C. elegans
aaatttgatcaca

SEQ ID NO: 690237 - DNA, 13 bp, C. elegans
aaatttgatccaa

SEQ ID NO: 690238 - DNA, 13 bp, C. elegans
aaatttgatctga

SEQ ID NO: 690239 - DNA, 13 bp, C. elegans
aaatttgattact

SEQ ID NO: 690240 - DNA, 13 bp, C. elegans
aaatttgcaaatt

SEQ ID NO: 690241 - DNA, 13 bp, C. elegans
aaatttgcaattg

SEQ ID NO: 690242 - DNA, 13 bp, C. elegans
aaatttgcacaat

SEQ ID NO: 690243 - DNA, 13 bp, C. elegans
aaatttgcatttt

SEQ ID NO: 690244 - DNA, 13 bp, C. elegans
aaatttgccaaaa

SEQ ID NO: 690245 - DNA, 13 bp, C. elegans
aaatttgccaaat

SEQ ID NO: 690246 - DNA, 13 bp, C. elegans
aaatttgccattt

SEQ ID NO: 690247 - DNA, 13 bp, C. elegans
aaatttgccgaac

SEQ ID NO: 690248 - DNA, 13 bp, C. elegans
aaatttgccgagc

SEQ ID NO: 690249 - DNA, 13 bp, C. elegans
aaatttgcctgaa

SEQ ID NO: 690250 - DNA, 13 bp, C. elegans
aaatttgcgattt

SEQ ID NO: 690251 - DNA, 13 bp, C. elegans
aaatttgcggcaa

SEQ ID NO: 690252 - DNA, 13 bp, C. elegans
aaatttgctagtt

SEQ ID NO: 690253 - DNA, 13 bp, C. elegans
aaatttgctccaa

SEQ ID NO: 690254 - DNA, 13 bp, C. elegans
aaatttgctgaaa

SEQ ID NO: 690255 - DNA, 13 bp, C. elegans
aaatttgctgaat

SEQ ID NO: 690256 - DNA, 13 bp, C. elegans
aaatttgctgtaa

SEQ ID NO: 690257 - DNA, 13 bp, C. elegans
aaatttggaaaat

SEQ ID NO: 690258 - DNA, 13 bp, C. elegans
aaatttggaacaa

SEQ ID NO: 690259 - DNA, 13 bp, C. elegans
aaatttggaatat

SEQ ID NO: 690260 - DNA, 13 bp, C. elegans
aaatttggaattc

SEQ ID NO: 690261 - DNA, 13 bp, C. elegans
aaatttggaattt

SEQ ID NO: 690262 - DNA, 13 bp, C. elegans
aaatttggacaaa

SEQ ID NO: 690263 - DNA, 13 bp, C. elegans
aaatttggagaaa

SEQ ID NO: 690264 - DNA, 13 bp, C. elegans
aaatttggagaat

SEQ ID NO: 690265 - DNA, 13 bp, C. elegans
aaatttggagcaa

SEQ ID NO: 690266 - DNA, 13 bp, C. elegans
aaatttggagttt

SEQ ID NO: 690267 - DNA, 13 bp, C. elegans
aaatttggatcaa

SEQ ID NO: 690268 - DNA, 13 bp, C. elegans
aaatttggatctt

SEQ ID NO: 690269 - DNA, 13 bp, C. elegans
aaatttggattca

SEQ ID NO: 690270 - DNA, 13 bp, C. elegans
aaatttggatttc

SEQ ID NO: 690271 - DNA, 13 bp, C. elegans
aaatttggatttt

SEQ ID NO: 690272 - DNA, 13 bp, C. elegans
aaatttggcaaat

SEQ ID NO: 690273 - DNA, 13 bp, C. elegans
aaatttggcagga

SEQ ID NO: 690274 - DNA, 13 bp, C. elegans
aaatttggcattt

SEQ ID NO: 690275 - DNA, 13 bp, C. elegans
aaatttggctgaa

SEQ ID NO: 690276 - DNA, 13 bp, C. elegans
aaatttgggagaa

SEQ ID NO: 690277 - DNA, 13 bp, C. elegans
aaatttgggccaa

SEQ ID NO: 690278 - DNA, 13 bp, C. elegans
aaatttgggtttt

SEQ ID NO: 690279 - DNA, 13 bp, C. elegans
aaatttggtaact

SEQ ID NO: 690280 - DNA, 13 bp, C. elegans
aaatttggtatat

SEQ ID NO: 690281 - DNA, 13 bp, C. elegans
aaatttggtatta

SEQ ID NO: 690282 - DNA, 13 bp, C. elegans
aaatttggtcaat

SEQ ID NO: 690283 - DNA, 13 bp, C. elegans
aaatttggtggaa

SEQ ID NO: 690284 - DNA, 13 bp, C. elegans
aaatttggtttct

SEQ ID NO: 690285 - DNA, 13 bp, C. elegans
aaatttgtaattc

SEQ ID NO: 690286 - DNA, 13 bp, C. elegans
aaatttgtacgaa

SEQ ID NO: 690287 - DNA, 13 bp, C. elegans
aaatttgtaggaa

SEQ ID NO: 690288 - DNA, 13 bp, C. elegans
aaatttgtagtta

SEQ ID NO: 690289 - DNA, 13 bp, C. elegans
aaatttgtatgta

SEQ ID NO: 690290 - DNA, 13 bp, C. elegans
aaatttgtcaaaa

SEQ ID NO: 690291 - DNA, 13 bp, C. elegans
aaatttgtcaaat

SEQ ID NO: 690292 - DNA, 13 bp, C. elegans
aaatttgtcaatt

SEQ ID NO: 690293 - DNA, 13 bp, C. elegans
aaatttgtcagaa

SEQ ID NO: 690294 - DNA, 13 bp, C. elegans
aaatttgtcattt

SEQ ID NO: 690295 - DNA, 13 bp, C. elegans
aaatttgtcgaaa

SEQ ID NO: 690296 - DNA, 13 bp, C. elegans
aaatttgtcgaat

SEQ ID NO: 690297 - DNA, 13 bp, C. elegans
aaatttgtcgatt

SEQ ID NO: 690298 - DNA, 13 bp, C. elegans
aaatttgtcgcgt

SEQ ID NO: 690299 - DNA, 13 bp, C. elegans
aaatttgtcgttt

SEQ ID NO: 690300 - DNA, 13 bp, C. elegans
aaatttgtcttaa

SEQ ID NO: 690301 - DNA, 13 bp, C. elegans
aaatttgtgaaaa

SEQ ID NO: 690302 - DNA, 13 bp, C. elegans
aaatttgtgaaac

SEQ ID NO: 690303 - DNA, 13 bp, C. elegans
aaatttgtgactt

SEQ ID NO: 690304 - DNA, 13 bp, C. elegans
aaatttgtgattt

SEQ ID NO: 690305 - DNA, 13 bp, C. elegans
aaatttgtgccaa

SEQ ID NO: 690306 - DNA, 13 bp, C. elegans
aaatttgtggaaa

SEQ ID NO: 690307 - DNA, 13 bp, C. elegans
aaatttgtggatc

SEQ ID NO: 690308 - DNA, 13 bp, C. elegans
aaatttgttaaac

SEQ ID NO: 690309 - DNA, 13 bp, C. elegans
aaatttgttaact

SEQ ID NO: 690310 - DNA, 13 bp, C. elegans
aaatttgttaaga

SEQ ID NO: 690311 - DNA, 13 bp, C. elegans
aaatttgttacat

SEQ ID NO: 690312 - DNA, 13 bp, C. elegans
aaatttgttccaa

SEQ ID NO: 690313 - DNA, 13 bp, C. elegans
aaatttgttgaaa

SEQ ID NO: 690314 - DNA, 13 bp, C. elegans
aaatttgttgaat

SEQ ID NO: 690315 - DNA, 13 bp, C. elegans
aaatttgttgagt

SEQ ID NO: 690316 - DNA, 13 bp, C. elegans
aaatttgtttaga

SEQ ID NO: 690317 - DNA, 13 bp, C. elegans
aaatttgtttatg

SEQ ID NO: 690318 - DNA, 13 bp, C. elegans
aaatttgtttgaa

SEQ ID NO: 690319 - DNA, 13 bp, C. elegans
aaatttgttttca

SEQ ID NO: 690320 - DNA, 13 bp, C. elegans
aaattttaaccca

SEQ ID NO: 690321 - DNA, 13 bp, C. elegans
aaattttaagcaa

SEQ ID NO: 690322 - DNA, 13 bp, C. elegans
aaattttaagctg

SEQ ID NO: 690323 - DNA, 13 bp, C. elegans
aaattttaagtga

SEQ ID NO: 690324 - DNA, 13 bp, C. elegans
aaattttaattcc

SEQ ID NO: 690325 - DNA, 13 bp, C. elegans
aaattttacgaga

SEQ ID NO: 690326 - DNA, 13 bp, C. elegans
aaattttacgtag

SEQ ID NO: 690327 - DNA, 13 bp, C. elegans
aaattttactctt

SEQ ID NO: 690328 - DNA, 13 bp, C. elegans
aaattttactgtt

SEQ ID NO: 690329 - DNA, 13 bp, C. elegans
aaattttagaacg

SEQ ID NO: 690330 - DNA, 13 bp, C. elegans
aaattttagacaa

SEQ ID NO: 690331 - DNA, 13 bp, C. elegans
aaattttagagct

SEQ ID NO: 690332 - DNA, 13 bp, C. elegans
aaattttagtaga

SEQ ID NO: 690333 - DNA, 13 bp, C. elegans
aaattttatagca

SEQ ID NO: 690334 - DNA, 13 bp, C. elegans
aaattttatagtc

SEQ ID NO: 690335 - DNA, 13 bp, C. elegans
aaattttatcagt

SEQ ID NO: 690336 - DNA, 13 bp, C. elegans
aaattttatggaa

SEQ ID NO: 690337 - DNA, 13 bp, C. elegans
aaattttatgttc

SEQ ID NO: 690338 - DNA, 13 bp, C. elegans
aaattttattgga

SEQ ID NO: 690339 - DNA, 13 bp, C. elegans
aaattttcaaaag

SEQ ID NO: 690340 - DNA, 13 bp, C. elegans
aaattttcaacga

SEQ ID NO: 690341 - DNA, 13 bp, C. elegans
aaattttcaacta

SEQ ID NO: 690342 - DNA, 13 bp, C. elegans
aaattttcaatac

SEQ ID NO: 690343 - DNA, 13 bp, C. elegans
aaattttcaatgt

SEQ ID NO: 690344 - DNA, 13 bp, C. elegans
aaattttcacaat

SEQ ID NO: 690345 - DNA, 13 bp, C. elegans
aaattttcagaaa

SEQ ID NO: 690346 - DNA, 13 bp, C. elegans
aaattttcaggtt

SEQ ID NO: 690347 - DNA, 15 bp, C. elegans
aaattttcagtgaaa

SEQ ID NO: 690348 - DNA, 13 bp, C. elegans
aaattttcataga

SEQ ID NO: 690349 - DNA, 13 bp, C. elegans
aaattttcattca

SEQ ID NO: 690350 - DNA, 13 bp, C. elegans
aaattttccacaa

SEQ ID NO: 690351 - DNA, 13 bp, C. elegans
aaattttccattt

SEQ ID NO: 690352 - DNA, 13 bp, C. elegans
aaattttcccaga

SEQ ID NO: 690353 - DNA, 13 bp, C. elegans
aaattttccccca

SEQ ID NO: 690354 - DNA, 13 bp, C. elegans
aaattttcccgcc

SEQ ID NO: 690355 - DNA, 13 bp, C. elegans
aaattttccttca

SEQ ID NO: 690356 - DNA, 13 bp, C. elegans
aaattttcgaaaa

SEQ ID NO: 690357 - DNA, 13 bp, C. elegans
aaattttcgaatt

SEQ ID NO: 690358 - DNA, 13 bp, C. elegans
aaattttcgacaa

SEQ ID NO: 690359 - DNA, 13 bp, C. elegans
aaattttcgagat

SEQ ID NO: 690360 - DNA, 13 bp, C. elegans
aaattttcgattc

SEQ ID NO: 690361 - DNA, 13 bp, C. elegans
aaattttcgcaaa

SEQ ID NO: 690362 - DNA, 13 bp, C. elegans
aaattttcggttt

SEQ ID NO: 690363 - DNA, 13 bp, C. elegans
aaattttcgtaaa

SEQ ID NO: 690364 - DNA, 13 bp, C. elegans
aaattttcgtgtt

SEQ ID NO: 690365 - DNA, 13 bp, C. elegans
aaattttcgttga

SEQ ID NO: 690366 - DNA, 13 bp, C. elegans
aaattttcgtttc

SEQ ID NO: 690367 - DNA, 13 bp, C. elegans
aaattttctagaa

SEQ ID NO: 690368 - DNA, 13 bp, C. elegans
aaattttctatct

SEQ ID NO: 690369 - DNA, 13 bp, C. elegans
aaattttctatga

SEQ ID NO: 690370 - DNA, 13 bp, C. elegans
aaattttctattc

SEQ ID NO: 690371 - DNA, 15 bp, C. elegans
aaattttctcaaaaa

SEQ ID NO: 690372 - DNA, 13 bp, C. elegans
aaattttctctgt

SEQ ID NO: 690373 - DNA, 13 bp, C. elegans
aaattttctgaaa

SEQ ID NO: 690374 - DNA, 13 bp, C. elegans
aaattttctgata

SEQ ID NO: 690375 - DNA, 13 bp, C. elegans
aaattttctggta

SEQ ID NO: 690376 - DNA, 13 bp, C. elegans
aaattttcttcca

SEQ ID NO: 690377 - DNA, 13 bp, C. elegans
aaattttctttgt

SEQ ID NO: 690378 - DNA, 13 bp, C. elegans
aaattttgaaaac

SEQ ID NO: 690379 - DNA, 13 bp, C. elegans
aaattttgaaact

SEQ ID NO: 690380 - DNA, 13 bp, C. elegans
aaattttgaagat

SEQ ID NO: 690381 - DNA, 13 bp, C. elegans
aaattttgaagtt

SEQ ID NO: 690382 - DNA, 13 bp, C. elegans
aaattttgaatag

SEQ ID NO: 690383 - DNA, 13 bp, C. elegans
aaattttgaattc

SEQ ID NO: 690384 - DNA, 13 bp, C. elegans
aaattttgaccaa

SEQ ID NO: 690385 - DNA, 13 bp, C. elegans
aaattttgagtaa

SEQ ID NO: 690386 - DNA, 13 bp, C. elegans
aaattttgagtta

SEQ ID NO: 690387 - DNA, 13 bp, C. elegans
aaattttgagttt

SEQ ID NO: 690388 - DNA, 13 bp, C. elegans
aaattttgatcat

SEQ ID NO: 690389 - DNA, 13 bp, C. elegans
aaattttgatcgt

SEQ ID NO: 690390 - DNA, 13 bp, C. elegans
aaattttgatctt

SEQ ID NO: 690391 - DNA, 13 bp, C. elegans
aaattttgcaaaa

SEQ ID NO: 690392 - DNA, 13 bp, C. elegans
aaattttgcaaac

SEQ ID NO: 690393 - DNA, 13 bp, C. elegans
aaattttgcaatt

SEQ ID NO: 690394 - DNA, 13 bp, C. elegans
aaattttgcagaa

SEQ ID NO: 690395 - DNA, 13 bp, C. elegans
aaattttgcagac

SEQ ID NO: 690396 - DNA, 13 bp, C. elegans
aaattttgcataa

SEQ ID NO: 690397 - DNA, 13 bp, C. elegans
aaattttgcattt

SEQ ID NO: 690398 - DNA, 13 bp, C. elegans
aaattttgccttt

SEQ ID NO: 690399 - DNA, 13 bp, C. elegans
aaattttgcgatt

SEQ ID NO: 690400 - DNA, 13 bp, C. elegans
aaattttgcgttt

SEQ ID NO: 690401 - DNA, 13 bp, C. elegans
aaattttgctgat

SEQ ID NO: 690402 - DNA, 13 bp, C. elegans
aaattttgcttct

SEQ ID NO: 690403 - DNA, 13 bp, C. elegans
aaattttgctttt

SEQ ID NO: 690404 - DNA, 13 bp, C. elegans
aaattttggaaaa

SEQ ID NO: 690405 - DNA, 13 bp, C. elegans
aaattttggaaat

SEQ ID NO: 690406 - DNA, 13 bp, C. elegans
aaattttggaact

SEQ ID NO: 690407 - DNA, 13 bp, C. elegans
aaattttggaatt

SEQ ID NO: 690408 - DNA, 13 bp, C. elegans
aaattttggagtt

SEQ ID NO: 690409 - DNA, 13 bp, C. elegans
aaattttggatat

SEQ ID NO: 690410 - DNA, 13 bp, C. elegans
aaattttggcaaa

SEQ ID NO: 690411 - DNA, 13 bp, C. elegans
aaattttggcaat

SEQ ID NO: 690412 - DNA, 13 bp, C. elegans
aaattttggcatc

SEQ ID NO: 690413 - DNA, 13 bp, C. elegans
aaattttggcgat

SEQ ID NO: 690414 - DNA, 13 bp, C. elegans
aaattttggctaa

SEQ ID NO: 690415 - DNA, 13 bp, C. elegans
aaattttgggttt

SEQ ID NO: 690416 - DNA, 13 bp, C. elegans
aaattttggtata

SEQ ID NO: 690417 - DNA, 13 bp, C. elegans
aaattttggttgt

SEQ ID NO: 690418 - DNA, 13 bp, C. elegans
aaattttgtagtt

SEQ ID NO: 690419 - DNA, 13 bp, C. elegans
aaattttgtcagt

SEQ ID NO: 690420 - DNA, 13 bp, C. elegans
aaattttgtcgtg

SEQ ID NO: 690421 - DNA, 13 bp, C. elegans
aaattttgtgaaa

SEQ ID NO: 690422 - DNA, 13 bp, C. elegans
aaattttgtgcaa

SEQ ID NO: 690423 - DNA, 13 bp, C. elegans
aaattttgtgtat

SEQ ID NO: 690424 - DNA, 13 bp, C. elegans
aaattttgttgta

SEQ ID NO: 690425 - DNA, 13 bp, C. elegans
aaattttgtttca

SEQ ID NO: 690426 - DNA, 13 bp, C. elegans
aaattttgtttct

SEQ ID NO: 690427 - DNA, 13 bp, C. elegans
aaattttgtttgg

SEQ ID NO: 690428 - DNA, 13 bp, C. elegans
aaattttgttttc

SEQ ID NO: 690429 - DNA, 13 bp, C. elegans
aaatttttaaagc

SEQ ID NO: 690430 - DNA, 13 bp, C. elegans
aaatttttagttg

SEQ ID NO: 690431 - DNA, 13 bp, C. elegans
aaatttttatcga

SEQ ID NO: 690432 - DNA, 13 bp, C. elegans
aaatttttatctg

SEQ ID NO: 690433 - DNA, 13 bp, C. elegans
aaatttttcaaca

SEQ ID NO: 690434 - DNA, 13 bp, C. elegans
aaatttttcaaga

SEQ ID NO: 690435 - DNA, 13 bp, C. elegans
aaatttttcacaa

SEQ ID NO: 690436 - DNA, 13 bp, C. elegans
aaatttttcagaa

SEQ ID NO: 690437 - DNA, 13 bp, C. elegans
aaatttttcagat

SEQ ID NO: 690438 - DNA, 13 bp, C. elegans
aaatttttccaat

SEQ ID NO: 690439 - DNA, 13 bp, C. elegans
aaatttttccaga

SEQ ID NO: 690440 - DNA, 13 bp, C. elegans
aaatttttccatt

SEQ ID NO: 690441 - DNA, 13 bp, C. elegans
aaatttttccgaa

SEQ ID NO: 690442 - DNA, 14 bp, C. elegans
aaatttttccgaaa

SEQ ID NO: 690443 - DNA, 13 bp, C. elegans
aaatttttcgaga

SEQ ID NO: 690444 - DNA, 13 bp, C. elegans
aaatttttcggag

SEQ ID NO: 690445 - DNA, 13 bp, C. elegans
aaatttttctcag

SEQ ID NO: 690446 - DNA, 13 bp, C. elegans
aaatttttctgta

SEQ ID NO: 690447 - DNA, 13 bp, C. elegans
aaatttttcttca

SEQ ID NO: 690448 - DNA, 13 bp, C. elegans
aaatttttgaaac

SEQ ID NO: 690449 - DNA, 13 bp, C. elegans
aaatttttgacaa

SEQ ID NO: 690450 - DNA, 13 bp, C. elegans
aaatttttgagaa

SEQ ID NO: 690451 - DNA, 13 bp, C. elegans
aaatttttgatct

SEQ ID NO: 690452 - DNA, 13 bp, C. elegans
aaatttttgcaaa

SEQ ID NO: 690453 - DNA, 13 bp, C. elegans
aaatttttgccaa

SEQ ID NO: 690454 - DNA, 13 bp, C. elegans
aaatttttgcgaa

SEQ ID NO: 690455 - DNA, 13 bp, C. elegans
aaatttttggatt

SEQ ID NO: 690456 - DNA, 13 bp, C. elegans
aaatttttggcaa

SEQ ID NO: 690457 - DNA, 13 bp, C. elegans
aaatttttggcta

SEQ ID NO: 690458 - DNA, 13 bp, C. elegans
aaatttttgggaa

SEQ ID NO: 690459 - DNA, 13 bp, C. elegans
aaatttttgggga

SEQ ID NO: 690460 - DNA, 13 bp, C. elegans
aaatttttgtgaa

SEQ ID NO: 690461 - DNA, 13 bp, C. elegans
aaatttttgtgat

SEQ ID NO: 690462 - DNA, 13 bp, C. elegans
aaattttttatgg

SEQ ID NO: 690463 - DNA, 13 bp, C. elegans
aaattttttcgga

SEQ ID NO: 690464 - DNA, 13 bp, C. elegans
aaattttttgaga

SEQ ID NO: 690465 - DNA, 13 bp, C. elegans
aaattttttgctc

SEQ ID NO: 690466 - DNA, 13 bp, C. elegans
aaatttttttcag

SEQ ID NO: 690467 - DNA, 13 bp, C. elegans
aacaaaaaacgtg

SEQ ID NO: 690468 - DNA, 13 bp, C. elegans
aacaaaaaagtgc

SEQ ID NO: 690469 - DNA, 13 bp, C. elegans
aacaaaaaatgtt

SEQ ID NO: 690470 - DNA, 13 bp, C. elegans
aacaaaaacgttt

SEQ ID NO: 690471 - DNA, 13 bp, C. elegans
aacaaaaactgtt

SEQ ID NO: 690472 - DNA, 13 bp, C. elegans
aacaaaaagttgt

SEQ ID NO: 690473 - DNA, 13 bp, C. elegans
aacaaaaagtttc

SEQ ID NO: 690474 - DNA, 13 bp, C. elegans
aacaaaaatcctt

SEQ ID NO: 690475 - DNA, 13 bp, C. elegans
aacaaaaatgatg

SEQ ID NO: 690476 - DNA, 13 bp, C. elegans
aacaaaaatgctt

SEQ ID NO: 690477 - DNA, 13 bp, C. elegans
aacaaaaatggtt

SEQ ID NO: 690478 - DNA, 13 bp, C. elegans
aacaaaaattgga

SEQ ID NO: 690479 - DNA, 13 bp, C. elegans
aacaaaaattggg

SEQ ID NO: 690480 - DNA, 13 bp, C. elegans
aacaaaaatttgg

SEQ ID NO: 690481 - DNA, 13 bp, C. elegans
aacaaaaattttc

SEQ ID NO: 690482 - DNA, 13 bp, C. elegans
aacaaaacagttt

SEQ ID NO: 690483 - DNA, 13 bp, C. elegans
aacaaaaccattt

SEQ ID NO: 690484 - DNA, 13 bp, C. elegans
aacaaaactactg

SEQ ID NO: 690485 - DNA, 13 bp, C. elegans
aacaaaactattg

SEQ ID NO: 690486 - DNA, 13 bp, C. elegans
aacaaaactgaat

SEQ ID NO: 690487 - DNA, 13 bp, C. elegans
aacaaaacttatt

SEQ ID NO: 690488 - DNA, 13 bp, C. elegans
aacaaaacttgaa

SEQ ID NO: 690489 - DNA, 13 bp, C. elegans
aacaaaactttta

SEQ ID NO: 690490 - DNA, 13 bp, C. elegans
aacaaaagaattt

SEQ ID NO: 690491 - DNA, 13 bp, C. elegans
aacaaaagtcaat

SEQ ID NO: 690492 - DNA, 13 bp, C. elegans
aacaaaagttcat

SEQ ID NO: 690493 - DNA, 13 bp, C. elegans
aacaaaagttttt

SEQ ID NO: 690494 - DNA, 13 bp, C. elegans
aacaaaatatgtt

SEQ ID NO: 690495 - DNA, 13 bp, C. elegans
aacaaaatcatga

SEQ ID NO: 690496 - DNA, 13 bp, C. elegans
aacaaaatgaatt

SEQ ID NO: 690497 - DNA, 13 bp, C. elegans
aacaaaatgtaat

SEQ ID NO: 690498 - DNA, 13 bp, C. elegans
aacaaaatgtata

SEQ ID NO: 690499 - DNA, 13 bp, C. elegans
aacaaaatgttgt

SEQ ID NO: 690500 - DNA, 13 bp, C. elegans
aacaaaatgtttc

SEQ ID NO: 690501 - DNA, 13 bp, C. elegans
aacaaaatgtttg

SEQ ID NO: 690502 - DNA, 13 bp, C. elegans
aacaaaatgtttt

SEQ ID NO: 690503 - DNA, 13 bp, C. elegans
aacaaaattatga

SEQ ID NO: 690504 - DNA, 13 bp, C. elegans
aacaaaattggaa

SEQ ID NO: 690505 - DNA, 13 bp, C. elegans
aacaaaattggag

SEQ ID NO: 690506 - DNA, 13 bp, C. elegans
aacaaaattgtcg

SEQ ID NO: 690507 - DNA, 13 bp, C. elegans
aacaaaattgttt

SEQ ID NO: 690508 - DNA, 13 bp, C. elegans
aacaaaatttact

SEQ ID NO: 690509 - DNA, 13 bp, C. elegans
aacaaaatttgaa

SEQ ID NO: 690510 - DNA, 13 bp, C. elegans
aacaaaattttga

SEQ ID NO: 690511 - DNA, 13 bp, C. elegans
aacaaacaattgt

SEQ ID NO: 690512 - DNA, 13 bp, C. elegans
aacaaacattgca

SEQ ID NO: 690513 - DNA, 13 bp, C. elegans
aacaaacccaatt

SEQ ID NO: 690514 - DNA, 13 bp, C. elegans
aacaaacgactac

SEQ ID NO: 690515 - DNA, 13 bp, C. elegans
aacaaactcgaaa

SEQ ID NO: 690516 - DNA, 13 bp, C. elegans
aacaaagaaattt

SEQ ID NO: 690517 - DNA, 13 bp, C. elegans
aacaaagattttg

SEQ ID NO: 690518 - DNA, 13 bp, C. elegans
aacaaagcaattt

SEQ ID NO: 690519 - DNA, 13 bp, C. elegans
aacaaagtatttt

SEQ ID NO: 690520 - DNA, 13 bp, C. elegans
aacaaagtgaaac

SEQ ID NO: 690521 - DNA, 13 bp, C. elegans
aacaaagttatgg

SEQ ID NO: 690522 - DNA, 13 bp, C. elegans
aacaaagttattt

SEQ ID NO: 690523 - DNA, 13 bp, C. elegans
aacaaatatggtt

SEQ ID NO: 690524 - DNA, 13 bp, C. elegans
aacaaatattcat

SEQ ID NO: 690525 - DNA, 13 bp, C. elegans
aacaaatattctt

SEQ ID NO: 690526 - DNA, 13 bp, C. elegans
aacaaatcaattt

SEQ ID NO: 690527 - DNA, 13 bp, C. elegans
aacaaatcattca

SEQ ID NO: 690528 - DNA, 13 bp, C. elegans
aacaaatcattga

SEQ ID NO: 690529 - DNA, 13 bp, C. elegans
aacaaatcatttt

SEQ ID NO: 690530 - DNA, 13 bp, C. elegans
aacaaatcgattt

SEQ ID NO: 690531 - DNA, 13 bp, C. elegans
aacaaatcttcaa

SEQ ID NO: 690532 - DNA, 13 bp, C. elegans
aacaaatgatttc

SEQ ID NO: 690533 - DNA, 13 bp, C. elegans
aacaaatgatttt

SEQ ID NO: 690534 - DNA, 13 bp, C. elegans
aacaaatggaaat

SEQ ID NO: 690535 - DNA, 13 bp, C. elegans
aacaaatgtatgt

SEQ ID NO: 690536 - DNA, 13 bp, C. elegans
aacaaattaatgt

SEQ ID NO: 690537 - DNA, 41 bp, C. elegans
aacaaattacagattctgaaagcctaagatgccagctatcg

SEQ ID NO: 690538 - DNA, 13 bp, C. elegans
aacaaattatgct

SEQ ID NO: 690539 - DNA, 13 bp, C. elegans
aacaaattatgtt

SEQ ID NO: 690540 - DNA, 13 bp, C. elegans
aacaaattcaatt

SEQ ID NO: 690541 - DNA, 13 bp, C. elegans
aacaaattcagat

SEQ ID NO: 690542 - DNA, 13 bp, C. elegans
aacaaattcgaat

SEQ ID NO: 690543 - DNA, 13 bp, C. elegans
aacaaattcggaa

SEQ ID NO: 690544 - DNA, 13 bp, C. elegans
aacaaattctcaa

SEQ ID NO: 690545 - DNA, 13 bp, C. elegans
aacaaattctgaa

SEQ ID NO: 690546 - DNA, 13 bp, C. elegans
aacaaattcttga

SEQ ID NO: 690547 - DNA, 13 bp, C. elegans
aacaaattgaaac

SEQ ID NO: 690548 - DNA, 13 bp, C. elegans
aacaaattgataa

SEQ ID NO: 690549 - DNA, 13 bp, C. elegans
aacaaattgctca

SEQ ID NO: 690550 - DNA, 13 bp, C. elegans
aacaaattgtgaa

SEQ ID NO: 690551 - DNA, 13 bp, C. elegans
aacaaatttattc

SEQ ID NO: 690552 - DNA, 13 bp, C. elegans
aacaaatttccag

SEQ ID NO: 690553 - DNA, 13 bp, C. elegans
aacaaatttcttt

SEQ ID NO: 690554 - DNA, 13 bp, C. elegans
aacaaatttggaa

SEQ ID NO: 690555 - DNA, 13 bp, C. elegans
aacaaattttcaa

SEQ ID NO: 690556 - DNA, 13 bp, C. elegans
aacaaattttcta

SEQ ID NO: 690557 - DNA, 13 bp, C. elegans
aacaaatttttgt

SEQ ID NO: 690558 - DNA, 13 bp, C. elegans
aacaacaaaatgt

SEQ ID NO: 690559 - DNA, 13 bp, C. elegans
aacaacaaagttt

SEQ ID NO: 690560 - DNA, 13 bp, C. elegans
aacaacaaattga

SEQ ID NO: 690561 - DNA, 13 bp, C. elegans
aacaacaacagtt

SEQ ID NO: 690562 - DNA, 13 bp, C. elegans
aacaacaactatt

SEQ ID NO: 690563 - DNA, 13 bp, C. elegans
aacaacaatttta

SEQ ID NO: 690564 - DNA, 13 bp, C. elegans
aacaacacatttt

SEQ ID NO: 690565 - DNA, 13 bp, C. elegans
aacaacagtattt

SEQ ID NO: 690566 - DNA, 13 bp, C. elegans
aacaacagttttt

SEQ ID NO: 690567 - DNA, 13 bp, C. elegans
aacaacatgaaac

SEQ ID NO: 690568 - DNA, 13 bp, C. elegans
aacaacattgaaa

SEQ ID NO: 690569 - DNA, 13 bp, C. elegans
aacaacattttaa

SEQ ID NO: 690570 - DNA, 13 bp, C. elegans
aacaacatttttt

SEQ ID NO: 690571 - DNA, 13 bp, C. elegans
aacaaccgaaaat

SEQ ID NO: 690572 - DNA, 13 bp, C. elegans
aacaaccgaatat

SEQ ID NO: 690573 - DNA, 13 bp, C. elegans
aacaacctgaaac

SEQ ID NO: 690574 - DNA, 13 bp, C. elegans
aacaacgaaattt

SEQ ID NO: 690575 - DNA, 13 bp, C. elegans
aacaacgacgacg

SEQ ID NO: 690576 - DNA, 13 bp, C. elegans
aacaacgtttttc

SEQ ID NO: 690577 - DNA, 13 bp, C. elegans
aacaactacattt

SEQ ID NO: 690578 - DNA, 13 bp, C. elegans
aacaactatattt

SEQ ID NO: 690579 - DNA, 13 bp, C. elegans
aacaactatttca

SEQ ID NO: 690580 - DNA, 13 bp, C. elegans
aacaactattttt

SEQ ID NO: 690581 - DNA, 13 bp, C. elegans
aacaactgaaaca

SEQ ID NO: 690582 - DNA, 13 bp, C. elegans
aacaacttatcag

SEQ ID NO: 690583 - DNA, 13 bp, C. elegans
aacaacttatgaa

SEQ ID NO: 690584 - DNA, 13 bp, C. elegans
aacaacttcaaat

SEQ ID NO: 690585 - DNA, 13 bp, C. elegans
aacaacttccaaa

SEQ ID NO: 690586 - DNA, 13 bp, C. elegans
aacaacttgtttt

SEQ ID NO: 690587 - DNA, 13 bp, C. elegans
aacaactttaaat

SEQ ID NO: 690588 - DNA, 13 bp, C. elegans
aacaactttccaa

SEQ ID NO: 690589 - DNA, 13 bp, C. elegans
aacaactttgttt

SEQ ID NO: 690590 - DNA, 13 bp, C. elegans
aacaacttttcaa

SEQ ID NO: 690591 - DNA, 13 bp, C. elegans
aacaacttttgga

SEQ ID NO: 690592 - DNA, 13 bp, C. elegans
aacaagaaacttt

SEQ ID NO: 690593 - DNA, 13 bp, C. elegans
aacaagaaagttt

SEQ ID NO: 690594 - DNA, 13 bp, C. elegans
aacaagaaatttt

SEQ ID NO: 690595 - DNA, 13 bp, C. elegans
aacaagaagaact

SEQ ID NO: 690596 - DNA, 13 bp, C. elegans
aacaagaattatt

SEQ ID NO: 690597 - DNA, 13 bp, C. elegans
aacaagattcaat

SEQ ID NO: 690598 - DNA, 13 bp, C. elegans
aacaaggaaatga

SEQ ID NO: 690599 - DNA, 13 bp, C. elegans
aacaaggaaattg

SEQ ID NO: 690600 - DNA, 13 bp, C. elegans
aacaaggaatacc

SEQ ID NO: 690601 - DNA, 13 bp, C. elegans
aacaaggaatcga

SEQ ID NO: 690602 - DNA, 13 bp, C. elegans
aacaagtaatttt

SEQ ID NO: 690603 - DNA, 13 bp, C. elegans
aacaagttcaaaa

SEQ ID NO: 690604 - DNA, 13 bp, C. elegans
aacaagttgaatt

SEQ ID NO: 690605 - DNA, 13 bp, C. elegans
aacaagttttaat

SEQ ID NO: 690606 - DNA, 13 bp, C. elegans
aacaagttttcaa

SEQ ID NO: 690607 - DNA, 13 bp, C. elegans
aacaagtttttat

SEQ ID NO: 690608 - DNA, 13 bp, C. elegans
aacaagtttttca

SEQ ID NO: 690609 - DNA, 13 bp, C. elegans
aacaagttttttc

SEQ ID NO: 690610 - DNA, 13 bp, C. elegans
aacaataaattgt

SEQ ID NO: 690611 - DNA, 13 bp, C. elegans
aacaataaatttg

SEQ ID NO: 690612 - DNA, 13 bp, C. elegans
aacaatacttttt

SEQ ID NO: 690613 - DNA, 13 bp, C. elegans
aacaatagttttc

SEQ ID NO: 690614 - DNA, 13 bp, C. elegans
aacaatatgggaa

SEQ ID NO: 690615 - DNA, 13 bp, C. elegans
aacaatattgata

SEQ ID NO: 690616 - DNA, 13 bp, C. elegans
aacaatattttga

SEQ ID NO: 690617 - DNA, 13 bp, C. elegans
aacaatcactttt

SEQ ID NO: 690618 - DNA, 13 bp, C. elegans
aacaatctacatt

SEQ ID NO: 690619 - DNA, 13 bp, C. elegans
aacaatctagaat

SEQ ID NO: 690620 - DNA, 14 bp, C. elegans
aacaatctattttt

SEQ ID NO: 690621 - DNA, 13 bp, C. elegans
aacaatctgaaaa

SEQ ID NO: 690622 - DNA, 13 bp, C. elegans
aacaatctggaaa

SEQ ID NO: 690623 - DNA, 13 bp, C. elegans
aacaatcttttta

SEQ ID NO: 690624 - DNA, 13 bp, C. elegans
aacaatgaaaatg

SEQ ID NO: 690625 - DNA, 13 bp, C. elegans
aacaatgaaattg

SEQ ID NO: 690626 - DNA, 13 bp, C. elegans
aacaatgaaattt

SEQ ID NO: 690627 - DNA, 13 bp, C. elegans
aacaatgaatatt

SEQ ID NO: 690628 - DNA, 13 bp, C. elegans
aacaatgcaaatt

SEQ ID NO: 690629 - DNA, 13 bp, C. elegans
aacaatgttcaaa

SEQ ID NO: 690630 - DNA, 13 bp, C. elegans
aacaatgtttcaa

SEQ ID NO: 690631 - DNA, 13 bp, C. elegans
aacaattactgta

SEQ ID NO: 690632 - DNA, 13 bp, C. elegans
aacaattatcaat

SEQ ID NO: 690633 - DNA, 13 bp, C. elegans
aacaattattgaa

SEQ ID NO: 690634 - DNA, 13 bp, C. elegans
aacaattattgga

SEQ ID NO: 690635 - DNA, 13 bp, C. elegans
aacaattatttca

SEQ ID NO: 690636 - DNA, 13 bp, C. elegans
aacaattatttct

SEQ ID NO: 690637 - DNA, 13 bp, C. elegans
aacaattatttgt

SEQ ID NO: 690638 - DNA, 13 bp, C. elegans
aacaattccgaaa

SEQ ID NO: 690639 - DNA, 13 bp, C. elegans
aacaattcgaaat

SEQ ID NO: 690640 - DNA, 13 bp, C. elegans
aacaattctacaa

SEQ ID NO: 690641 - DNA, 13 bp, C. elegans
aacaattcttcaa

SEQ ID NO: 690642 - DNA, 13 bp, C. elegans
aacaattctttgt

SEQ ID NO: 690643 - DNA, 13 bp, C. elegans
aacaattgaaaca

SEQ ID NO: 690644 - DNA, 13 bp, C. elegans
aacaattgaagaa

SEQ ID NO: 690645 - DNA, 13 bp, C. elegans
aacaattgaagtt

SEQ ID NO: 690646 - DNA, 13 bp, C. elegans
aacaattgaatca

SEQ ID NO: 690647 - DNA, 13 bp, C. elegans
aacaattgagaaa

SEQ ID NO: 690648 - DNA, 13 bp, C. elegans
aacaattgctttt

SEQ ID NO: 690649 - DNA, 13 bp, C. elegans
aacaattggaaaa

SEQ ID NO: 690650 - DNA, 13 bp, C. elegans
aacaattggaaac

SEQ ID NO: 690651 - DNA, 13 bp, C. elegans
aacaattggtgaa

SEQ ID NO: 690652 - DNA, 13 bp, C. elegans
aacaattgtcaaa

SEQ ID NO: 690653 - DNA, 13 bp, C. elegans
aacaattgtgttt

SEQ ID NO: 690654 - DNA, 13 bp, C. elegans
aacaattgttgaa

SEQ ID NO: 690655 - DNA, 13 bp, C. elegans
aacaattgtttgt

SEQ ID NO: 690656 - DNA, 13 bp, C. elegans
aacaattgttttt

SEQ ID NO: 690657 - DNA, 13 bp, C. elegans
aacaatttacatt

SEQ ID NO: 690658 - DNA, 13 bp, C. elegans
aacaatttatcaa

SEQ ID NO: 690659 - DNA, 13 bp, C. elegans
aacaatttatgta

SEQ ID NO: 690660 - DNA, 13 bp, C. elegans
aacaatttattca

SEQ ID NO: 690661 - DNA, 13 bp, C. elegans
aacaatttcaatt

SEQ ID NO: 690662 - DNA, 13 bp, C. elegans
aacaatttcagat

SEQ ID NO: 690663 - DNA, 13 bp, C. elegans
aacaatttcatat

SEQ ID NO: 690664 - DNA, 13 bp, C. elegans
aacaatttcatct

SEQ ID NO: 690665 - DNA, 13 bp, C. elegans
aacaatttccaaa

SEQ ID NO: 690666 - DNA, 13 bp, C. elegans
aacaatttccaac

SEQ ID NO: 690667 - DNA, 13 bp, C. elegans
aacaatttccaat

SEQ ID NO: 690668 - DNA, 13 bp, C. elegans
aacaatttccatt

SEQ ID NO: 690669 - DNA, 13 bp, C. elegans
aacaatttccgaa

SEQ ID NO: 690670 - DNA, 13 bp, C. elegans
aacaatttcctaa

SEQ ID NO: 690671 - DNA, 13 bp, C. elegans
aacaatttcctca

SEQ ID NO: 690672 - DNA, 13 bp, C. elegans
aacaatttctaat

SEQ ID NO: 690673 - DNA, 13 bp, C. elegans
aacaatttctcaa

SEQ ID NO: 690674 - DNA, 13 bp, C. elegans
aacaatttctgaa

SEQ ID NO: 690675 - DNA, 13 bp, C. elegans
aacaatttgaaaa

SEQ ID NO: 690676 - DNA, 13 bp, C. elegans
aacaatttgaaac

SEQ ID NO: 690677 - DNA, 13 bp, C. elegans
aacaatttgaata

SEQ ID NO: 690678 - DNA, 13 bp, C. elegans
aacaatttgagat

SEQ ID NO: 690679 - DNA, 13 bp, C. elegans
aacaatttgatat

SEQ ID NO: 690680 - DNA, 13 bp, C. elegans
aacaatttgatta

SEQ ID NO: 690681 - DNA, 13 bp, C. elegans
aacaatttgcatt

SEQ ID NO: 690682 - DNA, 13 bp, C. elegans
aacaatttgccga

SEQ ID NO: 690683 - DNA, 13 bp, C. elegans
aacaatttggaaa

SEQ ID NO: 690684 - DNA, 13 bp, C. elegans
aacaatttgttag

SEQ ID NO: 690685 - DNA, 13 bp, C. elegans
aacaattttaaac

SEQ ID NO: 690686 - DNA, 13 bp, C. elegans
aacaattttactg

SEQ ID NO: 690687 - DNA, 13 bp, C. elegans
aacaattttagaa

SEQ ID NO: 690688 - DNA, 13 bp, C. elegans
aacaattttattc

SEQ ID NO: 690689 - DNA, 13 bp, C. elegans
aacaattttcatt

SEQ ID NO: 690690 - DNA, 13 bp, C. elegans
aacaattttccta

SEQ ID NO: 690691 - DNA, 13 bp, C. elegans
aacaattttcgat

SEQ ID NO: 690692 - DNA, 13 bp, C. elegans
aacaattttctga

SEQ ID NO: 690693 - DNA, 13 bp, C. elegans
aacaattttgaaa

SEQ ID NO: 690694 - DNA, 13 bp, C. elegans
aacaattttgtag

SEQ ID NO: 690695 - DNA, 13 bp, C. elegans
aacaattttgttt

SEQ ID NO: 690696 - DNA, 13 bp, C. elegans
aacaatttttaac

SEQ ID NO: 690697 - DNA, 13 bp, C. elegans
aacaatttttctg

SEQ ID NO: 690698 - DNA, 13 bp, C. elegans
aacaatttttgct

SEQ ID NO: 690699 - DNA, 13 bp, C. elegans
aacaatttttgtt

SEQ ID NO: 690700 - DNA, 13 bp, C. elegans
aacaattttttcc

SEQ ID NO: 690701 - DNA, 13 bp, C. elegans
aacaattttttga

SEQ ID NO: 690702 - DNA, 13 bp, C. elegans
aacaatttttttc

SEQ ID NO: 690703 - DNA, 13 bp, C. elegans
aacacaaaaatgt

SEQ ID NO: 690704 - DNA, 13 bp, C. elegans
aacacaaaatttt

SEQ ID NO: 690705 - DNA, 13 bp, C. elegans
aacacaaattcat

SEQ ID NO: 690706 - DNA, 13 bp, C. elegans
aacacaaattttc

SEQ ID NO: 690707 - DNA, 13 bp, C. elegans
aacacaatttatt

SEQ ID NO: 690708 - DNA, 13 bp, C. elegans
aacacaatttcaa

SEQ ID NO: 690709 - DNA, 13 bp, C. elegans
aacacaattttaa

SEQ ID NO: 690710 - DNA, 13 bp, C. elegans
aacacaattttag

SEQ ID NO: 690711 - DNA, 13 bp, C. elegans
aacacaattttca

SEQ ID NO: 690712 - DNA, 13 bp, C. elegans
aacacaattttta

SEQ ID NO: 690713 - DNA, 13 bp, C. elegans
aacacacttttct

SEQ ID NO: 690714 - DNA, 13 bp, C. elegans
aacacagaaaatg

SEQ ID NO: 690715 - DNA, 13 bp, C. elegans
aacacagtttcaa

SEQ ID NO: 690716 - DNA, 13 bp, C. elegans
aacacatcatttt

SEQ ID NO: 690717 - DNA, 13 bp, C. elegans
aacacattgaaat

SEQ ID NO: 690718 - DNA, 13 bp, C. elegans
aacacatttattt

SEQ ID NO: 690719 - DNA, 13 bp, C. elegans
aacacattttcca

SEQ ID NO: 690720 - DNA, 13 bp, C. elegans
aacacattttgaa

SEQ ID NO: 690721 - DNA, 13 bp, C. elegans
aacacatttttca

SEQ ID NO: 690722 - DNA, 13 bp, C. elegans
aacacatttttct

SEQ ID NO: 690723 - DNA, 13 bp, C. elegans
aacacccatcatg

SEQ ID NO: 690724 - DNA, 13 bp, C. elegans
aacacccgatttc

SEQ ID NO: 690725 - DNA, 13 bp, C. elegans
aacaccgaatttc

SEQ ID NO: 690726 - DNA, 13 bp, C. elegans
aacaccgtatttt

SEQ ID NO: 690727 - DNA, 13 bp, C. elegans
aacacgaattttc

SEQ ID NO: 690728 - DNA, 13 bp, C. elegans
aacacgttttttt

SEQ ID NO: 690729 - DNA, 13 bp, C. elegans
aacactatatttt

SEQ ID NO: 690730 - DNA, 13 bp, C. elegans
aacactcattttt

SEQ ID NO: 690731 - DNA, 13 bp, C. elegans
aacactccaggag

SEQ ID NO: 690732 - DNA, 13 bp, C. elegans
aacactgaaaata

SEQ ID NO: 690733 - DNA, 13 bp, C. elegans
aacactgaaaatc

SEQ ID NO: 690734 - DNA, 13 bp, C. elegans
aacactgaaattg

SEQ ID NO: 690735 - DNA, 13 bp, C. elegans
aacactgaaattt

SEQ ID NO: 690736 - DNA, 13 bp, C. elegans
aacactgacaaaa

SEQ ID NO: 690737 - DNA, 13 bp, C. elegans
aacactgcaaaaa

SEQ ID NO: 690738 - DNA, 13 bp, C. elegans
aacactgcaactt

SEQ ID NO: 690739 - DNA, 13 bp, C. elegans
aacactggaaaaa

SEQ ID NO: 690740 - DNA, 13 bp, C. elegans
aacacttataatt

SEQ ID NO: 690741 - DNA, 13 bp, C. elegans
aacacttcttcgt

SEQ ID NO: 690742 - DNA, 13 bp, C. elegans
aacacttcttttt

SEQ ID NO: 690743 - DNA, 13 bp, C. elegans
aacacttgttttt

SEQ ID NO: 690744 - DNA, 13 bp, C. elegans
aacactttcgaaa

SEQ ID NO: 690745 - DNA, 13 bp, C. elegans
aacactttgaaat

SEQ ID NO: 690746 - DNA, 13 bp, C. elegans
aacactttgaatt

SEQ ID NO: 690747 - DNA, 13 bp, C. elegans
aacactttgtttt

SEQ ID NO: 690748 - DNA, 13 bp, C. elegans
aacacttttattg

SEQ ID NO: 690749 - DNA, 13 bp, C. elegans
aacacttttcaaa

SEQ ID NO: 690750 - DNA, 13 bp, C. elegans
aacacttttctca

SEQ ID NO: 690751 - DNA, 13 bp, C. elegans
aacacttttgaaa

SEQ ID NO: 690752 - DNA, 13 bp, C. elegans
aacactttttgat

SEQ ID NO: 690753 - DNA, 13 bp, C. elegans
aacacttttttct

SEQ ID NO: 690754 - DNA, 13 bp, C. elegans
aacagaaaactga

SEQ ID NO: 690755 - DNA, 13 bp, C. elegans
aacagaaaacttt

SEQ ID NO: 690756 - DNA, 13 bp, C. elegans
aacagaaaagttg

SEQ ID NO: 690757 - DNA, 13 bp, C. elegans
aacagaaacttta

SEQ ID NO: 690758 - DNA, 13 bp, C. elegans
aacagaaatatat

SEQ ID NO: 690759 - DNA, 13 bp, C. elegans
aacagaaattgaa

SEQ ID NO: 690760 - DNA, 13 bp, C. elegans
aacagaacaaatt

SEQ ID NO: 690761 - DNA, 13 bp, C. elegans
aacagaagatatt

SEQ ID NO: 690762 - DNA, 14 bp, C. elegans
aacagaagattttg

SEQ ID NO: 690763 - DNA, 13 bp, C. elegans
aacagaatcaaca

SEQ ID NO: 690764 - DNA, 13 bp, C. elegans
aacagagaaacat

SEQ ID NO: 690765 - DNA, 13 bp, C. elegans
aacagattttcat

SEQ ID NO: 690766 - DNA, 13 bp, C. elegans
aacagcaattttt

SEQ ID NO: 690767 - DNA, 13 bp, C. elegans
aacagcactgact

SEQ ID NO: 690768 - DNA, 13 bp, C. elegans
aacagcagcagca

SEQ ID NO: 690769 - DNA, 13 bp, C. elegans
aacagctcaaaaa

SEQ ID NO: 690770 - DNA, 13 bp, C. elegans
aacagctgaaaaa

SEQ ID NO: 690771 - DNA, 13 bp, C. elegans
aacagctgaaatc

SEQ ID NO: 690772 - DNA, 13 bp, C. elegans
aacagctttaaaa

SEQ ID NO: 690773 - DNA, 13 bp, C. elegans
aacaggaaaaatc

SEQ ID NO: 690774 - DNA, 13 bp, C. elegans
aacaggtttcaat

SEQ ID NO: 690775 - DNA, 13 bp, C. elegans
aacagtaataaat

SEQ ID NO: 690776 - DNA, 13 bp, C. elegans
aacagtaataata

SEQ ID NO: 690777 - DNA, 13 bp, C. elegans
aacagtacttttt

SEQ ID NO: 690778 - DNA, 13 bp, C. elegans
aacagtagaaaat

SEQ ID NO: 690779 - DNA, 13 bp, C. elegans
aacagtagaattt

SEQ ID NO: 690780 - DNA, 13 bp, C. elegans
aacagtatatttt

SEQ ID NO: 690781 - DNA, 13 bp, C. elegans
aacagtattttga

SEQ ID NO: 690782 - DNA, 13 bp, C. elegans
aacagtatttttt

SEQ ID NO: 690783 - DNA, 13 bp, C. elegans
aacagtcaaaaca

SEQ ID NO: 690784 - DNA, 13 bp, C. elegans
aacagtggaaaaa

SEQ ID NO: 690785 - DNA, 13 bp, C. elegans
aacagttaattta

SEQ ID NO: 690786 - DNA, 13 bp, C. elegans
aacagttatattt

SEQ ID NO: 690787 - DNA, 13 bp, C. elegans
aacagttattatt

SEQ ID NO: 690788 - DNA, 13 bp, C. elegans
aacagttcaaaac

SEQ ID NO: 690789 - DNA, 13 bp, C. elegans
aacagttctcaaa

SEQ ID NO: 690790 - DNA, 13 bp, C. elegans
aacagttgaaaaa

SEQ ID NO: 690791 - DNA, 13 bp, C. elegans
aacagttgaaaag

SEQ ID NO: 690792 - DNA, 13 bp, C. elegans
aacagtttatttc

SEQ ID NO: 690793 - DNA, 13 bp, C. elegans
aacagtttatttt

SEQ ID NO: 690794 - DNA, 13 bp, C. elegans
aacagtttctcaa

SEQ ID NO: 690795 - DNA, 13 bp, C. elegans
aacagtttgaaat

SEQ ID NO: 690796 - DNA, 13 bp, C. elegans
aacagttttaata

SEQ ID NO: 690797 - DNA, 13 bp, C. elegans
aacagttttcaaa

SEQ ID NO: 690798 - DNA, 13 bp, C. elegans
aacagttttcgaa

SEQ ID NO: 690799 - DNA, 13 bp, C. elegans
aacagttttcttt

SEQ ID NO: 690800 - DNA, 13 bp, C. elegans
aacagttttggaa

SEQ ID NO: 690801 - DNA, 13 bp, C. elegans
aacagtttttttt

SEQ ID NO: 690802 - DNA, 13 bp, C. elegans
aacataaaatgtt

SEQ ID NO: 690803 - DNA, 13 bp, C. elegans
aacataaattttc

SEQ ID NO: 690804 - DNA, 13 bp, C. elegans
aacatattgtttt

SEQ ID NO: 690805 - DNA, 13 bp, C. elegans
aacatatttactt

SEQ ID NO: 690806 - DNA, 13 bp, C. elegans
aacatatttcaaa

SEQ ID NO: 690807 - DNA, 13 bp, C. elegans
aacatatttgaaa

SEQ ID NO: 690808 - DNA, 13 bp, C. elegans
aacatatttgatt

SEQ ID NO: 690809 - DNA, 13 bp, C. elegans
aacatattttact

SEQ ID NO: 690810 - DNA, 13 bp, C. elegans
aacatattttcat

SEQ ID NO: 690811 - DNA, 13 bp, C. elegans
aacatattttgct

SEQ ID NO: 690812 - DNA, 13 bp, C. elegans
aacatatttttct

SEQ ID NO: 690813 - DNA, 13 bp, C. elegans
aacatcaaacatt

SEQ ID NO: 690814 - DNA, 13 bp, C. elegans
aacatcaatttat

SEQ ID NO: 690815 - DNA, 13 bp, C. elegans
aacatcaatttca

SEQ ID NO: 690816 - DNA, 13 bp, C. elegans
aacatcaatttgc

SEQ ID NO: 690817 - DNA, 13 bp, C. elegans
aacatcagaaaat

SEQ ID NO: 690818 - DNA, 13 bp, C. elegans
aacatcagttctt

SEQ ID NO: 690819 - DNA, 13 bp, C. elegans
aacatcatattta

SEQ ID NO: 690820 - DNA, 13 bp, C. elegans
aacatcatttcaa

SEQ ID NO: 690821 - DNA, 13 bp, C. elegans
aacatcatttttc

SEQ ID NO: 690822 - DNA, 13 bp, C. elegans
aacatccaaacta

SEQ ID NO: 690823 - DNA, 13 bp, C. elegans
aacatccaaattt

SEQ ID NO: 690824 - DNA, 13 bp, C. elegans
aacatcgattttc

SEQ ID NO: 690825 - DNA, 13 bp, C. elegans
aacatcgcaaaaa

SEQ ID NO: 690826 - DNA, 13 bp, C. elegans
aacatctaaattt

SEQ ID NO: 690827 - DNA, 13 bp, C. elegans
aacatctattttt

SEQ ID NO: 690828 - DNA, 13 bp, C. elegans
aacatctcatttt

SEQ ID NO: 690829 - DNA, 13 bp, C. elegans
aacatctgaaaaa

SEQ ID NO: 690830 - DNA, 13 bp, C. elegans
aacatctgaaaat

SEQ ID NO: 690831 - DNA, 13 bp, C. elegans
aacatctgaaaca

SEQ ID NO: 690832 - DNA, 13 bp, C. elegans
aacatctgatcaa

SEQ ID NO: 690833 - DNA, 13 bp, C. elegans
aacatctgtgagg

SEQ ID NO: 690834 - DNA, 13 bp, C. elegans
aacatcttcaaaa

SEQ ID NO: 690835 - DNA, 13 bp, C. elegans
aacatcttcaata

SEQ ID NO: 690836 - DNA, 13 bp, C. elegans
aacatcttctttt

SEQ ID NO: 690837 - DNA, 13 bp, C. elegans
aacatctttgaaa

SEQ ID NO: 690838 - DNA, 13 bp, C. elegans
aacatgaaaaatg

SEQ ID NO: 690839 - DNA, 13 bp, C. elegans
aacatgaaaagat

SEQ ID NO: 690840 - DNA, 13 bp, C. elegans
aacatgaaaatat

SEQ ID NO: 690841 - DNA, 13 bp, C. elegans
aacatgaaaattg

SEQ ID NO: 690842 - DNA, 13 bp, C. elegans
aacatgaaacagt

SEQ ID NO: 690843 - DNA, 13 bp, C. elegans
aacatgaaatatt

SEQ ID NO: 690844 - DNA, 13 bp, C. elegans
aacatgaaattaa

SEQ ID NO: 690845 - DNA, 13 bp, C. elegans
aacatgaaattcg

SEQ ID NO: 690846 - DNA, 13 bp, C. elegans
aacatgaactttt

SEQ ID NO: 690847 - DNA, 13 bp, C. elegans
aacatgaatttca

SEQ ID NO: 690848 - DNA, 13 bp, C. elegans
aacatgaatttta

SEQ ID NO: 690849 - DNA, 13 bp, C. elegans
aacatgagatttt

SEQ ID NO: 690850 - DNA, 13 bp, C. elegans
aacatgataattt

SEQ ID NO: 690851 - DNA, 13 bp, C. elegans
aacatgcaaattg

SEQ ID NO: 690852 - DNA, 13 bp, C. elegans
aacatgcaacatt

SEQ ID NO: 690853 - DNA, 13 bp, C. elegans
aacatgcaatatt

SEQ ID NO: 690854 - DNA, 13 bp, C. elegans
aacatgcaatttt

SEQ ID NO: 690855 - DNA, 13 bp, C. elegans
aacatgcatttta

SEQ ID NO: 690856 - DNA, 13 bp, C. elegans
aacatgcattttt

SEQ ID NO: 690857 - DNA, 13 bp, C. elegans
aacatgccaaaaa

SEQ ID NO: 690858 - DNA, 13 bp, C. elegans
aacatgcgacatt

SEQ ID NO: 690859 - DNA, 13 bp, C. elegans
aacatgctttttt

SEQ ID NO: 690860 - DNA, 13 bp, C. elegans
aacatggaaatat

SEQ ID NO: 690861 - DNA, 13 bp, C. elegans
aacatggatttct

SEQ ID NO: 690862 - DNA, 13 bp, C. elegans
aacatgtaaaaac

SEQ ID NO: 690863 - DNA, 13 bp, C. elegans
aacatgtatttat

SEQ ID NO: 690864 - DNA, 13 bp, C. elegans
aacatgtattttg

SEQ ID NO: 690865 - DNA, 13 bp, C. elegans
aacatgttcaaat

SEQ ID NO: 690866 - DNA, 13 bp, C. elegans
aacatgttcatat

SEQ ID NO: 690867 - DNA, 13 bp, C. elegans
aacatgtttaaaa

SEQ ID NO: 690868 - DNA, 13 bp, C. elegans
aacatgtttcatt

SEQ ID NO: 690869 - DNA, 13 bp, C. elegans
aacatgttttaca

SEQ ID NO: 690870 - DNA, 13 bp, C. elegans
aacatgttttttc

SEQ ID NO: 690871 - DNA, 13 bp, C. elegans
aacattaaactta

SEQ ID NO: 690872 - DNA, 13 bp, C. elegans
aacattaactttt

SEQ ID NO: 690873 - DNA, 13 bp, C. elegans
aacattaatgaaa

SEQ ID NO: 690874 - DNA, 13 bp, C. elegans
aacattaattgaa

SEQ ID NO: 690875 - DNA, 13 bp, C. elegans
aacattaattgtt

SEQ ID NO: 690876 - DNA, 13 bp, C. elegans
aacattagatttt

SEQ ID NO: 690877 - DNA, 13 bp, C. elegans
aacattattcaaa

SEQ ID NO: 690878 - DNA, 13 bp, C. elegans
aacattattgaat

SEQ ID NO: 690879 - DNA, 13 bp, C. elegans
aacattatttcct

SEQ ID NO: 690880 - DNA, 13 bp, C. elegans
aacattatttttg

SEQ ID NO: 690881 - DNA, 13 bp, C. elegans
aacattcaaattt

SEQ ID NO: 690882 - DNA, 13 bp, C. elegans
aacattcaacttt

SEQ ID NO: 690883 - DNA, 13 bp, C. elegans
aacattcaagaat

SEQ ID NO: 690884 - DNA, 13 bp, C. elegans
aacattcaattga

SEQ ID NO: 690885 - DNA, 13 bp, C. elegans
aacattcacattt

SEQ ID NO: 690886 - DNA, 13 bp, C. elegans
aacattcagtttt

SEQ ID NO: 690887 - DNA, 13 bp, C. elegans
aacattcattatc

SEQ ID NO: 690888 - DNA, 13 bp, C. elegans
aacattcattcat

SEQ ID NO: 690889 - DNA, 13 bp, C. elegans
aacattcatttca

SEQ ID NO: 690890 - DNA, 13 bp, C. elegans
aacattcattttg

SEQ ID NO: 690891 - DNA, 13 bp, C. elegans
aacattcattttt

SEQ ID NO: 690892 - DNA, 13 bp, C. elegans
aacattccaaatt

SEQ ID NO: 690893 - DNA, 16 bp, C. elegans
aacattccagactttt

SEQ ID NO: 690894 - DNA, 13 bp, C. elegans
aacattcgaattt

SEQ ID NO: 690895 - DNA, 13 bp, C. elegans
aacattcgagaaa

SEQ ID NO: 690896 - DNA, 13 bp, C. elegans
aacattcgttttt

SEQ ID NO: 690897 - DNA, 13 bp, C. elegans
aacattctaaaat

SEQ ID NO: 690898 - DNA, 13 bp, C. elegans
aacattctcattt

SEQ ID NO: 690899 - DNA, 13 bp, C. elegans
aacattctggaat

SEQ ID NO: 690900 - DNA, 13 bp, C. elegans
aacattgaaaatt

SEQ ID NO: 690901 - DNA, 13 bp, C. elegans
aacattgaaactg

SEQ ID NO: 690902 - DNA, 13 bp, C. elegans
aacattgaaataa

SEQ ID NO: 690903 - DNA, 13 bp, C. elegans
aacattgaacaaa

SEQ ID NO: 690904 - DNA, 13 bp, C. elegans
aacattgaacatt

SEQ ID NO: 690905 - DNA, 13 bp, C. elegans
aacattgaacttt

SEQ ID NO: 690906 - DNA, 13 bp, C. elegans
aacattgaattat

SEQ ID NO: 690907 - DNA, 13 bp, C. elegans
aacattgacaaat

SEQ ID NO: 690908 - DNA, 13 bp, C. elegans
aacattgataatt

SEQ ID NO: 690909 - DNA, 13 bp, C. elegans
aacattgcatttt

SEQ ID NO: 690910 - DNA, 13 bp, C. elegans
aacattggaaatc

SEQ ID NO: 690911 - DNA, 13 bp, C. elegans
aacattgtaaaaa

SEQ ID NO: 690912 - DNA, 13 bp, C. elegans
aacattgtagttt

SEQ ID NO: 690913 - DNA, 13 bp, C. elegans
aacattgtataat

SEQ ID NO: 690914 - DNA, 13 bp, C. elegans
aacattgtgtttt

SEQ ID NO: 690915 - DNA, 13 bp, C. elegans
aacattgtttaaa

SEQ ID NO: 690916 - DNA, 13 bp, C. elegans
aacattgttttat

SEQ ID NO: 690917 - DNA, 13 bp, C. elegans
aacatttaaattc

SEQ ID NO: 690918 - DNA, 13 bp, C. elegans
aacatttaatgtt

SEQ ID NO: 690919 - DNA, 13 bp, C. elegans
aacatttacagaa

SEQ ID NO: 690920 - DNA, 13 bp, C. elegans
aacatttatagat

SEQ ID NO: 690921 - DNA, 13 bp, C. elegans
aacatttatattc

SEQ ID NO: 690922 - DNA, 13 bp, C. elegans
aacatttatcatt

SEQ ID NO: 690923 - DNA, 13 bp, C. elegans
aacatttatgaaa

SEQ ID NO: 690924 - DNA, 13 bp, C. elegans
aacatttatttgt

SEQ ID NO: 690925 - DNA, 13 bp, C. elegans
aacatttcaaaat

SEQ ID NO: 690926 - DNA, 13 bp, C. elegans
aacatttcaagaa

SEQ ID NO: 690927 - DNA, 13 bp, C. elegans
aacatttcaataa

SEQ ID NO: 690928 - DNA, 13 bp, C. elegans
aacatttcaattt

SEQ ID NO: 690929 - DNA, 13 bp, C. elegans
aacatttcacaaa

SEQ ID NO: 690930 - DNA, 13 bp, C. elegans
aacatttcagaat

SEQ ID NO: 690931 - DNA, 13 bp, C. elegans
aacatttccaaat

SEQ ID NO: 690932 - DNA, 13 bp, C. elegans
aacatttccaata

SEQ ID NO: 690933 - DNA, 13 bp, C. elegans
aacatttccattt

SEQ ID NO: 690934 - DNA, 13 bp, C. elegans
aacatttccggca

SEQ ID NO: 690935 - DNA, 13 bp, C. elegans
aacatttcgaaat

SEQ ID NO: 690936 - DNA, 13 bp, C. elegans
aacatttcgagaa

SEQ ID NO: 690937 - DNA, 13 bp, C. elegans
aacatttctagaa

SEQ ID NO: 690938 - DNA, 13 bp, C. elegans
aacatttctgcaa

SEQ ID NO: 690939 - DNA, 13 bp, C. elegans
aacatttcttcaa

SEQ ID NO: 690940 - DNA, 13 bp, C. elegans
aacatttcttttc

SEQ ID NO: 690941 - DNA, 13 bp, C. elegans
aacatttgaaatg

SEQ ID NO: 690942 - DNA, 13 bp, C. elegans
aacatttgaatca

SEQ ID NO: 690943 - DNA, 13 bp, C. elegans
aacatttgaatta

SEQ ID NO: 690944 - DNA, 13 bp, C. elegans
aacatttgagttt

SEQ ID NO: 690945 - DNA, 13 bp, C. elegans
aacatttgatttt

SEQ ID NO: 690946 - DNA, 13 bp, C. elegans
aacatttggaaat

SEQ ID NO: 690947 - DNA, 13 bp, C. elegans
aacatttggattt

SEQ ID NO: 690948 - DNA, 13 bp, C. elegans
aacatttgtcaaa

SEQ ID NO: 690949 - DNA, 13 bp, C. elegans
aacatttgtcatt

SEQ ID NO: 690950 - DNA, 13 bp, C. elegans
aacatttgttgaa

SEQ ID NO: 690951 - DNA, 13 bp, C. elegans
aacatttgtttca

SEQ ID NO: 690952 - DNA, 13 bp, C. elegans
aacatttgtttgt

SEQ ID NO: 690953 - DNA, 13 bp, C. elegans
aacatttgtttta

SEQ ID NO: 690954 - DNA, 13 bp, C. elegans
aacatttgttttt

SEQ ID NO: 690955 - DNA, 13 bp, C. elegans
aacattttacaaa

SEQ ID NO: 690956 - DNA, 13 bp, C. elegans
aacattttagatt

SEQ ID NO: 690957 - DNA, 13 bp, C. elegans
aacattttatcat

SEQ ID NO: 690958 - DNA, 13 bp, C. elegans
aacattttatgaa

SEQ ID NO: 690959 - DNA, 13 bp, C. elegans
aacattttattga

SEQ ID NO: 690960 - DNA, 13 bp, C. elegans
aacattttcaaaa

SEQ ID NO: 690961 - DNA, 13 bp, C. elegans
aacattttcaaga

SEQ ID NO: 690962 - DNA, 13 bp, C. elegans
aacattttcaagt

SEQ ID NO: 690963 - DNA, 13 bp, C. elegans
aacattttcaata

SEQ ID NO: 690964 - DNA, 13 bp, C. elegans
aacattttcaatt

SEQ ID NO: 690965 - DNA, 13 bp, C. elegans
aacattttcacaa

SEQ ID NO: 690966 - DNA, 13 bp, C. elegans
aacattttcagat

SEQ ID NO: 690967 - DNA, 13 bp, C. elegans
aacattttcataa

SEQ ID NO: 690968 - DNA, 13 bp, C. elegans
aacattttccaaa

SEQ ID NO: 690969 - DNA, 13 bp, C. elegans
aacattttccaat

SEQ ID NO: 690970 - DNA, 13 bp, C. elegans
aacattttcgatt

SEQ ID NO: 690971 - DNA, 13 bp, C. elegans
aacattttctaaa

SEQ ID NO: 690972 - DNA, 13 bp, C. elegans
aacattttctgaa

SEQ ID NO: 690973 - DNA, 13 bp, C. elegans
aacattttcttaa

SEQ ID NO: 690974 - DNA, 13 bp, C. elegans
aacattttcttat

SEQ ID NO: 690975 - DNA, 13 bp, C. elegans
aacattttctttc

SEQ ID NO: 690976 - DNA, 13 bp, C. elegans
aacattttgaaaa

SEQ ID NO: 690977 - DNA, 13 bp, C. elegans
aacattttgaaat

SEQ ID NO: 690978 - DNA, 13 bp, C. elegans
aacattttgaaca

SEQ ID NO: 690979 - DNA, 13 bp, C. elegans
aacattttgagaa

SEQ ID NO: 690980 - DNA, 13 bp, C. elegans
aacattttgagca

SEQ ID NO: 690981 - DNA, 13 bp, C. elegans
aacattttgatga

SEQ ID NO: 690982 - DNA, 13 bp, C. elegans
aacattttgctaa

SEQ ID NO: 690983 - DNA, 13 bp, C. elegans
aacattttgggaa

SEQ ID NO: 690984 - DNA, 13 bp, C. elegans
aacattttgtgtg

SEQ ID NO: 690985 - DNA, 13 bp, C. elegans
aacattttgttag

SEQ ID NO: 690986 - DNA, 13 bp, C. elegans
aacatttttacat

SEQ ID NO: 690987 - DNA, 13 bp, C. elegans
aacatttttagaa

SEQ ID NO: 690988 - DNA, 13 bp, C. elegans
aacatttttcaca

SEQ ID NO: 690989 - DNA, 13 bp, C. elegans
aacatttttcaga

SEQ ID NO: 690990 - DNA, 13 bp, C. elegans
aacatttttcgaa

SEQ ID NO: 690991 - DNA, 13 bp, C. elegans
aacatttttcgat

SEQ ID NO: 690992 - DNA, 13 bp, C. elegans
aacatttttctca

SEQ ID NO: 690993 - DNA, 13 bp, C. elegans
aacatttttctct

SEQ ID NO: 690994 - DNA, 13 bp, C. elegans
aacatttttctgt

SEQ ID NO: 690995 - DNA, 13 bp, C. elegans
aacatttttgaaa

SEQ ID NO: 690996 - DNA, 13 bp, C. elegans
aacatttttgaac

SEQ ID NO: 690997 - DNA, 13 bp, C. elegans
aacatttttgcag

SEQ ID NO: 690998 - DNA, 13 bp, C. elegans
aacatttttgctt

SEQ ID NO: 690999 - DNA, 13 bp, C. elegans
aacatttttggaa

SEQ ID NO: 691000 - DNA, 13 bp, C. elegans
aacatttttggat

SEQ ID NO: 691001 - DNA, 13 bp, C. elegans
aacatttttgtag

SEQ ID NO: 691002 - DNA, 13 bp, C. elegans
aacatttttgttg

SEQ ID NO: 691003 - DNA, 13 bp, C. elegans
aacattttttcag

SEQ ID NO: 691004 - DNA, 13 bp, C. elegans
aacattttttcct

SEQ ID NO: 691005 - DNA, 13 bp, C. elegans
aacattttttctc

SEQ ID NO: 691006 - DNA, 13 bp, C. elegans
aacattttttctg

SEQ ID NO: 691007 - DNA, 13 bp, C. elegans
aacattttttgaa

SEQ ID NO: 691008 - DNA, 13 bp, C. elegans
aacattttttgta

SEQ ID NO: 691009 - DNA, 13 bp, C. elegans
aaccaaaaaatcg

SEQ ID NO: 691010 - DNA, 13 bp, C. elegans
aaccaaaaactgc

SEQ ID NO: 691011 - DNA, 13 bp, C. elegans
aaccaaaaactgg

SEQ ID NO: 691012 - DNA, 13 bp, C. elegans
aaccaaaaatgtt

SEQ ID NO: 691013 - DNA, 13 bp, C. elegans
aaccaaaaattgt

SEQ ID NO: 691014 - DNA, 13 bp, C. elegans
aaccaaaagtttt

SEQ ID NO: 691015 - DNA, 13 bp, C. elegans
aaccaaaatgaga

SEQ ID NO: 691016 - DNA, 13 bp, C. elegans
aaccaaaatggac

SEQ ID NO: 691017 - DNA, 13 bp, C. elegans
aaccaaaattcta

SEQ ID NO: 691018 - DNA, 13 bp, C. elegans
aaccaaagagtaa

SEQ ID NO: 691019 - DNA, 13 bp, C. elegans
aaccaaagttttc

SEQ ID NO: 691020 - DNA, 13 bp, C. elegans
aaccaaatatcat

SEQ ID NO: 691021 - DNA, 13 bp, C. elegans
aaccaaatgaata

SEQ ID NO: 691022 - DNA, 13 bp, C. elegans
aaccaaatttatt

SEQ ID NO: 691023 - DNA, 13 bp, C. elegans
aaccaaatttcat

SEQ ID NO: 691024 - DNA, 13 bp, C. elegans
aaccaaatttttg

SEQ ID NO: 691025 - DNA, 13 bp, C. elegans
aaccaaatttttt

SEQ ID NO: 691026 - DNA, 13 bp, C. elegans
aaccaacaaaatg

SEQ ID NO: 691027 - DNA, 13 bp, C. elegans
aaccaacaaattt

SEQ ID NO: 691028 - DNA, 13 bp, C. elegans
aaccaaggcgacc

SEQ ID NO: 691029 - DNA, 13 bp, C. elegans
aaccaataattat

SEQ ID NO: 691030 - DNA, 13 bp, C. elegans
aaccaataatttc

SEQ ID NO: 691031 - DNA, 13 bp, C. elegans
aaccaatatccct

SEQ ID NO: 691032 - DNA, 13 bp, C. elegans
aaccaatattttc

SEQ ID NO: 691033 - DNA, 13 bp, C. elegans
aaccaatcaattt

SEQ ID NO: 691034 - DNA, 13 bp, C. elegans
aaccaatcagcga

SEQ ID NO: 691035 - DNA, 13 bp, C. elegans
aaccaattaattt

SEQ ID NO: 691036 - DNA, 13 bp, C. elegans
aaccaattgattt

SEQ ID NO: 691037 - DNA, 13 bp, C. elegans
aaccaatttaaat

SEQ ID NO: 691038 - DNA, 13 bp, C. elegans
aaccaatttgtgt

SEQ ID NO: 691039 - DNA, 13 bp, C. elegans
aaccaattttctt

SEQ ID NO: 691040 - DNA, 13 bp, C. elegans
aaccacaaattgc

SEQ ID NO: 691041 - DNA, 13 bp, C. elegans
aaccacaattacc

SEQ ID NO: 691042 - DNA, 13 bp, C. elegans
aaccacaattttc

SEQ ID NO: 691043 - DNA, 13 bp, C. elegans
aaccacgtggtgt

SEQ ID NO: 691044 - DNA, 13 bp, C. elegans
aaccactgaaaat

SEQ ID NO: 691045 - DNA, 13 bp, C. elegans
aaccacttcaaca

SEQ ID NO: 691046 - DNA, 13 bp, C. elegans
aaccactttttca

SEQ ID NO: 691047 - DNA, 13 bp, C. elegans
aaccagaaaaatc

SEQ ID NO: 691048 - DNA, 13 bp, C. elegans
aaccagaaaatca

SEQ ID NO: 691049 - DNA, 13 bp, C. elegans
aaccagcaatgac

SEQ ID NO: 691050 - DNA, 13 bp, C. elegans
aaccagtaaaaat

SEQ ID NO: 691051 - DNA, 13 bp, C. elegans
aaccagtaatttt

SEQ ID NO: 691052 - DNA, 13 bp, C. elegans
aaccagttgagaa

SEQ ID NO: 691053 - DNA, 13 bp, C. elegans
aaccataggaaat

SEQ ID NO: 691054 - DNA, 13 bp, C. elegans
aaccatgagatca

SEQ ID NO: 691055 - DNA, 13 bp, C. elegans
aaccattgaaaaa

SEQ ID NO: 691056 - DNA, 13 bp, C. elegans
aaccatttcacaa

SEQ ID NO: 691057 - DNA, 13 bp, C. elegans
aaccattttctaa

SEQ ID NO: 691058 - DNA, 13 bp, C. elegans
aaccatttttcat

SEQ ID NO: 691059 - DNA, 13 bp, C. elegans
aaccattttttaa

SEQ ID NO: 691060 - DNA, 13 bp, C. elegans
aacccaaaaaatg

SEQ ID NO: 691061 - DNA, 13 bp, C. elegans
aacccaaaaatgt

SEQ ID NO: 691062 - DNA, 13 bp, C. elegans
aacccaaactttt

SEQ ID NO: 691063 - DNA, 13 bp, C. elegans
aacccacaaaatt

SEQ ID NO: 691064 - DNA, 13 bp, C. elegans
aacccattttttt

SEQ ID NO: 691065 - DNA, 13 bp, C. elegans
aaccccgaaattt

SEQ ID NO: 691066 - DNA, 13 bp, C. elegans
aaccccgcccact

SEQ ID NO: 691067 - DNA, 13 bp, C. elegans
aaccccgtgaaaa

SEQ ID NO: 691068 - DNA, 13 bp, C. elegans
aacccctgaaatc

SEQ ID NO: 691069 - DNA, 13 bp, C. elegans
aacccgaaaattc

SEQ ID NO: 691070 - DNA, 13 bp, C. elegans
aaccctaaaaatt

SEQ ID NO: 691071 - DNA, 13 bp, C. elegans
aaccgaaaattta

SEQ ID NO: 691072 - DNA, 13 bp, C. elegans
aaccgaataaaat

SEQ ID NO: 691073 - DNA, 13 bp, C. elegans
aaccgaattttct

SEQ ID NO: 691074 - DNA, 13 bp, C. elegans
aaccgacaccctt

SEQ ID NO: 691075 - DNA, 13 bp, C. elegans
aaccgagaaagtg

SEQ ID NO: 691076 - DNA, 13 bp, C. elegans
aaccgagatggga

SEQ ID NO: 691077 - DNA, 13 bp, C. elegans
aaccgccaatttg

SEQ ID NO: 691078 - DNA, 13 bp, C. elegans
aaccgccataaaa

SEQ ID NO: 691079 - DNA, 13 bp, C. elegans
aaccgctccaaaa

SEQ ID NO: 691080 - DNA, 13 bp, C. elegans
aaccgctgaaaat

SEQ ID NO: 691081 - DNA, 13 bp, C. elegans
aaccggaaaatcg

SEQ ID NO: 691082 - DNA, 13 bp, C. elegans
aaccggaaaattt

SEQ ID NO: 691083 - DNA, 13 bp, C. elegans
aaccggaaattat

SEQ ID NO: 691084 - DNA, 13 bp, C. elegans
aaccggcaatttc

SEQ ID NO: 691085 - DNA, 13 bp, C. elegans
aaccgtgccgcaa

SEQ ID NO: 691086 - DNA, 13 bp, C. elegans
aaccgttaaaaaa

SEQ ID NO: 691087 - DNA, 13 bp, C. elegans
aaccgtttttttt

SEQ ID NO: 691088 - DNA, 13 bp, C. elegans
aacctaaacctaa

SEQ ID NO: 691089 - DNA, 13 bp, C. elegans
aacctaaattttt

SEQ ID NO: 691090 - DNA, 13 bp, C. elegans
aacctatataatt

SEQ ID NO: 691091 - DNA, 13 bp, C. elegans
aacctatatacat

SEQ ID NO: 691092 - DNA, 13 bp, C. elegans
aacctcaagtttc

SEQ ID NO: 691093 - DNA, 13 bp, C. elegans
aacctgaaaagaa

SEQ ID NO: 691094 - DNA, 13 bp, C. elegans
aacctgaaaatca

SEQ ID NO: 691095 - DNA, 13 bp, C. elegans
aacctgaaattaa

SEQ ID NO: 691096 - DNA, 13 bp, C. elegans
aacctgaatattt

SEQ ID NO: 691097 - DNA, 13 bp, C. elegans
aacctgaattttc

SEQ ID NO: 691098 - DNA, 13 bp, C. elegans
aacctgatttttg

SEQ ID NO: 691099 - DNA, 13 bp, C. elegans
aacctgatttttt

SEQ ID NO: 691100 - DNA, 13 bp, C. elegans
aacctgcccgcct

SEQ ID NO: 691101 - DNA, 15 bp, C. elegans
aacctggtctacact

SEQ ID NO: 691102 - DNA, 14 bp, C. elegans
aaccttcaattttt

SEQ ID NO: 691103 - DNA, 13 bp, C. elegans
aaccttctcaaaa

SEQ ID NO: 691104 - DNA, 13 bp, C. elegans
aaccttctggaat

SEQ ID NO: 691105 - DNA, 13 bp, C. elegans
aaccttctgggaa

SEQ ID NO: 691106 - DNA, 13 bp, C. elegans
aaccttgattttt

SEQ ID NO: 691107 - DNA, 13 bp, C. elegans
aacctttattaca

SEQ ID NO: 691108 - DNA, 13 bp, C. elegans
aacctttcaaaaa

SEQ ID NO: 691109 - DNA, 13 bp, C. elegans
aacctttcaaatt

SEQ ID NO: 691110 - DNA, 13 bp, C. elegans
aaccttttaattt

SEQ ID NO: 691111 - DNA, 13 bp, C. elegans
aacctttttcaaa

SEQ ID NO: 691112 - DNA, 13 bp, C. elegans
aaccttttttgtt

SEQ ID NO: 691113 - DNA, 13 bp, C. elegans
aacctttttttgc

SEQ ID NO: 691114 - DNA, 13 bp, C. elegans
aacgaaaaatatt

SEQ ID NO: 691115 - DNA, 13 bp, C. elegans
aacgaaaatcaat

SEQ ID NO: 691116 - DNA, 13 bp, C. elegans
aacgaaaatgtgt

SEQ ID NO: 691117 - DNA, 13 bp, C. elegans
aacgaaaatgttc

SEQ ID NO: 691118 - DNA, 13 bp, C. elegans
aacgaaaattaat

SEQ ID NO: 691119 - DNA, 13 bp, C. elegans
aacgaaaattaga

SEQ ID NO: 691120 - DNA, 13 bp, C. elegans
aacgaaaattctt

SEQ ID NO: 691121 - DNA, 13 bp, C. elegans
aacgaaatattta

SEQ ID NO: 691122 - DNA, 13 bp, C. elegans
aacgaaatcgata

SEQ ID NO: 691123 - DNA, 13 bp, C. elegans
aacgaaatgtgat

SEQ ID NO: 691124 - DNA, 13 bp, C. elegans
aacgaacaatttt

SEQ ID NO: 691125 - DNA, 13 bp, C. elegans
aacgaactttttt

SEQ ID NO: 691126 - DNA, 13 bp, C. elegans
aacgaagaaattg

SEQ ID NO: 691127 - DNA, 13 bp, C. elegans
aacgaatagttta

SEQ ID NO: 691128 - DNA, 13 bp, C. elegans
aacgaatataagt

SEQ ID NO: 691129 - DNA, 13 bp, C. elegans
aacgaatccaatt

SEQ ID NO: 691130 - DNA, 13 bp, C. elegans
aacgaattcaaaa

SEQ ID NO: 691131 - DNA, 13 bp, C. elegans
aacgaattcattt

SEQ ID NO: 691132 - DNA, 13 bp, C. elegans
aacgaatttcgta

SEQ ID NO: 691133 - DNA, 13 bp, C. elegans
aacgaatttgaaa

SEQ ID NO: 691134 - DNA, 13 bp, C. elegans
aacgaattttgtg

SEQ ID NO: 691135 - DNA, 13 bp, C. elegans
aacgacaaatttt

SEQ ID NO: 691136 - DNA, 13 bp, C. elegans
aacgaccatttat

SEQ ID NO: 691137 - DNA, 13 bp, C. elegans
aacgactgaaaaa

SEQ ID NO: 691138 - DNA, 13 bp, C. elegans
aacgactggcgga

SEQ ID NO: 691139 - DNA, 13 bp, C. elegans
aacgagcaacaag

SEQ ID NO: 691140 - DNA, 13 bp, C. elegans
aacgagccgcgac

SEQ ID NO: 691141 - DNA, 13 bp, C. elegans
aacgaggaaaatg

SEQ ID NO: 691142 - DNA, 13 bp, C. elegans
aacgagtgtgggt

SEQ ID NO: 691143 - DNA, 13 bp, C. elegans
aacgagtttcctt

SEQ ID NO: 691144 - DNA, 13 bp, C. elegans
aacgagtttttct

SEQ ID NO: 691145 - DNA, 13 bp, C. elegans
aacgagttttttt

SEQ ID NO: 691146 - DNA, 13 bp, C. elegans
aacgataattttc

SEQ ID NO: 691147 - DNA, 13 bp, C. elegans
aacgatgctccga

SEQ ID NO: 691148 - DNA, 13 bp, C. elegans
aacgattaaaatt

SEQ ID NO: 691149 - DNA, 14 bp, C. elegans
aacgattgatagtt

SEQ ID NO: 691150 - DNA, 13 bp, C. elegans
aacgatttttaga

SEQ ID NO: 691151 - DNA, 13 bp, C. elegans
aacgatttttcca

SEQ ID NO: 691152 - DNA, 13 bp, C. elegans
aacgatttttccg

SEQ ID NO: 691153 - DNA, 13 bp, C. elegans
aacgatttttgtt

SEQ ID NO: 691154 - DNA, 13 bp, C. elegans
aacgatttttttt

SEQ ID NO: 691155 - DNA, 13 bp, C. elegans
aacgcaaaaaatt

SEQ ID NO: 691156 - DNA, 13 bp, C. elegans
aacgcaagctctt

SEQ ID NO: 691157 - DNA, 13 bp, C. elegans
aacgcacaaaact

SEQ ID NO: 691158 - DNA, 13 bp, C. elegans
aacgcgctccaat

SEQ ID NO: 691159 - DNA, 13 bp, C. elegans
aacgctgaaaata

SEQ ID NO: 691160 - DNA, 13 bp, C. elegans
aacggaaaaatgg

SEQ ID NO: 691161 - DNA, 13 bp, C. elegans
aacggaaaaatgt

SEQ ID NO: 691162 - DNA, 13 bp, C. elegans
aacggaaactatt

SEQ ID NO: 691163 - DNA, 13 bp, C. elegans
aacggaattattt

SEQ ID NO: 691164 - DNA, 13 bp, C. elegans
aacggcctgaaaa

SEQ ID NO: 691165 - DNA, 13 bp, C. elegans
aacgggaaaaaat

SEQ ID NO: 691166 - DNA, 13 bp, C. elegans
aacgggaaaaata

SEQ ID NO: 691167 - DNA, 13 bp, C. elegans
aacggttttattt

SEQ ID NO: 691168 - DNA, 13 bp, C. elegans
aacggtttttttt

SEQ ID NO: 691169 - DNA, 13 bp, C. elegans
aacgtactgacgt

SEQ ID NO: 691170 - DNA, 13 bp, C. elegans
aacgtataatttt

SEQ ID NO: 691171 - DNA, 13 bp, C. elegans
aacgtattatttt

SEQ ID NO: 691172 - DNA, 13 bp, C. elegans
aacgtatttttaa

SEQ ID NO: 691173 - DNA, 13 bp, C. elegans
aacgtctgaaatt

SEQ ID NO: 691174 - DNA, 13 bp, C. elegans
aacgtgaaatttt

SEQ ID NO: 691175 - DNA, 13 bp, C. elegans
aacgtgatttttg

SEQ ID NO: 691176 - DNA, 13 bp, C. elegans
aacgtgttttttg

SEQ ID NO: 691177 - DNA, 13 bp, C. elegans
aacgttcaaagtt

SEQ ID NO: 691178 - DNA, 13 bp, C. elegans
aacgttcattttc

SEQ ID NO: 691179 - DNA, 13 bp, C. elegans
aacgttccaaaat

SEQ ID NO: 691180 - DNA, 13 bp, C. elegans
aacgttgaaattt

SEQ ID NO: 691181 - DNA, 13 bp, C. elegans
aacgttgtcaaaa

SEQ ID NO: 691182 - DNA, 13 bp, C. elegans
aacgtttcaaaat

SEQ ID NO: 691183 - DNA, 13 bp, C. elegans
aacgtttggaaaa

SEQ ID NO: 691184 - DNA, 13 bp, C. elegans
aacgtttgttttt

SEQ ID NO: 691185 - DNA, 13 bp, C. elegans
aacgttttaatat

SEQ ID NO: 691186 - DNA, 13 bp, C. elegans
aacgttttatcat

SEQ ID NO: 691187 - DNA, 13 bp, C. elegans
aacgttttcaaga

SEQ ID NO: 691188 - DNA, 13 bp, C. elegans
aacgttttcaata

SEQ ID NO: 691189 - DNA, 13 bp, C. elegans
aacgttttcagtt

SEQ ID NO: 691190 - DNA, 13 bp, C. elegans
aacgttttccaac

SEQ ID NO: 691191 - DNA, 13 bp, C. elegans
aacgttttctttt

SEQ ID NO: 691192 - DNA, 13 bp, C. elegans
aacgttttggaaa

SEQ ID NO: 691193 - DNA, 13 bp, C. elegans
aacgtttttaaat

SEQ ID NO: 691194 - DNA, 13 bp, C. elegans
aacgtttttcaac

SEQ ID NO: 691195 - DNA, 13 bp, C. elegans
aacgtttttctag

SEQ ID NO: 691196 - DNA, 13 bp, C. elegans
aacgtttttctgt

SEQ ID NO: 691197 - DNA, 13 bp, C. elegans
aacgtttttcttc

SEQ ID NO: 691198 - DNA, 13 bp, C. elegans
aacgttttttaat

SEQ ID NO: 691199 - DNA, 13 bp, C. elegans
aacgttttttatt

SEQ ID NO: 691200 - DNA, 13 bp, C. elegans
aacgttttttgaa

SEQ ID NO: 691201 - DNA, 13 bp, C. elegans
aacgttttttttc

SEQ ID NO: 691202 - DNA, 13 bp, C. elegans
aactaaaaactga

SEQ ID NO: 691203 - DNA, 13 bp, C. elegans
aactaaaaatgct

SEQ ID NO: 691204 - DNA, 13 bp, C. elegans
aactaaaagtttt

SEQ ID NO: 691205 - DNA, 13 bp, C. elegans
aactaaacgtttt

SEQ ID NO: 691206 - DNA, 13 bp, C. elegans
aactaaacttttt

SEQ ID NO: 691207 - DNA, 13 bp, C. elegans
aactaaagttttc

SEQ ID NO: 691208 - DNA, 13 bp, C. elegans
aactaaatatttc

SEQ ID NO: 691209 - DNA, 14 bp, C. elegans
aactaaatgtattt

SEQ ID NO: 691210 - DNA, 13 bp, C. elegans
aactaaatttaac

SEQ ID NO: 691211 - DNA, 13 bp, C. elegans
aactaacttattt

SEQ ID NO: 691212 - DNA, 13 bp, C. elegans
aactaataaattg

SEQ ID NO: 691213 - DNA, 13 bp, C. elegans
aactaatatccct

SEQ ID NO: 691214 - DNA, 13 bp, C. elegans
aactaatgaaata

SEQ ID NO: 691215 - DNA, 13 bp, C. elegans
aactaatgcaatt

SEQ ID NO: 691216 - DNA, 13 bp, C. elegans
aactaatgcattt

SEQ ID NO: 691217 - DNA, 13 bp, C. elegans
aactaattttaac

SEQ ID NO: 691218 - DNA, 13 bp, C. elegans
aactaatttttga

SEQ ID NO: 691219 - DNA, 13 bp, C. elegans
aactacaaaactt

SEQ ID NO: 691220 - DNA, 13 bp, C. elegans
aactacaaagact

SEQ ID NO: 691221 - DNA, 13 bp, C. elegans
aactacaaatcta

SEQ ID NO: 691222 - DNA, 13 bp, C. elegans
aactacaaatttg

SEQ ID NO: 691223 - DNA, 13 bp, C. elegans
aactacaacaatt

SEQ ID NO: 691224 - DNA, 13 bp, C. elegans
aactacaacattt

SEQ ID NO: 691225 - DNA, 13 bp, C. elegans
aactacaataatc

SEQ ID NO: 691226 - DNA, 13 bp, C. elegans
aactacaataatt

SEQ ID NO: 691227 - DNA, 13 bp, C. elegans
aactacaatgttc

SEQ ID NO: 691228 - DNA, 13 bp, C. elegans
aactacaattttc

SEQ ID NO: 691229 - DNA, 13 bp, C. elegans
aactacaattttt

SEQ ID NO: 691230 - DNA, 13 bp, C. elegans
aactacacaaatt

SEQ ID NO: 691231 - DNA, 13 bp, C. elegans
aactacacaattt

SEQ ID NO: 691232 - DNA, 13 bp, C. elegans
aactacagtaacc

SEQ ID NO: 691233 - DNA, 14 bp, C. elegans
aactacagtaatcc

SEQ ID NO: 691234 - DNA, 13 bp, C. elegans
aactacagtaatt

SEQ ID NO: 691235 - DNA, 13 bp, C. elegans
aactacagtaccc

SEQ ID NO: 691236 - DNA, 13 bp, C. elegans
aactacagtattc

SEQ ID NO: 691237 - DNA, 13 bp, C. elegans
aactacatcaata

SEQ ID NO: 691238 - DNA, 13 bp, C. elegans
aactacatgaaaa

SEQ ID NO: 691239 - DNA, 13 bp, C. elegans
aactacatgttta

SEQ ID NO: 691240 - DNA, 13 bp, C. elegans
aactaccaaaatt

SEQ ID NO: 691241 - DNA, 13 bp, C. elegans
aactaccgtaatc

SEQ ID NO: 691242 - DNA, 13 bp, C. elegans
aactaccgtactc

SEQ ID NO: 691243 - DNA, 13 bp, C. elegans
aactacgaaaaac

SEQ ID NO: 691244 - DNA, 13 bp, C. elegans
aactacgaaaaat

SEQ ID NO: 691245 - DNA, 13 bp, C. elegans
aactacgacactc

SEQ ID NO: 691246 - DNA, 13 bp, C. elegans
aactacggatgat

SEQ ID NO: 691247 - DNA, 13 bp, C. elegans
aactacggtagtt

SEQ ID NO: 691248 - DNA, 13 bp, C. elegans
aactactacagta

SEQ ID NO: 691249 - DNA, 13 bp, C. elegans
aactactactact

SEQ ID NO: 691250 - DNA, 13 bp, C. elegans
aactactggaaat

SEQ ID NO: 691251 - DNA, 13 bp, C. elegans
aactacttgaaaa

SEQ ID NO: 691252 - DNA, 13 bp, C. elegans
aactactttgaaa

SEQ ID NO: 691253 - DNA, 13 bp, C. elegans
aactagaaacatt

SEQ ID NO: 691254 - DNA, 13 bp, C. elegans
aactagaaatgct

SEQ ID NO: 691255 - DNA, 13 bp, C. elegans
aactagaatttct

SEQ ID NO: 691256 - DNA, 13 bp, C. elegans
aactagaattttg

SEQ ID NO: 691257 - DNA, 13 bp, C. elegans
aactagcaaaaat

SEQ ID NO: 691258 - DNA, 13 bp, C. elegans
aactagttcaact

SEQ ID NO: 691259 - DNA, 13 bp, C. elegans
aactataaaattg

SEQ ID NO: 691260 - DNA, 13 bp, C. elegans
aactataactttt

SEQ ID NO: 691261 - DNA, 13 bp, C. elegans
aactatactaatt

SEQ ID NO: 691262 - DNA, 13 bp, C. elegans
aactatacttttt

SEQ ID NO: 691263 - DNA, 13 bp, C. elegans
aactatagaaaat

SEQ ID NO: 691264 - DNA, 13 bp, C. elegans
aactatattttca

SEQ ID NO: 691265 - DNA, 13 bp, C. elegans
aactatattttct

SEQ ID NO: 691266 - DNA, 13 bp, C. elegans
aactatcaaatta

SEQ ID NO: 691267 - DNA, 13 bp, C. elegans
aactatcaatttt

SEQ ID NO: 691268 - DNA, 13 bp, C. elegans
aactatgaaaaat

SEQ ID NO: 691269 - DNA, 13 bp, C. elegans
aactatgaaaact

SEQ ID NO: 691270 - DNA, 13 bp, C. elegans
aactatgaaattt

SEQ ID NO: 691271 - DNA, 13 bp, C. elegans
aactatgaatatt

SEQ ID NO: 691272 - DNA, 13 bp, C. elegans
aactatgagaaat

SEQ ID NO: 691273 - DNA, 13 bp, C. elegans
aactatgataaaa

SEQ ID NO: 691274 - DNA, 13 bp, C. elegans
aactatgatattc

SEQ ID NO: 691275 - DNA, 13 bp, C. elegans
aactatgatcttt

SEQ ID NO: 691276 - DNA, 13 bp, C. elegans
aactatgattttt

SEQ ID NO: 691277 - DNA, 13 bp, C. elegans
aactatgcgaaat

SEQ ID NO: 691278 - DNA, 13 bp, C. elegans
aactattcaaata

SEQ ID NO: 691279 - DNA, 13 bp, C. elegans
aactattcaaatc

SEQ ID NO: 691280 - DNA, 13 bp, C. elegans
aactattcaattt

SEQ ID NO: 691281 - DNA, 13 bp, C. elegans
aactattccaatt

SEQ ID NO: 691282 - DNA, 13 bp, C. elegans
aactattcgaaaa

SEQ ID NO: 691283 - DNA, 13 bp, C. elegans
aactattcgaaat

SEQ ID NO: 691284 - DNA, 13 bp, C. elegans
aactattgatttt

SEQ ID NO: 691285 - DNA, 13 bp, C. elegans
aactattggaaaa

SEQ ID NO: 691286 - DNA, 13 bp, C. elegans
aactatttagaaa

SEQ ID NO: 691287 - DNA, 13 bp, C. elegans
aactatttatttc

SEQ ID NO: 691288 - DNA, 13 bp, C. elegans
aactatttcaaaa

SEQ ID NO: 691289 - DNA, 13 bp, C. elegans
aactatttctaaa

SEQ ID NO: 691290 - DNA, 13 bp, C. elegans
aactattttaaag

SEQ ID NO: 691291 - DNA, 13 bp, C. elegans
aactattttctat

SEQ ID NO: 691292 - DNA, 13 bp, C. elegans
aactattttgttt

SEQ ID NO: 691293 - DNA, 13 bp, C. elegans
aactatttttccg

SEQ ID NO: 691294 - DNA, 13 bp, C. elegans
aactatttttgat

SEQ ID NO: 691295 - DNA, 13 bp, C. elegans
aactcaaaaagtc

SEQ ID NO: 691296 - DNA, 13 bp, C. elegans
aactcaaaactgg

SEQ ID NO: 691297 - DNA, 13 bp, C. elegans
aactcaaaagttc

SEQ ID NO: 691298 - DNA, 13 bp, C. elegans
aactcaaaatcat

SEQ ID NO: 691299 - DNA, 13 bp, C. elegans
aactcaaaattat

SEQ ID NO: 691300 - DNA, 13 bp, C. elegans
aactcaaaattct

SEQ ID NO: 691301 - DNA, 13 bp, C. elegans
aactcaaactcaa

SEQ ID NO: 691302 - DNA, 13 bp, C. elegans
aactcaaactttg

SEQ ID NO: 691303 - DNA, 13 bp, C. elegans
aactcaaactttt

SEQ ID NO: 691304 - DNA, 13 bp, C. elegans
aactcaaatattt

SEQ ID NO: 691305 - DNA, 13 bp, C. elegans
aactcaaattaat

SEQ ID NO: 691306 - DNA, 13 bp, C. elegans
aactcaaattcaa

SEQ ID NO: 691307 - DNA, 13 bp, C. elegans
aactcaaatttcc

SEQ ID NO: 691308 - DNA, 13 bp, C. elegans
aactcaagttttt

SEQ ID NO: 691309 - DNA, 13 bp, C. elegans
aactcaatttgaa

SEQ ID NO: 691310 - DNA, 13 bp, C. elegans
aactcaattttaa

SEQ ID NO: 691311 - DNA, 13 bp, C. elegans
aactcaattttat

SEQ ID NO: 691312 - DNA, 13 bp, C. elegans
aactcaattttca

SEQ ID NO: 691313 - DNA, 13 bp, C. elegans
aactcaattttcc

SEQ ID NO: 691314 - DNA, 13 bp, C. elegans
aactcaatttttc

SEQ ID NO: 691315 - DNA, 13 bp, C. elegans
aactcacactttc

SEQ ID NO: 691316 - DNA, 13 bp, C. elegans
aactcataattta

SEQ ID NO: 691317 - DNA, 13 bp, C. elegans
aactcataatttt

SEQ ID NO: 691318 - DNA, 13 bp, C. elegans
aactcatatttca

SEQ ID NO: 691319 - DNA, 13 bp, C. elegans
aactcatcatttt

SEQ ID NO: 691320 - DNA, 13 bp, C. elegans
aactcattcaaac

SEQ ID NO: 691321 - DNA, 13 bp, C. elegans
aactcattgtttt

SEQ ID NO: 691322 - DNA, 13 bp, C. elegans
aactcatttttca

SEQ ID NO: 691323 - DNA, 13 bp, C. elegans
aactcatttttcc

SEQ ID NO: 691324 - DNA, 13 bp, C. elegans
aactcatttttga

SEQ ID NO: 691325 - DNA, 13 bp, C. elegans
aactcattttttc

SEQ ID NO: 691326 - DNA, 13 bp, C. elegans
aactccaaaaatc

SEQ ID NO: 691327 - DNA, 13 bp, C. elegans
aactccaaaacta

SEQ ID NO: 691328 - DNA, 13 bp, C. elegans
aactccaaaactt

SEQ ID NO: 691329 - DNA, 13 bp, C. elegans
aactccaaaatta

SEQ ID NO: 691330 - DNA, 13 bp, C. elegans
aactccaaaattt

SEQ ID NO: 691331 - DNA, 13 bp, C. elegans
aactccaagcaaa

SEQ ID NO: 691332 - DNA, 13 bp, C. elegans
aactccagaattc

SEQ ID NO: 691333 - DNA, 13 bp, C. elegans
aactccattattt

SEQ ID NO: 691334 - DNA, 13 bp, C. elegans
aactccattttta

SEQ ID NO: 691335 - DNA, 13 bp, C. elegans
aactcccaatttt

SEQ ID NO: 691336 - DNA, 13 bp, C. elegans
aactccgcccact

SEQ ID NO: 691337 - DNA, 13 bp, C. elegans
aactccgcccatt

SEQ ID NO: 691338 - DNA, 13 bp, C. elegans
aactccggcaatt

SEQ ID NO: 691339 - DNA, 13 bp, C. elegans
aactcctaaaaat

SEQ ID NO: 691340 - DNA, 13 bp, C. elegans
aactcctctaaaa

SEQ ID NO: 691341 - DNA, 13 bp, C. elegans
aactcgaaaaact

SEQ ID NO: 691342 - DNA, 13 bp, C. elegans
aactcgaaaaatc

SEQ ID NO: 691343 - DNA, 13 bp, C. elegans
aactcgaaaacta

SEQ ID NO: 691344 - DNA, 13 bp, C. elegans
aactcgaaaattt

SEQ ID NO: 691345 - DNA, 13 bp, C. elegans
aactcgaaataat

SEQ ID NO: 691346 - DNA, 13 bp, C. elegans
aactcgaaatttt

SEQ ID NO: 691347 - DNA, 13 bp, C. elegans
aactcgaataaaa

SEQ ID NO: 691348 - DNA, 13 bp, C. elegans
aactcgaatttcg

SEQ ID NO: 691349 - DNA, 13 bp, C. elegans
aactcgaattttt

SEQ ID NO: 691350 - DNA, 13 bp, C. elegans
aactcgacaaaaa

SEQ ID NO: 691351 - DNA, 13 bp, C. elegans
aactcgacaaatt

SEQ ID NO: 691352 - DNA, 13 bp, C. elegans
aactcgacacaaa

SEQ ID NO: 691353 - DNA, 13 bp, C. elegans
aactcgataaaaa

SEQ ID NO: 691354 - DNA, 13 bp, C. elegans
aactcgataaatt

SEQ ID NO: 691355 - DNA, 13 bp, C. elegans
aactcgattttca

SEQ ID NO: 691356 - DNA, 13 bp, C. elegans
aactcgattttta

SEQ ID NO: 691357 - DNA, 13 bp, C. elegans
aactcgatttttc

SEQ ID NO: 691358 - DNA, 13 bp, C. elegans
aactcggaaattg

SEQ ID NO: 691359 - DNA, 13 bp, C. elegans
aactcggaaattt

SEQ ID NO: 691360 - DNA, 13 bp, C. elegans
aactcggacaatt

SEQ ID NO: 691361 - DNA, 13 bp, C. elegans
aactcgttgaaaa

SEQ ID NO: 691362 - DNA, 13 bp, C. elegans
aactcgtttttcc

SEQ ID NO: 691363 - DNA, 13 bp, C. elegans
aactcgtttttta

SEQ ID NO: 691364 - DNA, 13 bp, C. elegans
aactctaatttta

SEQ ID NO: 691365 - DNA, 13 bp, C. elegans
aactctacaattt

SEQ ID NO: 691366 - DNA, 13 bp, C. elegans
aactctacagtaa

SEQ ID NO: 691367 - DNA, 13 bp, C. elegans
aactctcaaaatt

SEQ ID NO: 691368 - DNA, 13 bp, C. elegans
aactctcgttgct

SEQ ID NO: 691369 - DNA, 13 bp, C. elegans
aactctctccact

SEQ ID NO: 691370 - DNA, 13 bp, C. elegans
aactctctctctc

SEQ ID NO: 691371 - DNA, 13 bp, C. elegans
aactctcttttct

SEQ ID NO: 691372 - DNA, 13 bp, C. elegans
aactctgaaatta

SEQ ID NO: 691373 - DNA, 13 bp, C. elegans
aactctgaaattt

SEQ ID NO: 691374 - DNA, 13 bp, C. elegans
aactctgattttt

SEQ ID NO: 691375 - DNA, 13 bp, C. elegans
aactctgccattt

SEQ ID NO: 691376 - DNA, 13 bp, C. elegans
aactctgcgtctc

SEQ ID NO: 691377 - DNA, 13 bp, C. elegans
aactctgtggaat

SEQ ID NO: 691378 - DNA, 13 bp, C. elegans
aactcttacagac

SEQ ID NO: 691379 - DNA, 13 bp, C. elegans
aactcttatcaat

SEQ ID NO: 691380 - DNA, 13 bp, C. elegans
aactcttccaaaa

SEQ ID NO: 691381 - DNA, 13 bp, C. elegans
aactcttccatct

SEQ ID NO: 691382 - DNA, 13 bp, C. elegans
aactcttccattt

SEQ ID NO: 691383 - DNA, 14 bp, C. elegans
aactcttcccacaa

SEQ ID NO: 691384 - DNA, 13 bp, C. elegans
aactcttctattt

SEQ ID NO: 691385 - DNA, 13 bp, C. elegans
aactcttgaaatt

SEQ ID NO: 691386 - DNA, 13 bp, C. elegans
aactcttgtcaaa

SEQ ID NO: 691387 - DNA, 13 bp, C. elegans
aactctttcaaat

SEQ ID NO: 691388 - DNA, 13 bp, C. elegans
aactctttgaaaa

SEQ ID NO: 691389 - DNA, 13 bp, C. elegans
aactctttgaaat

SEQ ID NO: 691390 - DNA, 13 bp, C. elegans
aactctttttctg

SEQ ID NO: 691391 - DNA, 13 bp, C. elegans
aactcttttttaa

SEQ ID NO: 691392 - DNA, 13 bp, C. elegans
aactgaaaaaagc

SEQ ID NO: 691393 - DNA, 13 bp, C. elegans
aactgaaaaaagt

SEQ ID NO: 691394 - DNA, 13 bp, C. elegans
aactgaaaaactg

SEQ ID NO: 691395 - DNA, 13 bp, C. elegans
aactgaaaaagct

SEQ ID NO: 691396 - DNA, 13 bp, C. elegans
aactgaaaaatgc

SEQ ID NO: 691397 - DNA, 13 bp, C. elegans
aactgaaaaattt

SEQ ID NO: 691398 - DNA, 13 bp, C. elegans
aactgaaaacaca

SEQ ID NO: 691399 - DNA, 13 bp, C. elegans
aactgaaaactga

SEQ ID NO: 691400 - DNA, 13 bp, C. elegans
aactgaaaacttg

SEQ ID NO: 691401 - DNA, 13 bp, C. elegans
aactgaaaacttt

SEQ ID NO: 691402 - DNA, 13 bp, C. elegans
aactgaaaagttt

SEQ ID NO: 691403 - DNA, 13 bp, C. elegans
aactgaaaatcgg

SEQ ID NO: 691404 - DNA, 13 bp, C. elegans
aactgaaaatctg

SEQ ID NO: 691405 - DNA, 13 bp, C. elegans
aactgaaaatctt

SEQ ID NO: 691406 - DNA, 13 bp, C. elegans
aactgaaaatgaa

SEQ ID NO: 691407 - DNA, 13 bp, C. elegans
aactgaaaatgcc

SEQ ID NO: 691408 - DNA, 13 bp, C. elegans
aactgaaaatgtc

SEQ ID NO: 691409 - DNA, 13 bp, C. elegans
aactgaaaattgt

SEQ ID NO: 691410 - DNA, 13 bp, C. elegans
aactgaaaatttg

SEQ ID NO: 691411 - DNA, 13 bp, C. elegans
aactgaaaatttt

SEQ ID NO: 691412 - DNA, 13 bp, C. elegans
aactgaaacttca

SEQ ID NO: 691413 - DNA, 13 bp, C. elegans
aactgaaataaat

SEQ ID NO: 691414 - DNA, 13 bp, C. elegans
aactgaaatactt

SEQ ID NO: 691415 - DNA, 13 bp, C. elegans
aactgaaatcaaa

SEQ ID NO: 691416 - DNA, 13 bp, C. elegans
aactgaaatggaa

SEQ ID NO: 691417 - DNA, 13 bp, C. elegans
aactgaaatgttg

SEQ ID NO: 691418 - DNA, 13 bp, C. elegans
aactgaaatttga

SEQ ID NO: 691419 - DNA, 13 bp, C. elegans
aactgaaatttta

SEQ ID NO: 691420 - DNA, 13 bp, C. elegans
aactgaacaaaat

SEQ ID NO: 691421 - DNA, 13 bp, C. elegans
aactgaacagaaa

SEQ ID NO: 691422 - DNA, 13 bp, C. elegans
aactgaacttgaa

SEQ ID NO: 691423 - DNA, 13 bp, C. elegans
aactgaactttaa

SEQ ID NO: 691424 - DNA, 13 bp, C. elegans
aactgaagaaaac

SEQ ID NO: 691425 - DNA, 13 bp, C. elegans
aactgaagacaag

SEQ ID NO: 691426 - DNA, 13 bp, C. elegans
aactgaatagttt

SEQ ID NO: 691427 - DNA, 13 bp, C. elegans
aactgaatcaaaa

SEQ ID NO: 691428 - DNA, 13 bp, C. elegans
aactgaatttatt

SEQ ID NO: 691429 - DNA, 13 bp, C. elegans
aactgaatttcat

SEQ ID NO: 691430 - DNA, 13 bp, C. elegans
aactgaatttcca

SEQ ID NO: 691431 - DNA, 13 bp, C. elegans
aactgaattttca

SEQ ID NO: 691432 - DNA, 13 bp, C. elegans
aactgaatttttc

SEQ ID NO: 691433 - DNA, 13 bp, C. elegans
aactgagaattta

SEQ ID NO: 691434 - DNA, 13 bp, C. elegans
aactgagatttca

SEQ ID NO: 691435 - DNA, 13 bp, C. elegans
aactgataaaact

SEQ ID NO: 691436 - DNA, 13 bp, C. elegans
aactgataaaata

SEQ ID NO: 691437 - DNA, 13 bp, C. elegans
aactgataaaatg

SEQ ID NO: 691438 - DNA, 13 bp, C. elegans
aactgataaatac

SEQ ID NO: 691439 - DNA, 13 bp, C. elegans
aactgataagaaa

SEQ ID NO: 691440 - DNA, 13 bp, C. elegans
aactgataaggaa

SEQ ID NO: 691441 - DNA, 13 bp, C. elegans
aactgataatttt

SEQ ID NO: 691442 - DNA, 13 bp, C. elegans
aactgatatattt

SEQ ID NO: 691443 - DNA, 13 bp, C. elegans
aactgatgaaaat

SEQ ID NO: 691444 - DNA, 13 bp, C. elegans
aactgatgaaatg

SEQ ID NO: 691445 - DNA, 13 bp, C. elegans
aactgatgttttt

SEQ ID NO: 691446 - DNA, 13 bp, C. elegans
aactgattgaaaa

SEQ ID NO: 691447 - DNA, 13 bp, C. elegans
aactgattgtgag

SEQ ID NO: 691448 - DNA, 13 bp, C. elegans
aactgatttgaat

SEQ ID NO: 691449 - DNA, 13 bp, C. elegans
aactgattttaaa

SEQ ID NO: 691450 - DNA, 13 bp, C. elegans
aactgcaaaaact

SEQ ID NO: 691451 - DNA, 13 bp, C. elegans
aactgcaaaacca

SEQ ID NO: 691452 - DNA, 13 bp, C. elegans
aactgcaaaagta

SEQ ID NO: 691453 - DNA, 13 bp, C. elegans
aactgcaaaataa

SEQ ID NO: 691454 - DNA, 13 bp, C. elegans
aactgcaaaatta

SEQ ID NO: 691455 - DNA, 13 bp, C. elegans
aactgcaacaaaa

SEQ ID NO: 691456 - DNA, 13 bp, C. elegans
aactgcaattgcc

SEQ ID NO: 691457 - DNA, 13 bp, C. elegans
aactgcaattttc

SEQ ID NO: 691458 - DNA, 13 bp, C. elegans
aactgcacaattt

SEQ ID NO: 691459 - DNA, 13 bp, C. elegans
aactgcagatttt

SEQ ID NO: 691460 - DNA, 13 bp, C. elegans
aactgcagttttt

SEQ ID NO: 691461 - DNA, 13 bp, C. elegans
aactgcatttttc

SEQ ID NO: 691462 - DNA, 13 bp, C. elegans
aactgccaaattg

SEQ ID NO: 691463 - DNA, 13 bp, C. elegans
aactgccaaattt

SEQ ID NO: 691464 - DNA, 13 bp, C. elegans
aactgccattttt

SEQ ID NO: 691465 - DNA, 13 bp, C. elegans
aactgccgaaatt

SEQ ID NO: 691466 - DNA, 13 bp, C. elegans
aactgccgatttg

SEQ ID NO: 691467 - DNA, 13 bp, C. elegans
aactgccgttttt

SEQ ID NO: 691468 - DNA, 13 bp, C. elegans
aactgctaaaaaa

SEQ ID NO: 691469 - DNA, 13 bp, C. elegans
aactgctccaaaa

SEQ ID NO: 691470 - DNA, 13 bp, C. elegans
aactgctgaaatt

SEQ ID NO: 691471 - DNA, 13 bp, C. elegans
aactggaaaaatg

SEQ ID NO: 691472 - DNA, 13 bp, C. elegans
aactggaaaactg

SEQ ID NO: 691473 - DNA, 13 bp, C. elegans
aactggaaaactt

SEQ ID NO: 691474 - DNA, 13 bp, C. elegans
aactggaaacatt

SEQ ID NO: 691475 - DNA, 13 bp, C. elegans
aactggaaacttt

SEQ ID NO: 691476 - DNA, 13 bp, C. elegans
aactggaaattaa

SEQ ID NO: 691477 - DNA, 13 bp, C. elegans
aactggaaatttg

SEQ ID NO: 691478 - DNA, 13 bp, C. elegans
aactggaataaaa

SEQ ID NO: 691479 - DNA, 13 bp, C. elegans
aactggaatgaca

SEQ ID NO: 691480 - DNA, 13 bp, C. elegans
aactggaatttta

SEQ ID NO: 691481 - DNA, 13 bp, C. elegans
aactggatttttc

SEQ ID NO: 691482 - DNA, 13 bp, C. elegans
aactggcaaaaat

SEQ ID NO: 691483 - DNA, 13 bp, C. elegans
aactggcgagacc

SEQ ID NO: 691484 - DNA, 13 bp, C. elegans
aactgggaaaaaa

SEQ ID NO: 691485 - DNA, 15 bp, C. elegans
aactgggacttcgaa

SEQ ID NO: 691486 - DNA, 13 bp, C. elegans
aactggtaaattg

SEQ ID NO: 691487 - DNA, 13 bp, C. elegans
aactggtttttca

SEQ ID NO: 691488 - DNA, 13 bp, C. elegans
aactgtaaaaaat

SEQ ID NO: 691489 - DNA, 13 bp, C. elegans
aactgtaaattaa

SEQ ID NO: 691490 - DNA, 13 bp, C. elegans
aactgtaaatttt

SEQ ID NO: 691491 - DNA, 13 bp, C. elegans
aactgtaagtttt

SEQ ID NO: 691492 - DNA, 13 bp, C. elegans
aactgtaataaaa

SEQ ID NO: 691493 - DNA, 13 bp, C. elegans
aactgtaattttt

SEQ ID NO: 691494 - DNA, 13 bp, C. elegans
aactgtataaaaa

SEQ ID NO: 691495 - DNA, 13 bp, C. elegans
aactgtatctcaa

SEQ ID NO: 691496 - DNA, 13 bp, C. elegans
aactgtattaaaa

SEQ ID NO: 691497 - DNA, 13 bp, C. elegans
aactgtcactttt

SEQ ID NO: 691498 - DNA, 13 bp, C. elegans
aactgtcgaaaat

SEQ ID NO: 691499 - DNA, 13 bp, C. elegans
aactgtctgaaac

SEQ ID NO: 691500 - DNA, 13 bp, C. elegans
aactgtgaaaaaa

SEQ ID NO: 691501 - DNA, 13 bp, C. elegans
aactgtgaaaaat

SEQ ID NO: 691502 - DNA, 13 bp, C. elegans
aactgtgaataaa

SEQ ID NO: 691503 - DNA, 13 bp, C. elegans
aactgtgacgtca

SEQ ID NO: 691504 - DNA, 13 bp, C. elegans
aactgtgattttt

SEQ ID NO: 691505 - DNA, 13 bp, C. elegans
aactgtgtttatt

SEQ ID NO: 691506 - DNA, 13 bp, C. elegans
aactgttaaaaat

SEQ ID NO: 691507 - DNA, 13 bp, C. elegans
aactgttaaaatt

SEQ ID NO: 691508 - DNA, 13 bp, C. elegans
aactgttaaattt

SEQ ID NO: 691509 - DNA, 13 bp, C. elegans
aactgttaacaaa

SEQ ID NO: 691510 - DNA, 13 bp, C. elegans
aactgttatttat

SEQ ID NO: 691511 - DNA, 13 bp, C. elegans
aactgttcaaaat

SEQ ID NO: 691512 - DNA, 13 bp, C. elegans
aactgttcaaata

SEQ ID NO: 691513 - DNA, 13 bp, C. elegans
aactgttcatttt

SEQ ID NO: 691514 - DNA, 13 bp, C. elegans
aactgttgatttt

SEQ ID NO: 691515 - DNA, 13 bp, C. elegans
aactgttgttatt

SEQ ID NO: 691516 - DNA, 13 bp, C. elegans
aactgttgttgtt

SEQ ID NO: 691517 - DNA, 13 bp, C. elegans
aactgtttaattt

SEQ ID NO: 691518 - DNA, 13 bp, C. elegans
aactgtttcaaat

SEQ ID NO: 691519 - DNA, 13 bp, C. elegans
aactgtttcagat

SEQ ID NO: 691520 - DNA, 13 bp, C. elegans
aactgtttgaaat

SEQ ID NO: 691521 - DNA, 13 bp, C. elegans
aactgttttaaaa

SEQ ID NO: 691522 - DNA, 13 bp, C. elegans
aactgttttagaa

SEQ ID NO: 691523 - DNA, 13 bp, C. elegans
aactgttttctat

SEQ ID NO: 691524 - DNA, 13 bp, C. elegans
aactgttttgtga

SEQ ID NO: 691525 - DNA, 13 bp, C. elegans
aactgttttttga

SEQ ID NO: 691526 - DNA, 13 bp, C. elegans
aactgtttttttg

SEQ ID NO: 691527 - DNA, 13 bp, C. elegans
aacttaaaactgt

SEQ ID NO: 691528 - DNA, 13 bp, C. elegans
aacttaaactttc

SEQ ID NO: 691529 - DNA, 13 bp, C. elegans
aacttaaattcaa

SEQ ID NO: 691530 - DNA, 13 bp, C. elegans
aacttaatggaaa

SEQ ID NO: 691531 - DNA, 14 bp, C. elegans
aacttagttatata

SEQ ID NO: 691532 - DNA, 13 bp, C. elegans
aacttagttttta

SEQ ID NO: 691533 - DNA, 13 bp, C. elegans
aacttagtttttc

SEQ ID NO: 691534 - DNA, 13 bp, C. elegans
aacttatagttag

SEQ ID NO: 691535 - DNA, 13 bp, C. elegans
aacttatcaaaac

SEQ ID NO: 691536 - DNA, 13 bp, C. elegans
aacttatcaaatt

SEQ ID NO: 691537 - DNA, 13 bp, C. elegans
aacttatcaatgt

SEQ ID NO: 691538 - DNA, 13 bp, C. elegans
aacttatcgattt

SEQ ID NO: 691539 - DNA, 13 bp, C. elegans
aacttatgaaaaa

SEQ ID NO: 691540 - DNA, 13 bp, C. elegans
aacttattcaaaa

SEQ ID NO: 691541 - DNA, 14 bp, C. elegans
aacttattcagaaa

SEQ ID NO: 691542 - DNA, 13 bp, C. elegans
aacttattcatgt

SEQ ID NO: 691543 - DNA, 13 bp, C. elegans
aacttattgaaaa

SEQ ID NO: 691544 - DNA, 13 bp, C. elegans
aacttatttattc

SEQ ID NO: 691545 - DNA, 13 bp, C. elegans
aacttatttgatt

SEQ ID NO: 691546 - DNA, 13 bp, C. elegans
aacttattttcaa

SEQ ID NO: 691547 - DNA, 13 bp, C. elegans
aacttattttcca

SEQ ID NO: 691548 - DNA, 13 bp, C. elegans
aacttattttcta

SEQ ID NO: 691549 - DNA, 13 bp, C. elegans
aacttcaaaaact

SEQ ID NO: 691550 - DNA, 13 bp, C. elegans
aacttcaaaaagt

SEQ ID NO: 691551 - DNA, 13 bp, C. elegans
aacttcaaaaatc

SEQ ID NO: 691552 - DNA, 13 bp, C. elegans
aacttcaaaatga

SEQ ID NO: 691553 - DNA, 13 bp, C. elegans
aacttcaaaattg

SEQ ID NO: 691554 - DNA, 13 bp, C. elegans
aacttcaaacttt

SEQ ID NO: 691555 - DNA, 13 bp, C. elegans
aacttcaaataat

SEQ ID NO: 691556 - DNA, 13 bp, C. elegans
aacttcaaatgtt

SEQ ID NO: 691557 - DNA, 13 bp, C. elegans
aacttcaaatttt

SEQ ID NO: 691558 - DNA, 13 bp, C. elegans
aacttcaacaaat

SEQ ID NO: 691559 - DNA, 13 bp, C. elegans
aacttcaacaatt

SEQ ID NO: 691560 - DNA, 13 bp, C. elegans
aacttcaactgac

SEQ ID NO: 691561 - DNA, 13 bp, C. elegans
aacttcaactttt

SEQ ID NO: 691562 - DNA, 13 bp, C. elegans
aacttcaagaatt

SEQ ID NO: 691563 - DNA, 13 bp, C. elegans
aacttcaagattt

SEQ ID NO: 691564 - DNA, 13 bp, C. elegans
aacttcaagtttt

SEQ ID NO: 691565 - DNA, 13 bp, C. elegans
aacttcaataaat

SEQ ID NO: 691566 - DNA, 13 bp, C. elegans
aacttcaatgttt

SEQ ID NO: 691567 - DNA, 13 bp, C. elegans
aacttcaattaaa

SEQ ID NO: 691568 - DNA, 13 bp, C. elegans
aacttcaattatt

SEQ ID NO: 691569 - DNA, 13 bp, C. elegans
aacttcaattctg

SEQ ID NO: 691570 - DNA, 13 bp, C. elegans
aacttcaattgtt

SEQ ID NO: 691571 - DNA, 13 bp, C. elegans
aacttcaatttaa

SEQ ID NO: 691572 - DNA, 13 bp, C. elegans
aacttcaatttat

SEQ ID NO: 691573 - DNA, 13 bp, C. elegans
aacttcaatttca

SEQ ID NO: 691574 - DNA, 13 bp, C. elegans
aacttcaattttc

SEQ ID NO: 691575 - DNA, 13 bp, C. elegans
aacttcaattttt

SEQ ID NO: 691576 - DNA, 13 bp, C. elegans
aacttcacaaaac

SEQ ID NO: 691577 - DNA, 13 bp, C. elegans
aacttcacggaaa

SEQ ID NO: 691578 - DNA, 13 bp, C. elegans
aacttcatagaaa

SEQ ID NO: 691579 - DNA, 13 bp, C. elegans
aacttcatcgatt

SEQ ID NO: 691580 - DNA, 13 bp, C. elegans
aacttcatgataa

SEQ ID NO: 691581 - DNA, 13 bp, C. elegans
aacttcatttttc

SEQ ID NO: 691582 - DNA, 13 bp, C. elegans
aacttccaaccca

SEQ ID NO: 691583 - DNA, 13 bp, C. elegans
aacttccaatttc

SEQ ID NO: 691584 - DNA, 13 bp, C. elegans
aacttccagaagg

SEQ ID NO: 691585 - DNA, 13 bp, C. elegans
aacttccagaatt

SEQ ID NO: 691586 - DNA, 13 bp, C. elegans
aacttccagtttt

SEQ ID NO: 691587 - DNA, 13 bp, C. elegans
aacttccattttc

SEQ ID NO: 691588 - DNA, 13 bp, C. elegans
aacttcccaaaaa

SEQ ID NO: 691589 - DNA, 13 bp, C. elegans
aacttcccaaaat

SEQ ID NO: 691590 - DNA, 13 bp, C. elegans
aacttccgaaaaa

SEQ ID NO: 691591 - DNA, 13 bp, C. elegans
aacttccggaaaa

SEQ ID NO: 691592 - DNA, 13 bp, C. elegans
aacttcctgaaaa

SEQ ID NO: 691593 - DNA, 13 bp, C. elegans
aacttcctgaaat

SEQ ID NO: 691594 - DNA, 13 bp, C. elegans
aacttcctgtttt

SEQ ID NO: 691595 - DNA, 13 bp, C. elegans
aacttcgaaaata

SEQ ID NO: 691596 - DNA, 13 bp, C. elegans
aacttcgaactct

SEQ ID NO: 691597 - DNA, 13 bp, C. elegans
aacttcggaaaaa

SEQ ID NO: 691598 - DNA, 13 bp, C. elegans
aacttcggaaatt

SEQ ID NO: 691599 - DNA, 13 bp, C. elegans
aacttcggccacc

SEQ ID NO: 691600 - DNA, 13 bp, C. elegans
aacttctaaattt

SEQ ID NO: 691601 - DNA, 13 bp, C. elegans
aacttctaacaaa

SEQ ID NO: 691602 - DNA, 13 bp, C. elegans
aacttctaagaaa

SEQ ID NO: 691603 - DNA, 13 bp, C. elegans
aacttctacagta

SEQ ID NO: 691604 - DNA, 13 bp, C. elegans
aacttctacgact

SEQ ID NO: 691605 - DNA, 13 bp, C. elegans
aacttctagaaaa

SEQ ID NO: 691606 - DNA, 13 bp, C. elegans
aacttctagattt

SEQ ID NO: 691607 - DNA, 13 bp, C. elegans
aacttctcaaaaa

SEQ ID NO: 691608 - DNA, 13 bp, C. elegans
aacttctcaaaca

SEQ ID NO: 691609 - DNA, 13 bp, C. elegans
aacttctcaatct

SEQ ID NO: 691610 - DNA, 13 bp, C. elegans
aacttctcacaaa

SEQ ID NO: 691611 - DNA, 13 bp, C. elegans
aacttctcagaaa

SEQ ID NO: 691612 - DNA, 13 bp, C. elegans
aacttctctaaaa

SEQ ID NO: 691613 - DNA, 13 bp, C. elegans
aacttctctgatt

SEQ ID NO: 691614 - DNA, 13 bp, C. elegans
aacttctgaaaaa

SEQ ID NO: 691615 - DNA, 13 bp, C. elegans
aacttctgaaact

SEQ ID NO: 691616 - DNA, 13 bp, C. elegans
aacttctgaaata

SEQ ID NO: 691617 - DNA, 13 bp, C. elegans
aacttctgaacaa

SEQ ID NO: 691618 - DNA, 13 bp, C. elegans
aacttctgaacca

SEQ ID NO: 691619 - DNA, 13 bp, C. elegans
aacttctgaattt

SEQ ID NO: 691620 - DNA, 13 bp, C. elegans
aacttctgatcca

SEQ ID NO: 691621 - DNA, 13 bp, C. elegans
aacttctgatttt

SEQ ID NO: 691622 - DNA, 13 bp, C. elegans
aacttctgcaaag

SEQ ID NO: 691623 - DNA, 13 bp, C. elegans
aacttctgttttt

SEQ ID NO: 691624 - DNA, 13 bp, C. elegans
aacttcttatttc

SEQ ID NO: 691625 - DNA, 13 bp, C. elegans
aacttcttcaaat

SEQ ID NO: 691626 - DNA, 13 bp, C. elegans
aacttcttcccca

SEQ ID NO: 691627 - DNA, 13 bp, C. elegans
aacttcttctctc

SEQ ID NO: 691628 - DNA, 13 bp, C. elegans
aacttcttgaaaa

SEQ ID NO: 691629 - DNA, 13 bp, C. elegans
aacttcttgaata

SEQ ID NO: 691630 - DNA, 13 bp, C. elegans
aacttctttaaaa

SEQ ID NO: 691631 - DNA, 13 bp, C. elegans
aacttctttcaaa

SEQ ID NO: 691632 - DNA, 13 bp, C. elegans
aacttgaaaaatc

SEQ ID NO: 691633 - DNA, 13 bp, C. elegans
aacttgaaaaatg

SEQ ID NO: 691634 - DNA, 13 bp, C. elegans
aacttgaaaactg

SEQ ID NO: 691635 - DNA, 13 bp, C. elegans
aacttgaaaataa

SEQ ID NO: 691636 - DNA, 13 bp, C. elegans
aacttgaaaatca

SEQ ID NO: 691637 - DNA, 13 bp, C. elegans
aacttgaaaatgt

SEQ ID NO: 691638 - DNA, 13 bp, C. elegans
aacttgaaactat

SEQ ID NO: 691639 - DNA, 13 bp, C. elegans
aacttgaaactgg

SEQ ID NO: 691640 - DNA, 13 bp, C. elegans
aacttgaaataat

SEQ ID NO: 691641 - DNA, 13 bp, C. elegans
aacttgaaattcc

SEQ ID NO: 691642 - DNA, 13 bp, C. elegans
aacttgaaatttg

SEQ ID NO: 691643 - DNA, 13 bp, C. elegans
aacttgaaatttt

SEQ ID NO: 691644 - DNA, 13 bp, C. elegans
aacttgaacaaat

SEQ ID NO: 691645 - DNA, 13 bp, C. elegans
aacttgaacaatt

SEQ ID NO: 691646 - DNA, 13 bp, C. elegans
aacttgaagaaac

SEQ ID NO: 691647 - DNA, 13 bp, C. elegans
aacttgaagaaat

SEQ ID NO: 691648 - DNA, 13 bp, C. elegans
aacttgaataaat

SEQ ID NO: 691649 - DNA, 13 bp, C. elegans
aacttgaatattt

SEQ ID NO: 691650 - DNA, 13 bp, C. elegans
aacttgaatgaaa

SEQ ID NO: 691651 - DNA, 13 bp, C. elegans
aacttgaatgttt

SEQ ID NO: 691652 - DNA, 13 bp, C. elegans
aacttgaattttc

SEQ ID NO: 691653 - DNA, 13 bp, C. elegans
aacttgacatttt

SEQ ID NO: 691654 - DNA, 13 bp, C. elegans
aacttgataaata

SEQ ID NO: 691655 - DNA, 13 bp, C. elegans
aacttgataactt

SEQ ID NO: 691656 - DNA, 13 bp, C. elegans
aacttgatatttt

SEQ ID NO: 691657 - DNA, 13 bp, C. elegans
aacttgatgaaac

SEQ ID NO: 691658 - DNA, 13 bp, C. elegans
aacttgatgtttt

SEQ ID NO: 691659 - DNA, 13 bp, C. elegans
aacttgatttatt

SEQ ID NO: 691660 - DNA, 13 bp, C. elegans
aacttgatttctt

SEQ ID NO: 691661 - DNA, 13 bp, C. elegans
aacttgattttca

SEQ ID NO: 691662 - DNA, 13 bp, C. elegans
aacttgcaaaaaa

SEQ ID NO: 691663 - DNA, 13 bp, C. elegans
aacttgcaaattt

SEQ ID NO: 691664 - DNA, 13 bp, C. elegans
aacttgcacaaaa

SEQ ID NO: 691665 - DNA, 13 bp, C. elegans
aacttgcacattt

SEQ ID NO: 691666 - DNA, 13 bp, C. elegans
aacttgcattttt

SEQ ID NO: 691667 - DNA, 13 bp, C. elegans
aacttgccaattt

SEQ ID NO: 691668 - DNA, 13 bp, C. elegans
aacttgccgaaaa

SEQ ID NO: 691669 - DNA, 13 bp, C. elegans
aacttgccgattt

SEQ ID NO: 691670 - DNA, 13 bp, C. elegans
aacttgctatttt

SEQ ID NO: 691671 - DNA, 13 bp, C. elegans
aacttggaaaaaa

SEQ ID NO: 691672 - DNA, 13 bp, C. elegans
aacttggaaaatg

SEQ ID NO: 691673 - DNA, 13 bp, C. elegans
aacttggaaattg

SEQ ID NO: 691674 - DNA, 13 bp, C. elegans
aacttggaatttt

SEQ ID NO: 691675 - DNA, 13 bp, C. elegans
aacttggattcag

SEQ ID NO: 691676 - DNA, 13 bp, C. elegans
aacttggcaaaaa

SEQ ID NO: 691677 - DNA, 13 bp, C. elegans
aacttggcaattt

SEQ ID NO: 691678 - DNA, 13 bp, C. elegans
aacttggcggttt

SEQ ID NO: 691679 - DNA, 13 bp, C. elegans
aacttggctcaaa

SEQ ID NO: 691680 - DNA, 13 bp, C. elegans
aacttgggcaaaa

SEQ ID NO: 691681 - DNA, 13 bp, C. elegans
aacttgggcaaga

SEQ ID NO: 691682 - DNA, 13 bp, C. elegans
aacttggtgaaaa

SEQ ID NO: 691683 - DNA, 13 bp, C. elegans
aacttggttaaaa

SEQ ID NO: 691684 - DNA, 13 bp, C. elegans
aacttgtaaaact

SEQ ID NO: 691685 - DNA, 13 bp, C. elegans
aacttgtaaaata

SEQ ID NO: 691686 - DNA, 13 bp, C. elegans
aacttgtaagata

SEQ ID NO: 691687 - DNA, 13 bp, C. elegans
aacttgtaataaa

SEQ ID NO: 691688 - DNA, 13 bp, C. elegans
aacttgtcagatt

SEQ ID NO: 691689 - DNA, 13 bp, C. elegans
aacttgtcccttc

SEQ ID NO: 691690 - DNA, 13 bp, C. elegans
aacttgtgaaaag

SEQ ID NO: 691691 - DNA, 13 bp, C. elegans
aacttgtgatttt

SEQ ID NO: 691692 - DNA, 13 bp, C. elegans
aacttgtggtttt

SEQ ID NO: 691693 - DNA, 13 bp, C. elegans
aacttgttcaaaa

SEQ ID NO: 691694 - DNA, 13 bp, C. elegans
aacttgttcagaa

SEQ ID NO: 691695 - DNA, 13 bp, C. elegans
aacttgtttattt

SEQ ID NO: 691696 - DNA, 13 bp, C. elegans
aacttgtttcaaa

SEQ ID NO: 691697 - DNA, 13 bp, C. elegans
aacttgttttatt

SEQ ID NO: 691698 - DNA, 13 bp, C. elegans
aacttgttttcaa

SEQ ID NO: 691699 - DNA, 13 bp, C. elegans
aacttgttttgaa

SEQ ID NO: 691700 - DNA, 13 bp, C. elegans
aacttgtttttca

SEQ ID NO: 691701 - DNA, 13 bp, C. elegans
aactttaaaactt

SEQ ID NO: 691702 - DNA, 13 bp, C. elegans
aactttaaaagaa

SEQ ID NO: 691703 - DNA, 13 bp, C. elegans
aactttaaaatag

SEQ ID NO: 691704 - DNA, 13 bp, C. elegans
aactttaaacttt

SEQ ID NO: 691705 - DNA, 13 bp, C. elegans
aactttaacaatt

SEQ ID NO: 691706 - DNA, 13 bp, C. elegans
aactttaactgac

SEQ ID NO: 691707 - DNA, 13 bp, C. elegans
aactttaagaaat

SEQ ID NO: 691708 - DNA, 13 bp, C. elegans
aactttaataaag

SEQ ID NO: 691709 - DNA, 13 bp, C. elegans
aactttacaataa

SEQ ID NO: 691710 - DNA, 13 bp, C. elegans
aactttacaattt

SEQ ID NO: 691711 - DNA, 13 bp, C. elegans
aactttaccaatt

SEQ ID NO: 691712 - DNA, 13 bp, C. elegans
aactttagaaatg

SEQ ID NO: 691713 - DNA, 13 bp, C. elegans
aactttagcaact

SEQ ID NO: 691714 - DNA, 13 bp, C. elegans
aactttagtttct

SEQ ID NO: 691715 - DNA, 13 bp, C. elegans
aactttatatttc

SEQ ID NO: 691716 - DNA, 13 bp, C. elegans
aactttatcaaaa

SEQ ID NO: 691717 - DNA, 13 bp, C. elegans
aactttatcataa

SEQ ID NO: 691718 - DNA, 13 bp, C. elegans
aactttatgaaaa

SEQ ID NO: 691719 - DNA, 13 bp, C. elegans
aactttatgaatt

SEQ ID NO: 691720 - DNA, 13 bp, C. elegans
aactttatggaaa

SEQ ID NO: 691721 - DNA, 13 bp, C. elegans
aactttatttcaa

SEQ ID NO: 691722 - DNA, 13 bp, C. elegans
aactttatttctc

SEQ ID NO: 691723 - DNA, 13 bp, C. elegans
aactttatttctg

SEQ ID NO: 691724 - DNA, 13 bp, C. elegans
aactttatttgtt

SEQ ID NO: 691725 - DNA, 13 bp, C. elegans
aactttattttgt

SEQ ID NO: 691726 - DNA, 14 bp, C. elegans
aactttcaaaaatt

SEQ ID NO: 691727 - DNA, 13 bp, C. elegans
aactttcaaactt

SEQ ID NO: 691728 - DNA, 13 bp, C. elegans
aactttcaaagtt

SEQ ID NO: 691729 - DNA, 13 bp, C. elegans
aactttcaaataa

SEQ ID NO: 691730 - DNA, 13 bp, C. elegans
aactttcaaattt

SEQ ID NO: 691731 - DNA, 13 bp, C. elegans
aactttcaacatt

SEQ ID NO: 691732 - DNA, 13 bp, C. elegans
aactttcaagttg

SEQ ID NO: 691733 - DNA, 13 bp, C. elegans
aactttcaagttt

SEQ ID NO: 691734 - DNA, 13 bp, C. elegans
aactttcaatttc

SEQ ID NO: 691735 - DNA, 13 bp, C. elegans
aactttcaatttg

SEQ ID NO: 691736 - DNA, 13 bp, C. elegans
aactttcaatttt

SEQ ID NO: 691737 - DNA, 13 bp, C. elegans
aactttcactcag

SEQ ID NO: 691738 - DNA, 13 bp, C. elegans
aactttcagaaaa

SEQ ID NO: 691739 - DNA, 13 bp, C. elegans
aactttcagaatt

SEQ ID NO: 691740 - DNA, 13 bp, C. elegans
aactttcagacaa

SEQ ID NO: 691741 - DNA, 13 bp, C. elegans
aactttcagataa

SEQ ID NO: 691742 - DNA, 13 bp, C. elegans
aactttcagattg

SEQ ID NO: 691743 - DNA, 13 bp, C. elegans
aactttcagcaaa

SEQ ID NO: 691744 - DNA, 13 bp, C. elegans
aactttcaggcaa

SEQ ID NO: 691745 - DNA, 13 bp, C. elegans
aactttcagtaaa

SEQ ID NO: 691746 - DNA, 13 bp, C. elegans
aactttcatattt

SEQ ID NO: 691747 - DNA, 13 bp, C. elegans
aactttcattgaa

SEQ ID NO: 691748 - DNA, 13 bp, C. elegans
aactttcatttaa

SEQ ID NO: 691749 - DNA, 13 bp, C. elegans
aactttcatttat

SEQ ID NO: 691750 - DNA, 13 bp, C. elegans
aactttccaaaac

SEQ ID NO: 691751 - DNA, 13 bp, C. elegans
aactttccaaaat

SEQ ID NO: 691752 - DNA, 13 bp, C. elegans
aactttccaacaa

SEQ ID NO: 691753 - DNA, 13 bp, C. elegans
aactttccaataa

SEQ ID NO: 691754 - DNA, 13 bp, C. elegans
aactttccaattt

SEQ ID NO: 691755 - DNA, 13 bp, C. elegans
aactttccgaaaa

SEQ ID NO: 691756 - DNA, 13 bp, C. elegans
aactttcctattt

SEQ ID NO: 691757 - DNA, 13 bp, C. elegans
aactttcctgaat

SEQ ID NO: 691758 - DNA, 13 bp, C. elegans
aactttcgaaatt

SEQ ID NO: 691759 - DNA, 13 bp, C. elegans
aactttcgagaga

SEQ ID NO: 691760 - DNA, 13 bp, C. elegans
aactttctaaata

SEQ ID NO: 691761 - DNA, 13 bp, C. elegans
aactttctagatt

SEQ ID NO: 691762 - DNA, 13 bp, C. elegans
aactttctattta

SEQ ID NO: 691763 - DNA, 13 bp, C. elegans
aactttctcaaaa

SEQ ID NO: 691764 - DNA, 13 bp, C. elegans
aactttctctatt

SEQ ID NO: 691765 - DNA, 13 bp, C. elegans
aactttctgaaaa

SEQ ID NO: 691766 - DNA, 13 bp, C. elegans
aactttctgaaat

SEQ ID NO: 691767 - DNA, 13 bp, C. elegans
aactttctgaaca

SEQ ID NO: 691768 - DNA, 13 bp, C. elegans
aactttctgagaa

SEQ ID NO: 691769 - DNA, 13 bp, C. elegans
aactttctgattt

SEQ ID NO: 691770 - DNA, 13 bp, C. elegans
aactttcttcaaa

SEQ ID NO: 691771 - DNA, 13 bp, C. elegans
aactttcttgttt

SEQ ID NO: 691772 - DNA, 13 bp, C. elegans
aactttgaaaaaa

SEQ ID NO: 691773 - DNA, 13 bp, C. elegans
aactttgaaaaat

SEQ ID NO: 691774 - DNA, 13 bp, C. elegans
aactttgaaacta

SEQ ID NO: 691775 - DNA, 13 bp, C. elegans
aactttgaaactt

SEQ ID NO: 691776 - DNA, 13 bp, C. elegans
aactttgaaatct

SEQ ID NO: 691777 - DNA, 18 bp, C. elegans
aactttgaaccgccataa

SEQ ID NO: 691778 - DNA, 13 bp, C. elegans
aactttgaacgtt

SEQ ID NO: 691779 - DNA, 13 bp, C. elegans
aactttgaacttt

SEQ ID NO: 691780 - DNA, 13 bp, C. elegans
aactttgaagaat

SEQ ID NO: 691781 - DNA, 13 bp, C. elegans
aactttgaataat

SEQ ID NO: 691782 - DNA, 13 bp, C. elegans
aactttgacaaat

SEQ ID NO: 691783 - DNA, 13 bp, C. elegans
aactttgagaaaa

SEQ ID NO: 691784 - DNA, 13 bp, C. elegans
aactttgagaaat

SEQ ID NO: 691785 - DNA, 13 bp, C. elegans
aactttgagtttt

SEQ ID NO: 691786 - DNA, 13 bp, C. elegans
aactttgatattt

SEQ ID NO: 691787 - DNA, 13 bp, C. elegans
aactttgattatt

SEQ ID NO: 691788 - DNA, 13 bp, C. elegans
aactttgattttc

SEQ ID NO: 691789 - DNA, 13 bp, C. elegans
aactttgattttg

SEQ ID NO: 691790 - DNA, 13 bp, C. elegans
aactttgccaact

SEQ ID NO: 691791 - DNA, 13 bp, C. elegans
aactttgctattt

SEQ ID NO: 691792 - DNA, 13 bp, C. elegans
aactttgctcaaa

SEQ ID NO: 691793 - DNA, 13 bp, C. elegans
aactttgctcatt

SEQ ID NO: 691794 - DNA, 13 bp, C. elegans
aactttggaaaat

SEQ ID NO: 691795 - DNA, 13 bp, C. elegans
aactttggaaagt

SEQ ID NO: 691796 - DNA, 13 bp, C. elegans
aactttggaagtt

SEQ ID NO: 691797 - DNA, 13 bp, C. elegans
aactttggaattt

SEQ ID NO: 691798 - DNA, 13 bp, C. elegans
aactttggatttt

SEQ ID NO: 691799 - DNA, 13 bp, C. elegans
aactttggcaaaa

SEQ ID NO: 691800 - DNA, 13 bp, C. elegans
aactttggcaact

SEQ ID NO: 691801 - DNA, 13 bp, C. elegans
aactttgtcaatt

SEQ ID NO: 691802 - DNA, 13 bp, C. elegans
aactttgtgaaac

SEQ ID NO: 691803 - DNA, 13 bp, C. elegans
aactttgtgaaat

SEQ ID NO: 691804 - DNA, 13 bp, C. elegans
aactttgttgaaa

SEQ ID NO: 691805 - DNA, 13 bp, C. elegans
aactttgtttcaa

SEQ ID NO: 691806 - DNA, 13 bp, C. elegans
aactttgttttga

SEQ ID NO: 691807 - DNA, 13 bp, C. elegans
aacttttaaaagt

SEQ ID NO: 691808 - DNA, 13 bp, C. elegans
aacttttaacaaa

SEQ ID NO: 691809 - DNA, 13 bp, C. elegans
aacttttaactga

SEQ ID NO: 691810 - DNA, 13 bp, C. elegans
aacttttaacttt

SEQ ID NO: 691811 - DNA, 13 bp, C. elegans
aacttttacaaat

SEQ ID NO: 691812 - DNA, 13 bp, C. elegans
aacttttacaatt

SEQ ID NO: 691813 - DNA, 13 bp, C. elegans
aacttttactgat

SEQ ID NO: 691814 - DNA, 13 bp, C. elegans
aacttttagaatt

SEQ ID NO: 691815 - DNA, 13 bp, C. elegans
aacttttagagaa

SEQ ID NO: 691816 - DNA, 13 bp, C. elegans
aacttttataaag

SEQ ID NO: 691817 - DNA, 13 bp, C. elegans
aacttttataact

SEQ ID NO: 691818 - DNA, 13 bp, C. elegans
aacttttatcaaa

SEQ ID NO: 691819 - DNA, 13 bp, C. elegans
aacttttatcaat

SEQ ID NO: 691820 - DNA, 13 bp, C. elegans
aacttttatgatt

SEQ ID NO: 691821 - DNA, 13 bp, C. elegans
aacttttattgaa

SEQ ID NO: 691822 - DNA, 13 bp, C. elegans
aacttttcaaaat

SEQ ID NO: 691823 - DNA, 13 bp, C. elegans
aacttttcaaact

SEQ ID NO: 691824 - DNA, 13 bp, C. elegans
aacttttcaaata

SEQ ID NO: 691825 - DNA, 13 bp, C. elegans
aacttttcaagaa

SEQ ID NO: 691826 - DNA, 13 bp, C. elegans
aacttttcaataa

SEQ ID NO: 691827 - DNA, 13 bp, C. elegans
aacttttcaattc

SEQ ID NO: 691828 - DNA, 13 bp, C. elegans
aacttttcacaaa

SEQ ID NO: 691829 - DNA, 13 bp, C. elegans
aacttttcagtta

SEQ ID NO: 691830 - DNA, 13 bp, C. elegans
aacttttcattaa

SEQ ID NO: 691831 - DNA, 13 bp, C. elegans
aacttttcattct

SEQ ID NO: 691832 - DNA, 13 bp, C. elegans
aacttttccaaaa

SEQ ID NO: 691833 - DNA, 13 bp, C. elegans
aacttttccaaca

SEQ ID NO: 691834 - DNA, 13 bp, C. elegans
aacttttccaatt

SEQ ID NO: 691835 - DNA, 13 bp, C. elegans
aacttttccagaa

SEQ ID NO: 691836 - DNA, 13 bp, C. elegans
aacttttccccaa

SEQ ID NO: 691837 - DNA, 13 bp, C. elegans
aacttttccgtgt

SEQ ID NO: 691838 - DNA, 13 bp, C. elegans
aacttttcgaaaa

SEQ ID NO: 691839 - DNA, 13 bp, C. elegans
aacttttcgaaac

SEQ ID NO: 691840 - DNA, 13 bp, C. elegans
aacttttcgattt

SEQ ID NO: 691841 - DNA, 13 bp, C. elegans
aacttttcgccaa

SEQ ID NO: 691842 - DNA, 13 bp, C. elegans
aacttttcggaaa

SEQ ID NO: 691843 - DNA, 13 bp, C. elegans
aacttttcggaat

SEQ ID NO: 691844 - DNA, 13 bp, C. elegans
aacttttctaaaa

SEQ ID NO: 691845 - DNA, 13 bp, C. elegans
aacttttctaaat

SEQ ID NO: 691846 - DNA, 13 bp, C. elegans
aacttttctcaaa

SEQ ID NO: 691847 - DNA, 13 bp, C. elegans
aacttttctgaat

SEQ ID NO: 691848 - DNA, 13 bp, C. elegans
aacttttctgata

SEQ ID NO: 691849 - DNA, 13 bp, C. elegans
aacttttctgatt

SEQ ID NO: 691850 - DNA, 13 bp, C. elegans
aacttttcttccc

SEQ ID NO: 691851 - DNA, 13 bp, C. elegans
aacttttctttgt

SEQ ID NO: 691852 - DNA, 13 bp, C. elegans
aacttttgaaaac

SEQ ID NO: 691853 - DNA, 13 bp, C. elegans
aacttttgaacaa

SEQ ID NO: 691854 - DNA, 13 bp, C. elegans
aacttttgaacat

SEQ ID NO: 691855 - DNA, 13 bp, C. elegans
aacttttgaagag

SEQ ID NO: 691856 - DNA, 13 bp, C. elegans
aacttttgaataa

SEQ ID NO: 691857 - DNA, 13 bp, C. elegans
aacttttgacaaa

SEQ ID NO: 691858 - DNA, 13 bp, C. elegans
aacttttgaccaa

SEQ ID NO: 691859 - DNA, 13 bp, C. elegans
aacttttgacttt

SEQ ID NO: 691860 - DNA, 13 bp, C. elegans
aacttttgagatc

SEQ ID NO: 691861 - DNA, 13 bp, C. elegans
aacttttgataaa

SEQ ID NO: 691862 - DNA, 13 bp, C. elegans
aacttttgatatt

SEQ ID NO: 691863 - DNA, 13 bp, C. elegans
aacttttgatcca

SEQ ID NO: 691864 - DNA, 13 bp, C. elegans
aacttttgatctt

SEQ ID NO: 691865 - DNA, 13 bp, C. elegans
aacttttgcaaaa

SEQ ID NO: 691866 - DNA, 13 bp, C. elegans
aacttttgcaaca

SEQ ID NO: 691867 - DNA, 13 bp, C. elegans
aacttttgccaac

SEQ ID NO: 691868 - DNA, 13 bp, C. elegans
aacttttgctaaa

SEQ ID NO: 691869 - DNA, 13 bp, C. elegans
aacttttgctcaa

SEQ ID NO: 691870 - DNA, 13 bp, C. elegans
aacttttggaaat

SEQ ID NO: 691871 - DNA, 13 bp, C. elegans
aacttttggaaca

SEQ ID NO: 691872 - DNA, 13 bp, C. elegans
aacttttggaatt

SEQ ID NO: 691873 - DNA, 13 bp, C. elegans
aacttttggattt

SEQ ID NO: 691874 - DNA, 13 bp, C. elegans
aacttttggcaac

SEQ ID NO: 691875 - DNA, 13 bp, C. elegans
aacttttgtcaaa

SEQ ID NO: 691876 - DNA, 13 bp, C. elegans
aactttttaaatg

SEQ ID NO: 691877 - DNA, 13 bp, C. elegans
aactttttaacta

SEQ ID NO: 691878 - DNA, 13 bp, C. elegans
aactttttaactt

SEQ ID NO: 691879 - DNA, 13 bp, C. elegans
aactttttacaaa

SEQ ID NO: 691880 - DNA, 13 bp, C. elegans
aactttttcaact

SEQ ID NO: 691881 - DNA, 13 bp, C. elegans
aactttttcagtt

SEQ ID NO: 691882 - DNA, 13 bp, C. elegans
aactttttcataa

SEQ ID NO: 691883 - DNA, 13 bp, C. elegans
aactttttcatat

SEQ ID NO: 691884 - DNA, 13 bp, C. elegans
aactttttcgaat

SEQ ID NO: 691885 - DNA, 13 bp, C. elegans
aactttttctgaa

SEQ ID NO: 691886 - DNA, 13 bp, C. elegans
aactttttgaaaa

SEQ ID NO: 691887 - DNA, 13 bp, C. elegans
aactttttgaaat

SEQ ID NO: 691888 - DNA, 13 bp, C. elegans
aactttttgaaca

SEQ ID NO: 691889 - DNA, 13 bp, C. elegans
aactttttgactt

SEQ ID NO: 691890 - DNA, 13 bp, C. elegans
aactttttgagtt

SEQ ID NO: 691891 - DNA, 13 bp, C. elegans
aactttttgataa

SEQ ID NO: 691892 - DNA, 13 bp, C. elegans
aactttttgcaat

SEQ ID NO: 691893 - DNA, 13 bp, C. elegans
aactttttggaaa

SEQ ID NO: 691894 - DNA, 13 bp, C. elegans
aactttttggaag

SEQ ID NO: 691895 - DNA, 13 bp, C. elegans
aactttttggcgg

SEQ ID NO: 691896 - DNA, 13 bp, C. elegans
aactttttggttt

SEQ ID NO: 691897 - DNA, 13 bp, C. elegans
aactttttgtagt

SEQ ID NO: 691898 - DNA, 13 bp, C. elegans
aactttttgttat

SEQ ID NO: 691899 - DNA, 13 bp, C. elegans
aactttttgttct

SEQ ID NO: 691900 - DNA, 13 bp, C. elegans
aactttttgtttg

SEQ ID NO: 691901 - DNA, 13 bp, C. elegans
aacttttttatag

SEQ ID NO: 691902 - DNA, 13 bp, C. elegans
aacttttttcaaa

SEQ ID NO: 691903 - DNA, 13 bp, C. elegans
aacttttttccaa

SEQ ID NO: 691904 - DNA, 13 bp, C. elegans
aacttttttcgaa

SEQ ID NO: 691905 - DNA, 13 bp, C. elegans
aacttttttgaaa

SEQ ID NO: 691906 - DNA, 13 bp, C. elegans
aacttttttgaat

SEQ ID NO: 691907 - DNA, 13 bp, C. elegans
aacttttttgatt

SEQ ID NO: 691908 - DNA, 13 bp, C. elegans
aacttttttgtct

SEQ ID NO: 691909 - DNA, 13 bp, C. elegans
aactttttttcac

SEQ ID NO: 691910 - DNA, 13 bp, C. elegans
aactttttttcag

SEQ ID NO: 691911 - DNA, 15 bp, C. elegans
aactttttttccaaa

SEQ ID NO: 691912 - DNA, 13 bp, C. elegans
aactttttttcga

SEQ ID NO: 691913 - DNA, 13 bp, C. elegans
aactttttttctg

SEQ ID NO: 691914 - DNA, 13 bp, C. elegans
aactttttttgaa

SEQ ID NO: 691915 - DNA, 13 bp, C. elegans
aagaaaaaacttt

SEQ ID NO: 691916 - DNA, 13 bp, C. elegans
aagaaaaacatct

SEQ ID NO: 691917 - DNA, 13 bp, C. elegans
aagaaaaacgtga

SEQ ID NO: 691918 - DNA, 13 bp, C. elegans
aagaaaaactcga

SEQ ID NO: 691919 - DNA, 13 bp, C. elegans
aagaaaaactgtg

SEQ ID NO: 691920 - DNA, 13 bp, C. elegans
aagaaaaagcttg

SEQ ID NO: 691921 - DNA, 13 bp, C. elegans
aagaaaaagtcta

SEQ ID NO: 691922 - DNA, 13 bp, C. elegans
aagaaaaatccga

SEQ ID NO: 691923 - DNA, 13 bp, C. elegans
aagaaaaatcggt

SEQ ID NO: 691924 - DNA, 13 bp, C. elegans
aagaaaaatctca

SEQ ID NO: 691925 - DNA, 13 bp, C. elegans
aagaaaaattctt

SEQ ID NO: 691926 - DNA, 13 bp, C. elegans
aagaaaacaactg

SEQ ID NO: 691927 - DNA, 13 bp, C. elegans
aagaaaacagttt

SEQ ID NO: 691928 - DNA, 13 bp, C. elegans
aagaaaacatttc

SEQ ID NO: 691929 - DNA, 13 bp, C. elegans
aagaaaacatttt

SEQ ID NO: 691930 - DNA, 13 bp, C. elegans
aagaaaaccccga

SEQ ID NO: 691931 - DNA, 13 bp, C. elegans
aagaaaacgagta

SEQ ID NO: 691932 - DNA, 13 bp, C. elegans
aagaaaacgattt

SEQ ID NO: 691933 - DNA, 13 bp, C. elegans
aagaaaacgtcaa

SEQ ID NO: 691934 - DNA, 13 bp, C. elegans
aagaaaacgttaa

SEQ ID NO: 691935 - DNA, 13 bp, C. elegans
aagaaaactatta

SEQ ID NO: 691936 - DNA, 13 bp, C. elegans
aagaaaactattt

SEQ ID NO: 691937 - DNA, 13 bp, C. elegans
aagaaaactcatt

SEQ ID NO: 691938 - DNA, 13 bp, C. elegans
aagaaaactgttt

SEQ ID NO: 691939 - DNA, 13 bp, C. elegans
aagaaaacttcaa

SEQ ID NO: 691940 - DNA, 13 bp, C. elegans
aagaaaactttaa

SEQ ID NO: 691941 - DNA, 13 bp, C. elegans
aagaaaactttta

SEQ ID NO: 691942 - DNA, 13 bp, C. elegans
aagaaaagtcgat

SEQ ID NO: 691943 - DNA, 13 bp, C. elegans
aagaaaagtgtgc

SEQ ID NO: 691944 - DNA, 13 bp, C. elegans
aagaaaatagttt

SEQ ID NO: 691945 - DNA, 13 bp, C. elegans
aagaaaatattct

SEQ ID NO: 691946 - DNA, 13 bp, C. elegans
aagaaaatcaatt

SEQ ID NO: 691947 - DNA, 13 bp, C. elegans
aagaaaatgagac

SEQ ID NO: 691948 - DNA, 13 bp, C. elegans
aagaaaattattg

SEQ ID NO: 691949 - DNA, 13 bp, C. elegans
aagaaaattcaat

SEQ ID NO: 691950 - DNA, 13 bp, C. elegans
aagaaaattgcga

SEQ ID NO: 691951 - DNA, 13 bp, C. elegans
aagaaaattggat

SEQ ID NO: 691952 - DNA, 13 bp, C. elegans
aagaaacaattca

SEQ ID NO: 691953 - DNA, 13 bp, C. elegans
aagaaacaatttt

SEQ ID NO: 691954 - DNA, 13 bp, C. elegans
aagaaacactttt

SEQ ID NO: 691955 - DNA, 13 bp, C. elegans
aagaaacattttt

SEQ ID NO: 691956 - DNA, 13 bp, C. elegans
aagaaactaaatt

SEQ ID NO: 691957 - DNA, 13 bp, C. elegans
aagaaactaatga

SEQ ID NO: 691958 - DNA, 13 bp, C. elegans
aagaaactagttt

SEQ ID NO: 691959 - DNA, 13 bp, C. elegans
aagaaacttaaat

SEQ ID NO: 691960 - DNA, 13 bp, C. elegans
aagaaacttggaa

SEQ ID NO: 691961 - DNA, 13 bp, C. elegans
aagaaactttaaa

SEQ ID NO: 691962 - DNA, 13 bp, C. elegans
aagaaacttttaa

SEQ ID NO: 691963 - DNA, 13 bp, C. elegans
aagaaactttttt

SEQ ID NO: 691964 - DNA, 13 bp, C. elegans
aagaaaggatcaa

SEQ ID NO: 691965 - DNA, 13 bp, C. elegans
aagaaagttttaa

SEQ ID NO: 691966 - DNA, 13 bp, C. elegans
aagaaagttttca

SEQ ID NO: 691967 - DNA, 13 bp, C. elegans
aagaaatacaatt

SEQ ID NO: 691968 - DNA, 13 bp, C. elegans
aagaaataccagt

SEQ ID NO: 691969 - DNA, 13 bp, C. elegans
aagaaatattgga

SEQ ID NO: 691970 - DNA, 13 bp, C. elegans
aagaaatcaatta

SEQ ID NO: 691971 - DNA, 14 bp, C. elegans
aagaaatcggaaaa

SEQ ID NO: 691972 - DNA, 13 bp, C. elegans
aagaaatctcaaa

SEQ ID NO: 691973 - DNA, 13 bp, C. elegans
aagaaatctgaat

SEQ ID NO: 691974 - DNA, 13 bp, C. elegans
aagaaatctggaa

SEQ ID NO: 691975 - DNA, 13 bp, C. elegans
aagaaatgggtgg

SEQ ID NO: 691976 - DNA, 13 bp, C. elegans
aagaaatgttgaa

SEQ ID NO: 691977 - DNA, 13 bp, C. elegans
aagaaatgtttaa

SEQ ID NO: 691978 - DNA, 13 bp, C. elegans
aagaaatgtttat

SEQ ID NO: 691979 - DNA, 13 bp, C. elegans
aagaaattattca

SEQ ID NO: 691980 - DNA, 13 bp, C. elegans
aagaaattcaact

SEQ ID NO: 691981 - DNA, 13 bp, C. elegans
aagaaattcattt

SEQ ID NO: 691982 - DNA, 13 bp, C. elegans
aagaaattccaaa

SEQ ID NO: 691983 - DNA, 13 bp, C. elegans
aagaaattcgaat

SEQ ID NO: 691984 - DNA, 13 bp, C. elegans
aagaaattctgaa

SEQ ID NO: 691985 - DNA, 13 bp, C. elegans
aagaaattgcaaa

SEQ ID NO: 691986 - DNA, 13 bp, C. elegans
aagaaattgctaa

SEQ ID NO: 691987 - DNA, 13 bp, C. elegans
aagaaattgtgaa

SEQ ID NO: 691988 - DNA, 13 bp, C. elegans
aagaaatttgatt

SEQ ID NO: 691989 - DNA, 13 bp, C. elegans
aagaaatttggaa

SEQ ID NO: 691990 - DNA, 13 bp, C. elegans
aagaaatttggcg

SEQ ID NO: 691991 - DNA, 13 bp, C. elegans
aagaaatttggtg

SEQ ID NO: 691992 - DNA, 13 bp, C. elegans
aagaaattttgag

SEQ ID NO: 691993 - DNA, 13 bp, C. elegans
aagaaattttgga

SEQ ID NO: 691994 - DNA, 13 bp, C. elegans
aagaaattttgtg

SEQ ID NO: 691995 - DNA, 13 bp, C. elegans
aagaacaaacatt

SEQ ID NO: 691996 - DNA, 13 bp, C. elegans
aagaacaaatatt

SEQ ID NO: 691997 - DNA, 13 bp, C. elegans
aagaacagttttt

SEQ ID NO: 691998 - DNA, 13 bp, C. elegans
aagaacatgaaac

SEQ ID NO: 691999 - DNA, 13 bp, C. elegans
aagaacatgtttt

SEQ ID NO: 692000 - DNA, 13 bp, C. elegans
aagaacatttctt

SEQ ID NO: 692001 - DNA, 13 bp, C. elegans
aagaacattttaa

SEQ ID NO: 692002 - DNA, 13 bp, C. elegans
aagaacattttga

SEQ ID NO: 692003 - DNA, 13 bp, C. elegans
aagaacattttta

SEQ ID NO: 692004 - DNA, 13 bp, C. elegans
aagaacctttgaa

SEQ ID NO: 692005 - DNA, 13 bp, C. elegans
aagaacgtgttga

SEQ ID NO: 692006 - DNA, 13 bp, C. elegans
aagaacgtttttt

SEQ ID NO: 692007 - DNA, 13 bp, C. elegans
aagaacttttaaa

SEQ ID NO: 692008 - DNA, 13 bp, C. elegans
aagaagaaaatgc

SEQ ID NO: 692009 - DNA, 13 bp, C. elegans
aagaagaaactga

SEQ ID NO: 692010 - DNA, 13 bp, C. elegans
aagaagaacacat

SEQ ID NO: 692011 - DNA, 13 bp, C. elegans
aagaagaacttga

SEQ ID NO: 692012 - DNA, 13 bp, C. elegans
aagaagaagacgt

SEQ ID NO: 692013 - DNA, 13 bp, C. elegans
aagaagaagatgc

SEQ ID NO: 692014 - DNA, 13 bp, C. elegans
aagaagaagatgt

SEQ ID NO: 692015 - DNA, 13 bp, C. elegans
aagaagaagcata

SEQ ID NO: 692016 - DNA, 13 bp, C. elegans
aagaagaagtttt

SEQ ID NO: 692017 - DNA, 13 bp, C. elegans
aagaagaatttta

SEQ ID NO: 692018 - DNA, 13 bp, C. elegans
aagaagacgacga

SEQ ID NO: 692019 - DNA, 13 bp, C. elegans
aagaagacgatga

SEQ ID NO: 692020 - DNA, 13 bp, C. elegans
aagaagatatttt

SEQ ID NO: 692021 - DNA, 13 bp, C. elegans
aagaagatctacg

SEQ ID NO: 692022 - DNA, 13 bp, C. elegans
aagaagatgaagc

SEQ ID NO: 692023 - DNA, 13 bp, C. elegans
aagaagatttgaa

SEQ ID NO: 692024 - DNA, 13 bp, C. elegans
aagaagctagagc

SEQ ID NO: 692025 - DNA, 13 bp, C. elegans
aagaagctcatga

SEQ ID NO: 692026 - DNA, 13 bp, C. elegans
aagaagctgaaaa

SEQ ID NO: 692027 - DNA, 13 bp, C. elegans
aagaaggacgagc

SEQ ID NO: 692028 - DNA, 13 bp, C. elegans
aagaagtcgtcca

SEQ ID NO: 692029 - DNA, 13 bp, C. elegans
aagaagtgggcgg

SEQ ID NO: 692030 - DNA, 13 bp, C. elegans
aagaagttaaaac

SEQ ID NO: 692031 - DNA, 13 bp, C. elegans
aagaagttgaagt

SEQ ID NO: 692032 - DNA, 13 bp, C. elegans
aagaagttgcaag

SEQ ID NO: 692033 - DNA, 13 bp, C. elegans
aagaagttgcgaa

SEQ ID NO: 692034 - DNA, 13 bp, C. elegans
aagaagttttttt

SEQ ID NO: 692035 - DNA, 13 bp, C. elegans
aagaatacaattt

SEQ ID NO: 692036 - DNA, 13 bp, C. elegans
aagaatacggtac

SEQ ID NO: 692037 - DNA, 13 bp, C. elegans
aagaatattttca

SEQ ID NO: 692038 - DNA, 13 bp, C. elegans
aagaatcaagaat

SEQ ID NO: 692039 - DNA, 13 bp, C. elegans
aagaatcagaaat

SEQ ID NO: 692040 - DNA, 13 bp, C. elegans
aagaatcagtttt

SEQ ID NO: 692041 - DNA, 13 bp, C. elegans
aagaatcgaacac

SEQ ID NO: 692042 - DNA, 13 bp, C. elegans
aagaatctcaaaa

SEQ ID NO: 692043 - DNA, 13 bp, C. elegans
aagaatctggaaa

SEQ ID NO: 692044 - DNA, 13 bp, C. elegans
aagaatgattttt

SEQ ID NO: 692045 - DNA, 13 bp, C. elegans
aagaatgcaattt

SEQ ID NO: 692046 - DNA, 13 bp, C. elegans
aagaatggactcc

SEQ ID NO: 692047 - DNA, 13 bp, C. elegans
aagaatgggaaat

SEQ ID NO: 692048 - DNA, 15 bp, C. elegans
aagaatgtacgtatg

SEQ ID NO: 692049 - DNA, 13 bp, C. elegans
aagaattattgta

SEQ ID NO: 692050 - DNA, 13 bp, C. elegans
aagaattcaaaag

SEQ ID NO: 692051 - DNA, 13 bp, C. elegans
aagaattcaaaga

SEQ ID NO: 692052 - DNA, 13 bp, C. elegans
aagaattcaaagt

SEQ ID NO: 692053 - DNA, 13 bp, C. elegans
aagaattcaagaa

SEQ ID NO: 692054 - DNA, 13 bp, C. elegans
aagaattcaattt

SEQ ID NO: 692055 - DNA, 13 bp, C. elegans
aagaattcagaaa

SEQ ID NO: 692056 - DNA, 13 bp, C. elegans
aagaattccaatt

SEQ ID NO: 692057 - DNA, 13 bp, C. elegans
aagaattcgaatt

SEQ ID NO: 692058 - DNA, 13 bp, C. elegans
aagaattgaaatg

SEQ ID NO: 692059 - DNA, 13 bp, C. elegans
aagaattgatgaa

SEQ ID NO: 692060 - DNA, 13 bp, C. elegans
aagaattggattt

SEQ ID NO: 692061 - DNA, 13 bp, C. elegans
aagaattggtttt

SEQ ID NO: 692062 - DNA, 13 bp, C. elegans
aagaattgttgaa

SEQ ID NO: 692063 - DNA, 13 bp, C. elegans
aagaatttcaaaa

SEQ ID NO: 692064 - DNA, 13 bp, C. elegans
aagaatttcaaca

SEQ ID NO: 692065 - DNA, 13 bp, C. elegans
aagaatttcaatt

SEQ ID NO: 692066 - DNA, 13 bp, C. elegans
aagaatttcattt

SEQ ID NO: 692067 - DNA, 13 bp, C. elegans
aagaatttcgaaa

SEQ ID NO: 692068 - DNA, 13 bp, C. elegans
aagaatttctgaa

SEQ ID NO: 692069 - DNA, 13 bp, C. elegans
aagaatttgaact

SEQ ID NO: 692070 - DNA, 13 bp, C. elegans
aagaatttgaatt

SEQ ID NO: 692071 - DNA, 13 bp, C. elegans
aagaatttgataa

SEQ ID NO: 692072 - DNA, 13 bp, C. elegans
aagaatttgcaaa

SEQ ID NO: 692073 - DNA, 13 bp, C. elegans
aagaatttgccga

SEQ ID NO: 692074 - DNA, 13 bp, C. elegans
aagaatttggaaa

SEQ ID NO: 692075 - DNA, 13 bp, C. elegans
aagaatttggaat

SEQ ID NO: 692076 - DNA, 13 bp, C. elegans
aagaatttgtaaa

SEQ ID NO: 692077 - DNA, 13 bp, C. elegans
aagaatttgtatt

SEQ ID NO: 692078 - DNA, 13 bp, C. elegans
aagaattttgaat

SEQ ID NO: 692079 - DNA, 13 bp, C. elegans
aagaatttttcca

SEQ ID NO: 692080 - DNA, 13 bp, C. elegans
aagacaaaaactc

SEQ ID NO: 692081 - DNA, 13 bp, C. elegans
aagacaaaatatt

SEQ ID NO: 692082 - DNA, 13 bp, C. elegans
aagacaaaatcag

SEQ ID NO: 692083 - DNA, 13 bp, C. elegans
aagacaaaattgt

SEQ ID NO: 692084 - DNA, 13 bp, C. elegans
aagacaaatgcaa

SEQ ID NO: 692085 - DNA, 13 bp, C. elegans
aagacaattttca

SEQ ID NO: 692086 - DNA, 13 bp, C. elegans
aagacaatttttg

SEQ ID NO: 692087 - DNA, 13 bp, C. elegans
aagacacaatttt

SEQ ID NO: 692088 - DNA, 13 bp, C. elegans
aagacaccgacaa

SEQ ID NO: 692089 - DNA, 13 bp, C. elegans
aagacactgaaaa

SEQ ID NO: 692090 - DNA, 13 bp, C. elegans
aagacattgaaaa

SEQ ID NO: 692091 - DNA, 13 bp, C. elegans
aagacatttgaaa

SEQ ID NO: 692092 - DNA, 13 bp, C. elegans
aagacatttgaat

SEQ ID NO: 692093 - DNA, 13 bp, C. elegans
aagacatttttga

SEQ ID NO: 692094 - DNA, 14 bp, C. elegans
aagacccaaagatg

SEQ ID NO: 692095 - DNA, 13 bp, C. elegans
aagacgaaaaact

SEQ ID NO: 692096 - DNA, 13 bp, C. elegans
aagacgaaaagtc

SEQ ID NO: 692097 - DNA, 13 bp, C. elegans
aagacgaaaattg

SEQ ID NO: 692098 - DNA, 13 bp, C. elegans
aagacgacgaaga

SEQ ID NO: 692099 - DNA, 13 bp, C. elegans
aagacgataattc

SEQ ID NO: 692100 - DNA, 13 bp, C. elegans
aagacgctgattg

SEQ ID NO: 692101 - DNA, 13 bp, C. elegans
aagacgtggaaaa

SEQ ID NO: 692102 - DNA, 13 bp, C. elegans
aagactaaaaatt

SEQ ID NO: 692103 - DNA, 13 bp, C. elegans
aagactacaaact

SEQ ID NO: 692104 - DNA, 13 bp, C. elegans
aagactatatttt

SEQ ID NO: 692105 - DNA, 13 bp, C. elegans
aagactattaaaa

SEQ ID NO: 692106 - DNA, 13 bp, C. elegans
aagactgaaaatg

SEQ ID NO: 692107 - DNA, 13 bp, C. elegans
aagactggaaaaa

SEQ ID NO: 692108 - DNA, 13 bp, C. elegans
aagacttcttgaa

SEQ ID NO: 692109 - DNA, 13 bp, C. elegans
aagactttggcaa

SEQ ID NO: 692110 - DNA, 13 bp, C. elegans
aagacttttcaaa

SEQ ID NO: 692111 - DNA, 13 bp, C. elegans
aagactttttgaa

SEQ ID NO: 692112 - DNA, 13 bp, C. elegans
aagacttttttct

SEQ ID NO: 692113 - DNA, 13 bp, C. elegans
aagagaaaattca

SEQ ID NO: 692114 - DNA, 13 bp, C. elegans
aagagaaatttga

SEQ ID NO: 692115 - DNA, 13 bp, C. elegans
aagagaagaagct

SEQ ID NO: 692116 - DNA, 13 bp, C. elegans
aagagaatcagaa

SEQ ID NO: 692117 - DNA, 13 bp, C. elegans
aagagacgcaaag

SEQ ID NO: 692118 - DNA, 13 bp, C. elegans
aagagacgcagag

SEQ ID NO: 692119 - DNA, 13 bp, C. elegans
aagagacgcagca

SEQ ID NO: 692120 - DNA, 13 bp, C. elegans
aagagaggccgtg

SEQ ID NO: 692121 - DNA, 13 bp, C. elegans
aagagatatcaaa

SEQ ID NO: 692122 - DNA, 13 bp, C. elegans
aagagatttttaa

SEQ ID NO: 692123 - DNA, 13 bp, C. elegans
aagagattttttt

SEQ ID NO: 692124 - DNA, 13 bp, C. elegans
aagagctgaaatt

SEQ ID NO: 692125 - DNA, 13 bp, C. elegans
aagagcttcaatt

SEQ ID NO: 692126 - DNA, 13 bp, C. elegans
aagagcttgaaat

SEQ ID NO: 692127 - DNA, 13 bp, C. elegans
aagaggcgcagag

SEQ ID NO: 692128 - DNA, 13 bp, C. elegans
aagaggcggagct

SEQ ID NO: 692129 - DNA, 13 bp, C. elegans
aagaggttttttt

SEQ ID NO: 692130 - DNA, 14 bp, C. elegans
aagagtactgtagt

SEQ ID NO: 692131 - DNA, 13 bp, C. elegans
aagagtgaaattt

SEQ ID NO: 692132 - DNA, 13 bp, C. elegans
aagagttcaaaaa

SEQ ID NO: 692133 - DNA, 13 bp, C. elegans
aagagttggaaag

SEQ ID NO: 692134 - DNA, 13 bp, C. elegans
aagagtttcaaaa

SEQ ID NO: 692135 - DNA, 13 bp, C. elegans
aagagtttgccga

SEQ ID NO: 692136 - DNA, 13 bp, C. elegans
aagagttttcagt

SEQ ID NO: 692137 - DNA, 13 bp, C. elegans
aagagttttcgtg

SEQ ID NO: 692138 - DNA, 13 bp, C. elegans
aagagtttttcaa

SEQ ID NO: 692139 - DNA, 13 bp, C. elegans
aagagtttttgat

SEQ ID NO: 692140 - DNA, 13 bp, C. elegans
aagagtttttgcc

SEQ ID NO: 692141 - DNA, 13 bp, C. elegans
aagataaaagttt

SEQ ID NO: 692142 - DNA, 13 bp, C. elegans
aagatatattttc

SEQ ID NO: 692143 - DNA, 13 bp, C. elegans
aagatatcaaatt

SEQ ID NO: 692144 - DNA, 13 bp, C. elegans
aagatatcaacaa

SEQ ID NO: 692145 - DNA, 13 bp, C. elegans
aagatatgagctg

SEQ ID NO: 692146 - DNA, 13 bp, C. elegans
aagatatgggcgg

SEQ ID NO: 692147 - DNA, 13 bp, C. elegans
aagatattcagaa

SEQ ID NO: 692148 - DNA, 13 bp, C. elegans
aagatattctaaa

SEQ ID NO: 692149 - DNA, 13 bp, C. elegans
aagatattgagaa

SEQ ID NO: 692150 - DNA, 13 bp, C. elegans
aagatattttcat

SEQ ID NO: 692151 - DNA, 13 bp, C. elegans
aagatcaaaaatc

SEQ ID NO: 692152 - DNA, 13 bp, C. elegans
aagatcaaatcaa

SEQ ID NO: 692153 - DNA, 13 bp, C. elegans
aagatcaagtagt

SEQ ID NO: 692154 - DNA, 13 bp, C. elegans
aagatcacaattt

SEQ ID NO: 692155 - DNA, 13 bp, C. elegans
aagatcagaagat

SEQ ID NO: 692156 - DNA, 13 bp, C. elegans
aagatcgaaattg

SEQ ID NO: 692157 - DNA, 13 bp, C. elegans
aagatcggaagaa

SEQ ID NO: 692158 - DNA, 13 bp, C. elegans
aagatctcaaaaa

SEQ ID NO: 692159 - DNA, 13 bp, C. elegans
aagatctggagaa

SEQ ID NO: 692160 - DNA, 13 bp, C. elegans
aagatgaaattgt

SEQ ID NO: 692161 - DNA, 13 bp, C. elegans
aagatgaacaact

SEQ ID NO: 692162 - DNA, 13 bp, C. elegans
aagatgaagtttc

SEQ ID NO: 692163 - DNA, 13 bp, C. elegans
aagatgaggaaat

SEQ ID NO: 692164 - DNA, 13 bp, C. elegans
aagatgataattt

SEQ ID NO: 692165 - DNA, 13 bp, C. elegans
aagatgatattga

SEQ ID NO: 692166 - DNA, 13 bp, C. elegans
aagatgcaaaaat

SEQ ID NO: 692167 - DNA, 13 bp, C. elegans
aagatggatgtga

SEQ ID NO: 692168 - DNA, 13 bp, C. elegans
aagatgtctggat

SEQ ID NO: 692169 - DNA, 13 bp, C. elegans
aagatgtgttttt

SEQ ID NO: 692170 - DNA, 13 bp, C. elegans
aagatgttcaaaa

SEQ ID NO: 692171 - DNA, 13 bp, C. elegans
aagatgtttgaaa

SEQ ID NO: 692172 - DNA, 13 bp, C. elegans
aagatgttttcgt

SEQ ID NO: 692173 - DNA, 13 bp, C. elegans
aagattacaaaac

SEQ ID NO: 692174 - DNA, 13 bp, C. elegans
aagattacatttt

SEQ ID NO: 692175 - DNA, 13 bp, C. elegans
aagattattcaaa

SEQ ID NO: 692176 - DNA, 13 bp, C. elegans
aagattattccaa

SEQ ID NO: 692177 - DNA, 13 bp, C. elegans
aagattattgatt

SEQ ID NO: 692178 - DNA, 13 bp, C. elegans
aagattattttga

SEQ ID NO: 692179 - DNA, 13 bp, C. elegans
aagattcaataaa

SEQ ID NO: 692180 - DNA, 13 bp, C. elegans
aagattcagaaat

SEQ ID NO: 692181 - DNA, 13 bp, C. elegans
aagattcatattt

SEQ ID NO: 692182 - DNA, 13 bp, C. elegans
aagattcccgaag

SEQ ID NO: 692183 - DNA, 13 bp, C. elegans
aagattctagatt

SEQ ID NO: 692184 - DNA, 13 bp, C. elegans
aagattctgaaaa

SEQ ID NO: 692185 - DNA, 13 bp, C. elegans
aagattgaaatat

SEQ ID NO: 692186 - DNA, 13 bp, C. elegans
aagattgagattt

SEQ ID NO: 692187 - DNA, 13 bp, C. elegans
aagattgtaaata

SEQ ID NO: 692188 - DNA, 13 bp, C. elegans
aagatttaaatga

SEQ ID NO: 692189 - DNA, 13 bp, C. elegans
aagatttcaaaaa

SEQ ID NO: 692190 - DNA, 13 bp, C. elegans
aagatttcaaagt

SEQ ID NO: 692191 - DNA, 13 bp, C. elegans
aagatttcaaatt

SEQ ID NO: 692192 - DNA, 13 bp, C. elegans
aagatttcaattc

SEQ ID NO: 692193 - DNA, 13 bp, C. elegans
aagatttcataaa

SEQ ID NO: 692194 - DNA, 13 bp, C. elegans
aagatttctggaa

SEQ ID NO: 692195 - DNA, 13 bp, C. elegans
aagatttgaaaag

SEQ ID NO: 692196 - DNA, 13 bp, C. elegans
aagatttgaagat

SEQ ID NO: 692197 - DNA, 13 bp, C. elegans
aagatttgaattt

SEQ ID NO: 692198 - DNA, 13 bp, C. elegans
aagatttgataaa

SEQ ID NO: 692199 - DNA, 13 bp, C. elegans
aagatttgggcgc

SEQ ID NO: 692200 - DNA, 13 bp, C. elegans
aagatttgttgaa

SEQ ID NO: 692201 - DNA, 13 bp, C. elegans
aagattttcgaaa

SEQ ID NO: 692202 - DNA, 13 bp, C. elegans
aagattttcgatt

SEQ ID NO: 692203 - DNA, 13 bp, C. elegans
aagattttgacat

SEQ ID NO: 692204 - DNA, 15 bp, C. elegans
aagattttgagaatt

SEQ ID NO: 692205 - DNA, 13 bp, C. elegans
aagattttgattt

SEQ ID NO: 692206 - DNA, 13 bp, C. elegans
aagattttggaat

SEQ ID NO: 692207 - DNA, 13 bp, C. elegans
aagattttggcat

SEQ ID NO: 692208 - DNA, 13 bp, C. elegans
aagattttgtatt

SEQ ID NO: 692209 - DNA, 13 bp, C. elegans
aagatttttaaac

SEQ ID NO: 692210 - DNA, 13 bp, C. elegans
aagatttttcaat

SEQ ID NO: 692211 - DNA, 13 bp, C. elegans
aagatttttctca

SEQ ID NO: 692212 - DNA, 13 bp, C. elegans
aagatttttctga

SEQ ID NO: 692213 - DNA, 13 bp, C. elegans
aagatttttctgg

SEQ ID NO: 692214 - DNA, 13 bp, C. elegans
aagatttttgcaa

SEQ ID NO: 692215 - DNA, 13 bp, C. elegans
aagatttttggaa

SEQ ID NO: 692216 - DNA, 13 bp, C. elegans
aagattttttagg

SEQ ID NO: 692217 - DNA, 13 bp, C. elegans
aagcaaaaattag

SEQ ID NO: 692218 - DNA, 13 bp, C. elegans
aagcaaaagtccg

SEQ ID NO: 692219 - DNA, 13 bp, C. elegans
aagcaaaatatga

SEQ ID NO: 692220 - DNA, 13 bp, C. elegans
aagcaaaatggga

SEQ ID NO: 692221 - DNA, 13 bp, C. elegans
aagcaaattttga

SEQ ID NO: 692222 - DNA, 13 bp, C. elegans
aagcaacaaaagt

SEQ ID NO: 692223 - DNA, 13 bp, C. elegans
aagcaataataat

SEQ ID NO: 692224 - DNA, 13 bp, C. elegans
aagcaatatattt

SEQ ID NO: 692225 - DNA, 13 bp, C. elegans
aagcaatgaaaat

SEQ ID NO: 692226 - DNA, 13 bp, C. elegans
aagcaattatttt

SEQ ID NO: 692227 - DNA, 13 bp, C. elegans
aagcaattttcaa

SEQ ID NO: 692228 - DNA, 13 bp, C. elegans
aagcacaaaaact

SEQ ID NO: 692229 - DNA, 13 bp, C. elegans
aagcacacttttt

SEQ ID NO: 692230 - DNA, 13 bp, C. elegans
aagcactgacaaa

SEQ ID NO: 692231 - DNA, 13 bp, C. elegans
aagcagaaaaagt

SEQ ID NO: 692232 - DNA, 13 bp, C. elegans
aagcagattccaa

SEQ ID NO: 692233 - DNA, 13 bp, C. elegans
aagcagttcaaaa

SEQ ID NO: 692234 - DNA, 13 bp, C. elegans
aagcatatatttt

SEQ ID NO: 692235 - DNA, 13 bp, C. elegans
aagcattaaaatt

SEQ ID NO: 692236 - DNA, 13 bp, C. elegans
aagcattaatttt

SEQ ID NO: 692237 - DNA, 13 bp, C. elegans
aagcattgaaaaa

SEQ ID NO: 692238 - DNA, 13 bp, C. elegans
aagcatttaaaat

SEQ ID NO: 692239 - DNA, 13 bp, C. elegans
aagcatttcaaat

SEQ ID NO: 692240 - DNA, 13 bp, C. elegans
aagcatttgaaaa

SEQ ID NO: 692241 - DNA, 13 bp, C. elegans
aagcatttttaaa

SEQ ID NO: 692242 - DNA, 13 bp, C. elegans
aagcattttttaa

SEQ ID NO: 692243 - DNA, 13 bp, C. elegans
aagcatttttttt

SEQ ID NO: 692244 - DNA, 13 bp, C. elegans
aagccaaaaaagt

SEQ ID NO: 692245 - DNA, 13 bp, C. elegans
aagccaaaaaatg

SEQ ID NO: 692246 - DNA, 13 bp, C. elegans
aagccaaaaccta

SEQ ID NO: 692247 - DNA, 13 bp, C. elegans
aagccaaaacttc

SEQ ID NO: 692248 - DNA, 13 bp, C. elegans
aagccaatttgaa

SEQ ID NO: 692249 - DNA, 13 bp, C. elegans
aagccaatttttt

SEQ ID NO: 692250 - DNA, 14 bp, C. elegans
aagccacagagagt

SEQ ID NO: 692251 - DNA, 13 bp, C. elegans
aagccagaaatta

SEQ ID NO: 692252 - DNA, 13 bp, C. elegans
aagccatgaaaaa

SEQ ID NO: 692253 - DNA, 13 bp, C. elegans
aagcccgaatacc

SEQ ID NO: 692254 - DNA, 13 bp, C. elegans
aagccgaaaaatg

SEQ ID NO: 692255 - DNA, 13 bp, C. elegans
aagccgaaatggg

SEQ ID NO: 692256 - DNA, 13 bp, C. elegans
aagccgaagaagc

SEQ ID NO: 692257 - DNA, 13 bp, C. elegans
aagccgagaacct

SEQ ID NO: 692258 - DNA, 13 bp, C. elegans
aagcctaaaaata

SEQ ID NO: 692259 - DNA, 13 bp, C. elegans
aagcctaaaagcc

SEQ ID NO: 692260 - DNA, 13 bp, C. elegans
aagcctaagccaa

SEQ ID NO: 692261 - DNA, 13 bp, C. elegans
aagcctaattcta

SEQ ID NO: 692262 - DNA, 13 bp, C. elegans
aagcctacgcctg

SEQ ID NO: 692263 - DNA, 13 bp, C. elegans
aagcgaaaaatct

SEQ ID NO: 692264 - DNA, 13 bp, C. elegans
aagcgaaaattca

SEQ ID NO: 692265 - DNA, 13 bp, C. elegans
aagcgaaatttga

SEQ ID NO: 692266 - DNA, 13 bp, C. elegans
aagcgatttttca

SEQ ID NO: 692267 - DNA, 13 bp, C. elegans
aagcgcgctccac

SEQ ID NO: 692268 - DNA, 13 bp, C. elegans
aagcggaaaattt

SEQ ID NO: 692269 - DNA, 13 bp, C. elegans
aagcgtcggctgc

SEQ ID NO: 692270 - DNA, 13 bp, C. elegans
aagcgtttttttt

SEQ ID NO: 692271 - DNA, 13 bp, C. elegans
aagctaaaaattt

SEQ ID NO: 692272 - DNA, 13 bp, C. elegans
aagctacagtaac

SEQ ID NO: 692273 - DNA, 13 bp, C. elegans
aagctacatattt

SEQ ID NO: 692274 - DNA, 13 bp, C. elegans
aagctactcgttt

SEQ ID NO: 692275 - DNA, 13 bp, C. elegans
aagctagattttt

SEQ ID NO: 692276 - DNA, 13 bp, C. elegans
aagctataaaaat

SEQ ID NO: 692277 - DNA, 13 bp, C. elegans
aagctatcaaaaa

SEQ ID NO: 692278 - DNA, 13 bp, C. elegans
aagctatcgaaaa

SEQ ID NO: 692279 - DNA, 13 bp, C. elegans
aagctatgcccaa

SEQ ID NO: 692280 - DNA, 13 bp, C. elegans
aagctattgaaaa

SEQ ID NO: 692281 - DNA, 13 bp, C. elegans
aagctattgccag

SEQ ID NO: 692282 - DNA, 13 bp, C. elegans
aagctattttcaa

SEQ ID NO: 692283 - DNA, 13 bp, C. elegans
aagctcaaaaaag

SEQ ID NO: 692284 - DNA, 13 bp, C. elegans
aagctcaaaaaca

SEQ ID NO: 692285 - DNA, 13 bp, C. elegans
aagctcaaaagtt

SEQ ID NO: 692286 - DNA, 13 bp, C. elegans
aagctcaaaatgt

SEQ ID NO: 692287 - DNA, 13 bp, C. elegans
aagctcaaaattt

SEQ ID NO: 692288 - DNA, 13 bp, C. elegans
aagctcaatttta

SEQ ID NO: 692289 - DNA, 13 bp, C. elegans
aagctcaattttt

SEQ ID NO: 692290 - DNA, 13 bp, C. elegans
aagctcacaaaat

SEQ ID NO: 692291 - DNA, 13 bp, C. elegans
aagctcacaattt

SEQ ID NO: 692292 - DNA, 13 bp, C. elegans
aagctcacgaaaa

SEQ ID NO: 692293 - DNA, 13 bp, C. elegans
aagctcaggctca

SEQ ID NO: 692294 - DNA, 13 bp, C. elegans
aagctccaaaatt

SEQ ID NO: 692295 - DNA, 13 bp, C. elegans
aagctccgcccac

SEQ ID NO: 692296 - DNA, 13 bp, C. elegans
aagctccgccccc

SEQ ID NO: 692297 - DNA, 13 bp, C. elegans
aagctccgtaaat

SEQ ID NO: 692298 - DNA, 13 bp, C. elegans
aagctcctcccat

SEQ ID NO: 692299 - DNA, 13 bp, C. elegans
aagctcgaaattt

SEQ ID NO: 692300 - DNA, 13 bp, C. elegans
aagctctacagta

SEQ ID NO: 692301 - DNA, 13 bp, C. elegans
aagctctagtttt

SEQ ID NO: 692302 - DNA, 13 bp, C. elegans
aagctctcaaaaa

SEQ ID NO: 692303 - DNA, 13 bp, C. elegans
aagctctcagtga

SEQ ID NO: 692304 - DNA, 13 bp, C. elegans
aagctctcgacga

SEQ ID NO: 692305 - DNA, 13 bp, C. elegans
aagctctcggcga

SEQ ID NO: 692306 - DNA, 13 bp, C. elegans
aagctctttcaga

SEQ ID NO: 692307 - DNA, 13 bp, C. elegans
aagctcttttaga

SEQ ID NO: 692308 - DNA, 13 bp, C. elegans
aagctgaaaaatc

SEQ ID NO: 692309 - DNA, 13 bp, C. elegans
aagctgaaaacaa

SEQ ID NO: 692310 - DNA, 13 bp, C. elegans
aagctgaaaagaa

SEQ ID NO: 692311 - DNA, 13 bp, C. elegans
aagctgaaaataa

SEQ ID NO: 692312 - DNA, 13 bp, C. elegans
aagctgaaaatct

SEQ ID NO: 692313 - DNA, 13 bp, C. elegans
aagctgaaatgag

SEQ ID NO: 692314 - DNA, 13 bp, C. elegans
aagctgaaatttg

SEQ ID NO: 692315 - DNA, 13 bp, C. elegans
aagctgaaggatc

SEQ ID NO: 692316 - DNA, 13 bp, C. elegans
aagctgaagtttt

SEQ ID NO: 692317 - DNA, 13 bp, C. elegans
aagctgaattcaa

SEQ ID NO: 692318 - DNA, 13 bp, C. elegans
aagctgccaaaat

SEQ ID NO: 692319 - DNA, 13 bp, C. elegans
aagctgccaaagt

SEQ ID NO: 692320 - DNA, 13 bp, C. elegans
aagctgcggaacc

SEQ ID NO: 692321 - DNA, 13 bp, C. elegans
aagctgctaaaat

SEQ ID NO: 692322 - DNA, 13 bp, C. elegans
aagctggtttttt

SEQ ID NO: 692323 - DNA, 14 bp, C. elegans
aagctgtaaaacgt

SEQ ID NO: 692324 - DNA, 13 bp, C. elegans
aagctgtcaaaaa

SEQ ID NO: 692325 - DNA, 13 bp, C. elegans
aagctgtcaaagt

SEQ ID NO: 692326 - DNA, 13 bp, C. elegans
aagctgtcgaaaa

SEQ ID NO: 692327 - DNA, 13 bp, C. elegans
aagcttaaaactt

SEQ ID NO: 692328 - DNA, 13 bp, C. elegans
aagcttaagctta

SEQ ID NO: 692329 - DNA, 13 bp, C. elegans
aagcttattttaa

SEQ ID NO: 692330 - DNA, 13 bp, C. elegans
aagcttcaaagtt

SEQ ID NO: 692331 - DNA, 13 bp, C. elegans
aagcttcaagaaa

SEQ ID NO: 692332 - DNA, 13 bp, C. elegans
aagcttcacgtag

SEQ ID NO: 692333 - DNA, 13 bp, C. elegans
aagcttccaaaaa

SEQ ID NO: 692334 - DNA, 13 bp, C. elegans
aagcttccagaat

SEQ ID NO: 692335 - DNA, 13 bp, C. elegans
aagcttcgatttt

SEQ ID NO: 692336 - DNA, 13 bp, C. elegans
aagcttctcaaaa

SEQ ID NO: 692337 - DNA, 13 bp, C. elegans
aagcttctggaaa

SEQ ID NO: 692338 - DNA, 13 bp, C. elegans
aagcttcttcttc

SEQ ID NO: 692339 - DNA, 13 bp, C. elegans
aagcttcttgaaa

SEQ ID NO: 692340 - DNA, 13 bp, C. elegans
aagcttcttgaag

SEQ ID NO: 692341 - DNA, 13 bp, C. elegans
aagcttgaaaatt

SEQ ID NO: 692342 - DNA, 13 bp, C. elegans
aagcttgtgaaaa

SEQ ID NO: 692343 - DNA, 13 bp, C. elegans
aagcttgttcaaa

SEQ ID NO: 692344 - DNA, 13 bp, C. elegans
aagctttaaaaaa

SEQ ID NO: 692345 - DNA, 13 bp, C. elegans
aagctttaaaatt

SEQ ID NO: 692346 - DNA, 13 bp, C. elegans
aagctttaatttt

SEQ ID NO: 692347 - DNA, 13 bp, C. elegans
aagctttcaaaaa

SEQ ID NO: 692348 - DNA, 13 bp, C. elegans
aagctttcaaagt

SEQ ID NO: 692349 - DNA, 13 bp, C. elegans
aagctttcaaatg

SEQ ID NO: 692350 - DNA, 13 bp, C. elegans
aagctttcaaatt

SEQ ID NO: 692351 - DNA, 13 bp, C. elegans
aagctttcagttt

SEQ ID NO: 692352 - DNA, 13 bp, C. elegans
aagctttgaaaaa

SEQ ID NO: 692353 - DNA, 13 bp, C. elegans
aagctttgaaatt

SEQ ID NO: 692354 - DNA, 13 bp, C. elegans
aagctttgaataa

SEQ ID NO: 692355 - DNA, 13 bp, C. elegans
aagctttggctta

SEQ ID NO: 692356 - DNA, 13 bp, C. elegans
aagcttttaataa

SEQ ID NO: 692357 - DNA, 13 bp, C. elegans
aagcttttatttt

SEQ ID NO: 692358 - DNA, 13 bp, C. elegans
aagcttttcgaaa

SEQ ID NO: 692359 - DNA, 13 bp, C. elegans
aagcttttgaata

SEQ ID NO: 692360 - DNA, 13 bp, C. elegans
aagcttttgattt

SEQ ID NO: 692361 - DNA, 13 bp, C. elegans
aagctttttgctc

SEQ ID NO: 692362 - DNA, 13 bp, C. elegans
aagctttttttgt

SEQ ID NO: 692363 - DNA, 13 bp, C. elegans
aagctttttttta

SEQ ID NO: 692364 - DNA, 13 bp, C. elegans
aaggaaaaaagtc

SEQ ID NO: 692365 - DNA, 13 bp, C. elegans
aaggaaaaatgtg

SEQ ID NO: 692366 - DNA, 13 bp, C. elegans
aaggaaaatcgaa

SEQ ID NO: 692367 - DNA, 13 bp, C. elegans
aaggaaacaaatt

SEQ ID NO: 692368 - DNA, 13 bp, C. elegans
aaggaaacaattt

SEQ ID NO: 692369 - DNA, 13 bp, C. elegans
aaggaaagatttt

SEQ ID NO: 692370 - DNA, 13 bp, C. elegans
aaggaaatatttt

SEQ ID NO: 692371 - DNA, 13 bp, C. elegans
aaggaaattttca

SEQ ID NO: 692372 - DNA, 13 bp, C. elegans
aaggaaattttga

SEQ ID NO: 692373 - DNA, 13 bp, C. elegans
aaggaacactttt

SEQ ID NO: 692374 - DNA, 13 bp, C. elegans
aaggaacagttca

SEQ ID NO: 692375 - DNA, 13 bp, C. elegans
aaggaatttggaa

SEQ ID NO: 692376 - DNA, 13 bp, C. elegans
aaggacaaggaca

SEQ ID NO: 692377 - DNA, 13 bp, C. elegans
aaggagaatatga

SEQ ID NO: 692378 - DNA, 13 bp, C. elegans
aaggagtactgta

SEQ ID NO: 692379 - DNA, 13 bp, C. elegans
aaggagtttctcg

SEQ ID NO: 692380 - DNA, 13 bp, C. elegans
aaggataatttat

SEQ ID NO: 692381 - DNA, 13 bp, C. elegans
aaggatcacaagg

SEQ ID NO: 692382 - DNA, 13 bp, C. elegans
aaggatcagaagg

SEQ ID NO: 692383 - DNA, 13 bp, C. elegans
aaggatcagatca

SEQ ID NO: 692384 - DNA, 13 bp, C. elegans
aaggatcgattgc

SEQ ID NO: 692385 - DNA, 13 bp, C. elegans
aaggatctaagga

SEQ ID NO: 692386 - DNA, 13 bp, C. elegans
aaggcaaaatgtg

SEQ ID NO: 692387 - DNA, 13 bp, C. elegans
aaggcaaacatcc

SEQ ID NO: 692388 - DNA, 13 bp, C. elegans
aaggcagaaaaat

SEQ ID NO: 692389 - DNA, 13 bp, C. elegans
aaggcgcacagat

SEQ ID NO: 692390 - DNA, 13 bp, C. elegans
aaggctaatttca

SEQ ID NO: 692391 - DNA, 13 bp, C. elegans
aaggctcaaaatt

SEQ ID NO: 692392 - DNA, 13 bp, C. elegans
aagggaaaatcat

SEQ ID NO: 692393 - DNA, 13 bp, C. elegans
aagggtatacata

SEQ ID NO: 692394 - DNA, 13 bp, C. elegans
aaggtagagtagc

SEQ ID NO: 692395 - DNA, 13 bp, C. elegans
aaggtagatcaaa

SEQ ID NO: 692396 - DNA, 13 bp, C. elegans
aaggtccagaaaa

SEQ ID NO: 692397 - DNA, 13 bp, C. elegans
aaggtggtactgg

SEQ ID NO: 692398 - DNA, 13 bp, C. elegans
aaggtgtcggccg

SEQ ID NO: 692399 - DNA, 13 bp, C. elegans
aaggttctggaac

SEQ ID NO: 692400 - DNA, 13 bp, C. elegans
aaggtttcaaatt

SEQ ID NO: 692401 - DNA, 13 bp, C. elegans
aaggttttcagtt

SEQ ID NO: 692402 - DNA, 13 bp, C. elegans
aaggttttggaaa

SEQ ID NO: 692403 - DNA, 13 bp, C. elegans
aaggtttttgtga

SEQ ID NO: 692404 - DNA, 13 bp, C. elegans
aaggttttttgaa

SEQ ID NO: 692405 - DNA, 13 bp, C. elegans
aagtaaaatcaac

SEQ ID NO: 692406 - DNA, 13 bp, C. elegans
aagtaaagcaaca

SEQ ID NO: 692407 - DNA, 13 bp, C. elegans
aagtaaccatttt

SEQ ID NO: 692408 - DNA, 13 bp, C. elegans
aagtaagcaattt

SEQ ID NO: 692409 - DNA, 13 bp, C. elegans
aagtaatgtagca

SEQ ID NO: 692410 - DNA, 13 bp, C. elegans
aagtaattatttc

SEQ ID NO: 692411 - DNA, 13 bp, C. elegans
aagtaattttcag

SEQ ID NO: 692412 - DNA, 13 bp, C. elegans
aagtacaattttt

SEQ ID NO: 692413 - DNA, 13 bp, C. elegans
aagtacagtaatc

SEQ ID NO: 692414 - DNA, 13 bp, C. elegans
aagtacagtaccc

SEQ ID NO: 692415 - DNA, 13 bp, C. elegans
aagtacataaata

SEQ ID NO: 692416 - DNA, 13 bp, C. elegans
aagtacatttaaa

SEQ ID NO: 692417 - DNA, 13 bp, C. elegans
aagtacatttatg

SEQ ID NO: 692418 - DNA, 13 bp, C. elegans
aagtacattttca

SEQ ID NO: 692419 - DNA, 13 bp, C. elegans
aagtacggaaaaa

SEQ ID NO: 692420 - DNA, 13 bp, C. elegans
aagtacttcaaaa

SEQ ID NO: 692421 - DNA, 13 bp, C. elegans
aagtacttgtttt

SEQ ID NO: 692422 - DNA, 13 bp, C. elegans
aagtactttttga

SEQ ID NO: 692423 - DNA, 13 bp, C. elegans
aagtagaacttga

SEQ ID NO: 692424 - DNA, 13 bp, C. elegans
aagtagaattttg

SEQ ID NO: 692425 - DNA, 13 bp, C. elegans
aagtagattttca

SEQ ID NO: 692426 - DNA, 13 bp, C. elegans
aagtagatttttc

SEQ ID NO: 692427 - DNA, 13 bp, C. elegans
aagtagatttttt

SEQ ID NO: 692428 - DNA, 13 bp, C. elegans
aagtagcaaaaac

SEQ ID NO: 692429 - DNA, 14 bp, C. elegans
aagtagcggtgaaa

SEQ ID NO: 692430 - DNA, 13 bp, C. elegans
aagtataaacttg

SEQ ID NO: 692431 - DNA, 13 bp, C. elegans
aagtataatcatg

SEQ ID NO: 692432 - DNA, 13 bp, C. elegans
aagtataatttca

SEQ ID NO: 692433 - DNA, 13 bp, C. elegans
aagtatactgaaa

SEQ ID NO: 692434 - DNA, 13 bp, C. elegans
aagtatatatttg

SEQ ID NO: 692435 - DNA, 13 bp, C. elegans
aagtatattgaaa

SEQ ID NO: 692436 - DNA, 13 bp, C. elegans
aagtatatttcaa

SEQ ID NO: 692437 - DNA, 13 bp, C. elegans
aagtatcgaaatt

SEQ ID NO: 692438 - DNA, 13 bp, C. elegans
aagtatctcaaaa

SEQ ID NO: 692439 - DNA, 13 bp, C. elegans
aagtatgaaaagt

SEQ ID NO: 692440 - DNA, 13 bp, C. elegans
aagtatgggaaaa

SEQ ID NO: 692441 - DNA, 13 bp, C. elegans
aagtatgtacata

SEQ ID NO: 692442 - DNA, 13 bp, C. elegans
aagtattcaattt

SEQ ID NO: 692443 - DNA, 13 bp, C. elegans
aagtattcagaaa

SEQ ID NO: 692444 - DNA, 13 bp, C. elegans
aagtattcgaaaa

SEQ ID NO: 692445 - DNA, 13 bp, C. elegans
aagtattgaaaca

SEQ ID NO: 692446 - DNA, 13 bp, C. elegans
aagtatttagaaa

SEQ ID NO: 692447 - DNA, 13 bp, C. elegans
aagtatttattct

SEQ ID NO: 692448 - DNA, 13 bp, C. elegans
aagtatttattga

SEQ ID NO: 692449 - DNA, 13 bp, C. elegans
aagtatttcaaat

SEQ ID NO: 692450 - DNA, 13 bp, C. elegans
aagtatttcaact

SEQ ID NO: 692451 - DNA, 13 bp, C. elegans
aagtatttcagaa

SEQ ID NO: 692452 - DNA, 13 bp, C. elegans
aagtatttctttt

SEQ ID NO: 692453 - DNA, 13 bp, C. elegans
aagtattttattc

SEQ ID NO: 692454 - DNA, 13 bp, C. elegans
aagtattttccaa

SEQ ID NO: 692455 - DNA, 13 bp, C. elegans
aagtattttctga

SEQ ID NO: 692456 - DNA, 13 bp, C. elegans
aagtattttttct

SEQ ID NO: 692457 - DNA, 13 bp, C. elegans
aagtcaaaaactt

SEQ ID NO: 692458 - DNA, 13 bp, C. elegans
aagtcaaaaatgg

SEQ ID NO: 692459 - DNA, 13 bp, C. elegans
aagtcaaaattgg

SEQ ID NO: 692460 - DNA, 13 bp, C. elegans
aagtcaagaaatc

SEQ ID NO: 692461 - DNA, 13 bp, C. elegans
aagtcaagatttt

SEQ ID NO: 692462 - DNA, 13 bp, C. elegans
aagtcacagtttt

SEQ ID NO: 692463 - DNA, 13 bp, C. elegans
aagtcagtttttt

SEQ ID NO: 692464 - DNA, 13 bp, C. elegans
aagtcccattttg

SEQ ID NO: 692465 - DNA, 13 bp, C. elegans
aagtccgaaaatt

SEQ ID NO: 692466 - DNA, 13 bp, C. elegans
aagtcctgaaaaa

SEQ ID NO: 692467 - DNA, 13 bp, C. elegans
aagtcgaaaattg

SEQ ID NO: 692468 - DNA, 13 bp, C. elegans
aagtcgaacaaaa

SEQ ID NO: 692469 - DNA, 13 bp, C. elegans
aagtcgaattttt

SEQ ID NO: 692470 - DNA, 14 bp, C. elegans
aagtcgaccaaaaa

SEQ ID NO: 692471 - DNA, 13 bp, C. elegans
aagtcgagaaaaa

SEQ ID NO: 692472 - DNA, 13 bp, C. elegans
aagtcgataaaat

SEQ ID NO: 692473 - DNA, 13 bp, C. elegans
aagtcgatttttc

SEQ ID NO: 692474 - DNA, 13 bp, C. elegans
aagtcgtattttt

SEQ ID NO: 692475 - DNA, 13 bp, C. elegans
aagtctacaaaaa

SEQ ID NO: 692476 - DNA, 13 bp, C. elegans
aagtctatgctcc

SEQ ID NO: 692477 - DNA, 13 bp, C. elegans
aagtctatttttt

SEQ ID NO: 692478 - DNA, 13 bp, C. elegans
aagtctcaaaaac

SEQ ID NO: 692479 - DNA, 13 bp, C. elegans
aagtctgaaaaat

SEQ ID NO: 692480 - DNA, 13 bp, C. elegans
aagtctgaaaata

SEQ ID NO: 692481 - DNA, 13 bp, C. elegans
aagtctggaagaa

SEQ ID NO: 692482 - DNA, 13 bp, C. elegans
aagtctgtttcaa

SEQ ID NO: 692483 - DNA, 13 bp, C. elegans
aagtcttacccaa

SEQ ID NO: 692484 - DNA, 13 bp, C. elegans
aagtcttgaaaaa

SEQ ID NO: 692485 - DNA, 15 bp, C. elegans
aagtctttgcaaaat

SEQ ID NO: 692486 - DNA, 13 bp, C. elegans
aagtctttggagc

SEQ ID NO: 692487 - DNA, 13 bp, C. elegans
aagtcttttaaaa

SEQ ID NO: 692488 - DNA, 13 bp, C. elegans
aagtgaaaaacga

SEQ ID NO: 692489 - DNA, 13 bp, C. elegans
aagtgaaaactga

SEQ ID NO: 692490 - DNA, 13 bp, C. elegans
aagtgaaaagtga

SEQ ID NO: 692491 - DNA, 13 bp, C. elegans
aagtgaaaagtta

SEQ ID NO: 692492 - DNA, 13 bp, C. elegans
aagtgaaaatatg

SEQ ID NO: 692493 - DNA, 13 bp, C. elegans
aagtgaaacagaa

SEQ ID NO: 692494 - DNA, 13 bp, C. elegans
aagtgaaacagtt

SEQ ID NO: 692495 - DNA, 13 bp, C. elegans
aagtgaaatggaa

SEQ ID NO: 692496 - DNA, 13 bp, C. elegans
aagtgaacttgaa

SEQ ID NO: 692497 - DNA, 13 bp, C. elegans
aagtgaagaaatg

SEQ ID NO: 692498 - DNA, 13 bp, C. elegans
aagtgaatcaaaa

SEQ ID NO: 692499 - DNA, 13 bp, C. elegans
aagtgaatttttg

SEQ ID NO: 692500 - DNA, 13 bp, C. elegans
aagtgactgaaaa

SEQ ID NO: 692501 - DNA, 13 bp, C. elegans
aagtgagaaaatg

SEQ ID NO: 692502 - DNA, 13 bp, C. elegans
aagtgagtttttg

SEQ ID NO: 692503 - DNA, 13 bp, C. elegans
aagtgatattggt

SEQ ID NO: 692504 - DNA, 13 bp, C. elegans
aagtgatatttca

SEQ ID NO: 692505 - DNA, 13 bp, C. elegans
aagtgatgaataa

SEQ ID NO: 692506 - DNA, 13 bp, C. elegans
aagtgatttcaat

SEQ ID NO: 692507 - DNA, 13 bp, C. elegans
aagtgattttatt

SEQ ID NO: 692508 - DNA, 13 bp, C. elegans
aagtgattttgaa

SEQ ID NO: 692509 - DNA, 13 bp, C. elegans
aagtgatttttca

SEQ ID NO: 692510 - DNA, 13 bp, C. elegans
aagtgcaaaaaag

SEQ ID NO: 692511 - DNA, 13 bp, C. elegans
aagtgcaactttt

SEQ ID NO: 692512 - DNA, 13 bp, C. elegans
aagtgcacaaaaa

SEQ ID NO: 692513 - DNA, 13 bp, C. elegans
aagtgcagaaaaa

SEQ ID NO: 692514 - DNA, 13 bp, C. elegans
aagtgcagaaaat

SEQ ID NO: 692515 - DNA, 13 bp, C. elegans
aagtgccaaattt

SEQ ID NO: 692516 - DNA, 13 bp, C. elegans
aagtgccgaaaaa

SEQ ID NO: 692517 - DNA, 13 bp, C. elegans
aagtgccgttttt

SEQ ID NO: 692518 - DNA, 13 bp, C. elegans
aagtgcctgaaaa

SEQ ID NO: 692519 - DNA, 13 bp, C. elegans
aagtgcgctccaa

SEQ ID NO: 692520 - DNA, 13 bp, C. elegans
aagtgcgctctac

SEQ ID NO: 692521 - DNA, 13 bp, C. elegans
aagtgctacagta

SEQ ID NO: 692522 - DNA, 13 bp, C. elegans
aagtgctagaaaa

SEQ ID NO: 692523 - DNA, 51 bp, C. elegans
aagtgctatgcactgcggatctgggattcaggtacactgcctggtggtgat

SEQ ID NO: 692524 - DNA, 13 bp, C. elegans
aagtgctcaaaat

SEQ ID NO: 692525 - DNA, 13 bp, C. elegans
aagtgctcaatgt

SEQ ID NO: 692526 - DNA, 13 bp, C. elegans
aagtgctcatttt

SEQ ID NO: 692527 - DNA, 13 bp, C. elegans
aagtgctcgaagt

SEQ ID NO: 692528 - DNA, 13 bp, C. elegans
aagtgcttctctc

SEQ ID NO: 692529 - DNA, 13 bp, C. elegans
aagtggaaacatt

SEQ ID NO: 692530 - DNA, 13 bp, C. elegans
aagtggcaaaatt

SEQ ID NO: 692531 - DNA, 13 bp, C. elegans
aagtggctcaact

SEQ ID NO: 692532 - DNA, 13 bp, C. elegans
aagtggctgaatt

SEQ ID NO: 692533 - DNA, 13 bp, C. elegans
aagtgggcggagc

SEQ ID NO: 692534 - DNA, 13 bp, C. elegans
aagtgggcggagt

SEQ ID NO: 692535 - DNA, 13 bp, C. elegans
aagtggttgaaaa

SEQ ID NO: 692536 - DNA, 13 bp, C. elegans
aagtggtttttaa

SEQ ID NO: 692537 - DNA, 13 bp, C. elegans
aagtgtaaaatat

SEQ ID NO: 692538 - DNA, 13 bp, C. elegans
aagtgtaaattat

SEQ ID NO: 692539 - DNA, 13 bp, C. elegans
aagtgtacaaaaa

SEQ ID NO: 692540 - DNA, 13 bp, C. elegans
aagtgtactgtaa

SEQ ID NO: 692541 - DNA, 13 bp, C. elegans
aagtgtatgtgtg

SEQ ID NO: 692542 - DNA, 13 bp, C. elegans
aagtgtatttcaa

SEQ ID NO: 692543 - DNA, 13 bp, C. elegans
aagtgtatttgaa

SEQ ID NO: 692544 - DNA, 13 bp, C. elegans
aagtgtattttta

SEQ ID NO: 692545 - DNA, 13 bp, C. elegans
aagtgtcacaaaa

SEQ ID NO: 692546 - DNA, 13 bp, C. elegans
aagtgtcactttt

SEQ ID NO: 692547 - DNA, 13 bp, C. elegans
aagtgtcggctgc

SEQ ID NO: 692548 - DNA, 13 bp, C. elegans
aagtgtgacgtca

SEQ ID NO: 692549 - DNA, 13 bp, C. elegans
aagtgttagtttt

SEQ ID NO: 692550 - DNA, 13 bp, C. elegans
aagtgttatattt

SEQ ID NO: 692551 - DNA, 13 bp, C. elegans
aagtgttctaaaa

SEQ ID NO: 692552 - DNA, 13 bp, C. elegans
aagtgttgaaatt

SEQ ID NO: 692553 - DNA, 13 bp, C. elegans
aagtgttgctctc

SEQ ID NO: 692554 - DNA, 13 bp, C. elegans
aagtgttggaaaa

SEQ ID NO: 692555 - DNA, 15 bp, C. elegans
aagtgttggacaatc

SEQ ID NO: 692556 - DNA, 13 bp, C. elegans
aagtgttggagat

SEQ ID NO: 692557 - DNA, 13 bp, C. elegans
aagtgtttaattt

SEQ ID NO: 692558 - DNA, 13 bp, C. elegans
aagtgtttattgt

SEQ ID NO: 692559 - DNA, 13 bp, C. elegans
aagtgtttcaagt

SEQ ID NO: 692560 - DNA, 13 bp, C. elegans
aagtgtttccgtc

SEQ ID NO: 692561 - DNA, 13 bp, C. elegans
aagtgtttgaaaa

SEQ ID NO: 692562 - DNA, 13 bp, C. elegans
aagtgtttgattt

SEQ ID NO: 692563 - DNA, 13 bp, C. elegans
aagtgttttaaaa

SEQ ID NO: 692564 - DNA, 13 bp, C. elegans
aagtgttttcaat

SEQ ID NO: 692565 - DNA, 13 bp, C. elegans
aagtgttttctga

SEQ ID NO: 692566 - DNA, 13 bp, C. elegans
aagtgttttgaaa

SEQ ID NO: 692567 - DNA, 13 bp, C. elegans
aagtgttttttct

SEQ ID NO: 692568 - DNA, 13 bp, C. elegans
aagttaaaattag

SEQ ID NO: 692569 - DNA, 13 bp, C. elegans
aagttaaactatt

SEQ ID NO: 692570 - DNA, 13 bp, C. elegans
aagttaacatttt

SEQ ID NO: 692571 - DNA, 13 bp, C. elegans
aagttaacttttt

SEQ ID NO: 692572 - DNA, 13 bp, C. elegans
aagttaatcaaaa

SEQ ID NO: 692573 - DNA, 13 bp, C. elegans
aagttaatgaaac

SEQ ID NO: 692574 - DNA, 13 bp, C. elegans
aagttaatgtttt

SEQ ID NO: 692575 - DNA, 13 bp, C. elegans
aagttaatttgaa

SEQ ID NO: 692576 - DNA, 13 bp, C. elegans
aagttaccaaaaa

SEQ ID NO: 692577 - DNA, 13 bp, C. elegans
aagttagaaaatg

SEQ ID NO: 692578 - DNA, 13 bp, C. elegans
aagttaggaaaat

SEQ ID NO: 692579 - DNA, 13 bp, C. elegans
aagttaggaattt

SEQ ID NO: 692580 - DNA, 13 bp, C. elegans
aagttagttggac

SEQ ID NO: 692581 - DNA, 13 bp, C. elegans
aagttagtttaaa

SEQ ID NO: 692582 - DNA, 13 bp, C. elegans
aagttatacatat

SEQ ID NO: 692583 - DNA, 13 bp, C. elegans
aagttatatagtt

SEQ ID NO: 692584 - DNA, 13 bp, C. elegans
aagttatcatgaa

SEQ ID NO: 692585 - DNA, 13 bp, C. elegans
aagttatcttttt

SEQ ID NO: 692586 - DNA, 13 bp, C. elegans
aagttatgaaatt

SEQ ID NO: 692587 - DNA, 13 bp, C. elegans
aagttatgaagtt

SEQ ID NO: 692588 - DNA, 13 bp, C. elegans
aagttatggaaat

SEQ ID NO: 692589 - DNA, 13 bp, C. elegans
aagttatggccgc

SEQ ID NO: 692590 - DNA, 13 bp, C. elegans
aagttatgtattt

SEQ ID NO: 692591 - DNA, 13 bp, C. elegans
aagttattgaaat

SEQ ID NO: 692592 - DNA, 13 bp, C. elegans
aagttatttgatt

SEQ ID NO: 692593 - DNA, 13 bp, C. elegans
aagttatttgtga

SEQ ID NO: 692594 - DNA, 13 bp, C. elegans
aagttcaaaaaag

SEQ ID NO: 692595 - DNA, 13 bp, C. elegans
aagttcaaaaaat

SEQ ID NO: 692596 - DNA, 13 bp, C. elegans
aagttcaaaaact

SEQ ID NO: 692597 - DNA, 13 bp, C. elegans
aagttcaaaaatt

SEQ ID NO: 692598 - DNA, 13 bp, C. elegans
aagttcaaaacaa

SEQ ID NO: 692599 - DNA, 13 bp, C. elegans
aagttcaaaagtt

SEQ ID NO: 692600 - DNA, 13 bp, C. elegans
aagttcaaaataa

SEQ ID NO: 692601 - DNA, 13 bp, C. elegans
aagttcaaaatga

SEQ ID NO: 692602 - DNA, 13 bp, C. elegans
aagttcaaacaaa

SEQ ID NO: 692603 - DNA, 13 bp, C. elegans
aagttcaaagaaa

SEQ ID NO: 692604 - DNA, 13 bp, C. elegans
aagttcaaatgtg

SEQ ID NO: 692605 - DNA, 13 bp, C. elegans
aagttcaacattt

SEQ ID NO: 692606 - DNA, 13 bp, C. elegans
aagttcaactgaa

SEQ ID NO: 692607 - DNA, 13 bp, C. elegans
aagttcaactttt

SEQ ID NO: 692608 - DNA, 13 bp, C. elegans
aagttcaagaaaa

SEQ ID NO: 692609 - DNA, 13 bp, C. elegans
aagttcaagaaac

SEQ ID NO: 692610 - DNA, 13 bp, C. elegans
aagttcaagcaga

SEQ ID NO: 692611 - DNA, 13 bp, C. elegans
aagttcaagttca

SEQ ID NO: 692612 - DNA, 13 bp, C. elegans
aagttcaatgttt

SEQ ID NO: 692613 - DNA, 13 bp, C. elegans
aagttcaattgaa

SEQ ID NO: 692614 - DNA, 13 bp, C. elegans
aagttcaatttaa

SEQ ID NO: 692615 - DNA, 13 bp, C. elegans
aagttcaatttta

SEQ ID NO: 692616 - DNA, 13 bp, C. elegans
aagttcacaaaaa

SEQ ID NO: 692617 - DNA, 13 bp, C. elegans
aagttcacaaatt

SEQ ID NO: 692618 - DNA, 13 bp, C. elegans
aagttcacttttt

SEQ ID NO: 692619 - DNA, 13 bp, C. elegans
aagttcagaaatt

SEQ ID NO: 692620 - DNA, 13 bp, C. elegans
aagttcataattt

SEQ ID NO: 692621 - DNA, 13 bp, C. elegans
aagttcatgatga

SEQ ID NO: 692622 - DNA, 13 bp, C. elegans
aagttcatgtttt

SEQ ID NO: 692623 - DNA, 13 bp, C. elegans
aagttcattattt

SEQ ID NO: 692624 - DNA, 13 bp, C. elegans
aagttcattcaaa

SEQ ID NO: 692625 - DNA, 13 bp, C. elegans
aagttcattgaaa

SEQ ID NO: 692626 - DNA, 13 bp, C. elegans
aagttccaaaaaa

SEQ ID NO: 692627 - DNA, 13 bp, C. elegans
aagttccaaaaac

SEQ ID NO: 692628 - DNA, 13 bp, C. elegans
aagttccaaaaat

SEQ ID NO: 692629 - DNA, 13 bp, C. elegans
aagttccaaaact

SEQ ID NO: 692630 - DNA, 13 bp, C. elegans
aagttccaagaaa

SEQ ID NO: 692631 - DNA, 13 bp, C. elegans
aagttccaataaa

SEQ ID NO: 692632 - DNA, 13 bp, C. elegans
aagttccagaatt

SEQ ID NO: 692633 - DNA, 13 bp, C. elegans
aagttccgaaaat

SEQ ID NO: 692634 - DNA, 13 bp, C. elegans
aagttccggaaaa

SEQ ID NO: 692635 - DNA, 13 bp, C. elegans
aagttcctgaaaa

SEQ ID NO: 692636 - DNA, 13 bp, C. elegans
aagttcgaaatta

SEQ ID NO: 692637 - DNA, 13 bp, C. elegans
aagttcgaaattt

SEQ ID NO: 692638 - DNA, 13 bp, C. elegans
aagttcgagaaaa

SEQ ID NO: 692639 - DNA, 13 bp, C. elegans
aagttcggagcaa

SEQ ID NO: 692640 - DNA, 13 bp, C. elegans
aagttctaataaa

SEQ ID NO: 692641 - DNA, 13 bp, C. elegans
aagttctacacgg

SEQ ID NO: 692642 - DNA, 13 bp, C. elegans
aagttctacagta

SEQ ID NO: 692643 - DNA, 13 bp, C. elegans
aagttctataatt

SEQ ID NO: 692644 - DNA, 13 bp, C. elegans
aagttctatcaaa

SEQ ID NO: 692645 - DNA, 13 bp, C. elegans
aagttctcaaaat

SEQ ID NO: 692646 - DNA, 13 bp, C. elegans
aagttctcaactg

SEQ ID NO: 692647 - DNA, 13 bp, C. elegans
aagttctcttttt

SEQ ID NO: 692648 - DNA, 13 bp, C. elegans
aagttctgcaaaa

SEQ ID NO: 692649 - DNA, 13 bp, C. elegans
aagttctggaaaa

SEQ ID NO: 692650 - DNA, 13 bp, C. elegans
aagttctggaaca

SEQ ID NO: 692651 - DNA, 13 bp, C. elegans
aagttctggaatg

SEQ ID NO: 692652 - DNA, 13 bp, C. elegans
aagttcttagaaa

SEQ ID NO: 692653 - DNA, 13 bp, C. elegans
aagttgaaaaatc

SEQ ID NO: 692654 - DNA, 13 bp, C. elegans
aagttgaaaaatt

SEQ ID NO: 692655 - DNA, 13 bp, C. elegans
aagttgaaaagta

SEQ ID NO: 692656 - DNA, 13 bp, C. elegans
aagttgaaaatag

SEQ ID NO: 692657 - DNA, 13 bp, C. elegans
aagttgaaaattg

SEQ ID NO: 692658 - DNA, 13 bp, C. elegans
aagttgaaaattt

SEQ ID NO: 692659 - DNA, 13 bp, C. elegans
aagttgaaacaaa

SEQ ID NO: 692660 - DNA, 13 bp, C. elegans
aagttgaaacatt

SEQ ID NO: 692661 - DNA, 13 bp, C. elegans
aagttgaaatcaa

SEQ ID NO: 692662 - DNA, 13 bp, C. elegans
aagttgaaatgaa

SEQ ID NO: 692663 - DNA, 13 bp, C. elegans
aagttgaactttg

SEQ ID NO: 692664 - DNA, 13 bp, C. elegans
aagttgaatattc

SEQ ID NO: 692665 - DNA, 13 bp, C. elegans
aagttgaatttct

SEQ ID NO: 692666 - DNA, 13 bp, C. elegans
aagttgaattttg

SEQ ID NO: 692667 - DNA, 13 bp, C. elegans
aagttgaattttt

SEQ ID NO: 692668 - DNA, 13 bp, C. elegans
aagttgacaattt

SEQ ID NO: 692669 - DNA, 13 bp, C. elegans
aagttgacttttt

SEQ ID NO: 692670 - DNA, 13 bp, C. elegans
aagttgagaaatt

SEQ ID NO: 692671 - DNA, 13 bp, C. elegans
aagttgagtgaaa

SEQ ID NO: 692672 - DNA, 13 bp, C. elegans
aagttgataaaat

SEQ ID NO: 692673 - DNA, 13 bp, C. elegans
aagttgatagaaa

SEQ ID NO: 692674 - DNA, 13 bp, C. elegans
aagttgatattga

SEQ ID NO: 692675 - DNA, 13 bp, C. elegans
aagttgatgtttc

SEQ ID NO: 692676 - DNA, 13 bp, C. elegans
aagttgatttaaa

SEQ ID NO: 692677 - DNA, 13 bp, C. elegans
aagttgattttga

SEQ ID NO: 692678 - DNA, 13 bp, C. elegans
aagttgcaaaaaa

SEQ ID NO: 692679 - DNA, 13 bp, C. elegans
aagttgcaaaatg

SEQ ID NO: 692680 - DNA, 13 bp, C. elegans
aagttgcaagagt

SEQ ID NO: 692681 - DNA, 13 bp, C. elegans
aagttgcacaaaa

SEQ ID NO: 692682 - DNA, 13 bp, C. elegans
aagttgcagtgat

SEQ ID NO: 692683 - DNA, 13 bp, C. elegans
aagttgccaaaaa

SEQ ID NO: 692684 - DNA, 13 bp, C. elegans
aagttgccaaact

SEQ ID NO: 692685 - DNA, 13 bp, C. elegans
aagttgccgaaaa

SEQ ID NO: 692686 - DNA, 13 bp, C. elegans
aagttgccgaaat

SEQ ID NO: 692687 - DNA, 13 bp, C. elegans
aagttgccgaatt

SEQ ID NO: 692688 - DNA, 13 bp, C. elegans
aagttgccggttg

SEQ ID NO: 692689 - DNA, 14 bp, C. elegans
aagttgcctccaaa

SEQ ID NO: 692690 - DNA, 13 bp, C. elegans
aagttgctcaaaa

SEQ ID NO: 692691 - DNA, 13 bp, C. elegans
aagttggaaaagt

SEQ ID NO: 692692 - DNA, 13 bp, C. elegans
aagttggaaactt

SEQ ID NO: 692693 - DNA, 13 bp, C. elegans
aagttggaagaaa

SEQ ID NO: 692694 - DNA, 13 bp, C. elegans
aagttggaatttt

SEQ ID NO: 692695 - DNA, 13 bp, C. elegans
aagttggcaaatt

SEQ ID NO: 692696 - DNA, 13 bp, C. elegans
aagttggctcaaa

SEQ ID NO: 692697 - DNA, 13 bp, C. elegans
aagttgggaaaat

SEQ ID NO: 692698 - DNA, 13 bp, C. elegans
aagttgggcaaat

SEQ ID NO: 692699 - DNA, 13 bp, C. elegans
aagttggtgattt

SEQ ID NO: 692700 - DNA, 13 bp, C. elegans
aagttggttaaat

SEQ ID NO: 692701 - DNA, 13 bp, C. elegans
aagttgtacaaaa

SEQ ID NO: 692702 - DNA, 13 bp, C. elegans
aagttgtcaaaaa

SEQ ID NO: 692703 - DNA, 14 bp, C. elegans
aagttgtcaaaaat

SEQ ID NO: 692704 - DNA, 13 bp, C. elegans
aagttgtcaaaat

SEQ ID NO: 692705 - DNA, 13 bp, C. elegans
aagttgtcaaagt

SEQ ID NO: 692706 - DNA, 13 bp, C. elegans
aagttgtcaaatt

SEQ ID NO: 692707 - DNA, 13 bp, C. elegans
aagttgtcaactt

SEQ ID NO: 692708 - DNA, 13 bp, C. elegans
aagttgtcacaaa

SEQ ID NO: 692709 - DNA, 13 bp, C. elegans
aagttgtgaaaat

SEQ ID NO: 692710 - DNA, 13 bp, C. elegans
aagttgtgaaaca

SEQ ID NO: 692711 - DNA, 13 bp, C. elegans
aagttgtgaaata

SEQ ID NO: 692712 - DNA, 13 bp, C. elegans
aagttgtggaatt

SEQ ID NO: 692713 - DNA, 13 bp, C. elegans
aagttgttaaaaa

SEQ ID NO: 692714 - DNA, 13 bp, C. elegans
aagttgttaaatt

SEQ ID NO: 692715 - DNA, 13 bp, C. elegans
aagttgttcaaaa

SEQ ID NO: 692716 - DNA, 13 bp, C. elegans
aagttgttcatct

SEQ ID NO: 692717 - DNA, 13 bp, C. elegans
aagttgttctaaa

SEQ ID NO: 692718 - DNA, 13 bp, C. elegans
aagttgttgaata

SEQ ID NO: 692719 - DNA, 13 bp, C. elegans
aagttgttgatat

SEQ ID NO: 692720 - DNA, 13 bp, C. elegans
aagttgttttcta

SEQ ID NO: 692721 - DNA, 13 bp, C. elegans
aagttgttttctt

SEQ ID NO: 692722 - DNA, 13 bp, C. elegans
aagtttaaacaat

SEQ ID NO: 692723 - DNA, 13 bp, C. elegans
aagtttaatcaaa

SEQ ID NO: 692724 - DNA, 13 bp, C. elegans
aagtttaatcttt

SEQ ID NO: 692725 - DNA, 13 bp, C. elegans
aagtttaattcat

SEQ ID NO: 692726 - DNA, 13 bp, C. elegans
aagtttacaattt

SEQ ID NO: 692727 - DNA, 13 bp, C. elegans
aagtttacagttt

SEQ ID NO: 692728 - DNA, 13 bp, C. elegans
aagtttacatttc

SEQ ID NO: 692729 - DNA, 13 bp, C. elegans
aagtttagaaaac

SEQ ID NO: 692730 - DNA, 13 bp, C. elegans
aagtttatcgatt

SEQ ID NO: 692731 - DNA, 13 bp, C. elegans
aagtttatgaaat

SEQ ID NO: 692732 - DNA, 13 bp, C. elegans
aagtttattacaa

SEQ ID NO: 692733 - DNA, 13 bp, C. elegans
aagtttattgaaa

SEQ ID NO: 692734 - DNA, 13 bp, C. elegans
aagtttattttca

SEQ ID NO: 692735 - DNA, 13 bp, C. elegans
aagtttcaaaaac

SEQ ID NO: 692736 - DNA, 13 bp, C. elegans
aagtttcaaacaa

SEQ ID NO: 692737 - DNA, 13 bp, C. elegans
aagtttcaaatct

SEQ ID NO: 692738 - DNA, 13 bp, C. elegans
aagtttcaaatga

SEQ ID NO: 692739 - DNA, 13 bp, C. elegans
aagtttcaaatta

SEQ ID NO: 692740 - DNA, 13 bp, C. elegans
aagtttcaagaaa

SEQ ID NO: 692741 - DNA, 13 bp, C. elegans
aagtttcaataaa

SEQ ID NO: 692742 - DNA, 13 bp, C. elegans
aagtttcaatttt

SEQ ID NO: 692743 - DNA, 13 bp, C. elegans
aagtttcacaaaa

SEQ ID NO: 692744 - DNA, 13 bp, C. elegans
aagtttcagaaaa

SEQ ID NO: 692745 - DNA, 13 bp, C. elegans
aagtttcatattt

SEQ ID NO: 692746 - DNA, 29 bp, C. elegans
aagtttcatgatcgaaaggtcgtcgaaac

SEQ ID NO: 692747 - DNA, 13 bp, C. elegans
aagtttcattgaa

SEQ ID NO: 692748 - DNA, 13 bp, C. elegans
aagtttccaaaaa

SEQ ID NO: 692749 - DNA, 13 bp, C. elegans
aagtttccaactt

SEQ ID NO: 692750 - DNA, 13 bp, C. elegans
aagtttccaattt

SEQ ID NO: 692751 - DNA, 13 bp, C. elegans
aagtttccataaa

SEQ ID NO: 692752 - DNA, 13 bp, C. elegans
aagtttccataat

SEQ ID NO: 692753 - DNA, 13 bp, C. elegans
aagtttccgattt

SEQ ID NO: 692754 - DNA, 13 bp, C. elegans
aagtttccggaaa

SEQ ID NO: 692755 - DNA, 13 bp, C. elegans
aagtttcctgcaa

SEQ ID NO: 692756 - DNA, 13 bp, C. elegans
aagtttcgaaaaa

SEQ ID NO: 692757 - DNA, 13 bp, C. elegans
aagtttcgaaatt

SEQ ID NO: 692758 - DNA, 13 bp, C. elegans
aagtttcgataaa

SEQ ID NO: 692759 - DNA, 13 bp, C. elegans
aagtttctagttt

SEQ ID NO: 692760 - DNA, 13 bp, C. elegans
aagtttctcaatt

SEQ ID NO: 692761 - DNA, 13 bp, C. elegans
aagtttctgaaaa

SEQ ID NO: 692762 - DNA, 13 bp, C. elegans
aagtttctgaaag

SEQ ID NO: 692763 - DNA, 13 bp, C. elegans
aagtttctgattt

SEQ ID NO: 692764 - DNA, 13 bp, C. elegans
aagtttctgcaaa

SEQ ID NO: 692765 - DNA, 13 bp, C. elegans
aagtttctggaat

SEQ ID NO: 692766 - DNA, 13 bp, C. elegans
aagtttctgtttt

SEQ ID NO: 692767 - DNA, 13 bp, C. elegans
aagtttcttcaaa

SEQ ID NO: 692768 - DNA, 13 bp, C. elegans
aagtttcttgatt

SEQ ID NO: 692769 - DNA, 13 bp, C. elegans
aagtttgaaaaat

SEQ ID NO: 692770 - DNA, 13 bp, C. elegans
aagtttgaaaact

SEQ ID NO: 692771 - DNA, 13 bp, C. elegans
aagtttgaaaata

SEQ ID NO: 692772 - DNA, 13 bp, C. elegans
aagtttgaaatat

SEQ ID NO: 692773 - DNA, 13 bp, C. elegans
aagtttgaagctt

SEQ ID NO: 692774 - DNA, 13 bp, C. elegans
aagtttgaagttt

SEQ ID NO: 692775 - DNA, 13 bp, C. elegans
aagtttgacattt

SEQ ID NO: 692776 - DNA, 13 bp, C. elegans
aagtttgaggagg

SEQ ID NO: 692777 - DNA, 13 bp, C. elegans
aagtttgaggttt

SEQ ID NO: 692778 - DNA, 13 bp, C. elegans
aagtttgataatt

SEQ ID NO: 692779 - DNA, 13 bp, C. elegans
aagtttgattgaa

SEQ ID NO: 692780 - DNA, 13 bp, C. elegans
aagtttgcaaaaa

SEQ ID NO: 692781 - DNA, 13 bp, C. elegans
aagtttgcaataa

SEQ ID NO: 692782 - DNA, 13 bp, C. elegans
aagtttgcatttt

SEQ ID NO: 692783 - DNA, 13 bp, C. elegans
aagtttgccaaat

SEQ ID NO: 692784 - DNA, 13 bp, C. elegans
aagtttggaaaaa

SEQ ID NO: 692785 - DNA, 13 bp, C. elegans
aagtttggaacaa

SEQ ID NO: 692786 - DNA, 13 bp, C. elegans
aagtttggagcaa

SEQ ID NO: 692787 - DNA, 14 bp, C. elegans
aagtttggattgat

SEQ ID NO: 692788 - DNA, 13 bp, C. elegans
aagtttggcaaat

SEQ ID NO: 692789 - DNA, 13 bp, C. elegans
aagtttggcaaga

SEQ ID NO: 692790 - DNA, 13 bp, C. elegans
aagtttgggtttt

SEQ ID NO: 692791 - DNA, 13 bp, C. elegans
aagtttggtgttg

SEQ ID NO: 692792 - DNA, 13 bp, C. elegans
aagtttgtcaaat

SEQ ID NO: 692793 - DNA, 13 bp, C. elegans
aagtttgtgaaaa

SEQ ID NO: 692794 - DNA, 13 bp, C. elegans
aagtttgtgaaac

SEQ ID NO: 692795 - DNA, 13 bp, C. elegans
aagtttgtgaaat

SEQ ID NO: 692796 - DNA, 13 bp, C. elegans
aagtttgtggaaa

SEQ ID NO: 692797 - DNA, 13 bp, C. elegans
aagtttgtgttgt

SEQ ID NO: 692798 - DNA, 13 bp, C. elegans
aagtttgtttcaa

SEQ ID NO: 692799 - DNA, 13 bp, C. elegans
aagttttaaactc

SEQ ID NO: 692800 - DNA, 13 bp, C. elegans
aagttttacagaa

SEQ ID NO: 692801 - DNA, 13 bp, C. elegans
aagttttagaaga

SEQ ID NO: 692802 - DNA, 13 bp, C. elegans
aagttttagaatt

SEQ ID NO: 692803 - DNA, 13 bp, C. elegans
aagttttagcttc

SEQ ID NO: 692804 - DNA, 13 bp, C. elegans
aagttttaggttt

SEQ ID NO: 692805 - DNA, 13 bp, C. elegans
aagttttatacaa

SEQ ID NO: 692806 - DNA, 13 bp, C. elegans
aagttttatcaaa

SEQ ID NO: 692807 - DNA, 13 bp, C. elegans
aagttttatgtat

SEQ ID NO: 692808 - DNA, 13 bp, C. elegans
aagttttattgat

SEQ ID NO: 692809 - DNA, 13 bp, C. elegans
aagttttcaaaaa

SEQ ID NO: 692810 - DNA, 13 bp, C. elegans
aagttttcaaata

SEQ ID NO: 692811 - DNA, 13 bp, C. elegans
aagttttcaaatt

SEQ ID NO: 692812 - DNA, 13 bp, C. elegans
aagttttcaacaa

SEQ ID NO: 692813 - DNA, 13 bp, C. elegans
aagttttcaacta

SEQ ID NO: 692814 - DNA, 13 bp, C. elegans
aagttttcaagaa

SEQ ID NO: 692815 - DNA, 13 bp, C. elegans
aagttttcacaaa

SEQ ID NO: 692816 - DNA, 13 bp, C. elegans
aagttttcacttt

SEQ ID NO: 692817 - DNA, 13 bp, C. elegans
aagttttcagttt

SEQ ID NO: 692818 - DNA, 13 bp, C. elegans
aagttttcatatt

SEQ ID NO: 692819 - DNA, 13 bp, C. elegans
aagttttcattat

SEQ ID NO: 692820 - DNA, 13 bp, C. elegans
aagttttcattct

SEQ ID NO: 692821 - DNA, 13 bp, C. elegans
aagttttcattta

SEQ ID NO: 692822 - DNA, 13 bp, C. elegans
aagttttcgaaat

SEQ ID NO: 692823 - DNA, 13 bp, C. elegans
aagttttcgacaa

SEQ ID NO: 692824 - DNA, 13 bp, C. elegans
aagttttcgattt

SEQ ID NO: 692825 - DNA, 13 bp, C. elegans
aagttttctaaaa

SEQ ID NO: 692826 - DNA, 13 bp, C. elegans
aagttttctataa

SEQ ID NO: 692827 - DNA, 13 bp, C. elegans
aagttttctggaa

SEQ ID NO: 692828 - DNA, 13 bp, C. elegans
aagttttctgtga

SEQ ID NO: 692829 - DNA, 13 bp, C. elegans
aagttttctttca

SEQ ID NO: 692830 - DNA, 13 bp, C. elegans
aagttttgaattt

SEQ ID NO: 692831 - DNA, 13 bp, C. elegans
aagttttgacatt

SEQ ID NO: 692832 - DNA, 13 bp, C. elegans
aagttttgagaaa

SEQ ID NO: 692833 - DNA, 13 bp, C. elegans
aagttttgagcaa

SEQ ID NO: 692834 - DNA, 13 bp, C. elegans
aagttttgagttt

SEQ ID NO: 692835 - DNA, 13 bp, C. elegans
aagttttgcattt

SEQ ID NO: 692836 - DNA, 13 bp, C. elegans
aagttttgccaaa

SEQ ID NO: 692837 - DNA, 13 bp, C. elegans
aagttttgctttt

SEQ ID NO: 692838 - DNA, 13 bp, C. elegans
aagttttggaaat

SEQ ID NO: 692839 - DNA, 13 bp, C. elegans
aagttttggaaca

SEQ ID NO: 692840 - DNA, 13 bp, C. elegans
aagttttggagaa

SEQ ID NO: 692841 - DNA, 13 bp, C. elegans
aagttttggattt

SEQ ID NO: 692842 - DNA, 13 bp, C. elegans
aagttttggcaat

SEQ ID NO: 692843 - DNA, 13 bp, C. elegans
aagttttggcggg

SEQ ID NO: 692844 - DNA, 13 bp, C. elegans
aagttttggtgaa

SEQ ID NO: 692845 - DNA, 13 bp, C. elegans
aagttttgttctc

SEQ ID NO: 692846 - DNA, 13 bp, C. elegans
aagtttttacaaa

SEQ ID NO: 692847 - DNA, 13 bp, C. elegans
aagtttttagaaa

SEQ ID NO: 692848 - DNA, 13 bp, C. elegans
aagtttttcatca

SEQ ID NO: 692849 - DNA, 13 bp, C. elegans
aagtttttccaaa

SEQ ID NO: 692850 - DNA, 13 bp, C. elegans
aagtttttcggct

SEQ ID NO: 692851 - DNA, 13 bp, C. elegans
aagtttttcgttt

SEQ ID NO: 692852 - DNA, 14 bp, C. elegans
aagtttttgaaaaa

SEQ ID NO: 692853 - DNA, 13 bp, C. elegans
aagtttttgaaca

SEQ ID NO: 692854 - DNA, 13 bp, C. elegans
aagtttttgaatt

SEQ ID NO: 692855 - DNA, 13 bp, C. elegans
aagtttttgagaa

SEQ ID NO: 692856 - DNA, 13 bp, C. elegans
aagtttttgataa

SEQ ID NO: 692857 - DNA, 13 bp, C. elegans
aagtttttggtat

SEQ ID NO: 692858 - DNA, 13 bp, C. elegans
aagtttttgtact

SEQ ID NO: 692859 - DNA, 13 bp, C. elegans
aagtttttgtaga

SEQ ID NO: 692860 - DNA, 13 bp, C. elegans
aagtttttgtata

SEQ ID NO: 692861 - DNA, 13 bp, C. elegans
aagtttttgtgaa

SEQ ID NO: 692862 - DNA, 13 bp, C. elegans
aagttttttaatg

SEQ ID NO: 692863 - DNA, 13 bp, C. elegans
aagttttttcata

SEQ ID NO: 692864 - DNA, 13 bp, C. elegans
aagttttttggaa

SEQ ID NO: 692865 - DNA, 13 bp, C. elegans
aagtttttttgga

SEQ ID NO: 692866 - DNA, 13 bp, C. elegans
aataaaaacgtga

SEQ ID NO: 692867 - DNA, 13 bp, C. elegans
aataaaaacttga

SEQ ID NO: 692868 - DNA, 13 bp, C. elegans
aataaaaatccga

SEQ ID NO: 692869 - DNA, 13 bp, C. elegans
aataaaaattgca

SEQ ID NO: 692870 - DNA, 13 bp, C. elegans
aataaaaatttcc

SEQ ID NO: 692871 - DNA, 13 bp, C. elegans
aataaaacatgtt

SEQ ID NO: 692872 - DNA, 13 bp, C. elegans
aataaaaccgaca

SEQ ID NO: 692873 - DNA, 13 bp, C. elegans
aataaaaccgttt

SEQ ID NO: 692874 - DNA, 13 bp, C. elegans
aataaaacgaatt

SEQ ID NO: 692875 - DNA, 13 bp, C. elegans
aataaaacttgaa

SEQ ID NO: 692876 - DNA, 13 bp, C. elegans
aataaaacttttc

SEQ ID NO: 692877 - DNA, 13 bp, C. elegans
aataaaagtttga

SEQ ID NO: 692878 - DNA, 13 bp, C. elegans
aataaaatattcc

SEQ ID NO: 692879 - DNA, 13 bp, C. elegans
aataaaatcgaat

SEQ ID NO: 692880 - DNA, 13 bp, C. elegans
aataaaatcgata

SEQ ID NO: 692881 - DNA, 13 bp, C. elegans
aataaaatcggaa

SEQ ID NO: 692882 - DNA, 13 bp, C. elegans
aataaaatggaac

SEQ ID NO: 692883 - DNA, 13 bp, C. elegans
aataaaatggatt

SEQ ID NO: 692884 - DNA, 13 bp, C. elegans
aataaaatgtgtc

SEQ ID NO: 692885 - DNA, 13 bp, C. elegans
aataaaatgtgtt

SEQ ID NO: 692886 - DNA, 13 bp, C. elegans
aataaaattcaga

SEQ ID NO: 692887 - DNA, 13 bp, C. elegans
aataaaattcgag

SEQ ID NO: 692888 - DNA, 13 bp, C. elegans
aataaaattctca

SEQ ID NO: 692889 - DNA, 13 bp, C. elegans
aataaaattcttc

SEQ ID NO: 692890 - DNA, 13 bp, C. elegans
aataaaattgcaa

SEQ ID NO: 692891 - DNA, 13 bp, C. elegans
aataaaattgtca

SEQ ID NO: 692892 - DNA, 13 bp, C. elegans
aataaaatttcag

SEQ ID NO: 692893 - DNA, 13 bp, C. elegans
aataaaattttcc

SEQ ID NO: 692894 - DNA, 13 bp, C. elegans
aataaacagtttc

SEQ ID NO: 692895 - DNA, 13 bp, C. elegans
aataaacatattg

SEQ ID NO: 692896 - DNA, 13 bp, C. elegans
aataaacatgatt

SEQ ID NO: 692897 - DNA, 13 bp, C. elegans
aataaacattcac

SEQ ID NO: 692898 - DNA, 13 bp, C. elegans
aataaacatttct

SEQ ID NO: 692899 - DNA, 13 bp, C. elegans
aataaacattttc

SEQ ID NO: 692900 - DNA, 13 bp, C. elegans
aataaaccaattt

SEQ ID NO: 692901 - DNA, 13 bp, C. elegans
aataaactgaaat

SEQ ID NO: 692902 - DNA, 13 bp, C. elegans
aataaacttcaat

SEQ ID NO: 692903 - DNA, 13 bp, C. elegans
aataaacttgatt

SEQ ID NO: 692904 - DNA, 13 bp, C. elegans
aataaagacaatt

SEQ ID NO: 692905 - DNA, 13 bp, C. elegans
aataaagctgaaa

SEQ ID NO: 692906 - DNA, 13 bp, C. elegans
aataaagtattga

SEQ ID NO: 692907 - DNA, 13 bp, C. elegans
aataaagtattgt

SEQ ID NO: 692908 - DNA, 13 bp, C. elegans
aataaagttattc

SEQ ID NO: 692909 - DNA, 13 bp, C. elegans
aataaagttgaat

SEQ ID NO: 692910 - DNA, 13 bp, C. elegans
aataaagttgtaa

SEQ ID NO: 692911 - DNA, 13 bp, C. elegans
aataaagtttaca

SEQ ID NO: 692912 - DNA, 13 bp, C. elegans
aataaagtttcaa

SEQ ID NO: 692913 - DNA, 13 bp, C. elegans
aataaagtttcag

SEQ ID NO: 692914 - DNA, 13 bp, C. elegans
aataaagtttgta

SEQ ID NO: 692915 - DNA, 13 bp, C. elegans
aataaagttttca

SEQ ID NO: 692916 - DNA, 13 bp, C. elegans
aataaagttttct

SEQ ID NO: 692917 - DNA, 13 bp, C. elegans
aataaagttttga

SEQ ID NO: 692918 - DNA, 13 bp, C. elegans
aataaataagttg

SEQ ID NO: 692919 - DNA, 13 bp, C. elegans
aataaatagttca

SEQ ID NO: 692920 - DNA, 13 bp, C. elegans
aataaatattcca

SEQ ID NO: 692921 - DNA, 13 bp, C. elegans
aataaatcagaat

SEQ ID NO: 692922 - DNA, 13 bp, C. elegans
aataaatcatgag

SEQ ID NO: 692923 - DNA, 13 bp, C. elegans
aataaatcgattt

SEQ ID NO: 692924 - DNA, 13 bp, C. elegans
aataaatcgtatt

SEQ ID NO: 692925 - DNA, 13 bp, C. elegans
aataaatctgaaa

SEQ ID NO: 692926 - DNA, 13 bp, C. elegans
aataaatctgatt

SEQ ID NO: 692927 - DNA, 13 bp, C. elegans
aataaatcttcaa

SEQ ID NO: 692928 - DNA, 13 bp, C. elegans
aataaatcttgaa

SEQ ID NO: 692929 - DNA, 13 bp, C. elegans
aataaatgatttg

SEQ ID NO: 692930 - DNA, 13 bp, C. elegans
aataaatgcaaat

SEQ ID NO: 692931 - DNA, 13 bp, C. elegans
aataaatgtagtt

SEQ ID NO: 692932 - DNA, 13 bp, C. elegans
aataaatgtcaat

SEQ ID NO: 692933 - DNA, 13 bp, C. elegans
aataaatgtcttt

SEQ ID NO: 692934 - DNA, 13 bp, C. elegans
aataaatgtgtat

SEQ ID NO: 692935 - DNA, 13 bp, C. elegans
aataaatgttcaa

SEQ ID NO: 692936 - DNA, 13 bp, C. elegans
aataaatgttcat

SEQ ID NO: 692937 - DNA, 13 bp, C. elegans
aataaatgttgga

SEQ ID NO: 692938 - DNA, 13 bp, C. elegans
aataaatgtttca

SEQ ID NO: 692939 - DNA, 13 bp, C. elegans
aataaattatcac

SEQ ID NO: 692940 - DNA, 13 bp, C. elegans
aataaattccgaa

SEQ ID NO: 692941 - DNA, 13 bp, C. elegans
aataaattgagtt

SEQ ID NO: 692942 - DNA, 13 bp, C. elegans
aataaattggatt

SEQ ID NO: 692943 - DNA, 13 bp, C. elegans
aataaattgtcaa

SEQ ID NO: 692944 - DNA, 13 bp, C. elegans
aataaattgtgaa

SEQ ID NO: 692945 - DNA, 13 bp, C. elegans
aataaatttcctt

SEQ ID NO: 692946 - DNA, 13 bp, C. elegans
aataaatttcttg

SEQ ID NO: 692947 - DNA, 13 bp, C. elegans
aataaatttgcat

SEQ ID NO: 692948 - DNA, 13 bp, C. elegans
aataaatttggat

SEQ ID NO: 692949 - DNA, 13 bp, C. elegans
aataaatttggtt

SEQ ID NO: 692950 - DNA, 13 bp, C. elegans
aataaatttgtca

SEQ ID NO: 692951 - DNA, 13 bp, C. elegans
aataaattttcag

SEQ ID NO: 692952 - DNA, 13 bp, C. elegans
aataaattttcct

SEQ ID NO: 692953 - DNA, 13 bp, C. elegans
aataaattttcgg

SEQ ID NO: 692954 - DNA, 13 bp, C. elegans
aataacaaattct

SEQ ID NO: 692955 - DNA, 13 bp, C. elegans
aataacaatgttt

SEQ ID NO: 692956 - DNA, 13 bp, C. elegans
aataacacaattt

SEQ ID NO: 692957 - DNA, 13 bp, C. elegans
aataacacttttt

SEQ ID NO: 692958 - DNA, 13 bp, C. elegans
aataacagttatt

SEQ ID NO: 692959 - DNA, 13 bp, C. elegans
aataacattttca

SEQ ID NO: 692960 - DNA, 13 bp, C. elegans
aataaccatttta

SEQ ID NO: 692961 - DNA, 13 bp, C. elegans
aataaccttgaaa

SEQ ID NO: 692962 - DNA, 13 bp, C. elegans
aataactcatttt

SEQ ID NO: 692963 - DNA, 13 bp, C. elegans
aataactgaaact

SEQ ID NO: 692964 - DNA, 13 bp, C. elegans
aataactgatttt

SEQ ID NO: 692965 - DNA, 13 bp, C. elegans
aataactggaaaa

SEQ ID NO: 692966 - DNA, 13 bp, C. elegans
aataactgtaaaa

SEQ ID NO: 692967 - DNA, 13 bp, C. elegans
aataactgtgaaa

SEQ ID NO: 692968 - DNA, 13 bp, C. elegans
aataactgttttt

SEQ ID NO: 692969 - DNA, 13 bp, C. elegans
aataacttcaaat

SEQ ID NO: 692970 - DNA, 13 bp, C. elegans
aataacttcattt

SEQ ID NO: 692971 - DNA, 13 bp, C. elegans
aataacttccaaa

SEQ ID NO: 692972 - DNA, 13 bp, C. elegans
aataacttgaaaa

SEQ ID NO: 692973 - DNA, 13 bp, C. elegans
aataactttaact

SEQ ID NO: 692974 - DNA, 13 bp, C. elegans
aataactttgaat

SEQ ID NO: 692975 - DNA, 13 bp, C. elegans
aataactttggaa

SEQ ID NO: 692976 - DNA, 13 bp, C. elegans
aataacttttttg

SEQ ID NO: 692977 - DNA, 13 bp, C. elegans
aataagaaacatt

SEQ ID NO: 692978 - DNA, 13 bp, C. elegans
aataagaattcca

SEQ ID NO: 692979 - DNA, 13 bp, C. elegans
aataagatttcaa

SEQ ID NO: 692980 - DNA, 13 bp, C. elegans
aataaggattttt

SEQ ID NO: 692981 - DNA, 13 bp, C. elegans
aataaggtgcgat

SEQ ID NO: 692982 - DNA, 13 bp, C. elegans
aataaggttttta

SEQ ID NO: 692983 - DNA, 14 bp, C. elegans
aataagtataatca

SEQ ID NO: 692984 - DNA, 13 bp, C. elegans
aataagtcattaa

SEQ ID NO: 692985 - DNA, 13 bp, C. elegans
aataagtggagcg

SEQ ID NO: 692986 - DNA, 13 bp, C. elegans
aataagttgaaat

SEQ ID NO: 692987 - DNA, 13 bp, C. elegans
aataagttgagaa

SEQ ID NO: 692988 - DNA, 13 bp, C. elegans
aataagttgccga

SEQ ID NO: 692989 - DNA, 13 bp, C. elegans
aataagttgttct

SEQ ID NO: 692990 - DNA, 13 bp, C. elegans
aataagtttgaaa

SEQ ID NO: 692991 - DNA, 13 bp, C. elegans
aataataaattgg

SEQ ID NO: 692992 - DNA, 13 bp, C. elegans
aataataatgtgt

SEQ ID NO: 692993 - DNA, 13 bp, C. elegans
aataataatgttg

SEQ ID NO: 692994 - DNA, 13 bp, C. elegans
aataatacaactt

SEQ ID NO: 692995 - DNA, 13 bp, C. elegans
aataatacacaag

SEQ ID NO: 692996 - DNA, 13 bp, C. elegans
aataatacttttc

SEQ ID NO: 692997 - DNA, 13 bp, C. elegans
aataataggtttt

SEQ ID NO: 692998 - DNA, 13 bp, C. elegans
aataatagtttct

SEQ ID NO: 692999 - DNA, 13 bp, C. elegans
aataatattttgc

SEQ ID NO: 693000 - DNA, 13 bp, C. elegans
aataatcaaattc

SEQ ID NO: 693001 - DNA, 13 bp, C. elegans
aataatcacattt

SEQ ID NO: 693002 - DNA, 13 bp, C. elegans
aataatcactttt

SEQ ID NO: 693003 - DNA, 13 bp, C. elegans
aataatcatgttt

SEQ ID NO: 693004 - DNA, 13 bp, C. elegans
aataatccaattt

SEQ ID NO: 693005 - DNA, 13 bp, C. elegans
aataatcccaata

SEQ ID NO: 693006 - DNA, 13 bp, C. elegans
aataatcctacaa

SEQ ID NO: 693007 - DNA, 13 bp, C. elegans
aataatcgaaaat

SEQ ID NO: 693008 - DNA, 13 bp, C. elegans
aataatcgaatat

SEQ ID NO: 693009 - DNA, 13 bp, C. elegans
aataatcgataat

SEQ ID NO: 693010 - DNA, 13 bp, C. elegans
aataatcgatgaa

SEQ ID NO: 693011 - DNA, 13 bp, C. elegans
aataatctatttc

SEQ ID NO: 693012 - DNA, 13 bp, C. elegans
aataatctcaaat

SEQ ID NO: 693013 - DNA, 13 bp, C. elegans
aataatctggaaa

SEQ ID NO: 693014 - DNA, 13 bp, C. elegans
aataatcttcatt

SEQ ID NO: 693015 - DNA, 13 bp, C. elegans
aataatgaaactt

SEQ ID NO: 693016 - DNA, 13 bp, C. elegans
aataatgaaatca

SEQ ID NO: 693017 - DNA, 13 bp, C. elegans
aataatgacaatt

SEQ ID NO: 693018 - DNA, 13 bp, C. elegans
aataatgacgtca

SEQ ID NO: 693019 - DNA, 13 bp, C. elegans
aataatgatgatt

SEQ ID NO: 693020 - DNA, 13 bp, C. elegans
aataatgcaaaat

SEQ ID NO: 693021 - DNA, 13 bp, C. elegans
aataatgcaaatg

SEQ ID NO: 693022 - DNA, 13 bp, C. elegans
aataatgtgttct

SEQ ID NO: 693023 - DNA, 13 bp, C. elegans
aataatgtgtttt

SEQ ID NO: 693024 - DNA, 13 bp, C. elegans
aataatgttcaaa

SEQ ID NO: 693025 - DNA, 13 bp, C. elegans
aataatgtttcca

SEQ ID NO: 693026 - DNA, 13 bp, C. elegans
aataatgtttctt

SEQ ID NO: 693027 - DNA, 13 bp, C. elegans
aataatgtttgat

SEQ ID NO: 693028 - DNA, 13 bp, C. elegans
aataattatttcc

SEQ ID NO: 693029 - DNA, 13 bp, C. elegans
aataattcacatt

SEQ ID NO: 693030 - DNA, 13 bp, C. elegans
aataattcatgtt

SEQ ID NO: 693031 - DNA, 13 bp, C. elegans
aataattcccaaa

SEQ ID NO: 693032 - DNA, 13 bp, C. elegans
aataattcgaaaa

SEQ ID NO: 693033 - DNA, 13 bp, C. elegans
aataattcgaaat

SEQ ID NO: 693034 - DNA, 13 bp, C. elegans
aataattcgatta

SEQ ID NO: 693035 - DNA, 13 bp, C. elegans
aataattctacaa

SEQ ID NO: 693036 - DNA, 13 bp, C. elegans
aataattctcaaa

SEQ ID NO: 693037 - DNA, 13 bp, C. elegans
aataattctcatt

SEQ ID NO: 693038 - DNA, 13 bp, C. elegans
aataattctgaaa

SEQ ID NO: 693039 - DNA, 13 bp, C. elegans
aataattcttcaa

SEQ ID NO: 693040 - DNA, 13 bp, C. elegans
aataattgaaaca

SEQ ID NO: 693041 - DNA, 13 bp, C. elegans
aataattgaagat

SEQ ID NO: 693042 - DNA, 13 bp, C. elegans
aataattgagaat

SEQ ID NO: 693043 - DNA, 13 bp, C. elegans
aataattgatcaa

SEQ ID NO: 693044 - DNA, 13 bp, C. elegans
aataattgatgaa

SEQ ID NO: 693045 - DNA, 13 bp, C. elegans
aataattgcattt

SEQ ID NO: 693046 - DNA, 13 bp, C. elegans
aataattggaagt

SEQ ID NO: 693047 - DNA, 13 bp, C. elegans
aataattggattt

SEQ ID NO: 693048 - DNA, 13 bp, C. elegans
aataattgggaaa

SEQ ID NO: 693049 - DNA, 13 bp, C. elegans
aataattgggatc

SEQ ID NO: 693050 - DNA, 13 bp, C. elegans
aataattgtttcc

SEQ ID NO: 693051 - DNA, 13 bp, C. elegans
aataattgttttc

SEQ ID NO: 693052 - DNA, 13 bp, C. elegans
aataatttatctg

SEQ ID NO: 693053 - DNA, 13 bp, C. elegans
aataatttcacaa

SEQ ID NO: 693054 - DNA, 13 bp, C. elegans
aataatttcagaa

SEQ ID NO: 693055 - DNA, 13 bp, C. elegans
aataatttcatca

SEQ ID NO: 693056 - DNA, 13 bp, C. elegans
aataatttccaga

SEQ ID NO: 693057 - DNA, 13 bp, C. elegans
aataatttccata

SEQ ID NO: 693058 - DNA, 13 bp, C. elegans
aataatttccggt

SEQ ID NO: 693059 - DNA, 13 bp, C. elegans
aataatttcgaaa

SEQ ID NO: 693060 - DNA, 13 bp, C. elegans
aataatttctcaa

SEQ ID NO: 693061 - DNA, 13 bp, C. elegans
aataatttctcag

SEQ ID NO: 693062 - DNA, 13 bp, C. elegans
aataatttctgaa

SEQ ID NO: 693063 - DNA, 13 bp, C. elegans
aataatttgccaa

SEQ ID NO: 693064 - DNA, 13 bp, C. elegans
aataatttggaag

SEQ ID NO: 693065 - DNA, 13 bp, C. elegans
aataatttggaat

SEQ ID NO: 693066 - DNA, 13 bp, C. elegans
aataatttgttga

SEQ ID NO: 693067 - DNA, 13 bp, C. elegans
aataatttgttgt

SEQ ID NO: 693068 - DNA, 13 bp, C. elegans
aataattttacag

SEQ ID NO: 693069 - DNA, 13 bp, C. elegans
aataattttcaac

SEQ ID NO: 693070 - DNA, 13 bp, C. elegans
aataattttcaca

SEQ ID NO: 693071 - DNA, 13 bp, C. elegans
aataattttcaga

SEQ ID NO: 693072 - DNA, 13 bp, C. elegans
aataattttccag

SEQ ID NO: 693073 - DNA, 13 bp, C. elegans
aataattttcttc

SEQ ID NO: 693074 - DNA, 13 bp, C. elegans
aataattttgcta

SEQ ID NO: 693075 - DNA, 13 bp, C. elegans
aataattttggcg

SEQ ID NO: 693076 - DNA, 13 bp, C. elegans
aataatttttgtc

SEQ ID NO: 693077 - DNA, 13 bp, C. elegans
aataattttttcg

SEQ ID NO: 693078 - DNA, 13 bp, C. elegans
aatacaaaatgtt

SEQ ID NO: 693079 - DNA, 13 bp, C. elegans
aatacaaaattct

SEQ ID NO: 693080 - DNA, 13 bp, C. elegans
aatacaaaatttc

SEQ ID NO: 693081 - DNA, 13 bp, C. elegans
aatacaaactgaa

SEQ ID NO: 693082 - DNA, 13 bp, C. elegans
aatacaaatgtaa

SEQ ID NO: 693083 - DNA, 13 bp, C. elegans
aatacaaattgtg

SEQ ID NO: 693084 - DNA, 13 bp, C. elegans
aatacaaatttga

SEQ ID NO: 693085 - DNA, 13 bp, C. elegans
aatacaagtagac

SEQ ID NO: 693086 - DNA, 13 bp, C. elegans
aatacaatatttc

SEQ ID NO: 693087 - DNA, 13 bp, C. elegans
aatacaattcaat

SEQ ID NO: 693088 - DNA, 13 bp, C. elegans
aatacaattgtat

SEQ ID NO: 693089 - DNA, 13 bp, C. elegans
aatacaattgttt

SEQ ID NO: 693090 - DNA, 13 bp, C. elegans
aatacaatttcaa

SEQ ID NO: 693091 - DNA, 13 bp, C. elegans
aatacaatttcag

SEQ ID NO: 693092 - DNA, 13 bp, C. elegans
aatacaatttcca

SEQ ID NO: 693093 - DNA, 13 bp, C. elegans
aatacaatttcta

SEQ ID NO: 693094 - DNA, 13 bp, C. elegans
aatacaattttga

SEQ ID NO: 693095 - DNA, 13 bp, C. elegans
aatacacaatttt

SEQ ID NO: 693096 - DNA, 13 bp, C. elegans
aatacacagattt

SEQ ID NO: 693097 - DNA, 13 bp, C. elegans
aatacacgaagaa

SEQ ID NO: 693098 - DNA, 13 bp, C. elegans
aatacacgtataa

SEQ ID NO: 693099 - DNA, 13 bp, C. elegans
aatacactgaata

SEQ ID NO: 693100 - DNA, 13 bp, C. elegans
aatacacttatta

SEQ ID NO: 693101 - DNA, 13 bp, C. elegans
aatacactttttt

SEQ ID NO: 693102 - DNA, 13 bp, C. elegans
aatacagaatttt

SEQ ID NO: 693103 - DNA, 32 bp, C. elegans
aatacagagaagattagcatggcccctgcgca

SEQ ID NO: 693104 - DNA, 13 bp, C. elegans
aatacagtatttt

SEQ ID NO: 693105 - DNA, 13 bp, C. elegans
aatacagtcaaaa

SEQ ID NO: 693106 - DNA, 13 bp, C. elegans
aatacagtgtggg

SEQ ID NO: 693107 - DNA, 13 bp, C. elegans
aatacagtttcaa

SEQ ID NO: 693108 - DNA, 13 bp, C. elegans
aatacagtttgtg

SEQ ID NO: 693109 - DNA, 13 bp, C. elegans
aatacagttttaa

SEQ ID NO: 693110 - DNA, 13 bp, C. elegans
aatacatacattt

SEQ ID NO: 693111 - DNA, 13 bp, C. elegans
aatacatagtttt

SEQ ID NO: 693112 - DNA, 13 bp, C. elegans
aatacatatgtac

SEQ ID NO: 693113 - DNA, 13 bp, C. elegans
aatacatgttttt

SEQ ID NO: 693114 - DNA, 13 bp, C. elegans
aatacattcaatt

SEQ ID NO: 693115 - DNA, 13 bp, C. elegans
aatacattcattt

SEQ ID NO: 693116 - DNA, 13 bp, C. elegans
aatacattgattt

SEQ ID NO: 693117 - DNA, 13 bp, C. elegans
aatacatttctag

SEQ ID NO: 693118 - DNA, 13 bp, C. elegans
aatacattttcat

SEQ ID NO: 693119 - DNA, 13 bp, C. elegans
aatacattttcga

SEQ ID NO: 693120 - DNA, 13 bp, C. elegans
aatacattttctt

SEQ ID NO: 693121 - DNA, 13 bp, C. elegans
aatacatttttgg

SEQ ID NO: 693122 - DNA, 13 bp, C. elegans
aatacattttttg

SEQ ID NO: 693123 - DNA, 13 bp, C. elegans
aataccaaaaatg

SEQ ID NO: 693124 - DNA, 13 bp, C. elegans
aataccaattttc

SEQ ID NO: 693125 - DNA, 13 bp, C. elegans
aataccattttca

SEQ ID NO: 693126 - DNA, 13 bp, C. elegans
aataccatttttc

SEQ ID NO: 693127 - DNA, 13 bp, C. elegans
aataccggcagta

SEQ ID NO: 693128 - DNA, 13 bp, C. elegans
aataccgtttttt

SEQ ID NO: 693129 - DNA, 13 bp, C. elegans
aatacctaaatca

SEQ ID NO: 693130 - DNA, 13 bp, C. elegans
aatacctcttcaa

SEQ ID NO: 693131 - DNA, 13 bp, C. elegans
aatacctgaaaat

SEQ ID NO: 693132 - DNA, 13 bp, C. elegans
aatacgaaaatat

SEQ ID NO: 693133 - DNA, 13 bp, C. elegans
aatacgaaaatta

SEQ ID NO: 693134 - DNA, 13 bp, C. elegans
aatacgaataatt

SEQ ID NO: 693135 - DNA, 13 bp, C. elegans
aatacgaattttg

SEQ ID NO: 693136 - DNA, 13 bp, C. elegans
aatacgagatttt

SEQ ID NO: 693137 - DNA, 13 bp, C. elegans
aatacgatttatt

SEQ ID NO: 693138 - DNA, 13 bp, C. elegans
aatacgattttca

SEQ ID NO: 693139 - DNA, 13 bp, C. elegans
aatacgatttttc

SEQ ID NO: 693140 - DNA, 13 bp, C. elegans
aatacgcattctc

SEQ ID NO: 693141 - DNA, 13 bp, C. elegans
aatacgcattttc

SEQ ID NO: 693142 - DNA, 13 bp, C. elegans
aatacggatattt

SEQ ID NO: 693143 - DNA, 13 bp, C. elegans
aatacggtagccg

SEQ ID NO: 693144 - DNA, 13 bp, C. elegans
aatacggtccttg

SEQ ID NO: 693145 - DNA, 13 bp, C. elegans
aatacggtttttt

SEQ ID NO: 693146 - DNA, 13 bp, C. elegans
aatacgtttttgt

SEQ ID NO: 693147 - DNA, 13 bp, C. elegans
aatactaaaactg

SEQ ID NO: 693148 - DNA, 13 bp, C. elegans
aatactaattttc

SEQ ID NO: 693149 - DNA, 13 bp, C. elegans
aatactacagtaa

SEQ ID NO: 693150 - DNA, 13 bp, C. elegans
aatactacatttt

SEQ ID NO: 693151 - DNA, 13 bp, C. elegans
aatactactacag

SEQ ID NO: 693152 - DNA, 13 bp, C. elegans
aatactatcaaat

SEQ ID NO: 693153 - DNA, 13 bp, C. elegans
aatactattaggg

SEQ ID NO: 693154 - DNA, 13 bp, C. elegans
aatactatttttc

SEQ ID NO: 693155 - DNA, 13 bp, C. elegans
aatactatttttg

SEQ ID NO: 693156 - DNA, 13 bp, C. elegans
aatactcaaaatt

SEQ ID NO: 693157 - DNA, 13 bp, C. elegans
aatactcaatttt

SEQ ID NO: 693158 - DNA, 13 bp, C. elegans
aatactcattttt

SEQ ID NO: 693159 - DNA, 13 bp, C. elegans
aatactccaaaat

SEQ ID NO: 693160 - DNA, 13 bp, C. elegans
aatactcgaaaat

SEQ ID NO: 693161 - DNA, 13 bp, C. elegans
aatactcttttca

SEQ ID NO: 693162 - DNA, 13 bp, C. elegans
aatactgaaaatc

SEQ ID NO: 693163 - DNA, 13 bp, C. elegans
aatactgattttt

SEQ ID NO: 693164 - DNA, 13 bp, C. elegans
aatactgcaaaaa

SEQ ID NO: 693165 - DNA, 13 bp, C. elegans
aatactgcaaata

SEQ ID NO: 693166 - DNA, 13 bp, C. elegans
aatactggaattt

SEQ ID NO: 693167 - DNA, 13 bp, C. elegans
aatactgtacccg

SEQ ID NO: 693168 - DNA, 13 bp, C. elegans
aatactgtagaaa

SEQ ID NO: 693169 - DNA, 13 bp, C. elegans
aatactgtttcac

SEQ ID NO: 693170 - DNA, 13 bp, C. elegans
aatactgttttac

SEQ ID NO: 693171 - DNA, 13 bp, C. elegans
aatactgtttttc

SEQ ID NO: 693172 - DNA, 13 bp, C. elegans
aatacttacaatt

SEQ ID NO: 693173 - DNA, 13 bp, C. elegans
aatacttactttt

SEQ ID NO: 693174 - DNA, 13 bp, C. elegans
aatacttatttga

SEQ ID NO: 693175 - DNA, 13 bp, C. elegans
aatacttcaattt

SEQ ID NO: 693176 - DNA, 15 bp, C. elegans
aatacttgtgtgaat

SEQ ID NO: 693177 - DNA, 13 bp, C. elegans
aatactttatttc

SEQ ID NO: 693178 - DNA, 13 bp, C. elegans
aatactttcaatt

SEQ ID NO: 693179 - DNA, 13 bp, C. elegans
aatactttcattt

SEQ ID NO: 693180 - DNA, 13 bp, C. elegans
aatactttgagaa

SEQ ID NO: 693181 - DNA, 13 bp, C. elegans
aatactttggaaa

SEQ ID NO: 693182 - DNA, 13 bp, C. elegans
aatacttttcaaa

SEQ ID NO: 693183 - DNA, 13 bp, C. elegans
aatacttttctca

SEQ ID NO: 693184 - DNA, 13 bp, C. elegans
aatacttttgaaa

SEQ ID NO: 693185 - DNA, 13 bp, C. elegans
aatacttttgtgt

SEQ ID NO: 693186 - DNA, 13 bp, C. elegans
aatactttttgga

SEQ ID NO: 693187 - DNA, 13 bp, C. elegans
aatacttttttca

SEQ ID NO: 693188 - DNA, 13 bp, C. elegans
aatagaaaacgtt

SEQ ID NO: 693189 - DNA, 13 bp, C. elegans
aatagaaaatggg

SEQ ID NO: 693190 - DNA, 13 bp, C. elegans
aatagaaatgctc

SEQ ID NO: 693191 - DNA, 13 bp, C. elegans
aatagaacaaatg

SEQ ID NO: 693192 - DNA, 13 bp, C. elegans
aatagaacatttc

SEQ ID NO: 693193 - DNA, 13 bp, C. elegans
aatagaatatcaa

SEQ ID NO: 693194 - DNA, 13 bp, C. elegans
aatagaatgcgaa

SEQ ID NO: 693195 - DNA, 13 bp, C. elegans
aatagaattcaaa

SEQ ID NO: 693196 - DNA, 13 bp, C. elegans
aatagacattttt

SEQ ID NO: 693197 - DNA, 13 bp, C. elegans
aatagagaaattg

SEQ ID NO: 693198 - DNA, 13 bp, C. elegans
aatagagaacata

SEQ ID NO: 693199 - DNA, 13 bp, C. elegans
aatagagtttcaa

SEQ ID NO: 693200 - DNA, 13 bp, C. elegans
aatagattcattc

SEQ ID NO: 693201 - DNA, 13 bp, C. elegans
aatagatttcaaa

SEQ ID NO: 693202 - DNA, 13 bp, C. elegans
aatagattttcca

SEQ ID NO: 693203 - DNA, 13 bp, C. elegans
aatagatttttca

SEQ ID NO: 693204 - DNA, 13 bp, C. elegans
aatagctattttt

SEQ ID NO: 693205 - DNA, 13 bp, C. elegans
aatagctcaaaaa

SEQ ID NO: 693206 - DNA, 13 bp, C. elegans
aatagcttcaaaa

SEQ ID NO: 693207 - DNA, 13 bp, C. elegans
aatagctttaaat

SEQ ID NO: 693208 - DNA, 13 bp, C. elegans
aataggaaaatgg

SEQ ID NO: 693209 - DNA, 13 bp, C. elegans
aataggaaattat

SEQ ID NO: 693210 - DNA, 13 bp, C. elegans
aataggcaaaatt

SEQ ID NO: 693211 - DNA, 13 bp, C. elegans
aataggccccgcc

SEQ ID NO: 693212 - DNA, 13 bp, C. elegans
aataggcggagct

SEQ ID NO: 693213 - DNA, 13 bp, C. elegans
aataggctccgcc

SEQ ID NO: 693214 - DNA, 13 bp, C. elegans
aataggctgaaaa

SEQ ID NO: 693215 - DNA, 13 bp, C. elegans
aatagtaaaactt

SEQ ID NO: 693216 - DNA, 13 bp, C. elegans
aatagtacaaatt

SEQ ID NO: 693217 - DNA, 13 bp, C. elegans
aatagtattgaaa

SEQ ID NO: 693218 - DNA, 13 bp, C. elegans
aatagtattgcat

SEQ ID NO: 693219 - DNA, 13 bp, C. elegans
aatagtatttcaa

SEQ ID NO: 693220 - DNA, 13 bp, C. elegans
aatagtattttca

SEQ ID NO: 693221 - DNA, 13 bp, C. elegans
aatagtcacaaaa

SEQ ID NO: 693222 - DNA, 13 bp, C. elegans
aatagtcattttc

SEQ ID NO: 693223 - DNA, 13 bp, C. elegans
aatagtctgaaaa

SEQ ID NO: 693224 - DNA, 13 bp, C. elegans
aatagtcttgaaa

SEQ ID NO: 693225 - DNA, 13 bp, C. elegans
aatagtgaaaatt

SEQ ID NO: 693226 - DNA, 13 bp, C. elegans
aatagtgtatttt

SEQ ID NO: 693227 - DNA, 13 bp, C. elegans
aatagtgtttcaa

SEQ ID NO: 693228 - DNA, 13 bp, C. elegans
aatagttattcaa

SEQ ID NO: 693229 - DNA, 13 bp, C. elegans
aatagttcaaaat

SEQ ID NO: 693230 - DNA, 13 bp, C. elegans
aatagttcaaatt

SEQ ID NO: 693231 - DNA, 13 bp, C. elegans
aatagttcagttt

SEQ ID NO: 693232 - DNA, 13 bp, C. elegans
aatagttcataaa

SEQ ID NO: 693233 - DNA, 13 bp, C. elegans
aatagttccaaaa

SEQ ID NO: 693234 - DNA, 13 bp, C. elegans
aatagttccactt

SEQ ID NO: 693235 - DNA, 13 bp, C. elegans
aatagttctgatc

SEQ ID NO: 693236 - DNA, 13 bp, C. elegans
aatagttgcccca

SEQ ID NO: 693237 - DNA, 13 bp, C. elegans
aatagtttagaaa

SEQ ID NO: 693238 - DNA, 13 bp, C. elegans
aatagtttattgc

SEQ ID NO: 693239 - DNA, 13 bp, C. elegans
aatagtttcaaat

SEQ ID NO: 693240 - DNA, 13 bp, C. elegans
aatagtttcacaa

SEQ ID NO: 693241 - DNA, 13 bp, C. elegans
aatagtttctatt

SEQ ID NO: 693242 - DNA, 13 bp, C. elegans
aatagtttgaaaa

SEQ ID NO: 693243 - DNA, 13 bp, C. elegans
aatagttttaaac

SEQ ID NO: 693244 - DNA, 14 bp, C. elegans
aatagttttagtca

SEQ ID NO: 693245 - DNA, 13 bp, C. elegans
aatagttttcaaa

SEQ ID NO: 693246 - DNA, 13 bp, C. elegans
aatagttttcaat

SEQ ID NO: 693247 - DNA, 13 bp, C. elegans
aatagttttccaa

SEQ ID NO: 693248 - DNA, 13 bp, C. elegans
aatagttttggaa

SEQ ID NO: 693249 - DNA, 13 bp, C. elegans
aatagtttttcaa

SEQ ID NO: 693250 - DNA, 13 bp, C. elegans
aatagtttttcat

SEQ ID NO: 693251 - DNA, 13 bp, C. elegans
aatataaaaatgc

SEQ ID NO: 693252 - DNA, 13 bp, C. elegans
aatataaattcca

SEQ ID NO: 693253 - DNA, 13 bp, C. elegans
aatataaattgag

SEQ ID NO: 693254 - DNA, 13 bp, C. elegans
aatataaattggg

SEQ ID NO: 693255 - DNA, 13 bp, C. elegans
aatataacaagtt

SEQ ID NO: 693256 - DNA, 13 bp, C. elegans
aatataatgctcg

SEQ ID NO: 693257 - DNA, 13 bp, C. elegans
aatataatttctc

SEQ ID NO: 693258 - DNA, 13 bp, C. elegans
aatatacacattt

SEQ ID NO: 693259 - DNA, 13 bp, C. elegans
aatatacagtttt

SEQ ID NO: 693260 - DNA, 13 bp, C. elegans
aatatacatatgt

SEQ ID NO: 693261 - DNA, 13 bp, C. elegans
aatatacattttc

SEQ ID NO: 693262 - DNA, 13 bp, C. elegans
aatatacgatttt

SEQ ID NO: 693263 - DNA, 13 bp, C. elegans
aatatactgaaat

SEQ ID NO: 693264 - DNA, 13 bp, C. elegans
aatatacttttgt

SEQ ID NO: 693265 - DNA, 13 bp, C. elegans
aatatagaaaatc

SEQ ID NO: 693266 - DNA, 13 bp, C. elegans
aatatagaaattc

SEQ ID NO: 693267 - DNA, 13 bp, C. elegans
aatatagtcaaaa

SEQ ID NO: 693268 - DNA, 13 bp, C. elegans
aatatagtgtttt

SEQ ID NO: 693269 - DNA, 13 bp, C. elegans
aatatataaactg

SEQ ID NO: 693270 - DNA, 13 bp, C. elegans
aatatatattcag

SEQ ID NO: 693271 - DNA, 13 bp, C. elegans
aatatatcaaaag

SEQ ID NO: 693272 - DNA, 13 bp, C. elegans
aatatatcaagtt

SEQ ID NO: 693273 - DNA, 13 bp, C. elegans
aatatatcgaaaa

SEQ ID NO: 693274 - DNA, 14 bp, C. elegans
aatatatggtgaag

SEQ ID NO: 693275 - DNA, 13 bp, C. elegans
aatatatgtatac

SEQ ID NO: 693276 - DNA, 13 bp, C. elegans
aatatattaccca

SEQ ID NO: 693277 - DNA, 13 bp, C. elegans
aatatattcagaa

SEQ ID NO: 693278 - DNA, 13 bp, C. elegans
aatatattcgaaa

SEQ ID NO: 693279 - DNA, 13 bp, C. elegans
aatatatttcaca

SEQ ID NO: 693280 - DNA, 13 bp, C. elegans
aatatatttctca

SEQ ID NO: 693281 - DNA, 13 bp, C. elegans
aatatatttgacg

SEQ ID NO: 693282 - DNA, 13 bp, C. elegans
aatatatttgcat

SEQ ID NO: 693283 - DNA, 13 bp, C. elegans
aatatatttggaa

SEQ ID NO: 693284 - DNA, 13 bp, C. elegans
aatatattttctg

SEQ ID NO: 693285 - DNA, 13 bp, C. elegans
aatatatttttcc

SEQ ID NO: 693286 - DNA, 13 bp, C. elegans
aatatcaaaaagt

SEQ ID NO: 693287 - DNA, 13 bp, C. elegans
aatatcaaaaatg

SEQ ID NO: 693288 - DNA, 13 bp, C. elegans
aatatcaaaatgt

SEQ ID NO: 693289 - DNA, 13 bp, C. elegans
aatatcaaaattc

SEQ ID NO: 693290 - DNA, 13 bp, C. elegans
aatatcaaacatt

SEQ ID NO: 693291 - DNA, 13 bp, C. elegans
aatatcaaacttt

SEQ ID NO: 693292 - DNA, 13 bp, C. elegans
aatatcaaagtga

SEQ ID NO: 693293 - DNA, 13 bp, C. elegans
aatatcaaatgtt

SEQ ID NO: 693294 - DNA, 13 bp, C. elegans
aatatcaaattct

SEQ ID NO: 693295 - DNA, 13 bp, C. elegans
aatatcaaatttc

SEQ ID NO: 693296 - DNA, 13 bp, C. elegans
aatatcaaatttg

SEQ ID NO: 693297 - DNA, 13 bp, C. elegans
aatatcaacattt

SEQ ID NO: 693298 - DNA, 13 bp, C. elegans
aatatcaactttt

SEQ ID NO: 693299 - DNA, 13 bp, C. elegans
aatatcaagaatt

SEQ ID NO: 693300 - DNA, 13 bp, C. elegans
aatatcaagttta

SEQ ID NO: 693301 - DNA, 13 bp, C. elegans
aatatcaatgaaa

SEQ ID NO: 693302 - DNA, 13 bp, C. elegans
aatatcaatgatt

SEQ ID NO: 693303 - DNA, 13 bp, C. elegans
aatatcaatttgc

SEQ ID NO: 693304 - DNA, 13 bp, C. elegans
aatatcaattttg

SEQ ID NO: 693305 - DNA, 13 bp, C. elegans
aatatcacaaaag

SEQ ID NO: 693306 - DNA, 13 bp, C. elegans
aatatcacatttt

SEQ ID NO: 693307 - DNA, 13 bp, C. elegans
aatatcactaatt

SEQ ID NO: 693308 - DNA, 13 bp, C. elegans
aatatcagaaaac

SEQ ID NO: 693309 - DNA, 13 bp, C. elegans
aatatcagatatt

SEQ ID NO: 693310 - DNA, 13 bp, C. elegans
aatatcagttttt

SEQ ID NO: 693311 - DNA, 13 bp, C. elegans
aatatcataatga

SEQ ID NO: 693312 - DNA, 13 bp, C. elegans
aatatcatagtaa

SEQ ID NO: 693313 - DNA, 13 bp, C. elegans
aatatcatagtta

SEQ ID NO: 693314 - DNA, 13 bp, C. elegans
aatatcatcaaat

SEQ ID NO: 693315 - DNA, 13 bp, C. elegans
aatatcatcaact

SEQ ID NO: 693316 - DNA, 13 bp, C. elegans
aatatcatcaatt

SEQ ID NO: 693317 - DNA, 13 bp, C. elegans
aatatcatgattt

SEQ ID NO: 693318 - DNA, 13 bp, C. elegans
aatatcatgtttt

SEQ ID NO: 693319 - DNA, 13 bp, C. elegans
aatatcattactt

SEQ ID NO: 693320 - DNA, 13 bp, C. elegans
aatatcattcaaa

SEQ ID NO: 693321 - DNA, 13 bp, C. elegans
aatatcattcatt

SEQ ID NO: 693322 - DNA, 13 bp, C. elegans
aatatcattgaaa

SEQ ID NO: 693323 - DNA, 13 bp, C. elegans
aatatccaatttt

SEQ ID NO: 693324 - DNA, 13 bp, C. elegans
aatatcccgaaaa

SEQ ID NO: 693325 - DNA, 13 bp, C. elegans
aatatccgaaaac

SEQ ID NO: 693326 - DNA, 13 bp, C. elegans
aatatccgaaaat

SEQ ID NO: 693327 - DNA, 13 bp, C. elegans
aatatcctaattt

SEQ ID NO: 693328 - DNA, 13 bp, C. elegans
aatatcctatttt

SEQ ID NO: 693329 - DNA, 13 bp, C. elegans
aatatcctgaaaa

SEQ ID NO: 693330 - DNA, 13 bp, C. elegans
aatatcgaaaaac

SEQ ID NO: 693331 - DNA, 13 bp, C. elegans
aatatcgaaaaat

SEQ ID NO: 693332 - DNA, 13 bp, C. elegans
aatatcgaaaatg

SEQ ID NO: 693333 - DNA, 13 bp, C. elegans
aatatcgaaattt

SEQ ID NO: 693334 - DNA, 13 bp, C. elegans
aatatcgacaaaa

SEQ ID NO: 693335 - DNA, 13 bp, C. elegans
aatatcgagtttt

SEQ ID NO: 693336 - DNA, 13 bp, C. elegans
aatatcgattatt

SEQ ID NO: 693337 - DNA, 13 bp, C. elegans
aatatcgatttta

SEQ ID NO: 693338 - DNA, 13 bp, C. elegans
aatatcgctgtca

SEQ ID NO: 693339 - DNA, 13 bp, C. elegans
aatatcggaaaaa

SEQ ID NO: 693340 - DNA, 13 bp, C. elegans
aatatctcaaatt

SEQ ID NO: 693341 - DNA, 13 bp, C. elegans
aatatctcaactt

SEQ ID NO: 693342 - DNA, 13 bp, C. elegans
aatatctcgaaat

SEQ ID NO: 693343 - DNA, 13 bp, C. elegans
aatatctcgattt

SEQ ID NO: 693344 - DNA, 13 bp, C. elegans
aatatctcggagc

SEQ ID NO: 693345 - DNA, 13 bp, C. elegans
aatatctctaaaa

SEQ ID NO: 693346 - DNA, 13 bp, C. elegans
aatatctcttcaa

SEQ ID NO: 693347 - DNA, 17 bp, C. elegans
aatatctcttggcagag

SEQ ID NO: 693348 - DNA, 13 bp, C. elegans
aatatctgaaaaa

SEQ ID NO: 693349 - DNA, 13 bp, C. elegans
aatatctgaaaat

SEQ ID NO: 693350 - DNA, 13 bp, C. elegans
aatatctgaagaa

SEQ ID NO: 693351 - DNA, 13 bp, C. elegans
aatatctgaattt

SEQ ID NO: 693352 - DNA, 13 bp, C. elegans
aatatctgatcaa

SEQ ID NO: 693353 - DNA, 13 bp, C. elegans
aatatctggaaat

SEQ ID NO: 693354 - DNA, 13 bp, C. elegans
aatatctgtttca

SEQ ID NO: 693355 - DNA, 13 bp, C. elegans
aatatcttcaatt

SEQ ID NO: 693356 - DNA, 13 bp, C. elegans
aatatcttccaaa

SEQ ID NO: 693357 - DNA, 13 bp, C. elegans
aatatcttgtttt

SEQ ID NO: 693358 - DNA, 13 bp, C. elegans
aatatgaaaactc

SEQ ID NO: 693359 - DNA, 13 bp, C. elegans
aatatgaaaagtg

SEQ ID NO: 693360 - DNA, 13 bp, C. elegans
aatatgaaaatca

SEQ ID NO: 693361 - DNA, 13 bp, C. elegans
aatatgaaaatgt

SEQ ID NO: 693362 - DNA, 13 bp, C. elegans
aatatgaaacaat

SEQ ID NO: 693363 - DNA, 13 bp, C. elegans
aatatgaaacatg

SEQ ID NO: 693364 - DNA, 13 bp, C. elegans
aatatgaaacttc

SEQ ID NO: 693365 - DNA, 13 bp, C. elegans
aatatgaaattct

SEQ ID NO: 693366 - DNA, 13 bp, C. elegans
aatatgaaattga

SEQ ID NO: 693367 - DNA, 13 bp, C. elegans
aatatgaacaatt

SEQ ID NO: 693368 - DNA, 13 bp, C. elegans
aatatgaacattt

SEQ ID NO: 693369 - DNA, 13 bp, C. elegans
aatatgaactttt

SEQ ID NO: 693370 - DNA, 13 bp, C. elegans
aatatgaatatga

SEQ ID NO: 693371 - DNA, 13 bp, C. elegans
aatatgaatattc

SEQ ID NO: 693372 - DNA, 13 bp, C. elegans
aatatgaatttcc

SEQ ID NO: 693373 - DNA, 13 bp, C. elegans
aatatgacaattt

SEQ ID NO: 693374 - DNA, 13 bp, C. elegans
aatatgacgtcat

SEQ ID NO: 693375 - DNA, 13 bp, C. elegans
aatatgagaaatt

SEQ ID NO: 693376 - DNA, 13 bp, C. elegans
aatatgagaatat

SEQ ID NO: 693377 - DNA, 13 bp, C. elegans
aatatgagcaatt

SEQ ID NO: 693378 - DNA, 13 bp, C. elegans
aatatgagttttg

SEQ ID NO: 693379 - DNA, 13 bp, C. elegans
aatatgataaatg

SEQ ID NO: 693380 - DNA, 13 bp, C. elegans
aatatgatattcg

SEQ ID NO: 693381 - DNA, 13 bp, C. elegans
aatatgatggatt

SEQ ID NO: 693382 - DNA, 13 bp, C. elegans
aatatgatgtatt

SEQ ID NO: 693383 - DNA, 13 bp, C. elegans
aatatgattttga

SEQ ID NO: 693384 - DNA, 13 bp, C. elegans
aatatgcaaattg

SEQ ID NO: 693385 - DNA, 13 bp, C. elegans
aatatgcaacaaa

SEQ ID NO: 693386 - DNA, 13 bp, C. elegans
aatatgcagaaaa

SEQ ID NO: 693387 - DNA, 13 bp, C. elegans
aatatgcattttc

SEQ ID NO: 693388 - DNA, 13 bp, C. elegans
aatatgccaattt

SEQ ID NO: 693389 - DNA, 13 bp, C. elegans
aatatgccggaaa

SEQ ID NO: 693390 - DNA, 13 bp, C. elegans
aatatgccttttt

SEQ ID NO: 693391 - DNA, 13 bp, C. elegans
aatatgcgaaaat

SEQ ID NO: 693392 - DNA, 13 bp, C. elegans
aatatgctgaaat

SEQ ID NO: 693393 - DNA, 13 bp, C. elegans
aatatgctttgaa

SEQ ID NO: 693394 - DNA, 13 bp, C. elegans
aatatggaaattc

SEQ ID NO: 693395 - DNA, 13 bp, C. elegans
aatatggaattta

SEQ ID NO: 693396 - DNA, 13 bp, C. elegans
aatatggcaaaaa

SEQ ID NO: 693397 - DNA, 13 bp, C. elegans
aatatgggaaatt

SEQ ID NO: 693398 - DNA, 13 bp, C. elegans
aatatgggtgtca

SEQ ID NO: 693399 - DNA, 13 bp, C. elegans
aatatggtatttt

SEQ ID NO: 693400 - DNA, 13 bp, C. elegans
aatatggtgcatt

SEQ ID NO: 693401 - DNA, 13 bp, C. elegans
aatatggtgggaa

SEQ ID NO: 693402 - DNA, 13 bp, C. elegans
aatatgtacaatt

SEQ ID NO: 693403 - DNA, 13 bp, C. elegans
aatatgtacattt

SEQ ID NO: 693404 - DNA, 13 bp, C. elegans
aatatgtactttt

SEQ ID NO: 693405 - DNA, 13 bp, C. elegans
aatatgtatttct

SEQ ID NO: 693406 - DNA, 13 bp, C. elegans
aatatgtatttga

SEQ ID NO: 693407 - DNA, 13 bp, C. elegans
aatatgtattttg

SEQ ID NO: 693408 - DNA, 13 bp, C. elegans
aatatgtgaaata

SEQ ID NO: 693409 - DNA, 13 bp, C. elegans
aatatgtgaaatt

SEQ ID NO: 693410 - DNA, 13 bp, C. elegans
aatatgtgataaa

SEQ ID NO: 693411 - DNA, 13 bp, C. elegans
aatatgtggaatt

SEQ ID NO: 693412 - DNA, 13 bp, C. elegans
aatatgttatgtt

SEQ ID NO: 693413 - DNA, 13 bp, C. elegans
aatatgttgaaac

SEQ ID NO: 693414 - DNA, 13 bp, C. elegans
aatatgtttcttt

SEQ ID NO: 693415 - DNA, 13 bp, C. elegans
aatatgtttgctt

SEQ ID NO: 693416 - DNA, 13 bp, C. elegans
aatatgttttcat

SEQ ID NO: 693417 - DNA, 13 bp, C. elegans
aatatgttttcta

SEQ ID NO: 693418 - DNA, 13 bp, C. elegans
aatattactgaaa

SEQ ID NO: 693419 - DNA, 13 bp, C. elegans
aatattactgttt

SEQ ID NO: 693420 - DNA, 13 bp, C. elegans
aatattagtttga

SEQ ID NO: 693421 - DNA, 13 bp, C. elegans
aatattagttttc

SEQ ID NO: 693422 - DNA, 13 bp, C. elegans
aatattatacgtt

SEQ ID NO: 693423 - DNA, 13 bp, C. elegans
aatattatcaatg

SEQ ID NO: 693424 - DNA, 13 bp, C. elegans
aatattatcagaa

SEQ ID NO: 693425 - DNA, 13 bp, C. elegans
aatattatcagtt

SEQ ID NO: 693426 - DNA, 13 bp, C. elegans
aatattatctgaa

SEQ ID NO: 693427 - DNA, 13 bp, C. elegans
aatattatgacaa

SEQ ID NO: 693428 - DNA, 13 bp, C. elegans
aatattatggaaa

SEQ ID NO: 693429 - DNA, 13 bp, C. elegans
aatattatgtttc

SEQ ID NO: 693430 - DNA, 13 bp, C. elegans
aatattattcaga

SEQ ID NO: 693431 - DNA, 13 bp, C. elegans
aatattattgtga

SEQ ID NO: 693432 - DNA, 13 bp, C. elegans
aatattatttcga

SEQ ID NO: 693433 - DNA, 13 bp, C. elegans
aatattatttgtg

SEQ ID NO: 693434 - DNA, 13 bp, C. elegans
aatattcaaaaga

SEQ ID NO: 693435 - DNA, 13 bp, C. elegans
aatattcaaaatg

SEQ ID NO: 693436 - DNA, 13 bp, C. elegans
aatattcaaactt

SEQ ID NO: 693437 - DNA, 13 bp, C. elegans
aatattcaaagaa

SEQ ID NO: 693438 - DNA, 13 bp, C. elegans
aatattcaaatac

SEQ ID NO: 693439 - DNA, 13 bp, C. elegans
aatattcaaatgt

SEQ ID NO: 693440 - DNA, 13 bp, C. elegans
aatattcaagttt

SEQ ID NO: 693441 - DNA, 13 bp, C. elegans
aatattcaatact

SEQ ID NO: 693442 - DNA, 13 bp, C. elegans
aatattcaatgtt

SEQ ID NO: 693443 - DNA, 13 bp, C. elegans
aatattcaattcc

SEQ ID NO: 693444 - DNA, 13 bp, C. elegans
aatattcacattt

SEQ ID NO: 693445 - DNA, 13 bp, C. elegans
aatattcagaatg

SEQ ID NO: 693446 - DNA, 13 bp, C. elegans
aatattcagattt

SEQ ID NO: 693447 - DNA, 13 bp, C. elegans
aatattcagtcaa

SEQ ID NO: 693448 - DNA, 13 bp, C. elegans
aatattcatgaat

SEQ ID NO: 693449 - DNA, 13 bp, C. elegans
aatattcattcaa

SEQ ID NO: 693450 - DNA, 13 bp, C. elegans
aatattcattgat

SEQ ID NO: 693451 - DNA, 13 bp, C. elegans
aatattcattttc

SEQ ID NO: 693452 - DNA, 13 bp, C. elegans
aatattcattttg

SEQ ID NO: 693453 - DNA, 13 bp, C. elegans
aatattccaaaac

SEQ ID NO: 693454 - DNA, 13 bp, C. elegans
aatattccaaaat

SEQ ID NO: 693455 - DNA, 13 bp, C. elegans
aatattccaaata

SEQ ID NO: 693456 - DNA, 13 bp, C. elegans
aatattccaattt

SEQ ID NO: 693457 - DNA, 13 bp, C. elegans
aatattccacaaa

SEQ ID NO: 693458 - DNA, 13 bp, C. elegans
aatattccatatt

SEQ ID NO: 693459 - DNA, 13 bp, C. elegans
aatattccatcaa

SEQ ID NO: 693460 - DNA, 13 bp, C. elegans
aatattcccaatt

SEQ ID NO: 693461 - DNA, 13 bp, C. elegans
aatattcccatcc

SEQ ID NO: 693462 - DNA, 13 bp, C. elegans
aatattcgaaaaa

SEQ ID NO: 693463 - DNA, 13 bp, C. elegans
aatattcgaaaac

SEQ ID NO: 693464 - DNA, 13 bp, C. elegans
aatattcgaataa

SEQ ID NO: 693465 - DNA, 13 bp, C. elegans
aatattcgaatat

SEQ ID NO: 693466 - DNA, 13 bp, C. elegans
aatattcgaattc

SEQ ID NO: 693467 - DNA, 13 bp, C. elegans
aatattcgagttt

SEQ ID NO: 693468 - DNA, 13 bp, C. elegans
aatattcgattac

SEQ ID NO: 693469 - DNA, 13 bp, C. elegans
aatattcgattat

SEQ ID NO: 693470 - DNA, 13 bp, C. elegans
aatattcggaaaa

SEQ ID NO: 693471 - DNA, 13 bp, C. elegans
aatattcggattt

SEQ ID NO: 693472 - DNA, 13 bp, C. elegans
aatattctacaaa

SEQ ID NO: 693473 - DNA, 13 bp, C. elegans
aatattctatttc

SEQ ID NO: 693474 - DNA, 13 bp, C. elegans
aatattctcaaac

SEQ ID NO: 693475 - DNA, 13 bp, C. elegans
aatattctcaaat

SEQ ID NO: 693476 - DNA, 13 bp, C. elegans
aatattctcattt

SEQ ID NO: 693477 - DNA, 13 bp, C. elegans
aatattctgaatt

SEQ ID NO: 693478 - DNA, 13 bp, C. elegans
aatattctgtttt

SEQ ID NO: 693479 - DNA, 13 bp, C. elegans
aatattcttgaga

SEQ ID NO: 693480 - DNA, 13 bp, C. elegans
aatattcttgttt

SEQ ID NO: 693481 - DNA, 13 bp, C. elegans
aatattcttttca

SEQ ID NO: 693482 - DNA, 13 bp, C. elegans
aatattgaaaaac

SEQ ID NO: 693483 - DNA, 13 bp, C. elegans
aatattgaaaatc

SEQ ID NO: 693484 - DNA, 13 bp, C. elegans
aatattgaaatct

SEQ ID NO: 693485 - DNA, 13 bp, C. elegans
aatattgaaattc

SEQ ID NO: 693486 - DNA, 13 bp, C. elegans
aatattgaacatt

SEQ ID NO: 693487 - DNA, 13 bp, C. elegans
aatattgaacttt

SEQ ID NO: 693488 - DNA, 13 bp, C. elegans
aatattgaatgtt

SEQ ID NO: 693489 - DNA, 13 bp, C. elegans
aatattgacaaaa

SEQ ID NO: 693490 - DNA, 13 bp, C. elegans
aatattgatgttt

SEQ ID NO: 693491 - DNA, 13 bp, C. elegans
aatattgattcaa

SEQ ID NO: 693492 - DNA, 13 bp, C. elegans
aatattgcaaaat

SEQ ID NO: 693493 - DNA, 13 bp, C. elegans
aatattgcaaata

SEQ ID NO: 693494 - DNA, 13 bp, C. elegans
aatattgcaaatt

SEQ ID NO: 693495 - DNA, 13 bp, C. elegans
aatattgcaatta

SEQ ID NO: 693496 - DNA, 13 bp, C. elegans
aatattgctcaat

SEQ ID NO: 693497 - DNA, 13 bp, C. elegans
aatattgctcatt

SEQ ID NO: 693498 - DNA, 13 bp, C. elegans
aatattgctgaaa

SEQ ID NO: 693499 - DNA, 13 bp, C. elegans
aatattggaaaac

SEQ ID NO: 693500 - DNA, 13 bp, C. elegans
aatattggaaaat

SEQ ID NO: 693501 - DNA, 13 bp, C. elegans
aatattggaaata

SEQ ID NO: 693502 - DNA, 13 bp, C. elegans
aatattggaattt

SEQ ID NO: 693503 - DNA, 13 bp, C. elegans
aatattggagaaa

SEQ ID NO: 693504 - DNA, 13 bp, C. elegans
aatattgggaatt

SEQ ID NO: 693505 - DNA, 13 bp, C. elegans
aatattgggtgaa

SEQ ID NO: 693506 - DNA, 13 bp, C. elegans
aatattgtcaatt

SEQ ID NO: 693507 - DNA, 13 bp, C. elegans
aatattgtgcaaa

SEQ ID NO: 693508 - DNA, 13 bp, C. elegans
aatattgtggaaa

SEQ ID NO: 693509 - DNA, 13 bp, C. elegans
aatattgttcatt

SEQ ID NO: 693510 - DNA, 13 bp, C. elegans
aatattgttcttt

SEQ ID NO: 693511 - DNA, 13 bp, C. elegans
aatattgttgaga

SEQ ID NO: 693512 - DNA, 13 bp, C. elegans
aatattgttggta

SEQ ID NO: 693513 - DNA, 13 bp, C. elegans
aatattgtttgaa

SEQ ID NO: 693514 - DNA, 13 bp, C. elegans
aatattgttttac

SEQ ID NO: 693515 - DNA, 13 bp, C. elegans
aatattgttttca

SEQ ID NO: 693516 - DNA, 13 bp, C. elegans
aatattgttttct

SEQ ID NO: 693517 - DNA, 13 bp, C. elegans
aatatttaccaat

SEQ ID NO: 693518 - DNA, 13 bp, C. elegans
aatatttactttc

SEQ ID NO: 693519 - DNA, 13 bp, C. elegans
aatatttagcttt

SEQ ID NO: 693520 - DNA, 13 bp, C. elegans
aatatttatctca

SEQ ID NO: 693521 - DNA, 13 bp, C. elegans
aatatttatgttg

SEQ ID NO: 693522 - DNA, 13 bp, C. elegans
aatatttattcag

SEQ ID NO: 693523 - DNA, 13 bp, C. elegans
aatatttattcca

SEQ ID NO: 693524 - DNA, 13 bp, C. elegans
aatatttattgca

SEQ ID NO: 693525 - DNA, 13 bp, C. elegans
aatatttatttgg

SEQ ID NO: 693526 - DNA, 13 bp, C. elegans
aatatttcaactg

SEQ ID NO: 693527 - DNA, 13 bp, C. elegans
aatatttcaagaa

SEQ ID NO: 693528 - DNA, 13 bp, C. elegans
aatatttcaagta

SEQ ID NO: 693529 - DNA, 13 bp, C. elegans
aatatttcaagtt

SEQ ID NO: 693530 - DNA, 13 bp, C. elegans
aatatttcaattc

SEQ ID NO: 693531 - DNA, 13 bp, C. elegans
aatatttcacaac

SEQ ID NO: 693532 - DNA, 13 bp, C. elegans
aatatttcagata

SEQ ID NO: 693533 - DNA, 13 bp, C. elegans
aatatttcagttt

SEQ ID NO: 693534 - DNA, 13 bp, C. elegans
aatatttcatcaa

SEQ ID NO: 693535 - DNA, 13 bp, C. elegans
aatatttcatgaa

SEQ ID NO: 693536 - DNA, 13 bp, C. elegans
aatatttcatgtt

SEQ ID NO: 693537 - DNA, 13 bp, C. elegans
aatatttccaaat

SEQ ID NO: 693538 - DNA, 13 bp, C. elegans
aatatttccaatt

SEQ ID NO: 693539 - DNA, 13 bp, C. elegans
aatatttccagaa

SEQ ID NO: 693540 - DNA, 13 bp, C. elegans
aatatttccggaa

SEQ ID NO: 693541 - DNA, 13 bp, C. elegans
aatatttcctatt

SEQ ID NO: 693542 - DNA, 13 bp, C. elegans
aatatttctgaaa

SEQ ID NO: 693543 - DNA, 13 bp, C. elegans
aatatttctgttt

SEQ ID NO: 693544 - DNA, 13 bp, C. elegans
aatatttcttccc

SEQ ID NO: 693545 - DNA, 13 bp, C. elegans
aatatttgaaaag

SEQ ID NO: 693546 - DNA, 13 bp, C. elegans
aatatttgaaacc

SEQ ID NO: 693547 - DNA, 13 bp, C. elegans
aatatttgaaagt

SEQ ID NO: 693548 - DNA, 13 bp, C. elegans
aatatttgaaatc

SEQ ID NO: 693549 - DNA, 13 bp, C. elegans
aatatttgaagaa

SEQ ID NO: 693550 - DNA, 13 bp, C. elegans
aatatttgaattc

SEQ ID NO: 693551 - DNA, 13 bp, C. elegans
aatatttgacagc

SEQ ID NO: 693552 - DNA, 13 bp, C. elegans
aatatttgacatt

SEQ ID NO: 693553 - DNA, 13 bp, C. elegans
aatatttgagaaa

SEQ ID NO: 693554 - DNA, 13 bp, C. elegans
aatatttgagatg

SEQ ID NO: 693555 - DNA, 13 bp, C. elegans
aatatttgagatt

SEQ ID NO: 693556 - DNA, 13 bp, C. elegans
aatatttgaggtg

SEQ ID NO: 693557 - DNA, 13 bp, C. elegans
aatatttgcaaat

SEQ ID NO: 693558 - DNA, 13 bp, C. elegans
aatatttgcaatt

SEQ ID NO: 693559 - DNA, 13 bp, C. elegans
aatatttgcttta

SEQ ID NO: 693560 - DNA, 13 bp, C. elegans
aatatttggaaat

SEQ ID NO: 693561 - DNA, 13 bp, C. elegans
aatatttggaaca

SEQ ID NO: 693562 - DNA, 13 bp, C. elegans
aatatttggattt

SEQ ID NO: 693563 - DNA, 13 bp, C. elegans
aatatttggcaat

SEQ ID NO: 693564 - DNA, 13 bp, C. elegans
aatatttggtaaa

SEQ ID NO: 693565 - DNA, 13 bp, C. elegans
aatatttggtgaa

SEQ ID NO: 693566 - DNA, 13 bp, C. elegans
aatatttgtatca

SEQ ID NO: 693567 - DNA, 13 bp, C. elegans
aatatttgtatgt

SEQ ID NO: 693568 - DNA, 13 bp, C. elegans
aatatttgtcttt

SEQ ID NO: 693569 - DNA, 13 bp, C. elegans
aatatttgtgata

SEQ ID NO: 693570 - DNA, 13 bp, C. elegans
aatatttgttgta

SEQ ID NO: 693571 - DNA, 13 bp, C. elegans
aatatttgttttc

SEQ ID NO: 693572 - DNA, 13 bp, C. elegans
aatattttacaca

SEQ ID NO: 693573 - DNA, 13 bp, C. elegans
aatattttcagaa

SEQ ID NO: 693574 - DNA, 13 bp, C. elegans
aatattttcagtt

SEQ ID NO: 693575 - DNA, 14 bp, C. elegans
aatattttccaaaa

SEQ ID NO: 693576 - DNA, 13 bp, C. elegans
aatattttcccca

SEQ ID NO: 693577 - DNA, 13 bp, C. elegans
aatattttccttc

SEQ ID NO: 693578 - DNA, 13 bp, C. elegans
aatattttcgaca

SEQ ID NO: 693579 - DNA, 13 bp, C. elegans
aatattttctatg

SEQ ID NO: 693580 - DNA, 13 bp, C. elegans
aatattttctgat

SEQ ID NO: 693581 - DNA, 13 bp, C. elegans
aatattttctgta

SEQ ID NO: 693582 - DNA, 13 bp, C. elegans
aatattttcttgg

SEQ ID NO: 693583 - DNA, 13 bp, C. elegans
aatattttctttg

SEQ ID NO: 693584 - DNA, 13 bp, C. elegans
aatattttgaatg

SEQ ID NO: 693585 - DNA, 13 bp, C. elegans
aatattttgacgg

SEQ ID NO: 693586 - DNA, 13 bp, C. elegans
aatattttgagat

SEQ ID NO: 693587 - DNA, 13 bp, C. elegans
aatattttgaggt

SEQ ID NO: 693588 - DNA, 13 bp, C. elegans
aatattttgatac

SEQ ID NO: 693589 - DNA, 13 bp, C. elegans
aatattttgcaaa

SEQ ID NO: 693590 - DNA, 13 bp, C. elegans
aatattttgcaca

SEQ ID NO: 693591 - DNA, 13 bp, C. elegans
aatattttggaat

SEQ ID NO: 693592 - DNA, 13 bp, C. elegans
aatattttggagt

SEQ ID NO: 693593 - DNA, 13 bp, C. elegans
aatattttggcaa

SEQ ID NO: 693594 - DNA, 13 bp, C. elegans
aatattttgtaag

SEQ ID NO: 693595 - DNA, 13 bp, C. elegans
aatattttgtcaa

SEQ ID NO: 693596 - DNA, 13 bp, C. elegans
aatattttgttct

SEQ ID NO: 693597 - DNA, 13 bp, C. elegans
aatattttgtttc

SEQ ID NO: 693598 - DNA, 13 bp, C. elegans
aatatttttcaca

SEQ ID NO: 693599 - DNA, 13 bp, C. elegans
aatatttttcgaa

SEQ ID NO: 693600 - DNA, 13 bp, C. elegans
aatatttttctac

SEQ ID NO: 693601 - DNA, 13 bp, C. elegans
aatatttttcttg

SEQ ID NO: 693602 - DNA, 13 bp, C. elegans
aatatttttgcaa

SEQ ID NO: 693603 - DNA, 13 bp, C. elegans
aatatttttgcat

SEQ ID NO: 693604 - DNA, 13 bp, C. elegans
aatatttttggag

SEQ ID NO: 693605 - DNA, 13 bp, C. elegans
aatatttttgtca

SEQ ID NO: 693606 - DNA, 13 bp, C. elegans
aatatttttgttc

SEQ ID NO: 693607 - DNA, 13 bp, C. elegans
aatattttttacc

SEQ ID NO: 693608 - DNA, 13 bp, C. elegans
aatattttttcac

SEQ ID NO: 693609 - DNA, 13 bp, C. elegans
aatattttttgca

SEQ ID NO: 693610 - DNA, 13 bp, C. elegans
aatattttttgtc

SEQ ID NO: 693611 - DNA, 13 bp, C. elegans
aatcaaaaaactg

SEQ ID NO: 693612 - DNA, 13 bp, C. elegans
aatcaaaaaatgg

SEQ ID NO: 693613 - DNA, 13 bp, C. elegans
aatcaaaaaccga

SEQ ID NO: 693614 - DNA, 13 bp, C. elegans
aatcaaaaacgct

SEQ ID NO: 693615 - DNA, 13 bp, C. elegans
aatcaaaaagatt

SEQ ID NO: 693616 - DNA, 13 bp, C. elegans
aatcaaaaagtct

SEQ ID NO: 693617 - DNA, 13 bp, C. elegans
aatcaaaaatctt

SEQ ID NO: 693618 - DNA, 13 bp, C. elegans
aatcaaaaatgtt

SEQ ID NO: 693619 - DNA, 13 bp, C. elegans
aatcaaaaattcc

SEQ ID NO: 693620 - DNA, 13 bp, C. elegans
aatcaaaaattct

SEQ ID NO: 693621 - DNA, 13 bp, C. elegans
aatcaaaaattga

SEQ ID NO: 693622 - DNA, 13 bp, C. elegans
aatcaaaaattgt

SEQ ID NO: 693623 - DNA, 13 bp, C. elegans
aatcaaaacattt

SEQ ID NO: 693624 - DNA, 13 bp, C. elegans
aatcaaaactcac

SEQ ID NO: 693625 - DNA, 13 bp, C. elegans
aatcaaaactgaa

SEQ ID NO: 693626 - DNA, 13 bp, C. elegans
aatcaaaacttta

SEQ ID NO: 693627 - DNA, 13 bp, C. elegans
aatcaaaagttca

SEQ ID NO: 693628 - DNA, 13 bp, C. elegans
aatcaaaagttct

SEQ ID NO: 693629 - DNA, 13 bp, C. elegans
aatcaaaagttta

SEQ ID NO: 693630 - DNA, 13 bp, C. elegans
aatcaaaagtttg

SEQ ID NO: 693631 - DNA, 13 bp, C. elegans
aatcaaaagtttt

SEQ ID NO: 693632 - DNA, 13 bp, C. elegans
aatcaaaatactt

SEQ ID NO: 693633 - DNA, 13 bp, C. elegans
aatcaaaatatct

SEQ ID NO: 693634 - DNA, 13 bp, C. elegans
aatcaaaatattc

SEQ ID NO: 693635 - DNA, 13 bp, C. elegans
aatcaaaatcgaa

SEQ ID NO: 693636 - DNA, 13 bp, C. elegans
aatcaaaatgtgt

SEQ ID NO: 693637 - DNA, 13 bp, C. elegans
aatcaaaatgttc

SEQ ID NO: 693638 - DNA, 13 bp, C. elegans
aatcaaaattcat

SEQ ID NO: 693639 - DNA, 13 bp, C. elegans
aatcaaaattgaa

SEQ ID NO: 693640 - DNA, 13 bp, C. elegans
aatcaaaattggc

SEQ ID NO: 693641 - DNA, 13 bp, C. elegans
aatcaaaattttg

SEQ ID NO: 693642 - DNA, 13 bp, C. elegans
aatcaaacaagtt

SEQ ID NO: 693643 - DNA, 13 bp, C. elegans
aatcaaacagttt

SEQ ID NO: 693644 - DNA, 13 bp, C. elegans
aatcaaactgaaa

SEQ ID NO: 693645 - DNA, 13 bp, C. elegans
aatcaaactttca

SEQ ID NO: 693646 - DNA, 13 bp, C. elegans
aatcaaagaccac

SEQ ID NO: 693647 - DNA, 13 bp, C. elegans
aatcaaagttcaa

SEQ ID NO: 693648 - DNA, 13 bp, C. elegans
aatcaaagttttt

SEQ ID NO: 693649 - DNA, 13 bp, C. elegans
aatcaaatacttt

SEQ ID NO: 693650 - DNA, 13 bp, C. elegans
aatcaaatagttt

SEQ ID NO: 693651 - DNA, 13 bp, C. elegans
aatcaaatcaatc

SEQ ID NO: 693652 - DNA, 13 bp, C. elegans
aatcaaatcagaa

SEQ ID NO: 693653 - DNA, 13 bp, C. elegans
aatcaaatcgaaa

SEQ ID NO: 693654 - DNA, 13 bp, C. elegans
aatcaaatgagat

SEQ ID NO: 693655 - DNA, 13 bp, C. elegans
aatcaaatggagt

SEQ ID NO: 693656 - DNA, 13 bp, C. elegans
aatcaaatgtgaa

SEQ ID NO: 693657 - DNA, 13 bp, C. elegans
aatcaaatgtttt

SEQ ID NO: 693658 - DNA, 13 bp, C. elegans
aatcaaattcaag

SEQ ID NO: 693659 - DNA, 13 bp, C. elegans
aatcaaattgaaa

SEQ ID NO: 693660 - DNA, 13 bp, C. elegans
aatcaaattgtca

SEQ ID NO: 693661 - DNA, 13 bp, C. elegans
aatcaaattgttt

SEQ ID NO: 693662 - DNA, 13 bp, C. elegans
aatcaaatttcaa

SEQ ID NO: 693663 - DNA, 13 bp, C. elegans
aatcaaatttcta

SEQ ID NO: 693664 - DNA, 13 bp, C. elegans
aatcaaattttca

SEQ ID NO: 693665 - DNA, 13 bp, C. elegans
aatcaaatttttg

SEQ ID NO: 693666 - DNA, 13 bp, C. elegans
aatcaacaaaatg

SEQ ID NO: 693667 - DNA, 13 bp, C. elegans
aatcaacaaattg

SEQ ID NO: 693668 - DNA, 13 bp, C. elegans
aatcaacaattga

SEQ ID NO: 693669 - DNA, 13 bp, C. elegans
aatcaacaatttt

SEQ ID NO: 693670 - DNA, 13 bp, C. elegans
aatcaacatattt

SEQ ID NO: 693671 - DNA, 13 bp, C. elegans
aatcaacatgaaa

SEQ ID NO: 693672 - DNA, 13 bp, C. elegans
aatcaacattcgt

SEQ ID NO: 693673 - DNA, 13 bp, C. elegans
aatcaacattttt

SEQ ID NO: 693674 - DNA, 13 bp, C. elegans
aatcaacgaaatt

SEQ ID NO: 693675 - DNA, 13 bp, C. elegans
aatcaacgaataa

SEQ ID NO: 693676 - DNA, 13 bp, C. elegans
aatcaacgaattt

SEQ ID NO: 693677 - DNA, 13 bp, C. elegans
aatcaacgagaaa

SEQ ID NO: 693678 - DNA, 13 bp, C. elegans
aatcaacggaaaa

SEQ ID NO: 693679 - DNA, 13 bp, C. elegans
aatcaactgaaaa

SEQ ID NO: 693680 - DNA, 13 bp, C. elegans
aatcaactgaaat

SEQ ID NO: 693681 - DNA, 13 bp, C. elegans
aatcaactgtttc

SEQ ID NO: 693682 - DNA, 13 bp, C. elegans
aatcaactttaaa

SEQ ID NO: 693683 - DNA, 13 bp, C. elegans
aatcaactttcag

SEQ ID NO: 693684 - DNA, 13 bp, C. elegans
aatcaagaaaact

SEQ ID NO: 693685 - DNA, 13 bp, C. elegans
aatcaagaaaatc

SEQ ID NO: 693686 - DNA, 13 bp, C. elegans
aatcaagaaaatg

SEQ ID NO: 693687 - DNA, 13 bp, C. elegans
aatcaagaaatca

SEQ ID NO: 693688 - DNA, 13 bp, C. elegans
aatcaagaaattt

SEQ ID NO: 693689 - DNA, 13 bp, C. elegans
aatcaagaagatt

SEQ ID NO: 693690 - DNA, 13 bp, C. elegans
aatcaagaatttc

SEQ ID NO: 693691 - DNA, 13 bp, C. elegans
aatcaagaatttg

SEQ ID NO: 693692 - DNA, 13 bp, C. elegans
aatcaagaatttt

SEQ ID NO: 693693 - DNA, 13 bp, C. elegans
aatcaagagaatc

SEQ ID NO: 693694 - DNA, 13 bp, C. elegans
aatcaaggaattt

SEQ ID NO: 693695 - DNA, 13 bp, C. elegans
aatcaagggaaaa

SEQ ID NO: 693696 - DNA, 13 bp, C. elegans
aatcaagttcaaa

SEQ ID NO: 693697 - DNA, 13 bp, C. elegans
aatcaagtttcaa

SEQ ID NO: 693698 - DNA, 13 bp, C. elegans
aatcaataatttg

SEQ ID NO: 693699 - DNA, 13 bp, C. elegans
aatcaatacaatt

SEQ ID NO: 693700 - DNA, 13 bp, C. elegans
aatcaatacttta

SEQ ID NO: 693701 - DNA, 13 bp, C. elegans
aatcaatagaaat

SEQ ID NO: 693702 - DNA, 13 bp, C. elegans
aatcaatagattt

SEQ ID NO: 693703 - DNA, 13 bp, C. elegans
aatcaatatttct

SEQ ID NO: 693704 - DNA, 13 bp, C. elegans
aatcaatatttga

SEQ ID NO: 693705 - DNA, 13 bp, C. elegans
aatcaatatttgt

SEQ ID NO: 693706 - DNA, 13 bp, C. elegans
aatcaatcaagaa

SEQ ID NO: 693707 - DNA, 13 bp, C. elegans
aatcaatcaatat

SEQ ID NO: 693708 - DNA, 13 bp, C. elegans
aatcaatcaattt

SEQ ID NO: 693709 - DNA, 13 bp, C. elegans
aatcaatcatttc

SEQ ID NO: 693710 - DNA, 13 bp, C. elegans
aatcaatcgattt

SEQ ID NO: 693711 - DNA, 13 bp, C. elegans
aatcaatgaaaat

SEQ ID NO: 693712 - DNA, 13 bp, C. elegans
aatcaatgaatta

SEQ ID NO: 693713 - DNA, 13 bp, C. elegans
aatcaatgaattt

SEQ ID NO: 693714 - DNA, 13 bp, C. elegans
aatcaatgggaaa

SEQ ID NO: 693715 - DNA, 13 bp, C. elegans
aatcaatgtttca

SEQ ID NO: 693716 - DNA, 13 bp, C. elegans
aatcaatgtttcc

SEQ ID NO: 693717 - DNA, 13 bp, C. elegans
aatcaatgtttta

SEQ ID NO: 693718 - DNA, 13 bp, C. elegans
aatcaattattca

SEQ ID NO: 693719 - DNA, 13 bp, C. elegans
aatcaattattcc

SEQ ID NO: 693720 - DNA, 13 bp, C. elegans
aatcaattcgaaa

SEQ ID NO: 693721 - DNA, 13 bp, C. elegans
aatcaattctaaa

SEQ ID NO: 693722 - DNA, 13 bp, C. elegans
aatcaattcttat

SEQ ID NO: 693723 - DNA, 13 bp, C. elegans
aatcaattggaaa

SEQ ID NO: 693724 - DNA, 13 bp, C. elegans
aatcaattgtttc

SEQ ID NO: 693725 - DNA, 13 bp, C. elegans
aatcaatttcaca

SEQ ID NO: 693726 - DNA, 13 bp, C. elegans
aatcaatttccga

SEQ ID NO: 693727 - DNA, 13 bp, C. elegans
aatcaatttgtca

SEQ ID NO: 693728 - DNA, 13 bp, C. elegans
aatcaatttgttt

SEQ ID NO: 693729 - DNA, 13 bp, C. elegans
aatcaattttatc

SEQ ID NO: 693730 - DNA, 13 bp, C. elegans
aatcaattttcag

SEQ ID NO: 693731 - DNA, 13 bp, C. elegans
aatcaattttcga

SEQ ID NO: 693732 - DNA, 13 bp, C. elegans
aatcaattttcta

SEQ ID NO: 693733 - DNA, 13 bp, C. elegans
aatcaattttctt

SEQ ID NO: 693734 - DNA, 13 bp, C. elegans
aatcaattttgta

SEQ ID NO: 693735 - DNA, 13 bp, C. elegans
aatcaattttgtg

SEQ ID NO: 693736 - DNA, 13 bp, C. elegans
aatcaatttttcg

SEQ ID NO: 693737 - DNA, 13 bp, C. elegans
aatcaatttttct

SEQ ID NO: 693738 - DNA, 13 bp, C. elegans
aatcaatttttga

SEQ ID NO: 693739 - DNA, 13 bp, C. elegans
aatcaatttttgc

SEQ ID NO: 693740 - DNA, 13 bp, C. elegans
aatcaattttttg

SEQ ID NO: 693741 - DNA, 13 bp, C. elegans
aatcacaaaaatg

SEQ ID NO: 693742 - DNA, 13 bp, C. elegans
aatcacaaaagtt

SEQ ID NO: 693743 - DNA, 13 bp, C. elegans
aatcacaaaattg

SEQ ID NO: 693744 - DNA, 13 bp, C. elegans
aatcacaaacttt

SEQ ID NO: 693745 - DNA, 13 bp, C. elegans
aatcacaaagttg

SEQ ID NO: 693746 - DNA, 13 bp, C. elegans
aatcacaagtttt

SEQ ID NO: 693747 - DNA, 13 bp, C. elegans
aatcacaattttg

SEQ ID NO: 693748 - DNA, 13 bp, C. elegans
aatcacataattt

SEQ ID NO: 693749 - DNA, 13 bp, C. elegans
aatcacatttcaa

SEQ ID NO: 693750 - DNA, 13 bp, C. elegans
aatcacatttttc

SEQ ID NO: 693751 - DNA, 18 bp, C. elegans
aatcaccccgccactttt

SEQ ID NO: 693752 - DNA, 13 bp, C. elegans
aatcaccggaaaa

SEQ ID NO: 693753 - DNA, 13 bp, C. elegans
aatcacgaatttc

SEQ ID NO: 693754 - DNA, 13 bp, C. elegans
aatcacggggttc

SEQ ID NO: 693755 - DNA, 13 bp, C. elegans
aatcactgaaaaa

SEQ ID NO: 693756 - DNA, 13 bp, C. elegans
aatcactgaaaat

SEQ ID NO: 693757 - DNA, 13 bp, C. elegans
aatcactgaaatt

SEQ ID NO: 693758 - DNA, 13 bp, C. elegans
aatcactgattct

SEQ ID NO: 693759 - DNA, 13 bp, C. elegans
aatcactgcaact

SEQ ID NO: 693760 - DNA, 13 bp, C. elegans
aatcactgctaat

SEQ ID NO: 693761 - DNA, 13 bp, C. elegans
aatcactgttttc

SEQ ID NO: 693762 - DNA, 13 bp, C. elegans
aatcacttcaaaa

SEQ ID NO: 693763 - DNA, 13 bp, C. elegans
aatcactttaatt

SEQ ID NO: 693764 - DNA, 13 bp, C. elegans
aatcacttttcaa

SEQ ID NO: 693765 - DNA, 13 bp, C. elegans
aatcactttttca

SEQ ID NO: 693766 - DNA, 13 bp, C. elegans
aatcactttttcc

SEQ ID NO: 693767 - DNA, 13 bp, C. elegans
aatcagaaaactt

SEQ ID NO: 693768 - DNA, 13 bp, C. elegans
aatcagaaaattg

SEQ ID NO: 693769 - DNA, 13 bp, C. elegans
aatcagaaactac

SEQ ID NO: 693770 - DNA, 13 bp, C. elegans
aatcagaaagttt

SEQ ID NO: 693771 - DNA, 13 bp, C. elegans
aatcagaaatgaa

SEQ ID NO: 693772 - DNA, 13 bp, C. elegans
aatcagaaattgt

SEQ ID NO: 693773 - DNA, 13 bp, C. elegans
aatcagaaatttc

SEQ ID NO: 693774 - DNA, 13 bp, C. elegans
aatcagaagaaat

SEQ ID NO: 693775 - DNA, 13 bp, C. elegans
aatcagaattgaa

SEQ ID NO: 693776 - DNA, 13 bp, C. elegans
aatcagaattttg

SEQ ID NO: 693777 - DNA, 13 bp, C. elegans
aatcagacatttt

SEQ ID NO: 693778 - DNA, 13 bp, C. elegans
aatcagatgaaat

SEQ ID NO: 693779 - DNA, 13 bp, C. elegans
aatcagattttta

SEQ ID NO: 693780 - DNA, 13 bp, C. elegans
aatcagcagaaaa

SEQ ID NO: 693781 - DNA, 13 bp, C. elegans
aatcagcatattt

SEQ ID NO: 693782 - DNA, 13 bp, C. elegans
aatcagcgattcg

SEQ ID NO: 693783 - DNA, 13 bp, C. elegans
aatcagcgatttg

SEQ ID NO: 693784 - DNA, 13 bp, C. elegans
aatcagcggaaaa

SEQ ID NO: 693785 - DNA, 13 bp, C. elegans
aatcaggaaaaac

SEQ ID NO: 693786 - DNA, 13 bp, C. elegans
aatcaggaaaaat

SEQ ID NO: 693787 - DNA, 13 bp, C. elegans
aatcaggtggttt

SEQ ID NO: 693788 - DNA, 13 bp, C. elegans
aatcaggtttctt

SEQ ID NO: 693789 - DNA, 13 bp, C. elegans
aatcagtacaaaa

SEQ ID NO: 693790 - DNA, 13 bp, C. elegans
aatcagtatattt

SEQ ID NO: 693791 - DNA, 13 bp, C. elegans
aatcagtgattcg

SEQ ID NO: 693792 - DNA, 13 bp, C. elegans
aatcagtggaaaa

SEQ ID NO: 693793 - DNA, 13 bp, C. elegans
aatcagttgaaaa

SEQ ID NO: 693794 - DNA, 13 bp, C. elegans
aatcagttgaaat

SEQ ID NO: 693795 - DNA, 13 bp, C. elegans
aatcagttgacaa

SEQ ID NO: 693796 - DNA, 13 bp, C. elegans
aatcagttgagat

SEQ ID NO: 693797 - DNA, 13 bp, C. elegans
aatcagtttagaa

SEQ ID NO: 693798 - DNA, 13 bp, C. elegans
aatcagtttcatt

SEQ ID NO: 693799 - DNA, 13 bp, C. elegans
aatcagtttgaaa

SEQ ID NO: 693800 - DNA, 13 bp, C. elegans
aatcagttttcac

SEQ ID NO: 693801 - DNA, 13 bp, C. elegans
aatcagttttgga

SEQ ID NO: 693802 - DNA, 13 bp, C. elegans
aatcagtttttaa

SEQ ID NO: 693803 - DNA, 13 bp, C. elegans
aatcagtttttat

SEQ ID NO: 693804 - DNA, 13 bp, C. elegans
aatcataaaactt

SEQ ID NO: 693805 - DNA, 13 bp, C. elegans
aatcataacttct

SEQ ID NO: 693806 - DNA, 13 bp, C. elegans
aatcataattgaa

SEQ ID NO: 693807 - DNA, 13 bp, C. elegans
aatcataatttct

SEQ ID NO: 693808 - DNA, 13 bp, C. elegans
aatcataattttg

SEQ ID NO: 693809 - DNA, 13 bp, C. elegans
aatcatacaaatt

SEQ ID NO: 693810 - DNA, 13 bp, C. elegans
aatcatacagtac

SEQ ID NO: 693811 - DNA, 13 bp, C. elegans
aatcatatgaagt

SEQ ID NO: 693812 - DNA, 13 bp, C. elegans
aatcatatggatt

SEQ ID NO: 693813 - DNA, 13 bp, C. elegans
aatcatattcaaa

SEQ ID NO: 693814 - DNA, 13 bp, C. elegans
aatcatattttct

SEQ ID NO: 693815 - DNA, 13 bp, C. elegans
aatcatcaaactt

SEQ ID NO: 693816 - DNA, 13 bp, C. elegans
aatcatcaagttt

SEQ ID NO: 693817 - DNA, 14 bp, C. elegans
aatcatcaatttct

SEQ ID NO: 693818 - DNA, 13 bp, C. elegans
aatcatcaatttt

SEQ ID NO: 693819 - DNA, 13 bp, C. elegans
aatcatcagaaaa

SEQ ID NO: 693820 - DNA, 13 bp, C. elegans
aatcatcataact

SEQ ID NO: 693821 - DNA, 13 bp, C. elegans
aatcatcatcaaa

SEQ ID NO: 693822 - DNA, 13 bp, C. elegans
aatcatcatcaat

SEQ ID NO: 693823 - DNA, 13 bp, C. elegans
aatcatcatcatt

SEQ ID NO: 693824 - DNA, 13 bp, C. elegans
aatcatccaaaat

SEQ ID NO: 693825 - DNA, 13 bp, C. elegans
aatcatccaattt

SEQ ID NO: 693826 - DNA, 13 bp, C. elegans
aatcatccgaata

SEQ ID NO: 693827 - DNA, 13 bp, C. elegans
aatcatcgaaatt

SEQ ID NO: 693828 - DNA, 13 bp, C. elegans
aatcatcgatttt

SEQ ID NO: 693829 - DNA, 13 bp, C. elegans
aatcatcggaatt

SEQ ID NO: 693830 - DNA, 13 bp, C. elegans
aatcatctggaaa

SEQ ID NO: 693831 - DNA, 13 bp, C. elegans
aatcatgaaaaat

SEQ ID NO: 693832 - DNA, 13 bp, C. elegans
aatcatgaaaatg

SEQ ID NO: 693833 - DNA, 13 bp, C. elegans
aatcatgaaaatt

SEQ ID NO: 693834 - DNA, 13 bp, C. elegans
aatcatgaaattt

SEQ ID NO: 693835 - DNA, 13 bp, C. elegans
aatcatgaagaaa

SEQ ID NO: 693836 - DNA, 13 bp, C. elegans
aatcatgcaaaat

SEQ ID NO: 693837 - DNA, 13 bp, C. elegans
aatcatggaaaaa

SEQ ID NO: 693838 - DNA, 13 bp, C. elegans
aatcatggaaaat

SEQ ID NO: 693839 - DNA, 13 bp, C. elegans
aatcatggaattt

SEQ ID NO: 693840 - DNA, 13 bp, C. elegans
aatcatggtgcat

SEQ ID NO: 693841 - DNA, 13 bp, C. elegans
aatcatgtaaaat

SEQ ID NO: 693842 - DNA, 13 bp, C. elegans
aatcatgttttta

SEQ ID NO: 693843 - DNA, 13 bp, C. elegans
aatcattaaaatc

SEQ ID NO: 693844 - DNA, 13 bp, C. elegans
aatcattaaattc

SEQ ID NO: 693845 - DNA, 13 bp, C. elegans
aatcattacctat

SEQ ID NO: 693846 - DNA, 13 bp, C. elegans
aatcattatgttt

SEQ ID NO: 693847 - DNA, 13 bp, C. elegans
aatcattatttct

SEQ ID NO: 693848 - DNA, 13 bp, C. elegans
aatcattattttc

SEQ ID NO: 693849 - DNA, 13 bp, C. elegans
aatcattcaaata

SEQ ID NO: 693850 - DNA, 13 bp, C. elegans
aatcattcaactt

SEQ ID NO: 693851 - DNA, 13 bp, C. elegans
aatcattcacaaa

SEQ ID NO: 693852 - DNA, 13 bp, C. elegans
aatcattctaaaa

SEQ ID NO: 693853 - DNA, 13 bp, C. elegans
aatcattgaaaaa

SEQ ID NO: 693854 - DNA, 13 bp, C. elegans
aatcattgaaaat

SEQ ID NO: 693855 - DNA, 13 bp, C. elegans
aatcattgaattt

SEQ ID NO: 693856 - DNA, 13 bp, C. elegans
aatcattgatttt

SEQ ID NO: 693857 - DNA, 13 bp, C. elegans
aatcattgcaaaa

SEQ ID NO: 693858 - DNA, 13 bp, C. elegans
aatcattggaaaa

SEQ ID NO: 693859 - DNA, 13 bp, C. elegans
aatcattgttttc

SEQ ID NO: 693860 - DNA, 13 bp, C. elegans
aatcatttatttc

SEQ ID NO: 693861 - DNA, 13 bp, C. elegans
aatcatttcaaaa

SEQ ID NO: 693862 - DNA, 13 bp, C. elegans
aatcatttcaatt

SEQ ID NO: 693863 - DNA, 13 bp, C. elegans
aatcatttcacaa

SEQ ID NO: 693864 - DNA, 13 bp, C. elegans
aatcatttcgaaa

SEQ ID NO: 693865 - DNA, 13 bp, C. elegans
aatcatttctcaa

SEQ ID NO: 693866 - DNA, 13 bp, C. elegans
aatcatttgaata

SEQ ID NO: 693867 - DNA, 13 bp, C. elegans
aatcatttgagtt

SEQ ID NO: 693868 - DNA, 13 bp, C. elegans
aatcattttatca

SEQ ID NO: 693869 - DNA, 13 bp, C. elegans
aatcattttattg

SEQ ID NO: 693870 - DNA, 14 bp, C. elegans
aatcattttcaaat

SEQ ID NO: 693871 - DNA, 13 bp, C. elegans
aatcattttcaga

SEQ ID NO: 693872 - DNA, 13 bp, C. elegans
aatcattttccaa

SEQ ID NO: 693873 - DNA, 13 bp, C. elegans
aatcattttccat

SEQ ID NO: 693874 - DNA, 13 bp, C. elegans
aatcattttctat

SEQ ID NO: 693875 - DNA, 14 bp, C. elegans
aatcattttctcat

SEQ ID NO: 693876 - DNA, 13 bp, C. elegans
aatcattttctga

SEQ ID NO: 693877 - DNA, 13 bp, C. elegans
aatcattttctgt

SEQ ID NO: 693878 - DNA, 13 bp, C. elegans
aatcattttgcaa

SEQ ID NO: 693879 - DNA, 13 bp, C. elegans
aatcattttggaa

SEQ ID NO: 693880 - DNA, 13 bp, C. elegans
aatcattttgtca

SEQ ID NO: 693881 - DNA, 13 bp, C. elegans
aatcatttttatg

SEQ ID NO: 693882 - DNA, 13 bp, C. elegans
aatcatttttcgt

SEQ ID NO: 693883 - DNA, 13 bp, C. elegans
aatcatttttctg

SEQ ID NO: 693884 - DNA, 13 bp, C. elegans
aatcatttttgaa

SEQ ID NO: 693885 - DNA, 13 bp, C. elegans
aatcatttttgtg

SEQ ID NO: 693886 - DNA, 13 bp, C. elegans
aatcattttttca

SEQ ID NO: 693887 - DNA, 13 bp, C. elegans
aatcattttttgt

SEQ ID NO: 693888 - DNA, 13 bp, C. elegans
aatccaaaaaagt

SEQ ID NO: 693889 - DNA, 13 bp, C. elegans
aatccaaaaactg

SEQ ID NO: 693890 - DNA, 13 bp, C. elegans
aatccaaaatctg

SEQ ID NO: 693891 - DNA, 13 bp, C. elegans
aatccaaaattat

SEQ ID NO: 693892 - DNA, 13 bp, C. elegans
aatccaaaatttt

SEQ ID NO: 693893 - DNA, 13 bp, C. elegans
aatccaaagcatt

SEQ ID NO: 693894 - DNA, 13 bp, C. elegans
aatccaaataatt

SEQ ID NO: 693895 - DNA, 13 bp, C. elegans
aatccaaatatca

SEQ ID NO: 693896 - DNA, 13 bp, C. elegans
aatccaaatctat

SEQ ID NO: 693897 - DNA, 13 bp, C. elegans
aatccaaatttca

SEQ ID NO: 693898 - DNA, 13 bp, C. elegans
aatccaaatttct

SEQ ID NO: 693899 - DNA, 13 bp, C. elegans
aatccaaatttta

SEQ ID NO: 693900 - DNA, 13 bp, C. elegans
aatccaaattttc

SEQ ID NO: 693901 - DNA, 13 bp, C. elegans
aatccaaattttt

SEQ ID NO: 693902 - DNA, 13 bp, C. elegans
aatccaaccagcc

SEQ ID NO: 693903 - DNA, 13 bp, C. elegans
aatccaagaaacc

SEQ ID NO: 693904 - DNA, 13 bp, C. elegans
aatccaatcgaaa

SEQ ID NO: 693905 - DNA, 13 bp, C. elegans
aatccaattattt

SEQ ID NO: 693906 - DNA, 13 bp, C. elegans
aatccaattcaga

SEQ ID NO: 693907 - DNA, 13 bp, C. elegans
aatccaatttctt

SEQ ID NO: 693908 - DNA, 13 bp, C. elegans
aatccaattttca

SEQ ID NO: 693909 - DNA, 13 bp, C. elegans
aatccaattttct

SEQ ID NO: 693910 - DNA, 13 bp, C. elegans
aatccaatttttc

SEQ ID NO: 693911 - DNA, 13 bp, C. elegans
aatccaatttttg

SEQ ID NO: 693912 - DNA, 13 bp, C. elegans
aatccacaaaatg

SEQ ID NO: 693913 - DNA, 13 bp, C. elegans
aatccacaatttt

SEQ ID NO: 693914 - DNA, 13 bp, C. elegans
aatccaccgaaga

SEQ ID NO: 693915 - DNA, 13 bp, C. elegans
aatccacgtggat

SEQ ID NO: 693916 - DNA, 13 bp, C. elegans
aatccactttttt

SEQ ID NO: 693917 - DNA, 13 bp, C. elegans
aatccagaaattg

SEQ ID NO: 693918 - DNA, 13 bp, C. elegans
aatccagtgcaac

SEQ ID NO: 693919 - DNA, 13 bp, C. elegans
aatccagttttct

SEQ ID NO: 693920 - DNA, 13 bp, C. elegans
aatccatcaaatt

SEQ ID NO: 693921 - DNA, 13 bp, C. elegans
aatccatcatatt

SEQ ID NO: 693922 - DNA, 13 bp, C. elegans
aatccatcatttt

SEQ ID NO: 693923 - DNA, 13 bp, C. elegans
aatccatctattt

SEQ ID NO: 693924 - DNA, 13 bp, C. elegans
aatccattgaaaa

SEQ ID NO: 693925 - DNA, 13 bp, C. elegans
aatccatttcaaa

SEQ ID NO: 693926 - DNA, 13 bp, C. elegans
aatccatttcgca

SEQ ID NO: 693927 - DNA, 13 bp, C. elegans
aatccattttcat

SEQ ID NO: 693928 - DNA, 13 bp, C. elegans
aatccatttttat

SEQ ID NO: 693929 - DNA, 13 bp, C. elegans
aatcccaattttc

SEQ ID NO: 693930 - DNA, 13 bp, C. elegans
aatcccacaaaat

SEQ ID NO: 693931 - DNA, 15 bp, C. elegans
aatcccactgagcca

SEQ ID NO: 693932 - DNA, 13 bp, C. elegans
aatcccatttttc

SEQ ID NO: 693933 - DNA, 13 bp, C. elegans
aatccccattttc

SEQ ID NO: 693934 - DNA, 13 bp, C. elegans
aatcccgaaaaat

SEQ ID NO: 693935 - DNA, 13 bp, C. elegans
aatccctaaaaat

SEQ ID NO: 693936 - DNA, 13 bp, C. elegans
aatcccttaaaaa

SEQ ID NO: 693937 - DNA, 13 bp, C. elegans
aatccgaaaatta

SEQ ID NO: 693938 - DNA, 13 bp, C. elegans
aatccgaaaattc

SEQ ID NO: 693939 - DNA, 13 bp, C. elegans
aatccgaaaattt

SEQ ID NO: 693940 - DNA, 13 bp, C. elegans
aatccgacaaaag

SEQ ID NO: 693941 - DNA, 13 bp, C. elegans
aatccggcaattc

SEQ ID NO: 693942 - DNA, 13 bp, C. elegans
aatcctaattttt

SEQ ID NO: 693943 - DNA, 13 bp, C. elegans
aatcctacttttt

SEQ ID NO: 693944 - DNA, 13 bp, C. elegans
aatcctaggccac

SEQ ID NO: 693945 - DNA, 13 bp, C. elegans
aatcctgaaaaaa

SEQ ID NO: 693946 - DNA, 13 bp, C. elegans
aatcctgaaaact

SEQ ID NO: 693947 - DNA, 13 bp, C. elegans
aatcctgaaatta

SEQ ID NO: 693948 - DNA, 13 bp, C. elegans
aatcctgattttt

SEQ ID NO: 693949 - DNA, 13 bp, C. elegans
aatcctggaaaaa

SEQ ID NO: 693950 - DNA, 13 bp, C. elegans
aatccttcaaaaa

SEQ ID NO: 693951 - DNA, 13 bp, C. elegans
aatccttccaaaa

SEQ ID NO: 693952 - DNA, 13 bp, C. elegans
aatcctttaaatg

SEQ ID NO: 693953 - DNA, 13 bp, C. elegans
aatcctttgaaaa

SEQ ID NO: 693954 - DNA, 13 bp, C. elegans
aatcctttttaaa

SEQ ID NO: 693955 - DNA, 13 bp, C. elegans
aatcgaaaaaacg

SEQ ID NO: 693956 - DNA, 13 bp, C. elegans
aatcgaaaaaatg

SEQ ID NO: 693957 - DNA, 13 bp, C. elegans
aatcgaaaaaatt

SEQ ID NO: 693958 - DNA, 13 bp, C. elegans
aatcgaaaaacat

SEQ ID NO: 693959 - DNA, 13 bp, C. elegans
aatcgaaaaacga

SEQ ID NO: 693960 - DNA, 13 bp, C. elegans
aatcgaaaaagtc

SEQ ID NO: 693961 - DNA, 13 bp, C. elegans
aatcgaaaaagtg

SEQ ID NO: 693962 - DNA, 13 bp, C. elegans
aatcgaaaaatct

SEQ ID NO: 693963 - DNA, 13 bp, C. elegans
aatcgaaaaatgt

SEQ ID NO: 693964 - DNA, 13 bp, C. elegans
aatcgaaaacttc

SEQ ID NO: 693965 - DNA, 13 bp, C. elegans
aatcgaaaatgaa

SEQ ID NO: 693966 - DNA, 13 bp, C. elegans
aatcgaaaatgtt

SEQ ID NO: 693967 - DNA, 14 bp, C. elegans
aatcgaaaatgttt

SEQ ID NO: 693968 - DNA, 13 bp, C. elegans
aatcgaaaattcc

SEQ ID NO: 693969 - DNA, 13 bp, C. elegans
aatcgaaaattcg

SEQ ID NO: 693970 - DNA, 13 bp, C. elegans
aatcgaaaattct

SEQ ID NO: 693971 - DNA, 13 bp, C. elegans
aatcgaaaattgg

SEQ ID NO: 693972 - DNA, 13 bp, C. elegans
aatcgaaaattgt

SEQ ID NO: 693973 - DNA, 13 bp, C. elegans
aatcgaaaattta

SEQ ID NO: 693974 - DNA, 13 bp, C. elegans
aatcgaaaatttc

SEQ ID NO: 693975 - DNA, 13 bp, C. elegans
aatcgaaaatttg

SEQ ID NO: 693976 - DNA, 13 bp, C. elegans
aatcgaaactttt

SEQ ID NO: 693977 - DNA, 13 bp, C. elegans
aatcgaaagttgt

SEQ ID NO: 693978 - DNA, 13 bp, C. elegans
aatcgaaatattc

SEQ ID NO: 693979 - DNA, 13 bp, C. elegans
aatcgaaatgaaa

SEQ ID NO: 693980 - DNA, 13 bp, C. elegans
aatcgaaattctc

SEQ ID NO: 693981 - DNA, 13 bp, C. elegans
aatcgaaatttct

SEQ ID NO: 693982 - DNA, 13 bp, C. elegans
aatcgaaatttta

SEQ ID NO: 693983 - DNA, 13 bp, C. elegans
aatcgaaattttc

SEQ ID NO: 693984 - DNA, 13 bp, C. elegans
aatcgaaattttg

SEQ ID NO: 693985 - DNA, 13 bp, C. elegans
aatcgaaattttt

SEQ ID NO: 693986 - DNA, 13 bp, C. elegans
aatcgaactgaaa

SEQ ID NO: 693987 - DNA, 13 bp, C. elegans
aatcgaagaaatt

SEQ ID NO: 693988 - DNA, 13 bp, C. elegans
aatcgaatcaaaa

SEQ ID NO: 693989 - DNA, 13 bp, C. elegans
aatcgaatgaaaa

SEQ ID NO: 693990 - DNA, 13 bp, C. elegans
aatcgaattatta

SEQ ID NO: 693991 - DNA, 13 bp, C. elegans
aatcgaattattt

SEQ ID NO: 693992 - DNA, 13 bp, C. elegans
aatcgaatttcaa

SEQ ID NO: 693993 - DNA, 13 bp, C. elegans
aatcgaattttct

SEQ ID NO: 693994 - DNA, 13 bp, C. elegans
aatcgaattttgg

SEQ ID NO: 693995 - DNA, 13 bp, C. elegans
aatcgaattttta

SEQ ID NO: 693996 - DNA, 13 bp, C. elegans
aatcgaatttttt

SEQ ID NO: 693997 - DNA, 13 bp, C. elegans
aatcgacaaaaac

SEQ ID NO: 693998 - DNA, 13 bp, C. elegans
aatcgacaaaatc

SEQ ID NO: 693999 - DNA, 13 bp, C. elegans
aatcgacaaactg

SEQ ID NO: 694000 - DNA, 13 bp, C. elegans
aatcgacaaattt

SEQ ID NO: 694001 - DNA, 13 bp, C. elegans
aatcgacaagttg

SEQ ID NO: 694002 - DNA, 13 bp, C. elegans
aatcgacaatttg

SEQ ID NO: 694003 - DNA, 13 bp, C. elegans
aatcgacacaaca

SEQ ID NO: 694004 - DNA, 13 bp, C. elegans
aatcgactgaaaa

SEQ ID NO: 694005 - DNA, 13 bp, C. elegans
aatcgagaaaaac

SEQ ID NO: 694006 - DNA, 13 bp, C. elegans
aatcgagaaaatt

SEQ ID NO: 694007 - DNA, 13 bp, C. elegans
aatcgagaaatta

SEQ ID NO: 694008 - DNA, 13 bp, C. elegans
aatcgagaaattt

SEQ ID NO: 694009 - DNA, 13 bp, C. elegans
aatcgagaatttt

SEQ ID NO: 694010 - DNA, 13 bp, C. elegans
aatcgagattttc

SEQ ID NO: 694011 - DNA, 13 bp, C. elegans
aatcgagtatttc

SEQ ID NO: 694012 - DNA, 13 bp, C. elegans
aatcgagtttttt

SEQ ID NO: 694013 - DNA, 13 bp, C. elegans
aatcgataaaacc

SEQ ID NO: 694014 - DNA, 14 bp, C. elegans
aatcgataaaaggc

SEQ ID NO: 694015 - DNA, 13 bp, C. elegans
aatcgataaaatg

SEQ ID NO: 694016 - DNA, 13 bp, C. elegans
aatcgataaataa

SEQ ID NO: 694017 - DNA, 13 bp, C. elegans
aatcgataaatat

SEQ ID NO: 694018 - DNA, 13 bp, C. elegans
aatcgataaatca

SEQ ID NO: 694019 - DNA, 13 bp, C. elegans
aatcgataaatcc

SEQ ID NO: 694020 - DNA, 13 bp, C. elegans
aatcgataaattg

SEQ ID NO: 694021 - DNA, 13 bp, C. elegans
aatcgataaattt

SEQ ID NO: 694022 - DNA, 13 bp, C. elegans
aatcgataataaa

SEQ ID NO: 694023 - DNA, 13 bp, C. elegans
aatcgataatcaa

SEQ ID NO: 694024 - DNA, 13 bp, C. elegans
aatcgataatcat

SEQ ID NO: 694025 - DNA, 13 bp, C. elegans
aatcgataattat

SEQ ID NO: 694026 - DNA, 13 bp, C. elegans
aatcgataattca

SEQ ID NO: 694027 - DNA, 13 bp, C. elegans
aatcgataattga

SEQ ID NO: 694028 - DNA, 13 bp, C. elegans
aatcgataattgt

SEQ ID NO: 694029 - DNA, 14 bp, C. elegans
aatcgataatttct

SEQ ID NO: 694030 - DNA, 13 bp, C. elegans
aatcgataatttg

SEQ ID NO: 694031 - DNA, 13 bp, C. elegans
aatcgatacaaat

SEQ ID NO: 694032 - DNA, 13 bp, C. elegans
aatcgatacacag

SEQ ID NO: 694033 - DNA, 13 bp, C. elegans
aatcgatagtttt

SEQ ID NO: 694034 - DNA, 13 bp, C. elegans
aatcgatatattt

SEQ ID NO: 694035 - DNA, 13 bp, C. elegans
aatcgatatttat

SEQ ID NO: 694036 - DNA, 13 bp, C. elegans
aatcgatatttcc

SEQ ID NO: 694037 - DNA, 13 bp, C. elegans
aatcgatatttct

SEQ ID NO: 694038 - DNA, 13 bp, C. elegans
aatcgatattttc

SEQ ID NO: 694039 - DNA, 13 bp, C. elegans
aatcgatgaaaaa

SEQ ID NO: 694040 - DNA, 13 bp, C. elegans
aatcgatggaaat

SEQ ID NO: 694041 - DNA, 13 bp, C. elegans
aatcgattatttt

SEQ ID NO: 694042 - DNA, 13 bp, C. elegans
aatcgattgtttt

SEQ ID NO: 694043 - DNA, 13 bp, C. elegans
aatcgatttaaaa

SEQ ID NO: 694044 - DNA, 13 bp, C. elegans
aatcgatttcaat

SEQ ID NO: 694045 - DNA, 13 bp, C. elegans
aatcgatttcgaa

SEQ ID NO: 694046 - DNA, 13 bp, C. elegans
aatcgattttaaa

SEQ ID NO: 694047 - DNA, 13 bp, C. elegans
aatcgattttatt

SEQ ID NO: 694048 - DNA, 13 bp, C. elegans
aatcgattttcgg

SEQ ID NO: 694049 - DNA, 13 bp, C. elegans
aatcgattttgcg

SEQ ID NO: 694050 - DNA, 13 bp, C. elegans
aatcgatttttaa

SEQ ID NO: 694051 - DNA, 13 bp, C. elegans
aatcgatttttac

SEQ ID NO: 694052 - DNA, 13 bp, C. elegans
aatcgatttttca

SEQ ID NO: 694053 - DNA, 13 bp, C. elegans
aatcgattttttc

SEQ ID NO: 694054 - DNA, 13 bp, C. elegans
aatcgcaattttc

SEQ ID NO: 694055 - DNA, 13 bp, C. elegans
aatcgcaattttt

SEQ ID NO: 694056 - DNA, 13 bp, C. elegans
aatcgcatttttc

SEQ ID NO: 694057 - DNA, 14 bp, C. elegans
aatcgcattttttt

SEQ ID NO: 694058 - DNA, 13 bp, C. elegans
aatcgccaaaaat

SEQ ID NO: 694059 - DNA, 13 bp, C. elegans
aatcgccaaaatt

SEQ ID NO: 694060 - DNA, 13 bp, C. elegans
aatcgccgaaatt

SEQ ID NO: 694061 - DNA, 13 bp, C. elegans
aatcgccgttttt

SEQ ID NO: 694062 - DNA, 13 bp, C. elegans
aatcgcgaatttt

SEQ ID NO: 694063 - DNA, 13 bp, C. elegans
aatcgcgattttc

SEQ ID NO: 694064 - DNA, 13 bp, C. elegans
aatcgctcaaaga

SEQ ID NO: 694065 - DNA, 13 bp, C. elegans
aatcgctgaaaaa

SEQ ID NO: 694066 - DNA, 13 bp, C. elegans
aatcgctgaaatt

SEQ ID NO: 694067 - DNA, 13 bp, C. elegans
aatcgctgattgg

SEQ ID NO: 694068 - DNA, 13 bp, C. elegans
aatcgctgatttt

SEQ ID NO: 694069 - DNA, 13 bp, C. elegans
aatcgcttttttc

SEQ ID NO: 694070 - DNA, 13 bp, C. elegans
aatcggaaaaagt

SEQ ID NO: 694071 - DNA, 13 bp, C. elegans
aatcggaaaacaa

SEQ ID NO: 694072 - DNA, 13 bp, C. elegans
aatcggaaaatcg

SEQ ID NO: 694073 - DNA, 13 bp, C. elegans
aatcggaaaattg

SEQ ID NO: 694074 - DNA, 13 bp, C. elegans
aatcggaaagaaa

SEQ ID NO: 694075 - DNA, 13 bp, C. elegans
aatcggaaatttc

SEQ ID NO: 694076 - DNA, 13 bp, C. elegans
aatcggaaatttt

SEQ ID NO: 694077 - DNA, 13 bp, C. elegans
aatcggaagaaaa

SEQ ID NO: 694078 - DNA, 13 bp, C. elegans
aatcggaagaaat

SEQ ID NO: 694079 - DNA, 13 bp, C. elegans
aatcggacaattt

SEQ ID NO: 694080 - DNA, 13 bp, C. elegans
aatcggagaaaaa

SEQ ID NO: 694081 - DNA, 13 bp, C. elegans
aatcggagaaatt

SEQ ID NO: 694082 - DNA, 13 bp, C. elegans
aatcggagaagaa

SEQ ID NO: 694083 - DNA, 13 bp, C. elegans
aatcggattttaa

SEQ ID NO: 694084 - DNA, 13 bp, C. elegans
aatcggcaagttt

SEQ ID NO: 694085 - DNA, 13 bp, C. elegans
aatcggcaatccg

SEQ ID NO: 694086 - DNA, 13 bp, C. elegans
aatcggcaattcc

SEQ ID NO: 694087 - DNA, 13 bp, C. elegans
aatcggcgaaatt

SEQ ID NO: 694088 - DNA, 13 bp, C. elegans
aatcgggaacttc

SEQ ID NO: 694089 - DNA, 13 bp, C. elegans
aatcgggaatttt

SEQ ID NO: 694090 - DNA, 13 bp, C. elegans
aatcgggtgtttt

SEQ ID NO: 694091 - DNA, 14 bp, C. elegans
aatcgggtttcctt

SEQ ID NO: 694092 - DNA, 13 bp, C. elegans
aatcggtaatttc

SEQ ID NO: 694093 - DNA, 13 bp, C. elegans
aatcggtactttt

SEQ ID NO: 694094 - DNA, 14 bp, C. elegans
aatcggtggaaaat

SEQ ID NO: 694095 - DNA, 13 bp, C. elegans
aatcggttgaaaa

SEQ ID NO: 694096 - DNA, 13 bp, C. elegans
aatcggttttttt

SEQ ID NO: 694097 - DNA, 13 bp, C. elegans
aatcgtaattttc

SEQ ID NO: 694098 - DNA, 13 bp, C. elegans
aatcgtattttca

SEQ ID NO: 694099 - DNA, 13 bp, C. elegans
aatcgtattttta

SEQ ID NO: 694100 - DNA, 13 bp, C. elegans
aatcgtcaaaaaa

SEQ ID NO: 694101 - DNA, 13 bp, C. elegans
aatcgtcaatttc

SEQ ID NO: 694102 - DNA, 13 bp, C. elegans
aatcgtcaatttt

SEQ ID NO: 694103 - DNA, 13 bp, C. elegans
aatcgtcattttt

SEQ ID NO: 694104 - DNA, 13 bp, C. elegans
aatcgtcgaaaaa

SEQ ID NO: 694105 - DNA, 13 bp, C. elegans
aatcgtcggaatt

SEQ ID NO: 694106 - DNA, 13 bp, C. elegans
aatcgtctggaaa

SEQ ID NO: 694107 - DNA, 13 bp, C. elegans
aatcgtctttttt

SEQ ID NO: 694108 - DNA, 13 bp, C. elegans
aatcgtgaaaatt

SEQ ID NO: 694109 - DNA, 13 bp, C. elegans
aatcgtgaaattt

SEQ ID NO: 694110 - DNA, 13 bp, C. elegans
aatcgtgattttc

SEQ ID NO: 694111 - DNA, 13 bp, C. elegans
aatcgtgttttta

SEQ ID NO: 694112 - DNA, 13 bp, C. elegans
aatcgtgtttttc

SEQ ID NO: 694113 - DNA, 13 bp, C. elegans
aatcgtgtttttt

SEQ ID NO: 694114 - DNA, 13 bp, C. elegans
aatcgttgatttt

SEQ ID NO: 694115 - DNA, 13 bp, C. elegans
aatcgtttaattt

SEQ ID NO: 694116 - DNA, 13 bp, C. elegans
aatcgtttctttt

SEQ ID NO: 694117 - DNA, 13 bp, C. elegans
aatcgttttacaa

SEQ ID NO: 694118 - DNA, 13 bp, C. elegans
aatcgttttccgc

SEQ ID NO: 694119 - DNA, 13 bp, C. elegans
aatcgttttctat

SEQ ID NO: 694120 - DNA, 13 bp, C. elegans
aatcgttttgaaa

SEQ ID NO: 694121 - DNA, 13 bp, C. elegans
aatcgtttttcta

SEQ ID NO: 694122 - DNA, 13 bp, C. elegans
aatctaaaaatgt

SEQ ID NO: 694123 - DNA, 13 bp, C. elegans
aatctaaaacttt

SEQ ID NO: 694124 - DNA, 13 bp, C. elegans
aatctaaaagttc

SEQ ID NO: 694125 - DNA, 13 bp, C. elegans
aatctaaaattga

SEQ ID NO: 694126 - DNA, 13 bp, C. elegans
aatctaaaatttc

SEQ ID NO: 694127 - DNA, 13 bp, C. elegans
aatctaaactttt

SEQ ID NO: 694128 - DNA, 13 bp, C. elegans
aatctaaatgaaa

SEQ ID NO: 694129 - DNA, 13 bp, C. elegans
aatctaaattgaa

SEQ ID NO: 694130 - DNA, 13 bp, C. elegans
aatctaatcaaat

SEQ ID NO: 694131 - DNA, 13 bp, C. elegans
aatctaatgaaaa

SEQ ID NO: 694132 - DNA, 13 bp, C. elegans
aatctaattgaaa

SEQ ID NO: 694133 - DNA, 13 bp, C. elegans
aatctaattttag

SEQ ID NO: 694134 - DNA, 13 bp, C. elegans
aatctaatttttc

SEQ ID NO: 694135 - DNA, 13 bp, C. elegans
aatctacaaatta

SEQ ID NO: 694136 - DNA, 13 bp, C. elegans
aatctacacaaat

SEQ ID NO: 694137 - DNA, 13 bp, C. elegans
aatctaccaaaat

SEQ ID NO: 694138 - DNA, 13 bp, C. elegans
aatctaccttttt

SEQ ID NO: 694139 - DNA, 13 bp, C. elegans
aatctactcaaaa

SEQ ID NO: 694140 - DNA, 13 bp, C. elegans
aatctactttttc

SEQ ID NO: 694141 - DNA, 37 bp, C. elegans
aatctactttttcaatcataactcggtcagttttcaa

SEQ ID NO: 694142 - DNA, 13 bp, C. elegans
aatctagaaaaca

SEQ ID NO: 694143 - DNA, 13 bp, C. elegans
aatctagaaatgt

SEQ ID NO: 694144 - DNA, 13 bp, C. elegans
aatctagaatcca

SEQ ID NO: 694145 - DNA, 13 bp, C. elegans
aatctagaatttt

SEQ ID NO: 694146 - DNA, 13 bp, C. elegans
aatctagatttct

SEQ ID NO: 694147 - DNA, 13 bp, C. elegans
aatctatcaattt

SEQ ID NO: 694148 - DNA, 13 bp, C. elegans
aatctatgaaaac

SEQ ID NO: 694149 - DNA, 13 bp, C. elegans
aatctattcaaaa

SEQ ID NO: 694150 - DNA, 13 bp, C. elegans
aatctattccaca

SEQ ID NO: 694151 - DNA, 13 bp, C. elegans
aatctattgtttt

SEQ ID NO: 694152 - DNA, 13 bp, C. elegans
aatctatttgaaa

SEQ ID NO: 694153 - DNA, 13 bp, C. elegans
aatctatttttca

SEQ ID NO: 694154 - DNA, 13 bp, C. elegans
aatctatttttcc

SEQ ID NO: 694155 - DNA, 13 bp, C. elegans
aatctatttttga

SEQ ID NO: 694156 - DNA, 13 bp, C. elegans
aatctcaaaaaag

SEQ ID NO: 694157 - DNA, 13 bp, C. elegans
aatctcaaaaatt

SEQ ID NO: 694158 - DNA, 13 bp, C. elegans
aatctcaaaactt

SEQ ID NO: 694159 - DNA, 13 bp, C. elegans
aatctcaaaagaa

SEQ ID NO: 694160 - DNA, 13 bp, C. elegans
aatctcaaaagtt

SEQ ID NO: 694161 - DNA, 13 bp, C. elegans
aatctcaaaattc

SEQ ID NO: 694162 - DNA, 13 bp, C. elegans
aatctcaaaattt

SEQ ID NO: 694163 - DNA, 13 bp, C. elegans
aatctcaaacttt

SEQ ID NO: 694164 - DNA, 13 bp, C. elegans
aatctcaaagttt

SEQ ID NO: 694165 - DNA, 13 bp, C. elegans
aatctcaaatatt

SEQ ID NO: 694166 - DNA, 13 bp, C. elegans
aatctcaaatcac

SEQ ID NO: 694167 - DNA, 13 bp, C. elegans
aatctcaaattct

SEQ ID NO: 694168 - DNA, 13 bp, C. elegans
aatctcaagaaat

SEQ ID NO: 694169 - DNA, 13 bp, C. elegans
aatctcaagattt

SEQ ID NO: 694170 - DNA, 13 bp, C. elegans
aatctcaatattt

SEQ ID NO: 694171 - DNA, 13 bp, C. elegans
aatctcaatcttc

SEQ ID NO: 694172 - DNA, 13 bp, C. elegans
aatctcaatttcc

SEQ ID NO: 694173 - DNA, 13 bp, C. elegans
aatctcaattttg

SEQ ID NO: 694174 - DNA, 13 bp, C. elegans
aatctcaattttt

SEQ ID NO: 694175 - DNA, 13 bp, C. elegans
aatctcacaaaat

SEQ ID NO: 694176 - DNA, 13 bp, C. elegans
aatctcacttttt

SEQ ID NO: 694177 - DNA, 13 bp, C. elegans
aatctcagaaaat

SEQ ID NO: 694178 - DNA, 13 bp, C. elegans
aatctcagaaatt

SEQ ID NO: 694179 - DNA, 13 bp, C. elegans
aatctcagtttta

SEQ ID NO: 694180 - DNA, 13 bp, C. elegans
aatctcatcaatt

SEQ ID NO: 694181 - DNA, 13 bp, C. elegans
aatctcattattt

SEQ ID NO: 694182 - DNA, 13 bp, C. elegans
aatctcatttaat

SEQ ID NO: 694183 - DNA, 13 bp, C. elegans
aatctcattttat

SEQ ID NO: 694184 - DNA, 13 bp, C. elegans
aatctcatttttc

SEQ ID NO: 694185 - DNA, 13 bp, C. elegans
aatctccaaaaac

SEQ ID NO: 694186 - DNA, 13 bp, C. elegans
aatctccaacttt

SEQ ID NO: 694187 - DNA, 13 bp, C. elegans
aatctccattttc

SEQ ID NO: 694188 - DNA, 13 bp, C. elegans
aatctcgaaaaat

SEQ ID NO: 694189 - DNA, 13 bp, C. elegans
aatctcgaaaatg

SEQ ID NO: 694190 - DNA, 13 bp, C. elegans
aatctcgaaattt

SEQ ID NO: 694191 - DNA, 13 bp, C. elegans
aatctcgaatttt

SEQ ID NO: 694192 - DNA, 13 bp, C. elegans
aatctcgagaaaa

SEQ ID NO: 694193 - DNA, 13 bp, C. elegans
aatctcgattttc

SEQ ID NO: 694194 - DNA, 13 bp, C. elegans
aatctcgattttt

SEQ ID NO: 694195 - DNA, 13 bp, C. elegans
aatctcgtttttt

SEQ ID NO: 694196 - DNA, 13 bp, C. elegans
aatctctattttc

SEQ ID NO: 694197 - DNA, 13 bp, C. elegans
aatctctcatttt

SEQ ID NO: 694198 - DNA, 13 bp, C. elegans
aatctctccgacc

SEQ ID NO: 694199 - DNA, 13 bp, C. elegans
aatctcttcaaaa

SEQ ID NO: 694200 - DNA, 13 bp, C. elegans
aatctgaaaaaat

SEQ ID NO: 694201 - DNA, 13 bp, C. elegans
aatctgaaaaaca

SEQ ID NO: 694202 - DNA, 13 bp, C. elegans
aatctgaaaaatc

SEQ ID NO: 694203 - DNA, 13 bp, C. elegans
aatctgaaaaatg

SEQ ID NO: 694204 - DNA, 13 bp, C. elegans
aatctgaaaagtt

SEQ ID NO: 694205 - DNA, 13 bp, C. elegans
aatctgaaaatat

SEQ ID NO: 694206 - DNA, 13 bp, C. elegans
aatctgaaaatcg

SEQ ID NO: 694207 - DNA, 13 bp, C. elegans
aatctgaaaatga

SEQ ID NO: 694208 - DNA, 13 bp, C. elegans
aatctgaaaatgt

SEQ ID NO: 694209 - DNA, 13 bp, C. elegans
aatctgaaacaaa

SEQ ID NO: 694210 - DNA, 13 bp, C. elegans
aatctgaaacaat

SEQ ID NO: 694211 - DNA, 13 bp, C. elegans
aatctgaaagaaa

SEQ ID NO: 694212 - DNA, 13 bp, C. elegans
aatctgaaagctc

SEQ ID NO: 694213 - DNA, 13 bp, C. elegans
aatctgaaagttt

SEQ ID NO: 694214 - DNA, 13 bp, C. elegans
aatctgaaattaa

SEQ ID NO: 694215 - DNA, 13 bp, C. elegans
aatctgaaattct

SEQ ID NO: 694216 - DNA, 13 bp, C. elegans
aatctgaaattgc

SEQ ID NO: 694217 - DNA, 13 bp, C. elegans
aatctgaaatttc

SEQ ID NO: 694218 - DNA, 13 bp, C. elegans
aatctgaataaat

SEQ ID NO: 694219 - DNA, 13 bp, C. elegans
aatctgaatattt

SEQ ID NO: 694220 - DNA, 13 bp, C. elegans
aatctgaatttat

SEQ ID NO: 694221 - DNA, 13 bp, C. elegans
aatctgaatttta

SEQ ID NO: 694222 - DNA, 13 bp, C. elegans
aatctgaattttc

SEQ ID NO: 694223 - DNA, 13 bp, C. elegans
aatctgacatttt

SEQ ID NO: 694224 - DNA, 13 bp, C. elegans
aatctgactgaaa

SEQ ID NO: 694225 - DNA, 13 bp, C. elegans
aatctgagatcaa

SEQ ID NO: 694226 - DNA, 13 bp, C. elegans
aatctgataaatt

SEQ ID NO: 694227 - DNA, 13 bp, C. elegans
aatctgataattt

SEQ ID NO: 694228 - DNA, 14 bp, C. elegans
aatctgatttttta

SEQ ID NO: 694229 - DNA, 13 bp, C. elegans
aatctgcaaaaat

SEQ ID NO: 694230 - DNA, 13 bp, C. elegans
aatctgcaaaact

SEQ ID NO: 694231 - DNA, 13 bp, C. elegans
aatctgcactttt

SEQ ID NO: 694232 - DNA, 13 bp, C. elegans
aatctgccgaaaa

SEQ ID NO: 694233 - DNA, 13 bp, C. elegans
aatctggaaaaag

SEQ ID NO: 694234 - DNA, 13 bp, C. elegans
aatctggaaaaca

SEQ ID NO: 694235 - DNA, 13 bp, C. elegans
aatctggaaaagt

SEQ ID NO: 694236 - DNA, 13 bp, C. elegans
aatctggaaaata

SEQ ID NO: 694237 - DNA, 13 bp, C. elegans
aatctggaaaatt

SEQ ID NO: 694238 - DNA, 13 bp, C. elegans
aatctggaaatct

SEQ ID NO: 694239 - DNA, 13 bp, C. elegans
aatctggaaatga

SEQ ID NO: 694240 - DNA, 13 bp, C. elegans
aatctggaaattt

SEQ ID NO: 694241 - DNA, 13 bp, C. elegans
aatctggaataaa

SEQ ID NO: 694242 - DNA, 13 bp, C. elegans
aatctggaggtca

SEQ ID NO: 694243 - DNA, 13 bp, C. elegans
aatctggattttt

SEQ ID NO: 694244 - DNA, 13 bp, C. elegans
aatctgtaaaaaa

SEQ ID NO: 694245 - DNA, 13 bp, C. elegans
aatctgtaaattc

SEQ ID NO: 694246 - DNA, 13 bp, C. elegans
aatctgtcaaatt

SEQ ID NO: 694247 - DNA, 13 bp, C. elegans
aatctgtgaaaaa

SEQ ID NO: 694248 - DNA, 13 bp, C. elegans
aatctgtgaattt

SEQ ID NO: 694249 - DNA, 13 bp, C. elegans
aatctgtggatat

SEQ ID NO: 694250 - DNA, 13 bp, C. elegans
aatctgttatttt

SEQ ID NO: 694251 - DNA, 13 bp, C. elegans
aatctgttgagaa

SEQ ID NO: 694252 - DNA, 13 bp, C. elegans
aatcttaaaaatg

SEQ ID NO: 694253 - DNA, 13 bp, C. elegans
aatcttaaaatca

SEQ ID NO: 694254 - DNA, 13 bp, C. elegans
aatcttaacattt

SEQ ID NO: 694255 - DNA, 13 bp, C. elegans
aatcttatggaaa

SEQ ID NO: 694256 - DNA, 13 bp, C. elegans
aatcttattttgt

SEQ ID NO: 694257 - DNA, 13 bp, C. elegans
aatcttcaaaaac

SEQ ID NO: 694258 - DNA, 13 bp, C. elegans
aatcttcaaaaat

SEQ ID NO: 694259 - DNA, 13 bp, C. elegans
aatcttcaaagtt

SEQ ID NO: 694260 - DNA, 13 bp, C. elegans
aatcttcaaatct

SEQ ID NO: 694261 - DNA, 13 bp, C. elegans
aatcttcaaattc

SEQ ID NO: 694262 - DNA, 13 bp, C. elegans
aatcttcaagttt

SEQ ID NO: 694263 - DNA, 13 bp, C. elegans
aatcttcaataaa

SEQ ID NO: 694264 - DNA, 13 bp, C. elegans
aatcttcactttt

SEQ ID NO: 694265 - DNA, 13 bp, C. elegans
aatcttcagtttt

SEQ ID NO: 694266 - DNA, 13 bp, C. elegans
aatcttcatattc

SEQ ID NO: 694267 - DNA, 13 bp, C. elegans
aatcttcatttaa

SEQ ID NO: 694268 - DNA, 13 bp, C. elegans
aatcttcatttct

SEQ ID NO: 694269 - DNA, 13 bp, C. elegans
aatcttcatttta

SEQ ID NO: 694270 - DNA, 13 bp, C. elegans
aatcttccaattt

SEQ ID NO: 694271 - DNA, 13 bp, C. elegans
aatcttcgatttt

SEQ ID NO: 694272 - DNA, 13 bp, C. elegans
aatcttctcttct

SEQ ID NO: 694273 - DNA, 13 bp, C. elegans
aatcttctggaaa

SEQ ID NO: 694274 - DNA, 15 bp, C. elegans
aatcttctggaaatt

SEQ ID NO: 694275 - DNA, 13 bp, C. elegans
aatcttctgtttt

SEQ ID NO: 694276 - DNA, 13 bp, C. elegans
aatcttcttgtcg

SEQ ID NO: 694277 - DNA, 13 bp, C. elegans
aatcttgaaaata

SEQ ID NO: 694278 - DNA, 13 bp, C. elegans
aatcttgaaaatc

SEQ ID NO: 694279 - DNA, 13 bp, C. elegans
aatcttgaaatat

SEQ ID NO: 694280 - DNA, 13 bp, C. elegans
aatcttgaaatta

SEQ ID NO: 694281 - DNA, 13 bp, C. elegans
aatcttgaaattc

SEQ ID NO: 694282 - DNA, 13 bp, C. elegans
aatcttgaaattt

SEQ ID NO: 694283 - DNA, 13 bp, C. elegans
aatcttgagaaaa

SEQ ID NO: 694284 - DNA, 13 bp, C. elegans
aatcttgatattt

SEQ ID NO: 694285 - DNA, 13 bp, C. elegans
aatcttgattttc

SEQ ID NO: 694286 - DNA, 13 bp, C. elegans
aatcttgcaaaat

SEQ ID NO: 694287 - DNA, 13 bp, C. elegans
aatcttggaaata

SEQ ID NO: 694288 - DNA, 13 bp, C. elegans
aatcttggaattt

SEQ ID NO: 694289 - DNA, 13 bp, C. elegans
aatcttgtgaaat

SEQ ID NO: 694290 - DNA, 13 bp, C. elegans
aatcttgttttta

SEQ ID NO: 694291 - DNA, 13 bp, C. elegans
aatctttaaaact

SEQ ID NO: 694292 - DNA, 13 bp, C. elegans
aatctttacaaaa

SEQ ID NO: 694293 - DNA, 13 bp, C. elegans
aatctttattcaa

SEQ ID NO: 694294 - DNA, 13 bp, C. elegans
aatctttcaaaaa

SEQ ID NO: 694295 - DNA, 13 bp, C. elegans
aatctttcaatct

SEQ ID NO: 694296 - DNA, 13 bp, C. elegans
aatctttcaattt

SEQ ID NO: 694297 - DNA, 13 bp, C. elegans
aatctttctaatt

SEQ ID NO: 694298 - DNA, 13 bp, C. elegans
aatctttctgaaa

SEQ ID NO: 694299 - DNA, 13 bp, C. elegans
aatctttgaaaaa

SEQ ID NO: 694300 - DNA, 13 bp, C. elegans
aatctttgaaaat

SEQ ID NO: 694301 - DNA, 13 bp, C. elegans
aatctttgaaaga

SEQ ID NO: 694302 - DNA, 13 bp, C. elegans
aatctttgaaata

SEQ ID NO: 694303 - DNA, 13 bp, C. elegans
aatctttgaagaa

SEQ ID NO: 694304 - DNA, 13 bp, C. elegans
aatctttgaagtt

SEQ ID NO: 694305 - DNA, 13 bp, C. elegans
aatctttgaataa

SEQ ID NO: 694306 - DNA, 13 bp, C. elegans
aatctttgcaaaa

SEQ ID NO: 694307 - DNA, 13 bp, C. elegans
aatctttgtttta

SEQ ID NO: 694308 - DNA, 13 bp, C. elegans
aatcttttaacaa

SEQ ID NO: 694309 - DNA, 13 bp, C. elegans
aatcttttagttt

SEQ ID NO: 694310 - DNA, 13 bp, C. elegans
aatcttttcaaaa

SEQ ID NO: 694311 - DNA, 13 bp, C. elegans
aatcttttgagaa

SEQ ID NO: 694312 - DNA, 13 bp, C. elegans
aatctttttccga

SEQ ID NO: 694313 - DNA, 13 bp, C. elegans
aatctttttgatt

SEQ ID NO: 694314 - DNA, 13 bp, C. elegans
aatctttttttgc

SEQ ID NO: 694315 - DNA, 13 bp, C. elegans
aatgaaaaaagtc

SEQ ID NO: 694316 - DNA, 13 bp, C. elegans
aatgaaaaacgat

SEQ ID NO: 694317 - DNA, 13 bp, C. elegans
aatgaaaaactat

SEQ ID NO: 694318 - DNA, 13 bp, C. elegans
aatgaaaaactcg

SEQ ID NO: 694319 - DNA, 13 bp, C. elegans
aatgaaaaacttc

SEQ ID NO: 694320 - DNA, 13 bp, C. elegans
aatgaaaaatctg

SEQ ID NO: 694321 - DNA, 13 bp, C. elegans
aatgaaaaatgca

SEQ ID NO: 694322 - DNA, 13 bp, C. elegans
aatgaaaaatgtt

SEQ ID NO: 694323 - DNA, 13 bp, C. elegans
aatgaaaacaatt

SEQ ID NO: 694324 - DNA, 13 bp, C. elegans
aatgaaaacatta

SEQ ID NO: 694325 - DNA, 13 bp, C. elegans
aatgaaaacgaag

SEQ ID NO: 694326 - DNA, 13 bp, C. elegans
aatgaaaactgaa

SEQ ID NO: 694327 - DNA, 13 bp, C. elegans
aatgaaaaggttt

SEQ ID NO: 694328 - DNA, 13 bp, C. elegans
aatgaaaatcatt

SEQ ID NO: 694329 - DNA, 13 bp, C. elegans
aatgaaaatctag

SEQ ID NO: 694330 - DNA, 13 bp, C. elegans
aatgaaaatgcca

SEQ ID NO: 694331 - DNA, 13 bp, C. elegans
aatgaaaatgttt

SEQ ID NO: 694332 - DNA, 13 bp, C. elegans
aatgaaaatttca

SEQ ID NO: 694333 - DNA, 13 bp, C. elegans
aatgaaaattttc

SEQ ID NO: 694334 - DNA, 13 bp, C. elegans
aatgaaacagcaa

SEQ ID NO: 694335 - DNA, 13 bp, C. elegans
aatgaaacagttt

SEQ ID NO: 694336 - DNA, 13 bp, C. elegans
aatgaaacattct

SEQ ID NO: 694337 - DNA, 13 bp, C. elegans
aatgaaacattga

SEQ ID NO: 694338 - DNA, 13 bp, C. elegans
aatgaaacatttg

SEQ ID NO: 694339 - DNA, 13 bp, C. elegans
aatgaaacatttt

SEQ ID NO: 694340 - DNA, 13 bp, C. elegans
aatgaaaccaaat

SEQ ID NO: 694341 - DNA, 13 bp, C. elegans
aatgaaacgaaat

SEQ ID NO: 694342 - DNA, 13 bp, C. elegans
aatgaaactattt

SEQ ID NO: 694343 - DNA, 13 bp, C. elegans
aatgaaactgaat

SEQ ID NO: 694344 - DNA, 13 bp, C. elegans
aatgaaactggaa

SEQ ID NO: 694345 - DNA, 13 bp, C. elegans
aatgaaacttctc

SEQ ID NO: 694346 - DNA, 13 bp, C. elegans
aatgaaactttaa

SEQ ID NO: 694347 - DNA, 13 bp, C. elegans
aatgaaagagttt

SEQ ID NO: 694348 - DNA, 13 bp, C. elegans
aatgaaagatttt

SEQ ID NO: 694349 - DNA, 13 bp, C. elegans
aatgaaagctggt

SEQ ID NO: 694350 - DNA, 13 bp, C. elegans
aatgaaagtatta

SEQ ID NO: 694351 - DNA, 13 bp, C. elegans
aatgaaagtttaa

SEQ ID NO: 694352 - DNA, 13 bp, C. elegans
aatgaaagtttcc

SEQ ID NO: 694353 - DNA, 13 bp, C. elegans
aatgaaagttttc

SEQ ID NO: 694354 - DNA, 13 bp, C. elegans
aatgaaataaatc

SEQ ID NO: 694355 - DNA, 13 bp, C. elegans
aatgaaatcattt

SEQ ID NO: 694356 - DNA, 13 bp, C. elegans
aatgaaatgaatg

SEQ ID NO: 694357 - DNA, 13 bp, C. elegans
aatgaaatgttca

SEQ ID NO: 694358 - DNA, 13 bp, C. elegans
aatgaaattaact

SEQ ID NO: 694359 - DNA, 13 bp, C. elegans
aatgaaattcaaa

SEQ ID NO: 694360 - DNA, 13 bp, C. elegans
aatgaaattcaat

SEQ ID NO: 694361 - DNA, 13 bp, C. elegans
aatgaaattccaa

SEQ ID NO: 694362 - DNA, 13 bp, C. elegans
aatgaaattctaa

SEQ ID NO: 694363 - DNA, 13 bp, C. elegans
aatgaaattgaga

SEQ ID NO: 694364 - DNA, 13 bp, C. elegans
aatgaaattgatt

SEQ ID NO: 694365 - DNA, 13 bp, C. elegans
aatgaaattggga

SEQ ID NO: 694366 - DNA, 13 bp, C. elegans
aatgaaattgtaa

SEQ ID NO: 694367 - DNA, 13 bp, C. elegans
aatgaaatttcag

SEQ ID NO: 694368 - DNA, 13 bp, C. elegans
aatgaaatttcgt

SEQ ID NO: 694369 - DNA, 13 bp, C. elegans
aatgaacaaatct

SEQ ID NO: 694370 - DNA, 13 bp, C. elegans
aatgaacaatttg

SEQ ID NO: 694371 - DNA, 13 bp, C. elegans
aatgaacaatttt

SEQ ID NO: 694372 - DNA, 13 bp, C. elegans
aatgaacttaaaa

SEQ ID NO: 694373 - DNA, 13 bp, C. elegans
aatgaagaaaatc

SEQ ID NO: 694374 - DNA, 13 bp, C. elegans
aatgaagaaatgg

SEQ ID NO: 694375 - DNA, 13 bp, C. elegans
aatgaagaaattg

SEQ ID NO: 694376 - DNA, 13 bp, C. elegans
aatgaagaatttt

SEQ ID NO: 694377 - DNA, 13 bp, C. elegans
aatgaagcaccaa

SEQ ID NO: 694378 - DNA, 13 bp, C. elegans
aatgaagctcaaa

SEQ ID NO: 694379 - DNA, 13 bp, C. elegans
aatgaaggaaact

SEQ ID NO: 694380 - DNA, 13 bp, C. elegans
aatgaagtttatt

SEQ ID NO: 694381 - DNA, 13 bp, C. elegans
aatgaagtttgaa

SEQ ID NO: 694382 - DNA, 13 bp, C. elegans
aatgaagtttttg

SEQ ID NO: 694383 - DNA, 13 bp, C. elegans
aatgaataaaact

SEQ ID NO: 694384 - DNA, 13 bp, C. elegans
aatgaataattca

SEQ ID NO: 694385 - DNA, 13 bp, C. elegans
aatgaatactgta

SEQ ID NO: 694386 - DNA, 13 bp, C. elegans
aatgaatattgta

SEQ ID NO: 694387 - DNA, 13 bp, C. elegans
aatgaatattgtt

SEQ ID NO: 694388 - DNA, 13 bp, C. elegans
aatgaatatttct

SEQ ID NO: 694389 - DNA, 13 bp, C. elegans
aatgaatattttc

SEQ ID NO: 694390 - DNA, 13 bp, C. elegans
aatgaatcatttc

SEQ ID NO: 694391 - DNA, 13 bp, C. elegans
aatgaatcttttt

SEQ ID NO: 694392 - DNA, 13 bp, C. elegans
aatgaatgaatat

SEQ ID NO: 694393 - DNA, 13 bp, C. elegans
aatgaatgaatga

SEQ ID NO: 694394 - DNA, 13 bp, C. elegans
aatgaatgagcaa

SEQ ID NO: 694395 - DNA, 13 bp, C. elegans
aatgaatgatatt

SEQ ID NO: 694396 - DNA, 13 bp, C. elegans
aatgaatgatgat

SEQ ID NO: 694397 - DNA, 13 bp, C. elegans
aatgaatgggaaa

SEQ ID NO: 694398 - DNA, 13 bp, C. elegans
aatgaatgtattt

SEQ ID NO: 694399 - DNA, 13 bp, C. elegans
aatgaatgttttg

SEQ ID NO: 694400 - DNA, 13 bp, C. elegans
aatgaattattga

SEQ ID NO: 694401 - DNA, 13 bp, C. elegans
aatgaattattgt

SEQ ID NO: 694402 - DNA, 13 bp, C. elegans
aatgaattcaata

SEQ ID NO: 694403 - DNA, 13 bp, C. elegans
aatgaattcattt

SEQ ID NO: 694404 - DNA, 13 bp, C. elegans
aatgaattgaaga

SEQ ID NO: 694405 - DNA, 13 bp, C. elegans
aatgaattgtatt

SEQ ID NO: 694406 - DNA, 13 bp, C. elegans
aatgaattgtttg

SEQ ID NO: 694407 - DNA, 13 bp, C. elegans
aatgaatttattg

SEQ ID NO: 694408 - DNA, 13 bp, C. elegans
aatgaatttcaat

SEQ ID NO: 694409 - DNA, 13 bp, C. elegans
aatgaattttcat

SEQ ID NO: 694410 - DNA, 13 bp, C. elegans
aatgaatttttac

SEQ ID NO: 694411 - DNA, 13 bp, C. elegans
aatgaatttttct

SEQ ID NO: 694412 - DNA, 13 bp, C. elegans
aatgacaaatgtt

SEQ ID NO: 694413 - DNA, 13 bp, C. elegans
aatgacaatttat

SEQ ID NO: 694414 - DNA, 13 bp, C. elegans
aatgacacatttt

SEQ ID NO: 694415 - DNA, 13 bp, C. elegans
aatgacagaaaac

SEQ ID NO: 694416 - DNA, 13 bp, C. elegans
aatgacagaatac

SEQ ID NO: 694417 - DNA, 13 bp, C. elegans
aatgacaggagga

SEQ ID NO: 694418 - DNA, 13 bp, C. elegans
aatgacataaaat

SEQ ID NO: 694419 - DNA, 13 bp, C. elegans
aatgacatgaaaa

SEQ ID NO: 694420 - DNA, 13 bp, C. elegans
aatgaccaaatat

SEQ ID NO: 694421 - DNA, 13 bp, C. elegans
aatgaccgaatca

SEQ ID NO: 694422 - DNA, 13 bp, C. elegans
aatgacgagaaaa

SEQ ID NO: 694423 - DNA, 13 bp, C. elegans
aatgacggaaaaa

SEQ ID NO: 694424 - DNA, 13 bp, C. elegans
aatgacgtcactc

SEQ ID NO: 694425 - DNA, 13 bp, C. elegans
aatgacgtcactt

SEQ ID NO: 694426 - DNA, 13 bp, C. elegans
aatgacgtcataa

SEQ ID NO: 694427 - DNA, 13 bp, C. elegans
aatgacgtcatca

SEQ ID NO: 694428 - DNA, 13 bp, C. elegans
aatgacgtcattt

SEQ ID NO: 694429 - DNA, 13 bp, C. elegans
aatgacgtggcaa

SEQ ID NO: 694430 - DNA, 13 bp, C. elegans
aatgactaaattt

SEQ ID NO: 694431 - DNA, 13 bp, C. elegans
aatgactcaaaaa

SEQ ID NO: 694432 - DNA, 13 bp, C. elegans
aatgactgaaaaa

SEQ ID NO: 694433 - DNA, 13 bp, C. elegans
aatgagaaaaacg

SEQ ID NO: 694434 - DNA, 13 bp, C. elegans
aatgagaaaaatc

SEQ ID NO: 694435 - DNA, 13 bp, C. elegans
aatgagaaaagtg

SEQ ID NO: 694436 - DNA, 13 bp, C. elegans
aatgagaaaatgt

SEQ ID NO: 694437 - DNA, 13 bp, C. elegans
aatgagaaaattg

SEQ ID NO: 694438 - DNA, 13 bp, C. elegans
aatgagaaacaat

SEQ ID NO: 694439 - DNA, 13 bp, C. elegans
aatgagaaaggcc

SEQ ID NO: 694440 - DNA, 13 bp, C. elegans
aatgagaaatatg

SEQ ID NO: 694441 - DNA, 13 bp, C. elegans
aatgagaaatatt

SEQ ID NO: 694442 - DNA, 13 bp, C. elegans
aatgagaaatgga

SEQ ID NO: 694443 - DNA, 13 bp, C. elegans
aatgagaaatttc

SEQ ID NO: 694444 - DNA, 13 bp, C. elegans
aatgagaacaaca

SEQ ID NO: 694445 - DNA, 13 bp, C. elegans
aatgagaagaagc

SEQ ID NO: 694446 - DNA, 13 bp, C. elegans
aatgagaagaatg

SEQ ID NO: 694447 - DNA, 13 bp, C. elegans
aatgagaatttca

SEQ ID NO: 694448 - DNA, 13 bp, C. elegans
aatgagaatttta

SEQ ID NO: 694449 - DNA, 13 bp, C. elegans
aatgagacattct

SEQ ID NO: 694450 - DNA, 13 bp, C. elegans
aatgagagaattt

SEQ ID NO: 694451 - DNA, 13 bp, C. elegans
aatgagattaatt

SEQ ID NO: 694452 - DNA, 13 bp, C. elegans
aatgagattttga

SEQ ID NO: 694453 - DNA, 13 bp, C. elegans
aatgagcaaaaac

SEQ ID NO: 694454 - DNA, 13 bp, C. elegans
aatgagcaaaaag

SEQ ID NO: 694455 - DNA, 13 bp, C. elegans
aatgagcagaaaa

SEQ ID NO: 694456 - DNA, 13 bp, C. elegans
aatgagcatttat

SEQ ID NO: 694457 - DNA, 13 bp, C. elegans
aatgagcattttg

SEQ ID NO: 694458 - DNA, 13 bp, C. elegans
aatgagcattttt

SEQ ID NO: 694459 - DNA, 13 bp, C. elegans
aatgagctcaaaa

SEQ ID NO: 694460 - DNA, 13 bp, C. elegans
aatgagctcaatt

SEQ ID NO: 694461 - DNA, 13 bp, C. elegans
aatgagctttttt

SEQ ID NO: 694462 - DNA, 13 bp, C. elegans
aatgaggaggatt

SEQ ID NO: 694463 - DNA, 13 bp, C. elegans
aatgaggcaaacg

SEQ ID NO: 694464 - DNA, 13 bp, C. elegans
aatgagggaaatt

SEQ ID NO: 694465 - DNA, 13 bp, C. elegans
aatgagtaattgt

SEQ ID NO: 694466 - DNA, 13 bp, C. elegans
aatgagtacaatc

SEQ ID NO: 694467 - DNA, 13 bp, C. elegans
aatgagtcatttt

SEQ ID NO: 694468 - DNA, 13 bp, C. elegans
aatgagtgtaata

SEQ ID NO: 694469 - DNA, 13 bp, C. elegans
aatgagtgtttgc

SEQ ID NO: 694470 - DNA, 13 bp, C. elegans
aatgagttcaaaa

SEQ ID NO: 694471 - DNA, 13 bp, C. elegans
aatgagttttatg

SEQ ID NO: 694472 - DNA, 13 bp, C. elegans
aatgagttttttg

SEQ ID NO: 694473 - DNA, 13 bp, C. elegans
aatgataaaattg

SEQ ID NO: 694474 - DNA, 13 bp, C. elegans
aatgataagaaac

SEQ ID NO: 694475 - DNA, 13 bp, C. elegans
aatgataatgata

SEQ ID NO: 694476 - DNA, 13 bp, C. elegans
aatgataatttcc

SEQ ID NO: 694477 - DNA, 13 bp, C. elegans
aatgatatcagaa

SEQ ID NO: 694478 - DNA, 14 bp, C. elegans
aatgatatgtacaa

SEQ ID NO: 694479 - DNA, 13 bp, C. elegans
aatgatattttca

SEQ ID NO: 694480 - DNA, 13 bp, C. elegans
aatgatcaataaa

SEQ ID NO: 694481 - DNA, 13 bp, C. elegans
aatgatcacaaaa

SEQ ID NO: 694482 - DNA, 13 bp, C. elegans
aatgatcacaaat

SEQ ID NO: 694483 - DNA, 13 bp, C. elegans
aatgatcagaatt

SEQ ID NO: 694484 - DNA, 13 bp, C. elegans
aatgatccgaaag

SEQ ID NO: 694485 - DNA, 13 bp, C. elegans
aatgatcttcaaa

SEQ ID NO: 694486 - DNA, 13 bp, C. elegans
aatgatctttaaa

SEQ ID NO: 694487 - DNA, 13 bp, C. elegans
aatgatgaaaatc

SEQ ID NO: 694488 - DNA, 13 bp, C. elegans
aatgatgaaaatg

SEQ ID NO: 694489 - DNA, 13 bp, C. elegans
aatgatgataaat

SEQ ID NO: 694490 - DNA, 13 bp, C. elegans
aatgatgataatt

SEQ ID NO: 694491 - DNA, 13 bp, C. elegans
aatgatgatgata

SEQ ID NO: 694492 - DNA, 13 bp, C. elegans
aatgatgatgttt

SEQ ID NO: 694493 - DNA, 13 bp, C. elegans
aatgatgattttg

SEQ ID NO: 694494 - DNA, 13 bp, C. elegans
aatgatgattttt

SEQ ID NO: 694495 - DNA, 13 bp, C. elegans
aatgatggaaatt

SEQ ID NO: 694496 - DNA, 13 bp, C. elegans
aatgatgtgattt

SEQ ID NO: 694497 - DNA, 13 bp, C. elegans
aatgattcaaaaa

SEQ ID NO: 694498 - DNA, 13 bp, C. elegans
aatgattccaaaa

SEQ ID NO: 694499 - DNA, 13 bp, C. elegans
aatgattctaaaa

SEQ ID NO: 694500 - DNA, 13 bp, C. elegans
aatgattgagaaa

SEQ ID NO: 694501 - DNA, 13 bp, C. elegans
aatgattggtttt

SEQ ID NO: 694502 - DNA, 13 bp, C. elegans
aatgattgtttga

SEQ ID NO: 694503 - DNA, 13 bp, C. elegans
aatgatttatcaa

SEQ ID NO: 694504 - DNA, 13 bp, C. elegans
aatgattttaagc

SEQ ID NO: 694505 - DNA, 13 bp, C. elegans
aatgattttccaa

SEQ ID NO: 694506 - DNA, 13 bp, C. elegans
aatgattttgaat

SEQ ID NO: 694507 - DNA, 13 bp, C. elegans
aatgattttgatt

SEQ ID NO: 694508 - DNA, 13 bp, C. elegans
aatgattttggag

SEQ ID NO: 694509 - DNA, 13 bp, C. elegans
aatgatttttctc

SEQ ID NO: 694510 - DNA, 13 bp, C. elegans
aatgatttttctg

SEQ ID NO: 694511 - DNA, 13 bp, C. elegans
aatgatttttgtg

SEQ ID NO: 694512 - DNA, 13 bp, C. elegans
aatgcaaaaaagg

SEQ ID NO: 694513 - DNA, 13 bp, C. elegans
aatgcaaaaatat

SEQ ID NO: 694514 - DNA, 13 bp, C. elegans
aatgcaaaaatca

SEQ ID NO: 694515 - DNA, 13 bp, C. elegans
aatgcaaaaatta

SEQ ID NO: 694516 - DNA, 13 bp, C. elegans
aatgcaaaaattt

SEQ ID NO: 694517 - DNA, 13 bp, C. elegans
aatgcaaaacttt

SEQ ID NO: 694518 - DNA, 13 bp, C. elegans
aatgcaaaatcaa

SEQ ID NO: 694519 - DNA, 13 bp, C. elegans
aatgcaaaattag

SEQ ID NO: 694520 - DNA, 13 bp, C. elegans
aatgcaaactttt

SEQ ID NO: 694521 - DNA, 13 bp, C. elegans
aatgcaaattaaa

SEQ ID NO: 694522 - DNA, 13 bp, C. elegans
aatgcaacatttt

SEQ ID NO: 694523 - DNA, 13 bp, C. elegans
aatgcaactttta

SEQ ID NO: 694524 - DNA, 13 bp, C. elegans
aatgcaagaattt

SEQ ID NO: 694525 - DNA, 13 bp, C. elegans
aatgcaagtgcgc

SEQ ID NO: 694526 - DNA, 13 bp, C. elegans
aatgcaagtgtgc

SEQ ID NO: 694527 - DNA, 13 bp, C. elegans
aatgcaagttttt

SEQ ID NO: 694528 - DNA, 13 bp, C. elegans
aatgcaattattt

SEQ ID NO: 694529 - DNA, 13 bp, C. elegans
aatgcaatttcag

SEQ ID NO: 694530 - DNA, 13 bp, C. elegans
aatgcaattttaa

SEQ ID NO: 694531 - DNA, 13 bp, C. elegans
aatgcaattttac

SEQ ID NO: 694532 - DNA, 13 bp, C. elegans
aatgcaatttttg

SEQ ID NO: 694533 - DNA, 13 bp, C. elegans
aatgcaatttttt

SEQ ID NO: 694534 - DNA, 13 bp, C. elegans
aatgcacaaaact

SEQ ID NO: 694535 - DNA, 13 bp, C. elegans
aatgcacaatttc

SEQ ID NO: 694536 - DNA, 13 bp, C. elegans
aatgcacagaaac

SEQ ID NO: 694537 - DNA, 13 bp, C. elegans
aatgcaccatgtt

SEQ ID NO: 694538 - DNA, 13 bp, C. elegans
aatgcacttttaa

SEQ ID NO: 694539 - DNA, 13 bp, C. elegans
aatgcagaaattt

SEQ ID NO: 694540 - DNA, 13 bp, C. elegans
aatgcaggaaaat

SEQ ID NO: 694541 - DNA, 13 bp, C. elegans
aatgcataaattt

SEQ ID NO: 694542 - DNA, 13 bp, C. elegans
aatgcatataaaa

SEQ ID NO: 694543 - DNA, 13 bp, C. elegans
aatgcatattttg

SEQ ID NO: 694544 - DNA, 13 bp, C. elegans
aatgcattaaaat

SEQ ID NO: 694545 - DNA, 13 bp, C. elegans
aatgcatttagtt

SEQ ID NO: 694546 - DNA, 13 bp, C. elegans
aatgcatttcttt

SEQ ID NO: 694547 - DNA, 13 bp, C. elegans
aatgcattttatt

SEQ ID NO: 694548 - DNA, 13 bp, C. elegans
aatgcatttttaa

SEQ ID NO: 694549 - DNA, 13 bp, C. elegans
aatgcatttttat

SEQ ID NO: 694550 - DNA, 13 bp, C. elegans
aatgcatttttgt

SEQ ID NO: 694551 - DNA, 13 bp, C. elegans
aatgcattttttc

SEQ ID NO: 694552 - DNA, 13 bp, C. elegans
aatgccaaaaaag

SEQ ID NO: 694553 - DNA, 13 bp, C. elegans
aatgccaaaaaat

SEQ ID NO: 694554 - DNA, 13 bp, C. elegans
aatgccaaaaaca

SEQ ID NO: 694555 - DNA, 13 bp, C. elegans
aatgccaaaacta

SEQ ID NO: 694556 - DNA, 13 bp, C. elegans
aatgccaaaatat

SEQ ID NO: 694557 - DNA, 13 bp, C. elegans
aatgccaaaattg

SEQ ID NO: 694558 - DNA, 13 bp, C. elegans
aatgccaacaaaa

SEQ ID NO: 694559 - DNA, 13 bp, C. elegans
aatgccaccaaaa

SEQ ID NO: 694560 - DNA, 13 bp, C. elegans
aatgccacgtcat

SEQ ID NO: 694561 - DNA, 13 bp, C. elegans
aatgccacgtggc

SEQ ID NO: 694562 - DNA, 13 bp, C. elegans
aatgccacgtgtc

SEQ ID NO: 694563 - DNA, 13 bp, C. elegans
aatgccatttttc

SEQ ID NO: 694564 - DNA, 13 bp, C. elegans
aatgccgaaaata

SEQ ID NO: 694565 - DNA, 13 bp, C. elegans
aatgccgaaattg

SEQ ID NO: 694566 - DNA, 13 bp, C. elegans
aatgcgaaaatat

SEQ ID NO: 694567 - DNA, 13 bp, C. elegans
aatgcgaaatttg

SEQ ID NO: 694568 - DNA, 13 bp, C. elegans
aatgcgaataaaa

SEQ ID NO: 694569 - DNA, 13 bp, C. elegans
aatgcgaattttc

SEQ ID NO: 694570 - DNA, 13 bp, C. elegans
aatgcgacgaaac

SEQ ID NO: 694571 - DNA, 13 bp, C. elegans
aatgcgagaaaaa

SEQ ID NO: 694572 - DNA, 13 bp, C. elegans
aatgcggcaattt

SEQ ID NO: 694573 - DNA, 13 bp, C. elegans
aatgcgggagttg

SEQ ID NO: 694574 - DNA, 13 bp, C. elegans
aatgcggtttttt

SEQ ID NO: 694575 - DNA, 13 bp, C. elegans
aatgcgtcaaaac

SEQ ID NO: 694576 - DNA, 13 bp, C. elegans
aatgctaaaattg

SEQ ID NO: 694577 - DNA, 13 bp, C. elegans
aatgctatcaaaa

SEQ ID NO: 694578 - DNA, 13 bp, C. elegans
aatgctatcatat

SEQ ID NO: 694579 - DNA, 13 bp, C. elegans
aatgctcaaaaat

SEQ ID NO: 694580 - DNA, 13 bp, C. elegans
aatgctcaaaagt

SEQ ID NO: 694581 - DNA, 13 bp, C. elegans
aatgctcaacttt

SEQ ID NO: 694582 - DNA, 13 bp, C. elegans
aatgctcaagaaa

SEQ ID NO: 694583 - DNA, 13 bp, C. elegans
aatgctcagaaaa

SEQ ID NO: 694584 - DNA, 13 bp, C. elegans
aatgctcatattt

SEQ ID NO: 694585 - DNA, 13 bp, C. elegans
aatgctcattttg

SEQ ID NO: 694586 - DNA, 13 bp, C. elegans
aatgctccaaaat

SEQ ID NO: 694587 - DNA, 13 bp, C. elegans
aatgctccaaact

SEQ ID NO: 694588 - DNA, 13 bp, C. elegans
aatgctcgatttt

SEQ ID NO: 694589 - DNA, 13 bp, C. elegans
aatgctcgttttt

SEQ ID NO: 694590 - DNA, 13 bp, C. elegans
aatgctctaaatt

SEQ ID NO: 694591 - DNA, 13 bp, C. elegans
aatgctctacaac

SEQ ID NO: 694592 - DNA, 13 bp, C. elegans
aatgctgaaaaac

SEQ ID NO: 694593 - DNA, 13 bp, C. elegans
aatgctgaaaaat

SEQ ID NO: 694594 - DNA, 13 bp, C. elegans
aatgctgagaaca

SEQ ID NO: 694595 - DNA, 13 bp, C. elegans
aatgcttaatttt

SEQ ID NO: 694596 - DNA, 13 bp, C. elegans
aatgcttgaaatt

SEQ ID NO: 694597 - DNA, 13 bp, C. elegans
aatgcttggaagg

SEQ ID NO: 694598 - DNA, 13 bp, C. elegans
aatgctttctaca

SEQ ID NO: 694599 - DNA, 13 bp, C. elegans
aatgctttgaaaa

SEQ ID NO: 694600 - DNA, 13 bp, C. elegans
aatgcttttcaaa

SEQ ID NO: 694601 - DNA, 13 bp, C. elegans
aatgcttttcaat

SEQ ID NO: 694602 - DNA, 13 bp, C. elegans
aatgcttttctct

SEQ ID NO: 694603 - DNA, 13 bp, C. elegans
aatgcttttttca

SEQ ID NO: 694604 - DNA, 13 bp, C. elegans
aatggaaaaaatc

SEQ ID NO: 694605 - DNA, 13 bp, C. elegans
aatggaaaaactg

SEQ ID NO: 694606 - DNA, 13 bp, C. elegans
aatggaaaaatgt

SEQ ID NO: 694607 - DNA, 13 bp, C. elegans
aatggaaaacatt

SEQ ID NO: 694608 - DNA, 13 bp, C. elegans
aatggaaaagtga

SEQ ID NO: 694609 - DNA, 13 bp, C. elegans
aatggaaaagtgt

SEQ ID NO: 694610 - DNA, 13 bp, C. elegans
aatggaaaagtta

SEQ ID NO: 694611 - DNA, 13 bp, C. elegans
aatggaaaagttt

SEQ ID NO: 694612 - DNA, 13 bp, C. elegans
aatggaaaatcaa

SEQ ID NO: 694613 - DNA, 13 bp, C. elegans
aatggaaaatgag

SEQ ID NO: 694614 - DNA, 13 bp, C. elegans
aatggaaaatttt

SEQ ID NO: 694615 - DNA, 13 bp, C. elegans
aatggaaacaatt

SEQ ID NO: 694616 - DNA, 13 bp, C. elegans
aatggaaagtttg

SEQ ID NO: 694617 - DNA, 13 bp, C. elegans
aatggaaatcaaa

SEQ ID NO: 694618 - DNA, 13 bp, C. elegans
aatggaaatgttt

SEQ ID NO: 694619 - DNA, 13 bp, C. elegans
aatggaaattatt

SEQ ID NO: 694620 - DNA, 13 bp, C. elegans
aatggaaattgaa

SEQ ID NO: 694621 - DNA, 13 bp, C. elegans
aatggaaatttaa

SEQ ID NO: 694622 - DNA, 13 bp, C. elegans
aatggaaatttca

SEQ ID NO: 694623 - DNA, 13 bp, C. elegans
aatggaaatttct

SEQ ID NO: 694624 - DNA, 13 bp, C. elegans
aatggaaatttgt

SEQ ID NO: 694625 - DNA, 13 bp, C. elegans
aatggaacaaaat

SEQ ID NO: 694626 - DNA, 13 bp, C. elegans
aatggaacagaaa

SEQ ID NO: 694627 - DNA, 14 bp, C. elegans
aatggaagaggtgg

SEQ ID NO: 694628 - DNA, 13 bp, C. elegans
aatggaataaatt

SEQ ID NO: 694629 - DNA, 13 bp, C. elegans
aatggaatcaaga

SEQ ID NO: 694630 - DNA, 13 bp, C. elegans
aatggaatggaaa

SEQ ID NO: 694631 - DNA, 13 bp, C. elegans
aatggaattattg

SEQ ID NO: 694632 - DNA, 13 bp, C. elegans
aatggaattgttt

SEQ ID NO: 694633 - DNA, 13 bp, C. elegans
aatggaatttgaa

SEQ ID NO: 694634 - DNA, 13 bp, C. elegans
aatggaattttta

SEQ ID NO: 694635 - DNA, 13 bp, C. elegans
aatggacaaattt

SEQ ID NO: 694636 - DNA, 13 bp, C. elegans
aatggagaaaaac

SEQ ID NO: 694637 - DNA, 13 bp, C. elegans
aatggagaacaac

SEQ ID NO: 694638 - DNA, 13 bp, C. elegans
aatggagcatttt

SEQ ID NO: 694639 - DNA, 13 bp, C. elegans
aatggagcgcaaa

SEQ ID NO: 694640 - DNA, 13 bp, C. elegans
aatggagttttta

SEQ ID NO: 694641 - DNA, 13 bp, C. elegans
aatggataaaatt

SEQ ID NO: 694642 - DNA, 13 bp, C. elegans
aatggatactgta

SEQ ID NO: 694643 - DNA, 13 bp, C. elegans
aatggatgaaatg

SEQ ID NO: 694644 - DNA, 13 bp, C. elegans
aatggattctttt

SEQ ID NO: 694645 - DNA, 13 bp, C. elegans
aatggatttttcc

SEQ ID NO: 694646 - DNA, 13 bp, C. elegans
aatggatttttct

SEQ ID NO: 694647 - DNA, 13 bp, C. elegans
aatggatttttgt

SEQ ID NO: 694648 - DNA, 13 bp, C. elegans
aatggcaaaaact

SEQ ID NO: 694649 - DNA, 13 bp, C. elegans
aatggcaaaaatt

SEQ ID NO: 694650 - DNA, 13 bp, C. elegans
aatggcaaaattc

SEQ ID NO: 694651 - DNA, 13 bp, C. elegans
aatggcaaattgc

SEQ ID NO: 694652 - DNA, 13 bp, C. elegans
aatggcaacaaaa

SEQ ID NO: 694653 - DNA, 13 bp, C. elegans
aatggcaacattt

SEQ ID NO: 694654 - DNA, 13 bp, C. elegans
aatggcaataaaa

SEQ ID NO: 694655 - DNA, 13 bp, C. elegans
aatggcaatttta

SEQ ID NO: 694656 - DNA, 13 bp, C. elegans
aatggcagaaaat

SEQ ID NO: 694657 - DNA, 13 bp, C. elegans
aatggcattagca

SEQ ID NO: 694658 - DNA, 13 bp, C. elegans
aatggcctagaaa

SEQ ID NO: 694659 - DNA, 13 bp, C. elegans
aatggctcaaaat

SEQ ID NO: 694660 - DNA, 13 bp, C. elegans
aatggctcagtgg

SEQ ID NO: 694661 - DNA, 13 bp, C. elegans
aatggctccaaat

SEQ ID NO: 694662 - DNA, 13 bp, C. elegans
aatggctgaaatt

SEQ ID NO: 694663 - DNA, 13 bp, C. elegans
aatggcttcaaaa

SEQ ID NO: 694664 - DNA, 13 bp, C. elegans
aatggcttgaaaa

SEQ ID NO: 694665 - DNA, 13 bp, C. elegans
aatgggaaaacga

SEQ ID NO: 694666 - DNA, 13 bp, C. elegans
aatgggaaaatca

SEQ ID NO: 694667 - DNA, 13 bp, C. elegans
aatgggaaattga

SEQ ID NO: 694668 - DNA, 13 bp, C. elegans
aatgggaactttt

SEQ ID NO: 694669 - DNA, 13 bp, C. elegans
aatgggacaacct

SEQ ID NO: 694670 - DNA, 13 bp, C. elegans
aatgggattttta

SEQ ID NO: 694671 - DNA, 13 bp, C. elegans
aatgggcgtggcc

SEQ ID NO: 694672 - DNA, 13 bp, C. elegans
aatgggcgtggct

SEQ ID NO: 694673 - DNA, 13 bp, C. elegans
aatggggaaaatg

SEQ ID NO: 694674 - DNA, 13 bp, C. elegans
aatggggaaattt

SEQ ID NO: 694675 - DNA, 13 bp, C. elegans
aatggggattttt

SEQ ID NO: 694676 - DNA, 13 bp, C. elegans
aatgggtactgta

SEQ ID NO: 694677 - DNA, 13 bp, C. elegans
aatgggttttcaa

SEQ ID NO: 694678 - DNA, 13 bp, C. elegans
aatggtaaatttt

SEQ ID NO: 694679 - DNA, 13 bp, C. elegans
aatggtgaatttt

SEQ ID NO: 694680 - DNA, 13 bp, C. elegans
aatggtgccaaaa

SEQ ID NO: 694681 - DNA, 13 bp, C. elegans
aatggttactgta

SEQ ID NO: 694682 - DNA, 13 bp, C. elegans
aatggttactttt

SEQ ID NO: 694683 - DNA, 13 bp, C. elegans
aatggttgcccag

SEQ ID NO: 694684 - DNA, 13 bp, C. elegans
aatggtttgaaaa

SEQ ID NO: 694685 - DNA, 13 bp, C. elegans
aatggttttcaat

SEQ ID NO: 694686 - DNA, 13 bp, C. elegans
aatggtttttgaa

SEQ ID NO: 694687 - DNA, 13 bp, C. elegans
aatgtaaaactat

SEQ ID NO: 694688 - DNA, 13 bp, C. elegans
aatgtaaactatt

SEQ ID NO: 694689 - DNA, 13 bp, C. elegans
aatgtaaactttt

SEQ ID NO: 694690 - DNA, 13 bp, C. elegans
aatgtaaatttct

SEQ ID NO: 694691 - DNA, 13 bp, C. elegans
aatgtaacatttt

SEQ ID NO: 694692 - DNA, 13 bp, C. elegans
aatgtaattgaaa

SEQ ID NO: 694693 - DNA, 13 bp, C. elegans
aatgtacaaaaac

SEQ ID NO: 694694 - DNA, 13 bp, C. elegans
aatgtacataaat

SEQ ID NO: 694695 - DNA, 13 bp, C. elegans
aatgtacataatt

SEQ ID NO: 694696 - DNA, 13 bp, C. elegans
aatgtaccaattt

SEQ ID NO: 694697 - DNA, 13 bp, C. elegans
aatgtacgaaatt

SEQ ID NO: 694698 - DNA, 13 bp, C. elegans
aatgtacgcaatt

SEQ ID NO: 694699 - DNA, 13 bp, C. elegans
aatgtactaaaat

SEQ ID NO: 694700 - DNA, 13 bp, C. elegans
aatgtactcaaaa

SEQ ID NO: 694701 - DNA, 13 bp, C. elegans
aatgtactttttt

SEQ ID NO: 694702 - DNA, 13 bp, C. elegans
aatgtagaaaaca

SEQ ID NO: 694703 - DNA, 13 bp, C. elegans
aatgtagaaatta

SEQ ID NO: 694704 - DNA, 13 bp, C. elegans
aatgtagagaaat

SEQ ID NO: 694705 - DNA, 13 bp, C. elegans
aatgtaggatttt

SEQ ID NO: 694706 - DNA, 13 bp, C. elegans
aatgtataaatgt

SEQ ID NO: 694707 - DNA, 13 bp, C. elegans
aatgtatatgttt

SEQ ID NO: 694708 - DNA, 13 bp, C. elegans
aatgtatatttct

SEQ ID NO: 694709 - DNA, 13 bp, C. elegans
aatgtatcgattt

SEQ ID NO: 694710 - DNA, 13 bp, C. elegans
aatgtatctttta

SEQ ID NO: 694711 - DNA, 13 bp, C. elegans
aatgtatgaattt

SEQ ID NO: 694712 - DNA, 13 bp, C. elegans
aatgtattatttc

SEQ ID NO: 694713 - DNA, 13 bp, C. elegans
aatgtattcaatt

SEQ ID NO: 694714 - DNA, 13 bp, C. elegans
aatgtattctcaa

SEQ ID NO: 694715 - DNA, 13 bp, C. elegans
aatgtattctttt

SEQ ID NO: 694716 - DNA, 13 bp, C. elegans
aatgtattgaaaa

SEQ ID NO: 694717 - DNA, 13 bp, C. elegans
aatgtattgtttc

SEQ ID NO: 694718 - DNA, 13 bp, C. elegans
aatgtatttcaaa

SEQ ID NO: 694719 - DNA, 13 bp, C. elegans
aatgtattttgaa

SEQ ID NO: 694720 - DNA, 13 bp, C. elegans
aatgtattttgat

SEQ ID NO: 694721 - DNA, 13 bp, C. elegans
aatgtattttgta

SEQ ID NO: 694722 - DNA, 13 bp, C. elegans
aatgtcaaaaaac

SEQ ID NO: 694723 - DNA, 13 bp, C. elegans
aatgtcaaaaaca

SEQ ID NO: 694724 - DNA, 13 bp, C. elegans
aatgtcaaaaatc

SEQ ID NO: 694725 - DNA, 13 bp, C. elegans
aatgtcaaaacta

SEQ ID NO: 694726 - DNA, 13 bp, C. elegans
aatgtcaaaatta

SEQ ID NO: 694727 - DNA, 13 bp, C. elegans
aatgtcaaataat

SEQ ID NO: 694728 - DNA, 13 bp, C. elegans
aatgtcaaattct

SEQ ID NO: 694729 - DNA, 13 bp, C. elegans
aatgtcaaatttc

SEQ ID NO: 694730 - DNA, 13 bp, C. elegans
aatgtcaaatttt

SEQ ID NO: 694731 - DNA, 13 bp, C. elegans
aatgtcaagaaaa

SEQ ID NO: 694732 - DNA, 13 bp, C. elegans
aatgtcaatttca

SEQ ID NO: 694733 - DNA, 13 bp, C. elegans
aatgtcaatttcc

SEQ ID NO: 694734 - DNA, 13 bp, C. elegans
aatgtcacatttt

SEQ ID NO: 694735 - DNA, 13 bp, C. elegans
aatgtcagaaaaa

SEQ ID NO: 694736 - DNA, 13 bp, C. elegans
aatgtcagctttc

SEQ ID NO: 694737 - DNA, 13 bp, C. elegans
aatgtcatatttt

SEQ ID NO: 694738 - DNA, 13 bp, C. elegans
aatgtcatcaaaa

SEQ ID NO: 694739 - DNA, 13 bp, C. elegans
aatgtcccatgtc

SEQ ID NO: 694740 - DNA, 13 bp, C. elegans
aatgtcccatttc

SEQ ID NO: 694741 - DNA, 13 bp, C. elegans
aatgtcccatttt

SEQ ID NO: 694742 - DNA, 13 bp, C. elegans
aatgtccgaaatt

SEQ ID NO: 694743 - DNA, 13 bp, C. elegans
aatgtcctaaatt

SEQ ID NO: 694744 - DNA, 13 bp, C. elegans
aatgtcgaaaaaa

SEQ ID NO: 694745 - DNA, 13 bp, C. elegans
aatgtcgaaaatt

SEQ ID NO: 694746 - DNA, 13 bp, C. elegans
aatgtcgattttt

SEQ ID NO: 694747 - DNA, 13 bp, C. elegans
aatgtcggaaaat

SEQ ID NO: 694748 - DNA, 13 bp, C. elegans
aatgtcggctgct

SEQ ID NO: 694749 - DNA, 13 bp, C. elegans
aatgtctaatttt

SEQ ID NO: 694750 - DNA, 13 bp, C. elegans
aatgtctactttt

SEQ ID NO: 694751 - DNA, 13 bp, C. elegans
aatgtctcaattt

SEQ ID NO: 694752 - DNA, 13 bp, C. elegans
aatgtctgaaaaa

SEQ ID NO: 694753 - DNA, 13 bp, C. elegans
aatgtctgaaaag

SEQ ID NO: 694754 - DNA, 13 bp, C. elegans
aatgtcttcaaaa

SEQ ID NO: 694755 - DNA, 13 bp, C. elegans
aatgtcttgaaat

SEQ ID NO: 694756 - DNA, 13 bp, C. elegans
aatgtcttttttg

SEQ ID NO: 694757 - DNA, 13 bp, C. elegans
aatgtgaaaaatc

SEQ ID NO: 694758 - DNA, 13 bp, C. elegans
aatgtgaaaagtt

SEQ ID NO: 694759 - DNA, 13 bp, C. elegans
aatgtgaaaatct

SEQ ID NO: 694760 - DNA, 13 bp, C. elegans
aatgtgaacaaaa

SEQ ID NO: 694761 - DNA, 13 bp, C. elegans
aatgtgaatttcc

SEQ ID NO: 694762 - DNA, 13 bp, C. elegans
aatgtgaattttt

SEQ ID NO: 694763 - DNA, 13 bp, C. elegans
aatgtgacaaaaa

SEQ ID NO: 694764 - DNA, 13 bp, C. elegans
aatgtgataagaa

SEQ ID NO: 694765 - DNA, 13 bp, C. elegans
aatgtgatacttt

SEQ ID NO: 694766 - DNA, 13 bp, C. elegans
aatgtgattaaat

SEQ ID NO: 694767 - DNA, 13 bp, C. elegans
aatgtgatttttc

SEQ ID NO: 694768 - DNA, 13 bp, C. elegans
aatgtgcaaaaac

SEQ ID NO: 694769 - DNA, 13 bp, C. elegans
aatgtgcaaaatt

SEQ ID NO: 694770 - DNA, 13 bp, C. elegans
aatgtgcaacaaa

SEQ ID NO: 694771 - DNA, 13 bp, C. elegans
aatgtgcaatttt

SEQ ID NO: 694772 - DNA, 13 bp, C. elegans
aatgtgcactttt

SEQ ID NO: 694773 - DNA, 13 bp, C. elegans
aatgtgcataaat

SEQ ID NO: 694774 - DNA, 13 bp, C. elegans
aatgtgcattttg

SEQ ID NO: 694775 - DNA, 13 bp, C. elegans
aatgtgccaaaaa

SEQ ID NO: 694776 - DNA, 13 bp, C. elegans
aatgtgccaaaat

SEQ ID NO: 694777 - DNA, 13 bp, C. elegans
aatgtgctaaaaa

SEQ ID NO: 694778 - DNA, 13 bp, C. elegans
aatgtgctgaaat

SEQ ID NO: 694779 - DNA, 13 bp, C. elegans
aatgtggaaaagt

SEQ ID NO: 694780 - DNA, 13 bp, C. elegans
aatgtggaaaatt

SEQ ID NO: 694781 - DNA, 13 bp, C. elegans
aatgtggaaattt

SEQ ID NO: 694782 - DNA, 13 bp, C. elegans
aatgtggattttt

SEQ ID NO: 694783 - DNA, 13 bp, C. elegans
aatgtggttttta

SEQ ID NO: 694784 - DNA, 13 bp, C. elegans
aatgtgtaaaatg

SEQ ID NO: 694785 - DNA, 13 bp, C. elegans
aatgtgtagaaat

SEQ ID NO: 694786 - DNA, 13 bp, C. elegans
aatgtgtatagtt

SEQ ID NO: 694787 - DNA, 13 bp, C. elegans
aatgtgtatattt

SEQ ID NO: 694788 - DNA, 13 bp, C. elegans
aatgtgtattgat

SEQ ID NO: 694789 - DNA, 13 bp, C. elegans
aatgtgtcttttt

SEQ ID NO: 694790 - DNA, 13 bp, C. elegans
aatgtgtgtctct

SEQ ID NO: 694791 - DNA, 13 bp, C. elegans
aatgtgtgtgtat

SEQ ID NO: 694792 - DNA, 13 bp, C. elegans
aatgtgttctttc

SEQ ID NO: 694793 - DNA, 13 bp, C. elegans
aatgtgttctttt

SEQ ID NO: 694794 - DNA, 13 bp, C. elegans
aatgtgttgtatc

SEQ ID NO: 694795 - DNA, 13 bp, C. elegans
aatgtgtttaaaa

SEQ ID NO: 694796 - DNA, 13 bp, C. elegans
aatgtgtttaatt

SEQ ID NO: 694797 - DNA, 13 bp, C. elegans
aatgtgtttcaat

SEQ ID NO: 694798 - DNA, 13 bp, C. elegans
aatgtgtttcatt

SEQ ID NO: 694799 - DNA, 13 bp, C. elegans
aatgtgtttgtcc

SEQ ID NO: 694800 - DNA, 13 bp, C. elegans
aatgtgttttcaa

SEQ ID NO: 694801 - DNA, 13 bp, C. elegans
aatgttaaaaaac

SEQ ID NO: 694802 - DNA, 13 bp, C. elegans
aatgttaaaatgt

SEQ ID NO: 694803 - DNA, 13 bp, C. elegans
aatgttaaacaat

SEQ ID NO: 694804 - DNA, 13 bp, C. elegans
aatgttaactttt

SEQ ID NO: 694805 - DNA, 13 bp, C. elegans
aatgttacaattt

SEQ ID NO: 694806 - DNA, 13 bp, C. elegans
aatgttacgcaaa

SEQ ID NO: 694807 - DNA, 13 bp, C. elegans
aatgttactgttt

SEQ ID NO: 694808 - DNA, 13 bp, C. elegans
aatgttatcaaat

SEQ ID NO: 694809 - DNA, 13 bp, C. elegans
aatgttatttcaa

SEQ ID NO: 694810 - DNA, 13 bp, C. elegans
aatgttcaaaaaa

SEQ ID NO: 694811 - DNA, 13 bp, C. elegans
aatgttcaaaaat

SEQ ID NO: 694812 - DNA, 13 bp, C. elegans
aatgttcaaaagt

SEQ ID NO: 694813 - DNA, 13 bp, C. elegans
aatgttcaaaata

SEQ ID NO: 694814 - DNA, 13 bp, C. elegans
aatgttcaaaatg

SEQ ID NO: 694815 - DNA, 13 bp, C. elegans
aatgttcaaagaa

SEQ ID NO: 694816 - DNA, 13 bp, C. elegans
aatgttcaaagtt

SEQ ID NO: 694817 - DNA, 13 bp, C. elegans
aatgttcaaatac

SEQ ID NO: 694818 - DNA, 13 bp, C. elegans
aatgttcaaatgt

SEQ ID NO: 694819 - DNA, 13 bp, C. elegans
aatgttcaaattt

SEQ ID NO: 694820 - DNA, 13 bp, C. elegans
aatgttcaacaaa

SEQ ID NO: 694821 - DNA, 13 bp, C. elegans
aatgttcaactaa

SEQ ID NO: 694822 - DNA, 13 bp, C. elegans
aatgttcaactga

SEQ ID NO: 694823 - DNA, 13 bp, C. elegans
aatgttcaagaac

SEQ ID NO: 694824 - DNA, 13 bp, C. elegans
aatgttcaagaat

SEQ ID NO: 694825 - DNA, 13 bp, C. elegans
aatgttcaatatt

SEQ ID NO: 694826 - DNA, 13 bp, C. elegans
aatgttcaattat

SEQ ID NO: 694827 - DNA, 13 bp, C. elegans
aatgttcaatttc

SEQ ID NO: 694828 - DNA, 14 bp, C. elegans
aatgttcaattttt

SEQ ID NO: 694829 - DNA, 13 bp, C. elegans
aatgttcacaaaa

SEQ ID NO: 694830 - DNA, 13 bp, C. elegans
aatgttcacaaat

SEQ ID NO: 694831 - DNA, 13 bp, C. elegans
aatgttcagcata

SEQ ID NO: 694832 - DNA, 13 bp, C. elegans
aatgttcaggaga

SEQ ID NO: 694833 - DNA, 13 bp, C. elegans
aatgttcagtaaa

SEQ ID NO: 694834 - DNA, 13 bp, C. elegans
aatgttcataaaa

SEQ ID NO: 694835 - DNA, 13 bp, C. elegans
aatgttcatattg

SEQ ID NO: 694836 - DNA, 13 bp, C. elegans
aatgttcatattt

SEQ ID NO: 694837 - DNA, 13 bp, C. elegans
aatgttcattatt

SEQ ID NO: 694838 - DNA, 13 bp, C. elegans
aatgttcattttc

SEQ ID NO: 694839 - DNA, 13 bp, C. elegans
aatgttccaaaac

SEQ ID NO: 694840 - DNA, 13 bp, C. elegans
aatgttccaaaat

SEQ ID NO: 694841 - DNA, 13 bp, C. elegans
aatgttccaaatt

SEQ ID NO: 694842 - DNA, 13 bp, C. elegans
aatgttccagaaa

SEQ ID NO: 694843 - DNA, 13 bp, C. elegans
aatgttccagaac

SEQ ID NO: 694844 - DNA, 13 bp, C. elegans
aatgttcccaaaa

SEQ ID NO: 694845 - DNA, 13 bp, C. elegans
aatgttccgaaaa

SEQ ID NO: 694846 - DNA, 13 bp, C. elegans
aatgttcctacat

SEQ ID NO: 694847 - DNA, 13 bp, C. elegans
aatgttccttttt

SEQ ID NO: 694848 - DNA, 13 bp, C. elegans
aatgttcgagaaa

SEQ ID NO: 694849 - DNA, 13 bp, C. elegans
aatgttcgttttt

SEQ ID NO: 694850 - DNA, 13 bp, C. elegans
aatgttctcaaat

SEQ ID NO: 694851 - DNA, 13 bp, C. elegans
aatgttctcgaaa

SEQ ID NO: 694852 - DNA, 13 bp, C. elegans
aatgttctgagaa

SEQ ID NO: 694853 - DNA, 13 bp, C. elegans
aatgttctgattt

SEQ ID NO: 694854 - DNA, 14 bp, C. elegans
aatgttctgccaat

SEQ ID NO: 694855 - DNA, 13 bp, C. elegans
aatgttctggaaa

SEQ ID NO: 694856 - DNA, 13 bp, C. elegans
aatgttcttaatt

SEQ ID NO: 694857 - DNA, 13 bp, C. elegans
aatgttcttcttt

SEQ ID NO: 694858 - DNA, 13 bp, C. elegans
aatgttgaaaaat

SEQ ID NO: 694859 - DNA, 13 bp, C. elegans
aatgttgaaaata

SEQ ID NO: 694860 - DNA, 13 bp, C. elegans
aatgttgaaactg

SEQ ID NO: 694861 - DNA, 13 bp, C. elegans
aatgttgaaattc

SEQ ID NO: 694862 - DNA, 13 bp, C. elegans
aatgttgaattga

SEQ ID NO: 694863 - DNA, 13 bp, C. elegans
aatgttgaatttc

SEQ ID NO: 694864 - DNA, 13 bp, C. elegans
aatgttgagcaaa

SEQ ID NO: 694865 - DNA, 13 bp, C. elegans
aatgttgatttct

SEQ ID NO: 694866 - DNA, 13 bp, C. elegans
aatgttgcaaaag

SEQ ID NO: 694867 - DNA, 13 bp, C. elegans
aatgttgcacttt

SEQ ID NO: 694868 - DNA, 13 bp, C. elegans
aatgttgcatgtt

SEQ ID NO: 694869 - DNA, 13 bp, C. elegans
aatgttgccattt

SEQ ID NO: 694870 - DNA, 13 bp, C. elegans
aatgttggaaaaa

SEQ ID NO: 694871 - DNA, 13 bp, C. elegans
aatgttggaaaag

SEQ ID NO: 694872 - DNA, 13 bp, C. elegans
aatgttggaatat

SEQ ID NO: 694873 - DNA, 13 bp, C. elegans
aatgttggaattt

SEQ ID NO: 694874 - DNA, 13 bp, C. elegans
aatgttggcagga

SEQ ID NO: 694875 - DNA, 13 bp, C. elegans
aatgttgtcaaaa

SEQ ID NO: 694876 - DNA, 13 bp, C. elegans
aatgttgtcaatt

SEQ ID NO: 694877 - DNA, 13 bp, C. elegans
aatgttgtgcaat

SEQ ID NO: 694878 - DNA, 13 bp, C. elegans
aatgttgttgaaa

SEQ ID NO: 694879 - DNA, 13 bp, C. elegans
aatgtttaaactt

SEQ ID NO: 694880 - DNA, 13 bp, C. elegans
aatgtttaactat

SEQ ID NO: 694881 - DNA, 13 bp, C. elegans
aatgtttaacttt

SEQ ID NO: 694882 - DNA, 13 bp, C. elegans
aatgtttaatctt

SEQ ID NO: 694883 - DNA, 13 bp, C. elegans
aatgtttaattct

SEQ ID NO: 694884 - DNA, 13 bp, C. elegans
aatgtttacaaat

SEQ ID NO: 694885 - DNA, 13 bp, C. elegans
aatgtttacattt

SEQ ID NO: 694886 - DNA, 13 bp, C. elegans
aatgtttactgtt

SEQ ID NO: 694887 - DNA, 13 bp, C. elegans
aatgtttactttt

SEQ ID NO: 694888 - DNA, 13 bp, C. elegans
aatgtttagaaaa

SEQ ID NO: 694889 - DNA, 13 bp, C. elegans
aatgtttatcaaa

SEQ ID NO: 694890 - DNA, 13 bp, C. elegans
aatgtttatgatt

SEQ ID NO: 694891 - DNA, 13 bp, C. elegans
aatgtttatttac

SEQ ID NO: 694892 - DNA, 13 bp, C. elegans
aatgtttatttca

SEQ ID NO: 694893 - DNA, 13 bp, C. elegans
aatgtttattttc

SEQ ID NO: 694894 - DNA, 13 bp, C. elegans
aatgtttcaaaaa

SEQ ID NO: 694895 - DNA, 13 bp, C. elegans
aatgtttcaaaca

SEQ ID NO: 694896 - DNA, 13 bp, C. elegans
aatgtttcaaatt

SEQ ID NO: 694897 - DNA, 13 bp, C. elegans
aatgtttcaacaa

SEQ ID NO: 694898 - DNA, 13 bp, C. elegans
aatgtttcaagaa

SEQ ID NO: 694899 - DNA, 13 bp, C. elegans
aatgtttcaataa

SEQ ID NO: 694900 - DNA, 13 bp, C. elegans
aatgtttcaatga

SEQ ID NO: 694901 - DNA, 13 bp, C. elegans
aatgtttcacttt

SEQ ID NO: 694902 - DNA, 13 bp, C. elegans
aatgtttcagatt

SEQ ID NO: 694903 - DNA, 13 bp, C. elegans
aatgtttcaggaa

SEQ ID NO: 694904 - DNA, 13 bp, C. elegans
aatgtttcagttg

SEQ ID NO: 694905 - DNA, 13 bp, C. elegans
aatgtttcataaa

SEQ ID NO: 694906 - DNA, 13 bp, C. elegans
aatgtttcatgtt

SEQ ID NO: 694907 - DNA, 13 bp, C. elegans
aatgtttcattca

SEQ ID NO: 694908 - DNA, 13 bp, C. elegans
aatgtttcattgt

SEQ ID NO: 694909 - DNA, 13 bp, C. elegans
aatgtttcccaat

SEQ ID NO: 694910 - DNA, 13 bp, C. elegans
aatgtttcgaaac

SEQ ID NO: 694911 - DNA, 13 bp, C. elegans
aatgtttcgaaat

SEQ ID NO: 694912 - DNA, 13 bp, C. elegans
aatgtttcgattt

SEQ ID NO: 694913 - DNA, 13 bp, C. elegans
aatgtttcgtttt

SEQ ID NO: 694914 - DNA, 13 bp, C. elegans
aatgtttctacat

SEQ ID NO: 694915 - DNA, 13 bp, C. elegans
aatgtttctgatt

SEQ ID NO: 694916 - DNA, 13 bp, C. elegans
aatgtttctggaa

SEQ ID NO: 694917 - DNA, 13 bp, C. elegans
aatgtttcttatt

SEQ ID NO: 694918 - DNA, 13 bp, C. elegans
aatgtttcttgaa

SEQ ID NO: 694919 - DNA, 13 bp, C. elegans
aatgtttctttct

SEQ ID NO: 694920 - DNA, 13 bp, C. elegans
aatgtttctttta

SEQ ID NO: 694921 - DNA, 13 bp, C. elegans
aatgtttcttttc

SEQ ID NO: 694922 - DNA, 13 bp, C. elegans
aatgtttgaaaat

SEQ ID NO: 694923 - DNA, 13 bp, C. elegans
aatgtttgaaatt

SEQ ID NO: 694924 - DNA, 13 bp, C. elegans
aatgtttgaacaa

SEQ ID NO: 694925 - DNA, 13 bp, C. elegans
aatgtttgaatag

SEQ ID NO: 694926 - DNA, 13 bp, C. elegans
aatgtttgaattg

SEQ ID NO: 694927 - DNA, 13 bp, C. elegans
aatgtttgataaa

SEQ ID NO: 694928 - DNA, 13 bp, C. elegans
aatgtttgataat

SEQ ID NO: 694929 - DNA, 13 bp, C. elegans
aatgtttgattct

SEQ ID NO: 694930 - DNA, 13 bp, C. elegans
aatgtttgatttc

SEQ ID NO: 694931 - DNA, 13 bp, C. elegans
aatgtttgcaaaa

SEQ ID NO: 694932 - DNA, 13 bp, C. elegans
aatgtttgcaatt

SEQ ID NO: 694933 - DNA, 13 bp, C. elegans
aatgtttggaaaa

SEQ ID NO: 694934 - DNA, 13 bp, C. elegans
aatgtttggaaat

SEQ ID NO: 694935 - DNA, 13 bp, C. elegans
aatgtttgtaaat

SEQ ID NO: 694936 - DNA, 13 bp, C. elegans
aatgtttgtagtt

SEQ ID NO: 694937 - DNA, 13 bp, C. elegans
aatgtttgttctt

SEQ ID NO: 694938 - DNA, 13 bp, C. elegans
aatgttttaatac

SEQ ID NO: 694939 - DNA, 13 bp, C. elegans
aatgttttaccaa

SEQ ID NO: 694940 - DNA, 13 bp, C. elegans
aatgttttacttt

SEQ ID NO: 694941 - DNA, 13 bp, C. elegans
aatgttttattcc

SEQ ID NO: 694942 - DNA, 13 bp, C. elegans
aatgttttcaagc

SEQ ID NO: 694943 - DNA, 13 bp, C. elegans
aatgttttcatat

SEQ ID NO: 694944 - DNA, 13 bp, C. elegans
aatgttttcatta

SEQ ID NO: 694945 - DNA, 13 bp, C. elegans
aatgttttcctca

SEQ ID NO: 694946 - DNA, 13 bp, C. elegans
aatgttttcgata

SEQ ID NO: 694947 - DNA, 13 bp, C. elegans
aatgttttctaaa

SEQ ID NO: 694948 - DNA, 13 bp, C. elegans
aatgttttctact

SEQ ID NO: 694949 - DNA, 13 bp, C. elegans
aatgttttctagt

SEQ ID NO: 694950 - DNA, 13 bp, C. elegans
aatgttttctatg

SEQ ID NO: 694951 - DNA, 13 bp, C. elegans
aatgttttctcaa

SEQ ID NO: 694952 - DNA, 13 bp, C. elegans
aatgttttctgaa

SEQ ID NO: 694953 - DNA, 13 bp, C. elegans
aatgttttctgat

SEQ ID NO: 694954 - DNA, 13 bp, C. elegans
aatgttttcttct

SEQ ID NO: 694955 - DNA, 13 bp, C. elegans
aatgttttcttgt

SEQ ID NO: 694956 - DNA, 13 bp, C. elegans
aatgttttgaaac

SEQ ID NO: 694957 - DNA, 13 bp, C. elegans
aatgttttgaaat

SEQ ID NO: 694958 - DNA, 13 bp, C. elegans
aatgttttgaata

SEQ ID NO: 694959 - DNA, 13 bp, C. elegans
aatgttttgatat

SEQ ID NO: 694960 - DNA, 13 bp, C. elegans
aatgttttgttcc

SEQ ID NO: 694961 - DNA, 13 bp, C. elegans
aatgtttttatac

SEQ ID NO: 694962 - DNA, 13 bp, C. elegans
aatgtttttcaca

SEQ ID NO: 694963 - DNA, 13 bp, C. elegans
aatgtttttcatc

SEQ ID NO: 694964 - DNA, 13 bp, C. elegans
aatgtttttcatt

SEQ ID NO: 694965 - DNA, 13 bp, C. elegans
aatgtttttcgaa

SEQ ID NO: 694966 - DNA, 13 bp, C. elegans
aatgtttttctac

SEQ ID NO: 694967 - DNA, 13 bp, C. elegans
aatgtttttcttc

SEQ ID NO: 694968 - DNA, 13 bp, C. elegans
aatgtttttcttg

SEQ ID NO: 694969 - DNA, 13 bp, C. elegans
aatgtttttgaaa

SEQ ID NO: 694970 - DNA, 13 bp, C. elegans
aatgtttttgggt

SEQ ID NO: 694971 - DNA, 13 bp, C. elegans
aatgttttttatc

SEQ ID NO: 694972 - DNA, 13 bp, C. elegans
aatgttttttcaa

SEQ ID NO: 694973 - DNA, 14 bp, C. elegans
aatgttttttgaaa

SEQ ID NO: 694974 - DNA, 13 bp, C. elegans
aatgtttttttca

SEQ ID NO: 694975 - DNA, 13 bp, C. elegans
aattaaaaaccga

SEQ ID NO: 694976 - DNA, 13 bp, C. elegans
aattaaaaacgtg

SEQ ID NO: 694977 - DNA, 13 bp, C. elegans
aattaaaaactga

SEQ ID NO: 694978 - DNA, 13 bp, C. elegans
aattaaaaatcga

SEQ ID NO: 694979 - DNA, 13 bp, C. elegans
aattaaaactaga

SEQ ID NO: 694980 - DNA, 13 bp, C. elegans
aattaaaactgaa

SEQ ID NO: 694981 - DNA, 13 bp, C. elegans
aattaaaactgtt

SEQ ID NO: 694982 - DNA, 13 bp, C. elegans
aattaaaacttct

SEQ ID NO: 694983 - DNA, 13 bp, C. elegans
aattaaaatcaga

SEQ ID NO: 694984 - DNA, 13 bp, C. elegans
aattaaaattgca

SEQ ID NO: 694985 - DNA, 13 bp, C. elegans
aattaaaatttcc

SEQ ID NO: 694986 - DNA, 13 bp, C. elegans
aattaaacatttc

SEQ ID NO: 694987 - DNA, 13 bp, C. elegans
aattaaaccttgc

SEQ ID NO: 694988 - DNA, 13 bp, C. elegans
aattaaacgtttt

SEQ ID NO: 694989 - DNA, 13 bp, C. elegans
aattaaacttgtt

SEQ ID NO: 694990 - DNA, 13 bp, C. elegans
aattaaagtttca

SEQ ID NO: 694991 - DNA, 13 bp, C. elegans
aattaaagttttg

SEQ ID NO: 694992 - DNA, 13 bp, C. elegans
aattaaatacgtt

SEQ ID NO: 694993 - DNA, 13 bp, C. elegans
aattaaatctcaa

SEQ ID NO: 694994 - DNA, 13 bp, C. elegans
aattaaatgaaac

SEQ ID NO: 694995 - DNA, 13 bp, C. elegans
aattaaatgagat

SEQ ID NO: 694996 - DNA, 13 bp, C. elegans
aattaaatgtgaa

SEQ ID NO: 694997 - DNA, 13 bp, C. elegans
aattaaatgtttc

SEQ ID NO: 694998 - DNA, 13 bp, C. elegans
aattaaattccag

SEQ ID NO: 694999 - DNA, 13 bp, C. elegans
aattaaattcgaa

SEQ ID NO: 695000 - DNA, 13 bp, C. elegans
aattaaattcgat

SEQ ID NO: 695001 - DNA, 13 bp, C. elegans
aattaaattctca

SEQ ID NO: 695002 - DNA, 13 bp, C. elegans
aattaaattctcc

SEQ ID NO: 695003 - DNA, 13 bp, C. elegans
aattaaattctga

SEQ ID NO: 695004 - DNA, 13 bp, C. elegans
aattaaattcttg

SEQ ID NO: 695005 - DNA, 13 bp, C. elegans
aattaaatttgct

SEQ ID NO: 695006 - DNA, 13 bp, C. elegans
aattaacaacatt

SEQ ID NO: 695007 - DNA, 13 bp, C. elegans
aattaacatcatt

SEQ ID NO: 695008 - DNA, 13 bp, C. elegans
aattaacatttct

SEQ ID NO: 695009 - DNA, 13 bp, C. elegans
aattaacatttgt

SEQ ID NO: 695010 - DNA, 14 bp, C. elegans
aattaaccatttta

SEQ ID NO: 695011 - DNA, 13 bp, C. elegans
aattaacgttttt

SEQ ID NO: 695012 - DNA, 13 bp, C. elegans
aattaactactaa

SEQ ID NO: 695013 - DNA, 13 bp, C. elegans
aattaactttcaa

SEQ ID NO: 695014 - DNA, 13 bp, C. elegans
aattaagaaatgt

SEQ ID NO: 695015 - DNA, 13 bp, C. elegans
aattaagaaattg

SEQ ID NO: 695016 - DNA, 13 bp, C. elegans
aattaatacagaa

SEQ ID NO: 695017 - DNA, 13 bp, C. elegans
aattaatcaactt

SEQ ID NO: 695018 - DNA, 13 bp, C. elegans
aattaatcaatga

SEQ ID NO: 695019 - DNA, 13 bp, C. elegans
aattaatcgataa

SEQ ID NO: 695020 - DNA, 13 bp, C. elegans
aattaatcgattt

SEQ ID NO: 695021 - DNA, 13 bp, C. elegans
aattaatcttcaa

SEQ ID NO: 695022 - DNA, 13 bp, C. elegans
aattaatgtttca

SEQ ID NO: 695023 - DNA, 13 bp, C. elegans
aattaattatgag

SEQ ID NO: 695024 - DNA, 13 bp, C. elegans
aattaattcaaca

SEQ ID NO: 695025 - DNA, 13 bp, C. elegans
aattaattcactt

SEQ ID NO: 695026 - DNA, 13 bp, C. elegans
aattaattccaaa

SEQ ID NO: 695027 - DNA, 13 bp, C. elegans
aattaattcgaat

SEQ ID NO: 695028 - DNA, 13 bp, C. elegans
aattaattctaga

SEQ ID NO: 695029 - DNA, 13 bp, C. elegans
aattaattgttct

SEQ ID NO: 695030 - DNA, 13 bp, C. elegans
aattaatttcaac

SEQ ID NO: 695031 - DNA, 13 bp, C. elegans
aattaatttcact

SEQ ID NO: 695032 - DNA, 13 bp, C. elegans
aattaatttccag

SEQ ID NO: 695033 - DNA, 13 bp, C. elegans
aattaatttcgaa

SEQ ID NO: 695034 - DNA, 13 bp, C. elegans
aattaatttctgt

SEQ ID NO: 695035 - DNA, 13 bp, C. elegans
aattaatttggaa

SEQ ID NO: 695036 - DNA, 13 bp, C. elegans
aattaatttgtga

SEQ ID NO: 695037 - DNA, 13 bp, C. elegans
aattaattttcag

SEQ ID NO: 695038 - DNA, 13 bp, C. elegans
aattaattttcca

SEQ ID NO: 695039 - DNA, 13 bp, C. elegans
aattaattttcga

SEQ ID NO: 695040 - DNA, 13 bp, C. elegans
aattaattttgct

SEQ ID NO: 695041 - DNA, 13 bp, C. elegans
aattaatttttcg

SEQ ID NO: 695042 - DNA, 13 bp, C. elegans
aattacaaaattg

SEQ ID NO: 695043 - DNA, 13 bp, C. elegans
aattacaattaca

SEQ ID NO: 695044 - DNA, 13 bp, C. elegans
aattacaatttct

SEQ ID NO: 695045 - DNA, 13 bp, C. elegans
aattacacaattt

SEQ ID NO: 695046 - DNA, 13 bp, C. elegans
aattacacagaaa

SEQ ID NO: 695047 - DNA, 13 bp, C. elegans
aattacacgtttt

SEQ ID NO: 695048 - DNA, 13 bp, C. elegans
aattacagctttt

SEQ ID NO: 695049 - DNA, 13 bp, C. elegans
aattacagtaaaa

SEQ ID NO: 695050 - DNA, 13 bp, C. elegans
aattacagtaacc

SEQ ID NO: 695051 - DNA, 13 bp, C. elegans
aattacagtactc

SEQ ID NO: 695052 - DNA, 13 bp, C. elegans
aattacagtagtt

SEQ ID NO: 695053 - DNA, 13 bp, C. elegans
aattacagtattc

SEQ ID NO: 695054 - DNA, 13 bp, C. elegans
aattacagttttc

SEQ ID NO: 695055 - DNA, 13 bp, C. elegans
aattacatagttt

SEQ ID NO: 695056 - DNA, 13 bp, C. elegans
aattacattttca

SEQ ID NO: 695057 - DNA, 13 bp, C. elegans
aattacatttttg

SEQ ID NO: 695058 - DNA, 13 bp, C. elegans
aattaccaaaagt

SEQ ID NO: 695059 - DNA, 13 bp, C. elegans
aattaccaaaatg

SEQ ID NO: 695060 - DNA, 13 bp, C. elegans
aattaccaaaatt

SEQ ID NO: 695061 - DNA, 13 bp, C. elegans
aattaccaatatt

SEQ ID NO: 695062 - DNA, 13 bp, C. elegans
aattaccaattat

SEQ ID NO: 695063 - DNA, 13 bp, C. elegans
aattaccactttt

SEQ ID NO: 695064 - DNA, 13 bp, C. elegans
aattaccatatat

SEQ ID NO: 695065 - DNA, 13 bp, C. elegans
aattaccattttc

SEQ ID NO: 695066 - DNA, 13 bp, C. elegans
aattaccgaaaac

SEQ ID NO: 695067 - DNA, 13 bp, C. elegans
aattaccgaaatt

SEQ ID NO: 695068 - DNA, 13 bp, C. elegans
aattaccgatttg

SEQ ID NO: 695069 - DNA, 13 bp, C. elegans
aattaccggaaat

SEQ ID NO: 695070 - DNA, 13 bp, C. elegans
aattaccgtcaaa

SEQ ID NO: 695071 - DNA, 13 bp, C. elegans
aattacgaaaata

SEQ ID NO: 695072 - DNA, 13 bp, C. elegans
aattacgaatttc

SEQ ID NO: 695073 - DNA, 13 bp, C. elegans
aattacgtgaaat

SEQ ID NO: 695074 - DNA, 13 bp, C. elegans
aattacgttttaa

SEQ ID NO: 695075 - DNA, 13 bp, C. elegans
aattactagaaat

SEQ ID NO: 695076 - DNA, 13 bp, C. elegans
aattactattcaa

SEQ ID NO: 695077 - DNA, 13 bp, C. elegans
aattactccaaaa

SEQ ID NO: 695078 - DNA, 13 bp, C. elegans
aattactcgaaaa

SEQ ID NO: 695079 - DNA, 13 bp, C. elegans
aattactctgaaa

SEQ ID NO: 695080 - DNA, 13 bp, C. elegans
aattactgaaact

SEQ ID NO: 695081 - DNA, 13 bp, C. elegans
aattactggaaaa

SEQ ID NO: 695082 - DNA, 13 bp, C. elegans
aattactggaata

SEQ ID NO: 695083 - DNA, 13 bp, C. elegans
aattactgtaact

SEQ ID NO: 695084 - DNA, 13 bp, C. elegans
aattactgtcaaa

SEQ ID NO: 695085 - DNA, 13 bp, C. elegans
aattactgtttta

SEQ ID NO: 695086 - DNA, 13 bp, C. elegans
aattacttcaaat

SEQ ID NO: 695087 - DNA, 13 bp, C. elegans
aattacttttcaa

SEQ ID NO: 695088 - DNA, 13 bp, C. elegans
aattactttttcc

SEQ ID NO: 695089 - DNA, 13 bp, C. elegans
aattagaaaatgc

SEQ ID NO: 695090 - DNA, 13 bp, C. elegans
aattagaaagttt

SEQ ID NO: 695091 - DNA, 13 bp, C. elegans
aattagaaatgta

SEQ ID NO: 695092 - DNA, 13 bp, C. elegans
aattagaacaatt

SEQ ID NO: 695093 - DNA, 13 bp, C. elegans
aattagaatttct

SEQ ID NO: 695094 - DNA, 13 bp, C. elegans
aattagacaattt

SEQ ID NO: 695095 - DNA, 13 bp, C. elegans
aattagacggtga

SEQ ID NO: 695096 - DNA, 15 bp, C. elegans
aattagagtcagaaa

SEQ ID NO: 695097 - DNA, 13 bp, C. elegans
aattagagttttt

SEQ ID NO: 695098 - DNA, 13 bp, C. elegans
aattagatatttc

SEQ ID NO: 695099 - DNA, 13 bp, C. elegans
aattagcatattt

SEQ ID NO: 695100 - DNA, 13 bp, C. elegans
aattagcattaaa

SEQ ID NO: 695101 - DNA, 13 bp, C. elegans
aattagggaaaat

SEQ ID NO: 695102 - DNA, 13 bp, C. elegans
aattaggggaaaa

SEQ ID NO: 695103 - DNA, 13 bp, C. elegans
aattagggttttt

SEQ ID NO: 695104 - DNA, 13 bp, C. elegans
aattagtagattt

SEQ ID NO: 695105 - DNA, 13 bp, C. elegans
aattagtcaaatt

SEQ ID NO: 695106 - DNA, 13 bp, C. elegans
aattagtcaattt

SEQ ID NO: 695107 - DNA, 13 bp, C. elegans
aattagtcgaaaa

SEQ ID NO: 695108 - DNA, 13 bp, C. elegans
aattagtctgaaa

SEQ ID NO: 695109 - DNA, 13 bp, C. elegans
aattagtgatatt

SEQ ID NO: 695110 - DNA, 13 bp, C. elegans
aattagttagaaa

SEQ ID NO: 695111 - DNA, 13 bp, C. elegans
aattagttcattt

SEQ ID NO: 695112 - DNA, 13 bp, C. elegans
aattagttgaaaa

SEQ ID NO: 695113 - DNA, 13 bp, C. elegans
aattagttgtaga

SEQ ID NO: 695114 - DNA, 13 bp, C. elegans
aattagtttcaaa

SEQ ID NO: 695115 - DNA, 13 bp, C. elegans
aattagtttgaaa

SEQ ID NO: 695116 - DNA, 13 bp, C. elegans
aattagtttggaa

SEQ ID NO: 695117 - DNA, 13 bp, C. elegans
aattataaatgca

SEQ ID NO: 695118 - DNA, 13 bp, C. elegans
aattataactgaa

SEQ ID NO: 695119 - DNA, 13 bp, C. elegans
aattatacatttc

SEQ ID NO: 695120 - DNA, 13 bp, C. elegans
aattatagtttca

SEQ ID NO: 695121 - DNA, 13 bp, C. elegans
aattatagttttg

SEQ ID NO: 695122 - DNA, 13 bp, C. elegans
aattatatgaaca

SEQ ID NO: 695123 - DNA, 13 bp, C. elegans
aattatattcaga

SEQ ID NO: 695124 - DNA, 13 bp, C. elegans
aattatattcggt

SEQ ID NO: 695125 - DNA, 13 bp, C. elegans
aattatattctca

SEQ ID NO: 695126 - DNA, 13 bp, C. elegans
aattatattggaa

SEQ ID NO: 695127 - DNA, 13 bp, C. elegans
aattatatttctc

SEQ ID NO: 695128 - DNA, 13 bp, C. elegans
aattatcaaagtt

SEQ ID NO: 695129 - DNA, 13 bp, C. elegans
aattatcaacatt

SEQ ID NO: 695130 - DNA, 13 bp, C. elegans
aattatcaagaaa

SEQ ID NO: 695131 - DNA, 13 bp, C. elegans
aattatcaagttt

SEQ ID NO: 695132 - DNA, 13 bp, C. elegans
aattatcaatttg

SEQ ID NO: 695133 - DNA, 13 bp, C. elegans
aattatcactgtt

SEQ ID NO: 695134 - DNA, 13 bp, C. elegans
aattatcactttt

SEQ ID NO: 695135 - DNA, 13 bp, C. elegans
aattatcagaaaa

SEQ ID NO: 695136 - DNA, 13 bp, C. elegans
aattatcatttac

SEQ ID NO: 695137 - DNA, 13 bp, C. elegans
aattatcattttc

SEQ ID NO: 695138 - DNA, 13 bp, C. elegans
aattatccaaatt

SEQ ID NO: 695139 - DNA, 13 bp, C. elegans
aattatccatttt

SEQ ID NO: 695140 - DNA, 13 bp, C. elegans
aattatccgaaaa

SEQ ID NO: 695141 - DNA, 13 bp, C. elegans
aattatccgattt

SEQ ID NO: 695142 - DNA, 13 bp, C. elegans
aattatcgaaata

SEQ ID NO: 695143 - DNA, 13 bp, C. elegans
aattatcgatgtt

SEQ ID NO: 695144 - DNA, 13 bp, C. elegans
aattatcgattta

SEQ ID NO: 695145 - DNA, 13 bp, C. elegans
aattatcgatttg

SEQ ID NO: 695146 - DNA, 13 bp, C. elegans
aattatcgatttt

SEQ ID NO: 695147 - DNA, 13 bp, C. elegans
aattatcggaaaa

SEQ ID NO: 695148 - DNA, 13 bp, C. elegans
aattatcgtattt

SEQ ID NO: 695149 - DNA, 13 bp, C. elegans
aattatcgttttt

SEQ ID NO: 695150 - DNA, 13 bp, C. elegans
aattatctacaaa

SEQ ID NO: 695151 - DNA, 13 bp, C. elegans
aattatctggaaa

SEQ ID NO: 695152 - DNA, 13 bp, C. elegans
aattatctgtttc

SEQ ID NO: 695153 - DNA, 13 bp, C. elegans
aattatctttcaa

SEQ ID NO: 695154 - DNA, 13 bp, C. elegans
aattatctttgaa

SEQ ID NO: 695155 - DNA, 13 bp, C. elegans
aattatcttttac

SEQ ID NO: 695156 - DNA, 13 bp, C. elegans
aattatgaaaact

SEQ ID NO: 695157 - DNA, 13 bp, C. elegans
aattatgaaaatg

SEQ ID NO: 695158 - DNA, 13 bp, C. elegans
aattatgaaacaa

SEQ ID NO: 695159 - DNA, 13 bp, C. elegans
aattatgaaattg

SEQ ID NO: 695160 - DNA, 13 bp, C. elegans
aattatgaacatt

SEQ ID NO: 695161 - DNA, 13 bp, C. elegans
aattatgaattct

SEQ ID NO: 695162 - DNA, 13 bp, C. elegans
aattatgacaaat

SEQ ID NO: 695163 - DNA, 13 bp, C. elegans
aattatgagaatt

SEQ ID NO: 695164 - DNA, 13 bp, C. elegans
aattatgaggttt

SEQ ID NO: 695165 - DNA, 13 bp, C. elegans
aattatgagtttt

SEQ ID NO: 695166 - DNA, 13 bp, C. elegans
aattatgatgttt

SEQ ID NO: 695167 - DNA, 13 bp, C. elegans
aattatgatttct

SEQ ID NO: 695168 - DNA, 13 bp, C. elegans
aattatgcaaaat

SEQ ID NO: 695169 - DNA, 13 bp, C. elegans
aattatggaaaat

SEQ ID NO: 695170 - DNA, 13 bp, C. elegans
aattatggaaatg

SEQ ID NO: 695171 - DNA, 13 bp, C. elegans
aattatggatttt

SEQ ID NO: 695172 - DNA, 13 bp, C. elegans
aattatgggaaaa

SEQ ID NO: 695173 - DNA, 13 bp, C. elegans
aattatggtattt

SEQ ID NO: 695174 - DNA, 13 bp, C. elegans
aattatgtcaatt

SEQ ID NO: 695175 - DNA, 13 bp, C. elegans
aattatgtgaaaa

SEQ ID NO: 695176 - DNA, 13 bp, C. elegans
aattatgtttgaa

SEQ ID NO: 695177 - DNA, 13 bp, C. elegans
aattatgttttca

SEQ ID NO: 695178 - DNA, 13 bp, C. elegans
aattatgttttct

SEQ ID NO: 695179 - DNA, 13 bp, C. elegans
aattattaactac

SEQ ID NO: 695180 - DNA, 13 bp, C. elegans
aattattacgaaa

SEQ ID NO: 695181 - DNA, 13 bp, C. elegans
aattattactgtt

SEQ ID NO: 695182 - DNA, 13 bp, C. elegans
aattattatggaa

SEQ ID NO: 695183 - DNA, 13 bp, C. elegans
aattattattcca

SEQ ID NO: 695184 - DNA, 13 bp, C. elegans
aattattatttcc

SEQ ID NO: 695185 - DNA, 13 bp, C. elegans
aattattcaaaga

SEQ ID NO: 695186 - DNA, 13 bp, C. elegans
aattattcaagaa

SEQ ID NO: 695187 - DNA, 13 bp, C. elegans
aattattcaattc

SEQ ID NO: 695188 - DNA, 13 bp, C. elegans
aattattcagtta

SEQ ID NO: 695189 - DNA, 13 bp, C. elegans
aattattcattca

SEQ ID NO: 695190 - DNA, 13 bp, C. elegans
aattattcattct

SEQ ID NO: 695191 - DNA, 13 bp, C. elegans
aattattcatttc

SEQ ID NO: 695192 - DNA, 13 bp, C. elegans
aattattccaaaa

SEQ ID NO: 695193 - DNA, 13 bp, C. elegans
aattattccaatt

SEQ ID NO: 695194 - DNA, 13 bp, C. elegans
aattattccagaa

SEQ ID NO: 695195 - DNA, 13 bp, C. elegans
aattattcgaatt

SEQ ID NO: 695196 - DNA, 13 bp, C. elegans
aattattcggaaa

SEQ ID NO: 695197 - DNA, 13 bp, C. elegans
aattattcgtttt

SEQ ID NO: 695198 - DNA, 13 bp, C. elegans
aattattgaaaac

SEQ ID NO: 695199 - DNA, 13 bp, C. elegans
aattattgaaaca

SEQ ID NO: 695200 - DNA, 13 bp, C. elegans
aattattgaatga

SEQ ID NO: 695201 - DNA, 13 bp, C. elegans
aattattgacttt

SEQ ID NO: 695202 - DNA, 13 bp, C. elegans
aattattgagtaa

SEQ ID NO: 695203 - DNA, 14 bp, C. elegans
aattattgattgaa

SEQ ID NO: 695204 - DNA, 13 bp, C. elegans
aattattgcaaaa

SEQ ID NO: 695205 - DNA, 13 bp, C. elegans
aattattgcaata

SEQ ID NO: 695206 - DNA, 13 bp, C. elegans
aattattgcaatt

SEQ ID NO: 695207 - DNA, 14 bp, C. elegans
aattattgcatttt

SEQ ID NO: 695208 - DNA, 13 bp, C. elegans
aattattgcgaaa

SEQ ID NO: 695209 - DNA, 13 bp, C. elegans
aattattgcttta

SEQ ID NO: 695210 - DNA, 13 bp, C. elegans
aattattggattt

SEQ ID NO: 695211 - DNA, 13 bp, C. elegans
aattattggcaaa

SEQ ID NO: 695212 - DNA, 13 bp, C. elegans
aattattgtcaaa

SEQ ID NO: 695213 - DNA, 13 bp, C. elegans
aattattgttaca

SEQ ID NO: 695214 - DNA, 13 bp, C. elegans
aattattgttcaa

SEQ ID NO: 695215 - DNA, 13 bp, C. elegans
aattattgttttc

SEQ ID NO: 695216 - DNA, 13 bp, C. elegans
aattatttatgtc

SEQ ID NO: 695217 - DNA, 13 bp, C. elegans
aattatttcaatg

SEQ ID NO: 695218 - DNA, 13 bp, C. elegans
aattatttcactt

SEQ ID NO: 695219 - DNA, 13 bp, C. elegans
aattatttcagat

SEQ ID NO: 695220 - DNA, 13 bp, C. elegans
aattatttcatgt

SEQ ID NO: 695221 - DNA, 13 bp, C. elegans
aattatttcgaaa

SEQ ID NO: 695222 - DNA, 13 bp, C. elegans
aattatttctcaa

SEQ ID NO: 695223 - DNA, 13 bp, C. elegans
aattatttctcag

SEQ ID NO: 695224 - DNA, 13 bp, C. elegans
aattatttgaact

SEQ ID NO: 695225 - DNA, 13 bp, C. elegans
aattatttgagaa

SEQ ID NO: 695226 - DNA, 13 bp, C. elegans
aattatttgattg

SEQ ID NO: 695227 - DNA, 13 bp, C. elegans
aattatttgcaaa

SEQ ID NO: 695228 - DNA, 13 bp, C. elegans
aattatttgcatt

SEQ ID NO: 695229 - DNA, 13 bp, C. elegans
aattatttgctca

SEQ ID NO: 695230 - DNA, 13 bp, C. elegans
aattatttggatt

SEQ ID NO: 695231 - DNA, 13 bp, C. elegans
aattatttgtatc

SEQ ID NO: 695232 - DNA, 13 bp, C. elegans
aattattttactc

SEQ ID NO: 695233 - DNA, 13 bp, C. elegans
aattattttcact

SEQ ID NO: 695234 - DNA, 13 bp, C. elegans
aattattttcaga

SEQ ID NO: 695235 - DNA, 13 bp, C. elegans
aattattttcagc

SEQ ID NO: 695236 - DNA, 13 bp, C. elegans
aattattttccaa

SEQ ID NO: 695237 - DNA, 13 bp, C. elegans
aattattttccat

SEQ ID NO: 695238 - DNA, 13 bp, C. elegans
aattattttcctc

SEQ ID NO: 695239 - DNA, 13 bp, C. elegans
aattattttcttg

SEQ ID NO: 695240 - DNA, 13 bp, C. elegans
aattattttgact

SEQ ID NO: 695241 - DNA, 13 bp, C. elegans
aattattttgcag

SEQ ID NO: 695242 - DNA, 13 bp, C. elegans
aattattttggca

SEQ ID NO: 695243 - DNA, 13 bp, C. elegans
aattatttttcca

SEQ ID NO: 695244 - DNA, 13 bp, C. elegans
aattatttttcgg

SEQ ID NO: 695245 - DNA, 13 bp, C. elegans
aattatttttctg

SEQ ID NO: 695246 - DNA, 14 bp, C. elegans
aattcaaaaaagtt

SEQ ID NO: 695247 - DNA, 13 bp, C. elegans
aattcaaaaaatg

SEQ ID NO: 695248 - DNA, 13 bp, C. elegans
aattcaaaaactt

SEQ ID NO: 695249 - DNA, 13 bp, C. elegans
aattcaaaaagat

SEQ ID NO: 695250 - DNA, 13 bp, C. elegans
aattcaaaaatag

SEQ ID NO: 695251 - DNA, 13 bp, C. elegans
aattcaaaacatc

SEQ ID NO: 695252 - DNA, 13 bp, C. elegans
aattcaaaactag

SEQ ID NO: 695253 - DNA, 13 bp, C. elegans
aattcaaaactat

SEQ ID NO: 695254 - DNA, 13 bp, C. elegans
aattcaaaactct

SEQ ID NO: 695255 - DNA, 13 bp, C. elegans
aattcaaaactgc

SEQ ID NO: 695256 - DNA, 13 bp, C. elegans
aattcaaaacttt

SEQ ID NO: 695257 - DNA, 13 bp, C. elegans
aattcaaaagtaa

SEQ ID NO: 695258 - DNA, 13 bp, C. elegans
aattcaaaagtac

SEQ ID NO: 695259 - DNA, 13 bp, C. elegans
aattcaaaagtat

SEQ ID NO: 695260 - DNA, 13 bp, C. elegans
aattcaaaagttg

SEQ ID NO: 695261 - DNA, 13 bp, C. elegans
aattcaaaagttt

SEQ ID NO: 695262 - DNA, 13 bp, C. elegans
aattcaaaatagt

SEQ ID NO: 695263 - DNA, 13 bp, C. elegans
aattcaaaatccg

SEQ ID NO: 695264 - DNA, 13 bp, C. elegans
aattcaaaatcct

SEQ ID NO: 695265 - DNA, 13 bp, C. elegans
aattcaaaatctg

SEQ ID NO: 695266 - DNA, 13 bp, C. elegans
aattcaaaatgtt

SEQ ID NO: 695267 - DNA, 13 bp, C. elegans
aattcaaaattca

SEQ ID NO: 695268 - DNA, 14 bp, C. elegans
aattcaaaatttca

SEQ ID NO: 695269 - DNA, 13 bp, C. elegans
aattcaaaatttg

SEQ ID NO: 695270 - DNA, 13 bp, C. elegans
aattcaaacaatt

SEQ ID NO: 695271 - DNA, 13 bp, C. elegans
aattcaaacatat

SEQ ID NO: 695272 - DNA, 13 bp, C. elegans
aattcaaacatca

SEQ ID NO: 695273 - DNA, 13 bp, C. elegans
aattcaaacgaaa

SEQ ID NO: 695274 - DNA, 13 bp, C. elegans
aattcaaactaac

SEQ ID NO: 695275 - DNA, 13 bp, C. elegans
aattcaaactcac

SEQ ID NO: 695276 - DNA, 13 bp, C. elegans
aattcaaactcag

SEQ ID NO: 695277 - DNA, 13 bp, C. elegans
aattcaaacttcc

SEQ ID NO: 695278 - DNA, 13 bp, C. elegans
aattcaaacttcg

SEQ ID NO: 695279 - DNA, 13 bp, C. elegans
aattcaaacttta

SEQ ID NO: 695280 - DNA, 13 bp, C. elegans
aattcaaagaatt

SEQ ID NO: 695281 - DNA, 13 bp, C. elegans
aattcaaagataa

SEQ ID NO: 695282 - DNA, 13 bp, C. elegans
aattcaaagatta

SEQ ID NO: 695283 - DNA, 13 bp, C. elegans
aattcaaagctaa

SEQ ID NO: 695284 - DNA, 13 bp, C. elegans
aattcaaagtaat

SEQ ID NO: 695285 - DNA, 13 bp, C. elegans
aattcaaagtgtt

SEQ ID NO: 695286 - DNA, 13 bp, C. elegans
aattcaaagttca

SEQ ID NO: 695287 - DNA, 13 bp, C. elegans
aattcaaatatcc

SEQ ID NO: 695288 - DNA, 13 bp, C. elegans
aattcaaatatgc

SEQ ID NO: 695289 - DNA, 13 bp, C. elegans
aattcaaatattc

SEQ ID NO: 695290 - DNA, 13 bp, C. elegans
aattcaaatcgat

SEQ ID NO: 695291 - DNA, 13 bp, C. elegans
aattcaaatctca

SEQ ID NO: 695292 - DNA, 13 bp, C. elegans
aattcaaatcttt

SEQ ID NO: 695293 - DNA, 13 bp, C. elegans
aattcaaatgaaa

SEQ ID NO: 695294 - DNA, 13 bp, C. elegans
aattcaaatgtaa

SEQ ID NO: 695295 - DNA, 14 bp, C. elegans
aattcaaatgtgca

SEQ ID NO: 695296 - DNA, 13 bp, C. elegans
aattcaaatgtgt

SEQ ID NO: 695297 - DNA, 13 bp, C. elegans
aattcaaatgttc

SEQ ID NO: 695298 - DNA, 13 bp, C. elegans
aattcaaattatg

SEQ ID NO: 695299 - DNA, 13 bp, C. elegans
aattcaaattcaa

SEQ ID NO: 695300 - DNA, 13 bp, C. elegans
aattcaaattcag

SEQ ID NO: 695301 - DNA, 13 bp, C. elegans
aattcaaattcat

SEQ ID NO: 695302 - DNA, 13 bp, C. elegans
aattcaaattctc

SEQ ID NO: 695303 - DNA, 13 bp, C. elegans
aattcaaatttac

SEQ ID NO: 695304 - DNA, 13 bp, C. elegans
aattcaaatttca

SEQ ID NO: 695305 - DNA, 14 bp, C. elegans
aattcaaatttcct

SEQ ID NO: 695306 - DNA, 13 bp, C. elegans
aattcaaatttcg

SEQ ID NO: 695307 - DNA, 13 bp, C. elegans
aattcaaatttga

SEQ ID NO: 695308 - DNA, 13 bp, C. elegans
aattcaaatttgt

SEQ ID NO: 695309 - DNA, 13 bp, C. elegans
aattcaaattttc

SEQ ID NO: 695310 - DNA, 13 bp, C. elegans
aattcaaattttg

SEQ ID NO: 695311 - DNA, 13 bp, C. elegans
aattcaacaaatc

SEQ ID NO: 695312 - DNA, 13 bp, C. elegans
aattcaacaattc

SEQ ID NO: 695313 - DNA, 13 bp, C. elegans
aattcaacatttt

SEQ ID NO: 695314 - DNA, 13 bp, C. elegans
aattcaacgaaaa

SEQ ID NO: 695315 - DNA, 13 bp, C. elegans
aattcaacgagga

SEQ ID NO: 695316 - DNA, 13 bp, C. elegans
aattcaacgattt

SEQ ID NO: 695317 - DNA, 13 bp, C. elegans
aattcaactcaaa

SEQ ID NO: 695318 - DNA, 13 bp, C. elegans
aattcaacttttg

SEQ ID NO: 695319 - DNA, 13 bp, C. elegans
aattcaagaaaac

SEQ ID NO: 695320 - DNA, 13 bp, C. elegans
aattcaagaaaag

SEQ ID NO: 695321 - DNA, 13 bp, C. elegans
aattcaagaaact

SEQ ID NO: 695322 - DNA, 13 bp, C. elegans
aattcaagaaatg

SEQ ID NO: 695323 - DNA, 13 bp, C. elegans
aattcaagaattt

SEQ ID NO: 695324 - DNA, 13 bp, C. elegans
aattcaagacaaa

SEQ ID NO: 695325 - DNA, 13 bp, C. elegans
aattcaagcaaaa

SEQ ID NO: 695326 - DNA, 13 bp, C. elegans
aattcaagcaatt

SEQ ID NO: 695327 - DNA, 13 bp, C. elegans
aattcaagtcaaa

SEQ ID NO: 695328 - DNA, 13 bp, C. elegans
aattcaagtgaaa

SEQ ID NO: 695329 - DNA, 13 bp, C. elegans
aattcaagttaaa

SEQ ID NO: 695330 - DNA, 13 bp, C. elegans
aattcaagtttta

SEQ ID NO: 695331 - DNA, 13 bp, C. elegans
aattcaagttttt

SEQ ID NO: 695332 - DNA, 13 bp, C. elegans
aattcaataaagt

SEQ ID NO: 695333 - DNA, 13 bp, C. elegans
aattcaataaatc

SEQ ID NO: 695334 - DNA, 13 bp, C. elegans
aattcaataaatg

SEQ ID NO: 695335 - DNA, 13 bp, C. elegans
aattcaatcaata

SEQ ID NO: 695336 - DNA, 13 bp, C. elegans
aattcaatcaatt

SEQ ID NO: 695337 - DNA, 13 bp, C. elegans
aattcaatcattt

SEQ ID NO: 695338 - DNA, 13 bp, C. elegans
aattcaatccagg

SEQ ID NO: 695339 - DNA, 13 bp, C. elegans
aattcaatgaaaa

SEQ ID NO: 695340 - DNA, 13 bp, C. elegans
aattcaattatct

SEQ ID NO: 695341 - DNA, 13 bp, C. elegans
aattcaattattg

SEQ ID NO: 695342 - DNA, 13 bp, C. elegans
aattcaattcaaa

SEQ ID NO: 695343 - DNA, 13 bp, C. elegans
aattcaattcatt

SEQ ID NO: 695344 - DNA, 13 bp, C. elegans
aattcaattctaa

SEQ ID NO: 695345 - DNA, 13 bp, C. elegans
aattcaatttcct

SEQ ID NO: 695346 - DNA, 13 bp, C. elegans
aattcaatttcga

SEQ ID NO: 695347 - DNA, 13 bp, C. elegans
aattcaatttgaa

SEQ ID NO: 695348 - DNA, 13 bp, C. elegans
aattcaatttgat

SEQ ID NO: 695349 - DNA, 13 bp, C. elegans
aattcaatttgtt

SEQ ID NO: 695350 - DNA, 13 bp, C. elegans
aattcaattttca

SEQ ID NO: 695351 - DNA, 13 bp, C. elegans
aattcaattttcg

SEQ ID NO: 695352 - DNA, 13 bp, C. elegans
aattcaatttttc

SEQ ID NO: 695353 - DNA, 13 bp, C. elegans
aattcacaaaact

SEQ ID NO: 695354 - DNA, 13 bp, C. elegans
aattcacaaaatg

SEQ ID NO: 695355 - DNA, 13 bp, C. elegans
aattcacaaatct

SEQ ID NO: 695356 - DNA, 13 bp, C. elegans
aattcacaaattt

SEQ ID NO: 695357 - DNA, 13 bp, C. elegans
aattcacaataat

SEQ ID NO: 695358 - DNA, 13 bp, C. elegans
aattcacaatttt

SEQ ID NO: 695359 - DNA, 13 bp, C. elegans
aattcacagaaat

SEQ ID NO: 695360 - DNA, 13 bp, C. elegans
aattcacatgttt

SEQ ID NO: 695361 - DNA, 13 bp, C. elegans
aattcacatttaa

SEQ ID NO: 695362 - DNA, 13 bp, C. elegans
aattcacatttca

SEQ ID NO: 695363 - DNA, 13 bp, C. elegans
aattcacatttta

SEQ ID NO: 695364 - DNA, 13 bp, C. elegans
aattcacattttg

SEQ ID NO: 695365 - DNA, 13 bp, C. elegans
aattcaccaaatt

SEQ ID NO: 695366 - DNA, 13 bp, C. elegans
aattcacctaaaa

SEQ ID NO: 695367 - DNA, 13 bp, C. elegans
aattcacgaaaaa

SEQ ID NO: 695368 - DNA, 13 bp, C. elegans
aattcactaattt

SEQ ID NO: 695369 - DNA, 13 bp, C. elegans
aattcactatttc

SEQ ID NO: 695370 - DNA, 13 bp, C. elegans
aattcactgtttt

SEQ ID NO: 695371 - DNA, 13 bp, C. elegans
aattcacttattt

SEQ ID NO: 695372 - DNA, 13 bp, C. elegans
aattcactttcaa

SEQ ID NO: 695373 - DNA, 13 bp, C. elegans
aattcactttttc

SEQ ID NO: 695374 - DNA, 13 bp, C. elegans
aattcagaaaaac

SEQ ID NO: 695375 - DNA, 13 bp, C. elegans
aattcagaaaaat

SEQ ID NO: 695376 - DNA, 13 bp, C. elegans
aattcagaaaatc

SEQ ID NO: 695377 - DNA, 13 bp, C. elegans
aattcagaaaatt

SEQ ID NO: 695378 - DNA, 13 bp, C. elegans
aattcagaaagtt

SEQ ID NO: 695379 - DNA, 13 bp, C. elegans
aattcagaaataa

SEQ ID NO: 695380 - DNA, 13 bp, C. elegans
aattcagaaatac

SEQ ID NO: 695381 - DNA, 13 bp, C. elegans
aattcagaacatt

SEQ ID NO: 695382 - DNA, 13 bp, C. elegans
aattcagaacttt

SEQ ID NO: 695383 - DNA, 13 bp, C. elegans
aattcagaagtat

SEQ ID NO: 695384 - DNA, 13 bp, C. elegans
aattcagaagttt

SEQ ID NO: 695385 - DNA, 13 bp, C. elegans
aattcagaatatc

SEQ ID NO: 695386 - DNA, 13 bp, C. elegans
aattcagaatatt

SEQ ID NO: 695387 - DNA, 13 bp, C. elegans
aattcagacaaaa

SEQ ID NO: 695388 - DNA, 13 bp, C. elegans
aattcagagaaaa

SEQ ID NO: 695389 - DNA, 13 bp, C. elegans
aattcagagcaat

SEQ ID NO: 695390 - DNA, 13 bp, C. elegans
aattcagattcag

SEQ ID NO: 695391 - DNA, 13 bp, C. elegans
aattcagatttta

SEQ ID NO: 695392 - DNA, 13 bp, C. elegans
aattcagcaaatc

SEQ ID NO: 695393 - DNA, 13 bp, C. elegans
aattcagccactt

SEQ ID NO: 695394 - DNA, 13 bp, C. elegans
aattcaggaattt

SEQ ID NO: 695395 - DNA, 13 bp, C. elegans
aattcaggtcaaa

SEQ ID NO: 695396 - DNA, 13 bp, C. elegans
aattcaggttttt

SEQ ID NO: 695397 - DNA, 13 bp, C. elegans
aattcagtaaaat

SEQ ID NO: 695398 - DNA, 13 bp, C. elegans
aattcagtttcaa

SEQ ID NO: 695399 - DNA, 13 bp, C. elegans
aattcagttttga

SEQ ID NO: 695400 - DNA, 13 bp, C. elegans
aattcagtttttg

SEQ ID NO: 695401 - DNA, 13 bp, C. elegans
aattcagtttttt

SEQ ID NO: 695402 - DNA, 13 bp, C. elegans
aattcataaagaa

SEQ ID NO: 695403 - DNA, 13 bp, C. elegans
aattcataatgtt

SEQ ID NO: 695404 - DNA, 13 bp, C. elegans
aattcataatttg

SEQ ID NO: 695405 - DNA, 13 bp, C. elegans
aattcatagtttt

SEQ ID NO: 695406 - DNA, 13 bp, C. elegans
aattcatatgaaa

SEQ ID NO: 695407 - DNA, 13 bp, C. elegans
aattcatatgatg

SEQ ID NO: 695408 - DNA, 13 bp, C. elegans
aattcatatttcc

SEQ ID NO: 695409 - DNA, 13 bp, C. elegans
aattcatatttgt

SEQ ID NO: 695410 - DNA, 13 bp, C. elegans
aattcatcaactg

SEQ ID NO: 695411 - DNA, 13 bp, C. elegans
aattcatcaataa

SEQ ID NO: 695412 - DNA, 13 bp, C. elegans
aattcatcaattt

SEQ ID NO: 695413 - DNA, 13 bp, C. elegans
aattcatcaccaa

SEQ ID NO: 695414 - DNA, 13 bp, C. elegans
aattcatcatatt

SEQ ID NO: 695415 - DNA, 13 bp, C. elegans
aattcatccaaaa

SEQ ID NO: 695416 - DNA, 13 bp, C. elegans
aattcatcgaaaa

SEQ ID NO: 695417 - DNA, 13 bp, C. elegans
aattcatcgattt

SEQ ID NO: 695418 - DNA, 13 bp, C. elegans
aattcatgaaaaa

SEQ ID NO: 695419 - DNA, 13 bp, C. elegans
aattcatgatttt

SEQ ID NO: 695420 - DNA, 13 bp, C. elegans
aattcatgcattt

SEQ ID NO: 695421 - DNA, 13 bp, C. elegans
aattcatggaaaa

SEQ ID NO: 695422 - DNA, 13 bp, C. elegans
aattcatgttttc

SEQ ID NO: 695423 - DNA, 13 bp, C. elegans
aattcattaacaa

SEQ ID NO: 695424 - DNA, 13 bp, C. elegans
aattcattaattg

SEQ ID NO: 695425 - DNA, 13 bp, C. elegans
aattcattcaatt

SEQ ID NO: 695426 - DNA, 13 bp, C. elegans
aattcattcattt

SEQ ID NO: 695427 - DNA, 13 bp, C. elegans
aattcattgcaaa

SEQ ID NO: 695428 - DNA, 13 bp, C. elegans
aattcatttattc

SEQ ID NO: 695429 - DNA, 13 bp, C. elegans
aattcatttcaaa

SEQ ID NO: 695430 - DNA, 13 bp, C. elegans
aattcatttcaat

SEQ ID NO: 695431 - DNA, 13 bp, C. elegans
aattcatttgatt

SEQ ID NO: 695432 - DNA, 13 bp, C. elegans
aattcattttcag

SEQ ID NO: 695433 - DNA, 13 bp, C. elegans
aattcattttcat

SEQ ID NO: 695434 - DNA, 13 bp, C. elegans
aattcattttcca

SEQ ID NO: 695435 - DNA, 13 bp, C. elegans
aattcattttcta

SEQ ID NO: 695436 - DNA, 13 bp, C. elegans
aattcattttgat

SEQ ID NO: 695437 - DNA, 13 bp, C. elegans
aattcattttgca

SEQ ID NO: 695438 - DNA, 13 bp, C. elegans
aattcatttttag

SEQ ID NO: 695439 - DNA, 13 bp, C. elegans
aattcattttttg

SEQ ID NO: 695440 - DNA, 13 bp, C. elegans
aattccaaaaact

SEQ ID NO: 695441 - DNA, 14 bp, C. elegans
aattccaaaaatta

SEQ ID NO: 695442 - DNA, 13 bp, C. elegans
aattccaaaactt

SEQ ID NO: 695443 - DNA, 13 bp, C. elegans
aattccaaaagta

SEQ ID NO: 695444 - DNA, 13 bp, C. elegans
aattccaaaatat

SEQ ID NO: 695445 - DNA, 13 bp, C. elegans
aattccaaaatct

SEQ ID NO: 695446 - DNA, 13 bp, C. elegans
aattccaaaattc

SEQ ID NO: 695447 - DNA, 13 bp, C. elegans
aattccaaaattt

SEQ ID NO: 695448 - DNA, 13 bp, C. elegans
aattccaaacaat

SEQ ID NO: 695449 - DNA, 13 bp, C. elegans
aattccaaagttt

SEQ ID NO: 695450 - DNA, 13 bp, C. elegans
aattccaaatcaa

SEQ ID NO: 695451 - DNA, 13 bp, C. elegans
aattccaaattcc

SEQ ID NO: 695452 - DNA, 13 bp, C. elegans
aattccaaatttc

SEQ ID NO: 695453 - DNA, 13 bp, C. elegans
aattccaagaaaa

SEQ ID NO: 695454 - DNA, 13 bp, C. elegans
aattccaataaat

SEQ ID NO: 695455 - DNA, 13 bp, C. elegans
aattccaataatt

SEQ ID NO: 695456 - DNA, 13 bp, C. elegans
aattccaatagga

SEQ ID NO: 695457 - DNA, 13 bp, C. elegans
aattccaatatta

SEQ ID NO: 695458 - DNA, 13 bp, C. elegans
aattccaatattt

SEQ ID NO: 695459 - DNA, 13 bp, C. elegans
aattccaattaat

SEQ ID NO: 695460 - DNA, 13 bp, C. elegans
aattccaattatc

SEQ ID NO: 695461 - DNA, 13 bp, C. elegans
aattccaattcaa

SEQ ID NO: 695462 - DNA, 13 bp, C. elegans
aattccaattccg

SEQ ID NO: 695463 - DNA, 13 bp, C. elegans
aattccaattcgt

SEQ ID NO: 695464 - DNA, 13 bp, C. elegans
aattccaattgtt

SEQ ID NO: 695465 - DNA, 13 bp, C. elegans
aattccaatttat

SEQ ID NO: 695466 - DNA, 13 bp, C. elegans
aattccaatttca

SEQ ID NO: 695467 - DNA, 13 bp, C. elegans
aattccaatttct

SEQ ID NO: 695468 - DNA, 13 bp, C. elegans
aattccaattttg

SEQ ID NO: 695469 - DNA, 13 bp, C. elegans
aattccacaaaac

SEQ ID NO: 695470 - DNA, 13 bp, C. elegans
aattccacaaatt

SEQ ID NO: 695471 - DNA, 14 bp, C. elegans
aattccacaacttc

SEQ ID NO: 695472 - DNA, 13 bp, C. elegans
aattccacaattt

SEQ ID NO: 695473 - DNA, 13 bp, C. elegans
aattccacttttt

SEQ ID NO: 695474 - DNA, 13 bp, C. elegans
aattccagaaaac

SEQ ID NO: 695475 - DNA, 13 bp, C. elegans
aattccagaaaat

SEQ ID NO: 695476 - DNA, 13 bp, C. elegans
aattccagaaaca

SEQ ID NO: 695477 - DNA, 13 bp, C. elegans
aattccagaaatt

SEQ ID NO: 695478 - DNA, 13 bp, C. elegans
aattccagaagtt

SEQ ID NO: 695479 - DNA, 13 bp, C. elegans
aattccagagaaa

SEQ ID NO: 695480 - DNA, 13 bp, C. elegans
aattccagagttt

SEQ ID NO: 695481 - DNA, 13 bp, C. elegans
aattccagatttc

SEQ ID NO: 695482 - DNA, 13 bp, C. elegans
aattccagatttt

SEQ ID NO: 695483 - DNA, 13 bp, C. elegans
aattccagcattt

SEQ ID NO: 695484 - DNA, 13 bp, C. elegans
aattccagccaaa

SEQ ID NO: 695485 - DNA, 13 bp, C. elegans
aattccaggaatt

SEQ ID NO: 695486 - DNA, 13 bp, C. elegans
aattccagttttc

SEQ ID NO: 695487 - DNA, 13 bp, C. elegans
aattccagttttt

SEQ ID NO: 695488 - DNA, 13 bp, C. elegans
aattccatcaatt

SEQ ID NO: 695489 - DNA, 13 bp, C. elegans
aattccatcattt

SEQ ID NO: 695490 - DNA, 13 bp, C. elegans
aattccatgaaaa

SEQ ID NO: 695491 - DNA, 13 bp, C. elegans
aattccatgaaat

SEQ ID NO: 695492 - DNA, 13 bp, C. elegans
aattccattaatt

SEQ ID NO: 695493 - DNA, 13 bp, C. elegans
aattccattattt

SEQ ID NO: 695494 - DNA, 13 bp, C. elegans
aattccattcaaa

SEQ ID NO: 695495 - DNA, 14 bp, C. elegans
aattccattttcaa

SEQ ID NO: 695496 - DNA, 13 bp, C. elegans
aattcccaaaaat

SEQ ID NO: 695497 - DNA, 13 bp, C. elegans
aattcccaaaatt

SEQ ID NO: 695498 - DNA, 13 bp, C. elegans
aattcccaatttg

SEQ ID NO: 695499 - DNA, 13 bp, C. elegans
aattcccaatttt

SEQ ID NO: 695500 - DNA, 13 bp, C. elegans
aattcccaccaaa

SEQ ID NO: 695501 - DNA, 13 bp, C. elegans
aattcccagtttt

SEQ ID NO: 695502 - DNA, 13 bp, C. elegans
aattcccatgctt

SEQ ID NO: 695503 - DNA, 13 bp, C. elegans
aattcccattttt

SEQ ID NO: 695504 - DNA, 13 bp, C. elegans
aattcccgcaatt

SEQ ID NO: 695505 - DNA, 13 bp, C. elegans
aattcccgccgaa

SEQ ID NO: 695506 - DNA, 13 bp, C. elegans
aattcccggaatt

SEQ ID NO: 695507 - DNA, 13 bp, C. elegans
aattcccgttaaa

SEQ ID NO: 695508 - DNA, 13 bp, C. elegans
aattcccgtttca

SEQ ID NO: 695509 - DNA, 13 bp, C. elegans
aattccctccaaa

SEQ ID NO: 695510 - DNA, 13 bp, C. elegans
aattccctgaaaa

SEQ ID NO: 695511 - DNA, 13 bp, C. elegans
aattccgaaaagt

SEQ ID NO: 695512 - DNA, 13 bp, C. elegans
aattccgaaattc

SEQ ID NO: 695513 - DNA, 13 bp, C. elegans
aattccgaaattt

SEQ ID NO: 695514 - DNA, 13 bp, C. elegans
aattccgacaaaa

SEQ ID NO: 695515 - DNA, 13 bp, C. elegans
aattccgactttt

SEQ ID NO: 695516 - DNA, 13 bp, C. elegans
aattccgataaaa

SEQ ID NO: 695517 - DNA, 13 bp, C. elegans
aattccgatattt

SEQ ID NO: 695518 - DNA, 13 bp, C. elegans
aattccgatgatt

SEQ ID NO: 695519 - DNA, 13 bp, C. elegans
aattccgccaatt

SEQ ID NO: 695520 - DNA, 13 bp, C. elegans
aattccggaaatg

SEQ ID NO: 695521 - DNA, 13 bp, C. elegans
aattccggaatgg

SEQ ID NO: 695522 - DNA, 13 bp, C. elegans
aattccggcaaat

SEQ ID NO: 695523 - DNA, 13 bp, C. elegans
aattccggcaatg

SEQ ID NO: 695524 - DNA, 13 bp, C. elegans
aattccggtgatt

SEQ ID NO: 695525 - DNA, 13 bp, C. elegans
aattccgtcaatt

SEQ ID NO: 695526 - DNA, 13 bp, C. elegans
aattccgtgaaaa

SEQ ID NO: 695527 - DNA, 13 bp, C. elegans
aattccgtttgtt

SEQ ID NO: 695528 - DNA, 13 bp, C. elegans
aattccgtttttg

SEQ ID NO: 695529 - DNA, 13 bp, C. elegans
aattcctaaaaag

SEQ ID NO: 695530 - DNA, 13 bp, C. elegans
aattcctaaactt

SEQ ID NO: 695531 - DNA, 13 bp, C. elegans
aattcctactttt

SEQ ID NO: 695532 - DNA, 13 bp, C. elegans
aattcctattttc

SEQ ID NO: 695533 - DNA, 13 bp, C. elegans
aattcctcatctt

SEQ ID NO: 695534 - DNA, 13 bp, C. elegans
aattcctgaaaaa

SEQ ID NO: 695535 - DNA, 13 bp, C. elegans
aattcctgaagaa

SEQ ID NO: 695536 - DNA, 13 bp, C. elegans
aattcctgcattt

SEQ ID NO: 695537 - DNA, 13 bp, C. elegans
aattcctggaaaa

SEQ ID NO: 695538 - DNA, 13 bp, C. elegans
aattcctgtttca

SEQ ID NO: 695539 - DNA, 13 bp, C. elegans
aattccttaaaat

SEQ ID NO: 695540 - DNA, 13 bp, C. elegans
aattccttaaatt

SEQ ID NO: 695541 - DNA, 13 bp, C. elegans
aattccttcattt

SEQ ID NO: 695542 - DNA, 13 bp, C. elegans
aattccttgattt

SEQ ID NO: 695543 - DNA, 13 bp, C. elegans
aattccttgtttt

SEQ ID NO: 695544 - DNA, 13 bp, C. elegans
aattcctttttcc

SEQ ID NO: 695545 - DNA, 14 bp, C. elegans
aattcgaaaaaatc

SEQ ID NO: 695546 - DNA, 13 bp, C. elegans
aattcgaaaaata

SEQ ID NO: 695547 - DNA, 13 bp, C. elegans
aattcgaaaacta

SEQ ID NO: 695548 - DNA, 13 bp, C. elegans
aattcgaaaactt

SEQ ID NO: 695549 - DNA, 13 bp, C. elegans
aattcgaaaagtg

SEQ ID NO: 695550 - DNA, 13 bp, C. elegans
aattcgaaaatca

SEQ ID NO: 695551 - DNA, 14 bp, C. elegans
aattcgaaaatttt

SEQ ID NO: 695552 - DNA, 13 bp, C. elegans
aattcgaaacaaa

SEQ ID NO: 695553 - DNA, 13 bp, C. elegans
aattcgaaataaa

SEQ ID NO: 695554 - DNA, 13 bp, C. elegans
aattcgaaatatc

SEQ ID NO: 695555 - DNA, 13 bp, C. elegans
aattcgaaattcc

SEQ ID NO: 695556 - DNA, 13 bp, C. elegans
aattcgaaatttt

SEQ ID NO: 695557 - DNA, 13 bp, C. elegans
aattcgaacaaaa

SEQ ID NO: 695558 - DNA, 13 bp, C. elegans
aattcgaacgttt

SEQ ID NO: 695559 - DNA, 13 bp, C. elegans
aattcgaagattt

SEQ ID NO: 695560 - DNA, 13 bp, C. elegans
aattcgaagcaaa

SEQ ID NO: 695561 - DNA, 13 bp, C. elegans
aattcgaaggaaa

SEQ ID NO: 695562 - DNA, 13 bp, C. elegans
aattcgaagttct

SEQ ID NO: 695563 - DNA, 13 bp, C. elegans
aattcgaatattt

SEQ ID NO: 695564 - DNA, 13 bp, C. elegans
aattcgaattatc

SEQ ID NO: 695565 - DNA, 13 bp, C. elegans
aattcgaattgtt

SEQ ID NO: 695566 - DNA, 13 bp, C. elegans
aattcgaatttca

SEQ ID NO: 695567 - DNA, 13 bp, C. elegans
aattcgaatttct

SEQ ID NO: 695568 - DNA, 13 bp, C. elegans
aattcgaatttga

SEQ ID NO: 695569 - DNA, 13 bp, C. elegans
aattcgaatttgt

SEQ ID NO: 695570 - DNA, 13 bp, C. elegans
aattcgacaattt

SEQ ID NO: 695571 - DNA, 13 bp, C. elegans
aattcgacgaaaa

SEQ ID NO: 695572 - DNA, 13 bp, C. elegans
aattcgactacat

SEQ ID NO: 695573 - DNA, 13 bp, C. elegans
aattcgacttttc

SEQ ID NO: 695574 - DNA, 13 bp, C. elegans
aattcgagaaaag

SEQ ID NO: 695575 - DNA, 13 bp, C. elegans
aattcgagaaact

SEQ ID NO: 695576 - DNA, 13 bp, C. elegans
aattcgagagaaa

SEQ ID NO: 695577 - DNA, 13 bp, C. elegans
aattcgagatttt

SEQ ID NO: 695578 - DNA, 13 bp, C. elegans
aattcgaggaaaa

SEQ ID NO: 695579 - DNA, 13 bp, C. elegans
aattcgagttccc

SEQ ID NO: 695580 - DNA, 13 bp, C. elegans
aattcgagttttc

SEQ ID NO: 695581 - DNA, 13 bp, C. elegans
aattcgagttttg

SEQ ID NO: 695582 - DNA, 13 bp, C. elegans
aattcgataaaaa

SEQ ID NO: 695583 - DNA, 13 bp, C. elegans
aattcgataattt

SEQ ID NO: 695584 - DNA, 13 bp, C. elegans
aattcgatcaaaa

SEQ ID NO: 695585 - DNA, 13 bp, C. elegans
aattcgatgaaaa

SEQ ID NO: 695586 - DNA, 13 bp, C. elegans
aattcgatgaaat

SEQ ID NO: 695587 - DNA, 13 bp, C. elegans
aattcgatgtttt

SEQ ID NO: 695588 - DNA, 13 bp, C. elegans
aattcgattgttt

SEQ ID NO: 695589 - DNA, 13 bp, C. elegans
aattcgatttcaa

SEQ ID NO: 695590 - DNA, 13 bp, C. elegans
aattcgattttca

SEQ ID NO: 695591 - DNA, 13 bp, C. elegans
aattcgattttta

SEQ ID NO: 695592 - DNA, 13 bp, C. elegans
aattcgcaaaaaa

SEQ ID NO: 695593 - DNA, 13 bp, C. elegans
aattcgcaatttc

SEQ ID NO: 695594 - DNA, 13 bp, C. elegans
aattcgcataatt

SEQ ID NO: 695595 - DNA, 13 bp, C. elegans
aattcgcattgga

SEQ ID NO: 695596 - DNA, 13 bp, C. elegans
aattcgcattttc

SEQ ID NO: 695597 - DNA, 13 bp, C. elegans
aattcgcattttt

SEQ ID NO: 695598 - DNA, 13 bp, C. elegans
aattcgccaaaaa

SEQ ID NO: 695599 - DNA, 13 bp, C. elegans
aattcgcccaaaa

SEQ ID NO: 695600 - DNA, 13 bp, C. elegans
aattcgccgaaaa

SEQ ID NO: 695601 - DNA, 13 bp, C. elegans
aattcgccgattt

SEQ ID NO: 695602 - DNA, 13 bp, C. elegans
aattcgcgaaaaa

SEQ ID NO: 695603 - DNA, 13 bp, C. elegans
aattcgcgatttt

SEQ ID NO: 695604 - DNA, 13 bp, C. elegans
aattcgctatttt

SEQ ID NO: 695605 - DNA, 13 bp, C. elegans
aattcgctgaaaa

SEQ ID NO: 695606 - DNA, 13 bp, C. elegans
aattcggaaaata

SEQ ID NO: 695607 - DNA, 13 bp, C. elegans
aattcggaaattt

SEQ ID NO: 695608 - DNA, 13 bp, C. elegans
aattcggaagaaa

SEQ ID NO: 695609 - DNA, 13 bp, C. elegans
aattcggaatttc

SEQ ID NO: 695610 - DNA, 13 bp, C. elegans
aattcggagaaat

SEQ ID NO: 695611 - DNA, 13 bp, C. elegans
aattcggcaattc

SEQ ID NO: 695612 - DNA, 13 bp, C. elegans
aattcggcgaatt

SEQ ID NO: 695613 - DNA, 13 bp, C. elegans
aattcgggatttt

SEQ ID NO: 695614 - DNA, 13 bp, C. elegans
aattcggtaattt

SEQ ID NO: 695615 - DNA, 13 bp, C. elegans
aattcggtgtttc

SEQ ID NO: 695616 - DNA, 13 bp, C. elegans
aattcggttaaaa

SEQ ID NO: 695617 - DNA, 13 bp, C. elegans
aattcgtaaaaaa

SEQ ID NO: 695618 - DNA, 13 bp, C. elegans
aattcgtaaaaat

SEQ ID NO: 695619 - DNA, 13 bp, C. elegans
aattcgtaaattt

SEQ ID NO: 695620 - DNA, 13 bp, C. elegans
aattcgtattatt

SEQ ID NO: 695621 - DNA, 13 bp, C. elegans
aattcgtattttc

SEQ ID NO: 695622 - DNA, 13 bp, C. elegans
aattcgtccattt

SEQ ID NO: 695623 - DNA, 13 bp, C. elegans
aattcgtctaaaa

SEQ ID NO: 695624 - DNA, 13 bp, C. elegans
aattcgtcttttt

SEQ ID NO: 695625 - DNA, 13 bp, C. elegans
aattcgttcaaaa

SEQ ID NO: 695626 - DNA, 13 bp, C. elegans
aattcgttcaatt

SEQ ID NO: 695627 - DNA, 13 bp, C. elegans
aattcgttcattt

SEQ ID NO: 695628 - DNA, 13 bp, C. elegans
aattcgttgaatt

SEQ ID NO: 695629 - DNA, 13 bp, C. elegans
aattcgttgtttt

SEQ ID NO: 695630 - DNA, 13 bp, C. elegans
aattcgtttgaaa

SEQ ID NO: 695631 - DNA, 13 bp, C. elegans
aattcgttttatt

SEQ ID NO: 695632 - DNA, 13 bp, C. elegans
aattcgttttctt

SEQ ID NO: 695633 - DNA, 13 bp, C. elegans
aattcgttttgaa

SEQ ID NO: 695634 - DNA, 13 bp, C. elegans
aattcgtttttat

SEQ ID NO: 695635 - DNA, 13 bp, C. elegans
aattctaaaaagt

SEQ ID NO: 695636 - DNA, 13 bp, C. elegans
aattctaaatcaa

SEQ ID NO: 695637 - DNA, 13 bp, C. elegans
aattctaaatgtt

SEQ ID NO: 695638 - DNA, 13 bp, C. elegans
aattctaaattct

SEQ ID NO: 695639 - DNA, 13 bp, C. elegans
aattctaaatttc

SEQ ID NO: 695640 - DNA, 13 bp, C. elegans
aattctaagccta

SEQ ID NO: 695641 - DNA, 13 bp, C. elegans
aattctaatgaaa

SEQ ID NO: 695642 - DNA, 13 bp, C. elegans
aattctaattttc

SEQ ID NO: 695643 - DNA, 13 bp, C. elegans
aattctacaaaat

SEQ ID NO: 695644 - DNA, 13 bp, C. elegans
aattctacaaatt

SEQ ID NO: 695645 - DNA, 13 bp, C. elegans
aattctacaattt

SEQ ID NO: 695646 - DNA, 13 bp, C. elegans
aattctacagtac

SEQ ID NO: 695647 - DNA, 13 bp, C. elegans
aattctacagtat

SEQ ID NO: 695648 - DNA, 13 bp, C. elegans
aattctacagttt

SEQ ID NO: 695649 - DNA, 13 bp, C. elegans
aattctaccaagt

SEQ ID NO: 695650 - DNA, 13 bp, C. elegans
aattctacgaaaa

SEQ ID NO: 695651 - DNA, 13 bp, C. elegans
aattctactgaaa

SEQ ID NO: 695652 - DNA, 13 bp, C. elegans
aattctactgttt

SEQ ID NO: 695653 - DNA, 13 bp, C. elegans
aattctagaaaaa

SEQ ID NO: 695654 - DNA, 13 bp, C. elegans
aattctagaagaa

SEQ ID NO: 695655 - DNA, 13 bp, C. elegans
aattctagaattt

SEQ ID NO: 695656 - DNA, 13 bp, C. elegans
aattctagacatt

SEQ ID NO: 695657 - DNA, 13 bp, C. elegans
aattctagataaa

SEQ ID NO: 695658 - DNA, 13 bp, C. elegans
aattctaggaatt

SEQ ID NO: 695659 - DNA, 13 bp, C. elegans
aattctaggccat

SEQ ID NO: 695660 - DNA, 13 bp, C. elegans
aattctaggtttt

SEQ ID NO: 695661 - DNA, 13 bp, C. elegans
aattctagtcaaa

SEQ ID NO: 695662 - DNA, 13 bp, C. elegans
aattctagttttg

SEQ ID NO: 695663 - DNA, 13 bp, C. elegans
aattctagttttt

SEQ ID NO: 695664 - DNA, 13 bp, C. elegans
aattctataaaac

SEQ ID NO: 695665 - DNA, 13 bp, C. elegans
aattctatcaaat

SEQ ID NO: 695666 - DNA, 13 bp, C. elegans
aattctatgagaa

SEQ ID NO: 695667 - DNA, 13 bp, C. elegans
aattctatgcaaa

SEQ ID NO: 695668 - DNA, 13 bp, C. elegans
aattctatggaaa

SEQ ID NO: 695669 - DNA, 13 bp, C. elegans
aattctattcatt

SEQ ID NO: 695670 - DNA, 13 bp, C. elegans
aattctattttca

SEQ ID NO: 695671 - DNA, 13 bp, C. elegans
aattctattttga

SEQ ID NO: 695672 - DNA, 13 bp, C. elegans
aattctcaaaaac

SEQ ID NO: 695673 - DNA, 13 bp, C. elegans
aattctcaaaaat

SEQ ID NO: 695674 - DNA, 13 bp, C. elegans
aattctcaaaact

SEQ ID NO: 695675 - DNA, 13 bp, C. elegans
aattctcaaaata

SEQ ID NO: 695676 - DNA, 13 bp, C. elegans
aattctcaaaatc

SEQ ID NO: 695677 - DNA, 14 bp, C. elegans
aattctcaaaatct

SEQ ID NO: 695678 - DNA, 13 bp, C. elegans
aattctcaaagtt

SEQ ID NO: 695679 - DNA, 13 bp, C. elegans
aattctcaaatct

SEQ ID NO: 695680 - DNA, 13 bp, C. elegans
aattctcaaattc

SEQ ID NO: 695681 - DNA, 13 bp, C. elegans
aattctcaaattt

SEQ ID NO: 695682 - DNA, 13 bp, C. elegans
aattctcaacaaa

SEQ ID NO: 695683 - DNA, 13 bp, C. elegans
aattctcaacatt

SEQ ID NO: 695684 - DNA, 13 bp, C. elegans
aattctcaataga

SEQ ID NO: 695685 - DNA, 13 bp, C. elegans
aattctcaatatc

SEQ ID NO: 695686 - DNA, 13 bp, C. elegans
aattctcaattat

SEQ ID NO: 695687 - DNA, 13 bp, C. elegans
aattctcaattcc

SEQ ID NO: 695688 - DNA, 13 bp, C. elegans
aattctcaattct

SEQ ID NO: 695689 - DNA, 13 bp, C. elegans
aattctcacattt

SEQ ID NO: 695690 - DNA, 13 bp, C. elegans
aattctcacgtgt

SEQ ID NO: 695691 - DNA, 13 bp, C. elegans
aattctcactttt

SEQ ID NO: 695692 - DNA, 13 bp, C. elegans
aattctcagaaaa

SEQ ID NO: 695693 - DNA, 13 bp, C. elegans
aattctcagtgac

SEQ ID NO: 695694 - DNA, 13 bp, C. elegans
aattctcatattt

SEQ ID NO: 695695 - DNA, 13 bp, C. elegans
aattctcattgga

SEQ ID NO: 695696 - DNA, 13 bp, C. elegans
aattctccaaata

SEQ ID NO: 695697 - DNA, 13 bp, C. elegans
aattctccaattt

SEQ ID NO: 695698 - DNA, 13 bp, C. elegans
aattctccatata

SEQ ID NO: 695699 - DNA, 13 bp, C. elegans
aattctccgattt

SEQ ID NO: 695700 - DNA, 13 bp, C. elegans
aattctcctcatt

SEQ ID NO: 695701 - DNA, 13 bp, C. elegans
aattctcgaaaat

SEQ ID NO: 695702 - DNA, 13 bp, C. elegans
aattctcgaaatt

SEQ ID NO: 695703 - DNA, 13 bp, C. elegans
aattctcgatttt

SEQ ID NO: 695704 - DNA, 13 bp, C. elegans
aattctcgcaaaa

SEQ ID NO: 695705 - DNA, 13 bp, C. elegans
aattctcggaatt

SEQ ID NO: 695706 - DNA, 13 bp, C. elegans
aattctcggattt

SEQ ID NO: 695707 - DNA, 13 bp, C. elegans
aattctctacatt

SEQ ID NO: 695708 - DNA, 13 bp, C. elegans
aattctctataaa

SEQ ID NO: 695709 - DNA, 13 bp, C. elegans
aattctctcaaat

SEQ ID NO: 695710 - DNA, 13 bp, C. elegans
aattctctccaaa

SEQ ID NO: 695711 - DNA, 13 bp, C. elegans
aattctctctctc

SEQ ID NO: 695712 - DNA, 13 bp, C. elegans
aattctctgaaaa

SEQ ID NO: 695713 - DNA, 13 bp, C. elegans
aattctctgtttt

SEQ ID NO: 695714 - DNA, 13 bp, C. elegans
aattctcttaaaa

SEQ ID NO: 695715 - DNA, 13 bp, C. elegans
aattctcttcaaa

SEQ ID NO: 695716 - DNA, 13 bp, C. elegans
aattctgaaaagc

SEQ ID NO: 695717 - DNA, 13 bp, C. elegans
aattctgaaaagt

SEQ ID NO: 695718 - DNA, 13 bp, C. elegans
aattctgaaaatg

SEQ ID NO: 695719 - DNA, 13 bp, C. elegans
aattctgaaactg

SEQ ID NO: 695720 - DNA, 13 bp, C. elegans
aattctgaaagaa

SEQ ID NO: 695721 - DNA, 13 bp, C. elegans
aattctgaaagag

SEQ ID NO: 695722 - DNA, 13 bp, C. elegans
aattctgaaagcg

SEQ ID NO: 695723 - DNA, 13 bp, C. elegans
aattctgaaataa

SEQ ID NO: 695724 - DNA, 13 bp, C. elegans
aattctgaaatct

SEQ ID NO: 695725 - DNA, 13 bp, C. elegans
aattctgaaattc

SEQ ID NO: 695726 - DNA, 13 bp, C. elegans
aattctgaaattt

SEQ ID NO: 695727 - DNA, 13 bp, C. elegans
aattctgaactta

SEQ ID NO: 695728 - DNA, 13 bp, C. elegans
aattctgaatatt

SEQ ID NO: 695729 - DNA, 13 bp, C. elegans
aattctgaattcc

SEQ ID NO: 695730 - DNA, 13 bp, C. elegans
aattctgaatttc

SEQ ID NO: 695731 - DNA, 13 bp, C. elegans
aattctgaatttg

SEQ ID NO: 695732 - DNA, 13 bp, C. elegans
aattctgacattt

SEQ ID NO: 695733 - DNA, 13 bp, C. elegans
aattctgaccaaa

SEQ ID NO: 695734 - DNA, 13 bp, C. elegans
aattctgagaatt

SEQ ID NO: 695735 - DNA, 13 bp, C. elegans
aattctgataaaa

SEQ ID NO: 695736 - DNA, 13 bp, C. elegans
aattctgatcatt

SEQ ID NO: 695737 - DNA, 13 bp, C. elegans
aattctgattttc

SEQ ID NO: 695738 - DNA, 13 bp, C. elegans
aattctgcaaatt

SEQ ID NO: 695739 - DNA, 13 bp, C. elegans
aattctgcaacaa

SEQ ID NO: 695740 - DNA, 13 bp, C. elegans
aattctgcatttt

SEQ ID NO: 695741 - DNA, 13 bp, C. elegans
aattctggaaaaa

SEQ ID NO: 695742 - DNA, 13 bp, C. elegans
aattctggaataa

SEQ ID NO: 695743 - DNA, 13 bp, C. elegans
aattctggatttt

SEQ ID NO: 695744 - DNA, 13 bp, C. elegans
aattctggcaatt

SEQ ID NO: 695745 - DNA, 13 bp, C. elegans
aattctgggaatt

SEQ ID NO: 695746 - DNA, 13 bp, C. elegans
aattctggttttg

SEQ ID NO: 695747 - DNA, 13 bp, C. elegans
aattctgtaaatt

SEQ ID NO: 695748 - DNA, 13 bp, C. elegans
aattctgtatttt

SEQ ID NO: 695749 - DNA, 13 bp, C. elegans
aattctgtcaatt

SEQ ID NO: 695750 - DNA, 13 bp, C. elegans
aattctgtttatt

SEQ ID NO: 695751 - DNA, 13 bp, C. elegans
aattctgtttcaa

SEQ ID NO: 695752 - DNA, 13 bp, C. elegans
aattctgtttcac

SEQ ID NO: 695753 - DNA, 13 bp, C. elegans
aattctgttttaa

SEQ ID NO: 695754 - DNA, 13 bp, C. elegans
aattcttaacatt

SEQ ID NO: 695755 - DNA, 13 bp, C. elegans
aattcttaacttt

SEQ ID NO: 695756 - DNA, 13 bp, C. elegans
aattcttcaaaat

SEQ ID NO: 695757 - DNA, 13 bp, C. elegans
aattcttcaaagt

SEQ ID NO: 695758 - DNA, 13 bp, C. elegans
aattcttcaaatg

SEQ ID NO: 695759 - DNA, 13 bp, C. elegans
aattcttcaactt

SEQ ID NO: 695760 - DNA, 13 bp, C. elegans
aattcttcaataa

SEQ ID NO: 695761 - DNA, 13 bp, C. elegans
aattcttcagaaa

SEQ ID NO: 695762 - DNA, 13 bp, C. elegans
aattcttcatatt

SEQ ID NO: 695763 - DNA, 13 bp, C. elegans
aattcttccactt

SEQ ID NO: 695764 - DNA, 13 bp, C. elegans
aattcttcgaaaa

SEQ ID NO: 695765 - DNA, 13 bp, C. elegans
aattcttcgaatt

SEQ ID NO: 695766 - DNA, 13 bp, C. elegans
aattcttcgtttt

SEQ ID NO: 695767 - DNA, 13 bp, C. elegans
aattcttctaaaa

SEQ ID NO: 695768 - DNA, 13 bp, C. elegans
aattcttctcaaa

SEQ ID NO: 695769 - DNA, 13 bp, C. elegans
aattcttcttgaa

SEQ ID NO: 695770 - DNA, 13 bp, C. elegans
aattcttgaaaca

SEQ ID NO: 695771 - DNA, 13 bp, C. elegans
aattcttgaaact

SEQ ID NO: 695772 - DNA, 13 bp, C. elegans
aattcttgaacta

SEQ ID NO: 695773 - DNA, 13 bp, C. elegans
aattcttgaattc

SEQ ID NO: 695774 - DNA, 13 bp, C. elegans
aattcttgatttt

SEQ ID NO: 695775 - DNA, 13 bp, C. elegans
aattcttgccaaa

SEQ ID NO: 695776 - DNA, 13 bp, C. elegans
aattcttggaaaa

SEQ ID NO: 695777 - DNA, 13 bp, C. elegans
aattcttggcaaa

SEQ ID NO: 695778 - DNA, 13 bp, C. elegans
aattcttgtattt

SEQ ID NO: 695779 - DNA, 13 bp, C. elegans
aattcttgttttg

SEQ ID NO: 695780 - DNA, 13 bp, C. elegans
aattctttaaaag

SEQ ID NO: 695781 - DNA, 13 bp, C. elegans
aattctttaaatg

SEQ ID NO: 695782 - DNA, 13 bp, C. elegans
aattctttatcaa

SEQ ID NO: 695783 - DNA, 13 bp, C. elegans
aattctttcaatt

SEQ ID NO: 695784 - DNA, 13 bp, C. elegans
aattctttccaaa

SEQ ID NO: 695785 - DNA, 13 bp, C. elegans
aattctttcgaaa

SEQ ID NO: 695786 - DNA, 13 bp, C. elegans
aattctttgaaaa

SEQ ID NO: 695787 - DNA, 13 bp, C. elegans
aattcttttctca

SEQ ID NO: 695788 - DNA, 13 bp, C. elegans
aattcttttgaaa

SEQ ID NO: 695789 - DNA, 13 bp, C. elegans
aattcttttgatt

SEQ ID NO: 695790 - DNA, 13 bp, C. elegans
aattcttttttga

SEQ ID NO: 695791 - DNA, 13 bp, C. elegans
aattgaaaaacag

SEQ ID NO: 695792 - DNA, 13 bp, C. elegans
aattgaaaaacta

SEQ ID NO: 695793 - DNA, 13 bp, C. elegans
aattgaaaaactt

SEQ ID NO: 695794 - DNA, 14 bp, C. elegans
aattgaaaaattca

SEQ ID NO: 695795 - DNA, 13 bp, C. elegans
aattgaaaaattg

SEQ ID NO: 695796 - DNA, 13 bp, C. elegans
aattgaaaacctt

SEQ ID NO: 695797 - DNA, 13 bp, C. elegans
aattgaaaactaa

SEQ ID NO: 695798 - DNA, 13 bp, C. elegans
aattgaaaactct

SEQ ID NO: 695799 - DNA, 13 bp, C. elegans
aattgaaaagtac

SEQ ID NO: 695800 - DNA, 13 bp, C. elegans
aattgaaaatcct

SEQ ID NO: 695801 - DNA, 13 bp, C. elegans
aattgaaaatcga

SEQ ID NO: 695802 - DNA, 13 bp, C. elegans
aattgaaaatctc

SEQ ID NO: 695803 - DNA, 13 bp, C. elegans
aattgaaaatctt

SEQ ID NO: 695804 - DNA, 13 bp, C. elegans
aattgaaaatgag

SEQ ID NO: 695805 - DNA, 13 bp, C. elegans
aattgaaaatgtt

SEQ ID NO: 695806 - DNA, 13 bp, C. elegans
aattgaaaattca

SEQ ID NO: 695807 - DNA, 13 bp, C. elegans
aattgaaaattcc

SEQ ID NO: 695808 - DNA, 13 bp, C. elegans
aattgaaaattct

SEQ ID NO: 695809 - DNA, 13 bp, C. elegans
aattgaaaatttc

SEQ ID NO: 695810 - DNA, 13 bp, C. elegans
aattgaaaatttg

SEQ ID NO: 695811 - DNA, 13 bp, C. elegans
aattgaaacaaca

SEQ ID NO: 695812 - DNA, 13 bp, C. elegans
aattgaaacaatt

SEQ ID NO: 695813 - DNA, 13 bp, C. elegans
aattgaaacagaa

SEQ ID NO: 695814 - DNA, 13 bp, C. elegans
aattgaaacagtt

SEQ ID NO: 695815 - DNA, 13 bp, C. elegans
aattgaaaccttt

SEQ ID NO: 695816 - DNA, 13 bp, C. elegans
aattgaaacggaa

SEQ ID NO: 695817 - DNA, 13 bp, C. elegans
aattgaaactatt

SEQ ID NO: 695818 - DNA, 13 bp, C. elegans
aattgaaactttc

SEQ ID NO: 695819 - DNA, 13 bp, C. elegans
aattgaaactttg

SEQ ID NO: 695820 - DNA, 13 bp, C. elegans
aattgaaagagga

SEQ ID NO: 695821 - DNA, 13 bp, C. elegans
aattgaaagattt

SEQ ID NO: 695822 - DNA, 13 bp, C. elegans
aattgaaagcaat

SEQ ID NO: 695823 - DNA, 13 bp, C. elegans
aattgaaagttct

SEQ ID NO: 695824 - DNA, 13 bp, C. elegans
aattgaaagttga

SEQ ID NO: 695825 - DNA, 13 bp, C. elegans
aattgaaagtttc

SEQ ID NO: 695826 - DNA, 13 bp, C. elegans
aattgaaataatc

SEQ ID NO: 695827 - DNA, 13 bp, C. elegans
aattgaaatatga

SEQ ID NO: 695828 - DNA, 13 bp, C. elegans
aattgaaatcaaa

SEQ ID NO: 695829 - DNA, 13 bp, C. elegans
aattgaaatgcaa

SEQ ID NO: 695830 - DNA, 13 bp, C. elegans
aattgaaatgtgt

SEQ ID NO: 695831 - DNA, 13 bp, C. elegans
aattgaaattcaa

SEQ ID NO: 695832 - DNA, 13 bp, C. elegans
aattgaaattccg

SEQ ID NO: 695833 - DNA, 13 bp, C. elegans
aattgaaattctc

SEQ ID NO: 695834 - DNA, 13 bp, C. elegans
aattgaaattctg

SEQ ID NO: 695835 - DNA, 15 bp, C. elegans
aattgaaattgaaaa

SEQ ID NO: 695836 - DNA, 13 bp, C. elegans
aattgaaattgat

SEQ ID NO: 695837 - DNA, 13 bp, C. elegans
aattgaaattgta

SEQ ID NO: 695838 - DNA, 13 bp, C. elegans
aattgaaatttca

SEQ ID NO: 695839 - DNA, 13 bp, C. elegans
aattgaaatttcc

SEQ ID NO: 695840 - DNA, 13 bp, C. elegans
aattgaaattttc

SEQ ID NO: 695841 - DNA, 13 bp, C. elegans
aattgaacaaact

SEQ ID NO: 695842 - DNA, 13 bp, C. elegans
aattgaacaaatt

SEQ ID NO: 695843 - DNA, 13 bp, C. elegans
aattgaacaataa

SEQ ID NO: 695844 - DNA, 13 bp, C. elegans
aattgaacaatta

SEQ ID NO: 695845 - DNA, 13 bp, C. elegans
aattgaacataaa

SEQ ID NO: 695846 - DNA, 13 bp, C. elegans
aattgaacatttt

SEQ ID NO: 695847 - DNA, 13 bp, C. elegans
aattgaaccaaaa

SEQ ID NO: 695848 - DNA, 13 bp, C. elegans
aattgaacgaaat

SEQ ID NO: 695849 - DNA, 13 bp, C. elegans
aattgaacgtttt

SEQ ID NO: 695850 - DNA, 13 bp, C. elegans
aattgaactgaaa

SEQ ID NO: 695851 - DNA, 13 bp, C. elegans
aattgaacttgaa

SEQ ID NO: 695852 - DNA, 13 bp, C. elegans
aattgaacttgct

SEQ ID NO: 695853 - DNA, 13 bp, C. elegans
aattgaactttat

SEQ ID NO: 695854 - DNA, 13 bp, C. elegans
aattgaactttca

SEQ ID NO: 695855 - DNA, 13 bp, C. elegans
aattgaagaaaca

SEQ ID NO: 695856 - DNA, 13 bp, C. elegans
aattgaagaaagc

SEQ ID NO: 695857 - DNA, 13 bp, C. elegans
aattgaagaaatg

SEQ ID NO: 695858 - DNA, 13 bp, C. elegans
aattgaagaacaa

SEQ ID NO: 695859 - DNA, 13 bp, C. elegans
aattgaagaagtt

SEQ ID NO: 695860 - DNA, 13 bp, C. elegans
aattgaagaatat

SEQ ID NO: 695861 - DNA, 13 bp, C. elegans
aattgaagaatga

SEQ ID NO: 695862 - DNA, 13 bp, C. elegans
aattgaagaatgt

SEQ ID NO: 695863 - DNA, 13 bp, C. elegans
aattgaagaattt

SEQ ID NO: 695864 - DNA, 13 bp, C. elegans
aattgaagagaat

SEQ ID NO: 695865 - DNA, 13 bp, C. elegans
aattgaagattta

SEQ ID NO: 695866 - DNA, 13 bp, C. elegans
aattgaagcaaaa

SEQ ID NO: 695867 - DNA, 13 bp, C. elegans
aattgaagttaaa

SEQ ID NO: 695868 - DNA, 13 bp, C. elegans
aattgaataaatc

SEQ ID NO: 695869 - DNA, 13 bp, C. elegans
aattgaataatga

SEQ ID NO: 695870 - DNA, 13 bp, C. elegans
aattgaataattg

SEQ ID NO: 695871 - DNA, 13 bp, C. elegans
aattgaatacatt

SEQ ID NO: 695872 - DNA, 13 bp, C. elegans
aattgaatattca

SEQ ID NO: 695873 - DNA, 13 bp, C. elegans
aattgaatcaaaa

SEQ ID NO: 695874 - DNA, 14 bp, C. elegans
aattgaatcaaaat

SEQ ID NO: 695875 - DNA, 13 bp, C. elegans
aattgaatcaact

SEQ ID NO: 695876 - DNA, 13 bp, C. elegans
aattgaatcaatt

SEQ ID NO: 695877 - DNA, 13 bp, C. elegans
aattgaatcttaa

SEQ ID NO: 695878 - DNA, 13 bp, C. elegans
aattgaatctttt

SEQ ID NO: 695879 - DNA, 13 bp, C. elegans
aattgaatgaatg

SEQ ID NO: 695880 - DNA, 13 bp, C. elegans
aattgaatgcaaa

SEQ ID NO: 695881 - DNA, 13 bp, C. elegans
aattgaatggaaa

SEQ ID NO: 695882 - DNA, 13 bp, C. elegans
aattgaatgttta

SEQ ID NO: 695883 - DNA, 13 bp, C. elegans
aattgaatgtttt

SEQ ID NO: 695884 - DNA, 13 bp, C. elegans
aattgaattagat

SEQ ID NO: 695885 - DNA, 13 bp, C. elegans
aattgaattatca

SEQ ID NO: 695886 - DNA, 13 bp, C. elegans
aattgaattatga

SEQ ID NO: 695887 - DNA, 13 bp, C. elegans
aattgaattattg

SEQ ID NO: 695888 - DNA, 13 bp, C. elegans
aattgaattcaaa

SEQ ID NO: 695889 - DNA, 13 bp, C. elegans
aattgaattcaat

SEQ ID NO: 695890 - DNA, 13 bp, C. elegans
aattgaattgctc

SEQ ID NO: 695891 - DNA, 13 bp, C. elegans
aattgaattgttg

SEQ ID NO: 695892 - DNA, 13 bp, C. elegans
aattgaattgttt

SEQ ID NO: 695893 - DNA, 13 bp, C. elegans
aattgaatttcag

SEQ ID NO: 695894 - DNA, 13 bp, C. elegans
aattgaatttctg

SEQ ID NO: 695895 - DNA, 13 bp, C. elegans
aattgaatttgaa

SEQ ID NO: 695896 - DNA, 13 bp, C. elegans
aattgaatttgta

SEQ ID NO: 695897 - DNA, 13 bp, C. elegans
aattgaattttcc

SEQ ID NO: 695898 - DNA, 13 bp, C. elegans
aattgacaaaaag

SEQ ID NO: 695899 - DNA, 13 bp, C. elegans
aattgacaaaatt

SEQ ID NO: 695900 - DNA, 13 bp, C. elegans
aattgacaaattg

SEQ ID NO: 695901 - DNA, 13 bp, C. elegans
aattgacaaattt

SEQ ID NO: 695902 - DNA, 13 bp, C. elegans
aattgacaacaaa

SEQ ID NO: 695903 - DNA, 13 bp, C. elegans
aattgacaacaca

SEQ ID NO: 695904 - DNA, 13 bp, C. elegans
aattgacaagaaa

SEQ ID NO: 695905 - DNA, 13 bp, C. elegans
aattgacaatatt

SEQ ID NO: 695906 - DNA, 13 bp, C. elegans
aattgacacaaat

SEQ ID NO: 695907 - DNA, 13 bp, C. elegans
aattgacactttt

SEQ ID NO: 695908 - DNA, 13 bp, C. elegans
aattgacatattt

SEQ ID NO: 695909 - DNA, 13 bp, C. elegans
aattgacatgaaa

SEQ ID NO: 695910 - DNA, 13 bp, C. elegans
aattgacatttct

SEQ ID NO: 695911 - DNA, 13 bp, C. elegans
aattgacattttc

SEQ ID NO: 695912 - DNA, 13 bp, C. elegans
aattgaccaaatt

SEQ ID NO: 695913 - DNA, 13 bp, C. elegans
aattgacgaaaaa

SEQ ID NO: 695914 - DNA, 13 bp, C. elegans
aattgactgaaac

SEQ ID NO: 695915 - DNA, 13 bp, C. elegans
aattgactttccg

SEQ ID NO: 695916 - DNA, 13 bp, C. elegans
aattgactttttc

SEQ ID NO: 695917 - DNA, 13 bp, C. elegans
aattgactttttg

SEQ ID NO: 695918 - DNA, 13 bp, C. elegans
aattgactttttt

SEQ ID NO: 695919 - DNA, 13 bp, C. elegans
aattgagaaaaac

SEQ ID NO: 695920 - DNA, 13 bp, C. elegans
aattgagaaaacc

SEQ ID NO: 695921 - DNA, 13 bp, C. elegans
aattgagaaacaa

SEQ ID NO: 695922 - DNA, 13 bp, C. elegans
aattgagaaacta

SEQ ID NO: 695923 - DNA, 13 bp, C. elegans
aattgagaaatat

SEQ ID NO: 695924 - DNA, 13 bp, C. elegans
aattgagaacaaa

SEQ ID NO: 695925 - DNA, 13 bp, C. elegans
aattgagaagttg

SEQ ID NO: 695926 - DNA, 13 bp, C. elegans
aattgagaattaa

SEQ ID NO: 695927 - DNA, 13 bp, C. elegans
aattgagaattat

SEQ ID NO: 695928 - DNA, 13 bp, C. elegans
aattgagaattga

SEQ ID NO: 695929 - DNA, 13 bp, C. elegans
aattgagacaatt

SEQ ID NO: 695930 - DNA, 13 bp, C. elegans
aattgagagaaat

SEQ ID NO: 695931 - DNA, 13 bp, C. elegans
aattgagagagaa

SEQ ID NO: 695932 - DNA, 13 bp, C. elegans
aattgagagattt

SEQ ID NO: 695933 - DNA, 13 bp, C. elegans
aattgagaggaaa

SEQ ID NO: 695934 - DNA, 13 bp, C. elegans
aattgagagtttt

SEQ ID NO: 695935 - DNA, 13 bp, C. elegans
aattgagattttg

SEQ ID NO: 695936 - DNA, 13 bp, C. elegans
aattgagcaaaac

SEQ ID NO: 695937 - DNA, 13 bp, C. elegans
aattgagcgattt

SEQ ID NO: 695938 - DNA, 13 bp, C. elegans
aattgagctcgga

SEQ ID NO: 695939 - DNA, 13 bp, C. elegans
aattgagctttgt

SEQ ID NO: 695940 - DNA, 13 bp, C. elegans
aattgaggaaaat

SEQ ID NO: 695941 - DNA, 13 bp, C. elegans
aattgaggaaatt

SEQ ID NO: 695942 - DNA, 13 bp, C. elegans
aattgagggaaat

SEQ ID NO: 695943 - DNA, 13 bp, C. elegans
aattgaggtttat

SEQ ID NO: 695944 - DNA, 13 bp, C. elegans
aattgagtaaaat

SEQ ID NO: 695945 - DNA, 13 bp, C. elegans
aattgagttttaa

SEQ ID NO: 695946 - DNA, 13 bp, C. elegans
aattgagtttttg

SEQ ID NO: 695947 - DNA, 13 bp, C. elegans
aattgataacaaa

SEQ ID NO: 695948 - DNA, 13 bp, C. elegans
aattgataacttt

SEQ ID NO: 695949 - DNA, 13 bp, C. elegans
aattgataagata

SEQ ID NO: 695950 - DNA, 13 bp, C. elegans
aattgataagatt

SEQ ID NO: 695951 - DNA, 13 bp, C. elegans
aattgataagttt

SEQ ID NO: 695952 - DNA, 13 bp, C. elegans
aattgataattga

SEQ ID NO: 695953 - DNA, 13 bp, C. elegans
aattgatagttca

SEQ ID NO: 695954 - DNA, 13 bp, C. elegans
aattgatagtttt

SEQ ID NO: 695955 - DNA, 13 bp, C. elegans
aattgatatgttt

SEQ ID NO: 695956 - DNA, 13 bp, C. elegans
aattgatatttga

SEQ ID NO: 695957 - DNA, 13 bp, C. elegans
aattgatattttg

SEQ ID NO: 695958 - DNA, 13 bp, C. elegans
aattgatcaaaat

SEQ ID NO: 695959 - DNA, 13 bp, C. elegans
aattgatgaaaat

SEQ ID NO: 695960 - DNA, 13 bp, C. elegans
aattgatgaaata

SEQ ID NO: 695961 - DNA, 13 bp, C. elegans
aattgatgaatat

SEQ ID NO: 695962 - DNA, 13 bp, C. elegans
aattgatgaattt

SEQ ID NO: 695963 - DNA, 13 bp, C. elegans
aattgatgagaaa

SEQ ID NO: 695964 - DNA, 13 bp, C. elegans
aattgatgatatt

SEQ ID NO: 695965 - DNA, 13 bp, C. elegans
aattgatggagaa

SEQ ID NO: 695966 - DNA, 13 bp, C. elegans
aattgattacttt

SEQ ID NO: 695967 - DNA, 13 bp, C. elegans
aattgattatttc

SEQ ID NO: 695968 - DNA, 13 bp, C. elegans
aattgattccaat

SEQ ID NO: 695969 - DNA, 13 bp, C. elegans
aattgattgaatt

SEQ ID NO: 695970 - DNA, 13 bp, C. elegans
aattgattgattt

SEQ ID NO: 695971 - DNA, 13 bp, C. elegans
aattgattggttt

SEQ ID NO: 695972 - DNA, 13 bp, C. elegans
aattgattgtgaa

SEQ ID NO: 695973 - DNA, 13 bp, C. elegans
aattgatttcaaa

SEQ ID NO: 695974 - DNA, 13 bp, C. elegans
aattgatttccaa

SEQ ID NO: 695975 - DNA, 13 bp, C. elegans
aattgatttctga

SEQ ID NO: 695976 - DNA, 13 bp, C. elegans
aattgatttcttt

SEQ ID NO: 695977 - DNA, 13 bp, C. elegans
aattgatttgaaa

SEQ ID NO: 695978 - DNA, 13 bp, C. elegans
aattgatttgagc

SEQ ID NO: 695979 - DNA, 13 bp, C. elegans
aattgatttgatt

SEQ ID NO: 695980 - DNA, 13 bp, C. elegans
aattgatttgcaa

SEQ ID NO: 695981 - DNA, 13 bp, C. elegans
aattgatttgtat

SEQ ID NO: 695982 - DNA, 13 bp, C. elegans
aattgattttcag

SEQ ID NO: 695983 - DNA, 13 bp, C. elegans
aattgattttcga

SEQ ID NO: 695984 - DNA, 13 bp, C. elegans
aattgattttcta

SEQ ID NO: 695985 - DNA, 13 bp, C. elegans
aattgattttgag

SEQ ID NO: 695986 - DNA, 13 bp, C. elegans
aattgattttgca

SEQ ID NO: 695987 - DNA, 13 bp, C. elegans
aattgatttttca

SEQ ID NO: 695988 - DNA, 13 bp, C. elegans
aattgatttttct

SEQ ID NO: 695989 - DNA, 13 bp, C. elegans
aattgattttttc

SEQ ID NO: 695990 - DNA, 13 bp, C. elegans
aattgcaaaaagt

SEQ ID NO: 695991 - DNA, 13 bp, C. elegans
aattgcaaaaata

SEQ ID NO: 695992 - DNA, 13 bp, C. elegans
aattgcaaaacaa

SEQ ID NO: 695993 - DNA, 13 bp, C. elegans
aattgcaaaacta

SEQ ID NO: 695994 - DNA, 13 bp, C. elegans
aattgcaaaatat

SEQ ID NO: 695995 - DNA, 13 bp, C. elegans
aattgcaaaatta

SEQ ID NO: 695996 - DNA, 13 bp, C. elegans
aattgcaaacaaa

SEQ ID NO: 695997 - DNA, 13 bp, C. elegans
aattgcaaagttt

SEQ ID NO: 695998 - DNA, 13 bp, C. elegans
aattgcaaataat

SEQ ID NO: 695999 - DNA, 13 bp, C. elegans
aattgcaagaatt

SEQ ID NO: 696000 - DNA, 13 bp, C. elegans
aattgcaagattt

SEQ ID NO: 696001 - DNA, 13 bp, C. elegans
aattgcaatatat

SEQ ID NO: 696002 - DNA, 13 bp, C. elegans
aattgcaatattt

SEQ ID NO: 696003 - DNA, 13 bp, C. elegans
aattgcaatgttt

SEQ ID NO: 696004 - DNA, 13 bp, C. elegans
aattgcaattatt

SEQ ID NO: 696005 - DNA, 13 bp, C. elegans
aattgcaatttaa

SEQ ID NO: 696006 - DNA, 13 bp, C. elegans
aattgcaatttga

SEQ ID NO: 696007 - DNA, 13 bp, C. elegans
aattgcaatttta

SEQ ID NO: 696008 - DNA, 13 bp, C. elegans
aattgcaattttc

SEQ ID NO: 696009 - DNA, 13 bp, C. elegans
aattgcaattttg

SEQ ID NO: 696010 - DNA, 13 bp, C. elegans
aattgcaattttt

SEQ ID NO: 696011 - DNA, 13 bp, C. elegans
aattgcacaaaaa

SEQ ID NO: 696012 - DNA, 13 bp, C. elegans
aattgcacgtttt

SEQ ID NO: 696013 - DNA, 13 bp, C. elegans
aattgcactaaat

SEQ ID NO: 696014 - DNA, 13 bp, C. elegans
aattgcagaaaat

SEQ ID NO: 696015 - DNA, 13 bp, C. elegans
aattgcagaattt

SEQ ID NO: 696016 - DNA, 13 bp, C. elegans
aattgcagatttc

SEQ ID NO: 696017 - DNA, 13 bp, C. elegans
aattgcagttcgg

SEQ ID NO: 696018 - DNA, 14 bp, C. elegans
aattgcatattttt

SEQ ID NO: 696019 - DNA, 13 bp, C. elegans
aattgcatcaaaa

SEQ ID NO: 696020 - DNA, 13 bp, C. elegans
aattgcatcaatt

SEQ ID NO: 696021 - DNA, 13 bp, C. elegans
aattgcatcattt

SEQ ID NO: 696022 - DNA, 13 bp, C. elegans
aattgcattaatt

SEQ ID NO: 696023 - DNA, 13 bp, C. elegans
aattgcattattt

SEQ ID NO: 696024 - DNA, 13 bp, C. elegans
aattgcattcaaa

SEQ ID NO: 696025 - DNA, 13 bp, C. elegans
aattgcatttatt

SEQ ID NO: 696026 - DNA, 13 bp, C. elegans
aattgcattttct

SEQ ID NO: 696027 - DNA, 13 bp, C. elegans
aattgcattttta

SEQ ID NO: 696028 - DNA, 13 bp, C. elegans
aattgcatttttc

SEQ ID NO: 696029 - DNA, 13 bp, C. elegans
aattgcatttttg

SEQ ID NO: 696030 - DNA, 13 bp, C. elegans
aattgccaaaaaa

SEQ ID NO: 696031 - DNA, 13 bp, C. elegans
aattgccaaaaat

SEQ ID NO: 696032 - DNA, 13 bp, C. elegans
aattgccaaaata

SEQ ID NO: 696033 - DNA, 13 bp, C. elegans
aattgccaaagtt

SEQ ID NO: 696034 - DNA, 13 bp, C. elegans
aattgccaaatct

SEQ ID NO: 696035 - DNA, 13 bp, C. elegans
aattgccaacaaa

SEQ ID NO: 696036 - DNA, 13 bp, C. elegans
aattgccaattta

SEQ ID NO: 696037 - DNA, 13 bp, C. elegans
aattgccaatttt

SEQ ID NO: 696038 - DNA, 13 bp, C. elegans
aattgccactttt

SEQ ID NO: 696039 - DNA, 13 bp, C. elegans
aattgccagaaaa

SEQ ID NO: 696040 - DNA, 13 bp, C. elegans
aattgccagaaat

SEQ ID NO: 696041 - DNA, 13 bp, C. elegans
aattgccagtttt

SEQ ID NO: 696042 - DNA, 13 bp, C. elegans
aattgccataaaa

SEQ ID NO: 696043 - DNA, 13 bp, C. elegans
aattgccataatt

SEQ ID NO: 696044 - DNA, 13 bp, C. elegans
aattgccatattt

SEQ ID NO: 696045 - DNA, 13 bp, C. elegans
aattgccatttca

SEQ ID NO: 696046 - DNA, 13 bp, C. elegans
aattgcccatttg

SEQ ID NO: 696047 - DNA, 13 bp, C. elegans
aattgcccttttc

SEQ ID NO: 696048 - DNA, 13 bp, C. elegans
aattgcccttttt

SEQ ID NO: 696049 - DNA, 13 bp, C. elegans
aattgccgaaaaa

SEQ ID NO: 696050 - DNA, 13 bp, C. elegans
aattgccgaaaat

SEQ ID NO: 696051 - DNA, 13 bp, C. elegans
aattgccgagaat

SEQ ID NO: 696052 - DNA, 13 bp, C. elegans
aattgccgatatt

SEQ ID NO: 696053 - DNA, 13 bp, C. elegans
aattgccgcattt

SEQ ID NO: 696054 - DNA, 13 bp, C. elegans
aattgccggaatg

SEQ ID NO: 696055 - DNA, 13 bp, C. elegans
aattgccggaatt

SEQ ID NO: 696056 - DNA, 13 bp, C. elegans
aattgccggagtt

SEQ ID NO: 696057 - DNA, 13 bp, C. elegans
aattgccgtaatt

SEQ ID NO: 696058 - DNA, 13 bp, C. elegans
aattgccgtattt

SEQ ID NO: 696059 - DNA, 13 bp, C. elegans
aattgccgttttc

SEQ ID NO: 696060 - DNA, 13 bp, C. elegans
aattgcctatttt

SEQ ID NO: 696061 - DNA, 13 bp, C. elegans
aattgcgaaaaat

SEQ ID NO: 696062 - DNA, 13 bp, C. elegans
aattgcgaaattc

SEQ ID NO: 696063 - DNA, 13 bp, C. elegans
aattgcgaatttc

SEQ ID NO: 696064 - DNA, 13 bp, C. elegans
aattgcgcaaaaa

SEQ ID NO: 696065 - DNA, 13 bp, C. elegans
aattgcggaaaat

SEQ ID NO: 696066 - DNA, 13 bp, C. elegans
aattgcggaaatt

SEQ ID NO: 696067 - DNA, 13 bp, C. elegans
aattgctaaaatt

SEQ ID NO: 696068 - DNA, 13 bp, C. elegans
aattgctagaaat

SEQ ID NO: 696069 - DNA, 13 bp, C. elegans
aattgctagaatt

SEQ ID NO: 696070 - DNA, 13 bp, C. elegans
aattgctattttc

SEQ ID NO: 696071 - DNA, 13 bp, C. elegans
aattgctcaaatt

SEQ ID NO: 696072 - DNA, 13 bp, C. elegans
aattgctcaattt

SEQ ID NO: 696073 - DNA, 13 bp, C. elegans
aattgctcagaaa

SEQ ID NO: 696074 - DNA, 13 bp, C. elegans
aattgctcatctt

SEQ ID NO: 696075 - DNA, 13 bp, C. elegans
aattgctccaaaa

SEQ ID NO: 696076 - DNA, 13 bp, C. elegans
aattgctctaaaa

SEQ ID NO: 696077 - DNA, 13 bp, C. elegans
aattgctctgaaa

SEQ ID NO: 696078 - DNA, 13 bp, C. elegans
aattgctgaaaaa

SEQ ID NO: 696079 - DNA, 13 bp, C. elegans
aattgctgaaaat

SEQ ID NO: 696080 - DNA, 13 bp, C. elegans
aattgctgaaatt

SEQ ID NO: 696081 - DNA, 13 bp, C. elegans
aattgctgattaa

SEQ ID NO: 696082 - DNA, 13 bp, C. elegans
aattgctgatttt

SEQ ID NO: 696083 - DNA, 13 bp, C. elegans
aattgctggaaaa

SEQ ID NO: 696084 - DNA, 13 bp, C. elegans
aattgctggaaat

SEQ ID NO: 696085 - DNA, 13 bp, C. elegans
aattgctggaact

SEQ ID NO: 696086 - DNA, 13 bp, C. elegans
aattgctggaatt

SEQ ID NO: 696087 - DNA, 13 bp, C. elegans
aattgcttcaatt

SEQ ID NO: 696088 - DNA, 13 bp, C. elegans
aattgcttgaaac

SEQ ID NO: 696089 - DNA, 13 bp, C. elegans
aattgctttaaat

SEQ ID NO: 696090 - DNA, 13 bp, C. elegans
aattgctttatta

SEQ ID NO: 696091 - DNA, 13 bp, C. elegans
aattgctttcaat

SEQ ID NO: 696092 - DNA, 13 bp, C. elegans
aattgcttttaat

SEQ ID NO: 696093 - DNA, 13 bp, C. elegans
aattggaaaaaca

SEQ ID NO: 696094 - DNA, 13 bp, C. elegans
aattggaaaaacc

SEQ ID NO: 696095 - DNA, 13 bp, C. elegans
aattggaaaaagg

SEQ ID NO: 696096 - DNA, 13 bp, C. elegans
aattggaaaacaa

SEQ ID NO: 696097 - DNA, 13 bp, C. elegans
aattggaaaacag

SEQ ID NO: 696098 - DNA, 13 bp, C. elegans
aattggaaaagag

SEQ ID NO: 696099 - DNA, 13 bp, C. elegans
aattggaaaagga

SEQ ID NO: 696100 - DNA, 13 bp, C. elegans
aattggaaaaggt

SEQ ID NO: 696101 - DNA, 13 bp, C. elegans
aattggaaaagtt

SEQ ID NO: 696102 - DNA, 13 bp, C. elegans
aattggaaaatat

SEQ ID NO: 696103 - DNA, 13 bp, C. elegans
aattggaaaatga

SEQ ID NO: 696104 - DNA, 13 bp, C. elegans
aattggaaaatgc

SEQ ID NO: 696105 - DNA, 13 bp, C. elegans
aattggaaaatgt

SEQ ID NO: 696106 - DNA, 13 bp, C. elegans
aattggaaaattg

SEQ ID NO: 696107 - DNA, 13 bp, C. elegans
aattggaaaattt

SEQ ID NO: 696108 - DNA, 13 bp, C. elegans
aattggaaacaat

SEQ ID NO: 696109 - DNA, 13 bp, C. elegans
aattggaaacatt

SEQ ID NO: 696110 - DNA, 13 bp, C. elegans
aattggaaacttc

SEQ ID NO: 696111 - DNA, 13 bp, C. elegans
aattggaaacttt

SEQ ID NO: 696112 - DNA, 13 bp, C. elegans
aattggaaagtgt

SEQ ID NO: 696113 - DNA, 13 bp, C. elegans
aattggaaagttc

SEQ ID NO: 696114 - DNA, 13 bp, C. elegans
aattggaaatcaa

SEQ ID NO: 696115 - DNA, 13 bp, C. elegans
aattggaaatcta

SEQ ID NO: 696116 - DNA, 13 bp, C. elegans
aattggaaatgat

SEQ ID NO: 696117 - DNA, 13 bp, C. elegans
aattggaaatgtt

SEQ ID NO: 696118 - DNA, 13 bp, C. elegans
aattggaaattct

SEQ ID NO: 696119 - DNA, 13 bp, C. elegans
aattggaaattgg

SEQ ID NO: 696120 - DNA, 13 bp, C. elegans
aattggaaattgt

SEQ ID NO: 696121 - DNA, 13 bp, C. elegans
aattggaaattta

SEQ ID NO: 696122 - DNA, 13 bp, C. elegans
aattggaaccaaa

SEQ ID NO: 696123 - DNA, 13 bp, C. elegans
aattggaactttt

SEQ ID NO: 696124 - DNA, 13 bp, C. elegans
aattggaataatt

SEQ ID NO: 696125 - DNA, 13 bp, C. elegans
aattggaattcaa

SEQ ID NO: 696126 - DNA, 13 bp, C. elegans
aattggaattcga

SEQ ID NO: 696127 - DNA, 13 bp, C. elegans
aattggaattgaa

SEQ ID NO: 696128 - DNA, 13 bp, C. elegans
aattggaatttaa

SEQ ID NO: 696129 - DNA, 13 bp, C. elegans
aattggaatttat

SEQ ID NO: 696130 - DNA, 13 bp, C. elegans
aattggaatttga

SEQ ID NO: 696131 - DNA, 13 bp, C. elegans
aattggaattttt

SEQ ID NO: 696132 - DNA, 13 bp, C. elegans
aattggacatccc

SEQ ID NO: 696133 - DNA, 13 bp, C. elegans
aattggacatttt

SEQ ID NO: 696134 - DNA, 13 bp, C. elegans
aattggactaaaa

SEQ ID NO: 696135 - DNA, 13 bp, C. elegans
aattggagaattt

SEQ ID NO: 696136 - DNA, 13 bp, C. elegans
aattggagatttg

SEQ ID NO: 696137 - DNA, 13 bp, C. elegans
aattggagcaaaa

SEQ ID NO: 696138 - DNA, 13 bp, C. elegans
aattggaggaaaa

SEQ ID NO: 696139 - DNA, 13 bp, C. elegans
aattggagttttt

SEQ ID NO: 696140 - DNA, 13 bp, C. elegans
aattggataacat

SEQ ID NO: 696141 - DNA, 13 bp, C. elegans
aattggatgaaaa

SEQ ID NO: 696142 - DNA, 13 bp, C. elegans
aattggatgaaat

SEQ ID NO: 696143 - DNA, 13 bp, C. elegans
aattggatgccta

SEQ ID NO: 696144 - DNA, 13 bp, C. elegans
aattggatggaaa

SEQ ID NO: 696145 - DNA, 13 bp, C. elegans
aattggattattt

SEQ ID NO: 696146 - DNA, 13 bp, C. elegans
aattggattcgtt

SEQ ID NO: 696147 - DNA, 13 bp, C. elegans
aattggatttgaa

SEQ ID NO: 696148 - DNA, 13 bp, C. elegans
aattggatttgtt

SEQ ID NO: 696149 - DNA, 13 bp, C. elegans
aattggattttct

SEQ ID NO: 696150 - DNA, 13 bp, C. elegans
aattggatttttg

SEQ ID NO: 696151 - DNA, 13 bp, C. elegans
aattggcaaaaac

SEQ ID NO: 696152 - DNA, 13 bp, C. elegans
aattggcaaaaag

SEQ ID NO: 696153 - DNA, 13 bp, C. elegans
aattggcaaaaat

SEQ ID NO: 696154 - DNA, 13 bp, C. elegans
aattggcaaaata

SEQ ID NO: 696155 - DNA, 13 bp, C. elegans
aattggcaaacca

SEQ ID NO: 696156 - DNA, 13 bp, C. elegans
aattggcaacatt

SEQ ID NO: 696157 - DNA, 13 bp, C. elegans
aattggcaagttg

SEQ ID NO: 696158 - DNA, 13 bp, C. elegans
aattggcactttt

SEQ ID NO: 696159 - DNA, 13 bp, C. elegans
aattggcagtttt

SEQ ID NO: 696160 - DNA, 13 bp, C. elegans
aattggcataaaa

SEQ ID NO: 696161 - DNA, 13 bp, C. elegans
aattggccaaaat

SEQ ID NO: 696162 - DNA, 13 bp, C. elegans
aattggccaattt

SEQ ID NO: 696163 - DNA, 13 bp, C. elegans
aattggccgaaaa

SEQ ID NO: 696164 - DNA, 13 bp, C. elegans
aattggccgtgga

SEQ ID NO: 696165 - DNA, 13 bp, C. elegans
aattggcctgaaa

SEQ ID NO: 696166 - DNA, 13 bp, C. elegans
aattggcgaaatt

SEQ ID NO: 696167 - DNA, 13 bp, C. elegans
aattggctggaaa

SEQ ID NO: 696168 - DNA, 13 bp, C. elegans
aattgggaaaaat

SEQ ID NO: 696169 - DNA, 13 bp, C. elegans
aattgggaaaaca

SEQ ID NO: 696170 - DNA, 13 bp, C. elegans
aattgggaaaagt

SEQ ID NO: 696171 - DNA, 13 bp, C. elegans
aattgggaaaatg

SEQ ID NO: 696172 - DNA, 13 bp, C. elegans
aattgggaagttt

SEQ ID NO: 696173 - DNA, 13 bp, C. elegans
aattgggaatatt

SEQ ID NO: 696174 - DNA, 13 bp, C. elegans
aattgggaatttt

SEQ ID NO: 696175 - DNA, 13 bp, C. elegans
aattgggacaaaa

SEQ ID NO: 696176 - DNA, 13 bp, C. elegans
aattgggagaaaa

SEQ ID NO: 696177 - DNA, 13 bp, C. elegans
aattgggattttt

SEQ ID NO: 696178 - DNA, 13 bp, C. elegans
aattggggaaaaa

SEQ ID NO: 696179 - DNA, 13 bp, C. elegans
aattgggtttgtt

SEQ ID NO: 696180 - DNA, 13 bp, C. elegans
aattggtagaaaa

SEQ ID NO: 696181 - DNA, 13 bp, C. elegans
aattggtagtttt

SEQ ID NO: 696182 - DNA, 13 bp, C. elegans
aattggtgaaaat

SEQ ID NO: 696183 - DNA, 13 bp, C. elegans
aattggtgaaata

SEQ ID NO: 696184 - DNA, 13 bp, C. elegans
aattggtgaagtt

SEQ ID NO: 696185 - DNA, 13 bp, C. elegans
aattggtgctatt

SEQ ID NO: 696186 - DNA, 13 bp, C. elegans
aattggtggattt

SEQ ID NO: 696187 - DNA, 13 bp, C. elegans
aattggtggccga

SEQ ID NO: 696188 - DNA, 13 bp, C. elegans
aattggtgtgaaa

SEQ ID NO: 696189 - DNA, 13 bp, C. elegans
aattggtttttaa

SEQ ID NO: 696190 - DNA, 13 bp, C. elegans
aattgtaaaaaca

SEQ ID NO: 696191 - DNA, 13 bp, C. elegans
aattgtaaaaatg

SEQ ID NO: 696192 - DNA, 13 bp, C. elegans
aattgtaaaactt

SEQ ID NO: 696193 - DNA, 13 bp, C. elegans
aattgtaaaattc

SEQ ID NO: 696194 - DNA, 13 bp, C. elegans
aattgtaaaattg

SEQ ID NO: 696195 - DNA, 13 bp, C. elegans
aattgtaaagcaa

SEQ ID NO: 696196 - DNA, 13 bp, C. elegans
aattgtaaatcta

SEQ ID NO: 696197 - DNA, 13 bp, C. elegans
aattgtaaattca

SEQ ID NO: 696198 - DNA, 13 bp, C. elegans
aattgtaaattct

SEQ ID NO: 696199 - DNA, 13 bp, C. elegans
aattgtaaattga

SEQ ID NO: 696200 - DNA, 13 bp, C. elegans
aattgtaacatat

SEQ ID NO: 696201 - DNA, 13 bp, C. elegans
aattgtaagattt

SEQ ID NO: 696202 - DNA, 13 bp, C. elegans
aattgtaatagtt

SEQ ID NO: 696203 - DNA, 13 bp, C. elegans
aattgtaattgaa

SEQ ID NO: 696204 - DNA, 13 bp, C. elegans
aattgtaatttcc

SEQ ID NO: 696205 - DNA, 13 bp, C. elegans
aattgtaatttgt

SEQ ID NO: 696206 - DNA, 13 bp, C. elegans
aattgtacaaaaa

SEQ ID NO: 696207 - DNA, 13 bp, C. elegans
aattgtacaaaac

SEQ ID NO: 696208 - DNA, 13 bp, C. elegans
aattgtactaaaa

SEQ ID NO: 696209 - DNA, 13 bp, C. elegans
aattgtactgaaa

SEQ ID NO: 696210 - DNA, 13 bp, C. elegans
aattgtacttttc

SEQ ID NO: 696211 - DNA, 13 bp, C. elegans
aattgtagaaatt

SEQ ID NO: 696212 - DNA, 13 bp, C. elegans
aattgtagagaaa

SEQ ID NO: 696213 - DNA, 13 bp, C. elegans
aattgtagttttc

SEQ ID NO: 696214 - DNA, 13 bp, C. elegans
aattgtatactca

SEQ ID NO: 696215 - DNA, 13 bp, C. elegans
aattgtatatttc

SEQ ID NO: 696216 - DNA, 13 bp, C. elegans
aattgtatcattt

SEQ ID NO: 696217 - DNA, 13 bp, C. elegans
aattgtatgaaaa

SEQ ID NO: 696218 - DNA, 13 bp, C. elegans
aattgtatggaaa

SEQ ID NO: 696219 - DNA, 13 bp, C. elegans
aattgtattatca

SEQ ID NO: 696220 - DNA, 13 bp, C. elegans
aattgtattattc

SEQ ID NO: 696221 - DNA, 13 bp, C. elegans
aattgtattcatt

SEQ ID NO: 696222 - DNA, 13 bp, C. elegans
aattgtatttcta

SEQ ID NO: 696223 - DNA, 13 bp, C. elegans
aattgtattttct

SEQ ID NO: 696224 - DNA, 13 bp, C. elegans
aattgtcaaaaac

SEQ ID NO: 696225 - DNA, 13 bp, C. elegans
aattgtcaaaaat

SEQ ID NO: 696226 - DNA, 13 bp, C. elegans
aattgtcaaaatt

SEQ ID NO: 696227 - DNA, 13 bp, C. elegans
aattgtcaaagtt

SEQ ID NO: 696228 - DNA, 13 bp, C. elegans
aattgtcaaattt

SEQ ID NO: 696229 - DNA, 13 bp, C. elegans
aattgtcaacaaa

SEQ ID NO: 696230 - DNA, 13 bp, C. elegans
aattgtcaactat

SEQ ID NO: 696231 - DNA, 13 bp, C. elegans
aattgtcaactgt

SEQ ID NO: 696232 - DNA, 13 bp, C. elegans
aattgtcaagttg

SEQ ID NO: 696233 - DNA, 13 bp, C. elegans
aattgtcaataat

SEQ ID NO: 696234 - DNA, 13 bp, C. elegans
aattgtcaattgt

SEQ ID NO: 696235 - DNA, 13 bp, C. elegans
aattgtcaatttt

SEQ ID NO: 696236 - DNA, 13 bp, C. elegans
aattgtcacaatt

SEQ ID NO: 696237 - DNA, 13 bp, C. elegans
aattgtcactttt

SEQ ID NO: 696238 - DNA, 13 bp, C. elegans
aattgtcagaaaa

SEQ ID NO: 696239 - DNA, 13 bp, C. elegans
aattgtcagaaat

SEQ ID NO: 696240 - DNA, 13 bp, C. elegans
aattgtcatatta

SEQ ID NO: 696241 - DNA, 13 bp, C. elegans
aattgtcatcatt

SEQ ID NO: 696242 - DNA, 13 bp, C. elegans
aattgtcatttta

SEQ ID NO: 696243 - DNA, 13 bp, C. elegans
aattgtcattttc

SEQ ID NO: 696244 - DNA, 13 bp, C. elegans
aattgtcattttg

SEQ ID NO: 696245 - DNA, 13 bp, C. elegans
aattgtccaattt

SEQ ID NO: 696246 - DNA, 13 bp, C. elegans
aattgtcccaaaa

SEQ ID NO: 696247 - DNA, 13 bp, C. elegans
aattgtccttttt

SEQ ID NO: 696248 - DNA, 13 bp, C. elegans
aattgtcgaaatt

SEQ ID NO: 696249 - DNA, 13 bp, C. elegans
aattgtcgaattg

SEQ ID NO: 696250 - DNA, 13 bp, C. elegans
aattgtcgagaaa

SEQ ID NO: 696251 - DNA, 13 bp, C. elegans
aattgtcgattgc

SEQ ID NO: 696252 - DNA, 13 bp, C. elegans
aattgtcggccgc

SEQ ID NO: 696253 - DNA, 13 bp, C. elegans
aattgtcggtttt

SEQ ID NO: 696254 - DNA, 13 bp, C. elegans
aattgtcgtttcg

SEQ ID NO: 696255 - DNA, 13 bp, C. elegans
aattgtcgttttt

SEQ ID NO: 696256 - DNA, 13 bp, C. elegans
aattgtctatttt

SEQ ID NO: 696257 - DNA, 13 bp, C. elegans
aattgtctgaaaa

SEQ ID NO: 696258 - DNA, 13 bp, C. elegans
aattgtcttaatt

SEQ ID NO: 696259 - DNA, 13 bp, C. elegans
aattgtcttgttt

SEQ ID NO: 696260 - DNA, 13 bp, C. elegans
aattgtgaaaaat

SEQ ID NO: 696261 - DNA, 13 bp, C. elegans
aattgtgaaaaga

SEQ ID NO: 696262 - DNA, 13 bp, C. elegans
aattgtgaaataa

SEQ ID NO: 696263 - DNA, 13 bp, C. elegans
aattgtgaaattg

SEQ ID NO: 696264 - DNA, 13 bp, C. elegans
aattgtgaatatt

SEQ ID NO: 696265 - DNA, 13 bp, C. elegans
aattgtgaattgt

SEQ ID NO: 696266 - DNA, 13 bp, C. elegans
aattgtgaatttt

SEQ ID NO: 696267 - DNA, 13 bp, C. elegans
aattgtgacgtca

SEQ ID NO: 696268 - DNA, 13 bp, C. elegans
aattgtgagattt

SEQ ID NO: 696269 - DNA, 13 bp, C. elegans
aattgtgattttc

SEQ ID NO: 696270 - DNA, 13 bp, C. elegans
aattgtgcaaatt

SEQ ID NO: 696271 - DNA, 13 bp, C. elegans
aattgtgcaattt

SEQ ID NO: 696272 - DNA, 13 bp, C. elegans
aattgtgccaaaa

SEQ ID NO: 696273 - DNA, 13 bp, C. elegans
aattgtgctatga

SEQ ID NO: 696274 - DNA, 13 bp, C. elegans
aattgtgctccaa

SEQ ID NO: 696275 - DNA, 13 bp, C. elegans
aattgtggctttg

SEQ ID NO: 696276 - DNA, 13 bp, C. elegans
aattgtggtttcg

SEQ ID NO: 696277 - DNA, 13 bp, C. elegans
aattgtggttttg

SEQ ID NO: 696278 - DNA, 13 bp, C. elegans
aattgtgtaattt

SEQ ID NO: 696279 - DNA, 13 bp, C. elegans
aattgtgtcaaaa

SEQ ID NO: 696280 - DNA, 13 bp, C. elegans
aattgtgtcattt

SEQ ID NO: 696281 - DNA, 13 bp, C. elegans
aattgtgtctttt

SEQ ID NO: 696282 - DNA, 13 bp, C. elegans
aattgtgtgaaat

SEQ ID NO: 696283 - DNA, 13 bp, C. elegans
aattgtgtgcaaa

SEQ ID NO: 696284 - DNA, 13 bp, C. elegans
aattgtgttcaaa

SEQ ID NO: 696285 - DNA, 13 bp, C. elegans
aattgtgtttaaa

SEQ ID NO: 696286 - DNA, 13 bp, C. elegans
aattgtgttttaa

SEQ ID NO: 696287 - DNA, 13 bp, C. elegans
aattgtgtttttc

SEQ ID NO: 696288 - DNA, 13 bp, C. elegans
aattgttaaaaac

SEQ ID NO: 696289 - DNA, 13 bp, C. elegans
aattgttaaatgt

SEQ ID NO: 696290 - DNA, 13 bp, C. elegans
aattgttactttt

SEQ ID NO: 696291 - DNA, 13 bp, C. elegans
aattgttagaaaa

SEQ ID NO: 696292 - DNA, 13 bp, C. elegans
aattgttaggaaa

SEQ ID NO: 696293 - DNA, 13 bp, C. elegans
aattgttatcaaa

SEQ ID NO: 696294 - DNA, 13 bp, C. elegans
aattgttattcaa

SEQ ID NO: 696295 - DNA, 13 bp, C. elegans
aattgttattttc

SEQ ID NO: 696296 - DNA, 13 bp, C. elegans
aattgttcaaaaa

SEQ ID NO: 696297 - DNA, 13 bp, C. elegans
aattgttcaaaac

SEQ ID NO: 696298 - DNA, 13 bp, C. elegans
aattgttcaaaga

SEQ ID NO: 696299 - DNA, 13 bp, C. elegans
aattgttcaaagt

SEQ ID NO: 696300 - DNA, 13 bp, C. elegans
aattgttcaaatt

SEQ ID NO: 696301 - DNA, 13 bp, C. elegans
aattgttcaactg

SEQ ID NO: 696302 - DNA, 13 bp, C. elegans
aattgttcaactt

SEQ ID NO: 696303 - DNA, 13 bp, C. elegans
aattgttcacaaa

SEQ ID NO: 696304 - DNA, 13 bp, C. elegans
aattgttcagaaa

SEQ ID NO: 696305 - DNA, 13 bp, C. elegans
aattgttcatatt

SEQ ID NO: 696306 - DNA, 13 bp, C. elegans
aattgttcatcaa

SEQ ID NO: 696307 - DNA, 13 bp, C. elegans
aattgttcatttt

SEQ ID NO: 696308 - DNA, 13 bp, C. elegans
aattgttccaaaa

SEQ ID NO: 696309 - DNA, 13 bp, C. elegans
aattgttccattt

SEQ ID NO: 696310 - DNA, 13 bp, C. elegans
aattgttcctttt

SEQ ID NO: 696311 - DNA, 13 bp, C. elegans
aattgttcgaaaa

SEQ ID NO: 696312 - DNA, 13 bp, C. elegans
aattgttcgaatt

SEQ ID NO: 696313 - DNA, 13 bp, C. elegans
aattgttcggaaa

SEQ ID NO: 696314 - DNA, 13 bp, C. elegans
aattgttcgtttt

SEQ ID NO: 696315 - DNA, 13 bp, C. elegans
aattgttctaaat

SEQ ID NO: 696316 - DNA, 13 bp, C. elegans
aattgttctacaa

SEQ ID NO: 696317 - DNA, 13 bp, C. elegans
aattgttctgtta

SEQ ID NO: 696318 - DNA, 13 bp, C. elegans
aattgttcttatt

SEQ ID NO: 696319 - DNA, 13 bp, C. elegans
aattgttcttcaa

SEQ ID NO: 696320 - DNA, 13 bp, C. elegans
aattgttcttttc

SEQ ID NO: 696321 - DNA, 13 bp, C. elegans
aattgttgaaaca

SEQ ID NO: 696322 - DNA, 13 bp, C. elegans
aattgttgaaata

SEQ ID NO: 696323 - DNA, 13 bp, C. elegans
aattgttgaacat

SEQ ID NO: 696324 - DNA, 13 bp, C. elegans
aattgttgaagtt

SEQ ID NO: 696325 - DNA, 13 bp, C. elegans
aattgttgaatat

SEQ ID NO: 696326 - DNA, 13 bp, C. elegans
aattgttgaattg

SEQ ID NO: 696327 - DNA, 13 bp, C. elegans
aattgttgagttt

SEQ ID NO: 696328 - DNA, 13 bp, C. elegans
aattgttgatttg

SEQ ID NO: 696329 - DNA, 13 bp, C. elegans
aattgttgcaatt

SEQ ID NO: 696330 - DNA, 13 bp, C. elegans
aattgttggaaat

SEQ ID NO: 696331 - DNA, 13 bp, C. elegans
aattgttgtaaaa

SEQ ID NO: 696332 - DNA, 13 bp, C. elegans
aattgttgtaaat

SEQ ID NO: 696333 - DNA, 13 bp, C. elegans
aattgttgtcaaa

SEQ ID NO: 696334 - DNA, 13 bp, C. elegans
aattgttgtgaaa

SEQ ID NO: 696335 - DNA, 13 bp, C. elegans
aattgttgttttc

SEQ ID NO: 696336 - DNA, 13 bp, C. elegans
aattgtttaaaga

SEQ ID NO: 696337 - DNA, 13 bp, C. elegans
aattgtttaacta

SEQ ID NO: 696338 - DNA, 13 bp, C. elegans
aattgtttaattc

SEQ ID NO: 696339 - DNA, 13 bp, C. elegans
aattgtttacaat

SEQ ID NO: 696340 - DNA, 13 bp, C. elegans
aattgtttagatt

SEQ ID NO: 696341 - DNA, 13 bp, C. elegans
aattgtttatgaa

SEQ ID NO: 696342 - DNA, 13 bp, C. elegans
aattgtttattcc

SEQ ID NO: 696343 - DNA, 13 bp, C. elegans
aattgtttattct

SEQ ID NO: 696344 - DNA, 13 bp, C. elegans
aattgtttcaaat

SEQ ID NO: 696345 - DNA, 13 bp, C. elegans
aattgtttcaaca

SEQ ID NO: 696346 - DNA, 13 bp, C. elegans
aattgtttcaact

SEQ ID NO: 696347 - DNA, 13 bp, C. elegans
aattgtttcaagt

SEQ ID NO: 696348 - DNA, 13 bp, C. elegans
aattgtttcaatt

SEQ ID NO: 696349 - DNA, 13 bp, C. elegans
aattgtttcatat

SEQ ID NO: 696350 - DNA, 13 bp, C. elegans
aattgtttccagc

SEQ ID NO: 696351 - DNA, 13 bp, C. elegans
aattgtttcgaat

SEQ ID NO: 696352 - DNA, 13 bp, C. elegans
aattgtttcttta

SEQ ID NO: 696353 - DNA, 13 bp, C. elegans
aattgtttgaaac

SEQ ID NO: 696354 - DNA, 13 bp, C. elegans
aattgtttgaaat

SEQ ID NO: 696355 - DNA, 13 bp, C. elegans
aattgtttgcaaa

SEQ ID NO: 696356 - DNA, 13 bp, C. elegans
aattgtttgcatt

SEQ ID NO: 696357 - DNA, 13 bp, C. elegans
aattgttttaaac

SEQ ID NO: 696358 - DNA, 13 bp, C. elegans
aattgttttaaca

SEQ ID NO: 696359 - DNA, 13 bp, C. elegans
aattgttttacat

SEQ ID NO: 696360 - DNA, 13 bp, C. elegans
aattgttttcaaa

SEQ ID NO: 696361 - DNA, 13 bp, C. elegans
aattgttttcaat

SEQ ID NO: 696362 - DNA, 13 bp, C. elegans
aattgttttccta

SEQ ID NO: 696363 - DNA, 13 bp, C. elegans
aattgttttctga

SEQ ID NO: 696364 - DNA, 13 bp, C. elegans
aattgttttctgt

SEQ ID NO: 696365 - DNA, 13 bp, C. elegans
aattgttttgaat

SEQ ID NO: 696366 - DNA, 13 bp, C. elegans
aattgttttgaga

SEQ ID NO: 696367 - DNA, 13 bp, C. elegans
aattgttttgcaa

SEQ ID NO: 696368 - DNA, 13 bp, C. elegans
aattgttttgttc

SEQ ID NO: 696369 - DNA, 13 bp, C. elegans
aattgtttttgaa

SEQ ID NO: 696370 - DNA, 13 bp, C. elegans
aatttaaaaactc

SEQ ID NO: 696371 - DNA, 13 bp, C. elegans
aatttaaaactac

SEQ ID NO: 696372 - DNA, 13 bp, C. elegans
aatttaaaacttg

SEQ ID NO: 696373 - DNA, 13 bp, C. elegans
aatttaaaagagt

SEQ ID NO: 696374 - DNA, 13 bp, C. elegans
aatttaaaagtgt

SEQ ID NO: 696375 - DNA, 13 bp, C. elegans
aatttaaacgaaa

SEQ ID NO: 696376 - DNA, 13 bp, C. elegans
aatttaaagtgaa

SEQ ID NO: 696377 - DNA, 13 bp, C. elegans
aatttaaagttca

SEQ ID NO: 696378 - DNA, 13 bp, C. elegans
aatttaaatacca

SEQ ID NO: 696379 - DNA, 13 bp, C. elegans
aatttaaatgtgc

SEQ ID NO: 696380 - DNA, 13 bp, C. elegans
aatttaaatgtgt

SEQ ID NO: 696381 - DNA, 13 bp, C. elegans
aatttaaatgttc

SEQ ID NO: 696382 - DNA, 13 bp, C. elegans
aatttaaattccg

SEQ ID NO: 696383 - DNA, 13 bp, C. elegans
aatttaaattctg

SEQ ID NO: 696384 - DNA, 13 bp, C. elegans
aatttaactttca

SEQ ID NO: 696385 - DNA, 13 bp, C. elegans
aatttaagtttca

SEQ ID NO: 696386 - DNA, 13 bp, C. elegans
aatttaatcgaaa

SEQ ID NO: 696387 - DNA, 13 bp, C. elegans
aatttaatgtgaa

SEQ ID NO: 696388 - DNA, 13 bp, C. elegans
aatttaattgcag

SEQ ID NO: 696389 - DNA, 13 bp, C. elegans
aatttaattgttg

SEQ ID NO: 696390 - DNA, 13 bp, C. elegans
aatttaatttcga

SEQ ID NO: 696391 - DNA, 13 bp, C. elegans
aatttaatttctc

SEQ ID NO: 696392 - DNA, 13 bp, C. elegans
aatttacaacttt

SEQ ID NO: 696393 - DNA, 13 bp, C. elegans
aatttacaagaat

SEQ ID NO: 696394 - DNA, 13 bp, C. elegans
aatttacaatcaa

SEQ ID NO: 696395 - DNA, 13 bp, C. elegans
aatttacaatgtt

SEQ ID NO: 696396 - DNA, 13 bp, C. elegans
aatttacaattcc

SEQ ID NO: 696397 - DNA, 13 bp, C. elegans
aatttacaatttc

SEQ ID NO: 696398 - DNA, 13 bp, C. elegans
aatttacacttga

SEQ ID NO: 696399 - DNA, 13 bp, C. elegans
aatttacatattc

SEQ ID NO: 696400 - DNA, 13 bp, C. elegans
aatttaccaattt

SEQ ID NO: 696401 - DNA, 13 bp, C. elegans
aatttaccatatt

SEQ ID NO: 696402 - DNA, 13 bp, C. elegans
aatttaccgattt

SEQ ID NO: 696403 - DNA, 13 bp, C. elegans
aatttacgaattt

SEQ ID NO: 696404 - DNA, 13 bp, C. elegans
aatttacgatttt

SEQ ID NO: 696405 - DNA, 13 bp, C. elegans
aatttacgttttt

SEQ ID NO: 696406 - DNA, 13 bp, C. elegans
aatttactgagaa

SEQ ID NO: 696407 - DNA, 13 bp, C. elegans
aatttactgattt

SEQ ID NO: 696408 - DNA, 13 bp, C. elegans
aatttacttgaaa

SEQ ID NO: 696409 - DNA, 13 bp, C. elegans
aatttacttttgt

SEQ ID NO: 696410 - DNA, 13 bp, C. elegans
aatttagaaacta

SEQ ID NO: 696411 - DNA, 13 bp, C. elegans
aatttagaagttt

SEQ ID NO: 696412 - DNA, 13 bp, C. elegans
aatttagaatgtt

SEQ ID NO: 696413 - DNA, 13 bp, C. elegans
aatttagcaaaat

SEQ ID NO: 696414 - DNA, 13 bp, C. elegans
aatttagcgattt

SEQ ID NO: 696415 - DNA, 13 bp, C. elegans
aatttaggatttt

SEQ ID NO: 696416 - DNA, 13 bp, C. elegans
aatttaggtttta

SEQ ID NO: 696417 - DNA, 13 bp, C. elegans
aatttagtgaaaa

SEQ ID NO: 696418 - DNA, 13 bp, C. elegans
aatttagtgaatt

SEQ ID NO: 696419 - DNA, 13 bp, C. elegans
aatttagtgtaaa

SEQ ID NO: 696420 - DNA, 13 bp, C. elegans
aatttagttcatt

SEQ ID NO: 696421 - DNA, 13 bp, C. elegans
aatttagttttcg

SEQ ID NO: 696422 - DNA, 13 bp, C. elegans
aatttatagcaat

SEQ ID NO: 696423 - DNA, 13 bp, C. elegans
aatttatatcaga

SEQ ID NO: 696424 - DNA, 13 bp, C. elegans
aatttatatttgg

SEQ ID NO: 696425 - DNA, 13 bp, C. elegans
aatttatcaaaag

SEQ ID NO: 696426 - DNA, 13 bp, C. elegans
aatttatcaagtt

SEQ ID NO: 696427 - DNA, 13 bp, C. elegans
aatttatcacaat

SEQ ID NO: 696428 - DNA, 13 bp, C. elegans
aatttatcacttt

SEQ ID NO: 696429 - DNA, 13 bp, C. elegans
aatttatcagatt

SEQ ID NO: 696430 - DNA, 13 bp, C. elegans
aatttatcatgat

SEQ ID NO: 696431 - DNA, 13 bp, C. elegans
aatttatccaatt

SEQ ID NO: 696432 - DNA, 13 bp, C. elegans
aatttatccattt

SEQ ID NO: 696433 - DNA, 13 bp, C. elegans
aatttatcgaaaa

SEQ ID NO: 696434 - DNA, 13 bp, C. elegans
aatttatcgattt

SEQ ID NO: 696435 - DNA, 13 bp, C. elegans
aatttatcgcaaa

SEQ ID NO: 696436 - DNA, 13 bp, C. elegans
aatttatctaccg

SEQ ID NO: 696437 - DNA, 13 bp, C. elegans
aatttatctgaaa

SEQ ID NO: 696438 - DNA, 13 bp, C. elegans
aatttatcttcaa

SEQ ID NO: 696439 - DNA, 13 bp, C. elegans
aatttatgaaaac

SEQ ID NO: 696440 - DNA, 13 bp, C. elegans
aatttatgaaact

SEQ ID NO: 696441 - DNA, 13 bp, C. elegans
aatttatgagaaa

SEQ ID NO: 696442 - DNA, 13 bp, C. elegans
aatttatgagaac

SEQ ID NO: 696443 - DNA, 13 bp, C. elegans
aatttatgaggga

SEQ ID NO: 696444 - DNA, 13 bp, C. elegans
aatttatggcaaa

SEQ ID NO: 696445 - DNA, 13 bp, C. elegans
aatttatgtgaaa

SEQ ID NO: 696446 - DNA, 13 bp, C. elegans
aatttatgtgatt

SEQ ID NO: 696447 - DNA, 13 bp, C. elegans
aatttatgtgcaa

SEQ ID NO: 696448 - DNA, 13 bp, C. elegans
aatttattagctt

SEQ ID NO: 696449 - DNA, 13 bp, C. elegans
aatttattcagaa

SEQ ID NO: 696450 - DNA, 13 bp, C. elegans
aatttattccaaa

SEQ ID NO: 696451 - DNA, 13 bp, C. elegans
aatttattccaat

SEQ ID NO: 696452 - DNA, 13 bp, C. elegans
aatttattccatt

SEQ ID NO: 696453 - DNA, 13 bp, C. elegans
aatttattcgaaa

SEQ ID NO: 696454 - DNA, 13 bp, C. elegans
aatttattcgaat

SEQ ID NO: 696455 - DNA, 13 bp, C. elegans
aatttattcgatt

SEQ ID NO: 696456 - DNA, 13 bp, C. elegans
aatttattctcca

SEQ ID NO: 696457 - DNA, 13 bp, C. elegans
aatttattctttg

SEQ ID NO: 696458 - DNA, 13 bp, C. elegans
aatttattgcata

SEQ ID NO: 696459 - DNA, 13 bp, C. elegans
aatttattggaaa

SEQ ID NO: 696460 - DNA, 13 bp, C. elegans
aatttattgtcaa

SEQ ID NO: 696461 - DNA, 13 bp, C. elegans
aatttattgtctt

SEQ ID NO: 696462 - DNA, 13 bp, C. elegans
aatttattgtgaa

SEQ ID NO: 696463 - DNA, 13 bp, C. elegans
aatttatttacag

SEQ ID NO: 696464 - DNA, 13 bp, C. elegans
aatttatttccag

SEQ ID NO: 696465 - DNA, 13 bp, C. elegans
aatttatttctac

SEQ ID NO: 696466 - DNA, 13 bp, C. elegans
aatttatttgttc

SEQ ID NO: 696467 - DNA, 13 bp, C. elegans
aatttattttcag

SEQ ID NO: 696468 - DNA, 13 bp, C. elegans
aatttattttgca

SEQ ID NO: 696469 - DNA, 13 bp, C. elegans
aatttattttgga

SEQ ID NO: 696470 - DNA, 13 bp, C. elegans
aatttcaaaaagg

SEQ ID NO: 696471 - DNA, 13 bp, C. elegans
aatttcaaaaatg

SEQ ID NO: 696472 - DNA, 13 bp, C. elegans
aatttcaaaacat

SEQ ID NO: 696473 - DNA, 13 bp, C. elegans
aatttcaaaacgt

SEQ ID NO: 696474 - DNA, 13 bp, C. elegans
aatttcaaaatag

SEQ ID NO: 696475 - DNA, 13 bp, C. elegans
aatttcaaaatct

SEQ ID NO: 696476 - DNA, 13 bp, C. elegans
aatttcaaaatga

SEQ ID NO: 696477 - DNA, 13 bp, C. elegans
aatttcaaacaac

SEQ ID NO: 696478 - DNA, 13 bp, C. elegans
aatttcaaacgtt

SEQ ID NO: 696479 - DNA, 13 bp, C. elegans
aatttcaaactca

SEQ ID NO: 696480 - DNA, 13 bp, C. elegans
aatttcaaactct

SEQ ID NO: 696481 - DNA, 13 bp, C. elegans
aatttcaaagaaa

SEQ ID NO: 696482 - DNA, 13 bp, C. elegans
aatttcaaagact

SEQ ID NO: 696483 - DNA, 13 bp, C. elegans
aatttcaaagtat

SEQ ID NO: 696484 - DNA, 13 bp, C. elegans
aatttcaaagtca

SEQ ID NO: 696485 - DNA, 13 bp, C. elegans
aatttcaaatcaa

SEQ ID NO: 696486 - DNA, 13 bp, C. elegans
aatttcaaatctt

SEQ ID NO: 696487 - DNA, 13 bp, C. elegans
aatttcaaatgag

SEQ ID NO: 696488 - DNA, 13 bp, C. elegans
aatttcaaatgtg

SEQ ID NO: 696489 - DNA, 13 bp, C. elegans
aatttcaaatgtt

SEQ ID NO: 696490 - DNA, 13 bp, C. elegans
aatttcaaattca

SEQ ID NO: 696491 - DNA, 13 bp, C. elegans
aatttcaaattcc

SEQ ID NO: 696492 - DNA, 13 bp, C. elegans
aatttcaaattga

SEQ ID NO: 696493 - DNA, 13 bp, C. elegans
aatttcaaatttc

SEQ ID NO: 696494 - DNA, 14 bp, C. elegans
aatttcaaatttcc

SEQ ID NO: 696495 - DNA, 13 bp, C. elegans
aatttcaacaaat

SEQ ID NO: 696496 - DNA, 13 bp, C. elegans
aatttcaacataa

SEQ ID NO: 696497 - DNA, 13 bp, C. elegans
aatttcaacattt

SEQ ID NO: 696498 - DNA, 13 bp, C. elegans
aatttcaacgaaa

SEQ ID NO: 696499 - DNA, 13 bp, C. elegans
aatttcaacgaat

SEQ ID NO: 696500 - DNA, 13 bp, C. elegans
aatttcaactcac

SEQ ID NO: 696501 - DNA, 13 bp, C. elegans
aatttcaacttac

SEQ ID NO: 696502 - DNA, 13 bp, C. elegans
aatttcaactttt

SEQ ID NO: 696503 - DNA, 13 bp, C. elegans
aatttcaagaaat

SEQ ID NO: 696504 - DNA, 13 bp, C. elegans
aatttcaagaact

SEQ ID NO: 696505 - DNA, 13 bp, C. elegans
aatttcaagacaa

SEQ ID NO: 696506 - DNA, 13 bp, C. elegans
aatttcaagacat

SEQ ID NO: 696507 - DNA, 13 bp, C. elegans
aatttcaaggaga

SEQ ID NO: 696508 - DNA, 13 bp, C. elegans
aatttcaagtatt

SEQ ID NO: 696509 - DNA, 13 bp, C. elegans
aatttcaagttat

SEQ ID NO: 696510 - DNA, 13 bp, C. elegans
aatttcaagtttt

SEQ ID NO: 696511 - DNA, 13 bp, C. elegans
aatttcaataatg

SEQ ID NO: 696512 - DNA, 13 bp, C. elegans
aatttcaatcaaa

SEQ ID NO: 696513 - DNA, 13 bp, C. elegans
aatttcaatgaaa

SEQ ID NO: 696514 - DNA, 13 bp, C. elegans
aatttcaatgaat

SEQ ID NO: 696515 - DNA, 13 bp, C. elegans
aatttcaatgata

SEQ ID NO: 696516 - DNA, 13 bp, C. elegans
aatttcaatggaa

SEQ ID NO: 696517 - DNA, 13 bp, C. elegans
aatttcaattccg

SEQ ID NO: 696518 - DNA, 13 bp, C. elegans
aatttcaattgtt

SEQ ID NO: 696519 - DNA, 13 bp, C. elegans
aatttcaatttca

SEQ ID NO: 696520 - DNA, 13 bp, C. elegans
aatttcaatttcg

SEQ ID NO: 696521 - DNA, 13 bp, C. elegans
aatttcaatttct

SEQ ID NO: 696522 - DNA, 13 bp, C. elegans
aatttcaattttc

SEQ ID NO: 696523 - DNA, 13 bp, C. elegans
aatttcacaaaat

SEQ ID NO: 696524 - DNA, 13 bp, C. elegans
aatttcacaaagt

SEQ ID NO: 696525 - DNA, 13 bp, C. elegans
aatttcacaaatc

SEQ ID NO: 696526 - DNA, 13 bp, C. elegans
aatttcacaaatt

SEQ ID NO: 696527 - DNA, 13 bp, C. elegans
aatttcacaacat

SEQ ID NO: 696528 - DNA, 13 bp, C. elegans
aatttcacaattt

SEQ ID NO: 696529 - DNA, 13 bp, C. elegans
aatttcacatatt

SEQ ID NO: 696530 - DNA, 13 bp, C. elegans
aatttcacatcaa

SEQ ID NO: 696531 - DNA, 13 bp, C. elegans
aatttcacattat

SEQ ID NO: 696532 - DNA, 13 bp, C. elegans
aatttcacatttc

SEQ ID NO: 696533 - DNA, 13 bp, C. elegans
aatttcactaaaa

SEQ ID NO: 696534 - DNA, 13 bp, C. elegans
aatttcactcaat

SEQ ID NO: 696535 - DNA, 13 bp, C. elegans
aatttcacttgaa

SEQ ID NO: 696536 - DNA, 13 bp, C. elegans
aatttcactttat

SEQ ID NO: 696537 - DNA, 13 bp, C. elegans
aatttcactttca

SEQ ID NO: 696538 - DNA, 13 bp, C. elegans
aatttcagaaaaa

SEQ ID NO: 696539 - DNA, 13 bp, C. elegans
aatttcagaaaat

SEQ ID NO: 696540 - DNA, 13 bp, C. elegans
aatttcagaaatc

SEQ ID NO: 696541 - DNA, 13 bp, C. elegans
aatttcagaacat

SEQ ID NO: 696542 - DNA, 13 bp, C. elegans
aatttcagaagaa

SEQ ID NO: 696543 - DNA, 13 bp, C. elegans
aatttcagaagat

SEQ ID NO: 696544 - DNA, 13 bp, C. elegans
aatttcagaagtt

SEQ ID NO: 696545 - DNA, 13 bp, C. elegans
aatttcagaatat

SEQ ID NO: 696546 - DNA, 13 bp, C. elegans
aatttcagaatta

SEQ ID NO: 696547 - DNA, 13 bp, C. elegans
aatttcagagaac

SEQ ID NO: 696548 - DNA, 13 bp, C. elegans
aatttcagagaat

SEQ ID NO: 696549 - DNA, 13 bp, C. elegans
aatttcagagcat

SEQ ID NO: 696550 - DNA, 13 bp, C. elegans
aatttcagagtaa

SEQ ID NO: 696551 - DNA, 13 bp, C. elegans
aatttcagatatt

SEQ ID NO: 696552 - DNA, 13 bp, C. elegans
aatttcagatgga

SEQ ID NO: 696553 - DNA, 13 bp, C. elegans
aatttcagatttt

SEQ ID NO: 696554 - DNA, 13 bp, C. elegans
aatttcagcactt

SEQ ID NO: 696555 - DNA, 13 bp, C. elegans
aatttcagccaaa

SEQ ID NO: 696556 - DNA, 13 bp, C. elegans
aatttcagccgaa

SEQ ID NO: 696557 - DNA, 13 bp, C. elegans
aatttcagcggcg

SEQ ID NO: 696558 - DNA, 13 bp, C. elegans
aatttcagcgttt

SEQ ID NO: 696559 - DNA, 13 bp, C. elegans
aatttcagctatt

SEQ ID NO: 696560 - DNA, 13 bp, C. elegans
aatttcagctcaa

SEQ ID NO: 696561 - DNA, 13 bp, C. elegans
aatttcagctgaa

SEQ ID NO: 696562 - DNA, 13 bp, C. elegans
aatttcagctttt

SEQ ID NO: 696563 - DNA, 13 bp, C. elegans
aatttcaggattt

SEQ ID NO: 696564 - DNA, 13 bp, C. elegans
aatttcaggcatt

SEQ ID NO: 696565 - DNA, 13 bp, C. elegans
aatttcaggccat

SEQ ID NO: 696566 - DNA, 13 bp, C. elegans
aatttcagggaaa

SEQ ID NO: 696567 - DNA, 13 bp, C. elegans
aatttcaggttta

SEQ ID NO: 696568 - DNA, 13 bp, C. elegans
aatttcaggtttt

SEQ ID NO: 696569 - DNA, 13 bp, C. elegans
aatttcagtaatt

SEQ ID NO: 696570 - DNA, 13 bp, C. elegans
aatttcagtatat

SEQ ID NO: 696571 - DNA, 13 bp, C. elegans
aatttcagtcaat

SEQ ID NO: 696572 - DNA, 13 bp, C. elegans
aatttcagtgaaa

SEQ ID NO: 696573 - DNA, 13 bp, C. elegans
aatttcagtgaat

SEQ ID NO: 696574 - DNA, 13 bp, C. elegans
aatttcagtggtt

SEQ ID NO: 696575 - DNA, 13 bp, C. elegans
aatttcagttgaa

SEQ ID NO: 696576 - DNA, 13 bp, C. elegans
aatttcagtttaa

SEQ ID NO: 696577 - DNA, 13 bp, C. elegans
aatttcagtttat

SEQ ID NO: 696578 - DNA, 13 bp, C. elegans
aatttcagtttta

SEQ ID NO: 696579 - DNA, 13 bp, C. elegans
aatttcataacat

SEQ ID NO: 696580 - DNA, 13 bp, C. elegans
aatttcatactta

SEQ ID NO: 696581 - DNA, 13 bp, C. elegans
aatttcatcaatt

SEQ ID NO: 696582 - DNA, 13 bp, C. elegans
aatttcatcgaaa

SEQ ID NO: 696583 - DNA, 13 bp, C. elegans
aatttcatgaaat

SEQ ID NO: 696584 - DNA, 13 bp, C. elegans
aatttcatgaatt

SEQ ID NO: 696585 - DNA, 13 bp, C. elegans
aatttcatggaaa

SEQ ID NO: 696586 - DNA, 13 bp, C. elegans
aatttcatggaga

SEQ ID NO: 696587 - DNA, 13 bp, C. elegans
aatttcatgttaa

SEQ ID NO: 696588 - DNA, 13 bp, C. elegans
aatttcatgttct

SEQ ID NO: 696589 - DNA, 13 bp, C. elegans
aatttcatgtttt

SEQ ID NO: 696590 - DNA, 13 bp, C. elegans
aatttcattgaaa

SEQ ID NO: 696591 - DNA, 13 bp, C. elegans
aatttcattgatt

SEQ ID NO: 696592 - DNA, 13 bp, C. elegans
aatttcattggaa

SEQ ID NO: 696593 - DNA, 13 bp, C. elegans
aatttcattgtga

SEQ ID NO: 696594 - DNA, 13 bp, C. elegans
aatttcattgtta

SEQ ID NO: 696595 - DNA, 13 bp, C. elegans
aatttcattgttt

SEQ ID NO: 696596 - DNA, 13 bp, C. elegans
aatttcatttaga

SEQ ID NO: 696597 - DNA, 13 bp, C. elegans
aatttcatttcaa

SEQ ID NO: 696598 - DNA, 13 bp, C. elegans
aatttcatttcat

SEQ ID NO: 696599 - DNA, 13 bp, C. elegans
aatttcattttag

SEQ ID NO: 696600 - DNA, 13 bp, C. elegans
aatttcattttgt

SEQ ID NO: 696601 - DNA, 13 bp, C. elegans
aatttccaaaacc

SEQ ID NO: 696602 - DNA, 13 bp, C. elegans
aatttccaaaatt

SEQ ID NO: 696603 - DNA, 13 bp, C. elegans
aatttccaaacaa

SEQ ID NO: 696604 - DNA, 13 bp, C. elegans
aatttccaaactg

SEQ ID NO: 696605 - DNA, 13 bp, C. elegans
aatttccaaagaa

SEQ ID NO: 696606 - DNA, 13 bp, C. elegans
aatttccaaagtt

SEQ ID NO: 696607 - DNA, 13 bp, C. elegans
aatttccaaattc

SEQ ID NO: 696608 - DNA, 13 bp, C. elegans
aatttccaaattg

SEQ ID NO: 696609 - DNA, 13 bp, C. elegans
aatttccaaattt

SEQ ID NO: 696610 - DNA, 13 bp, C. elegans
aatttccaacaaa

SEQ ID NO: 696611 - DNA, 13 bp, C. elegans
aatttccaagtga

SEQ ID NO: 696612 - DNA, 13 bp, C. elegans
aatttccaagttt

SEQ ID NO: 696613 - DNA, 15 bp, C. elegans
aatttccaataaaaa

SEQ ID NO: 696614 - DNA, 13 bp, C. elegans
aatttccaatcaa

SEQ ID NO: 696615 - DNA, 13 bp, C. elegans
aatttccaatgat

SEQ ID NO: 696616 - DNA, 13 bp, C. elegans
aatttccaatgtt

SEQ ID NO: 696617 - DNA, 13 bp, C. elegans
aatttccaattcc

SEQ ID NO: 696618 - DNA, 13 bp, C. elegans
aatttccaattgt

SEQ ID NO: 696619 - DNA, 13 bp, C. elegans
aatttccaatttt

SEQ ID NO: 696620 - DNA, 13 bp, C. elegans
aatttccacaaca

SEQ ID NO: 696621 - DNA, 13 bp, C. elegans
aatttccacattt

SEQ ID NO: 696622 - DNA, 13 bp, C. elegans
aatttccaccaaa

SEQ ID NO: 696623 - DNA, 13 bp, C. elegans
aatttccaccttt

SEQ ID NO: 696624 - DNA, 13 bp, C. elegans
aatttccactatt

SEQ ID NO: 696625 - DNA, 13 bp, C. elegans
aatttccactcaa

SEQ ID NO: 696626 - DNA, 13 bp, C. elegans
aatttccagaaaa

SEQ ID NO: 696627 - DNA, 13 bp, C. elegans
aatttccagaaac

SEQ ID NO: 696628 - DNA, 13 bp, C. elegans
aatttccagccaa

SEQ ID NO: 696629 - DNA, 13 bp, C. elegans
aatttccagcttt

SEQ ID NO: 696630 - DNA, 13 bp, C. elegans
aatttccagttgt

SEQ ID NO: 696631 - DNA, 13 bp, C. elegans
aatttccagtttt

SEQ ID NO: 696632 - DNA, 13 bp, C. elegans
aatttccatagaa

SEQ ID NO: 696633 - DNA, 13 bp, C. elegans
aatttccatattc

SEQ ID NO: 696634 - DNA, 13 bp, C. elegans
aatttccattaaa

SEQ ID NO: 696635 - DNA, 13 bp, C. elegans
aatttccattctt

SEQ ID NO: 696636 - DNA, 13 bp, C. elegans
aatttccatttaa

SEQ ID NO: 696637 - DNA, 13 bp, C. elegans
aatttccatttta

SEQ ID NO: 696638 - DNA, 13 bp, C. elegans
aatttccattttc

SEQ ID NO: 696639 - DNA, 13 bp, C. elegans
aatttcccaaaaa

SEQ ID NO: 696640 - DNA, 13 bp, C. elegans
aatttcccaaaat

SEQ ID NO: 696641 - DNA, 13 bp, C. elegans
aatttcccaaagt

SEQ ID NO: 696642 - DNA, 13 bp, C. elegans
aatttcccaagtt

SEQ ID NO: 696643 - DNA, 13 bp, C. elegans
aatttcccaccaa

SEQ ID NO: 696644 - DNA, 13 bp, C. elegans
aatttcccatttt

SEQ ID NO: 696645 - DNA, 13 bp, C. elegans
aatttccccaaaa

SEQ ID NO: 696646 - DNA, 13 bp, C. elegans
aatttccccattt

SEQ ID NO: 696647 - DNA, 13 bp, C. elegans
aatttcccccaaa

SEQ ID NO: 696648 - DNA, 13 bp, C. elegans
aatttcccctttt

SEQ ID NO: 696649 - DNA, 13 bp, C. elegans
aatttcccgcaaa

SEQ ID NO: 696650 - DNA, 13 bp, C. elegans
aatttcccgccaa

SEQ ID NO: 696651 - DNA, 13 bp, C. elegans
aatttcccgctaa

SEQ ID NO: 696652 - DNA, 13 bp, C. elegans
aatttcccgtaaa

SEQ ID NO: 696653 - DNA, 13 bp, C. elegans
aatttccctcatt

SEQ ID NO: 696654 - DNA, 13 bp, C. elegans
aatttcccttcaa

SEQ ID NO: 696655 - DNA, 13 bp, C. elegans
aatttccgaaaat

SEQ ID NO: 696656 - DNA, 13 bp, C. elegans
aatttccgaaatt

SEQ ID NO: 696657 - DNA, 13 bp, C. elegans
aatttccgaattt

SEQ ID NO: 696658 - DNA, 13 bp, C. elegans
aatttccgacaaa

SEQ ID NO: 696659 - DNA, 13 bp, C. elegans
aatttccgagttt

SEQ ID NO: 696660 - DNA, 13 bp, C. elegans
aatttccgatcaa

SEQ ID NO: 696661 - DNA, 13 bp, C. elegans
aatttccgcaatt

SEQ ID NO: 696662 - DNA, 13 bp, C. elegans
aatttccgcattt

SEQ ID NO: 696663 - DNA, 13 bp, C. elegans
aatttccgctttt

SEQ ID NO: 696664 - DNA, 13 bp, C. elegans
aatttccggcaaa

SEQ ID NO: 696665 - DNA, 13 bp, C. elegans
aatttccggtcaa

SEQ ID NO: 696666 - DNA, 13 bp, C. elegans
aatttccggtgaa

SEQ ID NO: 696667 - DNA, 13 bp, C. elegans
aatttccggtttt

SEQ ID NO: 696668 - DNA, 13 bp, C. elegans
aatttccgtcaat

SEQ ID NO: 696669 - DNA, 13 bp, C. elegans
aatttccgttttc

SEQ ID NO: 696670 - DNA, 13 bp, C. elegans
aatttcctaatta

SEQ ID NO: 696671 - DNA, 13 bp, C. elegans
aatttcctcatct

SEQ ID NO: 696672 - DNA, 13 bp, C. elegans
aatttcctcgaaa

SEQ ID NO: 696673 - DNA, 13 bp, C. elegans
aatttcctgaaaa

SEQ ID NO: 696674 - DNA, 13 bp, C. elegans
aatttcctgaaac

SEQ ID NO: 696675 - DNA, 13 bp, C. elegans
aatttcctgattt

SEQ ID NO: 696676 - DNA, 13 bp, C. elegans
aatttcctgcaaa

SEQ ID NO: 696677 - DNA, 13 bp, C. elegans
aatttcctgtaaa

SEQ ID NO: 696678 - DNA, 13 bp, C. elegans
aatttccttaaaa

SEQ ID NO: 696679 - DNA, 13 bp, C. elegans
aatttccttataa

SEQ ID NO: 696680 - DNA, 13 bp, C. elegans
aatttccttgaat

SEQ ID NO: 696681 - DNA, 13 bp, C. elegans
aatttccttgatt

SEQ ID NO: 696682 - DNA, 13 bp, C. elegans
aatttccttttca

SEQ ID NO: 696683 - DNA, 13 bp, C. elegans
aatttcgaaaaaa

SEQ ID NO: 696684 - DNA, 13 bp, C. elegans
aatttcgaaaaac

SEQ ID NO: 696685 - DNA, 13 bp, C. elegans
aatttcgaaaaat

SEQ ID NO: 696686 - DNA, 13 bp, C. elegans
aatttcgaaaacc

SEQ ID NO: 696687 - DNA, 13 bp, C. elegans
aatttcgaaaact

SEQ ID NO: 696688 - DNA, 13 bp, C. elegans
aatttcgaaaatc

SEQ ID NO: 696689 - DNA, 13 bp, C. elegans
aatttcgaaaatt

SEQ ID NO: 696690 - DNA, 13 bp, C. elegans
aatttcgaaagaa

SEQ ID NO: 696691 - DNA, 13 bp, C. elegans
aatttcgaaatgt

SEQ ID NO: 696692 - DNA, 13 bp, C. elegans
aatttcgaacaaa

SEQ ID NO: 696693 - DNA, 13 bp, C. elegans
aatttcgaagaat

SEQ ID NO: 696694 - DNA, 13 bp, C. elegans
aatttcgaagatt

SEQ ID NO: 696695 - DNA, 13 bp, C. elegans
aatttcgaattga

SEQ ID NO: 696696 - DNA, 14 bp, C. elegans
aatttcgaatttcc

SEQ ID NO: 696697 - DNA, 13 bp, C. elegans
aatttcgaatttt

SEQ ID NO: 696698 - DNA, 13 bp, C. elegans
aatttcgacaaaa

SEQ ID NO: 696699 - DNA, 13 bp, C. elegans
aatttcgacaaat

SEQ ID NO: 696700 - DNA, 13 bp, C. elegans
aatttcgacaact

SEQ ID NO: 696701 - DNA, 13 bp, C. elegans
aatttcgacaatt

SEQ ID NO: 696702 - DNA, 13 bp, C. elegans
aatttcgacgaaa

SEQ ID NO: 696703 - DNA, 13 bp, C. elegans
aatttcgagaatt

SEQ ID NO: 696704 - DNA, 13 bp, C. elegans
aatttcgagattt

SEQ ID NO: 696705 - DNA, 13 bp, C. elegans
aatttcgagcatt

SEQ ID NO: 696706 - DNA, 13 bp, C. elegans
aatttcgagtaaa

SEQ ID NO: 696707 - DNA, 13 bp, C. elegans
aatttcgagtcaa

SEQ ID NO: 696708 - DNA, 13 bp, C. elegans
aatttcgagtgaa

SEQ ID NO: 696709 - DNA, 13 bp, C. elegans
aatttcgatactt

SEQ ID NO: 696710 - DNA, 13 bp, C. elegans
aatttcgatattt

SEQ ID NO: 696711 - DNA, 13 bp, C. elegans
aatttcgatgatt

SEQ ID NO: 696712 - DNA, 13 bp, C. elegans
aatttcgatgtga

SEQ ID NO: 696713 - DNA, 13 bp, C. elegans
aatttcgattttc

SEQ ID NO: 696714 - DNA, 13 bp, C. elegans
aatttcgattttt

SEQ ID NO: 696715 - DNA, 13 bp, C. elegans
aatttcgcaacaa

SEQ ID NO: 696716 - DNA, 13 bp, C. elegans
aatttcgcacatt

SEQ ID NO: 696717 - DNA, 13 bp, C. elegans
aatttcgcatttt

SEQ ID NO: 696718 - DNA, 13 bp, C. elegans
aatttcgccaaaa

SEQ ID NO: 696719 - DNA, 13 bp, C. elegans
aatttcgccaact

SEQ ID NO: 696720 - DNA, 13 bp, C. elegans
aatttcgcgaaaa

SEQ ID NO: 696721 - DNA, 13 bp, C. elegans
aatttcgcgccaa

SEQ ID NO: 696722 - DNA, 13 bp, C. elegans
aatttcgcgtctg

SEQ ID NO: 696723 - DNA, 13 bp, C. elegans
aatttcgctaaaa

SEQ ID NO: 696724 - DNA, 13 bp, C. elegans
aatttcgctcaaa

SEQ ID NO: 696725 - DNA, 13 bp, C. elegans
aatttcggaaaaa

SEQ ID NO: 696726 - DNA, 13 bp, C. elegans
aatttcggaaaat

SEQ ID NO: 696727 - DNA, 13 bp, C. elegans
aatttcggaataa

SEQ ID NO: 696728 - DNA, 13 bp, C. elegans
aatttcggaattt

SEQ ID NO: 696729 - DNA, 13 bp, C. elegans
aatttcggagcat

SEQ ID NO: 696730 - DNA, 13 bp, C. elegans
aatttcggatttt

SEQ ID NO: 696731 - DNA, 13 bp, C. elegans
aatttcggcactt

SEQ ID NO: 696732 - DNA, 13 bp, C. elegans
aatttcggcagtt

SEQ ID NO: 696733 - DNA, 13 bp, C. elegans
aatttcggcgaaa

SEQ ID NO: 696734 - DNA, 13 bp, C. elegans
aatttcggctatt

SEQ ID NO: 696735 - DNA, 13 bp, C. elegans
aatttcgggaaaa

SEQ ID NO: 696736 - DNA, 13 bp, C. elegans
aatttcgggtttt

SEQ ID NO: 696737 - DNA, 13 bp, C. elegans
aatttcgtaaaaa

SEQ ID NO: 696738 - DNA, 13 bp, C. elegans
aatttcgtaatga

SEQ ID NO: 696739 - DNA, 13 bp, C. elegans
aatttcgtaattt

SEQ ID NO: 696740 - DNA, 13 bp, C. elegans
aatttcgtagttt

SEQ ID NO: 696741 - DNA, 13 bp, C. elegans
aatttcgtatttt

SEQ ID NO: 696742 - DNA, 13 bp, C. elegans
aatttcgtcaaaa

SEQ ID NO: 696743 - DNA, 13 bp, C. elegans
aatttcgtctgaa

SEQ ID NO: 696744 - DNA, 13 bp, C. elegans
aatttcgtgcaaa

SEQ ID NO: 696745 - DNA, 13 bp, C. elegans
aatttcgtggttt

SEQ ID NO: 696746 - DNA, 13 bp, C. elegans
aatttcgtttatt

SEQ ID NO: 696747 - DNA, 13 bp, C. elegans
aatttcgtttgtt

SEQ ID NO: 696748 - DNA, 13 bp, C. elegans
aatttcgttttaa

SEQ ID NO: 696749 - DNA, 13 bp, C. elegans
aatttcgtttttc

SEQ ID NO: 696750 - DNA, 13 bp, C. elegans
aatttctaaaaac

SEQ ID NO: 696751 - DNA, 13 bp, C. elegans
aatttctaaactt

SEQ ID NO: 696752 - DNA, 13 bp, C. elegans
aatttctaaagtt

SEQ ID NO: 696753 - DNA, 13 bp, C. elegans
aatttctaaattg

SEQ ID NO: 696754 - DNA, 13 bp, C. elegans
aatttctaaccaa

SEQ ID NO: 696755 - DNA, 13 bp, C. elegans
aatttctaagttt

SEQ ID NO: 696756 - DNA, 13 bp, C. elegans
aatttctaatttc

SEQ ID NO: 696757 - DNA, 13 bp, C. elegans
aatttctacaaaa

SEQ ID NO: 696758 - DNA, 13 bp, C. elegans
aatttctacagaa

SEQ ID NO: 696759 - DNA, 13 bp, C. elegans
aatttctacgttt

SEQ ID NO: 696760 - DNA, 13 bp, C. elegans
aatttctactgtt

SEQ ID NO: 696761 - DNA, 13 bp, C. elegans
aatttctagaaat

SEQ ID NO: 696762 - DNA, 13 bp, C. elegans
aatttctagaatt

SEQ ID NO: 696763 - DNA, 13 bp, C. elegans
aatttctagagaa

SEQ ID NO: 696764 - DNA, 13 bp, C. elegans
aatttctagcttt

SEQ ID NO: 696765 - DNA, 13 bp, C. elegans
aatttctatcatt

SEQ ID NO: 696766 - DNA, 13 bp, C. elegans
aatttctatttca

SEQ ID NO: 696767 - DNA, 13 bp, C. elegans
aatttctcaaaaa

SEQ ID NO: 696768 - DNA, 13 bp, C. elegans
aatttctcaaaac

SEQ ID NO: 696769 - DNA, 13 bp, C. elegans
aatttctcaaaat

SEQ ID NO: 696770 - DNA, 13 bp, C. elegans
aatttctcaaatt

SEQ ID NO: 696771 - DNA, 13 bp, C. elegans
aatttctcaatat

SEQ ID NO: 696772 - DNA, 13 bp, C. elegans
aatttctcaattc

SEQ ID NO: 696773 - DNA, 13 bp, C. elegans
aatttctcaattt

SEQ ID NO: 696774 - DNA, 13 bp, C. elegans
aatttctcactat

SEQ ID NO: 696775 - DNA, 13 bp, C. elegans
aatttctcagttt

SEQ ID NO: 696776 - DNA, 13 bp, C. elegans
aatttctcatatt

SEQ ID NO: 696777 - DNA, 13 bp, C. elegans
aatttctcatgtt

SEQ ID NO: 696778 - DNA, 13 bp, C. elegans
aatttctcattat

SEQ ID NO: 696779 - DNA, 13 bp, C. elegans
aatttctccaaaa

SEQ ID NO: 696780 - DNA, 13 bp, C. elegans
aatttctccaact

SEQ ID NO: 696781 - DNA, 13 bp, C. elegans
aatttctccaatt

SEQ ID NO: 696782 - DNA, 13 bp, C. elegans
aatttctccagaa

SEQ ID NO: 696783 - DNA, 13 bp, C. elegans
aatttctccagtt

SEQ ID NO: 696784 - DNA, 13 bp, C. elegans
aatttctccattt

SEQ ID NO: 696785 - DNA, 13 bp, C. elegans
aatttctcgaatt

SEQ ID NO: 696786 - DNA, 13 bp, C. elegans
aatttctcgagtt

SEQ ID NO: 696787 - DNA, 13 bp, C. elegans
aatttctcgataa

SEQ ID NO: 696788 - DNA, 13 bp, C. elegans
aatttctcgtcat

SEQ ID NO: 696789 - DNA, 13 bp, C. elegans
aatttctctaaaa

SEQ ID NO: 696790 - DNA, 13 bp, C. elegans
aatttctctaaat

SEQ ID NO: 696791 - DNA, 13 bp, C. elegans
aatttctctagaa

SEQ ID NO: 696792 - DNA, 13 bp, C. elegans
aatttctctccaa

SEQ ID NO: 696793 - DNA, 13 bp, C. elegans
aatttctctggaa

SEQ ID NO: 696794 - DNA, 13 bp, C. elegans
aatttctcttcaa

SEQ ID NO: 696795 - DNA, 13 bp, C. elegans
aatttctcttcca

SEQ ID NO: 696796 - DNA, 13 bp, C. elegans
aatttctctttaa

SEQ ID NO: 696797 - DNA, 13 bp, C. elegans
aatttctgaaagt

SEQ ID NO: 696798 - DNA, 13 bp, C. elegans
aatttctgaaatc

SEQ ID NO: 696799 - DNA, 13 bp, C. elegans
aatttctgaaatt

SEQ ID NO: 696800 - DNA, 13 bp, C. elegans
aatttctgaacaa

SEQ ID NO: 696801 - DNA, 13 bp, C. elegans
aatttctgaatat

SEQ ID NO: 696802 - DNA, 13 bp, C. elegans
aatttctgaattt

SEQ ID NO: 696803 - DNA, 13 bp, C. elegans
aatttctgagaaa

SEQ ID NO: 696804 - DNA, 13 bp, C. elegans
aatttctgataaa

SEQ ID NO: 696805 - DNA, 13 bp, C. elegans
aatttctgatgaa

SEQ ID NO: 696806 - DNA, 13 bp, C. elegans
aatttctgattat

SEQ ID NO: 696807 - DNA, 13 bp, C. elegans
aatttctgatttt

SEQ ID NO: 696808 - DNA, 13 bp, C. elegans
aatttctgcaaat

SEQ ID NO: 696809 - DNA, 13 bp, C. elegans
aatttctgcaact

SEQ ID NO: 696810 - DNA, 13 bp, C. elegans
aatttctgcaatt

SEQ ID NO: 696811 - DNA, 13 bp, C. elegans
aatttctgccaaa

SEQ ID NO: 696812 - DNA, 13 bp, C. elegans
aatttctggaaaa

SEQ ID NO: 696813 - DNA, 13 bp, C. elegans
aatttctggcttg

SEQ ID NO: 696814 - DNA, 13 bp, C. elegans
aatttctgggcat

SEQ ID NO: 696815 - DNA, 13 bp, C. elegans
aatttctggtttt

SEQ ID NO: 696816 - DNA, 13 bp, C. elegans
aatttctgtaaac

SEQ ID NO: 696817 - DNA, 13 bp, C. elegans
aatttctgtatat

SEQ ID NO: 696818 - DNA, 13 bp, C. elegans
aatttctgtcaaa

SEQ ID NO: 696819 - DNA, 13 bp, C. elegans
aatttctgttcaa

SEQ ID NO: 696820 - DNA, 13 bp, C. elegans
aatttctgttgtt

SEQ ID NO: 696821 - DNA, 13 bp, C. elegans
aatttcttaaaca

SEQ ID NO: 696822 - DNA, 13 bp, C. elegans
aatttcttaatga

SEQ ID NO: 696823 - DNA, 13 bp, C. elegans
aatttcttcaaaa

SEQ ID NO: 696824 - DNA, 13 bp, C. elegans
aatttcttcaagt

SEQ ID NO: 696825 - DNA, 13 bp, C. elegans
aatttcttcaatt

SEQ ID NO: 696826 - DNA, 13 bp, C. elegans
aatttcttcactt

SEQ ID NO: 696827 - DNA, 13 bp, C. elegans
aatttcttcagtt

SEQ ID NO: 696828 - DNA, 13 bp, C. elegans
aatttcttccgaa

SEQ ID NO: 696829 - DNA, 13 bp, C. elegans
aatttcttgaaaa

SEQ ID NO: 696830 - DNA, 13 bp, C. elegans
aatttcttgaatt

SEQ ID NO: 696831 - DNA, 13 bp, C. elegans
aatttcttgcaaa

SEQ ID NO: 696832 - DNA, 13 bp, C. elegans
aatttcttggaat

SEQ ID NO: 696833 - DNA, 13 bp, C. elegans
aatttcttgtcaa

SEQ ID NO: 696834 - DNA, 13 bp, C. elegans
aatttcttgtgaa

SEQ ID NO: 696835 - DNA, 13 bp, C. elegans
aatttcttgttct

SEQ ID NO: 696836 - DNA, 13 bp, C. elegans
aatttctttccaa

SEQ ID NO: 696837 - DNA, 13 bp, C. elegans
aatttctttgaaa

SEQ ID NO: 696838 - DNA, 13 bp, C. elegans
aatttctttgaat

SEQ ID NO: 696839 - DNA, 13 bp, C. elegans
aatttctttgcaa

SEQ ID NO: 696840 - DNA, 13 bp, C. elegans
aatttctttgtca

SEQ ID NO: 696841 - DNA, 13 bp, C. elegans
aatttcttttgaa

SEQ ID NO: 696842 - DNA, 13 bp, C. elegans
aatttgaaaaaac

SEQ ID NO: 696843 - DNA, 13 bp, C. elegans
aatttgaaaaaca

SEQ ID NO: 696844 - DNA, 13 bp, C. elegans
aatttgaaaaact

SEQ ID NO: 696845 - DNA, 13 bp, C. elegans
aatttgaaaaagt

SEQ ID NO: 696846 - DNA, 13 bp, C. elegans
aatttgaaaacag

SEQ ID NO: 696847 - DNA, 13 bp, C. elegans
aatttgaaaagtt

SEQ ID NO: 696848 - DNA, 13 bp, C. elegans
aatttgaaaatct

SEQ ID NO: 696849 - DNA, 13 bp, C. elegans
aatttgaaaatga

SEQ ID NO: 696850 - DNA, 13 bp, C. elegans
aatttgaaacata

SEQ ID NO: 696851 - DNA, 13 bp, C. elegans
aatttgaaacttt

SEQ ID NO: 696852 - DNA, 13 bp, C. elegans
aatttgaaagtta

SEQ ID NO: 696853 - DNA, 13 bp, C. elegans
aatttgaaatcaa

SEQ ID NO: 696854 - DNA, 13 bp, C. elegans
aatttgaaatcag

SEQ ID NO: 696855 - DNA, 13 bp, C. elegans
aatttgaaatctt

SEQ ID NO: 696856 - DNA, 13 bp, C. elegans
aatttgaaattac

SEQ ID NO: 696857 - DNA, 13 bp, C. elegans
aatttgaaattca

SEQ ID NO: 696858 - DNA, 13 bp, C. elegans
aatttgaaattcc

SEQ ID NO: 696859 - DNA, 13 bp, C. elegans
aatttgaaattct

SEQ ID NO: 696860 - DNA, 13 bp, C. elegans
aatttgaacaaat

SEQ ID NO: 696861 - DNA, 13 bp, C. elegans
aatttgaacattt

SEQ ID NO: 696862 - DNA, 13 bp, C. elegans
aatttgaactaat

SEQ ID NO: 696863 - DNA, 13 bp, C. elegans
aatttgaactatt

SEQ ID NO: 696864 - DNA, 13 bp, C. elegans
aatttgaacttct

SEQ ID NO: 696865 - DNA, 13 bp, C. elegans
aatttgaactttc

SEQ ID NO: 696866 - DNA, 13 bp, C. elegans
aatttgaagaaat

SEQ ID NO: 696867 - DNA, 13 bp, C. elegans
aatttgaagagtt

SEQ ID NO: 696868 - DNA, 13 bp, C. elegans
aatttgaagcaaa

SEQ ID NO: 696869 - DNA, 13 bp, C. elegans
aatttgaagcgaa

SEQ ID NO: 696870 - DNA, 13 bp, C. elegans
aatttgaagctat

SEQ ID NO: 696871 - DNA, 13 bp, C. elegans
aatttgaaggatt

SEQ ID NO: 696872 - DNA, 13 bp, C. elegans
aatttgaaggttt

SEQ ID NO: 696873 - DNA, 13 bp, C. elegans
aatttgaagttaa

SEQ ID NO: 696874 - DNA, 13 bp, C. elegans
aatttgaagttac

SEQ ID NO: 696875 - DNA, 13 bp, C. elegans
aatttgaagtttt

SEQ ID NO: 696876 - DNA, 13 bp, C. elegans
aatttgaatatct

SEQ ID NO: 696877 - DNA, 13 bp, C. elegans
aatttgaatcaaa

SEQ ID NO: 696878 - DNA, 13 bp, C. elegans
aatttgaatcaat

SEQ ID NO: 696879 - DNA, 13 bp, C. elegans
aatttgaatgata

SEQ ID NO: 696880 - DNA, 13 bp, C. elegans
aatttgaatgatg

SEQ ID NO: 696881 - DNA, 13 bp, C. elegans
aatttgaatgttc

SEQ ID NO: 696882 - DNA, 13 bp, C. elegans
aatttgaattcat

SEQ ID NO: 696883 - DNA, 13 bp, C. elegans
aatttgaattccg

SEQ ID NO: 696884 - DNA, 13 bp, C. elegans
aatttgaattcta

SEQ ID NO: 696885 - DNA, 13 bp, C. elegans
aatttgaattctc

SEQ ID NO: 696886 - DNA, 13 bp, C. elegans
aatttgaattgaa

SEQ ID NO: 696887 - DNA, 13 bp, C. elegans
aatttgaatttca

SEQ ID NO: 696888 - DNA, 13 bp, C. elegans
aatttgaatttcg

SEQ ID NO: 696889 - DNA, 13 bp, C. elegans
aatttgacaaaaa

SEQ ID NO: 696890 - DNA, 13 bp, C. elegans
aatttgacaaaca

SEQ ID NO: 696891 - DNA, 13 bp, C. elegans
aatttgacaacac

SEQ ID NO: 696892 - DNA, 13 bp, C. elegans
aatttgacaattt

SEQ ID NO: 696893 - DNA, 13 bp, C. elegans
aatttgacaccca

SEQ ID NO: 696894 - DNA, 13 bp, C. elegans
aatttgacagaaa

SEQ ID NO: 696895 - DNA, 13 bp, C. elegans
aatttgacaggaa

SEQ ID NO: 696896 - DNA, 13 bp, C. elegans
aatttgacagtga

SEQ ID NO: 696897 - DNA, 13 bp, C. elegans
aatttgacatcaa

SEQ ID NO: 696898 - DNA, 13 bp, C. elegans
aatttgacatttt

SEQ ID NO: 696899 - DNA, 13 bp, C. elegans
aatttgacgaaaa

SEQ ID NO: 696900 - DNA, 13 bp, C. elegans
aatttgacgaaat

SEQ ID NO: 696901 - DNA, 13 bp, C. elegans
aatttgacgattt

SEQ ID NO: 696902 - DNA, 13 bp, C. elegans
aatttgactattt

SEQ ID NO: 696903 - DNA, 13 bp, C. elegans
aatttgactggaa

SEQ ID NO: 696904 - DNA, 13 bp, C. elegans
aatttgacttttt

SEQ ID NO: 696905 - DNA, 13 bp, C. elegans
aatttgagaaaca

SEQ ID NO: 696906 - DNA, 13 bp, C. elegans
aatttgagaaata

SEQ ID NO: 696907 - DNA, 13 bp, C. elegans
aatttgagaaatt

SEQ ID NO: 696908 - DNA, 13 bp, C. elegans
aatttgagaataa

SEQ ID NO: 696909 - DNA, 13 bp, C. elegans
aatttgagacttt

SEQ ID NO: 696910 - DNA, 13 bp, C. elegans
aatttgagattat

SEQ ID NO: 696911 - DNA, 13 bp, C. elegans
aatttgagatttt

SEQ ID NO: 696912 - DNA, 13 bp, C. elegans
aatttgagcaatt

SEQ ID NO: 696913 - DNA, 13 bp, C. elegans
aatttgagcacaa

SEQ ID NO: 696914 - DNA, 13 bp, C. elegans
aatttgagcactt

SEQ ID NO: 696915 - DNA, 13 bp, C. elegans
aatttgagcattt

SEQ ID NO: 696916 - DNA, 13 bp, C. elegans
aatttgaggaaaa

SEQ ID NO: 696917 - DNA, 13 bp, C. elegans
aatttgagtagaa

SEQ ID NO: 696918 - DNA, 13 bp, C. elegans
aatttgagtgaaa

SEQ ID NO: 696919 - DNA, 13 bp, C. elegans
aatttgagtgagg

SEQ ID NO: 696920 - DNA, 13 bp, C. elegans
aatttgagttatt

SEQ ID NO: 696921 - DNA, 13 bp, C. elegans
aatttgagtttcc

SEQ ID NO: 696922 - DNA, 13 bp, C. elegans
aatttgagttttc

SEQ ID NO: 696923 - DNA, 13 bp, C. elegans
aatttgataagaa

SEQ ID NO: 696924 - DNA, 13 bp, C. elegans
aatttgataatga

SEQ ID NO: 696925 - DNA, 13 bp, C. elegans
aatttgatacttt

SEQ ID NO: 696926 - DNA, 13 bp, C. elegans
aatttgatagaat

SEQ ID NO: 696927 - DNA, 13 bp, C. elegans
aatttgatatcaa

SEQ ID NO: 696928 - DNA, 13 bp, C. elegans
aatttgatatgaa

SEQ ID NO: 696929 - DNA, 13 bp, C. elegans
aatttgatcaaaa

SEQ ID NO: 696930 - DNA, 13 bp, C. elegans
aatttgatcaaat

SEQ ID NO: 696931 - DNA, 13 bp, C. elegans
aatttgatcaatt

SEQ ID NO: 696932 - DNA, 13 bp, C. elegans
aatttgatcagaa

SEQ ID NO: 696933 - DNA, 13 bp, C. elegans
aatttgatctttt

SEQ ID NO: 696934 - DNA, 13 bp, C. elegans
aatttgatgaaaa

SEQ ID NO: 696935 - DNA, 13 bp, C. elegans
aatttgatgaaat

SEQ ID NO: 696936 - DNA, 13 bp, C. elegans
aatttgatgaatt

SEQ ID NO: 696937 - DNA, 13 bp, C. elegans
aatttgatgattt

SEQ ID NO: 696938 - DNA, 13 bp, C. elegans
aatttgatgcaat

SEQ ID NO: 696939 - DNA, 13 bp, C. elegans
aatttgattcaat

SEQ ID NO: 696940 - DNA, 13 bp, C. elegans
aatttgattgata

SEQ ID NO: 696941 - DNA, 13 bp, C. elegans
aatttgattggaa

SEQ ID NO: 696942 - DNA, 13 bp, C. elegans
aatttgatttgat

SEQ ID NO: 696943 - DNA, 13 bp, C. elegans
aatttgatttgca

SEQ ID NO: 696944 - DNA, 13 bp, C. elegans
aatttgatttgga

SEQ ID NO: 696945 - DNA, 13 bp, C. elegans
aatttgattttct

SEQ ID NO: 696946 - DNA, 13 bp, C. elegans
aatttgcaaaaaa

SEQ ID NO: 696947 - DNA, 13 bp, C. elegans
aatttgcaaacta

SEQ ID NO: 696948 - DNA, 13 bp, C. elegans
aatttgcaaactt

SEQ ID NO: 696949 - DNA, 13 bp, C. elegans
aatttgcaacaaa

SEQ ID NO: 696950 - DNA, 13 bp, C. elegans
aatttgcaacttc

SEQ ID NO: 696951 - DNA, 13 bp, C. elegans
aatttgcaagaat

SEQ ID NO: 696952 - DNA, 13 bp, C. elegans
aatttgcaagatt

SEQ ID NO: 696953 - DNA, 13 bp, C. elegans
aatttgcaatgtt

SEQ ID NO: 696954 - DNA, 13 bp, C. elegans
aatttgcaattaa

SEQ ID NO: 696955 - DNA, 13 bp, C. elegans
aatttgcaattca

SEQ ID NO: 696956 - DNA, 13 bp, C. elegans
aatttgcaattcc

SEQ ID NO: 696957 - DNA, 13 bp, C. elegans
aatttgcaattga

SEQ ID NO: 696958 - DNA, 13 bp, C. elegans
aatttgcaatttt

SEQ ID NO: 696959 - DNA, 13 bp, C. elegans
aatttgcacaaaa

SEQ ID NO: 696960 - DNA, 13 bp, C. elegans
aatttgcacaatt

SEQ ID NO: 696961 - DNA, 13 bp, C. elegans
aatttgcagagct

SEQ ID NO: 696962 - DNA, 13 bp, C. elegans
aatttgcagattt

SEQ ID NO: 696963 - DNA, 13 bp, C. elegans
aatttgcagttat

SEQ ID NO: 696964 - DNA, 13 bp, C. elegans
aatttgcataatt

SEQ ID NO: 696965 - DNA, 13 bp, C. elegans
aatttgcatagtt

SEQ ID NO: 696966 - DNA, 13 bp, C. elegans
aatttgcatattt

SEQ ID NO: 696967 - DNA, 13 bp, C. elegans
aatttgcattata

SEQ ID NO: 696968 - DNA, 13 bp, C. elegans
aatttgcatttca

SEQ ID NO: 696969 - DNA, 13 bp, C. elegans
aatttgcattttt

SEQ ID NO: 696970 - DNA, 14 bp, C. elegans
aatttgcattttta

SEQ ID NO: 696971 - DNA, 13 bp, C. elegans
aatttgccaaaaa

SEQ ID NO: 696972 - DNA, 13 bp, C. elegans
aatttgccaaaac

SEQ ID NO: 696973 - DNA, 13 bp, C. elegans
aatttgccaaaag

SEQ ID NO: 696974 - DNA, 13 bp, C. elegans
aatttgccaaaat

SEQ ID NO: 696975 - DNA, 13 bp, C. elegans
aatttgccaaatt

SEQ ID NO: 696976 - DNA, 13 bp, C. elegans
aatttgccaattt

SEQ ID NO: 696977 - DNA, 13 bp, C. elegans
aatttgccacaaa

SEQ ID NO: 696978 - DNA, 13 bp, C. elegans
aatttgccagttt

SEQ ID NO: 696979 - DNA, 13 bp, C. elegans
aatttgcccaaaa

SEQ ID NO: 696980 - DNA, 13 bp, C. elegans
aatttgcccgaaa

SEQ ID NO: 696981 - DNA, 13 bp, C. elegans
aatttgccgaaaa

SEQ ID NO: 696982 - DNA, 13 bp, C. elegans
aatttgccgaact

SEQ ID NO: 696983 - DNA, 13 bp, C. elegans
aatttgccgagcg

SEQ ID NO: 696984 - DNA, 13 bp, C. elegans
aatttgccgattt

SEQ ID NO: 696985 - DNA, 13 bp, C. elegans
aatttgccgccaa

SEQ ID NO: 696986 - DNA, 13 bp, C. elegans
aatttgccggtaa

SEQ ID NO: 696987 - DNA, 13 bp, C. elegans
aatttgccgtgct

SEQ ID NO: 696988 - DNA, 13 bp, C. elegans
aatttgcctattt

SEQ ID NO: 696989 - DNA, 13 bp, C. elegans
aatttgcggaaaa

SEQ ID NO: 696990 - DNA, 13 bp, C. elegans
aatttgcgtttta

SEQ ID NO: 696991 - DNA, 13 bp, C. elegans
aatttgctaaaaa

SEQ ID NO: 696992 - DNA, 13 bp, C. elegans
aatttgctaagaa

SEQ ID NO: 696993 - DNA, 13 bp, C. elegans
aatttgctaattt

SEQ ID NO: 696994 - DNA, 13 bp, C. elegans
aatttgctagaaa

SEQ ID NO: 696995 - DNA, 13 bp, C. elegans
aatttgctatttt

SEQ ID NO: 696996 - DNA, 13 bp, C. elegans
aatttgctcaaat

SEQ ID NO: 696997 - DNA, 13 bp, C. elegans
aatttgctcaatt

SEQ ID NO: 696998 - DNA, 13 bp, C. elegans
aatttgctcgaaa

SEQ ID NO: 696999 - DNA, 13 bp, C. elegans
aatttgctctaaa

SEQ ID NO: 697000 - DNA, 13 bp, C. elegans
aatttgctctgat

SEQ ID NO: 697001 - DNA, 13 bp, C. elegans
aatttgctctttt

SEQ ID NO: 697002 - DNA, 13 bp, C. elegans
aatttgctgaatt

SEQ ID NO: 697003 - DNA, 13 bp, C. elegans
aatttgctgagaa

SEQ ID NO: 697004 - DNA, 13 bp, C. elegans
aatttgctggaaa

SEQ ID NO: 697005 - DNA, 13 bp, C. elegans
aatttgctgtttc

SEQ ID NO: 697006 - DNA, 13 bp, C. elegans
aatttgctgtttt

SEQ ID NO: 697007 - DNA, 13 bp, C. elegans
aatttgcttattt

SEQ ID NO: 697008 - DNA, 13 bp, C. elegans
aatttgcttcaaa

SEQ ID NO: 697009 - DNA, 13 bp, C. elegans
aatttgcttcaat

SEQ ID NO: 697010 - DNA, 13 bp, C. elegans
aatttgcttgttt

SEQ ID NO: 697011 - DNA, 13 bp, C. elegans
aatttgctttaaa

SEQ ID NO: 697012 - DNA, 13 bp, C. elegans
aatttgctttttc

SEQ ID NO: 697013 - DNA, 13 bp, C. elegans
aatttggaaaaat

SEQ ID NO: 697014 - DNA, 13 bp, C. elegans
aatttggaaaagt

SEQ ID NO: 697015 - DNA, 13 bp, C. elegans
aatttggaaaatc

SEQ ID NO: 697016 - DNA, 13 bp, C. elegans
aatttggaaactt

SEQ ID NO: 697017 - DNA, 13 bp, C. elegans
aatttggaaatat

SEQ ID NO: 697018 - DNA, 13 bp, C. elegans
aatttggaaatta

SEQ ID NO: 697019 - DNA, 13 bp, C. elegans
aatttggaaattc

SEQ ID NO: 697020 - DNA, 13 bp, C. elegans
aatttggaacaat

SEQ ID NO: 697021 - DNA, 13 bp, C. elegans
aatttggaagaaa

SEQ ID NO: 697022 - DNA, 13 bp, C. elegans
aatttggaagaat

SEQ ID NO: 697023 - DNA, 13 bp, C. elegans
aatttggaagtcg

SEQ ID NO: 697024 - DNA, 13 bp, C. elegans
aatttggaatata

SEQ ID NO: 697025 - DNA, 13 bp, C. elegans
aatttggaatctt

SEQ ID NO: 697026 - DNA, 13 bp, C. elegans
aatttggaattga

SEQ ID NO: 697027 - DNA, 13 bp, C. elegans
aatttggaattgt

SEQ ID NO: 697028 - DNA, 13 bp, C. elegans
aatttggaatttc

SEQ ID NO: 697029 - DNA, 13 bp, C. elegans
aatttggaatttt

SEQ ID NO: 697030 - DNA, 13 bp, C. elegans
aatttggagaaaa

SEQ ID NO: 697031 - DNA, 13 bp, C. elegans
aatttggagaatt

SEQ ID NO: 697032 - DNA, 13 bp, C. elegans
aatttggagcatt

SEQ ID NO: 697033 - DNA, 13 bp, C. elegans
aatttggaggaaa

SEQ ID NO: 697034 - DNA, 13 bp, C. elegans
aatttggataatt

SEQ ID NO: 697035 - DNA, 13 bp, C. elegans
aatttggatattt

SEQ ID NO: 697036 - DNA, 13 bp, C. elegans
aatttggattcag

SEQ ID NO: 697037 - DNA, 13 bp, C. elegans
aatttggatttca

SEQ ID NO: 697038 - DNA, 13 bp, C. elegans
aatttggcaaaac

SEQ ID NO: 697039 - DNA, 13 bp, C. elegans
aatttggcaaaat

SEQ ID NO: 697040 - DNA, 13 bp, C. elegans
aatttggcaaatc

SEQ ID NO: 697041 - DNA, 13 bp, C. elegans
aatttggcaaatt

SEQ ID NO: 697042 - DNA, 13 bp, C. elegans
aatttggcaattt

SEQ ID NO: 697043 - DNA, 13 bp, C. elegans
aatttggcatttt

SEQ ID NO: 697044 - DNA, 13 bp, C. elegans
aatttggcggtaa

SEQ ID NO: 697045 - DNA, 13 bp, C. elegans
aatttggctgaaa

SEQ ID NO: 697046 - DNA, 13 bp, C. elegans
aatttgggaaaaa

SEQ ID NO: 697047 - DNA, 13 bp, C. elegans
aatttgggaaaag

SEQ ID NO: 697048 - DNA, 13 bp, C. elegans
aatttgggaaata

SEQ ID NO: 697049 - DNA, 13 bp, C. elegans
aatttgggaagtt

SEQ ID NO: 697050 - DNA, 13 bp, C. elegans
aatttgggatatt

SEQ ID NO: 697051 - DNA, 13 bp, C. elegans
aatttgggcaaga

SEQ ID NO: 697052 - DNA, 13 bp, C. elegans
aatttgggctttt

SEQ ID NO: 697053 - DNA, 13 bp, C. elegans
aatttgggggttt

SEQ ID NO: 697054 - DNA, 13 bp, C. elegans
aatttgggtaaaa

SEQ ID NO: 697055 - DNA, 13 bp, C. elegans
aatttgggtaatt

SEQ ID NO: 697056 - DNA, 13 bp, C. elegans
aatttggtaaaaa

SEQ ID NO: 697057 - DNA, 13 bp, C. elegans
aatttggtaaact

SEQ ID NO: 697058 - DNA, 13 bp, C. elegans
aatttggtaattg

SEQ ID NO: 697059 - DNA, 13 bp, C. elegans
aatttggtacttt

SEQ ID NO: 697060 - DNA, 13 bp, C. elegans
aatttggtattat

SEQ ID NO: 697061 - DNA, 13 bp, C. elegans
aatttggtattta

SEQ ID NO: 697062 - DNA, 13 bp, C. elegans
aatttggtcaatt

SEQ ID NO: 697063 - DNA, 13 bp, C. elegans
aatttggtttaaa

SEQ ID NO: 697064 - DNA, 13 bp, C. elegans
aatttggttttaa

SEQ ID NO: 697065 - DNA, 13 bp, C. elegans
aatttgtaaaact

SEQ ID NO: 697066 - DNA, 13 bp, C. elegans
aatttgtaaactg

SEQ ID NO: 697067 - DNA, 14 bp, C. elegans
aatttgtaaattca

SEQ ID NO: 697068 - DNA, 13 bp, C. elegans
aatttgtaatgtt

SEQ ID NO: 697069 - DNA, 13 bp, C. elegans
aatttgtaattca

SEQ ID NO: 697070 - DNA, 13 bp, C. elegans
aatttgtaattct

SEQ ID NO: 697071 - DNA, 13 bp, C. elegans
aatttgtactttt

SEQ ID NO: 697072 - DNA, 13 bp, C. elegans
aatttgtagaatt

SEQ ID NO: 697073 - DNA, 13 bp, C. elegans
aatttgtagattt

SEQ ID NO: 697074 - DNA, 13 bp, C. elegans
aatttgtatattc

SEQ ID NO: 697075 - DNA, 13 bp, C. elegans
aatttgtatcatt

SEQ ID NO: 697076 - DNA, 13 bp, C. elegans
aatttgtatgaaa

SEQ ID NO: 697077 - DNA, 13 bp, C. elegans
aatttgtattcaa

SEQ ID NO: 697078 - DNA, 13 bp, C. elegans
aatttgtatttca

SEQ ID NO: 697079 - DNA, 13 bp, C. elegans
aatttgtatttcc

SEQ ID NO: 697080 - DNA, 13 bp, C. elegans
aatttgtcaaaaa

SEQ ID NO: 697081 - DNA, 13 bp, C. elegans
aatttgtcaacaa

SEQ ID NO: 697082 - DNA, 13 bp, C. elegans
aatttgtcaacta

SEQ ID NO: 697083 - DNA, 13 bp, C. elegans
aatttgtcaactg

SEQ ID NO: 697084 - DNA, 13 bp, C. elegans
aatttgtcagttt

SEQ ID NO: 697085 - DNA, 13 bp, C. elegans
aatttgtcataat

SEQ ID NO: 697086 - DNA, 13 bp, C. elegans
aatttgtcatttt

SEQ ID NO: 697087 - DNA, 13 bp, C. elegans
aatttgtccattt

SEQ ID NO: 697088 - DNA, 13 bp, C. elegans
aatttgtcgaaaa

SEQ ID NO: 697089 - DNA, 13 bp, C. elegans
aatttgtcgagtt

SEQ ID NO: 697090 - DNA, 13 bp, C. elegans
aatttgtcgattt

SEQ ID NO: 697091 - DNA, 13 bp, C. elegans
aatttgtcggatg

SEQ ID NO: 697092 - DNA, 13 bp, C. elegans
aatttgtcggttt

SEQ ID NO: 697093 - DNA, 13 bp, C. elegans
aatttgtctgaaa

SEQ ID NO: 697094 - DNA, 13 bp, C. elegans
aatttgtgaaact

SEQ ID NO: 697095 - DNA, 13 bp, C. elegans
aatttgtgaactt

SEQ ID NO: 697096 - DNA, 13 bp, C. elegans
aatttgtgaattt

SEQ ID NO: 697097 - DNA, 13 bp, C. elegans
aatttgtgagaaa

SEQ ID NO: 697098 - DNA, 13 bp, C. elegans
aatttgtgagaat

SEQ ID NO: 697099 - DNA, 13 bp, C. elegans
aatttgtgatgac

SEQ ID NO: 697100 - DNA, 13 bp, C. elegans
aatttgtgattaa

SEQ ID NO: 697101 - DNA, 13 bp, C. elegans
aatttgtgcaaaa

SEQ ID NO: 697102 - DNA, 13 bp, C. elegans
aatttgtgcaata

SEQ ID NO: 697103 - DNA, 13 bp, C. elegans
aatttgtggtaaa

SEQ ID NO: 697104 - DNA, 13 bp, C. elegans
aatttgtgtaaat

SEQ ID NO: 697105 - DNA, 13 bp, C. elegans
aatttgtgtgtgt

SEQ ID NO: 697106 - DNA, 13 bp, C. elegans
aatttgtgttaaa

SEQ ID NO: 697107 - DNA, 13 bp, C. elegans
aatttgtgttctt

SEQ ID NO: 697108 - DNA, 13 bp, C. elegans
aatttgttaacaa

SEQ ID NO: 697109 - DNA, 13 bp, C. elegans
aatttgttaactt

SEQ ID NO: 697110 - DNA, 13 bp, C. elegans
aatttgttacttt

SEQ ID NO: 697111 - DNA, 13 bp, C. elegans
aatttgttcaaaa

SEQ ID NO: 697112 - DNA, 13 bp, C. elegans
aatttgttcaata

SEQ ID NO: 697113 - DNA, 13 bp, C. elegans
aatttgttcattc

SEQ ID NO: 697114 - DNA, 13 bp, C. elegans
aatttgttcattt

SEQ ID NO: 697115 - DNA, 13 bp, C. elegans
aatttgttgaaaa

SEQ ID NO: 697116 - DNA, 13 bp, C. elegans
aatttgttgaaat

SEQ ID NO: 697117 - DNA, 13 bp, C. elegans
aatttgttgaaca

SEQ ID NO: 697118 - DNA, 13 bp, C. elegans
aatttgttgagaa

SEQ ID NO: 697119 - DNA, 13 bp, C. elegans
aatttgttgccaa

SEQ ID NO: 697120 - DNA, 13 bp, C. elegans
aatttgttgttct

SEQ ID NO: 697121 - DNA, 13 bp, C. elegans
aatttgtttcagt

SEQ ID NO: 697122 - DNA, 13 bp, C. elegans
aatttgtttcatt

SEQ ID NO: 697123 - DNA, 13 bp, C. elegans
aatttgtttctat

SEQ ID NO: 697124 - DNA, 13 bp, C. elegans
aatttgttttcaa

SEQ ID NO: 697125 - DNA, 13 bp, C. elegans
aatttgttttgca

SEQ ID NO: 697126 - DNA, 13 bp, C. elegans
aattttaaaatcc

SEQ ID NO: 697127 - DNA, 13 bp, C. elegans
aattttaaagcat

SEQ ID NO: 697128 - DNA, 13 bp, C. elegans
aattttaaagctt

SEQ ID NO: 697129 - DNA, 13 bp, C. elegans
aattttaaaggat

SEQ ID NO: 697130 - DNA, 13 bp, C. elegans
aattttaaatcgt

SEQ ID NO: 697131 - DNA, 13 bp, C. elegans
aattttaaattgg

SEQ ID NO: 697132 - DNA, 13 bp, C. elegans
aattttaacagcg

SEQ ID NO: 697133 - DNA, 13 bp, C. elegans
aattttaacagtt

SEQ ID NO: 697134 - DNA, 13 bp, C. elegans
aattttaacatga

SEQ ID NO: 697135 - DNA, 13 bp, C. elegans
aattttaacctca

SEQ ID NO: 697136 - DNA, 13 bp, C. elegans
aattttaacgaaa

SEQ ID NO: 697137 - DNA, 13 bp, C. elegans
aattttaagcaaa

SEQ ID NO: 697138 - DNA, 13 bp, C. elegans
aattttaagccaa

SEQ ID NO: 697139 - DNA, 13 bp, C. elegans
aattttaagtctt

SEQ ID NO: 697140 - DNA, 13 bp, C. elegans
aattttaattcca

SEQ ID NO: 697141 - DNA, 13 bp, C. elegans
aattttacaacaa

SEQ ID NO: 697142 - DNA, 14 bp, C. elegans
aattttacagaaaa

SEQ ID NO: 697143 - DNA, 13 bp, C. elegans
aattttaccaaaa

SEQ ID NO: 697144 - DNA, 13 bp, C. elegans
aattttacctaaa

SEQ ID NO: 697145 - DNA, 13 bp, C. elegans
aattttacgaata

SEQ ID NO: 697146 - DNA, 13 bp, C. elegans
aattttacgactg

SEQ ID NO: 697147 - DNA, 13 bp, C. elegans
aattttacgattt

SEQ ID NO: 697148 - DNA, 13 bp, C. elegans
aattttacggaat

SEQ ID NO: 697149 - DNA, 13 bp, C. elegans
aattttactgaaa

SEQ ID NO: 697150 - DNA, 13 bp, C. elegans
aattttactgtga

SEQ ID NO: 697151 - DNA, 13 bp, C. elegans
aattttactgttt

SEQ ID NO: 697152 - DNA, 13 bp, C. elegans
aattttagaaaga

SEQ ID NO: 697153 - DNA, 13 bp, C. elegans
aattttagaagaa

SEQ ID NO: 697154 - DNA, 13 bp, C. elegans
aattttagaagtc

SEQ ID NO: 697155 - DNA, 13 bp, C. elegans
aattttagactta

SEQ ID NO: 697156 - DNA, 13 bp, C. elegans
aattttagagaat

SEQ ID NO: 697157 - DNA, 13 bp, C. elegans
aattttagagttt

SEQ ID NO: 697158 - DNA, 13 bp, C. elegans
aattttagatgaa

SEQ ID NO: 697159 - DNA, 13 bp, C. elegans
aattttagcaatt

SEQ ID NO: 697160 - DNA, 13 bp, C. elegans
aattttagctaga

SEQ ID NO: 697161 - DNA, 13 bp, C. elegans
aattttaggaaaa

SEQ ID NO: 697162 - DNA, 13 bp, C. elegans
aattttaggaaca

SEQ ID NO: 697163 - DNA, 13 bp, C. elegans
aattttaggataa

SEQ ID NO: 697164 - DNA, 13 bp, C. elegans
aattttagtcgaa

SEQ ID NO: 697165 - DNA, 13 bp, C. elegans
aattttagtggtt

SEQ ID NO: 697166 - DNA, 13 bp, C. elegans
aattttagtgtct

SEQ ID NO: 697167 - DNA, 13 bp, C. elegans
aattttatcactt

SEQ ID NO: 697168 - DNA, 14 bp, C. elegans
aattttatcgattt

SEQ ID NO: 697169 - DNA, 13 bp, C. elegans
aattttatcgttt

SEQ ID NO: 697170 - DNA, 13 bp, C. elegans
aattttatctcaa

SEQ ID NO: 697171 - DNA, 13 bp, C. elegans
aattttatgaaga

SEQ ID NO: 697172 - DNA, 13 bp, C. elegans
aattttatgactt

SEQ ID NO: 697173 - DNA, 13 bp, C. elegans
aattttatgatct

SEQ ID NO: 697174 - DNA, 13 bp, C. elegans
aattttattcgat

SEQ ID NO: 697175 - DNA, 13 bp, C. elegans
aattttattgcat

SEQ ID NO: 697176 - DNA, 13 bp, C. elegans
aattttattgtac

SEQ ID NO: 697177 - DNA, 13 bp, C. elegans
aattttattgtga

SEQ ID NO: 697178 - DNA, 13 bp, C. elegans
aattttcaaaaac

SEQ ID NO: 697179 - DNA, 13 bp, C. elegans
aattttcaaaagt

SEQ ID NO: 697180 - DNA, 13 bp, C. elegans
aattttcaaaatg

SEQ ID NO: 697181 - DNA, 13 bp, C. elegans
aattttcaaacat

SEQ ID NO: 697182 - DNA, 13 bp, C. elegans
aattttcaaacct

SEQ ID NO: 697183 - DNA, 13 bp, C. elegans
aattttcaaagat

SEQ ID NO: 697184 - DNA, 13 bp, C. elegans
aattttcaaagtt

SEQ ID NO: 697185 - DNA, 13 bp, C. elegans
aattttcaaatcc

SEQ ID NO: 697186 - DNA, 13 bp, C. elegans
aattttcaaatgt

SEQ ID NO: 697187 - DNA, 13 bp, C. elegans
aattttcaacaaa

SEQ ID NO: 697188 - DNA, 13 bp, C. elegans
aattttcaacaat

SEQ ID NO: 697189 - DNA, 13 bp, C. elegans
aattttcaacatt

SEQ ID NO: 697190 - DNA, 13 bp, C. elegans
aattttcaaccca

SEQ ID NO: 697191 - DNA, 13 bp, C. elegans
aattttcaacgta

SEQ ID NO: 697192 - DNA, 13 bp, C. elegans
aattttcaactaa

SEQ ID NO: 697193 - DNA, 13 bp, C. elegans
aattttcaagatt

SEQ ID NO: 697194 - DNA, 13 bp, C. elegans
aattttcaagttt

SEQ ID NO: 697195 - DNA, 13 bp, C. elegans
aattttcaatact

SEQ ID NO: 697196 - DNA, 13 bp, C. elegans
aattttcaatcaa

SEQ ID NO: 697197 - DNA, 13 bp, C. elegans
aattttcaatccc

SEQ ID NO: 697198 - DNA, 13 bp, C. elegans
aattttcaatgaa

SEQ ID NO: 697199 - DNA, 13 bp, C. elegans
aattttcaatgat

SEQ ID NO: 697200 - DNA, 13 bp, C. elegans
aattttcaatgtt

SEQ ID NO: 697201 - DNA, 13 bp, C. elegans
aattttcaattac

SEQ ID NO: 697202 - DNA, 13 bp, C. elegans
aattttcaatttc

SEQ ID NO: 697203 - DNA, 13 bp, C. elegans
aattttcacactt

SEQ ID NO: 697204 - DNA, 13 bp, C. elegans
aattttcaccaaa

SEQ ID NO: 697205 - DNA, 13 bp, C. elegans
aattttcacccaa

SEQ ID NO: 697206 - DNA, 13 bp, C. elegans
aattttcacgatt

SEQ ID NO: 697207 - DNA, 13 bp, C. elegans
aattttcactcaa

SEQ ID NO: 697208 - DNA, 13 bp, C. elegans
aattttcactgaa

SEQ ID NO: 697209 - DNA, 13 bp, C. elegans
aattttcagaaaa

SEQ ID NO: 697210 - DNA, 13 bp, C. elegans
aattttcagaaag

SEQ ID NO: 697211 - DNA, 13 bp, C. elegans
aattttcagagaa

SEQ ID NO: 697212 - DNA, 13 bp, C. elegans
aattttcagagca

SEQ ID NO: 697213 - DNA, 13 bp, C. elegans
aattttcagatta

SEQ ID NO: 697214 - DNA, 13 bp, C. elegans
aattttcagattt

SEQ ID NO: 697215 - DNA, 13 bp, C. elegans
aattttcagcaaa

SEQ ID NO: 697216 - DNA, 13 bp, C. elegans
aattttcagcagc

SEQ ID NO: 697217 - DNA, 13 bp, C. elegans
aattttcagcgat

SEQ ID NO: 697218 - DNA, 13 bp, C. elegans
aattttcagcgtt

SEQ ID NO: 697219 - DNA, 13 bp, C. elegans
aattttcagctaa

SEQ ID NO: 697220 - DNA, 13 bp, C. elegans
aattttcagctga

SEQ ID NO: 697221 - DNA, 13 bp, C. elegans
aattttcagctgt

SEQ ID NO: 697222 - DNA, 13 bp, C. elegans
aattttcaggtaa

SEQ ID NO: 697223 - DNA, 13 bp, C. elegans
aattttcagtaaa

SEQ ID NO: 697224 - DNA, 13 bp, C. elegans
aattttcagtgaa

SEQ ID NO: 697225 - DNA, 13 bp, C. elegans
aattttcagttta

SEQ ID NO: 697226 - DNA, 13 bp, C. elegans
aattttcagtttt

SEQ ID NO: 697227 - DNA, 13 bp, C. elegans
aattttcataact

SEQ ID NO: 697228 - DNA, 13 bp, C. elegans
aattttcatattc

SEQ ID NO: 697229 - DNA, 13 bp, C. elegans
aattttcatcaaa

SEQ ID NO: 697230 - DNA, 13 bp, C. elegans
aattttcatccaa

SEQ ID NO: 697231 - DNA, 13 bp, C. elegans
aattttcatctca

SEQ ID NO: 697232 - DNA, 13 bp, C. elegans
aattttcatctct

SEQ ID NO: 697233 - DNA, 13 bp, C. elegans
aattttcatgaaa

SEQ ID NO: 697234 - DNA, 13 bp, C. elegans
aattttcatgaat

SEQ ID NO: 697235 - DNA, 13 bp, C. elegans
aattttcatgatt

SEQ ID NO: 697236 - DNA, 13 bp, C. elegans
aattttcatgtat

SEQ ID NO: 697237 - DNA, 13 bp, C. elegans
aattttcatgttt

SEQ ID NO: 697238 - DNA, 13 bp, C. elegans
aattttcattcaa

SEQ ID NO: 697239 - DNA, 13 bp, C. elegans
aattttcattcag

SEQ ID NO: 697240 - DNA, 13 bp, C. elegans
aattttcattcga

SEQ ID NO: 697241 - DNA, 13 bp, C. elegans
aattttcattgat

SEQ ID NO: 697242 - DNA, 13 bp, C. elegans
aattttcattgtt

SEQ ID NO: 697243 - DNA, 13 bp, C. elegans
aattttcatttac

SEQ ID NO: 697244 - DNA, 13 bp, C. elegans
aattttcatttca

SEQ ID NO: 697245 - DNA, 13 bp, C. elegans
aattttccaaaat

SEQ ID NO: 697246 - DNA, 13 bp, C. elegans
aattttccaaaga

SEQ ID NO: 697247 - DNA, 13 bp, C. elegans
aattttccaaatt

SEQ ID NO: 697248 - DNA, 13 bp, C. elegans
aattttccaacaa

SEQ ID NO: 697249 - DNA, 13 bp, C. elegans
aattttccaactt

SEQ ID NO: 697250 - DNA, 13 bp, C. elegans
aattttccaagtt

SEQ ID NO: 697251 - DNA, 13 bp, C. elegans
aattttccaatta

SEQ ID NO: 697252 - DNA, 13 bp, C. elegans
aattttccacatt

SEQ ID NO: 697253 - DNA, 13 bp, C. elegans
aattttccagatg

SEQ ID NO: 697254 - DNA, 13 bp, C. elegans
aattttccagatt

SEQ ID NO: 697255 - DNA, 13 bp, C. elegans
aattttccagcaa

SEQ ID NO: 697256 - DNA, 13 bp, C. elegans
aattttccagcta

SEQ ID NO: 697257 - DNA, 13 bp, C. elegans
aattttccataaa

SEQ ID NO: 697258 - DNA, 13 bp, C. elegans
aattttccatgat

SEQ ID NO: 697259 - DNA, 13 bp, C. elegans
aattttccatttc

SEQ ID NO: 697260 - DNA, 13 bp, C. elegans
aattttcccaaat

SEQ ID NO: 697261 - DNA, 13 bp, C. elegans
aattttcccaata

SEQ ID NO: 697262 - DNA, 13 bp, C. elegans
aattttcccactg

SEQ ID NO: 697263 - DNA, 13 bp, C. elegans
aattttcccagaa

SEQ ID NO: 697264 - DNA, 13 bp, C. elegans
aattttcccctga

SEQ ID NO: 697265 - DNA, 13 bp, C. elegans
aattttcccgatt

SEQ ID NO: 697266 - DNA, 13 bp, C. elegans
aattttcccgttt

SEQ ID NO: 697267 - DNA, 13 bp, C. elegans
aattttccgagaa

SEQ ID NO: 697268 - DNA, 13 bp, C. elegans
aattttccgattt

SEQ ID NO: 697269 - DNA, 13 bp, C. elegans
aattttccgccaa

SEQ ID NO: 697270 - DNA, 13 bp, C. elegans
aattttccggttt

SEQ ID NO: 697271 - DNA, 13 bp, C. elegans
aattttcctactt

SEQ ID NO: 697272 - DNA, 13 bp, C. elegans
aattttcctcgtt

SEQ ID NO: 697273 - DNA, 13 bp, C. elegans
aattttcctctga

SEQ ID NO: 697274 - DNA, 13 bp, C. elegans
aattttccttata

SEQ ID NO: 697275 - DNA, 13 bp, C. elegans
aattttcctttca

SEQ ID NO: 697276 - DNA, 13 bp, C. elegans
aattttcgaaaaa

SEQ ID NO: 697277 - DNA, 13 bp, C. elegans
aattttcgaaatt

SEQ ID NO: 697278 - DNA, 13 bp, C. elegans
aattttcgaatct

SEQ ID NO: 697279 - DNA, 13 bp, C. elegans
aattttcgacatt

SEQ ID NO: 697280 - DNA, 13 bp, C. elegans
aattttcgacttt

SEQ ID NO: 697281 - DNA, 13 bp, C. elegans
aattttcgagttt

SEQ ID NO: 697282 - DNA, 13 bp, C. elegans
aattttcgatcaa

SEQ ID NO: 697283 - DNA, 13 bp, C. elegans
aattttcgatcac

SEQ ID NO: 697284 - DNA, 13 bp, C. elegans
aattttcgatcat

SEQ ID NO: 697285 - DNA, 13 bp, C. elegans
aattttcgatgaa

SEQ ID NO: 697286 - DNA, 13 bp, C. elegans
aattttcgatgtt

SEQ ID NO: 697287 - DNA, 13 bp, C. elegans
aattttcgattag

SEQ ID NO: 697288 - DNA, 13 bp, C. elegans
aattttcgattcc

SEQ ID NO: 697289 - DNA, 13 bp, C. elegans
aattttcgatttt

SEQ ID NO: 697290 - DNA, 13 bp, C. elegans
aattttcgcaaaa

SEQ ID NO: 697291 - DNA, 13 bp, C. elegans
aattttcgcattt

SEQ ID NO: 697292 - DNA, 13 bp, C. elegans
aattttcgcctaa

SEQ ID NO: 697293 - DNA, 13 bp, C. elegans
aattttcgctttt

SEQ ID NO: 697294 - DNA, 13 bp, C. elegans
aattttcggaaaa

SEQ ID NO: 697295 - DNA, 13 bp, C. elegans
aattttcggaaat

SEQ ID NO: 697296 - DNA, 13 bp, C. elegans
aattttcggcaga

SEQ ID NO: 697297 - DNA, 13 bp, C. elegans
aattttcggcgaa

SEQ ID NO: 697298 - DNA, 13 bp, C. elegans
aattttcgggatt

SEQ ID NO: 697299 - DNA, 13 bp, C. elegans
aattttcggtcaa

SEQ ID NO: 697300 - DNA, 13 bp, C. elegans
aattttcgtagtt

SEQ ID NO: 697301 - DNA, 13 bp, C. elegans
aattttcgtattt

SEQ ID NO: 697302 - DNA, 13 bp, C. elegans
aattttcgtgtat

SEQ ID NO: 697303 - DNA, 13 bp, C. elegans
aattttcgtgttt

SEQ ID NO: 697304 - DNA, 13 bp, C. elegans
aattttcgttgaa

SEQ ID NO: 697305 - DNA, 13 bp, C. elegans
aattttcgttttc

SEQ ID NO: 697306 - DNA, 13 bp, C. elegans
aattttctacaat

SEQ ID NO: 697307 - DNA, 13 bp, C. elegans
aattttctacata

SEQ ID NO: 697308 - DNA, 13 bp, C. elegans
aattttctacgtt

SEQ ID NO: 697309 - DNA, 13 bp, C. elegans
aattttctagaaa

SEQ ID NO: 697310 - DNA, 13 bp, C. elegans
aattttctagaat

SEQ ID NO: 697311 - DNA, 13 bp, C. elegans
aattttctagctt

SEQ ID NO: 697312 - DNA, 13 bp, C. elegans
aattttctaggaa

SEQ ID NO: 697313 - DNA, 13 bp, C. elegans
aattttctagttt

SEQ ID NO: 697314 - DNA, 13 bp, C. elegans
aattttctatcaa

SEQ ID NO: 697315 - DNA, 13 bp, C. elegans
aattttctatgca

SEQ ID NO: 697316 - DNA, 13 bp, C. elegans
aattttctcaaat

SEQ ID NO: 697317 - DNA, 13 bp, C. elegans
aattttctcataa

SEQ ID NO: 697318 - DNA, 13 bp, C. elegans
aattttctccaat

SEQ ID NO: 697319 - DNA, 13 bp, C. elegans
aattttctcctaa

SEQ ID NO: 697320 - DNA, 13 bp, C. elegans
aattttctcgaat

SEQ ID NO: 697321 - DNA, 13 bp, C. elegans
aattttctctaat

SEQ ID NO: 697322 - DNA, 13 bp, C. elegans
aattttctctcaa

SEQ ID NO: 697323 - DNA, 13 bp, C. elegans
aattttctctgaa

SEQ ID NO: 697324 - DNA, 13 bp, C. elegans
aattttctgaaaa

SEQ ID NO: 697325 - DNA, 13 bp, C. elegans
aattttctgaatt

SEQ ID NO: 697326 - DNA, 13 bp, C. elegans
aattttctgacaa

SEQ ID NO: 697327 - DNA, 13 bp, C. elegans
aattttctgactt

SEQ ID NO: 697328 - DNA, 13 bp, C. elegans
aattttctgagtt

SEQ ID NO: 697329 - DNA, 13 bp, C. elegans
aattttctgattt

SEQ ID NO: 697330 - DNA, 13 bp, C. elegans
aattttctgcatt

SEQ ID NO: 697331 - DNA, 13 bp, C. elegans
aattttctggaaa

SEQ ID NO: 697332 - DNA, 13 bp, C. elegans
aattttctggaat

SEQ ID NO: 697333 - DNA, 13 bp, C. elegans
aattttctggaga

SEQ ID NO: 697334 - DNA, 13 bp, C. elegans
aattttctgtaaa

SEQ ID NO: 697335 - DNA, 15 bp, C. elegans
aattttctgtgaaaa

SEQ ID NO: 697336 - DNA, 13 bp, C. elegans
aattttctgttgt

SEQ ID NO: 697337 - DNA, 13 bp, C. elegans
aattttctgttta

SEQ ID NO: 697338 - DNA, 13 bp, C. elegans
aattttctgtttc

SEQ ID NO: 697339 - DNA, 13 bp, C. elegans
aattttcttagaa

SEQ ID NO: 697340 - DNA, 13 bp, C. elegans
aattttcttcaaa

SEQ ID NO: 697341 - DNA, 13 bp, C. elegans
aattttcttcaac

SEQ ID NO: 697342 - DNA, 13 bp, C. elegans
aattttcttcaga

SEQ ID NO: 697343 - DNA, 13 bp, C. elegans
aattttcttcgaa

SEQ ID NO: 697344 - DNA, 13 bp, C. elegans
aattttcttcgtt

SEQ ID NO: 697345 - DNA, 13 bp, C. elegans
aattttcttgaat

SEQ ID NO: 697346 - DNA, 13 bp, C. elegans
aattttcttgctt

SEQ ID NO: 697347 - DNA, 13 bp, C. elegans
aattttcttgtca

SEQ ID NO: 697348 - DNA, 13 bp, C. elegans
aattttctttcaa

SEQ ID NO: 697349 - DNA, 13 bp, C. elegans
aattttctttgaa

SEQ ID NO: 697350 - DNA, 13 bp, C. elegans
aattttgaaaatc

SEQ ID NO: 697351 - DNA, 13 bp, C. elegans
aattttgaaacaa

SEQ ID NO: 697352 - DNA, 13 bp, C. elegans
aattttgaaacgc

SEQ ID NO: 697353 - DNA, 13 bp, C. elegans
aattttgaaatca

SEQ ID NO: 697354 - DNA, 13 bp, C. elegans
aattttgaacaaa

SEQ ID NO: 697355 - DNA, 13 bp, C. elegans
aattttgaacttt

SEQ ID NO: 697356 - DNA, 13 bp, C. elegans
aattttgaagaac

SEQ ID NO: 697357 - DNA, 13 bp, C. elegans
aattttgaaggga

SEQ ID NO: 697358 - DNA, 13 bp, C. elegans
aattttgaagttg

SEQ ID NO: 697359 - DNA, 13 bp, C. elegans
aattttgaatcaa

SEQ ID NO: 697360 - DNA, 13 bp, C. elegans
aattttgaatggt

SEQ ID NO: 697361 - DNA, 13 bp, C. elegans
aattttgaattac

SEQ ID NO: 697362 - DNA, 13 bp, C. elegans
aattttgaatttc

SEQ ID NO: 697363 - DNA, 13 bp, C. elegans
aattttgaatttg

SEQ ID NO: 697364 - DNA, 13 bp, C. elegans
aattttgacaatt

SEQ ID NO: 697365 - DNA, 13 bp, C. elegans
aattttgacattt

SEQ ID NO: 697366 - DNA, 13 bp, C. elegans
aattttgactaaa

SEQ ID NO: 697367 - DNA, 13 bp, C. elegans
aattttgactcaa

SEQ ID NO: 697368 - DNA, 13 bp, C. elegans
aattttgacttat

SEQ ID NO: 697369 - DNA, 13 bp, C. elegans
aattttgactttt

SEQ ID NO: 697370 - DNA, 13 bp, C. elegans
aattttgagaaaa

SEQ ID NO: 697371 - DNA, 13 bp, C. elegans
aattttgagaaag

SEQ ID NO: 697372 - DNA, 13 bp, C. elegans
aattttgagaaat

SEQ ID NO: 697373 - DNA, 13 bp, C. elegans
aattttgagaatt

SEQ ID NO: 697374 - DNA, 13 bp, C. elegans
aattttgagcaat

SEQ ID NO: 697375 - DNA, 13 bp, C. elegans
aattttgagcatt

SEQ ID NO: 697376 - DNA, 13 bp, C. elegans
aattttgagcttt

SEQ ID NO: 697377 - DNA, 13 bp, C. elegans
aattttgaggcaa

SEQ ID NO: 697378 - DNA, 13 bp, C. elegans
aattttgaggttt

SEQ ID NO: 697379 - DNA, 13 bp, C. elegans
aattttgagtacg

SEQ ID NO: 697380 - DNA, 13 bp, C. elegans
aattttgagtcta

SEQ ID NO: 697381 - DNA, 13 bp, C. elegans
aattttgagtctt

SEQ ID NO: 697382 - DNA, 13 bp, C. elegans
aattttgataact

SEQ ID NO: 697383 - DNA, 13 bp, C. elegans
aattttgatcaat

SEQ ID NO: 697384 - DNA, 13 bp, C. elegans
aattttgatccaa

SEQ ID NO: 697385 - DNA, 13 bp, C. elegans
aattttgatcttt

SEQ ID NO: 697386 - DNA, 13 bp, C. elegans
aattttgatgaaa

SEQ ID NO: 697387 - DNA, 13 bp, C. elegans
aattttgatggat

SEQ ID NO: 697388 - DNA, 13 bp, C. elegans
aattttgattctt

SEQ ID NO: 697389 - DNA, 13 bp, C. elegans
aattttgcaacaa

SEQ ID NO: 697390 - DNA, 13 bp, C. elegans
aattttgcaataa

SEQ ID NO: 697391 - DNA, 13 bp, C. elegans
aattttgcagaga

SEQ ID NO: 697392 - DNA, 13 bp, C. elegans
aattttgcataat

SEQ ID NO: 697393 - DNA, 13 bp, C. elegans
aattttgcatcaa

SEQ ID NO: 697394 - DNA, 13 bp, C. elegans
aattttgccacaa

SEQ ID NO: 697395 - DNA, 13 bp, C. elegans
aattttgccactt

SEQ ID NO: 697396 - DNA, 13 bp, C. elegans
aattttgccattt

SEQ ID NO: 697397 - DNA, 13 bp, C. elegans
aattttgcccttt

SEQ ID NO: 697398 - DNA, 13 bp, C. elegans
aattttgccgttt

SEQ ID NO: 697399 - DNA, 13 bp, C. elegans
aattttgcctttt

SEQ ID NO: 697400 - DNA, 13 bp, C. elegans
aattttgcgtcaa

SEQ ID NO: 697401 - DNA, 13 bp, C. elegans
aattttgcgtgtt

SEQ ID NO: 697402 - DNA, 13 bp, C. elegans
aattttgctaaaa

SEQ ID NO: 697403 - DNA, 13 bp, C. elegans
aattttgctcaaa

SEQ ID NO: 697404 - DNA, 13 bp, C. elegans
aattttgctcata

SEQ ID NO: 697405 - DNA, 13 bp, C. elegans
aattttgctccaa

SEQ ID NO: 697406 - DNA, 13 bp, C. elegans
aattttgctctcc

SEQ ID NO: 697407 - DNA, 13 bp, C. elegans
aattttgctttaa

SEQ ID NO: 697408 - DNA, 13 bp, C. elegans
aattttgctttat

SEQ ID NO: 697409 - DNA, 13 bp, C. elegans
aattttggaaaat

SEQ ID NO: 697410 - DNA, 14 bp, C. elegans
aattttggaaaatt

SEQ ID NO: 697411 - DNA, 13 bp, C. elegans
aattttggaaatt

SEQ ID NO: 697412 - DNA, 13 bp, C. elegans
aattttggaagtc

SEQ ID NO: 697413 - DNA, 13 bp, C. elegans
aattttggagaaa

SEQ ID NO: 697414 - DNA, 13 bp, C. elegans
aattttggcaatt

SEQ ID NO: 697415 - DNA, 13 bp, C. elegans
aattttggcatat

SEQ ID NO: 697416 - DNA, 13 bp, C. elegans
aattttggccaaa

SEQ ID NO: 697417 - DNA, 13 bp, C. elegans
aattttggcgaaa

SEQ ID NO: 697418 - DNA, 13 bp, C. elegans
aattttggctatt

SEQ ID NO: 697419 - DNA, 13 bp, C. elegans
aattttggctgga

SEQ ID NO: 697420 - DNA, 13 bp, C. elegans
aattttggcttct

SEQ ID NO: 697421 - DNA, 13 bp, C. elegans
aattttgggcaaa

SEQ ID NO: 697422 - DNA, 13 bp, C. elegans
aattttggtaaaa

SEQ ID NO: 697423 - DNA, 13 bp, C. elegans
aattttggtagtt

SEQ ID NO: 697424 - DNA, 13 bp, C. elegans
aattttggtataa

SEQ ID NO: 697425 - DNA, 13 bp, C. elegans
aattttggtgatt

SEQ ID NO: 697426 - DNA, 13 bp, C. elegans
aattttggtgctc

SEQ ID NO: 697427 - DNA, 13 bp, C. elegans
aattttgtacaaa

SEQ ID NO: 697428 - DNA, 13 bp, C. elegans
aattttgtacatt

SEQ ID NO: 697429 - DNA, 13 bp, C. elegans
aattttgtacttt

SEQ ID NO: 697430 - DNA, 13 bp, C. elegans
aattttgtagatc

SEQ ID NO: 697431 - DNA, 13 bp, C. elegans
aattttgtagttg

SEQ ID NO: 697432 - DNA, 13 bp, C. elegans
aattttgtataca

SEQ ID NO: 697433 - DNA, 13 bp, C. elegans
aattttgtatgta

SEQ ID NO: 697434 - DNA, 13 bp, C. elegans
aattttgtattct

SEQ ID NO: 697435 - DNA, 13 bp, C. elegans
aattttgtcattt

SEQ ID NO: 697436 - DNA, 13 bp, C. elegans
aattttgtgaaaa

SEQ ID NO: 697437 - DNA, 13 bp, C. elegans
aattttgtgaaat

SEQ ID NO: 697438 - DNA, 13 bp, C. elegans
aattttgtgattc

SEQ ID NO: 697439 - DNA, 13 bp, C. elegans
aattttgtgctcc

SEQ ID NO: 697440 - DNA, 13 bp, C. elegans
aattttgtgctga

SEQ ID NO: 697441 - DNA, 13 bp, C. elegans
aattttgtggaat

SEQ ID NO: 697442 - DNA, 13 bp, C. elegans
aattttgtgtcat

SEQ ID NO: 697443 - DNA, 13 bp, C. elegans
aattttgtgttaa

SEQ ID NO: 697444 - DNA, 13 bp, C. elegans
aattttgttcaga

SEQ ID NO: 697445 - DNA, 13 bp, C. elegans
aattttgttgaaa

SEQ ID NO: 697446 - DNA, 13 bp, C. elegans
aattttgtttcag

SEQ ID NO: 697447 - DNA, 13 bp, C. elegans
aatttttaaagag

SEQ ID NO: 697448 - DNA, 13 bp, C. elegans
aatttttaaggtt

SEQ ID NO: 697449 - DNA, 13 bp, C. elegans
aatttttaattcg

SEQ ID NO: 697450 - DNA, 13 bp, C. elegans
aatttttacagaa

SEQ ID NO: 697451 - DNA, 13 bp, C. elegans
aatttttacagtt

SEQ ID NO: 697452 - DNA, 13 bp, C. elegans
aatttttaccaaa

SEQ ID NO: 697453 - DNA, 13 bp, C. elegans
aatttttagcaaa

SEQ ID NO: 697454 - DNA, 13 bp, C. elegans
aatttttaggaaa

SEQ ID NO: 697455 - DNA, 13 bp, C. elegans
aatttttagtggt

SEQ ID NO: 697456 - DNA, 13 bp, C. elegans
aatttttagtttc

SEQ ID NO: 697457 - DNA, 13 bp, C. elegans
aatttttatacac

SEQ ID NO: 697458 - DNA, 13 bp, C. elegans
aatttttatagct

SEQ ID NO: 697459 - DNA, 13 bp, C. elegans
aatttttatcaag

SEQ ID NO: 697460 - DNA, 13 bp, C. elegans
aatttttatggaa

SEQ ID NO: 697461 - DNA, 13 bp, C. elegans
aatttttattcca

SEQ ID NO: 697462 - DNA, 13 bp, C. elegans
aatttttattccg

SEQ ID NO: 697463 - DNA, 13 bp, C. elegans
aatttttattctg

SEQ ID NO: 697464 - DNA, 14 bp, C. elegans
aatttttcaaatct

SEQ ID NO: 697465 - DNA, 13 bp, C. elegans
aatttttcaacgc

SEQ ID NO: 697466 - DNA, 13 bp, C. elegans
aatttttcaagta

SEQ ID NO: 697467 - DNA, 13 bp, C. elegans
aatttttcaatac

SEQ ID NO: 697468 - DNA, 13 bp, C. elegans
aatttttcaatca

SEQ ID NO: 697469 - DNA, 13 bp, C. elegans
aatttttcaatgt

SEQ ID NO: 697470 - DNA, 13 bp, C. elegans
aatttttcacaat

SEQ ID NO: 697471 - DNA, 13 bp, C. elegans
aatttttcacatt

SEQ ID NO: 697472 - DNA, 13 bp, C. elegans
aatttttcaccag

SEQ ID NO: 697473 - DNA, 13 bp, C. elegans
aatttttcactat

SEQ ID NO: 697474 - DNA, 13 bp, C. elegans
aatttttcactca

SEQ ID NO: 697475 - DNA, 13 bp, C. elegans
aatttttcactgt

SEQ ID NO: 697476 - DNA, 13 bp, C. elegans
aatttttcactta

SEQ ID NO: 697477 - DNA, 13 bp, C. elegans
aatttttcagaaa

SEQ ID NO: 697478 - DNA, 13 bp, C. elegans
aatttttcagaat

SEQ ID NO: 697479 - DNA, 13 bp, C. elegans
aatttttcagatt

SEQ ID NO: 697480 - DNA, 13 bp, C. elegans
aatttttcagctg

SEQ ID NO: 697481 - DNA, 13 bp, C. elegans
aatttttcagctt

SEQ ID NO: 697482 - DNA, 13 bp, C. elegans
aatttttcagtga

SEQ ID NO: 697483 - DNA, 13 bp, C. elegans
aatttttcatcaa

SEQ ID NO: 697484 - DNA, 13 bp, C. elegans
aatttttcatgag

SEQ ID NO: 697485 - DNA, 13 bp, C. elegans
aatttttccaaaa

SEQ ID NO: 697486 - DNA, 13 bp, C. elegans
aatttttccaaat

SEQ ID NO: 697487 - DNA, 13 bp, C. elegans
aatttttccaact

SEQ ID NO: 697488 - DNA, 13 bp, C. elegans
aatttttccactg

SEQ ID NO: 697489 - DNA, 13 bp, C. elegans
aatttttccactt

SEQ ID NO: 697490 - DNA, 13 bp, C. elegans
aatttttccagaa

SEQ ID NO: 697491 - DNA, 13 bp, C. elegans
aatttttccagga

SEQ ID NO: 697492 - DNA, 13 bp, C. elegans
aatttttcccaga

SEQ ID NO: 697493 - DNA, 13 bp, C. elegans
aatttttccctaa

SEQ ID NO: 697494 - DNA, 13 bp, C. elegans
aatttttccgaaa

SEQ ID NO: 697495 - DNA, 13 bp, C. elegans
aatttttccgata

SEQ ID NO: 697496 - DNA, 13 bp, C. elegans
aatttttccgccg

SEQ ID NO: 697497 - DNA, 13 bp, C. elegans
aatttttcctaaa

SEQ ID NO: 697498 - DNA, 13 bp, C. elegans
aatttttcctcaa

SEQ ID NO: 697499 - DNA, 13 bp, C. elegans
aatttttcgaaaa

SEQ ID NO: 697500 - DNA, 13 bp, C. elegans
aatttttcgaaac

SEQ ID NO: 697501 - DNA, 13 bp, C. elegans
aatttttcgagga

SEQ ID NO: 697502 - DNA, 13 bp, C. elegans
aatttttcgatat

SEQ ID NO: 697503 - DNA, 13 bp, C. elegans
aatttttcgcaaa

SEQ ID NO: 697504 - DNA, 13 bp, C. elegans
aatttttcgccca

SEQ ID NO: 697505 - DNA, 13 bp, C. elegans
aatttttcgcgca

SEQ ID NO: 697506 - DNA, 13 bp, C. elegans
aatttttcgtttg

SEQ ID NO: 697507 - DNA, 13 bp, C. elegans
aatttttctacac

SEQ ID NO: 697508 - DNA, 13 bp, C. elegans
aatttttctagat

SEQ ID NO: 697509 - DNA, 14 bp, C. elegans
aatttttctcaaaa

SEQ ID NO: 697510 - DNA, 13 bp, C. elegans
aatttttctcact

SEQ ID NO: 697511 - DNA, 13 bp, C. elegans
aatttttctccca

SEQ ID NO: 697512 - DNA, 13 bp, C. elegans
aatttttctctca

SEQ ID NO: 697513 - DNA, 13 bp, C. elegans
aatttttctggtt

SEQ ID NO: 697514 - DNA, 14 bp, C. elegans
aatttttctgtgaa

SEQ ID NO: 697515 - DNA, 13 bp, C. elegans
aatttttctgttg

SEQ ID NO: 697516 - DNA, 13 bp, C. elegans
aatttttcttcaa

SEQ ID NO: 697517 - DNA, 13 bp, C. elegans
aatttttgaaaac

SEQ ID NO: 697518 - DNA, 13 bp, C. elegans
aatttttgaaaca

SEQ ID NO: 697519 - DNA, 13 bp, C. elegans
aatttttgaaact

SEQ ID NO: 697520 - DNA, 13 bp, C. elegans
aatttttgaactt

SEQ ID NO: 697521 - DNA, 13 bp, C. elegans
aatttttgaattc

SEQ ID NO: 697522 - DNA, 13 bp, C. elegans
aatttttgacatt

SEQ ID NO: 697523 - DNA, 13 bp, C. elegans
aatttttgactgt

SEQ ID NO: 697524 - DNA, 13 bp, C. elegans
aatttttgagaaa

SEQ ID NO: 697525 - DNA, 13 bp, C. elegans
aatttttgagaat

SEQ ID NO: 697526 - DNA, 13 bp, C. elegans
aatttttgagatt

SEQ ID NO: 697527 - DNA, 13 bp, C. elegans
aatttttgagctg

SEQ ID NO: 697528 - DNA, 13 bp, C. elegans
aatttttgagtga

SEQ ID NO: 697529 - DNA, 13 bp, C. elegans
aatttttgatcaa

SEQ ID NO: 697530 - DNA, 13 bp, C. elegans
aatttttgcaatt

SEQ ID NO: 697531 - DNA, 13 bp, C. elegans
aatttttgcagaa

SEQ ID NO: 697532 - DNA, 13 bp, C. elegans
aatttttgcattt

SEQ ID NO: 697533 - DNA, 13 bp, C. elegans
aatttttgccaaa

SEQ ID NO: 697534 - DNA, 13 bp, C. elegans
aatttttgccttt

SEQ ID NO: 697535 - DNA, 13 bp, C. elegans
aatttttgctaaa

SEQ ID NO: 697536 - DNA, 13 bp, C. elegans
aatttttgctgaa

SEQ ID NO: 697537 - DNA, 13 bp, C. elegans
aatttttgcttga

SEQ ID NO: 697538 - DNA, 13 bp, C. elegans
aatttttgctttc

SEQ ID NO: 697539 - DNA, 13 bp, C. elegans
aatttttggaaat

SEQ ID NO: 697540 - DNA, 13 bp, C. elegans
aatttttggaact

SEQ ID NO: 697541 - DNA, 13 bp, C. elegans
aatttttggagaa

SEQ ID NO: 697542 - DNA, 13 bp, C. elegans
aatttttggatca

SEQ ID NO: 697543 - DNA, 13 bp, C. elegans
aatttttgggaat

SEQ ID NO: 697544 - DNA, 13 bp, C. elegans
aatttttggttcc

SEQ ID NO: 697545 - DNA, 13 bp, C. elegans
aatttttgtatct

SEQ ID NO: 697546 - DNA, 13 bp, C. elegans
aatttttgtcaaa

SEQ ID NO: 697547 - DNA, 13 bp, C. elegans
aatttttgtcgaa

SEQ ID NO: 697548 - DNA, 13 bp, C. elegans
aatttttgtgaac

SEQ ID NO: 697549 - DNA, 13 bp, C. elegans
aatttttgtgaga

SEQ ID NO: 697550 - DNA, 13 bp, C. elegans
aatttttgtggtg

SEQ ID NO: 697551 - DNA, 13 bp, C. elegans
aatttttgtgtaa

SEQ ID NO: 697552 - DNA, 13 bp, C. elegans
aatttttgtgtga

SEQ ID NO: 697553 - DNA, 13 bp, C. elegans
aatttttgtgtgg

SEQ ID NO: 697554 - DNA, 13 bp, C. elegans
aatttttgttaga

SEQ ID NO: 697555 - DNA, 13 bp, C. elegans
aatttttgttcta

SEQ ID NO: 697556 - DNA, 13 bp, C. elegans
aatttttgttgaa

SEQ ID NO: 697557 - DNA, 13 bp, C. elegans
aattttttacaga

SEQ ID NO: 697558 - DNA, 13 bp, C. elegans
aattttttacagt

SEQ ID NO: 697559 - DNA, 13 bp, C. elegans
aattttttcacat

SEQ ID NO: 697560 - DNA, 13 bp, C. elegans
aattttttcagaa

SEQ ID NO: 697561 - DNA, 13 bp, C. elegans
aattttttccaag

SEQ ID NO: 697562 - DNA, 13 bp, C. elegans
aattttttccata

SEQ ID NO: 697563 - DNA, 13 bp, C. elegans
aattttttccatg

SEQ ID NO: 697564 - DNA, 13 bp, C. elegans
aattttttccgaa

SEQ ID NO: 697565 - DNA, 13 bp, C. elegans
aattttttccgtt

SEQ ID NO: 697566 - DNA, 14 bp, C. elegans
aattttttcgaaaa

SEQ ID NO: 697567 - DNA, 13 bp, C. elegans
aattttttcgatt

SEQ ID NO: 697568 - DNA, 13 bp, C. elegans
aattttttcggaa

SEQ ID NO: 697569 - DNA, 13 bp, C. elegans
aattttttctaac

SEQ ID NO: 697570 - DNA, 13 bp, C. elegans
aattttttctagt

SEQ ID NO: 697571 - DNA, 13 bp, C. elegans
aattttttctcga

SEQ ID NO: 697572 - DNA, 13 bp, C. elegans
aattttttcttga

SEQ ID NO: 697573 - DNA, 13 bp, C. elegans
aattttttgaaac

SEQ ID NO: 697574 - DNA, 13 bp, C. elegans
aattttttgaaag

SEQ ID NO: 697575 - DNA, 13 bp, C. elegans
aattttttgaaca

SEQ ID NO: 697576 - DNA, 13 bp, C. elegans
aattttttgaatg

SEQ ID NO: 697577 - DNA, 13 bp, C. elegans
aattttttgacaa

SEQ ID NO: 697578 - DNA, 13 bp, C. elegans
aattttttgacga

SEQ ID NO: 697579 - DNA, 13 bp, C. elegans
aattttttgagca

SEQ ID NO: 697580 - DNA, 13 bp, C. elegans
aattttttgcaca

SEQ ID NO: 697581 - DNA, 13 bp, C. elegans
aattttttgcatt

SEQ ID NO: 697582 - DNA, 13 bp, C. elegans
aattttttgcgaa

SEQ ID NO: 697583 - DNA, 13 bp, C. elegans
aattttttgctaa

SEQ ID NO: 697584 - DNA, 13 bp, C. elegans
aattttttgctga

SEQ ID NO: 697585 - DNA, 13 bp, C. elegans
aattttttggaaa

SEQ ID NO: 697586 - DNA, 13 bp, C. elegans
aattttttggaga

SEQ ID NO: 697587 - DNA, 13 bp, C. elegans
aattttttgggaa

SEQ ID NO: 697588 - DNA, 13 bp, C. elegans
aattttttggtcg

SEQ ID NO: 697589 - DNA, 13 bp, C. elegans
aattttttgtaga

SEQ ID NO: 697590 - DNA, 13 bp, C. elegans
aattttttgtgca

SEQ ID NO: 697591 - DNA, 13 bp, C. elegans
aattttttgtgtc

SEQ ID NO: 697592 - DNA, 13 bp, C. elegans
aattttttgttca

SEQ ID NO: 697593 - DNA, 13 bp, C. elegans
aattttttgttgc

SEQ ID NO: 697594 - DNA, 14 bp, C. elegans
aatttttttcacaa

SEQ ID NO: 697595 - DNA, 13 bp, C. elegans
aatttttttctcg

SEQ ID NO: 697596 - DNA, 13 bp, C. elegans
aatttttttgaca

SEQ ID NO: 697597 - DNA, 13 bp, C. elegans
aatttttttgcaa

SEQ ID NO: 697598 - DNA, 13 bp, C. elegans
aatttttttggga

SEQ ID NO: 697599 - DNA, 13 bp, C. elegans
aatttttttgtac

SEQ ID NO: 697600 - DNA, 13 bp, C. elegans
aattttttttcgc

SEQ ID NO: 697601 - DNA, 14 bp, C. elegans
aattttttttgcac

SEQ ID NO: 697602 - DNA, 13 bp, C. elegans
aattttttttgcc

SEQ ID NO: 697603 - DNA, 13 bp, C. elegans
aattttttttgcg

SEQ ID NO: 697604 - DNA, 13 bp, C. elegans
acaaaaaaatcgg

SEQ ID NO: 697605 - DNA, 13 bp, C. elegans
acaaaaaacagtt

SEQ ID NO: 697606 - DNA, 13 bp, C. elegans
acaaaaaaccatg

SEQ ID NO: 697607 - DNA, 13 bp, C. elegans
acaaaaaaccttt

SEQ ID NO: 697608 - DNA, 13 bp, C. elegans
acaaaaaagtgtc

SEQ ID NO: 697609 - DNA, 14 bp, C. elegans
acaaaaaagttcaa

SEQ ID NO: 697610 - DNA, 13 bp, C. elegans
acaaaaaagttcc

SEQ ID NO: 697611 - DNA, 13 bp, C. elegans
acaaaaaagttgt

SEQ ID NO: 697612 - DNA, 13 bp, C. elegans
acaaaaaatcgat

SEQ ID NO: 697613 - DNA, 13 bp, C. elegans
acaaaaaatgatc

SEQ ID NO: 697614 - DNA, 13 bp, C. elegans
acaaaaaatggat

SEQ ID NO: 697615 - DNA, 13 bp, C. elegans
acaaaaaatgtgt

SEQ ID NO: 697616 - DNA, 13 bp, C. elegans
acaaaaaatgtta

SEQ ID NO: 697617 - DNA, 13 bp, C. elegans
acaaaaaatgttc

SEQ ID NO: 697618 - DNA, 13 bp, C. elegans
acaaaaaattcag

SEQ ID NO: 697619 - DNA, 13 bp, C. elegans
acaaaaaattcgg

SEQ ID NO: 697620 - DNA, 13 bp, C. elegans
acaaaaaattgat

SEQ ID NO: 697621 - DNA, 13 bp, C. elegans
acaaaaaattgta

SEQ ID NO: 697622 - DNA, 13 bp, C. elegans
acaaaaaatttga

SEQ ID NO: 697623 - DNA, 13 bp, C. elegans
acaaaaacgtgaa

SEQ ID NO: 697624 - DNA, 13 bp, C. elegans
acaaaaactacag

SEQ ID NO: 697625 - DNA, 13 bp, C. elegans
acaaaaactacga

SEQ ID NO: 697626 - DNA, 13 bp, C. elegans
acaaaaactatga

SEQ ID NO: 697627 - DNA, 13 bp, C. elegans
acaaaaactgaat

SEQ ID NO: 697628 - DNA, 13 bp, C. elegans
acaaaaactgata

SEQ ID NO: 697629 - DNA, 13 bp, C. elegans
acaaaaacttgaa

SEQ ID NO: 697630 - DNA, 13 bp, C. elegans
acaaaaacttgtc

SEQ ID NO: 697631 - DNA, 13 bp, C. elegans
acaaaaactttta

SEQ ID NO: 697632 - DNA, 13 bp, C. elegans
acaaaaacttttt

SEQ ID NO: 697633 - DNA, 13 bp, C. elegans
acaaaaagagttt

SEQ ID NO: 697634 - DNA, 13 bp, C. elegans
acaaaaagattta

SEQ ID NO: 697635 - DNA, 13 bp, C. elegans
acaaaaagtatgc

SEQ ID NO: 697636 - DNA, 13 bp, C. elegans
acaaaaagtattt

SEQ ID NO: 697637 - DNA, 13 bp, C. elegans
acaaaaagtcaat

SEQ ID NO: 697638 - DNA, 13 bp, C. elegans
acaaaaagtgcaa

SEQ ID NO: 697639 - DNA, 13 bp, C. elegans
acaaaaagtgtcc

SEQ ID NO: 697640 - DNA, 13 bp, C. elegans
acaaaaagttcaa

SEQ ID NO: 697641 - DNA, 13 bp, C. elegans
acaaaaagttgaa

SEQ ID NO: 697642 - DNA, 13 bp, C. elegans
acaaaaatagttt

SEQ ID NO: 697643 - DNA, 13 bp, C. elegans
acaaaaatatcga

SEQ ID NO: 697644 - DNA, 13 bp, C. elegans
acaaaaatcattt

SEQ ID NO: 697645 - DNA, 13 bp, C. elegans
acaaaaatctgaa

SEQ ID NO: 697646 - DNA, 13 bp, C. elegans
acaaaaatctgca

SEQ ID NO: 697647 - DNA, 13 bp, C. elegans
acaaaaatcttta

SEQ ID NO: 697648 - DNA, 13 bp, C. elegans
acaaaaatgaatg

SEQ ID NO: 697649 - DNA, 13 bp, C. elegans
acaaaaatgatgt

SEQ ID NO: 697650 - DNA, 13 bp, C. elegans
acaaaaatgtatt

SEQ ID NO: 697651 - DNA, 13 bp, C. elegans
acaaaaatgtcaa

SEQ ID NO: 697652 - DNA, 13 bp, C. elegans
acaaaaatgtgaa

SEQ ID NO: 697653 - DNA, 13 bp, C. elegans
acaaaaatgtgtg

SEQ ID NO: 697654 - DNA, 13 bp, C. elegans
acaaaaattattg

SEQ ID NO: 697655 - DNA, 13 bp, C. elegans
acaaaaattcgtt

SEQ ID NO: 697656 - DNA, 13 bp, C. elegans
acaaaacatttca

SEQ ID NO: 697657 - DNA, 14 bp, C. elegans
acaaaacattttga

SEQ ID NO: 697658 - DNA, 13 bp, C. elegans
acaaaacattttt

SEQ ID NO: 697659 - DNA, 13 bp, C. elegans
acaaaacgatttt

SEQ ID NO: 697660 - DNA, 13 bp, C. elegans
acaaaactggaaa

SEQ ID NO: 697661 - DNA, 13 bp, C. elegans
acaaaacttattg

SEQ ID NO: 697662 - DNA, 13 bp, C. elegans
acaaaacttcaat

SEQ ID NO: 697663 - DNA, 13 bp, C. elegans
acaaaactttatt

SEQ ID NO: 697664 - DNA, 13 bp, C. elegans
acaaaagaatttt

SEQ ID NO: 697665 - DNA, 13 bp, C. elegans
acaaaagagcttg

SEQ ID NO: 697666 - DNA, 13 bp, C. elegans
acaaaagagttct

SEQ ID NO: 697667 - DNA, 13 bp, C. elegans
acaaaagtattgg

SEQ ID NO: 697668 - DNA, 13 bp, C. elegans
acaaaagtcaatt

SEQ ID NO: 697669 - DNA, 13 bp, C. elegans
acaaaagttgcaa

SEQ ID NO: 697670 - DNA, 13 bp, C. elegans
acaaaagtttatt

SEQ ID NO: 697671 - DNA, 13 bp, C. elegans
acaaaagtttgaa

SEQ ID NO: 697672 - DNA, 13 bp, C. elegans
acaaaataatgtt

SEQ ID NO: 697673 - DNA, 13 bp, C. elegans
acaaaatactgct

SEQ ID NO: 697674 - DNA, 13 bp, C. elegans
acaaaatattcac

SEQ ID NO: 697675 - DNA, 13 bp, C. elegans
acaaaatattcta

SEQ ID NO: 697676 - DNA, 13 bp, C. elegans
acaaaatattgaa

SEQ ID NO: 697677 - DNA, 13 bp, C. elegans
acaaaatattgat

SEQ ID NO: 697678 - DNA, 13 bp, C. elegans
acaaaatattgct

SEQ ID NO: 697679 - DNA, 13 bp, C. elegans
acaaaatcatccg

SEQ ID NO: 697680 - DNA, 13 bp, C. elegans
acaaaatccaatt

SEQ ID NO: 697681 - DNA, 13 bp, C. elegans
acaaaatccagaa

SEQ ID NO: 697682 - DNA, 13 bp, C. elegans
acaaaatcgattt

SEQ ID NO: 697683 - DNA, 13 bp, C. elegans
acaaaatgatcaa

SEQ ID NO: 697684 - DNA, 13 bp, C. elegans
acaaaatgcaaca

SEQ ID NO: 697685 - DNA, 13 bp, C. elegans
acaaaatgcacaa

SEQ ID NO: 697686 - DNA, 13 bp, C. elegans
acaaaatgccaaa

SEQ ID NO: 697687 - DNA, 13 bp, C. elegans
acaaaatgcctac

SEQ ID NO: 697688 - DNA, 13 bp, C. elegans
acaaaatggaaca

SEQ ID NO: 697689 - DNA, 13 bp, C. elegans
acaaaatggcaat

SEQ ID NO: 697690 - DNA, 13 bp, C. elegans
acaaaatgtataa

SEQ ID NO: 697691 - DNA, 13 bp, C. elegans
acaaaatgttcaa

SEQ ID NO: 697692 - DNA, 13 bp, C. elegans
acaaaatgttgcc

SEQ ID NO: 697693 - DNA, 13 bp, C. elegans
acaaaatgtttgt

SEQ ID NO: 697694 - DNA, 13 bp, C. elegans
acaaaattatatg

SEQ ID NO: 697695 - DNA, 13 bp, C. elegans
acaaaattcaatt

SEQ ID NO: 697696 - DNA, 13 bp, C. elegans
acaaaattcactt

SEQ ID NO: 697697 - DNA, 13 bp, C. elegans
acaaaattcattt

SEQ ID NO: 697698 - DNA, 13 bp, C. elegans
acaaaattcgcaa

SEQ ID NO: 697699 - DNA, 13 bp, C. elegans
acaaaattgagct

SEQ ID NO: 697700 - DNA, 13 bp, C. elegans
acaaaattgagtt

SEQ ID NO: 697701 - DNA, 13 bp, C. elegans
acaaaattgataa

SEQ ID NO: 697702 - DNA, 13 bp, C. elegans
acaaaattggaaa

SEQ ID NO: 697703 - DNA, 13 bp, C. elegans
acaaaattgtaat

SEQ ID NO: 697704 - DNA, 13 bp, C. elegans
acaaaattgtgaa

SEQ ID NO: 697705 - DNA, 13 bp, C. elegans
acaaaattgttct

SEQ ID NO: 697706 - DNA, 13 bp, C. elegans
acaaaatttattg

SEQ ID NO: 697707 - DNA, 13 bp, C. elegans
acaaaatttcatt

SEQ ID NO: 697708 - DNA, 13 bp, C. elegans
acaaaatttgaaa

SEQ ID NO: 697709 - DNA, 13 bp, C. elegans
acaaaatttgaga

SEQ ID NO: 697710 - DNA, 13 bp, C. elegans
acaaaattttcaa

SEQ ID NO: 697711 - DNA, 13 bp, C. elegans
acaaaattttgaa

SEQ ID NO: 697712 - DNA, 13 bp, C. elegans
acaaacaaattga

SEQ ID NO: 697713 - DNA, 13 bp, C. elegans
acaaacaaatttg

SEQ ID NO: 697714 - DNA, 13 bp, C. elegans
acaaacaatttta

SEQ ID NO: 697715 - DNA, 13 bp, C. elegans
acaaacaattttg

SEQ ID NO: 697716 - DNA, 13 bp, C. elegans
acaaacattgttt

SEQ ID NO: 697717 - DNA, 13 bp, C. elegans
acaaacatttaat

SEQ ID NO: 697718 - DNA, 13 bp, C. elegans
acaaacatttatt

SEQ ID NO: 697719 - DNA, 13 bp, C. elegans
acaaacatttcaa

SEQ ID NO: 697720 - DNA, 13 bp, C. elegans
acaaacattttca

SEQ ID NO: 697721 - DNA, 13 bp, C. elegans
acaaacattttgt

SEQ ID NO: 697722 - DNA, 13 bp, C. elegans
acaaacgacaact

SEQ ID NO: 697723 - DNA, 13 bp, C. elegans
acaaactaaattt

SEQ ID NO: 697724 - DNA, 13 bp, C. elegans
acaaactacaatg

SEQ ID NO: 697725 - DNA, 13 bp, C. elegans
acaaactacaatt

SEQ ID NO: 697726 - DNA, 13 bp, C. elegans
acaaactacagaa

SEQ ID NO: 697727 - DNA, 13 bp, C. elegans
acaaactacatat

SEQ ID NO: 697728 - DNA, 13 bp, C. elegans
acaaactatggac

SEQ ID NO: 697729 - DNA, 13 bp, C. elegans
acaaactgaaact

SEQ ID NO: 697730 - DNA, 13 bp, C. elegans
acaaactgccgga

SEQ ID NO: 697731 - DNA, 13 bp, C. elegans
acaaacttcagca

SEQ ID NO: 697732 - DNA, 13 bp, C. elegans
acaaactttccat

SEQ ID NO: 697733 - DNA, 13 bp, C. elegans
acaaacttttaat

SEQ ID NO: 697734 - DNA, 13 bp, C. elegans
acaaagactacaa

SEQ ID NO: 697735 - DNA, 13 bp, C. elegans
acaaagatttgaa

SEQ ID NO: 697736 - DNA, 13 bp, C. elegans
acaaagctcaaat

SEQ ID NO: 697737 - DNA, 13 bp, C. elegans
acaaagtatgcta

SEQ ID NO: 697738 - DNA, 13 bp, C. elegans
acaaagtatgtat

SEQ ID NO: 697739 - DNA, 13 bp, C. elegans
acaaagtgatcaa

SEQ ID NO: 697740 - DNA, 13 bp, C. elegans
acaaagttgttca

SEQ ID NO: 697741 - DNA, 13 bp, C. elegans
acaaagtttggag

SEQ ID NO: 697742 - DNA, 13 bp, C. elegans
acaaagttttgaa

SEQ ID NO: 697743 - DNA, 13 bp, C. elegans
acaaataaaactg

SEQ ID NO: 697744 - DNA, 13 bp, C. elegans
acaaataattgat

SEQ ID NO: 697745 - DNA, 13 bp, C. elegans
acaaataattgtt

SEQ ID NO: 697746 - DNA, 13 bp, C. elegans
acaaataatttga

SEQ ID NO: 697747 - DNA, 13 bp, C. elegans
acaaatacttttt

SEQ ID NO: 697748 - DNA, 13 bp, C. elegans
acaaatatattca

SEQ ID NO: 697749 - DNA, 13 bp, C. elegans
acaaatatgaatt

SEQ ID NO: 697750 - DNA, 13 bp, C. elegans
acaaatattccaa

SEQ ID NO: 697751 - DNA, 13 bp, C. elegans
acaaatatttgga

SEQ ID NO: 697752 - DNA, 13 bp, C. elegans
acaaatcaatttg

SEQ ID NO: 697753 - DNA, 13 bp, C. elegans
acaaatcacaatt

SEQ ID NO: 697754 - DNA, 13 bp, C. elegans
acaaatcacattt

SEQ ID NO: 697755 - DNA, 13 bp, C. elegans
acaaatcattttt

SEQ ID NO: 697756 - DNA, 13 bp, C. elegans
acaaatccaaatt

SEQ ID NO: 697757 - DNA, 13 bp, C. elegans
acaaatccaattg

SEQ ID NO: 697758 - DNA, 13 bp, C. elegans
acaaatccaattt

SEQ ID NO: 697759 - DNA, 13 bp, C. elegans
acaaatcgaatta

SEQ ID NO: 697760 - DNA, 13 bp, C. elegans
acaaatcttcaaa

SEQ ID NO: 697761 - DNA, 13 bp, C. elegans
acaaatgaatact

SEQ ID NO: 697762 - DNA, 13 bp, C. elegans
acaaatgcaaaat

SEQ ID NO: 697763 - DNA, 13 bp, C. elegans
acaaatgctccac

SEQ ID NO: 697764 - DNA, 13 bp, C. elegans
acaaatgtgaaaa

SEQ ID NO: 697765 - DNA, 13 bp, C. elegans
acaaatgttgttt

SEQ ID NO: 697766 - DNA, 13 bp, C. elegans
acaaatgtttgtt

SEQ ID NO: 697767 - DNA, 13 bp, C. elegans
acaaattatcaat

SEQ ID NO: 697768 - DNA, 13 bp, C. elegans
acaaattatcgat

SEQ ID NO: 697769 - DNA, 13 bp, C. elegans
acaaattattgat

SEQ ID NO: 697770 - DNA, 13 bp, C. elegans
acaaattatttga

SEQ ID NO: 697771 - DNA, 13 bp, C. elegans
acaaattatttgt

SEQ ID NO: 697772 - DNA, 13 bp, C. elegans
acaaattcaactt

SEQ ID NO: 697773 - DNA, 13 bp, C. elegans
acaaattcagaaa

SEQ ID NO: 697774 - DNA, 13 bp, C. elegans
acaaattccgaaa

SEQ ID NO: 697775 - DNA, 13 bp, C. elegans
acaaattcgaatt

SEQ ID NO: 697776 - DNA, 13 bp, C. elegans
acaaattctagaa

SEQ ID NO: 697777 - DNA, 13 bp, C. elegans
acaaattctcaat

SEQ ID NO: 697778 - DNA, 13 bp, C. elegans
acaaattctttaa

SEQ ID NO: 697779 - DNA, 13 bp, C. elegans
acaaattgaactt

SEQ ID NO: 697780 - DNA, 13 bp, C. elegans
acaaattgagaaa

SEQ ID NO: 697781 - DNA, 13 bp, C. elegans
acaaattgcaaaa

SEQ ID NO: 697782 - DNA, 13 bp, C. elegans
acaaattgcagaa

SEQ ID NO: 697783 - DNA, 13 bp, C. elegans
acaaattggaaaa

SEQ ID NO: 697784 - DNA, 13 bp, C. elegans
acaaattgtaatt

SEQ ID NO: 697785 - DNA, 13 bp, C. elegans
acaaattgtcaat

SEQ ID NO: 697786 - DNA, 13 bp, C. elegans
acaaattgtggtt

SEQ ID NO: 697787 - DNA, 13 bp, C. elegans
acaaatttattga

SEQ ID NO: 697788 - DNA, 13 bp, C. elegans
acaaatttcaatt

SEQ ID NO: 697789 - DNA, 13 bp, C. elegans
acaaatttcatat

SEQ ID NO: 697790 - DNA, 13 bp, C. elegans
acaaatttccgat

SEQ ID NO: 697791 - DNA, 13 bp, C. elegans
acaaatttgaagt

SEQ ID NO: 697792 - DNA, 13 bp, C. elegans
acaaatttgattt

SEQ ID NO: 697793 - DNA, 13 bp, C. elegans
acaaatttgcaaa

SEQ ID NO: 697794 - DNA, 13 bp, C. elegans
acaaattttcgtt

SEQ ID NO: 697795 - DNA, 13 bp, C. elegans
acaaattttcttc

SEQ ID NO: 697796 - DNA, 13 bp, C. elegans
acaaattttgatg

SEQ ID NO: 697797 - DNA, 13 bp, C. elegans
acaaattttggat

SEQ ID NO: 697798 - DNA, 13 bp, C. elegans
acaaattttgggc

SEQ ID NO: 697799 - DNA, 13 bp, C. elegans
acaaattttgttt

SEQ ID NO: 697800 - DNA, 13 bp, C. elegans
acaaatttttcaa

SEQ ID NO: 697801 - DNA, 13 bp, C. elegans
acaaatttttgaa

SEQ ID NO: 697802 - DNA, 13 bp, C. elegans
acaaattttttca

SEQ ID NO: 697803 - DNA, 13 bp, C. elegans
acaaattttttga

SEQ ID NO: 697804 - DNA, 13 bp, C. elegans
acaaatttttttc

SEQ ID NO: 697805 - DNA, 13 bp, C. elegans
acaacaaaaatgt

SEQ ID NO: 697806 - DNA, 13 bp, C. elegans
acaacaaaacttt

SEQ ID NO: 697807 - DNA, 13 bp, C. elegans
acaacaattatga

SEQ ID NO: 697808 - DNA, 13 bp, C. elegans
acaacaatttcaa

SEQ ID NO: 697809 - DNA, 13 bp, C. elegans
acaacaattttat

SEQ ID NO: 697810 - DNA, 13 bp, C. elegans
acaacaattttct

SEQ ID NO: 697811 - DNA, 13 bp, C. elegans
acaacacaaattt

SEQ ID NO: 697812 - DNA, 13 bp, C. elegans
acaacacattttg

SEQ ID NO: 697813 - DNA, 13 bp, C. elegans
acaacactttttg

SEQ ID NO: 697814 - DNA, 13 bp, C. elegans
acaacagagagca

SEQ ID NO: 697815 - DNA, 13 bp, C. elegans
acaaccgaatatc

SEQ ID NO: 697816 - DNA, 13 bp, C. elegans
acaacctgatatt

SEQ ID NO: 697817 - DNA, 13 bp, C. elegans
acaacgaaatcga

SEQ ID NO: 697818 - DNA, 13 bp, C. elegans
acaacgacactcc

SEQ ID NO: 697819 - DNA, 30 bp, C. elegans
acaacgcaaggacaaggacaacattctaat

SEQ ID NO: 697820 - DNA, 13 bp, C. elegans
acaacgttttttt

SEQ ID NO: 697821 - DNA, 13 bp, C. elegans
acaactaaaattt

SEQ ID NO: 697822 - DNA, 13 bp, C. elegans
acaactaaatttt

SEQ ID NO: 697823 - DNA, 13 bp, C. elegans
acaactaattaca

SEQ ID NO: 697824 - DNA, 13 bp, C. elegans
acaactaattttt

SEQ ID NO: 697825 - DNA, 13 bp, C. elegans
acaactagcaaaa

SEQ ID NO: 697826 - DNA, 13 bp, C. elegans
acaactatttaaa

SEQ ID NO: 697827 - DNA, 13 bp, C. elegans
acaactatttcaa

SEQ ID NO: 697828 - DNA, 13 bp, C. elegans
acaactcaaaatt

SEQ ID NO: 697829 - DNA, 13 bp, C. elegans
acaactcggcaac

SEQ ID NO: 697830 - DNA, 13 bp, C. elegans
acaactctttttt

SEQ ID NO: 697831 - DNA, 13 bp, C. elegans
acaactgaaattt

SEQ ID NO: 697832 - DNA, 13 bp, C. elegans
acaactgttttaa

SEQ ID NO: 697833 - DNA, 13 bp, C. elegans
acaacttatcagt

SEQ ID NO: 697834 - DNA, 16 bp, C. elegans
acaacttatgaaccaa

SEQ ID NO: 697835 - DNA, 13 bp, C. elegans
acaacttcaaaac

SEQ ID NO: 697836 - DNA, 13 bp, C. elegans
acaacttcaaatg

SEQ ID NO: 697837 - DNA, 14 bp, C. elegans
acaacttccaaaaa

SEQ ID NO: 697838 - DNA, 13 bp, C. elegans
acaacttgaaaaa

SEQ ID NO: 697839 - DNA, 13 bp, C. elegans
acaacttgaaaac

SEQ ID NO: 697840 - DNA, 13 bp, C. elegans
acaacttgccgga

SEQ ID NO: 697841 - DNA, 13 bp, C. elegans
acaactttctttt

SEQ ID NO: 697842 - DNA, 13 bp, C. elegans
acaactttgaaac

SEQ ID NO: 697843 - DNA, 13 bp, C. elegans
acaactttgaatt

SEQ ID NO: 697844 - DNA, 13 bp, C. elegans
acaactttgccga

SEQ ID NO: 697845 - DNA, 13 bp, C. elegans
acaacttttgaaa

SEQ ID NO: 697846 - DNA, 13 bp, C. elegans
acaactttttaaa

SEQ ID NO: 697847 - DNA, 13 bp, C. elegans
acaactttttgat

SEQ ID NO: 697848 - DNA, 13 bp, C. elegans
acaactttttgtt

SEQ ID NO: 697849 - DNA, 13 bp, C. elegans
acaacttttttct

SEQ ID NO: 697850 - DNA, 13 bp, C. elegans
acaacttttttgt

SEQ ID NO: 697851 - DNA, 13 bp, C. elegans
acaagaaaaactg

SEQ ID NO: 697852 - DNA, 13 bp, C. elegans
acaagaaaaattc

SEQ ID NO: 697853 - DNA, 13 bp, C. elegans
acaagaaaacatt

SEQ ID NO: 697854 - DNA, 13 bp, C. elegans
acaagaaaagtat

SEQ ID NO: 697855 - DNA, 13 bp, C. elegans
acaagaaaattca

SEQ ID NO: 697856 - DNA, 13 bp, C. elegans
acaagaaactatg

SEQ ID NO: 697857 - DNA, 13 bp, C. elegans
acaagaaatacca

SEQ ID NO: 697858 - DNA, 13 bp, C. elegans
acaagaaatatat

SEQ ID NO: 697859 - DNA, 13 bp, C. elegans
acaagaaattgaa

SEQ ID NO: 697860 - DNA, 13 bp, C. elegans
acaagaacatttt

SEQ ID NO: 697861 - DNA, 13 bp, C. elegans
acaagaagaactg

SEQ ID NO: 697862 - DNA, 13 bp, C. elegans
acaagaaggtttt

SEQ ID NO: 697863 - DNA, 13 bp, C. elegans
acaagaatttcaa

SEQ ID NO: 697864 - DNA, 13 bp, C. elegans
acaagaatttcca

SEQ ID NO: 697865 - DNA, 13 bp, C. elegans
acaagaattttaa

SEQ ID NO: 697866 - DNA, 13 bp, C. elegans
acaagacggaaac

SEQ ID NO: 697867 - DNA, 13 bp, C. elegans
acaagagtttgaa

SEQ ID NO: 697868 - DNA, 13 bp, C. elegans
acaagatattttg

SEQ ID NO: 697869 - DNA, 13 bp, C. elegans
acaagatgttttg

SEQ ID NO: 697870 - DNA, 13 bp, C. elegans
acaagatttcaaa

SEQ ID NO: 697871 - DNA, 13 bp, C. elegans
acaagattttcaa

SEQ ID NO: 697872 - DNA, 13 bp, C. elegans
acaagctgaaaaa

SEQ ID NO: 697873 - DNA, 13 bp, C. elegans
acaaggaaaatat

SEQ ID NO: 697874 - DNA, 13 bp, C. elegans
acaaggaaaatgg

SEQ ID NO: 697875 - DNA, 13 bp, C. elegans
acaaggaaattga

SEQ ID NO: 697876 - DNA, 13 bp, C. elegans
acaaggcaggcat

SEQ ID NO: 697877 - DNA, 13 bp, C. elegans
acaagtatttttt

SEQ ID NO: 697878 - DNA, 13 bp, C. elegans
acaagtcataaaa

SEQ ID NO: 697879 - DNA, 13 bp, C. elegans
acaagtgaattta

SEQ ID NO: 697880 - DNA, 13 bp, C. elegans
acaagttgattat

SEQ ID NO: 697881 - DNA, 13 bp, C. elegans
acaagttgcaaaa

SEQ ID NO: 697882 - DNA, 13 bp, C. elegans
acaagtttccaaa

SEQ ID NO: 697883 - DNA, 13 bp, C. elegans
acaagtttcgaaa

SEQ ID NO: 697884 - DNA, 13 bp, C. elegans
acaagtttgaaaa

SEQ ID NO: 697885 - DNA, 13 bp, C. elegans
acaagttttagaa

SEQ ID NO: 697886 - DNA, 13 bp, C. elegans
acaagttttcctt

SEQ ID NO: 697887 - DNA, 13 bp, C. elegans
acaagttttctgt

SEQ ID NO: 697888 - DNA, 13 bp, C. elegans
acaagtttttcat

SEQ ID NO: 697889 - DNA, 13 bp, C. elegans
acaataaaatgtt

SEQ ID NO: 697890 - DNA, 13 bp, C. elegans
acaataaatgttt

SEQ ID NO: 697891 - DNA, 13 bp, C. elegans
acaataataaatg

SEQ ID NO: 697892 - DNA, 13 bp, C. elegans
acaataatttcta

SEQ ID NO: 697893 - DNA, 13 bp, C. elegans
acaataatttgaa

SEQ ID NO: 697894 - DNA, 13 bp, C. elegans
acaatacgatttt

SEQ ID NO: 697895 - DNA, 13 bp, C. elegans
acaatactttgaa

SEQ ID NO: 697896 - DNA, 13 bp, C. elegans
acaatactttttt

SEQ ID NO: 697897 - DNA, 13 bp, C. elegans
acaatagagcaca

SEQ ID NO: 697898 - DNA, 14 bp, C. elegans
acaatagtcacaaa

SEQ ID NO: 697899 - DNA, 13 bp, C. elegans
acaatagtggtac

SEQ ID NO: 697900 - DNA, 13 bp, C. elegans
acaatagttttta

SEQ ID NO: 697901 - DNA, 13 bp, C. elegans
acaatatctgaaa

SEQ ID NO: 697902 - DNA, 13 bp, C. elegans
acaatatgatttt

SEQ ID NO: 697903 - DNA, 13 bp, C. elegans
acaatattcatca

SEQ ID NO: 697904 - DNA, 13 bp, C. elegans
acaatattgaaat

SEQ ID NO: 697905 - DNA, 13 bp, C. elegans
acaatatttattc

SEQ ID NO: 697906 - DNA, 13 bp, C. elegans
acaatatttgaaa

SEQ ID NO: 697907 - DNA, 13 bp, C. elegans
acaatatttttct

SEQ ID NO: 697908 - DNA, 13 bp, C. elegans
acaatattttttc

SEQ ID NO: 697909 - DNA, 13 bp, C. elegans
acaatcaactcaa

SEQ ID NO: 697910 - DNA, 13 bp, C. elegans
acaatcaatttga

SEQ ID NO: 697911 - DNA, 13 bp, C. elegans
acaatcgcattgt

SEQ ID NO: 697912 - DNA, 13 bp, C. elegans
acaatcgcctgcc

SEQ ID NO: 697913 - DNA, 13 bp, C. elegans
acaatcgctacag

SEQ ID NO: 697914 - DNA, 13 bp, C. elegans
acaatcttattta

SEQ ID NO: 697915 - DNA, 13 bp, C. elegans
acaatcttcaaaa

SEQ ID NO: 697916 - DNA, 13 bp, C. elegans
acaatgaaaaatc

SEQ ID NO: 697917 - DNA, 13 bp, C. elegans
acaatgaaaatga

SEQ ID NO: 697918 - DNA, 13 bp, C. elegans
acaatgaaaatta

SEQ ID NO: 697919 - DNA, 13 bp, C. elegans
acaatgaaattga

SEQ ID NO: 697920 - DNA, 14 bp, C. elegans
acaatgaccaaata

SEQ ID NO: 697921 - DNA, 13 bp, C. elegans
acaatgatctttt

SEQ ID NO: 697922 - DNA, 13 bp, C. elegans
acaatgattgaaa

SEQ ID NO: 697923 - DNA, 13 bp, C. elegans
acaatgcccactt

SEQ ID NO: 697924 - DNA, 13 bp, C. elegans
acaatgttctaat

SEQ ID NO: 697925 - DNA, 13 bp, C. elegans
acaatgtttcaaa

SEQ ID NO: 697926 - DNA, 13 bp, C. elegans
acaatgttttaat

SEQ ID NO: 697927 - DNA, 13 bp, C. elegans
acaatgttttgat

SEQ ID NO: 697928 - DNA, 13 bp, C. elegans
acaattaaaactt

SEQ ID NO: 697929 - DNA, 13 bp, C. elegans
acaattaaaattc

SEQ ID NO: 697930 - DNA, 13 bp, C. elegans
acaattaacaatt

SEQ ID NO: 697931 - DNA, 13 bp, C. elegans
acaattaattgtt

SEQ ID NO: 697932 - DNA, 13 bp, C. elegans
acaattaatttct

SEQ ID NO: 697933 - DNA, 13 bp, C. elegans
acaattagaaatt

SEQ ID NO: 697934 - DNA, 13 bp, C. elegans
acaattataaagt

SEQ ID NO: 697935 - DNA, 13 bp, C. elegans
acaattatgaaat

SEQ ID NO: 697936 - DNA, 13 bp, C. elegans
acaattatgtttt

SEQ ID NO: 697937 - DNA, 13 bp, C. elegans
acaattattcaaa

SEQ ID NO: 697938 - DNA, 13 bp, C. elegans
acaattattgatt

SEQ ID NO: 697939 - DNA, 13 bp, C. elegans
acaattatttcaa

SEQ ID NO: 697940 - DNA, 13 bp, C. elegans
acaattatttctt

SEQ ID NO: 697941 - DNA, 13 bp, C. elegans
acaattattttca

SEQ ID NO: 697942 - DNA, 13 bp, C. elegans
acaattattttcc

SEQ ID NO: 697943 - DNA, 13 bp, C. elegans
acaattcactttt

SEQ ID NO: 697944 - DNA, 13 bp, C. elegans
acaattcataatt

SEQ ID NO: 697945 - DNA, 13 bp, C. elegans
acaattcattttc

SEQ ID NO: 697946 - DNA, 13 bp, C. elegans
acaattccaaatt

SEQ ID NO: 697947 - DNA, 13 bp, C. elegans
acaattcgaaaat

SEQ ID NO: 697948 - DNA, 13 bp, C. elegans
acaattctaaatt

SEQ ID NO: 697949 - DNA, 13 bp, C. elegans
acaattctagaaa

SEQ ID NO: 697950 - DNA, 13 bp, C. elegans
acaattctgagtc

SEQ ID NO: 697951 - DNA, 13 bp, C. elegans
acaattcttaaaa

SEQ ID NO: 697952 - DNA, 13 bp, C. elegans
acaattgaaaatg

SEQ ID NO: 697953 - DNA, 13 bp, C. elegans
acaattgaagctc

SEQ ID NO: 697954 - DNA, 13 bp, C. elegans
acaattgaatttt

SEQ ID NO: 697955 - DNA, 13 bp, C. elegans
acaattgagatat

SEQ ID NO: 697956 - DNA, 13 bp, C. elegans
acaattgataaaa

SEQ ID NO: 697957 - DNA, 13 bp, C. elegans
acaattgcaaaat

SEQ ID NO: 697958 - DNA, 13 bp, C. elegans
acaattgccaaaa

SEQ ID NO: 697959 - DNA, 13 bp, C. elegans
acaattgccgttt

SEQ ID NO: 697960 - DNA, 13 bp, C. elegans
acaattgcttttt

SEQ ID NO: 697961 - DNA, 13 bp, C. elegans
acaattggaattg

SEQ ID NO: 697962 - DNA, 13 bp, C. elegans
acaattgttaaat

SEQ ID NO: 697963 - DNA, 13 bp, C. elegans
acaattgtttgaa

SEQ ID NO: 697964 - DNA, 13 bp, C. elegans
acaattgttttga

SEQ ID NO: 697965 - DNA, 13 bp, C. elegans
acaatttaagttt

SEQ ID NO: 697966 - DNA, 13 bp, C. elegans
acaatttacaaat

SEQ ID NO: 697967 - DNA, 13 bp, C. elegans
acaatttagaaat

SEQ ID NO: 697968 - DNA, 13 bp, C. elegans
acaatttataaca

SEQ ID NO: 697969 - DNA, 13 bp, C. elegans
acaatttatcaat

SEQ ID NO: 697970 - DNA, 13 bp, C. elegans
acaatttatcatt

SEQ ID NO: 697971 - DNA, 13 bp, C. elegans
acaatttattgat

SEQ ID NO: 697972 - DNA, 13 bp, C. elegans
acaatttcaaaat

SEQ ID NO: 697973 - DNA, 13 bp, C. elegans
acaatttcaaact

SEQ ID NO: 697974 - DNA, 13 bp, C. elegans
acaatttcaaata

SEQ ID NO: 697975 - DNA, 13 bp, C. elegans
acaatttcaataa

SEQ ID NO: 697976 - DNA, 13 bp, C. elegans
acaatttcaatca

SEQ ID NO: 697977 - DNA, 13 bp, C. elegans
acaatttcacaaa

SEQ ID NO: 697978 - DNA, 13 bp, C. elegans
acaatttcagatg

SEQ ID NO: 697979 - DNA, 13 bp, C. elegans
acaatttcagcaa

SEQ ID NO: 697980 - DNA, 13 bp, C. elegans
acaatttcataaa

SEQ ID NO: 697981 - DNA, 13 bp, C. elegans
acaatttcatttt

SEQ ID NO: 697982 - DNA, 13 bp, C. elegans
acaatttccaatt

SEQ ID NO: 697983 - DNA, 13 bp, C. elegans
acaatttccattt

SEQ ID NO: 697984 - DNA, 13 bp, C. elegans
acaatttccctac

SEQ ID NO: 697985 - DNA, 13 bp, C. elegans
acaatttcgagtc

SEQ ID NO: 697986 - DNA, 13 bp, C. elegans
acaatttctaatc

SEQ ID NO: 697987 - DNA, 13 bp, C. elegans
acaatttctcatt

SEQ ID NO: 697988 - DNA, 13 bp, C. elegans
acaatttctgaaa

SEQ ID NO: 697989 - DNA, 13 bp, C. elegans
acaatttctggaa

SEQ ID NO: 697990 - DNA, 13 bp, C. elegans
acaatttcttaaa

SEQ ID NO: 697991 - DNA, 13 bp, C. elegans
acaatttcttatt

SEQ ID NO: 697992 - DNA, 13 bp, C. elegans
acaatttcttcaa

SEQ ID NO: 697993 - DNA, 13 bp, C. elegans
acaatttgaaaaa

SEQ ID NO: 697994 - DNA, 13 bp, C. elegans
acaatttgaaaca

SEQ ID NO: 697995 - DNA, 13 bp, C. elegans
acaatttgaacaa

SEQ ID NO: 697996 - DNA, 13 bp, C. elegans
acaatttgaagaa

SEQ ID NO: 697997 - DNA, 13 bp, C. elegans
acaatttgacaat

SEQ ID NO: 697998 - DNA, 13 bp, C. elegans
acaatttgagaaa

SEQ ID NO: 697999 - DNA, 13 bp, C. elegans
acaatttgcattt

SEQ ID NO: 698000 - DNA, 13 bp, C. elegans
acaatttgttttc

SEQ ID NO: 698001 - DNA, 13 bp, C. elegans
acaattttaagat

SEQ ID NO: 698002 - DNA, 13 bp, C. elegans
acaattttaccaa

SEQ ID NO: 698003 - DNA, 13 bp, C. elegans
acaattttatcaa

SEQ ID NO: 698004 - DNA, 13 bp, C. elegans
acaattttatttc

SEQ ID NO: 698005 - DNA, 14 bp, C. elegans
acaattttcaaaaa

SEQ ID NO: 698006 - DNA, 13 bp, C. elegans
acaattttcaaat

SEQ ID NO: 698007 - DNA, 13 bp, C. elegans
acaattttcaact

SEQ ID NO: 698008 - DNA, 13 bp, C. elegans
acaattttcaatt

SEQ ID NO: 698009 - DNA, 13 bp, C. elegans
acaattttcactt

SEQ ID NO: 698010 - DNA, 13 bp, C. elegans
acaattttcataa

SEQ ID NO: 698011 - DNA, 13 bp, C. elegans
acaattttcatcg

SEQ ID NO: 698012 - DNA, 13 bp, C. elegans
acaattttcatga

SEQ ID NO: 698013 - DNA, 13 bp, C. elegans
acaattttcatgt

SEQ ID NO: 698014 - DNA, 13 bp, C. elegans
acaattttcattc

SEQ ID NO: 698015 - DNA, 13 bp, C. elegans
acaattttccgat

SEQ ID NO: 698016 - DNA, 13 bp, C. elegans
acaattttcctac

SEQ ID NO: 698017 - DNA, 13 bp, C. elegans
acaattttcgagt

SEQ ID NO: 698018 - DNA, 13 bp, C. elegans
acaattttctgat

SEQ ID NO: 698019 - DNA, 13 bp, C. elegans
acaattttctttg

SEQ ID NO: 698020 - DNA, 13 bp, C. elegans
acaattttgaaaa

SEQ ID NO: 698021 - DNA, 13 bp, C. elegans
acaattttgaaat

SEQ ID NO: 698022 - DNA, 13 bp, C. elegans
acaattttgaatt

SEQ ID NO: 698023 - DNA, 13 bp, C. elegans
acaattttgcaaa

SEQ ID NO: 698024 - DNA, 13 bp, C. elegans
acaattttgccaa

SEQ ID NO: 698025 - DNA, 13 bp, C. elegans
acaattttgctct

SEQ ID NO: 698026 - DNA, 13 bp, C. elegans
acaattttgtgaa

SEQ ID NO: 698027 - DNA, 13 bp, C. elegans
acaatttttacaa

SEQ ID NO: 698028 - DNA, 13 bp, C. elegans
acaatttttattg

SEQ ID NO: 698029 - DNA, 13 bp, C. elegans
acaatttttcaaa

SEQ ID NO: 698030 - DNA, 13 bp, C. elegans
acaatttttcaat

SEQ ID NO: 698031 - DNA, 13 bp, C. elegans
acaatttttctga

SEQ ID NO: 698032 - DNA, 13 bp, C. elegans
acaatttttgaaa

SEQ ID NO: 698033 - DNA, 13 bp, C. elegans
acaatttttgaat

SEQ ID NO: 698034 - DNA, 13 bp, C. elegans
acaatttttgcca

SEQ ID NO: 698035 - DNA, 13 bp, C. elegans
acaatttttggtt

SEQ ID NO: 698036 - DNA, 13 bp, C. elegans
acaatttttgtaa

SEQ ID NO: 698037 - DNA, 13 bp, C. elegans
acaatttttgtat

SEQ ID NO: 698038 - DNA, 13 bp, C. elegans
acaatttttgtga

SEQ ID NO: 698039 - DNA, 14 bp, C. elegans
acaattttttcaaa

SEQ ID NO: 698040 - DNA, 13 bp, C. elegans
acaatttttttag

SEQ ID NO: 698041 - DNA, 13 bp, C. elegans
acaatttttttga

SEQ ID NO: 698042 - DNA, 13 bp, C. elegans
acaatttttttgt

SEQ ID NO: 698043 - DNA, 13 bp, C. elegans
acacaaaaatgca

SEQ ID NO: 698044 - DNA, 13 bp, C. elegans
acacaaaaatgtc

SEQ ID NO: 698045 - DNA, 13 bp, C. elegans
acacaaaatctct

SEQ ID NO: 698046 - DNA, 13 bp, C. elegans
acacaaaatttgc

SEQ ID NO: 698047 - DNA, 13 bp, C. elegans
acacaaaatttta

SEQ ID NO: 698048 - DNA, 14 bp, C. elegans
acacaaacgctaca

SEQ ID NO: 698049 - DNA, 13 bp, C. elegans
acacaaatatcga

SEQ ID NO: 698050 - DNA, 13 bp, C. elegans
acacaaatcgtct

SEQ ID NO: 698051 - DNA, 13 bp, C. elegans
acacaaatctcgt

SEQ ID NO: 698052 - DNA, 13 bp, C. elegans
acacaaattaatt

SEQ ID NO: 698053 - DNA, 13 bp, C. elegans
acacaaattgttt

SEQ ID NO: 698054 - DNA, 13 bp, C. elegans
acacaagaaacat

SEQ ID NO: 698055 - DNA, 13 bp, C. elegans
acacaaggaaacc

SEQ ID NO: 698056 - DNA, 13 bp, C. elegans
acacaatatttaa

SEQ ID NO: 698057 - DNA, 13 bp, C. elegans
acacaattatttt

SEQ ID NO: 698058 - DNA, 13 bp, C. elegans
acacaattgtttt

SEQ ID NO: 698059 - DNA, 13 bp, C. elegans
acacaattttcaa

SEQ ID NO: 698060 - DNA, 13 bp, C. elegans
acacacacaaatt

SEQ ID NO: 698061 - DNA, 13 bp, C. elegans
acacacacagaga

SEQ ID NO: 698062 - DNA, 13 bp, C. elegans
acacacacattca

SEQ ID NO: 698063 - DNA, 14 bp, C. elegans
acacacacattttt

SEQ ID NO: 698064 - DNA, 13 bp, C. elegans
acacacactctct

SEQ ID NO: 698065 - DNA, 13 bp, C. elegans
acacacacttata

SEQ ID NO: 698066 - DNA, 13 bp, C. elegans
acacacagcggcg

SEQ ID NO: 698067 - DNA, 13 bp, C. elegans
acacacatacact

SEQ ID NO: 698068 - DNA, 13 bp, C. elegans
acacacatacata

SEQ ID NO: 698069 - DNA, 13 bp, C. elegans
acacactctctcg

SEQ ID NO: 698070 - DNA, 13 bp, C. elegans
acacactctctct

SEQ ID NO: 698071 - DNA, 13 bp, C. elegans
acacactttttat

SEQ ID NO: 698072 - DNA, 13 bp, C. elegans
acacacttttttc

SEQ ID NO: 698073 - DNA, 13 bp, C. elegans
acacagcattttg

SEQ ID NO: 698074 - DNA, 13 bp, C. elegans
acacagtttcaag

SEQ ID NO: 698075 - DNA, 13 bp, C. elegans
acacagtttttct

SEQ ID NO: 698076 - DNA, 13 bp, C. elegans
acacagttttttg

SEQ ID NO: 698077 - DNA, 13 bp, C. elegans
acacatacacacg

SEQ ID NO: 698078 - DNA, 13 bp, C. elegans
acacatacacatt

SEQ ID NO: 698079 - DNA, 13 bp, C. elegans
acacatattttgt

SEQ ID NO: 698080 - DNA, 13 bp, C. elegans
acacatatttttg

SEQ ID NO: 698081 - DNA, 13 bp, C. elegans
acacatgtttttg

SEQ ID NO: 698082 - DNA, 13 bp, C. elegans
acacattcaattt

SEQ ID NO: 698083 - DNA, 13 bp, C. elegans
acacatttattga

SEQ ID NO: 698084 - DNA, 13 bp, C. elegans
acacatttgaaaa

SEQ ID NO: 698085 - DNA, 13 bp, C. elegans
acacattttctca

SEQ ID NO: 698086 - DNA, 13 bp, C. elegans
acacattttgcaa

SEQ ID NO: 698087 - DNA, 13 bp, C. elegans
acacatttttaga

SEQ ID NO: 698088 - DNA, 13 bp, C. elegans
acacatttttcaa

SEQ ID NO: 698089 - DNA, 13 bp, C. elegans
acacatttttggc

SEQ ID NO: 698090 - DNA, 13 bp, C. elegans
acacattttttat

SEQ ID NO: 698091 - DNA, 13 bp, C. elegans
acaccaaaaaatg

SEQ ID NO: 698092 - DNA, 13 bp, C. elegans
acaccaccttcaa

SEQ ID NO: 698093 - DNA, 13 bp, C. elegans
acaccacctttaa

SEQ ID NO: 698094 - DNA, 13 bp, C. elegans
acaccacgtgatt

SEQ ID NO: 698095 - DNA, 13 bp, C. elegans
acaccacgtggat

SEQ ID NO: 698096 - DNA, 13 bp, C. elegans
acaccgagaagtt

SEQ ID NO: 698097 - DNA, 13 bp, C. elegans
acaccgcttcaaa

SEQ ID NO: 698098 - DNA, 13 bp, C. elegans
acaccgtcacgtc

SEQ ID NO: 698099 - DNA, 13 bp, C. elegans
acacctcgcgggt

SEQ ID NO: 698100 - DNA, 13 bp, C. elegans
acacgaaacttgt

SEQ ID NO: 698101 - DNA, 13 bp, C. elegans
acacgattttcaa

SEQ ID NO: 698102 - DNA, 13 bp, C. elegans
acacggaaaagtt

SEQ ID NO: 698103 - DNA, 13 bp, C. elegans
acacggaattctg

SEQ ID NO: 698104 - DNA, 13 bp, C. elegans
acacgtcaaaaat

SEQ ID NO: 698105 - DNA, 15 bp, C. elegans
acacgtgcggcacgg

SEQ ID NO: 698106 - DNA, 13 bp, C. elegans
acacgtggtgcca

SEQ ID NO: 698107 - DNA, 13 bp, C. elegans
acacgttgaaaaa

SEQ ID NO: 698108 - DNA, 13 bp, C. elegans
acactaaatttta

SEQ ID NO: 698109 - DNA, 13 bp, C. elegans
acactatttctct

SEQ ID NO: 698110 - DNA, 13 bp, C. elegans
acactattttctc

SEQ ID NO: 698111 - DNA, 13 bp, C. elegans
acactattttgta

SEQ ID NO: 698112 - DNA, 13 bp, C. elegans
acactcaattttt

SEQ ID NO: 698113 - DNA, 13 bp, C. elegans
acactccgttatt

SEQ ID NO: 698114 - DNA, 33 bp, C. elegans
acactcggcatttattagaggctgcttggcaga

SEQ ID NO: 698115 - DNA, 13 bp, C. elegans
acactctctcacc

SEQ ID NO: 698116 - DNA, 13 bp, C. elegans
acactgaaaaaat

SEQ ID NO: 698117 - DNA, 13 bp, C. elegans
acactgaaaacat

SEQ ID NO: 698118 - DNA, 13 bp, C. elegans
acactgaaaatca

SEQ ID NO: 698119 - DNA, 13 bp, C. elegans
acactgaacattt

SEQ ID NO: 698120 - DNA, 15 bp, C. elegans
acactgcaacttttt

SEQ ID NO: 698121 - DNA, 13 bp, C. elegans
acactgcctggtg

SEQ ID NO: 698122 - DNA, 13 bp, C. elegans
acacttataaata

SEQ ID NO: 698123 - DNA, 13 bp, C. elegans
acacttccagaat

SEQ ID NO: 698124 - DNA, 13 bp, C. elegans
acacttcgttttc

SEQ ID NO: 698125 - DNA, 13 bp, C. elegans
acacttgcaaaaa

SEQ ID NO: 698126 - DNA, 13 bp, C. elegans
acacttgttcata

SEQ ID NO: 698127 - DNA, 13 bp, C. elegans
acactttcaaaca

SEQ ID NO: 698128 - DNA, 13 bp, C. elegans
acactttcaaatg

SEQ ID NO: 698129 - DNA, 13 bp, C. elegans
acactttcaattt

SEQ ID NO: 698130 - DNA, 13 bp, C. elegans
acactttccaaaa

SEQ ID NO: 698131 - DNA, 13 bp, C. elegans
acactttccaatt

SEQ ID NO: 698132 - DNA, 13 bp, C. elegans
acactttctcatt

SEQ ID NO: 698133 - DNA, 13 bp, C. elegans
acactttgatctt

SEQ ID NO: 698134 - DNA, 13 bp, C. elegans
acactttgttttt

SEQ ID NO: 698135 - DNA, 13 bp, C. elegans
acacttttaaagt

SEQ ID NO: 698136 - DNA, 13 bp, C. elegans
acacttttgtatt

SEQ ID NO: 698137 - DNA, 13 bp, C. elegans
acacttttgtttt

SEQ ID NO: 698138 - DNA, 13 bp, C. elegans
acactttttcaaa

SEQ ID NO: 698139 - DNA, 13 bp, C. elegans
acactttttcact

SEQ ID NO: 698140 - DNA, 13 bp, C. elegans
acactttttctga

SEQ ID NO: 698141 - DNA, 13 bp, C. elegans
acactttttgaaa

SEQ ID NO: 698142 - DNA, 13 bp, C. elegans
acactttttgata

SEQ ID NO: 698143 - DNA, 13 bp, C. elegans
acactttttgggt

SEQ ID NO: 698144 - DNA, 13 bp, C. elegans
acacttttttaat

SEQ ID NO: 698145 - DNA, 13 bp, C. elegans
acacttttttcag

SEQ ID NO: 698146 - DNA, 13 bp, C. elegans
acacttttttcta

SEQ ID NO: 698147 - DNA, 13 bp, C. elegans
acacttttttgtt

SEQ ID NO: 698148 - DNA, 13 bp, C. elegans
acagaaaaaatcg

SEQ ID NO: 698149 - DNA, 13 bp, C. elegans
acagaaaaagtga

SEQ ID NO: 698150 - DNA, 13 bp, C. elegans
acagaaaaattgt

SEQ ID NO: 698151 - DNA, 13 bp, C. elegans
acagaaaacattc

SEQ ID NO: 698152 - DNA, 13 bp, C. elegans
acagaaaacattt

SEQ ID NO: 698153 - DNA, 13 bp, C. elegans
acagaaaacttgt

SEQ ID NO: 698154 - DNA, 13 bp, C. elegans
acagaaaatcact

SEQ ID NO: 698155 - DNA, 13 bp, C. elegans
acagaaaatctga

SEQ ID NO: 698156 - DNA, 13 bp, C. elegans
acagaaaatgcaa

SEQ ID NO: 698157 - DNA, 13 bp, C. elegans
acagaaaattaca

SEQ ID NO: 698158 - DNA, 13 bp, C. elegans
acagaaatagagg

SEQ ID NO: 698159 - DNA, 13 bp, C. elegans
acagaaattcaaa

SEQ ID NO: 698160 - DNA, 13 bp, C. elegans
acagaaattcatt

SEQ ID NO: 698161 - DNA, 13 bp, C. elegans
acagaaatttgaa

SEQ ID NO: 698162 - DNA, 13 bp, C. elegans
acagaaatttttt

SEQ ID NO: 698163 - DNA, 13 bp, C. elegans
acagaacattcat

SEQ ID NO: 698164 - DNA, 13 bp, C. elegans
acagaagctgtcg

SEQ ID NO: 698165 - DNA, 13 bp, C. elegans
acagaagttcaaa

SEQ ID NO: 698166 - DNA, 13 bp, C. elegans
acagaatcagaaa

SEQ ID NO: 698167 - DNA, 13 bp, C. elegans
acagaatggacaa

SEQ ID NO: 698168 - DNA, 13 bp, C. elegans
acagaatttgaac

SEQ ID NO: 698169 - DNA, 13 bp, C. elegans
acagagaaaatat

SEQ ID NO: 698170 - DNA, 13 bp, C. elegans
acagagaaatttg

SEQ ID NO: 698171 - DNA, 13 bp, C. elegans
acagagtcaaagc

SEQ ID NO: 698172 - DNA, 13 bp, C. elegans
acagatgtataga

SEQ ID NO: 698173 - DNA, 13 bp, C. elegans
acagatttttcaa

SEQ ID NO: 698174 - DNA, 13 bp, C. elegans
acagcaaaaatgt

SEQ ID NO: 698175 - DNA, 13 bp, C. elegans
acagcaagccatt

SEQ ID NO: 698176 - DNA, 13 bp, C. elegans
acagcagcagcag

SEQ ID NO: 698177 - DNA, 13 bp, C. elegans
acagcagccgaca

SEQ ID NO: 698178 - DNA, 13 bp, C. elegans
acagcgttttttt

SEQ ID NO: 698179 - DNA, 13 bp, C. elegans
acagctcaaaaat

SEQ ID NO: 698180 - DNA, 13 bp, C. elegans
acagctgaaaatt

SEQ ID NO: 698181 - DNA, 13 bp, C. elegans
acagctgaaactg

SEQ ID NO: 698182 - DNA, 13 bp, C. elegans
acagcttcaaaaa

SEQ ID NO: 698183 - DNA, 13 bp, C. elegans
acagcttttccca

SEQ ID NO: 698184 - DNA, 13 bp, C. elegans
acaggaattcaaa

SEQ ID NO: 698185 - DNA, 22 bp, C. elegans
acaggattgtactcattattga

SEQ ID NO: 698186 - DNA, 14 bp, C. elegans
acaggtatatacag

SEQ ID NO: 698187 - DNA, 13 bp, C. elegans
acagtaaattttt

SEQ ID NO: 698188 - DNA, 13 bp, C. elegans
acagtaacccgat

SEQ ID NO: 698189 - DNA, 13 bp, C. elegans
acagtaacttttt

SEQ ID NO: 698190 - DNA, 13 bp, C. elegans
acagtaatccaac

SEQ ID NO: 698191 - DNA, 13 bp, C. elegans
acagtaatccttt

SEQ ID NO: 698192 - DNA, 13 bp, C. elegans
acagtaattctac

SEQ ID NO: 698193 - DNA, 13 bp, C. elegans
acagtaattctta

SEQ ID NO: 698194 - DNA, 13 bp, C. elegans
acagtaatttcaa

SEQ ID NO: 698195 - DNA, 13 bp, C. elegans
acagtacccatac

SEQ ID NO: 698196 - DNA, 13 bp, C. elegans
acagtaccccaac

SEQ ID NO: 698197 - DNA, 13 bp, C. elegans
acagtacccttta

SEQ ID NO: 698198 - DNA, 13 bp, C. elegans
acagtacttttac

SEQ ID NO: 698199 - DNA, 13 bp, C. elegans
acagtagacattt

SEQ ID NO: 698200 - DNA, 13 bp, C. elegans
acagtattttcga

SEQ ID NO: 698201 - DNA, 13 bp, C. elegans
acagtatttttaa

SEQ ID NO: 698202 - DNA, 13 bp, C. elegans
acagtcattagat

SEQ ID NO: 698203 - DNA, 13 bp, C. elegans
acagtgaaaaagt

SEQ ID NO: 698204 - DNA, 13 bp, C. elegans
acagtgatttcaa

SEQ ID NO: 698205 - DNA, 13 bp, C. elegans
acagtgcaatttt

SEQ ID NO: 698206 - DNA, 13 bp, C. elegans
acagtgtatttgt

SEQ ID NO: 698207 - DNA, 13 bp, C. elegans
acagtgtattttt

SEQ ID NO: 698208 - DNA, 13 bp, C. elegans
acagtgtcgagaa

SEQ ID NO: 698209 - DNA, 13 bp, C. elegans
acagttaaatttt

SEQ ID NO: 698210 - DNA, 13 bp, C. elegans
acagttagaaaaa

SEQ ID NO: 698211 - DNA, 13 bp, C. elegans
acagttatattcg

SEQ ID NO: 698212 - DNA, 13 bp, C. elegans
acagttatatttg

SEQ ID NO: 698213 - DNA, 13 bp, C. elegans
acagttattttat

SEQ ID NO: 698214 - DNA, 13 bp, C. elegans
acagttgaaaaat

SEQ ID NO: 698215 - DNA, 13 bp, C. elegans
acagttgtgacgt

SEQ ID NO: 698216 - DNA, 13 bp, C. elegans
acagtttcaagtg

SEQ ID NO: 698217 - DNA, 13 bp, C. elegans
acagtttcaattt

SEQ ID NO: 698218 - DNA, 13 bp, C. elegans
acagtttccaaaa

SEQ ID NO: 698219 - DNA, 13 bp, C. elegans
acagtttgaaaca

SEQ ID NO: 698220 - DNA, 13 bp, C. elegans
acagtttgaaata

SEQ ID NO: 698221 - DNA, 13 bp, C. elegans
acagttttaagaa

SEQ ID NO: 698222 - DNA, 13 bp, C. elegans
acagttttaatat

SEQ ID NO: 698223 - DNA, 13 bp, C. elegans
acagttttacgca

SEQ ID NO: 698224 - DNA, 13 bp, C. elegans
acagttttattca

SEQ ID NO: 698225 - DNA, 13 bp, C. elegans
acagttttatttt

SEQ ID NO: 698226 - DNA, 13 bp, C. elegans
acagttttgaaaa

SEQ ID NO: 698227 - DNA, 13 bp, C. elegans
acagttttgaaac

SEQ ID NO: 698228 - DNA, 13 bp, C. elegans
acagttttgcaaa

SEQ ID NO: 698229 - DNA, 13 bp, C. elegans
acagttttggaaa

SEQ ID NO: 698230 - DNA, 13 bp, C. elegans
acagttttgtttt

SEQ ID NO: 698231 - DNA, 13 bp, C. elegans
acagtttttctgt

SEQ ID NO: 698232 - DNA, 13 bp, C. elegans
acagttttttctt

SEQ ID NO: 698233 - DNA, 13 bp, C. elegans
acagttttttgta

SEQ ID NO: 698234 - DNA, 13 bp, C. elegans
acagttttttttc

SEQ ID NO: 698235 - DNA, 13 bp, C. elegans
acataaaactgga

SEQ ID NO: 698236 - DNA, 13 bp, C. elegans
acataacattttt

SEQ ID NO: 698237 - DNA, 14 bp, C. elegans
acataagattcgag

SEQ ID NO: 698238 - DNA, 13 bp, C. elegans
acataatatttga

SEQ ID NO: 698239 - DNA, 13 bp, C. elegans
acataatattttc

SEQ ID NO: 698240 - DNA, 13 bp, C. elegans
acataatttgatt

SEQ ID NO: 698241 - DNA, 13 bp, C. elegans
acataattttcaa

SEQ ID NO: 698242 - DNA, 13 bp, C. elegans
acataattttcat

SEQ ID NO: 698243 - DNA, 13 bp, C. elegans
acatacaattttt

SEQ ID NO: 698244 - DNA, 13 bp, C. elegans
acatacacacact

SEQ ID NO: 698245 - DNA, 13 bp, C. elegans
acatacatataat

SEQ ID NO: 698246 - DNA, 13 bp, C. elegans
acatacatataca

SEQ ID NO: 698247 - DNA, 13 bp, C. elegans
acatacatttaaa

SEQ ID NO: 698248 - DNA, 13 bp, C. elegans
acatactacatac

SEQ ID NO: 698249 - DNA, 13 bp, C. elegans
acatactgaaaca

SEQ ID NO: 698250 - DNA, 13 bp, C. elegans
acatagaaaattg

SEQ ID NO: 698251 - DNA, 13 bp, C. elegans
acatagtttttga

SEQ ID NO: 698252 - DNA, 13 bp, C. elegans
acatataagttca

SEQ ID NO: 698253 - DNA, 13 bp, C. elegans
acatatacacaca

SEQ ID NO: 698254 - DNA, 13 bp, C. elegans
acatatacataca

SEQ ID NO: 698255 - DNA, 13 bp, C. elegans
acatatacttttt

SEQ ID NO: 698256 - DNA, 13 bp, C. elegans
acatatattattc

SEQ ID NO: 698257 - DNA, 13 bp, C. elegans
acatatattcaat

SEQ ID NO: 698258 - DNA, 14 bp, C. elegans
acatatatttcccc

SEQ ID NO: 698259 - DNA, 13 bp, C. elegans
acatatattttga

SEQ ID NO: 698260 - DNA, 13 bp, C. elegans
acatatcactttt

SEQ ID NO: 698261 - DNA, 13 bp, C. elegans
acatatcagggag

SEQ ID NO: 698262 - DNA, 13 bp, C. elegans
acatatgtatttt

SEQ ID NO: 698263 - DNA, 13 bp, C. elegans
acatattcaattt

SEQ ID NO: 698264 - DNA, 13 bp, C. elegans
acatatttcaaaa

SEQ ID NO: 698265 - DNA, 13 bp, C. elegans
acatatttcaaat

SEQ ID NO: 698266 - DNA, 13 bp, C. elegans
acatatttcattt

SEQ ID NO: 698267 - DNA, 13 bp, C. elegans
acatatttctgaa

SEQ ID NO: 698268 - DNA, 13 bp, C. elegans
acatatttgaaaa

SEQ ID NO: 698269 - DNA, 13 bp, C. elegans
acatattttctct

SEQ ID NO: 698270 - DNA, 13 bp, C. elegans
acatattttgtga

SEQ ID NO: 698271 - DNA, 13 bp, C. elegans
acatatttttcaa

SEQ ID NO: 698272 - DNA, 13 bp, C. elegans
acatatttttcga

SEQ ID NO: 698273 - DNA, 13 bp, C. elegans
acatatttttgca

SEQ ID NO: 698274 - DNA, 13 bp, C. elegans
acatatttttggg

SEQ ID NO: 698275 - DNA, 13 bp, C. elegans
acatatttttgta

SEQ ID NO: 698276 - DNA, 13 bp, C. elegans
acatatttttgtg

SEQ ID NO: 698277 - DNA, 13 bp, C. elegans
acatcaaaaattt

SEQ ID NO: 698278 - DNA, 13 bp, C. elegans
acatcaaattatt

SEQ ID NO: 698279 - DNA, 13 bp, C. elegans
acatcaaatttca

SEQ ID NO: 698280 - DNA, 13 bp, C. elegans
acatcaaatttga

SEQ ID NO: 698281 - DNA, 13 bp, C. elegans
acatcaacttttt

SEQ ID NO: 698282 - DNA, 13 bp, C. elegans
acatcaattttaa

SEQ ID NO: 698283 - DNA, 13 bp, C. elegans
acatcacatgaat

SEQ ID NO: 698284 - DNA, 13 bp, C. elegans
acatcacattttg

SEQ ID NO: 698285 - DNA, 14 bp, C. elegans
acatcatcatcatc

SEQ ID NO: 698286 - DNA, 13 bp, C. elegans
acatcatttttaa

SEQ ID NO: 698287 - DNA, 13 bp, C. elegans
acatcatttttct

SEQ ID NO: 698288 - DNA, 13 bp, C. elegans
acatccaaaattg

SEQ ID NO: 698289 - DNA, 13 bp, C. elegans
acatcgaactatt

SEQ ID NO: 698290 - DNA, 13 bp, C. elegans
acatcgtgttcta

SEQ ID NO: 698291 - DNA, 13 bp, C. elegans
acatctaaaaatc

SEQ ID NO: 698292 - DNA, 13 bp, C. elegans
acatctgaaaaat

SEQ ID NO: 698293 - DNA, 13 bp, C. elegans
acatctgaaaatt

SEQ ID NO: 698294 - DNA, 13 bp, C. elegans
acatctgcaaaaa

SEQ ID NO: 698295 - DNA, 13 bp, C. elegans
acatcttcaaaat

SEQ ID NO: 698296 - DNA, 13 bp, C. elegans
acatcttcccaaa

SEQ ID NO: 698297 - DNA, 13 bp, C. elegans
acatcttgcaaat

SEQ ID NO: 698298 - DNA, 13 bp, C. elegans
acatctttaaatt

SEQ ID NO: 698299 - DNA, 13 bp, C. elegans
acatctttcaaaa

SEQ ID NO: 698300 - DNA, 13 bp, C. elegans
acatcttttttgt

SEQ ID NO: 698301 - DNA, 13 bp, C. elegans
acatgaaaaagag

SEQ ID NO: 698302 - DNA, 13 bp, C. elegans
acatgaaaacaat

SEQ ID NO: 698303 - DNA, 13 bp, C. elegans
acatgaaaacatt

SEQ ID NO: 698304 - DNA, 13 bp, C. elegans
acatgaaaattat

SEQ ID NO: 698305 - DNA, 13 bp, C. elegans
acatgaaaatttc

SEQ ID NO: 698306 - DNA, 13 bp, C. elegans
acatgaaaatttg

SEQ ID NO: 698307 - DNA, 13 bp, C. elegans
acatgaaacattt

SEQ ID NO: 698308 - DNA, 13 bp, C. elegans
acatgaaactttt

SEQ ID NO: 698309 - DNA, 13 bp, C. elegans
acatgaaattcgt

SEQ ID NO: 698310 - DNA, 13 bp, C. elegans
acatgaaatttga

SEQ ID NO: 698311 - DNA, 13 bp, C. elegans
acatgaaattttg

SEQ ID NO: 698312 - DNA, 13 bp, C. elegans
acatgcaattttc

SEQ ID NO: 698313 - DNA, 13 bp, C. elegans
acatgccacaatt

SEQ ID NO: 698314 - DNA, 13 bp, C. elegans
acatggaagccct

SEQ ID NO: 698315 - DNA, 13 bp, C. elegans
acatggtgcatca

SEQ ID NO: 698316 - DNA, 14 bp, C. elegans
acatgtatttaaat

SEQ ID NO: 698317 - DNA, 13 bp, C. elegans
acatgtatttatt

SEQ ID NO: 698318 - DNA, 13 bp, C. elegans
acatgttaaaaaa

SEQ ID NO: 698319 - DNA, 13 bp, C. elegans
acatgttactttt

SEQ ID NO: 698320 - DNA, 13 bp, C. elegans
acatgttccaaaa

SEQ ID NO: 698321 - DNA, 13 bp, C. elegans
acatgttcttttt

SEQ ID NO: 698322 - DNA, 13 bp, C. elegans
acatgtttcattt

SEQ ID NO: 698323 - DNA, 13 bp, C. elegans
acatgtttgtttt

SEQ ID NO: 698324 - DNA, 13 bp, C. elegans
acatgttttatgt

SEQ ID NO: 698325 - DNA, 13 bp, C. elegans
acatgtttttcta

SEQ ID NO: 698326 - DNA, 13 bp, C. elegans
acatgtttttctc

SEQ ID NO: 698327 - DNA, 13 bp, C. elegans
acatgtttttgat

SEQ ID NO: 698328 - DNA, 13 bp, C. elegans
acatgtttttgtt

SEQ ID NO: 698329 - DNA, 13 bp, C. elegans
acattaattgaaa

SEQ ID NO: 698330 - DNA, 13 bp, C. elegans
acattacaaattt

SEQ ID NO: 698331 - DNA, 51 bp, C. elegans
acattagatatacggtgtctatcgcggacctcgatcgatgtctgctgcgca

SEQ ID NO: 698332 - DNA, 13 bp, C. elegans
acattattagaaa

SEQ ID NO: 698333 - DNA, 13 bp, C. elegans
acattattgattt

SEQ ID NO: 698334 - DNA, 13 bp, C. elegans
acattatttctca

SEQ ID NO: 698335 - DNA, 13 bp, C. elegans
acattattttatg

SEQ ID NO: 698336 - DNA, 13 bp, C. elegans
acattattttgat

SEQ ID NO: 698337 - DNA, 13 bp, C. elegans
acattatttttcc

SEQ ID NO: 698338 - DNA, 13 bp, C. elegans
acattcaaaaagt

SEQ ID NO: 698339 - DNA, 13 bp, C. elegans
acattcaaaagtt

SEQ ID NO: 698340 - DNA, 13 bp, C. elegans
acattcaaaatca

SEQ ID NO: 698341 - DNA, 13 bp, C. elegans
acattcaaaattt

SEQ ID NO: 698342 - DNA, 13 bp, C. elegans
acattcaaagttt

SEQ ID NO: 698343 - DNA, 13 bp, C. elegans
acattcaaatgtt

SEQ ID NO: 698344 - DNA, 13 bp, C. elegans
acattcaaattca

SEQ ID NO: 698345 - DNA, 13 bp, C. elegans
acattcaaattga

SEQ ID NO: 698346 - DNA, 13 bp, C. elegans
acattcaaattta

SEQ ID NO: 698347 - DNA, 13 bp, C. elegans
acattcaaatttt

SEQ ID NO: 698348 - DNA, 13 bp, C. elegans
acattcaacattt

SEQ ID NO: 698349 - DNA, 13 bp, C. elegans
acattcaattgaa

SEQ ID NO: 698350 - DNA, 13 bp, C. elegans
acattcacatttt

SEQ ID NO: 698351 - DNA, 13 bp, C. elegans
acattcacttttt

SEQ ID NO: 698352 - DNA, 13 bp, C. elegans
acattcataagat

SEQ ID NO: 698353 - DNA, 13 bp, C. elegans
acattccaaaaat

SEQ ID NO: 698354 - DNA, 13 bp, C. elegans
acattccaaaatt

SEQ ID NO: 698355 - DNA, 13 bp, C. elegans
acattgaaaaaat

SEQ ID NO: 698356 - DNA, 13 bp, C. elegans
acattgaaaaact

SEQ ID NO: 698357 - DNA, 13 bp, C. elegans
acattgaaaagtt

SEQ ID NO: 698358 - DNA, 13 bp, C. elegans
acattgaaaatta

SEQ ID NO: 698359 - DNA, 13 bp, C. elegans
acattgaaacttt

SEQ ID NO: 698360 - DNA, 13 bp, C. elegans
acattgaaagctt

SEQ ID NO: 698361 - DNA, 13 bp, C. elegans
acattgaaatgaa

SEQ ID NO: 698362 - DNA, 13 bp, C. elegans
acattgaaatttt

SEQ ID NO: 698363 - DNA, 13 bp, C. elegans
acattgaatattt

SEQ ID NO: 698364 - DNA, 13 bp, C. elegans
acattgaatttaa

SEQ ID NO: 698365 - DNA, 13 bp, C. elegans
acattgaatttta

SEQ ID NO: 698366 - DNA, 13 bp, C. elegans
acattgatttttt

SEQ ID NO: 698367 - DNA, 13 bp, C. elegans
acattgcaaaaaa

SEQ ID NO: 698368 - DNA, 13 bp, C. elegans
acattgccaaaat

SEQ ID NO: 698369 - DNA, 13 bp, C. elegans
acattgccaattt

SEQ ID NO: 698370 - DNA, 13 bp, C. elegans
acattggaaaaag

SEQ ID NO: 698371 - DNA, 13 bp, C. elegans
acattgttcaaaa

SEQ ID NO: 698372 - DNA, 14 bp, C. elegans
acattgttttaatt

SEQ ID NO: 698373 - DNA, 13 bp, C. elegans
acattgtttttca

SEQ ID NO: 698374 - DNA, 13 bp, C. elegans
acatttaaaattg

SEQ ID NO: 698375 - DNA, 13 bp, C. elegans
acatttaaacttc

SEQ ID NO: 698376 - DNA, 13 bp, C. elegans
acatttaaagaat

SEQ ID NO: 698377 - DNA, 13 bp, C. elegans
acatttaaagttt

SEQ ID NO: 698378 - DNA, 13 bp, C. elegans
acatttaaattag

SEQ ID NO: 698379 - DNA, 13 bp, C. elegans
acatttaattttc

SEQ ID NO: 698380 - DNA, 13 bp, C. elegans
acatttactttta

SEQ ID NO: 698381 - DNA, 13 bp, C. elegans
acatttatagaat

SEQ ID NO: 698382 - DNA, 13 bp, C. elegans
acatttatcaaaa

SEQ ID NO: 698383 - DNA, 13 bp, C. elegans
acatttatcaagg

SEQ ID NO: 698384 - DNA, 13 bp, C. elegans
acatttatcattt

SEQ ID NO: 698385 - DNA, 13 bp, C. elegans
acatttatggtca

SEQ ID NO: 698386 - DNA, 13 bp, C. elegans
acatttattattg

SEQ ID NO: 698387 - DNA, 13 bp, C. elegans
acatttattcatt

SEQ ID NO: 698388 - DNA, 13 bp, C. elegans
acatttatttcaa

SEQ ID NO: 698389 - DNA, 13 bp, C. elegans
acatttatttgca

SEQ ID NO: 698390 - DNA, 13 bp, C. elegans
acatttcaaagtt

SEQ ID NO: 698391 - DNA, 13 bp, C. elegans
acatttcaactga

SEQ ID NO: 698392 - DNA, 13 bp, C. elegans
acatttcaagaat

SEQ ID NO: 698393 - DNA, 13 bp, C. elegans
acatttcaatgaa

SEQ ID NO: 698394 - DNA, 13 bp, C. elegans
acatttcaatgtt

SEQ ID NO: 698395 - DNA, 13 bp, C. elegans
acatttcaattgt

SEQ ID NO: 698396 - DNA, 13 bp, C. elegans
acatttcacaaaa

SEQ ID NO: 698397 - DNA, 13 bp, C. elegans
acatttcagattt

SEQ ID NO: 698398 - DNA, 13 bp, C. elegans
acatttcataagt

SEQ ID NO: 698399 - DNA, 13 bp, C. elegans
acatttccaaatt

SEQ ID NO: 698400 - DNA, 13 bp, C. elegans
acatttccacaaa

SEQ ID NO: 698401 - DNA, 13 bp, C. elegans
acatttccataat

SEQ ID NO: 698402 - DNA, 13 bp, C. elegans
acatttccatttt

SEQ ID NO: 698403 - DNA, 13 bp, C. elegans
acatttccgattt

SEQ ID NO: 698404 - DNA, 13 bp, C. elegans
acatttcgaaaaa

SEQ ID NO: 698405 - DNA, 13 bp, C. elegans
acatttcgaaact

SEQ ID NO: 698406 - DNA, 13 bp, C. elegans
acatttcgagaat

SEQ ID NO: 698407 - DNA, 13 bp, C. elegans
acatttcggaatt

SEQ ID NO: 698408 - DNA, 13 bp, C. elegans
acatttctaaaaa

SEQ ID NO: 698409 - DNA, 13 bp, C. elegans
acatttctaaaca

SEQ ID NO: 698410 - DNA, 13 bp, C. elegans
acatttctaaatt

SEQ ID NO: 698411 - DNA, 13 bp, C. elegans
acatttctatttc

SEQ ID NO: 698412 - DNA, 13 bp, C. elegans
acatttctcaagt

SEQ ID NO: 698413 - DNA, 13 bp, C. elegans
acatttctcaatt

SEQ ID NO: 698414 - DNA, 13 bp, C. elegans
acatttctcgatt

SEQ ID NO: 698415 - DNA, 13 bp, C. elegans
acatttctgaaat

SEQ ID NO: 698416 - DNA, 13 bp, C. elegans
acatttctgaaca

SEQ ID NO: 698417 - DNA, 13 bp, C. elegans
acatttctgaatt

SEQ ID NO: 698418 - DNA, 13 bp, C. elegans
acatttctgtaaa

SEQ ID NO: 698419 - DNA, 13 bp, C. elegans
acatttcttcatt

SEQ ID NO: 698420 - DNA, 13 bp, C. elegans
acatttcttgaat

SEQ ID NO: 698421 - DNA, 13 bp, C. elegans
acatttctttaaa

SEQ ID NO: 698422 - DNA, 13 bp, C. elegans
acatttctttgga

SEQ ID NO: 698423 - DNA, 13 bp, C. elegans
acatttgaaatgt

SEQ ID NO: 698424 - DNA, 13 bp, C. elegans
acatttgaaattc

SEQ ID NO: 698425 - DNA, 13 bp, C. elegans
acatttgaaattt

SEQ ID NO: 698426 - DNA, 13 bp, C. elegans
acatttgaactct

SEQ ID NO: 698427 - DNA, 13 bp, C. elegans
acatttgaacttt

SEQ ID NO: 698428 - DNA, 13 bp, C. elegans
acatttgaagttg

SEQ ID NO: 698429 - DNA, 13 bp, C. elegans
acatttgaatatt

SEQ ID NO: 698430 - DNA, 13 bp, C. elegans
acatttgaatttc

SEQ ID NO: 698431 - DNA, 13 bp, C. elegans
acatttgaatttt

SEQ ID NO: 698432 - DNA, 13 bp, C. elegans
acatttgacaatt

SEQ ID NO: 698433 - DNA, 13 bp, C. elegans
acatttgagaaaa

SEQ ID NO: 698434 - DNA, 13 bp, C. elegans
acatttgagattt

SEQ ID NO: 698435 - DNA, 13 bp, C. elegans
acatttgatattc

SEQ ID NO: 698436 - DNA, 13 bp, C. elegans
acatttgatttca

SEQ ID NO: 698437 - DNA, 13 bp, C. elegans
acatttgcaacaa

SEQ ID NO: 698438 - DNA, 13 bp, C. elegans
acatttggaaaac

SEQ ID NO: 698439 - DNA, 13 bp, C. elegans
acatttggagcaa

SEQ ID NO: 698440 - DNA, 13 bp, C. elegans
acatttggagcca

SEQ ID NO: 698441 - DNA, 13 bp, C. elegans
acatttgtaaaaa

SEQ ID NO: 698442 - DNA, 13 bp, C. elegans
acatttgtaaatt

SEQ ID NO: 698443 - DNA, 13 bp, C. elegans
acatttgtcactc

SEQ ID NO: 698444 - DNA, 13 bp, C. elegans
acatttgttattt

SEQ ID NO: 698445 - DNA, 13 bp, C. elegans
acatttgttccca

SEQ ID NO: 698446 - DNA, 13 bp, C. elegans
acatttgttcttt

SEQ ID NO: 698447 - DNA, 13 bp, C. elegans
acatttgtttttc

SEQ ID NO: 698448 - DNA, 13 bp, C. elegans
acattttaaaaca

SEQ ID NO: 698449 - DNA, 13 bp, C. elegans
acattttaaacat

SEQ ID NO: 698450 - DNA, 13 bp, C. elegans
acattttaaactt

SEQ ID NO: 698451 - DNA, 13 bp, C. elegans
acattttaatact

SEQ ID NO: 698452 - DNA, 13 bp, C. elegans
acattttacaata

SEQ ID NO: 698453 - DNA, 13 bp, C. elegans
acattttacaatt

SEQ ID NO: 698454 - DNA, 13 bp, C. elegans
acattttatacaa

SEQ ID NO: 698455 - DNA, 13 bp, C. elegans
acattttatagaa

SEQ ID NO: 698456 - DNA, 13 bp, C. elegans
acattttatcaat

SEQ ID NO: 698457 - DNA, 13 bp, C. elegans
acattttattcaa

SEQ ID NO: 698458 - DNA, 13 bp, C. elegans
acattttattcga

SEQ ID NO: 698459 - DNA, 13 bp, C. elegans
acattttatttgg

SEQ ID NO: 698460 - DNA, 13 bp, C. elegans
acattttcaaatt

SEQ ID NO: 698461 - DNA, 13 bp, C. elegans
acattttcaagaa

SEQ ID NO: 698462 - DNA, 13 bp, C. elegans
acattttcaagtt

SEQ ID NO: 698463 - DNA, 13 bp, C. elegans
acattttcaatca

SEQ ID NO: 698464 - DNA, 13 bp, C. elegans
acattttcaatct

SEQ ID NO: 698465 - DNA, 13 bp, C. elegans
acattttcaattc

SEQ ID NO: 698466 - DNA, 13 bp, C. elegans
acattttcacaga

SEQ ID NO: 698467 - DNA, 13 bp, C. elegans
acattttcacata

SEQ ID NO: 698468 - DNA, 13 bp, C. elegans
acattttcagaaa

SEQ ID NO: 698469 - DNA, 13 bp, C. elegans
acattttcagaat

SEQ ID NO: 698470 - DNA, 13 bp, C. elegans
acattttcagatt

SEQ ID NO: 698471 - DNA, 13 bp, C. elegans
acattttcagccc

SEQ ID NO: 698472 - DNA, 13 bp, C. elegans
acattttcagttt

SEQ ID NO: 698473 - DNA, 13 bp, C. elegans
acattttcattat

SEQ ID NO: 698474 - DNA, 13 bp, C. elegans
acattttccaaaa

SEQ ID NO: 698475 - DNA, 13 bp, C. elegans
acattttccattc

SEQ ID NO: 698476 - DNA, 13 bp, C. elegans
acattttccattt

SEQ ID NO: 698477 - DNA, 13 bp, C. elegans
acattttcccaaa

SEQ ID NO: 698478 - DNA, 13 bp, C. elegans
acattttccccac

SEQ ID NO: 698479 - DNA, 13 bp, C. elegans
acattttccccct

SEQ ID NO: 698480 - DNA, 13 bp, C. elegans
acattttcctaca

SEQ ID NO: 698481 - DNA, 13 bp, C. elegans
acattttcgaata

SEQ ID NO: 698482 - DNA, 13 bp, C. elegans
acattttcgagtt

SEQ ID NO: 698483 - DNA, 13 bp, C. elegans
acattttcgatgt

SEQ ID NO: 698484 - DNA, 13 bp, C. elegans
acattttcgattt

SEQ ID NO: 698485 - DNA, 13 bp, C. elegans
acattttctaagc

SEQ ID NO: 698486 - DNA, 13 bp, C. elegans
acattttctcaaa

SEQ ID NO: 698487 - DNA, 13 bp, C. elegans
acattttctgatg

SEQ ID NO: 698488 - DNA, 13 bp, C. elegans
acattttcttaaa

SEQ ID NO: 698489 - DNA, 13 bp, C. elegans
acattttcttact

SEQ ID NO: 698490 - DNA, 13 bp, C. elegans
acattttgaaaac

SEQ ID NO: 698491 - DNA, 13 bp, C. elegans
acattttgaaata

SEQ ID NO: 698492 - DNA, 13 bp, C. elegans
acattttgaaatt

SEQ ID NO: 698493 - DNA, 13 bp, C. elegans
acattttgaacat

SEQ ID NO: 698494 - DNA, 13 bp, C. elegans
acattttgaactt

SEQ ID NO: 698495 - DNA, 13 bp, C. elegans
acattttgaagct

SEQ ID NO: 698496 - DNA, 13 bp, C. elegans
acattttgaagtg

SEQ ID NO: 698497 - DNA, 13 bp, C. elegans
acattttgaataa

SEQ ID NO: 698498 - DNA, 13 bp, C. elegans
acattttgaattt

SEQ ID NO: 698499 - DNA, 13 bp, C. elegans
acattttgacaaa

SEQ ID NO: 698500 - DNA, 13 bp, C. elegans
acattttgacaat

SEQ ID NO: 698501 - DNA, 13 bp, C. elegans
acattttgagcaa

SEQ ID NO: 698502 - DNA, 13 bp, C. elegans
acattttgagcca

SEQ ID NO: 698503 - DNA, 13 bp, C. elegans
acattttgagctt

SEQ ID NO: 698504 - DNA, 13 bp, C. elegans
acattttgattga

SEQ ID NO: 698505 - DNA, 13 bp, C. elegans
acattttgcattt

SEQ ID NO: 698506 - DNA, 13 bp, C. elegans
acattttgctctt

SEQ ID NO: 698507 - DNA, 13 bp, C. elegans
acattttggacca

SEQ ID NO: 698508 - DNA, 13 bp, C. elegans
acattttggtaaa

SEQ ID NO: 698509 - DNA, 13 bp, C. elegans
acattttgtaaat

SEQ ID NO: 698510 - DNA, 13 bp, C. elegans
acattttgtaata

SEQ ID NO: 698511 - DNA, 13 bp, C. elegans
acattttgtcagt

SEQ ID NO: 698512 - DNA, 13 bp, C. elegans
acattttgtgaaa

SEQ ID NO: 698513 - DNA, 13 bp, C. elegans
acattttgtgttt

SEQ ID NO: 698514 - DNA, 13 bp, C. elegans
acattttgttcat

SEQ ID NO: 698515 - DNA, 13 bp, C. elegans
acattttgttctc

SEQ ID NO: 698516 - DNA, 13 bp, C. elegans
acattttgtttta

SEQ ID NO: 698517 - DNA, 13 bp, C. elegans
acattttgttttc

SEQ ID NO: 698518 - DNA, 13 bp, C. elegans
acatttttaaaca

SEQ ID NO: 698519 - DNA, 13 bp, C. elegans
acatttttaacca

SEQ ID NO: 698520 - DNA, 13 bp, C. elegans
acatttttaagga

SEQ ID NO: 698521 - DNA, 13 bp, C. elegans
acatttttacact

SEQ ID NO: 698522 - DNA, 13 bp, C. elegans
acatttttaggca

SEQ ID NO: 698523 - DNA, 13 bp, C. elegans
acatttttataca

SEQ ID NO: 698524 - DNA, 13 bp, C. elegans
acatttttattca

SEQ ID NO: 698525 - DNA, 13 bp, C. elegans
acatttttcaaaa

SEQ ID NO: 698526 - DNA, 13 bp, C. elegans
acatttttcacaa

SEQ ID NO: 698527 - DNA, 13 bp, C. elegans
acatttttcacga

SEQ ID NO: 698528 - DNA, 13 bp, C. elegans
acatttttcactt

SEQ ID NO: 698529 - DNA, 13 bp, C. elegans
acatttttcagaa

SEQ ID NO: 698530 - DNA, 13 bp, C. elegans
acatttttcattg

SEQ ID NO: 698531 - DNA, 13 bp, C. elegans
acatttttcggtt

SEQ ID NO: 698532 - DNA, 13 bp, C. elegans
acatttttctaca

SEQ ID NO: 698533 - DNA, 13 bp, C. elegans
acatttttctctc

SEQ ID NO: 698534 - DNA, 13 bp, C. elegans
acatttttctgat

SEQ ID NO: 698535 - DNA, 13 bp, C. elegans
acatttttcttca

SEQ ID NO: 698536 - DNA, 13 bp, C. elegans
acatttttgaaaa

SEQ ID NO: 698537 - DNA, 13 bp, C. elegans
acatttttgaaga

SEQ ID NO: 698538 - DNA, 13 bp, C. elegans
acatttttgaatg

SEQ ID NO: 698539 - DNA, 13 bp, C. elegans
acatttttggaaa

SEQ ID NO: 698540 - DNA, 13 bp, C. elegans
acatttttggaca

SEQ ID NO: 698541 - DNA, 13 bp, C. elegans
acatttttggagt

SEQ ID NO: 698542 - DNA, 13 bp, C. elegans
acatttttggata

SEQ ID NO: 698543 - DNA, 13 bp, C. elegans
acatttttggcgg

SEQ ID NO: 698544 - DNA, 13 bp, C. elegans
acatttttgggaa

SEQ ID NO: 698545 - DNA, 13 bp, C. elegans
acatttttgtatg

SEQ ID NO: 698546 - DNA, 13 bp, C. elegans
acatttttgtatt

SEQ ID NO: 698547 - DNA, 13 bp, C. elegans
acatttttgttct

SEQ ID NO: 698548 - DNA, 13 bp, C. elegans
acatttttgtttg

SEQ ID NO: 698549 - DNA, 14 bp, C. elegans
acattttttaaaca

SEQ ID NO: 698550 - DNA, 13 bp, C. elegans
acattttttctca

SEQ ID NO: 698551 - DNA, 13 bp, C. elegans
acattttttgggc

SEQ ID NO: 698552 - DNA, 14 bp, C. elegans
acattttttgttga

SEQ ID NO: 698553 - DNA, 13 bp, C. elegans
acatttttttaca

SEQ ID NO: 698554 - DNA, 14 bp, C. elegans
acatttttttcaaa

SEQ ID NO: 698555 - DNA, 13 bp, C. elegans
acatttttttgag

SEQ ID NO: 698556 - DNA, 13 bp, C. elegans
acatttttttgga

SEQ ID NO: 698557 - DNA, 13 bp, C. elegans
acatttttttggg

SEQ ID NO: 698558 - DNA, 13 bp, C. elegans
accaaaaaaactg

SEQ ID NO: 698559 - DNA, 13 bp, C. elegans
accaaaaaacttc

SEQ ID NO: 698560 - DNA, 13 bp, C. elegans
accaaaaaagctt

SEQ ID NO: 698561 - DNA, 13 bp, C. elegans
accaaaaaagttg

SEQ ID NO: 698562 - DNA, 13 bp, C. elegans
accaaaaaattag

SEQ ID NO: 698563 - DNA, 13 bp, C. elegans
accaaaaaattgt

SEQ ID NO: 698564 - DNA, 13 bp, C. elegans
accaaaaacattt

SEQ ID NO: 698565 - DNA, 13 bp, C. elegans
accaaaaactatt

SEQ ID NO: 698566 - DNA, 13 bp, C. elegans
accaaaaactggg

SEQ ID NO: 698567 - DNA, 13 bp, C. elegans
accaaaaacttac

SEQ ID NO: 698568 - DNA, 13 bp, C. elegans
accaaaaagtttc

SEQ ID NO: 698569 - DNA, 13 bp, C. elegans
accaaaaattgat

SEQ ID NO: 698570 - DNA, 13 bp, C. elegans
accaaaaattttc

SEQ ID NO: 698571 - DNA, 13 bp, C. elegans
accaaaacttgaa

SEQ ID NO: 698572 - DNA, 13 bp, C. elegans
accaaaagctgta

SEQ ID NO: 698573 - DNA, 13 bp, C. elegans
accaaaagttgaa

SEQ ID NO: 698574 - DNA, 13 bp, C. elegans
accaaaatatgca

SEQ ID NO: 698575 - DNA, 13 bp, C. elegans
accaaaattctga

SEQ ID NO: 698576 - DNA, 13 bp, C. elegans
accaaaattggtc

SEQ ID NO: 698577 - DNA, 13 bp, C. elegans
accaaagatttct

SEQ ID NO: 698578 - DNA, 13 bp, C. elegans
accaaaggagtgg

SEQ ID NO: 698579 - DNA, 13 bp, C. elegans
accaaatgaatat

SEQ ID NO: 698580 - DNA, 13 bp, C. elegans
accaaatgtttta

SEQ ID NO: 698581 - DNA, 13 bp, C. elegans
accaaattggaaa

SEQ ID NO: 698582 - DNA, 13 bp, C. elegans
accaaatttccag

SEQ ID NO: 698583 - DNA, 13 bp, C. elegans
accaaatttgaat

SEQ ID NO: 698584 - DNA, 13 bp, C. elegans
accaaatttttaa

SEQ ID NO: 698585 - DNA, 13 bp, C. elegans
accaacaaaagtt

SEQ ID NO: 698586 - DNA, 13 bp, C. elegans
accaacaaatttt

SEQ ID NO: 698587 - DNA, 13 bp, C. elegans
accaacatttttt

SEQ ID NO: 698588 - DNA, 13 bp, C. elegans
accaacctaatat

SEQ ID NO: 698589 - DNA, 13 bp, C. elegans
accaacggaaaat

SEQ ID NO: 698590 - DNA, 13 bp, C. elegans
accaacttcaaat

SEQ ID NO: 698591 - DNA, 13 bp, C. elegans
accaacttccaac

SEQ ID NO: 698592 - DNA, 13 bp, C. elegans
accaacttgtcaa

SEQ ID NO: 698593 - DNA, 13 bp, C. elegans
accaacttttttc

SEQ ID NO: 698594 - DNA, 13 bp, C. elegans
accaagggtgtca

SEQ ID NO: 698595 - DNA, 13 bp, C. elegans
accaagtgcaaac

SEQ ID NO: 698596 - DNA, 13 bp, C. elegans
accaagtgtaaac

SEQ ID NO: 698597 - DNA, 13 bp, C. elegans
accaataaaatgt

SEQ ID NO: 698598 - DNA, 13 bp, C. elegans
accaataatattt

SEQ ID NO: 698599 - DNA, 13 bp, C. elegans
accaataatctta

SEQ ID NO: 698600 - DNA, 13 bp, C. elegans
accaatatattct

SEQ ID NO: 698601 - DNA, 13 bp, C. elegans
accaatattctca

SEQ ID NO: 698602 - DNA, 13 bp, C. elegans
accaatcagcaac

SEQ ID NO: 698603 - DNA, 13 bp, C. elegans
accaattatttta

SEQ ID NO: 698604 - DNA, 13 bp, C. elegans
accaatttatttt

SEQ ID NO: 698605 - DNA, 13 bp, C. elegans
accaattttcaaa

SEQ ID NO: 698606 - DNA, 13 bp, C. elegans
accaattttgttt

SEQ ID NO: 698607 - DNA, 13 bp, C. elegans
accaatttttaaa

SEQ ID NO: 698608 - DNA, 13 bp, C. elegans
accaattttttct

SEQ ID NO: 698609 - DNA, 13 bp, C. elegans
accacaaaaattt

SEQ ID NO: 698610 - DNA, 13 bp, C. elegans
accacaaatttta

SEQ ID NO: 698611 - DNA, 13 bp, C. elegans
accacaaattttg

SEQ ID NO: 698612 - DNA, 13 bp, C. elegans
accacaataattt

SEQ ID NO: 698613 - DNA, 13 bp, C. elegans
accacaatttgcc

SEQ ID NO: 698614 - DNA, 13 bp, C. elegans
accaccatcatca

SEQ ID NO: 698615 - DNA, 13 bp, C. elegans
accaccccaagtg

SEQ ID NO: 698616 - DNA, 13 bp, C. elegans
accacgcccactt

SEQ ID NO: 698617 - DNA, 13 bp, C. elegans
accacgccccttt

SEQ ID NO: 698618 - DNA, 13 bp, C. elegans
accactattcaaa

SEQ ID NO: 698619 - DNA, 13 bp, C. elegans
accactctctctc

SEQ ID NO: 698620 - DNA, 13 bp, C. elegans
accactttcaaaa

SEQ ID NO: 698621 - DNA, 13 bp, C. elegans
accagaagctgct

SEQ ID NO: 698622 - DNA, 20 bp, C. elegans
accagccgtggaccgcacct

SEQ ID NO: 698623 - DNA, 19 bp, C. elegans
accagccgttcgcacgcgc

SEQ ID NO: 698624 - DNA, 13 bp, C. elegans
accagggatgtgc

SEQ ID NO: 698625 - DNA, 13 bp, C. elegans
accaggggtgggc

SEQ ID NO: 698626 - DNA, 15 bp, C. elegans
accaggggtgtgcgg

SEQ ID NO: 698627 - DNA, 13 bp, C. elegans
accaggtctcgac

SEQ ID NO: 698628 - DNA, 13 bp, C. elegans
accagtctggaga

SEQ ID NO: 698629 - DNA, 13 bp, C. elegans
accagtttatgga

SEQ ID NO: 698630 - DNA, 13 bp, C. elegans
accagtttttttc

SEQ ID NO: 698631 - DNA, 13 bp, C. elegans
accagtttttttt

SEQ ID NO: 698632 - DNA, 13 bp, C. elegans
accataaatattt

SEQ ID NO: 698633 - DNA, 13 bp, C. elegans
accataatttttt

SEQ ID NO: 698634 - DNA, 13 bp, C. elegans
accatatcaaaat

SEQ ID NO: 698635 - DNA, 13 bp, C. elegans
accatatccccca

SEQ ID NO: 698636 - DNA, 13 bp, C. elegans
accatattttcaa

SEQ ID NO: 698637 - DNA, 13 bp, C. elegans
accatcaggaggt

SEQ ID NO: 698638 - DNA, 13 bp, C. elegans
accatcatcatca

SEQ ID NO: 698639 - DNA, 13 bp, C. elegans
accatcattttca

SEQ ID NO: 698640 - DNA, 13 bp, C. elegans
accatctcatctt

SEQ ID NO: 698641 - DNA, 13 bp, C. elegans
accatgcaaaatc

SEQ ID NO: 698642 - DNA, 13 bp, C. elegans
accatgtgtaaac

SEQ ID NO: 698643 - DNA, 13 bp, C. elegans
accatgttcaaaa

SEQ ID NO: 698644 - DNA, 13 bp, C. elegans
accatgtttttga

SEQ ID NO: 698645 - DNA, 13 bp, C. elegans
accattaaaattt

SEQ ID NO: 698646 - DNA, 13 bp, C. elegans
accattccggaat

SEQ ID NO: 698647 - DNA, 13 bp, C. elegans
accattcgaaatc

SEQ ID NO: 698648 - DNA, 13 bp, C. elegans
accattgtcaact

SEQ ID NO: 698649 - DNA, 13 bp, C. elegans
accatttcatttt

SEQ ID NO: 698650 - DNA, 13 bp, C. elegans
accatttgttctt

SEQ ID NO: 698651 - DNA, 13 bp, C. elegans
accattttcttca

SEQ ID NO: 698652 - DNA, 13 bp, C. elegans
accatttttctgt

SEQ ID NO: 698653 - DNA, 13 bp, C. elegans
accattttttcat

SEQ ID NO: 698654 - DNA, 13 bp, C. elegans
accattttttcca

SEQ ID NO: 698655 - DNA, 13 bp, C. elegans
accattttttgca

SEQ ID NO: 698656 - DNA, 13 bp, C. elegans
accattttttggt

SEQ ID NO: 698657 - DNA, 13 bp, C. elegans
acccaaaaaagtt

SEQ ID NO: 698658 - DNA, 13 bp, C. elegans
acccaaaaattca

SEQ ID NO: 698659 - DNA, 13 bp, C. elegans
acccaaaagtttg

SEQ ID NO: 698660 - DNA, 13 bp, C. elegans
acccaaaatgatc

SEQ ID NO: 698661 - DNA, 13 bp, C. elegans
acccaaaatttga

SEQ ID NO: 698662 - DNA, 13 bp, C. elegans
acccaaatttcca

SEQ ID NO: 698663 - DNA, 13 bp, C. elegans
acccacaatttgc

SEQ ID NO: 698664 - DNA, 13 bp, C. elegans
acccactttttca

SEQ ID NO: 698665 - DNA, 13 bp, C. elegans
acccagacgcaaa

SEQ ID NO: 698666 - DNA, 13 bp, C. elegans
acccaggaaacca

SEQ ID NO: 698667 - DNA, 13 bp, C. elegans
acccattttcaaa

SEQ ID NO: 698668 - DNA, 13 bp, C. elegans
acccattttttct

SEQ ID NO: 698669 - DNA, 13 bp, C. elegans
accccaaaatgtt

SEQ ID NO: 698670 - DNA, 24 bp, C. elegans
accccagtaaagtctacttcggta

SEQ ID NO: 698671 - DNA, 13 bp, C. elegans
acccccaattttt

SEQ ID NO: 698672 - DNA, 13 bp, C. elegans
accccccgttttt

SEQ ID NO: 698673 - DNA, 13 bp, C. elegans
acccccgattttt

SEQ ID NO: 698674 - DNA, 13 bp, C. elegans
accccgaaaaatt

SEQ ID NO: 698675 - DNA, 13 bp, C. elegans
accccgccccttt

SEQ ID NO: 698676 - DNA, 13 bp, C. elegans
accccttcatttg

SEQ ID NO: 698677 - DNA, 14 bp, C. elegans
acccgactacttaa

SEQ ID NO: 698678 - DNA, 13 bp, C. elegans
acccggtctcgaa

SEQ ID NO: 698679 - DNA, 13 bp, C. elegans
accctaaaccaat

SEQ ID NO: 698680 - DNA, 13 bp, C. elegans
accctaagcctaa

SEQ ID NO: 698681 - DNA, 13 bp, C. elegans
accctctattagt

SEQ ID NO: 698682 - DNA, 13 bp, C. elegans
acccttttcattt

SEQ ID NO: 698683 - DNA, 13 bp, C. elegans
accgaaaaaatag

SEQ ID NO: 698684 - DNA, 13 bp, C. elegans
accgaaaaacact

SEQ ID NO: 698685 - DNA, 13 bp, C. elegans
accgaaaaatcga

SEQ ID NO: 698686 - DNA, 13 bp, C. elegans
accgaaaaatgta

SEQ ID NO: 698687 - DNA, 13 bp, C. elegans
accgaaaacatta

SEQ ID NO: 698688 - DNA, 13 bp, C. elegans
accgaaaactgaa

SEQ ID NO: 698689 - DNA, 13 bp, C. elegans
accgaaaatcgaa

SEQ ID NO: 698690 - DNA, 13 bp, C. elegans
accgaaaatgtga

SEQ ID NO: 698691 - DNA, 13 bp, C. elegans
accgaaattgaaa

SEQ ID NO: 698692 - DNA, 13 bp, C. elegans
accgaaatttttt

SEQ ID NO: 698693 - DNA, 13 bp, C. elegans
accgaacttttct

SEQ ID NO: 698694 - DNA, 13 bp, C. elegans
accgaatataact

SEQ ID NO: 698695 - DNA, 13 bp, C. elegans
accgaatatcata

SEQ ID NO: 698696 - DNA, 13 bp, C. elegans
accgaattttgaa

SEQ ID NO: 698697 - DNA, 13 bp, C. elegans
accgactaccgta

SEQ ID NO: 698698 - DNA, 13 bp, C. elegans
accgacttgtcaa

SEQ ID NO: 698699 - DNA, 21 bp, C. elegans
accgagaatttgctcgccgaa

SEQ ID NO: 698700 - DNA, 13 bp, C. elegans
accgagagctttc

SEQ ID NO: 698701 - DNA, 13 bp, C. elegans
accgagatttgaa

SEQ ID NO: 698702 - DNA, 13 bp, C. elegans
accgatttgccag

SEQ ID NO: 698703 - DNA, 13 bp, C. elegans
accgattttcaat

SEQ ID NO: 698704 - DNA, 13 bp, C. elegans
accgatttttaat

SEQ ID NO: 698705 - DNA, 13 bp, C. elegans
accgcccaacttc

SEQ ID NO: 698706 - DNA, 13 bp, C. elegans
accgcccgttttt

SEQ ID NO: 698707 - DNA, 13 bp, C. elegans
accggaaattatg

SEQ ID NO: 698708 - DNA, 13 bp, C. elegans
accggaaatttga

SEQ ID NO: 698709 - DNA, 23 bp, C. elegans
accggacgcacatgcgtccggtt

SEQ ID NO: 698710 - DNA, 14 bp, C. elegans
accggacgtccggt

SEQ ID NO: 698711 - DNA, 13 bp, C. elegans
accggcaaaaatt

SEQ ID NO: 698712 - DNA, 13 bp, C. elegans
accggcaaaatgc

SEQ ID NO: 698713 - DNA, 13 bp, C. elegans
accggcaactttt

SEQ ID NO: 698714 - DNA, 13 bp, C. elegans
accggcaagtgcc

SEQ ID NO: 698715 - DNA, 13 bp, C. elegans
accggcaatttcc

SEQ ID NO: 698716 - DNA, 13 bp, C. elegans
accggttaccgta

SEQ ID NO: 698717 - DNA, 13 bp, C. elegans
accgtacccgctt

SEQ ID NO: 698718 - DNA, 13 bp, C. elegans
accgtatttttaa

SEQ ID NO: 698719 - DNA, 13 bp, C. elegans
accgtatttttgg

SEQ ID NO: 698720 - DNA, 13 bp, C. elegans
accgtcaaatttt

SEQ ID NO: 698721 - DNA, 13 bp, C. elegans
accgtcagacttc

SEQ ID NO: 698722 - DNA, 13 bp, C. elegans
accgtttttcttc

SEQ ID NO: 698723 - DNA, 13 bp, C. elegans
accgttttttcga

SEQ ID NO: 698724 - DNA, 13 bp, C. elegans
accgtttttttct

SEQ ID NO: 698725 - DNA, 13 bp, C. elegans
acctaacaactag

SEQ ID NO: 698726 - DNA, 15 bp, C. elegans
acctaagcctaagct

SEQ ID NO: 698727 - DNA, 13 bp, C. elegans
acctacagtaacc

SEQ ID NO: 698728 - DNA, 13 bp, C. elegans
acctacagtaccc

SEQ ID NO: 698729 - DNA, 13 bp, C. elegans
acctacagtactc

SEQ ID NO: 698730 - DNA, 13 bp, C. elegans
acctaccgtaacc

SEQ ID NO: 698731 - DNA, 13 bp, C. elegans
acctaccgtaatc

SEQ ID NO: 698732 - DNA, 13 bp, C. elegans
acctacctgccta

SEQ ID NO: 698733 - DNA, 13 bp, C. elegans
acctacgcctgcc

SEQ ID NO: 698734 - DNA, 13 bp, C. elegans
acctactgccaaa

SEQ ID NO: 698735 - DNA, 13 bp, C. elegans
acctactttttaa

SEQ ID NO: 698736 - DNA, 13 bp, C. elegans
acctagaaaaatt

SEQ ID NO: 698737 - DNA, 13 bp, C. elegans
acctagattttgt

SEQ ID NO: 698738 - DNA, 13 bp, C. elegans
acctattcagttg

SEQ ID NO: 698739 - DNA, 13 bp, C. elegans
acctattttgaaa

SEQ ID NO: 698740 - DNA, 13 bp, C. elegans
acctattttgcct

SEQ ID NO: 698741 - DNA, 13 bp, C. elegans
acctatttttcat

SEQ ID NO: 698742 - DNA, 13 bp, C. elegans
acctcaaatttga

SEQ ID NO: 698743 - DNA, 13 bp, C. elegans
acctcaacatttt

SEQ ID NO: 698744 - DNA, 13 bp, C. elegans
acctcaattcaaa

SEQ ID NO: 698745 - DNA, 13 bp, C. elegans
acctcaatttttc

SEQ ID NO: 698746 - DNA, 13 bp, C. elegans
acctcagtttttg

SEQ ID NO: 698747 - DNA, 13 bp, C. elegans
acctcctgctctc

SEQ ID NO: 698748 - DNA, 13 bp, C. elegans
acctcgacaattt

SEQ ID NO: 698749 - DNA, 13 bp, C. elegans
acctctattagtt

SEQ ID NO: 698750 - DNA, 13 bp, C. elegans
acctctggcctag

SEQ ID NO: 698751 - DNA, 13 bp, C. elegans
acctgaaaaactt

SEQ ID NO: 698752 - DNA, 13 bp, C. elegans
acctgaaaagaag

SEQ ID NO: 698753 - DNA, 13 bp, C. elegans
acctgaaacaaaa

SEQ ID NO: 698754 - DNA, 14 bp, C. elegans
acctgacaccacgt

SEQ ID NO: 698755 - DNA, 13 bp, C. elegans
acctgacctcaaa

SEQ ID NO: 698756 - DNA, 13 bp, C. elegans
acctgattttttt

SEQ ID NO: 698757 - DNA, 13 bp, C. elegans
acctgcctacctt

SEQ ID NO: 698758 - DNA, 13 bp, C. elegans
acctgtgagatgt

SEQ ID NO: 698759 - DNA, 13 bp, C. elegans
acctgtgctcatt

SEQ ID NO: 698760 - DNA, 14 bp, C. elegans
accttctggaaaat

SEQ ID NO: 698761 - DNA, 13 bp, C. elegans
accttctggacca

SEQ ID NO: 698762 - DNA, 13 bp, C. elegans
acctttaataaaa

SEQ ID NO: 698763 - DNA, 13 bp, C. elegans
acctttgatgaat

SEQ ID NO: 698764 - DNA, 13 bp, C. elegans
accttttcacatt

SEQ ID NO: 698765 - DNA, 13 bp, C. elegans
accttttccaaat

SEQ ID NO: 698766 - DNA, 13 bp, C. elegans
accttttccaatt

SEQ ID NO: 698767 - DNA, 13 bp, C. elegans
accttttctcatt

SEQ ID NO: 698768 - DNA, 13 bp, C. elegans
accttttgaaaaa

SEQ ID NO: 698769 - DNA, 13 bp, C. elegans
accttttggaaat

SEQ ID NO: 698770 - DNA, 13 bp, C. elegans
acctttttcaaaa

SEQ ID NO: 698771 - DNA, 13 bp, C. elegans
acctttttcaaat

SEQ ID NO: 698772 - DNA, 13 bp, C. elegans
acctttttttcca

SEQ ID NO: 698773 - DNA, 13 bp, C. elegans
acgaaaaacaatt

SEQ ID NO: 698774 - DNA, 13 bp, C. elegans
acgaaaaacgttt

SEQ ID NO: 698775 - DNA, 13 bp, C. elegans
acgaaaaactaca

SEQ ID NO: 698776 - DNA, 13 bp, C. elegans
acgaaaaactttt

SEQ ID NO: 698777 - DNA, 13 bp, C. elegans
acgaaaaagtccc

SEQ ID NO: 698778 - DNA, 13 bp, C. elegans
acgaaaaatctga

SEQ ID NO: 698779 - DNA, 13 bp, C. elegans
acgaaaaatgcaa

SEQ ID NO: 698780 - DNA, 13 bp, C. elegans
acgaaaaatgcag

SEQ ID NO: 698781 - DNA, 13 bp, C. elegans
acgaaaaattcca

SEQ ID NO: 698782 - DNA, 13 bp, C. elegans
acgaaaaattcga

SEQ ID NO: 698783 - DNA, 13 bp, C. elegans
acgaaaaattctg

SEQ ID NO: 698784 - DNA, 13 bp, C. elegans
acgaaaaattgat

SEQ ID NO: 698785 - DNA, 13 bp, C. elegans
acgaaaagtcaat

SEQ ID NO: 698786 - DNA, 13 bp, C. elegans
acgaaaatatcga

SEQ ID NO: 698787 - DNA, 13 bp, C. elegans
acgaaaatgctcg

SEQ ID NO: 698788 - DNA, 13 bp, C. elegans
acgaaaatgtata

SEQ ID NO: 698789 - DNA, 13 bp, C. elegans
acgaaaattcaat

SEQ ID NO: 698790 - DNA, 13 bp, C. elegans
acgaaaattcgaa

SEQ ID NO: 698791 - DNA, 13 bp, C. elegans
acgaaaattgaaa

SEQ ID NO: 698792 - DNA, 13 bp, C. elegans
acgaaaattgcaa

SEQ ID NO: 698793 - DNA, 13 bp, C. elegans
acgaaaattgttg

SEQ ID NO: 698794 - DNA, 13 bp, C. elegans
acgaaaatttcga

SEQ ID NO: 698795 - DNA, 13 bp, C. elegans
acgaaaattttga

SEQ ID NO: 698796 - DNA, 13 bp, C. elegans
acgaaacaaattt

SEQ ID NO: 698797 - DNA, 19 bp, C. elegans
acgaaacttcatcttccat

SEQ ID NO: 698798 - DNA, 13 bp, C. elegans
acgaaataaattt

SEQ ID NO: 698799 - DNA, 13 bp, C. elegans
acgaaattcgaaa

SEQ ID NO: 698800 - DNA, 13 bp, C. elegans
acgaaattctgag

SEQ ID NO: 698801 - DNA, 13 bp, C. elegans
acgaaatttggta

SEQ ID NO: 698802 - DNA, 13 bp, C. elegans
acgaaatttgttt

SEQ ID NO: 698803 - DNA, 13 bp, C. elegans
acgaacaaagttt

SEQ ID NO: 698804 - DNA, 13 bp, C. elegans
acgaagaaattga

SEQ ID NO: 698805 - DNA, 13 bp, C. elegans
acgaagaagtgtt

SEQ ID NO: 698806 - DNA, 13 bp, C. elegans
acgaagttgtccc

SEQ ID NO: 698807 - DNA, 13 bp, C. elegans
acgaataattaaa

SEQ ID NO: 698808 - DNA, 13 bp, C. elegans
acgaatactacat

SEQ ID NO: 698809 - DNA, 13 bp, C. elegans
acgaatatcatgt

SEQ ID NO: 698810 - DNA, 13 bp, C. elegans
acgaattcaaaaa

SEQ ID NO: 698811 - DNA, 13 bp, C. elegans
acgaatttcataa

SEQ ID NO: 698812 - DNA, 13 bp, C. elegans
acgaattttcaga

SEQ ID NO: 698813 - DNA, 13 bp, C. elegans
acgaattttcgaa

SEQ ID NO: 698814 - DNA, 13 bp, C. elegans
acgaattttctcg

SEQ ID NO: 698815 - DNA, 13 bp, C. elegans
acgacaaaactta

SEQ ID NO: 698816 - DNA, 13 bp, C. elegans
acgacaaaattgt

SEQ ID NO: 698817 - DNA, 13 bp, C. elegans
acgacaaattgca

SEQ ID NO: 698818 - DNA, 13 bp, C. elegans
acgacatattttt

SEQ ID NO: 698819 - DNA, 13 bp, C. elegans
acgacgaagaaga

SEQ ID NO: 698820 - DNA, 13 bp, C. elegans
acgacgacgacga

SEQ ID NO: 698821 - DNA, 13 bp, C. elegans
acgacgacgacgg

SEQ ID NO: 698822 - DNA, 13 bp, C. elegans
acgacttccaaaa

SEQ ID NO: 698823 - DNA, 13 bp, C. elegans
acgactttttttt

SEQ ID NO: 698824 - DNA, 13 bp, C. elegans
acgagaaaaaagt

SEQ ID NO: 698825 - DNA, 13 bp, C. elegans
acgagaaaatgtt

SEQ ID NO: 698826 - DNA, 13 bp, C. elegans
acgagaaaattga

SEQ ID NO: 698827 - DNA, 13 bp, C. elegans
acgagaaacgcgc

SEQ ID NO: 698828 - DNA, 13 bp, C. elegans
acgagagaaaatt

SEQ ID NO: 698829 - DNA, 13 bp, C. elegans
acgagattttcaa

SEQ ID NO: 698830 - DNA, 13 bp, C. elegans
acgagcaacaagt

SEQ ID NO: 698831 - DNA, 13 bp, C. elegans
acgagctacagta

SEQ ID NO: 698832 - DNA, 13 bp, C. elegans
acgaggaattcga

SEQ ID NO: 698833 - DNA, 13 bp, C. elegans
acgaggaattctc

SEQ ID NO: 698834 - DNA, 13 bp, C. elegans
acgagtagacaat

SEQ ID NO: 698835 - DNA, 13 bp, C. elegans
acgagttccgcgc

SEQ ID NO: 698836 - DNA, 13 bp, C. elegans
acgagtttttatt

SEQ ID NO: 698837 - DNA, 13 bp, C. elegans
acgatcaattcca

SEQ ID NO: 698838 - DNA, 13 bp, C. elegans
acgatgaaaaaat

SEQ ID NO: 698839 - DNA, 13 bp, C. elegans
acgatgggtctca

SEQ ID NO: 698840 - DNA, 13 bp, C. elegans
acgattatttgaa

SEQ ID NO: 698841 - DNA, 13 bp, C. elegans
acgattgaaatcg

SEQ ID NO: 698842 - DNA, 13 bp, C. elegans
acgatttgccgaa

SEQ ID NO: 698843 - DNA, 13 bp, C. elegans
acgattttaagaa

SEQ ID NO: 698844 - DNA, 13 bp, C. elegans
acgatttttaatt

SEQ ID NO: 698845 - DNA, 14 bp, C. elegans
acgatttttgaatt

SEQ ID NO: 698846 - DNA, 13 bp, C. elegans
acgattttttccg

SEQ ID NO: 698847 - DNA, 13 bp, C. elegans
acgcaaaatttga

SEQ ID NO: 698848 - DNA, 13 bp, C. elegans
acgcaaacaccag

SEQ ID NO: 698849 - DNA, 13 bp, C. elegans
acgcagacttttc

SEQ ID NO: 698850 - DNA, 13 bp, C. elegans
acgcattttcaat

SEQ ID NO: 698851 - DNA, 13 bp, C. elegans
acgccaataattt

SEQ ID NO: 698852 - DNA, 13 bp, C. elegans
acgccgcatgtat

SEQ ID NO: 698853 - DNA, 13 bp, C. elegans
acgcctacttttt

SEQ ID NO: 698854 - DNA, 13 bp, C. elegans
acgcctgcctcca

SEQ ID NO: 698855 - DNA, 16 bp, C. elegans
acgcgacacgcaacgc

SEQ ID NO: 698856 - DNA, 14 bp, C. elegans
acgcgatacgcaac

SEQ ID NO: 698857 - DNA, 13 bp, C. elegans
acgcgcattttca

SEQ ID NO: 698858 - DNA, 13 bp, C. elegans
acgctccgcctcc

SEQ ID NO: 698859 - DNA, 13 bp, C. elegans
acgctctcctcaa

SEQ ID NO: 698860 - DNA, 13 bp, C. elegans
acgctctgaaaat

SEQ ID NO: 698861 - DNA, 14 bp, C. elegans
acgctgatttcaaa

SEQ ID NO: 698862 - DNA, 13 bp, C. elegans
acgctgtttctga

SEQ ID NO: 698863 - DNA, 13 bp, C. elegans
acggaaaaatggg

SEQ ID NO: 698864 - DNA, 13 bp, C. elegans
acggaaaaattca

SEQ ID NO: 698865 - DNA, 13 bp, C. elegans
acggaaaaatttc

SEQ ID NO: 698866 - DNA, 13 bp, C. elegans
acggaaaatgaat

SEQ ID NO: 698867 - DNA, 13 bp, C. elegans
acggaaacactta

SEQ ID NO: 698868 - DNA, 13 bp, C. elegans
acggaccaatcga

SEQ ID NO: 698869 - DNA, 13 bp, C. elegans
acggagaattcga

SEQ ID NO: 698870 - DNA, 13 bp, C. elegans
acggatttttttc

SEQ ID NO: 698871 - DNA, 13 bp, C. elegans
acggcaaatcggc

SEQ ID NO: 698872 - DNA, 13 bp, C. elegans
acggcaaatttgc

SEQ ID NO: 698873 - DNA, 13 bp, C. elegans
acggcctgaaacg

SEQ ID NO: 698874 - DNA, 13 bp, C. elegans
acgggaaaaattg

SEQ ID NO: 698875 - DNA, 13 bp, C. elegans
acgggaaacaaat

SEQ ID NO: 698876 - DNA, 13 bp, C. elegans
acgggacaaacgg

SEQ ID NO: 698877 - DNA, 13 bp, C. elegans
acgggagaaaatg

SEQ ID NO: 698878 - DNA, 13 bp, C. elegans
acggggttctggc

SEQ ID NO: 698879 - DNA, 13 bp, C. elegans
acggtggttcagt

SEQ ID NO: 698880 - DNA, 13 bp, C. elegans
acggttttttgtt

SEQ ID NO: 698881 - DNA, 13 bp, C. elegans
acgtagatcaatc

SEQ ID NO: 698882 - DNA, 13 bp, C. elegans
acgtatttatttt

SEQ ID NO: 698883 - DNA, 13 bp, C. elegans
acgtattttcaaa

SEQ ID NO: 698884 - DNA, 13 bp, C. elegans
acgtcacaacctt

SEQ ID NO: 698885 - DNA, 13 bp, C. elegans
acgtcacagtttt

SEQ ID NO: 698886 - DNA, 13 bp, C. elegans
acgtcacatttct

SEQ ID NO: 698887 - DNA, 13 bp, C. elegans
acgtcacatttta

SEQ ID NO: 698888 - DNA, 13 bp, C. elegans
acgtcactttttt

SEQ ID NO: 698889 - DNA, 13 bp, C. elegans
acgtcagcacatt

SEQ ID NO: 698890 - DNA, 13 bp, C. elegans
acgtcataatttt

SEQ ID NO: 698891 - DNA, 13 bp, C. elegans
acgtcatttttga

SEQ ID NO: 698892 - DNA, 13 bp, C. elegans
acgtcatttttta

SEQ ID NO: 698893 - DNA, 13 bp, C. elegans
acgtcttcttctt

SEQ ID NO: 698894 - DNA, 13 bp, C. elegans
acgtcttcttttt

SEQ ID NO: 698895 - DNA, 13 bp, C. elegans
acgtctttttttg

SEQ ID NO: 698896 - DNA, 13 bp, C. elegans
acgtgaagcttct

SEQ ID NO: 698897 - DNA, 14 bp, C. elegans
acgtgaagcttctt

SEQ ID NO: 698898 - DNA, 19 bp, C. elegans
acgtgacctttgggtcatc

SEQ ID NO: 698899 - DNA, 13 bp, C. elegans
acgtggcatcgag

SEQ ID NO: 698900 - DNA, 13 bp, C. elegans
acgtggtgtcaaa

SEQ ID NO: 698901 - DNA, 13 bp, C. elegans
acgtgtggagaga

SEQ ID NO: 698902 - DNA, 13 bp, C. elegans
acgtgttttattt

SEQ ID NO: 698903 - DNA, 13 bp, C. elegans
acgtgttttcaag

SEQ ID NO: 698904 - DNA, 13 bp, C. elegans
acgttattttttc

SEQ ID NO: 698905 - DNA, 13 bp, C. elegans
acgttcaaaatat

SEQ ID NO: 698906 - DNA, 13 bp, C. elegans
acgttcagttttt

SEQ ID NO: 698907 - DNA, 13 bp, C. elegans
acgtttaaaaaat

SEQ ID NO: 698908 - DNA, 13 bp, C. elegans
acgtttaaaattt

SEQ ID NO: 698909 - DNA, 13 bp, C. elegans
acgtttaatttaa

SEQ ID NO: 698910 - DNA, 13 bp, C. elegans
acgtttatttgaa

SEQ ID NO: 698911 - DNA, 13 bp, C. elegans
acgtttattttga

SEQ ID NO: 698912 - DNA, 13 bp, C. elegans
acgtttcaaataa

SEQ ID NO: 698913 - DNA, 13 bp, C. elegans
acgttttaaattt

SEQ ID NO: 698914 - DNA, 13 bp, C. elegans
acgttttaatttt

SEQ ID NO: 698915 - DNA, 13 bp, C. elegans
acgttttattatt

SEQ ID NO: 698916 - DNA, 13 bp, C. elegans
acgttttcaaaaa

SEQ ID NO: 698917 - DNA, 13 bp, C. elegans
acgttttcaattt

SEQ ID NO: 698918 - DNA, 13 bp, C. elegans
acgttttctttca

SEQ ID NO: 698919 - DNA, 13 bp, C. elegans
acgttttgaattt

SEQ ID NO: 698920 - DNA, 13 bp, C. elegans
acgtttttaaatt

SEQ ID NO: 698921 - DNA, 13 bp, C. elegans
acgtttttatctt

SEQ ID NO: 698922 - DNA, 13 bp, C. elegans
acgtttttcataa

SEQ ID NO: 698923 - DNA, 13 bp, C. elegans
acgtttttctcaa

SEQ ID NO: 698924 - DNA, 13 bp, C. elegans
acgttttttcttc

SEQ ID NO: 698925 - DNA, 13 bp, C. elegans
actaaaaaccttt

SEQ ID NO: 698926 - DNA, 13 bp, C. elegans
actaaaaagtttc

SEQ ID NO: 698927 - DNA, 13 bp, C. elegans
actaaaaattgaa

SEQ ID NO: 698928 - DNA, 13 bp, C. elegans
actaaaactgaaa

SEQ ID NO: 698929 - DNA, 13 bp, C. elegans
actaaaattcata

SEQ ID NO: 698930 - DNA, 13 bp, C. elegans
actaaaattcgaa

SEQ ID NO: 698931 - DNA, 13 bp, C. elegans
actaaaatttcaa

SEQ ID NO: 698932 - DNA, 13 bp, C. elegans
actaaacaaagta

SEQ ID NO: 698933 - DNA, 13 bp, C. elegans
actaaatttcaaa

SEQ ID NO: 698934 - DNA, 13 bp, C. elegans
actaacaatattt

SEQ ID NO: 698935 - DNA, 13 bp, C. elegans
actaacaatttgt

SEQ ID NO: 698936 - DNA, 13 bp, C. elegans
actaacttattta

SEQ ID NO: 698937 - DNA, 13 bp, C. elegans
actaataaaaatg

SEQ ID NO: 698938 - DNA, 13 bp, C. elegans
actaataaatgaa

SEQ ID NO: 698939 - DNA, 13 bp, C. elegans
actaattcaaaat

SEQ ID NO: 698940 - DNA, 13 bp, C. elegans
actaattcaattt

SEQ ID NO: 698941 - DNA, 13 bp, C. elegans
actaattctaatt

SEQ ID NO: 698942 - DNA, 13 bp, C. elegans
actaattgtaaat

SEQ ID NO: 698943 - DNA, 13 bp, C. elegans
actaattttcaat

SEQ ID NO: 698944 - DNA, 13 bp, C. elegans
actaattttctaa

SEQ ID NO: 698945 - DNA, 13 bp, C. elegans
actacaaaaatgt

SEQ ID NO: 698946 - DNA, 13 bp, C. elegans
actacaaaactat

SEQ ID NO: 698947 - DNA, 13 bp, C. elegans
actacaaaattgt

SEQ ID NO: 698948 - DNA, 13 bp, C. elegans
actacaaactaca

SEQ ID NO: 698949 - DNA, 13 bp, C. elegans
actacaaactacg

SEQ ID NO: 698950 - DNA, 15 bp, C. elegans
actacaaagactaca

SEQ ID NO: 698951 - DNA, 13 bp, C. elegans
actacaaagttgt

SEQ ID NO: 698952 - DNA, 13 bp, C. elegans
actacaaagtttt

SEQ ID NO: 698953 - DNA, 13 bp, C. elegans
actacaactacaa

SEQ ID NO: 698954 - DNA, 13 bp, C. elegans
actacaacttttg

SEQ ID NO: 698955 - DNA, 13 bp, C. elegans
actacaataatcc

SEQ ID NO: 698956 - DNA, 13 bp, C. elegans
actacaattttta

SEQ ID NO: 698957 - DNA, 13 bp, C. elegans
actacaatttttt

SEQ ID NO: 698958 - DNA, 13 bp, C. elegans
actacagagttca

SEQ ID NO: 698959 - DNA, 14 bp, C. elegans
actacagtaacccc

SEQ ID NO: 698960 - DNA, 14 bp, C. elegans
actacagtaacccg

SEQ ID NO: 698961 - DNA, 13 bp, C. elegans
actacagtaaccg

SEQ ID NO: 698962 - DNA, 13 bp, C. elegans
actacagtaacct

SEQ ID NO: 698963 - DNA, 13 bp, C. elegans
actacagtaactc

SEQ ID NO: 698964 - DNA, 13 bp, C. elegans
actacagtaatat

SEQ ID NO: 698965 - DNA, 13 bp, C. elegans
actacagtacccc

SEQ ID NO: 698966 - DNA, 13 bp, C. elegans
actacagtacccg

SEQ ID NO: 698967 - DNA, 13 bp, C. elegans
actacagtacctt

SEQ ID NO: 698968 - DNA, 13 bp, C. elegans
actacagtactct

SEQ ID NO: 698969 - DNA, 13 bp, C. elegans
actacagtagtaa

SEQ ID NO: 698970 - DNA, 13 bp, C. elegans
actacagtagtca

SEQ ID NO: 698971 - DNA, 13 bp, C. elegans
actacagtatccc

SEQ ID NO: 698972 - DNA, 13 bp, C. elegans
actacagtattcc

SEQ ID NO: 698973 - DNA, 13 bp, C. elegans
actacagtattct

SEQ ID NO: 698974 - DNA, 13 bp, C. elegans
actacattttcaa

SEQ ID NO: 698975 - DNA, 15 bp, C. elegans
actaccacaactacc

SEQ ID NO: 698976 - DNA, 13 bp, C. elegans
actaccgtaaccc

SEQ ID NO: 698977 - DNA, 13 bp, C. elegans
actaccgtaatca

SEQ ID NO: 698978 - DNA, 13 bp, C. elegans
actaccgtaatcc

SEQ ID NO: 698979 - DNA, 13 bp, C. elegans
actaccgtaccaa

SEQ ID NO: 698980 - DNA, 13 bp, C. elegans
actaccgtatatt

SEQ ID NO: 698981 - DNA, 13 bp, C. elegans
actaccttcaaat

SEQ ID NO: 698982 - DNA, 13 bp, C. elegans
actacgatttttt

SEQ ID NO: 698983 - DNA, 13 bp, C. elegans
actacgttgcgca

SEQ ID NO: 698984 - DNA, 13 bp, C. elegans
actactacaacta

SEQ ID NO: 698985 - DNA, 13 bp, C. elegans
actactgaaaata

SEQ ID NO: 698986 - DNA, 13 bp, C. elegans
actactggagatg

SEQ ID NO: 698987 - DNA, 13 bp, C. elegans
actactgtagatt

SEQ ID NO: 698988 - DNA, 13 bp, C. elegans
actacttcaaaat

SEQ ID NO: 698989 - DNA, 13 bp, C. elegans
actacttccaaaa

SEQ ID NO: 698990 - DNA, 13 bp, C. elegans
actagaaaaatat

SEQ ID NO: 698991 - DNA, 13 bp, C. elegans
actagaaaacaat

SEQ ID NO: 698992 - DNA, 13 bp, C. elegans
actagaaatattt

SEQ ID NO: 698993 - DNA, 13 bp, C. elegans
actagaatttcag

SEQ ID NO: 698994 - DNA, 13 bp, C. elegans
actagatatcttc

SEQ ID NO: 698995 - DNA, 13 bp, C. elegans
actagattttttt

SEQ ID NO: 698996 - DNA, 13 bp, C. elegans
actaggaaaaaat

SEQ ID NO: 698997 - DNA, 13 bp, C. elegans
actaggaaaatat

SEQ ID NO: 698998 - DNA, 31 bp, C. elegans
actagggaatggtgttacccctgcaatcgct

SEQ ID NO: 698999 - DNA, 13 bp, C. elegans
actagttgttttt

SEQ ID NO: 699000 - DNA, 13 bp, C. elegans
actagttttttat

SEQ ID NO: 699001 - DNA, 13 bp, C. elegans
actataactattt

SEQ ID NO: 699002 - DNA, 13 bp, C. elegans
actataatttttc

SEQ ID NO: 699003 - DNA, 13 bp, C. elegans
actatacattttt

SEQ ID NO: 699004 - DNA, 13 bp, C. elegans
actatctcgaaaa

SEQ ID NO: 699005 - DNA, 13 bp, C. elegans
actatgaaaataa

SEQ ID NO: 699006 - DNA, 13 bp, C. elegans
actatgacagttt

SEQ ID NO: 699007 - DNA, 13 bp, C. elegans
actatgatattta

SEQ ID NO: 699008 - DNA, 13 bp, C. elegans
actatgatatttg

SEQ ID NO: 699009 - DNA, 13 bp, C. elegans
actatgggaaaat

SEQ ID NO: 699010 - DNA, 13 bp, C. elegans
actatgtcaatac

SEQ ID NO: 699011 - DNA, 13 bp, C. elegans
actattaaaaagt

SEQ ID NO: 699012 - DNA, 13 bp, C. elegans
actattaaatttg

SEQ ID NO: 699013 - DNA, 13 bp, C. elegans
actattactatta

SEQ ID NO: 699014 - DNA, 13 bp, C. elegans
actattcaaaatc

SEQ ID NO: 699015 - DNA, 13 bp, C. elegans
actattcaaatat

SEQ ID NO: 699016 - DNA, 13 bp, C. elegans
actattcaagttt

SEQ ID NO: 699017 - DNA, 13 bp, C. elegans
actattcataaaa

SEQ ID NO: 699018 - DNA, 13 bp, C. elegans
actattcatttca

SEQ ID NO: 699019 - DNA, 13 bp, C. elegans
actattctaaaaa

SEQ ID NO: 699020 - DNA, 13 bp, C. elegans
actattctgatct

SEQ ID NO: 699021 - DNA, 13 bp, C. elegans
actattgaaaaat

SEQ ID NO: 699022 - DNA, 13 bp, C. elegans
actattgaaatat

SEQ ID NO: 699023 - DNA, 13 bp, C. elegans
actattgctagaa

SEQ ID NO: 699024 - DNA, 13 bp, C. elegans
actatttcaaatt

SEQ ID NO: 699025 - DNA, 13 bp, C. elegans
actatttcacttt

SEQ ID NO: 699026 - DNA, 13 bp, C. elegans
actatttccatat

SEQ ID NO: 699027 - DNA, 13 bp, C. elegans
actatttcgaaat

SEQ ID NO: 699028 - DNA, 13 bp, C. elegans
actatttggaaag

SEQ ID NO: 699029 - DNA, 13 bp, C. elegans
actattttattcc

SEQ ID NO: 699030 - DNA, 13 bp, C. elegans
actattttcaaaa

SEQ ID NO: 699031 - DNA, 13 bp, C. elegans
actattttctgaa

SEQ ID NO: 699032 - DNA, 13 bp, C. elegans
actattttctgtt

SEQ ID NO: 699033 - DNA, 13 bp, C. elegans
actattttgaaat

SEQ ID NO: 699034 - DNA, 13 bp, C. elegans
actattttgtatt

SEQ ID NO: 699035 - DNA, 13 bp, C. elegans
actattttgtttg

SEQ ID NO: 699036 - DNA, 13 bp, C. elegans
actatttttaagt

SEQ ID NO: 699037 - DNA, 13 bp, C. elegans
actatttttatca

SEQ ID NO: 699038 - DNA, 13 bp, C. elegans
actatttttggag

SEQ ID NO: 699039 - DNA, 13 bp, C. elegans
actattttttcaa

SEQ ID NO: 699040 - DNA, 13 bp, C. elegans
actcaaaaaaatg

SEQ ID NO: 699041 - DNA, 13 bp, C. elegans
actcaaaaacatt

SEQ ID NO: 699042 - DNA, 13 bp, C. elegans
actcaaaaagtga

SEQ ID NO: 699043 - DNA, 13 bp, C. elegans
actcaaaaatcat

SEQ ID NO: 699044 - DNA, 13 bp, C. elegans
actcaaaaatctg

SEQ ID NO: 699045 - DNA, 13 bp, C. elegans
actcaaaaattct

SEQ ID NO: 699046 - DNA, 13 bp, C. elegans
actcaaaatgtgc

SEQ ID NO: 699047 - DNA, 13 bp, C. elegans
actcaaaattgat

SEQ ID NO: 699048 - DNA, 13 bp, C. elegans
actcaaaatttga

SEQ ID NO: 699049 - DNA, 13 bp, C. elegans
actcaaagaagca

SEQ ID NO: 699050 - DNA, 13 bp, C. elegans
actcaaagtgatt

SEQ ID NO: 699051 - DNA, 13 bp, C. elegans
actcaaatgtttt

SEQ ID NO: 699052 - DNA, 13 bp, C. elegans
actcaactttgaa

SEQ ID NO: 699053 - DNA, 13 bp, C. elegans
actcaacttttcc

SEQ ID NO: 699054 - DNA, 13 bp, C. elegans
actcaagaataat

SEQ ID NO: 699055 - DNA, 13 bp, C. elegans
actcaagcttctc

SEQ ID NO: 699056 - DNA, 13 bp, C. elegans
actcaagtttttt

SEQ ID NO: 699057 - DNA, 13 bp, C. elegans
actcaataagaaa

SEQ ID NO: 699058 - DNA, 13 bp, C. elegans
actcaattgtttt

SEQ ID NO: 699059 - DNA, 13 bp, C. elegans
actcaatttgttc

SEQ ID NO: 699060 - DNA, 13 bp, C. elegans
actcaattttcag

SEQ ID NO: 699061 - DNA, 13 bp, C. elegans
actcaatttttca

SEQ ID NO: 699062 - DNA, 13 bp, C. elegans
actcacaatcagt

SEQ ID NO: 699063 - DNA, 13 bp, C. elegans
actcactcactca

SEQ ID NO: 699064 - DNA, 13 bp, C. elegans
actcacttttttc

SEQ ID NO: 699065 - DNA, 13 bp, C. elegans
actcagaaaatgt

SEQ ID NO: 699066 - DNA, 13 bp, C. elegans
actcagaattgtc

SEQ ID NO: 699067 - DNA, 13 bp, C. elegans
actcagttttttt

SEQ ID NO: 699068 - DNA, 13 bp, C. elegans
actcatattctga

SEQ ID NO: 699069 - DNA, 13 bp, C. elegans
actcatatttatt

SEQ ID NO: 699070 - DNA, 13 bp, C. elegans
actcatattttgc

SEQ ID NO: 699071 - DNA, 13 bp, C. elegans
actcatcaaaaat

SEQ ID NO: 699072 - DNA, 13 bp, C. elegans
actcatcaatttt

SEQ ID NO: 699073 - DNA, 13 bp, C. elegans
actcatctcttct

SEQ ID NO: 699074 - DNA, 13 bp, C. elegans
actcattattgat

SEQ ID NO: 699075 - DNA, 13 bp, C. elegans
actcatttttaaa

SEQ ID NO: 699076 - DNA, 13 bp, C. elegans
actcattttttga

SEQ ID NO: 699077 - DNA, 13 bp, C. elegans
actccaaaaaagt

SEQ ID NO: 699078 - DNA, 13 bp, C. elegans
actccaaaaaatt

SEQ ID NO: 699079 - DNA, 13 bp, C. elegans
actccaaaaactc

SEQ ID NO: 699080 - DNA, 13 bp, C. elegans
actccaaattttc

SEQ ID NO: 699081 - DNA, 13 bp, C. elegans
actccaccttcaa

SEQ ID NO: 699082 - DNA, 13 bp, C. elegans
actccacctttaa

SEQ ID NO: 699083 - DNA, 13 bp, C. elegans
actccacttttga

SEQ ID NO: 699084 - DNA, 13 bp, C. elegans
actccagaattcg

SEQ ID NO: 699085 - DNA, 13 bp, C. elegans
actccatatgatt

SEQ ID NO: 699086 - DNA, 13 bp, C. elegans
actccatcttcaa

SEQ ID NO: 699087 - DNA, 13 bp, C. elegans
actccatctttaa

SEQ ID NO: 699088 - DNA, 13 bp, C. elegans
actccatttgatt

SEQ ID NO: 699089 - DNA, 14 bp, C. elegans
actcccgcattttt

SEQ ID NO: 699090 - DNA, 13 bp, C. elegans
actccctattagt

SEQ ID NO: 699091 - DNA, 13 bp, C. elegans
actccgaaaattt

SEQ ID NO: 699092 - DNA, 13 bp, C. elegans
actccgcccactc

SEQ ID NO: 699093 - DNA, 13 bp, C. elegans
actccgccccttt

SEQ ID NO: 699094 - DNA, 13 bp, C. elegans
actcgaaaaagtt

SEQ ID NO: 699095 - DNA, 13 bp, C. elegans
actcgaaaattcg

SEQ ID NO: 699096 - DNA, 13 bp, C. elegans
actcgaaaattta

SEQ ID NO: 699097 - DNA, 13 bp, C. elegans
actcgaatttttc

SEQ ID NO: 699098 - DNA, 13 bp, C. elegans
actcgatatgctt

SEQ ID NO: 699099 - DNA, 13 bp, C. elegans
actcgcgagatgt

SEQ ID NO: 699100 - DNA, 13 bp, C. elegans
actcggaaattgt

SEQ ID NO: 699101 - DNA, 13 bp, C. elegans
actcggcaaaacg

SEQ ID NO: 699102 - DNA, 13 bp, C. elegans
actcggcattcag

SEQ ID NO: 699103 - DNA, 55 bp, C. elegans
actcgggaatcgctcgcccactatgggggagtctacgcaaggacaacgcaaggac

SEQ ID NO: 699104 - DNA, 13 bp, C. elegans
actcgtcttctct

SEQ ID NO: 699105 - DNA, 13 bp, C. elegans
actcgtgagatgt

SEQ ID NO: 699106 - DNA, 13 bp, C. elegans
actcgttttcttc

SEQ ID NO: 699107 - DNA, 13 bp, C. elegans
actctaaaaaact

SEQ ID NO: 699108 - DNA, 13 bp, C. elegans
actctaattttgc

SEQ ID NO: 699109 - DNA, 13 bp, C. elegans
actctaatttttc

SEQ ID NO: 699110 - DNA, 13 bp, C. elegans
actctacagtcct

SEQ ID NO: 699111 - DNA, 13 bp, C. elegans
actctataaaaat

SEQ ID NO: 699112 - DNA, 13 bp, C. elegans
actctcaaaaact

SEQ ID NO: 699113 - DNA, 13 bp, C. elegans
actctcaaaaagt

SEQ ID NO: 699114 - DNA, 13 bp, C. elegans
actctcaagcatc

SEQ ID NO: 699115 - DNA, 13 bp, C. elegans
actctctggtttc

SEQ ID NO: 699116 - DNA, 13 bp, C. elegans
actctgaaatcga

SEQ ID NO: 699117 - DNA, 13 bp, C. elegans
actctggcagttc

SEQ ID NO: 699118 - DNA, 13 bp, C. elegans
actctgtggactt

SEQ ID NO: 699119 - DNA, 13 bp, C. elegans
actctgtttgttg

SEQ ID NO: 699120 - DNA, 13 bp, C. elegans
actcttcaaattt

SEQ ID NO: 699121 - DNA, 13 bp, C. elegans
actcttccatttt

SEQ ID NO: 699122 - DNA, 13 bp, C. elegans
actcttcctaatg

SEQ ID NO: 699123 - DNA, 13 bp, C. elegans
actcttggaaact

SEQ ID NO: 699124 - DNA, 13 bp, C. elegans
actctttgaaact

SEQ ID NO: 699125 - DNA, 13 bp, C. elegans
actctttttcaat

SEQ ID NO: 699126 - DNA, 13 bp, C. elegans
actctttttgcaa

SEQ ID NO: 699127 - DNA, 13 bp, C. elegans
actgaaaaaactt

SEQ ID NO: 699128 - DNA, 13 bp, C. elegans
actgaaaaaagtg

SEQ ID NO: 699129 - DNA, 13 bp, C. elegans
actgaaaaacaat

SEQ ID NO: 699130 - DNA, 13 bp, C. elegans
actgaaaaactgg

SEQ ID NO: 699131 - DNA, 13 bp, C. elegans
actgaaaaattga

SEQ ID NO: 699132 - DNA, 13 bp, C. elegans
actgaaaacatga

SEQ ID NO: 699133 - DNA, 13 bp, C. elegans
actgaaaacccaa

SEQ ID NO: 699134 - DNA, 13 bp, C. elegans
actgaaaactttt

SEQ ID NO: 699135 - DNA, 13 bp, C. elegans
actgaaaagtgaa

SEQ ID NO: 699136 - DNA, 13 bp, C. elegans
actgaaaagtttg

SEQ ID NO: 699137 - DNA, 13 bp, C. elegans
actgaaaatcagt

SEQ ID NO: 699138 - DNA, 13 bp, C. elegans
actgaaaatgcac

SEQ ID NO: 699139 - DNA, 13 bp, C. elegans
actgaaaatgtct

SEQ ID NO: 699140 - DNA, 13 bp, C. elegans
actgaaaattatt

SEQ ID NO: 699141 - DNA, 13 bp, C. elegans
actgaaaattcaa

SEQ ID NO: 699142 - DNA, 13 bp, C. elegans
actgaaaattccc

SEQ ID NO: 699143 - DNA, 13 bp, C. elegans
actgaaaattcga

SEQ ID NO: 699144 - DNA, 13 bp, C. elegans
actgaaaattgag

SEQ ID NO: 699145 - DNA, 13 bp, C. elegans
actgaaaatttaa

SEQ ID NO: 699146 - DNA, 13 bp, C. elegans
actgaaacagaaa

SEQ ID NO: 699147 - DNA, 13 bp, C. elegans
actgaaacttcaa

SEQ ID NO: 699148 - DNA, 13 bp, C. elegans
actgaaactttaa

SEQ ID NO: 699149 - DNA, 13 bp, C. elegans
actgaaactttga

SEQ ID NO: 699150 - DNA, 13 bp, C. elegans
actgaaatgtgaa

SEQ ID NO: 699151 - DNA, 13 bp, C. elegans
actgaaattcaaa

SEQ ID NO: 699152 - DNA, 13 bp, C. elegans
actgaaattccaa

SEQ ID NO: 699153 - DNA, 13 bp, C. elegans
actgaaattcgaa

SEQ ID NO: 699154 - DNA, 13 bp, C. elegans
actgaaattgtca

SEQ ID NO: 699155 - DNA, 13 bp, C. elegans
actgaaattgtgt

SEQ ID NO: 699156 - DNA, 13 bp, C. elegans
actgaaattttga

SEQ ID NO: 699157 - DNA, 13 bp, C. elegans
actgaacatttca

SEQ ID NO: 699158 - DNA, 13 bp, C. elegans
actgaatataaat

SEQ ID NO: 699159 - DNA, 13 bp, C. elegans
actgaatattcaa

SEQ ID NO: 699160 - DNA, 13 bp, C. elegans
actgaattattat

SEQ ID NO: 699161 - DNA, 13 bp, C. elegans
actgaattcaaaa

SEQ ID NO: 699162 - DNA, 13 bp, C. elegans
actgaattgaaat

SEQ ID NO: 699163 - DNA, 13 bp, C. elegans
actgaatttatca

SEQ ID NO: 699164 - DNA, 13 bp, C. elegans
actgaattttgta

SEQ ID NO: 699165 - DNA, 13 bp, C. elegans
actgaatttttcg

SEQ ID NO: 699166 - DNA, 13 bp, C. elegans
actgaatttttgc

SEQ ID NO: 699167 - DNA, 13 bp, C. elegans
actgacaaaacgc

SEQ ID NO: 699168 - DNA, 13 bp, C. elegans
actgacaaaactc

SEQ ID NO: 699169 - DNA, 13 bp, C. elegans
actgacaaaatgt

SEQ ID NO: 699170 - DNA, 13 bp, C. elegans
actgacaaacttt

SEQ ID NO: 699171 - DNA, 13 bp, C. elegans
actgacaatcatg

SEQ ID NO: 699172 - DNA, 13 bp, C. elegans
actgacaattttt

SEQ ID NO: 699173 - DNA, 13 bp, C. elegans
actgaccgaaaaa

SEQ ID NO: 699174 - DNA, 14 bp, C. elegans
actgagaattattg

SEQ ID NO: 699175 - DNA, 13 bp, C. elegans
actgataaaatgt

SEQ ID NO: 699176 - DNA, 14 bp, C. elegans
actgataaataaat

SEQ ID NO: 699177 - DNA, 13 bp, C. elegans
actgataaatatt

SEQ ID NO: 699178 - DNA, 13 bp, C. elegans
actgataagaaat

SEQ ID NO: 699179 - DNA, 13 bp, C. elegans
actgataagaatt

SEQ ID NO: 699180 - DNA, 13 bp, C. elegans
actgataataatt

SEQ ID NO: 699181 - DNA, 13 bp, C. elegans
actgataatattt

SEQ ID NO: 699182 - DNA, 13 bp, C. elegans
actgataatttga

SEQ ID NO: 699183 - DNA, 13 bp, C. elegans
actgatatgaaaa

SEQ ID NO: 699184 - DNA, 13 bp, C. elegans
actgatatttttt

SEQ ID NO: 699185 - DNA, 13 bp, C. elegans
actgatcaatttt

SEQ ID NO: 699186 - DNA, 13 bp, C. elegans
actgatgaagaaa

SEQ ID NO: 699187 - DNA, 13 bp, C. elegans
actgatgaatttt

SEQ ID NO: 699188 - DNA, 13 bp, C. elegans
actgatggaaaac

SEQ ID NO: 699189 - DNA, 13 bp, C. elegans
actgattctgatg

SEQ ID NO: 699190 - DNA, 13 bp, C. elegans
actgatttattga

SEQ ID NO: 699191 - DNA, 13 bp, C. elegans
actgatttcatat

SEQ ID NO: 699192 - DNA, 13 bp, C. elegans
actgattttttca

SEQ ID NO: 699193 - DNA, 13 bp, C. elegans
actgcaaactaca

SEQ ID NO: 699194 - DNA, 13 bp, C. elegans
actgcaattttca

SEQ ID NO: 699195 - DNA, 13 bp, C. elegans
actgcaattttta

SEQ ID NO: 699196 - DNA, 13 bp, C. elegans
actgcacacaaaa

SEQ ID NO: 699197 - DNA, 13 bp, C. elegans
actgccaaatttt

SEQ ID NO: 699198 - DNA, 13 bp, C. elegans
actgccacgtcat

SEQ ID NO: 699199 - DNA, 13 bp, C. elegans
actgccagaattt

SEQ ID NO: 699200 - DNA, 13 bp, C. elegans
actgccagcaaaa

SEQ ID NO: 699201 - DNA, 13 bp, C. elegans
actgctaaaaaaa

SEQ ID NO: 699202 - DNA, 13 bp, C. elegans
actggaaaaattt

SEQ ID NO: 699203 - DNA, 13 bp, C. elegans
actggaaaatcat

SEQ ID NO: 699204 - DNA, 13 bp, C. elegans
actggaaatgaaa

SEQ ID NO: 699205 - DNA, 13 bp, C. elegans
actggaaattcaa

SEQ ID NO: 699206 - DNA, 13 bp, C. elegans
actggaaattgaa

SEQ ID NO: 699207 - DNA, 13 bp, C. elegans
actggaaatttca

SEQ ID NO: 699208 - DNA, 13 bp, C. elegans
actggaaatttga

SEQ ID NO: 699209 - DNA, 13 bp, C. elegans
actggaagaaaat

SEQ ID NO: 699210 - DNA, 13 bp, C. elegans
actggaataaaaa

SEQ ID NO: 699211 - DNA, 13 bp, C. elegans
actggcaaaattt

SEQ ID NO: 699212 - DNA, 13 bp, C. elegans
actggcaacattt

SEQ ID NO: 699213 - DNA, 13 bp, C. elegans
actggcgaaattt

SEQ ID NO: 699214 - DNA, 13 bp, C. elegans
actggcggagttt

SEQ ID NO: 699215 - DNA, 13 bp, C. elegans
actggtatttctt

SEQ ID NO: 699216 - DNA, 13 bp, C. elegans
actgtaaaaaaat

SEQ ID NO: 699217 - DNA, 13 bp, C. elegans
actgtaaaataaa

SEQ ID NO: 699218 - DNA, 13 bp, C. elegans
actgtaaaatatt

SEQ ID NO: 699219 - DNA, 13 bp, C. elegans
actgtaaaatgtt

SEQ ID NO: 699220 - DNA, 13 bp, C. elegans
actgtaaacaaaa

SEQ ID NO: 699221 - DNA, 13 bp, C. elegans
actgtaactcgtg

SEQ ID NO: 699222 - DNA, 13 bp, C. elegans
actgtaacttcaa

SEQ ID NO: 699223 - DNA, 13 bp, C. elegans
actgtaataattt

SEQ ID NO: 699224 - DNA, 13 bp, C. elegans
actgtaatatttt

SEQ ID NO: 699225 - DNA, 13 bp, C. elegans
actgtaatttcaa

SEQ ID NO: 699226 - DNA, 13 bp, C. elegans
actgtacaatttt

SEQ ID NO: 699227 - DNA, 13 bp, C. elegans
actgtagaaaaac

SEQ ID NO: 699228 - DNA, 13 bp, C. elegans
actgtagaattat

SEQ ID NO: 699229 - DNA, 13 bp, C. elegans
actgtagttttta

SEQ ID NO: 699230 - DNA, 13 bp, C. elegans
actgtataaaaaa

SEQ ID NO: 699231 - DNA, 13 bp, C. elegans
actgtatttaaaa

SEQ ID NO: 699232 - DNA, 13 bp, C. elegans
actgtattttcaa

SEQ ID NO: 699233 - DNA, 13 bp, C. elegans
actgtatttttaa

SEQ ID NO: 699234 - DNA, 13 bp, C. elegans
actgtatttttct

SEQ ID NO: 699235 - DNA, 13 bp, C. elegans
actgtcaaaaagt

SEQ ID NO: 699236 - DNA, 13 bp, C. elegans
actgtcaaaaatt

SEQ ID NO: 699237 - DNA, 13 bp, C. elegans
actgtcggctgct

SEQ ID NO: 699238 - DNA, 13 bp, C. elegans
actgtgaattttt

SEQ ID NO: 699239 - DNA, 13 bp, C. elegans
actgttcaaaaat

SEQ ID NO: 699240 - DNA, 13 bp, C. elegans
actgttcaaattt

SEQ ID NO: 699241 - DNA, 13 bp, C. elegans
actgttcaatttt

SEQ ID NO: 699242 - DNA, 13 bp, C. elegans
actgttggaaaat

SEQ ID NO: 699243 - DNA, 13 bp, C. elegans
actgttgtttaaa

SEQ ID NO: 699244 - DNA, 13 bp, C. elegans
actgtttcaaaaa

SEQ ID NO: 699245 - DNA, 13 bp, C. elegans
actgtttcaaggt

SEQ ID NO: 699246 - DNA, 13 bp, C. elegans
actgtttcaagtt

SEQ ID NO: 699247 - DNA, 13 bp, C. elegans
actgtttcacata

SEQ ID NO: 699248 - DNA, 13 bp, C. elegans
actgtttcactat

SEQ ID NO: 699249 - DNA, 13 bp, C. elegans
actgtttcagaaa

SEQ ID NO: 699250 - DNA, 13 bp, C. elegans
actgtttcagaac

SEQ ID NO: 699251 - DNA, 13 bp, C. elegans
actgtttcagaat

SEQ ID NO: 699252 - DNA, 13 bp, C. elegans
actgtttcagaga

SEQ ID NO: 699253 - DNA, 13 bp, C. elegans
actgtttcagttt

SEQ ID NO: 699254 - DNA, 13 bp, C. elegans
actgtttcataaa

SEQ ID NO: 699255 - DNA, 13 bp, C. elegans
actgtttcatcaa

SEQ ID NO: 699256 - DNA, 13 bp, C. elegans
actgtttcatgtt

SEQ ID NO: 699257 - DNA, 13 bp, C. elegans
actgtttcattat

SEQ ID NO: 699258 - DNA, 13 bp, C. elegans
actgttttaatat

SEQ ID NO: 699259 - DNA, 13 bp, C. elegans
actgttttaccgc

SEQ ID NO: 699260 - DNA, 13 bp, C. elegans
actgttttataaa

SEQ ID NO: 699261 - DNA, 13 bp, C. elegans
actgttttcattt

SEQ ID NO: 699262 - DNA, 13 bp, C. elegans
actgttttcgaaa

SEQ ID NO: 699263 - DNA, 13 bp, C. elegans
actgttttttctc

SEQ ID NO: 699264 - DNA, 13 bp, C. elegans
actgtttttttcc

SEQ ID NO: 699265 - DNA, 13 bp, C. elegans
acttaaaaattct

SEQ ID NO: 699266 - DNA, 13 bp, C. elegans
acttaaaacgttt

SEQ ID NO: 699267 - DNA, 13 bp, C. elegans
acttaaaatgttt

SEQ ID NO: 699268 - DNA, 13 bp, C. elegans
acttaaacatttt

SEQ ID NO: 699269 - DNA, 13 bp, C. elegans
acttaaagttttg

SEQ ID NO: 699270 - DNA, 13 bp, C. elegans
acttaaatgaaag

SEQ ID NO: 699271 - DNA, 13 bp, C. elegans
acttaaattttga

SEQ ID NO: 699272 - DNA, 13 bp, C. elegans
acttaacattttt

SEQ ID NO: 699273 - DNA, 13 bp, C. elegans
acttaatcatttt

SEQ ID NO: 699274 - DNA, 13 bp, C. elegans
acttaattcaaaa

SEQ ID NO: 699275 - DNA, 13 bp, C. elegans
acttaccaaaaat

SEQ ID NO: 699276 - DNA, 13 bp, C. elegans
acttactagttag

SEQ ID NO: 699277 - DNA, 13 bp, C. elegans
acttactattaga

SEQ ID NO: 699278 - DNA, 13 bp, C. elegans
acttatcaatttt

SEQ ID NO: 699279 - DNA, 13 bp, C. elegans
acttatcagaaaa

SEQ ID NO: 699280 - DNA, 13 bp, C. elegans
acttatcagtgat

SEQ ID NO: 699281 - DNA, 13 bp, C. elegans
acttatgggacaa

SEQ ID NO: 699282 - DNA, 13 bp, C. elegans
acttattcagaaa

SEQ ID NO: 699283 - DNA, 13 bp, C. elegans
acttatttttcca

SEQ ID NO: 699284 - DNA, 13 bp, C. elegans
acttcaaaaaatg

SEQ ID NO: 699285 - DNA, 13 bp, C. elegans
acttcaaaaacat

SEQ ID NO: 699286 - DNA, 13 bp, C. elegans
acttcaaaaatat

SEQ ID NO: 699287 - DNA, 13 bp, C. elegans
acttcaaaaccaa

SEQ ID NO: 699288 - DNA, 13 bp, C. elegans
acttcaaaacgag

SEQ ID NO: 699289 - DNA, 13 bp, C. elegans
acttcaaaactca

SEQ ID NO: 699290 - DNA, 13 bp, C. elegans
acttcaaaacttg

SEQ ID NO: 699291 - DNA, 13 bp, C. elegans
acttcaaaatatt

SEQ ID NO: 699292 - DNA, 13 bp, C. elegans
acttcaaaattca

SEQ ID NO: 699293 - DNA, 13 bp, C. elegans
acttcaaaattta

SEQ ID NO: 699294 - DNA, 13 bp, C. elegans
acttcaaacaatt

SEQ ID NO: 699295 - DNA, 13 bp, C. elegans
acttcaaaccaac

SEQ ID NO: 699296 - DNA, 13 bp, C. elegans
acttcaaatataa

SEQ ID NO: 699297 - DNA, 13 bp, C. elegans
acttcaaatgttc

SEQ ID NO: 699298 - DNA, 13 bp, C. elegans
acttcaaattaat

SEQ ID NO: 699299 - DNA, 13 bp, C. elegans
acttcaaatttct

SEQ ID NO: 699300 - DNA, 13 bp, C. elegans
acttcaaatttta

SEQ ID NO: 699301 - DNA, 13 bp, C. elegans
acttcaactgaaa

SEQ ID NO: 699302 - DNA, 13 bp, C. elegans
acttcaatatttt

SEQ ID NO: 699303 - DNA, 13 bp, C. elegans
acttcaattaaat

SEQ ID NO: 699304 - DNA, 13 bp, C. elegans
acttcaattattt

SEQ ID NO: 699305 - DNA, 13 bp, C. elegans
acttcaatttcaa

SEQ ID NO: 699306 - DNA, 13 bp, C. elegans
acttcaatttcat

SEQ ID NO: 699307 - DNA, 13 bp, C. elegans
acttcacacattt

SEQ ID NO: 699308 - DNA, 13 bp, C. elegans
acttcacatttta

SEQ ID NO: 699309 - DNA, 13 bp, C. elegans
acttcacttttca

SEQ ID NO: 699310 - DNA, 13 bp, C. elegans
acttcagagcatt

SEQ ID NO: 699311 - DNA, 13 bp, C. elegans
acttcagttttca

SEQ ID NO: 699312 - DNA, 13 bp, C. elegans
acttcatcagaaa

SEQ ID NO: 699313 - DNA, 13 bp, C. elegans
acttcatcttcca

SEQ ID NO: 699314 - DNA, 13 bp, C. elegans
acttcattaattt

SEQ ID NO: 699315 - DNA, 13 bp, C. elegans
acttcattcaaaa

SEQ ID NO: 699316 - DNA, 13 bp, C. elegans
acttcatttttcg

SEQ ID NO: 699317 - DNA, 13 bp, C. elegans
acttccaaaaact

SEQ ID NO: 699318 - DNA, 13 bp, C. elegans
acttccaaaaagt

SEQ ID NO: 699319 - DNA, 13 bp, C. elegans
acttccaaaacaa

SEQ ID NO: 699320 - DNA, 13 bp, C. elegans
acttccaaaatgt

SEQ ID NO: 699321 - DNA, 13 bp, C. elegans
acttccaaaatta

SEQ ID NO: 699322 - DNA, 13 bp, C. elegans
acttccaaattta

SEQ ID NO: 699323 - DNA, 13 bp, C. elegans
acttccaaatttg

SEQ ID NO: 699324 - DNA, 13 bp, C. elegans
acttccaacaaaa

SEQ ID NO: 699325 - DNA, 13 bp, C. elegans
acttccaattatt

SEQ ID NO: 699326 - DNA, 13 bp, C. elegans
acttccacaattt

SEQ ID NO: 699327 - DNA, 13 bp, C. elegans
acttccagaaaac

SEQ ID NO: 699328 - DNA, 13 bp, C. elegans
acttccagcaaat

SEQ ID NO: 699329 - DNA, 13 bp, C. elegans
acttcccgccaaa

SEQ ID NO: 699330 - DNA, 13 bp, C. elegans
acttcccttgtta

SEQ ID NO: 699331 - DNA, 13 bp, C. elegans
acttccgcatttt

SEQ ID NO: 699332 - DNA, 13 bp, C. elegans
acttccggcaaac

SEQ ID NO: 699333 - DNA, 13 bp, C. elegans
acttcctcaaaaa

SEQ ID NO: 699334 - DNA, 13 bp, C. elegans
acttcctgccaca

SEQ ID NO: 699335 - DNA, 13 bp, C. elegans
acttccttgtttt

SEQ ID NO: 699336 - DNA, 13 bp, C. elegans
acttcgaaaaaaa

SEQ ID NO: 699337 - DNA, 13 bp, C. elegans
acttctaaatatt

SEQ ID NO: 699338 - DNA, 13 bp, C. elegans
acttctaaattta

SEQ ID NO: 699339 - DNA, 13 bp, C. elegans
acttctaaatttc

SEQ ID NO: 699340 - DNA, 13 bp, C. elegans
acttctaaatttt

SEQ ID NO: 699341 - DNA, 13 bp, C. elegans
acttctaataaaa

SEQ ID NO: 699342 - DNA, 13 bp, C. elegans
acttctacagtat

SEQ ID NO: 699343 - DNA, 13 bp, C. elegans
acttctagttttt

SEQ ID NO: 699344 - DNA, 13 bp, C. elegans
acttctcaaaaaa

SEQ ID NO: 699345 - DNA, 13 bp, C. elegans
acttctcaaaata

SEQ ID NO: 699346 - DNA, 13 bp, C. elegans
acttctcaaaatt

SEQ ID NO: 699347 - DNA, 13 bp, C. elegans
acttctcaaccaa

SEQ ID NO: 699348 - DNA, 15 bp, C. elegans
acttctcaactgatt

SEQ ID NO: 699349 - DNA, 13 bp, C. elegans
acttctcacaaaa

SEQ ID NO: 699350 - DNA, 13 bp, C. elegans
acttctctcaaaa

SEQ ID NO: 699351 - DNA, 13 bp, C. elegans
acttctcttcatg

SEQ ID NO: 699352 - DNA, 13 bp, C. elegans
acttctggagcta

SEQ ID NO: 699353 - DNA, 13 bp, C. elegans
acttcttatcaat

SEQ ID NO: 699354 - DNA, 13 bp, C. elegans
acttcttcaaaaa

SEQ ID NO: 699355 - DNA, 13 bp, C. elegans
acttcttctaatt

SEQ ID NO: 699356 - DNA, 13 bp, C. elegans
acttcttgaaaaa

SEQ ID NO: 699357 - DNA, 14 bp, C. elegans
acttcttgaaaact

SEQ ID NO: 699358 - DNA, 13 bp, C. elegans
acttcttgaaatc

SEQ ID NO: 699359 - DNA, 13 bp, C. elegans
acttctttaaaat

SEQ ID NO: 699360 - DNA, 13 bp, C. elegans
acttgaaaaactc

SEQ ID NO: 699361 - DNA, 13 bp, C. elegans
acttgaaaaagaa

SEQ ID NO: 699362 - DNA, 13 bp, C. elegans
acttgaaaacaaa

SEQ ID NO: 699363 - DNA, 13 bp, C. elegans
acttgaaaacaat

SEQ ID NO: 699364 - DNA, 13 bp, C. elegans
acttgaaaactga

SEQ ID NO: 699365 - DNA, 13 bp, C. elegans
acttgaaaactgt

SEQ ID NO: 699366 - DNA, 13 bp, C. elegans
acttgaaaataat

SEQ ID NO: 699367 - DNA, 13 bp, C. elegans
acttgaaaattga

SEQ ID NO: 699368 - DNA, 13 bp, C. elegans
acttgaaacaatt

SEQ ID NO: 699369 - DNA, 13 bp, C. elegans
acttgaaacagta

SEQ ID NO: 699370 - DNA, 13 bp, C. elegans
acttgaaacttta

SEQ ID NO: 699371 - DNA, 14 bp, C. elegans
acttgaaagttatt

SEQ ID NO: 699372 - DNA, 13 bp, C. elegans
acttgaaataatt

SEQ ID NO: 699373 - DNA, 14 bp, C. elegans
acttgaacactctt

SEQ ID NO: 699374 - DNA, 13 bp, C. elegans
acttgaacttttt

SEQ ID NO: 699375 - DNA, 13 bp, C. elegans
acttgaagatttt

SEQ ID NO: 699376 - DNA, 13 bp, C. elegans
acttgaataaatt

SEQ ID NO: 699377 - DNA, 13 bp, C. elegans
acttgaatattat

SEQ ID NO: 699378 - DNA, 13 bp, C. elegans
acttgaatattta

SEQ ID NO: 699379 - DNA, 13 bp, C. elegans
acttgaatatttt

SEQ ID NO: 699380 - DNA, 13 bp, C. elegans
acttgaatcagca

SEQ ID NO: 699381 - DNA, 13 bp, C. elegans
acttgaattttta

SEQ ID NO: 699382 - DNA, 13 bp, C. elegans
acttgacaaaaat

SEQ ID NO: 699383 - DNA, 13 bp, C. elegans
acttgataaaata

SEQ ID NO: 699384 - DNA, 13 bp, C. elegans
acttgataaactc

SEQ ID NO: 699385 - DNA, 13 bp, C. elegans
acttgataatttt

SEQ ID NO: 699386 - DNA, 13 bp, C. elegans
acttgatgaaaca

SEQ ID NO: 699387 - DNA, 13 bp, C. elegans
acttgcaaaaata

SEQ ID NO: 699388 - DNA, 13 bp, C. elegans
acttgcaacaaaa

SEQ ID NO: 699389 - DNA, 13 bp, C. elegans
acttgccgaattt

SEQ ID NO: 699390 - DNA, 13 bp, C. elegans
acttgccgagctc

SEQ ID NO: 699391 - DNA, 13 bp, C. elegans
acttgccgatttg

SEQ ID NO: 699392 - DNA, 13 bp, C. elegans
acttgccggtttt

SEQ ID NO: 699393 - DNA, 13 bp, C. elegans
acttgctgatttg

SEQ ID NO: 699394 - DNA, 13 bp, C. elegans
acttggttccaaa

SEQ ID NO: 699395 - DNA, 13 bp, C. elegans
acttgtcaatgtc

SEQ ID NO: 699396 - DNA, 13 bp, C. elegans
acttgtctaaaaa

SEQ ID NO: 699397 - DNA, 13 bp, C. elegans
acttgtgattttc

SEQ ID NO: 699398 - DNA, 13 bp, C. elegans
acttgttgaaaaa

SEQ ID NO: 699399 - DNA, 13 bp, C. elegans
acttgttgaaaca

SEQ ID NO: 699400 - DNA, 13 bp, C. elegans
acttgtttcaaaa

SEQ ID NO: 699401 - DNA, 13 bp, C. elegans
acttgttttgaaa

SEQ ID NO: 699402 - DNA, 13 bp, C. elegans
acttgttttgtct

SEQ ID NO: 699403 - DNA, 13 bp, C. elegans
actttaaaaaatc

SEQ ID NO: 699404 - DNA, 13 bp, C. elegans
actttaaaaacat

SEQ ID NO: 699405 - DNA, 13 bp, C. elegans
actttaaaacttt

SEQ ID NO: 699406 - DNA, 13 bp, C. elegans
actttaaaagtgt

SEQ ID NO: 699407 - DNA, 13 bp, C. elegans
actttaaaagttg

SEQ ID NO: 699408 - DNA, 13 bp, C. elegans
actttaaaattct

SEQ ID NO: 699409 - DNA, 13 bp, C. elegans
actttaaagatca

SEQ ID NO: 699410 - DNA, 13 bp, C. elegans
actttaacatttt

SEQ ID NO: 699411 - DNA, 13 bp, C. elegans
actttaattattc

SEQ ID NO: 699412 - DNA, 13 bp, C. elegans
actttaattgtca

SEQ ID NO: 699413 - DNA, 13 bp, C. elegans
actttaatttgtt

SEQ ID NO: 699414 - DNA, 13 bp, C. elegans
actttaattttga

SEQ ID NO: 699415 - DNA, 13 bp, C. elegans
actttacattttc

SEQ ID NO: 699416 - DNA, 13 bp, C. elegans
actttatagtttt

SEQ ID NO: 699417 - DNA, 13 bp, C. elegans
actttatcagttt

SEQ ID NO: 699418 - DNA, 13 bp, C. elegans
actttatttcaaa

SEQ ID NO: 699419 - DNA, 13 bp, C. elegans
actttcaaaaatg

SEQ ID NO: 699420 - DNA, 13 bp, C. elegans
actttcaaaagtt

SEQ ID NO: 699421 - DNA, 13 bp, C. elegans
actttcaaaataa

SEQ ID NO: 699422 - DNA, 13 bp, C. elegans
actttcaaaatta

SEQ ID NO: 699423 - DNA, 13 bp, C. elegans
actttcaaaattc

SEQ ID NO: 699424 - DNA, 13 bp, C. elegans
actttcaaagttt

SEQ ID NO: 699425 - DNA, 13 bp, C. elegans
actttcaaatatt

SEQ ID NO: 699426 - DNA, 13 bp, C. elegans
actttcaaattga

SEQ ID NO: 699427 - DNA, 13 bp, C. elegans
actttcaaatttc

SEQ ID NO: 699428 - DNA, 14 bp, C. elegans
actttcaaattttc

SEQ ID NO: 699429 - DNA, 13 bp, C. elegans
actttcaacaatt

SEQ ID NO: 699430 - DNA, 13 bp, C. elegans
actttcaactttt

SEQ ID NO: 699431 - DNA, 13 bp, C. elegans
actttcaagtttt

SEQ ID NO: 699432 - DNA, 13 bp, C. elegans
actttcaatattc

SEQ ID NO: 699433 - DNA, 13 bp, C. elegans
actttcaatattt

SEQ ID NO: 699434 - DNA, 13 bp, C. elegans
actttcaatgttt

SEQ ID NO: 699435 - DNA, 13 bp, C. elegans
actttcaattccg

SEQ ID NO: 699436 - DNA, 13 bp, C. elegans
actttcaatttaa

SEQ ID NO: 699437 - DNA, 13 bp, C. elegans
actttcaatttat

SEQ ID NO: 699438 - DNA, 13 bp, C. elegans
actttcaatttca

SEQ ID NO: 699439 - DNA, 13 bp, C. elegans
actttcaatttct

SEQ ID NO: 699440 - DNA, 13 bp, C. elegans
actttcaatttga

SEQ ID NO: 699441 - DNA, 13 bp, C. elegans
actttcacataaa

SEQ ID NO: 699442 - DNA, 13 bp, C. elegans
actttcagaaaat

SEQ ID NO: 699443 - DNA, 13 bp, C. elegans
actttcagatatt

SEQ ID NO: 699444 - DNA, 13 bp, C. elegans
actttcataaaat

SEQ ID NO: 699445 - DNA, 13 bp, C. elegans
actttcatattca

SEQ ID NO: 699446 - DNA, 13 bp, C. elegans
actttcattgttt

SEQ ID NO: 699447 - DNA, 13 bp, C. elegans
actttcattttaa

SEQ ID NO: 699448 - DNA, 13 bp, C. elegans
actttcattttca

SEQ ID NO: 699449 - DNA, 13 bp, C. elegans
actttccaaaaac

SEQ ID NO: 699450 - DNA, 13 bp, C. elegans
actttccaagaaa

SEQ ID NO: 699451 - DNA, 13 bp, C. elegans
actttccaataaa

SEQ ID NO: 699452 - DNA, 13 bp, C. elegans
actttccagaaat

SEQ ID NO: 699453 - DNA, 13 bp, C. elegans
actttcctcgaca

SEQ ID NO: 699454 - DNA, 13 bp, C. elegans
actttcgaaactt

SEQ ID NO: 699455 - DNA, 13 bp, C. elegans
actttcgacaact

SEQ ID NO: 699456 - DNA, 13 bp, C. elegans
actttcgattttt

SEQ ID NO: 699457 - DNA, 13 bp, C. elegans
actttcggaaaaa

SEQ ID NO: 699458 - DNA, 13 bp, C. elegans
actttctaaaaat

SEQ ID NO: 699459 - DNA, 13 bp, C. elegans
actttctaaaatt

SEQ ID NO: 699460 - DNA, 13 bp, C. elegans
actttctaatttc

SEQ ID NO: 699461 - DNA, 13 bp, C. elegans
actttctacaatt

SEQ ID NO: 699462 - DNA, 13 bp, C. elegans
actttctaccaaa

SEQ ID NO: 699463 - DNA, 13 bp, C. elegans
actttctagaata

SEQ ID NO: 699464 - DNA, 13 bp, C. elegans
actttctccaatt

SEQ ID NO: 699465 - DNA, 13 bp, C. elegans
actttctcgaatt

SEQ ID NO: 699466 - DNA, 13 bp, C. elegans
actttctcgtttt

SEQ ID NO: 699467 - DNA, 13 bp, C. elegans
actttctgaaaat

SEQ ID NO: 699468 - DNA, 13 bp, C. elegans
actttctgaaata

SEQ ID NO: 699469 - DNA, 13 bp, C. elegans
actttcttccaaa

SEQ ID NO: 699470 - DNA, 13 bp, C. elegans
actttgaaaaatc

SEQ ID NO: 699471 - DNA, 13 bp, C. elegans
actttgaaaatgt

SEQ ID NO: 699472 - DNA, 13 bp, C. elegans
actttgaaaatta

SEQ ID NO: 699473 - DNA, 13 bp, C. elegans
actttgaaaattt

SEQ ID NO: 699474 - DNA, 13 bp, C. elegans
actttgaaactga

SEQ ID NO: 699475 - DNA, 13 bp, C. elegans
actttgaaacttt

SEQ ID NO: 699476 - DNA, 13 bp, C. elegans
actttgaaagtaa

SEQ ID NO: 699477 - DNA, 13 bp, C. elegans
actttgaaattaa

SEQ ID NO: 699478 - DNA, 13 bp, C. elegans
actttgaaattgt

SEQ ID NO: 699479 - DNA, 13 bp, C. elegans
actttgaaatttc

SEQ ID NO: 699480 - DNA, 13 bp, C. elegans
actttgaacttta

SEQ ID NO: 699481 - DNA, 13 bp, C. elegans
actttgaagaatt

SEQ ID NO: 699482 - DNA, 14 bp, C. elegans
actttgaagagatt

SEQ ID NO: 699483 - DNA, 13 bp, C. elegans
actttgaccgaaa

SEQ ID NO: 699484 - DNA, 13 bp, C. elegans
actttgactggaa

SEQ ID NO: 699485 - DNA, 13 bp, C. elegans
actttgagttttc

SEQ ID NO: 699486 - DNA, 13 bp, C. elegans
actttgatgaaaa

SEQ ID NO: 699487 - DNA, 13 bp, C. elegans
actttgcaatttt

SEQ ID NO: 699488 - DNA, 13 bp, C. elegans
actttgcacattt

SEQ ID NO: 699489 - DNA, 13 bp, C. elegans
actttgctctttt

SEQ ID NO: 699490 - DNA, 13 bp, C. elegans
actttgctttttc

SEQ ID NO: 699491 - DNA, 13 bp, C. elegans
actttggaaattc

SEQ ID NO: 699492 - DNA, 13 bp, C. elegans
actttggatgctt

SEQ ID NO: 699493 - DNA, 13 bp, C. elegans
actttggattttc

SEQ ID NO: 699494 - DNA, 13 bp, C. elegans
actttgggaattc

SEQ ID NO: 699495 - DNA, 13 bp, C. elegans
actttgggaattt

SEQ ID NO: 699496 - DNA, 13 bp, C. elegans
actttgttaattt

SEQ ID NO: 699497 - DNA, 13 bp, C. elegans
actttgttcaaaa

SEQ ID NO: 699498 - DNA, 13 bp, C. elegans
actttgttcattt

SEQ ID NO: 699499 - DNA, 13 bp, C. elegans
actttgttgaaaa

SEQ ID NO: 699500 - DNA, 13 bp, C. elegans
actttgttttgtc

SEQ ID NO: 699501 - DNA, 13 bp, C. elegans
acttttaaaatgt

SEQ ID NO: 699502 - DNA, 13 bp, C. elegans
acttttaaacaat

SEQ ID NO: 699503 - DNA, 13 bp, C. elegans
acttttaaagttt

SEQ ID NO: 699504 - DNA, 13 bp, C. elegans
acttttaaattgt

SEQ ID NO: 699505 - DNA, 13 bp, C. elegans
acttttaaatttg

SEQ ID NO: 699506 - DNA, 13 bp, C. elegans
acttttaaggttt

SEQ ID NO: 699507 - DNA, 13 bp, C. elegans
acttttaatgaaa

SEQ ID NO: 699508 - DNA, 14 bp, C. elegans
acttttaatgaaaa

SEQ ID NO: 699509 - DNA, 13 bp, C. elegans
acttttaattgta

SEQ ID NO: 699510 - DNA, 13 bp, C. elegans
acttttacaaatt

SEQ ID NO: 699511 - DNA, 13 bp, C. elegans
acttttacaattt

SEQ ID NO: 699512 - DNA, 13 bp, C. elegans
acttttacacttt

SEQ ID NO: 699513 - DNA, 13 bp, C. elegans
acttttacattta

SEQ ID NO: 699514 - DNA, 13 bp, C. elegans
acttttataaaac

SEQ ID NO: 699515 - DNA, 13 bp, C. elegans
acttttataactt

SEQ ID NO: 699516 - DNA, 13 bp, C. elegans
acttttatcagtt

SEQ ID NO: 699517 - DNA, 13 bp, C. elegans
acttttatcgatt

SEQ ID NO: 699518 - DNA, 13 bp, C. elegans
acttttatgaata

SEQ ID NO: 699519 - DNA, 13 bp, C. elegans
acttttattcaat

SEQ ID NO: 699520 - DNA, 13 bp, C. elegans
acttttattctaa

SEQ ID NO: 699521 - DNA, 13 bp, C. elegans
acttttattgaat

SEQ ID NO: 699522 - DNA, 13 bp, C. elegans
acttttattgatt

SEQ ID NO: 699523 - DNA, 13 bp, C. elegans
acttttatttcaa

SEQ ID NO: 699524 - DNA, 13 bp, C. elegans
acttttatttgtg

SEQ ID NO: 699525 - DNA, 13 bp, C. elegans
acttttcaaacaa

SEQ ID NO: 699526 - DNA, 13 bp, C. elegans
acttttcaaagaa

SEQ ID NO: 699527 - DNA, 13 bp, C. elegans
acttttcaaagtt

SEQ ID NO: 699528 - DNA, 13 bp, C. elegans
acttttcaaatcg

SEQ ID NO: 699529 - DNA, 13 bp, C. elegans
acttttcaactaa

SEQ ID NO: 699530 - DNA, 13 bp, C. elegans
acttttcaacttc

SEQ ID NO: 699531 - DNA, 13 bp, C. elegans
acttttcaagaaa

SEQ ID NO: 699532 - DNA, 13 bp, C. elegans
acttttcaagaat

SEQ ID NO: 699533 - DNA, 13 bp, C. elegans
acttttcaatcaa

SEQ ID NO: 699534 - DNA, 13 bp, C. elegans
acttttcaattct

SEQ ID NO: 699535 - DNA, 13 bp, C. elegans
acttttcagttaa

SEQ ID NO: 699536 - DNA, 13 bp, C. elegans
acttttcatcaaa

SEQ ID NO: 699537 - DNA, 13 bp, C. elegans
acttttcattgaa

SEQ ID NO: 699538 - DNA, 13 bp, C. elegans
acttttccaaaaa

SEQ ID NO: 699539 - DNA, 13 bp, C. elegans
acttttccaacat

SEQ ID NO: 699540 - DNA, 13 bp, C. elegans
acttttccaataa

SEQ ID NO: 699541 - DNA, 13 bp, C. elegans
acttttccacatt

SEQ ID NO: 699542 - DNA, 13 bp, C. elegans
acttttccacgcg

SEQ ID NO: 699543 - DNA, 13 bp, C. elegans
acttttccagatt

SEQ ID NO: 699544 - DNA, 13 bp, C. elegans
acttttccccaaa

SEQ ID NO: 699545 - DNA, 13 bp, C. elegans
acttttccgaaaa

SEQ ID NO: 699546 - DNA, 13 bp, C. elegans
acttttccggttt

SEQ ID NO: 699547 - DNA, 13 bp, C. elegans
acttttcctaaaa

SEQ ID NO: 699548 - DNA, 13 bp, C. elegans
acttttcctaatt

SEQ ID NO: 699549 - DNA, 13 bp, C. elegans
acttttcctcaaa

SEQ ID NO: 699550 - DNA, 13 bp, C. elegans
acttttcctgaaa

SEQ ID NO: 699551 - DNA, 13 bp, C. elegans
acttttccttcaa

SEQ ID NO: 699552 - DNA, 13 bp, C. elegans
acttttcgacaaa

SEQ ID NO: 699553 - DNA, 13 bp, C. elegans
acttttcgagaaa

SEQ ID NO: 699554 - DNA, 13 bp, C. elegans
acttttcgataaa

SEQ ID NO: 699555 - DNA, 13 bp, C. elegans
acttttcgattaa

SEQ ID NO: 699556 - DNA, 13 bp, C. elegans
acttttcgcattt

SEQ ID NO: 699557 - DNA, 13 bp, C. elegans
acttttcggtttt

SEQ ID NO: 699558 - DNA, 13 bp, C. elegans
acttttcgttttc

SEQ ID NO: 699559 - DNA, 13 bp, C. elegans
acttttctaatta

SEQ ID NO: 699560 - DNA, 13 bp, C. elegans
acttttctacaaa

SEQ ID NO: 699561 - DNA, 13 bp, C. elegans
acttttctataaa

SEQ ID NO: 699562 - DNA, 13 bp, C. elegans
acttttctataat

SEQ ID NO: 699563 - DNA, 13 bp, C. elegans
acttttctcaata

SEQ ID NO: 699564 - DNA, 13 bp, C. elegans
acttttctctcga

SEQ ID NO: 699565 - DNA, 13 bp, C. elegans
acttttctgaaaa

SEQ ID NO: 699566 - DNA, 13 bp, C. elegans
acttttctgcaat

SEQ ID NO: 699567 - DNA, 13 bp, C. elegans
acttttctggcgg

SEQ ID NO: 699568 - DNA, 13 bp, C. elegans
acttttcttccca

SEQ ID NO: 699569 - DNA, 13 bp, C. elegans
acttttctttgaa

SEQ ID NO: 699570 - DNA, 13 bp, C. elegans
acttttgaaaaat

SEQ ID NO: 699571 - DNA, 13 bp, C. elegans
acttttgaaacat

SEQ ID NO: 699572 - DNA, 13 bp, C. elegans
acttttgaaatat

SEQ ID NO: 699573 - DNA, 13 bp, C. elegans
acttttgaagatt

SEQ ID NO: 699574 - DNA, 13 bp, C. elegans
acttttgaagttt

SEQ ID NO: 699575 - DNA, 13 bp, C. elegans
acttttgaatcaa

SEQ ID NO: 699576 - DNA, 13 bp, C. elegans
acttttgaatttt

SEQ ID NO: 699577 - DNA, 13 bp, C. elegans
acttttgagagaa

SEQ ID NO: 699578 - DNA, 13 bp, C. elegans
acttttgaggaaa

SEQ ID NO: 699579 - DNA, 13 bp, C. elegans
acttttgatatca

SEQ ID NO: 699580 - DNA, 13 bp, C. elegans
acttttgatctac

SEQ ID NO: 699581 - DNA, 13 bp, C. elegans
acttttgatgatt

SEQ ID NO: 699582 - DNA, 13 bp, C. elegans
acttttgattaaa

SEQ ID NO: 699583 - DNA, 13 bp, C. elegans
acttttgattcaa

SEQ ID NO: 699584 - DNA, 13 bp, C. elegans
acttttgattttc

SEQ ID NO: 699585 - DNA, 13 bp, C. elegans
acttttgcaaatt

SEQ ID NO: 699586 - DNA, 13 bp, C. elegans
acttttgcaattt

SEQ ID NO: 699587 - DNA, 13 bp, C. elegans
acttttgccaatt

SEQ ID NO: 699588 - DNA, 13 bp, C. elegans
acttttgccattt

SEQ ID NO: 699589 - DNA, 13 bp, C. elegans
acttttgctcttt

SEQ ID NO: 699590 - DNA, 13 bp, C. elegans
acttttgcttgaa

SEQ ID NO: 699591 - DNA, 13 bp, C. elegans
acttttggaaaag

SEQ ID NO: 699592 - DNA, 13 bp, C. elegans
acttttggaaatt

SEQ ID NO: 699593 - DNA, 13 bp, C. elegans
acttttggaagaa

SEQ ID NO: 699594 - DNA, 13 bp, C. elegans
acttttggaataa

SEQ ID NO: 699595 - DNA, 14 bp, C. elegans
acttttggagctac

SEQ ID NO: 699596 - DNA, 13 bp, C. elegans
acttttggtaaat

SEQ ID NO: 699597 - DNA, 13 bp, C. elegans
acttttgtaacaa

SEQ ID NO: 699598 - DNA, 13 bp, C. elegans
acttttgtaataa

SEQ ID NO: 699599 - DNA, 13 bp, C. elegans
acttttgtagttt

SEQ ID NO: 699600 - DNA, 13 bp, C. elegans
acttttgtcaatt

SEQ ID NO: 699601 - DNA, 13 bp, C. elegans
acttttgtgtaaa

SEQ ID NO: 699602 - DNA, 13 bp, C. elegans
acttttgttgtga

SEQ ID NO: 699603 - DNA, 13 bp, C. elegans
acttttgttgttg

SEQ ID NO: 699604 - DNA, 13 bp, C. elegans
actttttaaaggt

SEQ ID NO: 699605 - DNA, 13 bp, C. elegans
actttttaaagtt

SEQ ID NO: 699606 - DNA, 13 bp, C. elegans
actttttaaatga

SEQ ID NO: 699607 - DNA, 13 bp, C. elegans
actttttaacaaa

SEQ ID NO: 699608 - DNA, 13 bp, C. elegans
actttttaaccaa

SEQ ID NO: 699609 - DNA, 13 bp, C. elegans
actttttaacgtg

SEQ ID NO: 699610 - DNA, 13 bp, C. elegans
actttttaatatc

SEQ ID NO: 699611 - DNA, 13 bp, C. elegans
actttttaatgga

SEQ ID NO: 699612 - DNA, 13 bp, C. elegans
actttttaatgtt

SEQ ID NO: 699613 - DNA, 13 bp, C. elegans
actttttacaact

SEQ ID NO: 699614 - DNA, 13 bp, C. elegans
actttttacaatt

SEQ ID NO: 699615 - DNA, 13 bp, C. elegans
actttttacataa

SEQ ID NO: 699616 - DNA, 13 bp, C. elegans
actttttatgaaa

SEQ ID NO: 699617 - DNA, 13 bp, C. elegans
actttttatgaat

SEQ ID NO: 699618 - DNA, 13 bp, C. elegans
actttttatggaa

SEQ ID NO: 699619 - DNA, 13 bp, C. elegans
actttttattcaa

SEQ ID NO: 699620 - DNA, 13 bp, C. elegans
actttttattcca

SEQ ID NO: 699621 - DNA, 13 bp, C. elegans
actttttcaaaaa

SEQ ID NO: 699622 - DNA, 13 bp, C. elegans
actttttcaaatt

SEQ ID NO: 699623 - DNA, 13 bp, C. elegans
actttttcaacta

SEQ ID NO: 699624 - DNA, 13 bp, C. elegans
actttttcacaaa

SEQ ID NO: 699625 - DNA, 13 bp, C. elegans
actttttcaccaa

SEQ ID NO: 699626 - DNA, 13 bp, C. elegans
actttttcactga

SEQ ID NO: 699627 - DNA, 13 bp, C. elegans
actttttcactgt

SEQ ID NO: 699628 - DNA, 13 bp, C. elegans
actttttcagcaa

SEQ ID NO: 699629 - DNA, 13 bp, C. elegans
actttttcattaa

SEQ ID NO: 699630 - DNA, 13 bp, C. elegans
actttttcatttg

SEQ ID NO: 699631 - DNA, 13 bp, C. elegans
actttttccaatt

SEQ ID NO: 699632 - DNA, 13 bp, C. elegans
actttttccacaa

SEQ ID NO: 699633 - DNA, 13 bp, C. elegans
actttttcctgtt

SEQ ID NO: 699634 - DNA, 13 bp, C. elegans
actttttcgagaa

SEQ ID NO: 699635 - DNA, 13 bp, C. elegans
actttttcgtaaa

SEQ ID NO: 699636 - DNA, 13 bp, C. elegans
actttttctaaaa

SEQ ID NO: 699637 - DNA, 13 bp, C. elegans
actttttctagaa

SEQ ID NO: 699638 - DNA, 13 bp, C. elegans
actttttctcaat

SEQ ID NO: 699639 - DNA, 13 bp, C. elegans
actttttctccat

SEQ ID NO: 699640 - DNA, 13 bp, C. elegans
actttttctcgtc

SEQ ID NO: 699641 - DNA, 13 bp, C. elegans
actttttctctaa

SEQ ID NO: 699642 - DNA, 13 bp, C. elegans
actttttctgaaa

SEQ ID NO: 699643 - DNA, 13 bp, C. elegans
actttttctgtaa

SEQ ID NO: 699644 - DNA, 13 bp, C. elegans
actttttctttga

SEQ ID NO: 699645 - DNA, 13 bp, C. elegans
actttttgaaatt

SEQ ID NO: 699646 - DNA, 13 bp, C. elegans
actttttgaacat

SEQ ID NO: 699647 - DNA, 13 bp, C. elegans
actttttgaagtt

SEQ ID NO: 699648 - DNA, 13 bp, C. elegans
actttttgacagt

SEQ ID NO: 699649 - DNA, 13 bp, C. elegans
actttttgacatt

SEQ ID NO: 699650 - DNA, 13 bp, C. elegans
actttttgaccaa

SEQ ID NO: 699651 - DNA, 13 bp, C. elegans
actttttgagcaa

SEQ ID NO: 699652 - DNA, 13 bp, C. elegans
actttttgagcag

SEQ ID NO: 699653 - DNA, 13 bp, C. elegans
actttttgatact

SEQ ID NO: 699654 - DNA, 13 bp, C. elegans
actttttgatgaa

SEQ ID NO: 699655 - DNA, 13 bp, C. elegans
actttttgattca

SEQ ID NO: 699656 - DNA, 13 bp, C. elegans
actttttgcaaat

SEQ ID NO: 699657 - DNA, 13 bp, C. elegans
actttttgcagtt

SEQ ID NO: 699658 - DNA, 13 bp, C. elegans
actttttgctctt

SEQ ID NO: 699659 - DNA, 13 bp, C. elegans
actttttggaagt

SEQ ID NO: 699660 - DNA, 13 bp, C. elegans
actttttggagaa

SEQ ID NO: 699661 - DNA, 13 bp, C. elegans
actttttggcatt

SEQ ID NO: 699662 - DNA, 13 bp, C. elegans
actttttgggaaa

SEQ ID NO: 699663 - DNA, 13 bp, C. elegans
actttttgggaat

SEQ ID NO: 699664 - DNA, 13 bp, C. elegans
actttttgtgaaa

SEQ ID NO: 699665 - DNA, 13 bp, C. elegans
actttttgtgtca

SEQ ID NO: 699666 - DNA, 13 bp, C. elegans
acttttttaaaac

SEQ ID NO: 699667 - DNA, 13 bp, C. elegans
acttttttacaaa

SEQ ID NO: 699668 - DNA, 13 bp, C. elegans
acttttttatagc

SEQ ID NO: 699669 - DNA, 13 bp, C. elegans
acttttttatcga

SEQ ID NO: 699670 - DNA, 13 bp, C. elegans
acttttttcaata

SEQ ID NO: 699671 - DNA, 13 bp, C. elegans
acttttttccgaa

SEQ ID NO: 699672 - DNA, 13 bp, C. elegans
acttttttcgaat

SEQ ID NO: 699673 - DNA, 13 bp, C. elegans
acttttttcgaga

SEQ ID NO: 699674 - DNA, 13 bp, C. elegans
acttttttctaag

SEQ ID NO: 699675 - DNA, 13 bp, C. elegans
acttttttctcag

SEQ ID NO: 699676 - DNA, 13 bp, C. elegans
acttttttcttgg

SEQ ID NO: 699677 - DNA, 13 bp, C. elegans
acttttttgaaat

SEQ ID NO: 699678 - DNA, 13 bp, C. elegans
acttttttgaata

SEQ ID NO: 699679 - DNA, 13 bp, C. elegans
acttttttgacag

SEQ ID NO: 699680 - DNA, 13 bp, C. elegans
acttttttgatgt

SEQ ID NO: 699681 - DNA, 13 bp, C. elegans
acttttttgcaaa

SEQ ID NO: 699682 - DNA, 13 bp, C. elegans
acttttttgcatt

SEQ ID NO: 699683 - DNA, 13 bp, C. elegans
acttttttggaaa

SEQ ID NO: 699684 - DNA, 13 bp, C. elegans
acttttttggagt

SEQ ID NO: 699685 - DNA, 13 bp, C. elegans
acttttttggtaa

SEQ ID NO: 699686 - DNA, 13 bp, C. elegans
acttttttgtaaa

SEQ ID NO: 699687 - DNA, 13 bp, C. elegans
acttttttgtaca

SEQ ID NO: 699688 - DNA, 13 bp, C. elegans
acttttttgtact

SEQ ID NO: 699689 - DNA, 13 bp, C. elegans
acttttttgtcaa

SEQ ID NO: 699690 - DNA, 13 bp, C. elegans
acttttttgttaa

SEQ ID NO: 699691 - DNA, 13 bp, C. elegans
actttttttcaaa

SEQ ID NO: 699692 - DNA, 13 bp, C. elegans
actttttttcggt

SEQ ID NO: 699693 - DNA, 13 bp, C. elegans
actttttttgaaa

SEQ ID NO: 699694 - DNA, 13 bp, C. elegans
actttttttgaat

SEQ ID NO: 699695 - DNA, 13 bp, C. elegans
acttttttttcag

SEQ ID NO: 699696 - DNA, 13 bp, C. elegans
acttttttttgac

SEQ ID NO: 699697 - DNA, 13 bp, C. elegans
acttttttttgag

SEQ ID NO: 699698 - DNA, 13 bp, C. elegans
acttttttttgca

SEQ ID NO: 699699 - DNA, 13 bp, C. elegans
acttttttttgga

SEQ ID NO: 699700 - DNA, 13 bp, C. elegans
agaaaaaaccatg

SEQ ID NO: 699701 - DNA, 13 bp, C. elegans
agaaaaaacttga

SEQ ID NO: 699702 - DNA, 13 bp, C. elegans
agaaaaaagagct

SEQ ID NO: 699703 - DNA, 13 bp, C. elegans
agaaaaaagtgtt

SEQ ID NO: 699704 - DNA, 13 bp, C. elegans
agaaaaaatcgat

SEQ ID NO: 699705 - DNA, 13 bp, C. elegans
agaaaaaatcgga

SEQ ID NO: 699706 - DNA, 13 bp, C. elegans
agaaaaaatcgtt

SEQ ID NO: 699707 - DNA, 13 bp, C. elegans
agaaaaaattcca

SEQ ID NO: 699708 - DNA, 13 bp, C. elegans
agaaaaaattcga

SEQ ID NO: 699709 - DNA, 13 bp, C. elegans
agaaaaacatatt

SEQ ID NO: 699710 - DNA, 13 bp, C. elegans
agaaaaacatttg

SEQ ID NO: 699711 - DNA, 13 bp, C. elegans
agaaaaacatttt

SEQ ID NO: 699712 - DNA, 13 bp, C. elegans
agaaaaacgaatg

SEQ ID NO: 699713 - DNA, 13 bp, C. elegans
agaaaaacgatta

SEQ ID NO: 699714 - DNA, 13 bp, C. elegans
agaaaaacgattt

SEQ ID NO: 699715 - DNA, 13 bp, C. elegans
agaaaaactatga

SEQ ID NO: 699716 - DNA, 13 bp, C. elegans
agaaaaactgaga

SEQ ID NO: 699717 - DNA, 13 bp, C. elegans
agaaaaacttcaa

SEQ ID NO: 699718 - DNA, 13 bp, C. elegans
agaaaaagaattc

SEQ ID NO: 699719 - DNA, 13 bp, C. elegans
agaaaaagagcta

SEQ ID NO: 699720 - DNA, 13 bp, C. elegans
agaaaaagatcct

SEQ ID NO: 699721 - DNA, 13 bp, C. elegans
agaaaaagcaatt

SEQ ID NO: 699722 - DNA, 13 bp, C. elegans
agaaaaaggtttt

SEQ ID NO: 699723 - DNA, 13 bp, C. elegans
agaaaaagtcaag

SEQ ID NO: 699724 - DNA, 13 bp, C. elegans
agaaaaagtgaca

SEQ ID NO: 699725 - DNA, 13 bp, C. elegans
agaaaaagtgttc

SEQ ID NO: 699726 - DNA, 13 bp, C. elegans
agaaaaagttcga

SEQ ID NO: 699727 - DNA, 13 bp, C. elegans
agaaaaatatttg

SEQ ID NO: 699728 - DNA, 13 bp, C. elegans
agaaaaatccaat

SEQ ID NO: 699729 - DNA, 13 bp, C. elegans
agaaaaatcgacg

SEQ ID NO: 699730 - DNA, 13 bp, C. elegans
agaaaaatcgatg

SEQ ID NO: 699731 - DNA, 13 bp, C. elegans
agaaaaatcgcca

SEQ ID NO: 699732 - DNA, 13 bp, C. elegans
agaaaaatcggaa

SEQ ID NO: 699733 - DNA, 13 bp, C. elegans
agaaaaatcggtt

SEQ ID NO: 699734 - DNA, 13 bp, C. elegans
agaaaaatctata

SEQ ID NO: 699735 - DNA, 13 bp, C. elegans
agaaaaatctatg

SEQ ID NO: 699736 - DNA, 13 bp, C. elegans
agaaaaatctatt

SEQ ID NO: 699737 - DNA, 13 bp, C. elegans
agaaaaatctgaa

SEQ ID NO: 699738 - DNA, 13 bp, C. elegans
agaaaaatcttaa

SEQ ID NO: 699739 - DNA, 13 bp, C. elegans
agaaaaatgacat

SEQ ID NO: 699740 - DNA, 13 bp, C. elegans
agaaaaatgacca

SEQ ID NO: 699741 - DNA, 13 bp, C. elegans
agaaaaatgattt

SEQ ID NO: 699742 - DNA, 13 bp, C. elegans
agaaaaatgcaat

SEQ ID NO: 699743 - DNA, 13 bp, C. elegans
agaaaaatgcaca

SEQ ID NO: 699744 - DNA, 13 bp, C. elegans
agaaaaatgcact

SEQ ID NO: 699745 - DNA, 13 bp, C. elegans
agaaaaatgcctg

SEQ ID NO: 699746 - DNA, 13 bp, C. elegans
agaaaaatggatt

SEQ ID NO: 699747 - DNA, 13 bp, C. elegans
agaaaaatggcaa

SEQ ID NO: 699748 - DNA, 13 bp, C. elegans
agaaaaatggcat

SEQ ID NO: 699749 - DNA, 13 bp, C. elegans
agaaaaatggttt

SEQ ID NO: 699750 - DNA, 13 bp, C. elegans
agaaaaatgtctg

SEQ ID NO: 699751 - DNA, 13 bp, C. elegans
agaaaaatgttct

SEQ ID NO: 699752 - DNA, 13 bp, C. elegans
agaaaaatgtttt

SEQ ID NO: 699753 - DNA, 13 bp, C. elegans
agaaaaattagtt

SEQ ID NO: 699754 - DNA, 13 bp, C. elegans
agaaaaattcaat

SEQ ID NO: 699755 - DNA, 13 bp, C. elegans
agaaaaattctac

SEQ ID NO: 699756 - DNA, 13 bp, C. elegans
agaaaaattgact

SEQ ID NO: 699757 - DNA, 13 bp, C. elegans
agaaaaatttgga

SEQ ID NO: 699758 - DNA, 13 bp, C. elegans
agaaaacaagttt

SEQ ID NO: 699759 - DNA, 13 bp, C. elegans
agaaaacaatatt

SEQ ID NO: 699760 - DNA, 13 bp, C. elegans
agaaaacaatgtg

SEQ ID NO: 699761 - DNA, 13 bp, C. elegans
agaaaacaattga

SEQ ID NO: 699762 - DNA, 13 bp, C. elegans
agaaaacaattta

SEQ ID NO: 699763 - DNA, 13 bp, C. elegans
agaaaacaatttt

SEQ ID NO: 699764 - DNA, 14 bp, C. elegans
agaaaacacgggaa

SEQ ID NO: 699765 - DNA, 13 bp, C. elegans
agaaaacatcgaa

SEQ ID NO: 699766 - DNA, 13 bp, C. elegans
agaaaacatggaa

SEQ ID NO: 699767 - DNA, 13 bp, C. elegans
agaaaacattatt

SEQ ID NO: 699768 - DNA, 13 bp, C. elegans
agaaaacattcaa

SEQ ID NO: 699769 - DNA, 13 bp, C. elegans
agaaaacatttaa

SEQ ID NO: 699770 - DNA, 13 bp, C. elegans
agaaaacatttca

SEQ ID NO: 699771 - DNA, 13 bp, C. elegans
agaaaaccatttt

SEQ ID NO: 699772 - DNA, 13 bp, C. elegans
agaaaacccaaat

SEQ ID NO: 699773 - DNA, 13 bp, C. elegans
agaaaaccccgaa

SEQ ID NO: 699774 - DNA, 13 bp, C. elegans
agaaaaccggcaa

SEQ ID NO: 699775 - DNA, 13 bp, C. elegans
agaaaacctattt

SEQ ID NO: 699776 - DNA, 13 bp, C. elegans
agaaaacctgaaa

SEQ ID NO: 699777 - DNA, 13 bp, C. elegans
agaaaacgagtga

SEQ ID NO: 699778 - DNA, 13 bp, C. elegans
agaaaactacagt

SEQ ID NO: 699779 - DNA, 13 bp, C. elegans
agaaaactatgaa

SEQ ID NO: 699780 - DNA, 13 bp, C. elegans
agaaaactcaaga

SEQ ID NO: 699781 - DNA, 13 bp, C. elegans
agaaaactcgaaa

SEQ ID NO: 699782 - DNA, 13 bp, C. elegans
agaaaactctgaa

SEQ ID NO: 699783 - DNA, 13 bp, C. elegans
agaaaactgaaat

SEQ ID NO: 699784 - DNA, 13 bp, C. elegans
agaaaactgaatt

SEQ ID NO: 699785 - DNA, 13 bp, C. elegans
agaaaactgcaaa

SEQ ID NO: 699786 - DNA, 13 bp, C. elegans
agaaaactgttaa

SEQ ID NO: 699787 - DNA, 13 bp, C. elegans
agaaaacttattt

SEQ ID NO: 699788 - DNA, 13 bp, C. elegans
agaaaacttcaga

SEQ ID NO: 699789 - DNA, 13 bp, C. elegans
agaaaacttgcaa

SEQ ID NO: 699790 - DNA, 13 bp, C. elegans
agaaaactttatt

SEQ ID NO: 699791 - DNA, 13 bp, C. elegans
agaaaactttcaa

SEQ ID NO: 699792 - DNA, 13 bp, C. elegans
agaaaactttgag

SEQ ID NO: 699793 - DNA, 13 bp, C. elegans
agaaaactttgat

SEQ ID NO: 699794 - DNA, 13 bp, C. elegans
agaaaagagattt

SEQ ID NO: 699795 - DNA, 13 bp, C. elegans
agaaaagattcat

SEQ ID NO: 699796 - DNA, 13 bp, C. elegans
agaaaagatttga

SEQ ID NO: 699797 - DNA, 13 bp, C. elegans
agaaaagctcaaa

SEQ ID NO: 699798 - DNA, 13 bp, C. elegans
agaaaagtcaatt

SEQ ID NO: 699799 - DNA, 13 bp, C. elegans
agaaaagtgcaaa

SEQ ID NO: 699800 - DNA, 13 bp, C. elegans
agaaaagtgtgaa

SEQ ID NO: 699801 - DNA, 13 bp, C. elegans
agaaaagtgtgcg

SEQ ID NO: 699802 - DNA, 13 bp, C. elegans
agaaaagttcggt

SEQ ID NO: 699803 - DNA, 13 bp, C. elegans
agaaaatacatgt

SEQ ID NO: 699804 - DNA, 13 bp, C. elegans
agaaaatactgaa

SEQ ID NO: 699805 - DNA, 13 bp, C. elegans
agaaaatagaccc

SEQ ID NO: 699806 - DNA, 13 bp, C. elegans
agaaaatagtgag

SEQ ID NO: 699807 - DNA, 13 bp, C. elegans
agaaaatatactt

SEQ ID NO: 699808 - DNA, 13 bp, C. elegans
agaaaatatcata

SEQ ID NO: 699809 - DNA, 13 bp, C. elegans
agaaaatatcgat

SEQ ID NO: 699810 - DNA, 13 bp, C. elegans
agaaaatatgtgt

SEQ ID NO: 699811 - DNA, 13 bp, C. elegans
agaaaatattcaa

SEQ ID NO: 699812 - DNA, 13 bp, C. elegans
agaaaatattcca

SEQ ID NO: 699813 - DNA, 13 bp, C. elegans
agaaaatattgca

SEQ ID NO: 699814 - DNA, 13 bp, C. elegans
agaaaatattgga

SEQ ID NO: 699815 - DNA, 13 bp, C. elegans
agaaaatatttga

SEQ ID NO: 699816 - DNA, 13 bp, C. elegans
agaaaatcaactt

SEQ ID NO: 699817 - DNA, 13 bp, C. elegans
agaaaatcaatga

SEQ ID NO: 699818 - DNA, 13 bp, C. elegans
agaaaatcacttc

SEQ ID NO: 699819 - DNA, 13 bp, C. elegans
agaaaatcagtgg

SEQ ID NO: 699820 - DNA, 13 bp, C. elegans
agaaaatcagtta

SEQ ID NO: 699821 - DNA, 13 bp, C. elegans
agaaaatcatatt

SEQ ID NO: 699822 - DNA, 13 bp, C. elegans
agaaaatcatttt

SEQ ID NO: 699823 - DNA, 13 bp, C. elegans
agaaaatccaatt

SEQ ID NO: 699824 - DNA, 13 bp, C. elegans
agaaaatccagaa

SEQ ID NO: 699825 - DNA, 13 bp, C. elegans
agaaaatcgaaat

SEQ ID NO: 699826 - DNA, 13 bp, C. elegans
agaaaatcgaatt

SEQ ID NO: 699827 - DNA, 13 bp, C. elegans
agaaaatcgacaa

SEQ ID NO: 699828 - DNA, 13 bp, C. elegans
agaaaatcgagaa

SEQ ID NO: 699829 - DNA, 14 bp, C. elegans
agaaaatcgatatt

SEQ ID NO: 699830 - DNA, 13 bp, C. elegans
agaaaatcgattt

SEQ ID NO: 699831 - DNA, 13 bp, C. elegans
agaaaatcggaaa

SEQ ID NO: 699832 - DNA, 13 bp, C. elegans
agaaaatcgtaat

SEQ ID NO: 699833 - DNA, 13 bp, C. elegans
agaaaatctatga

SEQ ID NO: 699834 - DNA, 13 bp, C. elegans
agaaaatgacaat

SEQ ID NO: 699835 - DNA, 13 bp, C. elegans
agaaaatgacttt

SEQ ID NO: 699836 - DNA, 13 bp, C. elegans
agaaaatgagcac

SEQ ID NO: 699837 - DNA, 13 bp, C. elegans
agaaaatgagtca

SEQ ID NO: 699838 - DNA, 13 bp, C. elegans
agaaaatgatgat

SEQ ID NO: 699839 - DNA, 13 bp, C. elegans
agaaaatgcacaa

SEQ ID NO: 699840 - DNA, 13 bp, C. elegans
agaaaatgccgaa

SEQ ID NO: 699841 - DNA, 13 bp, C. elegans
agaaaatgcgatt

SEQ ID NO: 699842 - DNA, 13 bp, C. elegans
agaaaatgctaaa

SEQ ID NO: 699843 - DNA, 13 bp, C. elegans
agaaaatggaatt

SEQ ID NO: 699844 - DNA, 13 bp, C. elegans
agaaaatggacaa

SEQ ID NO: 699845 - DNA, 13 bp, C. elegans
agaaaatggatga

SEQ ID NO: 699846 - DNA, 13 bp, C. elegans
agaaaatggcaaa

SEQ ID NO: 699847 - DNA, 13 bp, C. elegans
agaaaatggtttt

SEQ ID NO: 699848 - DNA, 13 bp, C. elegans
agaaaatgtatat

SEQ ID NO: 699849 - DNA, 13 bp, C. elegans
agaaaatgtatga

SEQ ID NO: 699850 - DNA, 13 bp, C. elegans
agaaaatgtattt

SEQ ID NO: 699851 - DNA, 13 bp, C. elegans
agaaaatgtcaat

SEQ ID NO: 699852 - DNA, 13 bp, C. elegans
agaaaatgtcagc

SEQ ID NO: 699853 - DNA, 13 bp, C. elegans
agaaaatgtgtaa

SEQ ID NO: 699854 - DNA, 13 bp, C. elegans
agaaaatgtgtgt

SEQ ID NO: 699855 - DNA, 13 bp, C. elegans
agaaaatgttcta

SEQ ID NO: 699856 - DNA, 13 bp, C. elegans
agaaaatgttgaa

SEQ ID NO: 699857 - DNA, 13 bp, C. elegans
agaaaatgttgga

SEQ ID NO: 699858 - DNA, 13 bp, C. elegans
agaaaatgttggt

SEQ ID NO: 699859 - DNA, 13 bp, C. elegans
agaaaatgttttt

SEQ ID NO: 699860 - DNA, 13 bp, C. elegans
agaaaattaaact

SEQ ID NO: 699861 - DNA, 13 bp, C. elegans
agaaaattaatca

SEQ ID NO: 699862 - DNA, 13 bp, C. elegans
agaaaattacatt

SEQ ID NO: 699863 - DNA, 13 bp, C. elegans
agaaaattcaaat

SEQ ID NO: 699864 - DNA, 13 bp, C. elegans
agaaaattcaatt

SEQ ID NO: 699865 - DNA, 13 bp, C. elegans
agaaaattccaaa

SEQ ID NO: 699866 - DNA, 13 bp, C. elegans
agaaaattccaga

SEQ ID NO: 699867 - DNA, 13 bp, C. elegans
agaaaattcggaa

SEQ ID NO: 699868 - DNA, 13 bp, C. elegans
agaaaattctaaa

SEQ ID NO: 699869 - DNA, 13 bp, C. elegans
agaaaattctcaa

SEQ ID NO: 699870 - DNA, 13 bp, C. elegans
agaaaattctgtt

SEQ ID NO: 699871 - DNA, 13 bp, C. elegans
agaaaattctttg

SEQ ID NO: 699872 - DNA, 13 bp, C. elegans
agaaaattgaatg

SEQ ID NO: 699873 - DNA, 13 bp, C. elegans
agaaaattgcatt

SEQ ID NO: 699874 - DNA, 13 bp, C. elegans
agaaaattgccaa

SEQ ID NO: 699875 - DNA, 13 bp, C. elegans
agaaaattggcca

SEQ ID NO: 699876 - DNA, 13 bp, C. elegans
agaaaattggtga

SEQ ID NO: 699877 - DNA, 13 bp, C. elegans
agaaaattgtgaa

SEQ ID NO: 699878 - DNA, 13 bp, C. elegans
agaaaattgttaa

SEQ ID NO: 699879 - DNA, 13 bp, C. elegans
agaaaattgttca

SEQ ID NO: 699880 - DNA, 13 bp, C. elegans
agaaaatttcaaa

SEQ ID NO: 699881 - DNA, 14 bp, C. elegans
agaaaatttcagaa

SEQ ID NO: 699882 - DNA, 13 bp, C. elegans
agaaaatttcatg

SEQ ID NO: 699883 - DNA, 13 bp, C. elegans
agaaaatttccaa

SEQ ID NO: 699884 - DNA, 13 bp, C. elegans
agaaaatttcgga

SEQ ID NO: 699885 - DNA, 13 bp, C. elegans
agaaaatttgaat

SEQ ID NO: 699886 - DNA, 13 bp, C. elegans
agaaaatttgctt

SEQ ID NO: 699887 - DNA, 13 bp, C. elegans
agaaaattttcta

SEQ ID NO: 699888 - DNA, 13 bp, C. elegans
agaaacaattaca

SEQ ID NO: 699889 - DNA, 13 bp, C. elegans
agaaacaattatt

SEQ ID NO: 699890 - DNA, 13 bp, C. elegans
agaaacaatttca

SEQ ID NO: 699891 - DNA, 13 bp, C. elegans
agaaacagtaaat

SEQ ID NO: 699892 - DNA, 13 bp, C. elegans
agaaacagtgaaa

SEQ ID NO: 699893 - DNA, 13 bp, C. elegans
agaaacatagaga

SEQ ID NO: 699894 - DNA, 13 bp, C. elegans
agaaacatggaaa

SEQ ID NO: 699895 - DNA, 13 bp, C. elegans
agaaacattcaaa

SEQ ID NO: 699896 - DNA, 13 bp, C. elegans
agaaacattgaaa

SEQ ID NO: 699897 - DNA, 13 bp, C. elegans
agaaacattggaa

SEQ ID NO: 699898 - DNA, 13 bp, C. elegans
agaaacatttctt

SEQ ID NO: 699899 - DNA, 13 bp, C. elegans
agaaaccaaattt

SEQ ID NO: 699900 - DNA, 13 bp, C. elegans
agaaacctatttt

SEQ ID NO: 699901 - DNA, 13 bp, C. elegans
agaaacctttttt

SEQ ID NO: 699902 - DNA, 13 bp, C. elegans
agaaactactgaa

SEQ ID NO: 699903 - DNA, 13 bp, C. elegans
agaaactataaat

SEQ ID NO: 699904 - DNA, 13 bp, C. elegans
agaaactataatt

SEQ ID NO: 699905 - DNA, 13 bp, C. elegans
agaaactcaattt

SEQ ID NO: 699906 - DNA, 13 bp, C. elegans
agaaactcgattt

SEQ ID NO: 699907 - DNA, 13 bp, C. elegans
agaaactctgaaa

SEQ ID NO: 699908 - DNA, 13 bp, C. elegans
agaaactgaaaac

SEQ ID NO: 699909 - DNA, 13 bp, C. elegans
agaaactgaagaa

SEQ ID NO: 699910 - DNA, 13 bp, C. elegans
agaaactgagaaa

SEQ ID NO: 699911 - DNA, 13 bp, C. elegans
agaaactgcaaaa

SEQ ID NO: 699912 - DNA, 13 bp, C. elegans
agaaactgttttt

SEQ ID NO: 699913 - DNA, 13 bp, C. elegans
agaaacttcgaaa

SEQ ID NO: 699914 - DNA, 13 bp, C. elegans
agaaacttctgga

SEQ ID NO: 699915 - DNA, 13 bp, C. elegans
agaaacttgaaaa

SEQ ID NO: 699916 - DNA, 13 bp, C. elegans
agaaacttggaaa

SEQ ID NO: 699917 - DNA, 13 bp, C. elegans
agaaacttggaga

SEQ ID NO: 699918 - DNA, 13 bp, C. elegans
agaaacttgtcaa

SEQ ID NO: 699919 - DNA, 13 bp, C. elegans
agaaactttcaga

SEQ ID NO: 699920 - DNA, 13 bp, C. elegans
agaaactttgaaa

SEQ ID NO: 699921 - DNA, 13 bp, C. elegans
agaaactttgaat

SEQ ID NO: 699922 - DNA, 13 bp, C. elegans
agaaagaacattt

SEQ ID NO: 699923 - DNA, 13 bp, C. elegans
agaaagcatttca

SEQ ID NO: 699924 - DNA, 13 bp, C. elegans
agaaagctgagaa

SEQ ID NO: 699925 - DNA, 13 bp, C. elegans
agaaaggtggcaa

SEQ ID NO: 699926 - DNA, 13 bp, C. elegans
agaaagtgctcaa

SEQ ID NO: 699927 - DNA, 13 bp, C. elegans
agaaagtggcaaa

SEQ ID NO: 699928 - DNA, 13 bp, C. elegans
agaaagtgtcaaa

SEQ ID NO: 699929 - DNA, 13 bp, C. elegans
agaaagttatcaa

SEQ ID NO: 699930 - DNA, 13 bp, C. elegans
agaaagttccaga

SEQ ID NO: 699931 - DNA, 14 bp, C. elegans
agaaagttctggaa

SEQ ID NO: 699932 - DNA, 13 bp, C. elegans
agaaagttgccaa

SEQ ID NO: 699933 - DNA, 13 bp, C. elegans
agaaagtttggaa

SEQ ID NO: 699934 - DNA, 13 bp, C. elegans
agaaagtttgttt

SEQ ID NO: 699935 - DNA, 13 bp, C. elegans
agaaagttttcaa

SEQ ID NO: 699936 - DNA, 13 bp, C. elegans
agaaataaattca

SEQ ID NO: 699937 - DNA, 13 bp, C. elegans
agaaataattcaa

SEQ ID NO: 699938 - DNA, 13 bp, C. elegans
agaaatacggaaa

SEQ ID NO: 699939 - DNA, 13 bp, C. elegans
agaaatacggtag

SEQ ID NO: 699940 - DNA, 13 bp, C. elegans
agaaatacgtttt

SEQ ID NO: 699941 - DNA, 13 bp, C. elegans
agaaatacttttt

SEQ ID NO: 699942 - DNA, 13 bp, C. elegans
agaaatatcacaa

SEQ ID NO: 699943 - DNA, 13 bp, C. elegans
agaaatatctaaa

SEQ ID NO: 699944 - DNA, 13 bp, C. elegans
agaaatatctcaa

SEQ ID NO: 699945 - DNA, 13 bp, C. elegans
agaaatatgtgaa

SEQ ID NO: 699946 - DNA, 13 bp, C. elegans
agaaatatgttta

SEQ ID NO: 699947 - DNA, 13 bp, C. elegans
agaaatattcaaa

SEQ ID NO: 699948 - DNA, 13 bp, C. elegans
agaaatattggaa

SEQ ID NO: 699949 - DNA, 13 bp, C. elegans
agaaatatttcaa

SEQ ID NO: 699950 - DNA, 13 bp, C. elegans
agaaatcaaattt

SEQ ID NO: 699951 - DNA, 13 bp, C. elegans
agaaatcaatatt

SEQ ID NO: 699952 - DNA, 13 bp, C. elegans
agaaatcaattgg

SEQ ID NO: 699953 - DNA, 13 bp, C. elegans
agaaatcacaatt

SEQ ID NO: 699954 - DNA, 13 bp, C. elegans
agaaatcagagaa

SEQ ID NO: 699955 - DNA, 13 bp, C. elegans
agaaatcattttt

SEQ ID NO: 699956 - DNA, 13 bp, C. elegans
agaaatccaaatt

SEQ ID NO: 699957 - DNA, 13 bp, C. elegans
agaaatccacaaa

SEQ ID NO: 699958 - DNA, 13 bp, C. elegans
agaaatcccaaaa

SEQ ID NO: 699959 - DNA, 13 bp, C. elegans
agaaatccgaaaa

SEQ ID NO: 699960 - DNA, 13 bp, C. elegans
agaaatccgtgaa

SEQ ID NO: 699961 - DNA, 13 bp, C. elegans
agaaatcgaaatt

SEQ ID NO: 699962 - DNA, 13 bp, C. elegans
agaaatcgaagaa

SEQ ID NO: 699963 - DNA, 13 bp, C. elegans
agaaatcgataaa

SEQ ID NO: 699964 - DNA, 13 bp, C. elegans
agaaatcgataat

SEQ ID NO: 699965 - DNA, 13 bp, C. elegans
agaaatctcaaaa

SEQ ID NO: 699966 - DNA, 13 bp, C. elegans
agaaatctcaatt

SEQ ID NO: 699967 - DNA, 13 bp, C. elegans
agaaatctgagaa

SEQ ID NO: 699968 - DNA, 13 bp, C. elegans
agaaatgactgaa

SEQ ID NO: 699969 - DNA, 13 bp, C. elegans
agaaatgcaaaat

SEQ ID NO: 699970 - DNA, 13 bp, C. elegans
agaaatggttttg

SEQ ID NO: 699971 - DNA, 13 bp, C. elegans
agaaatggttttt

SEQ ID NO: 699972 - DNA, 13 bp, C. elegans
agaaatgtatatt

SEQ ID NO: 699973 - DNA, 13 bp, C. elegans
agaaatgtgacgt

SEQ ID NO: 699974 - DNA, 13 bp, C. elegans
agaaatgttcaaa

SEQ ID NO: 699975 - DNA, 13 bp, C. elegans
agaaatgttcaat

SEQ ID NO: 699976 - DNA, 13 bp, C. elegans
agaaatgttgatt

SEQ ID NO: 699977 - DNA, 13 bp, C. elegans
agaaatgttggaa

SEQ ID NO: 699978 - DNA, 13 bp, C. elegans
agaaatgtttttt

SEQ ID NO: 699979 - DNA, 13 bp, C. elegans
agaaattaacttt

SEQ ID NO: 699980 - DNA, 13 bp, C. elegans
agaaattaccaaa

SEQ ID NO: 699981 - DNA, 13 bp, C. elegans
agaaattacgaaa

SEQ ID NO: 699982 - DNA, 13 bp, C. elegans
agaaattatgatt

SEQ ID NO: 699983 - DNA, 13 bp, C. elegans
agaaattattgaa

SEQ ID NO: 699984 - DNA, 13 bp, C. elegans
agaaattattgga

SEQ ID NO: 699985 - DNA, 13 bp, C. elegans
agaaattcaaatt

SEQ ID NO: 699986 - DNA, 13 bp, C. elegans
agaaattcaactt

SEQ ID NO: 699987 - DNA, 13 bp, C. elegans
agaaattcaagtt

SEQ ID NO: 699988 - DNA, 13 bp, C. elegans
agaaattcaattt

SEQ ID NO: 699989 - DNA, 13 bp, C. elegans
agaaattcatgaa

SEQ ID NO: 699990 - DNA, 13 bp, C. elegans
agaaattcgatat

SEQ ID NO: 699991 - DNA, 13 bp, C. elegans
agaaattcggaat

SEQ ID NO: 699992 - DNA, 13 bp, C. elegans
agaaattcgtttt

SEQ ID NO: 699993 - DNA, 13 bp, C. elegans
agaaattctacaa

SEQ ID NO: 699994 - DNA, 13 bp, C. elegans
agaaattctataa

SEQ ID NO: 699995 - DNA, 13 bp, C. elegans
agaaattctcaaa

SEQ ID NO: 699996 - DNA, 13 bp, C. elegans
agaaattctcatt

SEQ ID NO: 699997 - DNA, 13 bp, C. elegans
agaaattctgaaa

SEQ ID NO: 699998 - DNA, 13 bp, C. elegans
agaaattcttcaa

SEQ ID NO: 699999 - DNA, 13 bp, C. elegans
agaaattcttgaa

SEQ ID NO: 700000 - DNA, 13 bp, C. elegans
agaaattcttgtt

SEQ ID NO: 700001 - DNA, 13 bp, C. elegans
agaaattgacatt

SEQ ID NO: 700002 - DNA, 13 bp, C. elegans
agaaattgagaga

SEQ ID NO: 700003 - DNA, 13 bp, C. elegans
agaaattgatatt

SEQ ID NO: 700004 - DNA, 13 bp, C. elegans
agaaattgatgaa

SEQ ID NO: 700005 - DNA, 14 bp, C. elegans
agaaattgatgatt

SEQ ID NO: 700006 - DNA, 13 bp, C. elegans
agaaattgatttt

SEQ ID NO: 700007 - DNA, 13 bp, C. elegans
agaaattgcaaat

SEQ ID NO: 700008 - DNA, 13 bp, C. elegans
agaaattgccgga

SEQ ID NO: 700009 - DNA, 13 bp, C. elegans
agaaattgcgaat

SEQ ID NO: 700010 - DNA, 13 bp, C. elegans
agaaattgctcaa

SEQ ID NO: 700011 - DNA, 13 bp, C. elegans
agaaattggaatt

SEQ ID NO: 700012 - DNA, 13 bp, C. elegans
agaaattggcaaa

SEQ ID NO: 700013 - DNA, 13 bp, C. elegans
agaaattgtaatt

SEQ ID NO: 700014 - DNA, 13 bp, C. elegans
agaaattgtagaa

SEQ ID NO: 700015 - DNA, 13 bp, C. elegans
agaaattgttata

SEQ ID NO: 700016 - DNA, 13 bp, C. elegans
agaaattgttatt

SEQ ID NO: 700017 - DNA, 13 bp, C. elegans
agaaattgttgaa

SEQ ID NO: 700018 - DNA, 13 bp, C. elegans
agaaattgttgtt

SEQ ID NO: 700019 - DNA, 13 bp, C. elegans
agaaatttatcga

SEQ ID NO: 700020 - DNA, 13 bp, C. elegans
agaaatttcaaat

SEQ ID NO: 700021 - DNA, 13 bp, C. elegans
agaaatttcaaga

SEQ ID NO: 700022 - DNA, 13 bp, C. elegans
agaaatttcagat

SEQ ID NO: 700023 - DNA, 13 bp, C. elegans
agaaatttcagtt

SEQ ID NO: 700024 - DNA, 13 bp, C. elegans
agaaatttcatga

SEQ ID NO: 700025 - DNA, 13 bp, C. elegans
agaaatttcatta

SEQ ID NO: 700026 - DNA, 13 bp, C. elegans
agaaatttccaaa

SEQ ID NO: 700027 - DNA, 13 bp, C. elegans
agaaatttccaat

SEQ ID NO: 700028 - DNA, 13 bp, C. elegans
agaaatttctcaa

SEQ ID NO: 700029 - DNA, 13 bp, C. elegans
agaaatttcttca

SEQ ID NO: 700030 - DNA, 13 bp, C. elegans
agaaatttcttta

SEQ ID NO: 700031 - DNA, 13 bp, C. elegans
agaaatttgaaat

SEQ ID NO: 700032 - DNA, 13 bp, C. elegans
agaaatttggaaa

SEQ ID NO: 700033 - DNA, 13 bp, C. elegans
agaaatttgtcaa

SEQ ID NO: 700034 - DNA, 13 bp, C. elegans
agaaattttcgat

SEQ ID NO: 700035 - DNA, 13 bp, C. elegans
agaaattttcggc

SEQ ID NO: 700036 - DNA, 13 bp, C. elegans
agaaattttgaag

SEQ ID NO: 700037 - DNA, 13 bp, C. elegans
agaacaaaaattg

SEQ ID NO: 700038 - DNA, 13 bp, C. elegans
agaacaaagtgaa

SEQ ID NO: 700039 - DNA, 13 bp, C. elegans
agaacaacaattt

SEQ ID NO: 700040 - DNA, 13 bp, C. elegans
agaacaacatttt

SEQ ID NO: 700041 - DNA, 13 bp, C. elegans
agaacaacttttt

SEQ ID NO: 700042 - DNA, 13 bp, C. elegans
agaacaatatttg

SEQ ID NO: 700043 - DNA, 13 bp, C. elegans
agaacaatttcaa

SEQ ID NO: 700044 - DNA, 13 bp, C. elegans
agaacaatttcag

SEQ ID NO: 700045 - DNA, 13 bp, C. elegans
agaacagaagata

SEQ ID NO: 700046 - DNA, 13 bp, C. elegans
agaacatatgaaa

SEQ ID NO: 700047 - DNA, 13 bp, C. elegans
agaacatcaggaa

SEQ ID NO: 700048 - DNA, 13 bp, C. elegans
agaacatgaagaa

SEQ ID NO: 700049 - DNA, 13 bp, C. elegans
agaacatttaaaa

SEQ ID NO: 700050 - DNA, 13 bp, C. elegans
agaacattttaga

SEQ ID NO: 700051 - DNA, 13 bp, C. elegans
agaacattttcaa

SEQ ID NO: 700052 - DNA, 13 bp, C. elegans
agaacattttctg

SEQ ID NO: 700053 - DNA, 13 bp, C. elegans
agaacattttgaa

SEQ ID NO: 700054 - DNA, 13 bp, C. elegans
agaacattttttg

SEQ ID NO: 700055 - DNA, 13 bp, C. elegans
agaacattttttt

SEQ ID NO: 700056 - DNA, 13 bp, C. elegans
agaaccttttttt

SEQ ID NO: 700057 - DNA, 13 bp, C. elegans
agaacgttgaatt

SEQ ID NO: 700058 - DNA, 13 bp, C. elegans
agaactacaattt

SEQ ID NO: 700059 - DNA, 13 bp, C. elegans
agaactatgaaaa

SEQ ID NO: 700060 - DNA, 13 bp, C. elegans
agaactcaaaatt

SEQ ID NO: 700061 - DNA, 13 bp, C. elegans
agaactcaaacaa

SEQ ID NO: 700062 - DNA, 13 bp, C. elegans
agaactccaaaaa

SEQ ID NO: 700063 - DNA, 13 bp, C. elegans
agaactcttttgt

SEQ ID NO: 700064 - DNA, 13 bp, C. elegans
agaactgcaagac

SEQ ID NO: 700065 - DNA, 13 bp, C. elegans
agaactggaaaaa

SEQ ID NO: 700066 - DNA, 13 bp, C. elegans
agaacttcgaatt

SEQ ID NO: 700067 - DNA, 13 bp, C. elegans
agaacttggaaaa

SEQ ID NO: 700068 - DNA, 13 bp, C. elegans
agaactttcattc

SEQ ID NO: 700069 - DNA, 13 bp, C. elegans
agaactttctgaa

SEQ ID NO: 700070 - DNA, 13 bp, C. elegans
agaactttgtaaa

SEQ ID NO: 700071 - DNA, 13 bp, C. elegans
agaacttttcaga

SEQ ID NO: 700072 - DNA, 13 bp, C. elegans
agaacttttgaaa

SEQ ID NO: 700073 - DNA, 13 bp, C. elegans
agaactttttatt

SEQ ID NO: 700074 - DNA, 13 bp, C. elegans
agaactttttcga

SEQ ID NO: 700075 - DNA, 13 bp, C. elegans
agaacttttttgt

SEQ ID NO: 700076 - DNA, 13 bp, C. elegans
agaagaaaaactt

SEQ ID NO: 700077 - DNA, 13 bp, C. elegans
agaagaaaactga

SEQ ID NO: 700078 - DNA, 13 bp, C. elegans
agaagaaattgga

SEQ ID NO: 700079 - DNA, 13 bp, C. elegans
agaagaacatttt

SEQ ID NO: 700080 - DNA, 13 bp, C. elegans
agaagaagaaact

SEQ ID NO: 700081 - DNA, 13 bp, C. elegans
agaagaagacgtc

SEQ ID NO: 700082 - DNA, 13 bp, C. elegans
agaagaagacgtg

SEQ ID NO: 700083 - DNA, 13 bp, C. elegans
agaagaagcagca

SEQ ID NO: 700084 - DNA, 13 bp, C. elegans
agaagaagcttca

SEQ ID NO: 700085 - DNA, 13 bp, C. elegans
agaagaattggaa

SEQ ID NO: 700086 - DNA, 13 bp, C. elegans
agaagacactcct

SEQ ID NO: 700087 - DNA, 13 bp, C. elegans
agaagacattcgt

SEQ ID NO: 700088 - DNA, 13 bp, C. elegans
agaagactcaaaa

SEQ ID NO: 700089 - DNA, 13 bp, C. elegans
agaagagaaaact

SEQ ID NO: 700090 - DNA, 13 bp, C. elegans
agaagagaagatt

SEQ ID NO: 700091 - DNA, 13 bp, C. elegans
agaagagacacag

SEQ ID NO: 700092 - DNA, 13 bp, C. elegans
agaagatcaattt

SEQ ID NO: 700093 - DNA, 13 bp, C. elegans
agaagatgaagca

SEQ ID NO: 700094 - DNA, 13 bp, C. elegans
agaagatgatgaa

SEQ ID NO: 700095 - DNA, 13 bp, C. elegans
agaagatgccaat

SEQ ID NO: 700096 - DNA, 13 bp, C. elegans
agaagattccaaa

SEQ ID NO: 700097 - DNA, 13 bp, C. elegans
agaagattctaga

SEQ ID NO: 700098 - DNA, 13 bp, C. elegans
agaagcagaaaat

SEQ ID NO: 700099 - DNA, 13 bp, C. elegans
agaagcagcagca

SEQ ID NO: 700100 - DNA, 13 bp, C. elegans
agaagctctctgg

SEQ ID NO: 700101 - DNA, 14 bp, C. elegans
agaagctgaaaagg

SEQ ID NO: 700102 - DNA, 13 bp, C. elegans
agaagctggaaaa

SEQ ID NO: 700103 - DNA, 13 bp, C. elegans
agaagctggaaat

SEQ ID NO: 700104 - DNA, 13 bp, C. elegans
agaagctgtcgga

SEQ ID NO: 700105 - DNA, 13 bp, C. elegans
agaagctgttgat

SEQ ID NO: 700106 - DNA, 13 bp, C. elegans
agaagcttctgaa

SEQ ID NO: 700107 - DNA, 13 bp, C. elegans
agaagcttcttct

SEQ ID NO: 700108 - DNA, 13 bp, C. elegans
agaagcttctttt

SEQ ID NO: 700109 - DNA, 13 bp, C. elegans
agaagcttgaaaa

SEQ ID NO: 700110 - DNA, 13 bp, C. elegans
agaagctttgagc

SEQ ID NO: 700111 - DNA, 13 bp, C. elegans
agaagctttttga

SEQ ID NO: 700112 - DNA, 13 bp, C. elegans
agaaggaatcgaa

SEQ ID NO: 700113 - DNA, 13 bp, C. elegans
agaaggttttgaa

SEQ ID NO: 700114 - DNA, 13 bp, C. elegans
agaaggttttttg

SEQ ID NO: 700115 - DNA, 13 bp, C. elegans
agaagtcgggggc

SEQ ID NO: 700116 - DNA, 13 bp, C. elegans
agaagtgaggata

SEQ ID NO: 700117 - DNA, 13 bp, C. elegans
agaagttcaaaat

SEQ ID NO: 700118 - DNA, 13 bp, C. elegans
agaagttcaattt

SEQ ID NO: 700119 - DNA, 13 bp, C. elegans
agaagttctaaaa

SEQ ID NO: 700120 - DNA, 13 bp, C. elegans
agaagttgacaaa

SEQ ID NO: 700121 - DNA, 13 bp, C. elegans
agaagttgccaaa

SEQ ID NO: 700122 - DNA, 13 bp, C. elegans
agaagttgctcaa

SEQ ID NO: 700123 - DNA, 13 bp, C. elegans
agaagttggaaaa

SEQ ID NO: 700124 - DNA, 13 bp, C. elegans
agaagtttcagaa

SEQ ID NO: 700125 - DNA, 13 bp, C. elegans
agaagtttctcaa

SEQ ID NO: 700126 - DNA, 13 bp, C. elegans
agaagtttgtatg

SEQ ID NO: 700127 - DNA, 13 bp, C. elegans
agaagtttgtttt

SEQ ID NO: 700128 - DNA, 13 bp, C. elegans
agaagtttttgga

SEQ ID NO: 700129 - DNA, 13 bp, C. elegans
agaataaaatcac

SEQ ID NO: 700130 - DNA, 13 bp, C. elegans
agaataaaatgtt

SEQ ID NO: 700131 - DNA, 13 bp, C. elegans
agaataaatttga

SEQ ID NO: 700132 - DNA, 13 bp, C. elegans
agaataagacgaa

SEQ ID NO: 700133 - DNA, 13 bp, C. elegans
agaataatgtttt

SEQ ID NO: 700134 - DNA, 13 bp, C. elegans
agaatacatattt

SEQ ID NO: 700135 - DNA, 13 bp, C. elegans
agaatacattttc

SEQ ID NO: 700136 - DNA, 13 bp, C. elegans
agaatacgaattt

SEQ ID NO: 700137 - DNA, 13 bp, C. elegans
agaatacgttttt

SEQ ID NO: 700138 - DNA, 13 bp, C. elegans
agaatatcaaaat

SEQ ID NO: 700139 - DNA, 13 bp, C. elegans
agaatatcaaatt

SEQ ID NO: 700140 - DNA, 13 bp, C. elegans
agaatatcgattt

SEQ ID NO: 700141 - DNA, 13 bp, C. elegans
agaatatctgaaa

SEQ ID NO: 700142 - DNA, 13 bp, C. elegans
agaatatgaaaca

SEQ ID NO: 700143 - DNA, 13 bp, C. elegans
agaatatgaacat

SEQ ID NO: 700144 - DNA, 13 bp, C. elegans
agaatatgagtac

SEQ ID NO: 700145 - DNA, 13 bp, C. elegans
agaatatggaaat

SEQ ID NO: 700146 - DNA, 13 bp, C. elegans
agaatatggaata

SEQ ID NO: 700147 - DNA, 13 bp, C. elegans
agaatatggaatt

SEQ ID NO: 700148 - DNA, 13 bp, C. elegans
agaatattcaaat

SEQ ID NO: 700149 - DNA, 13 bp, C. elegans
agaatattccaat

SEQ ID NO: 700150 - DNA, 13 bp, C. elegans
agaatattgaaga

SEQ ID NO: 700151 - DNA, 13 bp, C. elegans
agaatattggaaa

SEQ ID NO: 700152 - DNA, 13 bp, C. elegans
agaatatttcaaa

SEQ ID NO: 700153 - DNA, 13 bp, C. elegans
agaatatttgaat

SEQ ID NO: 700154 - DNA, 13 bp, C. elegans
agaatatttggaa

SEQ ID NO: 700155 - DNA, 13 bp, C. elegans
agaatattttttc

SEQ ID NO: 700156 - DNA, 13 bp, C. elegans
agaatcaaaaatc

SEQ ID NO: 700157 - DNA, 13 bp, C. elegans
agaatcaacattc

SEQ ID NO: 700158 - DNA, 13 bp, C. elegans
agaatcaagaaac

SEQ ID NO: 700159 - DNA, 13 bp, C. elegans
agaatcagaacca

SEQ ID NO: 700160 - DNA, 13 bp, C. elegans
agaatccaattca

SEQ ID NO: 700161 - DNA, 13 bp, C. elegans
agaatcgaaaaat

SEQ ID NO: 700162 - DNA, 13 bp, C. elegans
agaatcgtttttt

SEQ ID NO: 700163 - DNA, 13 bp, C. elegans
agaatctgtaatt

SEQ ID NO: 700164 - DNA, 13 bp, C. elegans
agaatcttctgaa

SEQ ID NO: 700165 - DNA, 13 bp, C. elegans
agaatgaaattgt

SEQ ID NO: 700166 - DNA, 13 bp, C. elegans
agaatgaatattt

SEQ ID NO: 700167 - DNA, 13 bp, C. elegans
agaatgaattgaa

SEQ ID NO: 700168 - DNA, 13 bp, C. elegans
agaatgagaatga

SEQ ID NO: 700169 - DNA, 13 bp, C. elegans
agaatgattcaaa

SEQ ID NO: 700170 - DNA, 13 bp, C. elegans
agaatgcctattt

SEQ ID NO: 700171 - DNA, 13 bp, C. elegans
agaatgctgagaa

SEQ ID NO: 700172 - DNA, 13 bp, C. elegans
agaatggacaaaa

SEQ ID NO: 700173 - DNA, 13 bp, C. elegans
agaatgtaaaatt

SEQ ID NO: 700174 - DNA, 13 bp, C. elegans
agaatgtatattt

SEQ ID NO: 700175 - DNA, 13 bp, C. elegans
agaatgtgcaaaa

SEQ ID NO: 700176 - DNA, 13 bp, C. elegans
agaatgtgtaata

SEQ ID NO: 700177 - DNA, 13 bp, C. elegans
agaatgttaaaat

SEQ ID NO: 700178 - DNA, 13 bp, C. elegans
agaatgttatttt

SEQ ID NO: 700179 - DNA, 13 bp, C. elegans
agaatgttcaaaa

SEQ ID NO: 700180 - DNA, 13 bp, C. elegans
agaatgttctgga

SEQ ID NO: 700181 - DNA, 13 bp, C. elegans
agaatgtttcaat

SEQ ID NO: 700182 - DNA, 13 bp, C. elegans
agaatgtttgaaa

SEQ ID NO: 700183 - DNA, 13 bp, C. elegans
agaatgttttcaa

SEQ ID NO: 700184 - DNA, 13 bp, C. elegans
agaattacaaatt

SEQ ID NO: 700185 - DNA, 13 bp, C. elegans
agaattacaattt

SEQ ID NO: 700186 - DNA, 13 bp, C. elegans
agaattactgtaa

SEQ ID NO: 700187 - DNA, 13 bp, C. elegans
agaattagaattt

SEQ ID NO: 700188 - DNA, 13 bp, C. elegans
agaattcaaaatt

SEQ ID NO: 700189 - DNA, 13 bp, C. elegans
agaattcaagaaa

SEQ ID NO: 700190 - DNA, 13 bp, C. elegans
agaattcaatgaa

SEQ ID NO: 700191 - DNA, 13 bp, C. elegans
agaattcatattt

SEQ ID NO: 700192 - DNA, 13 bp, C. elegans
agaattccaaaaa

SEQ ID NO: 700193 - DNA, 13 bp, C. elegans
agaattccatttt

SEQ ID NO: 700194 - DNA, 13 bp, C. elegans
agaattcgaagaa

SEQ ID NO: 700195 - DNA, 13 bp, C. elegans
agaattcgaatat

SEQ ID NO: 700196 - DNA, 13 bp, C. elegans
agaattcgagaaa

SEQ ID NO: 700197 - DNA, 13 bp, C. elegans
agaattctaaaaa

SEQ ID NO: 700198 - DNA, 13 bp, C. elegans
agaattctaaaat

SEQ ID NO: 700199 - DNA, 13 bp, C. elegans
agaattctggaaa

SEQ ID NO: 700200 - DNA, 13 bp, C. elegans
agaattctttgaa

SEQ ID NO: 700201 - DNA, 13 bp, C. elegans
agaattgaaattt

SEQ ID NO: 700202 - DNA, 13 bp, C. elegans
agaattgagaaga

SEQ ID NO: 700203 - DNA, 13 bp, C. elegans
agaattgccaaaa

SEQ ID NO: 700204 - DNA, 13 bp, C. elegans
agaattggaaaac

SEQ ID NO: 700205 - DNA, 13 bp, C. elegans
agaattggaaata

SEQ ID NO: 700206 - DNA, 13 bp, C. elegans
agaattggtgaaa

SEQ ID NO: 700207 - DNA, 13 bp, C. elegans
agaattgtaaatt

SEQ ID NO: 700208 - DNA, 13 bp, C. elegans
agaattgtctgaa

SEQ ID NO: 700209 - DNA, 13 bp, C. elegans
agaattgtgaaaa

SEQ ID NO: 700210 - DNA, 13 bp, C. elegans
agaattgtgagaa

SEQ ID NO: 700211 - DNA, 13 bp, C. elegans
agaattgttgaag

SEQ ID NO: 700212 - DNA, 13 bp, C. elegans
agaattgttttat

SEQ ID NO: 700213 - DNA, 13 bp, C. elegans
agaattgttttca

SEQ ID NO: 700214 - DNA, 13 bp, C. elegans
agaatttaaaaac

SEQ ID NO: 700215 - DNA, 13 bp, C. elegans
agaatttaaagtt

SEQ ID NO: 700216 - DNA, 13 bp, C. elegans
agaatttaatgtt

SEQ ID NO: 700217 - DNA, 13 bp, C. elegans
agaatttaattca

SEQ ID NO: 700218 - DNA, 13 bp, C. elegans
agaatttacagaa

SEQ ID NO: 700219 - DNA, 13 bp, C. elegans
agaatttactgaa

SEQ ID NO: 700220 - DNA, 13 bp, C. elegans
agaatttatgaaa

SEQ ID NO: 700221 - DNA, 13 bp, C. elegans
agaatttattaca

SEQ ID NO: 700222 - DNA, 13 bp, C. elegans
agaatttattgtt

SEQ ID NO: 700223 - DNA, 13 bp, C. elegans
agaatttattttc

SEQ ID NO: 700224 - DNA, 13 bp, C. elegans
agaatttcaaaat

SEQ ID NO: 700225 - DNA, 13 bp, C. elegans
agaatttcaaatt

SEQ ID NO: 700226 - DNA, 13 bp, C. elegans
agaatttcaattt

SEQ ID NO: 700227 - DNA, 13 bp, C. elegans
agaatttcacaaa

SEQ ID NO: 700228 - DNA, 13 bp, C. elegans
agaatttcagcaa

SEQ ID NO: 700229 - DNA, 13 bp, C. elegans
agaatttcatgaa

SEQ ID NO: 700230 - DNA, 13 bp, C. elegans
agaatttccagaa

SEQ ID NO: 700231 - DNA, 13 bp, C. elegans
agaatttcgatat

SEQ ID NO: 700232 - DNA, 13 bp, C. elegans
agaatttcggaaa

SEQ ID NO: 700233 - DNA, 13 bp, C. elegans
agaatttcgtgtt

SEQ ID NO: 700234 - DNA, 13 bp, C. elegans
agaatttctaaaa

SEQ ID NO: 700235 - DNA, 13 bp, C. elegans
agaatttctgaat

SEQ ID NO: 700236 - DNA, 13 bp, C. elegans
agaatttctgtga

SEQ ID NO: 700237 - DNA, 13 bp, C. elegans
agaatttcttcaa

SEQ ID NO: 700238 - DNA, 13 bp, C. elegans
agaatttcttttt

SEQ ID NO: 700239 - DNA, 13 bp, C. elegans
agaatttgaaatt

SEQ ID NO: 700240 - DNA, 13 bp, C. elegans
agaatttgacatt

SEQ ID NO: 700241 - DNA, 13 bp, C. elegans
agaatttgatatt

SEQ ID NO: 700242 - DNA, 13 bp, C. elegans
agaatttgcttat

SEQ ID NO: 700243 - DNA, 13 bp, C. elegans
agaatttggagaa

SEQ ID NO: 700244 - DNA, 13 bp, C. elegans
agaatttgtaaat

SEQ ID NO: 700245 - DNA, 13 bp, C. elegans
agaatttgtgttt

SEQ ID NO: 700246 - DNA, 13 bp, C. elegans
agaatttgttgaa

SEQ ID NO: 700247 - DNA, 13 bp, C. elegans
agaatttgttttg

SEQ ID NO: 700248 - DNA, 13 bp, C. elegans
agaattttatcaa

SEQ ID NO: 700249 - DNA, 13 bp, C. elegans
agaattttatcga

SEQ ID NO: 700250 - DNA, 13 bp, C. elegans
agaattttcaaat

SEQ ID NO: 700251 - DNA, 13 bp, C. elegans
agaattttcaaga

SEQ ID NO: 700252 - DNA, 13 bp, C. elegans
agaattttcaagt

SEQ ID NO: 700253 - DNA, 13 bp, C. elegans
agaattttcagaa

SEQ ID NO: 700254 - DNA, 13 bp, C. elegans
agaattttcatag

SEQ ID NO: 700255 - DNA, 13 bp, C. elegans
agaattttcggaa

SEQ ID NO: 700256 - DNA, 13 bp, C. elegans
agaattttctcat

SEQ ID NO: 700257 - DNA, 13 bp, C. elegans
agaattttctgaa

SEQ ID NO: 700258 - DNA, 13 bp, C. elegans
agaattttctgta

SEQ ID NO: 700259 - DNA, 13 bp, C. elegans
agaattttgatat

SEQ ID NO: 700260 - DNA, 13 bp, C. elegans
agaattttgattg

SEQ ID NO: 700261 - DNA, 13 bp, C. elegans
agaattttgcaaa

SEQ ID NO: 700262 - DNA, 13 bp, C. elegans
agaattttgcaag

SEQ ID NO: 700263 - DNA, 13 bp, C. elegans
agaattttggaaa

SEQ ID NO: 700264 - DNA, 13 bp, C. elegans
agaattttgtgat

SEQ ID NO: 700265 - DNA, 13 bp, C. elegans
agaattttgtgct

SEQ ID NO: 700266 - DNA, 13 bp, C. elegans
agaattttgtgta

SEQ ID NO: 700267 - DNA, 13 bp, C. elegans
agaattttgttta

SEQ ID NO: 700268 - DNA, 13 bp, C. elegans
agaatttttcaaa

SEQ ID NO: 700269 - DNA, 13 bp, C. elegans
agaatttttcgaa

SEQ ID NO: 700270 - DNA, 13 bp, C. elegans
agaatttttctaa

SEQ ID NO: 700271 - DNA, 13 bp, C. elegans
agaatttttgaat

SEQ ID NO: 700272 - DNA, 13 bp, C. elegans
agaatttttgaga

SEQ ID NO: 700273 - DNA, 13 bp, C. elegans
agaattttttttc

SEQ ID NO: 700274 - DNA, 13 bp, C. elegans
agacaaaaaagtg

SEQ ID NO: 700275 - DNA, 13 bp, C. elegans
agacaaaaactca

SEQ ID NO: 700276 - DNA, 13 bp, C. elegans
agacaaaagtttt

SEQ ID NO: 700277 - DNA, 13 bp, C. elegans
agacaaaattccc

SEQ ID NO: 700278 - DNA, 13 bp, C. elegans
agacaaattgatt

SEQ ID NO: 700279 - DNA, 13 bp, C. elegans
agacaactgaaat

SEQ ID NO: 700280 - DNA, 13 bp, C. elegans
agacaataaattc

SEQ ID NO: 700281 - DNA, 13 bp, C. elegans
agacaattttgga

SEQ ID NO: 700282 - DNA, 13 bp, C. elegans
agacactgcgaaa

SEQ ID NO: 700283 - DNA, 13 bp, C. elegans
agacagctgaaaa

SEQ ID NO: 700284 - DNA, 13 bp, C. elegans
agacatcaaaaat

SEQ ID NO: 700285 - DNA, 13 bp, C. elegans
agacatgaaacaa

SEQ ID NO: 700286 - DNA, 13 bp, C. elegans
agacatttttttt

SEQ ID NO: 700287 - DNA, 13 bp, C. elegans
agaccaagaaaat

SEQ ID NO: 700288 - DNA, 13 bp, C. elegans
agaccagtagatg

SEQ ID NO: 700289 - DNA, 13 bp, C. elegans
agacccaaaaatt

SEQ ID NO: 700290 - DNA, 13 bp, C. elegans
agacctttcaaat

SEQ ID NO: 700291 - DNA, 13 bp, C. elegans
agacgaaaacctg

SEQ ID NO: 700292 - DNA, 13 bp, C. elegans
agacgaaaagcca

SEQ ID NO: 700293 - DNA, 13 bp, C. elegans
agacgatttttaa

SEQ ID NO: 700294 - DNA, 13 bp, C. elegans
agacgcagacatc

SEQ ID NO: 700295 - DNA, 13 bp, C. elegans
agacgcagagaac

SEQ ID NO: 700296 - DNA, 13 bp, C. elegans
agacgcagagaag

SEQ ID NO: 700297 - DNA, 13 bp, C. elegans
agacgcagagaat

SEQ ID NO: 700298 - DNA, 13 bp, C. elegans
agacgcagatact

SEQ ID NO: 700299 - DNA, 13 bp, C. elegans
agacgctactcca

SEQ ID NO: 700300 - DNA, 13 bp, C. elegans
agacgttccaaaa

SEQ ID NO: 700301 - DNA, 13 bp, C. elegans
agacgttttgaaa

SEQ ID NO: 700302 - DNA, 13 bp, C. elegans
agactaagcctaa

SEQ ID NO: 700303 - DNA, 13 bp, C. elegans
agactaattttcg

SEQ ID NO: 700304 - DNA, 13 bp, C. elegans
agactacaaacta

SEQ ID NO: 700305 - DNA, 13 bp, C. elegans
agactattctgta

SEQ ID NO: 700306 - DNA, 13 bp, C. elegans
agactattttcaa

SEQ ID NO: 700307 - DNA, 13 bp, C. elegans
agactccgcccac

SEQ ID NO: 700308 - DNA, 13 bp, C. elegans
agactgaaaatga

SEQ ID NO: 700309 - DNA, 13 bp, C. elegans
agactgaagaaaa

SEQ ID NO: 700310 - DNA, 13 bp, C. elegans
agactgagtatca

SEQ ID NO: 700311 - DNA, 13 bp, C. elegans
agactgtgaaaaa

SEQ ID NO: 700312 - DNA, 13 bp, C. elegans
agacttcaaaaaa

SEQ ID NO: 700313 - DNA, 13 bp, C. elegans
agacttcacaaaa

SEQ ID NO: 700314 - DNA, 13 bp, C. elegans
agacttccagctc

SEQ ID NO: 700315 - DNA, 13 bp, C. elegans
agacttctcaaaa

SEQ ID NO: 700316 - DNA, 13 bp, C. elegans
agactttgaaaat

SEQ ID NO: 700317 - DNA, 13 bp, C. elegans
agactttggcaaa

SEQ ID NO: 700318 - DNA, 13 bp, C. elegans
agacttttgaaat

SEQ ID NO: 700319 - DNA, 13 bp, C. elegans
agactttttggaa

SEQ ID NO: 700320 - DNA, 13 bp, C. elegans
agacttttttgaa

SEQ ID NO: 700321 - DNA, 13 bp, C. elegans
agagaaaaattca

SEQ ID NO: 700322 - DNA, 13 bp, C. elegans
agagaaaattgca

SEQ ID NO: 700323 - DNA, 13 bp, C. elegans
agagaaaatttgg

SEQ ID NO: 700324 - DNA, 13 bp, C. elegans
agagaaactgaaa

SEQ ID NO: 700325 - DNA, 13 bp, C. elegans
agagaaattggaa

SEQ ID NO: 700326 - DNA, 13 bp, C. elegans
agagaaatttttg

SEQ ID NO: 700327 - DNA, 13 bp, C. elegans
agagaagattttt

SEQ ID NO: 700328 - DNA, 13 bp, C. elegans
agagaagccagaa

SEQ ID NO: 700329 - DNA, 13 bp, C. elegans
agagaatcaaaat

SEQ ID NO: 700330 - DNA, 13 bp, C. elegans
agagaattatggt

SEQ ID NO: 700331 - DNA, 13 bp, C. elegans
agagaattgaatt

SEQ ID NO: 700332 - DNA, 13 bp, C. elegans
agagaatttcaag

SEQ ID NO: 700333 - DNA, 13 bp, C. elegans
agagacaaaaatc

SEQ ID NO: 700334 - DNA, 13 bp, C. elegans
agagacacagaca

SEQ ID NO: 700335 - DNA, 13 bp, C. elegans
agagacatagaga

SEQ ID NO: 700336 - DNA, 13 bp, C. elegans
agagacgcagaaa

SEQ ID NO: 700337 - DNA, 13 bp, C. elegans
agagacgcagaat

SEQ ID NO: 700338 - DNA, 13 bp, C. elegans
agagagtgtgaga

SEQ ID NO: 700339 - DNA, 13 bp, C. elegans
agagagttattac

SEQ ID NO: 700340 - DNA, 13 bp, C. elegans
agagagtttagag

SEQ ID NO: 700341 - DNA, 13 bp, C. elegans
agagatagagata

SEQ ID NO: 700342 - DNA, 13 bp, C. elegans
agagatatcgaaa

SEQ ID NO: 700343 - DNA, 13 bp, C. elegans
agagatattgaaa

SEQ ID NO: 700344 - DNA, 13 bp, C. elegans
agagatattttta

SEQ ID NO: 700345 - DNA, 13 bp, C. elegans
agagattgagaga

SEQ ID NO: 700346 - DNA, 13 bp, C. elegans
agagatttatgaa

SEQ ID NO: 700347 - DNA, 13 bp, C. elegans
agagattttcaaa

SEQ ID NO: 700348 - DNA, 13 bp, C. elegans
agagcaacttttt

SEQ ID NO: 700349 - DNA, 13 bp, C. elegans
agagcacacttgc

SEQ ID NO: 700350 - DNA, 13 bp, C. elegans
agagcattgctaa

SEQ ID NO: 700351 - DNA, 13 bp, C. elegans
agagcgcgcgcgc

SEQ ID NO: 700352 - DNA, 13 bp, C. elegans
agagcgcgctcgc

SEQ ID NO: 700353 - DNA, 13 bp, C. elegans
agagcgcgtttgc

SEQ ID NO: 700354 - DNA, 13 bp, C. elegans
agagctcatttcg

SEQ ID NO: 700355 - DNA, 13 bp, C. elegans
agagctccaagga

SEQ ID NO: 700356 - DNA, 13 bp, C. elegans
agagctcttgtca

SEQ ID NO: 700357 - DNA, 13 bp, C. elegans
agagcttaaaatt

SEQ ID NO: 700358 - DNA, 13 bp, C. elegans
agagcttatatct

SEQ ID NO: 700359 - DNA, 13 bp, C. elegans
agagcttgaaaaa

SEQ ID NO: 700360 - DNA, 13 bp, C. elegans
agagcttgaaaat

SEQ ID NO: 700361 - DNA, 13 bp, C. elegans
agagcttgcgttg

SEQ ID NO: 700362 - DNA, 13 bp, C. elegans
agagctttaattt

SEQ ID NO: 700363 - DNA, 13 bp, C. elegans
agagctttcaaat

SEQ ID NO: 700364 - DNA, 13 bp, C. elegans
agagctttcaatt

SEQ ID NO: 700365 - DNA, 13 bp, C. elegans
agagctttgaaaa

SEQ ID NO: 700366 - DNA, 13 bp, C. elegans
agagcttttgaaa

SEQ ID NO: 700367 - DNA, 13 bp, C. elegans
agaggaattttga

SEQ ID NO: 700368 - DNA, 13 bp, C. elegans
agaggtaccaatt

SEQ ID NO: 700369 - DNA, 13 bp, C. elegans
agaggttttgaaa

SEQ ID NO: 700370 - DNA, 13 bp, C. elegans
agagtactgtaac

SEQ ID NO: 700371 - DNA, 13 bp, C. elegans
agagtatttgaaa

SEQ ID NO: 700372 - DNA, 13 bp, C. elegans
agagtattttcga

SEQ ID NO: 700373 - DNA, 14 bp, C. elegans
agagtcattatttt

SEQ ID NO: 700374 - DNA, 13 bp, C. elegans
agagtgggcggag

SEQ ID NO: 700375 - DNA, 13 bp, C. elegans
agagtgtcccatc

SEQ ID NO: 700376 - DNA, 13 bp, C. elegans
agagtgtcccatt

SEQ ID NO: 700377 - DNA, 13 bp, C. elegans
agagtgtttcatt

SEQ ID NO: 700378 - DNA, 13 bp, C. elegans
agagttcaatttt

SEQ ID NO: 700379 - DNA, 13 bp, C. elegans
agagttctgaaaa

SEQ ID NO: 700380 - DNA, 13 bp, C. elegans
agagttgtgaaaa

SEQ ID NO: 700381 - DNA, 13 bp, C. elegans
agagtttaaagaa

SEQ ID NO: 700382 - DNA, 13 bp, C. elegans
agagtttcaaaaa

SEQ ID NO: 700383 - DNA, 13 bp, C. elegans
agagtttcgaaaa

SEQ ID NO: 700384 - DNA, 13 bp, C. elegans
agagtttgaaatt

SEQ ID NO: 700385 - DNA, 13 bp, C. elegans
agagtttgagaaa

SEQ ID NO: 700386 - DNA, 13 bp, C. elegans
agagttttaattt

SEQ ID NO: 700387 - DNA, 13 bp, C. elegans
agagttttatatt

SEQ ID NO: 700388 - DNA, 13 bp, C. elegans
agagttttatgaa

SEQ ID NO: 700389 - DNA, 13 bp, C. elegans
agagttttcaact

SEQ ID NO: 700390 - DNA, 13 bp, C. elegans
agagtttttcacg

SEQ ID NO: 700391 - DNA, 13 bp, C. elegans
agataaagacgaa

SEQ ID NO: 700392 - DNA, 13 bp, C. elegans
agataaagttcaa

SEQ ID NO: 700393 - DNA, 13 bp, C. elegans
agataactttttg

SEQ ID NO: 700394 - DNA, 13 bp, C. elegans
agataagaaggat

SEQ ID NO: 700395 - DNA, 13 bp, C. elegans
agataatcaaaat

SEQ ID NO: 700396 - DNA, 13 bp, C. elegans
agataattcaatt

SEQ ID NO: 700397 - DNA, 13 bp, C. elegans
agataattgattt

SEQ ID NO: 700398 - DNA, 13 bp, C. elegans
agataatttcatt

SEQ ID NO: 700399 - DNA, 13 bp, C. elegans
agataattttgtt

SEQ ID NO: 700400 - DNA, 13 bp, C. elegans
agatacaagcgtt

SEQ ID NO: 700401 - DNA, 13 bp, C. elegans
agatacagtcatt

SEQ ID NO: 700402 - DNA, 13 bp, C. elegans
agatacgcagaca

SEQ ID NO: 700403 - DNA, 13 bp, C. elegans
agatactgaaaaa

SEQ ID NO: 700404 - DNA, 13 bp, C. elegans
agataggagttgt

SEQ ID NO: 700405 - DNA, 13 bp, C. elegans
agatataacagtt

SEQ ID NO: 700406 - DNA, 13 bp, C. elegans
agatatattttct

SEQ ID NO: 700407 - DNA, 13 bp, C. elegans
agatatcaaaaag

SEQ ID NO: 700408 - DNA, 13 bp, C. elegans
agatatcaataaa

SEQ ID NO: 700409 - DNA, 13 bp, C. elegans
agatatcaatatt

SEQ ID NO: 700410 - DNA, 13 bp, C. elegans
agatatcgaaaaa

SEQ ID NO: 700411 - DNA, 13 bp, C. elegans
agatattcatttt

SEQ ID NO: 700412 - DNA, 13 bp, C. elegans
agatattgtagaa

SEQ ID NO: 700413 - DNA, 13 bp, C. elegans
agatatttagaaa

SEQ ID NO: 700414 - DNA, 13 bp, C. elegans
agatatttcaaaa

SEQ ID NO: 700415 - DNA, 13 bp, C. elegans
agatatttgaaat

SEQ ID NO: 700416 - DNA, 13 bp, C. elegans
agatatttttgaa

SEQ ID NO: 700417 - DNA, 13 bp, C. elegans
agatcaaaaagtt

SEQ ID NO: 700418 - DNA, 13 bp, C. elegans
agatcaaaaattg

SEQ ID NO: 700419 - DNA, 13 bp, C. elegans
agatcaaaacatt

SEQ ID NO: 700420 - DNA, 13 bp, C. elegans
agatcaaaacgaa

SEQ ID NO: 700421 - DNA, 13 bp, C. elegans
agatcaaaccgat

SEQ ID NO: 700422 - DNA, 13 bp, C. elegans
agatcaaactaca

SEQ ID NO: 700423 - DNA, 13 bp, C. elegans
agatcaaactgaa

SEQ ID NO: 700424 - DNA, 13 bp, C. elegans
agatcaaagcaaa

SEQ ID NO: 700425 - DNA, 13 bp, C. elegans
agatcaaatatgt

SEQ ID NO: 700426 - DNA, 13 bp, C. elegans
agatcaaatttga

SEQ ID NO: 700427 - DNA, 13 bp, C. elegans
agatcacagaaaa

SEQ ID NO: 700428 - DNA, 13 bp, C. elegans
agatcactgaaat

SEQ ID NO: 700429 - DNA, 13 bp, C. elegans
agatcagaaaatt

SEQ ID NO: 700430 - DNA, 13 bp, C. elegans
agatcagaatagt

SEQ ID NO: 700431 - DNA, 13 bp, C. elegans
agatcatcaggca

SEQ ID NO: 700432 - DNA, 13 bp, C. elegans
agatcatgagaat

SEQ ID NO: 700433 - DNA, 13 bp, C. elegans
agatcattcaaaa

SEQ ID NO: 700434 - DNA, 13 bp, C. elegans
agatcatttcaaa

SEQ ID NO: 700435 - DNA, 13 bp, C. elegans
agatcatttgaaa

SEQ ID NO: 700436 - DNA, 13 bp, C. elegans
agatccaaatttc

SEQ ID NO: 700437 - DNA, 13 bp, C. elegans
agatcgaattttt

SEQ ID NO: 700438 - DNA, 13 bp, C. elegans
agatctacgaaaa

SEQ ID NO: 700439 - DNA, 13 bp, C. elegans
agatcttgttttc

SEQ ID NO: 700440 - DNA, 13 bp, C. elegans
agatctttgaaaa

SEQ ID NO: 700441 - DNA, 13 bp, C. elegans
agatgaaaagtga

SEQ ID NO: 700442 - DNA, 13 bp, C. elegans
agatgaataaatt

SEQ ID NO: 700443 - DNA, 13 bp, C. elegans
agatgaatttcca

SEQ ID NO: 700444 - DNA, 13 bp, C. elegans
agatgaatttgca

SEQ ID NO: 700445 - DNA, 13 bp, C. elegans
agatgacgtggca

SEQ ID NO: 700446 - DNA, 13 bp, C. elegans
agatgagatggtg

SEQ ID NO: 700447 - DNA, 13 bp, C. elegans
agatgaggaaatt

SEQ ID NO: 700448 - DNA, 13 bp, C. elegans
agatgaggaattt

SEQ ID NO: 700449 - DNA, 13 bp, C. elegans
agatgagggagtt

SEQ ID NO: 700450 - DNA, 13 bp, C. elegans
agatgagtgaaaa

SEQ ID NO: 700451 - DNA, 13 bp, C. elegans
agatgatgatgat

SEQ ID NO: 700452 - DNA, 13 bp, C. elegans
agatgatttattt

SEQ ID NO: 700453 - DNA, 13 bp, C. elegans
agatgcaaaaaga

SEQ ID NO: 700454 - DNA, 13 bp, C. elegans
agatgctgaaagt

SEQ ID NO: 700455 - DNA, 13 bp, C. elegans
agatgctgattgg

SEQ ID NO: 700456 - DNA, 13 bp, C. elegans
agatgtaaagaac

SEQ ID NO: 700457 - DNA, 13 bp, C. elegans
agatgtcgggcgc

SEQ ID NO: 700458 - DNA, 13 bp, C. elegans
agatgtgacacgg

SEQ ID NO: 700459 - DNA, 13 bp, C. elegans
agatgtttgaaat

SEQ ID NO: 700460 - DNA, 13 bp, C. elegans
agatgttttttca

SEQ ID NO: 700461 - DNA, 13 bp, C. elegans
agatgtttttttc

SEQ ID NO: 700462 - DNA, 13 bp, C. elegans
agattaacatttt

SEQ ID NO: 700463 - DNA, 13 bp, C. elegans
agattactgtact

SEQ ID NO: 700464 - DNA, 13 bp, C. elegans
agattactgtaga

SEQ ID NO: 700465 - DNA, 13 bp, C. elegans
agattactgtagc

SEQ ID NO: 700466 - DNA, 13 bp, C. elegans
agattactgtagt

SEQ ID NO: 700467 - DNA, 13 bp, C. elegans
agattactgtatt

SEQ ID NO: 700468 - DNA, 13 bp, C. elegans
agattattattga

SEQ ID NO: 700469 - DNA, 13 bp, C. elegans
agattattctttt

SEQ ID NO: 700470 - DNA, 13 bp, C. elegans
agattattgaaaa

SEQ ID NO: 700471 - DNA, 13 bp, C. elegans
agattattttctt

SEQ ID NO: 700472 - DNA, 13 bp, C. elegans
agattcaacaaaa

SEQ ID NO: 700473 - DNA, 13 bp, C. elegans
agattcacaaaaa

SEQ ID NO: 700474 - DNA, 14 bp, C. elegans
agattcacagaaga

SEQ ID NO: 700475 - DNA, 13 bp, C. elegans
agattcagagaaa

SEQ ID NO: 700476 - DNA, 13 bp, C. elegans
agattcccgaaga

SEQ ID NO: 700477 - DNA, 13 bp, C. elegans
agattcgcgaaaa

SEQ ID NO: 700478 - DNA, 13 bp, C. elegans
agattcggagaga

SEQ ID NO: 700479 - DNA, 13 bp, C. elegans
agattcggtgttt

SEQ ID NO: 700480 - DNA, 13 bp, C. elegans
agattctagtttt

SEQ ID NO: 700481 - DNA, 13 bp, C. elegans
agattctcaaagc

SEQ ID NO: 700482 - DNA, 13 bp, C. elegans
agattgcattttt

SEQ ID NO: 700483 - DNA, 13 bp, C. elegans
agatttaaaatga

SEQ ID NO: 700484 - DNA, 13 bp, C. elegans
agatttaacaaaa

SEQ ID NO: 700485 - DNA, 13 bp, C. elegans
agatttaactgaa

SEQ ID NO: 700486 - DNA, 13 bp, C. elegans
agatttaatcaga

SEQ ID NO: 700487 - DNA, 13 bp, C. elegans
agatttacaaaaa

SEQ ID NO: 700488 - DNA, 13 bp, C. elegans
agatttacaattt

SEQ ID NO: 700489 - DNA, 13 bp, C. elegans
agatttagcaaaa

SEQ ID NO: 700490 - DNA, 13 bp, C. elegans
agatttatagaaa

SEQ ID NO: 700491 - DNA, 13 bp, C. elegans
agatttatcaaaa

SEQ ID NO: 700492 - DNA, 13 bp, C. elegans
agatttattgaaa

SEQ ID NO: 700493 - DNA, 13 bp, C. elegans
agatttattttca

SEQ ID NO: 700494 - DNA, 13 bp, C. elegans
agatttcaaaaaa

SEQ ID NO: 700495 - DNA, 13 bp, C. elegans
agatttcaacaaa

SEQ ID NO: 700496 - DNA, 13 bp, C. elegans
agatttcaagaag

SEQ ID NO: 700497 - DNA, 13 bp, C. elegans
agatttcacaaaa

SEQ ID NO: 700498 - DNA, 13 bp, C. elegans
agatttcagcaaa

SEQ ID NO: 700499 - DNA, 13 bp, C. elegans
agatttccagaat

SEQ ID NO: 700500 - DNA, 13 bp, C. elegans
agatttccgaaaa

SEQ ID NO: 700501 - DNA, 13 bp, C. elegans
agatttctaaaaa

SEQ ID NO: 700502 - DNA, 13 bp, C. elegans
agatttctattta

SEQ ID NO: 700503 - DNA, 13 bp, C. elegans
agatttctcaaaa

SEQ ID NO: 700504 - DNA, 13 bp, C. elegans
agatttctcaaag

SEQ ID NO: 700505 - DNA, 13 bp, C. elegans
agatttctgaaaa

SEQ ID NO: 700506 - DNA, 13 bp, C. elegans
agatttcttcaaa

SEQ ID NO: 700507 - DNA, 13 bp, C. elegans
agatttcttgaaa

SEQ ID NO: 700508 - DNA, 13 bp, C. elegans
agatttctttttc

SEQ ID NO: 700509 - DNA, 13 bp, C. elegans
agatttgaaattt

SEQ ID NO: 700510 - DNA, 13 bp, C. elegans
agatttgaatttt

SEQ ID NO: 700511 - DNA, 13 bp, C. elegans
agatttgacaaaa

SEQ ID NO: 700512 - DNA, 13 bp, C. elegans
agatttgacgcaa

SEQ ID NO: 700513 - DNA, 13 bp, C. elegans
agatttgcaattt

SEQ ID NO: 700514 - DNA, 13 bp, C. elegans
agatttgccaaat

SEQ ID NO: 700515 - DNA, 20 bp, C. elegans
agatttgctgacgatattgt

SEQ ID NO: 700516 - DNA, 13 bp, C. elegans
agatttggttaaa

SEQ ID NO: 700517 - DNA, 13 bp, C. elegans
agattttagcgaa

SEQ ID NO: 700518 - DNA, 13 bp, C. elegans
agattttatatga

SEQ ID NO: 700519 - DNA, 13 bp, C. elegans
agattttatcgaa

SEQ ID NO: 700520 - DNA, 13 bp, C. elegans
agattttatgaat

SEQ ID NO: 700521 - DNA, 13 bp, C. elegans
agattttattgta

SEQ ID NO: 700522 - DNA, 13 bp, C. elegans
agattttcaaaat

SEQ ID NO: 700523 - DNA, 13 bp, C. elegans
agattttcaacaa

SEQ ID NO: 700524 - DNA, 13 bp, C. elegans
agattttcaattt

SEQ ID NO: 700525 - DNA, 13 bp, C. elegans
agattttcaccaa

SEQ ID NO: 700526 - DNA, 13 bp, C. elegans
agattttcagata

SEQ ID NO: 700527 - DNA, 13 bp, C. elegans
agattttcataat

SEQ ID NO: 700528 - DNA, 13 bp, C. elegans
agattttcattta

SEQ ID NO: 700529 - DNA, 13 bp, C. elegans
agattttccaaac

SEQ ID NO: 700530 - DNA, 13 bp, C. elegans
agattttccgttt

SEQ ID NO: 700531 - DNA, 13 bp, C. elegans
agattttcctttt

SEQ ID NO: 700532 - DNA, 13 bp, C. elegans
agattttcgaaaa

SEQ ID NO: 700533 - DNA, 13 bp, C. elegans
agattttcgagaa

SEQ ID NO: 700534 - DNA, 13 bp, C. elegans
agattttcgcaaa

SEQ ID NO: 700535 - DNA, 13 bp, C. elegans
agattttcggaat

SEQ ID NO: 700536 - DNA, 13 bp, C. elegans
agattttctagtt

SEQ ID NO: 700537 - DNA, 13 bp, C. elegans
agattttcttctt

SEQ ID NO: 700538 - DNA, 13 bp, C. elegans
agattttcttgca

SEQ ID NO: 700539 - DNA, 13 bp, C. elegans
agattttgaaaat

SEQ ID NO: 700540 - DNA, 13 bp, C. elegans
agattttgaaaca

SEQ ID NO: 700541 - DNA, 13 bp, C. elegans
agattttgaacaa

SEQ ID NO: 700542 - DNA, 13 bp, C. elegans
agattttgatatt

SEQ ID NO: 700543 - DNA, 13 bp, C. elegans
agattttgattat

SEQ ID NO: 700544 - DNA, 13 bp, C. elegans
agattttgcaaaa

SEQ ID NO: 700545 - DNA, 13 bp, C. elegans
agattttgttcac

SEQ ID NO: 700546 - DNA, 13 bp, C. elegans
agatttttaagaa

SEQ ID NO: 700547 - DNA, 13 bp, C. elegans
agatttttacttt

SEQ ID NO: 700548 - DNA, 13 bp, C. elegans
agatttttatcga

SEQ ID NO: 700549 - DNA, 13 bp, C. elegans
agatttttattca

SEQ ID NO: 700550 - DNA, 13 bp, C. elegans
agatttttcaaaa

SEQ ID NO: 700551 - DNA, 13 bp, C. elegans
agatttttcaaac

SEQ ID NO: 700552 - DNA, 13 bp, C. elegans
agatttttcaact

SEQ ID NO: 700553 - DNA, 13 bp, C. elegans
agatttttcataa

SEQ ID NO: 700554 - DNA, 13 bp, C. elegans
agatttttccgtt

SEQ ID NO: 700555 - DNA, 13 bp, C. elegans
agatttttcctac

SEQ ID NO: 700556 - DNA, 13 bp, C. elegans
agatttttcgaaa

SEQ ID NO: 700557 - DNA, 13 bp, C. elegans
agatttttcgaga

SEQ ID NO: 700558 - DNA, 13 bp, C. elegans
agatttttctgaa

SEQ ID NO: 700559 - DNA, 13 bp, C. elegans
agatttttctgtt

SEQ ID NO: 700560 - DNA, 13 bp, C. elegans
agatttttgaaaa

SEQ ID NO: 700561 - DNA, 13 bp, C. elegans
agatttttgaatt

SEQ ID NO: 700562 - DNA, 13 bp, C. elegans
agatttttggagt

SEQ ID NO: 700563 - DNA, 13 bp, C. elegans
agatttttgtaaa

SEQ ID NO: 700564 - DNA, 13 bp, C. elegans
agatttttgtttc

SEQ ID NO: 700565 - DNA, 13 bp, C. elegans
agattttttcaat

SEQ ID NO: 700566 - DNA, 13 bp, C. elegans
agattttttcgat

SEQ ID NO: 700567 - DNA, 13 bp, C. elegans
agattttttctaa

SEQ ID NO: 700568 - DNA, 14 bp, C. elegans
agattttttgaaac

SEQ ID NO: 700569 - DNA, 13 bp, C. elegans
agattttttgaga

SEQ ID NO: 700570 - DNA, 13 bp, C. elegans
agattttttgcca

SEQ ID NO: 700571 - DNA, 13 bp, C. elegans
agattttttgccg

SEQ ID NO: 700572 - DNA, 13 bp, C. elegans
agattttttggaa

SEQ ID NO: 700573 - DNA, 13 bp, C. elegans
agattttttgtaa

SEQ ID NO: 700574 - DNA, 13 bp, C. elegans
agattttttgtga

SEQ ID NO: 700575 - DNA, 13 bp, C. elegans
agatttttttcta

SEQ ID NO: 700576 - DNA, 13 bp, C. elegans
agattttttttca

SEQ ID NO: 700577 - DNA, 13 bp, C. elegans
agcaaaaaaattt

SEQ ID NO: 700578 - DNA, 13 bp, C. elegans
agcaaaaaatgca

SEQ ID NO: 700579 - DNA, 13 bp, C. elegans
agcaaaaaatgtt

SEQ ID NO: 700580 - DNA, 13 bp, C. elegans
agcaaaaaattga

SEQ ID NO: 700581 - DNA, 13 bp, C. elegans
agcaaaaagcaat

SEQ ID NO: 700582 - DNA, 13 bp, C. elegans
agcaaaaagtgtt

SEQ ID NO: 700583 - DNA, 13 bp, C. elegans
agcaaaaatcaat

SEQ ID NO: 700584 - DNA, 13 bp, C. elegans
agcaaaaatcgat

SEQ ID NO: 700585 - DNA, 13 bp, C. elegans
agcaaaaattgtt

SEQ ID NO: 700586 - DNA, 13 bp, C. elegans
agcaaaaatttta

SEQ ID NO: 700587 - DNA, 13 bp, C. elegans
agcaaaacaattt

SEQ ID NO: 700588 - DNA, 13 bp, C. elegans
agcaaaagtttga

SEQ ID NO: 700589 - DNA, 13 bp, C. elegans
agcaaaatatttt

SEQ ID NO: 700590 - DNA, 13 bp, C. elegans
agcaaaatgagca

SEQ ID NO: 700591 - DNA, 13 bp, C. elegans
agcaaaatgtgaa

SEQ ID NO: 700592 - DNA, 13 bp, C. elegans
agcaaacgatttt

SEQ ID NO: 700593 - DNA, 13 bp, C. elegans
agcaaagttggag

SEQ ID NO: 700594 - DNA, 13 bp, C. elegans
agcaaataccaaa

SEQ ID NO: 700595 - DNA, 13 bp, C. elegans
agcaaatcgacaa

SEQ ID NO: 700596 - DNA, 13 bp, C. elegans
agcaaatgttgaa

SEQ ID NO: 700597 - DNA, 13 bp, C. elegans
agcaaattgaaaa

SEQ ID NO: 700598 - DNA, 13 bp, C. elegans
agcaaattttata

SEQ ID NO: 700599 - DNA, 13 bp, C. elegans
agcaaattttttt

SEQ ID NO: 700600 - DNA, 13 bp, C. elegans
agcaacaactttg

SEQ ID NO: 700601 - DNA, 13 bp, C. elegans
agcaacatttcaa

SEQ ID NO: 700602 - DNA, 13 bp, C. elegans
agcaacatttttc

SEQ ID NO: 700603 - DNA, 13 bp, C. elegans
agcaacatttttt

SEQ ID NO: 700604 - DNA, 13 bp, C. elegans
agcaaccaaaaat

SEQ ID NO: 700605 - DNA, 13 bp, C. elegans
agcaactcaaaaa

SEQ ID NO: 700606 - DNA, 13 bp, C. elegans
agcaagaaccttt

SEQ ID NO: 700607 - DNA, 13 bp, C. elegans
agcaagaatgaaa

SEQ ID NO: 700608 - DNA, 13 bp, C. elegans
agcaagacccaaa

SEQ ID NO: 700609 - DNA, 13 bp, C. elegans
agcaaggtgcaga

SEQ ID NO: 700610 - DNA, 13 bp, C. elegans
agcaagtgggaaa

SEQ ID NO: 700611 - DNA, 13 bp, C. elegans
agcaatacatttt

SEQ ID NO: 700612 - DNA, 13 bp, C. elegans
agcaatacttttt

SEQ ID NO: 700613 - DNA, 13 bp, C. elegans
agcaatatcactt

SEQ ID NO: 700614 - DNA, 13 bp, C. elegans
agcaatatgaaca

SEQ ID NO: 700615 - DNA, 13 bp, C. elegans
agcaatatttgaa

SEQ ID NO: 700616 - DNA, 13 bp, C. elegans
agcaatatttttt

SEQ ID NO: 700617 - DNA, 13 bp, C. elegans
agcaatcgcgctc

SEQ ID NO: 700618 - DNA, 13 bp, C. elegans
agcaatctggagg

SEQ ID NO: 700619 - DNA, 13 bp, C. elegans
agcaatgatcaat

SEQ ID NO: 700620 - DNA, 13 bp, C. elegans
agcaatgggaaaa

SEQ ID NO: 700621 - DNA, 13 bp, C. elegans
agcaattcaattg

SEQ ID NO: 700622 - DNA, 13 bp, C. elegans
agcaattgaaaat

SEQ ID NO: 700623 - DNA, 13 bp, C. elegans
agcaattgccaaa

SEQ ID NO: 700624 - DNA, 13 bp, C. elegans
agcaattgccgat

SEQ ID NO: 700625 - DNA, 13 bp, C. elegans
agcaatttcttca

SEQ ID NO: 700626 - DNA, 13 bp, C. elegans
agcaatttgccaa

SEQ ID NO: 700627 - DNA, 13 bp, C. elegans
agcaatttgtcaa

SEQ ID NO: 700628 - DNA, 13 bp, C. elegans
agcaattttccaa

SEQ ID NO: 700629 - DNA, 13 bp, C. elegans
agcaattttgttt

SEQ ID NO: 700630 - DNA, 13 bp, C. elegans
agcaatttttcca

SEQ ID NO: 700631 - DNA, 13 bp, C. elegans
agcaatttttttt

SEQ ID NO: 700632 - DNA, 13 bp, C. elegans
agcacaatatcgt

SEQ ID NO: 700633 - DNA, 13 bp, C. elegans
agcacattgagca

SEQ ID NO: 700634 - DNA, 14 bp, C. elegans
agcacatttgccac

SEQ ID NO: 700635 - DNA, 13 bp, C. elegans
agcacgaaaaatt

SEQ ID NO: 700636 - DNA, 13 bp, C. elegans
agcacttgaagaa

SEQ ID NO: 700637 - DNA, 13 bp, C. elegans
agcactttgagca

SEQ ID NO: 700638 - DNA, 13 bp, C. elegans
agcacttttttaa

SEQ ID NO: 700639 - DNA, 13 bp, C. elegans
agcagaaaattca

SEQ ID NO: 700640 - DNA, 13 bp, C. elegans
agcagaaatttga

SEQ ID NO: 700641 - DNA, 13 bp, C. elegans
agcagacccaatt

SEQ ID NO: 700642 - DNA, 13 bp, C. elegans
agcagcaacaact

SEQ ID NO: 700643 - DNA, 13 bp, C. elegans
agcagcaacagca

SEQ ID NO: 700644 - DNA, 13 bp, C. elegans
agcagcagcagca

SEQ ID NO: 700645 - DNA, 13 bp, C. elegans
agcagcagcagcc

SEQ ID NO: 700646 - DNA, 13 bp, C. elegans
agcagcagcagcg

SEQ ID NO: 700647 - DNA, 13 bp, C. elegans
agcagcagcagct

SEQ ID NO: 700648 - DNA, 13 bp, C. elegans
agcagccgacaat

SEQ ID NO: 700649 - DNA, 13 bp, C. elegans
agcagccgacgcc

SEQ ID NO: 700650 - DNA, 13 bp, C. elegans
agcagcgaccaaa

SEQ ID NO: 700651 - DNA, 13 bp, C. elegans
agcagtattttgg

SEQ ID NO: 700652 - DNA, 13 bp, C. elegans
agcagtttcatta

SEQ ID NO: 700653 - DNA, 13 bp, C. elegans
agcagtttttcaa

SEQ ID NO: 700654 - DNA, 13 bp, C. elegans
agcagtttttctg

SEQ ID NO: 700655 - DNA, 13 bp, C. elegans
agcataaaaatga

SEQ ID NO: 700656 - DNA, 13 bp, C. elegans
agcataattatgt

SEQ ID NO: 700657 - DNA, 13 bp, C. elegans
agcatagtcaaaa

SEQ ID NO: 700658 - DNA, 13 bp, C. elegans
agcatattttatt

SEQ ID NO: 700659 - DNA, 13 bp, C. elegans
agcatatttttga

SEQ ID NO: 700660 - DNA, 13 bp, C. elegans
agcatctgcaaaa

SEQ ID NO: 700661 - DNA, 13 bp, C. elegans
agcattatttgaa

SEQ ID NO: 700662 - DNA, 13 bp, C. elegans
agcattctaaaaa

SEQ ID NO: 700663 - DNA, 13 bp, C. elegans
agcattctttgaa

SEQ ID NO: 700664 - DNA, 13 bp, C. elegans
agcattgaatctt

SEQ ID NO: 700665 - DNA, 13 bp, C. elegans
agcatttattcat

SEQ ID NO: 700666 - DNA, 13 bp, C. elegans
agcatttcagaac

SEQ ID NO: 700667 - DNA, 13 bp, C. elegans
agcatttctaaat

SEQ ID NO: 700668 - DNA, 13 bp, C. elegans
agcatttctaatt

SEQ ID NO: 700669 - DNA, 13 bp, C. elegans
agcattttcaaca

SEQ ID NO: 700670 - DNA, 13 bp, C. elegans
agcatttttaaat

SEQ ID NO: 700671 - DNA, 13 bp, C. elegans
agccaaaaactga

SEQ ID NO: 700672 - DNA, 13 bp, C. elegans
agccaaaaatatt

SEQ ID NO: 700673 - DNA, 13 bp, C. elegans
agccaaagccaaa

SEQ ID NO: 700674 - DNA, 13 bp, C. elegans
agccaagaaatca

SEQ ID NO: 700675 - DNA, 13 bp, C. elegans
agccacaagaaat

SEQ ID NO: 700676 - DNA, 13 bp, C. elegans
agccacgtttcac

SEQ ID NO: 700677 - DNA, 13 bp, C. elegans
agccactgagcca

SEQ ID NO: 700678 - DNA, 13 bp, C. elegans
agccatccgtgtt

SEQ ID NO: 700679 - DNA, 13 bp, C. elegans
agccattttattg

SEQ ID NO: 700680 - DNA, 13 bp, C. elegans
agccatttttcca

SEQ ID NO: 700681 - DNA, 13 bp, C. elegans
agcccaacaatat

SEQ ID NO: 700682 - DNA, 13 bp, C. elegans
agcccattcctga

SEQ ID NO: 700683 - DNA, 13 bp, C. elegans
agccgacatcttg

SEQ ID NO: 700684 - DNA, 13 bp, C. elegans
agccgagatatga

SEQ ID NO: 700685 - DNA, 13 bp, C. elegans
agccgattttcaa

SEQ ID NO: 700686 - DNA, 13 bp, C. elegans
agccgttcgaaaa

SEQ ID NO: 700687 - DNA, 13 bp, C. elegans
agcctaaaatttg

SEQ ID NO: 700688 - DNA, 13 bp, C. elegans
agcctaagcctaa

SEQ ID NO: 700689 - DNA, 13 bp, C. elegans
agcctaagcctga

SEQ ID NO: 700690 - DNA, 13 bp, C. elegans
agcctaagcctta

SEQ ID NO: 700691 - DNA, 13 bp, C. elegans
agcctaagggccc

SEQ ID NO: 700692 - DNA, 13 bp, C. elegans
agcctaagtctaa

SEQ ID NO: 700693 - DNA, 13 bp, C. elegans
agcctatgcctat

SEQ ID NO: 700694 - DNA, 13 bp, C. elegans
agcctgagccaaa

SEQ ID NO: 700695 - DNA, 14 bp, C. elegans
agcctgagcctaat

SEQ ID NO: 700696 - DNA, 13 bp, C. elegans
agcctgagcttaa

SEQ ID NO: 700697 - DNA, 14 bp, C. elegans
agcgaaaaaatcga

SEQ ID NO: 700698 - DNA, 13 bp, C. elegans
agcgaaaaatcga

SEQ ID NO: 700699 - DNA, 13 bp, C. elegans
agcgaaaaatgtt

SEQ ID NO: 700700 - DNA, 13 bp, C. elegans
agcgaaaagtgaa

SEQ ID NO: 700701 - DNA, 13 bp, C. elegans
agcgaaaatcgaa

SEQ ID NO: 700702 - DNA, 13 bp, C. elegans
agcgaaaattgga

SEQ ID NO: 700703 - DNA, 13 bp, C. elegans
agcgaagaaaaat

SEQ ID NO: 700704 - DNA, 13 bp, C. elegans
agcgaccgacatc

SEQ ID NO: 700705 - DNA, 14 bp, C. elegans
agcgatattcaatt

SEQ ID NO: 700706 - DNA, 13 bp, C. elegans
agcgatattccat

SEQ ID NO: 700707 - DNA, 13 bp, C. elegans
agcgcatttgcac

SEQ ID NO: 700708 - DNA, 14 bp, C. elegans
agcgccagtgggga

SEQ ID NO: 700709 - DNA, 13 bp, C. elegans
agcgcccgacact

SEQ ID NO: 700710 - DNA, 13 bp, C. elegans
agcgcgctctaat

SEQ ID NO: 700711 - DNA, 13 bp, C. elegans
agcgcgctttgat

SEQ ID NO: 700712 - DNA, 14 bp, C. elegans
agcgctttatatat

SEQ ID NO: 700713 - DNA, 13 bp, C. elegans
agcgctttcagaa

SEQ ID NO: 700714 - DNA, 15 bp, C. elegans
agcggccgacacgtt

SEQ ID NO: 700715 - DNA, 15 bp, C. elegans
agcggcgcgcggaac

SEQ ID NO: 700716 - DNA, 15 bp, C. elegans
agcgggaaattcaaa

SEQ ID NO: 700717 - DNA, 22 bp, C. elegans
agcgggaagaccatcgaaaaat

SEQ ID NO: 700718 - DNA, 13 bp, C. elegans
agcggttttggag

SEQ ID NO: 700719 - DNA, 13 bp, C. elegans
agcgtcaaaagta

SEQ ID NO: 700720 - DNA, 13 bp, C. elegans
agcgtttattatt

SEQ ID NO: 700721 - DNA, 13 bp, C. elegans
agctaaaaattgt

SEQ ID NO: 700722 - DNA, 13 bp, C. elegans
agctaaaatttga

SEQ ID NO: 700723 - DNA, 13 bp, C. elegans
agctaaatttttt

SEQ ID NO: 700724 - DNA, 13 bp, C. elegans
agctaatttcaaa

SEQ ID NO: 700725 - DNA, 13 bp, C. elegans
agctaattttcaa

SEQ ID NO: 700726 - DNA, 13 bp, C. elegans
agctacaaagaag

SEQ ID NO: 700727 - DNA, 13 bp, C. elegans
agctacaataatt

SEQ ID NO: 700728 - DNA, 13 bp, C. elegans
agctacaatggct

SEQ ID NO: 700729 - DNA, 13 bp, C. elegans
agctacagtaccc

SEQ ID NO: 700730 - DNA, 13 bp, C. elegans
agctacagtactc

SEQ ID NO: 700731 - DNA, 13 bp, C. elegans
agctacagtagcc

SEQ ID NO: 700732 - DNA, 13 bp, C. elegans
agctaccgtaacc

SEQ ID NO: 700733 - DNA, 13 bp, C. elegans
agctaccgtaccc

SEQ ID NO: 700734 - DNA, 13 bp, C. elegans
agctaccgtactc

SEQ ID NO: 700735 - DNA, 13 bp, C. elegans
agctagaaacaat

SEQ ID NO: 700736 - DNA, 13 bp, C. elegans
agctataaaaatt

SEQ ID NO: 700737 - DNA, 13 bp, C. elegans
agctatcaaaaaa

SEQ ID NO: 700738 - DNA, 13 bp, C. elegans
agctattttcatt

SEQ ID NO: 700739 - DNA, 13 bp, C. elegans
agctatttttgat

SEQ ID NO: 700740 - DNA, 13 bp, C. elegans
agctattttttct

SEQ ID NO: 700741 - DNA, 13 bp, C. elegans
agctcaaaaaatc

SEQ ID NO: 700742 - DNA, 13 bp, C. elegans
agctcaaaaaatt

SEQ ID NO: 700743 - DNA, 13 bp, C. elegans
agctcaaaaacat

SEQ ID NO: 700744 - DNA, 13 bp, C. elegans
agctcaaaaattt

SEQ ID NO: 700745 - DNA, 13 bp, C. elegans
agctcaaaatcaa

SEQ ID NO: 700746 - DNA, 13 bp, C. elegans
agctcaggctcag

SEQ ID NO: 700747 - DNA, 13 bp, C. elegans
agctcattgagcc

SEQ ID NO: 700748 - DNA, 13 bp, C. elegans
agctcattttgag

SEQ ID NO: 700749 - DNA, 13 bp, C. elegans
agctccaaaggat

SEQ ID NO: 700750 - DNA, 13 bp, C. elegans
agctccaaagtca

SEQ ID NO: 700751 - DNA, 13 bp, C. elegans
agctcccgtaaat

SEQ ID NO: 700752 - DNA, 13 bp, C. elegans
agctccgcccact

SEQ ID NO: 700753 - DNA, 13 bp, C. elegans
agctccgcctatt

SEQ ID NO: 700754 - DNA, 13 bp, C. elegans
agctccttttttc

SEQ ID NO: 700755 - DNA, 13 bp, C. elegans
agctcgacaaatt

SEQ ID NO: 700756 - DNA, 13 bp, C. elegans
agctcgcggagca

SEQ ID NO: 700757 - DNA, 13 bp, C. elegans
agctcgtaaatcg

SEQ ID NO: 700758 - DNA, 13 bp, C. elegans
agctcgtaaatct

SEQ ID NO: 700759 - DNA, 13 bp, C. elegans
agctctacaattt

SEQ ID NO: 700760 - DNA, 13 bp, C. elegans
agctctcggtgag

SEQ ID NO: 700761 - DNA, 13 bp, C. elegans
agctctctctctc

SEQ ID NO: 700762 - DNA, 13 bp, C. elegans
agctcttctctcc

SEQ ID NO: 700763 - DNA, 13 bp, C. elegans
agctgaaaaaatg

SEQ ID NO: 700764 - DNA, 13 bp, C. elegans
agctgaaaaactg

SEQ ID NO: 700765 - DNA, 13 bp, C. elegans
agctgaaaaatcg

SEQ ID NO: 700766 - DNA, 13 bp, C. elegans
agctgaaaaattg

SEQ ID NO: 700767 - DNA, 13 bp, C. elegans
agctgaaaactga

SEQ ID NO: 700768 - DNA, 13 bp, C. elegans
agctgaaaagttt

SEQ ID NO: 700769 - DNA, 13 bp, C. elegans
agctgaaaatcgc

SEQ ID NO: 700770 - DNA, 13 bp, C. elegans
agctgaaaattag

SEQ ID NO: 700771 - DNA, 13 bp, C. elegans
agctgaaaattcc

SEQ ID NO: 700772 - DNA, 13 bp, C. elegans
agctgaaaattgg

SEQ ID NO: 700773 - DNA, 13 bp, C. elegans
agctgaaactaat

SEQ ID NO: 700774 - DNA, 13 bp, C. elegans
agctgaaactttt

SEQ ID NO: 700775 - DNA, 13 bp, C. elegans
agctgaaatactt

SEQ ID NO: 700776 - DNA, 13 bp, C. elegans
agctgaaatgttt

SEQ ID NO: 700777 - DNA, 13 bp, C. elegans
agctgaaattaat

SEQ ID NO: 700778 - DNA, 13 bp, C. elegans
agctgaaattttg

SEQ ID NO: 700779 - DNA, 13 bp, C. elegans
agctgattttatt

SEQ ID NO: 700780 - DNA, 13 bp, C. elegans
agctgccaaagtt

SEQ ID NO: 700781 - DNA, 13 bp, C. elegans
agctgcgaatctc

SEQ ID NO: 700782 - DNA, 13 bp, C. elegans
agctgctattttc

SEQ ID NO: 700783 - DNA, 13 bp, C. elegans
agctggaaaaatg

SEQ ID NO: 700784 - DNA, 13 bp, C. elegans
agctggcgcaggt

SEQ ID NO: 700785 - DNA, 13 bp, C. elegans
agctgtcaaagtt

SEQ ID NO: 700786 - DNA, 27 bp, C. elegans
agctgttattgatgcaaacggatacgc

SEQ ID NO: 700787 - DNA, 13 bp, C. elegans
agctgttgaaaaa

SEQ ID NO: 700788 - DNA, 13 bp, C. elegans
agctgtttttgtt

SEQ ID NO: 700789 - DNA, 13 bp, C. elegans
agctgtttttttc

SEQ ID NO: 700790 - DNA, 13 bp, C. elegans
agcttaagccaaa

SEQ ID NO: 700791 - DNA, 13 bp, C. elegans
agcttaaggatca

SEQ ID NO: 700792 - DNA, 13 bp, C. elegans
agcttatatctca

SEQ ID NO: 700793 - DNA, 13 bp, C. elegans
agcttcaaaagta

SEQ ID NO: 700794 - DNA, 13 bp, C. elegans
agcttcaatattt

SEQ ID NO: 700795 - DNA, 13 bp, C. elegans
agcttcagaaaaa

SEQ ID NO: 700796 - DNA, 13 bp, C. elegans
agcttcagaaaat

SEQ ID NO: 700797 - DNA, 13 bp, C. elegans
agcttcattattt

SEQ ID NO: 700798 - DNA, 13 bp, C. elegans
agcttcctctttt

SEQ ID NO: 700799 - DNA, 13 bp, C. elegans
agcttcgttgcaa

SEQ ID NO: 700800 - DNA, 13 bp, C. elegans
agcttctctcgat

SEQ ID NO: 700801 - DNA, 13 bp, C. elegans
agcttctgaaaaa

SEQ ID NO: 700802 - DNA, 13 bp, C. elegans
agcttcttccaga

SEQ ID NO: 700803 - DNA, 13 bp, C. elegans
agcttcttcttct

SEQ ID NO: 700804 - DNA, 13 bp, C. elegans
agcttcttctttt

SEQ ID NO: 700805 - DNA, 13 bp, C. elegans
agcttgaaaaaca

SEQ ID NO: 700806 - DNA, 13 bp, C. elegans
agcttgaaatcgc

SEQ ID NO: 700807 - DNA, 13 bp, C. elegans
agcttgaacattt

SEQ ID NO: 700808 - DNA, 13 bp, C. elegans
agcttgagcacct

SEQ ID NO: 700809 - DNA, 13 bp, C. elegans
agcttggaaaacg

SEQ ID NO: 700810 - DNA, 13 bp, C. elegans
agcttggcgtgaa

SEQ ID NO: 700811 - DNA, 13 bp, C. elegans
agcttggtgtgtg

SEQ ID NO: 700812 - DNA, 13 bp, C. elegans
agctttaaaaaat

SEQ ID NO: 700813 - DNA, 13 bp, C. elegans
agctttaaaataa

SEQ ID NO: 700814 - DNA, 13 bp, C. elegans
agctttataaaat

SEQ ID NO: 700815 - DNA, 13 bp, C. elegans
agctttatatttt

SEQ ID NO: 700816 - DNA, 13 bp, C. elegans
agctttattaaaa

SEQ ID NO: 700817 - DNA, 13 bp, C. elegans
agctttatttatt

SEQ ID NO: 700818 - DNA, 13 bp, C. elegans
agctttcaaataa

SEQ ID NO: 700819 - DNA, 13 bp, C. elegans
agctttcaaatga

SEQ ID NO: 700820 - DNA, 13 bp, C. elegans
agctttcagaaaa

SEQ ID NO: 700821 - DNA, 13 bp, C. elegans
agctttcatttaa

SEQ ID NO: 700822 - DNA, 13 bp, C. elegans
agctttcatttga

SEQ ID NO: 700823 - DNA, 13 bp, C. elegans
agctttcgaaaaa

SEQ ID NO: 700824 - DNA, 13 bp, C. elegans
agctttgaaaata

SEQ ID NO: 700825 - DNA, 13 bp, C. elegans
agctttgaaataa

SEQ ID NO: 700826 - DNA, 13 bp, C. elegans
agctttgaaatta

SEQ ID NO: 700827 - DNA, 13 bp, C. elegans
agcttttatatat

SEQ ID NO: 700828 - DNA, 13 bp, C. elegans
agcttttcaaaaa

SEQ ID NO: 700829 - DNA, 13 bp, C. elegans
agcttttcaataa

SEQ ID NO: 700830 - DNA, 13 bp, C. elegans
agcttttgaaaaa

SEQ ID NO: 700831 - DNA, 13 bp, C. elegans
agcttttgaagag

SEQ ID NO: 700832 - DNA, 13 bp, C. elegans
agcttttggagca

SEQ ID NO: 700833 - DNA, 13 bp, C. elegans
agctttttcattt

SEQ ID NO: 700834 - DNA, 13 bp, C. elegans
agctttttctatt

SEQ ID NO: 700835 - DNA, 13 bp, C. elegans
agctttttctcaa

SEQ ID NO: 700836 - DNA, 13 bp, C. elegans
agcttttttcctt

SEQ ID NO: 700837 - DNA, 13 bp, C. elegans
agcttttttcgaa

SEQ ID NO: 700838 - DNA, 13 bp, C. elegans
aggaaaaaatcag

SEQ ID NO: 700839 - DNA, 13 bp, C. elegans
aggaaaaattcga

SEQ ID NO: 700840 - DNA, 13 bp, C. elegans
aggaaaaattttt

SEQ ID NO: 700841 - DNA, 13 bp, C. elegans
aggaaaactataa

SEQ ID NO: 700842 - DNA, 13 bp, C. elegans
aggaaaactattt

SEQ ID NO: 700843 - DNA, 13 bp, C. elegans
aggaaaactggaa

SEQ ID NO: 700844 - DNA, 13 bp, C. elegans
aggaaaagtttga

SEQ ID NO: 700845 - DNA, 13 bp, C. elegans
aggaaaataattt

SEQ ID NO: 700846 - DNA, 13 bp, C. elegans
aggaaaatccaaa

SEQ ID NO: 700847 - DNA, 13 bp, C. elegans
aggaaaattacaa

SEQ ID NO: 700848 - DNA, 13 bp, C. elegans
aggaaaattggag

SEQ ID NO: 700849 - DNA, 13 bp, C. elegans
aggaaaattggca

SEQ ID NO: 700850 - DNA, 13 bp, C. elegans
aggaaaattggga

SEQ ID NO: 700851 - DNA, 13 bp, C. elegans
aggaaaattgttt

SEQ ID NO: 700852 - DNA, 13 bp, C. elegans
aggaaaatttgaa

SEQ ID NO: 700853 - DNA, 13 bp, C. elegans
aggaaacaatgga

SEQ ID NO: 700854 - DNA, 13 bp, C. elegans
aggaaacattgag

SEQ ID NO: 700855 - DNA, 13 bp, C. elegans
aggaaacattttt

SEQ ID NO: 700856 - DNA, 13 bp, C. elegans
aggaaactttgaa

SEQ ID NO: 700857 - DNA, 13 bp, C. elegans
aggaaagtttttc

SEQ ID NO: 700858 - DNA, 13 bp, C. elegans
aggaaataaccat

SEQ ID NO: 700859 - DNA, 13 bp, C. elegans
aggaaatatattg

SEQ ID NO: 700860 - DNA, 13 bp, C. elegans
aggaaatcgaaaa

SEQ ID NO: 700861 - DNA, 13 bp, C. elegans
aggaaatgagaat

SEQ ID NO: 700862 - DNA, 13 bp, C. elegans
aggaaatgatttt

SEQ ID NO: 700863 - DNA, 13 bp, C. elegans
aggaaatggaaat

SEQ ID NO: 700864 - DNA, 13 bp, C. elegans
aggaaattatttt

SEQ ID NO: 700865 - DNA, 13 bp, C. elegans
aggaaattcaaag

SEQ ID NO: 700866 - DNA, 13 bp, C. elegans
aggaaattcaaat

SEQ ID NO: 700867 - DNA, 13 bp, C. elegans
aggaaattcaatt

SEQ ID NO: 700868 - DNA, 13 bp, C. elegans
aggaaattgagaa

SEQ ID NO: 700869 - DNA, 13 bp, C. elegans
aggaaattgataa

SEQ ID NO: 700870 - DNA, 13 bp, C. elegans
aggaaattgtttt

SEQ ID NO: 700871 - DNA, 13 bp, C. elegans
aggaaatttgaaa

SEQ ID NO: 700872 - DNA, 13 bp, C. elegans
aggaaatttggaa

SEQ ID NO: 700873 - DNA, 13 bp, C. elegans
aggaaattttaaa

SEQ ID NO: 700874 - DNA, 13 bp, C. elegans
aggaaattttgaa

SEQ ID NO: 700875 - DNA, 13 bp, C. elegans
aggaagtcaatct

SEQ ID NO: 700876 - DNA, 13 bp, C. elegans
aggaagttgccac

SEQ ID NO: 700877 - DNA, 13 bp, C. elegans
aggaagttttcaa

SEQ ID NO: 700878 - DNA, 13 bp, C. elegans
aggaatattggtt

SEQ ID NO: 700879 - DNA, 13 bp, C. elegans
aggaatccatcaa

SEQ ID NO: 700880 - DNA, 13 bp, C. elegans
aggaatgtaggca

SEQ ID NO: 700881 - DNA, 13 bp, C. elegans
aggaattgaaaat

SEQ ID NO: 700882 - DNA, 13 bp, C. elegans
aggaattgataaa

SEQ ID NO: 700883 - DNA, 13 bp, C. elegans
aggaatttcaaaa

SEQ ID NO: 700884 - DNA, 13 bp, C. elegans
aggaatttcaatt

SEQ ID NO: 700885 - DNA, 13 bp, C. elegans
aggaatttgaata

SEQ ID NO: 700886 - DNA, 13 bp, C. elegans
aggaccaggacca

SEQ ID NO: 700887 - DNA, 14 bp, C. elegans
aggacgattttgga

SEQ ID NO: 700888 - DNA, 13 bp, C. elegans
aggagaagaagct

SEQ ID NO: 700889 - DNA, 14 bp, C. elegans
aggagacccaggaa

SEQ ID NO: 700890 - DNA, 13 bp, C. elegans
aggagattttttt

SEQ ID NO: 700891 - DNA, 13 bp, C. elegans
aggagtacggtag

SEQ ID NO: 700892 - DNA, 13 bp, C. elegans
aggagtccattct

SEQ ID NO: 700893 - DNA, 14 bp, C. elegans
aggagtcggtggag

SEQ ID NO: 700894 - DNA, 13 bp, C. elegans
aggatatcaaaaa

SEQ ID NO: 700895 - DNA, 29 bp, C. elegans
aggatatttcgagagccctggaagatgat

SEQ ID NO: 700896 - DNA, 13 bp, C. elegans
aggatcagatcac

SEQ ID NO: 700897 - DNA, 13 bp, C. elegans
aggatgtgcgcct

SEQ ID NO: 700898 - DNA, 13 bp, C. elegans
aggattacattaa

SEQ ID NO: 700899 - DNA, 13 bp, C. elegans
aggattacggtag

SEQ ID NO: 700900 - DNA, 13 bp, C. elegans
aggattactgtag

SEQ ID NO: 700901 - DNA, 13 bp, C. elegans
aggattactgtat

SEQ ID NO: 700902 - DNA, 13 bp, C. elegans
aggattcaaagtc

SEQ ID NO: 700903 - DNA, 13 bp, C. elegans
aggatttcaaata

SEQ ID NO: 700904 - DNA, 13 bp, C. elegans
aggatttcctata

SEQ ID NO: 700905 - DNA, 13 bp, C. elegans
aggattttgagtg

SEQ ID NO: 700906 - DNA, 13 bp, C. elegans
aggatttttgagc

SEQ ID NO: 700907 - DNA, 13 bp, C. elegans
aggattttttcga

SEQ ID NO: 700908 - DNA, 13 bp, C. elegans
aggattttttgaa

SEQ ID NO: 700909 - DNA, 13 bp, C. elegans
aggattttttgag

SEQ ID NO: 700910 - DNA, 13 bp, C. elegans
aggcaaacttttt

SEQ ID NO: 700911 - DNA, 13 bp, C. elegans
aggcaactcaaaa

SEQ ID NO: 700912 - DNA, 13 bp, C. elegans
aggcacaaaaata

SEQ ID NO: 700913 - DNA, 13 bp, C. elegans
aggcacgtaggca

SEQ ID NO: 700914 - DNA, 13 bp, C. elegans
aggcaggcgaagg

SEQ ID NO: 700915 - DNA, 13 bp, C. elegans
aggcaggtaggca

SEQ ID NO: 700916 - DNA, 13 bp, C. elegans
aggcataaggcag

SEQ ID NO: 700917 - DNA, 13 bp, C. elegans
aggcatgaagtag

SEQ ID NO: 700918 - DNA, 13 bp, C. elegans
aggcatgcaaaac

SEQ ID NO: 700919 - DNA, 13 bp, C. elegans
aggcattccacgt

SEQ ID NO: 700920 - DNA, 13 bp, C. elegans
aggccaccaactt

SEQ ID NO: 700921 - DNA, 13 bp, C. elegans
aggccacgcccac

SEQ ID NO: 700922 - DNA, 13 bp, C. elegans
aggccggacttga

SEQ ID NO: 700923 - DNA, 13 bp, C. elegans
aggcctaaaagtt

SEQ ID NO: 700924 - DNA, 13 bp, C. elegans
aggcctagactta

SEQ ID NO: 700925 - DNA, 13 bp, C. elegans
aggcctaggctta

SEQ ID NO: 700926 - DNA, 14 bp, C. elegans
aggcctcgagtgac

SEQ ID NO: 700927 - DNA, 13 bp, C. elegans
aggcgcggtttca

SEQ ID NO: 700928 - DNA, 13 bp, C. elegans
aggctagaaaaag

SEQ ID NO: 700929 - DNA, 13 bp, C. elegans
aggctcaggctca

SEQ ID NO: 700930 - DNA, 16 bp, C. elegans
aggctcaggctcaggc

SEQ ID NO: 700931 - DNA, 13 bp, C. elegans
aggctcaggctta

SEQ ID NO: 700932 - DNA, 13 bp, C. elegans
aggctccgcccat

SEQ ID NO: 700933 - DNA, 13 bp, C. elegans
aggctgcaccaaa

SEQ ID NO: 700934 - DNA, 13 bp, C. elegans
aggcttaggttta

SEQ ID NO: 700935 - DNA, 13 bp, C. elegans
agggaaatttgaa

SEQ ID NO: 700936 - DNA, 13 bp, C. elegans
agggaaatttttt

SEQ ID NO: 700937 - DNA, 13 bp, C. elegans
agggaagccagaa

SEQ ID NO: 700938 - DNA, 13 bp, C. elegans
agggatgggcggc

SEQ ID NO: 700939 - DNA, 13 bp, C. elegans
agggcatcgaaaa

SEQ ID NO: 700940 - DNA, 13 bp, C. elegans
aggggcggagtct

SEQ ID NO: 700941 - DNA, 13 bp, C. elegans
aggggtactgtag

SEQ ID NO: 700942 - DNA, 13 bp, C. elegans
agggttactgtag

SEQ ID NO: 700943 - DNA, 13 bp, C. elegans
agggttttaaaaa

SEQ ID NO: 700944 - DNA, 13 bp, C. elegans
aggtaaacttttt

SEQ ID NO: 700945 - DNA, 13 bp, C. elegans
aggtaatttaaaa

SEQ ID NO: 700946 - DNA, 13 bp, C. elegans
aggtaggtaggca

SEQ ID NO: 700947 - DNA, 13 bp, C. elegans
aggtattcaaaaa

SEQ ID NO: 700948 - DNA, 13 bp, C. elegans
aggtattttaaat

SEQ ID NO: 700949 - DNA, 16 bp, C. elegans
aggtcacgagttcaag

SEQ ID NO: 700950 - DNA, 13 bp, C. elegans
aggtcacgggttc

SEQ ID NO: 700951 - DNA, 13 bp, C. elegans
aggtgaaaactga

SEQ ID NO: 700952 - DNA, 13 bp, C. elegans
aggtgctgaaaca

SEQ ID NO: 700953 - DNA, 13 bp, C. elegans
aggtggccgagtt

SEQ ID NO: 700954 - DNA, 13 bp, C. elegans
aggttactgtact

SEQ ID NO: 700955 - DNA, 13 bp, C. elegans
aggttactgtagt

SEQ ID NO: 700956 - DNA, 13 bp, C. elegans
aggttcaaaaatg

SEQ ID NO: 700957 - DNA, 13 bp, C. elegans
aggttctagaata

SEQ ID NO: 700958 - DNA, 13 bp, C. elegans
aggttctggagca

SEQ ID NO: 700959 - DNA, 13 bp, C. elegans
aggttgaaccgga

SEQ ID NO: 700960 - DNA, 13 bp, C. elegans
aggttgtcccatc

SEQ ID NO: 700961 - DNA, 13 bp, C. elegans
aggtttaggctca

SEQ ID NO: 700962 - DNA, 13 bp, C. elegans
aggtttaggctta

SEQ ID NO: 700963 - DNA, 13 bp, C. elegans
aggtttagtagaa

SEQ ID NO: 700964 - DNA, 13 bp, C. elegans
aggtttagtctta

SEQ ID NO: 700965 - DNA, 13 bp, C. elegans
aggtttcaaagtt

SEQ ID NO: 700966 - DNA, 13 bp, C. elegans
aggtttcatgttc

SEQ ID NO: 700967 - DNA, 13 bp, C. elegans
aggtttgagaaag

SEQ ID NO: 700968 - DNA, 13 bp, C. elegans
aggttttcaacaa

SEQ ID NO: 700969 - DNA, 13 bp, C. elegans
aggttttcaattc

SEQ ID NO: 700970 - DNA, 13 bp, C. elegans
aggttttcatttt

SEQ ID NO: 700971 - DNA, 13 bp, C. elegans
aggttttggaaaa

SEQ ID NO: 700972 - DNA, 13 bp, C. elegans
aggttttgtgaat

SEQ ID NO: 700973 - DNA, 13 bp, C. elegans
aggtttttaagaa

SEQ ID NO: 700974 - DNA, 13 bp, C. elegans
aggtttttgcaaa

SEQ ID NO: 700975 - DNA, 13 bp, C. elegans
aggttttttgaca

SEQ ID NO: 700976 - DNA, 13 bp, C. elegans
aggtttttttctg

SEQ ID NO: 700977 - DNA, 13 bp, C. elegans
aggtttttttgaa

SEQ ID NO: 700978 - DNA, 13 bp, C. elegans
agtaaaaatcatc

SEQ ID NO: 700979 - DNA, 13 bp, C. elegans
agtaaaaattcaa

SEQ ID NO: 700980 - DNA, 13 bp, C. elegans
agtaaaatatcgc

SEQ ID NO: 700981 - DNA, 13 bp, C. elegans
agtaaaatattct

SEQ ID NO: 700982 - DNA, 13 bp, C. elegans
agtaaactatttt

SEQ ID NO: 700983 - DNA, 13 bp, C. elegans
agtaaagtttcaa

SEQ ID NO: 700984 - DNA, 13 bp, C. elegans
agtaaatgatttt

SEQ ID NO: 700985 - DNA, 13 bp, C. elegans
agtaaattttcag

SEQ ID NO: 700986 - DNA, 13 bp, C. elegans
agtaaattttgtt

SEQ ID NO: 700987 - DNA, 13 bp, C. elegans
agtaacaaaaatt

SEQ ID NO: 700988 - DNA, 13 bp, C. elegans
agtaacccgaaaa

SEQ ID NO: 700989 - DNA, 13 bp, C. elegans
agtaagaaaatgt

SEQ ID NO: 700990 - DNA, 13 bp, C. elegans
agtaatgaattat

SEQ ID NO: 700991 - DNA, 13 bp, C. elegans
agtaattcagaaa

SEQ ID NO: 700992 - DNA, 13 bp, C. elegans
agtacaactacag

SEQ ID NO: 700993 - DNA, 13 bp, C. elegans
agtacaattttga

SEQ ID NO: 700994 - DNA, 13 bp, C. elegans
agtacagtactcc

SEQ ID NO: 700995 - DNA, 13 bp, C. elegans
agtacatttttgt

SEQ ID NO: 700996 - DNA, 13 bp, C. elegans
agtacattttttt

SEQ ID NO: 700997 - DNA, 13 bp, C. elegans
agtacccccaaaa

SEQ ID NO: 700998 - DNA, 14 bp, C. elegans
agtaccttgacatt

SEQ ID NO: 700999 - DNA, 13 bp, C. elegans
agtacgcaaacac

SEQ ID NO: 701000 - DNA, 13 bp, C. elegans
agtacgtaatgtg

SEQ ID NO: 701001 - DNA, 13 bp, C. elegans
agtactattgaaa

SEQ ID NO: 701002 - DNA, 13 bp, C. elegans
agtactcgacgag

SEQ ID NO: 701003 - DNA, 13 bp, C. elegans
agtactgtaattt

SEQ ID NO: 701004 - DNA, 13 bp, C. elegans
agtactgtagaat

SEQ ID NO: 701005 - DNA, 13 bp, C. elegans
agtacttttgaat

SEQ ID NO: 701006 - DNA, 13 bp, C. elegans
agtagatcaaaaa

SEQ ID NO: 701007 - DNA, 13 bp, C. elegans
agtagatcaaacc

SEQ ID NO: 701008 - DNA, 13 bp, C. elegans
agtagatcaattt

SEQ ID NO: 701009 - DNA, 13 bp, C. elegans
agtagattttttc

SEQ ID NO: 701010 - DNA, 13 bp, C. elegans
agtagcacatttt

SEQ ID NO: 701011 - DNA, 13 bp, C. elegans
agtagcgccagtg

SEQ ID NO: 701012 - DNA, 13 bp, C. elegans
agtaggcggagcc

SEQ ID NO: 701013 - DNA, 13 bp, C. elegans
agtagtactgtag

SEQ ID NO: 701014 - DNA, 13 bp, C. elegans
agtagtattgtag

SEQ ID NO: 701015 - DNA, 13 bp, C. elegans
agtagtcaattaa

SEQ ID NO: 701016 - DNA, 13 bp, C. elegans
agtagttttaatt

SEQ ID NO: 701017 - DNA, 13 bp, C. elegans
agtagtttttaga

SEQ ID NO: 701018 - DNA, 13 bp, C. elegans
agtataaagttaa

SEQ ID NO: 701019 - DNA, 13 bp, C. elegans
agtatcaaatttt

SEQ ID NO: 701020 - DNA, 13 bp, C. elegans
agtatcaatattt

SEQ ID NO: 701021 - DNA, 13 bp, C. elegans
agtatcagaaaaa

SEQ ID NO: 701022 - DNA, 13 bp, C. elegans
agtatctagagac

SEQ ID NO: 701023 - DNA, 13 bp, C. elegans
agtattatcaaaa

SEQ ID NO: 701024 - DNA, 13 bp, C. elegans
agtattattggta

SEQ ID NO: 701025 - DNA, 13 bp, C. elegans
agtattatttgaa

SEQ ID NO: 701026 - DNA, 13 bp, C. elegans
agtattcaatttt

SEQ ID NO: 701027 - DNA, 13 bp, C. elegans
agtattcagaaaa

SEQ ID NO: 701028 - DNA, 13 bp, C. elegans
agtattcatttaa

SEQ ID NO: 701029 - DNA, 13 bp, C. elegans
agtattgaaataa

SEQ ID NO: 701030 - DNA, 13 bp, C. elegans
agtattgaatatt

SEQ ID NO: 701031 - DNA, 13 bp, C. elegans
agtattgatctcg

SEQ ID NO: 701032 - DNA, 13 bp, C. elegans
agtatttcagttt

SEQ ID NO: 701033 - DNA, 13 bp, C. elegans
agtatttccaaaa

SEQ ID NO: 701034 - DNA, 13 bp, C. elegans
agtatttctaatg

SEQ ID NO: 701035 - DNA, 13 bp, C. elegans
agtatttctttaa

SEQ ID NO: 701036 - DNA, 13 bp, C. elegans
agtatttgaagaa

SEQ ID NO: 701037 - DNA, 13 bp, C. elegans
agtattttattct

SEQ ID NO: 701038 - DNA, 13 bp, C. elegans
agtattttcattt

SEQ ID NO: 701039 - DNA, 13 bp, C. elegans
agtattttgaaat

SEQ ID NO: 701040 - DNA, 13 bp, C. elegans
agtatttttcaaa

SEQ ID NO: 701041 - DNA, 13 bp, C. elegans
agtatttttcatt

SEQ ID NO: 701042 - DNA, 13 bp, C. elegans
agtatttttgaaa

SEQ ID NO: 701043 - DNA, 13 bp, C. elegans
agtattttttcaa

SEQ ID NO: 701044 - DNA, 13 bp, C. elegans
agtcaaaaaactc

SEQ ID NO: 701045 - DNA, 13 bp, C. elegans
agtcaaaaagcaa

SEQ ID NO: 701046 - DNA, 13 bp, C. elegans
agtcaaaattgaa

SEQ ID NO: 701047 - DNA, 13 bp, C. elegans
agtcaaaattgta

SEQ ID NO: 701048 - DNA, 13 bp, C. elegans
agtcaaaatttag

SEQ ID NO: 701049 - DNA, 13 bp, C. elegans
agtcaaagttttg

SEQ ID NO: 701050 - DNA, 13 bp, C. elegans
agtcaaattaaaa

SEQ ID NO: 701051 - DNA, 13 bp, C. elegans
agtcaaattttaa

SEQ ID NO: 701052 - DNA, 13 bp, C. elegans
agtcaaattttga

SEQ ID NO: 701053 - DNA, 13 bp, C. elegans
agtcaaatttttg

SEQ ID NO: 701054 - DNA, 13 bp, C. elegans
agtcaagataaat

SEQ ID NO: 701055 - DNA, 13 bp, C. elegans
agtcaatctgaaa

SEQ ID NO: 701056 - DNA, 13 bp, C. elegans
agtcaatgagcat

SEQ ID NO: 701057 - DNA, 13 bp, C. elegans
agtcaattgaaaa

SEQ ID NO: 701058 - DNA, 13 bp, C. elegans
agtcaattttcag

SEQ ID NO: 701059 - DNA, 13 bp, C. elegans
agtcaatttttct

SEQ ID NO: 701060 - DNA, 13 bp, C. elegans
agtcaatttttga

SEQ ID NO: 701061 - DNA, 13 bp, C. elegans
agtcacaaaagtt

SEQ ID NO: 701062 - DNA, 13 bp, C. elegans
agtcacaaaattt

SEQ ID NO: 701063 - DNA, 13 bp, C. elegans
agtcacatttctc

SEQ ID NO: 701064 - DNA, 13 bp, C. elegans
agtcactaaattt

SEQ ID NO: 701065 - DNA, 13 bp, C. elegans
agtcagcgggaaa

SEQ ID NO: 701066 - DNA, 13 bp, C. elegans
agtcataatttta

SEQ ID NO: 701067 - DNA, 13 bp, C. elegans
agtcattagatgg

SEQ ID NO: 701068 - DNA, 13 bp, C. elegans
agtcattttctga

SEQ ID NO: 701069 - DNA, 13 bp, C. elegans
agtccgcaaacac

SEQ ID NO: 701070 - DNA, 13 bp, C. elegans
agtcctaaatcac

SEQ ID NO: 701071 - DNA, 13 bp, C. elegans
agtcgaaaaaatc

SEQ ID NO: 701072 - DNA, 13 bp, C. elegans
agtcgaaattttt

SEQ ID NO: 701073 - DNA, 13 bp, C. elegans
agtcgaccgaaaa

SEQ ID NO: 701074 - DNA, 13 bp, C. elegans
agtcgagattttg

SEQ ID NO: 701075 - DNA, 13 bp, C. elegans
agtcggaaaaaaa

SEQ ID NO: 701076 - DNA, 13 bp, C. elegans
agtcgtaaaacta

SEQ ID NO: 701077 - DNA, 13 bp, C. elegans
agtcgtctgaaaa

SEQ ID NO: 701078 - DNA, 13 bp, C. elegans
agtcgtttcgaga

SEQ ID NO: 701079 - DNA, 13 bp, C. elegans
agtctaataaggc

SEQ ID NO: 701080 - DNA, 13 bp, C. elegans
agtctatattttt

SEQ ID NO: 701081 - DNA, 13 bp, C. elegans
agtctattgaatt

SEQ ID NO: 701082 - DNA, 13 bp, C. elegans
agtctcgccacga

SEQ ID NO: 701083 - DNA, 13 bp, C. elegans
agtctcttctccc

SEQ ID NO: 701084 - DNA, 13 bp, C. elegans
agtctgaaaatgt

SEQ ID NO: 701085 - DNA, 13 bp, C. elegans
agtctgaaaattt

SEQ ID NO: 701086 - DNA, 13 bp, C. elegans
agtctgaaataaa

SEQ ID NO: 701087 - DNA, 13 bp, C. elegans
agtctgaataatt

SEQ ID NO: 701088 - DNA, 13 bp, C. elegans
agtctgtgagcct

SEQ ID NO: 701089 - DNA, 13 bp, C. elegans
agtcttgaaattt

SEQ ID NO: 701090 - DNA, 13 bp, C. elegans
agtcttgaatgca

SEQ ID NO: 701091 - DNA, 13 bp, C. elegans
agtcttggaaact

SEQ ID NO: 701092 - DNA, 13 bp, C. elegans
agtcttttgaaga

SEQ ID NO: 701093 - DNA, 13 bp, C. elegans
agtgaaaaaatca

SEQ ID NO: 701094 - DNA, 13 bp, C. elegans
agtgaaaaaatgc

SEQ ID NO: 701095 - DNA, 13 bp, C. elegans
agtgaaaaaattt

SEQ ID NO: 701096 - DNA, 13 bp, C. elegans
agtgaaaaacaat

SEQ ID NO: 701097 - DNA, 13 bp, C. elegans
agtgaaaagagtt

SEQ ID NO: 701098 - DNA, 13 bp, C. elegans
agtgaaaatcgat

SEQ ID NO: 701099 - DNA, 13 bp, C. elegans
agtgaaaatcttt

SEQ ID NO: 701100 - DNA, 13 bp, C. elegans
agtgaaaatttga

SEQ ID NO: 701101 - DNA, 13 bp, C. elegans
agtgaaacagtaa

SEQ ID NO: 701102 - DNA, 13 bp, C. elegans
agtgaaacttctt

SEQ ID NO: 701103 - DNA, 13 bp, C. elegans
agtgaaacttttt

SEQ ID NO: 701104 - DNA, 13 bp, C. elegans
agtgaaagatttt

SEQ ID NO: 701105 - DNA, 13 bp, C. elegans
agtgaaattattt

SEQ ID NO: 701106 - DNA, 13 bp, C. elegans
agtgaaattgaaa

SEQ ID NO: 701107 - DNA, 13 bp, C. elegans
agtgaacaaagtt

SEQ ID NO: 701108 - DNA, 13 bp, C. elegans
agtgaacaacttt

SEQ ID NO: 701109 - DNA, 13 bp, C. elegans
agtgaactatttt

SEQ ID NO: 701110 - DNA, 13 bp, C. elegans
agtgaataaattt

SEQ ID NO: 701111 - DNA, 13 bp, C. elegans
agtgaataattag

SEQ ID NO: 701112 - DNA, 13 bp, C. elegans
agtgaataattta

SEQ ID NO: 701113 - DNA, 13 bp, C. elegans
agtgaatttacaa

SEQ ID NO: 701114 - DNA, 13 bp, C. elegans
agtgacaattact

SEQ ID NO: 701115 - DNA, 13 bp, C. elegans
agtgacgccgtga

SEQ ID NO: 701116 - DNA, 13 bp, C. elegans
agtgacgtcactt

SEQ ID NO: 701117 - DNA, 13 bp, C. elegans
agtgacgtcatca

SEQ ID NO: 701118 - DNA, 13 bp, C. elegans
agtgaggaaatga

SEQ ID NO: 701119 - DNA, 13 bp, C. elegans
agtgatcaaaaaa

SEQ ID NO: 701120 - DNA, 13 bp, C. elegans
agtgatttgggaa

SEQ ID NO: 701121 - DNA, 13 bp, C. elegans
agtgattttccag

SEQ ID NO: 701122 - DNA, 13 bp, C. elegans
agtgatttttcat

SEQ ID NO: 701123 - DNA, 13 bp, C. elegans
agtgcaattttat

SEQ ID NO: 701124 - DNA, 13 bp, C. elegans
agtgcagaaaaaa

SEQ ID NO: 701125 - DNA, 13 bp, C. elegans
agtgccaaaaatg

SEQ ID NO: 701126 - DNA, 13 bp, C. elegans
agtgccaaaatac

SEQ ID NO: 701127 - DNA, 13 bp, C. elegans
agtgccacatttt

SEQ ID NO: 701128 - DNA, 13 bp, C. elegans
agtgcgctccatc

SEQ ID NO: 701129 - DNA, 13 bp, C. elegans
agtgcgtatttta

SEQ ID NO: 701130 - DNA, 13 bp, C. elegans
agtgctaattttt

SEQ ID NO: 701131 - DNA, 13 bp, C. elegans
agtgctattttca

SEQ ID NO: 701132 - DNA, 13 bp, C. elegans
agtgctcaaaaaa

SEQ ID NO: 701133 - DNA, 13 bp, C. elegans
agtgctcaaaaat

SEQ ID NO: 701134 - DNA, 13 bp, C. elegans
agtgctcaaaatt

SEQ ID NO: 701135 - DNA, 13 bp, C. elegans
agtggaaaaaact

SEQ ID NO: 701136 - DNA, 13 bp, C. elegans
agtggaaaaaatg

SEQ ID NO: 701137 - DNA, 13 bp, C. elegans
agtggaaaaacaa

SEQ ID NO: 701138 - DNA, 13 bp, C. elegans
agtggaaaaatga

SEQ ID NO: 701139 - DNA, 13 bp, C. elegans
agtggaaagtttg

SEQ ID NO: 701140 - DNA, 13 bp, C. elegans
agtggaaatttga

SEQ ID NO: 701141 - DNA, 13 bp, C. elegans
agtggaatatcat

SEQ ID NO: 701142 - DNA, 13 bp, C. elegans
agtggaatttgaa

SEQ ID NO: 701143 - DNA, 13 bp, C. elegans
agtggacgaaaaa

SEQ ID NO: 701144 - DNA, 13 bp, C. elegans
agtggagacgcag

SEQ ID NO: 701145 - DNA, 14 bp, C. elegans
agtggagagttcag

SEQ ID NO: 701146 - DNA, 13 bp, C. elegans
agtggagggatat

SEQ ID NO: 701147 - DNA, 13 bp, C. elegans
agtggatttcaat

SEQ ID NO: 701148 - DNA, 13 bp, C. elegans
agtgggaaaagtg

SEQ ID NO: 701149 - DNA, 13 bp, C. elegans
agtgggaattttg

SEQ ID NO: 701150 - DNA, 20 bp, C. elegans
agtgggtcccggtcgaggaa

SEQ ID NO: 701151 - DNA, 35 bp, C. elegans
agtggtggacactaatggtgaatacttgtgtgaat

SEQ ID NO: 701152 - DNA, 13 bp, C. elegans
agtgtaaaatatt

SEQ ID NO: 701153 - DNA, 13 bp, C. elegans
agtgtattgtatt

SEQ ID NO: 701154 - DNA, 13 bp, C. elegans
agtgtattttact

SEQ ID NO: 701155 - DNA, 13 bp, C. elegans
agtgtcccatgtc

SEQ ID NO: 701156 - DNA, 13 bp, C. elegans
agtgtcgagaacg

SEQ ID NO: 701157 - DNA, 13 bp, C. elegans
agtgtcggctgct

SEQ ID NO: 701158 - DNA, 13 bp, C. elegans
agtgtctcatttc

SEQ ID NO: 701159 - DNA, 13 bp, C. elegans
agtgtgacgtcat

SEQ ID NO: 701160 - DNA, 13 bp, C. elegans
agtgtgtctgctt

SEQ ID NO: 701161 - DNA, 13 bp, C. elegans
agtgtgtgtatgt

SEQ ID NO: 701162 - DNA, 13 bp, C. elegans
agtgttcaaaaac

SEQ ID NO: 701163 - DNA, 13 bp, C. elegans
agtgttcaagaaa

SEQ ID NO: 701164 - DNA, 13 bp, C. elegans
agtgttcacaaaa

SEQ ID NO: 701165 - DNA, 13 bp, C. elegans
agtgttcataatt

SEQ ID NO: 701166 - DNA, 13 bp, C. elegans
agtgttcattttt

SEQ ID NO: 701167 - DNA, 14 bp, C. elegans
agtgttctaccctt

SEQ ID NO: 701168 - DNA, 13 bp, C. elegans
agtgttgaaaact

SEQ ID NO: 701169 - DNA, 13 bp, C. elegans
agtgtttaaaaaa

SEQ ID NO: 701170 - DNA, 13 bp, C. elegans
agtgttttttcta

SEQ ID NO: 701171 - DNA, 13 bp, C. elegans
agttaaaaaagtt

SEQ ID NO: 701172 - DNA, 13 bp, C. elegans
agttaaaaacatt

SEQ ID NO: 701173 - DNA, 13 bp, C. elegans
agttaaaactttt

SEQ ID NO: 701174 - DNA, 13 bp, C. elegans
agttaaacatttt

SEQ ID NO: 701175 - DNA, 13 bp, C. elegans
agttaaacttttt

SEQ ID NO: 701176 - DNA, 13 bp, C. elegans
agttaaagttatt

SEQ ID NO: 701177 - DNA, 13 bp, C. elegans
agttaaagttgaa

SEQ ID NO: 701178 - DNA, 13 bp, C. elegans
agttaaatgtttt

SEQ ID NO: 701179 - DNA, 13 bp, C. elegans
agttaaatttcaa

SEQ ID NO: 701180 - DNA, 13 bp, C. elegans
agttaacaacttt

SEQ ID NO: 701181 - DNA, 13 bp, C. elegans
agttaacagtttt

SEQ ID NO: 701182 - DNA, 13 bp, C. elegans
agttaactttttt

SEQ ID NO: 701183 - DNA, 13 bp, C. elegans
agttaattcaaat

SEQ ID NO: 701184 - DNA, 13 bp, C. elegans
agttacaaaagtt

SEQ ID NO: 701185 - DNA, 13 bp, C. elegans
agttacaaatatt

SEQ ID NO: 701186 - DNA, 13 bp, C. elegans
agttacagtaacc

SEQ ID NO: 701187 - DNA, 13 bp, C. elegans
agttacagtaatc

SEQ ID NO: 701188 - DNA, 13 bp, C. elegans
agttacagtaatt

SEQ ID NO: 701189 - DNA, 13 bp, C. elegans
agttacagtactc

SEQ ID NO: 701190 - DNA, 13 bp, C. elegans
agttacggatttt

SEQ ID NO: 701191 - DNA, 13 bp, C. elegans
agttactgtaatt

SEQ ID NO: 701192 - DNA, 13 bp, C. elegans
agttactttgaag

SEQ ID NO: 701193 - DNA, 13 bp, C. elegans
agttacttttttg

SEQ ID NO: 701194 - DNA, 13 bp, C. elegans
agttagactgctt

SEQ ID NO: 701195 - DNA, 13 bp, C. elegans
agttagctttttt

SEQ ID NO: 701196 - DNA, 13 bp, C. elegans
agttaggcaaaaa

SEQ ID NO: 701197 - DNA, 13 bp, C. elegans
agttagtttgaag

SEQ ID NO: 701198 - DNA, 13 bp, C. elegans
agttatacttatt

SEQ ID NO: 701199 - DNA, 13 bp, C. elegans
agttatatttggt

SEQ ID NO: 701200 - DNA, 13 bp, C. elegans
agttatcaaaact

SEQ ID NO: 701201 - DNA, 13 bp, C. elegans
agttatcaagttt

SEQ ID NO: 701202 - DNA, 13 bp, C. elegans
agttatcaatttt

SEQ ID NO: 701203 - DNA, 13 bp, C. elegans
agttatcattgtt

SEQ ID NO: 701204 - DNA, 13 bp, C. elegans
agttatcattttt

SEQ ID NO: 701205 - DNA, 13 bp, C. elegans
agttatcgaaaaa

SEQ ID NO: 701206 - DNA, 13 bp, C. elegans
agttatcgatttt

SEQ ID NO: 701207 - DNA, 13 bp, C. elegans
agttatgaaattt

SEQ ID NO: 701208 - DNA, 13 bp, C. elegans
agttatgacggct

SEQ ID NO: 701209 - DNA, 13 bp, C. elegans
agttatgacgtca

SEQ ID NO: 701210 - DNA, 13 bp, C. elegans
agttatgagaaaa

SEQ ID NO: 701211 - DNA, 13 bp, C. elegans
agttatggaaaaa

SEQ ID NO: 701212 - DNA, 13 bp, C. elegans
agttatggatttt

SEQ ID NO: 701213 - DNA, 13 bp, C. elegans
agttatggccgct

SEQ ID NO: 701214 - DNA, 14 bp, C. elegans
agttattacatcaa

SEQ ID NO: 701215 - DNA, 13 bp, C. elegans
agttattgaaaaa

SEQ ID NO: 701216 - DNA, 13 bp, C. elegans
agttatttcaaaa

SEQ ID NO: 701217 - DNA, 13 bp, C. elegans
agttatttcattt

SEQ ID NO: 701218 - DNA, 13 bp, C. elegans
agttatttggaag

SEQ ID NO: 701219 - DNA, 13 bp, C. elegans
agttatttggagc

SEQ ID NO: 701220 - DNA, 13 bp, C. elegans
agttattttgatg

SEQ ID NO: 701221 - DNA, 13 bp, C. elegans
agttattttttca

SEQ ID NO: 701222 - DNA, 13 bp, C. elegans
agttcaaaagtaa

SEQ ID NO: 701223 - DNA, 13 bp, C. elegans
agttcaaaagttt

SEQ ID NO: 701224 - DNA, 13 bp, C. elegans
agttcaaaatcaa

SEQ ID NO: 701225 - DNA, 13 bp, C. elegans
agttcaaaattta

SEQ ID NO: 701226 - DNA, 13 bp, C. elegans
agttcaaacttta

SEQ ID NO: 701227 - DNA, 13 bp, C. elegans
agttcaaactttt

SEQ ID NO: 701228 - DNA, 13 bp, C. elegans
agttcaaagaatg

SEQ ID NO: 701229 - DNA, 13 bp, C. elegans
agttcaaatttca

SEQ ID NO: 701230 - DNA, 13 bp, C. elegans
agttcaaattttc

SEQ ID NO: 701231 - DNA, 13 bp, C. elegans
agttcaagttcaa

SEQ ID NO: 701232 - DNA, 13 bp, C. elegans
agttcaatttaat

SEQ ID NO: 701233 - DNA, 13 bp, C. elegans
agttcaatttgtt

SEQ ID NO: 701234 - DNA, 13 bp, C. elegans
agttcaattttat

SEQ ID NO: 701235 - DNA, 13 bp, C. elegans
agttcaattttta

SEQ ID NO: 701236 - DNA, 13 bp, C. elegans
agttcacaaaaaa

SEQ ID NO: 701237 - DNA, 13 bp, C. elegans
agttcagaatttc

SEQ ID NO: 701238 - DNA, 13 bp, C. elegans
agttcagcaaaaa

SEQ ID NO: 701239 - DNA, 13 bp, C. elegans
agttcagttttga

SEQ ID NO: 701240 - DNA, 13 bp, C. elegans
agttcataaattt

SEQ ID NO: 701241 - DNA, 13 bp, C. elegans
agttcatcaaaaa

SEQ ID NO: 701242 - DNA, 13 bp, C. elegans
agttcatgagaat

SEQ ID NO: 701243 - DNA, 13 bp, C. elegans
agttcattttcaa

SEQ ID NO: 701244 - DNA, 13 bp, C. elegans
agttcatttttca

SEQ ID NO: 701245 - DNA, 13 bp, C. elegans
agttcattttttg

SEQ ID NO: 701246 - DNA, 13 bp, C. elegans
agttccaaaattc

SEQ ID NO: 701247 - DNA, 13 bp, C. elegans
agttccaaatttc

SEQ ID NO: 701248 - DNA, 13 bp, C. elegans
agttccagttatt

SEQ ID NO: 701249 - DNA, 13 bp, C. elegans
agttccagttttt

SEQ ID NO: 701250 - DNA, 13 bp, C. elegans
agttcccgatttt

SEQ ID NO: 701251 - DNA, 13 bp, C. elegans
agttcccgcccat

SEQ ID NO: 701252 - DNA, 13 bp, C. elegans
agttccggcaaat

SEQ ID NO: 701253 - DNA, 13 bp, C. elegans
agttcgaataaaa

SEQ ID NO: 701254 - DNA, 13 bp, C. elegans
agttcgagaaaaa

SEQ ID NO: 701255 - DNA, 13 bp, C. elegans
agttcggaaaact

SEQ ID NO: 701256 - DNA, 13 bp, C. elegans
agttctaaaatgt

SEQ ID NO: 701257 - DNA, 13 bp, C. elegans
agttctacttcat

SEQ ID NO: 701258 - DNA, 13 bp, C. elegans
agttctagaagtt

SEQ ID NO: 701259 - DNA, 13 bp, C. elegans
agttctattttca

SEQ ID NO: 701260 - DNA, 13 bp, C. elegans
agttctcaaattt

SEQ ID NO: 701261 - DNA, 13 bp, C. elegans
agttctcaacttt

SEQ ID NO: 701262 - DNA, 13 bp, C. elegans
agttctcaatttt

SEQ ID NO: 701263 - DNA, 13 bp, C. elegans
agttctcattttg

SEQ ID NO: 701264 - DNA, 13 bp, C. elegans
agttctcgattat

SEQ ID NO: 701265 - DNA, 13 bp, C. elegans
agttctgaaaaat

SEQ ID NO: 701266 - DNA, 13 bp, C. elegans
agttctgaatttt

SEQ ID NO: 701267 - DNA, 13 bp, C. elegans
agttcttccaaaa

SEQ ID NO: 701268 - DNA, 13 bp, C. elegans
agttcttcttgtt

SEQ ID NO: 701269 - DNA, 13 bp, C. elegans
agttcttgaaaca

SEQ ID NO: 701270 - DNA, 13 bp, C. elegans
agttcttgaaatt

SEQ ID NO: 701271 - DNA, 13 bp, C. elegans
agttctttgaata

SEQ ID NO: 701272 - DNA, 13 bp, C. elegans
agttctttttaaa

SEQ ID NO: 701273 - DNA, 13 bp, C. elegans
agttgaaaaatag

SEQ ID NO: 701274 - DNA, 13 bp, C. elegans
agttgaaaaccaa

SEQ ID NO: 701275 - DNA, 13 bp, C. elegans
agttgaaaactat

SEQ ID NO: 701276 - DNA, 13 bp, C. elegans
agttgaaaactga

SEQ ID NO: 701277 - DNA, 13 bp, C. elegans
agttgaaaacttt

SEQ ID NO: 701278 - DNA, 13 bp, C. elegans
agttgaaaagttg

SEQ ID NO: 701279 - DNA, 13 bp, C. elegans
agttgaaaagttt

SEQ ID NO: 701280 - DNA, 13 bp, C. elegans
agttgaaaatatt

SEQ ID NO: 701281 - DNA, 13 bp, C. elegans
agttgaaaattat

SEQ ID NO: 701282 - DNA, 13 bp, C. elegans
agttgaaaattgc

SEQ ID NO: 701283 - DNA, 13 bp, C. elegans
agttgaaaattgt

SEQ ID NO: 701284 - DNA, 13 bp, C. elegans
agttgaaatactt

SEQ ID NO: 701285 - DNA, 13 bp, C. elegans
agttgaaatgaaa

SEQ ID NO: 701286 - DNA, 13 bp, C. elegans
agttgaaatgttt

SEQ ID NO: 701287 - DNA, 13 bp, C. elegans
agttgaaattcaa

SEQ ID NO: 701288 - DNA, 13 bp, C. elegans
agttgaaattttc

SEQ ID NO: 701289 - DNA, 13 bp, C. elegans
agttgaaattttt

SEQ ID NO: 701290 - DNA, 13 bp, C. elegans
agttgaacaaaaa

SEQ ID NO: 701291 - DNA, 13 bp, C. elegans
agttgaacaaatt

SEQ ID NO: 701292 - DNA, 13 bp, C. elegans
agttgaacaatgg

SEQ ID NO: 701293 - DNA, 13 bp, C. elegans
agttgaacacttt

SEQ ID NO: 701294 - DNA, 13 bp, C. elegans
agttgaacatttt

SEQ ID NO: 701295 - DNA, 13 bp, C. elegans
agttgaactcatt

SEQ ID NO: 701296 - DNA, 13 bp, C. elegans
agttgaagaaaat

SEQ ID NO: 701297 - DNA, 13 bp, C. elegans
agttgaatatttg

SEQ ID NO: 701298 - DNA, 13 bp, C. elegans
agttgaatatttt

SEQ ID NO: 701299 - DNA, 13 bp, C. elegans
agttgaatgaaaa

SEQ ID NO: 701300 - DNA, 13 bp, C. elegans
agttgaatgtttt

SEQ ID NO: 701301 - DNA, 13 bp, C. elegans
agttgaattttaa

SEQ ID NO: 701302 - DNA, 13 bp, C. elegans
agttgaattttac

SEQ ID NO: 701303 - DNA, 13 bp, C. elegans
agttgaattttga

SEQ ID NO: 701304 - DNA, 13 bp, C. elegans
agttgacaaaagt

SEQ ID NO: 701305 - DNA, 13 bp, C. elegans
agttgacaacttt

SEQ ID NO: 701306 - DNA, 13 bp, C. elegans
agttgacaagttt

SEQ ID NO: 701307 - DNA, 13 bp, C. elegans
agttgacaatggt

SEQ ID NO: 701308 - DNA, 13 bp, C. elegans
agttgagcatttt

SEQ ID NO: 701309 - DNA, 13 bp, C. elegans
agttgataagaaa

SEQ ID NO: 701310 - DNA, 13 bp, C. elegans
agttgatagaaaa

SEQ ID NO: 701311 - DNA, 13 bp, C. elegans
agttgatagtttt

SEQ ID NO: 701312 - DNA, 13 bp, C. elegans
agttgatatttaa

SEQ ID NO: 701313 - DNA, 13 bp, C. elegans
agttgatattttg

SEQ ID NO: 701314 - DNA, 13 bp, C. elegans
agttgatcaaaaa

SEQ ID NO: 701315 - DNA, 13 bp, C. elegans
agttgatcaagaa

SEQ ID NO: 701316 - DNA, 13 bp, C. elegans
agttgatcacttt

SEQ ID NO: 701317 - DNA, 13 bp, C. elegans
agttgatgatatt

SEQ ID NO: 701318 - DNA, 13 bp, C. elegans
agttgatggaaaa

SEQ ID NO: 701319 - DNA, 13 bp, C. elegans
agttgatgtttca

SEQ ID NO: 701320 - DNA, 13 bp, C. elegans
agttgattaattt

SEQ ID NO: 701321 - DNA, 13 bp, C. elegans
agttgattcaaaa

SEQ ID NO: 701322 - DNA, 13 bp, C. elegans
agttgattttgaa

SEQ ID NO: 701323 - DNA, 13 bp, C. elegans
agttgcaaaattg

SEQ ID NO: 701324 - DNA, 13 bp, C. elegans
agttgcaagtttt

SEQ ID NO: 701325 - DNA, 13 bp, C. elegans
agttgcagtgaaa

SEQ ID NO: 701326 - DNA, 13 bp, C. elegans
agttgcagttatt

SEQ ID NO: 701327 - DNA, 13 bp, C. elegans
agttgccagaatt

SEQ ID NO: 701328 - DNA, 13 bp, C. elegans
agttgccgaagtt

SEQ ID NO: 701329 - DNA, 13 bp, C. elegans
agttgccgttttt

SEQ ID NO: 701330 - DNA, 13 bp, C. elegans
agttgctcaaaaa

SEQ ID NO: 701331 - DNA, 13 bp, C. elegans
agttgctcttttt

SEQ ID NO: 701332 - DNA, 13 bp, C. elegans
agttggaaaaaat

SEQ ID NO: 701333 - DNA, 13 bp, C. elegans
agttggaaaaagt

SEQ ID NO: 701334 - DNA, 13 bp, C. elegans
agttggaaaactt

SEQ ID NO: 701335 - DNA, 13 bp, C. elegans
agttggaaaatca

SEQ ID NO: 701336 - DNA, 13 bp, C. elegans
agttggaaaatga

SEQ ID NO: 701337 - DNA, 13 bp, C. elegans
agttggaaccaat

SEQ ID NO: 701338 - DNA, 13 bp, C. elegans
agttggacaagtc

SEQ ID NO: 701339 - DNA, 13 bp, C. elegans
agttggagaaagt

SEQ ID NO: 701340 - DNA, 13 bp, C. elegans
agttggagaaatt

SEQ ID NO: 701341 - DNA, 13 bp, C. elegans
agttggagcaaaa

SEQ ID NO: 701342 - DNA, 17 bp, C. elegans
agttggtaatcccccca

SEQ ID NO: 701343 - DNA, 13 bp, C. elegans
agttggtgaaaaa

SEQ ID NO: 701344 - DNA, 13 bp, C. elegans
agttggtggagga

SEQ ID NO: 701345 - DNA, 13 bp, C. elegans
agttggtggccta

SEQ ID NO: 701346 - DNA, 13 bp, C. elegans
agttggttcaaaa

SEQ ID NO: 701347 - DNA, 13 bp, C. elegans
agttggttggaaa

SEQ ID NO: 701348 - DNA, 13 bp, C. elegans
agttgtagggggt

SEQ ID NO: 701349 - DNA, 13 bp, C. elegans
agttgtataattt

SEQ ID NO: 701350 - DNA, 13 bp, C. elegans
agttgtatttctt

SEQ ID NO: 701351 - DNA, 13 bp, C. elegans
agttgtcaactac

SEQ ID NO: 701352 - DNA, 13 bp, C. elegans
agttgtcagaaat

SEQ ID NO: 701353 - DNA, 13 bp, C. elegans
agttgtcatacag

SEQ ID NO: 701354 - DNA, 13 bp, C. elegans
agttgtctaattt

SEQ ID NO: 701355 - DNA, 13 bp, C. elegans
agttgtgaaaaac

SEQ ID NO: 701356 - DNA, 13 bp, C. elegans
agttgtgaaatat

SEQ ID NO: 701357 - DNA, 13 bp, C. elegans
agttgtgaagaaa

SEQ ID NO: 701358 - DNA, 13 bp, C. elegans
agttgtgacgtca

SEQ ID NO: 701359 - DNA, 13 bp, C. elegans
agttgtgataaaa

SEQ ID NO: 701360 - DNA, 13 bp, C. elegans
agttgtggaaaaa

SEQ ID NO: 701361 - DNA, 13 bp, C. elegans
agttgttattgaa

SEQ ID NO: 701362 - DNA, 13 bp, C. elegans
agttgttcaaaaa

SEQ ID NO: 701363 - DNA, 13 bp, C. elegans
agttgttcaaaca

SEQ ID NO: 701364 - DNA, 13 bp, C. elegans
agttgttccaaat

SEQ ID NO: 701365 - DNA, 13 bp, C. elegans
agttgttgatatt

SEQ ID NO: 701366 - DNA, 13 bp, C. elegans
agttgtttcaaaa

SEQ ID NO: 701367 - DNA, 13 bp, C. elegans
agttgttttaaaa

SEQ ID NO: 701368 - DNA, 13 bp, C. elegans
agttgttttccaa

SEQ ID NO: 701369 - DNA, 13 bp, C. elegans
agttgtttttcat

SEQ ID NO: 701370 - DNA, 13 bp, C. elegans
agtttaaaaaaca

SEQ ID NO: 701371 - DNA, 13 bp, C. elegans
agtttaaaaatcg

SEQ ID NO: 701372 - DNA, 13 bp, C. elegans
agtttaaaagttt

SEQ ID NO: 701373 - DNA, 13 bp, C. elegans
agtttaaactatt

SEQ ID NO: 701374 - DNA, 13 bp, C. elegans
agtttaaagaaga

SEQ ID NO: 701375 - DNA, 13 bp, C. elegans
agtttaacaacaa

SEQ ID NO: 701376 - DNA, 13 bp, C. elegans
agtttaagtttta

SEQ ID NO: 701377 - DNA, 13 bp, C. elegans
agtttacaatttc

SEQ ID NO: 701378 - DNA, 13 bp, C. elegans
agtttacaatttt

SEQ ID NO: 701379 - DNA, 13 bp, C. elegans
agtttacacttgg

SEQ ID NO: 701380 - DNA, 13 bp, C. elegans
agtttacatttca

SEQ ID NO: 701381 - DNA, 13 bp, C. elegans
agtttactttttc

SEQ ID NO: 701382 - DNA, 13 bp, C. elegans
agtttagtacaca

SEQ ID NO: 701383 - DNA, 13 bp, C. elegans
agtttatacattt

SEQ ID NO: 701384 - DNA, 13 bp, C. elegans
agtttatagtact

SEQ ID NO: 701385 - DNA, 13 bp, C. elegans
agtttatagttta

SEQ ID NO: 701386 - DNA, 13 bp, C. elegans
agtttatagtttc

SEQ ID NO: 701387 - DNA, 13 bp, C. elegans
agtttatcaaatt

SEQ ID NO: 701388 - DNA, 13 bp, C. elegans
agtttatcaagtt

SEQ ID NO: 701389 - DNA, 13 bp, C. elegans
agtttatcatttt

SEQ ID NO: 701390 - DNA, 13 bp, C. elegans
agtttatggaaaa

SEQ ID NO: 701391 - DNA, 13 bp, C. elegans
agtttatgttttc

SEQ ID NO: 701392 - DNA, 13 bp, C. elegans
agtttattcaatt

SEQ ID NO: 701393 - DNA, 13 bp, C. elegans
agtttattgaact

SEQ ID NO: 701394 - DNA, 13 bp, C. elegans
agtttattgtaaa

SEQ ID NO: 701395 - DNA, 13 bp, C. elegans
agtttatttcaat

SEQ ID NO: 701396 - DNA, 13 bp, C. elegans
agtttatttcatt

SEQ ID NO: 701397 - DNA, 13 bp, C. elegans
agtttatttgtaa

SEQ ID NO: 701398 - DNA, 13 bp, C. elegans
agtttcaaaaatg

SEQ ID NO: 701399 - DNA, 13 bp, C. elegans
agtttcaaaattc

SEQ ID NO: 701400 - DNA, 13 bp, C. elegans
agtttcaaaattt

SEQ ID NO: 701401 - DNA, 13 bp, C. elegans
agtttcaaacttc

SEQ ID NO: 701402 - DNA, 13 bp, C. elegans
agtttcaaagaat

SEQ ID NO: 701403 - DNA, 13 bp, C. elegans
agtttcaaagagt

SEQ ID NO: 701404 - DNA, 13 bp, C. elegans
agtttcaaagttt

SEQ ID NO: 701405 - DNA, 14 bp, C. elegans
agtttcaaatattt

SEQ ID NO: 701406 - DNA, 13 bp, C. elegans
agtttcaaatttt

SEQ ID NO: 701407 - DNA, 13 bp, C. elegans
agtttcaacaaaa

SEQ ID NO: 701408 - DNA, 13 bp, C. elegans
agtttcaacattt

SEQ ID NO: 701409 - DNA, 13 bp, C. elegans
agtttcaactttc

SEQ ID NO: 701410 - DNA, 13 bp, C. elegans
agtttcaagcaaa

SEQ ID NO: 701411 - DNA, 13 bp, C. elegans
agtttcaatcaat

SEQ ID NO: 701412 - DNA, 13 bp, C. elegans
agtttcaatgttt

SEQ ID NO: 701413 - DNA, 13 bp, C. elegans
agtttcaattata

SEQ ID NO: 701414 - DNA, 13 bp, C. elegans
agtttcaatttca

SEQ ID NO: 701415 - DNA, 13 bp, C. elegans
agtttcaatttcg

SEQ ID NO: 701416 - DNA, 13 bp, C. elegans
agtttcacaaagt

SEQ ID NO: 701417 - DNA, 13 bp, C. elegans
agtttcacagaaa

SEQ ID NO: 701418 - DNA, 13 bp, C. elegans
agtttcagaaaaa

SEQ ID NO: 701419 - DNA, 13 bp, C. elegans
agtttcagaaatt

SEQ ID NO: 701420 - DNA, 13 bp, C. elegans
agtttcagataaa

SEQ ID NO: 701421 - DNA, 13 bp, C. elegans
agtttcagatcaa

SEQ ID NO: 701422 - DNA, 13 bp, C. elegans
agtttcagattta

SEQ ID NO: 701423 - DNA, 13 bp, C. elegans
agtttcagcaaaa

SEQ ID NO: 701424 - DNA, 13 bp, C. elegans
agtttcaggtttt

SEQ ID NO: 701425 - DNA, 13 bp, C. elegans
agtttcagttcaa

SEQ ID NO: 701426 - DNA, 13 bp, C. elegans
agtttcagttcat

SEQ ID NO: 701427 - DNA, 13 bp, C. elegans
agtttcagttttt

SEQ ID NO: 701428 - DNA, 13 bp, C. elegans
agtttcatcatga

SEQ ID NO: 701429 - DNA, 13 bp, C. elegans
agtttcattattt

SEQ ID NO: 701430 - DNA, 13 bp, C. elegans
agtttcattgaaa

SEQ ID NO: 701431 - DNA, 13 bp, C. elegans
agtttcattttat

SEQ ID NO: 701432 - DNA, 13 bp, C. elegans
agtttcattttca

SEQ ID NO: 701433 - DNA, 13 bp, C. elegans
agtttccaaataa

SEQ ID NO: 701434 - DNA, 13 bp, C. elegans
agtttccaaatgt

SEQ ID NO: 701435 - DNA, 13 bp, C. elegans
agtttccaaatta

SEQ ID NO: 701436 - DNA, 13 bp, C. elegans
agtttccaagaaa

SEQ ID NO: 701437 - DNA, 13 bp, C. elegans
agtttccagattt

SEQ ID NO: 701438 - DNA, 13 bp, C. elegans
agtttccagcaaa

SEQ ID NO: 701439 - DNA, 13 bp, C. elegans
agtttccccaaaa

SEQ ID NO: 701440 - DNA, 13 bp, C. elegans
agtttcctccaaa

SEQ ID NO: 701441 - DNA, 13 bp, C. elegans
agtttccttcatt

SEQ ID NO: 701442 - DNA, 13 bp, C. elegans
agtttcctttttc

SEQ ID NO: 701443 - DNA, 13 bp, C. elegans
agtttcgatattt

SEQ ID NO: 701444 - DNA, 13 bp, C. elegans
agtttcgatttta

SEQ ID NO: 701445 - DNA, 13 bp, C. elegans
agtttcggcaatt

SEQ ID NO: 701446 - DNA, 13 bp, C. elegans
agtttctaatttt

SEQ ID NO: 701447 - DNA, 13 bp, C. elegans
agtttctcaacaa

SEQ ID NO: 701448 - DNA, 13 bp, C. elegans
agtttctcaattt

SEQ ID NO: 701449 - DNA, 13 bp, C. elegans
agtttctccaaaa

SEQ ID NO: 701450 - DNA, 13 bp, C. elegans
agtttctcgaaaa

SEQ ID NO: 701451 - DNA, 13 bp, C. elegans
agtttctcgaatt

SEQ ID NO: 701452 - DNA, 13 bp, C. elegans
agtttctctgaaa

SEQ ID NO: 701453 - DNA, 13 bp, C. elegans
agtttctgaaaaa

SEQ ID NO: 701454 - DNA, 13 bp, C. elegans
agtttctgaaaat

SEQ ID NO: 701455 - DNA, 13 bp, C. elegans
agtttctgaaact

SEQ ID NO: 701456 - DNA, 13 bp, C. elegans
agtttctgtgcat

SEQ ID NO: 701457 - DNA, 13 bp, C. elegans
agtttcttcagaa

SEQ ID NO: 701458 - DNA, 13 bp, C. elegans
agtttcttcttct

SEQ ID NO: 701459 - DNA, 13 bp, C. elegans
agtttcttgtgaa

SEQ ID NO: 701460 - DNA, 13 bp, C. elegans
agtttcttttgaa

SEQ ID NO: 701461 - DNA, 13 bp, C. elegans
agtttctttttga

SEQ ID NO: 701462 - DNA, 13 bp, C. elegans
agtttgaaaagtc

SEQ ID NO: 701463 - DNA, 13 bp, C. elegans
agtttgaaaatac

SEQ ID NO: 701464 - DNA, 13 bp, C. elegans
agtttgaaatttg

SEQ ID NO: 701465 - DNA, 13 bp, C. elegans
agtttgaaatttt

SEQ ID NO: 701466 - DNA, 13 bp, C. elegans
agtttgaactttc

SEQ ID NO: 701467 - DNA, 13 bp, C. elegans
agtttgaagatgg

SEQ ID NO: 701468 - DNA, 13 bp, C. elegans
agtttgaagattt

SEQ ID NO: 701469 - DNA, 13 bp, C. elegans
agtttgaagttac

SEQ ID NO: 701470 - DNA, 13 bp, C. elegans
agtttgaataaaa

SEQ ID NO: 701471 - DNA, 13 bp, C. elegans
agtttgaataatt

SEQ ID NO: 701472 - DNA, 13 bp, C. elegans
agtttgaattaat

SEQ ID NO: 701473 - DNA, 13 bp, C. elegans
agtttgaattgtt

SEQ ID NO: 701474 - DNA, 13 bp, C. elegans
agtttgaatttga

SEQ ID NO: 701475 - DNA, 13 bp, C. elegans
agtttgacaaatt

SEQ ID NO: 701476 - DNA, 13 bp, C. elegans
agtttgagaaaac

SEQ ID NO: 701477 - DNA, 13 bp, C. elegans
agtttgataaatt

SEQ ID NO: 701478 - DNA, 13 bp, C. elegans
agtttgataattt

SEQ ID NO: 701479 - DNA, 13 bp, C. elegans
agtttgatgaaaa

SEQ ID NO: 701480 - DNA, 13 bp, C. elegans
agtttgcaatttt

SEQ ID NO: 701481 - DNA, 13 bp, C. elegans
agtttgcactttt

SEQ ID NO: 701482 - DNA, 13 bp, C. elegans
agtttgccaaaaa

SEQ ID NO: 701483 - DNA, 13 bp, C. elegans
agtttgccgaaaa

SEQ ID NO: 701484 - DNA, 13 bp, C. elegans
agtttgccggaaa

SEQ ID NO: 701485 - DNA, 13 bp, C. elegans
agtttgccgtttt

SEQ ID NO: 701486 - DNA, 13 bp, C. elegans
agtttggaaattt

SEQ ID NO: 701487 - DNA, 13 bp, C. elegans
agtttggaacttt

SEQ ID NO: 701488 - DNA, 13 bp, C. elegans
agtttggagcaaa

SEQ ID NO: 701489 - DNA, 13 bp, C. elegans
agtttggagtttt

SEQ ID NO: 701490 - DNA, 13 bp, C. elegans
agtttggatattt

SEQ ID NO: 701491 - DNA, 13 bp, C. elegans
agtttggtcagtg

SEQ ID NO: 701492 - DNA, 13 bp, C. elegans
agtttgtaatttg

SEQ ID NO: 701493 - DNA, 13 bp, C. elegans
agtttgtagaaaa

SEQ ID NO: 701494 - DNA, 13 bp, C. elegans
agtttgtattgaa

SEQ ID NO: 701495 - DNA, 13 bp, C. elegans
agtttgtcaagac

SEQ ID NO: 701496 - DNA, 13 bp, C. elegans
agtttgttcaaaa

SEQ ID NO: 701497 - DNA, 13 bp, C. elegans
agtttgtttcatt

SEQ ID NO: 701498 - DNA, 13 bp, C. elegans
agtttgtttttca

SEQ ID NO: 701499 - DNA, 13 bp, C. elegans
agttttaaaacta

SEQ ID NO: 701500 - DNA, 13 bp, C. elegans
agttttaaaattg

SEQ ID NO: 701501 - DNA, 13 bp, C. elegans
agttttaaagaaa

SEQ ID NO: 701502 - DNA, 13 bp, C. elegans
agttttaaatgaa

SEQ ID NO: 701503 - DNA, 13 bp, C. elegans
agttttaaatgct

SEQ ID NO: 701504 - DNA, 13 bp, C. elegans
agttttaactttt

SEQ ID NO: 701505 - DNA, 13 bp, C. elegans
agttttaagttaa

SEQ ID NO: 701506 - DNA, 13 bp, C. elegans
agttttaataaga

SEQ ID NO: 701507 - DNA, 13 bp, C. elegans
agttttaattgta

SEQ ID NO: 701508 - DNA, 13 bp, C. elegans
agttttacaaaat

SEQ ID NO: 701509 - DNA, 14 bp, C. elegans
agttttacaactaa

SEQ ID NO: 701510 - DNA, 13 bp, C. elegans
agttttacagatt

SEQ ID NO: 701511 - DNA, 13 bp, C. elegans
agttttaccaaaa

SEQ ID NO: 701512 - DNA, 13 bp, C. elegans
agttttagaaaaa

SEQ ID NO: 701513 - DNA, 13 bp, C. elegans
agttttagagtta

SEQ ID NO: 701514 - DNA, 13 bp, C. elegans
agttttataacaa

SEQ ID NO: 701515 - DNA, 13 bp, C. elegans
agttttatacaaa

SEQ ID NO: 701516 - DNA, 13 bp, C. elegans
agttttatcagaa

SEQ ID NO: 701517 - DNA, 13 bp, C. elegans
agttttatcgatt

SEQ ID NO: 701518 - DNA, 13 bp, C. elegans
agttttatgaaaa

SEQ ID NO: 701519 - DNA, 13 bp, C. elegans
agttttatgtgaa

SEQ ID NO: 701520 - DNA, 13 bp, C. elegans
agttttattgtaa

SEQ ID NO: 701521 - DNA, 13 bp, C. elegans
agttttatttcag

SEQ ID NO: 701522 - DNA, 13 bp, C. elegans
agttttcaaaaat

SEQ ID NO: 701523 - DNA, 13 bp, C. elegans
agttttcaaaatt

SEQ ID NO: 701524 - DNA, 13 bp, C. elegans
agttttcaaactt

SEQ ID NO: 701525 - DNA, 13 bp, C. elegans
agttttcaacaaa

SEQ ID NO: 701526 - DNA, 13 bp, C. elegans
agttttcaacaat

SEQ ID NO: 701527 - DNA, 13 bp, C. elegans
agttttcaacatt

SEQ ID NO: 701528 - DNA, 13 bp, C. elegans
agttttcaaccaa

SEQ ID NO: 701529 - DNA, 13 bp, C. elegans
agttttcaagaaa

SEQ ID NO: 701530 - DNA, 13 bp, C. elegans
agttttcaagatt

SEQ ID NO: 701531 - DNA, 13 bp, C. elegans
agttttcaagttt

SEQ ID NO: 701532 - DNA, 13 bp, C. elegans
agttttcaataaa

SEQ ID NO: 701533 - DNA, 13 bp, C. elegans
agttttcaatcga

SEQ ID NO: 701534 - DNA, 13 bp, C. elegans
agttttcaatgat

SEQ ID NO: 701535 - DNA, 13 bp, C. elegans
agttttcaattcc

SEQ ID NO: 701536 - DNA, 13 bp, C. elegans
agttttcacaatt

SEQ ID NO: 701537 - DNA, 13 bp, C. elegans
agttttcacattt

SEQ ID NO: 701538 - DNA, 13 bp, C. elegans
agttttcaccaaa

SEQ ID NO: 701539 - DNA, 13 bp, C. elegans
agttttcactttt

SEQ ID NO: 701540 - DNA, 13 bp, C. elegans
agttttcagaaaa

SEQ ID NO: 701541 - DNA, 13 bp, C. elegans
agttttcagcgtt

SEQ ID NO: 701542 - DNA, 13 bp, C. elegans
agttttcagctca

SEQ ID NO: 701543 - DNA, 13 bp, C. elegans
agttttcaggttt

SEQ ID NO: 701544 - DNA, 13 bp, C. elegans
agttttcagttga

SEQ ID NO: 701545 - DNA, 13 bp, C. elegans
agttttcagtttt

SEQ ID NO: 701546 - DNA, 13 bp, C. elegans
agttttcataact

SEQ ID NO: 701547 - DNA, 13 bp, C. elegans
agttttcatagtt

SEQ ID NO: 701548 - DNA, 13 bp, C. elegans
agttttcatatat

SEQ ID NO: 701549 - DNA, 13 bp, C. elegans
agttttcatcaat

SEQ ID NO: 701550 - DNA, 13 bp, C. elegans
agttttcattaaa

SEQ ID NO: 701551 - DNA, 13 bp, C. elegans
agttttcattcat

SEQ ID NO: 701552 - DNA, 13 bp, C. elegans
agttttcattgat

SEQ ID NO: 701553 - DNA, 13 bp, C. elegans
agttttcattgtt

SEQ ID NO: 701554 - DNA, 13 bp, C. elegans
agttttcatttaa

SEQ ID NO: 701555 - DNA, 13 bp, C. elegans
agttttcatttct

SEQ ID NO: 701556 - DNA, 13 bp, C. elegans
agttttcattttc

SEQ ID NO: 701557 - DNA, 13 bp, C. elegans
agttttcattttg

SEQ ID NO: 701558 - DNA, 13 bp, C. elegans
agttttccaacaa

SEQ ID NO: 701559 - DNA, 13 bp, C. elegans
agttttccaattt

SEQ ID NO: 701560 - DNA, 13 bp, C. elegans
agttttccagaag

SEQ ID NO: 701561 - DNA, 13 bp, C. elegans
agttttcccgttt

SEQ ID NO: 701562 - DNA, 13 bp, C. elegans
agttttccgattt

SEQ ID NO: 701563 - DNA, 13 bp, C. elegans
agttttcctaaaa

SEQ ID NO: 701564 - DNA, 13 bp, C. elegans
agttttccttttc

SEQ ID NO: 701565 - DNA, 13 bp, C. elegans
agttttcgaaaaa

SEQ ID NO: 701566 - DNA, 13 bp, C. elegans
agttttcgaaaat

SEQ ID NO: 701567 - DNA, 13 bp, C. elegans
agttttcgaaatc

SEQ ID NO: 701568 - DNA, 13 bp, C. elegans
agttttcgagatt

SEQ ID NO: 701569 - DNA, 13 bp, C. elegans
agttttcgagttt

SEQ ID NO: 701570 - DNA, 13 bp, C. elegans
agttttcgatatt

SEQ ID NO: 701571 - DNA, 13 bp, C. elegans
agttttcgatgaa

SEQ ID NO: 701572 - DNA, 13 bp, C. elegans
agttttcggaaaa

SEQ ID NO: 701573 - DNA, 13 bp, C. elegans
agttttcggatat

SEQ ID NO: 701574 - DNA, 13 bp, C. elegans
agttttcggattt

SEQ ID NO: 701575 - DNA, 13 bp, C. elegans
agttttcgtggcg

SEQ ID NO: 701576 - DNA, 13 bp, C. elegans
agttttcgttttc

SEQ ID NO: 701577 - DNA, 13 bp, C. elegans
agttttctaatta

SEQ ID NO: 701578 - DNA, 13 bp, C. elegans
agttttctagttt

SEQ ID NO: 701579 - DNA, 13 bp, C. elegans
agttttctcaaaa

SEQ ID NO: 701580 - DNA, 13 bp, C. elegans
agttttctccaaa

SEQ ID NO: 701581 - DNA, 13 bp, C. elegans
agttttctcgaaa

SEQ ID NO: 701582 - DNA, 13 bp, C. elegans
agttttctctttc

SEQ ID NO: 701583 - DNA, 13 bp, C. elegans
agttttctgaaat

SEQ ID NO: 701584 - DNA, 13 bp, C. elegans
agttttctgcaaa

SEQ ID NO: 701585 - DNA, 13 bp, C. elegans
agttttctgtaaa

SEQ ID NO: 701586 - DNA, 13 bp, C. elegans
agttttgaaaaag

SEQ ID NO: 701587 - DNA, 13 bp, C. elegans
agttttgaaaaat

SEQ ID NO: 701588 - DNA, 13 bp, C. elegans
agttttgaaaaca

SEQ ID NO: 701589 - DNA, 13 bp, C. elegans
agttttgaaaacc

SEQ ID NO: 701590 - DNA, 13 bp, C. elegans
agttttgaacaaa

SEQ ID NO: 701591 - DNA, 13 bp, C. elegans
agttttgaagaaa

SEQ ID NO: 701592 - DNA, 13 bp, C. elegans
agttttgaagcaa

SEQ ID NO: 701593 - DNA, 13 bp, C. elegans
agttttgaaggtt

SEQ ID NO: 701594 - DNA, 13 bp, C. elegans
agttttgaagtaa

SEQ ID NO: 701595 - DNA, 13 bp, C. elegans
agttttgaatata

SEQ ID NO: 701596 - DNA, 13 bp, C. elegans
agttttgaatgtt

SEQ ID NO: 701597 - DNA, 13 bp, C. elegans
agttttgaattct

SEQ ID NO: 701598 - DNA, 13 bp, C. elegans
agttttgacattt

SEQ ID NO: 701599 - DNA, 13 bp, C. elegans
agttttgagaaat

SEQ ID NO: 701600 - DNA, 13 bp, C. elegans
agttttgagaatt

SEQ ID NO: 701601 - DNA, 13 bp, C. elegans
agttttgagcttc

SEQ ID NO: 701602 - DNA, 13 bp, C. elegans
agttttgagtatt

SEQ ID NO: 701603 - DNA, 13 bp, C. elegans
agttttgataaga

SEQ ID NO: 701604 - DNA, 13 bp, C. elegans
agttttgatactc

SEQ ID NO: 701605 - DNA, 13 bp, C. elegans
agttttgatatta

SEQ ID NO: 701606 - DNA, 13 bp, C. elegans
agttttgatctac

SEQ ID NO: 701607 - DNA, 13 bp, C. elegans
agttttgatttac

SEQ ID NO: 701608 - DNA, 13 bp, C. elegans
agttttgcaaatt

SEQ ID NO: 701609 - DNA, 13 bp, C. elegans
agttttgcaacaa

SEQ ID NO: 701610 - DNA, 13 bp, C. elegans
agttttgcaataa

SEQ ID NO: 701611 - DNA, 13 bp, C. elegans
agttttgccaaag

SEQ ID NO: 701612 - DNA, 13 bp, C. elegans
agttttgccgatt

SEQ ID NO: 701613 - DNA, 13 bp, C. elegans
agttttgcgattt

SEQ ID NO: 701614 - DNA, 13 bp, C. elegans
agttttgctcaaa

SEQ ID NO: 701615 - DNA, 13 bp, C. elegans
agttttggaagtt

SEQ ID NO: 701616 - DNA, 13 bp, C. elegans
agttttggaccaa

SEQ ID NO: 701617 - DNA, 13 bp, C. elegans
agttttggagcat

SEQ ID NO: 701618 - DNA, 13 bp, C. elegans
agttttggaggtt

SEQ ID NO: 701619 - DNA, 13 bp, C. elegans
agttttggagtta

SEQ ID NO: 701620 - DNA, 13 bp, C. elegans
agttttggatatt

SEQ ID NO: 701621 - DNA, 13 bp, C. elegans
agttttggcaaat

SEQ ID NO: 701622 - DNA, 13 bp, C. elegans
agttttgggattt

SEQ ID NO: 701623 - DNA, 13 bp, C. elegans
agttttggtttaa

SEQ ID NO: 701624 - DNA, 13 bp, C. elegans
agttttgtagaat

SEQ ID NO: 701625 - DNA, 13 bp, C. elegans
agttttgtatcaa

SEQ ID NO: 701626 - DNA, 13 bp, C. elegans
agttttgtcaaaa

SEQ ID NO: 701627 - DNA, 13 bp, C. elegans
agttttgtgaaaa

SEQ ID NO: 701628 - DNA, 13 bp, C. elegans
agttttgtgaaat

SEQ ID NO: 701629 - DNA, 13 bp, C. elegans
agttttgtgataa

SEQ ID NO: 701630 - DNA, 13 bp, C. elegans
agttttgttaaaa

SEQ ID NO: 701631 - DNA, 14 bp, C. elegans
agttttgttttcaa

SEQ ID NO: 701632 - DNA, 13 bp, C. elegans
agtttttaaacca

SEQ ID NO: 701633 - DNA, 13 bp, C. elegans
agtttttaaaggt

SEQ ID NO: 701634 - DNA, 13 bp, C. elegans
agtttttaaccaa

SEQ ID NO: 701635 - DNA, 13 bp, C. elegans
agtttttaagaaa

SEQ ID NO: 701636 - DNA, 13 bp, C. elegans
agtttttaatcaa

SEQ ID NO: 701637 - DNA, 13 bp, C. elegans
agtttttactgtt

SEQ ID NO: 701638 - DNA, 13 bp, C. elegans
agtttttaggaaa

SEQ ID NO: 701639 - DNA, 13 bp, C. elegans
agtttttagtaaa

SEQ ID NO: 701640 - DNA, 13 bp, C. elegans
agtttttatgcaa

SEQ ID NO: 701641 - DNA, 13 bp, C. elegans
agtttttcaaact

SEQ ID NO: 701642 - DNA, 13 bp, C. elegans
agtttttcaaaga

SEQ ID NO: 701643 - DNA, 13 bp, C. elegans
agtttttcaaagc

SEQ ID NO: 701644 - DNA, 13 bp, C. elegans
agtttttcaataa

SEQ ID NO: 701645 - DNA, 13 bp, C. elegans
agtttttcaattt

SEQ ID NO: 701646 - DNA, 13 bp, C. elegans
agtttttcacaaa

SEQ ID NO: 701647 - DNA, 13 bp, C. elegans
agtttttcactaa

SEQ ID NO: 701648 - DNA, 13 bp, C. elegans
agtttttcagaaa

SEQ ID NO: 701649 - DNA, 13 bp, C. elegans
agtttttcagaat

SEQ ID NO: 701650 - DNA, 13 bp, C. elegans
agtttttcataat

SEQ ID NO: 701651 - DNA, 13 bp, C. elegans
agtttttcatatt

SEQ ID NO: 701652 - DNA, 13 bp, C. elegans
agtttttcatgaa

SEQ ID NO: 701653 - DNA, 13 bp, C. elegans
agtttttccaatt

SEQ ID NO: 701654 - DNA, 13 bp, C. elegans
agtttttcccttt

SEQ ID NO: 701655 - DNA, 13 bp, C. elegans
agtttttcctaaa

SEQ ID NO: 701656 - DNA, 13 bp, C. elegans
agtttttcgaaat

SEQ ID NO: 701657 - DNA, 13 bp, C. elegans
agtttttcgactt

SEQ ID NO: 701658 - DNA, 13 bp, C. elegans
agtttttcgcttt

SEQ ID NO: 701659 - DNA, 13 bp, C. elegans
agtttttcgtcat

SEQ ID NO: 701660 - DNA, 13 bp, C. elegans
agtttttctaact

SEQ ID NO: 701661 - DNA, 13 bp, C. elegans
agtttttctcata

SEQ ID NO: 701662 - DNA, 13 bp, C. elegans
agtttttctgtgt

SEQ ID NO: 701663 - DNA, 13 bp, C. elegans
agtttttcttcaa

SEQ ID NO: 701664 - DNA, 13 bp, C. elegans
agtttttcttcca

SEQ ID NO: 701665 - DNA, 13 bp, C. elegans
agtttttctttaa

SEQ ID NO: 701666 - DNA, 13 bp, C. elegans
agtttttctttga

SEQ ID NO: 701667 - DNA, 13 bp, C. elegans
agtttttgaaaaa

SEQ ID NO: 701668 - DNA, 13 bp, C. elegans
agtttttgaaaga

SEQ ID NO: 701669 - DNA, 13 bp, C. elegans
agtttttgaaata

SEQ ID NO: 701670 - DNA, 13 bp, C. elegans
agtttttgaactt

SEQ ID NO: 701671 - DNA, 13 bp, C. elegans
agtttttgaatat

SEQ ID NO: 701672 - DNA, 13 bp, C. elegans
agtttttgacaat

SEQ ID NO: 701673 - DNA, 13 bp, C. elegans
agtttttgagaga

SEQ ID NO: 701674 - DNA, 13 bp, C. elegans
agtttttgagcta

SEQ ID NO: 701675 - DNA, 13 bp, C. elegans
agtttttgatgat

SEQ ID NO: 701676 - DNA, 13 bp, C. elegans
agtttttgatggg

SEQ ID NO: 701677 - DNA, 13 bp, C. elegans
agtttttgcataa

SEQ ID NO: 701678 - DNA, 13 bp, C. elegans
agtttttgccgaa

SEQ ID NO: 701679 - DNA, 13 bp, C. elegans
agtttttgctgtt

SEQ ID NO: 701680 - DNA, 13 bp, C. elegans
agtttttggaaat

SEQ ID NO: 701681 - DNA, 13 bp, C. elegans
agtttttggaatc

SEQ ID NO: 701682 - DNA, 13 bp, C. elegans
agtttttggaatt

SEQ ID NO: 701683 - DNA, 13 bp, C. elegans
agtttttggagta

SEQ ID NO: 701684 - DNA, 13 bp, C. elegans
agtttttggtaaa

SEQ ID NO: 701685 - DNA, 13 bp, C. elegans
agtttttggtagt

SEQ ID NO: 701686 - DNA, 13 bp, C. elegans
agtttttgtaaaa

SEQ ID NO: 701687 - DNA, 13 bp, C. elegans
agtttttgtggaa

SEQ ID NO: 701688 - DNA, 13 bp, C. elegans
agtttttgtgtaa

SEQ ID NO: 701689 - DNA, 13 bp, C. elegans
agtttttgttaga

SEQ ID NO: 701690 - DNA, 13 bp, C. elegans
agtttttgttcag

SEQ ID NO: 701691 - DNA, 13 bp, C. elegans
agtttttgttcta

SEQ ID NO: 701692 - DNA, 13 bp, C. elegans
agttttttaaaag

SEQ ID NO: 701693 - DNA, 13 bp, C. elegans
agttttttaaagt

SEQ ID NO: 701694 - DNA, 13 bp, C. elegans
agttttttacaaa

SEQ ID NO: 701695 - DNA, 13 bp, C. elegans
agttttttatcaa

SEQ ID NO: 701696 - DNA, 13 bp, C. elegans
agttttttcacag

SEQ ID NO: 701697 - DNA, 13 bp, C. elegans
agttttttccaat

SEQ ID NO: 701698 - DNA, 13 bp, C. elegans
agttttttcctga

SEQ ID NO: 701699 - DNA, 13 bp, C. elegans
agttttttcgatt

SEQ ID NO: 701700 - DNA, 13 bp, C. elegans
agttttttcggtt

SEQ ID NO: 701701 - DNA, 13 bp, C. elegans
agttttttcgtcg

SEQ ID NO: 701702 - DNA, 13 bp, C. elegans
agttttttctaga

SEQ ID NO: 701703 - DNA, 13 bp, C. elegans
agttttttctgaa

SEQ ID NO: 701704 - DNA, 13 bp, C. elegans
agttttttcttaa

SEQ ID NO: 701705 - DNA, 13 bp, C. elegans
agttttttcttcc

SEQ ID NO: 701706 - DNA, 13 bp, C. elegans
agttttttcttga

SEQ ID NO: 701707 - DNA, 13 bp, C. elegans
agttttttgaaat

SEQ ID NO: 701708 - DNA, 13 bp, C. elegans
agttttttgagat

SEQ ID NO: 701709 - DNA, 13 bp, C. elegans
agttttttgaggt

SEQ ID NO: 701710 - DNA, 13 bp, C. elegans
agttttttgcaat

SEQ ID NO: 701711 - DNA, 13 bp, C. elegans
agttttttggaat

SEQ ID NO: 701712 - DNA, 13 bp, C. elegans
agttttttggcgg

SEQ ID NO: 701713 - DNA, 13 bp, C. elegans
agttttttgtgaa

SEQ ID NO: 701714 - DNA, 13 bp, C. elegans
agtttttttcaaa

SEQ ID NO: 701715 - DNA, 13 bp, C. elegans
ataaaaaaagttc

SEQ ID NO: 701716 - DNA, 13 bp, C. elegans
ataaaaaatctct

SEQ ID NO: 701717 - DNA, 13 bp, C. elegans
ataaaaaatgtcg

SEQ ID NO: 701718 - DNA, 13 bp, C. elegans
ataaaaaatgttg

SEQ ID NO: 701719 - DNA, 13 bp, C. elegans
ataaaaaatttcg

SEQ ID NO: 701720 - DNA, 13 bp, C. elegans
ataaaaacacttt

SEQ ID NO: 701721 - DNA, 13 bp, C. elegans
ataaaaacatgta

SEQ ID NO: 701722 - DNA, 13 bp, C. elegans
ataaaaacatttg

SEQ ID NO: 701723 - DNA, 13 bp, C. elegans
ataaaaacgattt

SEQ ID NO: 701724 - DNA, 13 bp, C. elegans
ataaaaacgtgaa

SEQ ID NO: 701725 - DNA, 13 bp, C. elegans
ataaaaactgtat

SEQ ID NO: 701726 - DNA, 13 bp, C. elegans
ataaaaactgtga

SEQ ID NO: 701727 - DNA, 13 bp, C. elegans
ataaaaacttgaa

SEQ ID NO: 701728 - DNA, 13 bp, C. elegans
ataaaaacttgca

SEQ ID NO: 701729 - DNA, 13 bp, C. elegans
ataaaaacttgta

SEQ ID NO: 701730 - DNA, 13 bp, C. elegans
ataaaaatacagt

SEQ ID NO: 701731 - DNA, 13 bp, C. elegans
ataaaaatgttac

SEQ ID NO: 701732 - DNA, 13 bp, C. elegans
ataaaaatgttca

SEQ ID NO: 701733 - DNA, 13 bp, C. elegans
ataaaaattccat

SEQ ID NO: 701734 - DNA, 13 bp, C. elegans
ataaaaattctcg

SEQ ID NO: 701735 - DNA, 13 bp, C. elegans
ataaaaattgtcg

SEQ ID NO: 701736 - DNA, 13 bp, C. elegans
ataaaaatttctg

SEQ ID NO: 701737 - DNA, 13 bp, C. elegans
ataaaacaatgtt

SEQ ID NO: 701738 - DNA, 13 bp, C. elegans
ataaaacatgaat

SEQ ID NO: 701739 - DNA, 13 bp, C. elegans
ataaaacattgga

SEQ ID NO: 701740 - DNA, 13 bp, C. elegans
ataaaacatttcc

SEQ ID NO: 701741 - DNA, 13 bp, C. elegans
ataaaacgatttt

SEQ ID NO: 701742 - DNA, 13 bp, C. elegans
ataaaacgttttg

SEQ ID NO: 701743 - DNA, 13 bp, C. elegans
ataaaacgttttt

SEQ ID NO: 701744 - DNA, 13 bp, C. elegans
ataaaactgaaat

SEQ ID NO: 701745 - DNA, 13 bp, C. elegans
ataaaactgaata

SEQ ID NO: 701746 - DNA, 13 bp, C. elegans
ataaaactgataa

SEQ ID NO: 701747 - DNA, 13 bp, C. elegans
ataaaactgttaa

SEQ ID NO: 701748 - DNA, 13 bp, C. elegans
ataaaacttgaaa

SEQ ID NO: 701749 - DNA, 13 bp, C. elegans
ataaaacttggaa

SEQ ID NO: 701750 - DNA, 13 bp, C. elegans
ataaaagtcgaaa

SEQ ID NO: 701751 - DNA, 13 bp, C. elegans
ataaaagtgtgaa

SEQ ID NO: 701752 - DNA, 13 bp, C. elegans
ataaaagtgttaa

SEQ ID NO: 701753 - DNA, 13 bp, C. elegans
ataaaagttccaa

SEQ ID NO: 701754 - DNA, 13 bp, C. elegans
ataaaagttttga

SEQ ID NO: 701755 - DNA, 13 bp, C. elegans
ataaaataatctg

SEQ ID NO: 701756 - DNA, 13 bp, C. elegans
ataaaatacgttt

SEQ ID NO: 701757 - DNA, 13 bp, C. elegans
ataaaatcagcaa

SEQ ID NO: 701758 - DNA, 13 bp, C. elegans
ataaaatcgaaac

SEQ ID NO: 701759 - DNA, 13 bp, C. elegans
ataaaatcgaaga

SEQ ID NO: 701760 - DNA, 13 bp, C. elegans
ataaaatcgataa

SEQ ID NO: 701761 - DNA, 13 bp, C. elegans
ataaaatctgcaa

SEQ ID NO: 701762 - DNA, 13 bp, C. elegans
ataaaatgaattg

SEQ ID NO: 701763 - DNA, 13 bp, C. elegans
ataaaatggaaac

SEQ ID NO: 701764 - DNA, 13 bp, C. elegans
ataaaatggtttt

SEQ ID NO: 701765 - DNA, 13 bp, C. elegans
ataaaatgtcaaa

SEQ ID NO: 701766 - DNA, 13 bp, C. elegans
ataaaatgttcga

SEQ ID NO: 701767 - DNA, 13 bp, C. elegans
ataaaatgttgtt

SEQ ID NO: 701768 - DNA, 13 bp, C. elegans
ataaaatgtttcc

SEQ ID NO: 701769 - DNA, 13 bp, C. elegans
ataaaattcaagg

SEQ ID NO: 701770 - DNA, 13 bp, C. elegans
ataaaattcagaa

SEQ ID NO: 701771 - DNA, 13 bp, C. elegans
ataaaattcatga

SEQ ID NO: 701772 - DNA, 13 bp, C. elegans
ataaaattctcat

SEQ ID NO: 701773 - DNA, 13 bp, C. elegans
ataaaatttccat

SEQ ID NO: 701774 - DNA, 13 bp, C. elegans
ataaaatttctgg

SEQ ID NO: 701775 - DNA, 13 bp, C. elegans
ataaaatttgcat

SEQ ID NO: 701776 - DNA, 13 bp, C. elegans
ataaaatttgcta

SEQ ID NO: 701777 - DNA, 13 bp, C. elegans
ataaaatttggaa

SEQ ID NO: 701778 - DNA, 13 bp, C. elegans
ataaacaaattgt

SEQ ID NO: 701779 - DNA, 13 bp, C. elegans
ataaacaacacgc

SEQ ID NO: 701780 - DNA, 13 bp, C. elegans
ataaacaattgtt

SEQ ID NO: 701781 - DNA, 13 bp, C. elegans
ataaacatcattt

SEQ ID NO: 701782 - DNA, 13 bp, C. elegans
ataaacatgattt

SEQ ID NO: 701783 - DNA, 13 bp, C. elegans
ataaacattttga

SEQ ID NO: 701784 - DNA, 13 bp, C. elegans
ataaaccaaattt

SEQ ID NO: 701785 - DNA, 13 bp, C. elegans
ataaaccattttt

SEQ ID NO: 701786 - DNA, 13 bp, C. elegans
ataaacgtttcaa

SEQ ID NO: 701787 - DNA, 13 bp, C. elegans
ataaactcaaact

SEQ ID NO: 701788 - DNA, 13 bp, C. elegans
ataaactcgaaaa

SEQ ID NO: 701789 - DNA, 13 bp, C. elegans
ataaactgaaact

SEQ ID NO: 701790 - DNA, 13 bp, C. elegans
ataaacttccgta

SEQ ID NO: 701791 - DNA, 13 bp, C. elegans
ataaacttgaaaa

SEQ ID NO: 701792 - DNA, 13 bp, C. elegans
ataaactttgaat

SEQ ID NO: 701793 - DNA, 13 bp, C. elegans
ataaacttttgtg

SEQ ID NO: 701794 - DNA, 13 bp, C. elegans
ataaactttttga

SEQ ID NO: 701795 - DNA, 13 bp, C. elegans
ataaacttttttc

SEQ ID NO: 701796 - DNA, 13 bp, C. elegans
ataaagcattaaa

SEQ ID NO: 701797 - DNA, 13 bp, C. elegans
ataaagcattttt

SEQ ID NO: 701798 - DNA, 13 bp, C. elegans
ataaagtgatttt

SEQ ID NO: 701799 - DNA, 13 bp, C. elegans
ataaagttcagaa

SEQ ID NO: 701800 - DNA, 13 bp, C. elegans
ataaagtttcaaa

SEQ ID NO: 701801 - DNA, 13 bp, C. elegans
ataaagtttgttt

SEQ ID NO: 701802 - DNA, 13 bp, C. elegans
ataaatacatttc

SEQ ID NO: 701803 - DNA, 13 bp, C. elegans
ataaatatgaaca

SEQ ID NO: 701804 - DNA, 13 bp, C. elegans
ataaatattccat

SEQ ID NO: 701805 - DNA, 13 bp, C. elegans
ataaatattccga

SEQ ID NO: 701806 - DNA, 13 bp, C. elegans
ataaatattctga

SEQ ID NO: 701807 - DNA, 13 bp, C. elegans
ataaatattgcaa

SEQ ID NO: 701808 - DNA, 13 bp, C. elegans
ataaatcaaattg

SEQ ID NO: 701809 - DNA, 13 bp, C. elegans
ataaatcagtttt

SEQ ID NO: 701810 - DNA, 13 bp, C. elegans
ataaatcattcaa

SEQ ID NO: 701811 - DNA, 13 bp, C. elegans
ataaatcatttca

SEQ ID NO: 701812 - DNA, 13 bp, C. elegans
ataaatcatttga

SEQ ID NO: 701813 - DNA, 13 bp, C. elegans
ataaatcggaaaa

SEQ ID NO: 701814 - DNA, 13 bp, C. elegans
ataaatctgaaac

SEQ ID NO: 701815 - DNA, 13 bp, C. elegans
ataaatctgataa

SEQ ID NO: 701816 - DNA, 13 bp, C. elegans
ataaatctgattt

SEQ ID NO: 701817 - DNA, 13 bp, C. elegans
ataaatgaaaact

SEQ ID NO: 701818 - DNA, 13 bp, C. elegans
ataaatgagcaaa

SEQ ID NO: 701819 - DNA, 13 bp, C. elegans
ataaatgcaattt

SEQ ID NO: 701820 - DNA, 13 bp, C. elegans
ataaatgcataaa

SEQ ID NO: 701821 - DNA, 13 bp, C. elegans
ataaatgcgggaa

SEQ ID NO: 701822 - DNA, 13 bp, C. elegans
ataaatgctcaaa

SEQ ID NO: 701823 - DNA, 13 bp, C. elegans
ataaatggaatta

SEQ ID NO: 701824 - DNA, 13 bp, C. elegans
ataaatgggtatt

SEQ ID NO: 701825 - DNA, 13 bp, C. elegans
ataaatgtactta

SEQ ID NO: 701826 - DNA, 13 bp, C. elegans
ataaatgtcaatt

SEQ ID NO: 701827 - DNA, 13 bp, C. elegans
ataaatgtgataa

SEQ ID NO: 701828 - DNA, 13 bp, C. elegans
ataaatgtgtttt

SEQ ID NO: 701829 - DNA, 13 bp, C. elegans
ataaattattgga

SEQ ID NO: 701830 - DNA, 13 bp, C. elegans
ataaattatttgc

SEQ ID NO: 701831 - DNA, 13 bp, C. elegans
ataaattcaactt

SEQ ID NO: 701832 - DNA, 13 bp, C. elegans
ataaattcacttg

SEQ ID NO: 701833 - DNA, 13 bp, C. elegans
ataaattcacttt

SEQ ID NO: 701834 - DNA, 13 bp, C. elegans
ataaattcatttc

SEQ ID NO: 701835 - DNA, 13 bp, C. elegans
ataaattccattt

SEQ ID NO: 701836 - DNA, 13 bp, C. elegans
ataaattcctttt

SEQ ID NO: 701837 - DNA, 13 bp, C. elegans
ataaattctcctt

SEQ ID NO: 701838 - DNA, 13 bp, C. elegans
ataaattcttcaa

SEQ ID NO: 701839 - DNA, 13 bp, C. elegans
ataaattctttga

SEQ ID NO: 701840 - DNA, 13 bp, C. elegans
ataaattgacaat

SEQ ID NO: 701841 - DNA, 13 bp, C. elegans
ataaattgcaaaa

SEQ ID NO: 701842 - DNA, 13 bp, C. elegans
ataaattggtatt

SEQ ID NO: 701843 - DNA, 13 bp, C. elegans
ataaattgtcatt

SEQ ID NO: 701844 - DNA, 13 bp, C. elegans
ataaattgtgaat

SEQ ID NO: 701845 - DNA, 13 bp, C. elegans
ataaatttatgtg

SEQ ID NO: 701846 - DNA, 13 bp, C. elegans
ataaatttattcc

SEQ ID NO: 701847 - DNA, 13 bp, C. elegans
ataaatttcacaa

SEQ ID NO: 701848 - DNA, 13 bp, C. elegans
ataaatttccaaa

SEQ ID NO: 701849 - DNA, 13 bp, C. elegans
ataaatttctgaa

SEQ ID NO: 701850 - DNA, 13 bp, C. elegans
ataaatttgccaa

SEQ ID NO: 701851 - DNA, 13 bp, C. elegans
ataaatttggcaa

SEQ ID NO: 701852 - DNA, 13 bp, C. elegans
ataaattttgaga

SEQ ID NO: 701853 - DNA, 13 bp, C. elegans
ataaattttgcga

SEQ ID NO: 701854 - DNA, 13 bp, C. elegans
ataacaaaacagt

SEQ ID NO: 701855 - DNA, 13 bp, C. elegans
ataacaaaatttg

SEQ ID NO: 701856 - DNA, 13 bp, C. elegans
ataacaaattttg

SEQ ID NO: 701857 - DNA, 13 bp, C. elegans
ataacaacggcaa

SEQ ID NO: 701858 - DNA, 13 bp, C. elegans
ataacaattgaaa

SEQ ID NO: 701859 - DNA, 13 bp, C. elegans
ataacaattgata

SEQ ID NO: 701860 - DNA, 13 bp, C. elegans
ataacaatttgaa

SEQ ID NO: 701861 - DNA, 13 bp, C. elegans
ataacaatttgtt

SEQ ID NO: 701862 - DNA, 13 bp, C. elegans
ataacagttttat

SEQ ID NO: 701863 - DNA, 13 bp, C. elegans
ataacatatttca

SEQ ID NO: 701864 - DNA, 13 bp, C. elegans
ataacatatttga

SEQ ID NO: 701865 - DNA, 13 bp, C. elegans
ataacattgaaat

SEQ ID NO: 701866 - DNA, 13 bp, C. elegans
ataacattttttg

SEQ ID NO: 701867 - DNA, 13 bp, C. elegans
ataacgtttcaaa

SEQ ID NO: 701868 - DNA, 13 bp, C. elegans
ataacgttttaaa

SEQ ID NO: 701869 - DNA, 13 bp, C. elegans
ataacgttttttt

SEQ ID NO: 701870 - DNA, 13 bp, C. elegans
ataactacagtaa

SEQ ID NO: 701871 - DNA, 13 bp, C. elegans
ataactacatcaa

SEQ ID NO: 701872 - DNA, 13 bp, C. elegans
ataactccaaatt

SEQ ID NO: 701873 - DNA, 13 bp, C. elegans
ataactgaaagtt

SEQ ID NO: 701874 - DNA, 13 bp, C. elegans
ataactggaaaaa

SEQ ID NO: 701875 - DNA, 13 bp, C. elegans
ataactgttaaaa

SEQ ID NO: 701876 - DNA, 13 bp, C. elegans
ataactgtttttt

SEQ ID NO: 701877 - DNA, 13 bp, C. elegans
ataacttactttt

SEQ ID NO: 701878 - DNA, 13 bp, C. elegans
ataacttcaattt

SEQ ID NO: 701879 - DNA, 13 bp, C. elegans
ataactttattca

SEQ ID NO: 701880 - DNA, 13 bp, C. elegans
ataactttatttc

SEQ ID NO: 701881 - DNA, 13 bp, C. elegans
ataactttcaaaa

SEQ ID NO: 701882 - DNA, 13 bp, C. elegans
ataactttgaaaa

SEQ ID NO: 701883 - DNA, 13 bp, C. elegans
ataactttgtaaa

SEQ ID NO: 701884 - DNA, 13 bp, C. elegans
ataactttttcaa

SEQ ID NO: 701885 - DNA, 14 bp, C. elegans
ataacttttttcaa

SEQ ID NO: 701886 - DNA, 13 bp, C. elegans
ataactttttttg

SEQ ID NO: 701887 - DNA, 13 bp, C. elegans
ataagaaaaatcg

SEQ ID NO: 701888 - DNA, 13 bp, C. elegans
ataagaaaacatt

SEQ ID NO: 701889 - DNA, 13 bp, C. elegans
ataagaaattcaa

SEQ ID NO: 701890 - DNA, 13 bp, C. elegans
ataagaaattcga

SEQ ID NO: 701891 - DNA, 13 bp, C. elegans
ataagaagctcat

SEQ ID NO: 701892 - DNA, 13 bp, C. elegans
ataagaaggatcg

SEQ ID NO: 701893 - DNA, 13 bp, C. elegans
ataagaattcaaa

SEQ ID NO: 701894 - DNA, 13 bp, C. elegans
ataagcatattca

SEQ ID NO: 701895 - DNA, 13 bp, C. elegans
ataagcctaagcc

SEQ ID NO: 701896 - DNA, 13 bp, C. elegans
ataagctcaaaat

SEQ ID NO: 701897 - DNA, 13 bp, C. elegans
ataaggaattttt

SEQ ID NO: 701898 - DNA, 13 bp, C. elegans
ataaggatttcct

SEQ ID NO: 701899 - DNA, 13 bp, C. elegans
ataagttatttgt

SEQ ID NO: 701900 - DNA, 13 bp, C. elegans
ataataaaacgtt

SEQ ID NO: 701901 - DNA, 13 bp, C. elegans
ataataaaacttc

SEQ ID NO: 701902 - DNA, 13 bp, C. elegans
ataataatcccaa

SEQ ID NO: 701903 - DNA, 13 bp, C. elegans
ataataatcgaaa

SEQ ID NO: 701904 - DNA, 13 bp, C. elegans
ataataattgtgt

SEQ ID NO: 701905 - DNA, 13 bp, C. elegans
ataatacacaagt

SEQ ID NO: 701906 - DNA, 13 bp, C. elegans
ataataccaaatt

SEQ ID NO: 701907 - DNA, 13 bp, C. elegans
ataatacgaagaa

SEQ ID NO: 701908 - DNA, 13 bp, C. elegans
ataatagttcaaa

SEQ ID NO: 701909 - DNA, 13 bp, C. elegans
ataatatcacttt

SEQ ID NO: 701910 - DNA, 13 bp, C. elegans
ataatatgacaat

SEQ ID NO: 701911 - DNA, 13 bp, C. elegans
ataatattctcaa

SEQ ID NO: 701912 - DNA, 13 bp, C. elegans
ataatattcttga

SEQ ID NO: 701913 - DNA, 13 bp, C. elegans
ataatattgcaaa

SEQ ID NO: 701914 - DNA, 13 bp, C. elegans
ataatattggttt

SEQ ID NO: 701915 - DNA, 13 bp, C. elegans
ataatatttcaac

SEQ ID NO: 701916 - DNA, 13 bp, C. elegans
ataatatttcaag

SEQ ID NO: 701917 - DNA, 13 bp, C. elegans
ataatattttcag

SEQ ID NO: 701918 - DNA, 13 bp, C. elegans
ataatatttttcg

SEQ ID NO: 701919 - DNA, 13 bp, C. elegans
ataatcaaaagtt

SEQ ID NO: 701920 - DNA, 13 bp, C. elegans
ataatcaaaatga

SEQ ID NO: 701921 - DNA, 13 bp, C. elegans
ataatcaacttgt

SEQ ID NO: 701922 - DNA, 13 bp, C. elegans
ataatcatgtttt

SEQ ID NO: 701923 - DNA, 13 bp, C. elegans
ataatccattttt

SEQ ID NO: 701924 - DNA, 13 bp, C. elegans
ataatcgaatatt

SEQ ID NO: 701925 - DNA, 13 bp, C. elegans
ataatcgactttt

SEQ ID NO: 701926 - DNA, 13 bp, C. elegans
ataatcgagaact

SEQ ID NO: 701927 - DNA, 14 bp, C. elegans
ataatcgatttttt

SEQ ID NO: 701928 - DNA, 13 bp, C. elegans
ataatctcatttt

SEQ ID NO: 701929 - DNA, 13 bp, C. elegans
ataatctctgaaa

SEQ ID NO: 701930 - DNA, 13 bp, C. elegans
ataatctgaaaca

SEQ ID NO: 701931 - DNA, 13 bp, C. elegans
ataatctgaaata

SEQ ID NO: 701932 - DNA, 13 bp, C. elegans
ataatcttgtttt

SEQ ID NO: 701933 - DNA, 13 bp, C. elegans
ataatgaaaactt

SEQ ID NO: 701934 - DNA, 13 bp, C. elegans
ataatgaaaagtt

SEQ ID NO: 701935 - DNA, 13 bp, C. elegans
ataatgaaacttc

SEQ ID NO: 701936 - DNA, 13 bp, C. elegans
ataatgaacattt

SEQ ID NO: 701937 - DNA, 13 bp, C. elegans
ataatgatccaaa

SEQ ID NO: 701938 - DNA, 13 bp, C. elegans
ataatgattcaaa

SEQ ID NO: 701939 - DNA, 13 bp, C. elegans
ataatgattcatt

SEQ ID NO: 701940 - DNA, 13 bp, C. elegans
ataatgatttgaa

SEQ ID NO: 701941 - DNA, 13 bp, C. elegans
ataatgcaaattt

SEQ ID NO: 701942 - DNA, 13 bp, C. elegans
ataatgcaatttt

SEQ ID NO: 701943 - DNA, 13 bp, C. elegans
ataatgctcaaaa

SEQ ID NO: 701944 - DNA, 13 bp, C. elegans
ataatggaatttt

SEQ ID NO: 701945 - DNA, 13 bp, C. elegans
ataatgtcaaatg

SEQ ID NO: 701946 - DNA, 13 bp, C. elegans
ataatgttcaatt

SEQ ID NO: 701947 - DNA, 13 bp, C. elegans
ataatgtttcaaa

SEQ ID NO: 701948 - DNA, 13 bp, C. elegans
ataatgtttcttt

SEQ ID NO: 701949 - DNA, 13 bp, C. elegans
ataatgttttctt

SEQ ID NO: 701950 - DNA, 13 bp, C. elegans
ataatgtttttca

SEQ ID NO: 701951 - DNA, 13 bp, C. elegans
ataattatcgatt

SEQ ID NO: 701952 - DNA, 13 bp, C. elegans
ataattatggacc

SEQ ID NO: 701953 - DNA, 13 bp, C. elegans
ataattcaaaaga

SEQ ID NO: 701954 - DNA, 13 bp, C. elegans
ataattcaacatt

SEQ ID NO: 701955 - DNA, 13 bp, C. elegans
ataattcaacttt

SEQ ID NO: 701956 - DNA, 13 bp, C. elegans
ataattcaatgtt

SEQ ID NO: 701957 - DNA, 13 bp, C. elegans
ataattcagtttt

SEQ ID NO: 701958 - DNA, 13 bp, C. elegans
ataattcattttc

SEQ ID NO: 701959 - DNA, 13 bp, C. elegans
ataattccaataa

SEQ ID NO: 701960 - DNA, 13 bp, C. elegans
ataattccaatat

SEQ ID NO: 701961 - DNA, 13 bp, C. elegans
ataattccaattt

SEQ ID NO: 701962 - DNA, 13 bp, C. elegans
ataattcgatttt

SEQ ID NO: 701963 - DNA, 13 bp, C. elegans
ataattctacagt

SEQ ID NO: 701964 - DNA, 13 bp, C. elegans
ataattgaaatga

SEQ ID NO: 701965 - DNA, 13 bp, C. elegans
ataattgaagttt

SEQ ID NO: 701966 - DNA, 13 bp, C. elegans
ataattgaattca

SEQ ID NO: 701967 - DNA, 13 bp, C. elegans
ataattgcaaaaa

SEQ ID NO: 701968 - DNA, 13 bp, C. elegans
ataattgcaattt

SEQ ID NO: 701969 - DNA, 13 bp, C. elegans
ataattgcagttt

SEQ ID NO: 701970 - DNA, 13 bp, C. elegans
ataattgccaaaa

SEQ ID NO: 701971 - DNA, 13 bp, C. elegans
ataattggcaaaa

SEQ ID NO: 701972 - DNA, 13 bp, C. elegans
ataattgttcaaa

SEQ ID NO: 701973 - DNA, 13 bp, C. elegans
ataattgttgaaa

SEQ ID NO: 701974 - DNA, 13 bp, C. elegans
ataattgtttcaa

SEQ ID NO: 701975 - DNA, 13 bp, C. elegans
ataattgtttcag

SEQ ID NO: 701976 - DNA, 13 bp, C. elegans
ataatttactctc

SEQ ID NO: 701977 - DNA, 13 bp, C. elegans
ataatttatttgc

SEQ ID NO: 701978 - DNA, 13 bp, C. elegans
ataatttcaagat

SEQ ID NO: 701979 - DNA, 13 bp, C. elegans
ataatttcacaat

SEQ ID NO: 701980 - DNA, 13 bp, C. elegans
ataatttcagaaa

SEQ ID NO: 701981 - DNA, 13 bp, C. elegans
ataatttcagtta

SEQ ID NO: 701982 - DNA, 13 bp, C. elegans
ataatttcattgc

SEQ ID NO: 701983 - DNA, 13 bp, C. elegans
ataatttcattgt

SEQ ID NO: 701984 - DNA, 13 bp, C. elegans
ataatttccaaca

SEQ ID NO: 701985 - DNA, 13 bp, C. elegans
ataatttcgaaaa

SEQ ID NO: 701986 - DNA, 13 bp, C. elegans
ataatttcgattt

SEQ ID NO: 701987 - DNA, 13 bp, C. elegans
ataatttctatca

SEQ ID NO: 701988 - DNA, 13 bp, C. elegans
ataatttctcaat

SEQ ID NO: 701989 - DNA, 13 bp, C. elegans
ataatttctcact

SEQ ID NO: 701990 - DNA, 13 bp, C. elegans
ataatttctgtga

SEQ ID NO: 701991 - DNA, 13 bp, C. elegans
ataatttgaatca

SEQ ID NO: 701992 - DNA, 13 bp, C. elegans
ataatttgacaac

SEQ ID NO: 701993 - DNA, 13 bp, C. elegans
ataatttgcaaaa

SEQ ID NO: 701994 - DNA, 13 bp, C. elegans
ataatttggcaaa

SEQ ID NO: 701995 - DNA, 13 bp, C. elegans
ataatttgtattc

SEQ ID NO: 701996 - DNA, 13 bp, C. elegans
ataatttgttagt

SEQ ID NO: 701997 - DNA, 13 bp, C. elegans
ataattttaagtc

SEQ ID NO: 701998 - DNA, 13 bp, C. elegans
ataattttacaca

SEQ ID NO: 701999 - DNA, 13 bp, C. elegans
ataattttcaaac

SEQ ID NO: 702000 - DNA, 13 bp, C. elegans
ataattttcaatg

SEQ ID NO: 702001 - DNA, 13 bp, C. elegans
ataattttcacaa

SEQ ID NO: 702002 - DNA, 13 bp, C. elegans
ataattttcagaa

SEQ ID NO: 702003 - DNA, 13 bp, C. elegans
ataattttcagtt

SEQ ID NO: 702004 - DNA, 13 bp, C. elegans
ataattttcatgt

SEQ ID NO: 702005 - DNA, 13 bp, C. elegans
ataattttccaat

SEQ ID NO: 702006 - DNA, 13 bp, C. elegans
ataattttccatc

SEQ ID NO: 702007 - DNA, 13 bp, C. elegans
ataattttcctaa

SEQ ID NO: 702008 - DNA, 13 bp, C. elegans
ataattttcgaag

SEQ ID NO: 702009 - DNA, 13 bp, C. elegans
ataattttctgta

SEQ ID NO: 702010 - DNA, 13 bp, C. elegans
ataattttgacta

SEQ ID NO: 702011 - DNA, 13 bp, C. elegans
ataattttgagta

SEQ ID NO: 702012 - DNA, 13 bp, C. elegans
ataattttgatgt

SEQ ID NO: 702013 - DNA, 13 bp, C. elegans
ataattttgcatt

SEQ ID NO: 702014 - DNA, 13 bp, C. elegans
ataattttgttga

SEQ ID NO: 702015 - DNA, 13 bp, C. elegans
ataattttgtttc

SEQ ID NO: 702016 - DNA, 13 bp, C. elegans
ataatttttaagc

SEQ ID NO: 702017 - DNA, 13 bp, C. elegans
ataatttttatcg

SEQ ID NO: 702018 - DNA, 13 bp, C. elegans
ataatttttatgg

SEQ ID NO: 702019 - DNA, 13 bp, C. elegans
ataatttttcgaa

SEQ ID NO: 702020 - DNA, 13 bp, C. elegans
ataatttttcgtt

SEQ ID NO: 702021 - DNA, 13 bp, C. elegans
ataatttttctgt

SEQ ID NO: 702022 - DNA, 13 bp, C. elegans
ataatttttgagt

SEQ ID NO: 702023 - DNA, 13 bp, C. elegans
ataatttttgtca

SEQ ID NO: 702024 - DNA, 13 bp, C. elegans
ataatttttgtgc

SEQ ID NO: 702025 - DNA, 13 bp, C. elegans
ataattttttcca

SEQ ID NO: 702026 - DNA, 13 bp, C. elegans
ataattttttctg

SEQ ID NO: 702027 - DNA, 13 bp, C. elegans
atacaaaaaagtc

SEQ ID NO: 702028 - DNA, 13 bp, C. elegans
atacaaaacattt

SEQ ID NO: 702029 - DNA, 13 bp, C. elegans
atacaaaagtttt

SEQ ID NO: 702030 - DNA, 13 bp, C. elegans
atacaaacatttg

SEQ ID NO: 702031 - DNA, 13 bp, C. elegans
atacaaactattt

SEQ ID NO: 702032 - DNA, 13 bp, C. elegans
atacaaacttctc

SEQ ID NO: 702033 - DNA, 13 bp, C. elegans
atacaaatttgtt

SEQ ID NO: 702034 - DNA, 13 bp, C. elegans
atacaaattttct

SEQ ID NO: 702035 - DNA, 13 bp, C. elegans
atacaactatttt

SEQ ID NO: 702036 - DNA, 13 bp, C. elegans
atacaactttgaa

SEQ ID NO: 702037 - DNA, 13 bp, C. elegans
atacaacttttaa

SEQ ID NO: 702038 - DNA, 13 bp, C. elegans
atacaatgtttta

SEQ ID NO: 702039 - DNA, 13 bp, C. elegans
atacaattgaatt

SEQ ID NO: 702040 - DNA, 13 bp, C. elegans
atacaatttcaca

SEQ ID NO: 702041 - DNA, 13 bp, C. elegans
atacaatttcttg

SEQ ID NO: 702042 - DNA, 13 bp, C. elegans
atacaatttttac

SEQ ID NO: 702043 - DNA, 13 bp, C. elegans
atacacacacatt

SEQ ID NO: 702044 - DNA, 13 bp, C. elegans
atacacgtggtgt

SEQ ID NO: 702045 - DNA, 13 bp, C. elegans
atacactcaaaat

SEQ ID NO: 702046 - DNA, 13 bp, C. elegans
atacacttattat

SEQ ID NO: 702047 - DNA, 13 bp, C. elegans
atacacttccaga

SEQ ID NO: 702048 - DNA, 13 bp, C. elegans
atacacttttaat

SEQ ID NO: 702049 - DNA, 13 bp, C. elegans
atacacttttttc

SEQ ID NO: 702050 - DNA, 13 bp, C. elegans
atacagcttttta

SEQ ID NO: 702051 - DNA, 13 bp, C. elegans
atacagttttaaa

SEQ ID NO: 702052 - DNA, 13 bp, C. elegans
atacatacacaca

SEQ ID NO: 702053 - DNA, 13 bp, C. elegans
atacatacatgtt

SEQ ID NO: 702054 - DNA, 13 bp, C. elegans
atacatacatttt

SEQ ID NO: 702055 - DNA, 13 bp, C. elegans
atacatactttgt

SEQ ID NO: 702056 - DNA, 13 bp, C. elegans
atacatatatgta

SEQ ID NO: 702057 - DNA, 13 bp, C. elegans
atacatattctgc

SEQ ID NO: 702058 - DNA, 13 bp, C. elegans
atacatatttctt

SEQ ID NO: 702059 - DNA, 13 bp, C. elegans
atacatatttgaa

SEQ ID NO: 702060 - DNA, 13 bp, C. elegans
atacatcaaaact

SEQ ID NO: 702061 - DNA, 13 bp, C. elegans
atacatcagatct

SEQ ID NO: 702062 - DNA, 13 bp, C. elegans
atacatgaaaatg

SEQ ID NO: 702063 - DNA, 13 bp, C. elegans
atacatgtttttt

SEQ ID NO: 702064 - DNA, 13 bp, C. elegans
atacatttaaatg

SEQ ID NO: 702065 - DNA, 13 bp, C. elegans
atacatttctaaa

SEQ ID NO: 702066 - DNA, 13 bp, C. elegans
atacatttggaaa

SEQ ID NO: 702067 - DNA, 13 bp, C. elegans
atacattttctaa

SEQ ID NO: 702068 - DNA, 13 bp, C. elegans
atacattttgaaa

SEQ ID NO: 702069 - DNA, 13 bp, C. elegans
atacattttgttt

SEQ ID NO: 702070 - DNA, 13 bp, C. elegans
atacatttttact

SEQ ID NO: 702071 - DNA, 13 bp, C. elegans
atacattttttga

SEQ ID NO: 702072 - DNA, 13 bp, C. elegans
atacattttttgg

SEQ ID NO: 702073 - DNA, 13 bp, C. elegans
ataccaaaattta

SEQ ID NO: 702074 - DNA, 13 bp, C. elegans
ataccaaacattt

SEQ ID NO: 702075 - DNA, 13 bp, C. elegans
ataccagaaaata

SEQ ID NO: 702076 - DNA, 13 bp, C. elegans
ataccagaaaatg

SEQ ID NO: 702077 - DNA, 13 bp, C. elegans
ataccgaaaaatc

SEQ ID NO: 702078 - DNA, 13 bp, C. elegans
ataccgattttcg

SEQ ID NO: 702079 - DNA, 13 bp, C. elegans
ataccggcaattt

SEQ ID NO: 702080 - DNA, 13 bp, C. elegans
ataccgtatattc

SEQ ID NO: 702081 - DNA, 13 bp, C. elegans
atacctcttcaaa

SEQ ID NO: 702082 - DNA, 13 bp, C. elegans
atacctgtgtgtt

SEQ ID NO: 702083 - DNA, 13 bp, C. elegans
ataccttatttcc

SEQ ID NO: 702084 - DNA, 13 bp, C. elegans
atacgaaaacatc

SEQ ID NO: 702085 - DNA, 14 bp, C. elegans
atacgaaaagggga

SEQ ID NO: 702086 - DNA, 13 bp, C. elegans
atacgaatttttc

SEQ ID NO: 702087 - DNA, 13 bp, C. elegans
atacgatttttta

SEQ ID NO: 702088 - DNA, 13 bp, C. elegans
atacggtattttt

SEQ ID NO: 702089 - DNA, 13 bp, C. elegans
atacgttcaaaat

SEQ ID NO: 702090 - DNA, 13 bp, C. elegans
atactaatggatt

SEQ ID NO: 702091 - DNA, 13 bp, C. elegans
atactacaaacta

SEQ ID NO: 702092 - DNA, 13 bp, C. elegans
atactacacaagt

SEQ ID NO: 702093 - DNA, 13 bp, C. elegans
atactatagaaaa

SEQ ID NO: 702094 - DNA, 13 bp, C. elegans
atactatgaaaat

SEQ ID NO: 702095 - DNA, 13 bp, C. elegans
atactattttcat

SEQ ID NO: 702096 - DNA, 13 bp, C. elegans
atactatttttga

SEQ ID NO: 702097 - DNA, 13 bp, C. elegans
atactcaaatgaa

SEQ ID NO: 702098 - DNA, 13 bp, C. elegans
atactcatttcaa

SEQ ID NO: 702099 - DNA, 13 bp, C. elegans
atactcattttct

SEQ ID NO: 702100 - DNA, 13 bp, C. elegans
atactcgaaaaaa

SEQ ID NO: 702101 - DNA, 13 bp, C. elegans
atactctcgaatt

SEQ ID NO: 702102 - DNA, 13 bp, C. elegans
atactctctctct

SEQ ID NO: 702103 - DNA, 13 bp, C. elegans
atactcttcatat

SEQ ID NO: 702104 - DNA, 13 bp, C. elegans
atactgaaaaata

SEQ ID NO: 702105 - DNA, 13 bp, C. elegans
atactgaactttt

SEQ ID NO: 702106 - DNA, 13 bp, C. elegans
atactgttttgaa

SEQ ID NO: 702107 - DNA, 13 bp, C. elegans
atacttcaaaaat

SEQ ID NO: 702108 - DNA, 13 bp, C. elegans
atacttcaaattt

SEQ ID NO: 702109 - DNA, 13 bp, C. elegans
atacttccggcaa

SEQ ID NO: 702110 - DNA, 13 bp, C. elegans
atacttgaaaaac

SEQ ID NO: 702111 - DNA, 13 bp, C. elegans
atacttgaaacat

SEQ ID NO: 702112 - DNA, 13 bp, C. elegans
atacttgattttt

SEQ ID NO: 702113 - DNA, 13 bp, C. elegans
atacttgcaaaat

SEQ ID NO: 702114 - DNA, 13 bp, C. elegans
atacttgtaaaat

SEQ ID NO: 702115 - DNA, 13 bp, C. elegans
atacttgtttgaa

SEQ ID NO: 702116 - DNA, 13 bp, C. elegans
atactttattgaa

SEQ ID NO: 702117 - DNA, 13 bp, C. elegans
atactttatttca

SEQ ID NO: 702118 - DNA, 13 bp, C. elegans
atactttccaaat

SEQ ID NO: 702119 - DNA, 13 bp, C. elegans
atactttgaaaat

SEQ ID NO: 702120 - DNA, 13 bp, C. elegans
atactttgattga

SEQ ID NO: 702121 - DNA, 13 bp, C. elegans
atacttttcaaaa

SEQ ID NO: 702122 - DNA, 13 bp, C. elegans
atacttttgaaaa

SEQ ID NO: 702123 - DNA, 13 bp, C. elegans
atacttttgaata

SEQ ID NO: 702124 - DNA, 13 bp, C. elegans
atactttttcaat

SEQ ID NO: 702125 - DNA, 13 bp, C. elegans
atactttttgaaa

SEQ ID NO: 702126 - DNA, 13 bp, C. elegans
atactttttggta

SEQ ID NO: 702127 - DNA, 13 bp, C. elegans
atactttttgtaa

SEQ ID NO: 702128 - DNA, 13 bp, C. elegans
atacttttttgtg

SEQ ID NO: 702129 - DNA, 13 bp, C. elegans
atagaaaatacat

SEQ ID NO: 702130 - DNA, 13 bp, C. elegans
atagaaaatctca

SEQ ID NO: 702131 - DNA, 13 bp, C. elegans
atagaaaattgca

SEQ ID NO: 702132 - DNA, 13 bp, C. elegans
atagaaatagttt

SEQ ID NO: 702133 - DNA, 13 bp, C. elegans
atagaaattcaaa

SEQ ID NO: 702134 - DNA, 13 bp, C. elegans
atagaaatttgta

SEQ ID NO: 702135 - DNA, 13 bp, C. elegans
atagaacaatatt

SEQ ID NO: 702136 - DNA, 13 bp, C. elegans
atagaacatttga

SEQ ID NO: 702137 - DNA, 13 bp, C. elegans
atagaagattttt

SEQ ID NO: 702138 - DNA, 13 bp, C. elegans
atagaatattcaa

SEQ ID NO: 702139 - DNA, 13 bp, C. elegans
atagaattttcta

SEQ ID NO: 702140 - DNA, 13 bp, C. elegans
atagacattttca

SEQ ID NO: 702141 - DNA, 13 bp, C. elegans
atagagaatatat

SEQ ID NO: 702142 - DNA, 13 bp, C. elegans
atagagcgcactt

SEQ ID NO: 702143 - DNA, 13 bp, C. elegans
atagatcaaaaat

SEQ ID NO: 702144 - DNA, 13 bp, C. elegans
atagatctacaaa

SEQ ID NO: 702145 - DNA, 13 bp, C. elegans
atagatgaatttt

SEQ ID NO: 702146 - DNA, 13 bp, C. elegans
atagattcaaaat

SEQ ID NO: 702147 - DNA, 13 bp, C. elegans
atagattgacaaa

SEQ ID NO: 702148 - DNA, 13 bp, C. elegans
atagatttaatca

SEQ ID NO: 702149 - DNA, 14 bp, C. elegans
atagatttggattc

SEQ ID NO: 702150 - DNA, 13 bp, C. elegans
atagatttgtcaa

SEQ ID NO: 702151 - DNA, 13 bp, C. elegans
atagattttccaa

SEQ ID NO: 702152 - DNA, 13 bp, C. elegans
atagattttcgaa

SEQ ID NO: 702153 - DNA, 13 bp, C. elegans
atagatttttgaa

SEQ ID NO: 702154 - DNA, 13 bp, C. elegans
atagcaaatgttg

SEQ ID NO: 702155 - DNA, 13 bp, C. elegans
atagcaataaact

SEQ ID NO: 702156 - DNA, 13 bp, C. elegans
atagcaattttga

SEQ ID NO: 702157 - DNA, 13 bp, C. elegans
atagcatttttca

SEQ ID NO: 702158 - DNA, 13 bp, C. elegans
atagccaatatgg

SEQ ID NO: 702159 - DNA, 13 bp, C. elegans
atagcgttttttt

SEQ ID NO: 702160 - DNA, 13 bp, C. elegans
atagctcagttgg

SEQ ID NO: 702161 - DNA, 13 bp, C. elegans
atagcttaaaacc

SEQ ID NO: 702162 - DNA, 13 bp, C. elegans
atagcttcaaatt

SEQ ID NO: 702163 - DNA, 13 bp, C. elegans
atagctttaaatt

SEQ ID NO: 702164 - DNA, 13 bp, C. elegans
ataggcaattttt

SEQ ID NO: 702165 - DNA, 13 bp, C. elegans
ataggtaaccaaa

SEQ ID NO: 702166 - DNA, 13 bp, C. elegans
atagtaaacattt

SEQ ID NO: 702167 - DNA, 13 bp, C. elegans
atagtaaataaca

SEQ ID NO: 702168 - DNA, 13 bp, C. elegans
atagtaaatgata

SEQ ID NO: 702169 - DNA, 13 bp, C. elegans
atagtattgaaaa

SEQ ID NO: 702170 - DNA, 13 bp, C. elegans
atagtattttgaa

SEQ ID NO: 702171 - DNA, 13 bp, C. elegans
atagtcaaaaaca

SEQ ID NO: 702172 - DNA, 13 bp, C. elegans
atagtcaaaaata

SEQ ID NO: 702173 - DNA, 13 bp, C. elegans
atagtcatttttc

SEQ ID NO: 702174 - DNA, 13 bp, C. elegans
atagtcttgaaaa

SEQ ID NO: 702175 - DNA, 13 bp, C. elegans
atagtgagaaatt

SEQ ID NO: 702176 - DNA, 13 bp, C. elegans
atagtgagttggg

SEQ ID NO: 702177 - DNA, 13 bp, C. elegans
atagtggaaattt

SEQ ID NO: 702178 - DNA, 13 bp, C. elegans
atagttagttata

SEQ ID NO: 702179 - DNA, 13 bp, C. elegans
atagttatttttc

SEQ ID NO: 702180 - DNA, 13 bp, C. elegans
atagttcaaaact

SEQ ID NO: 702181 - DNA, 13 bp, C. elegans
atagttccagtta

SEQ ID NO: 702182 - DNA, 13 bp, C. elegans
atagttggcaatg

SEQ ID NO: 702183 - DNA, 13 bp, C. elegans
atagttgtgaaaa

SEQ ID NO: 702184 - DNA, 13 bp, C. elegans
atagtttaaagaa

SEQ ID NO: 702185 - DNA, 13 bp, C. elegans
atagtttcaagaa

SEQ ID NO: 702186 - DNA, 13 bp, C. elegans
atagtttcaagtt

SEQ ID NO: 702187 - DNA, 13 bp, C. elegans
atagtttcaataa

SEQ ID NO: 702188 - DNA, 13 bp, C. elegans
atagttttcattt

SEQ ID NO: 702189 - DNA, 13 bp, C. elegans
atagttttggaat

SEQ ID NO: 702190 - DNA, 13 bp, C. elegans
atagtttttcaaa

SEQ ID NO: 702191 - DNA, 13 bp, C. elegans
atagtttttcaat

SEQ ID NO: 702192 - DNA, 13 bp, C. elegans
atagtttttctaa

SEQ ID NO: 702193 - DNA, 13 bp, C. elegans
atagtttttctat

SEQ ID NO: 702194 - DNA, 13 bp, C. elegans
atagtttttctca

SEQ ID NO: 702195 - DNA, 13 bp, C. elegans
atagtttttcttg

SEQ ID NO: 702196 - DNA, 13 bp, C. elegans
atataaaatctag

SEQ ID NO: 702197 - DNA, 13 bp, C. elegans
atataaaattagg

SEQ ID NO: 702198 - DNA, 13 bp, C. elegans
atataaaatttcc

SEQ ID NO: 702199 - DNA, 13 bp, C. elegans
atataaacttcaa

SEQ ID NO: 702200 - DNA, 13 bp, C. elegans
atataaatttcag

SEQ ID NO: 702201 - DNA, 13 bp, C. elegans
atataagctctca

SEQ ID NO: 702202 - DNA, 13 bp, C. elegans
atataagttcaaa

SEQ ID NO: 702203 - DNA, 13 bp, C. elegans
atataatctgaaa

SEQ ID NO: 702204 - DNA, 13 bp, C. elegans
atataattgcaaa

SEQ ID NO: 702205 - DNA, 13 bp, C. elegans
atataatttgtga

SEQ ID NO: 702206 - DNA, 13 bp, C. elegans
atatacaacattt

SEQ ID NO: 702207 - DNA, 13 bp, C. elegans
atatacacatata

SEQ ID NO: 702208 - DNA, 13 bp, C. elegans
atatacaggcaca

SEQ ID NO: 702209 - DNA, 13 bp, C. elegans
atatacagtgctg

SEQ ID NO: 702210 - DNA, 13 bp, C. elegans
atatacatacata

SEQ ID NO: 702211 - DNA, 13 bp, C. elegans
atatacatacatt

SEQ ID NO: 702212 - DNA, 13 bp, C. elegans
atatacatagaaa

SEQ ID NO: 702213 - DNA, 13 bp, C. elegans
atatacatataca

SEQ ID NO: 702214 - DNA, 13 bp, C. elegans
atatacatatgta

SEQ ID NO: 702215 - DNA, 13 bp, C. elegans
atatacatattct

SEQ ID NO: 702216 - DNA, 13 bp, C. elegans
atatacctgaaaa

SEQ ID NO: 702217 - DNA, 13 bp, C. elegans
atatagatttttc

SEQ ID NO: 702218 - DNA, 13 bp, C. elegans
atatagctataaa

SEQ ID NO: 702219 - DNA, 13 bp, C. elegans
atataggaaattt

SEQ ID NO: 702220 - DNA, 13 bp, C. elegans
atatataggtttg

SEQ ID NO: 702221 - DNA, 13 bp, C. elegans
atatatatatgtc

SEQ ID NO: 702222 - DNA, 13 bp, C. elegans
atatatatgcttt

SEQ ID NO: 702223 - DNA, 13 bp, C. elegans
atatatattttcc

SEQ ID NO: 702224 - DNA, 13 bp, C. elegans
atatatgaaaaac

SEQ ID NO: 702225 - DNA, 13 bp, C. elegans
atatatgaaacaa

SEQ ID NO: 702226 - DNA, 13 bp, C. elegans
atatatggatttt

SEQ ID NO: 702227 - DNA, 13 bp, C. elegans
atatatgtacata

SEQ ID NO: 702228 - DNA, 13 bp, C. elegans
atatatgtacatt

SEQ ID NO: 702229 - DNA, 13 bp, C. elegans
atatatgtatact

SEQ ID NO: 702230 - DNA, 13 bp, C. elegans
atatatgtatgta

SEQ ID NO: 702231 - DNA, 13 bp, C. elegans
atatattcaattg

SEQ ID NO: 702232 - DNA, 13 bp, C. elegans
atatattcacaaa

SEQ ID NO: 702233 - DNA, 13 bp, C. elegans
atatattcatcaa

SEQ ID NO: 702234 - DNA, 13 bp, C. elegans
atatattccaatt

SEQ ID NO: 702235 - DNA, 13 bp, C. elegans
atatattccattt

SEQ ID NO: 702236 - DNA, 13 bp, C. elegans
atatattctgaat

SEQ ID NO: 702237 - DNA, 13 bp, C. elegans
atatattctggaa

SEQ ID NO: 702238 - DNA, 13 bp, C. elegans
atatattgaaaac

SEQ ID NO: 702239 - DNA, 13 bp, C. elegans
atatattgtttca

SEQ ID NO: 702240 - DNA, 13 bp, C. elegans
atatattgtttct

SEQ ID NO: 702241 - DNA, 13 bp, C. elegans
atatatttcactc

SEQ ID NO: 702242 - DNA, 13 bp, C. elegans
atatatttccaaa

SEQ ID NO: 702243 - DNA, 13 bp, C. elegans
atatatttcgaaa

SEQ ID NO: 702244 - DNA, 13 bp, C. elegans
atatatttctgtt

SEQ ID NO: 702245 - DNA, 13 bp, C. elegans
atatattttcagc

SEQ ID NO: 702246 - DNA, 13 bp, C. elegans
atatattttccca

SEQ ID NO: 702247 - DNA, 13 bp, C. elegans
atatattttgaac

SEQ ID NO: 702248 - DNA, 13 bp, C. elegans
atatatttttcag

SEQ ID NO: 702249 - DNA, 13 bp, C. elegans
atatcaaaaaatg

SEQ ID NO: 702250 - DNA, 13 bp, C. elegans
atatcaaaaatct

SEQ ID NO: 702251 - DNA, 13 bp, C. elegans
atatcaaaacatt

SEQ ID NO: 702252 - DNA, 13 bp, C. elegans
atatcaaaagttt

SEQ ID NO: 702253 - DNA, 13 bp, C. elegans
atatcaaaatgtg

SEQ ID NO: 702254 - DNA, 13 bp, C. elegans
atatcaaaattct

SEQ ID NO: 702255 - DNA, 13 bp, C. elegans
atatcaaatttgt

SEQ ID NO: 702256 - DNA, 13 bp, C. elegans
atatcaacaactt

SEQ ID NO: 702257 - DNA, 13 bp, C. elegans
atatcaacatttt

SEQ ID NO: 702258 - DNA, 13 bp, C. elegans
atatcaaccaaat

SEQ ID NO: 702259 - DNA, 13 bp, C. elegans
atatcaacttttc

SEQ ID NO: 702260 - DNA, 13 bp, C. elegans
atatcaagttttc

SEQ ID NO: 702261 - DNA, 13 bp, C. elegans
atatcaatgtcaa

SEQ ID NO: 702262 - DNA, 13 bp, C. elegans
atatcaatttctt

SEQ ID NO: 702263 - DNA, 13 bp, C. elegans
atatcaatttgcc

SEQ ID NO: 702264 - DNA, 13 bp, C. elegans
atatcaatttgtt

SEQ ID NO: 702265 - DNA, 13 bp, C. elegans
atatcaattttca

SEQ ID NO: 702266 - DNA, 13 bp, C. elegans
atatcaatttttg

SEQ ID NO: 702267 - DNA, 13 bp, C. elegans
atatcacaaaaga

SEQ ID NO: 702268 - DNA, 13 bp, C. elegans
atatcacattttc

SEQ ID NO: 702269 - DNA, 13 bp, C. elegans
atatcacattttg

SEQ ID NO: 702270 - DNA, 13 bp, C. elegans
atatcagaaaata

SEQ ID NO: 702271 - DNA, 13 bp, C. elegans
atatcagttttca

SEQ ID NO: 702272 - DNA, 13 bp, C. elegans
atatcagttttta

SEQ ID NO: 702273 - DNA, 13 bp, C. elegans
atatcatagtttt

SEQ ID NO: 702274 - DNA, 13 bp, C. elegans
atatcatcagagt

SEQ ID NO: 702275 - DNA, 13 bp, C. elegans
atatcatcatcat

SEQ ID NO: 702276 - DNA, 13 bp, C. elegans
atatcattgtaaa

SEQ ID NO: 702277 - DNA, 13 bp, C. elegans
atatcatttttca

SEQ ID NO: 702278 - DNA, 13 bp, C. elegans
atatcatttttgg

SEQ ID NO: 702279 - DNA, 13 bp, C. elegans
atatcattttttg

SEQ ID NO: 702280 - DNA, 13 bp, C. elegans
atatccaaatttc

SEQ ID NO: 702281 - DNA, 13 bp, C. elegans
atatccaacgtat

SEQ ID NO: 702282 - DNA, 13 bp, C. elegans
atatccaactgaa

SEQ ID NO: 702283 - DNA, 13 bp, C. elegans
atatccaatttta

SEQ ID NO: 702284 - DNA, 13 bp, C. elegans
atatccccccact

SEQ ID NO: 702285 - DNA, 14 bp, C. elegans
atatcccttcaaaa

SEQ ID NO: 702286 - DNA, 13 bp, C. elegans
atatccgaaaaaa

SEQ ID NO: 702287 - DNA, 13 bp, C. elegans
atatccggcaatt

SEQ ID NO: 702288 - DNA, 13 bp, C. elegans
atatcgaaaaata

SEQ ID NO: 702289 - DNA, 13 bp, C. elegans
atatcgaaaatcg

SEQ ID NO: 702290 - DNA, 13 bp, C. elegans
atatcgaaaatga

SEQ ID NO: 702291 - DNA, 13 bp, C. elegans
atatcgaaaatgt

SEQ ID NO: 702292 - DNA, 13 bp, C. elegans
atatcgaatttta

SEQ ID NO: 702293 - DNA, 13 bp, C. elegans
atatcgattttat

SEQ ID NO: 702294 - DNA, 13 bp, C. elegans
atatcgattttca

SEQ ID NO: 702295 - DNA, 13 bp, C. elegans
atatcgattttct

SEQ ID NO: 702296 - DNA, 13 bp, C. elegans
atatcgatttttc

SEQ ID NO: 702297 - DNA, 13 bp, C. elegans
atatcgatttttt

SEQ ID NO: 702298 - DNA, 14 bp, C. elegans
atatcgattttttg

SEQ ID NO: 702299 - DNA, 13 bp, C. elegans
atatcggaaaaat

SEQ ID NO: 702300 - DNA, 13 bp, C. elegans
atatcggaaaatc

SEQ ID NO: 702301 - DNA, 13 bp, C. elegans
atatcggagcatc

SEQ ID NO: 702302 - DNA, 13 bp, C. elegans
atatcggatatta

SEQ ID NO: 702303 - DNA, 13 bp, C. elegans
atatcgtattgtt

SEQ ID NO: 702304 - DNA, 13 bp, C. elegans
atatcgtcagcaa

SEQ ID NO: 702305 - DNA, 13 bp, C. elegans
atatctaagaaaa

SEQ ID NO: 702306 - DNA, 13 bp, C. elegans
atatctaatttca

SEQ ID NO: 702307 - DNA, 13 bp, C. elegans
atatctacagtaa

SEQ ID NO: 702308 - DNA, 13 bp, C. elegans
atatctattgtta

SEQ ID NO: 702309 - DNA, 13 bp, C. elegans
atatctcaaccaa

SEQ ID NO: 702310 - DNA, 14 bp, C. elegans
atatctcaattttc

SEQ ID NO: 702311 - DNA, 13 bp, C. elegans
atatctcagttct

SEQ ID NO: 702312 - DNA, 13 bp, C. elegans
atatctccaaaac

SEQ ID NO: 702313 - DNA, 13 bp, C. elegans
atatctcgtagcg

SEQ ID NO: 702314 - DNA, 13 bp, C. elegans
atatctctaaaat

SEQ ID NO: 702315 - DNA, 13 bp, C. elegans
atatctctcgaaa

SEQ ID NO: 702316 - DNA, 13 bp, C. elegans
atatctcttctag

SEQ ID NO: 702317 - DNA, 13 bp, C. elegans
atatctgaaattc

SEQ ID NO: 702318 - DNA, 13 bp, C. elegans
atatctgaaattt

SEQ ID NO: 702319 - DNA, 13 bp, C. elegans
atatctgaatttt

SEQ ID NO: 702320 - DNA, 13 bp, C. elegans
atatctgataaat

SEQ ID NO: 702321 - DNA, 13 bp, C. elegans
atatctgattttt

SEQ ID NO: 702322 - DNA, 13 bp, C. elegans
atatctgcaaaaa

SEQ ID NO: 702323 - DNA, 13 bp, C. elegans
atatcttatcaat

SEQ ID NO: 702324 - DNA, 13 bp, C. elegans
atatcttcaaaat

SEQ ID NO: 702325 - DNA, 13 bp, C. elegans
atatcttcaattt

SEQ ID NO: 702326 - DNA, 13 bp, C. elegans
atatcttgaaaat

SEQ ID NO: 702327 - DNA, 13 bp, C. elegans
atatcttgaaaca

SEQ ID NO: 702328 - DNA, 13 bp, C. elegans
atatcttgcttgc

SEQ ID NO: 702329 - DNA, 13 bp, C. elegans
atatcttgtttta

SEQ ID NO: 702330 - DNA, 13 bp, C. elegans
atatctttgaaac

SEQ ID NO: 702331 - DNA, 13 bp, C. elegans
atatctttgaatt

SEQ ID NO: 702332 - DNA, 13 bp, C. elegans
atatcttttgaaa

SEQ ID NO: 702333 - DNA, 13 bp, C. elegans
atatcttttttga

SEQ ID NO: 702334 - DNA, 13 bp, C. elegans
atatgaaaaatgt

SEQ ID NO: 702335 - DNA, 13 bp, C. elegans
atatgaaaatgat

SEQ ID NO: 702336 - DNA, 13 bp, C. elegans
atatgaaaattac

SEQ ID NO: 702337 - DNA, 13 bp, C. elegans
atatgaaaattga

SEQ ID NO: 702338 - DNA, 13 bp, C. elegans
atatgaaatcagt

SEQ ID NO: 702339 - DNA, 13 bp, C. elegans
atatgaacaaatt

SEQ ID NO: 702340 - DNA, 13 bp, C. elegans
atatgaaccaaat

SEQ ID NO: 702341 - DNA, 13 bp, C. elegans
atatgaactcaaa

SEQ ID NO: 702342 - DNA, 13 bp, C. elegans
atatgaagagtat

SEQ ID NO: 702343 - DNA, 13 bp, C. elegans
atatgaagttttt

SEQ ID NO: 702344 - DNA, 13 bp, C. elegans
atatgaatatttc

SEQ ID NO: 702345 - DNA, 13 bp, C. elegans
atatgaatgttct

SEQ ID NO: 702346 - DNA, 13 bp, C. elegans
atatgagacctat

SEQ ID NO: 702347 - DNA, 13 bp, C. elegans
atatgagcttttg

SEQ ID NO: 702348 - DNA, 13 bp, C. elegans
atatgatacaatt

SEQ ID NO: 702349 - DNA, 13 bp, C. elegans
atatgatggatta

SEQ ID NO: 702350 - DNA, 13 bp, C. elegans
atatgattcttca

SEQ ID NO: 702351 - DNA, 13 bp, C. elegans
atatgatttattg

SEQ ID NO: 702352 - DNA, 13 bp, C. elegans
atatgattttcat

SEQ ID NO: 702353 - DNA, 13 bp, C. elegans
atatgattttcta

SEQ ID NO: 702354 - DNA, 13 bp, C. elegans
atatgatttttgg

SEQ ID NO: 702355 - DNA, 13 bp, C. elegans
atatgcaaaataa

SEQ ID NO: 702356 - DNA, 13 bp, C. elegans
atatgcaacaaaa

SEQ ID NO: 702357 - DNA, 13 bp, C. elegans
atatgcaagtccg

SEQ ID NO: 702358 - DNA, 13 bp, C. elegans
atatgcaattttt

SEQ ID NO: 702359 - DNA, 13 bp, C. elegans
atatgcagaaaat

SEQ ID NO: 702360 - DNA, 13 bp, C. elegans
atatgcagttttt

SEQ ID NO: 702361 - DNA, 13 bp, C. elegans
atatgccaatttg

SEQ ID NO: 702362 - DNA, 13 bp, C. elegans
atatgccgatttg

SEQ ID NO: 702363 - DNA, 13 bp, C. elegans
atatgcctgccta

SEQ ID NO: 702364 - DNA, 13 bp, C. elegans
atatgcgccttta

SEQ ID NO: 702365 - DNA, 13 bp, C. elegans
atatgctcaaaaa

SEQ ID NO: 702366 - DNA, 13 bp, C. elegans
atatgctcaaaag

SEQ ID NO: 702367 - DNA, 13 bp, C. elegans
atatgctcaaaat

SEQ ID NO: 702368 - DNA, 13 bp, C. elegans
atatgctcctttt

SEQ ID NO: 702369 - DNA, 13 bp, C. elegans
atatgctgcttaa

SEQ ID NO: 702370 - DNA, 13 bp, C. elegans
atatgcttccaat

SEQ ID NO: 702371 - DNA, 13 bp, C. elegans
atatggaaaaatt

SEQ ID NO: 702372 - DNA, 13 bp, C. elegans
atatggaacaaat

SEQ ID NO: 702373 - DNA, 14 bp, C. elegans
atatggaatatcaa

SEQ ID NO: 702374 - DNA, 13 bp, C. elegans
atatggaatttta

SEQ ID NO: 702375 - DNA, 13 bp, C. elegans
atatggaattttt

SEQ ID NO: 702376 - DNA, 13 bp, C. elegans
atatggctgcaat

SEQ ID NO: 702377 - DNA, 13 bp, C. elegans
atatggtgcatcg

SEQ ID NO: 702378 - DNA, 13 bp, C. elegans
atatgtacatata

SEQ ID NO: 702379 - DNA, 13 bp, C. elegans
atatgtataagaa

SEQ ID NO: 702380 - DNA, 13 bp, C. elegans
atatgtatataca

SEQ ID NO: 702381 - DNA, 13 bp, C. elegans
atatgtatatcaa

SEQ ID NO: 702382 - DNA, 13 bp, C. elegans
atatgtatatgta

SEQ ID NO: 702383 - DNA, 13 bp, C. elegans
atatgtatgtaca

SEQ ID NO: 702384 - DNA, 13 bp, C. elegans
atatgtattcaaa

SEQ ID NO: 702385 - DNA, 13 bp, C. elegans
atatgtatttcag

SEQ ID NO: 702386 - DNA, 13 bp, C. elegans
atatgtatttgaa

SEQ ID NO: 702387 - DNA, 13 bp, C. elegans
atatgtatttttc

SEQ ID NO: 702388 - DNA, 13 bp, C. elegans
atatgtcatgatt

SEQ ID NO: 702389 - DNA, 13 bp, C. elegans
atatgtctgaaaa

SEQ ID NO: 702390 - DNA, 13 bp, C. elegans
atatgtgaaacag

SEQ ID NO: 702391 - DNA, 13 bp, C. elegans
atatgtgtatgtg

SEQ ID NO: 702392 - DNA, 13 bp, C. elegans
atatgttcaaagt

SEQ ID NO: 702393 - DNA, 13 bp, C. elegans
atatgttcatatt

SEQ ID NO: 702394 - DNA, 13 bp, C. elegans
atatgttcattta

SEQ ID NO: 702395 - DNA, 13 bp, C. elegans
atatgttccaaaa

SEQ ID NO: 702396 - DNA, 13 bp, C. elegans
atatgttccaatt

SEQ ID NO: 702397 - DNA, 13 bp, C. elegans
atatgttggaaaa

SEQ ID NO: 702398 - DNA, 13 bp, C. elegans
atatgtttagatt

SEQ ID NO: 702399 - DNA, 13 bp, C. elegans
atatgtttcaaaa

SEQ ID NO: 702400 - DNA, 13 bp, C. elegans
atatgtttcacaa

SEQ ID NO: 702401 - DNA, 13 bp, C. elegans
atatgtttcagaa

SEQ ID NO: 702402 - DNA, 13 bp, C. elegans
atatgtttctaaa

SEQ ID NO: 702403 - DNA, 13 bp, C. elegans
atatgtttggaaa

SEQ ID NO: 702404 - DNA, 13 bp, C. elegans
atatgttttactt

SEQ ID NO: 702405 - DNA, 13 bp, C. elegans
atatgttttcaaa

SEQ ID NO: 702406 - DNA, 13 bp, C. elegans
atatgttttctca

SEQ ID NO: 702407 - DNA, 13 bp, C. elegans
atattaaccaaat

SEQ ID NO: 702408 - DNA, 13 bp, C. elegans
atattaatagaag

SEQ ID NO: 702409 - DNA, 13 bp, C. elegans
atattacattttc

SEQ ID NO: 702410 - DNA, 13 bp, C. elegans
atattacccagac

SEQ ID NO: 702411 - DNA, 13 bp, C. elegans
atattactttcaa

SEQ ID NO: 702412 - DNA, 13 bp, C. elegans
atattactttttg

SEQ ID NO: 702413 - DNA, 13 bp, C. elegans
atattatctcaaa

SEQ ID NO: 702414 - DNA, 13 bp, C. elegans
atattatctgaaa

SEQ ID NO: 702415 - DNA, 13 bp, C. elegans
atattatcttcaa

SEQ ID NO: 702416 - DNA, 13 bp, C. elegans
atattattcaaac

SEQ ID NO: 702417 - DNA, 13 bp, C. elegans
atattattgcaaa

SEQ ID NO: 702418 - DNA, 13 bp, C. elegans
atattattgttca

SEQ ID NO: 702419 - DNA, 13 bp, C. elegans
atattatttacag

SEQ ID NO: 702420 - DNA, 13 bp, C. elegans
atattatttgaac

SEQ ID NO: 702421 - DNA, 13 bp, C. elegans
atattattttcag

SEQ ID NO: 702422 - DNA, 13 bp, C. elegans
atattcaaaaagc

SEQ ID NO: 702423 - DNA, 13 bp, C. elegans
atattcaaaaatg

SEQ ID NO: 702424 - DNA, 13 bp, C. elegans
atattcaaaacag

SEQ ID NO: 702425 - DNA, 13 bp, C. elegans
atattcaaaagat

SEQ ID NO: 702426 - DNA, 13 bp, C. elegans
atattcaaaagtt

SEQ ID NO: 702427 - DNA, 13 bp, C. elegans
atattcaaacttt

SEQ ID NO: 702428 - DNA, 13 bp, C. elegans
atattcaaagaaa

SEQ ID NO: 702429 - DNA, 13 bp, C. elegans
atattcaaagttt

SEQ ID NO: 702430 - DNA, 13 bp, C. elegans
atattcaaatgag

SEQ ID NO: 702431 - DNA, 13 bp, C. elegans
atattcaaatgtt

SEQ ID NO: 702432 - DNA, 13 bp, C. elegans
atattcaaattcc

SEQ ID NO: 702433 - DNA, 13 bp, C. elegans
atattcaaattgc

SEQ ID NO: 702434 - DNA, 13 bp, C. elegans
atattcaaatttc

SEQ ID NO: 702435 - DNA, 13 bp, C. elegans
atattcaaatttg

SEQ ID NO: 702436 - DNA, 13 bp, C. elegans
atattcaacattt

SEQ ID NO: 702437 - DNA, 13 bp, C. elegans
atattcaactttt

SEQ ID NO: 702438 - DNA, 13 bp, C. elegans
atattcaataaac

SEQ ID NO: 702439 - DNA, 13 bp, C. elegans
atattcaataatc

SEQ ID NO: 702440 - DNA, 13 bp, C. elegans
atattcaatcatt

SEQ ID NO: 702441 - DNA, 13 bp, C. elegans
atattcaatgaaa

SEQ ID NO: 702442 - DNA, 13 bp, C. elegans
atattcaatgttt

SEQ ID NO: 702443 - DNA, 13 bp, C. elegans
atattcaattttg

SEQ ID NO: 702444 - DNA, 13 bp, C. elegans
atattcacaaaat

SEQ ID NO: 702445 - DNA, 13 bp, C. elegans
atattcacaattt

SEQ ID NO: 702446 - DNA, 13 bp, C. elegans
atattcacatttt

SEQ ID NO: 702447 - DNA, 13 bp, C. elegans
atattcagaaaaa

SEQ ID NO: 702448 - DNA, 13 bp, C. elegans
atattcagaaatt

SEQ ID NO: 702449 - DNA, 13 bp, C. elegans
atattcagtttca

SEQ ID NO: 702450 - DNA, 13 bp, C. elegans
atattcagttttt

SEQ ID NO: 702451 - DNA, 13 bp, C. elegans
atattcatattca

SEQ ID NO: 702452 - DNA, 13 bp, C. elegans
atattcatcagat

SEQ ID NO: 702453 - DNA, 13 bp, C. elegans
atattcatgtttt

SEQ ID NO: 702454 - DNA, 13 bp, C. elegans
atattcattcaaa

SEQ ID NO: 702455 - DNA, 13 bp, C. elegans
atattcattcaat

SEQ ID NO: 702456 - DNA, 13 bp, C. elegans
atattccaaaact

SEQ ID NO: 702457 - DNA, 13 bp, C. elegans
atattccaagaaa

SEQ ID NO: 702458 - DNA, 13 bp, C. elegans
atattccactcac

SEQ ID NO: 702459 - DNA, 13 bp, C. elegans
atattccagaaat

SEQ ID NO: 702460 - DNA, 13 bp, C. elegans
atattccagagtt

SEQ ID NO: 702461 - DNA, 13 bp, C. elegans
atattccatcaaa

SEQ ID NO: 702462 - DNA, 13 bp, C. elegans
atattccatttta

SEQ ID NO: 702463 - DNA, 13 bp, C. elegans
atattccattttg

SEQ ID NO: 702464 - DNA, 13 bp, C. elegans
atattcccaattt

SEQ ID NO: 702465 - DNA, 13 bp, C. elegans
atattcccccaaa

SEQ ID NO: 702466 - DNA, 13 bp, C. elegans
atattcctaattt

SEQ ID NO: 702467 - DNA, 13 bp, C. elegans
atattcgaaaaaa

SEQ ID NO: 702468 - DNA, 13 bp, C. elegans
atattcgaataaa

SEQ ID NO: 702469 - DNA, 13 bp, C. elegans
atattcgaatttt

SEQ ID NO: 702470 - DNA, 13 bp, C. elegans
atattcgagaaaa

SEQ ID NO: 702471 - DNA, 13 bp, C. elegans
atattcgatcatt

SEQ ID NO: 702472 - DNA, 13 bp, C. elegans
atattcgattttc

SEQ ID NO: 702473 - DNA, 13 bp, C. elegans
atattcggaaatt

SEQ ID NO: 702474 - DNA, 13 bp, C. elegans
atattcggaatta

SEQ ID NO: 702475 - DNA, 13 bp, C. elegans
atattcgtttttc

SEQ ID NO: 702476 - DNA, 13 bp, C. elegans
atattctaaaaga

SEQ ID NO: 702477 - DNA, 13 bp, C. elegans
atattctaaatag

SEQ ID NO: 702478 - DNA, 13 bp, C. elegans
atattctatcaat

SEQ ID NO: 702479 - DNA, 13 bp, C. elegans
atattctcaaaat

SEQ ID NO: 702480 - DNA, 13 bp, C. elegans
atattctcaaact

SEQ ID NO: 702481 - DNA, 13 bp, C. elegans
atattctcaattc

SEQ ID NO: 702482 - DNA, 13 bp, C. elegans
atattctcaattt

SEQ ID NO: 702483 - DNA, 13 bp, C. elegans
atattctcacatt

SEQ ID NO: 702484 - DNA, 16 bp, C. elegans
atattctccataattc

SEQ ID NO: 702485 - DNA, 13 bp, C. elegans
atattctgaaaaa

SEQ ID NO: 702486 - DNA, 13 bp, C. elegans
atattctgaaact

SEQ ID NO: 702487 - DNA, 13 bp, C. elegans
atattctgaaatg

SEQ ID NO: 702488 - DNA, 13 bp, C. elegans
atattctgaagtt

SEQ ID NO: 702489 - DNA, 13 bp, C. elegans
atattctgaattc

SEQ ID NO: 702490 - DNA, 13 bp, C. elegans
atattctgatatt

SEQ ID NO: 702491 - DNA, 13 bp, C. elegans
atattctggtttt

SEQ ID NO: 702492 - DNA, 13 bp, C. elegans
atattctgtaaaa

SEQ ID NO: 702493 - DNA, 13 bp, C. elegans
atattcttattca

SEQ ID NO: 702494 - DNA, 13 bp, C. elegans
atattcttcaaat

SEQ ID NO: 702495 - DNA, 13 bp, C. elegans
atattcttcaatt

SEQ ID NO: 702496 - DNA, 13 bp, C. elegans
atattcttctaaa

SEQ ID NO: 702497 - DNA, 13 bp, C. elegans
atattcttgaatt

SEQ ID NO: 702498 - DNA, 14 bp, C. elegans
atattcttgagaag

SEQ ID NO: 702499 - DNA, 13 bp, C. elegans
atattcttgtatt

SEQ ID NO: 702500 - DNA, 13 bp, C. elegans
atattgaaaaatg

SEQ ID NO: 702501 - DNA, 13 bp, C. elegans
atattgaaaatca

SEQ ID NO: 702502 - DNA, 13 bp, C. elegans
atattgaaaatgt

SEQ ID NO: 702503 - DNA, 13 bp, C. elegans
atattgaaaattc

SEQ ID NO: 702504 - DNA, 13 bp, C. elegans
atattgaaactga

SEQ ID NO: 702505 - DNA, 13 bp, C. elegans
atattgaaacttt

SEQ ID NO: 702506 - DNA, 13 bp, C. elegans
atattgaaagttg

SEQ ID NO: 702507 - DNA, 13 bp, C. elegans
atattgaaagttt

SEQ ID NO: 702508 - DNA, 13 bp, C. elegans
atattgaaataga

SEQ ID NO: 702509 - DNA, 13 bp, C. elegans
atattgaaattga

SEQ ID NO: 702510 - DNA, 13 bp, C. elegans
atattgaacaaaa

SEQ ID NO: 702511 - DNA, 13 bp, C. elegans
atattgaacaaat

SEQ ID NO: 702512 - DNA, 13 bp, C. elegans
atattgaacattc

SEQ ID NO: 702513 - DNA, 13 bp, C. elegans
atattgaactttt

SEQ ID NO: 702514 - DNA, 13 bp, C. elegans
atattgaagattt

SEQ ID NO: 702515 - DNA, 13 bp, C. elegans
atattgaatttgg

SEQ ID NO: 702516 - DNA, 13 bp, C. elegans
atattgaatttgt

SEQ ID NO: 702517 - DNA, 13 bp, C. elegans
atattgacatttt

SEQ ID NO: 702518 - DNA, 13 bp, C. elegans
atattgataagaa

SEQ ID NO: 702519 - DNA, 13 bp, C. elegans
atattgataagca

SEQ ID NO: 702520 - DNA, 13 bp, C. elegans
atattgatagttt

SEQ ID NO: 702521 - DNA, 13 bp, C. elegans
atattgatattga

SEQ ID NO: 702522 - DNA, 13 bp, C. elegans
atattgatatttg

SEQ ID NO: 702523 - DNA, 13 bp, C. elegans
atattgatttctg

SEQ ID NO: 702524 - DNA, 13 bp, C. elegans
atattgattttca

SEQ ID NO: 702525 - DNA, 13 bp, C. elegans
atattgatttttc

SEQ ID NO: 702526 - DNA, 13 bp, C. elegans
atattgcaaaaaa

SEQ ID NO: 702527 - DNA, 13 bp, C. elegans
atattgcaacaaa

SEQ ID NO: 702528 - DNA, 13 bp, C. elegans
atattgcaatttt

SEQ ID NO: 702529 - DNA, 13 bp, C. elegans
atattgcattgac

SEQ ID NO: 702530 - DNA, 13 bp, C. elegans
atattgcattttc

SEQ ID NO: 702531 - DNA, 13 bp, C. elegans
atattgccgaaaa

SEQ ID NO: 702532 - DNA, 13 bp, C. elegans
atattgccggaaa

SEQ ID NO: 702533 - DNA, 13 bp, C. elegans
atattgcgaaaaa

SEQ ID NO: 702534 - DNA, 13 bp, C. elegans
atattgctgaaat

SEQ ID NO: 702535 - DNA, 13 bp, C. elegans
atattggaaacaa

SEQ ID NO: 702536 - DNA, 13 bp, C. elegans
atattggaaactt

SEQ ID NO: 702537 - DNA, 13 bp, C. elegans
atattggaaattg

SEQ ID NO: 702538 - DNA, 13 bp, C. elegans
atattggaagaaa

SEQ ID NO: 702539 - DNA, 13 bp, C. elegans
atattggaatttc

SEQ ID NO: 702540 - DNA, 13 bp, C. elegans
atattggcaattt

SEQ ID NO: 702541 - DNA, 13 bp, C. elegans
atattggtttgat

SEQ ID NO: 702542 - DNA, 13 bp, C. elegans
atattggtttgga

SEQ ID NO: 702543 - DNA, 13 bp, C. elegans
atattgtaaaagt

SEQ ID NO: 702544 - DNA, 13 bp, C. elegans
atattgtgaaaaa

SEQ ID NO: 702545 - DNA, 13 bp, C. elegans
atattgtgagaaa

SEQ ID NO: 702546 - DNA, 13 bp, C. elegans
atattgttcaaaa

SEQ ID NO: 702547 - DNA, 13 bp, C. elegans
atattgttcattg

SEQ ID NO: 702548 - DNA, 13 bp, C. elegans
atattgttgaaaa

SEQ ID NO: 702549 - DNA, 13 bp, C. elegans
atatttaatggaa

SEQ ID NO: 702550 - DNA, 13 bp, C. elegans
atatttactgttt

SEQ ID NO: 702551 - DNA, 13 bp, C. elegans
atatttagaaaac

SEQ ID NO: 702552 - DNA, 13 bp, C. elegans
atatttagttcaa

SEQ ID NO: 702553 - DNA, 15 bp, C. elegans
atatttatcgatttt

SEQ ID NO: 702554 - DNA, 13 bp, C. elegans
atatttatgttca

SEQ ID NO: 702555 - DNA, 13 bp, C. elegans
atatttattcaac

SEQ ID NO: 702556 - DNA, 13 bp, C. elegans
atatttattggaa

SEQ ID NO: 702557 - DNA, 13 bp, C. elegans
atatttattggca

SEQ ID NO: 702558 - DNA, 13 bp, C. elegans
atatttatttcag

SEQ ID NO: 702559 - DNA, 13 bp, C. elegans
atatttattttgc

SEQ ID NO: 702560 - DNA, 13 bp, C. elegans
atatttcaaaaag

SEQ ID NO: 702561 - DNA, 13 bp, C. elegans
atatttcaaaatc

SEQ ID NO: 702562 - DNA, 13 bp, C. elegans
atatttcaaagtg

SEQ ID NO: 702563 - DNA, 13 bp, C. elegans
atatttcaagaaa

SEQ ID NO: 702564 - DNA, 13 bp, C. elegans
atatttcaagata

SEQ ID NO: 702565 - DNA, 13 bp, C. elegans
atatttcaagatt

SEQ ID NO: 702566 - DNA, 13 bp, C. elegans
atatttcaagttt

SEQ ID NO: 702567 - DNA, 13 bp, C. elegans
atatttcaatatg

SEQ ID NO: 702568 - DNA, 13 bp, C. elegans
atatttcaatgtt

SEQ ID NO: 702569 - DNA, 13 bp, C. elegans
atatttcaattgt

SEQ ID NO: 702570 - DNA, 13 bp, C. elegans
atatttcacaata

SEQ ID NO: 702571 - DNA, 13 bp, C. elegans
atatttcactctc

SEQ ID NO: 702572 - DNA, 13 bp, C. elegans
atatttcactgaa

SEQ ID NO: 702573 - DNA, 13 bp, C. elegans
atatttcagaaaa

SEQ ID NO: 702574 - DNA, 13 bp, C. elegans
atatttcagatta

SEQ ID NO: 702575 - DNA, 13 bp, C. elegans
atatttcagcaaa

SEQ ID NO: 702576 - DNA, 13 bp, C. elegans
atatttcatagat

SEQ ID NO: 702577 - DNA, 13 bp, C. elegans
atatttcatcaaa

SEQ ID NO: 702578 - DNA, 13 bp, C. elegans
atatttcattgtt

SEQ ID NO: 702579 - DNA, 13 bp, C. elegans
atatttcatttca

SEQ ID NO: 702580 - DNA, 13 bp, C. elegans
atatttccaaaaa

SEQ ID NO: 702581 - DNA, 13 bp, C. elegans
atatttccaataa

SEQ ID NO: 702582 - DNA, 13 bp, C. elegans
atatttccaatac

SEQ ID NO: 702583 - DNA, 13 bp, C. elegans
atatttccaatat

SEQ ID NO: 702584 - DNA, 13 bp, C. elegans
atatttccagatt

SEQ ID NO: 702585 - DNA, 13 bp, C. elegans
atatttccccaca

SEQ ID NO: 702586 - DNA, 13 bp, C. elegans
atatttccgaaaa

SEQ ID NO: 702587 - DNA, 13 bp, C. elegans
atatttccgataa

SEQ ID NO: 702588 - DNA, 13 bp, C. elegans
atatttcctcaaa

SEQ ID NO: 702589 - DNA, 13 bp, C. elegans
atatttcgaaaat

SEQ ID NO: 702590 - DNA, 13 bp, C. elegans
atatttcgaagaa

SEQ ID NO: 702591 - DNA, 13 bp, C. elegans
atatttcgcaaaa

SEQ ID NO: 702592 - DNA, 13 bp, C. elegans
atatttcgcaaca

SEQ ID NO: 702593 - DNA, 13 bp, C. elegans
atatttcgtaatt

SEQ ID NO: 702594 - DNA, 13 bp, C. elegans
atatttcgtttca

SEQ ID NO: 702595 - DNA, 13 bp, C. elegans
atatttctacaaa

SEQ ID NO: 702596 - DNA, 13 bp, C. elegans
atatttctacaat

SEQ ID NO: 702597 - DNA, 13 bp, C. elegans
atatttctagaaa

SEQ ID NO: 702598 - DNA, 13 bp, C. elegans
atatttctagatt

SEQ ID NO: 702599 - DNA, 13 bp, C. elegans
atatttctatgtt

SEQ ID NO: 702600 - DNA, 13 bp, C. elegans
atatttctcaaat

SEQ ID NO: 702601 - DNA, 13 bp, C. elegans
atatttctcaatt

SEQ ID NO: 702602 - DNA, 13 bp, C. elegans
atatttctcatta

SEQ ID NO: 702603 - DNA, 13 bp, C. elegans
atatttctctaaa

SEQ ID NO: 702604 - DNA, 13 bp, C. elegans
atatttctgaatt

SEQ ID NO: 702605 - DNA, 13 bp, C. elegans
atatttctgatca

SEQ ID NO: 702606 - DNA, 13 bp, C. elegans
atatttctgatga

SEQ ID NO: 702607 - DNA, 13 bp, C. elegans
atatttctgatta

SEQ ID NO: 702608 - DNA, 13 bp, C. elegans
atatttctgcaaa

SEQ ID NO: 702609 - DNA, 13 bp, C. elegans
atatttctggaaa

SEQ ID NO: 702610 - DNA, 13 bp, C. elegans
atatttcttcaaa

SEQ ID NO: 702611 - DNA, 13 bp, C. elegans
atatttcttgatt

SEQ ID NO: 702612 - DNA, 13 bp, C. elegans
atatttgaaacat

SEQ ID NO: 702613 - DNA, 13 bp, C. elegans
atatttgaaactt

SEQ ID NO: 702614 - DNA, 13 bp, C. elegans
atatttgaaatgt

SEQ ID NO: 702615 - DNA, 13 bp, C. elegans
atatttgaacaaa

SEQ ID NO: 702616 - DNA, 13 bp, C. elegans
atatttgaacaac

SEQ ID NO: 702617 - DNA, 13 bp, C. elegans
atatttgaaggga

SEQ ID NO: 702618 - DNA, 13 bp, C. elegans
atatttgaatcag

SEQ ID NO: 702619 - DNA, 13 bp, C. elegans
atatttgaatgaa

SEQ ID NO: 702620 - DNA, 13 bp, C. elegans
atatttgacaatt

SEQ ID NO: 702621 - DNA, 13 bp, C. elegans
atatttgacattt

SEQ ID NO: 702622 - DNA, 13 bp, C. elegans
atatttgactttt

SEQ ID NO: 702623 - DNA, 13 bp, C. elegans
atatttgagaaat

SEQ ID NO: 702624 - DNA, 13 bp, C. elegans
atatttgagaatt

SEQ ID NO: 702625 - DNA, 13 bp, C. elegans
atatttgagagct

SEQ ID NO: 702626 - DNA, 13 bp, C. elegans
atatttgatttga

SEQ ID NO: 702627 - DNA, 13 bp, C. elegans
atatttgcaagaa

SEQ ID NO: 702628 - DNA, 13 bp, C. elegans
atatttgcatatt

SEQ ID NO: 702629 - DNA, 13 bp, C. elegans
atatttgcatttt

SEQ ID NO: 702630 - DNA, 13 bp, C. elegans
atatttgccaaat

SEQ ID NO: 702631 - DNA, 13 bp, C. elegans
atatttgccaatt

SEQ ID NO: 702632 - DNA, 13 bp, C. elegans
atatttgctttat

SEQ ID NO: 702633 - DNA, 13 bp, C. elegans
atatttggaaaag

SEQ ID NO: 702634 - DNA, 13 bp, C. elegans
atatttggaaaat

SEQ ID NO: 702635 - DNA, 13 bp, C. elegans
atatttggaagaa

SEQ ID NO: 702636 - DNA, 13 bp, C. elegans
atatttggcaaaa

SEQ ID NO: 702637 - DNA, 13 bp, C. elegans
atatttggcattt

SEQ ID NO: 702638 - DNA, 13 bp, C. elegans
atatttggttcaa

SEQ ID NO: 702639 - DNA, 13 bp, C. elegans
atatttggttgtg

SEQ ID NO: 702640 - DNA, 13 bp, C. elegans
atatttgtgaaac

SEQ ID NO: 702641 - DNA, 13 bp, C. elegans
atatttgtgaaat

SEQ ID NO: 702642 - DNA, 13 bp, C. elegans
atatttgttatct

SEQ ID NO: 702643 - DNA, 13 bp, C. elegans
atatttgttcaaa

SEQ ID NO: 702644 - DNA, 13 bp, C. elegans
atatttgttccaa

SEQ ID NO: 702645 - DNA, 13 bp, C. elegans
atatttgttctga

SEQ ID NO: 702646 - DNA, 13 bp, C. elegans
atatttgttgaaa

SEQ ID NO: 702647 - DNA, 13 bp, C. elegans
atatttgttgata

SEQ ID NO: 702648 - DNA, 13 bp, C. elegans
atattttaaacca

SEQ ID NO: 702649 - DNA, 13 bp, C. elegans
atattttacagat

SEQ ID NO: 702650 - DNA, 13 bp, C. elegans
atattttactctc

SEQ ID NO: 702651 - DNA, 13 bp, C. elegans
atattttagagaa

SEQ ID NO: 702652 - DNA, 13 bp, C. elegans
atattttatgcat

SEQ ID NO: 702653 - DNA, 13 bp, C. elegans
atattttcaaatg

SEQ ID NO: 702654 - DNA, 13 bp, C. elegans
atattttcacaaa

SEQ ID NO: 702655 - DNA, 13 bp, C. elegans
atattttcacaga

SEQ ID NO: 702656 - DNA, 14 bp, C. elegans
atattttcactgtt

SEQ ID NO: 702657 - DNA, 13 bp, C. elegans
atattttcagaaa

SEQ ID NO: 702658 - DNA, 13 bp, C. elegans
atattttcagaat

SEQ ID NO: 702659 - DNA, 13 bp, C. elegans
atattttcagatg

SEQ ID NO: 702660 - DNA, 13 bp, C. elegans
atattttcagttt

SEQ ID NO: 702661 - DNA, 13 bp, C. elegans
atattttcatgtt

SEQ ID NO: 702662 - DNA, 13 bp, C. elegans
atattttcattac

SEQ ID NO: 702663 - DNA, 13 bp, C. elegans
atattttcattca

SEQ ID NO: 702664 - DNA, 13 bp, C. elegans
atattttccaaat

SEQ ID NO: 702665 - DNA, 13 bp, C. elegans
atattttccaatt

SEQ ID NO: 702666 - DNA, 13 bp, C. elegans
atattttccatta

SEQ ID NO: 702667 - DNA, 13 bp, C. elegans
atattttccgttt

SEQ ID NO: 702668 - DNA, 13 bp, C. elegans
atattttcctgaa

SEQ ID NO: 702669 - DNA, 13 bp, C. elegans
atattttcgaaaa

SEQ ID NO: 702670 - DNA, 13 bp, C. elegans
atattttcgagtc

SEQ ID NO: 702671 - DNA, 13 bp, C. elegans
atattttcggaat

SEQ ID NO: 702672 - DNA, 13 bp, C. elegans
atattttcggttt

SEQ ID NO: 702673 - DNA, 13 bp, C. elegans
atattttctaatc

SEQ ID NO: 702674 - DNA, 13 bp, C. elegans
atattttctatgt

SEQ ID NO: 702675 - DNA, 13 bp, C. elegans
atattttctcact

SEQ ID NO: 702676 - DNA, 13 bp, C. elegans
atattttctcagt

SEQ ID NO: 702677 - DNA, 13 bp, C. elegans
atattttctcatc

SEQ ID NO: 702678 - DNA, 13 bp, C. elegans
atattttctcgtt

SEQ ID NO: 702679 - DNA, 13 bp, C. elegans
atattttctctca

SEQ ID NO: 702680 - DNA, 13 bp, C. elegans
atattttctgaaa

SEQ ID NO: 702681 - DNA, 13 bp, C. elegans
atattttctgaat

SEQ ID NO: 702682 - DNA, 13 bp, C. elegans
atattttctgatc

SEQ ID NO: 702683 - DNA, 13 bp, C. elegans
atattttctggaa

SEQ ID NO: 702684 - DNA, 13 bp, C. elegans
atattttctggat

SEQ ID NO: 702685 - DNA, 13 bp, C. elegans
atattttctggtt

SEQ ID NO: 702686 - DNA, 13 bp, C. elegans
atattttctgtca

SEQ ID NO: 702687 - DNA, 13 bp, C. elegans
atattttgaaaag

SEQ ID NO: 702688 - DNA, 13 bp, C. elegans
atattttgaaaga

SEQ ID NO: 702689 - DNA, 13 bp, C. elegans
atattttgaaatc

SEQ ID NO: 702690 - DNA, 13 bp, C. elegans
atattttgaacaa

SEQ ID NO: 702691 - DNA, 13 bp, C. elegans
atattttgacaaa

SEQ ID NO: 702692 - DNA, 13 bp, C. elegans
atattttgacaac

SEQ ID NO: 702693 - DNA, 13 bp, C. elegans
atattttgacatt

SEQ ID NO: 702694 - DNA, 13 bp, C. elegans
atattttgacttt

SEQ ID NO: 702695 - DNA, 13 bp, C. elegans
atattttgagaaa

SEQ ID NO: 702696 - DNA, 13 bp, C. elegans
atattttgagcca

SEQ ID NO: 702697 - DNA, 13 bp, C. elegans
atattttgatact

SEQ ID NO: 702698 - DNA, 13 bp, C. elegans
atattttgcaaat

SEQ ID NO: 702699 - DNA, 13 bp, C. elegans
atattttgcataa

SEQ ID NO: 702700 - DNA, 13 bp, C. elegans
atattttgcattt

SEQ ID NO: 702701 - DNA, 13 bp, C. elegans
atattttgccaaa

SEQ ID NO: 702702 - DNA, 13 bp, C. elegans
atattttggaaat

SEQ ID NO: 702703 - DNA, 13 bp, C. elegans
atattttggaaca

SEQ ID NO: 702704 - DNA, 13 bp, C. elegans
atattttggagag

SEQ ID NO: 702705 - DNA, 13 bp, C. elegans
atattttggtctt

SEQ ID NO: 702706 - DNA, 13 bp, C. elegans
atattttgtaagt

SEQ ID NO: 702707 - DNA, 13 bp, C. elegans
atattttgtagat

SEQ ID NO: 702708 - DNA, 13 bp, C. elegans
atattttgtcatt

SEQ ID NO: 702709 - DNA, 13 bp, C. elegans
atattttgtgaaa

SEQ ID NO: 702710 - DNA, 13 bp, C. elegans
atattttgtgcaa

SEQ ID NO: 702711 - DNA, 13 bp, C. elegans
atattttgttcgt

SEQ ID NO: 702712 - DNA, 13 bp, C. elegans
atattttgttgaa

SEQ ID NO: 702713 - DNA, 13 bp, C. elegans
atatttttagatc

SEQ ID NO: 702714 - DNA, 13 bp, C. elegans
atatttttcaact

SEQ ID NO: 702715 - DNA, 13 bp, C. elegans
atatttttcagaa

SEQ ID NO: 702716 - DNA, 13 bp, C. elegans
atatttttccaga

SEQ ID NO: 702717 - DNA, 13 bp, C. elegans
atatttttccgaa

SEQ ID NO: 702718 - DNA, 13 bp, C. elegans
atatttttctaca

SEQ ID NO: 702719 - DNA, 13 bp, C. elegans
atatttttcttga

SEQ ID NO: 702720 - DNA, 13 bp, C. elegans
atatttttgagaa

SEQ ID NO: 702721 - DNA, 13 bp, C. elegans
atatttttgcaaa

SEQ ID NO: 702722 - DNA, 13 bp, C. elegans
atatttttgcatt

SEQ ID NO: 702723 - DNA, 13 bp, C. elegans
atatttttgctgt

SEQ ID NO: 702724 - DNA, 13 bp, C. elegans
atatttttggaaa

SEQ ID NO: 702725 - DNA, 13 bp, C. elegans
atatttttggtca

SEQ ID NO: 702726 - DNA, 13 bp, C. elegans
atatttttgtcaa

SEQ ID NO: 702727 - DNA, 13 bp, C. elegans
atatttttgtgag

SEQ ID NO: 702728 - DNA, 13 bp, C. elegans
atatttttgtgca

SEQ ID NO: 702729 - DNA, 13 bp, C. elegans
atatttttgttca

SEQ ID NO: 702730 - DNA, 13 bp, C. elegans
atattttttcaac

SEQ ID NO: 702731 - DNA, 13 bp, C. elegans
atattttttcgat

SEQ ID NO: 702732 - DNA, 13 bp, C. elegans
atattttttcgca

SEQ ID NO: 702733 - DNA, 13 bp, C. elegans
atattttttctgg

SEQ ID NO: 702734 - DNA, 13 bp, C. elegans
atattttttgaag

SEQ ID NO: 702735 - DNA, 13 bp, C. elegans
atattttttgaca

SEQ ID NO: 702736 - DNA, 13 bp, C. elegans
atattttttgagc

SEQ ID NO: 702737 - DNA, 13 bp, C. elegans
atatttttttcga

SEQ ID NO: 702738 - DNA, 13 bp, C. elegans
atcaaaaaaagtt

SEQ ID NO: 702739 - DNA, 13 bp, C. elegans
atcaaaaaaggtt

SEQ ID NO: 702740 - DNA, 13 bp, C. elegans
atcaaaaaatccc

SEQ ID NO: 702741 - DNA, 13 bp, C. elegans
atcaaaaaatgtt

SEQ ID NO: 702742 - DNA, 13 bp, C. elegans
atcaaaaaccaga

SEQ ID NO: 702743 - DNA, 13 bp, C. elegans
atcaaaaactcac

SEQ ID NO: 702744 - DNA, 13 bp, C. elegans
atcaaaaactgat

SEQ ID NO: 702745 - DNA, 13 bp, C. elegans
atcaaaaactgca

SEQ ID NO: 702746 - DNA, 13 bp, C. elegans
atcaaaaacttca

SEQ ID NO: 702747 - DNA, 13 bp, C. elegans
atcaaaaactttc

SEQ ID NO: 702748 - DNA, 13 bp, C. elegans
atcaaaaactttg

SEQ ID NO: 702749 - DNA, 14 bp, C. elegans
atcaaaaagtatca

SEQ ID NO: 702750 - DNA, 13 bp, C. elegans
atcaaaaagtcat

SEQ ID NO: 702751 - DNA, 13 bp, C. elegans
atcaaaaagtctt

SEQ ID NO: 702752 - DNA, 13 bp, C. elegans
atcaaaaagtgat

SEQ ID NO: 702753 - DNA, 13 bp, C. elegans
atcaaaaagttat

SEQ ID NO: 702754 - DNA, 13 bp, C. elegans
atcaaaaagttga

SEQ ID NO: 702755 - DNA, 13 bp, C. elegans
atcaaaaagttgc

SEQ ID NO: 702756 - DNA, 13 bp, C. elegans
atcaaaaagttgt

SEQ ID NO: 702757 - DNA, 13 bp, C. elegans
atcaaaaagttta

SEQ ID NO: 702758 - DNA, 13 bp, C. elegans
atcaaaaagtttt

SEQ ID NO: 702759 - DNA, 13 bp, C. elegans
atcaaaaatcatc

SEQ ID NO: 702760 - DNA, 13 bp, C. elegans
atcaaaaatcggt

SEQ ID NO: 702761 - DNA, 13 bp, C. elegans
atcaaaaatcttc

SEQ ID NO: 702762 - DNA, 13 bp, C. elegans
atcaaaaatgaga

SEQ ID NO: 702763 - DNA, 13 bp, C. elegans
atcaaaaatgcaa

SEQ ID NO: 702764 - DNA, 13 bp, C. elegans
atcaaaaatgcat

SEQ ID NO: 702765 - DNA, 13 bp, C. elegans
atcaaaaatgtaa

SEQ ID NO: 702766 - DNA, 13 bp, C. elegans
atcaaaaatgtct

SEQ ID NO: 702767 - DNA, 13 bp, C. elegans
atcaaaaatgttc

SEQ ID NO: 702768 - DNA, 13 bp, C. elegans
atcaaaaattcat

SEQ ID NO: 702769 - DNA, 13 bp, C. elegans
atcaaaaattccg

SEQ ID NO: 702770 - DNA, 13 bp, C. elegans
atcaaaaattgaa

SEQ ID NO: 702771 - DNA, 13 bp, C. elegans
atcaaaaattgct

SEQ ID NO: 702772 - DNA, 13 bp, C. elegans
atcaaaaatttca

SEQ ID NO: 702773 - DNA, 13 bp, C. elegans
atcaaaaatttct

SEQ ID NO: 702774 - DNA, 13 bp, C. elegans
atcaaaaatttga

SEQ ID NO: 702775 - DNA, 13 bp, C. elegans
atcaaaacattgt

SEQ ID NO: 702776 - DNA, 13 bp, C. elegans
atcaaaacatttt

SEQ ID NO: 702777 - DNA, 13 bp, C. elegans
atcaaaaccgaaa

SEQ ID NO: 702778 - DNA, 13 bp, C. elegans
atcaaaacgaaat

SEQ ID NO: 702779 - DNA, 13 bp, C. elegans
atcaaaacgtttt

SEQ ID NO: 702780 - DNA, 13 bp, C. elegans
atcaaaactttga

SEQ ID NO: 702781 - DNA, 13 bp, C. elegans
atcaaaagatttt

SEQ ID NO: 702782 - DNA, 13 bp, C. elegans
atcaaaagtcaaa

SEQ ID NO: 702783 - DNA, 13 bp, C. elegans
atcaaaagtgaaa

SEQ ID NO: 702784 - DNA, 13 bp, C. elegans
atcaaaagttaca

SEQ ID NO: 702785 - DNA, 13 bp, C. elegans
atcaaaagttcaa

SEQ ID NO: 702786 - DNA, 13 bp, C. elegans
atcaaaagttgaa

SEQ ID NO: 702787 - DNA, 13 bp, C. elegans
atcaaaagttgta

SEQ ID NO: 702788 - DNA, 13 bp, C. elegans
atcaaaatatgaa

SEQ ID NO: 702789 - DNA, 13 bp, C. elegans
atcaaaatcaaga

SEQ ID NO: 702790 - DNA, 13 bp, C. elegans
atcaaaatcattt

SEQ ID NO: 702791 - DNA, 13 bp, C. elegans
atcaaaatccaat

SEQ ID NO: 702792 - DNA, 13 bp, C. elegans
atcaaaatcttga

SEQ ID NO: 702793 - DNA, 13 bp, C. elegans
atcaaaatgaaag

SEQ ID NO: 702794 - DNA, 13 bp, C. elegans
atcaaaatgaaca

SEQ ID NO: 702795 - DNA, 13 bp, C. elegans
atcaaaatgagat

SEQ ID NO: 702796 - DNA, 13 bp, C. elegans
atcaaaatgattt

SEQ ID NO: 702797 - DNA, 13 bp, C. elegans
atcaaaatgcaaa

SEQ ID NO: 702798 - DNA, 13 bp, C. elegans
atcaaaatggaaa

SEQ ID NO: 702799 - DNA, 13 bp, C. elegans
atcaaaatgtatt

SEQ ID NO: 702800 - DNA, 13 bp, C. elegans
atcaaaatgttaa

SEQ ID NO: 702801 - DNA, 13 bp, C. elegans
atcaaaatgttgc

SEQ ID NO: 702802 - DNA, 13 bp, C. elegans
atcaaaattattg

SEQ ID NO: 702803 - DNA, 13 bp, C. elegans
atcaaaattggat

SEQ ID NO: 702804 - DNA, 13 bp, C. elegans
atcaaaattgttt

SEQ ID NO: 702805 - DNA, 13 bp, C. elegans
atcaaaatttcat

SEQ ID NO: 702806 - DNA, 13 bp, C. elegans
atcaaaatttgaa

SEQ ID NO: 702807 - DNA, 13 bp, C. elegans
atcaaacaattgt

SEQ ID NO: 702808 - DNA, 13 bp, C. elegans
atcaaacaatttc

SEQ ID NO: 702809 - DNA, 13 bp, C. elegans
atcaaacacatag

SEQ ID NO: 702810 - DNA, 13 bp, C. elegans
atcaaacagtaat

SEQ ID NO: 702811 - DNA, 13 bp, C. elegans
atcaaacatatta

SEQ ID NO: 702812 - DNA, 13 bp, C. elegans
atcaaacatcgaa

SEQ ID NO: 702813 - DNA, 13 bp, C. elegans
atcaaacattatt

SEQ ID NO: 702814 - DNA, 13 bp, C. elegans
atcaaacatttct

SEQ ID NO: 702815 - DNA, 13 bp, C. elegans
atcaaaccaacat

SEQ ID NO: 702816 - DNA, 13 bp, C. elegans
atcaaacgaaaac

SEQ ID NO: 702817 - DNA, 13 bp, C. elegans
atcaaactttaat

SEQ ID NO: 702818 - DNA, 13 bp, C. elegans
atcaaacttttgt

SEQ ID NO: 702819 - DNA, 13 bp, C. elegans
atcaaagaatttt

SEQ ID NO: 702820 - DNA, 13 bp, C. elegans
atcaaagatcaaa

SEQ ID NO: 702821 - DNA, 13 bp, C. elegans
atcaaagcaaatt

SEQ ID NO: 702822 - DNA, 13 bp, C. elegans
atcaaagcgaaat

SEQ ID NO: 702823 - DNA, 13 bp, C. elegans
atcaaagtagatc

SEQ ID NO: 702824 - DNA, 13 bp, C. elegans
atcaaagttattt

SEQ ID NO: 702825 - DNA, 13 bp, C. elegans
atcaaagtttaac

SEQ ID NO: 702826 - DNA, 13 bp, C. elegans
atcaaataaattc

SEQ ID NO: 702827 - DNA, 13 bp, C. elegans
atcaaataattga

SEQ ID NO: 702828 - DNA, 13 bp, C. elegans
atcaaatacattt

SEQ ID NO: 702829 - DNA, 13 bp, C. elegans
atcaaatatacca

SEQ ID NO: 702830 - DNA, 13 bp, C. elegans
atcaaatatcata

SEQ ID NO: 702831 - DNA, 13 bp, C. elegans
atcaaatatgaaa

SEQ ID NO: 702832 - DNA, 13 bp, C. elegans
atcaaatattcaa

SEQ ID NO: 702833 - DNA, 13 bp, C. elegans
atcaaatatttgt

SEQ ID NO: 702834 - DNA, 13 bp, C. elegans
atcaaatcaaatc

SEQ ID NO: 702835 - DNA, 13 bp, C. elegans
atcaaatcaatca

SEQ ID NO: 702836 - DNA, 13 bp, C. elegans
atcaaatcaattt

SEQ ID NO: 702837 - DNA, 13 bp, C. elegans
atcaaatcgaaaa

SEQ ID NO: 702838 - DNA, 13 bp, C. elegans
atcaaatcgaaat

SEQ ID NO: 702839 - DNA, 13 bp, C. elegans
atcaaatcgtttt

SEQ ID NO: 702840 - DNA, 13 bp, C. elegans
atcaaatgatttt

SEQ ID NO: 702841 - DNA, 13 bp, C. elegans
atcaaatgttaat

SEQ ID NO: 702842 - DNA, 13 bp, C. elegans
atcaaattaacat

SEQ ID NO: 702843 - DNA, 13 bp, C. elegans
atcaaattatgaa

SEQ ID NO: 702844 - DNA, 13 bp, C. elegans
atcaaattcccat

SEQ ID NO: 702845 - DNA, 13 bp, C. elegans
atcaaattcgaaa

SEQ ID NO: 702846 - DNA, 13 bp, C. elegans
atcaaattgataa

SEQ ID NO: 702847 - DNA, 13 bp, C. elegans
atcaaattgcgat

SEQ ID NO: 702848 - DNA, 13 bp, C. elegans
atcaaattggaaa

SEQ ID NO: 702849 - DNA, 13 bp, C. elegans
atcaaattgtaaa

SEQ ID NO: 702850 - DNA, 13 bp, C. elegans
atcaaattgtgtg

SEQ ID NO: 702851 - DNA, 13 bp, C. elegans
atcaaatttcgaa

SEQ ID NO: 702852 - DNA, 13 bp, C. elegans
atcaaatttgtca

SEQ ID NO: 702853 - DNA, 13 bp, C. elegans
atcaaattttcaa

SEQ ID NO: 702854 - DNA, 13 bp, C. elegans
atcaaatttttcc

SEQ ID NO: 702855 - DNA, 13 bp, C. elegans
atcaacaaatatt

SEQ ID NO: 702856 - DNA, 13 bp, C. elegans
atcaacaaattgc

SEQ ID NO: 702857 - DNA, 13 bp, C. elegans
atcaacaacagaa

SEQ ID NO: 702858 - DNA, 13 bp, C. elegans
atcaacaatattt

SEQ ID NO: 702859 - DNA, 13 bp, C. elegans
atcaacaattttg

SEQ ID NO: 702860 - DNA, 13 bp, C. elegans
atcaacagcttct

SEQ ID NO: 702861 - DNA, 13 bp, C. elegans
atcaacatcatca

SEQ ID NO: 702862 - DNA, 13 bp, C. elegans
atcaacattaata

SEQ ID NO: 702863 - DNA, 13 bp, C. elegans
atcaacatttatt

SEQ ID NO: 702864 - DNA, 13 bp, C. elegans
atcaacatttttc

SEQ ID NO: 702865 - DNA, 13 bp, C. elegans
atcaacctattca

SEQ ID NO: 702866 - DNA, 13 bp, C. elegans
atcaacgaaataa

SEQ ID NO: 702867 - DNA, 13 bp, C. elegans
atcaacgaatttc

SEQ ID NO: 702868 - DNA, 13 bp, C. elegans
atcaacgattttt

SEQ ID NO: 702869 - DNA, 13 bp, C. elegans
atcaacgtgtatt

SEQ ID NO: 702870 - DNA, 13 bp, C. elegans
atcaactacagta

SEQ ID NO: 702871 - DNA, 13 bp, C. elegans
atcaactgacaaa

SEQ ID NO: 702872 - DNA, 13 bp, C. elegans
atcaacttcaaaa

SEQ ID NO: 702873 - DNA, 13 bp, C. elegans
atcaactttaaaa

SEQ ID NO: 702874 - DNA, 13 bp, C. elegans
atcaactttcaat

SEQ ID NO: 702875 - DNA, 13 bp, C. elegans
atcaacttttaaa

SEQ ID NO: 702876 - DNA, 13 bp, C. elegans
atcaacttttctt

SEQ ID NO: 702877 - DNA, 13 bp, C. elegans
atcaacttttgtt

SEQ ID NO: 702878 - DNA, 13 bp, C. elegans
atcaagaaaaact

SEQ ID NO: 702879 - DNA, 13 bp, C. elegans
atcaagaaaaagt

SEQ ID NO: 702880 - DNA, 13 bp, C. elegans
atcaagaaaatca

SEQ ID NO: 702881 - DNA, 13 bp, C. elegans
atcaagaaacttt

SEQ ID NO: 702882 - DNA, 13 bp, C. elegans
atcaagaaatatt

SEQ ID NO: 702883 - DNA, 13 bp, C. elegans
atcaagaaatttt

SEQ ID NO: 702884 - DNA, 13 bp, C. elegans
atcaagacgtttt

SEQ ID NO: 702885 - DNA, 13 bp, C. elegans
atcaagattttca

SEQ ID NO: 702886 - DNA, 13 bp, C. elegans
atcaagccgaaat

SEQ ID NO: 702887 - DNA, 13 bp, C. elegans
atcaagtatgaaa

SEQ ID NO: 702888 - DNA, 13 bp, C. elegans
atcaagtgaaaag

SEQ ID NO: 702889 - DNA, 13 bp, C. elegans
atcaagttttcca

SEQ ID NO: 702890 - DNA, 13 bp, C. elegans
atcaagttttctt

SEQ ID NO: 702891 - DNA, 13 bp, C. elegans
atcaagttttttt

SEQ ID NO: 702892 - DNA, 13 bp, C. elegans
atcaataaaatga

SEQ ID NO: 702893 - DNA, 13 bp, C. elegans
atcaataaaattc

SEQ ID NO: 702894 - DNA, 13 bp, C. elegans
atcaataaatcga

SEQ ID NO: 702895 - DNA, 13 bp, C. elegans
atcaataaatgat

SEQ ID NO: 702896 - DNA, 13 bp, C. elegans
atcaataaatttg

SEQ ID NO: 702897 - DNA, 13 bp, C. elegans
atcaataacattt

SEQ ID NO: 702898 - DNA, 13 bp, C. elegans
atcaataacttca

SEQ ID NO: 702899 - DNA, 13 bp, C. elegans
atcaataatcaat

SEQ ID NO: 702900 - DNA, 13 bp, C. elegans
atcaataattatc

SEQ ID NO: 702901 - DNA, 13 bp, C. elegans
atcaataatttca

SEQ ID NO: 702902 - DNA, 13 bp, C. elegans
atcaataatttgc

SEQ ID NO: 702903 - DNA, 13 bp, C. elegans
atcaataatttgt

SEQ ID NO: 702904 - DNA, 13 bp, C. elegans
atcaataattttc

SEQ ID NO: 702905 - DNA, 13 bp, C. elegans
atcaataattttg

SEQ ID NO: 702906 - DNA, 13 bp, C. elegans
atcaatacatttt

SEQ ID NO: 702907 - DNA, 13 bp, C. elegans
atcaatacgagta

SEQ ID NO: 702908 - DNA, 13 bp, C. elegans
atcaatagtttta

SEQ ID NO: 702909 - DNA, 13 bp, C. elegans
atcaatagttttg

SEQ ID NO: 702910 - DNA, 13 bp, C. elegans
atcaatattatca

SEQ ID NO: 702911 - DNA, 13 bp, C. elegans
atcaatattccag

SEQ ID NO: 702912 - DNA, 13 bp, C. elegans
atcaatattcttt

SEQ ID NO: 702913 - DNA, 13 bp, C. elegans
atcaatatttcga

SEQ ID NO: 702914 - DNA, 13 bp, C. elegans
atcaatattttct

SEQ ID NO: 702915 - DNA, 13 bp, C. elegans
atcaatattttgt

SEQ ID NO: 702916 - DNA, 13 bp, C. elegans
atcaatatttttc

SEQ ID NO: 702917 - DNA, 13 bp, C. elegans
atcaatatttttg

SEQ ID NO: 702918 - DNA, 13 bp, C. elegans
atcaatcaaaact

SEQ ID NO: 702919 - DNA, 13 bp, C. elegans
atcaatcaattca

SEQ ID NO: 702920 - DNA, 13 bp, C. elegans
atcaatcaattga

SEQ ID NO: 702921 - DNA, 13 bp, C. elegans
atcaatcaatttc

SEQ ID NO: 702922 - DNA, 13 bp, C. elegans
atcaatcaatttt

SEQ ID NO: 702923 - DNA, 13 bp, C. elegans
atcaatcattttc

SEQ ID NO: 702924 - DNA, 13 bp, C. elegans
atcaatgaaaaag

SEQ ID NO: 702925 - DNA, 13 bp, C. elegans
atcaatgaaattc

SEQ ID NO: 702926 - DNA, 13 bp, C. elegans
atcaatgaaattt

SEQ ID NO: 702927 - DNA, 13 bp, C. elegans
atcaatgattttc

SEQ ID NO: 702928 - DNA, 13 bp, C. elegans
atcaatgattttt

SEQ ID NO: 702929 - DNA, 13 bp, C. elegans
atcaatgcaccat

SEQ ID NO: 702930 - DNA, 13 bp, C. elegans
atcaatggaaatt

SEQ ID NO: 702931 - DNA, 13 bp, C. elegans
atcaatgggaaaa

SEQ ID NO: 702932 - DNA, 13 bp, C. elegans
atcaatgtatttt

SEQ ID NO: 702933 - DNA, 13 bp, C. elegans
atcaatgtttatt

SEQ ID NO: 702934 - DNA, 13 bp, C. elegans
atcaatgttttgt

SEQ ID NO: 702935 - DNA, 13 bp, C. elegans
atcaattaagttt

SEQ ID NO: 702936 - DNA, 13 bp, C. elegans
atcaattatcaat

SEQ ID NO: 702937 - DNA, 13 bp, C. elegans
atcaattcaaaat

SEQ ID NO: 702938 - DNA, 13 bp, C. elegans
atcaattcaaact

SEQ ID NO: 702939 - DNA, 13 bp, C. elegans
atcaattccatct

SEQ ID NO: 702940 - DNA, 13 bp, C. elegans
atcaattgaaatt

SEQ ID NO: 702941 - DNA, 13 bp, C. elegans
atcaattgaactt

SEQ ID NO: 702942 - DNA, 13 bp, C. elegans
atcaattgatcaa

SEQ ID NO: 702943 - DNA, 13 bp, C. elegans
atcaattgttcaa

SEQ ID NO: 702944 - DNA, 13 bp, C. elegans
atcaattgttttg

SEQ ID NO: 702945 - DNA, 13 bp, C. elegans
atcaattgttttt

SEQ ID NO: 702946 - DNA, 13 bp, C. elegans
atcaatttcaatt

SEQ ID NO: 702947 - DNA, 13 bp, C. elegans
atcaatttcacgt

SEQ ID NO: 702948 - DNA, 13 bp, C. elegans
atcaatttcgaaa

SEQ ID NO: 702949 - DNA, 13 bp, C. elegans
atcaatttctgaa

SEQ ID NO: 702950 - DNA, 13 bp, C. elegans
atcaatttctgga

SEQ ID NO: 702951 - DNA, 13 bp, C. elegans
atcaatttgaaaa

SEQ ID NO: 702952 - DNA, 13 bp, C. elegans
atcaatttgaatt

SEQ ID NO: 702953 - DNA, 13 bp, C. elegans
atcaatttgcaaa

SEQ ID NO: 702954 - DNA, 13 bp, C. elegans
atcaatttgccgg

SEQ ID NO: 702955 - DNA, 13 bp, C. elegans
atcaatttggaaa

SEQ ID NO: 702956 - DNA, 13 bp, C. elegans
atcaatttgtaca

SEQ ID NO: 702957 - DNA, 13 bp, C. elegans
atcaattttacaa

SEQ ID NO: 702958 - DNA, 13 bp, C. elegans
atcaattttcaaa

SEQ ID NO: 702959 - DNA, 13 bp, C. elegans
atcaattttcgaa

SEQ ID NO: 702960 - DNA, 13 bp, C. elegans
atcaattttctca

SEQ ID NO: 702961 - DNA, 13 bp, C. elegans
atcaattttctgg

SEQ ID NO: 702962 - DNA, 13 bp, C. elegans
atcaattttgtgt

SEQ ID NO: 702963 - DNA, 13 bp, C. elegans
atcaatttttcgt

SEQ ID NO: 702964 - DNA, 13 bp, C. elegans
atcaatttttctg

SEQ ID NO: 702965 - DNA, 13 bp, C. elegans
atcaatttttgat

SEQ ID NO: 702966 - DNA, 13 bp, C. elegans
atcaatttttgct

SEQ ID NO: 702967 - DNA, 13 bp, C. elegans
atcaatttttgtc

SEQ ID NO: 702968 - DNA, 13 bp, C. elegans
atcaatttttgtt

SEQ ID NO: 702969 - DNA, 13 bp, C. elegans
atcacaaaaaatg

SEQ ID NO: 702970 - DNA, 13 bp, C. elegans
atcacaaaaattg

SEQ ID NO: 702971 - DNA, 13 bp, C. elegans
atcacaaaatttg

SEQ ID NO: 702972 - DNA, 13 bp, C. elegans
atcacaaatattt

SEQ ID NO: 702973 - DNA, 13 bp, C. elegans
atcacaaatcaca

SEQ ID NO: 702974 - DNA, 13 bp, C. elegans
atcacaaatttaa

SEQ ID NO: 702975 - DNA, 13 bp, C. elegans
atcacaacttttt

SEQ ID NO: 702976 - DNA, 13 bp, C. elegans
atcacaatgaaaa

SEQ ID NO: 702977 - DNA, 13 bp, C. elegans
atcacaattattt

SEQ ID NO: 702978 - DNA, 13 bp, C. elegans
atcacaatttcag

SEQ ID NO: 702979 - DNA, 13 bp, C. elegans
atcacaattttca

SEQ ID NO: 702980 - DNA, 13 bp, C. elegans
atcacaatttttc

SEQ ID NO: 702981 - DNA, 13 bp, C. elegans
atcacacattttc

SEQ ID NO: 702982 - DNA, 13 bp, C. elegans
atcacagttttca

SEQ ID NO: 702983 - DNA, 13 bp, C. elegans
atcacatcatttt

SEQ ID NO: 702984 - DNA, 13 bp, C. elegans
atcacatgaaaaa

SEQ ID NO: 702985 - DNA, 13 bp, C. elegans
atcacatttaaaa

SEQ ID NO: 702986 - DNA, 13 bp, C. elegans
atcacatttgacg

SEQ ID NO: 702987 - DNA, 13 bp, C. elegans
atcacattttctt

SEQ ID NO: 702988 - DNA, 13 bp, C. elegans
atcacattttgaa

SEQ ID NO: 702989 - DNA, 13 bp, C. elegans
atcacatttttca

SEQ ID NO: 702990 - DNA, 13 bp, C. elegans
atcacatttttcc

SEQ ID NO: 702991 - DNA, 13 bp, C. elegans
atcacatttttcg

SEQ ID NO: 702992 - DNA, 13 bp, C. elegans
atcaccaggaggt

SEQ ID NO: 702993 - DNA, 13 bp, C. elegans
atcaccatttttt

SEQ ID NO: 702994 - DNA, 19 bp, C. elegans
atcacgatttcaatcgtaa

SEQ ID NO: 702995 - DNA, 13 bp, C. elegans
atcacggaatgaa

SEQ ID NO: 702996 - DNA, 13 bp, C. elegans
atcactaaatttt

SEQ ID NO: 702997 - DNA, 13 bp, C. elegans
atcactatttttc

SEQ ID NO: 702998 - DNA, 13 bp, C. elegans
atcactcaaaaat

SEQ ID NO: 702999 - DNA, 13 bp, C. elegans
atcactgattttg

SEQ ID NO: 703000 - DNA, 13 bp, C. elegans
atcactgtagttt

SEQ ID NO: 703001 - DNA, 13 bp, C. elegans
atcacttcaaatc

SEQ ID NO: 703002 - DNA, 13 bp, C. elegans
atcacttcaattt

SEQ ID NO: 703003 - DNA, 13 bp, C. elegans
atcacttgattta

SEQ ID NO: 703004 - DNA, 13 bp, C. elegans
atcactttgaaaa

SEQ ID NO: 703005 - DNA, 13 bp, C. elegans
atcacttttccaa

SEQ ID NO: 703006 - DNA, 13 bp, C. elegans
atcacttttctgt

SEQ ID NO: 703007 - DNA, 13 bp, C. elegans
atcactttttatc

SEQ ID NO: 703008 - DNA, 13 bp, C. elegans
atcactttttgaa

SEQ ID NO: 703009 - DNA, 13 bp, C. elegans
atcactttttggt

SEQ ID NO: 703010 - DNA, 13 bp, C. elegans
atcacttttttga

SEQ ID NO: 703011 - DNA, 13 bp, C. elegans
atcactttttttg

SEQ ID NO: 703012 - DNA, 13 bp, C. elegans
atcagaaaaacag

SEQ ID NO: 703013 - DNA, 13 bp, C. elegans
atcagaaaaatca

SEQ ID NO: 703014 - DNA, 13 bp, C. elegans
atcagaaaatcaa

SEQ ID NO: 703015 - DNA, 13 bp, C. elegans
atcagaaatcaaa

SEQ ID NO: 703016 - DNA, 13 bp, C. elegans
atcagaaatgttt

SEQ ID NO: 703017 - DNA, 13 bp, C. elegans
atcagaaattcag

SEQ ID NO: 703018 - DNA, 13 bp, C. elegans
atcagaaattgaa

SEQ ID NO: 703019 - DNA, 13 bp, C. elegans
atcagaaattttg

SEQ ID NO: 703020 - DNA, 13 bp, C. elegans
atcagaaattttt

SEQ ID NO: 703021 - DNA, 13 bp, C. elegans
atcagaactattt

SEQ ID NO: 703022 - DNA, 13 bp, C. elegans
atcagaagaaaat

SEQ ID NO: 703023 - DNA, 13 bp, C. elegans
atcagaagttggc

SEQ ID NO: 703024 - DNA, 13 bp, C. elegans
atcagaataaatt

SEQ ID NO: 703025 - DNA, 13 bp, C. elegans
atcagaatgaata

SEQ ID NO: 703026 - DNA, 13 bp, C. elegans
atcagaatttcaa

SEQ ID NO: 703027 - DNA, 13 bp, C. elegans
atcagaatttttc

SEQ ID NO: 703028 - DNA, 13 bp, C. elegans
atcagacaatttt

SEQ ID NO: 703029 - DNA, 13 bp, C. elegans
atcagacattttt

SEQ ID NO: 703030 - DNA, 13 bp, C. elegans
atcagatgaagtg

SEQ ID NO: 703031 - DNA, 13 bp, C. elegans
atcagattaaaaa

SEQ ID NO: 703032 - DNA, 13 bp, C. elegans
atcagattatttt

SEQ ID NO: 703033 - DNA, 13 bp, C. elegans
atcagatttattt

SEQ ID NO: 703034 - DNA, 13 bp, C. elegans
atcagattttttt

SEQ ID NO: 703035 - DNA, 13 bp, C. elegans
atcagcaaattgc

SEQ ID NO: 703036 - DNA, 13 bp, C. elegans
atcagcaaattgt

SEQ ID NO: 703037 - DNA, 13 bp, C. elegans
atcagcaagagaa

SEQ ID NO: 703038 - DNA, 13 bp, C. elegans
atcagctttaaaa

SEQ ID NO: 703039 - DNA, 13 bp, C. elegans
atcagcttttata

SEQ ID NO: 703040 - DNA, 13 bp, C. elegans
atcaggagcacaa

SEQ ID NO: 703041 - DNA, 13 bp, C. elegans
atcagggaaattt

SEQ ID NO: 703042 - DNA, 13 bp, C. elegans
atcagggctggga

SEQ ID NO: 703043 - DNA, 13 bp, C. elegans
atcaggtactttt

SEQ ID NO: 703044 - DNA, 13 bp, C. elegans
atcagtaattttt

SEQ ID NO: 703045 - DNA, 13 bp, C. elegans
atcagtatttata

SEQ ID NO: 703046 - DNA, 13 bp, C. elegans
atcagtggaaaaa

SEQ ID NO: 703047 - DNA, 13 bp, C. elegans
atcagttcttcac

SEQ ID NO: 703048 - DNA, 13 bp, C. elegans
atcagttgaaaac

SEQ ID NO: 703049 - DNA, 13 bp, C. elegans
atcagttgagaaa

SEQ ID NO: 703050 - DNA, 13 bp, C. elegans
atcagtttcaaat

SEQ ID NO: 703051 - DNA, 13 bp, C. elegans
atcagtttcagaa

SEQ ID NO: 703052 - DNA, 13 bp, C. elegans
atcagtttctttt

SEQ ID NO: 703053 - DNA, 13 bp, C. elegans
atcagttttaata

SEQ ID NO: 703054 - DNA, 13 bp, C. elegans
atcagttttacaa

SEQ ID NO: 703055 - DNA, 13 bp, C. elegans
atcagttttattt

SEQ ID NO: 703056 - DNA, 13 bp, C. elegans
atcagttttcaaa

SEQ ID NO: 703057 - DNA, 13 bp, C. elegans
atcagttttcaga

SEQ ID NO: 703058 - DNA, 13 bp, C. elegans
atcagttttccat

SEQ ID NO: 703059 - DNA, 13 bp, C. elegans
atcagttttcggt

SEQ ID NO: 703060 - DNA, 13 bp, C. elegans
atcagtttttatt

SEQ ID NO: 703061 - DNA, 13 bp, C. elegans
atcagtttttcgt

SEQ ID NO: 703062 - DNA, 13 bp, C. elegans
atcagtttttctg

SEQ ID NO: 703063 - DNA, 13 bp, C. elegans
atcagtttttgaa

SEQ ID NO: 703064 - DNA, 13 bp, C. elegans
atcagtttttgat

SEQ ID NO: 703065 - DNA, 13 bp, C. elegans
atcataaaacatt

SEQ ID NO: 703066 - DNA, 13 bp, C. elegans
atcataaaatctt

SEQ ID NO: 703067 - DNA, 13 bp, C. elegans
atcataatctttt

SEQ ID NO: 703068 - DNA, 13 bp, C. elegans
atcataatttgaa

SEQ ID NO: 703069 - DNA, 13 bp, C. elegans
atcatatcgtaaa

SEQ ID NO: 703070 - DNA, 13 bp, C. elegans
atcatattatttc

SEQ ID NO: 703071 - DNA, 13 bp, C. elegans
atcatattgaaaa

SEQ ID NO: 703072 - DNA, 13 bp, C. elegans
atcatattttgaa

SEQ ID NO: 703073 - DNA, 13 bp, C. elegans
atcatattttgtg

SEQ ID NO: 703074 - DNA, 13 bp, C. elegans
atcatcaaaaatc

SEQ ID NO: 703075 - DNA, 13 bp, C. elegans
atcatcaaaaatt

SEQ ID NO: 703076 - DNA, 13 bp, C. elegans
atcatcaaaagtt

SEQ ID NO: 703077 - DNA, 13 bp, C. elegans
atcatcaaaatca

SEQ ID NO: 703078 - DNA, 13 bp, C. elegans
atcatcaaaatga

SEQ ID NO: 703079 - DNA, 13 bp, C. elegans
atcatcaaatcat

SEQ ID NO: 703080 - DNA, 13 bp, C. elegans
atcatcaaatttc

SEQ ID NO: 703081 - DNA, 13 bp, C. elegans
atcatcaatcaaa

SEQ ID NO: 703082 - DNA, 13 bp, C. elegans
atcatcaatttca

SEQ ID NO: 703083 - DNA, 13 bp, C. elegans
atcatcaattttc

SEQ ID NO: 703084 - DNA, 13 bp, C. elegans
atcatcagaaaaa

SEQ ID NO: 703085 - DNA, 13 bp, C. elegans
atcatcagtcaaa

SEQ ID NO: 703086 - DNA, 13 bp, C. elegans
atcatcagttttc

SEQ ID NO: 703087 - DNA, 13 bp, C. elegans
atcatcatcaaaa

SEQ ID NO: 703088 - DNA, 13 bp, C. elegans
atcatcatcaaat

SEQ ID NO: 703089 - DNA, 13 bp, C. elegans
atcatcatcacca

SEQ ID NO: 703090 - DNA, 13 bp, C. elegans
atcatcatcataa

SEQ ID NO: 703091 - DNA, 13 bp, C. elegans
atcatcatcatat

SEQ ID NO: 703092 - DNA, 13 bp, C. elegans
atcatcatcatca

SEQ ID NO: 703093 - DNA, 13 bp, C. elegans
atcatcatcattg

SEQ ID NO: 703094 - DNA, 13 bp, C. elegans
atcatcatcattt

SEQ ID NO: 703095 - DNA, 13 bp, C. elegans
atcatcatcgtcg

SEQ ID NO: 703096 - DNA, 13 bp, C. elegans
atcatcatcttct

SEQ ID NO: 703097 - DNA, 13 bp, C. elegans
atcatcattactt

SEQ ID NO: 703098 - DNA, 13 bp, C. elegans
atcatcattatca

SEQ ID NO: 703099 - DNA, 13 bp, C. elegans
atcatcattcaaa

SEQ ID NO: 703100 - DNA, 13 bp, C. elegans
atcatcattgttt

SEQ ID NO: 703101 - DNA, 13 bp, C. elegans
atcatcatttcaa

SEQ ID NO: 703102 - DNA, 13 bp, C. elegans
atcatcatttctt

SEQ ID NO: 703103 - DNA, 13 bp, C. elegans
atcatcattttga

SEQ ID NO: 703104 - DNA, 13 bp, C. elegans
atcatcctttatt

SEQ ID NO: 703105 - DNA, 13 bp, C. elegans
atcatcgaaaaaa

SEQ ID NO: 703106 - DNA, 13 bp, C. elegans
atcatcgaaattt

SEQ ID NO: 703107 - DNA, 13 bp, C. elegans
atcatctcaaaat

SEQ ID NO: 703108 - DNA, 13 bp, C. elegans
atcatctcaaatt

SEQ ID NO: 703109 - DNA, 13 bp, C. elegans
atcatctgaaaag

SEQ ID NO: 703110 - DNA, 13 bp, C. elegans
atcatctgaaaat

SEQ ID NO: 703111 - DNA, 13 bp, C. elegans
atcatcttcataa

SEQ ID NO: 703112 - DNA, 14 bp, C. elegans
atcatcttcatcat

SEQ ID NO: 703113 - DNA, 13 bp, C. elegans
atcatcttccagg

SEQ ID NO: 703114 - DNA, 13 bp, C. elegans
atcatcttcttct

SEQ ID NO: 703115 - DNA, 13 bp, C. elegans
atcatgaaaaaat

SEQ ID NO: 703116 - DNA, 13 bp, C. elegans
atcatgaaaaact

SEQ ID NO: 703117 - DNA, 13 bp, C. elegans
atcatgaaattcg

SEQ ID NO: 703118 - DNA, 13 bp, C. elegans
atcatgaacattt

SEQ ID NO: 703119 - DNA, 13 bp, C. elegans
atcatgaagtttt

SEQ ID NO: 703120 - DNA, 13 bp, C. elegans
atcatgagaaaaa

SEQ ID NO: 703121 - DNA, 13 bp, C. elegans
atcatgagaaaat

SEQ ID NO: 703122 - DNA, 13 bp, C. elegans
atcatgataaaaa

SEQ ID NO: 703123 - DNA, 13 bp, C. elegans
atcatgatatttg

SEQ ID NO: 703124 - DNA, 13 bp, C. elegans
atcatgatgaaaa

SEQ ID NO: 703125 - DNA, 13 bp, C. elegans
atcatggaaacaa

SEQ ID NO: 703126 - DNA, 13 bp, C. elegans
atcatggaaattt

SEQ ID NO: 703127 - DNA, 13 bp, C. elegans
atcatgtttattt

SEQ ID NO: 703128 - DNA, 13 bp, C. elegans
atcatgttttcaa

SEQ ID NO: 703129 - DNA, 13 bp, C. elegans
atcattaattttc

SEQ ID NO: 703130 - DNA, 13 bp, C. elegans
atcattatcattt

SEQ ID NO: 703131 - DNA, 13 bp, C. elegans
atcattattgttt

SEQ ID NO: 703132 - DNA, 13 bp, C. elegans
atcattatttgaa

SEQ ID NO: 703133 - DNA, 13 bp, C. elegans
atcattattttca

SEQ ID NO: 703134 - DNA, 13 bp, C. elegans
atcattcaaaaat

SEQ ID NO: 703135 - DNA, 13 bp, C. elegans
atcattcacattt

SEQ ID NO: 703136 - DNA, 13 bp, C. elegans
atcattcatttca

SEQ ID NO: 703137 - DNA, 13 bp, C. elegans
atcattcgttttc

SEQ ID NO: 703138 - DNA, 13 bp, C. elegans
atcattgaaaact

SEQ ID NO: 703139 - DNA, 13 bp, C. elegans
atcattggaaaat

SEQ ID NO: 703140 - DNA, 13 bp, C. elegans
atcattgttttta

SEQ ID NO: 703141 - DNA, 13 bp, C. elegans
atcatttagtttt

SEQ ID NO: 703142 - DNA, 13 bp, C. elegans
atcatttattcaa

SEQ ID NO: 703143 - DNA, 13 bp, C. elegans
atcatttcaaatt

SEQ ID NO: 703144 - DNA, 13 bp, C. elegans
atcatttcaattt

SEQ ID NO: 703145 - DNA, 13 bp, C. elegans
atcatttccaatt

SEQ ID NO: 703146 - DNA, 13 bp, C. elegans
atcatttctcaat

SEQ ID NO: 703147 - DNA, 13 bp, C. elegans
atcatttgaacaa

SEQ ID NO: 703148 - DNA, 13 bp, C. elegans
atcattttacatt

SEQ ID NO: 703149 - DNA, 13 bp, C. elegans
atcattttcaaat

SEQ ID NO: 703150 - DNA, 13 bp, C. elegans
atcattttcacat

SEQ ID NO: 703151 - DNA, 13 bp, C. elegans
atcattttcatgt

SEQ ID NO: 703152 - DNA, 13 bp, C. elegans
atcattttcattc

SEQ ID NO: 703153 - DNA, 13 bp, C. elegans
atcattttcggca

SEQ ID NO: 703154 - DNA, 13 bp, C. elegans
atcattttctaca

SEQ ID NO: 703155 - DNA, 13 bp, C. elegans
atcattttctcac

SEQ ID NO: 703156 - DNA, 13 bp, C. elegans
atcattttctgtg

SEQ ID NO: 703157 - DNA, 13 bp, C. elegans
atcattttgcaat

SEQ ID NO: 703158 - DNA, 13 bp, C. elegans
atcattttggaat

SEQ ID NO: 703159 - DNA, 13 bp, C. elegans
atcattttggcgg

SEQ ID NO: 703160 - DNA, 13 bp, C. elegans
atcattttgttag

SEQ ID NO: 703161 - DNA, 13 bp, C. elegans
atcatttttcaaa

SEQ ID NO: 703162 - DNA, 13 bp, C. elegans
atcatttttcaca

SEQ ID NO: 703163 - DNA, 13 bp, C. elegans
atcatttttcact

SEQ ID NO: 703164 - DNA, 13 bp, C. elegans
atcatttttcgac

SEQ ID NO: 703165 - DNA, 13 bp, C. elegans
atcatttttgaga

SEQ ID NO: 703166 - DNA, 13 bp, C. elegans
atcattttttgat

SEQ ID NO: 703167 - DNA, 13 bp, C. elegans
atcattttttgca

SEQ ID NO: 703168 - DNA, 13 bp, C. elegans
atccaaaaactca

SEQ ID NO: 703169 - DNA, 13 bp, C. elegans
atccaaaaacttt

SEQ ID NO: 703170 - DNA, 13 bp, C. elegans
atccaaaaatttg

SEQ ID NO: 703171 - DNA, 13 bp, C. elegans
atccaaaattatg

SEQ ID NO: 703172 - DNA, 13 bp, C. elegans
atccaaaattcta

SEQ ID NO: 703173 - DNA, 13 bp, C. elegans
atccaaaattgtc

SEQ ID NO: 703174 - DNA, 13 bp, C. elegans
atccaaactaatg

SEQ ID NO: 703175 - DNA, 13 bp, C. elegans
atccaaactagaa

SEQ ID NO: 703176 - DNA, 13 bp, C. elegans
atccaaatttttt

SEQ ID NO: 703177 - DNA, 13 bp, C. elegans
atccaacttttaa

SEQ ID NO: 703178 - DNA, 13 bp, C. elegans
atccaactttttt

SEQ ID NO: 703179 - DNA, 13 bp, C. elegans
atccaaggagaca

SEQ ID NO: 703180 - DNA, 13 bp, C. elegans
atccaataatttt

SEQ ID NO: 703181 - DNA, 13 bp, C. elegans
atccaatgaattt

SEQ ID NO: 703182 - DNA, 13 bp, C. elegans
atccaattgtagt

SEQ ID NO: 703183 - DNA, 13 bp, C. elegans
atccaatttattt

SEQ ID NO: 703184 - DNA, 13 bp, C. elegans
atccaatttcaat

SEQ ID NO: 703185 - DNA, 13 bp, C. elegans
atccaattttcag

SEQ ID NO: 703186 - DNA, 13 bp, C. elegans
atccaattttcca

SEQ ID NO: 703187 - DNA, 13 bp, C. elegans
atccaattttcga

SEQ ID NO: 703188 - DNA, 13 bp, C. elegans
atccaatttttaa

SEQ ID NO: 703189 - DNA, 13 bp, C. elegans
atccaatttttta

SEQ ID NO: 703190 - DNA, 13 bp, C. elegans
atccacaaaatga

SEQ ID NO: 703191 - DNA, 13 bp, C. elegans
atccacaattttt

SEQ ID NO: 703192 - DNA, 13 bp, C. elegans
atccacatttttt

SEQ ID NO: 703193 - DNA, 13 bp, C. elegans
atccacttttggt

SEQ ID NO: 703194 - DNA, 13 bp, C. elegans
atccagattcgaa

SEQ ID NO: 703195 - DNA, 13 bp, C. elegans
atccagatttgaa

SEQ ID NO: 703196 - DNA, 13 bp, C. elegans
atccatagttttt

SEQ ID NO: 703197 - DNA, 13 bp, C. elegans
atccatattttcc

SEQ ID NO: 703198 - DNA, 13 bp, C. elegans
atccatccaccca

SEQ ID NO: 703199 - DNA, 13 bp, C. elegans
atccatctttctg

SEQ ID NO: 703200 - DNA, 13 bp, C. elegans
atccatgcaaatg

SEQ ID NO: 703201 - DNA, 13 bp, C. elegans
atccattgaattt

SEQ ID NO: 703202 - DNA, 13 bp, C. elegans
atccatttcaaat

SEQ ID NO: 703203 - DNA, 13 bp, C. elegans
atccattttctga

SEQ ID NO: 703204 - DNA, 13 bp, C. elegans
atccatttttata

SEQ ID NO: 703205 - DNA, 13 bp, C. elegans
atccatttttctg

SEQ ID NO: 703206 - DNA, 13 bp, C. elegans
atcccaaatttcc

SEQ ID NO: 703207 - DNA, 13 bp, C. elegans
atcccatcactaa

SEQ ID NO: 703208 - DNA, 13 bp, C. elegans
atcccattgattt

SEQ ID NO: 703209 - DNA, 13 bp, C. elegans
atccccactggcg

SEQ ID NO: 703210 - DNA, 13 bp, C. elegans
atcccgatttttg

SEQ ID NO: 703211 - DNA, 13 bp, C. elegans
atcccggaaaaat

SEQ ID NO: 703212 - DNA, 13 bp, C. elegans
atcccgttttttt

SEQ ID NO: 703213 - DNA, 13 bp, C. elegans
atccctaaaatcc

SEQ ID NO: 703214 - DNA, 13 bp, C. elegans
atcccttcaaaag

SEQ ID NO: 703215 - DNA, 13 bp, C. elegans
atccgaaaaaata

SEQ ID NO: 703216 - DNA, 13 bp, C. elegans
atccgaaaatttt

SEQ ID NO: 703217 - DNA, 13 bp, C. elegans
atccgaacaaaaa

SEQ ID NO: 703218 - DNA, 13 bp, C. elegans
atccgaatgtata

SEQ ID NO: 703219 - DNA, 13 bp, C. elegans
atccgacgacgac

SEQ ID NO: 703220 - DNA, 13 bp, C. elegans
atccgcacacaag

SEQ ID NO: 703221 - DNA, 106 bp, C. elegans
atccgcataggaccgccacggatattcaaatgattataagttctccaaatgaacctgtaccaagtaaacgaactgttcgtcgacgtttacagcaagcaggactaca

SEQ ID NO: 703222 - DNA, 13 bp, C. elegans
atccggaaaacgt

SEQ ID NO: 703223 - DNA, 13 bp, C. elegans
atccgtttttaat

SEQ ID NO: 703224 - DNA, 13 bp, C. elegans
atcctaattttca

SEQ ID NO: 703225 - DNA, 13 bp, C. elegans
atcctacagtatc

SEQ ID NO: 703226 - DNA, 13 bp, C. elegans
atcctatgaattt

SEQ ID NO: 703227 - DNA, 13 bp, C. elegans
atcctcaaatttt

SEQ ID NO: 703228 - DNA, 13 bp, C. elegans
atcctcagcttct

SEQ ID NO: 703229 - DNA, 13 bp, C. elegans
atcctgaaaaaaa

SEQ ID NO: 703230 - DNA, 13 bp, C. elegans
atcctgaaaaact

SEQ ID NO: 703231 - DNA, 13 bp, C. elegans
atcctgaagataa

SEQ ID NO: 703232 - DNA, 13 bp, C. elegans
atcctgacaccac

SEQ ID NO: 703233 - DNA, 13 bp, C. elegans
atcctgatttatt

SEQ ID NO: 703234 - DNA, 13 bp, C. elegans
atcctgctgaaat

SEQ ID NO: 703235 - DNA, 13 bp, C. elegans
atccttagatcct

SEQ ID NO: 703236 - DNA, 13 bp, C. elegans
atccttcaaaaat

SEQ ID NO: 703237 - DNA, 13 bp, C. elegans
atccttcggagct

SEQ ID NO: 703238 - DNA, 13 bp, C. elegans
atcctttaaaaat

SEQ ID NO: 703239 - DNA, 13 bp, C. elegans
atcctttggagct

SEQ ID NO: 703240 - DNA, 13 bp, C. elegans
atccttttttgca

SEQ ID NO: 703241 - DNA, 13 bp, C. elegans
atcgaaaaaattt

SEQ ID NO: 703242 - DNA, 13 bp, C. elegans
atcgaaaaaccaa

SEQ ID NO: 703243 - DNA, 13 bp, C. elegans
atcgaaaaaccga

SEQ ID NO: 703244 - DNA, 13 bp, C. elegans
atcgaaaaacgga

SEQ ID NO: 703245 - DNA, 13 bp, C. elegans
atcgaaaaactaa

SEQ ID NO: 703246 - DNA, 13 bp, C. elegans
atcgaaaaactac

SEQ ID NO: 703247 - DNA, 13 bp, C. elegans
atcgaaaaagatg

SEQ ID NO: 703248 - DNA, 13 bp, C. elegans
atcgaaaaagttt

SEQ ID NO: 703249 - DNA, 13 bp, C. elegans
atcgaaaaataat

SEQ ID NO: 703250 - DNA, 14 bp, C. elegans
atcgaaaaatcgga

SEQ ID NO: 703251 - DNA, 13 bp, C. elegans
atcgaaaaatgga

SEQ ID NO: 703252 - DNA, 13 bp, C. elegans
atcgaaaaatgtc

SEQ ID NO: 703253 - DNA, 13 bp, C. elegans
atcgaaaaatgtt

SEQ ID NO: 703254 - DNA, 13 bp, C. elegans
atcgaaaaattac

SEQ ID NO: 703255 - DNA, 13 bp, C. elegans
atcgaaaaatttc

SEQ ID NO: 703256 - DNA, 13 bp, C. elegans
atcgaaaacgaaa

SEQ ID NO: 703257 - DNA, 13 bp, C. elegans
atcgaaaactgaa

SEQ ID NO: 703258 - DNA, 13 bp, C. elegans
atcgaaaactttt

SEQ ID NO: 703259 - DNA, 13 bp, C. elegans
atcgaaaagaaat

SEQ ID NO: 703260 - DNA, 13 bp, C. elegans
atcgaaaatatat

SEQ ID NO: 703261 - DNA, 13 bp, C. elegans
atcgaaaatattt

SEQ ID NO: 703262 - DNA, 13 bp, C. elegans
atcgaaaatcaaa

SEQ ID NO: 703263 - DNA, 13 bp, C. elegans
atcgaaaatcgaa

SEQ ID NO: 703264 - DNA, 13 bp, C. elegans
atcgaaaatctca

SEQ ID NO: 703265 - DNA, 13 bp, C. elegans
atcgaaaatgtgt

SEQ ID NO: 703266 - DNA, 13 bp, C. elegans
atcgaaaattgga

SEQ ID NO: 703267 - DNA, 13 bp, C. elegans
atcgaaaattgtt

SEQ ID NO: 703268 - DNA, 13 bp, C. elegans
atcgaaaatttga

SEQ ID NO: 703269 - DNA, 13 bp, C. elegans
atcgaaaattttg

SEQ ID NO: 703270 - DNA, 13 bp, C. elegans
atcgaaagaaaac

SEQ ID NO: 703271 - DNA, 13 bp, C. elegans
atcgaaatatttt

SEQ ID NO: 703272 - DNA, 13 bp, C. elegans
atcgaaatcaaaa

SEQ ID NO: 703273 - DNA, 13 bp, C. elegans
atcgaaattggaa

SEQ ID NO: 703274 - DNA, 13 bp, C. elegans
atcgaaatttata

SEQ ID NO: 703275 - DNA, 13 bp, C. elegans
atcgaaatttcga

SEQ ID NO: 703276 - DNA, 13 bp, C. elegans
atcgaaatttcgt

SEQ ID NO: 703277 - DNA, 13 bp, C. elegans
atcgaacaaaaat

SEQ ID NO: 703278 - DNA, 13 bp, C. elegans
atcgaacatcgaa

SEQ ID NO: 703279 - DNA, 13 bp, C. elegans
atcgaacattttt

SEQ ID NO: 703280 - DNA, 13 bp, C. elegans
atcgaattaaaaa

SEQ ID NO: 703281 - DNA, 13 bp, C. elegans
atcgaattcaaat

SEQ ID NO: 703282 - DNA, 13 bp, C. elegans
atcgaatttcaat

SEQ ID NO: 703283 - DNA, 13 bp, C. elegans
atcgaatttccac

SEQ ID NO: 703284 - DNA, 13 bp, C. elegans
atcgaatttcgaa

SEQ ID NO: 703285 - DNA, 13 bp, C. elegans
atcgaattttcga

SEQ ID NO: 703286 - DNA, 13 bp, C. elegans
atcgaattttctc

SEQ ID NO: 703287 - DNA, 13 bp, C. elegans
atcgaattttgtt

SEQ ID NO: 703288 - DNA, 13 bp, C. elegans
atcgacaaaccgg

SEQ ID NO: 703289 - DNA, 13 bp, C. elegans
atcgacaaactgc

SEQ ID NO: 703290 - DNA, 13 bp, C. elegans
atcgacaaatttc

SEQ ID NO: 703291 - DNA, 13 bp, C. elegans
atcgactacagta

SEQ ID NO: 703292 - DNA, 13 bp, C. elegans
atcgacttccaaa

SEQ ID NO: 703293 - DNA, 13 bp, C. elegans
atcgactttaaaa

SEQ ID NO: 703294 - DNA, 13 bp, C. elegans
atcgacttttttt

SEQ ID NO: 703295 - DNA, 13 bp, C. elegans
atcgagaaaaaat

SEQ ID NO: 703296 - DNA, 13 bp, C. elegans
atcgagaacaaaa

SEQ ID NO: 703297 - DNA, 13 bp, C. elegans
atcgaggaaaaat

SEQ ID NO: 703298 - DNA, 13 bp, C. elegans
atcgataaaaatt

SEQ ID NO: 703299 - DNA, 13 bp, C. elegans
atcgataaatcaa

SEQ ID NO: 703300 - DNA, 13 bp, C. elegans
atcgataaatttc

SEQ ID NO: 703301 - DNA, 13 bp, C. elegans
atcgataatttaa

SEQ ID NO: 703302 - DNA, 13 bp, C. elegans
atcgataatttga

SEQ ID NO: 703303 - DNA, 13 bp, C. elegans
atcgatacatttt

SEQ ID NO: 703304 - DNA, 13 bp, C. elegans
atcgatataaaat

SEQ ID NO: 703305 - DNA, 13 bp, C. elegans
atcgatattcgga

SEQ ID NO: 703306 - DNA, 13 bp, C. elegans
atcgatattcggt

SEQ ID NO: 703307 - DNA, 13 bp, C. elegans
atcgatatttgaa

SEQ ID NO: 703308 - DNA, 13 bp, C. elegans
atcgatatttttc

SEQ ID NO: 703309 - DNA, 13 bp, C. elegans
atcgatcaataaa

SEQ ID NO: 703310 - DNA, 13 bp, C. elegans
atcgatccttaaa

SEQ ID NO: 703311 - DNA, 13 bp, C. elegans
atcgatgaaaaac

SEQ ID NO: 703312 - DNA, 13 bp, C. elegans
atcgatgaaaatt

SEQ ID NO: 703313 - DNA, 13 bp, C. elegans
atcgatgaagcca

SEQ ID NO: 703314 - DNA, 13 bp, C. elegans
atcgatgcaccat

SEQ ID NO: 703315 - DNA, 13 bp, C. elegans
atcgatgtctgct

SEQ ID NO: 703316 - DNA, 13 bp, C. elegans
atcgattaaatcg

SEQ ID NO: 703317 - DNA, 13 bp, C. elegans
atcgattcgaaat

SEQ ID NO: 703318 - DNA, 13 bp, C. elegans
atcgattgaaaat

SEQ ID NO: 703319 - DNA, 13 bp, C. elegans
atcgattgataaa

SEQ ID NO: 703320 - DNA, 13 bp, C. elegans
atcgattgatttt

SEQ ID NO: 703321 - DNA, 13 bp, C. elegans
atcgatttatttt

SEQ ID NO: 703322 - DNA, 13 bp, C. elegans
atcgatttccaaa

SEQ ID NO: 703323 - DNA, 13 bp, C. elegans
atcgatttgtttt

SEQ ID NO: 703324 - DNA, 13 bp, C. elegans
atcgattttattg

SEQ ID NO: 703325 - DNA, 13 bp, C. elegans
atcgattttcaaa

SEQ ID NO: 703326 - DNA, 13 bp, C. elegans
atcgattttcatc

SEQ ID NO: 703327 - DNA, 13 bp, C. elegans
atcgattttccga

SEQ ID NO: 703328 - DNA, 13 bp, C. elegans
atcgattttcctg

SEQ ID NO: 703329 - DNA, 13 bp, C. elegans
atcgattttcgaa

SEQ ID NO: 703330 - DNA, 13 bp, C. elegans
atcgattttcgat

SEQ ID NO: 703331 - DNA, 13 bp, C. elegans
atcgattttcgtt

SEQ ID NO: 703332 - DNA, 13 bp, C. elegans
atcgattttcttc

SEQ ID NO: 703333 - DNA, 13 bp, C. elegans
atcgattttgtga

SEQ ID NO: 703334 - DNA, 13 bp, C. elegans
atcgatttttcca

SEQ ID NO: 703335 - DNA, 13 bp, C. elegans
atcgatttttcgc

SEQ ID NO: 703336 - DNA, 13 bp, C. elegans
atcgatttttcgt

SEQ ID NO: 703337 - DNA, 13 bp, C. elegans
atcgatttttctt

SEQ ID NO: 703338 - DNA, 13 bp, C. elegans
atcgatttttgca

SEQ ID NO: 703339 - DNA, 13 bp, C. elegans
atcgatttttgcg

SEQ ID NO: 703340 - DNA, 13 bp, C. elegans
atcgatttttgtc

SEQ ID NO: 703341 - DNA, 13 bp, C. elegans
atcgatttttgtt

SEQ ID NO: 703342 - DNA, 13 bp, C. elegans
atcgattttttct

SEQ ID NO: 703343 - DNA, 13 bp, C. elegans
atcgattttttga

SEQ ID NO: 703344 - DNA, 13 bp, C. elegans
atcgattttttgc

SEQ ID NO: 703345 - DNA, 13 bp, C. elegans
atcgattttttgg

SEQ ID NO: 703346 - DNA, 13 bp, C. elegans
atcgatttttttg

SEQ ID NO: 703347 - DNA, 13 bp, C. elegans
atcgcaaaaaaac

SEQ ID NO: 703348 - DNA, 13 bp, C. elegans
atcgcaaaaaaat

SEQ ID NO: 703349 - DNA, 13 bp, C. elegans
atcgcaaaaaatc

SEQ ID NO: 703350 - DNA, 13 bp, C. elegans
atcgcaaaaattc

SEQ ID NO: 703351 - DNA, 13 bp, C. elegans
atcgcaaaatttt

SEQ ID NO: 703352 - DNA, 13 bp, C. elegans
atcgcaaattttt

SEQ ID NO: 703353 - DNA, 13 bp, C. elegans
atcgcatttttat

SEQ ID NO: 703354 - DNA, 13 bp, C. elegans
atcgccgaaaaat

SEQ ID NO: 703355 - DNA, 13 bp, C. elegans
atcgccgattgcc

SEQ ID NO: 703356 - DNA, 13 bp, C. elegans
atcgcctgccgga

SEQ ID NO: 703357 - DNA, 13 bp, C. elegans
atcgcttcatatg

SEQ ID NO: 703358 - DNA, 13 bp, C. elegans
atcggaaaaaatc

SEQ ID NO: 703359 - DNA, 13 bp, C. elegans
atcggaaaaataa

SEQ ID NO: 703360 - DNA, 13 bp, C. elegans
atcggaaaaattg

SEQ ID NO: 703361 - DNA, 13 bp, C. elegans
atcggaaaagtac

SEQ ID NO: 703362 - DNA, 13 bp, C. elegans
atcggaaattgtt

SEQ ID NO: 703363 - DNA, 13 bp, C. elegans
atcggaagaaaaa

SEQ ID NO: 703364 - DNA, 13 bp, C. elegans
atcggcaaaaaat

SEQ ID NO: 703365 - DNA, 13 bp, C. elegans
atcggcaaactgc

SEQ ID NO: 703366 - DNA, 13 bp, C. elegans
atcggcaattccg

SEQ ID NO: 703367 - DNA, 13 bp, C. elegans
atcggcaatttgg

SEQ ID NO: 703368 - DNA, 13 bp, C. elegans
atcggctaatttt

SEQ ID NO: 703369 - DNA, 13 bp, C. elegans
atcgggaaaaatt

SEQ ID NO: 703370 - DNA, 13 bp, C. elegans
atcggttcaaaaa

SEQ ID NO: 703371 - DNA, 13 bp, C. elegans
atcgtcaaattgc

SEQ ID NO: 703372 - DNA, 13 bp, C. elegans
atcgtcagatttt

SEQ ID NO: 703373 - DNA, 13 bp, C. elegans
atcgtgaaaaaat

SEQ ID NO: 703374 - DNA, 13 bp, C. elegans
atcgtgaaatttc

SEQ ID NO: 703375 - DNA, 15 bp, C. elegans
atcgtggaaagaccc

SEQ ID NO: 703376 - DNA, 13 bp, C. elegans
atcgtgttttttc

SEQ ID NO: 703377 - DNA, 13 bp, C. elegans
atcgttaacagct

SEQ ID NO: 703378 - DNA, 13 bp, C. elegans
atcgttcaaaaat

SEQ ID NO: 703379 - DNA, 13 bp, C. elegans
atcgttcaatttt

SEQ ID NO: 703380 - DNA, 13 bp, C. elegans
atcgttgcgagac

SEQ ID NO: 703381 - DNA, 13 bp, C. elegans
atcgttgtttcgt

SEQ ID NO: 703382 - DNA, 13 bp, C. elegans
atcgtttaaaatc

SEQ ID NO: 703383 - DNA, 13 bp, C. elegans
atcgtttaatttt

SEQ ID NO: 703384 - DNA, 13 bp, C. elegans
atcgtttgatttt

SEQ ID NO: 703385 - DNA, 13 bp, C. elegans
atcgtttttcgaa

SEQ ID NO: 703386 - DNA, 13 bp, C. elegans
atcgttttttatc

SEQ ID NO: 703387 - DNA, 13 bp, C. elegans
atcgttttttgaa

SEQ ID NO: 703388 - DNA, 13 bp, C. elegans
atctaaaaattac

SEQ ID NO: 703389 - DNA, 13 bp, C. elegans
atctaaaatatct

SEQ ID NO: 703390 - DNA, 13 bp, C. elegans
atctaaaatctaa

SEQ ID NO: 703391 - DNA, 13 bp, C. elegans
atctaaaattact

SEQ ID NO: 703392 - DNA, 13 bp, C. elegans
atctaaaattgat

SEQ ID NO: 703393 - DNA, 13 bp, C. elegans
atctaaactttaa

SEQ ID NO: 703394 - DNA, 13 bp, C. elegans
atctaaagaaaac

SEQ ID NO: 703395 - DNA, 13 bp, C. elegans
atctaaatttctg

SEQ ID NO: 703396 - DNA, 13 bp, C. elegans
atctaaattttca

SEQ ID NO: 703397 - DNA, 13 bp, C. elegans
atctaaatttttc

SEQ ID NO: 703398 - DNA, 13 bp, C. elegans
atctaaatttttg

SEQ ID NO: 703399 - DNA, 13 bp, C. elegans
atctaacaaatat

SEQ ID NO: 703400 - DNA, 13 bp, C. elegans
atctaagtagatc

SEQ ID NO: 703401 - DNA, 13 bp, C. elegans
atctaattttcaa

SEQ ID NO: 703402 - DNA, 13 bp, C. elegans
atctaattttgtt

SEQ ID NO: 703403 - DNA, 13 bp, C. elegans
atctaatttttca

SEQ ID NO: 703404 - DNA, 13 bp, C. elegans
atctaatttttga

SEQ ID NO: 703405 - DNA, 13 bp, C. elegans
atctacaaaaact

SEQ ID NO: 703406 - DNA, 13 bp, C. elegans
atctacaaaactt

SEQ ID NO: 703407 - DNA, 13 bp, C. elegans
atctacaaaatat

SEQ ID NO: 703408 - DNA, 13 bp, C. elegans
atctacaaatttc

SEQ ID NO: 703409 - DNA, 13 bp, C. elegans
atctacaacatct

SEQ ID NO: 703410 - DNA, 13 bp, C. elegans
atctacaagaaat

SEQ ID NO: 703411 - DNA, 13 bp, C. elegans
atctacaatattt

SEQ ID NO: 703412 - DNA, 13 bp, C. elegans
atctacaatgctc

SEQ ID NO: 703413 - DNA, 13 bp, C. elegans
atctacacaattt

SEQ ID NO: 703414 - DNA, 13 bp, C. elegans
atctacagaaaaa

SEQ ID NO: 703415 - DNA, 13 bp, C. elegans
atctacagtaata

SEQ ID NO: 703416 - DNA, 13 bp, C. elegans
atctacagttttt

SEQ ID NO: 703417 - DNA, 13 bp, C. elegans
atctacatatctt

SEQ ID NO: 703418 - DNA, 13 bp, C. elegans
atctacattttct

SEQ ID NO: 703419 - DNA, 13 bp, C. elegans
atctacatttttg

SEQ ID NO: 703420 - DNA, 13 bp, C. elegans
atctaccaaaaat

SEQ ID NO: 703421 - DNA, 13 bp, C. elegans
atctaccaatttt

SEQ ID NO: 703422 - DNA, 13 bp, C. elegans
atctacctaccta

SEQ ID NO: 703423 - DNA, 13 bp, C. elegans
atctacgaaaaat

SEQ ID NO: 703424 - DNA, 13 bp, C. elegans
atctacgaaaatt

SEQ ID NO: 703425 - DNA, 13 bp, C. elegans
atctacgaatttt

SEQ ID NO: 703426 - DNA, 13 bp, C. elegans
atctactcggaga

SEQ ID NO: 703427 - DNA, 13 bp, C. elegans
atctactgtttca

SEQ ID NO: 703428 - DNA, 13 bp, C. elegans
atctacttttgaa

SEQ ID NO: 703429 - DNA, 13 bp, C. elegans
atctacttttttg

SEQ ID NO: 703430 - DNA, 13 bp, C. elegans
atctagaaaaatt

SEQ ID NO: 703431 - DNA, 13 bp, C. elegans
atctagaaaattt

SEQ ID NO: 703432 - DNA, 13 bp, C. elegans
atctagaatattt

SEQ ID NO: 703433 - DNA, 13 bp, C. elegans
atctagatatttt

SEQ ID NO: 703434 - DNA, 13 bp, C. elegans
atctagatttttg

SEQ ID NO: 703435 - DNA, 13 bp, C. elegans
atctagttgaaaa

SEQ ID NO: 703436 - DNA, 13 bp, C. elegans
atctagttttaaa

SEQ ID NO: 703437 - DNA, 13 bp, C. elegans
atctataaaatga

SEQ ID NO: 703438 - DNA, 13 bp, C. elegans
atctatcaaaaca

SEQ ID NO: 703439 - DNA, 13 bp, C. elegans
atctatcagaata

SEQ ID NO: 703440 - DNA, 13 bp, C. elegans
atctatctctctc

SEQ ID NO: 703441 - DNA, 13 bp, C. elegans
atctatgtgaaaa

SEQ ID NO: 703442 - DNA, 13 bp, C. elegans
atctattcgaaat

SEQ ID NO: 703443 - DNA, 13 bp, C. elegans
atctattctctct

SEQ ID NO: 703444 - DNA, 13 bp, C. elegans
atctattgatttt

SEQ ID NO: 703445 - DNA, 13 bp, C. elegans
atctattgtatgt

SEQ ID NO: 703446 - DNA, 13 bp, C. elegans
atctattgttatt

SEQ ID NO: 703447 - DNA, 13 bp, C. elegans
atctatttcaaat

SEQ ID NO: 703448 - DNA, 13 bp, C. elegans
atctattttcaga

SEQ ID NO: 703449 - DNA, 13 bp, C. elegans
atctattttgaaa

SEQ ID NO: 703450 - DNA, 13 bp, C. elegans
atctatttttgcc

SEQ ID NO: 703451 - DNA, 13 bp, C. elegans
atctattttttcg

SEQ ID NO: 703452 - DNA, 13 bp, C. elegans
atctcaaaaaact

SEQ ID NO: 703453 - DNA, 13 bp, C. elegans
atctcaaaaacca

SEQ ID NO: 703454 - DNA, 13 bp, C. elegans
atctcaaaaactg

SEQ ID NO: 703455 - DNA, 13 bp, C. elegans
atctcaaaacatt

SEQ ID NO: 703456 - DNA, 13 bp, C. elegans
atctcaaaacttg

SEQ ID NO: 703457 - DNA, 13 bp, C. elegans
atctcaaaagatt

SEQ ID NO: 703458 - DNA, 13 bp, C. elegans
atctcaaaagttc

SEQ ID NO: 703459 - DNA, 13 bp, C. elegans
atctcaaaatatt

SEQ ID NO: 703460 - DNA, 13 bp, C. elegans
atctcaaaatcaa

SEQ ID NO: 703461 - DNA, 13 bp, C. elegans
atctcaaaatctg

SEQ ID NO: 703462 - DNA, 13 bp, C. elegans
atctcaaaatttg

SEQ ID NO: 703463 - DNA, 13 bp, C. elegans
atctcaaattgtt

SEQ ID NO: 703464 - DNA, 13 bp, C. elegans
atctcaaatttct

SEQ ID NO: 703465 - DNA, 13 bp, C. elegans
atctcaaatttga

SEQ ID NO: 703466 - DNA, 13 bp, C. elegans
atctcaagttcta

SEQ ID NO: 703467 - DNA, 13 bp, C. elegans
atctcaatttcaa

SEQ ID NO: 703468 - DNA, 13 bp, C. elegans
atctcaattttaa

SEQ ID NO: 703469 - DNA, 13 bp, C. elegans
atctcaattttca

SEQ ID NO: 703470 - DNA, 13 bp, C. elegans
atctcaattttcg

SEQ ID NO: 703471 - DNA, 13 bp, C. elegans
atctcagttgtcg

SEQ ID NO: 703472 - DNA, 13 bp, C. elegans
atctcagttttcc

SEQ ID NO: 703473 - DNA, 13 bp, C. elegans
atctcataaaatt

SEQ ID NO: 703474 - DNA, 13 bp, C. elegans
atctcatcaattt

SEQ ID NO: 703475 - DNA, 13 bp, C. elegans
atctcatgttttt

SEQ ID NO: 703476 - DNA, 13 bp, C. elegans
atctcatttgatt

SEQ ID NO: 703477 - DNA, 13 bp, C. elegans
atctcattttaga

SEQ ID NO: 703478 - DNA, 13 bp, C. elegans
atctcattttgtt

SEQ ID NO: 703479 - DNA, 13 bp, C. elegans
atctcatttttca

SEQ ID NO: 703480 - DNA, 13 bp, C. elegans
atctccacaaaaa

SEQ ID NO: 703481 - DNA, 13 bp, C. elegans
atctccacttttt

SEQ ID NO: 703482 - DNA, 13 bp, C. elegans
atctccatttttc

SEQ ID NO: 703483 - DNA, 13 bp, C. elegans
atctcccgaattt

SEQ ID NO: 703484 - DNA, 13 bp, C. elegans
atctccgaaaatt

SEQ ID NO: 703485 - DNA, 14 bp, C. elegans
atctccgtggaaaa

SEQ ID NO: 703486 - DNA, 13 bp, C. elegans
atctcctcagaga

SEQ ID NO: 703487 - DNA, 13 bp, C. elegans
atctcgaatttct

SEQ ID NO: 703488 - DNA, 13 bp, C. elegans
atctcggttgtct

SEQ ID NO: 703489 - DNA, 13 bp, C. elegans
atctcggtttttt

SEQ ID NO: 703490 - DNA, 13 bp, C. elegans
atctctaaatttt

SEQ ID NO: 703491 - DNA, 13 bp, C. elegans
atctctaatttcc

SEQ ID NO: 703492 - DNA, 13 bp, C. elegans
atctctaattttc

SEQ ID NO: 703493 - DNA, 13 bp, C. elegans
atctctatctctc

SEQ ID NO: 703494 - DNA, 13 bp, C. elegans
atctctatttctc

SEQ ID NO: 703495 - DNA, 13 bp, C. elegans
atctctcaaaatt

SEQ ID NO: 703496 - DNA, 13 bp, C. elegans
atctctcaatttt

SEQ ID NO: 703497 - DNA, 13 bp, C. elegans
atctctcattttc

SEQ ID NO: 703498 - DNA, 13 bp, C. elegans
atctctgaaacta

SEQ ID NO: 703499 - DNA, 13 bp, C. elegans
atctctgaatttt

SEQ ID NO: 703500 - DNA, 13 bp, C. elegans
atctctgtgtctc

SEQ ID NO: 703501 - DNA, 14 bp, C. elegans
atctcttcaaaaga

SEQ ID NO: 703502 - DNA, 13 bp, C. elegans
atctcttccaaaa

SEQ ID NO: 703503 - DNA, 13 bp, C. elegans
atctcttgatttt

SEQ ID NO: 703504 - DNA, 13 bp, C. elegans
atctctttttcca

SEQ ID NO: 703505 - DNA, 13 bp, C. elegans
atctgaaaaaaat

SEQ ID NO: 703506 - DNA, 13 bp, C. elegans
atctgaaaaacga

SEQ ID NO: 703507 - DNA, 13 bp, C. elegans
atctgaaaaattg

SEQ ID NO: 703508 - DNA, 13 bp, C. elegans
atctgaaaacaaa

SEQ ID NO: 703509 - DNA, 13 bp, C. elegans
atctgaaaactca

SEQ ID NO: 703510 - DNA, 13 bp, C. elegans
atctgaaaataat

SEQ ID NO: 703511 - DNA, 13 bp, C. elegans
atctgaaaatcga

SEQ ID NO: 703512 - DNA, 13 bp, C. elegans
atctgaaaatgat

SEQ ID NO: 703513 - DNA, 13 bp, C. elegans
atctgaaaatgtt

SEQ ID NO: 703514 - DNA, 13 bp, C. elegans
atctgaaaattat

SEQ ID NO: 703515 - DNA, 13 bp, C. elegans
atctgaaacaatt

SEQ ID NO: 703516 - DNA, 13 bp, C. elegans
atctgaaacagta

SEQ ID NO: 703517 - DNA, 13 bp, C. elegans
atctgaaactgaa

SEQ ID NO: 703518 - DNA, 13 bp, C. elegans
atctgaaactttt

SEQ ID NO: 703519 - DNA, 13 bp, C. elegans
atctgaaataaat

SEQ ID NO: 703520 - DNA, 13 bp, C. elegans
atctgaaatatct

SEQ ID NO: 703521 - DNA, 13 bp, C. elegans
atctgaaatcaaa

SEQ ID NO: 703522 - DNA, 13 bp, C. elegans
atctgaaattaaa

SEQ ID NO: 703523 - DNA, 13 bp, C. elegans
atctgaaattcca

SEQ ID NO: 703524 - DNA, 13 bp, C. elegans
atctgaaattgtc

SEQ ID NO: 703525 - DNA, 13 bp, C. elegans
atctgaaattgtt

SEQ ID NO: 703526 - DNA, 13 bp, C. elegans
atctgaaatttca

SEQ ID NO: 703527 - DNA, 13 bp, C. elegans
atctgaaatttcc

SEQ ID NO: 703528 - DNA, 13 bp, C. elegans
atctgaaatttta

SEQ ID NO: 703529 - DNA, 13 bp, C. elegans
atctgaaattttc

SEQ ID NO: 703530 - DNA, 13 bp, C. elegans
atctgaataaaaa

SEQ ID NO: 703531 - DNA, 13 bp, C. elegans
atctgaatatatt

SEQ ID NO: 703532 - DNA, 13 bp, C. elegans
atctgaatatttt

SEQ ID NO: 703533 - DNA, 13 bp, C. elegans
atctgaatctgaa

SEQ ID NO: 703534 - DNA, 13 bp, C. elegans
atctgaattcaaa

SEQ ID NO: 703535 - DNA, 13 bp, C. elegans
atctgaatttaaa

SEQ ID NO: 703536 - DNA, 13 bp, C. elegans
atctgaatttcag

SEQ ID NO: 703537 - DNA, 13 bp, C. elegans
atctgaatttgaa

SEQ ID NO: 703538 - DNA, 13 bp, C. elegans
atctgaattttat

SEQ ID NO: 703539 - DNA, 13 bp, C. elegans
atctgaatttttc

SEQ ID NO: 703540 - DNA, 13 bp, C. elegans
atctgacattttc

SEQ ID NO: 703541 - DNA, 13 bp, C. elegans
atctgatattttt

SEQ ID NO: 703542 - DNA, 13 bp, C. elegans
atctgatccttca

SEQ ID NO: 703543 - DNA, 13 bp, C. elegans
atctgatcttcca

SEQ ID NO: 703544 - DNA, 13 bp, C. elegans
atctgatttattt

SEQ ID NO: 703545 - DNA, 13 bp, C. elegans
atctgatttttga

SEQ ID NO: 703546 - DNA, 13 bp, C. elegans
atctgcaaatatt

SEQ ID NO: 703547 - DNA, 13 bp, C. elegans
atctgccggaaaa

SEQ ID NO: 703548 - DNA, 13 bp, C. elegans
atctggaaaaaat

SEQ ID NO: 703549 - DNA, 13 bp, C. elegans
atctggaaaaatt

SEQ ID NO: 703550 - DNA, 13 bp, C. elegans
atctggaaaactg

SEQ ID NO: 703551 - DNA, 13 bp, C. elegans
atctgggaaattt

SEQ ID NO: 703552 - DNA, 13 bp, C. elegans
atctggtttttta

SEQ ID NO: 703553 - DNA, 13 bp, C. elegans
atctgtgaaattt

SEQ ID NO: 703554 - DNA, 13 bp, C. elegans
atctgtgctcaac

SEQ ID NO: 703555 - DNA, 13 bp, C. elegans
atctgttcaaaaa

SEQ ID NO: 703556 - DNA, 19 bp, C. elegans
atctgttccgctcactcca

SEQ ID NO: 703557 - DNA, 13 bp, C. elegans
atctgtttaattt

SEQ ID NO: 703558 - DNA, 13 bp, C. elegans
atctgtttttaaa

SEQ ID NO: 703559 - DNA, 13 bp, C. elegans
atcttaaaacttt

SEQ ID NO: 703560 - DNA, 13 bp, C. elegans
atcttaaaggtgg

SEQ ID NO: 703561 - DNA, 13 bp, C. elegans
atcttaatctgaa

SEQ ID NO: 703562 - DNA, 13 bp, C. elegans
atcttacgacaaa

SEQ ID NO: 703563 - DNA, 13 bp, C. elegans
atcttatgaaaat

SEQ ID NO: 703564 - DNA, 13 bp, C. elegans
atcttatgatttt

SEQ ID NO: 703565 - DNA, 13 bp, C. elegans
atcttcaaaaatt

SEQ ID NO: 703566 - DNA, 13 bp, C. elegans
atcttcaaaatta

SEQ ID NO: 703567 - DNA, 13 bp, C. elegans
atcttcaaacttt

SEQ ID NO: 703568 - DNA, 13 bp, C. elegans
atcttcaaagatt

SEQ ID NO: 703569 - DNA, 13 bp, C. elegans
atcttcaaattga

SEQ ID NO: 703570 - DNA, 13 bp, C. elegans
atcttcaaatttt

SEQ ID NO: 703571 - DNA, 13 bp, C. elegans
atcttcaatattt

SEQ ID NO: 703572 - DNA, 13 bp, C. elegans
atcttcacatttt

SEQ ID NO: 703573 - DNA, 13 bp, C. elegans
atcttcagaattt

SEQ ID NO: 703574 - DNA, 13 bp, C. elegans
atcttcagttttt

SEQ ID NO: 703575 - DNA, 13 bp, C. elegans
atcttcatcaaaa

SEQ ID NO: 703576 - DNA, 13 bp, C. elegans
atcttcattttcc

SEQ ID NO: 703577 - DNA, 13 bp, C. elegans
atcttcattttga

SEQ ID NO: 703578 - DNA, 13 bp, C. elegans
atcttccagaaaa

SEQ ID NO: 703579 - DNA, 13 bp, C. elegans
atcttccattttc

SEQ ID NO: 703580 - DNA, 13 bp, C. elegans
atcttcccatttt

SEQ ID NO: 703581 - DNA, 13 bp, C. elegans
atcttctaaaatt

SEQ ID NO: 703582 - DNA, 13 bp, C. elegans
atcttctattaat

SEQ ID NO: 703583 - DNA, 13 bp, C. elegans
atcttctgaaaaa

SEQ ID NO: 703584 - DNA, 13 bp, C. elegans
atcttctgaaaat

SEQ ID NO: 703585 - DNA, 13 bp, C. elegans
atcttctgatctt

SEQ ID NO: 703586 - DNA, 13 bp, C. elegans
atcttctgttctc

SEQ ID NO: 703587 - DNA, 13 bp, C. elegans
atcttcttctgaa

SEQ ID NO: 703588 - DNA, 13 bp, C. elegans
atcttcttttcca

SEQ ID NO: 703589 - DNA, 13 bp, C. elegans
atcttgaaaaaat

SEQ ID NO: 703590 - DNA, 13 bp, C. elegans
atcttgaaaactg

SEQ ID NO: 703591 - DNA, 13 bp, C. elegans
atcttgaaaataa

SEQ ID NO: 703592 - DNA, 13 bp, C. elegans
atcttgaatttat

SEQ ID NO: 703593 - DNA, 13 bp, C. elegans
atcttgcgttttt

SEQ ID NO: 703594 - DNA, 13 bp, C. elegans
atcttgttttaaa

SEQ ID NO: 703595 - DNA, 13 bp, C. elegans
atctttaaaagtt

SEQ ID NO: 703596 - DNA, 13 bp, C. elegans
atctttaaagaaa

SEQ ID NO: 703597 - DNA, 13 bp, C. elegans
atctttcaaaaat

SEQ ID NO: 703598 - DNA, 13 bp, C. elegans
atctttcaaaatt

SEQ ID NO: 703599 - DNA, 13 bp, C. elegans
atctttcaaataa

SEQ ID NO: 703600 - DNA, 13 bp, C. elegans
atctttcagattt

SEQ ID NO: 703601 - DNA, 13 bp, C. elegans
atctttcagtttt

SEQ ID NO: 703602 - DNA, 13 bp, C. elegans
atctttctgaatt

SEQ ID NO: 703603 - DNA, 13 bp, C. elegans
atctttgaaaaat

SEQ ID NO: 703604 - DNA, 13 bp, C. elegans
atctttgaaaatt

SEQ ID NO: 703605 - DNA, 13 bp, C. elegans
atctttgaaatat

SEQ ID NO: 703606 - DNA, 13 bp, C. elegans
atctttgaaattt

SEQ ID NO: 703607 - DNA, 13 bp, C. elegans
atctttgattttc

SEQ ID NO: 703608 - DNA, 13 bp, C. elegans
atctttgcaaaat

SEQ ID NO: 703609 - DNA, 13 bp, C. elegans
atctttggtttta

SEQ ID NO: 703610 - DNA, 13 bp, C. elegans
atctttgtaattt

SEQ ID NO: 703611 - DNA, 13 bp, C. elegans
atctttgttttca

SEQ ID NO: 703612 - DNA, 13 bp, C. elegans
atcttttaaaaag

SEQ ID NO: 703613 - DNA, 13 bp, C. elegans
atcttttactcat

SEQ ID NO: 703614 - DNA, 13 bp, C. elegans
atcttttccaaaa

SEQ ID NO: 703615 - DNA, 13 bp, C. elegans
atcttttctcaat

SEQ ID NO: 703616 - DNA, 13 bp, C. elegans
atcttttgaaatt

SEQ ID NO: 703617 - DNA, 13 bp, C. elegans
atctttttgaaat

SEQ ID NO: 703618 - DNA, 13 bp, C. elegans
atctttttgaatt

SEQ ID NO: 703619 - DNA, 13 bp, C. elegans
atctttttgctcg

SEQ ID NO: 703620 - DNA, 13 bp, C. elegans
atcttttttcaga

SEQ ID NO: 703621 - DNA, 13 bp, C. elegans
atgaaaaaattgt

SEQ ID NO: 703622 - DNA, 13 bp, C. elegans
atgaaaaacatga

SEQ ID NO: 703623 - DNA, 13 bp, C. elegans
atgaaaaactcaa

SEQ ID NO: 703624 - DNA, 13 bp, C. elegans
atgaaaaactgaa

SEQ ID NO: 703625 - DNA, 13 bp, C. elegans
atgaaaaactgga

SEQ ID NO: 703626 - DNA, 13 bp, C. elegans
atgaaaaagtggc

SEQ ID NO: 703627 - DNA, 13 bp, C. elegans
atgaaaaagtttt

SEQ ID NO: 703628 - DNA, 13 bp, C. elegans
atgaaaaatattg

SEQ ID NO: 703629 - DNA, 13 bp, C. elegans
atgaaaaatcaca

SEQ ID NO: 703630 - DNA, 13 bp, C. elegans
atgaaaaatggat

SEQ ID NO: 703631 - DNA, 13 bp, C. elegans
atgaaaaattcaa

SEQ ID NO: 703632 - DNA, 14 bp, C. elegans
atgaaaaattcgaa

SEQ ID NO: 703633 - DNA, 13 bp, C. elegans
atgaaaacatatt

SEQ ID NO: 703634 - DNA, 13 bp, C. elegans
atgaaaacatcaa

SEQ ID NO: 703635 - DNA, 13 bp, C. elegans
atgaaaacattat

SEQ ID NO: 703636 - DNA, 13 bp, C. elegans
atgaaaacattca

SEQ ID NO: 703637 - DNA, 13 bp, C. elegans
atgaaaactggaa

SEQ ID NO: 703638 - DNA, 13 bp, C. elegans
atgaaaactgtca

SEQ ID NO: 703639 - DNA, 13 bp, C. elegans
atgaaaactgtga

SEQ ID NO: 703640 - DNA, 13 bp, C. elegans
atgaaaactgttt

SEQ ID NO: 703641 - DNA, 13 bp, C. elegans
atgaaaagagcaa

SEQ ID NO: 703642 - DNA, 13 bp, C. elegans
atgaaaagattga

SEQ ID NO: 703643 - DNA, 13 bp, C. elegans
atgaaaaggaaac

SEQ ID NO: 703644 - DNA, 13 bp, C. elegans
atgaaaagtcaat

SEQ ID NO: 703645 - DNA, 13 bp, C. elegans
atgaaaagtcgat

SEQ ID NO: 703646 - DNA, 13 bp, C. elegans
atgaaaagtgtga

SEQ ID NO: 703647 - DNA, 13 bp, C. elegans
atgaaaatagtat

SEQ ID NO: 703648 - DNA, 13 bp, C. elegans
atgaaaatatatg

SEQ ID NO: 703649 - DNA, 13 bp, C. elegans
atgaaaatatcga

SEQ ID NO: 703650 - DNA, 13 bp, C. elegans
atgaaaatatcta

SEQ ID NO: 703651 - DNA, 13 bp, C. elegans
atgaaaatcaaag

SEQ ID NO: 703652 - DNA, 13 bp, C. elegans
atgaaaatcatga

SEQ ID NO: 703653 - DNA, 13 bp, C. elegans
atgaaaatccaat

SEQ ID NO: 703654 - DNA, 13 bp, C. elegans
atgaaaatcgaaa

SEQ ID NO: 703655 - DNA, 13 bp, C. elegans
atgaaaatcgatg

SEQ ID NO: 703656 - DNA, 13 bp, C. elegans
atgaaaatctaaa

SEQ ID NO: 703657 - DNA, 13 bp, C. elegans
atgaaaatctcaa

SEQ ID NO: 703658 - DNA, 13 bp, C. elegans
atgaaaatggatt

SEQ ID NO: 703659 - DNA, 13 bp, C. elegans
atgaaaatggcaa

SEQ ID NO: 703660 - DNA, 13 bp, C. elegans
atgaaaatgtcaa

SEQ ID NO: 703661 - DNA, 13 bp, C. elegans
atgaaaatgtgta

SEQ ID NO: 703662 - DNA, 13 bp, C. elegans
atgaaaatgttaa

SEQ ID NO: 703663 - DNA, 13 bp, C. elegans
atgaaaatgttga

SEQ ID NO: 703664 - DNA, 13 bp, C. elegans
atgaaaattatca

SEQ ID NO: 703665 - DNA, 13 bp, C. elegans
atgaaaattgaga

SEQ ID NO: 703666 - DNA, 13 bp, C. elegans
atgaaaattgatt

SEQ ID NO: 703667 - DNA, 13 bp, C. elegans
atgaaaattgcaa

SEQ ID NO: 703668 - DNA, 13 bp, C. elegans
atgaaaatttgaa

SEQ ID NO: 703669 - DNA, 13 bp, C. elegans
atgaaaattttcg

SEQ ID NO: 703670 - DNA, 13 bp, C. elegans
atgaaaatttttc

SEQ ID NO: 703671 - DNA, 13 bp, C. elegans
atgaaacaaatga

SEQ ID NO: 703672 - DNA, 13 bp, C. elegans
atgaaacaatttt

SEQ ID NO: 703673 - DNA, 13 bp, C. elegans
atgaaacagagaa

SEQ ID NO: 703674 - DNA, 13 bp, C. elegans
atgaaacattgaa

SEQ ID NO: 703675 - DNA, 13 bp, C. elegans
atgaaactaaata

SEQ ID NO: 703676 - DNA, 13 bp, C. elegans
atgaaagaaatca

SEQ ID NO: 703677 - DNA, 13 bp, C. elegans
atgaaagagcaaa

SEQ ID NO: 703678 - DNA, 13 bp, C. elegans
atgaaagtttatt

SEQ ID NO: 703679 - DNA, 13 bp, C. elegans
atgaaataattgt

SEQ ID NO: 703680 - DNA, 13 bp, C. elegans
atgaaatactttt

SEQ ID NO: 703681 - DNA, 13 bp, C. elegans
atgaaatatgatt

SEQ ID NO: 703682 - DNA, 13 bp, C. elegans
atgaaatatgcac

SEQ ID NO: 703683 - DNA, 13 bp, C. elegans
atgaaatcaaaat

SEQ ID NO: 703684 - DNA, 13 bp, C. elegans
atgaaatcattga

SEQ ID NO: 703685 - DNA, 13 bp, C. elegans
atgaaatcatttt

SEQ ID NO: 703686 - DNA, 13 bp, C. elegans
atgaaatcgaaaa

SEQ ID NO: 703687 - DNA, 13 bp, C. elegans
atgaaatcgattt

SEQ ID NO: 703688 - DNA, 13 bp, C. elegans
atgaaatctcaaa

SEQ ID NO: 703689 - DNA, 13 bp, C. elegans
atgaaatctcaat

SEQ ID NO: 703690 - DNA, 13 bp, C. elegans
atgaaatctgaaa

SEQ ID NO: 703691 - DNA, 13 bp, C. elegans
atgaaatgaatga

SEQ ID NO: 703692 - DNA, 13 bp, C. elegans
atgaaatgagaat

SEQ ID NO: 703693 - DNA, 13 bp, C. elegans
atgaaatgtttaa

SEQ ID NO: 703694 - DNA, 13 bp, C. elegans
atgaaattatcta

SEQ ID NO: 703695 - DNA, 13 bp, C. elegans
atgaaattatttc

SEQ ID NO: 703696 - DNA, 13 bp, C. elegans
atgaaattcaaag

SEQ ID NO: 703697 - DNA, 13 bp, C. elegans
atgaaattcaaca

SEQ ID NO: 703698 - DNA, 13 bp, C. elegans
atgaaattcaata

SEQ ID NO: 703699 - DNA, 13 bp, C. elegans
atgaaattcagtt

SEQ ID NO: 703700 - DNA, 13 bp, C. elegans
atgaaattccaat

SEQ ID NO: 703701 - DNA, 13 bp, C. elegans
atgaaattcgaaa

SEQ ID NO: 703702 - DNA, 13 bp, C. elegans
atgaaattcgaga

SEQ ID NO: 703703 - DNA, 13 bp, C. elegans
atgaaattcggaa

SEQ ID NO: 703704 - DNA, 13 bp, C. elegans
atgaaattgtgaa

SEQ ID NO: 703705 - DNA, 13 bp, C. elegans
atgaaatttcaaa

SEQ ID NO: 703706 - DNA, 13 bp, C. elegans
atgaaatttgaat

SEQ ID NO: 703707 - DNA, 13 bp, C. elegans
atgaaattttcat

SEQ ID NO: 703708 - DNA, 13 bp, C. elegans
atgaaatttttga

SEQ ID NO: 703709 - DNA, 13 bp, C. elegans
atgaacaaaaatg

SEQ ID NO: 703710 - DNA, 13 bp, C. elegans
atgaacaaaattt

SEQ ID NO: 703711 - DNA, 13 bp, C. elegans
atgaacaaattga

SEQ ID NO: 703712 - DNA, 13 bp, C. elegans
atgaacaaggaat

SEQ ID NO: 703713 - DNA, 13 bp, C. elegans
atgaacaatttca

SEQ ID NO: 703714 - DNA, 13 bp, C. elegans
atgaacaattttc

SEQ ID NO: 703715 - DNA, 13 bp, C. elegans
atgaacagttttc

SEQ ID NO: 703716 - DNA, 13 bp, C. elegans
atgaacatttccg

SEQ ID NO: 703717 - DNA, 13 bp, C. elegans
atgaacatttttc

SEQ ID NO: 703718 - DNA, 13 bp, C. elegans
atgaacccaaaaa

SEQ ID NO: 703719 - DNA, 13 bp, C. elegans
atgaactcaaact

SEQ ID NO: 703720 - DNA, 13 bp, C. elegans
atgaactttattt

SEQ ID NO: 703721 - DNA, 13 bp, C. elegans
atgaactttcaga

SEQ ID NO: 703722 - DNA, 13 bp, C. elegans
atgaacttttatt

SEQ ID NO: 703723 - DNA, 13 bp, C. elegans
atgaacttttgtt

SEQ ID NO: 703724 - DNA, 13 bp, C. elegans
atgaagaaaatca

SEQ ID NO: 703725 - DNA, 13 bp, C. elegans
atgaagaaagtga

SEQ ID NO: 703726 - DNA, 13 bp, C. elegans
atgaagaacaatt

SEQ ID NO: 703727 - DNA, 13 bp, C. elegans
atgaagaagaagc

SEQ ID NO: 703728 - DNA, 13 bp, C. elegans
atgaagaattgaa

SEQ ID NO: 703729 - DNA, 13 bp, C. elegans
atgaagagtattt

SEQ ID NO: 703730 - DNA, 13 bp, C. elegans
atgaagatttatt

SEQ ID NO: 703731 - DNA, 13 bp, C. elegans
atgaagcataaaa

SEQ ID NO: 703732 - DNA, 13 bp, C. elegans
atgaagtaaatcg

SEQ ID NO: 703733 - DNA, 13 bp, C. elegans
atgaagttgaaaa

SEQ ID NO: 703734 - DNA, 13 bp, C. elegans
atgaagtttcaaa

SEQ ID NO: 703735 - DNA, 13 bp, C. elegans
atgaagtttttaa

SEQ ID NO: 703736 - DNA, 13 bp, C. elegans
atgaagtttttat

SEQ ID NO: 703737 - DNA, 13 bp, C. elegans
atgaatacaataa

SEQ ID NO: 703738 - DNA, 13 bp, C. elegans
atgaatacatttt

SEQ ID NO: 703739 - DNA, 13 bp, C. elegans
atgaatacttttt

SEQ ID NO: 703740 - DNA, 13 bp, C. elegans
atgaatattcaat

SEQ ID NO: 703741 - DNA, 13 bp, C. elegans
atgaatattcata

SEQ ID NO: 703742 - DNA, 13 bp, C. elegans
atgaatattgtgt

SEQ ID NO: 703743 - DNA, 13 bp, C. elegans
atgaatattttga

SEQ ID NO: 703744 - DNA, 13 bp, C. elegans
atgaatattttgg

SEQ ID NO: 703745 - DNA, 13 bp, C. elegans
atgaatcacaaaa

SEQ ID NO: 703746 - DNA, 13 bp, C. elegans
atgaatctgaaaa

SEQ ID NO: 703747 - DNA, 13 bp, C. elegans
atgaatgaaatga

SEQ ID NO: 703748 - DNA, 13 bp, C. elegans
atgaatgaataat

SEQ ID NO: 703749 - DNA, 13 bp, C. elegans
atgaatgacaaaa

SEQ ID NO: 703750 - DNA, 13 bp, C. elegans
atgaatggcaaaa

SEQ ID NO: 703751 - DNA, 13 bp, C. elegans
atgaatgtgtttt

SEQ ID NO: 703752 - DNA, 13 bp, C. elegans
atgaattaattct

SEQ ID NO: 703753 - DNA, 13 bp, C. elegans
atgaattactgta

SEQ ID NO: 703754 - DNA, 13 bp, C. elegans
atgaattatgaat

SEQ ID NO: 703755 - DNA, 13 bp, C. elegans
atgaattattcaa

SEQ ID NO: 703756 - DNA, 13 bp, C. elegans
atgaattcaaatt

SEQ ID NO: 703757 - DNA, 13 bp, C. elegans
atgaattcatttt

SEQ ID NO: 703758 - DNA, 13 bp, C. elegans
atgaattccaaaa

SEQ ID NO: 703759 - DNA, 13 bp, C. elegans
atgaattcccaaa

SEQ ID NO: 703760 - DNA, 13 bp, C. elegans
atgaattgaataa

SEQ ID NO: 703761 - DNA, 13 bp, C. elegans
atgaattgaatga

SEQ ID NO: 703762 - DNA, 13 bp, C. elegans
atgaattggaaaa

SEQ ID NO: 703763 - DNA, 13 bp, C. elegans
atgaattgttttc

SEQ ID NO: 703764 - DNA, 13 bp, C. elegans
atgaatttcattt

SEQ ID NO: 703765 - DNA, 13 bp, C. elegans
atgaatttccaaa

SEQ ID NO: 703766 - DNA, 13 bp, C. elegans
atgaatttctcaa

SEQ ID NO: 703767 - DNA, 13 bp, C. elegans
atgaatttgaaaa

SEQ ID NO: 703768 - DNA, 13 bp, C. elegans
atgaatttgattt

SEQ ID NO: 703769 - DNA, 13 bp, C. elegans
atgaatttgtatt

SEQ ID NO: 703770 - DNA, 13 bp, C. elegans
atgaattttcaaa

SEQ ID NO: 703771 - DNA, 13 bp, C. elegans
atgaattttcaga

SEQ ID NO: 703772 - DNA, 13 bp, C. elegans
atgaattttcgtt

SEQ ID NO: 703773 - DNA, 13 bp, C. elegans
atgaattttgcaa

SEQ ID NO: 703774 - DNA, 13 bp, C. elegans
atgaattttgtaa

SEQ ID NO: 703775 - DNA, 13 bp, C. elegans
atgaattttttca

SEQ ID NO: 703776 - DNA, 13 bp, C. elegans
atgacaaaaatcg

SEQ ID NO: 703777 - DNA, 13 bp, C. elegans
atgacaaaacaat

SEQ ID NO: 703778 - DNA, 13 bp, C. elegans
atgacaaaagagc

SEQ ID NO: 703779 - DNA, 13 bp, C. elegans
atgacaaaatttc

SEQ ID NO: 703780 - DNA, 13 bp, C. elegans
atgacaaagtgat

SEQ ID NO: 703781 - DNA, 13 bp, C. elegans
atgacaaatttga

SEQ ID NO: 703782 - DNA, 16 bp, C. elegans
atgacaacgcaagacc

SEQ ID NO: 703783 - DNA, 13 bp, C. elegans
atgacaatgaaaa

SEQ ID NO: 703784 - DNA, 13 bp, C. elegans
atgacaattttga

SEQ ID NO: 703785 - DNA, 13 bp, C. elegans
atgacaatttttg

SEQ ID NO: 703786 - DNA, 13 bp, C. elegans
atgacacaaaaat

SEQ ID NO: 703787 - DNA, 13 bp, C. elegans
atgacacagaaaa

SEQ ID NO: 703788 - DNA, 32 bp, C. elegans
atgacagaatggcgcccatatggatggaaaag

SEQ ID NO: 703789 - DNA, 13 bp, C. elegans
atgacatatttta

SEQ ID NO: 703790 - DNA, 13 bp, C. elegans
atgacattgaaaa

SEQ ID NO: 703791 - DNA, 13 bp, C. elegans
atgacatttttct

SEQ ID NO: 703792 - DNA, 13 bp, C. elegans
atgacccaaaact

SEQ ID NO: 703793 - DNA, 13 bp, C. elegans
atgaccgagtttt

SEQ ID NO: 703794 - DNA, 13 bp, C. elegans
atgacctagaaat

SEQ ID NO: 703795 - DNA, 13 bp, C. elegans
atgacgtcacaga

SEQ ID NO: 703796 - DNA, 13 bp, C. elegans
atgacgtcactaa

SEQ ID NO: 703797 - DNA, 13 bp, C. elegans
atgacgtcacttc

SEQ ID NO: 703798 - DNA, 13 bp, C. elegans
atgacgtcacttt

SEQ ID NO: 703799 - DNA, 13 bp, C. elegans
atgacgtcataaa

SEQ ID NO: 703800 - DNA, 13 bp, C. elegans
atgacgtcatatt

SEQ ID NO: 703801 - DNA, 13 bp, C. elegans
atgacgtcatttc

SEQ ID NO: 703802 - DNA, 13 bp, C. elegans
atgacgtggcaac

SEQ ID NO: 703803 - DNA, 13 bp, C. elegans
atgacgtggcagt

SEQ ID NO: 703804 - DNA, 13 bp, C. elegans
atgactactgtag

SEQ ID NO: 703805 - DNA, 13 bp, C. elegans
atgactcaaaaaa

SEQ ID NO: 703806 - DNA, 13 bp, C. elegans
atgactgattttt

SEQ ID NO: 703807 - DNA, 13 bp, C. elegans
atgacttcaaaaa

SEQ ID NO: 703808 - DNA, 13 bp, C. elegans
atgactttatttt

SEQ ID NO: 703809 - DNA, 13 bp, C. elegans
atgactttgaaaa

SEQ ID NO: 703810 - DNA, 13 bp, C. elegans
atgagaaaaatcg

SEQ ID NO: 703811 - DNA, 13 bp, C. elegans
atgagaaaaattc

SEQ ID NO: 703812 - DNA, 13 bp, C. elegans
atgagaaaacaat

SEQ ID NO: 703813 - DNA, 13 bp, C. elegans
atgagaaaagtgg

SEQ ID NO: 703814 - DNA, 13 bp, C. elegans
atgagaaaatcga

SEQ ID NO: 703815 - DNA, 13 bp, C. elegans
atgagaaagtgca

SEQ ID NO: 703816 - DNA, 13 bp, C. elegans
atgagaaattatt

SEQ ID NO: 703817 - DNA, 13 bp, C. elegans
atgagaaattgaa

SEQ ID NO: 703818 - DNA, 13 bp, C. elegans
atgagaaattgga

SEQ ID NO: 703819 - DNA, 13 bp, C. elegans
atgagaaatttgt

SEQ ID NO: 703820 - DNA, 13 bp, C. elegans
atgagaaccccaa

SEQ ID NO: 703821 - DNA, 13 bp, C. elegans
atgagaactgcaa

SEQ ID NO: 703822 - DNA, 13 bp, C. elegans
atgagaatattta

SEQ ID NO: 703823 - DNA, 13 bp, C. elegans
atgagaatgtttt

SEQ ID NO: 703824 - DNA, 13 bp, C. elegans
atgagaattgaaa

SEQ ID NO: 703825 - DNA, 13 bp, C. elegans
atgagaatttcga

SEQ ID NO: 703826 - DNA, 13 bp, C. elegans
atgagcaaaatga

SEQ ID NO: 703827 - DNA, 13 bp, C. elegans
atgagcaattgga

SEQ ID NO: 703828 - DNA, 13 bp, C. elegans
atgagcatttcaa

SEQ ID NO: 703829 - DNA, 13 bp, C. elegans
atgagccaacatt

SEQ ID NO: 703830 - DNA, 13 bp, C. elegans
atgagctctttta

SEQ ID NO: 703831 - DNA, 13 bp, C. elegans
atgagtatttgcc

SEQ ID NO: 703832 - DNA, 13 bp, C. elegans
atgagtgaaaaat

SEQ ID NO: 703833 - DNA, 13 bp, C. elegans
atgataaaatcaa

SEQ ID NO: 703834 - DNA, 13 bp, C. elegans
atgataaaatgat

SEQ ID NO: 703835 - DNA, 13 bp, C. elegans
atgataaatatac

SEQ ID NO: 703836 - DNA, 13 bp, C. elegans
atgataaattgaa

SEQ ID NO: 703837 - DNA, 13 bp, C. elegans
atgataatgataa

SEQ ID NO: 703838 - DNA, 13 bp, C. elegans
atgataatttcag

SEQ ID NO: 703839 - DNA, 14 bp, C. elegans
atgatactcagtct

SEQ ID NO: 703840 - DNA, 13 bp, C. elegans
atgatatcagaaa

SEQ ID NO: 703841 - DNA, 13 bp, C. elegans
atgatatctcaaa

SEQ ID NO: 703842 - DNA, 13 bp, C. elegans
atgatattttcca

SEQ ID NO: 703843 - DNA, 13 bp, C. elegans
atgatattttctt

SEQ ID NO: 703844 - DNA, 13 bp, C. elegans
atgatattttgaa

SEQ ID NO: 703845 - DNA, 13 bp, C. elegans
atgatcaaaattc

SEQ ID NO: 703846 - DNA, 13 bp, C. elegans
atgatcaattttt

SEQ ID NO: 703847 - DNA, 13 bp, C. elegans
atgatcacttttt

SEQ ID NO: 703848 - DNA, 13 bp, C. elegans
atgatcatatttt

SEQ ID NO: 703849 - DNA, 13 bp, C. elegans
atgatcatttgaa

SEQ ID NO: 703850 - DNA, 13 bp, C. elegans
atgatcatttttt

SEQ ID NO: 703851 - DNA, 13 bp, C. elegans
atgatctacaaca

SEQ ID NO: 703852 - DNA, 13 bp, C. elegans
atgatctcagctt

SEQ ID NO: 703853 - DNA, 13 bp, C. elegans
atgatctctaatt

SEQ ID NO: 703854 - DNA, 13 bp, C. elegans
atgatctgaaatt

SEQ ID NO: 703855 - DNA, 13 bp, C. elegans
atgatgaaacttc

SEQ ID NO: 703856 - DNA, 13 bp, C. elegans
atgatgaagatga

SEQ ID NO: 703857 - DNA, 13 bp, C. elegans
atgatgacgtcac

SEQ ID NO: 703858 - DNA, 13 bp, C. elegans
atgatgagaaatt

SEQ ID NO: 703859 - DNA, 13 bp, C. elegans
atgatgataatga

SEQ ID NO: 703860 - DNA, 13 bp, C. elegans
atgatgatatttg

SEQ ID NO: 703861 - DNA, 13 bp, C. elegans
atgatgatgaaaa

SEQ ID NO: 703862 - DNA, 13 bp, C. elegans
atgatgatgataa

SEQ ID NO: 703863 - DNA, 13 bp, C. elegans
atgatgatgatcg

SEQ ID NO: 703864 - DNA, 13 bp, C. elegans
atgatgatgatgg

SEQ ID NO: 703865 - DNA, 13 bp, C. elegans
atgatgatgattg

SEQ ID NO: 703866 - DNA, 13 bp, C. elegans
atgatgatgattt

SEQ ID NO: 703867 - DNA, 13 bp, C. elegans
atgatgattatga

SEQ ID NO: 703868 - DNA, 13 bp, C. elegans
atgatgattattt

SEQ ID NO: 703869 - DNA, 13 bp, C. elegans
atgatgatttgaa

SEQ ID NO: 703870 - DNA, 13 bp, C. elegans
atgatgcaaattt

SEQ ID NO: 703871 - DNA, 13 bp, C. elegans
atgatggaaaaag

SEQ ID NO: 703872 - DNA, 13 bp, C. elegans
atgatggaaaatg

SEQ ID NO: 703873 - DNA, 13 bp, C. elegans
atgatgtcatatt

SEQ ID NO: 703874 - DNA, 13 bp, C. elegans
atgattactgtag

SEQ ID NO: 703875 - DNA, 13 bp, C. elegans
atgattatactta

SEQ ID NO: 703876 - DNA, 13 bp, C. elegans
atgattattttct

SEQ ID NO: 703877 - DNA, 13 bp, C. elegans
atgattattttga

SEQ ID NO: 703878 - DNA, 13 bp, C. elegans
atgattatttttc

SEQ ID NO: 703879 - DNA, 13 bp, C. elegans
atgattcaaaaca

SEQ ID NO: 703880 - DNA, 13 bp, C. elegans
atgattcacaaaa

SEQ ID NO: 703881 - DNA, 13 bp, C. elegans
atgattccagaat

SEQ ID NO: 703882 - DNA, 14 bp, C. elegans
atgattctcagttt

SEQ ID NO: 703883 - DNA, 13 bp, C. elegans
atgattgaaaaag

SEQ ID NO: 703884 - DNA, 13 bp, C. elegans
atgattgaaaaat

SEQ ID NO: 703885 - DNA, 13 bp, C. elegans
atgattgaaaatg

SEQ ID NO: 703886 - DNA, 13 bp, C. elegans
atgattgttttaa

SEQ ID NO: 703887 - DNA, 13 bp, C. elegans
atgatttacaaat

SEQ ID NO: 703888 - DNA, 13 bp, C. elegans
atgatttcatttt

SEQ ID NO: 703889 - DNA, 13 bp, C. elegans
atgatttcgaaat

SEQ ID NO: 703890 - DNA, 13 bp, C. elegans
atgatttctgttt

SEQ ID NO: 703891 - DNA, 13 bp, C. elegans
atgatttgaaatt

SEQ ID NO: 703892 - DNA, 13 bp, C. elegans
atgatttgaagaa

SEQ ID NO: 703893 - DNA, 13 bp, C. elegans
atgatttgatgat

SEQ ID NO: 703894 - DNA, 13 bp, C. elegans
atgatttggaaat

SEQ ID NO: 703895 - DNA, 13 bp, C. elegans
atgatttgtatgt

SEQ ID NO: 703896 - DNA, 13 bp, C. elegans
atgatttgtcaaa

SEQ ID NO: 703897 - DNA, 13 bp, C. elegans
atgattttcaaga

SEQ ID NO: 703898 - DNA, 13 bp, C. elegans
atgattttccatt

SEQ ID NO: 703899 - DNA, 13 bp, C. elegans
atgattttcccat

SEQ ID NO: 703900 - DNA, 13 bp, C. elegans
atgattttccttt

SEQ ID NO: 703901 - DNA, 13 bp, C. elegans
atgattttcgaaa

SEQ ID NO: 703902 - DNA, 13 bp, C. elegans
atgattttctatt

SEQ ID NO: 703903 - DNA, 13 bp, C. elegans
atgattttctcaa

SEQ ID NO: 703904 - DNA, 13 bp, C. elegans
atgattttgaaaa

SEQ ID NO: 703905 - DNA, 13 bp, C. elegans
atgattttgaaga

SEQ ID NO: 703906 - DNA, 13 bp, C. elegans
atgattttggagt

SEQ ID NO: 703907 - DNA, 13 bp, C. elegans
atgatttttcatt

SEQ ID NO: 703908 - DNA, 14 bp, C. elegans
atgatttttcgaaa

SEQ ID NO: 703909 - DNA, 13 bp, C. elegans
atgattttttcca

SEQ ID NO: 703910 - DNA, 13 bp, C. elegans
atgatttttttac

SEQ ID NO: 703911 - DNA, 13 bp, C. elegans
atgcaaaaaagga

SEQ ID NO: 703912 - DNA, 13 bp, C. elegans
atgcaaaaaatat

SEQ ID NO: 703913 - DNA, 13 bp, C. elegans
atgcaaaaaatga

SEQ ID NO: 703914 - DNA, 13 bp, C. elegans
atgcaaaaatact

SEQ ID NO: 703915 - DNA, 13 bp, C. elegans
atgcaaaaatcga

SEQ ID NO: 703916 - DNA, 13 bp, C. elegans
atgcaaaaatgca

SEQ ID NO: 703917 - DNA, 13 bp, C. elegans
atgcaaaacaaat

SEQ ID NO: 703918 - DNA, 13 bp, C. elegans
atgcaaaacaatt

SEQ ID NO: 703919 - DNA, 13 bp, C. elegans
atgcaaaattagt

SEQ ID NO: 703920 - DNA, 13 bp, C. elegans
atgcaaaatttaa

SEQ ID NO: 703921 - DNA, 13 bp, C. elegans
atgcaaagtttta

SEQ ID NO: 703922 - DNA, 13 bp, C. elegans
atgcaaatatata

SEQ ID NO: 703923 - DNA, 13 bp, C. elegans
atgcaaatttcca

SEQ ID NO: 703924 - DNA, 13 bp, C. elegans
atgcaaatttgga

SEQ ID NO: 703925 - DNA, 13 bp, C. elegans
atgcaaattttga

SEQ ID NO: 703926 - DNA, 13 bp, C. elegans
atgcaacgaaaaa

SEQ ID NO: 703927 - DNA, 13 bp, C. elegans
atgcaagtccatt

SEQ ID NO: 703928 - DNA, 13 bp, C. elegans
atgcaataaaaat

SEQ ID NO: 703929 - DNA, 13 bp, C. elegans
atgcaataatttt

SEQ ID NO: 703930 - DNA, 13 bp, C. elegans
atgcaatacaaat

SEQ ID NO: 703931 - DNA, 13 bp, C. elegans
atgcaatgaaaat

SEQ ID NO: 703932 - DNA, 13 bp, C. elegans
atgcaattaattt

SEQ ID NO: 703933 - DNA, 13 bp, C. elegans
atgcaattcaaaa

SEQ ID NO: 703934 - DNA, 13 bp, C. elegans
atgcaattcgaga

SEQ ID NO: 703935 - DNA, 13 bp, C. elegans
atgcacaaaattc

SEQ ID NO: 703936 - DNA, 13 bp, C. elegans
atgcacaaacggt

SEQ ID NO: 703937 - DNA, 13 bp, C. elegans
atgcacaattttc

SEQ ID NO: 703938 - DNA, 13 bp, C. elegans
atgcacattttca

SEQ ID NO: 703939 - DNA, 13 bp, C. elegans
atgcacattttct

SEQ ID NO: 703940 - DNA, 13 bp, C. elegans
atgcaccatgatc

SEQ ID NO: 703941 - DNA, 13 bp, C. elegans
atgcaccatgttc

SEQ ID NO: 703942 - DNA, 13 bp, C. elegans
atgcagagaaaaa

SEQ ID NO: 703943 - DNA, 13 bp, C. elegans
atgcatattttgg

SEQ ID NO: 703944 - DNA, 13 bp, C. elegans
atgcatgtttcaa

SEQ ID NO: 703945 - DNA, 13 bp, C. elegans
atgcattatttca

SEQ ID NO: 703946 - DNA, 13 bp, C. elegans
atgcatttctttt

SEQ ID NO: 703947 - DNA, 13 bp, C. elegans
atgcatttgaaaa

SEQ ID NO: 703948 - DNA, 13 bp, C. elegans
atgcattttcaaa

SEQ ID NO: 703949 - DNA, 13 bp, C. elegans
atgcattttcaac

SEQ ID NO: 703950 - DNA, 13 bp, C. elegans
atgccaaaatgac

SEQ ID NO: 703951 - DNA, 13 bp, C. elegans
atgccaaaattga

SEQ ID NO: 703952 - DNA, 13 bp, C. elegans
atgccaaatttca

SEQ ID NO: 703953 - DNA, 13 bp, C. elegans
atgccaatctatt

SEQ ID NO: 703954 - DNA, 13 bp, C. elegans
atgccacgtggca

SEQ ID NO: 703955 - DNA, 13 bp, C. elegans
atgccacgtgtca

SEQ ID NO: 703956 - DNA, 13 bp, C. elegans
atgccattcaaaa

SEQ ID NO: 703957 - DNA, 13 bp, C. elegans
atgcccagaaatt

SEQ ID NO: 703958 - DNA, 13 bp, C. elegans
atgccctcatttt

SEQ ID NO: 703959 - DNA, 13 bp, C. elegans
atgccgaaagttc

SEQ ID NO: 703960 - DNA, 13 bp, C. elegans
atgccgaaattga

SEQ ID NO: 703961 - DNA, 13 bp, C. elegans
atgccgaatgccg

SEQ ID NO: 703962 - DNA, 14 bp, C. elegans
atgccgttatgccg

SEQ ID NO: 703963 - DNA, 13 bp, C. elegans
atgcctacctact

SEQ ID NO: 703964 - DNA, 13 bp, C. elegans
atgcctatttttc

SEQ ID NO: 703965 - DNA, 13 bp, C. elegans
atgcgaattttca

SEQ ID NO: 703966 - DNA, 13 bp, C. elegans
atgcgcacattgc

SEQ ID NO: 703967 - DNA, 13 bp, C. elegans
atgcgcctttaaa

SEQ ID NO: 703968 - DNA, 13 bp, C. elegans
atgcgcctttaat

SEQ ID NO: 703969 - DNA, 13 bp, C. elegans
atgcgggaattga

SEQ ID NO: 703970 - DNA, 13 bp, C. elegans
atgcgtacagttt

SEQ ID NO: 703971 - DNA, 13 bp, C. elegans
atgcgtctcttct

SEQ ID NO: 703972 - DNA, 13 bp, C. elegans
atgcgtgcaattt

SEQ ID NO: 703973 - DNA, 13 bp, C. elegans
atgctaaaaatct

SEQ ID NO: 703974 - DNA, 13 bp, C. elegans
atgctaaatattt

SEQ ID NO: 703975 - DNA, 13 bp, C. elegans
atgctcaaaaaaa

SEQ ID NO: 703976 - DNA, 13 bp, C. elegans
atgctcaaaaact

SEQ ID NO: 703977 - DNA, 13 bp, C. elegans
atgctcaaaaata

SEQ ID NO: 703978 - DNA, 13 bp, C. elegans
atgctcaaaatat

SEQ ID NO: 703979 - DNA, 13 bp, C. elegans
atgctcaaaatct

SEQ ID NO: 703980 - DNA, 13 bp, C. elegans
atgctcaaatgct

SEQ ID NO: 703981 - DNA, 13 bp, C. elegans
atgctcaaatttc

SEQ ID NO: 703982 - DNA, 13 bp, C. elegans
atgctcaatgagc

SEQ ID NO: 703983 - DNA, 13 bp, C. elegans
atgctcaattaaa

SEQ ID NO: 703984 - DNA, 13 bp, C. elegans
atgctcagaacaa

SEQ ID NO: 703985 - DNA, 13 bp, C. elegans
atgctcattgagc

SEQ ID NO: 703986 - DNA, 13 bp, C. elegans
atgctcatttttc

SEQ ID NO: 703987 - DNA, 13 bp, C. elegans
atgctccaaaaaa

SEQ ID NO: 703988 - DNA, 13 bp, C. elegans
atgctccaaaaac

SEQ ID NO: 703989 - DNA, 13 bp, C. elegans
atgctccaaaatt

SEQ ID NO: 703990 - DNA, 13 bp, C. elegans
atgctccgtgagc

SEQ ID NO: 703991 - DNA, 13 bp, C. elegans
atgctcctacatc

SEQ ID NO: 703992 - DNA, 13 bp, C. elegans
atgctcgaaagtg

SEQ ID NO: 703993 - DNA, 13 bp, C. elegans
atgctctattgga

SEQ ID NO: 703994 - DNA, 13 bp, C. elegans
atgctctgaaaat

SEQ ID NO: 703995 - DNA, 13 bp, C. elegans
atgctcttttact

SEQ ID NO: 703996 - DNA, 13 bp, C. elegans
atgctctttttct

SEQ ID NO: 703997 - DNA, 13 bp, C. elegans
atgctgaaactac

SEQ ID NO: 703998 - DNA, 13 bp, C. elegans
atgctgaatattt

SEQ ID NO: 703999 - DNA, 13 bp, C. elegans
atgctgctctttc

SEQ ID NO: 704000 - DNA, 13 bp, C. elegans
atgctggaatcaa

SEQ ID NO: 704001 - DNA, 13 bp, C. elegans
atgctgttttcaa

SEQ ID NO: 704002 - DNA, 13 bp, C. elegans
atgcttcaatttt

SEQ ID NO: 704003 - DNA, 13 bp, C. elegans
atgcttcagctaa

SEQ ID NO: 704004 - DNA, 13 bp, C. elegans
atgcttccttttt

SEQ ID NO: 704005 - DNA, 13 bp, C. elegans
atgcttctcaaca

SEQ ID NO: 704006 - DNA, 13 bp, C. elegans
atgcttcttcttc

SEQ ID NO: 704007 - DNA, 13 bp, C. elegans
atgcttgaaaaat

SEQ ID NO: 704008 - DNA, 13 bp, C. elegans
atgctttatttca

SEQ ID NO: 704009 - DNA, 13 bp, C. elegans
atgctttcaaatt

SEQ ID NO: 704010 - DNA, 13 bp, C. elegans
atgctttggattc

SEQ ID NO: 704011 - DNA, 13 bp, C. elegans
atgcttttgaaaa

SEQ ID NO: 704012 - DNA, 13 bp, C. elegans
atggaaaaaagac

SEQ ID NO: 704013 - DNA, 13 bp, C. elegans
atggaaaaaatgg

SEQ ID NO: 704014 - DNA, 13 bp, C. elegans
atggaaaaaattg

SEQ ID NO: 704015 - DNA, 13 bp, C. elegans
atggaaaaacatt

SEQ ID NO: 704016 - DNA, 13 bp, C. elegans
atggaaaaactga

SEQ ID NO: 704017 - DNA, 13 bp, C. elegans
atggaaaaattat

SEQ ID NO: 704018 - DNA, 13 bp, C. elegans
atggaaaaattca

SEQ ID NO: 704019 - DNA, 13 bp, C. elegans
atggaaaactcaa

SEQ ID NO: 704020 - DNA, 13 bp, C. elegans
atggaaaagtggc

SEQ ID NO: 704021 - DNA, 13 bp, C. elegans
atggaaaatcaat

SEQ ID NO: 704022 - DNA, 13 bp, C. elegans
atggaaaatcgaa

SEQ ID NO: 704023 - DNA, 13 bp, C. elegans
atggaaaatctga

SEQ ID NO: 704024 - DNA, 13 bp, C. elegans
atggaaaatgcaa

SEQ ID NO: 704025 - DNA, 13 bp, C. elegans
atggaaaatgtca

SEQ ID NO: 704026 - DNA, 13 bp, C. elegans
atggaaaatgttg

SEQ ID NO: 704027 - DNA, 13 bp, C. elegans
atggaaaattcaa

SEQ ID NO: 704028 - DNA, 13 bp, C. elegans
atggaaaattcca

SEQ ID NO: 704029 - DNA, 13 bp, C. elegans
atggaaaattgtt

SEQ ID NO: 704030 - DNA, 13 bp, C. elegans
atggaaaatttac

SEQ ID NO: 704031 - DNA, 13 bp, C. elegans
atggaaaatttca

SEQ ID NO: 704032 - DNA, 13 bp, C. elegans
atggaaaatttga

SEQ ID NO: 704033 - DNA, 13 bp, C. elegans
atggaaacaaaat

SEQ ID NO: 704034 - DNA, 13 bp, C. elegans
atggaaatatttt

SEQ ID NO: 704035 - DNA, 13 bp, C. elegans
atggaaattcaaa

SEQ ID NO: 704036 - DNA, 13 bp, C. elegans
atggaaattcgaa

SEQ ID NO: 704037 - DNA, 13 bp, C. elegans
atggaaattgaaa

SEQ ID NO: 704038 - DNA, 13 bp, C. elegans
atggaaattgaat

SEQ ID NO: 704039 - DNA, 13 bp, C. elegans
atggaaatttcaa

SEQ ID NO: 704040 - DNA, 13 bp, C. elegans
atggaaatttgaa

SEQ ID NO: 704041 - DNA, 13 bp, C. elegans
atggaaatttttg

SEQ ID NO: 704042 - DNA, 13 bp, C. elegans
atggaacagtttt

SEQ ID NO: 704043 - DNA, 13 bp, C. elegans
atggaagactaca

SEQ ID NO: 704044 - DNA, 13 bp, C. elegans
atggaagaggtgg

SEQ ID NO: 704045 - DNA, 13 bp, C. elegans
atggaagatgaag

SEQ ID NO: 704046 - DNA, 13 bp, C. elegans
atggaagttcaaa

SEQ ID NO: 704047 - DNA, 13 bp, C. elegans
atggaatatcaaa

SEQ ID NO: 704048 - DNA, 13 bp, C. elegans
atggaatatgaaa

SEQ ID NO: 704049 - DNA, 13 bp, C. elegans
atggaatcaattt

SEQ ID NO: 704050 - DNA, 13 bp, C. elegans
atggaatggaaaa

SEQ ID NO: 704051 - DNA, 13 bp, C. elegans
atggaattattga

SEQ ID NO: 704052 - DNA, 13 bp, C. elegans
atggaattgaatt

SEQ ID NO: 704053 - DNA, 13 bp, C. elegans
atggaattggaaa

SEQ ID NO: 704054 - DNA, 13 bp, C. elegans
atggaatttgaaa

SEQ ID NO: 704055 - DNA, 13 bp, C. elegans
atggaatttggaa

SEQ ID NO: 704056 - DNA, 13 bp, C. elegans
atggaattttcta

SEQ ID NO: 704057 - DNA, 13 bp, C. elegans
atggaattttgaa

SEQ ID NO: 704058 - DNA, 14 bp, C. elegans
atggagaatcagaa

SEQ ID NO: 704059 - DNA, 13 bp, C. elegans
atggagaattcga

SEQ ID NO: 704060 - DNA, 13 bp, C. elegans
atggagcgcattt

SEQ ID NO: 704061 - DNA, 13 bp, C. elegans
atggataatgtca

SEQ ID NO: 704062 - DNA, 13 bp, C. elegans
atggatcaaaaat

SEQ ID NO: 704063 - DNA, 13 bp, C. elegans
atggatgaaatga

SEQ ID NO: 704064 - DNA, 13 bp, C. elegans
atggatgctgaaa

SEQ ID NO: 704065 - DNA, 13 bp, C. elegans
atggatggatgga

SEQ ID NO: 704066 - DNA, 13 bp, C. elegans
atggattactgta

SEQ ID NO: 704067 - DNA, 13 bp, C. elegans
atggattctcatc

SEQ ID NO: 704068 - DNA, 13 bp, C. elegans
atggattgggatg

SEQ ID NO: 704069 - DNA, 13 bp, C. elegans
atggattttaatt

SEQ ID NO: 704070 - DNA, 13 bp, C. elegans
atggattttcgaa

SEQ ID NO: 704071 - DNA, 13 bp, C. elegans
atggattttcgga

SEQ ID NO: 704072 - DNA, 13 bp, C. elegans
atggatttttaaa

SEQ ID NO: 704073 - DNA, 13 bp, C. elegans
atggatttttcgt

SEQ ID NO: 704074 - DNA, 13 bp, C. elegans
atggatttttcta

SEQ ID NO: 704075 - DNA, 13 bp, C. elegans
atggattttttca

SEQ ID NO: 704076 - DNA, 13 bp, C. elegans
atggcaaatacaa

SEQ ID NO: 704077 - DNA, 13 bp, C. elegans
atggcaatttgaa

SEQ ID NO: 704078 - DNA, 13 bp, C. elegans
atggcacgcaagt

SEQ ID NO: 704079 - DNA, 13 bp, C. elegans
atggcataatatc

SEQ ID NO: 704080 - DNA, 13 bp, C. elegans
atggccattaaga

SEQ ID NO: 704081 - DNA, 13 bp, C. elegans
atggcctaaaatt

SEQ ID NO: 704082 - DNA, 13 bp, C. elegans
atggcctacattt

SEQ ID NO: 704083 - DNA, 13 bp, C. elegans
atggcgaaaattt

SEQ ID NO: 704084 - DNA, 13 bp, C. elegans
atggcgggaaaat

SEQ ID NO: 704085 - DNA, 13 bp, C. elegans
atggctcaacagg

SEQ ID NO: 704086 - DNA, 13 bp, C. elegans
atggcttgaaaaa

SEQ ID NO: 704087 - DNA, 30 bp, C. elegans
atggcttgctgtgatccgcaggaataccac

SEQ ID NO: 704088 - DNA, 13 bp, C. elegans
atgggaaatgtga

SEQ ID NO: 704089 - DNA, 13 bp, C. elegans
atgggaacgaaaa

SEQ ID NO: 704090 - DNA, 13 bp, C. elegans
atgggaatatttt

SEQ ID NO: 704091 - DNA, 13 bp, C. elegans
atgggacaacctg

SEQ ID NO: 704092 - DNA, 13 bp, C. elegans
atgggacactttg

SEQ ID NO: 704093 - DNA, 13 bp, C. elegans
atgggacagccta

SEQ ID NO: 704094 - DNA, 13 bp, C. elegans
atgggacagcctg

SEQ ID NO: 704095 - DNA, 13 bp, C. elegans
atgggaggcaggc

SEQ ID NO: 704096 - DNA, 13 bp, C. elegans
atgggcaaattgc

SEQ ID NO: 704097 - DNA, 13 bp, C. elegans
atgggcaattttg

SEQ ID NO: 704098 - DNA, 15 bp, C. elegans
atgggcaccttctga

SEQ ID NO: 704099 - DNA, 13 bp, C. elegans
atgggcgaaaaaa

SEQ ID NO: 704100 - DNA, 13 bp, C. elegans
atgggcggagcta

SEQ ID NO: 704101 - DNA, 13 bp, C. elegans
atgggcggagttt

SEQ ID NO: 704102 - DNA, 13 bp, C. elegans
atggggaaaaatt

SEQ ID NO: 704103 - DNA, 13 bp, C. elegans
atggggcttattt

SEQ ID NO: 704104 - DNA, 13 bp, C. elegans
atgggtcccgcca

SEQ ID NO: 704105 - DNA, 13 bp, C. elegans
atgggtgtcaaat

SEQ ID NO: 704106 - DNA, 13 bp, C. elegans
atggtactttttt

SEQ ID NO: 704107 - DNA, 13 bp, C. elegans
atggtaggtaggc

SEQ ID NO: 704108 - DNA, 13 bp, C. elegans
atggtagttttca

SEQ ID NO: 704109 - DNA, 13 bp, C. elegans
atggtatttaaaa

SEQ ID NO: 704110 - DNA, 13 bp, C. elegans
atggtctttgggg

SEQ ID NO: 704111 - DNA, 15 bp, C. elegans
atggtgaatatggaa

SEQ ID NO: 704112 - DNA, 13 bp, C. elegans
atggtgcatcaac

SEQ ID NO: 704113 - DNA, 14 bp, C. elegans
atggtgcatcgaac

SEQ ID NO: 704114 - DNA, 13 bp, C. elegans
atggtgcatcgag

SEQ ID NO: 704115 - DNA, 13 bp, C. elegans
atggtgcatcgga

SEQ ID NO: 704116 - DNA, 13 bp, C. elegans
atggtgcattgag

SEQ ID NO: 704117 - DNA, 13 bp, C. elegans
atggtgcattgat

SEQ ID NO: 704118 - DNA, 13 bp, C. elegans
atggtgttttcct

SEQ ID NO: 704119 - DNA, 13 bp, C. elegans
atggttccaaaat

SEQ ID NO: 704120 - DNA, 13 bp, C. elegans
atggttgaaaaaa

SEQ ID NO: 704121 - DNA, 13 bp, C. elegans
atggttttcaaat

SEQ ID NO: 704122 - DNA, 13 bp, C. elegans
atggtttttgaga

SEQ ID NO: 704123 - DNA, 13 bp, C. elegans
atggttttttgca

SEQ ID NO: 704124 - DNA, 13 bp, C. elegans
atgtaaaaacata

SEQ ID NO: 704125 - DNA, 13 bp, C. elegans
atgtaaaaatgtt

SEQ ID NO: 704126 - DNA, 13 bp, C. elegans
atgtaaatgtaaa

SEQ ID NO: 704127 - DNA, 13 bp, C. elegans
atgtaacattttt

SEQ ID NO: 704128 - DNA, 13 bp, C. elegans
atgtaacttgaac

SEQ ID NO: 704129 - DNA, 13 bp, C. elegans
atgtaattatctt

SEQ ID NO: 704130 - DNA, 13 bp, C. elegans
atgtaattattga

SEQ ID NO: 704131 - DNA, 13 bp, C. elegans
atgtacaaaaaat

SEQ ID NO: 704132 - DNA, 13 bp, C. elegans
atgtacaaaaaca

SEQ ID NO: 704133 - DNA, 13 bp, C. elegans
atgtacaaaaatg

SEQ ID NO: 704134 - DNA, 13 bp, C. elegans
atgtacatcaaaa

SEQ ID NO: 704135 - DNA, 13 bp, C. elegans
atgtaccacttgc

SEQ ID NO: 704136 - DNA, 13 bp, C. elegans
atgtaccatgttt

SEQ ID NO: 704137 - DNA, 13 bp, C. elegans
atgtacctttaaa

SEQ ID NO: 704138 - DNA, 13 bp, C. elegans
atgtacctttgat

SEQ ID NO: 704139 - DNA, 13 bp, C. elegans
atgtacctttttt

SEQ ID NO: 704140 - DNA, 13 bp, C. elegans
atgtactttaatc

SEQ ID NO: 704141 - DNA, 13 bp, C. elegans
atgtactttttgt

SEQ ID NO: 704142 - DNA, 13 bp, C. elegans
atgtagaaaattg

SEQ ID NO: 704143 - DNA, 13 bp, C. elegans
atgtagatatttt

SEQ ID NO: 704144 - DNA, 13 bp, C. elegans
atgtagtcgtaaa

SEQ ID NO: 704145 - DNA, 13 bp, C. elegans
atgtataaacttt

SEQ ID NO: 704146 - DNA, 13 bp, C. elegans
atgtataatttca

SEQ ID NO: 704147 - DNA, 13 bp, C. elegans
atgtatacaattt

SEQ ID NO: 704148 - DNA, 13 bp, C. elegans
atgtatatgaatg

SEQ ID NO: 704149 - DNA, 13 bp, C. elegans
atgtatatgtatt

SEQ ID NO: 704150 - DNA, 13 bp, C. elegans
atgtatattgaaa

SEQ ID NO: 704151 - DNA, 13 bp, C. elegans
atgtatatttcaa

SEQ ID NO: 704152 - DNA, 13 bp, C. elegans
atgtatattttag

SEQ ID NO: 704153 - DNA, 13 bp, C. elegans
atgtatcatgttt

SEQ ID NO: 704154 - DNA, 13 bp, C. elegans
atgtatctctttt

SEQ ID NO: 704155 - DNA, 13 bp, C. elegans
atgtatgtataaa

SEQ ID NO: 704156 - DNA, 13 bp, C. elegans
atgtatgtgtgtg

SEQ ID NO: 704157 - DNA, 13 bp, C. elegans
atgtattacattt

SEQ ID NO: 704158 - DNA, 13 bp, C. elegans
atgtattgaattt

SEQ ID NO: 704159 - DNA, 13 bp, C. elegans
atgtattgtttca

SEQ ID NO: 704160 - DNA, 13 bp, C. elegans
atgtatttctcaa

SEQ ID NO: 704161 - DNA, 13 bp, C. elegans
atgtatttgaaaa

SEQ ID NO: 704162 - DNA, 13 bp, C. elegans
atgtattttacaa

SEQ ID NO: 704163 - DNA, 13 bp, C. elegans
atgtattttctga

SEQ ID NO: 704164 - DNA, 13 bp, C. elegans
atgtattttgata

SEQ ID NO: 704165 - DNA, 13 bp, C. elegans
atgtattttgtga

SEQ ID NO: 704166 - DNA, 13 bp, C. elegans
atgtatttttaca

SEQ ID NO: 704167 - DNA, 14 bp, C. elegans
atgtatttttctac

SEQ ID NO: 704168 - DNA, 13 bp, C. elegans
atgtatttttctg

SEQ ID NO: 704169 - DNA, 13 bp, C. elegans
atgtcaaaaaatc

SEQ ID NO: 704170 - DNA, 13 bp, C. elegans
atgtcaaaaatgg

SEQ ID NO: 704171 - DNA, 13 bp, C. elegans
atgtcaaaagaaa

SEQ ID NO: 704172 - DNA, 13 bp, C. elegans
atgtcaaaatatc

SEQ ID NO: 704173 - DNA, 13 bp, C. elegans
atgtcaaaatatt

SEQ ID NO: 704174 - DNA, 13 bp, C. elegans
atgtcaaaatttg

SEQ ID NO: 704175 - DNA, 13 bp, C. elegans
atgtcaaacattt

SEQ ID NO: 704176 - DNA, 13 bp, C. elegans
atgtcaaattttc

SEQ ID NO: 704177 - DNA, 13 bp, C. elegans
atgtcaactttgt

SEQ ID NO: 704178 - DNA, 13 bp, C. elegans
atgtcaatttaaa

SEQ ID NO: 704179 - DNA, 13 bp, C. elegans
atgtcagaaaaac

SEQ ID NO: 704180 - DNA, 13 bp, C. elegans
atgtcagaaattt

SEQ ID NO: 704181 - DNA, 13 bp, C. elegans
atgtcatattttt

SEQ ID NO: 704182 - DNA, 13 bp, C. elegans
atgtcatcaaaaa

SEQ ID NO: 704183 - DNA, 13 bp, C. elegans
atgtcatttaaaa

SEQ ID NO: 704184 - DNA, 13 bp, C. elegans
atgtcatttttga

SEQ ID NO: 704185 - DNA, 13 bp, C. elegans
atgtccaaatatc

SEQ ID NO: 704186 - DNA, 13 bp, C. elegans
atgtccaaatttt

SEQ ID NO: 704187 - DNA, 13 bp, C. elegans
atgtccgaatggc

SEQ ID NO: 704188 - DNA, 13 bp, C. elegans
atgtcgaaaaaaa

SEQ ID NO: 704189 - DNA, 13 bp, C. elegans
atgtcgatgcacc

SEQ ID NO: 704190 - DNA, 13 bp, C. elegans
atgtctaaaaatt

SEQ ID NO: 704191 - DNA, 13 bp, C. elegans
atgtctcaaaaaa

SEQ ID NO: 704192 - DNA, 13 bp, C. elegans
atgtctcaaattt

SEQ ID NO: 704193 - DNA, 14 bp, C. elegans
atgtctcgatgcgt

SEQ ID NO: 704194 - DNA, 13 bp, C. elegans
atgtctgaaaatg

SEQ ID NO: 704195 - DNA, 13 bp, C. elegans
atgtctgaaattc

SEQ ID NO: 704196 - DNA, 13 bp, C. elegans
atgtctgcgtctc

SEQ ID NO: 704197 - DNA, 13 bp, C. elegans
atgtctggaaatt

SEQ ID NO: 704198 - DNA, 13 bp, C. elegans
atgtctttcattt

SEQ ID NO: 704199 - DNA, 13 bp, C. elegans
atgtgaaaaatgg

SEQ ID NO: 704200 - DNA, 13 bp, C. elegans
atgtgaaaaattt

SEQ ID NO: 704201 - DNA, 13 bp, C. elegans
atgtgaaaactgt

SEQ ID NO: 704202 - DNA, 13 bp, C. elegans
atgtgaaaatgca

SEQ ID NO: 704203 - DNA, 13 bp, C. elegans
atgtgaaacaatt

SEQ ID NO: 704204 - DNA, 13 bp, C. elegans
atgtgaaacagta

SEQ ID NO: 704205 - DNA, 13 bp, C. elegans
atgtgaaagtgaa

SEQ ID NO: 704206 - DNA, 13 bp, C. elegans
atgtgaaagttca

SEQ ID NO: 704207 - DNA, 13 bp, C. elegans
atgtgaaagtttc

SEQ ID NO: 704208 - DNA, 13 bp, C. elegans
atgtgaaattttt

SEQ ID NO: 704209 - DNA, 13 bp, C. elegans
atgtgaagaaaat

SEQ ID NO: 704210 - DNA, 13 bp, C. elegans
atgtgaagttttt

SEQ ID NO: 704211 - DNA, 13 bp, C. elegans
atgtgaatcaaaa

SEQ ID NO: 704212 - DNA, 13 bp, C. elegans
atgtgaattttat

SEQ ID NO: 704213 - DNA, 13 bp, C. elegans
atgtgacagtttt

SEQ ID NO: 704214 - DNA, 13 bp, C. elegans
atgtgacattttt

SEQ ID NO: 704215 - DNA, 13 bp, C. elegans
atgtgacgtcatc

SEQ ID NO: 704216 - DNA, 13 bp, C. elegans
atgtgatactttt

SEQ ID NO: 704217 - DNA, 13 bp, C. elegans
atgtgatttattc

SEQ ID NO: 704218 - DNA, 13 bp, C. elegans
atgtgcactgacc

SEQ ID NO: 704219 - DNA, 13 bp, C. elegans
atgtgcagaaaaa

SEQ ID NO: 704220 - DNA, 13 bp, C. elegans
atgtgcatttttc

SEQ ID NO: 704221 - DNA, 13 bp, C. elegans
atgtgcatttttt

SEQ ID NO: 704222 - DNA, 13 bp, C. elegans
atgtgccaaaata

SEQ ID NO: 704223 - DNA, 13 bp, C. elegans
atgtgcctttaaa

SEQ ID NO: 704224 - DNA, 13 bp, C. elegans
atgtgctcatttt

SEQ ID NO: 704225 - DNA, 13 bp, C. elegans
atgtgctccaaaa

SEQ ID NO: 704226 - DNA, 13 bp, C. elegans
atgtgctctattg

SEQ ID NO: 704227 - DNA, 13 bp, C. elegans
atgtggaaaaaat

SEQ ID NO: 704228 - DNA, 13 bp, C. elegans
atgtggtaatttt

SEQ ID NO: 704229 - DNA, 13 bp, C. elegans
atgtgtaactttt

SEQ ID NO: 704230 - DNA, 13 bp, C. elegans
atgtgtagaattt

SEQ ID NO: 704231 - DNA, 13 bp, C. elegans
atgtgtattaaaa

SEQ ID NO: 704232 - DNA, 13 bp, C. elegans
atgtgtgtagaaa

SEQ ID NO: 704233 - DNA, 13 bp, C. elegans
atgtgttttctca

SEQ ID NO: 704234 - DNA, 13 bp, C. elegans
atgtgttttgaaa

SEQ ID NO: 704235 - DNA, 13 bp, C. elegans
atgtgttttgttc

SEQ ID NO: 704236 - DNA, 13 bp, C. elegans
atgtgtttttgaa

SEQ ID NO: 704237 - DNA, 13 bp, C. elegans
atgttaaacattt

SEQ ID NO: 704238 - DNA, 13 bp, C. elegans
atgttaaattcaa

SEQ ID NO: 704239 - DNA, 13 bp, C. elegans
atgttaattttga

SEQ ID NO: 704240 - DNA, 13 bp, C. elegans
atgttactcaaaa

SEQ ID NO: 704241 - DNA, 13 bp, C. elegans
atgttataaaaca

SEQ ID NO: 704242 - DNA, 13 bp, C. elegans
atgttattgaaaa

SEQ ID NO: 704243 - DNA, 13 bp, C. elegans
atgttatttgaaa

SEQ ID NO: 704244 - DNA, 13 bp, C. elegans
atgttcaaaaaat

SEQ ID NO: 704245 - DNA, 13 bp, C. elegans
atgttcaaaaacg

SEQ ID NO: 704246 - DNA, 13 bp, C. elegans
atgttcaaaaagt

SEQ ID NO: 704247 - DNA, 13 bp, C. elegans
atgttcaaaaatg

SEQ ID NO: 704248 - DNA, 13 bp, C. elegans
atgttcaaacaat

SEQ ID NO: 704249 - DNA, 13 bp, C. elegans
atgttcaaacttt

SEQ ID NO: 704250 - DNA, 13 bp, C. elegans
atgttcaaattat

SEQ ID NO: 704251 - DNA, 13 bp, C. elegans
atgttcaaattct

SEQ ID NO: 704252 - DNA, 13 bp, C. elegans
atgttcaaattta

SEQ ID NO: 704253 - DNA, 13 bp, C. elegans
atgttcaacaatt

SEQ ID NO: 704254 - DNA, 13 bp, C. elegans
atgttcaatgaaa

SEQ ID NO: 704255 - DNA, 13 bp, C. elegans
atgttcaattatt

SEQ ID NO: 704256 - DNA, 13 bp, C. elegans
atgttcaattgaa

SEQ ID NO: 704257 - DNA, 13 bp, C. elegans
atgttcaatttat

SEQ ID NO: 704258 - DNA, 13 bp, C. elegans
atgttcaattttt

SEQ ID NO: 704259 - DNA, 13 bp, C. elegans
atgttcagtttta

SEQ ID NO: 704260 - DNA, 13 bp, C. elegans
atgttcataaaaa

SEQ ID NO: 704261 - DNA, 13 bp, C. elegans
atgttcataaatt

SEQ ID NO: 704262 - DNA, 13 bp, C. elegans
atgttcatattta

SEQ ID NO: 704263 - DNA, 13 bp, C. elegans
atgttcattaatt

SEQ ID NO: 704264 - DNA, 13 bp, C. elegans
atgttcattattt

SEQ ID NO: 704265 - DNA, 13 bp, C. elegans
atgttcattcatt

SEQ ID NO: 704266 - DNA, 13 bp, C. elegans
atgttcattgaaa

SEQ ID NO: 704267 - DNA, 13 bp, C. elegans
atgttcatttatt

SEQ ID NO: 704268 - DNA, 13 bp, C. elegans
atgttcattttca

SEQ ID NO: 704269 - DNA, 13 bp, C. elegans
atgttccaaaaat

SEQ ID NO: 704270 - DNA, 13 bp, C. elegans
atgttccaaaatt

SEQ ID NO: 704271 - DNA, 14 bp, C. elegans
atgttccagaactt

SEQ ID NO: 704272 - DNA, 14 bp, C. elegans
atgttccagaagtt

SEQ ID NO: 704273 - DNA, 13 bp, C. elegans
atgttccattttg

SEQ ID NO: 704274 - DNA, 13 bp, C. elegans
atgttccgacccc

SEQ ID NO: 704275 - DNA, 13 bp, C. elegans
atgttcctatatg

SEQ ID NO: 704276 - DNA, 13 bp, C. elegans
atgttcctttaaa

SEQ ID NO: 704277 - DNA, 13 bp, C. elegans
atgttcgaatttc

SEQ ID NO: 704278 - DNA, 13 bp, C. elegans
atgttcggcaaac

SEQ ID NO: 704279 - DNA, 13 bp, C. elegans
atgttcgtttttc

SEQ ID NO: 704280 - DNA, 13 bp, C. elegans
atgttctaaaatt

SEQ ID NO: 704281 - DNA, 13 bp, C. elegans
atgttctaatttt

SEQ ID NO: 704282 - DNA, 13 bp, C. elegans
atgttctcaaata

SEQ ID NO: 704283 - DNA, 13 bp, C. elegans
atgttctcataaa

SEQ ID NO: 704284 - DNA, 13 bp, C. elegans
atgttctctatta

SEQ ID NO: 704285 - DNA, 13 bp, C. elegans
atgttctgatttt

SEQ ID NO: 704286 - DNA, 13 bp, C. elegans
atgttctgttgtt

SEQ ID NO: 704287 - DNA, 13 bp, C. elegans
atgttcttaaaaa

SEQ ID NO: 704288 - DNA, 13 bp, C. elegans
atgttcttaaaat

SEQ ID NO: 704289 - DNA, 13 bp, C. elegans
atgttcttcaaaa

SEQ ID NO: 704290 - DNA, 13 bp, C. elegans
atgttcttcattt

SEQ ID NO: 704291 - DNA, 13 bp, C. elegans
atgttcttgaaaa

SEQ ID NO: 704292 - DNA, 13 bp, C. elegans
atgttctttcaga

SEQ ID NO: 704293 - DNA, 13 bp, C. elegans
atgttcttttaaa

SEQ ID NO: 704294 - DNA, 13 bp, C. elegans
atgttcttttgaa

SEQ ID NO: 704295 - DNA, 13 bp, C. elegans
atgttctttttga

SEQ ID NO: 704296 - DNA, 13 bp, C. elegans
atgttgaaaaaag

SEQ ID NO: 704297 - DNA, 13 bp, C. elegans
atgttgaaaaata

SEQ ID NO: 704298 - DNA, 13 bp, C. elegans
atgttgaaaagaa

SEQ ID NO: 704299 - DNA, 13 bp, C. elegans
atgttgaaaatca

SEQ ID NO: 704300 - DNA, 13 bp, C. elegans
atgttgaaaatta

SEQ ID NO: 704301 - DNA, 13 bp, C. elegans
atgttgaataatt

SEQ ID NO: 704302 - DNA, 13 bp, C. elegans
atgttgaatgaat

SEQ ID NO: 704303 - DNA, 13 bp, C. elegans
atgttgagaaaaa

SEQ ID NO: 704304 - DNA, 13 bp, C. elegans
atgttgagatcaa

SEQ ID NO: 704305 - DNA, 13 bp, C. elegans
atgttgataaatt

SEQ ID NO: 704306 - DNA, 13 bp, C. elegans
atgttgataattt

SEQ ID NO: 704307 - DNA, 13 bp, C. elegans
atgttgcaacaaa

SEQ ID NO: 704308 - DNA, 13 bp, C. elegans
atgttgcacaata

SEQ ID NO: 704309 - DNA, 13 bp, C. elegans
atgttgctcaata

SEQ ID NO: 704310 - DNA, 13 bp, C. elegans
atgttgctcgaaa

SEQ ID NO: 704311 - DNA, 13 bp, C. elegans
atgttggaaaatg

SEQ ID NO: 704312 - DNA, 13 bp, C. elegans
atgttggttttga

SEQ ID NO: 704313 - DNA, 13 bp, C. elegans
atgttgtgaaaaa

SEQ ID NO: 704314 - DNA, 13 bp, C. elegans
atgttgtgcaata

SEQ ID NO: 704315 - DNA, 13 bp, C. elegans
atgttgttttcaa

SEQ ID NO: 704316 - DNA, 13 bp, C. elegans
atgtttaaaaatc

SEQ ID NO: 704317 - DNA, 13 bp, C. elegans
atgtttaaaacaa

SEQ ID NO: 704318 - DNA, 13 bp, C. elegans
atgtttaactatt

SEQ ID NO: 704319 - DNA, 13 bp, C. elegans
atgtttaactcgc

SEQ ID NO: 704320 - DNA, 13 bp, C. elegans
atgtttaagaaat

SEQ ID NO: 704321 - DNA, 13 bp, C. elegans
atgtttagaaatc

SEQ ID NO: 704322 - DNA, 13 bp, C. elegans
atgtttagaaatt

SEQ ID NO: 704323 - DNA, 13 bp, C. elegans
atgtttatattct

SEQ ID NO: 704324 - DNA, 13 bp, C. elegans
atgtttatcaaaa

SEQ ID NO: 704325 - DNA, 13 bp, C. elegans
atgtttatgaaat

SEQ ID NO: 704326 - DNA, 13 bp, C. elegans
atgtttatttgaa

SEQ ID NO: 704327 - DNA, 13 bp, C. elegans
atgtttattttca

SEQ ID NO: 704328 - DNA, 13 bp, C. elegans
atgtttcaaaaaa

SEQ ID NO: 704329 - DNA, 13 bp, C. elegans
atgtttcaaacta

SEQ ID NO: 704330 - DNA, 13 bp, C. elegans
atgtttcaaatat

SEQ ID NO: 704331 - DNA, 13 bp, C. elegans
atgtttcaactga

SEQ ID NO: 704332 - DNA, 13 bp, C. elegans
atgtttcaacttt

SEQ ID NO: 704333 - DNA, 13 bp, C. elegans
atgtttcaatttt

SEQ ID NO: 704334 - DNA, 13 bp, C. elegans
atgtttcacaaaa

SEQ ID NO: 704335 - DNA, 13 bp, C. elegans
atgtttcactatt

SEQ ID NO: 704336 - DNA, 13 bp, C. elegans
atgtttcataatt

SEQ ID NO: 704337 - DNA, 13 bp, C. elegans
atgtttcattatt

SEQ ID NO: 704338 - DNA, 13 bp, C. elegans
atgtttcattgtt

SEQ ID NO: 704339 - DNA, 13 bp, C. elegans
atgtttccaaatt

SEQ ID NO: 704340 - DNA, 13 bp, C. elegans
atgtttccagttt

SEQ ID NO: 704341 - DNA, 13 bp, C. elegans
atgtttccatttt

SEQ ID NO: 704342 - DNA, 13 bp, C. elegans
atgtttcccaaaa

SEQ ID NO: 704343 - DNA, 13 bp, C. elegans
atgtttcccatta

SEQ ID NO: 704344 - DNA, 13 bp, C. elegans
atgtttcgttttg

SEQ ID NO: 704345 - DNA, 13 bp, C. elegans
atgtttctgataa

SEQ ID NO: 704346 - DNA, 13 bp, C. elegans
atgtttcttcttc

SEQ ID NO: 704347 - DNA, 13 bp, C. elegans
atgtttcttttaa

SEQ ID NO: 704348 - DNA, 13 bp, C. elegans
atgtttcttttca

SEQ ID NO: 704349 - DNA, 13 bp, C. elegans
atgtttgaaaaat

SEQ ID NO: 704350 - DNA, 13 bp, C. elegans
atgtttgaaaacc

SEQ ID NO: 704351 - DNA, 13 bp, C. elegans
atgtttgaatgaa

SEQ ID NO: 704352 - DNA, 13 bp, C. elegans
atgtttgaattga

SEQ ID NO: 704353 - DNA, 13 bp, C. elegans
atgtttgaatttg

SEQ ID NO: 704354 - DNA, 13 bp, C. elegans
atgtttgacattg

SEQ ID NO: 704355 - DNA, 13 bp, C. elegans
atgtttgagagtt

SEQ ID NO: 704356 - DNA, 13 bp, C. elegans
atgtttgatgaaa

SEQ ID NO: 704357 - DNA, 13 bp, C. elegans
atgtttgatttaa

SEQ ID NO: 704358 - DNA, 13 bp, C. elegans
atgtttgcatttt

SEQ ID NO: 704359 - DNA, 13 bp, C. elegans
atgtttgtaaatt

SEQ ID NO: 704360 - DNA, 13 bp, C. elegans
atgtttgtgaaaa

SEQ ID NO: 704361 - DNA, 13 bp, C. elegans
atgtttgtgtata

SEQ ID NO: 704362 - DNA, 13 bp, C. elegans
atgttttaaatcg

SEQ ID NO: 704363 - DNA, 13 bp, C. elegans
atgttttaacttt

SEQ ID NO: 704364 - DNA, 13 bp, C. elegans
atgttttaatgat

SEQ ID NO: 704365 - DNA, 13 bp, C. elegans
atgttttacaaat

SEQ ID NO: 704366 - DNA, 13 bp, C. elegans
atgttttatctat

SEQ ID NO: 704367 - DNA, 13 bp, C. elegans
atgttttatgaaa

SEQ ID NO: 704368 - DNA, 13 bp, C. elegans
atgttttattatc

SEQ ID NO: 704369 - DNA, 13 bp, C. elegans
atgttttatttac

SEQ ID NO: 704370 - DNA, 13 bp, C. elegans
atgttttcaaaaa

SEQ ID NO: 704371 - DNA, 13 bp, C. elegans
atgttttcaaatc

SEQ ID NO: 704372 - DNA, 14 bp, C. elegans
atgttttcaaatta

SEQ ID NO: 704373 - DNA, 13 bp, C. elegans
atgttttcacatt

SEQ ID NO: 704374 - DNA, 13 bp, C. elegans
atgttttcagttt

SEQ ID NO: 704375 - DNA, 13 bp, C. elegans
atgttttcatcaa

SEQ ID NO: 704376 - DNA, 13 bp, C. elegans
atgttttccgttt

SEQ ID NO: 704377 - DNA, 13 bp, C. elegans
atgttttcctatt

SEQ ID NO: 704378 - DNA, 13 bp, C. elegans
atgttttcgaaaa

SEQ ID NO: 704379 - DNA, 13 bp, C. elegans
atgttttctaaaa

SEQ ID NO: 704380 - DNA, 13 bp, C. elegans
atgttttctaatt

SEQ ID NO: 704381 - DNA, 13 bp, C. elegans
atgttttctatta

SEQ ID NO: 704382 - DNA, 13 bp, C. elegans
atgttttctcaat

SEQ ID NO: 704383 - DNA, 13 bp, C. elegans
atgttttctgatt

SEQ ID NO: 704384 - DNA, 13 bp, C. elegans
atgttttctggaa

SEQ ID NO: 704385 - DNA, 13 bp, C. elegans
atgttttctgtta

SEQ ID NO: 704386 - DNA, 13 bp, C. elegans
atgttttcttaaa

SEQ ID NO: 704387 - DNA, 13 bp, C. elegans
atgttttcttcaa

SEQ ID NO: 704388 - DNA, 13 bp, C. elegans
atgttttcttgaa

SEQ ID NO: 704389 - DNA, 13 bp, C. elegans
atgttttcttgtg

SEQ ID NO: 704390 - DNA, 13 bp, C. elegans
atgttttgaaaaa

SEQ ID NO: 704391 - DNA, 13 bp, C. elegans
atgttttgaaaat

SEQ ID NO: 704392 - DNA, 13 bp, C. elegans
atgttttgaaata

SEQ ID NO: 704393 - DNA, 13 bp, C. elegans
atgttttgaatgt

SEQ ID NO: 704394 - DNA, 13 bp, C. elegans
atgttttgcaaca

SEQ ID NO: 704395 - DNA, 13 bp, C. elegans
atgttttgcattt

SEQ ID NO: 704396 - DNA, 13 bp, C. elegans
atgttttggcaaa

SEQ ID NO: 704397 - DNA, 13 bp, C. elegans
atgttttgtaaat

SEQ ID NO: 704398 - DNA, 13 bp, C. elegans
atgttttgtcaaa

SEQ ID NO: 704399 - DNA, 13 bp, C. elegans
atgttttgtcagt

SEQ ID NO: 704400 - DNA, 13 bp, C. elegans
atgttttgtttca

SEQ ID NO: 704401 - DNA, 13 bp, C. elegans
atgtttttagaat

SEQ ID NO: 704402 - DNA, 13 bp, C. elegans
atgtttttcaaaa

SEQ ID NO: 704403 - DNA, 13 bp, C. elegans
atgtttttcagaa

SEQ ID NO: 704404 - DNA, 13 bp, C. elegans
atgtttttctata

SEQ ID NO: 704405 - DNA, 13 bp, C. elegans
atgtttttcttaa

SEQ ID NO: 704406 - DNA, 13 bp, C. elegans
atgtttttgaaga

SEQ ID NO: 704407 - DNA, 13 bp, C. elegans
atgtttttgaagt

SEQ ID NO: 704408 - DNA, 13 bp, C. elegans
atgtttttggaaa

SEQ ID NO: 704409 - DNA, 13 bp, C. elegans
atgtttttgttca

SEQ ID NO: 704410 - DNA, 13 bp, C. elegans
atgttttttcaaa

SEQ ID NO: 704411 - DNA, 13 bp, C. elegans
atgttttttcaat

SEQ ID NO: 704412 - DNA, 13 bp, C. elegans
atgttttttccca

SEQ ID NO: 704413 - DNA, 13 bp, C. elegans
atgttttttctag

SEQ ID NO: 704414 - DNA, 13 bp, C. elegans
atgttttttgaaa

SEQ ID NO: 704415 - DNA, 13 bp, C. elegans
atgttttttgtgc

SEQ ID NO: 704416 - DNA, 13 bp, C. elegans
atgtttttttaca

SEQ ID NO: 704417 - DNA, 13 bp, C. elegans
attaaaaaacctt

SEQ ID NO: 704418 - DNA, 13 bp, C. elegans
attaaaaaatgca

SEQ ID NO: 704419 - DNA, 13 bp, C. elegans
attaaaaacgatt

SEQ ID NO: 704420 - DNA, 13 bp, C. elegans
attaaaaacttca

SEQ ID NO: 704421 - DNA, 13 bp, C. elegans
attaaaaaggttt

SEQ ID NO: 704422 - DNA, 13 bp, C. elegans
attaaaaagtcaa

SEQ ID NO: 704423 - DNA, 13 bp, C. elegans
attaaaaagtgtt

SEQ ID NO: 704424 - DNA, 13 bp, C. elegans
attaaaaagttca

SEQ ID NO: 704425 - DNA, 13 bp, C. elegans
attaaaaatgtga

SEQ ID NO: 704426 - DNA, 13 bp, C. elegans
attaaaaattctg

SEQ ID NO: 704427 - DNA, 13 bp, C. elegans
attaaaactgaaa

SEQ ID NO: 704428 - DNA, 13 bp, C. elegans
attaaaacttgaa

SEQ ID NO: 704429 - DNA, 13 bp, C. elegans
attaaaacttgtt

SEQ ID NO: 704430 - DNA, 13 bp, C. elegans
attaaaactttcc

SEQ ID NO: 704431 - DNA, 13 bp, C. elegans
attaaaacttttc

SEQ ID NO: 704432 - DNA, 13 bp, C. elegans
attaaaagttgat

SEQ ID NO: 704433 - DNA, 13 bp, C. elegans
attaaaatcagaa

SEQ ID NO: 704434 - DNA, 13 bp, C. elegans
attaaaatggatt

SEQ ID NO: 704435 - DNA, 13 bp, C. elegans
attaaaatgttgc

SEQ ID NO: 704436 - DNA, 13 bp, C. elegans
attaaacacaatt

SEQ ID NO: 704437 - DNA, 13 bp, C. elegans
attaaacattttc

SEQ ID NO: 704438 - DNA, 13 bp, C. elegans
attaaacttgttt

SEQ ID NO: 704439 - DNA, 13 bp, C. elegans
attaaactttttc

SEQ ID NO: 704440 - DNA, 13 bp, C. elegans
attaaagaaaatc

SEQ ID NO: 704441 - DNA, 13 bp, C. elegans
attaaagctcaaa

SEQ ID NO: 704442 - DNA, 13 bp, C. elegans
attaaaggattaa

SEQ ID NO: 704443 - DNA, 13 bp, C. elegans
attaaaggtggtg

SEQ ID NO: 704444 - DNA, 13 bp, C. elegans
attaaagtttcca

SEQ ID NO: 704445 - DNA, 13 bp, C. elegans
attaaataaaacg

SEQ ID NO: 704446 - DNA, 13 bp, C. elegans
attaaatctgaaa

SEQ ID NO: 704447 - DNA, 13 bp, C. elegans
attaaattagcaa

SEQ ID NO: 704448 - DNA, 13 bp, C. elegans
attaaattctcaa

SEQ ID NO: 704449 - DNA, 13 bp, C. elegans
attaaattcttca

SEQ ID NO: 704450 - DNA, 13 bp, C. elegans
attaaattcttga

SEQ ID NO: 704451 - DNA, 13 bp, C. elegans
attaaattgtttc

SEQ ID NO: 704452 - DNA, 13 bp, C. elegans
attaaatttctga

SEQ ID NO: 704453 - DNA, 13 bp, C. elegans
attaaatttgcaa

SEQ ID NO: 704454 - DNA, 13 bp, C. elegans
attaaatttgttc

SEQ ID NO: 704455 - DNA, 13 bp, C. elegans
attaaatttgttg

SEQ ID NO: 704456 - DNA, 13 bp, C. elegans
attaaattttcag

SEQ ID NO: 704457 - DNA, 13 bp, C. elegans
attaacaaaattg

SEQ ID NO: 704458 - DNA, 13 bp, C. elegans
attaacaatttgt

SEQ ID NO: 704459 - DNA, 13 bp, C. elegans
attaacacaattt

SEQ ID NO: 704460 - DNA, 13 bp, C. elegans
attaacattttgt

SEQ ID NO: 704461 - DNA, 13 bp, C. elegans
attaacggatttt

SEQ ID NO: 704462 - DNA, 13 bp, C. elegans
attaactcaattt

SEQ ID NO: 704463 - DNA, 13 bp, C. elegans
attaactctcatt

SEQ ID NO: 704464 - DNA, 13 bp, C. elegans
attaactgaaaat

SEQ ID NO: 704465 - DNA, 13 bp, C. elegans
attaactgaaatt

SEQ ID NO: 704466 - DNA, 13 bp, C. elegans
attaactgatttt

SEQ ID NO: 704467 - DNA, 13 bp, C. elegans
attaacttcaaat

SEQ ID NO: 704468 - DNA, 14 bp, C. elegans
attaacttggatca

SEQ ID NO: 704469 - DNA, 13 bp, C. elegans
attaacttttcaa

SEQ ID NO: 704470 - DNA, 13 bp, C. elegans
attaagaaaagtt

SEQ ID NO: 704471 - DNA, 13 bp, C. elegans
attaagaaattcg

SEQ ID NO: 704472 - DNA, 13 bp, C. elegans
attaagatttgaa

SEQ ID NO: 704473 - DNA, 13 bp, C. elegans
attaagcaacatt

SEQ ID NO: 704474 - DNA, 13 bp, C. elegans
attaagcttgaaa

SEQ ID NO: 704475 - DNA, 13 bp, C. elegans
attaagtgtattt

SEQ ID NO: 704476 - DNA, 13 bp, C. elegans
attaagtttttca

SEQ ID NO: 704477 - DNA, 13 bp, C. elegans
attaagtttttga

SEQ ID NO: 704478 - DNA, 13 bp, C. elegans
attaatacgaaat

SEQ ID NO: 704479 - DNA, 13 bp, C. elegans
attaatagttttg

SEQ ID NO: 704480 - DNA, 13 bp, C. elegans
attaatcagtttt

SEQ ID NO: 704481 - DNA, 13 bp, C. elegans
attaatccaattt

SEQ ID NO: 704482 - DNA, 13 bp, C. elegans
attaatgaaaatc

SEQ ID NO: 704483 - DNA, 13 bp, C. elegans
attaatgaaaatg

SEQ ID NO: 704484 - DNA, 13 bp, C. elegans
attaatgacaatt

SEQ ID NO: 704485 - DNA, 13 bp, C. elegans
attaatggaaatt

SEQ ID NO: 704486 - DNA, 13 bp, C. elegans
attaatgttgtaa

SEQ ID NO: 704487 - DNA, 13 bp, C. elegans
attaatgtttcat

SEQ ID NO: 704488 - DNA, 13 bp, C. elegans
attaatgttttca

SEQ ID NO: 704489 - DNA, 13 bp, C. elegans
attaattatcttg

SEQ ID NO: 704490 - DNA, 13 bp, C. elegans
attaattcaagaa

SEQ ID NO: 704491 - DNA, 13 bp, C. elegans
attaattcaagtt

SEQ ID NO: 704492 - DNA, 13 bp, C. elegans
attaattcacaaa

SEQ ID NO: 704493 - DNA, 13 bp, C. elegans
attaattcagttt

SEQ ID NO: 704494 - DNA, 13 bp, C. elegans
attaattctttga

SEQ ID NO: 704495 - DNA, 13 bp, C. elegans
attaattgaacaa

SEQ ID NO: 704496 - DNA, 13 bp, C. elegans
attaattgaatgt

SEQ ID NO: 704497 - DNA, 13 bp, C. elegans
attaattgattca

SEQ ID NO: 704498 - DNA, 13 bp, C. elegans
attaattggaatt

SEQ ID NO: 704499 - DNA, 13 bp, C. elegans
attaattgttttc

SEQ ID NO: 704500 - DNA, 13 bp, C. elegans
attaatttattgc

SEQ ID NO: 704501 - DNA, 13 bp, C. elegans
attaatttcaact

SEQ ID NO: 704502 - DNA, 13 bp, C. elegans
attaatttccaac

SEQ ID NO: 704503 - DNA, 13 bp, C. elegans
attaatttctgaa

SEQ ID NO: 704504 - DNA, 13 bp, C. elegans
attaatttggaat

SEQ ID NO: 704505 - DNA, 13 bp, C. elegans
attaatttgtgat

SEQ ID NO: 704506 - DNA, 13 bp, C. elegans
attaattttctgt

SEQ ID NO: 704507 - DNA, 13 bp, C. elegans
attaattttgagt

SEQ ID NO: 704508 - DNA, 13 bp, C. elegans
attaattttgcat

SEQ ID NO: 704509 - DNA, 13 bp, C. elegans
attaatttttgcc

SEQ ID NO: 704510 - DNA, 13 bp, C. elegans
attacaaaaaagt

SEQ ID NO: 704511 - DNA, 13 bp, C. elegans
attacaaaaaatg

SEQ ID NO: 704512 - DNA, 13 bp, C. elegans
attacaaaaactg

SEQ ID NO: 704513 - DNA, 13 bp, C. elegans
attacaaaaattc

SEQ ID NO: 704514 - DNA, 13 bp, C. elegans
attacaaaatttg

SEQ ID NO: 704515 - DNA, 13 bp, C. elegans
attacaaacaatt

SEQ ID NO: 704516 - DNA, 13 bp, C. elegans
attacaaactttt

SEQ ID NO: 704517 - DNA, 13 bp, C. elegans
attacaaagtttt

SEQ ID NO: 704518 - DNA, 13 bp, C. elegans
attacaaattttg

SEQ ID NO: 704519 - DNA, 13 bp, C. elegans
attacaacaattt

SEQ ID NO: 704520 - DNA, 13 bp, C. elegans
attacaagaaata

SEQ ID NO: 704521 - DNA, 13 bp, C. elegans
attacaagaattt

SEQ ID NO: 704522 - DNA, 13 bp, C. elegans
attacaagttttt

SEQ ID NO: 704523 - DNA, 13 bp, C. elegans
attacaatttctt

SEQ ID NO: 704524 - DNA, 13 bp, C. elegans
attacaatttttc

SEQ ID NO: 704525 - DNA, 13 bp, C. elegans
attacacttgaaa

SEQ ID NO: 704526 - DNA, 13 bp, C. elegans
attacagtaattc

SEQ ID NO: 704527 - DNA, 13 bp, C. elegans
attacagtacccc

SEQ ID NO: 704528 - DNA, 13 bp, C. elegans
attacagtattct

SEQ ID NO: 704529 - DNA, 13 bp, C. elegans
attacagttttaa

SEQ ID NO: 704530 - DNA, 24 bp, C. elegans
attacatcgccctagaggatcaaa

SEQ ID NO: 704531 - DNA, 13 bp, C. elegans
attacatgttttc

SEQ ID NO: 704532 - DNA, 13 bp, C. elegans
attacatttgaaa

SEQ ID NO: 704533 - DNA, 13 bp, C. elegans
attacattttcag

SEQ ID NO: 704534 - DNA, 13 bp, C. elegans
attacattttcat

SEQ ID NO: 704535 - DNA, 13 bp, C. elegans
attacatttttcc

SEQ ID NO: 704536 - DNA, 13 bp, C. elegans
attaccaaaaatt

SEQ ID NO: 704537 - DNA, 13 bp, C. elegans
attaccacatttt

SEQ ID NO: 704538 - DNA, 13 bp, C. elegans
attacccaatttt

SEQ ID NO: 704539 - DNA, 13 bp, C. elegans
attacccgaaaaa

SEQ ID NO: 704540 - DNA, 13 bp, C. elegans
attaccgattttt

SEQ ID NO: 704541 - DNA, 13 bp, C. elegans
attacgaaattcg

SEQ ID NO: 704542 - DNA, 13 bp, C. elegans
attacgagaaaaa

SEQ ID NO: 704543 - DNA, 13 bp, C. elegans
attacggaaacac

SEQ ID NO: 704544 - DNA, 13 bp, C. elegans
attacgggaacac

SEQ ID NO: 704545 - DNA, 13 bp, C. elegans
attactaatttgt

SEQ ID NO: 704546 - DNA, 13 bp, C. elegans
attactattgtgc

SEQ ID NO: 704547 - DNA, 13 bp, C. elegans
attactcaatttt

SEQ ID NO: 704548 - DNA, 13 bp, C. elegans
attactcacaaaa

SEQ ID NO: 704549 - DNA, 13 bp, C. elegans
attactcatattt

SEQ ID NO: 704550 - DNA, 13 bp, C. elegans
attactgatatgt

SEQ ID NO: 704551 - DNA, 13 bp, C. elegans
attactgattttc

SEQ ID NO: 704552 - DNA, 13 bp, C. elegans
attactgtaaaat

SEQ ID NO: 704553 - DNA, 13 bp, C. elegans
attactgtaaatt

SEQ ID NO: 704554 - DNA, 13 bp, C. elegans
attactgtaactt

SEQ ID NO: 704555 - DNA, 13 bp, C. elegans
attactgtaattc

SEQ ID NO: 704556 - DNA, 13 bp, C. elegans
attactgtaattt

SEQ ID NO: 704557 - DNA, 13 bp, C. elegans
attactgtagctt

SEQ ID NO: 704558 - DNA, 13 bp, C. elegans
attactgtagtgg

SEQ ID NO: 704559 - DNA, 13 bp, C. elegans
attactgtagttt

SEQ ID NO: 704560 - DNA, 13 bp, C. elegans
attactgtatttt

SEQ ID NO: 704561 - DNA, 13 bp, C. elegans
attagaaaaatgt

SEQ ID NO: 704562 - DNA, 13 bp, C. elegans
attagaaaatcat

SEQ ID NO: 704563 - DNA, 13 bp, C. elegans
attagaaagtttg

SEQ ID NO: 704564 - DNA, 13 bp, C. elegans
attagaaattgaa

SEQ ID NO: 704565 - DNA, 13 bp, C. elegans
attagaaattgga

SEQ ID NO: 704566 - DNA, 13 bp, C. elegans
attagaacaattt

SEQ ID NO: 704567 - DNA, 13 bp, C. elegans
attagaacttttc

SEQ ID NO: 704568 - DNA, 13 bp, C. elegans
attagaagaaatt

SEQ ID NO: 704569 - DNA, 13 bp, C. elegans
attagaatcaaaa

SEQ ID NO: 704570 - DNA, 13 bp, C. elegans
attagaattgaat

SEQ ID NO: 704571 - DNA, 13 bp, C. elegans
attagaattttct

SEQ ID NO: 704572 - DNA, 13 bp, C. elegans
attagacttaaaa

SEQ ID NO: 704573 - DNA, 13 bp, C. elegans
attagagaaacaa

SEQ ID NO: 704574 - DNA, 13 bp, C. elegans
attagagcaaaaa

SEQ ID NO: 704575 - DNA, 13 bp, C. elegans
attagagcgcact

SEQ ID NO: 704576 - DNA, 13 bp, C. elegans
attagatgaattt

SEQ ID NO: 704577 - DNA, 13 bp, C. elegans
attagatttgttc

SEQ ID NO: 704578 - DNA, 13 bp, C. elegans
attagattttcag

SEQ ID NO: 704579 - DNA, 13 bp, C. elegans
attagattttgat

SEQ ID NO: 704580 - DNA, 13 bp, C. elegans
attagatttttca

SEQ ID NO: 704581 - DNA, 13 bp, C. elegans
attagcaaaatta

SEQ ID NO: 704582 - DNA, 13 bp, C. elegans
attagcattaaaa

SEQ ID NO: 704583 - DNA, 13 bp, C. elegans
attaggaaaaaac

SEQ ID NO: 704584 - DNA, 13 bp, C. elegans
attaggaaaatgc

SEQ ID NO: 704585 - DNA, 13 bp, C. elegans
attaggcaattat

SEQ ID NO: 704586 - DNA, 13 bp, C. elegans
attagggaaattt

SEQ ID NO: 704587 - DNA, 13 bp, C. elegans
attagtattgcac

SEQ ID NO: 704588 - DNA, 13 bp, C. elegans
attagtcttgaat

SEQ ID NO: 704589 - DNA, 13 bp, C. elegans
attagtgaaaaat

SEQ ID NO: 704590 - DNA, 13 bp, C. elegans
attagtggaaaat

SEQ ID NO: 704591 - DNA, 13 bp, C. elegans
attagtttattca

SEQ ID NO: 704592 - DNA, 13 bp, C. elegans
attagtttgaaaa

SEQ ID NO: 704593 - DNA, 13 bp, C. elegans
attagttttggaa

SEQ ID NO: 704594 - DNA, 13 bp, C. elegans
attataaaaagct

SEQ ID NO: 704595 - DNA, 13 bp, C. elegans
attataaaaagtg

SEQ ID NO: 704596 - DNA, 13 bp, C. elegans
attataaaagttc

SEQ ID NO: 704597 - DNA, 13 bp, C. elegans
attatacacaatt

SEQ ID NO: 704598 - DNA, 13 bp, C. elegans
attatacatagtt

SEQ ID NO: 704599 - DNA, 13 bp, C. elegans
attatactcaaat

SEQ ID NO: 704600 - DNA, 13 bp, C. elegans
attatactgaaat

SEQ ID NO: 704601 - DNA, 13 bp, C. elegans
attatactttgat

SEQ ID NO: 704602 - DNA, 13 bp, C. elegans
attatagaaaaca

SEQ ID NO: 704603 - DNA, 13 bp, C. elegans
attatagagtttt

SEQ ID NO: 704604 - DNA, 13 bp, C. elegans
attataggaaaat

SEQ ID NO: 704605 - DNA, 13 bp, C. elegans
attatatattgca

SEQ ID NO: 704606 - DNA, 13 bp, C. elegans
attatatcagttt

SEQ ID NO: 704607 - DNA, 13 bp, C. elegans
attatatcatcaa

SEQ ID NO: 704608 - DNA, 13 bp, C. elegans
attatatgaaagt

SEQ ID NO: 704609 - DNA, 13 bp, C. elegans
attatatgtacat

SEQ ID NO: 704610 - DNA, 13 bp, C. elegans
attatatgttttc

SEQ ID NO: 704611 - DNA, 13 bp, C. elegans
attatattccaaa

SEQ ID NO: 704612 - DNA, 13 bp, C. elegans
attatatttctag

SEQ ID NO: 704613 - DNA, 13 bp, C. elegans
attatatttgcaa

SEQ ID NO: 704614 - DNA, 13 bp, C. elegans
attatatttgctc

SEQ ID NO: 704615 - DNA, 13 bp, C. elegans
attatattttctg

SEQ ID NO: 704616 - DNA, 13 bp, C. elegans
attatcaaaatga

SEQ ID NO: 704617 - DNA, 13 bp, C. elegans
attatcaaaattg

SEQ ID NO: 704618 - DNA, 13 bp, C. elegans
attatcaaatatc

SEQ ID NO: 704619 - DNA, 13 bp, C. elegans
attatcaaatgaa

SEQ ID NO: 704620 - DNA, 13 bp, C. elegans
attatcaactgaa

SEQ ID NO: 704621 - DNA, 13 bp, C. elegans
attatcaatgttt

SEQ ID NO: 704622 - DNA, 13 bp, C. elegans
attatcaattcaa

SEQ ID NO: 704623 - DNA, 13 bp, C. elegans
attatcaatttca

SEQ ID NO: 704624 - DNA, 13 bp, C. elegans
attatcacacttt

SEQ ID NO: 704625 - DNA, 13 bp, C. elegans
attatcacagttt

SEQ ID NO: 704626 - DNA, 13 bp, C. elegans
attatcacgaaaa

SEQ ID NO: 704627 - DNA, 13 bp, C. elegans
attatcagaaaac

SEQ ID NO: 704628 - DNA, 13 bp, C. elegans
attatcagaaaag

SEQ ID NO: 704629 - DNA, 13 bp, C. elegans
attatcagaaaat

SEQ ID NO: 704630 - DNA, 13 bp, C. elegans
attatcagttttc

SEQ ID NO: 704631 - DNA, 13 bp, C. elegans
attatcagttttt

SEQ ID NO: 704632 - DNA, 14 bp, C. elegans
attatcatcatcat

SEQ ID NO: 704633 - DNA, 13 bp, C. elegans
attatcatgaaat

SEQ ID NO: 704634 - DNA, 13 bp, C. elegans
attatcatgattt

SEQ ID NO: 704635 - DNA, 13 bp, C. elegans
attatcattgttt

SEQ ID NO: 704636 - DNA, 13 bp, C. elegans
attatccaaaaat

SEQ ID NO: 704637 - DNA, 13 bp, C. elegans
attatccaaaatt

SEQ ID NO: 704638 - DNA, 13 bp, C. elegans
attatccaatatt

SEQ ID NO: 704639 - DNA, 13 bp, C. elegans
attatccgaaaaa

SEQ ID NO: 704640 - DNA, 13 bp, C. elegans
attatccgaaaat

SEQ ID NO: 704641 - DNA, 13 bp, C. elegans
attatcgaaattt

SEQ ID NO: 704642 - DNA, 13 bp, C. elegans
attatcgattatt

SEQ ID NO: 704643 - DNA, 15 bp, C. elegans
attatcgatttttgt

SEQ ID NO: 704644 - DNA, 13 bp, C. elegans
attatcggatttt

SEQ ID NO: 704645 - DNA, 13 bp, C. elegans
attatgaaaaact

SEQ ID NO: 704646 - DNA, 13 bp, C. elegans
attatgaaaaatc

SEQ ID NO: 704647 - DNA, 13 bp, C. elegans
attatgaaaactt

SEQ ID NO: 704648 - DNA, 13 bp, C. elegans
attatgaaaatct

SEQ ID NO: 704649 - DNA, 13 bp, C. elegans
attatgaaatgaa

SEQ ID NO: 704650 - DNA, 13 bp, C. elegans
attatgaaattca

SEQ ID NO: 704651 - DNA, 13 bp, C. elegans
attatgaaatttg

SEQ ID NO: 704652 - DNA, 13 bp, C. elegans
attatgaacaatt

SEQ ID NO: 704653 - DNA, 13 bp, C. elegans
attatgaagaatt

SEQ ID NO: 704654 - DNA, 13 bp, C. elegans
attatgaagatga

SEQ ID NO: 704655 - DNA, 13 bp, C. elegans
attatgaatgaaa

SEQ ID NO: 704656 - DNA, 13 bp, C. elegans
attatgaatgttt

SEQ ID NO: 704657 - DNA, 13 bp, C. elegans
attatgaattgta

SEQ ID NO: 704658 - DNA, 13 bp, C. elegans
attatgacaaatt

SEQ ID NO: 704659 - DNA, 13 bp, C. elegans
attatgacgtcac

SEQ ID NO: 704660 - DNA, 13 bp, C. elegans
attatgagctttt

SEQ ID NO: 704661 - DNA, 13 bp, C. elegans
attatgagttttc

SEQ ID NO: 704662 - DNA, 13 bp, C. elegans
attatgatattca

SEQ ID NO: 704663 - DNA, 13 bp, C. elegans
attatgatattcg

SEQ ID NO: 704664 - DNA, 13 bp, C. elegans
attatgatatttg

SEQ ID NO: 704665 - DNA, 13 bp, C. elegans
attatgatgatga

SEQ ID NO: 704666 - DNA, 13 bp, C. elegans
attatgattatga

SEQ ID NO: 704667 - DNA, 13 bp, C. elegans
attatgatttcaa

SEQ ID NO: 704668 - DNA, 13 bp, C. elegans
attatgctcattt

SEQ ID NO: 704669 - DNA, 13 bp, C. elegans
attatggaaaaat

SEQ ID NO: 704670 - DNA, 13 bp, C. elegans
attatggaaaatt

SEQ ID NO: 704671 - DNA, 13 bp, C. elegans
attatggaaactt

SEQ ID NO: 704672 - DNA, 13 bp, C. elegans
attatggaaattt

SEQ ID NO: 704673 - DNA, 13 bp, C. elegans
attatggacaata

SEQ ID NO: 704674 - DNA, 14 bp, C. elegans
attatgtattcagt

SEQ ID NO: 704675 - DNA, 13 bp, C. elegans
attatgtatttga

SEQ ID NO: 704676 - DNA, 13 bp, C. elegans
attatgtgaaatt

SEQ ID NO: 704677 - DNA, 13 bp, C. elegans
attatgtgcaaaa

SEQ ID NO: 704678 - DNA, 13 bp, C. elegans
attatgtttcttc

SEQ ID NO: 704679 - DNA, 13 bp, C. elegans
attatgtttgaat

SEQ ID NO: 704680 - DNA, 13 bp, C. elegans
attatgttttcca

SEQ ID NO: 704681 - DNA, 13 bp, C. elegans
attattaaaagtg

SEQ ID NO: 704682 - DNA, 13 bp, C. elegans
attattacagttt

SEQ ID NO: 704683 - DNA, 13 bp, C. elegans
attattacgaaaa

SEQ ID NO: 704684 - DNA, 13 bp, C. elegans
attattacgaaat

SEQ ID NO: 704685 - DNA, 13 bp, C. elegans
attattacgggaa

SEQ ID NO: 704686 - DNA, 13 bp, C. elegans
attattagttcaa

SEQ ID NO: 704687 - DNA, 13 bp, C. elegans
attattatgtgaa

SEQ ID NO: 704688 - DNA, 13 bp, C. elegans
attattattttgc

SEQ ID NO: 704689 - DNA, 13 bp, C. elegans
attattcaaagtt

SEQ ID NO: 704690 - DNA, 13 bp, C. elegans
attattcaaattc

SEQ ID NO: 704691 - DNA, 13 bp, C. elegans
attattcaacaaa

SEQ ID NO: 704692 - DNA, 13 bp, C. elegans
attattcaagtaa

SEQ ID NO: 704693 - DNA, 13 bp, C. elegans
attattcaatcat

SEQ ID NO: 704694 - DNA, 13 bp, C. elegans
attattcaattgt

SEQ ID NO: 704695 - DNA, 13 bp, C. elegans
attattcaatttc

SEQ ID NO: 704696 - DNA, 13 bp, C. elegans
attattcagtttt

SEQ ID NO: 704697 - DNA, 13 bp, C. elegans
attattcatttgt

SEQ ID NO: 704698 - DNA, 13 bp, C. elegans
attattccacaat

SEQ ID NO: 704699 - DNA, 13 bp, C. elegans
attattccgtttt

SEQ ID NO: 704700 - DNA, 14 bp, C. elegans
attattcgaaattt

SEQ ID NO: 704701 - DNA, 13 bp, C. elegans
attattcgaattt

SEQ ID NO: 704702 - DNA, 13 bp, C. elegans
attattcggattt

SEQ ID NO: 704703 - DNA, 13 bp, C. elegans
attattctcaaat

SEQ ID NO: 704704 - DNA, 13 bp, C. elegans
attattctcagtt

SEQ ID NO: 704705 - DNA, 13 bp, C. elegans
attattctggaaa

SEQ ID NO: 704706 - DNA, 13 bp, C. elegans
attattcttcaaa

SEQ ID NO: 704707 - DNA, 13 bp, C. elegans
attattgaaaaca

SEQ ID NO: 704708 - DNA, 13 bp, C. elegans
attattgaaattc

SEQ ID NO: 704709 - DNA, 13 bp, C. elegans
attattgaacaat

SEQ ID NO: 704710 - DNA, 13 bp, C. elegans
attattgaacatt

SEQ ID NO: 704711 - DNA, 13 bp, C. elegans
attattgaattcc

SEQ ID NO: 704712 - DNA, 13 bp, C. elegans
attattgagaata

SEQ ID NO: 704713 - DNA, 13 bp, C. elegans
attattgagaatt

SEQ ID NO: 704714 - DNA, 13 bp, C. elegans
attattgatttct

SEQ ID NO: 704715 - DNA, 13 bp, C. elegans
attattgattttc

SEQ ID NO: 704716 - DNA, 13 bp, C. elegans
attattgcatttt

SEQ ID NO: 704717 - DNA, 13 bp, C. elegans
attattggaaatt

SEQ ID NO: 704718 - DNA, 13 bp, C. elegans
attattggaattt

SEQ ID NO: 704719 - DNA, 13 bp, C. elegans
attattggcgtgc

SEQ ID NO: 704720 - DNA, 13 bp, C. elegans
attattgtacttt

SEQ ID NO: 704721 - DNA, 13 bp, C. elegans
attattgtcaaaa

SEQ ID NO: 704722 - DNA, 13 bp, C. elegans
attattgtcaaca

SEQ ID NO: 704723 - DNA, 13 bp, C. elegans
attattgttattc

SEQ ID NO: 704724 - DNA, 13 bp, C. elegans
attattgttttgc

SEQ ID NO: 704725 - DNA, 13 bp, C. elegans
attatttcaaagt

SEQ ID NO: 704726 - DNA, 13 bp, C. elegans
attatttcaagtt

SEQ ID NO: 704727 - DNA, 13 bp, C. elegans
attatttcaattg

SEQ ID NO: 704728 - DNA, 13 bp, C. elegans
attatttcagcat

SEQ ID NO: 704729 - DNA, 13 bp, C. elegans
attatttcagttt

SEQ ID NO: 704730 - DNA, 13 bp, C. elegans
attatttccaaat

SEQ ID NO: 704731 - DNA, 13 bp, C. elegans
attatttccacaa

SEQ ID NO: 704732 - DNA, 13 bp, C. elegans
attatttccagaa

SEQ ID NO: 704733 - DNA, 13 bp, C. elegans
attatttccatga

SEQ ID NO: 704734 - DNA, 13 bp, C. elegans
attatttctaaac

SEQ ID NO: 704735 - DNA, 13 bp, C. elegans
attatttctagtt

SEQ ID NO: 704736 - DNA, 13 bp, C. elegans
attatttctcaaa

SEQ ID NO: 704737 - DNA, 13 bp, C. elegans
attatttgaagaa

SEQ ID NO: 704738 - DNA, 13 bp, C. elegans
attatttgaagat

SEQ ID NO: 704739 - DNA, 13 bp, C. elegans
attatttgaagtt

SEQ ID NO: 704740 - DNA, 13 bp, C. elegans
attatttgatgat

SEQ ID NO: 704741 - DNA, 13 bp, C. elegans
attatttgctctt

SEQ ID NO: 704742 - DNA, 13 bp, C. elegans
attatttggatta

SEQ ID NO: 704743 - DNA, 13 bp, C. elegans
attatttgtcaaa

SEQ ID NO: 704744 - DNA, 13 bp, C. elegans
attatttgttcaa

SEQ ID NO: 704745 - DNA, 13 bp, C. elegans
attatttgttgag

SEQ ID NO: 704746 - DNA, 13 bp, C. elegans
attatttgtttca

SEQ ID NO: 704747 - DNA, 13 bp, C. elegans
attattttactgt

SEQ ID NO: 704748 - DNA, 13 bp, C. elegans
attattttcagca

SEQ ID NO: 704749 - DNA, 13 bp, C. elegans
attattttcatgt

SEQ ID NO: 704750 - DNA, 13 bp, C. elegans
attattttccagt

SEQ ID NO: 704751 - DNA, 13 bp, C. elegans
attattttccgtt

SEQ ID NO: 704752 - DNA, 13 bp, C. elegans
attattttctaca

SEQ ID NO: 704753 - DNA, 13 bp, C. elegans
attattttctcag

SEQ ID NO: 704754 - DNA, 13 bp, C. elegans
attattttctcga

SEQ ID NO: 704755 - DNA, 13 bp, C. elegans
attattttctgaa

SEQ ID NO: 704756 - DNA, 13 bp, C. elegans
attattttgagct

SEQ ID NO: 704757 - DNA, 13 bp, C. elegans
attattttgatga

SEQ ID NO: 704758 - DNA, 13 bp, C. elegans
attattttgtgaa

SEQ ID NO: 704759 - DNA, 13 bp, C. elegans
attattttgtgga

SEQ ID NO: 704760 - DNA, 13 bp, C. elegans
attatttttacac

SEQ ID NO: 704761 - DNA, 13 bp, C. elegans
attatttttcacc

SEQ ID NO: 704762 - DNA, 13 bp, C. elegans
attatttttcgaa

SEQ ID NO: 704763 - DNA, 13 bp, C. elegans
attatttttctgc

SEQ ID NO: 704764 - DNA, 13 bp, C. elegans
attatttttgaag

SEQ ID NO: 704765 - DNA, 13 bp, C. elegans
attatttttgcag

SEQ ID NO: 704766 - DNA, 13 bp, C. elegans
attcaaaaaaagt

SEQ ID NO: 704767 - DNA, 14 bp, C. elegans
attcaaaaaatcga

SEQ ID NO: 704768 - DNA, 13 bp, C. elegans
attcaaaaaatgg

SEQ ID NO: 704769 - DNA, 13 bp, C. elegans
attcaaaaacatt

SEQ ID NO: 704770 - DNA, 13 bp, C. elegans
attcaaaaacttc

SEQ ID NO: 704771 - DNA, 13 bp, C. elegans
attcaaaaagttg

SEQ ID NO: 704772 - DNA, 13 bp, C. elegans
attcaaaaatcag

SEQ ID NO: 704773 - DNA, 13 bp, C. elegans
attcaaaaatggg

SEQ ID NO: 704774 - DNA, 13 bp, C. elegans
attcaaaaatgtc

SEQ ID NO: 704775 - DNA, 13 bp, C. elegans
attcaaaaatgtt

SEQ ID NO: 704776 - DNA, 13 bp, C. elegans
attcaaaaattca

SEQ ID NO: 704777 - DNA, 13 bp, C. elegans
attcaaaacatat

SEQ ID NO: 704778 - DNA, 13 bp, C. elegans
attcaaaacgatt

SEQ ID NO: 704779 - DNA, 13 bp, C. elegans
attcaaaacgttc

SEQ ID NO: 704780 - DNA, 13 bp, C. elegans
attcaaaactcaa

SEQ ID NO: 704781 - DNA, 13 bp, C. elegans
attcaaaactgtt

SEQ ID NO: 704782 - DNA, 13 bp, C. elegans
attcaaaacttct

SEQ ID NO: 704783 - DNA, 13 bp, C. elegans
attcaaaagaaca

SEQ ID NO: 704784 - DNA, 13 bp, C. elegans
attcaaaagaata

SEQ ID NO: 704785 - DNA, 13 bp, C. elegans
attcaaaagcttt

SEQ ID NO: 704786 - DNA, 13 bp, C. elegans
attcaaaaggaaa

SEQ ID NO: 704787 - DNA, 13 bp, C. elegans
attcaaaagtaag

SEQ ID NO: 704788 - DNA, 13 bp, C. elegans
attcaaaagttct

SEQ ID NO: 704789 - DNA, 13 bp, C. elegans
attcaaaagtttc

SEQ ID NO: 704790 - DNA, 13 bp, C. elegans
attcaaaagtttt

SEQ ID NO: 704791 - DNA, 13 bp, C. elegans
attcaaaatcttc

SEQ ID NO: 704792 - DNA, 13 bp, C. elegans
attcaaaatgaaa

SEQ ID NO: 704793 - DNA, 13 bp, C. elegans
attcaaaatgata

SEQ ID NO: 704794 - DNA, 13 bp, C. elegans
attcaaaatgttc

SEQ ID NO: 704795 - DNA, 13 bp, C. elegans
attcaaaattcca

SEQ ID NO: 704796 - DNA, 13 bp, C. elegans
attcaaaattctg

SEQ ID NO: 704797 - DNA, 13 bp, C. elegans
attcaaaattgac

SEQ ID NO: 704798 - DNA, 13 bp, C. elegans
attcaaaatttct

SEQ ID NO: 704799 - DNA, 13 bp, C. elegans
attcaaaatttga

SEQ ID NO: 704800 - DNA, 13 bp, C. elegans
attcaaaattttg

SEQ ID NO: 704801 - DNA, 13 bp, C. elegans
attcaaacaaatc

SEQ ID NO: 704802 - DNA, 13 bp, C. elegans
attcaaacaactt

SEQ ID NO: 704803 - DNA, 13 bp, C. elegans
attcaaacagaaa

SEQ ID NO: 704804 - DNA, 13 bp, C. elegans
attcaaacatata

SEQ ID NO: 704805 - DNA, 13 bp, C. elegans
attcaaacattat

SEQ ID NO: 704806 - DNA, 13 bp, C. elegans
attcaaacattca

SEQ ID NO: 704807 - DNA, 13 bp, C. elegans
attcaaacatttt

SEQ ID NO: 704808 - DNA, 13 bp, C. elegans
attcaaaccatca

SEQ ID NO: 704809 - DNA, 13 bp, C. elegans
attcaaaccattt

SEQ ID NO: 704810 - DNA, 13 bp, C. elegans
attcaaactaaat

SEQ ID NO: 704811 - DNA, 13 bp, C. elegans
attcaaactattt

SEQ ID NO: 704812 - DNA, 13 bp, C. elegans
attcaaactcttt

SEQ ID NO: 704813 - DNA, 13 bp, C. elegans
attcaaactgaaa

SEQ ID NO: 704814 - DNA, 13 bp, C. elegans
attcaaactgttt

SEQ ID NO: 704815 - DNA, 13 bp, C. elegans
attcaaacttatt

SEQ ID NO: 704816 - DNA, 13 bp, C. elegans
attcaaacttttt

SEQ ID NO: 704817 - DNA, 13 bp, C. elegans
attcaaagaaaac

SEQ ID NO: 704818 - DNA, 13 bp, C. elegans
attcaaagaaatg

SEQ ID NO: 704819 - DNA, 13 bp, C. elegans
attcaaagttatt

SEQ ID NO: 704820 - DNA, 13 bp, C. elegans
attcaaagtttga

SEQ ID NO: 704821 - DNA, 13 bp, C. elegans
attcaaagttttt

SEQ ID NO: 704822 - DNA, 13 bp, C. elegans
attcaaataaaga

SEQ ID NO: 704823 - DNA, 13 bp, C. elegans
attcaaataattc

SEQ ID NO: 704824 - DNA, 13 bp, C. elegans
attcaaatatctt

SEQ ID NO: 704825 - DNA, 13 bp, C. elegans
attcaaatattcg

SEQ ID NO: 704826 - DNA, 13 bp, C. elegans
attcaaatattct

SEQ ID NO: 704827 - DNA, 13 bp, C. elegans
attcaaatcaaac

SEQ ID NO: 704828 - DNA, 13 bp, C. elegans
attcaaatcattt

SEQ ID NO: 704829 - DNA, 13 bp, C. elegans
attcaaatccaat

SEQ ID NO: 704830 - DNA, 13 bp, C. elegans
attcaaatcgaaa

SEQ ID NO: 704831 - DNA, 13 bp, C. elegans
attcaaatcttca

SEQ ID NO: 704832 - DNA, 13 bp, C. elegans
attcaaatgaaac

SEQ ID NO: 704833 - DNA, 13 bp, C. elegans
attcaaatgagaa

SEQ ID NO: 704834 - DNA, 13 bp, C. elegans
attcaaatgagga

SEQ ID NO: 704835 - DNA, 13 bp, C. elegans
attcaaatgcaaa

SEQ ID NO: 704836 - DNA, 13 bp, C. elegans
attcaaatgtctt

SEQ ID NO: 704837 - DNA, 13 bp, C. elegans
attcaaatgttta

SEQ ID NO: 704838 - DNA, 14 bp, C. elegans
attcaaatgttttt

SEQ ID NO: 704839 - DNA, 13 bp, C. elegans
attcaaattattc

SEQ ID NO: 704840 - DNA, 13 bp, C. elegans
attcaaattcaaa

SEQ ID NO: 704841 - DNA, 13 bp, C. elegans
attcaaattccaa

SEQ ID NO: 704842 - DNA, 13 bp, C. elegans
attcaaattctgt

SEQ ID NO: 704843 - DNA, 13 bp, C. elegans
attcaaattcttc

SEQ ID NO: 704844 - DNA, 13 bp, C. elegans
attcaaattgaaa

SEQ ID NO: 704845 - DNA, 13 bp, C. elegans
attcaaattgaga

SEQ ID NO: 704846 - DNA, 13 bp, C. elegans
attcaaatttcta

SEQ ID NO: 704847 - DNA, 13 bp, C. elegans
attcaaatttctc

SEQ ID NO: 704848 - DNA, 13 bp, C. elegans
attcaaatttctg

SEQ ID NO: 704849 - DNA, 13 bp, C. elegans
attcaaatttctt

SEQ ID NO: 704850 - DNA, 13 bp, C. elegans
attcaaatttgaa

SEQ ID NO: 704851 - DNA, 13 bp, C. elegans
attcaaatttgca

SEQ ID NO: 704852 - DNA, 13 bp, C. elegans
attcaaatttgtt

SEQ ID NO: 704853 - DNA, 14 bp, C. elegans
attcaaattttcaa

SEQ ID NO: 704854 - DNA, 14 bp, C. elegans
attcaaattttcca

SEQ ID NO: 704855 - DNA, 13 bp, C. elegans
attcaaattttgc

SEQ ID NO: 704856 - DNA, 13 bp, C. elegans
attcaaatttttc

SEQ ID NO: 704857 - DNA, 13 bp, C. elegans
attcaacaaattc

SEQ ID NO: 704858 - DNA, 13 bp, C. elegans
attcaacaacttt

SEQ ID NO: 704859 - DNA, 13 bp, C. elegans
attcaacaatttt

SEQ ID NO: 704860 - DNA, 13 bp, C. elegans
attcaacatttaa

SEQ ID NO: 704861 - DNA, 13 bp, C. elegans
attcaacatttat

SEQ ID NO: 704862 - DNA, 13 bp, C. elegans
attcaacattttg

SEQ ID NO: 704863 - DNA, 13 bp, C. elegans
attcaaccatttt

SEQ ID NO: 704864 - DNA, 13 bp, C. elegans
attcaacgaaaaa

SEQ ID NO: 704865 - DNA, 13 bp, C. elegans
attcaacgatttt

SEQ ID NO: 704866 - DNA, 13 bp, C. elegans
attcaactaacat

SEQ ID NO: 704867 - DNA, 13 bp, C. elegans
attcaactcaaaa

SEQ ID NO: 704868 - DNA, 13 bp, C. elegans
attcaactgtttc

SEQ ID NO: 704869 - DNA, 13 bp, C. elegans
attcaacttacaa

SEQ ID NO: 704870 - DNA, 13 bp, C. elegans
attcaactttaaa

SEQ ID NO: 704871 - DNA, 13 bp, C. elegans
attcaactttcat

SEQ ID NO: 704872 - DNA, 13 bp, C. elegans
attcaacttttcc

SEQ ID NO: 704873 - DNA, 13 bp, C. elegans
attcaagaaaaag

SEQ ID NO: 704874 - DNA, 13 bp, C. elegans
attcaagaaaagt

SEQ ID NO: 704875 - DNA, 13 bp, C. elegans
attcaagaaaatc

SEQ ID NO: 704876 - DNA, 13 bp, C. elegans
attcaagaaaatg

SEQ ID NO: 704877 - DNA, 13 bp, C. elegans
attcaagaaataa

SEQ ID NO: 704878 - DNA, 13 bp, C. elegans
attcaagaaatca

SEQ ID NO: 704879 - DNA, 13 bp, C. elegans
attcaagaacaaa

SEQ ID NO: 704880 - DNA, 13 bp, C. elegans
attcaagaacttt

SEQ ID NO: 704881 - DNA, 13 bp, C. elegans
attcaagaattca

SEQ ID NO: 704882 - DNA, 13 bp, C. elegans
attcaagacttca

SEQ ID NO: 704883 - DNA, 13 bp, C. elegans
attcaagattttt

SEQ ID NO: 704884 - DNA, 13 bp, C. elegans
attcaaggttttt

SEQ ID NO: 704885 - DNA, 13 bp, C. elegans
attcaagtcaaat

SEQ ID NO: 704886 - DNA, 13 bp, C. elegans
attcaagttattt

SEQ ID NO: 704887 - DNA, 13 bp, C. elegans
attcaagttcaaa

SEQ ID NO: 704888 - DNA, 13 bp, C. elegans
attcaagtttcaa

SEQ ID NO: 704889 - DNA, 13 bp, C. elegans
attcaagtttcta

SEQ ID NO: 704890 - DNA, 13 bp, C. elegans
attcaagttttca

SEQ ID NO: 704891 - DNA, 13 bp, C. elegans
attcaagttttcc

SEQ ID NO: 704892 - DNA, 13 bp, C. elegans
attcaagttttgc

SEQ ID NO: 704893 - DNA, 13 bp, C. elegans
attcaagtttttt

SEQ ID NO: 704894 - DNA, 13 bp, C. elegans
attcaataaaact

SEQ ID NO: 704895 - DNA, 13 bp, C. elegans
attcaataaagtt

SEQ ID NO: 704896 - DNA, 13 bp, C. elegans
attcaataaatga

SEQ ID NO: 704897 - DNA, 13 bp, C. elegans
attcaataattca

SEQ ID NO: 704898 - DNA, 13 bp, C. elegans
attcaatagaaaa

SEQ ID NO: 704899 - DNA, 13 bp, C. elegans
attcaatagtttt

SEQ ID NO: 704900 - DNA, 13 bp, C. elegans
attcaatatgaac

SEQ ID NO: 704901 - DNA, 13 bp, C. elegans
attcaatattcca

SEQ ID NO: 704902 - DNA, 13 bp, C. elegans
attcaatatttca

SEQ ID NO: 704903 - DNA, 13 bp, C. elegans
attcaatatttct

SEQ ID NO: 704904 - DNA, 13 bp, C. elegans
attcaatattttc

SEQ ID NO: 704905 - DNA, 13 bp, C. elegans
attcaatattttg

SEQ ID NO: 704906 - DNA, 13 bp, C. elegans
attcaatcaaaat

SEQ ID NO: 704907 - DNA, 13 bp, C. elegans
attcaatcaataa

SEQ ID NO: 704908 - DNA, 13 bp, C. elegans
attcaatgaaagt

SEQ ID NO: 704909 - DNA, 13 bp, C. elegans
attcaatgaagaa

SEQ ID NO: 704910 - DNA, 13 bp, C. elegans
attcaatgagaaa

SEQ ID NO: 704911 - DNA, 13 bp, C. elegans
attcaatgaggaa

SEQ ID NO: 704912 - DNA, 13 bp, C. elegans
attcaatgataaa

SEQ ID NO: 704913 - DNA, 13 bp, C. elegans
attcaatgcaaaa

SEQ ID NO: 704914 - DNA, 13 bp, C. elegans
attcaatgtttat

SEQ ID NO: 704915 - DNA, 13 bp, C. elegans
attcaattaaaac

SEQ ID NO: 704916 - DNA, 13 bp, C. elegans
attcaattattca

SEQ ID NO: 704917 - DNA, 13 bp, C. elegans
attcaattcattt

SEQ ID NO: 704918 - DNA, 13 bp, C. elegans
attcaattccatt

SEQ ID NO: 704919 - DNA, 13 bp, C. elegans
attcaattctgaa

SEQ ID NO: 704920 - DNA, 13 bp, C. elegans
attcaattcttca

SEQ ID NO: 704921 - DNA, 13 bp, C. elegans
attcaattcttta

SEQ ID NO: 704922 - DNA, 13 bp, C. elegans
attcaattgaaca

SEQ ID NO: 704923 - DNA, 13 bp, C. elegans
attcaattgaata

SEQ ID NO: 704924 - DNA, 13 bp, C. elegans
attcaattgcaaa

SEQ ID NO: 704925 - DNA, 13 bp, C. elegans
attcaattgtatt

SEQ ID NO: 704926 - DNA, 13 bp, C. elegans
attcaattgttta

SEQ ID NO: 704927 - DNA, 13 bp, C. elegans
attcaattgtttc

SEQ ID NO: 704928 - DNA, 13 bp, C. elegans
attcaattgtttt

SEQ ID NO: 704929 - DNA, 13 bp, C. elegans
attcaatttcaaa

SEQ ID NO: 704930 - DNA, 13 bp, C. elegans
attcaatttcaac

SEQ ID NO: 704931 - DNA, 13 bp, C. elegans
attcaatttccaa

SEQ ID NO: 704932 - DNA, 13 bp, C. elegans
attcaatttccat

SEQ ID NO: 704933 - DNA, 13 bp, C. elegans
attcaatttcctg

SEQ ID NO: 704934 - DNA, 13 bp, C. elegans
attcaatttgaac

SEQ ID NO: 704935 - DNA, 13 bp, C. elegans
attcaatttgttt

SEQ ID NO: 704936 - DNA, 13 bp, C. elegans
attcaattttaca

SEQ ID NO: 704937 - DNA, 13 bp, C. elegans
attcaattttacc

SEQ ID NO: 704938 - DNA, 13 bp, C. elegans
attcaattttatc

SEQ ID NO: 704939 - DNA, 13 bp, C. elegans
attcaattttatg

SEQ ID NO: 704940 - DNA, 13 bp, C. elegans
attcaattttcag

SEQ ID NO: 704941 - DNA, 13 bp, C. elegans
attcaattttcat

SEQ ID NO: 704942 - DNA, 13 bp, C. elegans
attcaattttccc

SEQ ID NO: 704943 - DNA, 13 bp, C. elegans
attcaattttcta

SEQ ID NO: 704944 - DNA, 13 bp, C. elegans
attcaattttctc

SEQ ID NO: 704945 - DNA, 13 bp, C. elegans
attcaattttgct

SEQ ID NO: 704946 - DNA, 13 bp, C. elegans
attcaattttgta

SEQ ID NO: 704947 - DNA, 13 bp, C. elegans
attcaattttgtt

SEQ ID NO: 704948 - DNA, 13 bp, C. elegans
attcaatttttac

SEQ ID NO: 704949 - DNA, 13 bp, C. elegans
attcaatttttca

SEQ ID NO: 704950 - DNA, 13 bp, C. elegans
attcaatttttgg

SEQ ID NO: 704951 - DNA, 13 bp, C. elegans
attcaatttttgt

SEQ ID NO: 704952 - DNA, 14 bp, C. elegans
attcacaaaaattt

SEQ ID NO: 704953 - DNA, 13 bp, C. elegans
attcacaaaatct

SEQ ID NO: 704954 - DNA, 13 bp, C. elegans
attcacaaagttt

SEQ ID NO: 704955 - DNA, 13 bp, C. elegans
attcacaaatttg

SEQ ID NO: 704956 - DNA, 13 bp, C. elegans
attcacaaatttt

SEQ ID NO: 704957 - DNA, 13 bp, C. elegans
attcacaatttct

SEQ ID NO: 704958 - DNA, 13 bp, C. elegans
attcacaattttg

SEQ ID NO: 704959 - DNA, 13 bp, C. elegans
attcacaattttt

SEQ ID NO: 704960 - DNA, 13 bp, C. elegans
attcacacaattt

SEQ ID NO: 704961 - DNA, 13 bp, C. elegans
attcacacacaca

SEQ ID NO: 704962 - DNA, 13 bp, C. elegans
attcacacatttt

SEQ ID NO: 704963 - DNA, 13 bp, C. elegans
attcacacttttt

SEQ ID NO: 704964 - DNA, 13 bp, C. elegans
attcacagttttc

SEQ ID NO: 704965 - DNA, 13 bp, C. elegans
attcacatatttt

SEQ ID NO: 704966 - DNA, 13 bp, C. elegans
attcacattattt

SEQ ID NO: 704967 - DNA, 13 bp, C. elegans
attcacatttcag

SEQ ID NO: 704968 - DNA, 13 bp, C. elegans
attcacattttaa

SEQ ID NO: 704969 - DNA, 13 bp, C. elegans
attcacattttcg

SEQ ID NO: 704970 - DNA, 13 bp, C. elegans
attcaccaaaaat

SEQ ID NO: 704971 - DNA, 13 bp, C. elegans
attcacccaaaac

SEQ ID NO: 704972 - DNA, 13 bp, C. elegans
attcacctaattt

SEQ ID NO: 704973 - DNA, 13 bp, C. elegans
attcacgaaaatt

SEQ ID NO: 704974 - DNA, 13 bp, C. elegans
attcacgattttc

SEQ ID NO: 704975 - DNA, 13 bp, C. elegans
attcacggaaaat

SEQ ID NO: 704976 - DNA, 13 bp, C. elegans
attcactatttct

SEQ ID NO: 704977 - DNA, 13 bp, C. elegans
attcactcaaatt

SEQ ID NO: 704978 - DNA, 13 bp, C. elegans
attcactgaaaat

SEQ ID NO: 704979 - DNA, 13 bp, C. elegans
attcactgaaatt

SEQ ID NO: 704980 - DNA, 13 bp, C. elegans
attcactgtcaaa

SEQ ID NO: 704981 - DNA, 13 bp, C. elegans
attcacttatgat

SEQ ID NO: 704982 - DNA, 13 bp, C. elegans
attcactttcaaa

SEQ ID NO: 704983 - DNA, 13 bp, C. elegans
attcactttgaaa

SEQ ID NO: 704984 - DNA, 13 bp, C. elegans
attcacttttaat

SEQ ID NO: 704985 - DNA, 13 bp, C. elegans
attcacttttgaa

SEQ ID NO: 704986 - DNA, 13 bp, C. elegans
attcacttttttg

SEQ ID NO: 704987 - DNA, 13 bp, C. elegans
attcagaaaatat

SEQ ID NO: 704988 - DNA, 13 bp, C. elegans
attcagaaaatga

SEQ ID NO: 704989 - DNA, 13 bp, C. elegans
attcagaaatatt

SEQ ID NO: 704990 - DNA, 13 bp, C. elegans
attcagaaatttc

SEQ ID NO: 704991 - DNA, 13 bp, C. elegans
attcagaagaaat

SEQ ID NO: 704992 - DNA, 13 bp, C. elegans
attcagaatataa

SEQ ID NO: 704993 - DNA, 13 bp, C. elegans
attcagaattcaa

SEQ ID NO: 704994 - DNA, 13 bp, C. elegans
attcagaatttca

SEQ ID NO: 704995 - DNA, 13 bp, C. elegans
attcagaattttc

SEQ ID NO: 704996 - DNA, 13 bp, C. elegans
attcagaattttg

SEQ ID NO: 704997 - DNA, 13 bp, C. elegans
attcagagaaaag

SEQ ID NO: 704998 - DNA, 13 bp, C. elegans
attcagagatttt

SEQ ID NO: 704999 - DNA, 13 bp, C. elegans
attcagagcaaaa

SEQ ID NO: 705000 - DNA, 13 bp, C. elegans
attcagatgaaat

SEQ ID NO: 705001 - DNA, 13 bp, C. elegans
attcagattttgc

SEQ ID NO: 705002 - DNA, 13 bp, C. elegans
attcagcaaaaat

SEQ ID NO: 705003 - DNA, 13 bp, C. elegans
attcagcaagttt

SEQ ID NO: 705004 - DNA, 13 bp, C. elegans
attcagcaatgga

SEQ ID NO: 705005 - DNA, 13 bp, C. elegans
attcaggaaactt

SEQ ID NO: 705006 - DNA, 13 bp, C. elegans
attcagtattcaa

SEQ ID NO: 705007 - DNA, 14 bp, C. elegans
attcagtcattttg

SEQ ID NO: 705008 - DNA, 13 bp, C. elegans
attcagtctcaaa

SEQ ID NO: 705009 - DNA, 13 bp, C. elegans
attcagtgcaaaa

SEQ ID NO: 705010 - DNA, 48 bp, C. elegans
attcagttgagctcgttatgtcggttgaagacacaattggagtggtgc

SEQ ID NO: 705011 - DNA, 13 bp, C. elegans
attcagttgattt

SEQ ID NO: 705012 - DNA, 13 bp, C. elegans
attcagttttcaa

SEQ ID NO: 705013 - DNA, 13 bp, C. elegans
attcagttttgtt

SEQ ID NO: 705014 - DNA, 13 bp, C. elegans
attcataaaagaa

SEQ ID NO: 705015 - DNA, 13 bp, C. elegans
attcataaatttg

SEQ ID NO: 705016 - DNA, 13 bp, C. elegans
attcataactttt

SEQ ID NO: 705017 - DNA, 13 bp, C. elegans
attcatatcattt

SEQ ID NO: 705018 - DNA, 13 bp, C. elegans
attcatattcaaa

SEQ ID NO: 705019 - DNA, 13 bp, C. elegans
attcatattctca

SEQ ID NO: 705020 - DNA, 13 bp, C. elegans
attcatcaaaaag

SEQ ID NO: 705021 - DNA, 13 bp, C. elegans
attcatcaaaatc

SEQ ID NO: 705022 - DNA, 13 bp, C. elegans
attcatcaactgg

SEQ ID NO: 705023 - DNA, 13 bp, C. elegans
attcatcaatttt

SEQ ID NO: 705024 - DNA, 13 bp, C. elegans
attcatcacattt

SEQ ID NO: 705025 - DNA, 13 bp, C. elegans
attcatcaccaaa

SEQ ID NO: 705026 - DNA, 13 bp, C. elegans
attcatcactttt

SEQ ID NO: 705027 - DNA, 13 bp, C. elegans
attcatcattttc

SEQ ID NO: 705028 - DNA, 13 bp, C. elegans
attcatcgaaaat

SEQ ID NO: 705029 - DNA, 13 bp, C. elegans
attcatcgatttt

SEQ ID NO: 705030 - DNA, 13 bp, C. elegans
attcatctcaaaa

SEQ ID NO: 705031 - DNA, 13 bp, C. elegans
attcatctttaaa

SEQ ID NO: 705032 - DNA, 13 bp, C. elegans
attcatgaaaatt

SEQ ID NO: 705033 - DNA, 13 bp, C. elegans
attcatgatattt

SEQ ID NO: 705034 - DNA, 13 bp, C. elegans
attcatggaaaat

SEQ ID NO: 705035 - DNA, 13 bp, C. elegans
attcatgtgatga

SEQ ID NO: 705036 - DNA, 13 bp, C. elegans
attcatgtgtgta

SEQ ID NO: 705037 - DNA, 13 bp, C. elegans
attcatgttatca

SEQ ID NO: 705038 - DNA, 13 bp, C. elegans
attcatgtttttg

SEQ ID NO: 705039 - DNA, 13 bp, C. elegans
attcattagaaaa

SEQ ID NO: 705040 - DNA, 13 bp, C. elegans
attcattatcaaa

SEQ ID NO: 705041 - DNA, 13 bp, C. elegans
attcattatttgt

SEQ ID NO: 705042 - DNA, 13 bp, C. elegans
attcattcaaaaa

SEQ ID NO: 705043 - DNA, 13 bp, C. elegans
attcattcaacat

SEQ ID NO: 705044 - DNA, 13 bp, C. elegans
attcattcacaaa

SEQ ID NO: 705045 - DNA, 13 bp, C. elegans
attcattcataaa

SEQ ID NO: 705046 - DNA, 13 bp, C. elegans
attcattcatatt

SEQ ID NO: 705047 - DNA, 13 bp, C. elegans
attcattccattt

SEQ ID NO: 705048 - DNA, 13 bp, C. elegans
attcattgaaaat

SEQ ID NO: 705049 - DNA, 13 bp, C. elegans
attcattgcaaaa

SEQ ID NO: 705050 - DNA, 13 bp, C. elegans
attcattgtttta

SEQ ID NO: 705051 - DNA, 13 bp, C. elegans
attcatttagttt

SEQ ID NO: 705052 - DNA, 13 bp, C. elegans
attcatttattga

SEQ ID NO: 705053 - DNA, 13 bp, C. elegans
attcatttatttg

SEQ ID NO: 705054 - DNA, 13 bp, C. elegans
attcatttcaaaa

SEQ ID NO: 705055 - DNA, 13 bp, C. elegans
attcatttcaatt

SEQ ID NO: 705056 - DNA, 13 bp, C. elegans
attcatttctaaa

SEQ ID NO: 705057 - DNA, 13 bp, C. elegans
attcatttgcgcg

SEQ ID NO: 705058 - DNA, 13 bp, C. elegans
attcatttggtta

SEQ ID NO: 705059 - DNA, 13 bp, C. elegans
attcattttatga

SEQ ID NO: 705060 - DNA, 14 bp, C. elegans
attcattttctgta

SEQ ID NO: 705061 - DNA, 13 bp, C. elegans
attcatttttaca

SEQ ID NO: 705062 - DNA, 14 bp, C. elegans
attcatttttcaaa

SEQ ID NO: 705063 - DNA, 13 bp, C. elegans
attcatttttcca

SEQ ID NO: 705064 - DNA, 13 bp, C. elegans
attcatttttccc

SEQ ID NO: 705065 - DNA, 13 bp, C. elegans
attcatttttgat

SEQ ID NO: 705066 - DNA, 13 bp, C. elegans
attcatttttgtc

SEQ ID NO: 705067 - DNA, 13 bp, C. elegans
attcattttttga

SEQ ID NO: 705068 - DNA, 13 bp, C. elegans
attccaaaaaagt

SEQ ID NO: 705069 - DNA, 13 bp, C. elegans
attccaaaaaatg

SEQ ID NO: 705070 - DNA, 13 bp, C. elegans
attccaaaaagaa

SEQ ID NO: 705071 - DNA, 13 bp, C. elegans
attccaaaaatat

SEQ ID NO: 705072 - DNA, 14 bp, C. elegans
attccaaaaattct

SEQ ID NO: 705073 - DNA, 13 bp, C. elegans
attccaaaacatc

SEQ ID NO: 705074 - DNA, 13 bp, C. elegans
attccaaaactat

SEQ ID NO: 705075 - DNA, 13 bp, C. elegans
attccaaaactta

SEQ ID NO: 705076 - DNA, 13 bp, C. elegans
attccaaaagtat

SEQ ID NO: 705077 - DNA, 13 bp, C. elegans
attccaaaagttc

SEQ ID NO: 705078 - DNA, 13 bp, C. elegans
attccaaaagttt

SEQ ID NO: 705079 - DNA, 13 bp, C. elegans
attccaaaataat

SEQ ID NO: 705080 - DNA, 13 bp, C. elegans
attccaaaatcaa

SEQ ID NO: 705081 - DNA, 13 bp, C. elegans
attccaaaatgaa

SEQ ID NO: 705082 - DNA, 13 bp, C. elegans
attccaaaattgt

SEQ ID NO: 705083 - DNA, 13 bp, C. elegans
attccaaacaaat

SEQ ID NO: 705084 - DNA, 13 bp, C. elegans
attccaaacattt

SEQ ID NO: 705085 - DNA, 13 bp, C. elegans
attccaaataaac

SEQ ID NO: 705086 - DNA, 13 bp, C. elegans
attccaaatattt

SEQ ID NO: 705087 - DNA, 13 bp, C. elegans
attccaaattcaa

SEQ ID NO: 705088 - DNA, 13 bp, C. elegans
attccaaattcta

SEQ ID NO: 705089 - DNA, 13 bp, C. elegans
attccaaattctt

SEQ ID NO: 705090 - DNA, 13 bp, C. elegans
attccaaatttca

SEQ ID NO: 705091 - DNA, 13 bp, C. elegans
attccaacaattt

SEQ ID NO: 705092 - DNA, 13 bp, C. elegans
attccaacatttt

SEQ ID NO: 705093 - DNA, 13 bp, C. elegans
attccaactttca

SEQ ID NO: 705094 - DNA, 13 bp, C. elegans
attccaagatttt

SEQ ID NO: 705095 - DNA, 13 bp, C. elegans
attccaagttttg

SEQ ID NO: 705096 - DNA, 13 bp, C. elegans
attccaataattt

SEQ ID NO: 705097 - DNA, 13 bp, C. elegans
attccaatatatt

SEQ ID NO: 705098 - DNA, 13 bp, C. elegans
attccaatcattt

SEQ ID NO: 705099 - DNA, 13 bp, C. elegans
attccaattattt

SEQ ID NO: 705100 - DNA, 13 bp, C. elegans
attccaattccaa

SEQ ID NO: 705101 - DNA, 13 bp, C. elegans
attccaattgttt

SEQ ID NO: 705102 - DNA, 13 bp, C. elegans
attccaatttatt

SEQ ID NO: 705103 - DNA, 13 bp, C. elegans
attccaatttcca

SEQ ID NO: 705104 - DNA, 13 bp, C. elegans
attccaattttat

SEQ ID NO: 705105 - DNA, 13 bp, C. elegans
attccaattttcc

SEQ ID NO: 705106 - DNA, 13 bp, C. elegans
attccaattttcg

SEQ ID NO: 705107 - DNA, 13 bp, C. elegans
attccaattttga

SEQ ID NO: 705108 - DNA, 13 bp, C. elegans
attccaatttttg

SEQ ID NO: 705109 - DNA, 13 bp, C. elegans
attccacaaaaat

SEQ ID NO: 705110 - DNA, 13 bp, C. elegans
attccacaaaact

SEQ ID NO: 705111 - DNA, 13 bp, C. elegans
attccacaaaatt

SEQ ID NO: 705112 - DNA, 13 bp, C. elegans
attccacagagtt

SEQ ID NO: 705113 - DNA, 13 bp, C. elegans
attccacagcaac

SEQ ID NO: 705114 - DNA, 13 bp, C. elegans
attccaccaaaaa

SEQ ID NO: 705115 - DNA, 13 bp, C. elegans
attccacttttaa

SEQ ID NO: 705116 - DNA, 13 bp, C. elegans
attccagaaaaaa

SEQ ID NO: 705117 - DNA, 13 bp, C. elegans
attccagaaaaca

SEQ ID NO: 705118 - DNA, 13 bp, C. elegans
attccagaaaact

SEQ ID NO: 705119 - DNA, 13 bp, C. elegans
attccagaaagtt

SEQ ID NO: 705120 - DNA, 13 bp, C. elegans
attccagaaattg

SEQ ID NO: 705121 - DNA, 13 bp, C. elegans
attccagaaggtt

SEQ ID NO: 705122 - DNA, 13 bp, C. elegans
attccagaagttt

SEQ ID NO: 705123 - DNA, 13 bp, C. elegans
attccagaatttt

SEQ ID NO: 705124 - DNA, 13 bp, C. elegans
attccagacattt

SEQ ID NO: 705125 - DNA, 13 bp, C. elegans
attccagatttca

SEQ ID NO: 705126 - DNA, 13 bp, C. elegans
attccagcagttt

SEQ ID NO: 705127 - DNA, 13 bp, C. elegans
attccagtgaaaa

SEQ ID NO: 705128 - DNA, 13 bp, C. elegans
attccagttaatt

SEQ ID NO: 705129 - DNA, 13 bp, C. elegans
attccagttttaa

SEQ ID NO: 705130 - DNA, 13 bp, C. elegans
attccagtttttc

SEQ ID NO: 705131 - DNA, 13 bp, C. elegans
attccagtttttt

SEQ ID NO: 705132 - DNA, 13 bp, C. elegans
attccatcaatta

SEQ ID NO: 705133 - DNA, 13 bp, C. elegans
attccatgaaatt

SEQ ID NO: 705134 - DNA, 13 bp, C. elegans
attccattaattt

SEQ ID NO: 705135 - DNA, 13 bp, C. elegans
attccatttcaaa

SEQ ID NO: 705136 - DNA, 13 bp, C. elegans
attccattttcct

SEQ ID NO: 705137 - DNA, 13 bp, C. elegans
attccatttttaa

SEQ ID NO: 705138 - DNA, 13 bp, C. elegans
attccatttttca

SEQ ID NO: 705139 - DNA, 13 bp, C. elegans
attcccaaaaact

SEQ ID NO: 705140 - DNA, 13 bp, C. elegans
attcccaaaaatt

SEQ ID NO: 705141 - DNA, 13 bp, C. elegans
attcccaaagttt

SEQ ID NO: 705142 - DNA, 13 bp, C. elegans
attcccaaatcac

SEQ ID NO: 705143 - DNA, 13 bp, C. elegans
attcccaacaaaa

SEQ ID NO: 705144 - DNA, 13 bp, C. elegans
attcccaatttta

SEQ ID NO: 705145 - DNA, 13 bp, C. elegans
attcccacaattt

SEQ ID NO: 705146 - DNA, 13 bp, C. elegans
attcccataattt

SEQ ID NO: 705147 - DNA, 13 bp, C. elegans
attcccatatttc

SEQ ID NO: 705148 - DNA, 13 bp, C. elegans
attcccattttca

SEQ ID NO: 705149 - DNA, 13 bp, C. elegans
attcccattttcc

SEQ ID NO: 705150 - DNA, 13 bp, C. elegans
attcccccaattt

SEQ ID NO: 705151 - DNA, 13 bp, C. elegans
attccccggtatt

SEQ ID NO: 705152 - DNA, 13 bp, C. elegans
attcccgaagaca

SEQ ID NO: 705153 - DNA, 13 bp, C. elegans
attcccgaatttt

SEQ ID NO: 705154 - DNA, 13 bp, C. elegans
attcccgatttgc

SEQ ID NO: 705155 - DNA, 13 bp, C. elegans
attcccgcgcaaa

SEQ ID NO: 705156 - DNA, 13 bp, C. elegans
attcccgcttttt

SEQ ID NO: 705157 - DNA, 13 bp, C. elegans
attccctcaaatt

SEQ ID NO: 705158 - DNA, 13 bp, C. elegans
attccctcaattt

SEQ ID NO: 705159 - DNA, 13 bp, C. elegans
attccgaaaaaaa

SEQ ID NO: 705160 - DNA, 13 bp, C. elegans
attccgaaaaagt

SEQ ID NO: 705161 - DNA, 13 bp, C. elegans
attccgaaaataa

SEQ ID NO: 705162 - DNA, 13 bp, C. elegans
attccgaaaattt

SEQ ID NO: 705163 - DNA, 13 bp, C. elegans
attccgaattttc

SEQ ID NO: 705164 - DNA, 13 bp, C. elegans
attccgaattttg

SEQ ID NO: 705165 - DNA, 13 bp, C. elegans
attccgacaactt

SEQ ID NO: 705166 - DNA, 13 bp, C. elegans
attccgagaatgc

SEQ ID NO: 705167 - DNA, 13 bp, C. elegans
attccgagaattt

SEQ ID NO: 705168 - DNA, 13 bp, C. elegans
attccgattttct

SEQ ID NO: 705169 - DNA, 13 bp, C. elegans
attccggaaatgt

SEQ ID NO: 705170 - DNA, 13 bp, C. elegans
attccggcaattc

SEQ ID NO: 705171 - DNA, 13 bp, C. elegans
attccggcacttt

SEQ ID NO: 705172 - DNA, 13 bp, C. elegans
attccggtatttt

SEQ ID NO: 705173 - DNA, 13 bp, C. elegans
attccgtcaattt

SEQ ID NO: 705174 - DNA, 13 bp, C. elegans
attccgtcgtttt

SEQ ID NO: 705175 - DNA, 13 bp, C. elegans
attccgtgaaaaa

SEQ ID NO: 705176 - DNA, 43 bp, C. elegans
attccgtgattattttcactcgggaatcgctcgcccactatgg

SEQ ID NO: 705177 - DNA, 13 bp, C. elegans
attccgtttgttc

SEQ ID NO: 705178 - DNA, 13 bp, C. elegans
attccgttttttg

SEQ ID NO: 705179 - DNA, 13 bp, C. elegans
attcctaaaaatc

SEQ ID NO: 705180 - DNA, 13 bp, C. elegans
attcctaaatttc

SEQ ID NO: 705181 - DNA, 13 bp, C. elegans
attcctaccgtac

SEQ ID NO: 705182 - DNA, 13 bp, C. elegans
attcctatctcat

SEQ ID NO: 705183 - DNA, 13 bp, C. elegans
attcctcaaattt

SEQ ID NO: 705184 - DNA, 13 bp, C. elegans
attcctcaatttc

SEQ ID NO: 705185 - DNA, 13 bp, C. elegans
attcctcaatttt

SEQ ID NO: 705186 - DNA, 13 bp, C. elegans
attcctcatcttc

SEQ ID NO: 705187 - DNA, 13 bp, C. elegans
attcctcgagaaa

SEQ ID NO: 705188 - DNA, 13 bp, C. elegans
attcctcgatttt

SEQ ID NO: 705189 - DNA, 13 bp, C. elegans
attcctgaaaact

SEQ ID NO: 705190 - DNA, 13 bp, C. elegans
attcctgaaattc

SEQ ID NO: 705191 - DNA, 13 bp, C. elegans
attcctgaatttt

SEQ ID NO: 705192 - DNA, 13 bp, C. elegans
attcctgataagc

SEQ ID NO: 705193 - DNA, 13 bp, C. elegans
attcctgcaaaaa

SEQ ID NO: 705194 - DNA, 13 bp, C. elegans
attcctggaattt

SEQ ID NO: 705195 - DNA, 13 bp, C. elegans
attcctgtctcat

SEQ ID NO: 705196 - DNA, 13 bp, C. elegans
attccttaaaaat

SEQ ID NO: 705197 - DNA, 13 bp, C. elegans
attccttatcaat

SEQ ID NO: 705198 - DNA, 13 bp, C. elegans
attccttcaaaaa

SEQ ID NO: 705199 - DNA, 13 bp, C. elegans
attccttcaaaag

SEQ ID NO: 705200 - DNA, 13 bp, C. elegans
attccttccaaaa

SEQ ID NO: 705201 - DNA, 13 bp, C. elegans
attccttgaaatt

SEQ ID NO: 705202 - DNA, 13 bp, C. elegans
attccttgagaac

SEQ ID NO: 705203 - DNA, 13 bp, C. elegans
attcctttaaaat

SEQ ID NO: 705204 - DNA, 13 bp, C. elegans
attcctttaaatt

SEQ ID NO: 705205 - DNA, 13 bp, C. elegans
attcgaaaaaaat

SEQ ID NO: 705206 - DNA, 13 bp, C. elegans
attcgaaaaaatc

SEQ ID NO: 705207 - DNA, 13 bp, C. elegans
attcgaaaaacat

SEQ ID NO: 705208 - DNA, 13 bp, C. elegans
attcgaaaaactc

SEQ ID NO: 705209 - DNA, 13 bp, C. elegans
attcgaaaaatca

SEQ ID NO: 705210 - DNA, 13 bp, C. elegans
attcgaaaaattg

SEQ ID NO: 705211 - DNA, 13 bp, C. elegans
attcgaaaacgtt

SEQ ID NO: 705212 - DNA, 13 bp, C. elegans
attcgaaaagtgg

SEQ ID NO: 705213 - DNA, 13 bp, C. elegans
attcgaaaataaa

SEQ ID NO: 705214 - DNA, 13 bp, C. elegans
attcgaaaataat

SEQ ID NO: 705215 - DNA, 13 bp, C. elegans
attcgaaaatcta

SEQ ID NO: 705216 - DNA, 13 bp, C. elegans
attcgaaacaatt

SEQ ID NO: 705217 - DNA, 13 bp, C. elegans
attcgaaatatta

SEQ ID NO: 705218 - DNA, 13 bp, C. elegans
attcgaaatattc

SEQ ID NO: 705219 - DNA, 13 bp, C. elegans
attcgaaatattt

SEQ ID NO: 705220 - DNA, 13 bp, C. elegans
attcgaaattatc

SEQ ID NO: 705221 - DNA, 13 bp, C. elegans
attcgaaattgaa

SEQ ID NO: 705222 - DNA, 13 bp, C. elegans
attcgaaatttct

SEQ ID NO: 705223 - DNA, 13 bp, C. elegans
attcgaaattttt

SEQ ID NO: 705224 - DNA, 13 bp, C. elegans
attcgaacatttt

SEQ ID NO: 705225 - DNA, 13 bp, C. elegans
attcgaagaaaac

SEQ ID NO: 705226 - DNA, 13 bp, C. elegans
attcgaagaaaat

SEQ ID NO: 705227 - DNA, 13 bp, C. elegans
attcgaataattc

SEQ ID NO: 705228 - DNA, 13 bp, C. elegans
attcgaatatttt

SEQ ID NO: 705229 - DNA, 13 bp, C. elegans
attcgaattcaga

SEQ ID NO: 705230 - DNA, 13 bp, C. elegans
attcgaattccag

SEQ ID NO: 705231 - DNA, 13 bp, C. elegans
attcgaattctac

SEQ ID NO: 705232 - DNA, 13 bp, C. elegans
attcgaattctcc

SEQ ID NO: 705233 - DNA, 13 bp, C. elegans
attcgaattcttc

SEQ ID NO: 705234 - DNA, 13 bp, C. elegans
attcgaatttcgt

SEQ ID NO: 705235 - DNA, 13 bp, C. elegans
attcgaatttctg

SEQ ID NO: 705236 - DNA, 13 bp, C. elegans
attcgaatttgtt

SEQ ID NO: 705237 - DNA, 13 bp, C. elegans
attcgaattttaa

SEQ ID NO: 705238 - DNA, 13 bp, C. elegans
attcgaattttct

SEQ ID NO: 705239 - DNA, 13 bp, C. elegans
attcgaattttga

SEQ ID NO: 705240 - DNA, 13 bp, C. elegans
attcgaattttta

SEQ ID NO: 705241 - DNA, 13 bp, C. elegans
attcgaatttttt

SEQ ID NO: 705242 - DNA, 13 bp, C. elegans
attcgacaaaatt

SEQ ID NO: 705243 - DNA, 13 bp, C. elegans
attcgacaatttt

SEQ ID NO: 705244 - DNA, 13 bp, C. elegans
attcgagaaaagt

SEQ ID NO: 705245 - DNA, 13 bp, C. elegans
attcgagaaagtt

SEQ ID NO: 705246 - DNA, 13 bp, C. elegans
attcgagaaattc

SEQ ID NO: 705247 - DNA, 13 bp, C. elegans
attcgagcatgca

SEQ ID NO: 705248 - DNA, 13 bp, C. elegans
attcgagcttttt

SEQ ID NO: 705249 - DNA, 13 bp, C. elegans
attcgaggaaaaa

SEQ ID NO: 705250 - DNA, 13 bp, C. elegans
attcgagtttttt

SEQ ID NO: 705251 - DNA, 13 bp, C. elegans
attcgatagaaaa

SEQ ID NO: 705252 - DNA, 13 bp, C. elegans
attcgatattttc

SEQ ID NO: 705253 - DNA, 13 bp, C. elegans
attcgatcatttt

SEQ ID NO: 705254 - DNA, 13 bp, C. elegans
attcgattatttg

SEQ ID NO: 705255 - DNA, 13 bp, C. elegans
attcgattcagaa

SEQ ID NO: 705256 - DNA, 13 bp, C. elegans
attcgattgtttc

SEQ ID NO: 705257 - DNA, 13 bp, C. elegans
attcgatttgaaa

SEQ ID NO: 705258 - DNA, 13 bp, C. elegans
attcgattttccg

SEQ ID NO: 705259 - DNA, 13 bp, C. elegans
attcgattttcga

SEQ ID NO: 705260 - DNA, 13 bp, C. elegans
attcgattttctg

SEQ ID NO: 705261 - DNA, 13 bp, C. elegans
attcgattttgat

SEQ ID NO: 705262 - DNA, 13 bp, C. elegans
attcgatttttca

SEQ ID NO: 705263 - DNA, 13 bp, C. elegans
attcgatttttcc

SEQ ID NO: 705264 - DNA, 13 bp, C. elegans
attcgcaaaaaat

SEQ ID NO: 705265 - DNA, 14 bp, C. elegans
attcgcaagtaaac

SEQ ID NO: 705266 - DNA, 13 bp, C. elegans
attcgcaattttt

SEQ ID NO: 705267 - DNA, 13 bp, C. elegans
attcgccaatttt

SEQ ID NO: 705268 - DNA, 13 bp, C. elegans
attcgccgaattt

SEQ ID NO: 705269 - DNA, 13 bp, C. elegans
attcggaaaaaat

SEQ ID NO: 705270 - DNA, 13 bp, C. elegans
attcggaaaagaa

SEQ ID NO: 705271 - DNA, 13 bp, C. elegans
attcggaaaatct

SEQ ID NO: 705272 - DNA, 13 bp, C. elegans
attcggaaatatt

SEQ ID NO: 705273 - DNA, 13 bp, C. elegans
attcggaatcagc

SEQ ID NO: 705274 - DNA, 13 bp, C. elegans
attcggaattttc

SEQ ID NO: 705275 - DNA, 13 bp, C. elegans
attcggacaaaaa

SEQ ID NO: 705276 - DNA, 13 bp, C. elegans
attcggacaattt

SEQ ID NO: 705277 - DNA, 13 bp, C. elegans
attcggacatttt

SEQ ID NO: 705278 - DNA, 13 bp, C. elegans
attcggagaaaat

SEQ ID NO: 705279 - DNA, 13 bp, C. elegans
attcggatgggtc

SEQ ID NO: 705280 - DNA, 13 bp, C. elegans
attcggcaaaaac

SEQ ID NO: 705281 - DNA, 13 bp, C. elegans
attcggcaattcg

SEQ ID NO: 705282 - DNA, 13 bp, C. elegans
attcggccaccaa

SEQ ID NO: 705283 - DNA, 13 bp, C. elegans
attcggtaaatcg

SEQ ID NO: 705284 - DNA, 13 bp, C. elegans
attcggtcattga

SEQ ID NO: 705285 - DNA, 13 bp, C. elegans
attcggtgcaaaa

SEQ ID NO: 705286 - DNA, 13 bp, C. elegans
attcggtgttttc

SEQ ID NO: 705287 - DNA, 13 bp, C. elegans
attcggttattgt

SEQ ID NO: 705288 - DNA, 13 bp, C. elegans
attcgtcagtttt

SEQ ID NO: 705289 - DNA, 13 bp, C. elegans
attcgtcattttc

SEQ ID NO: 705290 - DNA, 13 bp, C. elegans
attcgtcattttt

SEQ ID NO: 705291 - DNA, 13 bp, C. elegans
attcgtctatttt

SEQ ID NO: 705292 - DNA, 13 bp, C. elegans
attcgtgaaaaat

SEQ ID NO: 705293 - DNA, 13 bp, C. elegans
attcgtggcgaga

SEQ ID NO: 705294 - DNA, 13 bp, C. elegans
attcgttaatttg

SEQ ID NO: 705295 - DNA, 13 bp, C. elegans
attcgtttatttg

SEQ ID NO: 705296 - DNA, 13 bp, C. elegans
attcgtttcaatt

SEQ ID NO: 705297 - DNA, 13 bp, C. elegans
attctaaacattt

SEQ ID NO: 705298 - DNA, 13 bp, C. elegans
attctaacaattt

SEQ ID NO: 705299 - DNA, 13 bp, C. elegans
attctaagaaaaa

SEQ ID NO: 705300 - DNA, 13 bp, C. elegans
attctaagaattc

SEQ ID NO: 705301 - DNA, 13 bp, C. elegans
attctaatagtaa

SEQ ID NO: 705302 - DNA, 13 bp, C. elegans
attctaatccaat

SEQ ID NO: 705303 - DNA, 13 bp, C. elegans
attctaatgattt

SEQ ID NO: 705304 - DNA, 13 bp, C. elegans
attctaatgcttt

SEQ ID NO: 705305 - DNA, 13 bp, C. elegans
attctaatgttct

SEQ ID NO: 705306 - DNA, 13 bp, C. elegans
attctaatttttg

SEQ ID NO: 705307 - DNA, 13 bp, C. elegans
attctacaaaatt

SEQ ID NO: 705308 - DNA, 13 bp, C. elegans
attctacaatatt

SEQ ID NO: 705309 - DNA, 13 bp, C. elegans
attctacactgaa

SEQ ID NO: 705310 - DNA, 13 bp, C. elegans
attctacactttt

SEQ ID NO: 705311 - DNA, 13 bp, C. elegans
attctaccaagtg

SEQ ID NO: 705312 - DNA, 13 bp, C. elegans
attctacgttttt

SEQ ID NO: 705313 - DNA, 13 bp, C. elegans
attctactaaaaa

SEQ ID NO: 705314 - DNA, 13 bp, C. elegans
attctactggctg

SEQ ID NO: 705315 - DNA, 13 bp, C. elegans
attctacttgaaa

SEQ ID NO: 705316 - DNA, 13 bp, C. elegans
attctacttttaa

SEQ ID NO: 705317 - DNA, 13 bp, C. elegans
attctacttttca

SEQ ID NO: 705318 - DNA, 13 bp, C. elegans
attctagagaaaa

SEQ ID NO: 705319 - DNA, 13 bp, C. elegans
attctagattttt

SEQ ID NO: 705320 - DNA, 13 bp, C. elegans
attctaggaattt

SEQ ID NO: 705321 - DNA, 13 bp, C. elegans
attctagtaattt

SEQ ID NO: 705322 - DNA, 13 bp, C. elegans
attctagtcattt

SEQ ID NO: 705323 - DNA, 13 bp, C. elegans
attctataacttt

SEQ ID NO: 705324 - DNA, 13 bp, C. elegans
attctatacattt

SEQ ID NO: 705325 - DNA, 13 bp, C. elegans
attctatcaaaat

SEQ ID NO: 705326 - DNA, 13 bp, C. elegans
attctatcaataa

SEQ ID NO: 705327 - DNA, 13 bp, C. elegans
attctatccaatt

SEQ ID NO: 705328 - DNA, 13 bp, C. elegans
attctatcgaaaa

SEQ ID NO: 705329 - DNA, 13 bp, C. elegans
attctatctgaaa

SEQ ID NO: 705330 - DNA, 13 bp, C. elegans
attctatgaaaaa

SEQ ID NO: 705331 - DNA, 13 bp, C. elegans
attctatgaaaac

SEQ ID NO: 705332 - DNA, 13 bp, C. elegans
attctatttcaaa

SEQ ID NO: 705333 - DNA, 13 bp, C. elegans
attctattttcaa

SEQ ID NO: 705334 - DNA, 13 bp, C. elegans
attctattttgaa

SEQ ID NO: 705335 - DNA, 13 bp, C. elegans
attctcaaaaaag

SEQ ID NO: 705336 - DNA, 13 bp, C. elegans
attctcaaaacaa

SEQ ID NO: 705337 - DNA, 13 bp, C. elegans
attctcaaaatct

SEQ ID NO: 705338 - DNA, 14 bp, C. elegans
attctcaaaatctt

SEQ ID NO: 705339 - DNA, 13 bp, C. elegans
attctcaaattca

SEQ ID NO: 705340 - DNA, 13 bp, C. elegans
attctcaaatttc

SEQ ID NO: 705341 - DNA, 13 bp, C. elegans
attctcaacaaaa

SEQ ID NO: 705342 - DNA, 13 bp, C. elegans
attctcaacattt

SEQ ID NO: 705343 - DNA, 13 bp, C. elegans
attctcaatgagg

SEQ ID NO: 705344 - DNA, 13 bp, C. elegans
attctcaattccg

SEQ ID NO: 705345 - DNA, 13 bp, C. elegans
attctcaattgtt

SEQ ID NO: 705346 - DNA, 13 bp, C. elegans
attctcaatttca

SEQ ID NO: 705347 - DNA, 13 bp, C. elegans
attctcacaaaat

SEQ ID NO: 705348 - DNA, 13 bp, C. elegans
attctcacaattt

SEQ ID NO: 705349 - DNA, 13 bp, C. elegans
attctcacagttt

SEQ ID NO: 705350 - DNA, 13 bp, C. elegans
attctcacatttt

SEQ ID NO: 705351 - DNA, 13 bp, C. elegans
attctcagaaagt

SEQ ID NO: 705352 - DNA, 13 bp, C. elegans
attctcagaatta

SEQ ID NO: 705353 - DNA, 13 bp, C. elegans
attctcagaattg

SEQ ID NO: 705354 - DNA, 13 bp, C. elegans
attctcaggctta

SEQ ID NO: 705355 - DNA, 13 bp, C. elegans
attctcagtttaa

SEQ ID NO: 705356 - DNA, 13 bp, C. elegans
attctcagttttt

SEQ ID NO: 705357 - DNA, 13 bp, C. elegans
attctcataaaat

SEQ ID NO: 705358 - DNA, 13 bp, C. elegans
attctcataaatt

SEQ ID NO: 705359 - DNA, 13 bp, C. elegans
attctcatcaaaa

SEQ ID NO: 705360 - DNA, 13 bp, C. elegans
attctcatcattt

SEQ ID NO: 705361 - DNA, 13 bp, C. elegans
attctcatgattt

SEQ ID NO: 705362 - DNA, 13 bp, C. elegans
attctcattcaat

SEQ ID NO: 705363 - DNA, 13 bp, C. elegans
attctcatttcca

SEQ ID NO: 705364 - DNA, 13 bp, C. elegans
attctcattttcc

SEQ ID NO: 705365 - DNA, 13 bp, C. elegans
attctcattttga

SEQ ID NO: 705366 - DNA, 13 bp, C. elegans
attctcatttttg

SEQ ID NO: 705367 - DNA, 13 bp, C. elegans
attctccaagttt

SEQ ID NO: 705368 - DNA, 13 bp, C. elegans
attctccaatttc

SEQ ID NO: 705369 - DNA, 13 bp, C. elegans
attctccagaaaa

SEQ ID NO: 705370 - DNA, 13 bp, C. elegans
attctccataatt

SEQ ID NO: 705371 - DNA, 13 bp, C. elegans
attctccatcttg

SEQ ID NO: 705372 - DNA, 13 bp, C. elegans
attctccgttttt

SEQ ID NO: 705373 - DNA, 13 bp, C. elegans
attctcctcattt

SEQ ID NO: 705374 - DNA, 13 bp, C. elegans
attctcgaaaaat

SEQ ID NO: 705375 - DNA, 13 bp, C. elegans
attctcgaaaatt

SEQ ID NO: 705376 - DNA, 13 bp, C. elegans
attctcgaagttt

SEQ ID NO: 705377 - DNA, 13 bp, C. elegans
attctcgagaaaa

SEQ ID NO: 705378 - DNA, 13 bp, C. elegans
attctcgattttc

SEQ ID NO: 705379 - DNA, 13 bp, C. elegans
attctcgcatttt

SEQ ID NO: 705380 - DNA, 13 bp, C. elegans
attctcgccaaaa

SEQ ID NO: 705381 - DNA, 13 bp, C. elegans
attctcggcaaat

SEQ ID NO: 705382 - DNA, 13 bp, C. elegans
attctcgtaattt

SEQ ID NO: 705383 - DNA, 13 bp, C. elegans
attctcgttttca

SEQ ID NO: 705384 - DNA, 13 bp, C. elegans
attctctaaaaat

SEQ ID NO: 705385 - DNA, 13 bp, C. elegans
attctctatcgaa

SEQ ID NO: 705386 - DNA, 13 bp, C. elegans
attctctccaaaa

SEQ ID NO: 705387 - DNA, 13 bp, C. elegans
attctctcgtttt

SEQ ID NO: 705388 - DNA, 13 bp, C. elegans
attctctgataaa

SEQ ID NO: 705389 - DNA, 13 bp, C. elegans
attctctggaaaa

SEQ ID NO: 705390 - DNA, 13 bp, C. elegans
attctcttcaatt

SEQ ID NO: 705391 - DNA, 13 bp, C. elegans
attctcttgaaaa

SEQ ID NO: 705392 - DNA, 13 bp, C. elegans
attctctttccta

SEQ ID NO: 705393 - DNA, 13 bp, C. elegans
attctgaaaaaaa

SEQ ID NO: 705394 - DNA, 13 bp, C. elegans
attctgaaaaata

SEQ ID NO: 705395 - DNA, 13 bp, C. elegans
attctgaaaaatc

SEQ ID NO: 705396 - DNA, 13 bp, C. elegans
attctgaaaaatt

SEQ ID NO: 705397 - DNA, 13 bp, C. elegans
attctgaaaactt

SEQ ID NO: 705398 - DNA, 13 bp, C. elegans
attctgaaaagtt

SEQ ID NO: 705399 - DNA, 13 bp, C. elegans
attctgaaaatat

SEQ ID NO: 705400 - DNA, 13 bp, C. elegans
attctgaaaatcg

SEQ ID NO: 705401 - DNA, 13 bp, C. elegans
attctgaaaatgg

SEQ ID NO: 705402 - DNA, 13 bp, C. elegans
attctgaaaattg

SEQ ID NO: 705403 - DNA, 13 bp, C. elegans
attctgaaacagt

SEQ ID NO: 705404 - DNA, 13 bp, C. elegans
attctgaaagagc

SEQ ID NO: 705405 - DNA, 13 bp, C. elegans
attctgaaagttt

SEQ ID NO: 705406 - DNA, 13 bp, C. elegans
attctgaaataat

SEQ ID NO: 705407 - DNA, 13 bp, C. elegans
attctgaaataga

SEQ ID NO: 705408 - DNA, 13 bp, C. elegans
attctgaaatatc

SEQ ID NO: 705409 - DNA, 13 bp, C. elegans
attctgaaatgtt

SEQ ID NO: 705410 - DNA, 13 bp, C. elegans
attctgaaattcc

SEQ ID NO: 705411 - DNA, 13 bp, C. elegans
attctgaaattcg

SEQ ID NO: 705412 - DNA, 13 bp, C. elegans
attctgaaatttc

SEQ ID NO: 705413 - DNA, 14 bp, C. elegans
attctgaaattttc

SEQ ID NO: 705414 - DNA, 13 bp, C. elegans
attctgaacattt

SEQ ID NO: 705415 - DNA, 13 bp, C. elegans
attctgaagaaaa

SEQ ID NO: 705416 - DNA, 13 bp, C. elegans
attctgaatttat

SEQ ID NO: 705417 - DNA, 13 bp, C. elegans
attctgaatttca

SEQ ID NO: 705418 - DNA, 13 bp, C. elegans
attctgaatttgt

SEQ ID NO: 705419 - DNA, 13 bp, C. elegans
attctgaattttc

SEQ ID NO: 705420 - DNA, 13 bp, C. elegans
attctgacgaaaa

SEQ ID NO: 705421 - DNA, 13 bp, C. elegans
attctgagttgaa

SEQ ID NO: 705422 - DNA, 13 bp, C. elegans
attctgataaaac

SEQ ID NO: 705423 - DNA, 13 bp, C. elegans
attctgataaatt

SEQ ID NO: 705424 - DNA, 13 bp, C. elegans
attctgatgattt

SEQ ID NO: 705425 - DNA, 13 bp, C. elegans
attctgattctga

SEQ ID NO: 705426 - DNA, 13 bp, C. elegans
attctgattgttt

SEQ ID NO: 705427 - DNA, 13 bp, C. elegans
attctgattttta

SEQ ID NO: 705428 - DNA, 13 bp, C. elegans
attctgatttttg

SEQ ID NO: 705429 - DNA, 13 bp, C. elegans
attctgcaaattg

SEQ ID NO: 705430 - DNA, 13 bp, C. elegans
attctgcaaattt

SEQ ID NO: 705431 - DNA, 13 bp, C. elegans
attctgcaagttt

SEQ ID NO: 705432 - DNA, 13 bp, C. elegans
attctgcaatttc

SEQ ID NO: 705433 - DNA, 13 bp, C. elegans
attctgcaatttt

SEQ ID NO: 705434 - DNA, 13 bp, C. elegans
attctgcagtttt

SEQ ID NO: 705435 - DNA, 13 bp, C. elegans
attctgcgaaaaa

SEQ ID NO: 705436 - DNA, 13 bp, C. elegans
attctggaaatat

SEQ ID NO: 705437 - DNA, 13 bp, C. elegans
attctggaaatct

SEQ ID NO: 705438 - DNA, 13 bp, C. elegans
attctggaaattg

SEQ ID NO: 705439 - DNA, 13 bp, C. elegans
attctggaacttt

SEQ ID NO: 705440 - DNA, 13 bp, C. elegans
attctggaattgt

SEQ ID NO: 705441 - DNA, 13 bp, C. elegans
attctggagaaaa

SEQ ID NO: 705442 - DNA, 13 bp, C. elegans
attctggattgtt

SEQ ID NO: 705443 - DNA, 13 bp, C. elegans
attctgtaaaaat

SEQ ID NO: 705444 - DNA, 13 bp, C. elegans
attctgtacctat

SEQ ID NO: 705445 - DNA, 13 bp, C. elegans
attctgtacctgc

SEQ ID NO: 705446 - DNA, 13 bp, C. elegans
attctgtattcct

SEQ ID NO: 705447 - DNA, 13 bp, C. elegans
attctgtcaattt

SEQ ID NO: 705448 - DNA, 13 bp, C. elegans
attctgtgaaaat

SEQ ID NO: 705449 - DNA, 13 bp, C. elegans
attctgtgaattt

SEQ ID NO: 705450 - DNA, 13 bp, C. elegans
attctgtgttttc

SEQ ID NO: 705451 - DNA, 13 bp, C. elegans
attctgttaaaaa

SEQ ID NO: 705452 - DNA, 13 bp, C. elegans
attctgttcaaaa

SEQ ID NO: 705453 - DNA, 13 bp, C. elegans
attctgttcaatt

SEQ ID NO: 705454 - DNA, 13 bp, C. elegans
attctgttgaaaa

SEQ ID NO: 705455 - DNA, 13 bp, C. elegans
attctgtttaatt

SEQ ID NO: 705456 - DNA, 13 bp, C. elegans
attcttaaaaatc

SEQ ID NO: 705457 - DNA, 13 bp, C. elegans
attcttaaaaatg

SEQ ID NO: 705458 - DNA, 13 bp, C. elegans
attcttaaaatgt

SEQ ID NO: 705459 - DNA, 13 bp, C. elegans
attcttaatttca

SEQ ID NO: 705460 - DNA, 13 bp, C. elegans
attcttatcaatt

SEQ ID NO: 705461 - DNA, 13 bp, C. elegans
attcttatttgaa

SEQ ID NO: 705462 - DNA, 13 bp, C. elegans
attcttcaaaaaa

SEQ ID NO: 705463 - DNA, 14 bp, C. elegans
attcttcaaaaaat

SEQ ID NO: 705464 - DNA, 13 bp, C. elegans
attcttcaaaagt

SEQ ID NO: 705465 - DNA, 13 bp, C. elegans
attcttcaaactt

SEQ ID NO: 705466 - DNA, 13 bp, C. elegans
attcttcaacttt

SEQ ID NO: 705467 - DNA, 13 bp, C. elegans
attcttcaagaaa

SEQ ID NO: 705468 - DNA, 13 bp, C. elegans
attcttcaataaa

SEQ ID NO: 705469 - DNA, 13 bp, C. elegans
attcttcaataat

SEQ ID NO: 705470 - DNA, 13 bp, C. elegans
attcttcacaaaa

SEQ ID NO: 705471 - DNA, 13 bp, C. elegans
attcttcatatgc

SEQ ID NO: 705472 - DNA, 13 bp, C. elegans
attcttcatcttc

SEQ ID NO: 705473 - DNA, 13 bp, C. elegans
attcttccaaatt

SEQ ID NO: 705474 - DNA, 13 bp, C. elegans
attcttccaattt

SEQ ID NO: 705475 - DNA, 13 bp, C. elegans
attcttccgaatt

SEQ ID NO: 705476 - DNA, 13 bp, C. elegans
attcttcgaaatt

SEQ ID NO: 705477 - DNA, 13 bp, C. elegans
attcttctaaaat

SEQ ID NO: 705478 - DNA, 13 bp, C. elegans
attcttctagttt

SEQ ID NO: 705479 - DNA, 13 bp, C. elegans
attcttctatcga

SEQ ID NO: 705480 - DNA, 13 bp, C. elegans
attcttctcaatt

SEQ ID NO: 705481 - DNA, 13 bp, C. elegans
attcttctgaaaa

SEQ ID NO: 705482 - DNA, 13 bp, C. elegans
attcttcttgaaa

SEQ ID NO: 705483 - DNA, 13 bp, C. elegans
attcttgaaaaaa

SEQ ID NO: 705484 - DNA, 13 bp, C. elegans
attcttgaaaatc

SEQ ID NO: 705485 - DNA, 13 bp, C. elegans
attcttgaaattt

SEQ ID NO: 705486 - DNA, 13 bp, C. elegans
attcttgaacaaa

SEQ ID NO: 705487 - DNA, 13 bp, C. elegans
attcttgaataaa

SEQ ID NO: 705488 - DNA, 13 bp, C. elegans
attcttgaattca

SEQ ID NO: 705489 - DNA, 13 bp, C. elegans
attcttgaattct

SEQ ID NO: 705490 - DNA, 13 bp, C. elegans
attcttgacaaaa

SEQ ID NO: 705491 - DNA, 13 bp, C. elegans
attcttgcaaatt

SEQ ID NO: 705492 - DNA, 13 bp, C. elegans
attcttgcaattt

SEQ ID NO: 705493 - DNA, 13 bp, C. elegans
attcttggaatac

SEQ ID NO: 705494 - DNA, 13 bp, C. elegans
attcttggaattt

SEQ ID NO: 705495 - DNA, 13 bp, C. elegans
attcttgtaaatt

SEQ ID NO: 705496 - DNA, 13 bp, C. elegans
attcttgtaattt

SEQ ID NO: 705497 - DNA, 13 bp, C. elegans
attcttgtagttt

SEQ ID NO: 705498 - DNA, 13 bp, C. elegans
attcttgtgaaat

SEQ ID NO: 705499 - DNA, 13 bp, C. elegans
attcttgttgaaa

SEQ ID NO: 705500 - DNA, 13 bp, C. elegans
attcttgttttca

SEQ ID NO: 705501 - DNA, 13 bp, C. elegans
attctttcaactt

SEQ ID NO: 705502 - DNA, 13 bp, C. elegans
attctttcagaaa

SEQ ID NO: 705503 - DNA, 13 bp, C. elegans
attctttccaaaa

SEQ ID NO: 705504 - DNA, 13 bp, C. elegans
attctttccaaat

SEQ ID NO: 705505 - DNA, 13 bp, C. elegans
attctttccaatt

SEQ ID NO: 705506 - DNA, 13 bp, C. elegans
attctttccgttt

SEQ ID NO: 705507 - DNA, 13 bp, C. elegans
attctttctcaaa

SEQ ID NO: 705508 - DNA, 13 bp, C. elegans
attctttctgaaa

SEQ ID NO: 705509 - DNA, 13 bp, C. elegans
attctttgaaaaa

SEQ ID NO: 705510 - DNA, 13 bp, C. elegans
attctttgaaata

SEQ ID NO: 705511 - DNA, 13 bp, C. elegans
attctttgaaatt

SEQ ID NO: 705512 - DNA, 13 bp, C. elegans
attctttgaactt

SEQ ID NO: 705513 - DNA, 13 bp, C. elegans
attcttttcaaat

SEQ ID NO: 705514 - DNA, 13 bp, C. elegans
attcttttggaaa

SEQ ID NO: 705515 - DNA, 13 bp, C. elegans
attgaaaaaaagc

SEQ ID NO: 705516 - DNA, 13 bp, C. elegans
attgaaaaaatac

SEQ ID NO: 705517 - DNA, 13 bp, C. elegans
attgaaaaaattg

SEQ ID NO: 705518 - DNA, 13 bp, C. elegans
attgaaaaacact

SEQ ID NO: 705519 - DNA, 13 bp, C. elegans
attgaaaaagtat

SEQ ID NO: 705520 - DNA, 13 bp, C. elegans
attgaaaaatgcg

SEQ ID NO: 705521 - DNA, 13 bp, C. elegans
attgaaaaattca

SEQ ID NO: 705522 - DNA, 13 bp, C. elegans
attgaaaacaaga

SEQ ID NO: 705523 - DNA, 13 bp, C. elegans
attgaaaacacaa

SEQ ID NO: 705524 - DNA, 13 bp, C. elegans
attgaaaacattg

SEQ ID NO: 705525 - DNA, 13 bp, C. elegans
attgaaaaccaat

SEQ ID NO: 705526 - DNA, 13 bp, C. elegans
attgaaaacgaaa

SEQ ID NO: 705527 - DNA, 13 bp, C. elegans
attgaaaactgga

SEQ ID NO: 705528 - DNA, 13 bp, C. elegans
attgaaaacttta

SEQ ID NO: 705529 - DNA, 13 bp, C. elegans
attgaaaactttc

SEQ ID NO: 705530 - DNA, 13 bp, C. elegans
attgaaaagaatt

SEQ ID NO: 705531 - DNA, 13 bp, C. elegans
attgaaaagtaca

SEQ ID NO: 705532 - DNA, 13 bp, C. elegans
attgaaaagtatt

SEQ ID NO: 705533 - DNA, 13 bp, C. elegans
attgaaaagtcga

SEQ ID NO: 705534 - DNA, 13 bp, C. elegans
attgaaaagttgt

SEQ ID NO: 705535 - DNA, 13 bp, C. elegans
attgaaaataaac

SEQ ID NO: 705536 - DNA, 13 bp, C. elegans
attgaaaatagat

SEQ ID NO: 705537 - DNA, 13 bp, C. elegans
attgaaaatatcc

SEQ ID NO: 705538 - DNA, 13 bp, C. elegans
attgaaaatctac

SEQ ID NO: 705539 - DNA, 13 bp, C. elegans
attgaaaatctcg

SEQ ID NO: 705540 - DNA, 14 bp, C. elegans
attgaaaatggaaa

SEQ ID NO: 705541 - DNA, 13 bp, C. elegans
attgaaaatgtta

SEQ ID NO: 705542 - DNA, 13 bp, C. elegans
attgaaaattagt

SEQ ID NO: 705543 - DNA, 13 bp, C. elegans
attgaaaattgat

SEQ ID NO: 705544 - DNA, 13 bp, C. elegans
attgaaaatttca

SEQ ID NO: 705545 - DNA, 13 bp, C. elegans
attgaaaatttct

SEQ ID NO: 705546 - DNA, 13 bp, C. elegans
attgaaaatttga

SEQ ID NO: 705547 - DNA, 13 bp, C. elegans
attgaaacaaaac

SEQ ID NO: 705548 - DNA, 13 bp, C. elegans
attgaaacaaatc

SEQ ID NO: 705549 - DNA, 13 bp, C. elegans
attgaaacaattg

SEQ ID NO: 705550 - DNA, 13 bp, C. elegans
attgaaacatatt

SEQ ID NO: 705551 - DNA, 13 bp, C. elegans
attgaaacattat

SEQ ID NO: 705552 - DNA, 13 bp, C. elegans
attgaaacatttc

SEQ ID NO: 705553 - DNA, 13 bp, C. elegans
attgaaacatttt

SEQ ID NO: 705554 - DNA, 13 bp, C. elegans
attgaaacctgaa

SEQ ID NO: 705555 - DNA, 13 bp, C. elegans
attgaaacgtttt

SEQ ID NO: 705556 - DNA, 13 bp, C. elegans
attgaaactattt

SEQ ID NO: 705557 - DNA, 13 bp, C. elegans
attgaaactttaa

SEQ ID NO: 705558 - DNA, 13 bp, C. elegans
attgaaactttat

SEQ ID NO: 705559 - DNA, 13 bp, C. elegans
attgaaacttttt

SEQ ID NO: 705560 - DNA, 13 bp, C. elegans
attgaaagaattc

SEQ ID NO: 705561 - DNA, 13 bp, C. elegans
attgaaagaattt

SEQ ID NO: 705562 - DNA, 13 bp, C. elegans
attgaaagattgt

SEQ ID NO: 705563 - DNA, 13 bp, C. elegans
attgaaagcaaat

SEQ ID NO: 705564 - DNA, 13 bp, C. elegans
attgaaagcattt

SEQ ID NO: 705565 - DNA, 13 bp, C. elegans
attgaaataaaac

SEQ ID NO: 705566 - DNA, 13 bp, C. elegans
attgaaataaatg

SEQ ID NO: 705567 - DNA, 13 bp, C. elegans
attgaaatacaaa

SEQ ID NO: 705568 - DNA, 13 bp, C. elegans
attgaaatcaaaa

SEQ ID NO: 705569 - DNA, 13 bp, C. elegans
attgaaatcatat

SEQ ID NO: 705570 - DNA, 13 bp, C. elegans
attgaaatgaata

SEQ ID NO: 705571 - DNA, 13 bp, C. elegans
attgaaatgagga

SEQ ID NO: 705572 - DNA, 13 bp, C. elegans
attgaaatggaaa

SEQ ID NO: 705573 - DNA, 13 bp, C. elegans
attgaaatgtttt

SEQ ID NO: 705574 - DNA, 13 bp, C. elegans
attgaaattactt

SEQ ID NO: 705575 - DNA, 13 bp, C. elegans
attgaaattagtt

SEQ ID NO: 705576 - DNA, 13 bp, C. elegans
attgaaattatgt

SEQ ID NO: 705577 - DNA, 13 bp, C. elegans
attgaaattcaat

SEQ ID NO: 705578 - DNA, 13 bp, C. elegans
attgaaattggaa

SEQ ID NO: 705579 - DNA, 13 bp, C. elegans
attgaaattgttg

SEQ ID NO: 705580 - DNA, 13 bp, C. elegans
attgaaattgttt

SEQ ID NO: 705581 - DNA, 13 bp, C. elegans
attgaaatttcgg

SEQ ID NO: 705582 - DNA, 13 bp, C. elegans
attgaaatttgga

SEQ ID NO: 705583 - DNA, 13 bp, C. elegans
attgaaattttcc

SEQ ID NO: 705584 - DNA, 13 bp, C. elegans
attgaaattttcg

SEQ ID NO: 705585 - DNA, 13 bp, C. elegans
attgaacaaaaat

SEQ ID NO: 705586 - DNA, 13 bp, C. elegans
attgaacaaaact

SEQ ID NO: 705587 - DNA, 13 bp, C. elegans
attgaacaaattg

SEQ ID NO: 705588 - DNA, 13 bp, C. elegans
attgaacagtttt

SEQ ID NO: 705589 - DNA, 13 bp, C. elegans
attgaacattcaa

SEQ ID NO: 705590 - DNA, 13 bp, C. elegans
attgaacatttac

SEQ ID NO: 705591 - DNA, 13 bp, C. elegans
attgaacatttct

SEQ ID NO: 705592 - DNA, 13 bp, C. elegans
attgaacatttga

SEQ ID NO: 705593 - DNA, 13 bp, C. elegans
attgaacattttc

SEQ ID NO: 705594 - DNA, 13 bp, C. elegans
attgaacgagaaa

SEQ ID NO: 705595 - DNA, 13 bp, C. elegans
attgaactcaatt

SEQ ID NO: 705596 - DNA, 13 bp, C. elegans
attgaacttaaaa

SEQ ID NO: 705597 - DNA, 13 bp, C. elegans
attgaacttcaaa

SEQ ID NO: 705598 - DNA, 13 bp, C. elegans
attgaacttttcg

SEQ ID NO: 705599 - DNA, 13 bp, C. elegans
attgaactttttg

SEQ ID NO: 705600 - DNA, 13 bp, C. elegans
attgaagaaaaac

SEQ ID NO: 705601 - DNA, 13 bp, C. elegans
attgaagaaaact

SEQ ID NO: 705602 - DNA, 13 bp, C. elegans
attgaagaaaatc

SEQ ID NO: 705603 - DNA, 13 bp, C. elegans
attgaagaaatat

SEQ ID NO: 705604 - DNA, 13 bp, C. elegans
attgaagaaatca

SEQ ID NO: 705605 - DNA, 13 bp, C. elegans
attgaagaaatta

SEQ ID NO: 705606 - DNA, 13 bp, C. elegans
attgaagaatatt

SEQ ID NO: 705607 - DNA, 13 bp, C. elegans
attgaagaccaaa

SEQ ID NO: 705608 - DNA, 13 bp, C. elegans
attgaagatgttt

SEQ ID NO: 705609 - DNA, 13 bp, C. elegans
attgaaggaaatt

SEQ ID NO: 705610 - DNA, 13 bp, C. elegans
attgaaggatttt

SEQ ID NO: 705611 - DNA, 13 bp, C. elegans
attgaaggtggag

SEQ ID NO: 705612 - DNA, 13 bp, C. elegans
attgaagttcaaa

SEQ ID NO: 705613 - DNA, 13 bp, C. elegans
attgaagttctga

SEQ ID NO: 705614 - DNA, 13 bp, C. elegans
attgaagtttcag

SEQ ID NO: 705615 - DNA, 13 bp, C. elegans
attgaagttttga

SEQ ID NO: 705616 - DNA, 13 bp, C. elegans
attgaataaaatg

SEQ ID NO: 705617 - DNA, 13 bp, C. elegans
attgaataaatac

SEQ ID NO: 705618 - DNA, 13 bp, C. elegans
attgaataaatga

SEQ ID NO: 705619 - DNA, 13 bp, C. elegans
attgaataaatgt

SEQ ID NO: 705620 - DNA, 13 bp, C. elegans
attgaataacttt

SEQ ID NO: 705621 - DNA, 13 bp, C. elegans
attgaataatcaa

SEQ ID NO: 705622 - DNA, 13 bp, C. elegans
attgaatacaagt

SEQ ID NO: 705623 - DNA, 13 bp, C. elegans
attgaatatcata

SEQ ID NO: 705624 - DNA, 13 bp, C. elegans
attgaatcaattt

SEQ ID NO: 705625 - DNA, 13 bp, C. elegans
attgaatctgaaa

SEQ ID NO: 705626 - DNA, 13 bp, C. elegans
attgaatcttgtt

SEQ ID NO: 705627 - DNA, 13 bp, C. elegans
attgaatgaattt

SEQ ID NO: 705628 - DNA, 13 bp, C. elegans
attgaatgcaaaa

SEQ ID NO: 705629 - DNA, 13 bp, C. elegans
attgaatgttttc

SEQ ID NO: 705630 - DNA, 13 bp, C. elegans
attgaattatttc

SEQ ID NO: 705631 - DNA, 13 bp, C. elegans
attgaattcaaat

SEQ ID NO: 705632 - DNA, 13 bp, C. elegans
attgaattcaata

SEQ ID NO: 705633 - DNA, 13 bp, C. elegans
attgaattctaaa

SEQ ID NO: 705634 - DNA, 13 bp, C. elegans
attgaattctcaa

SEQ ID NO: 705635 - DNA, 13 bp, C. elegans
attgaattgaaaa

SEQ ID NO: 705636 - DNA, 13 bp, C. elegans
attgaattgaact

SEQ ID NO: 705637 - DNA, 13 bp, C. elegans
attgaattgaata

SEQ ID NO: 705638 - DNA, 13 bp, C. elegans
attgaattgaatt

SEQ ID NO: 705639 - DNA, 13 bp, C. elegans
attgaattgcaaa

SEQ ID NO: 705640 - DNA, 13 bp, C. elegans
attgaattggaaa

SEQ ID NO: 705641 - DNA, 13 bp, C. elegans
attgaatttaaag

SEQ ID NO: 705642 - DNA, 13 bp, C. elegans
attgaatttatca

SEQ ID NO: 705643 - DNA, 13 bp, C. elegans
attgaatttcata

SEQ ID NO: 705644 - DNA, 13 bp, C. elegans
attgaatttcgaa

SEQ ID NO: 705645 - DNA, 13 bp, C. elegans
attgaatttctcg

SEQ ID NO: 705646 - DNA, 13 bp, C. elegans
attgaatttctga

SEQ ID NO: 705647 - DNA, 13 bp, C. elegans
attgaatttgaaa

SEQ ID NO: 705648 - DNA, 13 bp, C. elegans
attgaatttgttc

SEQ ID NO: 705649 - DNA, 13 bp, C. elegans
attgaattttcac

SEQ ID NO: 705650 - DNA, 13 bp, C. elegans
attgaattttctt

SEQ ID NO: 705651 - DNA, 13 bp, C. elegans
attgaatttttca

SEQ ID NO: 705652 - DNA, 13 bp, C. elegans
attgaatttttcg

SEQ ID NO: 705653 - DNA, 14 bp, C. elegans
attgaatttttgaa

SEQ ID NO: 705654 - DNA, 13 bp, C. elegans
attgaattttttc

SEQ ID NO: 705655 - DNA, 13 bp, C. elegans
attgacaaaaatt

SEQ ID NO: 705656 - DNA, 13 bp, C. elegans
attgacaaaatga

SEQ ID NO: 705657 - DNA, 13 bp, C. elegans
attgacaaaattg

SEQ ID NO: 705658 - DNA, 13 bp, C. elegans
attgacaaattga

SEQ ID NO: 705659 - DNA, 13 bp, C. elegans
attgacaaatttc

SEQ ID NO: 705660 - DNA, 13 bp, C. elegans
attgacaatattt

SEQ ID NO: 705661 - DNA, 13 bp, C. elegans
attgacaattgcc

SEQ ID NO: 705662 - DNA, 13 bp, C. elegans
attgacaatttct

SEQ ID NO: 705663 - DNA, 13 bp, C. elegans
attgacaatttgt

SEQ ID NO: 705664 - DNA, 13 bp, C. elegans
attgacacaaaat

SEQ ID NO: 705665 - DNA, 15 bp, C. elegans
attgacagacgaaaa

SEQ ID NO: 705666 - DNA, 13 bp, C. elegans
attgaccaatttt

SEQ ID NO: 705667 - DNA, 13 bp, C. elegans
attgacgaaaatt

SEQ ID NO: 705668 - DNA, 13 bp, C. elegans
attgacgaagaaa

SEQ ID NO: 705669 - DNA, 13 bp, C. elegans
attgacggaaaat

SEQ ID NO: 705670 - DNA, 13 bp, C. elegans
attgacggaattg

SEQ ID NO: 705671 - DNA, 13 bp, C. elegans
attgactaaaaaa

SEQ ID NO: 705672 - DNA, 13 bp, C. elegans
attgactatattc

SEQ ID NO: 705673 - DNA, 13 bp, C. elegans
attgacttccttt

SEQ ID NO: 705674 - DNA, 13 bp, C. elegans
attgactttgaaa

SEQ ID NO: 705675 - DNA, 13 bp, C. elegans
attgacttttgaa

SEQ ID NO: 705676 - DNA, 13 bp, C. elegans
attgactttttga

SEQ ID NO: 705677 - DNA, 13 bp, C. elegans
attgagaaaaacc

SEQ ID NO: 705678 - DNA, 13 bp, C. elegans
attgagaaaaatg

SEQ ID NO: 705679 - DNA, 13 bp, C. elegans
attgagaaaagta

SEQ ID NO: 705680 - DNA, 13 bp, C. elegans
attgagaaaatga

SEQ ID NO: 705681 - DNA, 13 bp, C. elegans
attgagaaatttt

SEQ ID NO: 705682 - DNA, 13 bp, C. elegans
attgagaagaaat

SEQ ID NO: 705683 - DNA, 13 bp, C. elegans
attgagaatattg

SEQ ID NO: 705684 - DNA, 13 bp, C. elegans
attgagaattttt

SEQ ID NO: 705685 - DNA, 13 bp, C. elegans
attgagacatttt

SEQ ID NO: 705686 - DNA, 13 bp, C. elegans
attgagagaaatt

SEQ ID NO: 705687 - DNA, 13 bp, C. elegans
attgagagaagaa

SEQ ID NO: 705688 - DNA, 13 bp, C. elegans
attgagatatttt

SEQ ID NO: 705689 - DNA, 13 bp, C. elegans
attgagcaagaaa

SEQ ID NO: 705690 - DNA, 13 bp, C. elegans
attgagcaatttc

SEQ ID NO: 705691 - DNA, 13 bp, C. elegans
attgagcatattt

SEQ ID NO: 705692 - DNA, 13 bp, C. elegans
attgagctaattt

SEQ ID NO: 705693 - DNA, 13 bp, C. elegans
attgagctcattt

SEQ ID NO: 705694 - DNA, 13 bp, C. elegans
attgagctttgtg

SEQ ID NO: 705695 - DNA, 13 bp, C. elegans
attgaggagaaaa

SEQ ID NO: 705696 - DNA, 13 bp, C. elegans
attgagtatttct

SEQ ID NO: 705697 - DNA, 13 bp, C. elegans
attgagttttata

SEQ ID NO: 705698 - DNA, 13 bp, C. elegans
attgataaaacaa

SEQ ID NO: 705699 - DNA, 13 bp, C. elegans
attgataagaaag

SEQ ID NO: 705700 - DNA, 13 bp, C. elegans
attgataagattt

SEQ ID NO: 705701 - DNA, 13 bp, C. elegans
attgataatttca

SEQ ID NO: 705702 - DNA, 13 bp, C. elegans
attgataatttcc

SEQ ID NO: 705703 - DNA, 13 bp, C. elegans
attgataattttg

SEQ ID NO: 705704 - DNA, 13 bp, C. elegans
attgatagaatat

SEQ ID NO: 705705 - DNA, 13 bp, C. elegans
attgatagacgaa

SEQ ID NO: 705706 - DNA, 13 bp, C. elegans
attgatagatttt

SEQ ID NO: 705707 - DNA, 13 bp, C. elegans
attgatatcaaaa

SEQ ID NO: 705708 - DNA, 13 bp, C. elegans
attgatattcaaa

SEQ ID NO: 705709 - DNA, 13 bp, C. elegans
attgatcaaaact

SEQ ID NO: 705710 - DNA, 13 bp, C. elegans
attgatcgaaaaa

SEQ ID NO: 705711 - DNA, 13 bp, C. elegans
attgatcgaaaat

SEQ ID NO: 705712 - DNA, 13 bp, C. elegans
attgatctacaaa

SEQ ID NO: 705713 - DNA, 13 bp, C. elegans
attgatgaaaaag

SEQ ID NO: 705714 - DNA, 13 bp, C. elegans
attgatgaaaata

SEQ ID NO: 705715 - DNA, 13 bp, C. elegans
attgatgaaaatt

SEQ ID NO: 705716 - DNA, 13 bp, C. elegans
attgatgaaattt

SEQ ID NO: 705717 - DNA, 13 bp, C. elegans
attgatgaacttt

SEQ ID NO: 705718 - DNA, 13 bp, C. elegans
attgatgaattat

SEQ ID NO: 705719 - DNA, 13 bp, C. elegans
attgatgaatttt

SEQ ID NO: 705720 - DNA, 13 bp, C. elegans
attgatgataaaa

SEQ ID NO: 705721 - DNA, 13 bp, C. elegans
attgatgatatta

SEQ ID NO: 705722 - DNA, 13 bp, C. elegans
attgatgatttca

SEQ ID NO: 705723 - DNA, 13 bp, C. elegans
attgatgattttc

SEQ ID NO: 705724 - DNA, 13 bp, C. elegans
attgatggaaaat

SEQ ID NO: 705725 - DNA, 13 bp, C. elegans
attgatggccgaa

SEQ ID NO: 705726 - DNA, 13 bp, C. elegans
attgattaaaaac

SEQ ID NO: 705727 - DNA, 13 bp, C. elegans
attgattatttca

SEQ ID NO: 705728 - DNA, 13 bp, C. elegans
attgattattttc

SEQ ID NO: 705729 - DNA, 13 bp, C. elegans
attgattccagaa

SEQ ID NO: 705730 - DNA, 13 bp, C. elegans
attgattgaaaat

SEQ ID NO: 705731 - DNA, 13 bp, C. elegans
attgattgaattt

SEQ ID NO: 705732 - DNA, 13 bp, C. elegans
attgattgattat

SEQ ID NO: 705733 - DNA, 13 bp, C. elegans
attgattgatttg

SEQ ID NO: 705734 - DNA, 13 bp, C. elegans
attgattggaaaa

SEQ ID NO: 705735 - DNA, 13 bp, C. elegans
attgattgttaaa

SEQ ID NO: 705736 - DNA, 13 bp, C. elegans
attgattgttttc

SEQ ID NO: 705737 - DNA, 13 bp, C. elegans
attgatttatcga

SEQ ID NO: 705738 - DNA, 13 bp, C. elegans
attgatttctaaa

SEQ ID NO: 705739 - DNA, 13 bp, C. elegans
attgatttctgat

SEQ ID NO: 705740 - DNA, 13 bp, C. elegans
attgatttgttga

SEQ ID NO: 705741 - DNA, 13 bp, C. elegans
attgattttaatg

SEQ ID NO: 705742 - DNA, 13 bp, C. elegans
attgattttatca

SEQ ID NO: 705743 - DNA, 13 bp, C. elegans
attgattttcatt

SEQ ID NO: 705744 - DNA, 13 bp, C. elegans
attgattttccgt

SEQ ID NO: 705745 - DNA, 13 bp, C. elegans
attgattttctca

SEQ ID NO: 705746 - DNA, 13 bp, C. elegans
attgatttttacg

SEQ ID NO: 705747 - DNA, 13 bp, C. elegans
attgatttttaga

SEQ ID NO: 705748 - DNA, 13 bp, C. elegans
attgatttttagg

SEQ ID NO: 705749 - DNA, 13 bp, C. elegans
attgatttttatc

SEQ ID NO: 705750 - DNA, 13 bp, C. elegans
attgatttttcaa

SEQ ID NO: 705751 - DNA, 13 bp, C. elegans
attgatttttcag

SEQ ID NO: 705752 - DNA, 13 bp, C. elegans
attgatttttcgg

SEQ ID NO: 705753 - DNA, 14 bp, C. elegans
attgatttttgaaa

SEQ ID NO: 705754 - DNA, 13 bp, C. elegans
attgatttttgag

SEQ ID NO: 705755 - DNA, 13 bp, C. elegans
attgatttttgct

SEQ ID NO: 705756 - DNA, 13 bp, C. elegans
attgcaaaaaatg

SEQ ID NO: 705757 - DNA, 13 bp, C. elegans
attgcaaaaatcg

SEQ ID NO: 705758 - DNA, 13 bp, C. elegans
attgcaaaaatct

SEQ ID NO: 705759 - DNA, 13 bp, C. elegans
attgcaaaaattg

SEQ ID NO: 705760 - DNA, 13 bp, C. elegans
attgcaaaactac

SEQ ID NO: 705761 - DNA, 13 bp, C. elegans
attgcaaaatgtt

SEQ ID NO: 705762 - DNA, 13 bp, C. elegans
attgcaaaatttc

SEQ ID NO: 705763 - DNA, 13 bp, C. elegans
attgcaaatttca

SEQ ID NO: 705764 - DNA, 13 bp, C. elegans
attgcaaatttcc

SEQ ID NO: 705765 - DNA, 13 bp, C. elegans
attgcaaattttc

SEQ ID NO: 705766 - DNA, 13 bp, C. elegans
attgcaaattttt

SEQ ID NO: 705767 - DNA, 13 bp, C. elegans
attgcaagaaaat

SEQ ID NO: 705768 - DNA, 13 bp, C. elegans
attgcaatcaaaa

SEQ ID NO: 705769 - DNA, 13 bp, C. elegans
attgcaattgcaa

SEQ ID NO: 705770 - DNA, 13 bp, C. elegans
attgcaatttaaa

SEQ ID NO: 705771 - DNA, 13 bp, C. elegans
attgcaatttgaa

SEQ ID NO: 705772 - DNA, 13 bp, C. elegans
attgcaattttat

SEQ ID NO: 705773 - DNA, 13 bp, C. elegans
attgcaattttct

SEQ ID NO: 705774 - DNA, 13 bp, C. elegans
attgcaatttttc

SEQ ID NO: 705775 - DNA, 13 bp, C. elegans
attgcaatttttt

SEQ ID NO: 705776 - DNA, 13 bp, C. elegans
attgcacaatttt

SEQ ID NO: 705777 - DNA, 13 bp, C. elegans
attgcacttttct

SEQ ID NO: 705778 - DNA, 13 bp, C. elegans
attgcactttttc

SEQ ID NO: 705779 - DNA, 13 bp, C. elegans
attgcactttttt

SEQ ID NO: 705780 - DNA, 13 bp, C. elegans
attgcagaaaaac

SEQ ID NO: 705781 - DNA, 13 bp, C. elegans
attgcagaaaatc

SEQ ID NO: 705782 - DNA, 13 bp, C. elegans
attgcagaaaatg

SEQ ID NO: 705783 - DNA, 13 bp, C. elegans
attgcagaagaaa

SEQ ID NO: 705784 - DNA, 13 bp, C. elegans
attgcagacgaaa

SEQ ID NO: 705785 - DNA, 13 bp, C. elegans
attgcaggaattt

SEQ ID NO: 705786 - DNA, 13 bp, C. elegans
attgcagtaaaaa

SEQ ID NO: 705787 - DNA, 13 bp, C. elegans
attgcagtttttc

SEQ ID NO: 705788 - DNA, 13 bp, C. elegans
attgcagtttttg

SEQ ID NO: 705789 - DNA, 13 bp, C. elegans
attgcataatttt

SEQ ID NO: 705790 - DNA, 13 bp, C. elegans
attgcatatttca

SEQ ID NO: 705791 - DNA, 13 bp, C. elegans
attgcatattttg

SEQ ID NO: 705792 - DNA, 13 bp, C. elegans
attgcatcaattt

SEQ ID NO: 705793 - DNA, 13 bp, C. elegans
attgcattaaatt

SEQ ID NO: 705794 - DNA, 13 bp, C. elegans
attgcattagtta

SEQ ID NO: 705795 - DNA, 13 bp, C. elegans
attgcatttgaaa

SEQ ID NO: 705796 - DNA, 13 bp, C. elegans
attgcattttatt

SEQ ID NO: 705797 - DNA, 13 bp, C. elegans
attgcattttcaa

SEQ ID NO: 705798 - DNA, 13 bp, C. elegans
attgccaaaaaat

SEQ ID NO: 705799 - DNA, 13 bp, C. elegans
attgccaaaaatt

SEQ ID NO: 705800 - DNA, 13 bp, C. elegans
attgccaaaattc

SEQ ID NO: 705801 - DNA, 13 bp, C. elegans
attgccaaacatt

SEQ ID NO: 705802 - DNA, 13 bp, C. elegans
attgccaaattta

SEQ ID NO: 705803 - DNA, 13 bp, C. elegans
attgccaaatttc

SEQ ID NO: 705804 - DNA, 13 bp, C. elegans
attgccaaatttt

SEQ ID NO: 705805 - DNA, 13 bp, C. elegans
attgccaagtttt

SEQ ID NO: 705806 - DNA, 13 bp, C. elegans
attgccaatttct

SEQ ID NO: 705807 - DNA, 13 bp, C. elegans
attgccagaaaat

SEQ ID NO: 705808 - DNA, 13 bp, C. elegans
attgccagaattt

SEQ ID NO: 705809 - DNA, 13 bp, C. elegans
attgccattttga

SEQ ID NO: 705810 - DNA, 13 bp, C. elegans
attgccattttgt

SEQ ID NO: 705811 - DNA, 13 bp, C. elegans
attgcccaaattg

SEQ ID NO: 705812 - DNA, 13 bp, C. elegans
attgcccatttta

SEQ ID NO: 705813 - DNA, 38 bp, C. elegans
attgcccgactgcaccaattctagttcaagcgaacaat

SEQ ID NO: 705814 - DNA, 13 bp, C. elegans
attgccgaaaatg

SEQ ID NO: 705815 - DNA, 13 bp, C. elegans
attgccgaaattg

SEQ ID NO: 705816 - DNA, 13 bp, C. elegans
attgccggaaatc

SEQ ID NO: 705817 - DNA, 13 bp, C. elegans
attgccggaatcg

SEQ ID NO: 705818 - DNA, 13 bp, C. elegans
attgccggacttg

SEQ ID NO: 705819 - DNA, 13 bp, C. elegans
attgccgtttggc

SEQ ID NO: 705820 - DNA, 13 bp, C. elegans
attgcctactctt

SEQ ID NO: 705821 - DNA, 13 bp, C. elegans
attgcctcaaaaa

SEQ ID NO: 705822 - DNA, 13 bp, C. elegans
attgcctgtttgc

SEQ ID NO: 705823 - DNA, 13 bp, C. elegans
attgcgaaaattc

SEQ ID NO: 705824 - DNA, 13 bp, C. elegans
attgcgattttca

SEQ ID NO: 705825 - DNA, 13 bp, C. elegans
attgcgatttttg

SEQ ID NO: 705826 - DNA, 13 bp, C. elegans
attgcggaaattt

SEQ ID NO: 705827 - DNA, 13 bp, C. elegans
attgcgtcaaggc

SEQ ID NO: 705828 - DNA, 13 bp, C. elegans
attgcgttttgtg

SEQ ID NO: 705829 - DNA, 13 bp, C. elegans
attgctaaaaatc

SEQ ID NO: 705830 - DNA, 13 bp, C. elegans
attgctaataaaa

SEQ ID NO: 705831 - DNA, 13 bp, C. elegans
attgctaattttt

SEQ ID NO: 705832 - DNA, 13 bp, C. elegans
attgctagaaaaa

SEQ ID NO: 705833 - DNA, 13 bp, C. elegans
attgctagaatac

SEQ ID NO: 705834 - DNA, 13 bp, C. elegans
attgctcaaaaag

SEQ ID NO: 705835 - DNA, 13 bp, C. elegans
attgctcaaaaat

SEQ ID NO: 705836 - DNA, 13 bp, C. elegans
attgctcaaaatg

SEQ ID NO: 705837 - DNA, 13 bp, C. elegans
attgctcaaaatt

SEQ ID NO: 705838 - DNA, 13 bp, C. elegans
attgctcaaattt

SEQ ID NO: 705839 - DNA, 13 bp, C. elegans
attgctcaatttt

SEQ ID NO: 705840 - DNA, 13 bp, C. elegans
attgctccaaatt

SEQ ID NO: 705841 - DNA, 13 bp, C. elegans
attgctccacttc

SEQ ID NO: 705842 - DNA, 13 bp, C. elegans
attgctccatttt

SEQ ID NO: 705843 - DNA, 13 bp, C. elegans
attgctcgttttt

SEQ ID NO: 705844 - DNA, 13 bp, C. elegans
attgctctatttt

SEQ ID NO: 705845 - DNA, 13 bp, C. elegans
attgctgaaaaac

SEQ ID NO: 705846 - DNA, 13 bp, C. elegans
attgctgaaaaat

SEQ ID NO: 705847 - DNA, 13 bp, C. elegans
attgctgaaactg

SEQ ID NO: 705848 - DNA, 13 bp, C. elegans
attgctgaaattg

SEQ ID NO: 705849 - DNA, 13 bp, C. elegans
attgctggaaaat

SEQ ID NO: 705850 - DNA, 13 bp, C. elegans
attgctggttttt

SEQ ID NO: 705851 - DNA, 13 bp, C. elegans
attgctttaaaac

SEQ ID NO: 705852 - DNA, 13 bp, C. elegans
attgctttaaaat

SEQ ID NO: 705853 - DNA, 13 bp, C. elegans
attgctttgaaat

SEQ ID NO: 705854 - DNA, 13 bp, C. elegans
attgcttttgaaa

SEQ ID NO: 705855 - DNA, 13 bp, C. elegans
attgcttttttaa

SEQ ID NO: 705856 - DNA, 14 bp, C. elegans
attggaaaaaatga

SEQ ID NO: 705857 - DNA, 13 bp, C. elegans
attggaaaaagtt

SEQ ID NO: 705858 - DNA, 13 bp, C. elegans
attggaaaaatca

SEQ ID NO: 705859 - DNA, 13 bp, C. elegans
attggaaaaatga

SEQ ID NO: 705860 - DNA, 14 bp, C. elegans
attggaaaacaaat

SEQ ID NO: 705861 - DNA, 13 bp, C. elegans
attggaaaagaat

SEQ ID NO: 705862 - DNA, 13 bp, C. elegans
attggaaaagtat

SEQ ID NO: 705863 - DNA, 13 bp, C. elegans
attggaaaataat

SEQ ID NO: 705864 - DNA, 13 bp, C. elegans
attggaaaatatt

SEQ ID NO: 705865 - DNA, 13 bp, C. elegans
attggaaaatcga

SEQ ID NO: 705866 - DNA, 13 bp, C. elegans
attggaaaatcgt

SEQ ID NO: 705867 - DNA, 13 bp, C. elegans
attggaaaatctc

SEQ ID NO: 705868 - DNA, 13 bp, C. elegans
attggaaaattat

SEQ ID NO: 705869 - DNA, 13 bp, C. elegans
attggaaaattgg

SEQ ID NO: 705870 - DNA, 13 bp, C. elegans
attggaaaatttc

SEQ ID NO: 705871 - DNA, 13 bp, C. elegans
attggaaacttcg

SEQ ID NO: 705872 - DNA, 13 bp, C. elegans
attggaaactttt

SEQ ID NO: 705873 - DNA, 13 bp, C. elegans
attggaaagaaat

SEQ ID NO: 705874 - DNA, 13 bp, C. elegans
attggaaatccca

SEQ ID NO: 705875 - DNA, 13 bp, C. elegans
attggaaattaaa

SEQ ID NO: 705876 - DNA, 13 bp, C. elegans
attggaaattggt

SEQ ID NO: 705877 - DNA, 13 bp, C. elegans
attggaaatttcg

SEQ ID NO: 705878 - DNA, 13 bp, C. elegans
attggaaattttc

SEQ ID NO: 705879 - DNA, 13 bp, C. elegans
attggaacttttt

SEQ ID NO: 705880 - DNA, 13 bp, C. elegans
attggaagaaaac

SEQ ID NO: 705881 - DNA, 13 bp, C. elegans
attggaatatatt

SEQ ID NO: 705882 - DNA, 13 bp, C. elegans
attggaatcaatt

SEQ ID NO: 705883 - DNA, 13 bp, C. elegans
attggaattattg

SEQ ID NO: 705884 - DNA, 13 bp, C. elegans
attggaatttcaa

SEQ ID NO: 705885 - DNA, 13 bp, C. elegans
attggaatttcat

SEQ ID NO: 705886 - DNA, 13 bp, C. elegans
attggaattttta

SEQ ID NO: 705887 - DNA, 13 bp, C. elegans
attggactcaaaa

SEQ ID NO: 705888 - DNA, 13 bp, C. elegans
attggagaaattt

SEQ ID NO: 705889 - DNA, 13 bp, C. elegans
attggagagcaac

SEQ ID NO: 705890 - DNA, 13 bp, C. elegans
attggagatttta

SEQ ID NO: 705891 - DNA, 13 bp, C. elegans
attggagattttg

SEQ ID NO: 705892 - DNA, 13 bp, C. elegans
attggagctcttt

SEQ ID NO: 705893 - DNA, 13 bp, C. elegans
attggaggaaaaa

SEQ ID NO: 705894 - DNA, 13 bp, C. elegans
attggatcttcga

SEQ ID NO: 705895 - DNA, 13 bp, C. elegans
attggatggaaaa

SEQ ID NO: 705896 - DNA, 13 bp, C. elegans
attggattttcaa

SEQ ID NO: 705897 - DNA, 13 bp, C. elegans
attggattttgaa

SEQ ID NO: 705898 - DNA, 13 bp, C. elegans
attggcaaaaaag

SEQ ID NO: 705899 - DNA, 13 bp, C. elegans
attggcaaaaaat

SEQ ID NO: 705900 - DNA, 13 bp, C. elegans
attggcaaaacat

SEQ ID NO: 705901 - DNA, 13 bp, C. elegans
attggcaaattgc

SEQ ID NO: 705902 - DNA, 13 bp, C. elegans
attggcaaatttc

SEQ ID NO: 705903 - DNA, 13 bp, C. elegans
attggcaatattt

SEQ ID NO: 705904 - DNA, 13 bp, C. elegans
attggcagaaaat

SEQ ID NO: 705905 - DNA, 13 bp, C. elegans
attggcagaaatt

SEQ ID NO: 705906 - DNA, 13 bp, C. elegans
attggcattttta

SEQ ID NO: 705907 - DNA, 13 bp, C. elegans
attggccaaattg

SEQ ID NO: 705908 - DNA, 13 bp, C. elegans
attggccggaaaa

SEQ ID NO: 705909 - DNA, 13 bp, C. elegans
attggccggaaat

SEQ ID NO: 705910 - DNA, 13 bp, C. elegans
attggcggaaatg

SEQ ID NO: 705911 - DNA, 13 bp, C. elegans
attggcggcaaaa

SEQ ID NO: 705912 - DNA, 13 bp, C. elegans
attggctgaaaac

SEQ ID NO: 705913 - DNA, 13 bp, C. elegans
attggcttatttt

SEQ ID NO: 705914 - DNA, 13 bp, C. elegans
attgggaaaaatg

SEQ ID NO: 705915 - DNA, 13 bp, C. elegans
attgggaaatttt

SEQ ID NO: 705916 - DNA, 13 bp, C. elegans
attgggaagtgga

SEQ ID NO: 705917 - DNA, 13 bp, C. elegans
attgggacatgtt

SEQ ID NO: 705918 - DNA, 13 bp, C. elegans
attgggatatttt

SEQ ID NO: 705919 - DNA, 13 bp, C. elegans
attggtataaaaa

SEQ ID NO: 705920 - DNA, 13 bp, C. elegans
attggtcgcagtt

SEQ ID NO: 705921 - DNA, 13 bp, C. elegans
attggtgaaaaat

SEQ ID NO: 705922 - DNA, 13 bp, C. elegans
attggtgaaaact

SEQ ID NO: 705923 - DNA, 13 bp, C. elegans
attggtgaatttt

SEQ ID NO: 705924 - DNA, 13 bp, C. elegans
attggtggaaaat

SEQ ID NO: 705925 - DNA, 13 bp, C. elegans
attggttaaaaat

SEQ ID NO: 705926 - DNA, 13 bp, C. elegans
attggttcaaaaa

SEQ ID NO: 705927 - DNA, 13 bp, C. elegans
attggttccaaaa

SEQ ID NO: 705928 - DNA, 13 bp, C. elegans
attggttccaact

SEQ ID NO: 705929 - DNA, 13 bp, C. elegans
attggttgaaaaa

SEQ ID NO: 705930 - DNA, 13 bp, C. elegans
attggttgaaaat

SEQ ID NO: 705931 - DNA, 13 bp, C. elegans
attggtttgaaaa

SEQ ID NO: 705932 - DNA, 13 bp, C. elegans
attggtttgaaat

SEQ ID NO: 705933 - DNA, 13 bp, C. elegans
attggttttcaaa

SEQ ID NO: 705934 - DNA, 13 bp, C. elegans
attggttttcatt

SEQ ID NO: 705935 - DNA, 13 bp, C. elegans
attggtttttcga

SEQ ID NO: 705936 - DNA, 13 bp, C. elegans
attgtaaaacaat

SEQ ID NO: 705937 - DNA, 13 bp, C. elegans
attgtaaaagtta

SEQ ID NO: 705938 - DNA, 13 bp, C. elegans
attgtaaatcaaa

SEQ ID NO: 705939 - DNA, 13 bp, C. elegans
attgtaaatgttt

SEQ ID NO: 705940 - DNA, 13 bp, C. elegans
attgtaaatttcc

SEQ ID NO: 705941 - DNA, 13 bp, C. elegans
attgtaacttttt

SEQ ID NO: 705942 - DNA, 13 bp, C. elegans
attgtaatatgat

SEQ ID NO: 705943 - DNA, 13 bp, C. elegans
attgtaattgcaa

SEQ ID NO: 705944 - DNA, 13 bp, C. elegans
attgtaatttctt

SEQ ID NO: 705945 - DNA, 13 bp, C. elegans
attgtacaaattt

SEQ ID NO: 705946 - DNA, 13 bp, C. elegans
attgtagaaattg

SEQ ID NO: 705947 - DNA, 13 bp, C. elegans
attgtatacttaa

SEQ ID NO: 705948 - DNA, 13 bp, C. elegans
attgtatcattaa

SEQ ID NO: 705949 - DNA, 13 bp, C. elegans
attgtatgtgtac

SEQ ID NO: 705950 - DNA, 13 bp, C. elegans
attgtattcaaat

SEQ ID NO: 705951 - DNA, 13 bp, C. elegans
attgtatttgaaa

SEQ ID NO: 705952 - DNA, 13 bp, C. elegans
attgtcaaaaacc

SEQ ID NO: 705953 - DNA, 13 bp, C. elegans
attgtcaaaaata

SEQ ID NO: 705954 - DNA, 13 bp, C. elegans
attgtcaaaattg

SEQ ID NO: 705955 - DNA, 13 bp, C. elegans
attgtcaaattaa

SEQ ID NO: 705956 - DNA, 13 bp, C. elegans
attgtcaaattgt

SEQ ID NO: 705957 - DNA, 13 bp, C. elegans
attgtcaactgaa

SEQ ID NO: 705958 - DNA, 13 bp, C. elegans
attgtcaatttca

SEQ ID NO: 705959 - DNA, 13 bp, C. elegans
attgtcaatttcc

SEQ ID NO: 705960 - DNA, 13 bp, C. elegans
attgtcacatttt

SEQ ID NO: 705961 - DNA, 13 bp, C. elegans
attgtcagaaaat

SEQ ID NO: 705962 - DNA, 13 bp, C. elegans
attgtcagaaatt

SEQ ID NO: 705963 - DNA, 13 bp, C. elegans
attgtcagttttt

SEQ ID NO: 705964 - DNA, 13 bp, C. elegans
attgtcatatttt

SEQ ID NO: 705965 - DNA, 13 bp, C. elegans
attgtcattttct

SEQ ID NO: 705966 - DNA, 13 bp, C. elegans
attgtcatttttg

SEQ ID NO: 705967 - DNA, 13 bp, C. elegans
attgtccaaaata

SEQ ID NO: 705968 - DNA, 13 bp, C. elegans
attgtcctgaaaa

SEQ ID NO: 705969 - DNA, 13 bp, C. elegans
attgtcgaaaatg

SEQ ID NO: 705970 - DNA, 13 bp, C. elegans
attgtcgattttt

SEQ ID NO: 705971 - DNA, 13 bp, C. elegans
attgtcggaaaaa

SEQ ID NO: 705972 - DNA, 13 bp, C. elegans
attgtcggaattg

SEQ ID NO: 705973 - DNA, 13 bp, C. elegans
attgtcggctgct

SEQ ID NO: 705974 - DNA, 13 bp, C. elegans
attgtctaaattt

SEQ ID NO: 705975 - DNA, 13 bp, C. elegans
attgtctaatttt

SEQ ID NO: 705976 - DNA, 13 bp, C. elegans
attgtctcaaaaa

SEQ ID NO: 705977 - DNA, 13 bp, C. elegans
attgtctcatttc

SEQ ID NO: 705978 - DNA, 13 bp, C. elegans
attgtctgaaaat

SEQ ID NO: 705979 - DNA, 13 bp, C. elegans
attgtctgaaact

SEQ ID NO: 705980 - DNA, 13 bp, C. elegans
attgtctgaaatt

SEQ ID NO: 705981 - DNA, 13 bp, C. elegans
attgtctgcttca

SEQ ID NO: 705982 - DNA, 13 bp, C. elegans
attgtcttcaaat

SEQ ID NO: 705983 - DNA, 13 bp, C. elegans
attgtctttcatt

SEQ ID NO: 705984 - DNA, 13 bp, C. elegans
attgtctttttca

SEQ ID NO: 705985 - DNA, 13 bp, C. elegans
attgtgaaaaatg

SEQ ID NO: 705986 - DNA, 13 bp, C. elegans
attgtgaaaatta

SEQ ID NO: 705987 - DNA, 13 bp, C. elegans
attgtgaaacttt

SEQ ID NO: 705988 - DNA, 13 bp, C. elegans
attgtgaaatctt

SEQ ID NO: 705989 - DNA, 13 bp, C. elegans
attgtgaaatgtt

SEQ ID NO: 705990 - DNA, 13 bp, C. elegans
attgtgaaattcg

SEQ ID NO: 705991 - DNA, 13 bp, C. elegans
attgtgaacaatt

SEQ ID NO: 705992 - DNA, 13 bp, C. elegans
attgtgaatattt

SEQ ID NO: 705993 - DNA, 13 bp, C. elegans
attgtgaatttga

SEQ ID NO: 705994 - DNA, 13 bp, C. elegans
attgtgaattttc

SEQ ID NO: 705995 - DNA, 13 bp, C. elegans
attgtgaattttg

SEQ ID NO: 705996 - DNA, 13 bp, C. elegans
attgtgacaattt

SEQ ID NO: 705997 - DNA, 13 bp, C. elegans
attgtgagaaaac

SEQ ID NO: 705998 - DNA, 13 bp, C. elegans
attgtgagaaata

SEQ ID NO: 705999 - DNA, 13 bp, C. elegans
attgtgatacgga

SEQ ID NO: 706000 - DNA, 13 bp, C. elegans
attgtgatattta

SEQ ID NO: 706001 - DNA, 13 bp, C. elegans
attgtgatctacg

SEQ ID NO: 706002 - DNA, 13 bp, C. elegans
attgtgatgaaaa

SEQ ID NO: 706003 - DNA, 13 bp, C. elegans
attgtgatttttc

SEQ ID NO: 706004 - DNA, 13 bp, C. elegans
attgtgccttttt

SEQ ID NO: 706005 - DNA, 13 bp, C. elegans
attgtggaaattt

SEQ ID NO: 706006 - DNA, 13 bp, C. elegans
attgtgtaaaaat

SEQ ID NO: 706007 - DNA, 13 bp, C. elegans
attgtgtaatatt

SEQ ID NO: 706008 - DNA, 13 bp, C. elegans
attgtgtcgattt

SEQ ID NO: 706009 - DNA, 13 bp, C. elegans
attgtgtgaaaat

SEQ ID NO: 706010 - DNA, 13 bp, C. elegans
attgtgttaaaaa

SEQ ID NO: 706011 - DNA, 13 bp, C. elegans
attgtgttcaaaa

SEQ ID NO: 706012 - DNA, 13 bp, C. elegans
attgtgttcaatt

SEQ ID NO: 706013 - DNA, 13 bp, C. elegans
attgtgtttgaat

SEQ ID NO: 706014 - DNA, 13 bp, C. elegans
attgtgttttaaa

SEQ ID NO: 706015 - DNA, 13 bp, C. elegans
attgtgttttcaa

SEQ ID NO: 706016 - DNA, 13 bp, C. elegans
attgtgtttttgc

SEQ ID NO: 706017 - DNA, 13 bp, C. elegans
attgttacaaaat

SEQ ID NO: 706018 - DNA, 13 bp, C. elegans
attgttactgaaa

SEQ ID NO: 706019 - DNA, 13 bp, C. elegans
attgttagaattt

SEQ ID NO: 706020 - DNA, 13 bp, C. elegans
attgttatcaaaa

SEQ ID NO: 706021 - DNA, 13 bp, C. elegans
attgttatcaatt

SEQ ID NO: 706022 - DNA, 13 bp, C. elegans
attgttatgaaat

SEQ ID NO: 706023 - DNA, 13 bp, C. elegans
attgttattttca

SEQ ID NO: 706024 - DNA, 13 bp, C. elegans
attgttcaaaact

SEQ ID NO: 706025 - DNA, 13 bp, C. elegans
attgttcaaaatt

SEQ ID NO: 706026 - DNA, 13 bp, C. elegans
attgttcaaataa

SEQ ID NO: 706027 - DNA, 13 bp, C. elegans
attgttcaaattt

SEQ ID NO: 706028 - DNA, 13 bp, C. elegans
attgttcaagaaa

SEQ ID NO: 706029 - DNA, 13 bp, C. elegans
attgttcaatatt

SEQ ID NO: 706030 - DNA, 13 bp, C. elegans
attgttcagtttc

SEQ ID NO: 706031 - DNA, 13 bp, C. elegans
attgttcataaaa

SEQ ID NO: 706032 - DNA, 13 bp, C. elegans
attgttcattcaa

SEQ ID NO: 706033 - DNA, 13 bp, C. elegans
attgttcattgaa

SEQ ID NO: 706034 - DNA, 13 bp, C. elegans
attgttccaaatt

SEQ ID NO: 706035 - DNA, 13 bp, C. elegans
attgttccaattt

SEQ ID NO: 706036 - DNA, 13 bp, C. elegans
attgttctaaaat

SEQ ID NO: 706037 - DNA, 13 bp, C. elegans
attgttctaattt

SEQ ID NO: 706038 - DNA, 13 bp, C. elegans
attgttctgaaat

SEQ ID NO: 706039 - DNA, 13 bp, C. elegans
attgttctttgaa

SEQ ID NO: 706040 - DNA, 13 bp, C. elegans
attgttgacattt

SEQ ID NO: 706041 - DNA, 13 bp, C. elegans
attgttgcaaatt

SEQ ID NO: 706042 - DNA, 13 bp, C. elegans
attgttgcatttt

SEQ ID NO: 706043 - DNA, 13 bp, C. elegans
attgttgccaaaa

SEQ ID NO: 706044 - DNA, 13 bp, C. elegans
attgttggaaaat

SEQ ID NO: 706045 - DNA, 13 bp, C. elegans
attgttggaaatt

SEQ ID NO: 706046 - DNA, 13 bp, C. elegans
attgttgtaaatt

SEQ ID NO: 706047 - DNA, 13 bp, C. elegans
attgttgttcaaa

SEQ ID NO: 706048 - DNA, 13 bp, C. elegans
attgtttaatgca

SEQ ID NO: 706049 - DNA, 13 bp, C. elegans
attgtttaatttc

SEQ ID NO: 706050 - DNA, 13 bp, C. elegans
attgtttacattt

SEQ ID NO: 706051 - DNA, 13 bp, C. elegans
attgtttagaaat

SEQ ID NO: 706052 - DNA, 13 bp, C. elegans
attgtttatttca

SEQ ID NO: 706053 - DNA, 13 bp, C. elegans
attgtttcaaaag

SEQ ID NO: 706054 - DNA, 13 bp, C. elegans
attgtttcaaaat

SEQ ID NO: 706055 - DNA, 13 bp, C. elegans
attgtttcaaaca

SEQ ID NO: 706056 - DNA, 14 bp, C. elegans
attgtttcaattta

SEQ ID NO: 706057 - DNA, 13 bp, C. elegans
attgtttcattct

SEQ ID NO: 706058 - DNA, 13 bp, C. elegans
attgtttccattc

SEQ ID NO: 706059 - DNA, 13 bp, C. elegans
attgtttcccaca

SEQ ID NO: 706060 - DNA, 13 bp, C. elegans
attgtttcgattt

SEQ ID NO: 706061 - DNA, 13 bp, C. elegans
attgtttctagct

SEQ ID NO: 706062 - DNA, 13 bp, C. elegans
attgtttctgaaa

SEQ ID NO: 706063 - DNA, 13 bp, C. elegans
attgtttgaaaga

SEQ ID NO: 706064 - DNA, 13 bp, C. elegans
attgtttgaataa

SEQ ID NO: 706065 - DNA, 13 bp, C. elegans
attgtttgataaa

SEQ ID NO: 706066 - DNA, 13 bp, C. elegans
attgtttgcaaat

SEQ ID NO: 706067 - DNA, 13 bp, C. elegans
attgtttgcaatt

SEQ ID NO: 706068 - DNA, 13 bp, C. elegans
attgtttgccaaa

SEQ ID NO: 706069 - DNA, 13 bp, C. elegans
attgtttgtaaat

SEQ ID NO: 706070 - DNA, 13 bp, C. elegans
attgttttaaatc

SEQ ID NO: 706071 - DNA, 13 bp, C. elegans
attgttttattac

SEQ ID NO: 706072 - DNA, 13 bp, C. elegans
attgttttcaaac

SEQ ID NO: 706073 - DNA, 13 bp, C. elegans
attgttttcaatg

SEQ ID NO: 706074 - DNA, 13 bp, C. elegans
attgttttcaatt

SEQ ID NO: 706075 - DNA, 13 bp, C. elegans
attgttttcgatt

SEQ ID NO: 706076 - DNA, 13 bp, C. elegans
attgttttcggaa

SEQ ID NO: 706077 - DNA, 13 bp, C. elegans
attgttttctcaa

SEQ ID NO: 706078 - DNA, 13 bp, C. elegans
attgttttcttga

SEQ ID NO: 706079 - DNA, 13 bp, C. elegans
attgtttttccaa

SEQ ID NO: 706080 - DNA, 13 bp, C. elegans
attgtttttctca

SEQ ID NO: 706081 - DNA, 13 bp, C. elegans
attgtttttgaaa

SEQ ID NO: 706082 - DNA, 13 bp, C. elegans
attgtttttgtca

SEQ ID NO: 706083 - DNA, 13 bp, C. elegans
attgttttttcca

SEQ ID NO: 706084 - DNA, 13 bp, C. elegans
atttaaaaaatcg

SEQ ID NO: 706085 - DNA, 13 bp, C. elegans
atttaaaaacgtt

SEQ ID NO: 706086 - DNA, 13 bp, C. elegans
atttaaaaattcc

SEQ ID NO: 706087 - DNA, 13 bp, C. elegans
atttaaaactgaa

SEQ ID NO: 706088 - DNA, 13 bp, C. elegans
atttaaaagcaat

SEQ ID NO: 706089 - DNA, 13 bp, C. elegans
atttaaaatagga

SEQ ID NO: 706090 - DNA, 13 bp, C. elegans
atttaaaattgtc

SEQ ID NO: 706091 - DNA, 13 bp, C. elegans
atttaaacaattc

SEQ ID NO: 706092 - DNA, 13 bp, C. elegans
atttaaacattga

SEQ ID NO: 706093 - DNA, 13 bp, C. elegans
atttaaacgaaaa

SEQ ID NO: 706094 - DNA, 13 bp, C. elegans
atttaaagcaaat

SEQ ID NO: 706095 - DNA, 13 bp, C. elegans
atttaaagctttt

SEQ ID NO: 706096 - DNA, 13 bp, C. elegans
atttaaaggcaca

SEQ ID NO: 706097 - DNA, 13 bp, C. elegans
atttaaataggaa

SEQ ID NO: 706098 - DNA, 13 bp, C. elegans
atttaaatgtgaa

SEQ ID NO: 706099 - DNA, 13 bp, C. elegans
atttaaatgtgga

SEQ ID NO: 706100 - DNA, 13 bp, C. elegans
atttaaatgtgtt

SEQ ID NO: 706101 - DNA, 13 bp, C. elegans
atttaaatttccc

SEQ ID NO: 706102 - DNA, 13 bp, C. elegans
atttaacaacaat

SEQ ID NO: 706103 - DNA, 13 bp, C. elegans
atttaacaatttc

SEQ ID NO: 706104 - DNA, 13 bp, C. elegans
atttaacacaatt

SEQ ID NO: 706105 - DNA, 13 bp, C. elegans
atttaacagtttt

SEQ ID NO: 706106 - DNA, 13 bp, C. elegans
atttaacatttga

SEQ ID NO: 706107 - DNA, 13 bp, C. elegans
atttaactgaaaa

SEQ ID NO: 706108 - DNA, 13 bp, C. elegans
atttaacttcaaa

SEQ ID NO: 706109 - DNA, 13 bp, C. elegans
atttaactttcag

SEQ ID NO: 706110 - DNA, 13 bp, C. elegans
atttaagaaaaca

SEQ ID NO: 706111 - DNA, 13 bp, C. elegans
atttaagcaattt

SEQ ID NO: 706112 - DNA, 13 bp, C. elegans
atttaagccaaat

SEQ ID NO: 706113 - DNA, 13 bp, C. elegans
atttaagtcattt

SEQ ID NO: 706114 - DNA, 13 bp, C. elegans
atttaatagtttc

SEQ ID NO: 706115 - DNA, 13 bp, C. elegans
atttaatgaaaac

SEQ ID NO: 706116 - DNA, 13 bp, C. elegans
atttaatggaaat

SEQ ID NO: 706117 - DNA, 13 bp, C. elegans
atttaatggattt

SEQ ID NO: 706118 - DNA, 13 bp, C. elegans
atttaatgttttc

SEQ ID NO: 706119 - DNA, 13 bp, C. elegans
atttaattcgaat

SEQ ID NO: 706120 - DNA, 13 bp, C. elegans
atttaattgagaa

SEQ ID NO: 706121 - DNA, 13 bp, C. elegans
atttaattgttct

SEQ ID NO: 706122 - DNA, 13 bp, C. elegans
atttaatttcaca

SEQ ID NO: 706123 - DNA, 13 bp, C. elegans
atttaatttcgtt

SEQ ID NO: 706124 - DNA, 13 bp, C. elegans
atttaatttgaac

SEQ ID NO: 706125 - DNA, 13 bp, C. elegans
atttaattttcag

SEQ ID NO: 706126 - DNA, 13 bp, C. elegans
atttaattttgct

SEQ ID NO: 706127 - DNA, 13 bp, C. elegans
atttacaaaaatc

SEQ ID NO: 706128 - DNA, 13 bp, C. elegans
atttacaaaatac

SEQ ID NO: 706129 - DNA, 13 bp, C. elegans
atttacaaattac

SEQ ID NO: 706130 - DNA, 13 bp, C. elegans
atttacaacaatt

SEQ ID NO: 706131 - DNA, 13 bp, C. elegans
atttacaactttt

SEQ ID NO: 706132 - DNA, 13 bp, C. elegans
atttacaagtttt

SEQ ID NO: 706133 - DNA, 13 bp, C. elegans
atttacaattgtt

SEQ ID NO: 706134 - DNA, 13 bp, C. elegans
atttacagaaaaa

SEQ ID NO: 706135 - DNA, 13 bp, C. elegans
atttacagtaatt

SEQ ID NO: 706136 - DNA, 13 bp, C. elegans
atttacagtttaa

SEQ ID NO: 706137 - DNA, 13 bp, C. elegans
atttacagttttg

SEQ ID NO: 706138 - DNA, 13 bp, C. elegans
atttacatacatt

SEQ ID NO: 706139 - DNA, 13 bp, C. elegans
atttacatgtttt

SEQ ID NO: 706140 - DNA, 13 bp, C. elegans
atttacatttgca

SEQ ID NO: 706141 - DNA, 13 bp, C. elegans
atttacatttttg

SEQ ID NO: 706142 - DNA, 13 bp, C. elegans
atttaccaaaaac

SEQ ID NO: 706143 - DNA, 13 bp, C. elegans
atttaccaaaaat

SEQ ID NO: 706144 - DNA, 13 bp, C. elegans
atttaccaaattt

SEQ ID NO: 706145 - DNA, 13 bp, C. elegans
atttaccaacttt

SEQ ID NO: 706146 - DNA, 13 bp, C. elegans
atttaccaatttt

SEQ ID NO: 706147 - DNA, 13 bp, C. elegans
atttaccattaat

SEQ ID NO: 706148 - DNA, 13 bp, C. elegans
atttaccgaaaaa

SEQ ID NO: 706149 - DNA, 13 bp, C. elegans
atttaccgccaaa

SEQ ID NO: 706150 - DNA, 13 bp, C. elegans
atttaccggaaaa

SEQ ID NO: 706151 - DNA, 13 bp, C. elegans
atttaccggaaat

SEQ ID NO: 706152 - DNA, 13 bp, C. elegans
atttaccggaagt

SEQ ID NO: 706153 - DNA, 13 bp, C. elegans
atttaccggtttg

SEQ ID NO: 706154 - DNA, 13 bp, C. elegans
atttaccgtattt

SEQ ID NO: 706155 - DNA, 13 bp, C. elegans
atttacgaagaaa

SEQ ID NO: 706156 - DNA, 13 bp, C. elegans
atttacggaaaaa

SEQ ID NO: 706157 - DNA, 13 bp, C. elegans
atttacggaaatc

SEQ ID NO: 706158 - DNA, 13 bp, C. elegans
atttacggaaatt

SEQ ID NO: 706159 - DNA, 13 bp, C. elegans
atttacggagttt

SEQ ID NO: 706160 - DNA, 13 bp, C. elegans
atttacgggatcg

SEQ ID NO: 706161 - DNA, 13 bp, C. elegans
atttacgggattt

SEQ ID NO: 706162 - DNA, 13 bp, C. elegans
atttacgggcttg

SEQ ID NO: 706163 - DNA, 13 bp, C. elegans
atttacggtttca

SEQ ID NO: 706164 - DNA, 13 bp, C. elegans
atttacggttttg

SEQ ID NO: 706165 - DNA, 13 bp, C. elegans
atttactatcaaa

SEQ ID NO: 706166 - DNA, 13 bp, C. elegans
atttactcaattt

SEQ ID NO: 706167 - DNA, 13 bp, C. elegans
atttactcgattt

SEQ ID NO: 706168 - DNA, 13 bp, C. elegans
atttactgaaaaa

SEQ ID NO: 706169 - DNA, 13 bp, C. elegans
atttactgatttt

SEQ ID NO: 706170 - DNA, 13 bp, C. elegans
atttactgcaaaa

SEQ ID NO: 706171 - DNA, 13 bp, C. elegans
atttactggaaat

SEQ ID NO: 706172 - DNA, 13 bp, C. elegans
atttactggaatt

SEQ ID NO: 706173 - DNA, 13 bp, C. elegans
atttactgtattt

SEQ ID NO: 706174 - DNA, 13 bp, C. elegans
atttacttcaatt

SEQ ID NO: 706175 - DNA, 13 bp, C. elegans
atttacttgaaat

SEQ ID NO: 706176 - DNA, 13 bp, C. elegans
atttactttgaaa

SEQ ID NO: 706177 - DNA, 13 bp, C. elegans
atttactttgatt

SEQ ID NO: 706178 - DNA, 13 bp, C. elegans
atttacttttcaa

SEQ ID NO: 706179 - DNA, 13 bp, C. elegans
atttacttttgat

SEQ ID NO: 706180 - DNA, 13 bp, C. elegans
atttagaaaatga

SEQ ID NO: 706181 - DNA, 13 bp, C. elegans
atttagaagattt

SEQ ID NO: 706182 - DNA, 13 bp, C. elegans
atttagaatgttt

SEQ ID NO: 706183 - DNA, 13 bp, C. elegans
atttagacaaaat

SEQ ID NO: 706184 - DNA, 13 bp, C. elegans
atttagacaactt

SEQ ID NO: 706185 - DNA, 13 bp, C. elegans
atttagacgcaga

SEQ ID NO: 706186 - DNA, 13 bp, C. elegans
atttagagacaaa

SEQ ID NO: 706187 - DNA, 13 bp, C. elegans
atttagagagaaa

SEQ ID NO: 706188 - DNA, 13 bp, C. elegans
atttagatatttc

SEQ ID NO: 706189 - DNA, 13 bp, C. elegans
atttagatctttt

SEQ ID NO: 706190 - DNA, 14 bp, C. elegans
atttagcagaccca

SEQ ID NO: 706191 - DNA, 13 bp, C. elegans
atttagcagtttt

SEQ ID NO: 706192 - DNA, 13 bp, C. elegans
atttagcatattt

SEQ ID NO: 706193 - DNA, 13 bp, C. elegans
atttagcgaaatt

SEQ ID NO: 706194 - DNA, 13 bp, C. elegans
atttagctcaaaa

SEQ ID NO: 706195 - DNA, 13 bp, C. elegans
atttaggttttct

SEQ ID NO: 706196 - DNA, 13 bp, C. elegans
atttagtaaaatg

SEQ ID NO: 706197 - DNA, 13 bp, C. elegans
atttagttgtaaa

SEQ ID NO: 706198 - DNA, 13 bp, C. elegans
atttagtttcaaa

SEQ ID NO: 706199 - DNA, 13 bp, C. elegans
atttagttttcac

SEQ ID NO: 706200 - DNA, 13 bp, C. elegans
atttataaacgtt

SEQ ID NO: 706201 - DNA, 13 bp, C. elegans
atttataaagttc

SEQ ID NO: 706202 - DNA, 13 bp, C. elegans
atttatacagttt

SEQ ID NO: 706203 - DNA, 13 bp, C. elegans
atttatacatttc

SEQ ID NO: 706204 - DNA, 13 bp, C. elegans
atttatactttca

SEQ ID NO: 706205 - DNA, 13 bp, C. elegans
atttatagtttga

SEQ ID NO: 706206 - DNA, 13 bp, C. elegans
atttatatgtgta

SEQ ID NO: 706207 - DNA, 13 bp, C. elegans
atttatattcggt

SEQ ID NO: 706208 - DNA, 13 bp, C. elegans
atttatattctca

SEQ ID NO: 706209 - DNA, 13 bp, C. elegans
atttatcaaacaa

SEQ ID NO: 706210 - DNA, 13 bp, C. elegans
atttatcaatcaa

SEQ ID NO: 706211 - DNA, 13 bp, C. elegans
atttatcaattca

SEQ ID NO: 706212 - DNA, 13 bp, C. elegans
atttatcaattga

SEQ ID NO: 706213 - DNA, 13 bp, C. elegans
atttatcacaaaa

SEQ ID NO: 706214 - DNA, 13 bp, C. elegans
atttatcacaaat

SEQ ID NO: 706215 - DNA, 13 bp, C. elegans
atttatcacattt

SEQ ID NO: 706216 - DNA, 13 bp, C. elegans
atttatcagtttc

SEQ ID NO: 706217 - DNA, 13 bp, C. elegans
atttatcagtttt

SEQ ID NO: 706218 - DNA, 13 bp, C. elegans
atttatcatcatt

SEQ ID NO: 706219 - DNA, 13 bp, C. elegans
atttatcatgttt

SEQ ID NO: 706220 - DNA, 13 bp, C. elegans
atttatccaaatt

SEQ ID NO: 706221 - DNA, 13 bp, C. elegans
atttatccaattt

SEQ ID NO: 706222 - DNA, 13 bp, C. elegans
atttatcgaaatt

SEQ ID NO: 706223 - DNA, 13 bp, C. elegans
atttatcgataaa

SEQ ID NO: 706224 - DNA, 13 bp, C. elegans
atttatcgatttg

SEQ ID NO: 706225 - DNA, 13 bp, C. elegans
atttatcgatttt

SEQ ID NO: 706226 - DNA, 13 bp, C. elegans
atttatcgctttt

SEQ ID NO: 706227 - DNA, 13 bp, C. elegans
atttatcggaaat

SEQ ID NO: 706228 - DNA, 13 bp, C. elegans
atttatctattca

SEQ ID NO: 706229 - DNA, 13 bp, C. elegans
atttatctccaaa

SEQ ID NO: 706230 - DNA, 13 bp, C. elegans
atttatctgaaaa

SEQ ID NO: 706231 - DNA, 13 bp, C. elegans
atttatctgtaaa

SEQ ID NO: 706232 - DNA, 13 bp, C. elegans
atttatgaattca

SEQ ID NO: 706233 - DNA, 13 bp, C. elegans
atttatgacaaaa

SEQ ID NO: 706234 - DNA, 13 bp, C. elegans
atttatgagcatt

SEQ ID NO: 706235 - DNA, 13 bp, C. elegans
atttatgagtttc

SEQ ID NO: 706236 - DNA, 13 bp, C. elegans
atttatgatttct

SEQ ID NO: 706237 - DNA, 13 bp, C. elegans
atttatgattttc

SEQ ID NO: 706238 - DNA, 13 bp, C. elegans
atttatggaaaaa

SEQ ID NO: 706239 - DNA, 13 bp, C. elegans
atttatggaaaat

SEQ ID NO: 706240 - DNA, 13 bp, C. elegans
atttatggaaatt

SEQ ID NO: 706241 - DNA, 13 bp, C. elegans
atttatggaattt

SEQ ID NO: 706242 - DNA, 13 bp, C. elegans
atttatggagaaa

SEQ ID NO: 706243 - DNA, 13 bp, C. elegans
atttatgggattt

SEQ ID NO: 706244 - DNA, 13 bp, C. elegans
atttatggtcttt

SEQ ID NO: 706245 - DNA, 13 bp, C. elegans
atttatgtatatg

SEQ ID NO: 706246 - DNA, 13 bp, C. elegans
atttatgtatgta

SEQ ID NO: 706247 - DNA, 13 bp, C. elegans
atttatgtcaaaa

SEQ ID NO: 706248 - DNA, 13 bp, C. elegans
atttatgtcattt

SEQ ID NO: 706249 - DNA, 13 bp, C. elegans
atttatgtgtttc

SEQ ID NO: 706250 - DNA, 13 bp, C. elegans
atttattacgatt

SEQ ID NO: 706251 - DNA, 13 bp, C. elegans
atttattacgctc

SEQ ID NO: 706252 - DNA, 13 bp, C. elegans
atttattactgtt

SEQ ID NO: 706253 - DNA, 13 bp, C. elegans
atttattaggaaa

SEQ ID NO: 706254 - DNA, 13 bp, C. elegans
atttattatggaa

SEQ ID NO: 706255 - DNA, 13 bp, C. elegans
atttattcaaaag

SEQ ID NO: 706256 - DNA, 13 bp, C. elegans
atttattcagatt

SEQ ID NO: 706257 - DNA, 13 bp, C. elegans
atttattcagttt

SEQ ID NO: 706258 - DNA, 13 bp, C. elegans
atttattcatatg

SEQ ID NO: 706259 - DNA, 13 bp, C. elegans
atttattcattga

SEQ ID NO: 706260 - DNA, 13 bp, C. elegans
atttattccaaaa

SEQ ID NO: 706261 - DNA, 13 bp, C. elegans
atttattcccaaa

SEQ ID NO: 706262 - DNA, 13 bp, C. elegans
atttattccgaag

SEQ ID NO: 706263 - DNA, 13 bp, C. elegans
atttattcctaaa

SEQ ID NO: 706264 - DNA, 13 bp, C. elegans
atttattcgaatt

SEQ ID NO: 706265 - DNA, 13 bp, C. elegans
atttattctcaaa

SEQ ID NO: 706266 - DNA, 13 bp, C. elegans
atttattctcgtt

SEQ ID NO: 706267 - DNA, 13 bp, C. elegans
atttattctgatt

SEQ ID NO: 706268 - DNA, 13 bp, C. elegans
atttattgacttt

SEQ ID NO: 706269 - DNA, 13 bp, C. elegans
atttattgagaaa

SEQ ID NO: 706270 - DNA, 13 bp, C. elegans
atttattgataac

SEQ ID NO: 706271 - DNA, 13 bp, C. elegans
atttattgataga

SEQ ID NO: 706272 - DNA, 13 bp, C. elegans
atttattgattct

SEQ ID NO: 706273 - DNA, 13 bp, C. elegans
atttattgcaaaa

SEQ ID NO: 706274 - DNA, 13 bp, C. elegans
atttattgcatgt

SEQ ID NO: 706275 - DNA, 13 bp, C. elegans
atttattgcattt

SEQ ID NO: 706276 - DNA, 13 bp, C. elegans
atttattggaaaa

SEQ ID NO: 706277 - DNA, 13 bp, C. elegans
atttattgttgaa

SEQ ID NO: 706278 - DNA, 13 bp, C. elegans
atttattgtttca

SEQ ID NO: 706279 - DNA, 13 bp, C. elegans
atttatttatcag

SEQ ID NO: 706280 - DNA, 13 bp, C. elegans
atttatttatcga

SEQ ID NO: 706281 - DNA, 13 bp, C. elegans
atttatttcagat

SEQ ID NO: 706282 - DNA, 13 bp, C. elegans
atttatttcagtt

SEQ ID NO: 706283 - DNA, 13 bp, C. elegans
atttatttcgaaa

SEQ ID NO: 706284 - DNA, 13 bp, C. elegans
atttatttctgaa

SEQ ID NO: 706285 - DNA, 13 bp, C. elegans
atttatttgagca

SEQ ID NO: 706286 - DNA, 13 bp, C. elegans
atttatttgcaaa

SEQ ID NO: 706287 - DNA, 13 bp, C. elegans
atttatttgcatt

SEQ ID NO: 706288 - DNA, 13 bp, C. elegans
atttatttgctca

SEQ ID NO: 706289 - DNA, 13 bp, C. elegans
atttatttgtcat

SEQ ID NO: 706290 - DNA, 13 bp, C. elegans
atttatttgtgaa

SEQ ID NO: 706291 - DNA, 13 bp, C. elegans
atttattttacga

SEQ ID NO: 706292 - DNA, 13 bp, C. elegans
atttattttcaac

SEQ ID NO: 706293 - DNA, 13 bp, C. elegans
atttattttcaga

SEQ ID NO: 706294 - DNA, 13 bp, C. elegans
atttattttctgc

SEQ ID NO: 706295 - DNA, 13 bp, C. elegans
atttattttgact

SEQ ID NO: 706296 - DNA, 13 bp, C. elegans
atttattttgagc

SEQ ID NO: 706297 - DNA, 13 bp, C. elegans
atttattttgtca

SEQ ID NO: 706298 - DNA, 13 bp, C. elegans
atttatttttcag

SEQ ID NO: 706299 - DNA, 13 bp, C. elegans
atttatttttgca

SEQ ID NO: 706300 - DNA, 13 bp, C. elegans
atttcaaaaaact

SEQ ID NO: 706301 - DNA, 13 bp, C. elegans
atttcaaaaaagt

SEQ ID NO: 706302 - DNA, 14 bp, C. elegans
atttcaaaaaatca

SEQ ID NO: 706303 - DNA, 13 bp, C. elegans
atttcaaaaagaa

SEQ ID NO: 706304 - DNA, 13 bp, C. elegans
atttcaaaacata

SEQ ID NO: 706305 - DNA, 13 bp, C. elegans
atttcaaaactta

SEQ ID NO: 706306 - DNA, 13 bp, C. elegans
atttcaaaacttt

SEQ ID NO: 706307 - DNA, 13 bp, C. elegans
atttcaaaagatt

SEQ ID NO: 706308 - DNA, 13 bp, C. elegans
atttcaaaagttt

SEQ ID NO: 706309 - DNA, 13 bp, C. elegans
atttcaaaatact

SEQ ID NO: 706310 - DNA, 13 bp, C. elegans
atttcaaaatcaa

SEQ ID NO: 706311 - DNA, 13 bp, C. elegans
atttcaaaatgaa

SEQ ID NO: 706312 - DNA, 13 bp, C. elegans
atttcaaaatgag

SEQ ID NO: 706313 - DNA, 13 bp, C. elegans
atttcaaaatgtg

SEQ ID NO: 706314 - DNA, 13 bp, C. elegans
atttcaaaattac

SEQ ID NO: 706315 - DNA, 13 bp, C. elegans
atttcaaaattca

SEQ ID NO: 706316 - DNA, 13 bp, C. elegans
atttcaaaattct

SEQ ID NO: 706317 - DNA, 13 bp, C. elegans
atttcaaacaaca

SEQ ID NO: 706318 - DNA, 13 bp, C. elegans
atttcaaacagtt

SEQ ID NO: 706319 - DNA, 13 bp, C. elegans
atttcaaacattc

SEQ ID NO: 706320 - DNA, 13 bp, C. elegans
atttcaaaccttt

SEQ ID NO: 706321 - DNA, 13 bp, C. elegans
atttcaaactatc

SEQ ID NO: 706322 - DNA, 13 bp, C. elegans
atttcaaactggc

SEQ ID NO: 706323 - DNA, 13 bp, C. elegans
atttcaaactttg

SEQ ID NO: 706324 - DNA, 13 bp, C. elegans
atttcaaagaaat

SEQ ID NO: 706325 - DNA, 13 bp, C. elegans
atttcaaagaatc

SEQ ID NO: 706326 - DNA, 13 bp, C. elegans
atttcaaagtaat

SEQ ID NO: 706327 - DNA, 13 bp, C. elegans
atttcaaagtctt

SEQ ID NO: 706328 - DNA, 13 bp, C. elegans
atttcaaagtgtt

SEQ ID NO: 706329 - DNA, 13 bp, C. elegans
atttcaaagttgg

SEQ ID NO: 706330 - DNA, 13 bp, C. elegans
atttcaaagtttg

SEQ ID NO: 706331 - DNA, 13 bp, C. elegans
atttcaaagtttt

SEQ ID NO: 706332 - DNA, 13 bp, C. elegans
atttcaaatcaaa

SEQ ID NO: 706333 - DNA, 13 bp, C. elegans
atttcaaatcaac

SEQ ID NO: 706334 - DNA, 13 bp, C. elegans
atttcaaatccaa

SEQ ID NO: 706335 - DNA, 13 bp, C. elegans
atttcaaatctca

SEQ ID NO: 706336 - DNA, 13 bp, C. elegans
atttcaaatctct

SEQ ID NO: 706337 - DNA, 13 bp, C. elegans
atttcaaatctga

SEQ ID NO: 706338 - DNA, 13 bp, C. elegans
atttcaaatgaaa

SEQ ID NO: 706339 - DNA, 13 bp, C. elegans
atttcaaatgatg

SEQ ID NO: 706340 - DNA, 13 bp, C. elegans
atttcaaatgatt

SEQ ID NO: 706341 - DNA, 13 bp, C. elegans
atttcaaatgtct

SEQ ID NO: 706342 - DNA, 13 bp, C. elegans
atttcaaatgtga

SEQ ID NO: 706343 - DNA, 13 bp, C. elegans
atttcaaatgtta

SEQ ID NO: 706344 - DNA, 13 bp, C. elegans
atttcaaatgttt

SEQ ID NO: 706345 - DNA, 13 bp, C. elegans
atttcaaattact

SEQ ID NO: 706346 - DNA, 13 bp, C. elegans
atttcaaattcca

SEQ ID NO: 706347 - DNA, 13 bp, C. elegans
atttcaaattcta

SEQ ID NO: 706348 - DNA, 13 bp, C. elegans
atttcaaattgca

SEQ ID NO: 706349 - DNA, 13 bp, C. elegans
atttcaaattttg

SEQ ID NO: 706350 - DNA, 13 bp, C. elegans
atttcaacaagtt

SEQ ID NO: 706351 - DNA, 13 bp, C. elegans
atttcaacaattg

SEQ ID NO: 706352 - DNA, 13 bp, C. elegans
atttcaacaattt

SEQ ID NO: 706353 - DNA, 13 bp, C. elegans
atttcaacacatt

SEQ ID NO: 706354 - DNA, 13 bp, C. elegans
atttcaacatttt

SEQ ID NO: 706355 - DNA, 13 bp, C. elegans
atttcaactaatt

SEQ ID NO: 706356 - DNA, 13 bp, C. elegans
atttcaactgttt

SEQ ID NO: 706357 - DNA, 13 bp, C. elegans
atttcaacttaaa

SEQ ID NO: 706358 - DNA, 13 bp, C. elegans
atttcaacttatt

SEQ ID NO: 706359 - DNA, 13 bp, C. elegans
atttcaactttgt

SEQ ID NO: 706360 - DNA, 13 bp, C. elegans
atttcaacttttc

SEQ ID NO: 706361 - DNA, 13 bp, C. elegans
atttcaagaaaac

SEQ ID NO: 706362 - DNA, 13 bp, C. elegans
atttcaagaaaat

SEQ ID NO: 706363 - DNA, 13 bp, C. elegans
atttcaagaaatg

SEQ ID NO: 706364 - DNA, 13 bp, C. elegans
atttcaagaaatt

SEQ ID NO: 706365 - DNA, 13 bp, C. elegans
atttcaagaagtt

SEQ ID NO: 706366 - DNA, 13 bp, C. elegans
atttcaagaatta

SEQ ID NO: 706367 - DNA, 13 bp, C. elegans
atttcaagacaaa

SEQ ID NO: 706368 - DNA, 13 bp, C. elegans
atttcaagagtta

SEQ ID NO: 706369 - DNA, 13 bp, C. elegans
atttcaagattct

SEQ ID NO: 706370 - DNA, 13 bp, C. elegans
atttcaagatttc

SEQ ID NO: 706371 - DNA, 13 bp, C. elegans
atttcaagatttt

SEQ ID NO: 706372 - DNA, 13 bp, C. elegans
atttcaagcaaat

SEQ ID NO: 706373 - DNA, 13 bp, C. elegans
atttcaagcaatt

SEQ ID NO: 706374 - DNA, 13 bp, C. elegans
atttcaagccttt

SEQ ID NO: 706375 - DNA, 13 bp, C. elegans
atttcaagctcaa

SEQ ID NO: 706376 - DNA, 13 bp, C. elegans
atttcaagctctt

SEQ ID NO: 706377 - DNA, 13 bp, C. elegans
atttcaagcttaa

SEQ ID NO: 706378 - DNA, 13 bp, C. elegans
atttcaagcttca

SEQ ID NO: 706379 - DNA, 13 bp, C. elegans
atttcaagcttga

SEQ ID NO: 706380 - DNA, 13 bp, C. elegans
atttcaaggagat

SEQ ID NO: 706381 - DNA, 13 bp, C. elegans
atttcaagtattt

SEQ ID NO: 706382 - DNA, 13 bp, C. elegans
atttcaagtcgat

SEQ ID NO: 706383 - DNA, 13 bp, C. elegans
atttcaagtgttt

SEQ ID NO: 706384 - DNA, 13 bp, C. elegans
atttcaagttaaa

SEQ ID NO: 706385 - DNA, 13 bp, C. elegans
atttcaagttgtt

SEQ ID NO: 706386 - DNA, 13 bp, C. elegans
atttcaagtttct

SEQ ID NO: 706387 - DNA, 13 bp, C. elegans
atttcaagtttta

SEQ ID NO: 706388 - DNA, 13 bp, C. elegans
atttcaataacat

SEQ ID NO: 706389 - DNA, 13 bp, C. elegans
atttcaataagtt

SEQ ID NO: 706390 - DNA, 13 bp, C. elegans
atttcaatagaaa

SEQ ID NO: 706391 - DNA, 13 bp, C. elegans
atttcaatagttt

SEQ ID NO: 706392 - DNA, 13 bp, C. elegans
atttcaatatgat

SEQ ID NO: 706393 - DNA, 13 bp, C. elegans
atttcaatattgt

SEQ ID NO: 706394 - DNA, 13 bp, C. elegans
atttcaatcaaat

SEQ ID NO: 706395 - DNA, 13 bp, C. elegans
atttcaatcaata

SEQ ID NO: 706396 - DNA, 13 bp, C. elegans
atttcaatcagtt

SEQ ID NO: 706397 - DNA, 13 bp, C. elegans
atttcaatccaaa

SEQ ID NO: 706398 - DNA, 13 bp, C. elegans
atttcaatcgaat

SEQ ID NO: 706399 - DNA, 13 bp, C. elegans
atttcaatcgttt

SEQ ID NO: 706400 - DNA, 13 bp, C. elegans
atttcaatctcaa

SEQ ID NO: 706401 - DNA, 13 bp, C. elegans
atttcaatgaaaa

SEQ ID NO: 706402 - DNA, 13 bp, C. elegans
atttcaatgagaa

SEQ ID NO: 706403 - DNA, 13 bp, C. elegans
atttcaatgataa

SEQ ID NO: 706404 - DNA, 13 bp, C. elegans
atttcaatgatca

SEQ ID NO: 706405 - DNA, 13 bp, C. elegans
atttcaatgattt

SEQ ID NO: 706406 - DNA, 13 bp, C. elegans
atttcaatggtgt

SEQ ID NO: 706407 - DNA, 13 bp, C. elegans
atttcaatgtaaa

SEQ ID NO: 706408 - DNA, 13 bp, C. elegans
atttcaatgttca

SEQ ID NO: 706409 - DNA, 13 bp, C. elegans
atttcaatgtttg

SEQ ID NO: 706410 - DNA, 14 bp, C. elegans
atttcaatgttttc

SEQ ID NO: 706411 - DNA, 13 bp, C. elegans
atttcaattaaag

SEQ ID NO: 706412 - DNA, 13 bp, C. elegans
atttcaattacgg

SEQ ID NO: 706413 - DNA, 13 bp, C. elegans
atttcaattagtt

SEQ ID NO: 706414 - DNA, 13 bp, C. elegans
atttcaattcaaa

SEQ ID NO: 706415 - DNA, 13 bp, C. elegans
atttcaattccca

SEQ ID NO: 706416 - DNA, 13 bp, C. elegans
atttcaattctaa

SEQ ID NO: 706417 - DNA, 13 bp, C. elegans
atttcaattgaaa

SEQ ID NO: 706418 - DNA, 13 bp, C. elegans
atttcaattgatt

SEQ ID NO: 706419 - DNA, 13 bp, C. elegans
atttcaattgttt

SEQ ID NO: 706420 - DNA, 13 bp, C. elegans
atttcaatttcaa

SEQ ID NO: 706421 - DNA, 13 bp, C. elegans
atttcaatttcag

SEQ ID NO: 706422 - DNA, 13 bp, C. elegans
atttcaatttcca

SEQ ID NO: 706423 - DNA, 13 bp, C. elegans
atttcaatttccc

SEQ ID NO: 706424 - DNA, 13 bp, C. elegans
atttcaatttcga

SEQ ID NO: 706425 - DNA, 13 bp, C. elegans
atttcaatttctc

SEQ ID NO: 706426 - DNA, 13 bp, C. elegans
atttcacaaaaat

SEQ ID NO: 706427 - DNA, 13 bp, C. elegans
atttcacaaacat

SEQ ID NO: 706428 - DNA, 13 bp, C. elegans
atttcacaaattt

SEQ ID NO: 706429 - DNA, 13 bp, C. elegans
atttcacaacata

SEQ ID NO: 706430 - DNA, 13 bp, C. elegans
atttcacaatatt

SEQ ID NO: 706431 - DNA, 14 bp, C. elegans
atttcacaattttc

SEQ ID NO: 706432 - DNA, 13 bp, C. elegans
atttcacactaaa

SEQ ID NO: 706433 - DNA, 13 bp, C. elegans
atttcacactgaa

SEQ ID NO: 706434 - DNA, 13 bp, C. elegans
atttcacactttt

SEQ ID NO: 706435 - DNA, 13 bp, C. elegans
atttcacagaaaa

SEQ ID NO: 706436 - DNA, 13 bp, C. elegans
atttcacagtttt

SEQ ID NO: 706437 - DNA, 13 bp, C. elegans
atttcacatggtt

SEQ ID NO: 706438 - DNA, 13 bp, C. elegans
atttcacattgtt

SEQ ID NO: 706439 - DNA, 13 bp, C. elegans
atttcacatttct

SEQ ID NO: 706440 - DNA, 13 bp, C. elegans
atttcaccaaaaa

SEQ ID NO: 706441 - DNA, 13 bp, C. elegans
atttcaccaaatt

SEQ ID NO: 706442 - DNA, 13 bp, C. elegans
atttcaccaattt

SEQ ID NO: 706443 - DNA, 13 bp, C. elegans
atttcaccagaaa

SEQ ID NO: 706444 - DNA, 13 bp, C. elegans
atttcaccgaaaa

SEQ ID NO: 706445 - DNA, 13 bp, C. elegans
atttcacgaaaat

SEQ ID NO: 706446 - DNA, 13 bp, C. elegans
atttcacgccaaa

SEQ ID NO: 706447 - DNA, 13 bp, C. elegans
atttcactaattt

SEQ ID NO: 706448 - DNA, 13 bp, C. elegans
atttcactacaaa

SEQ ID NO: 706449 - DNA, 13 bp, C. elegans
atttcactatttc

SEQ ID NO: 706450 - DNA, 13 bp, C. elegans
atttcactcaaaa

SEQ ID NO: 706451 - DNA, 13 bp, C. elegans
atttcactctttc

SEQ ID NO: 706452 - DNA, 13 bp, C. elegans
atttcactgattt

SEQ ID NO: 706453 - DNA, 13 bp, C. elegans
atttcactgtttc

SEQ ID NO: 706454 - DNA, 13 bp, C. elegans
atttcactttcca

SEQ ID NO: 706455 - DNA, 13 bp, C. elegans
atttcacttttga

SEQ ID NO: 706456 - DNA, 13 bp, C. elegans
atttcactttttg

SEQ ID NO: 706457 - DNA, 13 bp, C. elegans
atttcagaaaaaa

SEQ ID NO: 706458 - DNA, 13 bp, C. elegans
atttcagaaaatc

SEQ ID NO: 706459 - DNA, 13 bp, C. elegans
atttcagaaaatg

SEQ ID NO: 706460 - DNA, 13 bp, C. elegans
atttcagaaaatt

SEQ ID NO: 706461 - DNA, 13 bp, C. elegans
atttcagaaatca

SEQ ID NO: 706462 - DNA, 13 bp, C. elegans
atttcagaaattc

SEQ ID NO: 706463 - DNA, 13 bp, C. elegans
atttcagaagaaa

SEQ ID NO: 706464 - DNA, 13 bp, C. elegans
atttcagaagata

SEQ ID NO: 706465 - DNA, 13 bp, C. elegans
atttcagaagttc

SEQ ID NO: 706466 - DNA, 13 bp, C. elegans
atttcagaagttt

SEQ ID NO: 706467 - DNA, 13 bp, C. elegans
atttcagaattat

SEQ ID NO: 706468 - DNA, 13 bp, C. elegans
atttcagaattgt

SEQ ID NO: 706469 - DNA, 13 bp, C. elegans
atttcagaatttt

SEQ ID NO: 706470 - DNA, 13 bp, C. elegans
atttcagacaaat

SEQ ID NO: 706471 - DNA, 13 bp, C. elegans
atttcagacattt

SEQ ID NO: 706472 - DNA, 13 bp, C. elegans
atttcagagaaat

SEQ ID NO: 706473 - DNA, 13 bp, C. elegans
atttcagagaatt

SEQ ID NO: 706474 - DNA, 13 bp, C. elegans
atttcagagctct

SEQ ID NO: 706475 - DNA, 13 bp, C. elegans
atttcagagtcag

SEQ ID NO: 706476 - DNA, 13 bp, C. elegans
atttcagagtttt

SEQ ID NO: 706477 - DNA, 13 bp, C. elegans
atttcagataaat

SEQ ID NO: 706478 - DNA, 13 bp, C. elegans
atttcagataatt

SEQ ID NO: 706479 - DNA, 13 bp, C. elegans
atttcagatcaaa

SEQ ID NO: 706480 - DNA, 13 bp, C. elegans
atttcagatttca

SEQ ID NO: 706481 - DNA, 14 bp, C. elegans
atttcagatttttc

SEQ ID NO: 706482 - DNA, 13 bp, C. elegans
atttcagcaattt

SEQ ID NO: 706483 - DNA, 13 bp, C. elegans
atttcagcttaaa

SEQ ID NO: 706484 - DNA, 13 bp, C. elegans
atttcagcttcaa

SEQ ID NO: 706485 - DNA, 13 bp, C. elegans
atttcagctttaa

SEQ ID NO: 706486 - DNA, 13 bp, C. elegans
atttcaggaaaat

SEQ ID NO: 706487 - DNA, 13 bp, C. elegans
atttcaggccaaa

SEQ ID NO: 706488 - DNA, 13 bp, C. elegans
atttcaggctcaa

SEQ ID NO: 706489 - DNA, 13 bp, C. elegans
atttcagggaaaa

SEQ ID NO: 706490 - DNA, 13 bp, C. elegans
atttcaggtaaaa

SEQ ID NO: 706491 - DNA, 13 bp, C. elegans
atttcaggtcaaa

SEQ ID NO: 706492 - DNA, 13 bp, C. elegans
atttcagtaaaat

SEQ ID NO: 706493 - DNA, 13 bp, C. elegans
atttcagtcaaaa

SEQ ID NO: 706494 - DNA, 13 bp, C. elegans
atttcagtcattt

SEQ ID NO: 706495 - DNA, 13 bp, C. elegans
atttcagtgacaa

SEQ ID NO: 706496 - DNA, 13 bp, C. elegans
atttcagtgataa

SEQ ID NO: 706497 - DNA, 13 bp, C. elegans
atttcagtgtaaa

SEQ ID NO: 706498 - DNA, 13 bp, C. elegans
atttcagttagtt

SEQ ID NO: 706499 - DNA, 13 bp, C. elegans
atttcagttattt

SEQ ID NO: 706500 - DNA, 13 bp, C. elegans
atttcagttcatt

SEQ ID NO: 706501 - DNA, 13 bp, C. elegans
atttcagttgtct

SEQ ID NO: 706502 - DNA, 13 bp, C. elegans
atttcagtttatt

SEQ ID NO: 706503 - DNA, 13 bp, C. elegans
atttcagtttcat

SEQ ID NO: 706504 - DNA, 13 bp, C. elegans
atttcagtttgat

SEQ ID NO: 706505 - DNA, 13 bp, C. elegans
atttcagttttaa

SEQ ID NO: 706506 - DNA, 14 bp, C. elegans
atttcagttttcca

SEQ ID NO: 706507 - DNA, 13 bp, C. elegans
atttcataacaat

SEQ ID NO: 706508 - DNA, 13 bp, C. elegans
atttcataatgag

SEQ ID NO: 706509 - DNA, 13 bp, C. elegans
atttcatacaaat

SEQ ID NO: 706510 - DNA, 13 bp, C. elegans
atttcatacaatt

SEQ ID NO: 706511 - DNA, 13 bp, C. elegans
atttcatacattt

SEQ ID NO: 706512 - DNA, 13 bp, C. elegans
atttcatagaaat

SEQ ID NO: 706513 - DNA, 13 bp, C. elegans
atttcatagaatt

SEQ ID NO: 706514 - DNA, 13 bp, C. elegans
atttcatagtgaa

SEQ ID NO: 706515 - DNA, 13 bp, C. elegans
atttcatatgttt

SEQ ID NO: 706516 - DNA, 13 bp, C. elegans
atttcatattctg

SEQ ID NO: 706517 - DNA, 13 bp, C. elegans
atttcatattgat

SEQ ID NO: 706518 - DNA, 13 bp, C. elegans
atttcatcaacaa

SEQ ID NO: 706519 - DNA, 13 bp, C. elegans
atttcatcaactt

SEQ ID NO: 706520 - DNA, 13 bp, C. elegans
atttcatcacttt

SEQ ID NO: 706521 - DNA, 14 bp, C. elegans
atttcatccaaaaa

SEQ ID NO: 706522 - DNA, 13 bp, C. elegans
atttcatccattt

SEQ ID NO: 706523 - DNA, 13 bp, C. elegans
atttcatctcaaa

SEQ ID NO: 706524 - DNA, 13 bp, C. elegans
atttcatctgaaa

SEQ ID NO: 706525 - DNA, 13 bp, C. elegans
atttcatgaaaat

SEQ ID NO: 706526 - DNA, 13 bp, C. elegans
atttcatgaatat

SEQ ID NO: 706527 - DNA, 13 bp, C. elegans
atttcatgatttt

SEQ ID NO: 706528 - DNA, 13 bp, C. elegans
atttcatgcaaaa

SEQ ID NO: 706529 - DNA, 13 bp, C. elegans
atttcatggaatt

SEQ ID NO: 706530 - DNA, 13 bp, C. elegans
atttcatggtttt

SEQ ID NO: 706531 - DNA, 13 bp, C. elegans
atttcatgtaatt

SEQ ID NO: 706532 - DNA, 13 bp, C. elegans
atttcattacaaa

SEQ ID NO: 706533 - DNA, 13 bp, C. elegans
atttcattatgaa

SEQ ID NO: 706534 - DNA, 13 bp, C. elegans
atttcattattca

SEQ ID NO: 706535 - DNA, 13 bp, C. elegans
atttcattcattc

SEQ ID NO: 706536 - DNA, 13 bp, C. elegans
atttcattcgaaa

SEQ ID NO: 706537 - DNA, 13 bp, C. elegans
atttcattcgttt

SEQ ID NO: 706538 - DNA, 14 bp, C. elegans
atttcattgaaaaa

SEQ ID NO: 706539 - DNA, 13 bp, C. elegans
atttcattgatat

SEQ ID NO: 706540 - DNA, 13 bp, C. elegans
atttcattgattt

SEQ ID NO: 706541 - DNA, 13 bp, C. elegans
atttcattgtaaa

SEQ ID NO: 706542 - DNA, 13 bp, C. elegans
atttcatttcaaa

SEQ ID NO: 706543 - DNA, 13 bp, C. elegans
atttcatttcact

SEQ ID NO: 706544 - DNA, 13 bp, C. elegans
atttcatttcgaa

SEQ ID NO: 706545 - DNA, 13 bp, C. elegans
atttcatttgaaa

SEQ ID NO: 706546 - DNA, 13 bp, C. elegans
atttcatttgatt

SEQ ID NO: 706547 - DNA, 13 bp, C. elegans
atttcattttaac

SEQ ID NO: 706548 - DNA, 13 bp, C. elegans
atttcattttcaa

SEQ ID NO: 706549 - DNA, 13 bp, C. elegans
atttcattttcac

SEQ ID NO: 706550 - DNA, 13 bp, C. elegans
atttcattttccc

SEQ ID NO: 706551 - DNA, 13 bp, C. elegans
atttcattttcgt

SEQ ID NO: 706552 - DNA, 13 bp, C. elegans
atttcatttttag

SEQ ID NO: 706553 - DNA, 13 bp, C. elegans
atttcatttttcg

SEQ ID NO: 706554 - DNA, 13 bp, C. elegans
atttccaaaaaat

SEQ ID NO: 706555 - DNA, 13 bp, C. elegans
atttccaaaaacg

SEQ ID NO: 706556 - DNA, 13 bp, C. elegans
atttccaaaaagt

SEQ ID NO: 706557 - DNA, 13 bp, C. elegans
atttccaaaaatt

SEQ ID NO: 706558 - DNA, 14 bp, C. elegans
atttccaaaaattt

SEQ ID NO: 706559 - DNA, 13 bp, C. elegans
atttccaaaacaa

SEQ ID NO: 706560 - DNA, 13 bp, C. elegans
atttccaaaaccg

SEQ ID NO: 706561 - DNA, 13 bp, C. elegans
atttccaaaactg

SEQ ID NO: 706562 - DNA, 13 bp, C. elegans
atttccaaaactt

SEQ ID NO: 706563 - DNA, 13 bp, C. elegans
atttccaaaagaa

SEQ ID NO: 706564 - DNA, 13 bp, C. elegans
atttccaaaagtt

SEQ ID NO: 706565 - DNA, 13 bp, C. elegans
atttccaaaatct

SEQ ID NO: 706566 - DNA, 13 bp, C. elegans
atttccaaaattt

SEQ ID NO: 706567 - DNA, 14 bp, C. elegans
atttccaaaatttt

SEQ ID NO: 706568 - DNA, 13 bp, C. elegans
atttccaaaccaa

SEQ ID NO: 706569 - DNA, 13 bp, C. elegans
atttccaaacttc

SEQ ID NO: 706570 - DNA, 13 bp, C. elegans
atttccaaagttt

SEQ ID NO: 706571 - DNA, 13 bp, C. elegans
atttccaaataaa

SEQ ID NO: 706572 - DNA, 13 bp, C. elegans
atttccaaatttc

SEQ ID NO: 706573 - DNA, 13 bp, C. elegans
atttccaacaaat

SEQ ID NO: 706574 - DNA, 13 bp, C. elegans
atttccaacttca

SEQ ID NO: 706575 - DNA, 13 bp, C. elegans
atttccaacttta

SEQ ID NO: 706576 - DNA, 13 bp, C. elegans
atttccaagcttt

SEQ ID NO: 706577 - DNA, 16 bp, C. elegans
atttccaagtaaaaaa

SEQ ID NO: 706578 - DNA, 13 bp, C. elegans
atttccaagtcaa

SEQ ID NO: 706579 - DNA, 13 bp, C. elegans
atttccaagtttt

SEQ ID NO: 706580 - DNA, 13 bp, C. elegans
atttccaataaac

SEQ ID NO: 706581 - DNA, 13 bp, C. elegans
atttccaatagaa

SEQ ID NO: 706582 - DNA, 13 bp, C. elegans
atttccaatattt

SEQ ID NO: 706583 - DNA, 13 bp, C. elegans
atttccaatcaaa

SEQ ID NO: 706584 - DNA, 13 bp, C. elegans
atttccaatcttt

SEQ ID NO: 706585 - DNA, 14 bp, C. elegans
atttccaatgaaaa

SEQ ID NO: 706586 - DNA, 13 bp, C. elegans
atttccaatgttt

SEQ ID NO: 706587 - DNA, 13 bp, C. elegans
atttccaattcca

SEQ ID NO: 706588 - DNA, 13 bp, C. elegans
atttccaattctc

SEQ ID NO: 706589 - DNA, 13 bp, C. elegans
atttccaatttat

SEQ ID NO: 706590 - DNA, 13 bp, C. elegans
atttccaatttca

SEQ ID NO: 706591 - DNA, 14 bp, C. elegans
atttccaattttcc

SEQ ID NO: 706592 - DNA, 13 bp, C. elegans
atttccacaaaat

SEQ ID NO: 706593 - DNA, 13 bp, C. elegans
atttccacgtttt

SEQ ID NO: 706594 - DNA, 13 bp, C. elegans
atttccactaaaa

SEQ ID NO: 706595 - DNA, 13 bp, C. elegans
atttccactattt

SEQ ID NO: 706596 - DNA, 13 bp, C. elegans
atttccactgaaa

SEQ ID NO: 706597 - DNA, 13 bp, C. elegans
atttccactttta

SEQ ID NO: 706598 - DNA, 13 bp, C. elegans
atttccagaaata

SEQ ID NO: 706599 - DNA, 13 bp, C. elegans
atttccagaaatc

SEQ ID NO: 706600 - DNA, 13 bp, C. elegans
atttccagaattt

SEQ ID NO: 706601 - DNA, 13 bp, C. elegans
atttccagagagc

SEQ ID NO: 706602 - DNA, 13 bp, C. elegans
atttccagatttc

SEQ ID NO: 706603 - DNA, 13 bp, C. elegans
atttccagcaaac

SEQ ID NO: 706604 - DNA, 13 bp, C. elegans
atttccagcaaat

SEQ ID NO: 706605 - DNA, 13 bp, C. elegans
atttccagccaaa

SEQ ID NO: 706606 - DNA, 13 bp, C. elegans
atttccaggaaat

SEQ ID NO: 706607 - DNA, 13 bp, C. elegans
atttccagtaatg

SEQ ID NO: 706608 - DNA, 13 bp, C. elegans
atttccagtaatt

SEQ ID NO: 706609 - DNA, 13 bp, C. elegans
atttccagtcaat

SEQ ID NO: 706610 - DNA, 13 bp, C. elegans
atttccagtgttt

SEQ ID NO: 706611 - DNA, 13 bp, C. elegans
atttccagttaaa

SEQ ID NO: 706612 - DNA, 13 bp, C. elegans
atttccagttatt

SEQ ID NO: 706613 - DNA, 13 bp, C. elegans
atttccataattt

SEQ ID NO: 706614 - DNA, 13 bp, C. elegans
atttccatagaaa

SEQ ID NO: 706615 - DNA, 13 bp, C. elegans
atttccatatatt

SEQ ID NO: 706616 - DNA, 13 bp, C. elegans
atttccatattca

SEQ ID NO: 706617 - DNA, 13 bp, C. elegans
atttccatattcc

SEQ ID NO: 706618 - DNA, 13 bp, C. elegans
atttccatattct

SEQ ID NO: 706619 - DNA, 13 bp, C. elegans
atttccatatttc

SEQ ID NO: 706620 - DNA, 13 bp, C. elegans
atttccatcaaat

SEQ ID NO: 706621 - DNA, 13 bp, C. elegans
atttccatgaaat

SEQ ID NO: 706622 - DNA, 13 bp, C. elegans
atttccatgtttt

SEQ ID NO: 706623 - DNA, 13 bp, C. elegans
atttccattaatt

SEQ ID NO: 706624 - DNA, 13 bp, C. elegans
atttccattcaat

SEQ ID NO: 706625 - DNA, 13 bp, C. elegans
atttccattgatt

SEQ ID NO: 706626 - DNA, 13 bp, C. elegans
atttccatttcta

SEQ ID NO: 706627 - DNA, 13 bp, C. elegans
atttccatttgaa

SEQ ID NO: 706628 - DNA, 13 bp, C. elegans
atttccattttac

SEQ ID NO: 706629 - DNA, 14 bp, C. elegans
atttccattttcaa

SEQ ID NO: 706630 - DNA, 13 bp, C. elegans
atttccattttcg

SEQ ID NO: 706631 - DNA, 13 bp, C. elegans
atttcccaaattc

SEQ ID NO: 706632 - DNA, 13 bp, C. elegans
atttcccaaattt

SEQ ID NO: 706633 - DNA, 13 bp, C. elegans
atttcccaataaa

SEQ ID NO: 706634 - DNA, 13 bp, C. elegans
atttcccaatttc

SEQ ID NO: 706635 - DNA, 14 bp, C. elegans
atttcccaattttc

SEQ ID NO: 706636 - DNA, 13 bp, C. elegans
atttcccacaaaa

SEQ ID NO: 706637 - DNA, 13 bp, C. elegans
atttcccacattt

SEQ ID NO: 706638 - DNA, 13 bp, C. elegans
atttcccagattt

SEQ ID NO: 706639 - DNA, 13 bp, C. elegans
atttcccatttca

SEQ ID NO: 706640 - DNA, 13 bp, C. elegans
atttcccattttc

SEQ ID NO: 706641 - DNA, 13 bp, C. elegans
atttccccaaatt

SEQ ID NO: 706642 - DNA, 13 bp, C. elegans
atttccccaattt

SEQ ID NO: 706643 - DNA, 13 bp, C. elegans
atttccccacaaa

SEQ ID NO: 706644 - DNA, 13 bp, C. elegans
atttccccacttt

SEQ ID NO: 706645 - DNA, 13 bp, C. elegans
atttccccattga

SEQ ID NO: 706646 - DNA, 13 bp, C. elegans
atttcccccaaaa

SEQ ID NO: 706647 - DNA, 13 bp, C. elegans
atttcccccattt

SEQ ID NO: 706648 - DNA, 13 bp, C. elegans
atttcccgaaaaa

SEQ ID NO: 706649 - DNA, 15 bp, C. elegans
atttcccgatttttc

SEQ ID NO: 706650 - DNA, 13 bp, C. elegans
atttcccgccaca

SEQ ID NO: 706651 - DNA, 13 bp, C. elegans
atttcccgccatt

SEQ ID NO: 706652 - DNA, 13 bp, C. elegans
atttcccgctaaa

SEQ ID NO: 706653 - DNA, 13 bp, C. elegans
atttcccgttttt

SEQ ID NO: 706654 - DNA, 13 bp, C. elegans
atttccctccaaa

SEQ ID NO: 706655 - DNA, 13 bp, C. elegans
atttccctgattt

SEQ ID NO: 706656 - DNA, 13 bp, C. elegans
atttcccttccaa

SEQ ID NO: 706657 - DNA, 13 bp, C. elegans
atttccgaaaaaa

SEQ ID NO: 706658 - DNA, 13 bp, C. elegans
atttccgaaaaac

SEQ ID NO: 706659 - DNA, 13 bp, C. elegans
atttccgaaaagt

SEQ ID NO: 706660 - DNA, 13 bp, C. elegans
atttccgaaaatt

SEQ ID NO: 706661 - DNA, 13 bp, C. elegans
atttccgaaatat

SEQ ID NO: 706662 - DNA, 13 bp, C. elegans
atttccgaagaaa

SEQ ID NO: 706663 - DNA, 13 bp, C. elegans
atttccgaatatt

SEQ ID NO: 706664 - DNA, 13 bp, C. elegans
atttccgacaatt

SEQ ID NO: 706665 - DNA, 13 bp, C. elegans
atttccgatcaaa

SEQ ID NO: 706666 - DNA, 13 bp, C. elegans
atttccgattgcc

SEQ ID NO: 706667 - DNA, 13 bp, C. elegans
atttccgatttta

SEQ ID NO: 706668 - DNA, 13 bp, C. elegans
atttccgcaaaaa

SEQ ID NO: 706669 - DNA, 13 bp, C. elegans
atttccgcatttt

SEQ ID NO: 706670 - DNA, 13 bp, C. elegans
atttccgccaaaa

SEQ ID NO: 706671 - DNA, 13 bp, C. elegans
atttccgctgaaa

SEQ ID NO: 706672 - DNA, 13 bp, C. elegans
atttccggaaaat

SEQ ID NO: 706673 - DNA, 13 bp, C. elegans
atttccggaattc

SEQ ID NO: 706674 - DNA, 13 bp, C. elegans
atttccggagaaa

SEQ ID NO: 706675 - DNA, 13 bp, C. elegans
atttccggtttgc

SEQ ID NO: 706676 - DNA, 13 bp, C. elegans
atttccggttttc

SEQ ID NO: 706677 - DNA, 13 bp, C. elegans
atttccgtcaaat

SEQ ID NO: 706678 - DNA, 13 bp, C. elegans
atttccgtgattt

SEQ ID NO: 706679 - DNA, 13 bp, C. elegans
atttccgtgcaaa

SEQ ID NO: 706680 - DNA, 13 bp, C. elegans
atttccgtttcaa

SEQ ID NO: 706681 - DNA, 13 bp, C. elegans
atttcctaaaaat

SEQ ID NO: 706682 - DNA, 13 bp, C. elegans
atttcctaattta

SEQ ID NO: 706683 - DNA, 13 bp, C. elegans
atttcctaatttc

SEQ ID NO: 706684 - DNA, 13 bp, C. elegans
atttcctacaaaa

SEQ ID NO: 706685 - DNA, 13 bp, C. elegans
atttcctacattt

SEQ ID NO: 706686 - DNA, 13 bp, C. elegans
atttcctagattt

SEQ ID NO: 706687 - DNA, 13 bp, C. elegans
atttcctataaat

SEQ ID NO: 706688 - DNA, 13 bp, C. elegans
atttcctatgttt

SEQ ID NO: 706689 - DNA, 13 bp, C. elegans
atttcctcaaaaa

SEQ ID NO: 706690 - DNA, 13 bp, C. elegans
atttcctcaaaag

SEQ ID NO: 706691 - DNA, 13 bp, C. elegans
atttcctcgattt

SEQ ID NO: 706692 - DNA, 13 bp, C. elegans
atttcctctaaaa

SEQ ID NO: 706693 - DNA, 13 bp, C. elegans
atttcctctaata

SEQ ID NO: 706694 - DNA, 13 bp, C. elegans
atttcctgaattt

SEQ ID NO: 706695 - DNA, 13 bp, C. elegans
atttcctggattt

SEQ ID NO: 706696 - DNA, 13 bp, C. elegans
atttcctgtaaaa

SEQ ID NO: 706697 - DNA, 13 bp, C. elegans
atttcctgtcaaa

SEQ ID NO: 706698 - DNA, 13 bp, C. elegans
atttccttcaatt

SEQ ID NO: 706699 - DNA, 13 bp, C. elegans
atttccttgaatt

SEQ ID NO: 706700 - DNA, 13 bp, C. elegans
atttccttgattt

SEQ ID NO: 706701 - DNA, 13 bp, C. elegans
atttcctttaaaa

SEQ ID NO: 706702 - DNA, 13 bp, C. elegans
atttcctttgaat

SEQ ID NO: 706703 - DNA, 13 bp, C. elegans
atttccttttgaa

SEQ ID NO: 706704 - DNA, 13 bp, C. elegans
atttcctttttga

SEQ ID NO: 706705 - DNA, 14 bp, C. elegans
atttcgaaaaaatt

SEQ ID NO: 706706 - DNA, 13 bp, C. elegans
atttcgaaaaact

SEQ ID NO: 706707 - DNA, 13 bp, C. elegans
atttcgaaaaatc

SEQ ID NO: 706708 - DNA, 13 bp, C. elegans
atttcgaaaaatg

SEQ ID NO: 706709 - DNA, 13 bp, C. elegans
atttcgaaaattc

SEQ ID NO: 706710 - DNA, 13 bp, C. elegans
atttcgaaacaat

SEQ ID NO: 706711 - DNA, 13 bp, C. elegans
atttcgaaacatt

SEQ ID NO: 706712 - DNA, 13 bp, C. elegans
atttcgaaataat

SEQ ID NO: 706713 - DNA, 13 bp, C. elegans
atttcgaaatatt

SEQ ID NO: 706714 - DNA, 13 bp, C. elegans
atttcgaaattcc

SEQ ID NO: 706715 - DNA, 13 bp, C. elegans
atttcgaaattcg

SEQ ID NO: 706716 - DNA, 13 bp, C. elegans
atttcgaaattct

SEQ ID NO: 706717 - DNA, 13 bp, C. elegans
atttcgaaatttc

SEQ ID NO: 706718 - DNA, 13 bp, C. elegans
atttcgaaatttg

SEQ ID NO: 706719 - DNA, 13 bp, C. elegans
atttcgaaatttt

SEQ ID NO: 706720 - DNA, 13 bp, C. elegans
atttcgaacaatt

SEQ ID NO: 706721 - DNA, 13 bp, C. elegans
atttcgaataaat

SEQ ID NO: 706722 - DNA, 13 bp, C. elegans
atttcgaataata

SEQ ID NO: 706723 - DNA, 13 bp, C. elegans
atttcgaataatt

SEQ ID NO: 706724 - DNA, 13 bp, C. elegans
atttcgaatatct

SEQ ID NO: 706725 - DNA, 13 bp, C. elegans
atttcgaatcgat

SEQ ID NO: 706726 - DNA, 13 bp, C. elegans
atttcgaattgaa

SEQ ID NO: 706727 - DNA, 13 bp, C. elegans
atttcgaatttcg

SEQ ID NO: 706728 - DNA, 13 bp, C. elegans
atttcgacaaaaa

SEQ ID NO: 706729 - DNA, 13 bp, C. elegans
atttcgacaattg

SEQ ID NO: 706730 - DNA, 13 bp, C. elegans
atttcgacaattt

SEQ ID NO: 706731 - DNA, 13 bp, C. elegans
atttcgacgattt

SEQ ID NO: 706732 - DNA, 13 bp, C. elegans
atttcgactaaaa

SEQ ID NO: 706733 - DNA, 13 bp, C. elegans
atttcgagaaatt

SEQ ID NO: 706734 - DNA, 13 bp, C. elegans
atttcgagagaaa

SEQ ID NO: 706735 - DNA, 13 bp, C. elegans
atttcgagatttc

SEQ ID NO: 706736 - DNA, 13 bp, C. elegans
atttcgagatttt

SEQ ID NO: 706737 - DNA, 13 bp, C. elegans
atttcgagccaaa

SEQ ID NO: 706738 - DNA, 13 bp, C. elegans
atttcgagttttg

SEQ ID NO: 706739 - DNA, 13 bp, C. elegans
atttcgagttttt

SEQ ID NO: 706740 - DNA, 13 bp, C. elegans
atttcgataaaaa

SEQ ID NO: 706741 - DNA, 13 bp, C. elegans
atttcgatatttt

SEQ ID NO: 706742 - DNA, 13 bp, C. elegans
atttcgatcattt

SEQ ID NO: 706743 - DNA, 13 bp, C. elegans
atttcgatctttt

SEQ ID NO: 706744 - DNA, 14 bp, C. elegans
atttcgatgaaaaa

SEQ ID NO: 706745 - DNA, 13 bp, C. elegans
atttcgatgattt

SEQ ID NO: 706746 - DNA, 13 bp, C. elegans
atttcgattattt

SEQ ID NO: 706747 - DNA, 13 bp, C. elegans
atttcgatttgaa

SEQ ID NO: 706748 - DNA, 13 bp, C. elegans
atttcgattttcc

SEQ ID NO: 706749 - DNA, 13 bp, C. elegans
atttcgattttcg

SEQ ID NO: 706750 - DNA, 13 bp, C. elegans
atttcgattttgt

SEQ ID NO: 706751 - DNA, 13 bp, C. elegans
atttcgattttta

SEQ ID NO: 706752 - DNA, 13 bp, C. elegans
atttcgcaaaaaa

SEQ ID NO: 706753 - DNA, 13 bp, C. elegans
atttcgcaaattt

SEQ ID NO: 706754 - DNA, 15 bp, C. elegans
atttcgcatggttaa

SEQ ID NO: 706755 - DNA, 13 bp, C. elegans
atttcgcatgttt

SEQ ID NO: 706756 - DNA, 13 bp, C. elegans
atttcgcattgtt

SEQ ID NO: 706757 - DNA, 13 bp, C. elegans
atttcgccgaaaa

SEQ ID NO: 706758 - DNA, 13 bp, C. elegans
atttcgcgattat

SEQ ID NO: 706759 - DNA, 13 bp, C. elegans
atttcgcttgaaa

SEQ ID NO: 706760 - DNA, 14 bp, C. elegans
atttcggaaaaaaa

SEQ ID NO: 706761 - DNA, 13 bp, C. elegans
atttcggaaaaac

SEQ ID NO: 706762 - DNA, 13 bp, C. elegans
atttcggaaactt

SEQ ID NO: 706763 - DNA, 13 bp, C. elegans
atttcggaatatt

SEQ ID NO: 706764 - DNA, 13 bp, C. elegans
atttcggagaaaa

SEQ ID NO: 706765 - DNA, 13 bp, C. elegans
atttcggagtttt

SEQ ID NO: 706766 - DNA, 13 bp, C. elegans
atttcggcaaaaa

SEQ ID NO: 706767 - DNA, 13 bp, C. elegans
atttcgggaattt

SEQ ID NO: 706768 - DNA, 13 bp, C. elegans
atttcggtgaaaa

SEQ ID NO: 706769 - DNA, 13 bp, C. elegans
atttcggtttcaa

SEQ ID NO: 706770 - DNA, 14 bp, C. elegans
atttcgtatggtta

SEQ ID NO: 706771 - DNA, 13 bp, C. elegans
atttcgtcaaaat

SEQ ID NO: 706772 - DNA, 13 bp, C. elegans
atttcgtccaaaa

SEQ ID NO: 706773 - DNA, 13 bp, C. elegans
atttcgtgaaatt

SEQ ID NO: 706774 - DNA, 13 bp, C. elegans
atttcgtggtttt

SEQ ID NO: 706775 - DNA, 13 bp, C. elegans
atttcgttgaatt

SEQ ID NO: 706776 - DNA, 13 bp, C. elegans
atttcgtttatta

SEQ ID NO: 706777 - DNA, 13 bp, C. elegans
atttcgtttcaaa

SEQ ID NO: 706778 - DNA, 13 bp, C. elegans
atttcgttttcca

SEQ ID NO: 706779 - DNA, 13 bp, C. elegans
atttctaaaacat

SEQ ID NO: 706780 - DNA, 13 bp, C. elegans
atttctaaacttt

SEQ ID NO: 706781 - DNA, 13 bp, C. elegans
atttctaaagaaa

SEQ ID NO: 706782 - DNA, 13 bp, C. elegans
atttctaaagtta

SEQ ID NO: 706783 - DNA, 13 bp, C. elegans
atttctaaattca

SEQ ID NO: 706784 - DNA, 13 bp, C. elegans
atttctaaccaaa

SEQ ID NO: 706785 - DNA, 13 bp, C. elegans
atttctaatcaaa

SEQ ID NO: 706786 - DNA, 13 bp, C. elegans
atttctaatgaaa

SEQ ID NO: 706787 - DNA, 13 bp, C. elegans
atttctaatttca

SEQ ID NO: 706788 - DNA, 13 bp, C. elegans
atttctacaaaaa

SEQ ID NO: 706789 - DNA, 13 bp, C. elegans
atttctacaaaat

SEQ ID NO: 706790 - DNA, 13 bp, C. elegans
atttctacaatat

SEQ ID NO: 706791 - DNA, 13 bp, C. elegans
atttctacaattt

SEQ ID NO: 706792 - DNA, 13 bp, C. elegans
atttctacacaaa

SEQ ID NO: 706793 - DNA, 13 bp, C. elegans
atttctacagaaa

SEQ ID NO: 706794 - DNA, 13 bp, C. elegans
atttctaccgttt

SEQ ID NO: 706795 - DNA, 13 bp, C. elegans
atttctactggaa

SEQ ID NO: 706796 - DNA, 13 bp, C. elegans
atttctagaatct

SEQ ID NO: 706797 - DNA, 13 bp, C. elegans
atttctagaattt

SEQ ID NO: 706798 - DNA, 13 bp, C. elegans
atttctagatatt

SEQ ID NO: 706799 - DNA, 13 bp, C. elegans
atttctagcaaat

SEQ ID NO: 706800 - DNA, 13 bp, C. elegans
atttctagctttt

SEQ ID NO: 706801 - DNA, 13 bp, C. elegans
atttctaggccat

SEQ ID NO: 706802 - DNA, 13 bp, C. elegans
atttctagtgatt

SEQ ID NO: 706803 - DNA, 13 bp, C. elegans
atttctatagttt

SEQ ID NO: 706804 - DNA, 13 bp, C. elegans
atttctatcaaat

SEQ ID NO: 706805 - DNA, 13 bp, C. elegans
atttctatgaaaa

SEQ ID NO: 706806 - DNA, 13 bp, C. elegans
atttctatgtaaa

SEQ ID NO: 706807 - DNA, 13 bp, C. elegans
atttctattagaa

SEQ ID NO: 706808 - DNA, 13 bp, C. elegans
atttctattcgaa

SEQ ID NO: 706809 - DNA, 13 bp, C. elegans
atttctattgaaa

SEQ ID NO: 706810 - DNA, 13 bp, C. elegans
atttctattgatt

SEQ ID NO: 706811 - DNA, 13 bp, C. elegans
atttctatttatg

SEQ ID NO: 706812 - DNA, 13 bp, C. elegans
atttctatttgaa

SEQ ID NO: 706813 - DNA, 13 bp, C. elegans
atttctatttgat

SEQ ID NO: 706814 - DNA, 13 bp, C. elegans
atttctattttga

SEQ ID NO: 706815 - DNA, 13 bp, C. elegans
atttctcaaaacg

SEQ ID NO: 706816 - DNA, 13 bp, C. elegans
atttctcaaaatc

SEQ ID NO: 706817 - DNA, 13 bp, C. elegans
atttctcaaaatt

SEQ ID NO: 706818 - DNA, 13 bp, C. elegans
atttctcaaacaa

SEQ ID NO: 706819 - DNA, 13 bp, C. elegans
atttctcaaacat

SEQ ID NO: 706820 - DNA, 13 bp, C. elegans
atttctcaaagtt

SEQ ID NO: 706821 - DNA, 13 bp, C. elegans
atttctcaaataa

SEQ ID NO: 706822 - DNA, 13 bp, C. elegans
atttctcaaattg

SEQ ID NO: 706823 - DNA, 13 bp, C. elegans
atttctcaacaat

SEQ ID NO: 706824 - DNA, 13 bp, C. elegans
atttctcaactga

SEQ ID NO: 706825 - DNA, 13 bp, C. elegans
atttctcaacttt

SEQ ID NO: 706826 - DNA, 13 bp, C. elegans
atttctcaattca

SEQ ID NO: 706827 - DNA, 13 bp, C. elegans
atttctcaattga

SEQ ID NO: 706828 - DNA, 13 bp, C. elegans
atttctcactgaa

SEQ ID NO: 706829 - DNA, 13 bp, C. elegans
atttctcataatt

SEQ ID NO: 706830 - DNA, 13 bp, C. elegans
atttctcatcaaa

SEQ ID NO: 706831 - DNA, 13 bp, C. elegans
atttctcatcaat

SEQ ID NO: 706832 - DNA, 13 bp, C. elegans
atttctcatcatt

SEQ ID NO: 706833 - DNA, 13 bp, C. elegans
atttctcatgttt

SEQ ID NO: 706834 - DNA, 13 bp, C. elegans
atttctcattcaa

SEQ ID NO: 706835 - DNA, 13 bp, C. elegans
atttctcattgtt

SEQ ID NO: 706836 - DNA, 13 bp, C. elegans
atttctcatttaa

SEQ ID NO: 706837 - DNA, 13 bp, C. elegans
atttctccaaaaa

SEQ ID NO: 706838 - DNA, 13 bp, C. elegans
atttctccaaaat

SEQ ID NO: 706839 - DNA, 13 bp, C. elegans
atttctccaaact

SEQ ID NO: 706840 - DNA, 13 bp, C. elegans
atttctccaaatt

SEQ ID NO: 706841 - DNA, 13 bp, C. elegans
atttctccaatta

SEQ ID NO: 706842 - DNA, 13 bp, C. elegans
atttctccagaaa

SEQ ID NO: 706843 - DNA, 13 bp, C. elegans
atttctccgtttt

SEQ ID NO: 706844 - DNA, 13 bp, C. elegans
atttctcgaaatt

SEQ ID NO: 706845 - DNA, 13 bp, C. elegans
atttctcgaagat

SEQ ID NO: 706846 - DNA, 13 bp, C. elegans
atttctcgacatt

SEQ ID NO: 706847 - DNA, 13 bp, C. elegans
atttctcgatttt

SEQ ID NO: 706848 - DNA, 13 bp, C. elegans
atttctcgcaaaa

SEQ ID NO: 706849 - DNA, 13 bp, C. elegans
atttctcgcaaat

SEQ ID NO: 706850 - DNA, 13 bp, C. elegans
atttctcgtattt

SEQ ID NO: 706851 - DNA, 13 bp, C. elegans
atttctcgtcatt

SEQ ID NO: 706852 - DNA, 13 bp, C. elegans
atttctcgttttc

SEQ ID NO: 706853 - DNA, 13 bp, C. elegans
atttctctaactt

SEQ ID NO: 706854 - DNA, 13 bp, C. elegans
atttctctagttt

SEQ ID NO: 706855 - DNA, 13 bp, C. elegans
atttctctcagaa

SEQ ID NO: 706856 - DNA, 13 bp, C. elegans
atttctctctcaa

SEQ ID NO: 706857 - DNA, 13 bp, C. elegans
atttctctgaata

SEQ ID NO: 706858 - DNA, 13 bp, C. elegans
atttctctgaatt

SEQ ID NO: 706859 - DNA, 13 bp, C. elegans
atttctctgattt

SEQ ID NO: 706860 - DNA, 13 bp, C. elegans
atttctctttgaa

SEQ ID NO: 706861 - DNA, 13 bp, C. elegans
atttctgaaaaaa

SEQ ID NO: 706862 - DNA, 13 bp, C. elegans
atttctgaaaaag

SEQ ID NO: 706863 - DNA, 13 bp, C. elegans
atttctgaaaaat

SEQ ID NO: 706864 - DNA, 13 bp, C. elegans
atttctgaaaacg

SEQ ID NO: 706865 - DNA, 13 bp, C. elegans
atttctgaaaagt

SEQ ID NO: 706866 - DNA, 13 bp, C. elegans
atttctgaaacaa

SEQ ID NO: 706867 - DNA, 13 bp, C. elegans
atttctgaaagtt

SEQ ID NO: 706868 - DNA, 14 bp, C. elegans
atttctgaaatttt

SEQ ID NO: 706869 - DNA, 13 bp, C. elegans
atttctgaaggaa

SEQ ID NO: 706870 - DNA, 13 bp, C. elegans
atttctgaagttt

SEQ ID NO: 706871 - DNA, 13 bp, C. elegans
atttctgaataat

SEQ ID NO: 706872 - DNA, 13 bp, C. elegans
atttctgaattaa

SEQ ID NO: 706873 - DNA, 13 bp, C. elegans
atttctgaattta

SEQ ID NO: 706874 - DNA, 13 bp, C. elegans
atttctgaatttt

SEQ ID NO: 706875 - DNA, 13 bp, C. elegans
atttctgacaaat

SEQ ID NO: 706876 - DNA, 13 bp, C. elegans
atttctgagcttt

SEQ ID NO: 706877 - DNA, 13 bp, C. elegans
atttctgagttta

SEQ ID NO: 706878 - DNA, 13 bp, C. elegans
atttctgataaat

SEQ ID NO: 706879 - DNA, 13 bp, C. elegans
atttctgataatt

SEQ ID NO: 706880 - DNA, 13 bp, C. elegans
atttctgatcatt

SEQ ID NO: 706881 - DNA, 13 bp, C. elegans
atttctgatcttc

SEQ ID NO: 706882 - DNA, 13 bp, C. elegans
atttctgatgaaa

SEQ ID NO: 706883 - DNA, 13 bp, C. elegans
atttctgattaaa

SEQ ID NO: 706884 - DNA, 13 bp, C. elegans
atttctgattttc

SEQ ID NO: 706885 - DNA, 13 bp, C. elegans
atttctgcaaaac

SEQ ID NO: 706886 - DNA, 13 bp, C. elegans
atttctgcaaact

SEQ ID NO: 706887 - DNA, 13 bp, C. elegans
atttctgcactat

SEQ ID NO: 706888 - DNA, 13 bp, C. elegans
atttctgcatttt

SEQ ID NO: 706889 - DNA, 13 bp, C. elegans
atttctgcgattt

SEQ ID NO: 706890 - DNA, 13 bp, C. elegans
atttctgctaatt

SEQ ID NO: 706891 - DNA, 13 bp, C. elegans
atttctgcttgaa

SEQ ID NO: 706892 - DNA, 13 bp, C. elegans
atttctggaaaat

SEQ ID NO: 706893 - DNA, 13 bp, C. elegans
atttctggcattt

SEQ ID NO: 706894 - DNA, 13 bp, C. elegans
atttctggttttg

SEQ ID NO: 706895 - DNA, 13 bp, C. elegans
atttctgtaaatt

SEQ ID NO: 706896 - DNA, 13 bp, C. elegans
atttctgtaattc

SEQ ID NO: 706897 - DNA, 13 bp, C. elegans
atttctgtagttt

SEQ ID NO: 706898 - DNA, 13 bp, C. elegans
atttctgtatttc

SEQ ID NO: 706899 - DNA, 13 bp, C. elegans
atttctgtcaaaa

SEQ ID NO: 706900 - DNA, 13 bp, C. elegans
atttctgtcaaga

SEQ ID NO: 706901 - DNA, 13 bp, C. elegans
atttctgtcaatt

SEQ ID NO: 706902 - DNA, 13 bp, C. elegans
atttctgtcatgg

SEQ ID NO: 706903 - DNA, 13 bp, C. elegans
atttctgtctgaa

SEQ ID NO: 706904 - DNA, 13 bp, C. elegans
atttctgtgaaat

SEQ ID NO: 706905 - DNA, 13 bp, C. elegans
atttctgtgaatt

SEQ ID NO: 706906 - DNA, 13 bp, C. elegans
atttctgtgactt

SEQ ID NO: 706907 - DNA, 13 bp, C. elegans
atttctgtgattt

SEQ ID NO: 706908 - DNA, 13 bp, C. elegans
atttctgtgcaaa

SEQ ID NO: 706909 - DNA, 13 bp, C. elegans
atttctgtgtatt

SEQ ID NO: 706910 - DNA, 13 bp, C. elegans
atttctgttaatt

SEQ ID NO: 706911 - DNA, 14 bp, C. elegans
atttctgttcaaaa

SEQ ID NO: 706912 - DNA, 13 bp, C. elegans
atttctgttgaaa

SEQ ID NO: 706913 - DNA, 13 bp, C. elegans
atttctgttgctt

SEQ ID NO: 706914 - DNA, 13 bp, C. elegans
atttctgtttcaa

SEQ ID NO: 706915 - DNA, 13 bp, C. elegans
atttctgttttaa

SEQ ID NO: 706916 - DNA, 13 bp, C. elegans
atttcttaagaaa

SEQ ID NO: 706917 - DNA, 13 bp, C. elegans
atttcttagaaat

SEQ ID NO: 706918 - DNA, 13 bp, C. elegans
atttcttatcaaa

SEQ ID NO: 706919 - DNA, 13 bp, C. elegans
atttcttatcaat

SEQ ID NO: 706920 - DNA, 13 bp, C. elegans
atttcttattcaa

SEQ ID NO: 706921 - DNA, 13 bp, C. elegans
atttcttcaaatc

SEQ ID NO: 706922 - DNA, 13 bp, C. elegans
atttcttcaaatt

SEQ ID NO: 706923 - DNA, 13 bp, C. elegans
atttcttcaactt

SEQ ID NO: 706924 - DNA, 13 bp, C. elegans
atttcttcacaaa

SEQ ID NO: 706925 - DNA, 13 bp, C. elegans
atttcttccaaat

SEQ ID NO: 706926 - DNA, 13 bp, C. elegans
atttcttcgaaaa

SEQ ID NO: 706927 - DNA, 13 bp, C. elegans
atttcttctaaaa

SEQ ID NO: 706928 - DNA, 13 bp, C. elegans
atttcttctcaaa

SEQ ID NO: 706929 - DNA, 13 bp, C. elegans
atttcttctcaat

SEQ ID NO: 706930 - DNA, 13 bp, C. elegans
atttcttctcgaa

SEQ ID NO: 706931 - DNA, 13 bp, C. elegans
atttcttctttga

SEQ ID NO: 706932 - DNA, 13 bp, C. elegans
atttcttgaaagt

SEQ ID NO: 706933 - DNA, 13 bp, C. elegans
atttcttgaatat

SEQ ID NO: 706934 - DNA, 13 bp, C. elegans
atttcttgacaaa

SEQ ID NO: 706935 - DNA, 13 bp, C. elegans
atttcttgagatt

SEQ ID NO: 706936 - DNA, 13 bp, C. elegans
atttcttgagttt

SEQ ID NO: 706937 - DNA, 13 bp, C. elegans
atttcttgattct

SEQ ID NO: 706938 - DNA, 13 bp, C. elegans
atttcttggaatt

SEQ ID NO: 706939 - DNA, 13 bp, C. elegans
atttcttggattt

SEQ ID NO: 706940 - DNA, 13 bp, C. elegans
atttcttgtaaat

SEQ ID NO: 706941 - DNA, 13 bp, C. elegans
atttcttgtagat

SEQ ID NO: 706942 - DNA, 13 bp, C. elegans
atttcttgtcaaa

SEQ ID NO: 706943 - DNA, 13 bp, C. elegans
atttcttgttaaa

SEQ ID NO: 706944 - DNA, 13 bp, C. elegans
atttctttacaaa

SEQ ID NO: 706945 - DNA, 13 bp, C. elegans
atttctttatgaa

SEQ ID NO: 706946 - DNA, 14 bp, C. elegans
atttctttcaaaac

SEQ ID NO: 706947 - DNA, 13 bp, C. elegans
atttctttctgaa

SEQ ID NO: 706948 - DNA, 13 bp, C. elegans
atttctttgaaat

SEQ ID NO: 706949 - DNA, 13 bp, C. elegans
atttctttgaatt

SEQ ID NO: 706950 - DNA, 13 bp, C. elegans
atttctttgctca

SEQ ID NO: 706951 - DNA, 13 bp, C. elegans
atttctttgctct

SEQ ID NO: 706952 - DNA, 13 bp, C. elegans
atttctttgtaaa

SEQ ID NO: 706953 - DNA, 13 bp, C. elegans
atttcttttgaaa

SEQ ID NO: 706954 - DNA, 13 bp, C. elegans
atttcttttgtaa

SEQ ID NO: 706955 - DNA, 13 bp, C. elegans
atttctttttaga

SEQ ID NO: 706956 - DNA, 13 bp, C. elegans
atttctttttcga

SEQ ID NO: 706957 - DNA, 13 bp, C. elegans
atttctttttgaa

SEQ ID NO: 706958 - DNA, 13 bp, C. elegans
atttctttttgca

SEQ ID NO: 706959 - DNA, 13 bp, C. elegans
atttgaaaaaagt

SEQ ID NO: 706960 - DNA, 13 bp, C. elegans
atttgaaaaactt

SEQ ID NO: 706961 - DNA, 13 bp, C. elegans
atttgaaaaagtc

SEQ ID NO: 706962 - DNA, 13 bp, C. elegans
atttgaaaaagtt

SEQ ID NO: 706963 - DNA, 13 bp, C. elegans
atttgaaaaatac

SEQ ID NO: 706964 - DNA, 13 bp, C. elegans
atttgaaaaatcc

SEQ ID NO: 706965 - DNA, 13 bp, C. elegans
atttgaaaaatgt

SEQ ID NO: 706966 - DNA, 13 bp, C. elegans
atttgaaaacgat

SEQ ID NO: 706967 - DNA, 13 bp, C. elegans
atttgaaaacttt

SEQ ID NO: 706968 - DNA, 13 bp, C. elegans
atttgaaaagaat

SEQ ID NO: 706969 - DNA, 13 bp, C. elegans
atttgaaaagcaa

SEQ ID NO: 706970 - DNA, 13 bp, C. elegans
atttgaaaaggat

SEQ ID NO: 706971 - DNA, 13 bp, C. elegans
atttgaaaagtat

SEQ ID NO: 706972 - DNA, 13 bp, C. elegans
atttgaaaagtgt

SEQ ID NO: 706973 - DNA, 13 bp, C. elegans
atttgaaaataac

SEQ ID NO: 706974 - DNA, 14 bp, C. elegans
atttgaaaatgtca

SEQ ID NO: 706975 - DNA, 13 bp, C. elegans
atttgaaaatgtt

SEQ ID NO: 706976 - DNA, 13 bp, C. elegans
atttgaaaattgt

SEQ ID NO: 706977 - DNA, 13 bp, C. elegans
atttgaaacaaaa

SEQ ID NO: 706978 - DNA, 13 bp, C. elegans
atttgaaacagaa

SEQ ID NO: 706979 - DNA, 13 bp, C. elegans
atttgaaacagtt

SEQ ID NO: 706980 - DNA, 13 bp, C. elegans
atttgaaacataa

SEQ ID NO: 706981 - DNA, 13 bp, C. elegans
atttgaaacattt

SEQ ID NO: 706982 - DNA, 13 bp, C. elegans
atttgaaagaata

SEQ ID NO: 706983 - DNA, 13 bp, C. elegans
atttgaaagcttt

SEQ ID NO: 706984 - DNA, 13 bp, C. elegans
atttgaaagtcaa

SEQ ID NO: 706985 - DNA, 13 bp, C. elegans
atttgaaagttaa

SEQ ID NO: 706986 - DNA, 13 bp, C. elegans
atttgaaagttgg

SEQ ID NO: 706987 - DNA, 13 bp, C. elegans
atttgaaagttgt

SEQ ID NO: 706988 - DNA, 13 bp, C. elegans
atttgaaataact

SEQ ID NO: 706989 - DNA, 13 bp, C. elegans
atttgaaatattg

SEQ ID NO: 706990 - DNA, 13 bp, C. elegans
atttgaaatcagc

SEQ ID NO: 706991 - DNA, 13 bp, C. elegans
atttgaaatcatt

SEQ ID NO: 706992 - DNA, 13 bp, C. elegans
atttgaaatctgt

SEQ ID NO: 706993 - DNA, 13 bp, C. elegans
atttgaaatgaat

SEQ ID NO: 706994 - DNA, 13 bp, C. elegans
atttgaaatgcat

SEQ ID NO: 706995 - DNA, 13 bp, C. elegans
atttgaaatgtgt

SEQ ID NO: 706996 - DNA, 13 bp, C. elegans
atttgaaatgttt

SEQ ID NO: 706997 - DNA, 13 bp, C. elegans
atttgaaattaca

SEQ ID NO: 706998 - DNA, 13 bp, C. elegans
atttgaaattcaa

SEQ ID NO: 706999 - DNA, 13 bp, C. elegans
atttgaaattcca

SEQ ID NO: 707000 - DNA, 13 bp, C. elegans
atttgaaattctt

SEQ ID NO: 707001 - DNA, 13 bp, C. elegans
atttgaaattgaa

SEQ ID NO: 707002 - DNA, 13 bp, C. elegans
atttgaaattgta

SEQ ID NO: 707003 - DNA, 13 bp, C. elegans
atttgaaattttg

SEQ ID NO: 707004 - DNA, 13 bp, C. elegans
atttgaacaaaac

SEQ ID NO: 707005 - DNA, 13 bp, C. elegans
atttgaacaagaa

SEQ ID NO: 707006 - DNA, 13 bp, C. elegans
atttgaacaattc

SEQ ID NO: 707007 - DNA, 13 bp, C. elegans
atttgaacaattt

SEQ ID NO: 707008 - DNA, 13 bp, C. elegans
atttgaacataaa

SEQ ID NO: 707009 - DNA, 13 bp, C. elegans
atttgaacatgaa

SEQ ID NO: 707010 - DNA, 13 bp, C. elegans
atttgaacattct

SEQ ID NO: 707011 - DNA, 13 bp, C. elegans
atttgaacatttt

SEQ ID NO: 707012 - DNA, 13 bp, C. elegans
atttgaaccgttt

SEQ ID NO: 707013 - DNA, 13 bp, C. elegans
atttgaactttaa

SEQ ID NO: 707014 - DNA, 13 bp, C. elegans
atttgaactttta

SEQ ID NO: 707015 - DNA, 14 bp, C. elegans
atttgaacttttta

SEQ ID NO: 707016 - DNA, 13 bp, C. elegans
atttgaagaaaat

SEQ ID NO: 707017 - DNA, 13 bp, C. elegans
atttgaagaaaca

SEQ ID NO: 707018 - DNA, 13 bp, C. elegans
atttgaagaaagt

SEQ ID NO: 707019 - DNA, 13 bp, C. elegans
atttgaagaacat

SEQ ID NO: 707020 - DNA, 13 bp, C. elegans
atttgaagaataa

SEQ ID NO: 707021 - DNA, 13 bp, C. elegans
atttgaagaatta

SEQ ID NO: 707022 - DNA, 13 bp, C. elegans
atttgaagataat

SEQ ID NO: 707023 - DNA, 13 bp, C. elegans
atttgaagatgaa

SEQ ID NO: 707024 - DNA, 13 bp, C. elegans
atttgaagatttc

SEQ ID NO: 707025 - DNA, 13 bp, C. elegans
atttgaagatttt

SEQ ID NO: 707026 - DNA, 13 bp, C. elegans
atttgaagcattt

SEQ ID NO: 707027 - DNA, 13 bp, C. elegans
atttgaagcccga

SEQ ID NO: 707028 - DNA, 13 bp, C. elegans
atttgaagcttta

SEQ ID NO: 707029 - DNA, 13 bp, C. elegans
atttgaaggaaaa

SEQ ID NO: 707030 - DNA, 13 bp, C. elegans
atttgaagggaaa

SEQ ID NO: 707031 - DNA, 13 bp, C. elegans
atttgaagttaca

SEQ ID NO: 707032 - DNA, 13 bp, C. elegans
atttgaagttggt

SEQ ID NO: 707033 - DNA, 13 bp, C. elegans
atttgaagttgtg

SEQ ID NO: 707034 - DNA, 13 bp, C. elegans
atttgaataaatc

SEQ ID NO: 707035 - DNA, 13 bp, C. elegans
atttgaataatgt

SEQ ID NO: 707036 - DNA, 13 bp, C. elegans
atttgaatacttt

SEQ ID NO: 707037 - DNA, 13 bp, C. elegans
atttgaatataga

SEQ ID NO: 707038 - DNA, 13 bp, C. elegans
atttgaatatcaa

SEQ ID NO: 707039 - DNA, 13 bp, C. elegans
atttgaatattga

SEQ ID NO: 707040 - DNA, 13 bp, C. elegans
atttgaatatttc

SEQ ID NO: 707041 - DNA, 13 bp, C. elegans
atttgaatctgaa

SEQ ID NO: 707042 - DNA, 13 bp, C. elegans
atttgaatgaaaa

SEQ ID NO: 707043 - DNA, 13 bp, C. elegans
atttgaatgaaat

SEQ ID NO: 707044 - DNA, 13 bp, C. elegans
atttgaatgtgaa

SEQ ID NO: 707045 - DNA, 13 bp, C. elegans
atttgaatgttta

SEQ ID NO: 707046 - DNA, 13 bp, C. elegans
atttgaatgtttc

SEQ ID NO: 707047 - DNA, 13 bp, C. elegans
atttgaattcaaa

SEQ ID NO: 707048 - DNA, 13 bp, C. elegans
atttgaattctcc

SEQ ID NO: 707049 - DNA, 13 bp, C. elegans
atttgaattgaaa

SEQ ID NO: 707050 - DNA, 13 bp, C. elegans
atttgaattgtaa

SEQ ID NO: 707051 - DNA, 13 bp, C. elegans
atttgaatttcat

SEQ ID NO: 707052 - DNA, 13 bp, C. elegans
atttgaatttccc

SEQ ID NO: 707053 - DNA, 13 bp, C. elegans
atttgaatttcga

SEQ ID NO: 707054 - DNA, 13 bp, C. elegans
atttgaatttcgc

SEQ ID NO: 707055 - DNA, 13 bp, C. elegans
atttgaatttctc

SEQ ID NO: 707056 - DNA, 13 bp, C. elegans
atttgaatttgac

SEQ ID NO: 707057 - DNA, 13 bp, C. elegans
atttgaatttgga

SEQ ID NO: 707058 - DNA, 13 bp, C. elegans
atttgaattttca

SEQ ID NO: 707059 - DNA, 14 bp, C. elegans
atttgaattttccg

SEQ ID NO: 707060 - DNA, 13 bp, C. elegans
atttgaattttcg

SEQ ID NO: 707061 - DNA, 13 bp, C. elegans
atttgaattttct

SEQ ID NO: 707062 - DNA, 13 bp, C. elegans
atttgaatttttc

SEQ ID NO: 707063 - DNA, 13 bp, C. elegans
atttgacaaaaaa

SEQ ID NO: 707064 - DNA, 13 bp, C. elegans
atttgacaaaaca

SEQ ID NO: 707065 - DNA, 13 bp, C. elegans
atttgacaaaatt

SEQ ID NO: 707066 - DNA, 13 bp, C. elegans
atttgacaaatca

SEQ ID NO: 707067 - DNA, 13 bp, C. elegans
atttgacaaatga

SEQ ID NO: 707068 - DNA, 13 bp, C. elegans
atttgacaaatgt

SEQ ID NO: 707069 - DNA, 13 bp, C. elegans
atttgacaatagt

SEQ ID NO: 707070 - DNA, 13 bp, C. elegans
atttgacaatttg

SEQ ID NO: 707071 - DNA, 13 bp, C. elegans
atttgacacacat

SEQ ID NO: 707072 - DNA, 13 bp, C. elegans
atttgacacattt

SEQ ID NO: 707073 - DNA, 13 bp, C. elegans
atttgacaccaaa

SEQ ID NO: 707074 - DNA, 13 bp, C. elegans
atttgacatattt

SEQ ID NO: 707075 - DNA, 13 bp, C. elegans
atttgacatgttt

SEQ ID NO: 707076 - DNA, 13 bp, C. elegans
atttgacattatt

SEQ ID NO: 707077 - DNA, 13 bp, C. elegans
atttgacatttga

SEQ ID NO: 707078 - DNA, 13 bp, C. elegans
atttgaccaaaaa

SEQ ID NO: 707079 - DNA, 13 bp, C. elegans
atttgaccaaaag

SEQ ID NO: 707080 - DNA, 13 bp, C. elegans
atttgaccaattt

SEQ ID NO: 707081 - DNA, 13 bp, C. elegans
atttgacccaaaa

SEQ ID NO: 707082 - DNA, 13 bp, C. elegans
atttgaccgaaaa

SEQ ID NO: 707083 - DNA, 13 bp, C. elegans
atttgaccgactt

SEQ ID NO: 707084 - DNA, 13 bp, C. elegans
atttgacctactt

SEQ ID NO: 707085 - DNA, 13 bp, C. elegans
atttgaccttttt

SEQ ID NO: 707086 - DNA, 13 bp, C. elegans
atttgacgagcaa

SEQ ID NO: 707087 - DNA, 13 bp, C. elegans
atttgacgcgcaa

SEQ ID NO: 707088 - DNA, 13 bp, C. elegans
atttgacggaaat

SEQ ID NO: 707089 - DNA, 13 bp, C. elegans
atttgactcataa

SEQ ID NO: 707090 - DNA, 13 bp, C. elegans
atttgactctttt

SEQ ID NO: 707091 - DNA, 13 bp, C. elegans
atttgactgaaat

SEQ ID NO: 707092 - DNA, 13 bp, C. elegans
atttgactgataa

SEQ ID NO: 707093 - DNA, 13 bp, C. elegans
atttgactggaaa

SEQ ID NO: 707094 - DNA, 13 bp, C. elegans
atttgactttgaa

SEQ ID NO: 707095 - DNA, 13 bp, C. elegans
atttgagaaaaga

SEQ ID NO: 707096 - DNA, 13 bp, C. elegans
atttgagaaagtt

SEQ ID NO: 707097 - DNA, 13 bp, C. elegans
atttgagaattca

SEQ ID NO: 707098 - DNA, 13 bp, C. elegans
atttgagaatttc

SEQ ID NO: 707099 - DNA, 13 bp, C. elegans
atttgagaatttg

SEQ ID NO: 707100 - DNA, 13 bp, C. elegans
atttgagagattt

SEQ ID NO: 707101 - DNA, 13 bp, C. elegans
atttgagagcttt

SEQ ID NO: 707102 - DNA, 13 bp, C. elegans
atttgagatttga

SEQ ID NO: 707103 - DNA, 13 bp, C. elegans
atttgagccaatt

SEQ ID NO: 707104 - DNA, 13 bp, C. elegans
atttgagcccatt

SEQ ID NO: 707105 - DNA, 13 bp, C. elegans
atttgagcttgaa

SEQ ID NO: 707106 - DNA, 13 bp, C. elegans
atttgaggaattt

SEQ ID NO: 707107 - DNA, 13 bp, C. elegans
atttgagtggaaa

SEQ ID NO: 707108 - DNA, 13 bp, C. elegans
atttgagtttgaa

SEQ ID NO: 707109 - DNA, 13 bp, C. elegans
atttgataaaaca

SEQ ID NO: 707110 - DNA, 13 bp, C. elegans
atttgataaacat

SEQ ID NO: 707111 - DNA, 13 bp, C. elegans
atttgataaatgt

SEQ ID NO: 707112 - DNA, 13 bp, C. elegans
atttgataacaaa

SEQ ID NO: 707113 - DNA, 13 bp, C. elegans
atttgatacattt

SEQ ID NO: 707114 - DNA, 13 bp, C. elegans
atttgatactatt

SEQ ID NO: 707115 - DNA, 13 bp, C. elegans
atttgatagatga

SEQ ID NO: 707116 - DNA, 13 bp, C. elegans
atttgatatgatt

SEQ ID NO: 707117 - DNA, 13 bp, C. elegans
atttgatattcaa

SEQ ID NO: 707118 - DNA, 13 bp, C. elegans
atttgatattcca

SEQ ID NO: 707119 - DNA, 13 bp, C. elegans
atttgatattgaa

SEQ ID NO: 707120 - DNA, 13 bp, C. elegans
atttgatatttga

SEQ ID NO: 707121 - DNA, 13 bp, C. elegans
atttgatattttc

SEQ ID NO: 707122 - DNA, 13 bp, C. elegans
atttgatcaattt

SEQ ID NO: 707123 - DNA, 13 bp, C. elegans
atttgatcagttt

SEQ ID NO: 707124 - DNA, 13 bp, C. elegans
atttgatcatttt

SEQ ID NO: 707125 - DNA, 13 bp, C. elegans
atttgatcgtttt

SEQ ID NO: 707126 - DNA, 13 bp, C. elegans
atttgatctacaa

SEQ ID NO: 707127 - DNA, 13 bp, C. elegans
atttgatctgaaa

SEQ ID NO: 707128 - DNA, 13 bp, C. elegans
atttgatgaaaaa

SEQ ID NO: 707129 - DNA, 13 bp, C. elegans
atttgatgaaaag

SEQ ID NO: 707130 - DNA, 13 bp, C. elegans
atttgatgaatat

SEQ ID NO: 707131 - DNA, 13 bp, C. elegans
atttgatgaattg

SEQ ID NO: 707132 - DNA, 13 bp, C. elegans
atttgatgatatt

SEQ ID NO: 707133 - DNA, 13 bp, C. elegans
atttgatgatgat

SEQ ID NO: 707134 - DNA, 13 bp, C. elegans
atttgatgattga

SEQ ID NO: 707135 - DNA, 13 bp, C. elegans
atttgatgcaatt

SEQ ID NO: 707136 - DNA, 13 bp, C. elegans
atttgatggaaat

SEQ ID NO: 707137 - DNA, 13 bp, C. elegans
atttgatgtaaaa

SEQ ID NO: 707138 - DNA, 13 bp, C. elegans
atttgattcaaat

SEQ ID NO: 707139 - DNA, 13 bp, C. elegans
atttgattcaatt

SEQ ID NO: 707140 - DNA, 13 bp, C. elegans
atttgattcattt

SEQ ID NO: 707141 - DNA, 13 bp, C. elegans
atttgattcgaaa

SEQ ID NO: 707142 - DNA, 13 bp, C. elegans
atttgattcttaa

SEQ ID NO: 707143 - DNA, 13 bp, C. elegans
atttgattgaatt

SEQ ID NO: 707144 - DNA, 13 bp, C. elegans
atttgatttatca

SEQ ID NO: 707145 - DNA, 13 bp, C. elegans
atttgatttcgaa

SEQ ID NO: 707146 - DNA, 13 bp, C. elegans
atttgatttgaaa

SEQ ID NO: 707147 - DNA, 13 bp, C. elegans
atttgatttgtga

SEQ ID NO: 707148 - DNA, 13 bp, C. elegans
atttgattttcta

SEQ ID NO: 707149 - DNA, 13 bp, C. elegans
atttgattttctg

SEQ ID NO: 707150 - DNA, 13 bp, C. elegans
atttgatttttca

SEQ ID NO: 707151 - DNA, 13 bp, C. elegans
atttgcaaaaaaa

SEQ ID NO: 707152 - DNA, 13 bp, C. elegans
atttgcaaaaagt

SEQ ID NO: 707153 - DNA, 13 bp, C. elegans
atttgcaaaaatg

SEQ ID NO: 707154 - DNA, 13 bp, C. elegans
atttgcaaaacaa

SEQ ID NO: 707155 - DNA, 13 bp, C. elegans
atttgcaaaagtg

SEQ ID NO: 707156 - DNA, 13 bp, C. elegans
atttgcaaaatat

SEQ ID NO: 707157 - DNA, 13 bp, C. elegans
atttgcaaaattt

SEQ ID NO: 707158 - DNA, 13 bp, C. elegans
atttgcaaatgtt

SEQ ID NO: 707159 - DNA, 13 bp, C. elegans
atttgcaaattta

SEQ ID NO: 707160 - DNA, 13 bp, C. elegans
atttgcaaatttc

SEQ ID NO: 707161 - DNA, 13 bp, C. elegans
atttgcaacaaaa

SEQ ID NO: 707162 - DNA, 13 bp, C. elegans
atttgcaacaaat

SEQ ID NO: 707163 - DNA, 13 bp, C. elegans
atttgcaagatgt

SEQ ID NO: 707164 - DNA, 13 bp, C. elegans
atttgcaataaat

SEQ ID NO: 707165 - DNA, 13 bp, C. elegans
atttgcaatactt

SEQ ID NO: 707166 - DNA, 13 bp, C. elegans
atttgcaatgaaa

SEQ ID NO: 707167 - DNA, 13 bp, C. elegans
atttgcaattatt

SEQ ID NO: 707168 - DNA, 13 bp, C. elegans
atttgcaatttct

SEQ ID NO: 707169 - DNA, 13 bp, C. elegans
atttgcaatttgc

SEQ ID NO: 707170 - DNA, 13 bp, C. elegans
atttgcaatttta

SEQ ID NO: 707171 - DNA, 13 bp, C. elegans
atttgcaattttt

SEQ ID NO: 707172 - DNA, 13 bp, C. elegans
atttgcacaattt

SEQ ID NO: 707173 - DNA, 13 bp, C. elegans
atttgcacaccaa

SEQ ID NO: 707174 - DNA, 13 bp, C. elegans
atttgcactgaaa

SEQ ID NO: 707175 - DNA, 13 bp, C. elegans
atttgcacttttt

SEQ ID NO: 707176 - DNA, 13 bp, C. elegans
atttgcagaaaaa

SEQ ID NO: 707177 - DNA, 13 bp, C. elegans
atttgcagaaatt

SEQ ID NO: 707178 - DNA, 13 bp, C. elegans
atttgcagtttgc

SEQ ID NO: 707179 - DNA, 13 bp, C. elegans
atttgcatattat

SEQ ID NO: 707180 - DNA, 13 bp, C. elegans
atttgcatcaaaa

SEQ ID NO: 707181 - DNA, 13 bp, C. elegans
atttgcattaaaa

SEQ ID NO: 707182 - DNA, 13 bp, C. elegans
atttgcattatta

SEQ ID NO: 707183 - DNA, 13 bp, C. elegans
atttgcattattt

SEQ ID NO: 707184 - DNA, 13 bp, C. elegans
atttgcattgaaa

SEQ ID NO: 707185 - DNA, 13 bp, C. elegans
atttgcattgttt

SEQ ID NO: 707186 - DNA, 13 bp, C. elegans
atttgccaaaatt

SEQ ID NO: 707187 - DNA, 13 bp, C. elegans
atttgccaaattt

SEQ ID NO: 707188 - DNA, 13 bp, C. elegans
atttgccaattcg

SEQ ID NO: 707189 - DNA, 13 bp, C. elegans
atttgccagaatt

SEQ ID NO: 707190 - DNA, 13 bp, C. elegans
atttgccattttc

SEQ ID NO: 707191 - DNA, 13 bp, C. elegans
atttgcccaaaat

SEQ ID NO: 707192 - DNA, 13 bp, C. elegans
atttgcccaaatt

SEQ ID NO: 707193 - DNA, 13 bp, C. elegans
atttgccgaaaaa

SEQ ID NO: 707194 - DNA, 13 bp, C. elegans
atttgccgaaatt

SEQ ID NO: 707195 - DNA, 13 bp, C. elegans
atttgccgaataa

SEQ ID NO: 707196 - DNA, 13 bp, C. elegans
atttgccgaattc

SEQ ID NO: 707197 - DNA, 13 bp, C. elegans
atttgccgaattt

SEQ ID NO: 707198 - DNA, 13 bp, C. elegans
atttgccgacaat

SEQ ID NO: 707199 - DNA, 13 bp, C. elegans
atttgccgagaaa

SEQ ID NO: 707200 - DNA, 13 bp, C. elegans
atttgccgagctt

SEQ ID NO: 707201 - DNA, 13 bp, C. elegans
atttgccgagttc

SEQ ID NO: 707202 - DNA, 13 bp, C. elegans
atttgccgattaa

SEQ ID NO: 707203 - DNA, 13 bp, C. elegans
atttgccgatttt

SEQ ID NO: 707204 - DNA, 13 bp, C. elegans
atttgccgcacac

SEQ ID NO: 707205 - DNA, 13 bp, C. elegans
atttgccggaaaa

SEQ ID NO: 707206 - DNA, 13 bp, C. elegans
atttgccggtaat

SEQ ID NO: 707207 - DNA, 13 bp, C. elegans
atttgccggtttt

SEQ ID NO: 707208 - DNA, 13 bp, C. elegans
atttgccgttttc

SEQ ID NO: 707209 - DNA, 13 bp, C. elegans
atttgcctttaaa

SEQ ID NO: 707210 - DNA, 13 bp, C. elegans
atttgcgaaaaaa

SEQ ID NO: 707211 - DNA, 13 bp, C. elegans
atttgcgaaaatt

SEQ ID NO: 707212 - DNA, 13 bp, C. elegans
atttgcgcaaaaa

SEQ ID NO: 707213 - DNA, 13 bp, C. elegans
atttgcgcgtcaa

SEQ ID NO: 707214 - DNA, 13 bp, C. elegans
atttgctaaaaat

SEQ ID NO: 707215 - DNA, 13 bp, C. elegans
atttgctatcgaa

SEQ ID NO: 707216 - DNA, 13 bp, C. elegans
atttgctattttc

SEQ ID NO: 707217 - DNA, 13 bp, C. elegans
atttgctcaattt

SEQ ID NO: 707218 - DNA, 13 bp, C. elegans
atttgctcacaaa

SEQ ID NO: 707219 - DNA, 13 bp, C. elegans
atttgctcatttc

SEQ ID NO: 707220 - DNA, 13 bp, C. elegans
atttgctccatca

SEQ ID NO: 707221 - DNA, 13 bp, C. elegans
atttgctctaaaa

SEQ ID NO: 707222 - DNA, 13 bp, C. elegans
atttgctgaaaaa

SEQ ID NO: 707223 - DNA, 13 bp, C. elegans
atttgctgaattt

SEQ ID NO: 707224 - DNA, 13 bp, C. elegans
atttgctgatttg

SEQ ID NO: 707225 - DNA, 13 bp, C. elegans
atttgctgatttt

SEQ ID NO: 707226 - DNA, 13 bp, C. elegans
atttgctggaaat

SEQ ID NO: 707227 - DNA, 13 bp, C. elegans
atttgcttaaaaa

SEQ ID NO: 707228 - DNA, 13 bp, C. elegans
atttgcttcaaaa

SEQ ID NO: 707229 - DNA, 13 bp, C. elegans
atttgcttgaaat

SEQ ID NO: 707230 - DNA, 14 bp, C. elegans
atttgctttaaatt

SEQ ID NO: 707231 - DNA, 13 bp, C. elegans
atttgctttcaaa

SEQ ID NO: 707232 - DNA, 13 bp, C. elegans
atttgctttgaaa

SEQ ID NO: 707233 - DNA, 13 bp, C. elegans
atttgctttttaa

SEQ ID NO: 707234 - DNA, 13 bp, C. elegans
atttggaaaaaag

SEQ ID NO: 707235 - DNA, 13 bp, C. elegans
atttggaaaaaat

SEQ ID NO: 707236 - DNA, 13 bp, C. elegans
atttggaaaaact

SEQ ID NO: 707237 - DNA, 14 bp, C. elegans
atttggaaaaagaa

SEQ ID NO: 707238 - DNA, 13 bp, C. elegans
atttggaaaaatt

SEQ ID NO: 707239 - DNA, 13 bp, C. elegans
atttggaaaactc

SEQ ID NO: 707240 - DNA, 13 bp, C. elegans
atttggaaaatat

SEQ ID NO: 707241 - DNA, 13 bp, C. elegans
atttggaaacatt

SEQ ID NO: 707242 - DNA, 13 bp, C. elegans
atttggaaacttt

SEQ ID NO: 707243 - DNA, 13 bp, C. elegans
atttggaaataat

SEQ ID NO: 707244 - DNA, 13 bp, C. elegans
atttggaaatatt

SEQ ID NO: 707245 - DNA, 13 bp, C. elegans
atttggaaatttt

SEQ ID NO: 707246 - DNA, 13 bp, C. elegans
atttggaacattt

SEQ ID NO: 707247 - DNA, 14 bp, C. elegans
atttggaagaaaat

SEQ ID NO: 707248 - DNA, 13 bp, C. elegans
atttggaagaatt

SEQ ID NO: 707249 - DNA, 13 bp, C. elegans
atttggaagattt

SEQ ID NO: 707250 - DNA, 13 bp, C. elegans
atttggaagcagc

SEQ ID NO: 707251 - DNA, 13 bp, C. elegans
atttggaagtttg

SEQ ID NO: 707252 - DNA, 13 bp, C. elegans
atttggaataaat

SEQ ID NO: 707253 - DNA, 13 bp, C. elegans
atttggaataatt

SEQ ID NO: 707254 - DNA, 13 bp, C. elegans
atttggaatatta

SEQ ID NO: 707255 - DNA, 13 bp, C. elegans
atttggaatattt

SEQ ID NO: 707256 - DNA, 13 bp, C. elegans
atttggaatcaaa

SEQ ID NO: 707257 - DNA, 13 bp, C. elegans
atttggaattaaa

SEQ ID NO: 707258 - DNA, 13 bp, C. elegans
atttggaatttga

SEQ ID NO: 707259 - DNA, 13 bp, C. elegans
atttggacaaaaa

SEQ ID NO: 707260 - DNA, 13 bp, C. elegans
atttggacaaaat

SEQ ID NO: 707261 - DNA, 13 bp, C. elegans
atttggacaaatt

SEQ ID NO: 707262 - DNA, 13 bp, C. elegans
atttggacatttt

SEQ ID NO: 707263 - DNA, 13 bp, C. elegans
atttggagaaaat

SEQ ID NO: 707264 - DNA, 13 bp, C. elegans
atttggagaaatt

SEQ ID NO: 707265 - DNA, 13 bp, C. elegans
atttggagagctc

SEQ ID NO: 707266 - DNA, 13 bp, C. elegans
atttggagcaatt

SEQ ID NO: 707267 - DNA, 13 bp, C. elegans
atttggagcattt

SEQ ID NO: 707268 - DNA, 13 bp, C. elegans
atttggagccatt

SEQ ID NO: 707269 - DNA, 13 bp, C. elegans
atttggagcggcc

SEQ ID NO: 707270 - DNA, 13 bp, C. elegans
atttggatctcga

SEQ ID NO: 707271 - DNA, 13 bp, C. elegans
atttggatttaaa

SEQ ID NO: 707272 - DNA, 13 bp, C. elegans
atttggatttcta

SEQ ID NO: 707273 - DNA, 13 bp, C. elegans
atttggattttca

SEQ ID NO: 707274 - DNA, 13 bp, C. elegans
atttggcaaactt

SEQ ID NO: 707275 - DNA, 13 bp, C. elegans
atttggcaattta

SEQ ID NO: 707276 - DNA, 13 bp, C. elegans
atttggccgtttt

SEQ ID NO: 707277 - DNA, 13 bp, C. elegans
atttggcgaaaaa

SEQ ID NO: 707278 - DNA, 13 bp, C. elegans
atttggcgcaaaa

SEQ ID NO: 707279 - DNA, 13 bp, C. elegans
atttggcggaaaa

SEQ ID NO: 707280 - DNA, 13 bp, C. elegans
atttggcttgaaa

SEQ ID NO: 707281 - DNA, 13 bp, C. elegans
atttgggaataaa

SEQ ID NO: 707282 - DNA, 13 bp, C. elegans
atttgggagttga

SEQ ID NO: 707283 - DNA, 13 bp, C. elegans
atttggggaaatt

SEQ ID NO: 707284 - DNA, 13 bp, C. elegans
atttggtaaaaaa

SEQ ID NO: 707285 - DNA, 13 bp, C. elegans
atttggtaaaaga

SEQ ID NO: 707286 - DNA, 13 bp, C. elegans
atttggtacattt

SEQ ID NO: 707287 - DNA, 13 bp, C. elegans
atttggtagaaaa

SEQ ID NO: 707288 - DNA, 13 bp, C. elegans
atttggtcaaatt

SEQ ID NO: 707289 - DNA, 13 bp, C. elegans
atttggtcattgt

SEQ ID NO: 707290 - DNA, 13 bp, C. elegans
atttggtgaacgg

SEQ ID NO: 707291 - DNA, 13 bp, C. elegans
atttggtgaattt

SEQ ID NO: 707292 - DNA, 13 bp, C. elegans
atttggtggaaat

SEQ ID NO: 707293 - DNA, 13 bp, C. elegans
atttggttggaaa

SEQ ID NO: 707294 - DNA, 13 bp, C. elegans
atttggttttaaa

SEQ ID NO: 707295 - DNA, 13 bp, C. elegans
atttggtttttgc

SEQ ID NO: 707296 - DNA, 13 bp, C. elegans
atttgtaaaaact

SEQ ID NO: 707297 - DNA, 13 bp, C. elegans
atttgtaaaacaa

SEQ ID NO: 707298 - DNA, 13 bp, C. elegans
atttgtaaaatga

SEQ ID NO: 707299 - DNA, 13 bp, C. elegans
atttgtaaatcta

SEQ ID NO: 707300 - DNA, 13 bp, C. elegans
atttgtaatttga

SEQ ID NO: 707301 - DNA, 13 bp, C. elegans
atttgtacatttc

SEQ ID NO: 707302 - DNA, 13 bp, C. elegans
atttgtagaaaat

SEQ ID NO: 707303 - DNA, 13 bp, C. elegans
atttgtatacttt

SEQ ID NO: 707304 - DNA, 13 bp, C. elegans
atttgtatagaaa

SEQ ID NO: 707305 - DNA, 13 bp, C. elegans
atttgtatattca

SEQ ID NO: 707306 - DNA, 13 bp, C. elegans
atttgtatgtatg

SEQ ID NO: 707307 - DNA, 13 bp, C. elegans
atttgtattcaaa

SEQ ID NO: 707308 - DNA, 13 bp, C. elegans
atttgtattgcat

SEQ ID NO: 707309 - DNA, 13 bp, C. elegans
atttgtatttaca

SEQ ID NO: 707310 - DNA, 13 bp, C. elegans
atttgtatttcaa

SEQ ID NO: 707311 - DNA, 13 bp, C. elegans
atttgtatttcca

SEQ ID NO: 707312 - DNA, 13 bp, C. elegans
atttgtattttca

SEQ ID NO: 707313 - DNA, 13 bp, C. elegans
atttgtcaaacaa

SEQ ID NO: 707314 - DNA, 13 bp, C. elegans
atttgtcaaagaa

SEQ ID NO: 707315 - DNA, 13 bp, C. elegans
atttgtcaatttc

SEQ ID NO: 707316 - DNA, 13 bp, C. elegans
atttgtcacaaat

SEQ ID NO: 707317 - DNA, 13 bp, C. elegans
atttgtcagaatt

SEQ ID NO: 707318 - DNA, 13 bp, C. elegans
atttgtcagttga

SEQ ID NO: 707319 - DNA, 13 bp, C. elegans
atttgtcatattt

SEQ ID NO: 707320 - DNA, 13 bp, C. elegans
atttgtcatttga

SEQ ID NO: 707321 - DNA, 13 bp, C. elegans
atttgtcattttg

SEQ ID NO: 707322 - DNA, 13 bp, C. elegans
atttgtccatttt

SEQ ID NO: 707323 - DNA, 13 bp, C. elegans
atttgtcccaaaa

SEQ ID NO: 707324 - DNA, 13 bp, C. elegans
atttgtcgaaaat

SEQ ID NO: 707325 - DNA, 13 bp, C. elegans
atttgtcgaattg

SEQ ID NO: 707326 - DNA, 13 bp, C. elegans
atttgtcggaatt

SEQ ID NO: 707327 - DNA, 13 bp, C. elegans
atttgtcgtcaaa

SEQ ID NO: 707328 - DNA, 13 bp, C. elegans
atttgtctacaaa

SEQ ID NO: 707329 - DNA, 13 bp, C. elegans
atttgtctgaaat

SEQ ID NO: 707330 - DNA, 13 bp, C. elegans
atttgtcttttga

SEQ ID NO: 707331 - DNA, 13 bp, C. elegans
atttgtgaaataa

SEQ ID NO: 707332 - DNA, 13 bp, C. elegans
atttgtgaaattt

SEQ ID NO: 707333 - DNA, 13 bp, C. elegans
atttgtgaatatt

SEQ ID NO: 707334 - DNA, 13 bp, C. elegans
atttgtgaatgaa

SEQ ID NO: 707335 - DNA, 13 bp, C. elegans
atttgtgaattct

SEQ ID NO: 707336 - DNA, 13 bp, C. elegans
atttgtgatgaat

SEQ ID NO: 707337 - DNA, 13 bp, C. elegans
atttgtgattgaa

SEQ ID NO: 707338 - DNA, 13 bp, C. elegans
atttgtgcaaaca

SEQ ID NO: 707339 - DNA, 13 bp, C. elegans
atttgtgcaattt

SEQ ID NO: 707340 - DNA, 13 bp, C. elegans
atttgtgcacaaa

SEQ ID NO: 707341 - DNA, 13 bp, C. elegans
atttgtgcatttt

SEQ ID NO: 707342 - DNA, 13 bp, C. elegans
atttgtggaaaaa

SEQ ID NO: 707343 - DNA, 13 bp, C. elegans
atttgtggaaaac

SEQ ID NO: 707344 - DNA, 13 bp, C. elegans
atttgtggaaaat

SEQ ID NO: 707345 - DNA, 13 bp, C. elegans
atttgtgtagatt

SEQ ID NO: 707346 - DNA, 13 bp, C. elegans
atttgtgtcaaaa

SEQ ID NO: 707347 - DNA, 13 bp, C. elegans
atttgtgtcaatt

SEQ ID NO: 707348 - DNA, 13 bp, C. elegans
atttgtgtgaaaa

SEQ ID NO: 707349 - DNA, 13 bp, C. elegans
atttgtgttaaaa

SEQ ID NO: 707350 - DNA, 13 bp, C. elegans
atttgtgttaaat

SEQ ID NO: 707351 - DNA, 13 bp, C. elegans
atttgttaaaaac

SEQ ID NO: 707352 - DNA, 13 bp, C. elegans
atttgttaaatga

SEQ ID NO: 707353 - DNA, 13 bp, C. elegans
atttgttaacttt

SEQ ID NO: 707354 - DNA, 13 bp, C. elegans
atttgttactaaa

SEQ ID NO: 707355 - DNA, 13 bp, C. elegans
atttgttagaaaa

SEQ ID NO: 707356 - DNA, 13 bp, C. elegans
atttgttagaaat

SEQ ID NO: 707357 - DNA, 13 bp, C. elegans
atttgttagaatt

SEQ ID NO: 707358 - DNA, 13 bp, C. elegans
atttgttagttga

SEQ ID NO: 707359 - DNA, 13 bp, C. elegans
atttgttatacat

SEQ ID NO: 707360 - DNA, 13 bp, C. elegans
atttgttatcaat

SEQ ID NO: 707361 - DNA, 13 bp, C. elegans
atttgttattcaa

SEQ ID NO: 707362 - DNA, 13 bp, C. elegans
atttgttattgaa

SEQ ID NO: 707363 - DNA, 13 bp, C. elegans
atttgttcaaaag

SEQ ID NO: 707364 - DNA, 13 bp, C. elegans
atttgttcaaaat

SEQ ID NO: 707365 - DNA, 13 bp, C. elegans
atttgttcaaatt

SEQ ID NO: 707366 - DNA, 13 bp, C. elegans
atttgttcaattt

SEQ ID NO: 707367 - DNA, 13 bp, C. elegans
atttgttcagttt

SEQ ID NO: 707368 - DNA, 13 bp, C. elegans
atttgttcatttg

SEQ ID NO: 707369 - DNA, 13 bp, C. elegans
atttgttccaatt

SEQ ID NO: 707370 - DNA, 13 bp, C. elegans
atttgttccattt

SEQ ID NO: 707371 - DNA, 13 bp, C. elegans
atttgttcgatgg

SEQ ID NO: 707372 - DNA, 13 bp, C. elegans
atttgttctaaaa

SEQ ID NO: 707373 - DNA, 13 bp, C. elegans
atttgttctgaaa

SEQ ID NO: 707374 - DNA, 13 bp, C. elegans
atttgttctgaat

SEQ ID NO: 707375 - DNA, 13 bp, C. elegans
atttgttgaaatt

SEQ ID NO: 707376 - DNA, 13 bp, C. elegans
atttgttgaacaa

SEQ ID NO: 707377 - DNA, 13 bp, C. elegans
atttgttgaagaa

SEQ ID NO: 707378 - DNA, 13 bp, C. elegans
atttgttgaatat

SEQ ID NO: 707379 - DNA, 13 bp, C. elegans
atttgttgaatta

SEQ ID NO: 707380 - DNA, 13 bp, C. elegans
atttgttgcaatt

SEQ ID NO: 707381 - DNA, 13 bp, C. elegans
atttgttgcattt

SEQ ID NO: 707382 - DNA, 13 bp, C. elegans
atttgttggaatt

SEQ ID NO: 707383 - DNA, 13 bp, C. elegans
atttgttgtaaat

SEQ ID NO: 707384 - DNA, 13 bp, C. elegans
atttgtttatcag

SEQ ID NO: 707385 - DNA, 13 bp, C. elegans
atttgtttcaaat

SEQ ID NO: 707386 - DNA, 13 bp, C. elegans
atttgtttcaatt

SEQ ID NO: 707387 - DNA, 13 bp, C. elegans
atttgtttctaat

SEQ ID NO: 707388 - DNA, 13 bp, C. elegans
atttgtttcttaa

SEQ ID NO: 707389 - DNA, 13 bp, C. elegans
atttgtttgagaa

SEQ ID NO: 707390 - DNA, 13 bp, C. elegans
atttgtttggaaa

SEQ ID NO: 707391 - DNA, 13 bp, C. elegans
atttgttttatca

SEQ ID NO: 707392 - DNA, 13 bp, C. elegans
atttgttttcgaa

SEQ ID NO: 707393 - DNA, 13 bp, C. elegans
atttgttttctaa

SEQ ID NO: 707394 - DNA, 13 bp, C. elegans
atttgttttgcaa

SEQ ID NO: 707395 - DNA, 14 bp, C. elegans
atttgtttttcaaa

SEQ ID NO: 707396 - DNA, 13 bp, C. elegans
attttaaaaccga

SEQ ID NO: 707397 - DNA, 13 bp, C. elegans
attttaaaacctt

SEQ ID NO: 707398 - DNA, 13 bp, C. elegans
attttaaaactct

SEQ ID NO: 707399 - DNA, 13 bp, C. elegans
attttaaaacttc

SEQ ID NO: 707400 - DNA, 13 bp, C. elegans
attttaaaatggt

SEQ ID NO: 707401 - DNA, 13 bp, C. elegans
attttaaacctaa

SEQ ID NO: 707402 - DNA, 13 bp, C. elegans
attttaaactcaa

SEQ ID NO: 707403 - DNA, 14 bp, C. elegans
attttaaactgttt

SEQ ID NO: 707404 - DNA, 13 bp, C. elegans
attttaaagaaac

SEQ ID NO: 707405 - DNA, 13 bp, C. elegans
attttaaagcaaa

SEQ ID NO: 707406 - DNA, 13 bp, C. elegans
attttaaagcatt

SEQ ID NO: 707407 - DNA, 13 bp, C. elegans
attttaaagccaa

SEQ ID NO: 707408 - DNA, 13 bp, C. elegans
attttaaagtgaa

SEQ ID NO: 707409 - DNA, 13 bp, C. elegans
attttaaagtgga

SEQ ID NO: 707410 - DNA, 13 bp, C. elegans
attttaaatcgaa

SEQ ID NO: 707411 - DNA, 13 bp, C. elegans
attttaaattccg

SEQ ID NO: 707412 - DNA, 13 bp, C. elegans
attttaacaagaa

SEQ ID NO: 707413 - DNA, 13 bp, C. elegans
attttaacatgtt

SEQ ID NO: 707414 - DNA, 13 bp, C. elegans
attttaacgaaaa

SEQ ID NO: 707415 - DNA, 13 bp, C. elegans
attttaacgattt

SEQ ID NO: 707416 - DNA, 13 bp, C. elegans
attttaacgtatt

SEQ ID NO: 707417 - DNA, 13 bp, C. elegans
attttaactcaaa

SEQ ID NO: 707418 - DNA, 13 bp, C. elegans
attttaactcaat

SEQ ID NO: 707419 - DNA, 13 bp, C. elegans
attttaactttga

SEQ ID NO: 707420 - DNA, 13 bp, C. elegans
attttaagaaaac

SEQ ID NO: 707421 - DNA, 13 bp, C. elegans
attttaagacaaa

SEQ ID NO: 707422 - DNA, 13 bp, C. elegans
attttaagacgaa

SEQ ID NO: 707423 - DNA, 13 bp, C. elegans
attttaagatgaa

SEQ ID NO: 707424 - DNA, 13 bp, C. elegans
attttaagcaaaa

SEQ ID NO: 707425 - DNA, 13 bp, C. elegans
attttaagccaaa

SEQ ID NO: 707426 - DNA, 13 bp, C. elegans
attttaagctaaa

SEQ ID NO: 707427 - DNA, 13 bp, C. elegans
attttaagctgat

SEQ ID NO: 707428 - DNA, 13 bp, C. elegans
attttaagcttaa

SEQ ID NO: 707429 - DNA, 13 bp, C. elegans
attttaagcttca

SEQ ID NO: 707430 - DNA, 13 bp, C. elegans
attttaaggattt

SEQ ID NO: 707431 - DNA, 13 bp, C. elegans
attttaagtagaa

SEQ ID NO: 707432 - DNA, 13 bp, C. elegans
attttaagtcaaa

SEQ ID NO: 707433 - DNA, 13 bp, C. elegans
attttaagtgaat

SEQ ID NO: 707434 - DNA, 13 bp, C. elegans
attttaagtgcaa

SEQ ID NO: 707435 - DNA, 13 bp, C. elegans
attttaagttgta

SEQ ID NO: 707436 - DNA, 13 bp, C. elegans
attttaatacagt

SEQ ID NO: 707437 - DNA, 13 bp, C. elegans
attttaataggaa

SEQ ID NO: 707438 - DNA, 13 bp, C. elegans
attttaatcagaa

SEQ ID NO: 707439 - DNA, 13 bp, C. elegans
attttaatccatt

SEQ ID NO: 707440 - DNA, 13 bp, C. elegans
attttaatctcaa

SEQ ID NO: 707441 - DNA, 13 bp, C. elegans
attttaatggaaa

SEQ ID NO: 707442 - DNA, 13 bp, C. elegans
attttaatggaat

SEQ ID NO: 707443 - DNA, 13 bp, C. elegans
attttaatgtcaa

SEQ ID NO: 707444 - DNA, 13 bp, C. elegans
attttaattcagt

SEQ ID NO: 707445 - DNA, 13 bp, C. elegans
attttaattctga

SEQ ID NO: 707446 - DNA, 13 bp, C. elegans
attttaatttcag

SEQ ID NO: 707447 - DNA, 13 bp, C. elegans
attttaattttcg

SEQ ID NO: 707448 - DNA, 13 bp, C. elegans
attttacaacgaa

SEQ ID NO: 707449 - DNA, 13 bp, C. elegans
attttacaacttt

SEQ ID NO: 707450 - DNA, 13 bp, C. elegans
attttacaagaaa

SEQ ID NO: 707451 - DNA, 13 bp, C. elegans
attttacaatcaa

SEQ ID NO: 707452 - DNA, 13 bp, C. elegans
attttacaatcat

SEQ ID NO: 707453 - DNA, 13 bp, C. elegans
attttacaatgat

SEQ ID NO: 707454 - DNA, 13 bp, C. elegans
attttacaattct

SEQ ID NO: 707455 - DNA, 13 bp, C. elegans
attttacactaaa

SEQ ID NO: 707456 - DNA, 13 bp, C. elegans
attttacagtttt

SEQ ID NO: 707457 - DNA, 13 bp, C. elegans
attttacatcatt

SEQ ID NO: 707458 - DNA, 13 bp, C. elegans
attttacatgttt

SEQ ID NO: 707459 - DNA, 13 bp, C. elegans
attttacattcaa

SEQ ID NO: 707460 - DNA, 13 bp, C. elegans
attttacattgcc

SEQ ID NO: 707461 - DNA, 13 bp, C. elegans
attttacatttgt

SEQ ID NO: 707462 - DNA, 13 bp, C. elegans
attttaccaaaaa

SEQ ID NO: 707463 - DNA, 13 bp, C. elegans
attttacgaaaaa

SEQ ID NO: 707464 - DNA, 13 bp, C. elegans
attttacgacttt

SEQ ID NO: 707465 - DNA, 13 bp, C. elegans
attttacgatttc

SEQ ID NO: 707466 - DNA, 13 bp, C. elegans
attttacgatttt

SEQ ID NO: 707467 - DNA, 13 bp, C. elegans
attttacgcgcaa

SEQ ID NO: 707468 - DNA, 13 bp, C. elegans
attttactaacaa

SEQ ID NO: 707469 - DNA, 13 bp, C. elegans
attttactcaatt

SEQ ID NO: 707470 - DNA, 13 bp, C. elegans
attttactccaaa

SEQ ID NO: 707471 - DNA, 13 bp, C. elegans
attttactcgaaa

SEQ ID NO: 707472 - DNA, 13 bp, C. elegans
attttactctctg

SEQ ID NO: 707473 - DNA, 13 bp, C. elegans
attttactgaaaa

SEQ ID NO: 707474 - DNA, 13 bp, C. elegans
attttactggttt

SEQ ID NO: 707475 - DNA, 13 bp, C. elegans
attttagaaatga

SEQ ID NO: 707476 - DNA, 13 bp, C. elegans
attttagaacaat

SEQ ID NO: 707477 - DNA, 13 bp, C. elegans
attttagaagttg

SEQ ID NO: 707478 - DNA, 13 bp, C. elegans
attttagaattga

SEQ ID NO: 707479 - DNA, 13 bp, C. elegans
attttagaatttg

SEQ ID NO: 707480 - DNA, 13 bp, C. elegans
attttagacaatt

SEQ ID NO: 707481 - DNA, 13 bp, C. elegans
attttagacattt

SEQ ID NO: 707482 - DNA, 13 bp, C. elegans
attttagagagaa

SEQ ID NO: 707483 - DNA, 13 bp, C. elegans
attttagaggaaa

SEQ ID NO: 707484 - DNA, 13 bp, C. elegans
attttagagggaa

SEQ ID NO: 707485 - DNA, 13 bp, C. elegans
attttagatgaaa

SEQ ID NO: 707486 - DNA, 13 bp, C. elegans
attttagattcaa

SEQ ID NO: 707487 - DNA, 13 bp, C. elegans
attttagatttga

SEQ ID NO: 707488 - DNA, 13 bp, C. elegans
attttagcaaata

SEQ ID NO: 707489 - DNA, 13 bp, C. elegans
attttagcaaatt

SEQ ID NO: 707490 - DNA, 13 bp, C. elegans
attttagctaaaa

SEQ ID NO: 707491 - DNA, 13 bp, C. elegans
attttagctgaaa

SEQ ID NO: 707492 - DNA, 13 bp, C. elegans
attttaggaaatt

SEQ ID NO: 707493 - DNA, 13 bp, C. elegans
attttaggatttc

SEQ ID NO: 707494 - DNA, 13 bp, C. elegans
attttaggcattt

SEQ ID NO: 707495 - DNA, 13 bp, C. elegans
attttagggaaaa

SEQ ID NO: 707496 - DNA, 13 bp, C. elegans
attttaggtgaat

SEQ ID NO: 707497 - DNA, 13 bp, C. elegans
attttagtcattt

SEQ ID NO: 707498 - DNA, 13 bp, C. elegans
attttagtctaat

SEQ ID NO: 707499 - DNA, 13 bp, C. elegans
attttagtgaact

SEQ ID NO: 707500 - DNA, 13 bp, C. elegans
attttagtggaaa

SEQ ID NO: 707501 - DNA, 13 bp, C. elegans
attttagttcaaa

SEQ ID NO: 707502 - DNA, 13 bp, C. elegans
attttagttttca

SEQ ID NO: 707503 - DNA, 13 bp, C. elegans
attttatacaatg

SEQ ID NO: 707504 - DNA, 13 bp, C. elegans
attttatagagtt

SEQ ID NO: 707505 - DNA, 13 bp, C. elegans
attttatagctaa

SEQ ID NO: 707506 - DNA, 13 bp, C. elegans
attttataggaaa

SEQ ID NO: 707507 - DNA, 13 bp, C. elegans
attttatcaaact

SEQ ID NO: 707508 - DNA, 13 bp, C. elegans
attttatcaatca

SEQ ID NO: 707509 - DNA, 13 bp, C. elegans
attttatcagttc

SEQ ID NO: 707510 - DNA, 13 bp, C. elegans
attttatcagttt

SEQ ID NO: 707511 - DNA, 13 bp, C. elegans
attttatccaaaa

SEQ ID NO: 707512 - DNA, 13 bp, C. elegans
attttatcgaaaa

SEQ ID NO: 707513 - DNA, 13 bp, C. elegans
attttatctaatg

SEQ ID NO: 707514 - DNA, 13 bp, C. elegans
attttatctcaat

SEQ ID NO: 707515 - DNA, 13 bp, C. elegans
attttatgaaaac

SEQ ID NO: 707516 - DNA, 13 bp, C. elegans
attttatgaacat

SEQ ID NO: 707517 - DNA, 13 bp, C. elegans
attttatgaagaa

SEQ ID NO: 707518 - DNA, 13 bp, C. elegans
attttatgagaaa

SEQ ID NO: 707519 - DNA, 13 bp, C. elegans
attttatgcaaaa

SEQ ID NO: 707520 - DNA, 13 bp, C. elegans
attttatgcaatt

SEQ ID NO: 707521 - DNA, 13 bp, C. elegans
attttatgcattt

SEQ ID NO: 707522 - DNA, 13 bp, C. elegans
attttatgccaaa

SEQ ID NO: 707523 - DNA, 13 bp, C. elegans
attttatgctaaa

SEQ ID NO: 707524 - DNA, 13 bp, C. elegans
attttatggaaac

SEQ ID NO: 707525 - DNA, 13 bp, C. elegans
attttatggagaa

SEQ ID NO: 707526 - DNA, 13 bp, C. elegans
attttatgtagaa

SEQ ID NO: 707527 - DNA, 13 bp, C. elegans
attttatgtcaaa

SEQ ID NO: 707528 - DNA, 13 bp, C. elegans
attttattacact

SEQ ID NO: 707529 - DNA, 13 bp, C. elegans
attttattacagt

SEQ ID NO: 707530 - DNA, 13 bp, C. elegans
attttattactgt

SEQ ID NO: 707531 - DNA, 13 bp, C. elegans
attttattcacaa

SEQ ID NO: 707532 - DNA, 13 bp, C. elegans
attttattcagaa

SEQ ID NO: 707533 - DNA, 13 bp, C. elegans
attttattctctg

SEQ ID NO: 707534 - DNA, 13 bp, C. elegans
attttattctgaa

SEQ ID NO: 707535 - DNA, 13 bp, C. elegans
attttattgaaga

SEQ ID NO: 707536 - DNA, 13 bp, C. elegans
attttattgaatc

SEQ ID NO: 707537 - DNA, 13 bp, C. elegans
attttattgcatt

SEQ ID NO: 707538 - DNA, 13 bp, C. elegans
attttattggaaa

SEQ ID NO: 707539 - DNA, 13 bp, C. elegans
attttattgtcaa

SEQ ID NO: 707540 - DNA, 13 bp, C. elegans
attttattgttca

SEQ ID NO: 707541 - DNA, 13 bp, C. elegans
attttatttcaga

SEQ ID NO: 707542 - DNA, 13 bp, C. elegans
attttatttccag

SEQ ID NO: 707543 - DNA, 13 bp, C. elegans
attttatttcgaa

SEQ ID NO: 707544 - DNA, 13 bp, C. elegans
attttcaaaaaag

SEQ ID NO: 707545 - DNA, 13 bp, C. elegans
attttcaaaaact

SEQ ID NO: 707546 - DNA, 14 bp, C. elegans
attttcaaaacaaa

SEQ ID NO: 707547 - DNA, 13 bp, C. elegans
attttcaaaacat

SEQ ID NO: 707548 - DNA, 13 bp, C. elegans
attttcaaaactg

SEQ ID NO: 707549 - DNA, 13 bp, C. elegans
attttcaaaactt

SEQ ID NO: 707550 - DNA, 13 bp, C. elegans
attttcaaaagaa

SEQ ID NO: 707551 - DNA, 13 bp, C. elegans
attttcaaaagga

SEQ ID NO: 707552 - DNA, 13 bp, C. elegans
attttcaaaagtc

SEQ ID NO: 707553 - DNA, 13 bp, C. elegans
attttcaaaatac

SEQ ID NO: 707554 - DNA, 13 bp, C. elegans
attttcaaaatct

SEQ ID NO: 707555 - DNA, 13 bp, C. elegans
attttcaaaatga

SEQ ID NO: 707556 - DNA, 13 bp, C. elegans
attttcaaaatgg

SEQ ID NO: 707557 - DNA, 13 bp, C. elegans
attttcaaaattc

SEQ ID NO: 707558 - DNA, 13 bp, C. elegans
attttcaaaattg

SEQ ID NO: 707559 - DNA, 13 bp, C. elegans
attttcaaacaaa

SEQ ID NO: 707560 - DNA, 13 bp, C. elegans
attttcaaacgag

SEQ ID NO: 707561 - DNA, 13 bp, C. elegans
attttcaaactca

SEQ ID NO: 707562 - DNA, 13 bp, C. elegans
attttcaaacttt

SEQ ID NO: 707563 - DNA, 13 bp, C. elegans
attttcaaaggaa

SEQ ID NO: 707564 - DNA, 13 bp, C. elegans
attttcaaaggtg

SEQ ID NO: 707565 - DNA, 13 bp, C. elegans
attttcaaagtaa

SEQ ID NO: 707566 - DNA, 13 bp, C. elegans
attttcaaagtta

SEQ ID NO: 707567 - DNA, 13 bp, C. elegans
attttcaaagttt

SEQ ID NO: 707568 - DNA, 13 bp, C. elegans
attttcaaatagt

SEQ ID NO: 707569 - DNA, 13 bp, C. elegans
attttcaaatcaa

SEQ ID NO: 707570 - DNA, 13 bp, C. elegans
attttcaaatctg

SEQ ID NO: 707571 - DNA, 13 bp, C. elegans
attttcaaatgga

SEQ ID NO: 707572 - DNA, 13 bp, C. elegans
attttcaaattac

SEQ ID NO: 707573 - DNA, 14 bp, C. elegans
attttcaaattaga

SEQ ID NO: 707574 - DNA, 14 bp, C. elegans
attttcaaattgtt

SEQ ID NO: 707575 - DNA, 13 bp, C. elegans
attttcaacaaaa

SEQ ID NO: 707576 - DNA, 13 bp, C. elegans
attttcaacaaat

SEQ ID NO: 707577 - DNA, 13 bp, C. elegans
attttcaacaaga

SEQ ID NO: 707578 - DNA, 13 bp, C. elegans
attttcaacaatt

SEQ ID NO: 707579 - DNA, 13 bp, C. elegans
attttcaacagtt

SEQ ID NO: 707580 - DNA, 13 bp, C. elegans
attttcaacattg

SEQ ID NO: 707581 - DNA, 14 bp, C. elegans
attttcaaccaatt

SEQ ID NO: 707582 - DNA, 13 bp, C. elegans
attttcaaccatt

SEQ ID NO: 707583 - DNA, 13 bp, C. elegans
attttcaacgaaa

SEQ ID NO: 707584 - DNA, 13 bp, C. elegans
attttcaactact

SEQ ID NO: 707585 - DNA, 13 bp, C. elegans
attttcaactgga

SEQ ID NO: 707586 - DNA, 13 bp, C. elegans
attttcaactgtt

SEQ ID NO: 707587 - DNA, 13 bp, C. elegans
attttcaacttct

SEQ ID NO: 707588 - DNA, 13 bp, C. elegans
attttcaacttga

SEQ ID NO: 707589 - DNA, 13 bp, C. elegans
attttcaactttc

SEQ ID NO: 707590 - DNA, 15 bp, C. elegans
attttcaagaaaaaa

SEQ ID NO: 707591 - DNA, 13 bp, C. elegans
attttcaagatat

SEQ ID NO: 707592 - DNA, 13 bp, C. elegans
attttcaagatca

SEQ ID NO: 707593 - DNA, 13 bp, C. elegans
attttcaagatgt

SEQ ID NO: 707594 - DNA, 13 bp, C. elegans
attttcaagcaaa

SEQ ID NO: 707595 - DNA, 13 bp, C. elegans
attttcaagcatt

SEQ ID NO: 707596 - DNA, 13 bp, C. elegans
attttcaagcgtt

SEQ ID NO: 707597 - DNA, 13 bp, C. elegans
attttcaagtcaa

SEQ ID NO: 707598 - DNA, 13 bp, C. elegans
attttcaagtctt

SEQ ID NO: 707599 - DNA, 13 bp, C. elegans
attttcaagtgaa

SEQ ID NO: 707600 - DNA, 13 bp, C. elegans
attttcaagttca

SEQ ID NO: 707601 - DNA, 13 bp, C. elegans
attttcaagtttt

SEQ ID NO: 707602 - DNA, 13 bp, C. elegans
attttcaataact

SEQ ID NO: 707603 - DNA, 13 bp, C. elegans
attttcaatacgt

SEQ ID NO: 707604 - DNA, 13 bp, C. elegans
attttcaatagaa

SEQ ID NO: 707605 - DNA, 13 bp, C. elegans
attttcaatatct

SEQ ID NO: 707606 - DNA, 13 bp, C. elegans
attttcaatatgt

SEQ ID NO: 707607 - DNA, 13 bp, C. elegans
attttcaatcaat

SEQ ID NO: 707608 - DNA, 13 bp, C. elegans
attttcaatctga

SEQ ID NO: 707609 - DNA, 13 bp, C. elegans
attttcaatcttc

SEQ ID NO: 707610 - DNA, 13 bp, C. elegans
attttcaatgcga

SEQ ID NO: 707611 - DNA, 13 bp, C. elegans
attttcaatggaa

SEQ ID NO: 707612 - DNA, 13 bp, C. elegans
attttcaattaga

SEQ ID NO: 707613 - DNA, 13 bp, C. elegans
attttcaattatc

SEQ ID NO: 707614 - DNA, 13 bp, C. elegans
attttcaattcaa

SEQ ID NO: 707615 - DNA, 13 bp, C. elegans
attttcaattcca

SEQ ID NO: 707616 - DNA, 13 bp, C. elegans
attttcaattcga

SEQ ID NO: 707617 - DNA, 13 bp, C. elegans
attttcaattcta

SEQ ID NO: 707618 - DNA, 13 bp, C. elegans
attttcaattgaa

SEQ ID NO: 707619 - DNA, 13 bp, C. elegans
attttcaattgtg

SEQ ID NO: 707620 - DNA, 13 bp, C. elegans
attttcaattgtt

SEQ ID NO: 707621 - DNA, 13 bp, C. elegans
attttcaatttca

SEQ ID NO: 707622 - DNA, 13 bp, C. elegans
attttcaatttcg

SEQ ID NO: 707623 - DNA, 13 bp, C. elegans
attttcaattttg

SEQ ID NO: 707624 - DNA, 13 bp, C. elegans
attttcacaaaaa

SEQ ID NO: 707625 - DNA, 13 bp, C. elegans
attttcacaaagt

SEQ ID NO: 707626 - DNA, 13 bp, C. elegans
attttcacaagtt

SEQ ID NO: 707627 - DNA, 13 bp, C. elegans
attttcacacttt

SEQ ID NO: 707628 - DNA, 13 bp, C. elegans
attttcacagatt

SEQ ID NO: 707629 - DNA, 14 bp, C. elegans
attttcacataaat

SEQ ID NO: 707630 - DNA, 13 bp, C. elegans
attttcacataat

SEQ ID NO: 707631 - DNA, 13 bp, C. elegans
attttcacattct

SEQ ID NO: 707632 - DNA, 13 bp, C. elegans
attttcacattga

SEQ ID NO: 707633 - DNA, 13 bp, C. elegans
attttcacattgt

SEQ ID NO: 707634 - DNA, 13 bp, C. elegans
attttcacccaat

SEQ ID NO: 707635 - DNA, 13 bp, C. elegans
attttcacccatt

SEQ ID NO: 707636 - DNA, 13 bp, C. elegans
attttcaccgaat

SEQ ID NO: 707637 - DNA, 13 bp, C. elegans
attttcacctaaa

SEQ ID NO: 707638 - DNA, 13 bp, C. elegans
attttcacctcaa

SEQ ID NO: 707639 - DNA, 13 bp, C. elegans
attttcacgaatt

SEQ ID NO: 707640 - DNA, 13 bp, C. elegans
attttcactcaaa

SEQ ID NO: 707641 - DNA, 13 bp, C. elegans
attttcactgaat

SEQ ID NO: 707642 - DNA, 13 bp, C. elegans
attttcactggaa

SEQ ID NO: 707643 - DNA, 13 bp, C. elegans
attttcactgtaa

SEQ ID NO: 707644 - DNA, 13 bp, C. elegans
attttcactttaa

SEQ ID NO: 707645 - DNA, 13 bp, C. elegans
attttcactttca

SEQ ID NO: 707646 - DNA, 13 bp, C. elegans
attttcagaagaa

SEQ ID NO: 707647 - DNA, 13 bp, C. elegans
attttcagaaggt

SEQ ID NO: 707648 - DNA, 13 bp, C. elegans
attttcagaatat

SEQ ID NO: 707649 - DNA, 13 bp, C. elegans
attttcagaatgg

SEQ ID NO: 707650 - DNA, 13 bp, C. elegans
attttcagaattt

SEQ ID NO: 707651 - DNA, 13 bp, C. elegans
attttcagacaaa

SEQ ID NO: 707652 - DNA, 13 bp, C. elegans
attttcagacaga

SEQ ID NO: 707653 - DNA, 13 bp, C. elegans
attttcagacttt

SEQ ID NO: 707654 - DNA, 13 bp, C. elegans
attttcagagaaa

SEQ ID NO: 707655 - DNA, 13 bp, C. elegans
attttcagagcgt

SEQ ID NO: 707656 - DNA, 13 bp, C. elegans
attttcagagttc

SEQ ID NO: 707657 - DNA, 13 bp, C. elegans
attttcagataaa

SEQ ID NO: 707658 - DNA, 13 bp, C. elegans
attttcagatatt

SEQ ID NO: 707659 - DNA, 13 bp, C. elegans
attttcagatttc

SEQ ID NO: 707660 - DNA, 13 bp, C. elegans
attttcagatttt

SEQ ID NO: 707661 - DNA, 13 bp, C. elegans
attttcagcataa

SEQ ID NO: 707662 - DNA, 13 bp, C. elegans
attttcagccaaa

SEQ ID NO: 707663 - DNA, 13 bp, C. elegans
attttcagcccca

SEQ ID NO: 707664 - DNA, 13 bp, C. elegans
attttcagccgaa

SEQ ID NO: 707665 - DNA, 13 bp, C. elegans
attttcagcctga

SEQ ID NO: 707666 - DNA, 13 bp, C. elegans
attttcagcctta

SEQ ID NO: 707667 - DNA, 13 bp, C. elegans
attttcagcgaat

SEQ ID NO: 707668 - DNA, 13 bp, C. elegans
attttcagcgttt

SEQ ID NO: 707669 - DNA, 13 bp, C. elegans
attttcagctaac

SEQ ID NO: 707670 - DNA, 13 bp, C. elegans
attttcagcttct

SEQ ID NO: 707671 - DNA, 13 bp, C. elegans
attttcagctttt

SEQ ID NO: 707672 - DNA, 13 bp, C. elegans
attttcaggaaaa

SEQ ID NO: 707673 - DNA, 13 bp, C. elegans
attttcaggcaga

SEQ ID NO: 707674 - DNA, 13 bp, C. elegans
attttcaggcgat

SEQ ID NO: 707675 - DNA, 13 bp, C. elegans
attttcaggtaat

SEQ ID NO: 707676 - DNA, 13 bp, C. elegans
attttcaggtttc

SEQ ID NO: 707677 - DNA, 13 bp, C. elegans
attttcagtaaaa

SEQ ID NO: 707678 - DNA, 13 bp, C. elegans
attttcagtaatt

SEQ ID NO: 707679 - DNA, 13 bp, C. elegans
attttcagtcagt

SEQ ID NO: 707680 - DNA, 13 bp, C. elegans
attttcagtcgat

SEQ ID NO: 707681 - DNA, 13 bp, C. elegans
attttcagtctaa

SEQ ID NO: 707682 - DNA, 13 bp, C. elegans
attttcagtgaat

SEQ ID NO: 707683 - DNA, 13 bp, C. elegans
attttcagtgact

SEQ ID NO: 707684 - DNA, 13 bp, C. elegans
attttcagtgaga

SEQ ID NO: 707685 - DNA, 13 bp, C. elegans
attttcagttggt

SEQ ID NO: 707686 - DNA, 13 bp, C. elegans
attttcagtttag

SEQ ID NO: 707687 - DNA, 13 bp, C. elegans
attttcagtttct

SEQ ID NO: 707688 - DNA, 13 bp, C. elegans
attttcagtttgc

SEQ ID NO: 707689 - DNA, 13 bp, C. elegans
attttcagtttgt

SEQ ID NO: 707690 - DNA, 13 bp, C. elegans
attttcataacat

SEQ ID NO: 707691 - DNA, 13 bp, C. elegans
attttcataatca

SEQ ID NO: 707692 - DNA, 13 bp, C. elegans
attttcataatct

SEQ ID NO: 707693 - DNA, 13 bp, C. elegans
attttcatcaata

SEQ ID NO: 707694 - DNA, 13 bp, C. elegans
attttcatcacaa

SEQ ID NO: 707695 - DNA, 13 bp, C. elegans
attttcatcacat

SEQ ID NO: 707696 - DNA, 13 bp, C. elegans
attttcatcactt

SEQ ID NO: 707697 - DNA, 13 bp, C. elegans
attttcatcagtt

SEQ ID NO: 707698 - DNA, 13 bp, C. elegans
attttcatcatat

SEQ ID NO: 707699 - DNA, 13 bp, C. elegans
attttcatcgatt

SEQ ID NO: 707700 - DNA, 13 bp, C. elegans
attttcatcgttt

SEQ ID NO: 707701 - DNA, 13 bp, C. elegans
attttcatcttca

SEQ ID NO: 707702 - DNA, 13 bp, C. elegans
attttcatgaaaa

SEQ ID NO: 707703 - DNA, 13 bp, C. elegans
attttcatgacaa

SEQ ID NO: 707704 - DNA, 13 bp, C. elegans
attttcatgagaa

SEQ ID NO: 707705 - DNA, 13 bp, C. elegans
attttcatgatta

SEQ ID NO: 707706 - DNA, 13 bp, C. elegans
attttcatgattt

SEQ ID NO: 707707 - DNA, 13 bp, C. elegans
attttcatgcatt

SEQ ID NO: 707708 - DNA, 13 bp, C. elegans
attttcatggaaa

SEQ ID NO: 707709 - DNA, 13 bp, C. elegans
attttcatgtaaa

SEQ ID NO: 707710 - DNA, 13 bp, C. elegans
attttcatgtgaa

SEQ ID NO: 707711 - DNA, 13 bp, C. elegans
attttcatgttac

SEQ ID NO: 707712 - DNA, 13 bp, C. elegans
attttcattatca

SEQ ID NO: 707713 - DNA, 13 bp, C. elegans
attttcattcaaa

SEQ ID NO: 707714 - DNA, 13 bp, C. elegans
attttcattcaca

SEQ ID NO: 707715 - DNA, 13 bp, C. elegans
attttcattgaat

SEQ ID NO: 707716 - DNA, 13 bp, C. elegans
attttcattggaa

SEQ ID NO: 707717 - DNA, 13 bp, C. elegans
attttcatttcaa

SEQ ID NO: 707718 - DNA, 13 bp, C. elegans
attttcatttcca

SEQ ID NO: 707719 - DNA, 13 bp, C. elegans
attttcatttgaa

SEQ ID NO: 707720 - DNA, 13 bp, C. elegans
attttcatttgat

SEQ ID NO: 707721 - DNA, 13 bp, C. elegans
attttcatttgga

SEQ ID NO: 707722 - DNA, 13 bp, C. elegans
attttcatttgtg

SEQ ID NO: 707723 - DNA, 13 bp, C. elegans
attttcattttcg

SEQ ID NO: 707724 - DNA, 13 bp, C. elegans
attttcattttga

SEQ ID NO: 707725 - DNA, 14 bp, C. elegans
attttccaaaaaat

SEQ ID NO: 707726 - DNA, 13 bp, C. elegans
attttccaaaaag

SEQ ID NO: 707727 - DNA, 13 bp, C. elegans
attttccaaaaat

SEQ ID NO: 707728 - DNA, 13 bp, C. elegans
attttccaaaata

SEQ ID NO: 707729 - DNA, 13 bp, C. elegans
attttccaaaatt

SEQ ID NO: 707730 - DNA, 13 bp, C. elegans
attttccaaacat

SEQ ID NO: 707731 - DNA, 13 bp, C. elegans
attttccaaataa

SEQ ID NO: 707732 - DNA, 13 bp, C. elegans
attttccaaatta

SEQ ID NO: 707733 - DNA, 13 bp, C. elegans
attttccaacaat

SEQ ID NO: 707734 - DNA, 13 bp, C. elegans
attttccaaccaa

SEQ ID NO: 707735 - DNA, 13 bp, C. elegans
attttccaacgaa

SEQ ID NO: 707736 - DNA, 13 bp, C. elegans
attttccaactca

SEQ ID NO: 707737 - DNA, 13 bp, C. elegans
attttccaacttt

SEQ ID NO: 707738 - DNA, 13 bp, C. elegans
attttccaagaaa

SEQ ID NO: 707739 - DNA, 13 bp, C. elegans
attttccaagaat

SEQ ID NO: 707740 - DNA, 13 bp, C. elegans
attttccaataaa

SEQ ID NO: 707741 - DNA, 13 bp, C. elegans
attttccaatgat

SEQ ID NO: 707742 - DNA, 13 bp, C. elegans
attttccaattat

SEQ ID NO: 707743 - DNA, 13 bp, C. elegans
attttccaatttc

SEQ ID NO: 707744 - DNA, 13 bp, C. elegans
attttccacaaaa

SEQ ID NO: 707745 - DNA, 13 bp, C. elegans
attttccacaatt

SEQ ID NO: 707746 - DNA, 13 bp, C. elegans
attttccacgaaa

SEQ ID NO: 707747 - DNA, 13 bp, C. elegans
attttccacgatt

SEQ ID NO: 707748 - DNA, 13 bp, C. elegans
attttccactcaa

SEQ ID NO: 707749 - DNA, 13 bp, C. elegans
attttccagaaag

SEQ ID NO: 707750 - DNA, 13 bp, C. elegans
attttccagacat

SEQ ID NO: 707751 - DNA, 13 bp, C. elegans
attttccagatga

SEQ ID NO: 707752 - DNA, 13 bp, C. elegans
attttccaggttt

SEQ ID NO: 707753 - DNA, 13 bp, C. elegans
attttccagtaaa

SEQ ID NO: 707754 - DNA, 13 bp, C. elegans
attttccagtaat

SEQ ID NO: 707755 - DNA, 13 bp, C. elegans
attttccagtact

SEQ ID NO: 707756 - DNA, 13 bp, C. elegans
attttccagtgaa

SEQ ID NO: 707757 - DNA, 13 bp, C. elegans
attttccagttaa

SEQ ID NO: 707758 - DNA, 13 bp, C. elegans
attttccagtttt

SEQ ID NO: 707759 - DNA, 13 bp, C. elegans
attttccataatt

SEQ ID NO: 707760 - DNA, 13 bp, C. elegans
attttccatataa

SEQ ID NO: 707761 - DNA, 13 bp, C. elegans
attttccatattc

SEQ ID NO: 707762 - DNA, 13 bp, C. elegans
attttccatattg

SEQ ID NO: 707763 - DNA, 13 bp, C. elegans
attttccatcaaa

SEQ ID NO: 707764 - DNA, 13 bp, C. elegans
attttccatcaca

SEQ ID NO: 707765 - DNA, 13 bp, C. elegans
attttccatcatt

SEQ ID NO: 707766 - DNA, 13 bp, C. elegans
attttccatgaaa

SEQ ID NO: 707767 - DNA, 13 bp, C. elegans
attttccatgttt

SEQ ID NO: 707768 - DNA, 13 bp, C. elegans
attttccattaaa

SEQ ID NO: 707769 - DNA, 15 bp, C. elegans
attttccattcaaaa

SEQ ID NO: 707770 - DNA, 13 bp, C. elegans
attttccattcca

SEQ ID NO: 707771 - DNA, 13 bp, C. elegans
attttccattctc

SEQ ID NO: 707772 - DNA, 13 bp, C. elegans
attttccatttcc

SEQ ID NO: 707773 - DNA, 13 bp, C. elegans
attttccatttcg

SEQ ID NO: 707774 - DNA, 13 bp, C. elegans
attttcccaattt

SEQ ID NO: 707775 - DNA, 13 bp, C. elegans
attttcccacaaa

SEQ ID NO: 707776 - DNA, 13 bp, C. elegans
attttcccacaat

SEQ ID NO: 707777 - DNA, 13 bp, C. elegans
attttcccacgct

SEQ ID NO: 707778 - DNA, 13 bp, C. elegans
attttcccactga

SEQ ID NO: 707779 - DNA, 13 bp, C. elegans
attttcccagttt

SEQ ID NO: 707780 - DNA, 13 bp, C. elegans
attttcccattaa

SEQ ID NO: 707781 - DNA, 13 bp, C. elegans
attttccccaatt

SEQ ID NO: 707782 - DNA, 13 bp, C. elegans
attttcccccaat

SEQ ID NO: 707783 - DNA, 13 bp, C. elegans
attttcccccgaa

SEQ ID NO: 707784 - DNA, 13 bp, C. elegans
attttcccgtcaa

SEQ ID NO: 707785 - DNA, 13 bp, C. elegans
attttcccgtggt

SEQ ID NO: 707786 - DNA, 13 bp, C. elegans
attttccgaaagg

SEQ ID NO: 707787 - DNA, 13 bp, C. elegans
attttccgaatat

SEQ ID NO: 707788 - DNA, 13 bp, C. elegans
attttccgaatgt

SEQ ID NO: 707789 - DNA, 13 bp, C. elegans
attttccgaattt

SEQ ID NO: 707790 - DNA, 13 bp, C. elegans
attttccgattaa

SEQ ID NO: 707791 - DNA, 13 bp, C. elegans
attttccggaata

SEQ ID NO: 707792 - DNA, 13 bp, C. elegans
attttccggaatt

SEQ ID NO: 707793 - DNA, 13 bp, C. elegans
attttccgtttgc

SEQ ID NO: 707794 - DNA, 13 bp, C. elegans
attttcctaaatt

SEQ ID NO: 707795 - DNA, 13 bp, C. elegans
attttcctaatat

SEQ ID NO: 707796 - DNA, 13 bp, C. elegans
attttcctacaaa

SEQ ID NO: 707797 - DNA, 13 bp, C. elegans
attttcctagaat

SEQ ID NO: 707798 - DNA, 13 bp, C. elegans
attttcctcaaaa

SEQ ID NO: 707799 - DNA, 13 bp, C. elegans
attttcctcaaat

SEQ ID NO: 707800 - DNA, 13 bp, C. elegans
attttcctcgatt

SEQ ID NO: 707801 - DNA, 13 bp, C. elegans
attttcctctcaa

SEQ ID NO: 707802 - DNA, 13 bp, C. elegans
attttcctgaaaa

SEQ ID NO: 707803 - DNA, 13 bp, C. elegans
attttcctgaatt

SEQ ID NO: 707804 - DNA, 13 bp, C. elegans
attttcctgattt

SEQ ID NO: 707805 - DNA, 13 bp, C. elegans
attttcctggaat

SEQ ID NO: 707806 - DNA, 13 bp, C. elegans
attttcctgtaat

SEQ ID NO: 707807 - DNA, 13 bp, C. elegans
attttcctgtttc

SEQ ID NO: 707808 - DNA, 13 bp, C. elegans
attttccttcaaa

SEQ ID NO: 707809 - DNA, 13 bp, C. elegans
attttccttgatt

SEQ ID NO: 707810 - DNA, 13 bp, C. elegans
attttccttgtaa

SEQ ID NO: 707811 - DNA, 13 bp, C. elegans
attttcctttaaa

SEQ ID NO: 707812 - DNA, 13 bp, C. elegans
attttcctttgaa

SEQ ID NO: 707813 - DNA, 13 bp, C. elegans
attttcgaaaaac

SEQ ID NO: 707814 - DNA, 13 bp, C. elegans
attttcgaaaaca

SEQ ID NO: 707815 - DNA, 13 bp, C. elegans
attttcgaaagta

SEQ ID NO: 707816 - DNA, 13 bp, C. elegans
attttcgaaatct

SEQ ID NO: 707817 - DNA, 13 bp, C. elegans
attttcgaaatga

SEQ ID NO: 707818 - DNA, 13 bp, C. elegans
attttcgaaattt

SEQ ID NO: 707819 - DNA, 13 bp, C. elegans
attttcgaacttt

SEQ ID NO: 707820 - DNA, 13 bp, C. elegans
attttcgaagttt

SEQ ID NO: 707821 - DNA, 13 bp, C. elegans
attttcgaataat

SEQ ID NO: 707822 - DNA, 13 bp, C. elegans
attttcgaataca

SEQ ID NO: 707823 - DNA, 13 bp, C. elegans
attttcgaatttc

SEQ ID NO: 707824 - DNA, 13 bp, C. elegans
attttcgaatttt

SEQ ID NO: 707825 - DNA, 13 bp, C. elegans
attttcgacgttt

SEQ ID NO: 707826 - DNA, 13 bp, C. elegans
attttcgagaaaa

SEQ ID NO: 707827 - DNA, 13 bp, C. elegans
attttcgagattt

SEQ ID NO: 707828 - DNA, 13 bp, C. elegans
attttcgagcaac

SEQ ID NO: 707829 - DNA, 13 bp, C. elegans
attttcgagcaat

SEQ ID NO: 707830 - DNA, 13 bp, C. elegans
attttcgaggatt

SEQ ID NO: 707831 - DNA, 13 bp, C. elegans
attttcgagtaaa

SEQ ID NO: 707832 - DNA, 13 bp, C. elegans
attttcgagtttc

SEQ ID NO: 707833 - DNA, 13 bp, C. elegans
attttcgataatt

SEQ ID NO: 707834 - DNA, 13 bp, C. elegans
attttcgatattc

SEQ ID NO: 707835 - DNA, 13 bp, C. elegans
attttcgatattt

SEQ ID NO: 707836 - DNA, 13 bp, C. elegans
attttcgatgaaa

SEQ ID NO: 707837 - DNA, 13 bp, C. elegans
attttcgattaaa

SEQ ID NO: 707838 - DNA, 13 bp, C. elegans
attttcgattatc

SEQ ID NO: 707839 - DNA, 13 bp, C. elegans
attttcgattgga

SEQ ID NO: 707840 - DNA, 13 bp, C. elegans
attttcgatttca

SEQ ID NO: 707841 - DNA, 13 bp, C. elegans
attttcgattttg

SEQ ID NO: 707842 - DNA, 13 bp, C. elegans
attttcgcaattt

SEQ ID NO: 707843 - DNA, 13 bp, C. elegans
attttcgcacttt

SEQ ID NO: 707844 - DNA, 13 bp, C. elegans
attttcgcatatt

SEQ ID NO: 707845 - DNA, 13 bp, C. elegans
attttcgcccaaa

SEQ ID NO: 707846 - DNA, 13 bp, C. elegans
attttcgccgttt

SEQ ID NO: 707847 - DNA, 13 bp, C. elegans
attttcgcgaaaa

SEQ ID NO: 707848 - DNA, 13 bp, C. elegans
attttcgcgattt

SEQ ID NO: 707849 - DNA, 13 bp, C. elegans
attttcgcggaaa

SEQ ID NO: 707850 - DNA, 13 bp, C. elegans
attttcgcgtttt

SEQ ID NO: 707851 - DNA, 13 bp, C. elegans
attttcgctattt

SEQ ID NO: 707852 - DNA, 13 bp, C. elegans
attttcgctcaat

SEQ ID NO: 707853 - DNA, 13 bp, C. elegans
attttcgctgaaa

SEQ ID NO: 707854 - DNA, 13 bp, C. elegans
attttcgctgatt

SEQ ID NO: 707855 - DNA, 13 bp, C. elegans
attttcgctttaa

SEQ ID NO: 707856 - DNA, 13 bp, C. elegans
attttcgctttta

SEQ ID NO: 707857 - DNA, 13 bp, C. elegans
attttcggaaatt

SEQ ID NO: 707858 - DNA, 13 bp, C. elegans
attttcggaacaa

SEQ ID NO: 707859 - DNA, 13 bp, C. elegans
attttcggaattg

SEQ ID NO: 707860 - DNA, 13 bp, C. elegans
attttcggaattt

SEQ ID NO: 707861 - DNA, 13 bp, C. elegans
attttcggataat

SEQ ID NO: 707862 - DNA, 13 bp, C. elegans
attttcggatatt

SEQ ID NO: 707863 - DNA, 13 bp, C. elegans
attttcggatttt

SEQ ID NO: 707864 - DNA, 13 bp, C. elegans
attttcggcaatt

SEQ ID NO: 707865 - DNA, 13 bp, C. elegans
attttcggtactt

SEQ ID NO: 707866 - DNA, 13 bp, C. elegans
attttcggtggaa

SEQ ID NO: 707867 - DNA, 13 bp, C. elegans
attttcggttatt

SEQ ID NO: 707868 - DNA, 13 bp, C. elegans
attttcgtaaaat

SEQ ID NO: 707869 - DNA, 13 bp, C. elegans
attttcgtaattt

SEQ ID NO: 707870 - DNA, 13 bp, C. elegans
attttcgtcaatt

SEQ ID NO: 707871 - DNA, 13 bp, C. elegans
attttcgtcagaa

SEQ ID NO: 707872 - DNA, 13 bp, C. elegans
attttcgtcattt

SEQ ID NO: 707873 - DNA, 13 bp, C. elegans
attttcgtgaaat

SEQ ID NO: 707874 - DNA, 13 bp, C. elegans
attttcgttaaat

SEQ ID NO: 707875 - DNA, 13 bp, C. elegans
attttcgttgaaa

SEQ ID NO: 707876 - DNA, 13 bp, C. elegans
attttcgtttaaa

SEQ ID NO: 707877 - DNA, 13 bp, C. elegans
attttcgtttcaa

SEQ ID NO: 707878 - DNA, 13 bp, C. elegans
attttcgtttgaa

SEQ ID NO: 707879 - DNA, 13 bp, C. elegans
attttctaaactc

SEQ ID NO: 707880 - DNA, 13 bp, C. elegans
attttctaaatct

SEQ ID NO: 707881 - DNA, 13 bp, C. elegans
attttctaaatgt

SEQ ID NO: 707882 - DNA, 13 bp, C. elegans
attttctaacatt

SEQ ID NO: 707883 - DNA, 13 bp, C. elegans
attttctacaaaa

SEQ ID NO: 707884 - DNA, 13 bp, C. elegans
attttctacaatt

SEQ ID NO: 707885 - DNA, 13 bp, C. elegans
attttctacactt

SEQ ID NO: 707886 - DNA, 13 bp, C. elegans
attttctacagtt

SEQ ID NO: 707887 - DNA, 13 bp, C. elegans
attttctacgatt

SEQ ID NO: 707888 - DNA, 13 bp, C. elegans
attttctactgaa

SEQ ID NO: 707889 - DNA, 13 bp, C. elegans
attttctacttca

SEQ ID NO: 707890 - DNA, 14 bp, C. elegans
attttctagaaatt

SEQ ID NO: 707891 - DNA, 13 bp, C. elegans
attttctagaagt

SEQ ID NO: 707892 - DNA, 13 bp, C. elegans
attttctagaatt

SEQ ID NO: 707893 - DNA, 13 bp, C. elegans
attttctagagct

SEQ ID NO: 707894 - DNA, 13 bp, C. elegans
attttctagcttc

SEQ ID NO: 707895 - DNA, 13 bp, C. elegans
attttctaggtca

SEQ ID NO: 707896 - DNA, 13 bp, C. elegans
attttctatcaaa

SEQ ID NO: 707897 - DNA, 13 bp, C. elegans
attttctattagt

SEQ ID NO: 707898 - DNA, 13 bp, C. elegans
attttctattgca

SEQ ID NO: 707899 - DNA, 13 bp, C. elegans
attttctcaaact

SEQ ID NO: 707900 - DNA, 13 bp, C. elegans
attttctcaacaa

SEQ ID NO: 707901 - DNA, 13 bp, C. elegans
attttctcaagaa

SEQ ID NO: 707902 - DNA, 13 bp, C. elegans
attttctcaagat

SEQ ID NO: 707903 - DNA, 13 bp, C. elegans
attttctcaatct

SEQ ID NO: 707904 - DNA, 13 bp, C. elegans
attttctcacatt

SEQ ID NO: 707905 - DNA, 13 bp, C. elegans
attttctcactga

SEQ ID NO: 707906 - DNA, 13 bp, C. elegans
attttctcagaaa

SEQ ID NO: 707907 - DNA, 13 bp, C. elegans
attttctcataaa

SEQ ID NO: 707908 - DNA, 13 bp, C. elegans
attttctcatcaa

SEQ ID NO: 707909 - DNA, 14 bp, C. elegans
attttctcatcaaa

SEQ ID NO: 707910 - DNA, 13 bp, C. elegans
attttctcattgg

SEQ ID NO: 707911 - DNA, 13 bp, C. elegans
attttctccaaaa

SEQ ID NO: 707912 - DNA, 13 bp, C. elegans
attttctccaatt

SEQ ID NO: 707913 - DNA, 13 bp, C. elegans
attttctccatat

SEQ ID NO: 707914 - DNA, 13 bp, C. elegans
attttctcccaat

SEQ ID NO: 707915 - DNA, 13 bp, C. elegans
attttctccgaaa

SEQ ID NO: 707916 - DNA, 13 bp, C. elegans
attttctcgaaaa

SEQ ID NO: 707917 - DNA, 13 bp, C. elegans
attttctcgaaat

SEQ ID NO: 707918 - DNA, 13 bp, C. elegans
attttctcgaact

SEQ ID NO: 707919 - DNA, 13 bp, C. elegans
attttctcgaatt

SEQ ID NO: 707920 - DNA, 13 bp, C. elegans
attttctcgagtt

SEQ ID NO: 707921 - DNA, 13 bp, C. elegans
attttctcgtaaa

SEQ ID NO: 707922 - DNA, 13 bp, C. elegans
attttctctctca

SEQ ID NO: 707923 - DNA, 13 bp, C. elegans
attttctctgaaa

SEQ ID NO: 707924 - DNA, 13 bp, C. elegans
attttctcttcca

SEQ ID NO: 707925 - DNA, 13 bp, C. elegans
attttctgaaaaa

SEQ ID NO: 707926 - DNA, 13 bp, C. elegans
attttctgaaatt

SEQ ID NO: 707927 - DNA, 13 bp, C. elegans
attttctgaacaa

SEQ ID NO: 707928 - DNA, 13 bp, C. elegans
attttctgaacat

SEQ ID NO: 707929 - DNA, 13 bp, C. elegans
attttctgaagaa

SEQ ID NO: 707930 - DNA, 13 bp, C. elegans
attttctgaatat

SEQ ID NO: 707931 - DNA, 13 bp, C. elegans
attttctgaattt

SEQ ID NO: 707932 - DNA, 13 bp, C. elegans
attttctgagcat

SEQ ID NO: 707933 - DNA, 13 bp, C. elegans
attttctgagttc

SEQ ID NO: 707934 - DNA, 13 bp, C. elegans
attttctgataaa

SEQ ID NO: 707935 - DNA, 13 bp, C. elegans
attttctgatctt

SEQ ID NO: 707936 - DNA, 13 bp, C. elegans
attttctgatgaa

SEQ ID NO: 707937 - DNA, 13 bp, C. elegans
attttctgatgtt

SEQ ID NO: 707938 - DNA, 13 bp, C. elegans
attttctgattaa

SEQ ID NO: 707939 - DNA, 13 bp, C. elegans
attttctgattcc

SEQ ID NO: 707940 - DNA, 13 bp, C. elegans
attttctgatttc

SEQ ID NO: 707941 - DNA, 13 bp, C. elegans
attttctgcaaaa

SEQ ID NO: 707942 - DNA, 13 bp, C. elegans
attttctgcacaa

SEQ ID NO: 707943 - DNA, 13 bp, C. elegans
attttctgcattt

SEQ ID NO: 707944 - DNA, 13 bp, C. elegans
attttctgcctct

SEQ ID NO: 707945 - DNA, 13 bp, C. elegans
attttctgcgaaa

SEQ ID NO: 707946 - DNA, 13 bp, C. elegans
attttctgctaaa

SEQ ID NO: 707947 - DNA, 13 bp, C. elegans
attttctgctcat

SEQ ID NO: 707948 - DNA, 13 bp, C. elegans
attttctgctgtt

SEQ ID NO: 707949 - DNA, 13 bp, C. elegans
attttctgcttca

SEQ ID NO: 707950 - DNA, 13 bp, C. elegans
attttctgcttta

SEQ ID NO: 707951 - DNA, 13 bp, C. elegans
attttctggagtt

SEQ ID NO: 707952 - DNA, 13 bp, C. elegans
attttctgggttt

SEQ ID NO: 707953 - DNA, 13 bp, C. elegans
attttctggtata

SEQ ID NO: 707954 - DNA, 13 bp, C. elegans
attttctggtcaa

SEQ ID NO: 707955 - DNA, 13 bp, C. elegans
attttctggtttc

SEQ ID NO: 707956 - DNA, 14 bp, C. elegans
attttctgtaaatt

SEQ ID NO: 707957 - DNA, 13 bp, C. elegans
attttctgtaatt

SEQ ID NO: 707958 - DNA, 13 bp, C. elegans
attttctgtagat

SEQ ID NO: 707959 - DNA, 13 bp, C. elegans
attttctgtcaaa

SEQ ID NO: 707960 - DNA, 13 bp, C. elegans
attttctgtcatt

SEQ ID NO: 707961 - DNA, 13 bp, C. elegans
attttctgtgatt

SEQ ID NO: 707962 - DNA, 13 bp, C. elegans
attttctgttaaa

SEQ ID NO: 707963 - DNA, 13 bp, C. elegans
attttctgttaat

SEQ ID NO: 707964 - DNA, 13 bp, C. elegans
attttctgttgaa

SEQ ID NO: 707965 - DNA, 14 bp, C. elegans
attttcttcaaaat

SEQ ID NO: 707966 - DNA, 13 bp, C. elegans
attttcttcaaat

SEQ ID NO: 707967 - DNA, 13 bp, C. elegans
attttcttcaaca

SEQ ID NO: 707968 - DNA, 13 bp, C. elegans
attttcttcaagt

SEQ ID NO: 707969 - DNA, 13 bp, C. elegans
attttcttcaata

SEQ ID NO: 707970 - DNA, 13 bp, C. elegans
attttcttcacat

SEQ ID NO: 707971 - DNA, 13 bp, C. elegans
attttcttccgtt

SEQ ID NO: 707972 - DNA, 13 bp, C. elegans
attttcttctaaa

SEQ ID NO: 707973 - DNA, 13 bp, C. elegans
attttcttctgaa

SEQ ID NO: 707974 - DNA, 13 bp, C. elegans
attttcttgaaaa

SEQ ID NO: 707975 - DNA, 13 bp, C. elegans
attttcttgaaac

SEQ ID NO: 707976 - DNA, 13 bp, C. elegans
attttcttgaaat

SEQ ID NO: 707977 - DNA, 13 bp, C. elegans
attttcttgcaat

SEQ ID NO: 707978 - DNA, 13 bp, C. elegans
attttcttgcatt

SEQ ID NO: 707979 - DNA, 13 bp, C. elegans
attttcttggatt

SEQ ID NO: 707980 - DNA, 13 bp, C. elegans
attttcttgtaat

SEQ ID NO: 707981 - DNA, 13 bp, C. elegans
attttcttgtcga

SEQ ID NO: 707982 - DNA, 13 bp, C. elegans
attttcttgttaa

SEQ ID NO: 707983 - DNA, 13 bp, C. elegans
attttctttcaga

SEQ ID NO: 707984 - DNA, 13 bp, C. elegans
attttctttccag

SEQ ID NO: 707985 - DNA, 13 bp, C. elegans
attttctttcgaa

SEQ ID NO: 707986 - DNA, 13 bp, C. elegans
attttctttgaaa

SEQ ID NO: 707987 - DNA, 13 bp, C. elegans
attttctttgaat

SEQ ID NO: 707988 - DNA, 13 bp, C. elegans
attttctttgtga

SEQ ID NO: 707989 - DNA, 13 bp, C. elegans
attttcttttgaa

SEQ ID NO: 707990 - DNA, 13 bp, C. elegans
attttgaaaaact

SEQ ID NO: 707991 - DNA, 13 bp, C. elegans
attttgaaaaatc

SEQ ID NO: 707992 - DNA, 13 bp, C. elegans
attttgaaaaatg

SEQ ID NO: 707993 - DNA, 13 bp, C. elegans
attttgaaaacaa

SEQ ID NO: 707994 - DNA, 13 bp, C. elegans
attttgaaaacca

SEQ ID NO: 707995 - DNA, 13 bp, C. elegans
attttgaaaagat

SEQ ID NO: 707996 - DNA, 13 bp, C. elegans
attttgaaaagtt

SEQ ID NO: 707997 - DNA, 13 bp, C. elegans
attttgaaaatca

SEQ ID NO: 707998 - DNA, 13 bp, C. elegans
attttgaaacaaa

SEQ ID NO: 707999 - DNA, 13 bp, C. elegans
attttgaaacaca

SEQ ID NO: 708000 - DNA, 13 bp, C. elegans
attttgaaacagt

SEQ ID NO: 708001 - DNA, 13 bp, C. elegans
attttgaaaccaa

SEQ ID NO: 708002 - DNA, 13 bp, C. elegans
attttgaaacgaa

SEQ ID NO: 708003 - DNA, 13 bp, C. elegans
attttgaaactat

SEQ ID NO: 708004 - DNA, 13 bp, C. elegans
attttgaaacttt

SEQ ID NO: 708005 - DNA, 13 bp, C. elegans
attttgaaagtta

SEQ ID NO: 708006 - DNA, 13 bp, C. elegans
attttgaaatgaa

SEQ ID NO: 708007 - DNA, 13 bp, C. elegans
attttgaaattca

SEQ ID NO: 708008 - DNA, 13 bp, C. elegans
attttgaaattct

SEQ ID NO: 708009 - DNA, 13 bp, C. elegans
attttgaaattgt

SEQ ID NO: 708010 - DNA, 14 bp, C. elegans
attttgaaatttcc

SEQ ID NO: 708011 - DNA, 13 bp, C. elegans
attttgaacgtat

SEQ ID NO: 708012 - DNA, 13 bp, C. elegans
attttgaactatt

SEQ ID NO: 708013 - DNA, 13 bp, C. elegans
attttgaactcat

SEQ ID NO: 708014 - DNA, 13 bp, C. elegans
attttgaactgaa

SEQ ID NO: 708015 - DNA, 13 bp, C. elegans
attttgaacttta

SEQ ID NO: 708016 - DNA, 13 bp, C. elegans
attttgaactttc

SEQ ID NO: 708017 - DNA, 13 bp, C. elegans
attttgaactttt

SEQ ID NO: 708018 - DNA, 13 bp, C. elegans
attttgaagaaat

SEQ ID NO: 708019 - DNA, 13 bp, C. elegans
attttgaagactt

SEQ ID NO: 708020 - DNA, 13 bp, C. elegans
attttgaagatat

SEQ ID NO: 708021 - DNA, 13 bp, C. elegans
attttgaagcatc

SEQ ID NO: 708022 - DNA, 13 bp, C. elegans
attttgaagcttt

SEQ ID NO: 708023 - DNA, 13 bp, C. elegans
attttgaaggaaa

SEQ ID NO: 708024 - DNA, 13 bp, C. elegans
attttgaaggaat

SEQ ID NO: 708025 - DNA, 13 bp, C. elegans
attttgaagggtt

SEQ ID NO: 708026 - DNA, 13 bp, C. elegans
attttgaagtgaa

SEQ ID NO: 708027 - DNA, 13 bp, C. elegans
attttgaagttac

SEQ ID NO: 708028 - DNA, 13 bp, C. elegans
attttgaataaga

SEQ ID NO: 708029 - DNA, 13 bp, C. elegans
attttgaatagaa

SEQ ID NO: 708030 - DNA, 13 bp, C. elegans
attttgaatagtt

SEQ ID NO: 708031 - DNA, 13 bp, C. elegans
attttgaatcaaa

SEQ ID NO: 708032 - DNA, 13 bp, C. elegans
attttgaatctaa

SEQ ID NO: 708033 - DNA, 13 bp, C. elegans
attttgaattcaa

SEQ ID NO: 708034 - DNA, 13 bp, C. elegans
attttgaattccg

SEQ ID NO: 708035 - DNA, 13 bp, C. elegans
attttgaattctt

SEQ ID NO: 708036 - DNA, 13 bp, C. elegans
attttgaattgaa

SEQ ID NO: 708037 - DNA, 13 bp, C. elegans
attttgaattgca

SEQ ID NO: 708038 - DNA, 13 bp, C. elegans
attttgaattgcc

SEQ ID NO: 708039 - DNA, 13 bp, C. elegans
attttgaatttcc

SEQ ID NO: 708040 - DNA, 13 bp, C. elegans
attttgacaaagt

SEQ ID NO: 708041 - DNA, 13 bp, C. elegans
attttgacaaatt

SEQ ID NO: 708042 - DNA, 13 bp, C. elegans
attttgacaattt

SEQ ID NO: 708043 - DNA, 13 bp, C. elegans
attttgacagaaa

SEQ ID NO: 708044 - DNA, 13 bp, C. elegans
attttgacagttt

SEQ ID NO: 708045 - DNA, 13 bp, C. elegans
attttgacatgaa

SEQ ID NO: 708046 - DNA, 13 bp, C. elegans
attttgacatttt

SEQ ID NO: 708047 - DNA, 13 bp, C. elegans
attttgaccaatt

SEQ ID NO: 708048 - DNA, 13 bp, C. elegans
attttgacctttt

SEQ ID NO: 708049 - DNA, 13 bp, C. elegans
attttgacgaaaa

SEQ ID NO: 708050 - DNA, 13 bp, C. elegans
attttgactgaaa

SEQ ID NO: 708051 - DNA, 13 bp, C. elegans
attttgacttatt

SEQ ID NO: 708052 - DNA, 13 bp, C. elegans
attttgagaaaaa

SEQ ID NO: 708053 - DNA, 13 bp, C. elegans
attttgagaactt

SEQ ID NO: 708054 - DNA, 13 bp, C. elegans
attttgagaagaa

SEQ ID NO: 708055 - DNA, 13 bp, C. elegans
attttgagaataa

SEQ ID NO: 708056 - DNA, 13 bp, C. elegans
attttgagaatgc

SEQ ID NO: 708057 - DNA, 13 bp, C. elegans
attttgagacagc

SEQ ID NO: 708058 - DNA, 13 bp, C. elegans
attttgagacttt

SEQ ID NO: 708059 - DNA, 13 bp, C. elegans
attttgagaggaa

SEQ ID NO: 708060 - DNA, 13 bp, C. elegans
attttgagagttt

SEQ ID NO: 708061 - DNA, 13 bp, C. elegans
attttgagataaa

SEQ ID NO: 708062 - DNA, 13 bp, C. elegans
attttgagatttc

SEQ ID NO: 708063 - DNA, 13 bp, C. elegans
attttgagcaaaa

SEQ ID NO: 708064 - DNA, 13 bp, C. elegans
attttgagcaatt

SEQ ID NO: 708065 - DNA, 13 bp, C. elegans
attttgagcactt

SEQ ID NO: 708066 - DNA, 13 bp, C. elegans
attttgagcagaa

SEQ ID NO: 708067 - DNA, 13 bp, C. elegans
attttgagcatta

SEQ ID NO: 708068 - DNA, 13 bp, C. elegans
attttgagcgaaa

SEQ ID NO: 708069 - DNA, 13 bp, C. elegans
attttgagcgatt

SEQ ID NO: 708070 - DNA, 13 bp, C. elegans
attttgaggattt

SEQ ID NO: 708071 - DNA, 13 bp, C. elegans
attttgagtacaa

SEQ ID NO: 708072 - DNA, 13 bp, C. elegans
attttgagtcaaa

SEQ ID NO: 708073 - DNA, 13 bp, C. elegans
attttgagtctac

SEQ ID NO: 708074 - DNA, 13 bp, C. elegans
attttgagtctat

SEQ ID NO: 708075 - DNA, 13 bp, C. elegans
attttgagtgtat

SEQ ID NO: 708076 - DNA, 13 bp, C. elegans
attttgagttttc

SEQ ID NO: 708077 - DNA, 13 bp, C. elegans
attttgatagttg

SEQ ID NO: 708078 - DNA, 13 bp, C. elegans
attttgatattca

SEQ ID NO: 708079 - DNA, 13 bp, C. elegans
attttgatattct

SEQ ID NO: 708080 - DNA, 13 bp, C. elegans
attttgatcaact

SEQ ID NO: 708081 - DNA, 13 bp, C. elegans
attttgatcagaa

SEQ ID NO: 708082 - DNA, 13 bp, C. elegans
attttgatccaaa

SEQ ID NO: 708083 - DNA, 13 bp, C. elegans
attttgatctaaa

SEQ ID NO: 708084 - DNA, 13 bp, C. elegans
attttgatctatt

SEQ ID NO: 708085 - DNA, 13 bp, C. elegans
attttgatgaaat

SEQ ID NO: 708086 - DNA, 13 bp, C. elegans
attttgatgaact

SEQ ID NO: 708087 - DNA, 13 bp, C. elegans
attttgatgaatt

SEQ ID NO: 708088 - DNA, 13 bp, C. elegans
attttgatgagaa

SEQ ID NO: 708089 - DNA, 13 bp, C. elegans
attttgatgataa

SEQ ID NO: 708090 - DNA, 13 bp, C. elegans
attttgatgatat

SEQ ID NO: 708091 - DNA, 13 bp, C. elegans
attttgatgatga

SEQ ID NO: 708092 - DNA, 13 bp, C. elegans
attttgatgtaaa

SEQ ID NO: 708093 - DNA, 13 bp, C. elegans
attttgatttact

SEQ ID NO: 708094 - DNA, 13 bp, C. elegans
attttgatttcca

SEQ ID NO: 708095 - DNA, 13 bp, C. elegans
attttgatttcga

SEQ ID NO: 708096 - DNA, 13 bp, C. elegans
attttgatttcta

SEQ ID NO: 708097 - DNA, 13 bp, C. elegans
attttgatttgaa

SEQ ID NO: 708098 - DNA, 13 bp, C. elegans
attttgattttca

SEQ ID NO: 708099 - DNA, 13 bp, C. elegans
attttgattttcg

SEQ ID NO: 708100 - DNA, 13 bp, C. elegans
attttgcaaaaaa

SEQ ID NO: 708101 - DNA, 13 bp, C. elegans
attttgcaaaact

SEQ ID NO: 708102 - DNA, 13 bp, C. elegans
attttgcaaaagt

SEQ ID NO: 708103 - DNA, 13 bp, C. elegans
attttgcaaaatt

SEQ ID NO: 708104 - DNA, 13 bp, C. elegans
attttgcaaactt

SEQ ID NO: 708105 - DNA, 13 bp, C. elegans
attttgcaaatgg

SEQ ID NO: 708106 - DNA, 13 bp, C. elegans
attttgcaaattt

SEQ ID NO: 708107 - DNA, 13 bp, C. elegans
attttgcaacata

SEQ ID NO: 708108 - DNA, 13 bp, C. elegans
attttgcaactaa

SEQ ID NO: 708109 - DNA, 13 bp, C. elegans
attttgcaatatt

SEQ ID NO: 708110 - DNA, 13 bp, C. elegans
attttgcaatgaa

SEQ ID NO: 708111 - DNA, 13 bp, C. elegans
attttgcaattat

SEQ ID NO: 708112 - DNA, 13 bp, C. elegans
attttgcaattgt

SEQ ID NO: 708113 - DNA, 13 bp, C. elegans
attttgcactatt

SEQ ID NO: 708114 - DNA, 13 bp, C. elegans
attttgcagaatt

SEQ ID NO: 708115 - DNA, 13 bp, C. elegans
attttgcagattt

SEQ ID NO: 708116 - DNA, 13 bp, C. elegans
attttgcataaat

SEQ ID NO: 708117 - DNA, 13 bp, C. elegans
attttgcatgatt

SEQ ID NO: 708118 - DNA, 13 bp, C. elegans
attttgcattgaa

SEQ ID NO: 708119 - DNA, 14 bp, C. elegans
attttgcatttaaa

SEQ ID NO: 708120 - DNA, 13 bp, C. elegans
attttgccaaact

SEQ ID NO: 708121 - DNA, 13 bp, C. elegans
attttgccaattt

SEQ ID NO: 708122 - DNA, 13 bp, C. elegans
attttgccatttt

SEQ ID NO: 708123 - DNA, 13 bp, C. elegans
attttgcccaatt

SEQ ID NO: 708124 - DNA, 13 bp, C. elegans
attttgcccactt

SEQ ID NO: 708125 - DNA, 13 bp, C. elegans
attttgccgattt

SEQ ID NO: 708126 - DNA, 13 bp, C. elegans
attttgccgcaaa

SEQ ID NO: 708127 - DNA, 13 bp, C. elegans
attttgcgaaaat

SEQ ID NO: 708128 - DNA, 13 bp, C. elegans
attttgcgatgca

SEQ ID NO: 708129 - DNA, 13 bp, C. elegans
attttgcgcatca

SEQ ID NO: 708130 - DNA, 13 bp, C. elegans
attttgcgttttc

SEQ ID NO: 708131 - DNA, 13 bp, C. elegans
attttgctacatt

SEQ ID NO: 708132 - DNA, 13 bp, C. elegans
attttgctataaa

SEQ ID NO: 708133 - DNA, 13 bp, C. elegans
attttgctcaatt

SEQ ID NO: 708134 - DNA, 13 bp, C. elegans
attttgctccaaa

SEQ ID NO: 708135 - DNA, 13 bp, C. elegans
attttgctgaaat

SEQ ID NO: 708136 - DNA, 13 bp, C. elegans
attttgctggaaa

SEQ ID NO: 708137 - DNA, 13 bp, C. elegans
attttgcttcaaa

SEQ ID NO: 708138 - DNA, 13 bp, C. elegans
attttgcttccaa

SEQ ID NO: 708139 - DNA, 13 bp, C. elegans
attttgcttgaaa

SEQ ID NO: 708140 - DNA, 13 bp, C. elegans
attttgctttaaa

SEQ ID NO: 708141 - DNA, 13 bp, C. elegans
attttgctttgaa

SEQ ID NO: 708142 - DNA, 14 bp, C. elegans
attttgcttttaaa

SEQ ID NO: 708143 - DNA, 13 bp, C. elegans
attttggaaaaaa

SEQ ID NO: 708144 - DNA, 13 bp, C. elegans
attttggaaaaga

SEQ ID NO: 708145 - DNA, 13 bp, C. elegans
attttggaaattt

SEQ ID NO: 708146 - DNA, 13 bp, C. elegans
attttggaagatt

SEQ ID NO: 708147 - DNA, 13 bp, C. elegans
attttggaagttg

SEQ ID NO: 708148 - DNA, 13 bp, C. elegans
attttggaataat

SEQ ID NO: 708149 - DNA, 13 bp, C. elegans
attttggaatgta

SEQ ID NO: 708150 - DNA, 13 bp, C. elegans
attttggaattct

SEQ ID NO: 708151 - DNA, 13 bp, C. elegans
attttggaattga

SEQ ID NO: 708152 - DNA, 13 bp, C. elegans
attttggaattgt

SEQ ID NO: 708153 - DNA, 13 bp, C. elegans
attttggaatttc

SEQ ID NO: 708154 - DNA, 13 bp, C. elegans
attttggacattt

SEQ ID NO: 708155 - DNA, 13 bp, C. elegans
attttggagaaat

SEQ ID NO: 708156 - DNA, 13 bp, C. elegans
attttggagagaa

SEQ ID NO: 708157 - DNA, 13 bp, C. elegans
attttggagtgtt

SEQ ID NO: 708158 - DNA, 13 bp, C. elegans
attttggagttta

SEQ ID NO: 708159 - DNA, 13 bp, C. elegans
attttggatttga

SEQ ID NO: 708160 - DNA, 13 bp, C. elegans
attttggcaaaat

SEQ ID NO: 708161 - DNA, 13 bp, C. elegans
attttggcacaaa

SEQ ID NO: 708162 - DNA, 13 bp, C. elegans
attttggcagaaa

SEQ ID NO: 708163 - DNA, 13 bp, C. elegans
attttggcagatt

SEQ ID NO: 708164 - DNA, 13 bp, C. elegans
attttggcagttg

SEQ ID NO: 708165 - DNA, 13 bp, C. elegans
attttggcagttt

SEQ ID NO: 708166 - DNA, 13 bp, C. elegans
attttggcataaa

SEQ ID NO: 708167 - DNA, 13 bp, C. elegans
attttggcatttt

SEQ ID NO: 708168 - DNA, 13 bp, C. elegans
attttggccgaaa

SEQ ID NO: 708169 - DNA, 13 bp, C. elegans
attttggcgccaa

SEQ ID NO: 708170 - DNA, 13 bp, C. elegans
attttggcgggaa

SEQ ID NO: 708171 - DNA, 13 bp, C. elegans
attttggctgaaa

SEQ ID NO: 708172 - DNA, 13 bp, C. elegans
attttggctttta

SEQ ID NO: 708173 - DNA, 13 bp, C. elegans
attttgggaaaca

SEQ ID NO: 708174 - DNA, 13 bp, C. elegans
attttgggatatt

SEQ ID NO: 708175 - DNA, 13 bp, C. elegans
attttgggtctat

SEQ ID NO: 708176 - DNA, 13 bp, C. elegans
attttgggtctca

SEQ ID NO: 708177 - DNA, 13 bp, C. elegans
attttggtaaaaa

SEQ ID NO: 708178 - DNA, 13 bp, C. elegans
attttggtgaatt

SEQ ID NO: 708179 - DNA, 13 bp, C. elegans
attttggtgcaaa

SEQ ID NO: 708180 - DNA, 13 bp, C. elegans
attttggtttaaa

SEQ ID NO: 708181 - DNA, 13 bp, C. elegans
attttggtttcaa

SEQ ID NO: 708182 - DNA, 13 bp, C. elegans
attttgtaaatga

SEQ ID NO: 708183 - DNA, 13 bp, C. elegans
attttgtaaattg

SEQ ID NO: 708184 - DNA, 13 bp, C. elegans
attttgtaacaaa

SEQ ID NO: 708185 - DNA, 13 bp, C. elegans
attttgtaatcaa

SEQ ID NO: 708186 - DNA, 13 bp, C. elegans
attttgtaattga

SEQ ID NO: 708187 - DNA, 13 bp, C. elegans
attttgtaccaaa

SEQ ID NO: 708188 - DNA, 13 bp, C. elegans
attttgtagcaaa

SEQ ID NO: 708189 - DNA, 13 bp, C. elegans
attttgtaggaat

SEQ ID NO: 708190 - DNA, 13 bp, C. elegans
attttgtatcaaa

SEQ ID NO: 708191 - DNA, 13 bp, C. elegans
attttgtattgaa

SEQ ID NO: 708192 - DNA, 13 bp, C. elegans
attttgtcaaaaa

SEQ ID NO: 708193 - DNA, 13 bp, C. elegans
attttgtcaagaa

SEQ ID NO: 708194 - DNA, 13 bp, C. elegans
attttgtcaattt

SEQ ID NO: 708195 - DNA, 13 bp, C. elegans
attttgtcagttg

SEQ ID NO: 708196 - DNA, 13 bp, C. elegans
attttgtcatttc

SEQ ID NO: 708197 - DNA, 13 bp, C. elegans
attttgtcatttg

SEQ ID NO: 708198 - DNA, 13 bp, C. elegans
attttgtccaaat

SEQ ID NO: 708199 - DNA, 13 bp, C. elegans
attttgtcgaatt

SEQ ID NO: 708200 - DNA, 13 bp, C. elegans
attttgtctaaat

SEQ ID NO: 708201 - DNA, 13 bp, C. elegans
attttgtctgaat

SEQ ID NO: 708202 - DNA, 13 bp, C. elegans
attttgtgaaaac

SEQ ID NO: 708203 - DNA, 13 bp, C. elegans
attttgtgaacac

SEQ ID NO: 708204 - DNA, 13 bp, C. elegans
attttgtgaataa

SEQ ID NO: 708205 - DNA, 13 bp, C. elegans
attttgtgatata

SEQ ID NO: 708206 - DNA, 13 bp, C. elegans
attttgtgcaaaa

SEQ ID NO: 708207 - DNA, 13 bp, C. elegans
attttgtgcaaat

SEQ ID NO: 708208 - DNA, 14 bp, C. elegans
attttgtgcaattt

SEQ ID NO: 708209 - DNA, 13 bp, C. elegans
attttgtgcattt

SEQ ID NO: 708210 - DNA, 13 bp, C. elegans
attttgtgccaaa

SEQ ID NO: 708211 - DNA, 13 bp, C. elegans
attttgtgctcaa

SEQ ID NO: 708212 - DNA, 13 bp, C. elegans
attttgtgctttg

SEQ ID NO: 708213 - DNA, 13 bp, C. elegans
attttgtggaaaa

SEQ ID NO: 708214 - DNA, 13 bp, C. elegans
attttgtggaatt

SEQ ID NO: 708215 - DNA, 13 bp, C. elegans
attttgtggagaa

SEQ ID NO: 708216 - DNA, 13 bp, C. elegans
attttgtgtcaaa

SEQ ID NO: 708217 - DNA, 13 bp, C. elegans
attttgtgtgaaa

SEQ ID NO: 708218 - DNA, 13 bp, C. elegans
attttgtgtggaa

SEQ ID NO: 708219 - DNA, 13 bp, C. elegans
attttgtgttaaa

SEQ ID NO: 708220 - DNA, 14 bp, C. elegans
attttgtgttcaaa

SEQ ID NO: 708221 - DNA, 13 bp, C. elegans
attttgtgttccc

SEQ ID NO: 708222 - DNA, 13 bp, C. elegans
attttgtgttcta

SEQ ID NO: 708223 - DNA, 13 bp, C. elegans
attttgttaaact

SEQ ID NO: 708224 - DNA, 13 bp, C. elegans
attttgttaacaa

SEQ ID NO: 708225 - DNA, 13 bp, C. elegans
attttgttaactt

SEQ ID NO: 708226 - DNA, 13 bp, C. elegans
attttgttactga

SEQ ID NO: 708227 - DNA, 13 bp, C. elegans
attttgttatcaa

SEQ ID NO: 708228 - DNA, 13 bp, C. elegans
attttgttcacaa

SEQ ID NO: 708229 - DNA, 13 bp, C. elegans
attttgttcagtt

SEQ ID NO: 708230 - DNA, 13 bp, C. elegans
attttgttccgtt

SEQ ID NO: 708231 - DNA, 13 bp, C. elegans
attttgttcgaaa

SEQ ID NO: 708232 - DNA, 13 bp, C. elegans
attttgttctaaa

SEQ ID NO: 708233 - DNA, 13 bp, C. elegans
attttgttctcaa

SEQ ID NO: 708234 - DNA, 13 bp, C. elegans
attttgttctgaa

SEQ ID NO: 708235 - DNA, 14 bp, C. elegans
attttgttgaaaac

SEQ ID NO: 708236 - DNA, 13 bp, C. elegans
attttgttgtaaa

SEQ ID NO: 708237 - DNA, 13 bp, C. elegans
attttgttgtaca

SEQ ID NO: 708238 - DNA, 13 bp, C. elegans
attttgtttagaa

SEQ ID NO: 708239 - DNA, 13 bp, C. elegans
attttgtttctca

SEQ ID NO: 708240 - DNA, 13 bp, C. elegans
attttgtttgaaa

SEQ ID NO: 708241 - DNA, 13 bp, C. elegans
attttgtttggaa

SEQ ID NO: 708242 - DNA, 13 bp, C. elegans
attttgtttgtca

SEQ ID NO: 708243 - DNA, 14 bp, C. elegans
attttgttttcaaa

SEQ ID NO: 708244 - DNA, 13 bp, C. elegans
atttttaaaacag

SEQ ID NO: 708245 - DNA, 13 bp, C. elegans
atttttaaaaccg

SEQ ID NO: 708246 - DNA, 13 bp, C. elegans
atttttaaaactg

SEQ ID NO: 708247 - DNA, 13 bp, C. elegans
atttttaaaatcc

SEQ ID NO: 708248 - DNA, 13 bp, C. elegans
atttttaaaggtt

SEQ ID NO: 708249 - DNA, 13 bp, C. elegans
atttttaaatgct

SEQ ID NO: 708250 - DNA, 13 bp, C. elegans
atttttaacgaaa

SEQ ID NO: 708251 - DNA, 13 bp, C. elegans
atttttaacgatt

SEQ ID NO: 708252 - DNA, 13 bp, C. elegans
atttttaacggat

SEQ ID NO: 708253 - DNA, 13 bp, C. elegans
atttttaacgttt

SEQ ID NO: 708254 - DNA, 13 bp, C. elegans
atttttaactgtt

SEQ ID NO: 708255 - DNA, 13 bp, C. elegans
atttttaacttca

SEQ ID NO: 708256 - DNA, 13 bp, C. elegans
atttttaagcact

SEQ ID NO: 708257 - DNA, 13 bp, C. elegans
atttttaagccaa

SEQ ID NO: 708258 - DNA, 13 bp, C. elegans
atttttaaggtat

SEQ ID NO: 708259 - DNA, 13 bp, C. elegans
atttttaagtgaa

SEQ ID NO: 708260 - DNA, 13 bp, C. elegans
atttttaatcgaa

SEQ ID NO: 708261 - DNA, 13 bp, C. elegans
atttttaatgcct

SEQ ID NO: 708262 - DNA, 13 bp, C. elegans
atttttaatgcga

SEQ ID NO: 708263 - DNA, 13 bp, C. elegans
atttttaatgtga

SEQ ID NO: 708264 - DNA, 13 bp, C. elegans
atttttacaacta

SEQ ID NO: 708265 - DNA, 13 bp, C. elegans
atttttacacaaa

SEQ ID NO: 708266 - DNA, 13 bp, C. elegans
atttttacacgaa

SEQ ID NO: 708267 - DNA, 13 bp, C. elegans
atttttacatgat

SEQ ID NO: 708268 - DNA, 13 bp, C. elegans
atttttaccaaaa

SEQ ID NO: 708269 - DNA, 13 bp, C. elegans
atttttaccaaat

SEQ ID NO: 708270 - DNA, 13 bp, C. elegans
atttttacccaaa

SEQ ID NO: 708271 - DNA, 13 bp, C. elegans
atttttacgaact

SEQ ID NO: 708272 - DNA, 13 bp, C. elegans
atttttacgaatt

SEQ ID NO: 708273 - DNA, 13 bp, C. elegans
atttttacgagtt

SEQ ID NO: 708274 - DNA, 13 bp, C. elegans
atttttacgattt

SEQ ID NO: 708275 - DNA, 13 bp, C. elegans
atttttacttgaa

SEQ ID NO: 708276 - DNA, 13 bp, C. elegans
atttttactttga

SEQ ID NO: 708277 - DNA, 13 bp, C. elegans
atttttagaacaa

SEQ ID NO: 708278 - DNA, 13 bp, C. elegans
atttttagaagaa

SEQ ID NO: 708279 - DNA, 13 bp, C. elegans
atttttagaatct

SEQ ID NO: 708280 - DNA, 13 bp, C. elegans
atttttagagaat

SEQ ID NO: 708281 - DNA, 13 bp, C. elegans
atttttagatgaa

SEQ ID NO: 708282 - DNA, 13 bp, C. elegans
atttttagatttc

SEQ ID NO: 708283 - DNA, 13 bp, C. elegans
atttttagcattt

SEQ ID NO: 708284 - DNA, 13 bp, C. elegans
atttttagccgaa

SEQ ID NO: 708285 - DNA, 13 bp, C. elegans
atttttagctaaa

SEQ ID NO: 708286 - DNA, 13 bp, C. elegans
atttttaggccaa

SEQ ID NO: 708287 - DNA, 13 bp, C. elegans
atttttaggccac

SEQ ID NO: 708288 - DNA, 13 bp, C. elegans
atttttaggccga

SEQ ID NO: 708289 - DNA, 13 bp, C. elegans
atttttagtggaa

SEQ ID NO: 708290 - DNA, 13 bp, C. elegans
atttttagttgga

SEQ ID NO: 708291 - DNA, 13 bp, C. elegans
atttttatacgtt

SEQ ID NO: 708292 - DNA, 13 bp, C. elegans
atttttatagaac

SEQ ID NO: 708293 - DNA, 13 bp, C. elegans
atttttatagagt

SEQ ID NO: 708294 - DNA, 13 bp, C. elegans
atttttatagtct

SEQ ID NO: 708295 - DNA, 13 bp, C. elegans
atttttatatcac

SEQ ID NO: 708296 - DNA, 13 bp, C. elegans
atttttatatgca

SEQ ID NO: 708297 - DNA, 13 bp, C. elegans
atttttatcaagt

SEQ ID NO: 708298 - DNA, 13 bp, C. elegans
atttttatcagaa

SEQ ID NO: 708299 - DNA, 13 bp, C. elegans
atttttatccaaa

SEQ ID NO: 708300 - DNA, 13 bp, C. elegans
atttttatcccaa

SEQ ID NO: 708301 - DNA, 13 bp, C. elegans
atttttatcgaaa

SEQ ID NO: 708302 - DNA, 13 bp, C. elegans
atttttatctcaa

SEQ ID NO: 708303 - DNA, 13 bp, C. elegans
atttttatctgaa

SEQ ID NO: 708304 - DNA, 13 bp, C. elegans
atttttatgaaac

SEQ ID NO: 708305 - DNA, 13 bp, C. elegans
atttttatgaaga

SEQ ID NO: 708306 - DNA, 13 bp, C. elegans
atttttatgatct

SEQ ID NO: 708307 - DNA, 13 bp, C. elegans
atttttatgcaaa

SEQ ID NO: 708308 - DNA, 13 bp, C. elegans
atttttatgccaa

SEQ ID NO: 708309 - DNA, 13 bp, C. elegans
atttttatgctaa

SEQ ID NO: 708310 - DNA, 13 bp, C. elegans
atttttatgtcga

SEQ ID NO: 708311 - DNA, 13 bp, C. elegans
atttttatgtcta

SEQ ID NO: 708312 - DNA, 13 bp, C. elegans
atttttattcagt

SEQ ID NO: 708313 - DNA, 13 bp, C. elegans
atttttattcgag

SEQ ID NO: 708314 - DNA, 13 bp, C. elegans
atttttattgcaa

SEQ ID NO: 708315 - DNA, 13 bp, C. elegans
atttttattggaa

SEQ ID NO: 708316 - DNA, 13 bp, C. elegans
atttttatttcag

SEQ ID NO: 708317 - DNA, 13 bp, C. elegans
atttttatttccg

SEQ ID NO: 708318 - DNA, 13 bp, C. elegans
atttttcaaaaca

SEQ ID NO: 708319 - DNA, 13 bp, C. elegans
atttttcaaaact

SEQ ID NO: 708320 - DNA, 13 bp, C. elegans
atttttcaaaagt

SEQ ID NO: 708321 - DNA, 13 bp, C. elegans
atttttcaaaatg

SEQ ID NO: 708322 - DNA, 13 bp, C. elegans
atttttcaaacaa

SEQ ID NO: 708323 - DNA, 13 bp, C. elegans
atttttcaaacga

SEQ ID NO: 708324 - DNA, 13 bp, C. elegans
atttttcaaactt

SEQ ID NO: 708325 - DNA, 13 bp, C. elegans
atttttcaaatca

SEQ ID NO: 708326 - DNA, 13 bp, C. elegans
atttttcaacaca

SEQ ID NO: 708327 - DNA, 13 bp, C. elegans
atttttcaactaa

SEQ ID NO: 708328 - DNA, 13 bp, C. elegans
atttttcaactga

SEQ ID NO: 708329 - DNA, 13 bp, C. elegans
atttttcaagaaa

SEQ ID NO: 708330 - DNA, 13 bp, C. elegans
atttttcaagaat

SEQ ID NO: 708331 - DNA, 13 bp, C. elegans
atttttcaagata

SEQ ID NO: 708332 - DNA, 13 bp, C. elegans
atttttcaagttt

SEQ ID NO: 708333 - DNA, 13 bp, C. elegans
atttttcaatcaa

SEQ ID NO: 708334 - DNA, 13 bp, C. elegans
atttttcaatctc

SEQ ID NO: 708335 - DNA, 13 bp, C. elegans
atttttcaatgaa

SEQ ID NO: 708336 - DNA, 13 bp, C. elegans
atttttcaatgat

SEQ ID NO: 708337 - DNA, 13 bp, C. elegans
atttttcaatgtt

SEQ ID NO: 708338 - DNA, 13 bp, C. elegans
atttttcaattcc

SEQ ID NO: 708339 - DNA, 13 bp, C. elegans
atttttcaattgt

SEQ ID NO: 708340 - DNA, 13 bp, C. elegans
atttttcacaaaa

SEQ ID NO: 708341 - DNA, 13 bp, C. elegans
atttttcacaaat

SEQ ID NO: 708342 - DNA, 13 bp, C. elegans
atttttcacaact

SEQ ID NO: 708343 - DNA, 13 bp, C. elegans
atttttcacacag

SEQ ID NO: 708344 - DNA, 14 bp, C. elegans
atttttcacagaaa

SEQ ID NO: 708345 - DNA, 13 bp, C. elegans
atttttcacagtt

SEQ ID NO: 708346 - DNA, 13 bp, C. elegans
atttttcaccaat

SEQ ID NO: 708347 - DNA, 13 bp, C. elegans
atttttcacgaaa

SEQ ID NO: 708348 - DNA, 13 bp, C. elegans
atttttcactcat

SEQ ID NO: 708349 - DNA, 13 bp, C. elegans
atttttcagaaaa

SEQ ID NO: 708350 - DNA, 14 bp, C. elegans
atttttcagaaatt

SEQ ID NO: 708351 - DNA, 13 bp, C. elegans
atttttcagagga

SEQ ID NO: 708352 - DNA, 13 bp, C. elegans
atttttcagatat

SEQ ID NO: 708353 - DNA, 13 bp, C. elegans
atttttcagcaat

SEQ ID NO: 708354 - DNA, 13 bp, C. elegans
atttttcagcagt

SEQ ID NO: 708355 - DNA, 13 bp, C. elegans
atttttcagctaa

SEQ ID NO: 708356 - DNA, 13 bp, C. elegans
atttttcagcttt

SEQ ID NO: 708357 - DNA, 13 bp, C. elegans
atttttcaggaaa

SEQ ID NO: 708358 - DNA, 13 bp, C. elegans
atttttcaggatt

SEQ ID NO: 708359 - DNA, 13 bp, C. elegans
atttttcaggtaa

SEQ ID NO: 708360 - DNA, 13 bp, C. elegans
atttttcagtgaa

SEQ ID NO: 708361 - DNA, 13 bp, C. elegans
atttttcagttat

SEQ ID NO: 708362 - DNA, 13 bp, C. elegans
atttttcagttca

SEQ ID NO: 708363 - DNA, 13 bp, C. elegans
atttttcatccaa

SEQ ID NO: 708364 - DNA, 13 bp, C. elegans
atttttcatcgaa

SEQ ID NO: 708365 - DNA, 13 bp, C. elegans
atttttcatctaa

SEQ ID NO: 708366 - DNA, 13 bp, C. elegans
atttttcatgaaa

SEQ ID NO: 708367 - DNA, 13 bp, C. elegans
atttttcatgtgt

SEQ ID NO: 708368 - DNA, 13 bp, C. elegans
atttttcatgttg

SEQ ID NO: 708369 - DNA, 13 bp, C. elegans
atttttcattaca

SEQ ID NO: 708370 - DNA, 13 bp, C. elegans
atttttcatttcg

SEQ ID NO: 708371 - DNA, 13 bp, C. elegans
atttttccaaaaa

SEQ ID NO: 708372 - DNA, 13 bp, C. elegans
atttttccaaaat

SEQ ID NO: 708373 - DNA, 13 bp, C. elegans
atttttccaaatt

SEQ ID NO: 708374 - DNA, 13 bp, C. elegans
atttttccaacaa

SEQ ID NO: 708375 - DNA, 13 bp, C. elegans
atttttccaacag

SEQ ID NO: 708376 - DNA, 13 bp, C. elegans
atttttccaacta

SEQ ID NO: 708377 - DNA, 13 bp, C. elegans
atttttccacaat

SEQ ID NO: 708378 - DNA, 13 bp, C. elegans
atttttccacaca

SEQ ID NO: 708379 - DNA, 13 bp, C. elegans
atttttccactat

SEQ ID NO: 708380 - DNA, 13 bp, C. elegans
atttttccagttt

SEQ ID NO: 708381 - DNA, 13 bp, C. elegans
atttttccataaa

SEQ ID NO: 708382 - DNA, 13 bp, C. elegans
atttttccattaa

SEQ ID NO: 708383 - DNA, 13 bp, C. elegans
atttttcccactt

SEQ ID NO: 708384 - DNA, 13 bp, C. elegans
atttttcccagtt

SEQ ID NO: 708385 - DNA, 13 bp, C. elegans
atttttccccaat

SEQ ID NO: 708386 - DNA, 13 bp, C. elegans
atttttcccgaat

SEQ ID NO: 708387 - DNA, 13 bp, C. elegans
atttttcccgcca

SEQ ID NO: 708388 - DNA, 13 bp, C. elegans
atttttcccggaa

SEQ ID NO: 708389 - DNA, 13 bp, C. elegans
atttttccgaaaa

SEQ ID NO: 708390 - DNA, 13 bp, C. elegans
atttttccgaaat

SEQ ID NO: 708391 - DNA, 13 bp, C. elegans
atttttccggaaa

SEQ ID NO: 708392 - DNA, 13 bp, C. elegans
atttttccgtgaa

SEQ ID NO: 708393 - DNA, 13 bp, C. elegans
atttttccgtgcc

SEQ ID NO: 708394 - DNA, 13 bp, C. elegans
atttttccgtgtc

SEQ ID NO: 708395 - DNA, 13 bp, C. elegans
atttttcctaaat

SEQ ID NO: 708396 - DNA, 13 bp, C. elegans
atttttcctagaa

SEQ ID NO: 708397 - DNA, 13 bp, C. elegans
atttttcctcaaa

SEQ ID NO: 708398 - DNA, 13 bp, C. elegans
atttttcctggtt

SEQ ID NO: 708399 - DNA, 13 bp, C. elegans
atttttccttcaa

SEQ ID NO: 708400 - DNA, 13 bp, C. elegans
atttttcgaaaaa

SEQ ID NO: 708401 - DNA, 13 bp, C. elegans
atttttcgaaaag

SEQ ID NO: 708402 - DNA, 14 bp, C. elegans
atttttcgaaaatt

SEQ ID NO: 708403 - DNA, 13 bp, C. elegans
atttttcgaactt

SEQ ID NO: 708404 - DNA, 13 bp, C. elegans
atttttcgaagat

SEQ ID NO: 708405 - DNA, 13 bp, C. elegans
atttttcgacgaa

SEQ ID NO: 708406 - DNA, 13 bp, C. elegans
atttttcgagaaa

SEQ ID NO: 708407 - DNA, 13 bp, C. elegans
atttttcgagttt

SEQ ID NO: 708408 - DNA, 13 bp, C. elegans
atttttcgataat

SEQ ID NO: 708409 - DNA, 13 bp, C. elegans
atttttcgatgac

SEQ ID NO: 708410 - DNA, 13 bp, C. elegans
atttttcgatgat

SEQ ID NO: 708411 - DNA, 13 bp, C. elegans
atttttcgattct

SEQ ID NO: 708412 - DNA, 13 bp, C. elegans
atttttcgccaaa

SEQ ID NO: 708413 - DNA, 13 bp, C. elegans
atttttcgccgaa

SEQ ID NO: 708414 - DNA, 13 bp, C. elegans
atttttcgcctct

SEQ ID NO: 708415 - DNA, 13 bp, C. elegans
atttttcgcgctc

SEQ ID NO: 708416 - DNA, 13 bp, C. elegans
atttttcgctatt

SEQ ID NO: 708417 - DNA, 13 bp, C. elegans
atttttcgctgtt

SEQ ID NO: 708418 - DNA, 13 bp, C. elegans
atttttcgcttgt

SEQ ID NO: 708419 - DNA, 13 bp, C. elegans
atttttcggacat

SEQ ID NO: 708420 - DNA, 13 bp, C. elegans
atttttcggcaat

SEQ ID NO: 708421 - DNA, 13 bp, C. elegans
atttttcgggttt

SEQ ID NO: 708422 - DNA, 13 bp, C. elegans
atttttcggtatt

SEQ ID NO: 708423 - DNA, 13 bp, C. elegans
atttttcgtaatt

SEQ ID NO: 708424 - DNA, 13 bp, C. elegans
atttttcgtcaaa

SEQ ID NO: 708425 - DNA, 13 bp, C. elegans
atttttcgtgaaa

SEQ ID NO: 708426 - DNA, 13 bp, C. elegans
atttttcgtgaat

SEQ ID NO: 708427 - DNA, 13 bp, C. elegans
atttttcgtggaa

SEQ ID NO: 708428 - DNA, 13 bp, C. elegans
atttttcgtttaa

SEQ ID NO: 708429 - DNA, 13 bp, C. elegans
atttttctaacaa

SEQ ID NO: 708430 - DNA, 13 bp, C. elegans
atttttctacaaa

SEQ ID NO: 708431 - DNA, 13 bp, C. elegans
atttttctacaat

SEQ ID NO: 708432 - DNA, 13 bp, C. elegans
atttttctacact

SEQ ID NO: 708433 - DNA, 13 bp, C. elegans
atttttctacgtt

SEQ ID NO: 708434 - DNA, 13 bp, C. elegans
atttttctagaaa

SEQ ID NO: 708435 - DNA, 13 bp, C. elegans
atttttctagcta

SEQ ID NO: 708436 - DNA, 13 bp, C. elegans
atttttctaggtg

SEQ ID NO: 708437 - DNA, 13 bp, C. elegans
atttttctcaaaa

SEQ ID NO: 708438 - DNA, 13 bp, C. elegans
atttttctcaata

SEQ ID NO: 708439 - DNA, 13 bp, C. elegans
atttttctcacaa

SEQ ID NO: 708440 - DNA, 13 bp, C. elegans
atttttctccaaa

SEQ ID NO: 708441 - DNA, 13 bp, C. elegans
atttttctccaat

SEQ ID NO: 708442 - DNA, 13 bp, C. elegans
atttttctcgaaa

SEQ ID NO: 708443 - DNA, 13 bp, C. elegans
atttttctctcga

SEQ ID NO: 708444 - DNA, 13 bp, C. elegans
atttttctctgaa

SEQ ID NO: 708445 - DNA, 13 bp, C. elegans
atttttctgaaga

SEQ ID NO: 708446 - DNA, 13 bp, C. elegans
atttttctgaatc

SEQ ID NO: 708447 - DNA, 13 bp, C. elegans
atttttctgataa

SEQ ID NO: 708448 - DNA, 13 bp, C. elegans
atttttctgatct

SEQ ID NO: 708449 - DNA, 13 bp, C. elegans
atttttctgattc

SEQ ID NO: 708450 - DNA, 13 bp, C. elegans
atttttctgcaaa

SEQ ID NO: 708451 - DNA, 14 bp, C. elegans
atttttctgcaaaa

SEQ ID NO: 708452 - DNA, 13 bp, C. elegans
atttttctgcatc

SEQ ID NO: 708453 - DNA, 13 bp, C. elegans
atttttctgctaa

SEQ ID NO: 708454 - DNA, 13 bp, C. elegans
atttttctggaaa

SEQ ID NO: 708455 - DNA, 13 bp, C. elegans
atttttctggttc

SEQ ID NO: 708456 - DNA, 13 bp, C. elegans
atttttctgtaat

SEQ ID NO: 708457 - DNA, 13 bp, C. elegans
atttttcttaagt

SEQ ID NO: 708458 - DNA, 13 bp, C. elegans
atttttcttccaa

SEQ ID NO: 708459 - DNA, 13 bp, C. elegans
atttttcttccag

SEQ ID NO: 708460 - DNA, 13 bp, C. elegans
atttttcttcgaa

SEQ ID NO: 708461 - DNA, 13 bp, C. elegans
atttttcttgaat

SEQ ID NO: 708462 - DNA, 13 bp, C. elegans
atttttcttgtca

SEQ ID NO: 708463 - DNA, 13 bp, C. elegans
atttttctttcga

SEQ ID NO: 708464 - DNA, 13 bp, C. elegans
atttttctttgaa

SEQ ID NO: 708465 - DNA, 13 bp, C. elegans
atttttgaaaaca

SEQ ID NO: 708466 - DNA, 13 bp, C. elegans
atttttgaaaagt

SEQ ID NO: 708467 - DNA, 13 bp, C. elegans
atttttgaaactt

SEQ ID NO: 708468 - DNA, 13 bp, C. elegans
atttttgaaatca

SEQ ID NO: 708469 - DNA, 13 bp, C. elegans
atttttgaaatgt

SEQ ID NO: 708470 - DNA, 13 bp, C. elegans
atttttgaacaaa

SEQ ID NO: 708471 - DNA, 13 bp, C. elegans
atttttgaaccaa

SEQ ID NO: 708472 - DNA, 13 bp, C. elegans
atttttgaactat

SEQ ID NO: 708473 - DNA, 14 bp, C. elegans
atttttgaacttaa

SEQ ID NO: 708474 - DNA, 13 bp, C. elegans
atttttgaacttg

SEQ ID NO: 708475 - DNA, 13 bp, C. elegans
atttttgaagaat

SEQ ID NO: 708476 - DNA, 13 bp, C. elegans
atttttgaagctt

SEQ ID NO: 708477 - DNA, 13 bp, C. elegans
atttttgaagtct

SEQ ID NO: 708478 - DNA, 13 bp, C. elegans
atttttgaataga

SEQ ID NO: 708479 - DNA, 13 bp, C. elegans
atttttgaatctt

SEQ ID NO: 708480 - DNA, 14 bp, C. elegans
atttttgaatttca

SEQ ID NO: 708481 - DNA, 13 bp, C. elegans
atttttgacaaag

SEQ ID NO: 708482 - DNA, 13 bp, C. elegans
atttttgacaaat

SEQ ID NO: 708483 - DNA, 13 bp, C. elegans
atttttgacaatt

SEQ ID NO: 708484 - DNA, 13 bp, C. elegans
atttttgacggaa

SEQ ID NO: 708485 - DNA, 13 bp, C. elegans
atttttgactgta

SEQ ID NO: 708486 - DNA, 13 bp, C. elegans
atttttgacttat

SEQ ID NO: 708487 - DNA, 14 bp, C. elegans
atttttgagaaaat

SEQ ID NO: 708488 - DNA, 13 bp, C. elegans
atttttgagaaag

SEQ ID NO: 708489 - DNA, 13 bp, C. elegans
atttttgagaaat

SEQ ID NO: 708490 - DNA, 13 bp, C. elegans
atttttgagaagt

SEQ ID NO: 708491 - DNA, 13 bp, C. elegans
atttttgagaatt

SEQ ID NO: 708492 - DNA, 13 bp, C. elegans
atttttgagcttt

SEQ ID NO: 708493 - DNA, 13 bp, C. elegans
atttttgataaga

SEQ ID NO: 708494 - DNA, 13 bp, C. elegans
atttttgatactt

SEQ ID NO: 708495 - DNA, 13 bp, C. elegans
atttttgatcaaa

SEQ ID NO: 708496 - DNA, 13 bp, C. elegans
atttttgatcatt

SEQ ID NO: 708497 - DNA, 13 bp, C. elegans
atttttgatctac

SEQ ID NO: 708498 - DNA, 13 bp, C. elegans
atttttgatgaat

SEQ ID NO: 708499 - DNA, 13 bp, C. elegans
atttttgatgatg

SEQ ID NO: 708500 - DNA, 13 bp, C. elegans
atttttgatggaa

SEQ ID NO: 708501 - DNA, 13 bp, C. elegans
atttttgattcaa

SEQ ID NO: 708502 - DNA, 13 bp, C. elegans
atttttgatttac

SEQ ID NO: 708503 - DNA, 13 bp, C. elegans
atttttgcaaaat

SEQ ID NO: 708504 - DNA, 13 bp, C. elegans
atttttgcaaagt

SEQ ID NO: 708505 - DNA, 13 bp, C. elegans
atttttgcaaata

SEQ ID NO: 708506 - DNA, 13 bp, C. elegans
atttttgcaaatt

SEQ ID NO: 708507 - DNA, 13 bp, C. elegans
atttttgcaactg

SEQ ID NO: 708508 - DNA, 13 bp, C. elegans
atttttgcaataa

SEQ ID NO: 708509 - DNA, 13 bp, C. elegans
atttttgcaattt

SEQ ID NO: 708510 - DNA, 13 bp, C. elegans
atttttgcacatg

SEQ ID NO: 708511 - DNA, 13 bp, C. elegans
atttttgcaccat

SEQ ID NO: 708512 - DNA, 13 bp, C. elegans
atttttgcagaaa

SEQ ID NO: 708513 - DNA, 13 bp, C. elegans
atttttgcagact

SEQ ID NO: 708514 - DNA, 13 bp, C. elegans
atttttgcataaa

SEQ ID NO: 708515 - DNA, 13 bp, C. elegans
atttttgcattaa

SEQ ID NO: 708516 - DNA, 13 bp, C. elegans
atttttgccaaaa

SEQ ID NO: 708517 - DNA, 13 bp, C. elegans
atttttgccaatt

SEQ ID NO: 708518 - DNA, 13 bp, C. elegans
atttttgccatat

SEQ ID NO: 708519 - DNA, 13 bp, C. elegans
atttttgccattt

SEQ ID NO: 708520 - DNA, 13 bp, C. elegans
atttttgcccgaa

SEQ ID NO: 708521 - DNA, 13 bp, C. elegans
atttttgcgaaaa

SEQ ID NO: 708522 - DNA, 13 bp, C. elegans
atttttgcgagaa

SEQ ID NO: 708523 - DNA, 13 bp, C. elegans
atttttgcgccga

SEQ ID NO: 708524 - DNA, 13 bp, C. elegans
atttttgcggaaa

SEQ ID NO: 708525 - DNA, 13 bp, C. elegans
atttttgcgggga

SEQ ID NO: 708526 - DNA, 13 bp, C. elegans
atttttgctacat

SEQ ID NO: 708527 - DNA, 13 bp, C. elegans
atttttgctcatt

SEQ ID NO: 708528 - DNA, 13 bp, C. elegans
atttttgctccaa

SEQ ID NO: 708529 - DNA, 13 bp, C. elegans
atttttgctcttg

SEQ ID NO: 708530 - DNA, 13 bp, C. elegans
atttttgctttaa

SEQ ID NO: 708531 - DNA, 13 bp, C. elegans
atttttggaaaat

SEQ ID NO: 708532 - DNA, 14 bp, C. elegans
atttttggaacatt

SEQ ID NO: 708533 - DNA, 13 bp, C. elegans
atttttggacttt

SEQ ID NO: 708534 - DNA, 13 bp, C. elegans
atttttggagcaa

SEQ ID NO: 708535 - DNA, 13 bp, C. elegans
atttttggatgaa

SEQ ID NO: 708536 - DNA, 13 bp, C. elegans
atttttggcaaat

SEQ ID NO: 708537 - DNA, 13 bp, C. elegans
atttttggcagaa

SEQ ID NO: 708538 - DNA, 13 bp, C. elegans
atttttggccaaa

SEQ ID NO: 708539 - DNA, 13 bp, C. elegans
atttttggccata

SEQ ID NO: 708540 - DNA, 13 bp, C. elegans
atttttggcccaa

SEQ ID NO: 708541 - DNA, 13 bp, C. elegans
atttttggcgaaa

SEQ ID NO: 708542 - DNA, 13 bp, C. elegans
atttttggctgat

SEQ ID NO: 708543 - DNA, 13 bp, C. elegans
atttttgggaatt

SEQ ID NO: 708544 - DNA, 13 bp, C. elegans
atttttgggagaa

SEQ ID NO: 708545 - DNA, 13 bp, C. elegans
atttttgggatta

SEQ ID NO: 708546 - DNA, 13 bp, C. elegans
atttttgggcgaa

SEQ ID NO: 708547 - DNA, 13 bp, C. elegans
atttttgggcgct

SEQ ID NO: 708548 - DNA, 13 bp, C. elegans
atttttggggaaa

SEQ ID NO: 708549 - DNA, 13 bp, C. elegans
atttttgggtaaa

SEQ ID NO: 708550 - DNA, 13 bp, C. elegans
atttttgggtcga

SEQ ID NO: 708551 - DNA, 13 bp, C. elegans
atttttggtactt

SEQ ID NO: 708552 - DNA, 13 bp, C. elegans
atttttggtataa

SEQ ID NO: 708553 - DNA, 13 bp, C. elegans
atttttggtcaaa

SEQ ID NO: 708554 - DNA, 13 bp, C. elegans
atttttggtcgac

SEQ ID NO: 708555 - DNA, 13 bp, C. elegans
atttttggtctaa

SEQ ID NO: 708556 - DNA, 13 bp, C. elegans
atttttggtctgc

SEQ ID NO: 708557 - DNA, 13 bp, C. elegans
atttttggtggcc

SEQ ID NO: 708558 - DNA, 14 bp, C. elegans
atttttgtaatgaa

SEQ ID NO: 708559 - DNA, 13 bp, C. elegans
atttttgtacaaa

SEQ ID NO: 708560 - DNA, 13 bp, C. elegans
atttttgtacaca

SEQ ID NO: 708561 - DNA, 13 bp, C. elegans
atttttgtagaat

SEQ ID NO: 708562 - DNA, 13 bp, C. elegans
atttttgtagatc

SEQ ID NO: 708563 - DNA, 13 bp, C. elegans
atttttgtatcaa

SEQ ID NO: 708564 - DNA, 13 bp, C. elegans
atttttgtatgaa

SEQ ID NO: 708565 - DNA, 13 bp, C. elegans
atttttgtcaaaa

SEQ ID NO: 708566 - DNA, 13 bp, C. elegans
atttttgtcagtt

SEQ ID NO: 708567 - DNA, 13 bp, C. elegans
atttttgtcatat

SEQ ID NO: 708568 - DNA, 13 bp, C. elegans
atttttgtccaaa

SEQ ID NO: 708569 - DNA, 13 bp, C. elegans
atttttgtcgatt

SEQ ID NO: 708570 - DNA, 13 bp, C. elegans
atttttgtctctg

SEQ ID NO: 708571 - DNA, 13 bp, C. elegans
atttttgtctgaa

SEQ ID NO: 708572 - DNA, 13 bp, C. elegans
atttttgtgaaat

SEQ ID NO: 708573 - DNA, 13 bp, C. elegans
atttttgtgcaat

SEQ ID NO: 708574 - DNA, 13 bp, C. elegans
atttttgtgccac

SEQ ID NO: 708575 - DNA, 13 bp, C. elegans
atttttgtgctca

SEQ ID NO: 708576 - DNA, 13 bp, C. elegans
atttttgtgtaaa

SEQ ID NO: 708577 - DNA, 13 bp, C. elegans
atttttgttcaaa

SEQ ID NO: 708578 - DNA, 13 bp, C. elegans
atttttgttcaac

SEQ ID NO: 708579 - DNA, 13 bp, C. elegans
atttttgttcaca

SEQ ID NO: 708580 - DNA, 13 bp, C. elegans
atttttgttctga

SEQ ID NO: 708581 - DNA, 14 bp, C. elegans
atttttgttgaaaa

SEQ ID NO: 708582 - DNA, 13 bp, C. elegans
atttttgttggaa

SEQ ID NO: 708583 - DNA, 13 bp, C. elegans
atttttgtttcaa

SEQ ID NO: 708584 - DNA, 13 bp, C. elegans
atttttgtttcag

SEQ ID NO: 708585 - DNA, 13 bp, C. elegans
attttttaaactg

SEQ ID NO: 708586 - DNA, 13 bp, C. elegans
attttttaaagct

SEQ ID NO: 708587 - DNA, 13 bp, C. elegans
attttttaacgat

SEQ ID NO: 708588 - DNA, 13 bp, C. elegans
attttttaatgtc

SEQ ID NO: 708589 - DNA, 13 bp, C. elegans
attttttacagtt

SEQ ID NO: 708590 - DNA, 13 bp, C. elegans
attttttacccct

SEQ ID NO: 708591 - DNA, 13 bp, C. elegans
attttttactaac

SEQ ID NO: 708592 - DNA, 13 bp, C. elegans
attttttactacg

SEQ ID NO: 708593 - DNA, 13 bp, C. elegans
attttttagagaa

SEQ ID NO: 708594 - DNA, 13 bp, C. elegans
attttttagctga

SEQ ID NO: 708595 - DNA, 13 bp, C. elegans
attttttaggaaa

SEQ ID NO: 708596 - DNA, 13 bp, C. elegans
attttttaggcaa

SEQ ID NO: 708597 - DNA, 13 bp, C. elegans
attttttatactg

SEQ ID NO: 708598 - DNA, 13 bp, C. elegans
attttttatcaac

SEQ ID NO: 708599 - DNA, 13 bp, C. elegans
attttttcaaaga

SEQ ID NO: 708600 - DNA, 13 bp, C. elegans
attttttcaacaa

SEQ ID NO: 708601 - DNA, 13 bp, C. elegans
attttttcaacta

SEQ ID NO: 708602 - DNA, 13 bp, C. elegans
attttttcaatca

SEQ ID NO: 708603 - DNA, 14 bp, C. elegans
attttttcaattga

SEQ ID NO: 708604 - DNA, 13 bp, C. elegans
attttttcacaaa

SEQ ID NO: 708605 - DNA, 13 bp, C. elegans
attttttcacaag

SEQ ID NO: 708606 - DNA, 13 bp, C. elegans
attttttcacaga

SEQ ID NO: 708607 - DNA, 14 bp, C. elegans
attttttcactgaa

SEQ ID NO: 708608 - DNA, 13 bp, C. elegans
attttttcatgaa

SEQ ID NO: 708609 - DNA, 13 bp, C. elegans
attttttccaaat

SEQ ID NO: 708610 - DNA, 13 bp, C. elegans
attttttccaact

SEQ ID NO: 708611 - DNA, 13 bp, C. elegans
attttttccagaa

SEQ ID NO: 708612 - DNA, 13 bp, C. elegans
attttttccaggt

SEQ ID NO: 708613 - DNA, 14 bp, C. elegans
attttttcccaaaa

SEQ ID NO: 708614 - DNA, 13 bp, C. elegans
attttttcccaca

SEQ ID NO: 708615 - DNA, 13 bp, C. elegans
attttttccccgt

SEQ ID NO: 708616 - DNA, 14 bp, C. elegans
attttttcccgaat

SEQ ID NO: 708617 - DNA, 13 bp, C. elegans
attttttcccgat

SEQ ID NO: 708618 - DNA, 13 bp, C. elegans
attttttcccgga

SEQ ID NO: 708619 - DNA, 13 bp, C. elegans
attttttcctaaa

SEQ ID NO: 708620 - DNA, 13 bp, C. elegans
attttttcctgat

SEQ ID NO: 708621 - DNA, 13 bp, C. elegans
attttttcgaatt

SEQ ID NO: 708622 - DNA, 13 bp, C. elegans
attttttcgccca

SEQ ID NO: 708623 - DNA, 13 bp, C. elegans
attttttcgcgaa

SEQ ID NO: 708624 - DNA, 13 bp, C. elegans
attttttcgctca

SEQ ID NO: 708625 - DNA, 13 bp, C. elegans
attttttcgctgt

SEQ ID NO: 708626 - DNA, 13 bp, C. elegans
attttttcggatt

SEQ ID NO: 708627 - DNA, 13 bp, C. elegans
attttttcgggtt

SEQ ID NO: 708628 - DNA, 13 bp, C. elegans
attttttcgtgaa

SEQ ID NO: 708629 - DNA, 13 bp, C. elegans
attttttcgttaa

SEQ ID NO: 708630 - DNA, 13 bp, C. elegans
attttttctacag

SEQ ID NO: 708631 - DNA, 13 bp, C. elegans
attttttctagaa

SEQ ID NO: 708632 - DNA, 13 bp, C. elegans
attttttctaggt

SEQ ID NO: 708633 - DNA, 13 bp, C. elegans
attttttctcaaa

SEQ ID NO: 708634 - DNA, 13 bp, C. elegans
attttttctcagt

SEQ ID NO: 708635 - DNA, 13 bp, C. elegans
attttttctccga

SEQ ID NO: 708636 - DNA, 13 bp, C. elegans
attttttctcgat

SEQ ID NO: 708637 - DNA, 13 bp, C. elegans
attttttctgaaa

SEQ ID NO: 708638 - DNA, 14 bp, C. elegans
attttttctgaaac

SEQ ID NO: 708639 - DNA, 13 bp, C. elegans
attttttctggaa

SEQ ID NO: 708640 - DNA, 13 bp, C. elegans
attttttctgggt

SEQ ID NO: 708641 - DNA, 13 bp, C. elegans
attttttcttcag

SEQ ID NO: 708642 - DNA, 13 bp, C. elegans
attttttcttgca

SEQ ID NO: 708643 - DNA, 13 bp, C. elegans
attttttgaaatc

SEQ ID NO: 708644 - DNA, 13 bp, C. elegans
attttttgaaccg

SEQ ID NO: 708645 - DNA, 13 bp, C. elegans
attttttgaacgt

SEQ ID NO: 708646 - DNA, 13 bp, C. elegans
attttttgaagaa

SEQ ID NO: 708647 - DNA, 13 bp, C. elegans
attttttgaagat

SEQ ID NO: 708648 - DNA, 13 bp, C. elegans
attttttgaagca

SEQ ID NO: 708649 - DNA, 13 bp, C. elegans
attttttgaagga

SEQ ID NO: 708650 - DNA, 13 bp, C. elegans
attttttgacaaa

SEQ ID NO: 708651 - DNA, 13 bp, C. elegans
attttttgacaat

SEQ ID NO: 708652 - DNA, 13 bp, C. elegans
attttttgacact

SEQ ID NO: 708653 - DNA, 13 bp, C. elegans
attttttgaccac

SEQ ID NO: 708654 - DNA, 13 bp, C. elegans
attttttgactga

SEQ ID NO: 708655 - DNA, 15 bp, C. elegans
attttttgagaaaat

SEQ ID NO: 708656 - DNA, 13 bp, C. elegans
attttttgatcat

SEQ ID NO: 708657 - DNA, 13 bp, C. elegans
attttttgcaaaa

SEQ ID NO: 708658 - DNA, 14 bp, C. elegans
attttttgcaaaat

SEQ ID NO: 708659 - DNA, 13 bp, C. elegans
attttttgcaaat

SEQ ID NO: 708660 - DNA, 13 bp, C. elegans
attttttgcatag

SEQ ID NO: 708661 - DNA, 13 bp, C. elegans
attttttgcccaa

SEQ ID NO: 708662 - DNA, 13 bp, C. elegans
attttttgccgat

SEQ ID NO: 708663 - DNA, 13 bp, C. elegans
attttttgcggaa

SEQ ID NO: 708664 - DNA, 13 bp, C. elegans
attttttgctaat

SEQ ID NO: 708665 - DNA, 13 bp, C. elegans
attttttgctctc

SEQ ID NO: 708666 - DNA, 13 bp, C. elegans
attttttgctgaa

SEQ ID NO: 708667 - DNA, 13 bp, C. elegans
attttttggaaaa

SEQ ID NO: 708668 - DNA, 13 bp, C. elegans
attttttggagaa

SEQ ID NO: 708669 - DNA, 13 bp, C. elegans
attttttggagag

SEQ ID NO: 708670 - DNA, 13 bp, C. elegans
attttttggagct

SEQ ID NO: 708671 - DNA, 13 bp, C. elegans
attttttggcaaa

SEQ ID NO: 708672 - DNA, 13 bp, C. elegans
attttttggcgaa

SEQ ID NO: 708673 - DNA, 13 bp, C. elegans
attttttggctaa

SEQ ID NO: 708674 - DNA, 13 bp, C. elegans
attttttgggaaa

SEQ ID NO: 708675 - DNA, 13 bp, C. elegans
attttttggtgaa

SEQ ID NO: 708676 - DNA, 13 bp, C. elegans
attttttgtcaaa

SEQ ID NO: 708677 - DNA, 13 bp, C. elegans
attttttgtcaga

SEQ ID NO: 708678 - DNA, 13 bp, C. elegans
attttttgtccat

SEQ ID NO: 708679 - DNA, 13 bp, C. elegans
attttttgtcgaa

SEQ ID NO: 708680 - DNA, 13 bp, C. elegans
attttttgtcgac

SEQ ID NO: 708681 - DNA, 13 bp, C. elegans
attttttgtcgat

SEQ ID NO: 708682 - DNA, 13 bp, C. elegans
attttttgtgcat

SEQ ID NO: 708683 - DNA, 13 bp, C. elegans
attttttgtggaa

SEQ ID NO: 708684 - DNA, 13 bp, C. elegans
attttttgttcaa

SEQ ID NO: 708685 - DNA, 13 bp, C. elegans
attttttgttcgc

SEQ ID NO: 708686 - DNA, 13 bp, C. elegans
attttttgttgca

SEQ ID NO: 708687 - DNA, 13 bp, C. elegans
atttttttaaacg

SEQ ID NO: 708688 - DNA, 13 bp, C. elegans
atttttttagcat

SEQ ID NO: 708689 - DNA, 13 bp, C. elegans
atttttttcagaa

SEQ ID NO: 708690 - DNA, 13 bp, C. elegans
atttttttcagga

SEQ ID NO: 708691 - DNA, 13 bp, C. elegans
atttttttccaga

SEQ ID NO: 708692 - DNA, 13 bp, C. elegans
atttttttcccac

SEQ ID NO: 708693 - DNA, 13 bp, C. elegans
atttttttccgat

SEQ ID NO: 708694 - DNA, 13 bp, C. elegans
atttttttccgca

SEQ ID NO: 708695 - DNA, 13 bp, C. elegans
atttttttcgaac

SEQ ID NO: 708696 - DNA, 13 bp, C. elegans
atttttttcgcca

SEQ ID NO: 708697 - DNA, 13 bp, C. elegans
atttttttctcga

SEQ ID NO: 708698 - DNA, 13 bp, C. elegans
atttttttctgca

SEQ ID NO: 708699 - DNA, 13 bp, C. elegans
atttttttgaaac

SEQ ID NO: 708700 - DNA, 13 bp, C. elegans
atttttttgacaa

SEQ ID NO: 708701 - DNA, 13 bp, C. elegans
atttttttgctac

SEQ ID NO: 708702 - DNA, 14 bp, C. elegans
atttttttgtcaaa

SEQ ID NO: 708703 - DNA, 14 bp, C. elegans
atttttttgtccaa

SEQ ID NO: 708704 - DNA, 13 bp, C. elegans
attttttttagac

SEQ ID NO: 708705 - DNA, 13 bp, C. elegans
attttttttccag

SEQ ID NO: 708706 - DNA, 13 bp, C. elegans
attttttttgcac

SEQ ID NO: 708707 - DNA, 13 bp, C. elegans
attttttttgcag

SEQ ID NO: 708708 - DNA, 13 bp, C. elegans
caaaaaaaagttg

SEQ ID NO: 708709 - DNA, 13 bp, C. elegans
caaaaaaacttga

SEQ ID NO: 708710 - DNA, 13 bp, C. elegans
caaaaaaagattt

SEQ ID NO: 708711 - DNA, 13 bp, C. elegans
caaaaaaagcttc

SEQ ID NO: 708712 - DNA, 13 bp, C. elegans
caaaaaaagcttt

SEQ ID NO: 708713 - DNA, 13 bp, C. elegans
caaaaaaatagtt

SEQ ID NO: 708714 - DNA, 13 bp, C. elegans
caaaaaaatcgca

SEQ ID NO: 708715 - DNA, 13 bp, C. elegans
caaaaaaatcggt

SEQ ID NO: 708716 - DNA, 13 bp, C. elegans
caaaaaaatctcc

SEQ ID NO: 708717 - DNA, 13 bp, C. elegans
caaaaaaatgcgg

SEQ ID NO: 708718 - DNA, 13 bp, C. elegans
caaaaaaatggtt

SEQ ID NO: 708719 - DNA, 13 bp, C. elegans
caaaaaaatgtga

SEQ ID NO: 708720 - DNA, 13 bp, C. elegans
caaaaaaatgtgc

SEQ ID NO: 708721 - DNA, 13 bp, C. elegans
caaaaaaatgttg

SEQ ID NO: 708722 - DNA, 13 bp, C. elegans
caaaaaaatgttt

SEQ ID NO: 708723 - DNA, 13 bp, C. elegans
caaaaaaattcga

SEQ ID NO: 708724 - DNA, 13 bp, C. elegans
caaaaaaattgga

SEQ ID NO: 708725 - DNA, 13 bp, C. elegans
caaaaaaatttga

SEQ ID NO: 708726 - DNA, 13 bp, C. elegans
caaaaaaatttgg

SEQ ID NO: 708727 - DNA, 13 bp, C. elegans
caaaaaaattttc

SEQ ID NO: 708728 - DNA, 13 bp, C. elegans
caaaaaacacttt

SEQ ID NO: 708729 - DNA, 13 bp, C. elegans
caaaaaacattga

SEQ ID NO: 708730 - DNA, 13 bp, C. elegans
caaaaaacgtgaa

SEQ ID NO: 708731 - DNA, 13 bp, C. elegans
caaaaaactacct

SEQ ID NO: 708732 - DNA, 13 bp, C. elegans
caaaaaactgtaa

SEQ ID NO: 708733 - DNA, 13 bp, C. elegans
caaaaaacttcta

SEQ ID NO: 708734 - DNA, 13 bp, C. elegans
caaaaaacttgaa

SEQ ID NO: 708735 - DNA, 13 bp, C. elegans
caaaaaacttgca

SEQ ID NO: 708736 - DNA, 13 bp, C. elegans
caaaaaagatgat

SEQ ID NO: 708737 - DNA, 13 bp, C. elegans
caaaaaagcaact

SEQ ID NO: 708738 - DNA, 13 bp, C. elegans
caaaaaagctcac

SEQ ID NO: 708739 - DNA, 13 bp, C. elegans
caaaaaaggaatt

SEQ ID NO: 708740 - DNA, 13 bp, C. elegans
caaaaaaggatga

SEQ ID NO: 708741 - DNA, 13 bp, C. elegans
caaaaaagtcaat

SEQ ID NO: 708742 - DNA, 13 bp, C. elegans
caaaaaagtgcag

SEQ ID NO: 708743 - DNA, 13 bp, C. elegans
caaaaaagtggaa

SEQ ID NO: 708744 - DNA, 13 bp, C. elegans
caaaaaagtgtga

SEQ ID NO: 708745 - DNA, 13 bp, C. elegans
caaaaaagttatg

SEQ ID NO: 708746 - DNA, 13 bp, C. elegans
caaaaaagttccc

SEQ ID NO: 708747 - DNA, 13 bp, C. elegans
caaaaaagttctg

SEQ ID NO: 708748 - DNA, 13 bp, C. elegans
caaaaaagttttc

SEQ ID NO: 708749 - DNA, 13 bp, C. elegans
caaaaaataattg

SEQ ID NO: 708750 - DNA, 13 bp, C. elegans
caaaaaatactga

SEQ ID NO: 708751 - DNA, 13 bp, C. elegans
caaaaaatacttt

SEQ ID NO: 708752 - DNA, 13 bp, C. elegans
caaaaaatagatt

SEQ ID NO: 708753 - DNA, 13 bp, C. elegans
caaaaaatatgtt

SEQ ID NO: 708754 - DNA, 13 bp, C. elegans
caaaaaatcaatg

SEQ ID NO: 708755 - DNA, 13 bp, C. elegans
caaaaaatcactt

SEQ ID NO: 708756 - DNA, 13 bp, C. elegans
caaaaaatcccag

SEQ ID NO: 708757 - DNA, 13 bp, C. elegans
caaaaaatccgtt

SEQ ID NO: 708758 - DNA, 13 bp, C. elegans
caaaaaatcgaat

SEQ ID NO: 708759 - DNA, 13 bp, C. elegans
caaaaaatcgagg

SEQ ID NO: 708760 - DNA, 13 bp, C. elegans
caaaaaatcgata

SEQ ID NO: 708761 - DNA, 13 bp, C. elegans
caaaaaatcgcaa

SEQ ID NO: 708762 - DNA, 13 bp, C. elegans
caaaaaatcgtgt

SEQ ID NO: 708763 - DNA, 13 bp, C. elegans
caaaaaatctaga

SEQ ID NO: 708764 - DNA, 13 bp, C. elegans
caaaaaatctgaa

SEQ ID NO: 708765 - DNA, 13 bp, C. elegans
caaaaaatgaatt

SEQ ID NO: 708766 - DNA, 13 bp, C. elegans
caaaaaatgacat

SEQ ID NO: 708767 - DNA, 13 bp, C. elegans
caaaaaatgagca

SEQ ID NO: 708768 - DNA, 13 bp, C. elegans
caaaaaatgatat

SEQ ID NO: 708769 - DNA, 13 bp, C. elegans
caaaaaatgatca

SEQ ID NO: 708770 - DNA, 13 bp, C. elegans
caaaaaatgattt

SEQ ID NO: 708771 - DNA, 13 bp, C. elegans
caaaaaatgcaat

SEQ ID NO: 708772 - DNA, 13 bp, C. elegans
caaaaaatgccaa

SEQ ID NO: 708773 - DNA, 13 bp, C. elegans
caaaaaatgccat

SEQ ID NO: 708774 - DNA, 13 bp, C. elegans
caaaaaatggaag

SEQ ID NO: 708775 - DNA, 13 bp, C. elegans
caaaaaatggaat

SEQ ID NO: 708776 - DNA, 13 bp, C. elegans
caaaaaatggatt

SEQ ID NO: 708777 - DNA, 13 bp, C. elegans
caaaaaatggtaa

SEQ ID NO: 708778 - DNA, 13 bp, C. elegans
caaaaaatgtgaa

SEQ ID NO: 708779 - DNA, 13 bp, C. elegans
caaaaaatgtgct

SEQ ID NO: 708780 - DNA, 13 bp, C. elegans
caaaaaatgttca

SEQ ID NO: 708781 - DNA, 13 bp, C. elegans
caaaaaattcccg

SEQ ID NO: 708782 - DNA, 13 bp, C. elegans
caaaaaattcgga

SEQ ID NO: 708783 - DNA, 13 bp, C. elegans
caaaaaattgcaa

SEQ ID NO: 708784 - DNA, 13 bp, C. elegans
caaaaaattggaa

SEQ ID NO: 708785 - DNA, 13 bp, C. elegans
caaaaaattggta

SEQ ID NO: 708786 - DNA, 13 bp, C. elegans
caaaaaattgtct

SEQ ID NO: 708787 - DNA, 13 bp, C. elegans
caaaaaattgttt

SEQ ID NO: 708788 - DNA, 13 bp, C. elegans
caaaaaatttcac

SEQ ID NO: 708789 - DNA, 13 bp, C. elegans
caaaaaatttccg

SEQ ID NO: 708790 - DNA, 13 bp, C. elegans
caaaaaatttttc

SEQ ID NO: 708791 - DNA, 13 bp, C. elegans
caaaaacaacagt

SEQ ID NO: 708792 - DNA, 13 bp, C. elegans
caaaaacaagatg

SEQ ID NO: 708793 - DNA, 13 bp, C. elegans
caaaaacaatttt

SEQ ID NO: 708794 - DNA, 13 bp, C. elegans
caaaaacactgaa

SEQ ID NO: 708795 - DNA, 13 bp, C. elegans
caaaaacattcca

SEQ ID NO: 708796 - DNA, 13 bp, C. elegans
caaaaacatttcc

SEQ ID NO: 708797 - DNA, 13 bp, C. elegans
caaaaacattttc

SEQ ID NO: 708798 - DNA, 13 bp, C. elegans
caaaaaccaattt

SEQ ID NO: 708799 - DNA, 13 bp, C. elegans
caaaaacccctct

SEQ ID NO: 708800 - DNA, 13 bp, C. elegans
caaaaaccctttt

SEQ ID NO: 708801 - DNA, 13 bp, C. elegans
caaaaaccgattt

SEQ ID NO: 708802 - DNA, 13 bp, C. elegans
caaaaacctctct

SEQ ID NO: 708803 - DNA, 13 bp, C. elegans
caaaaaccttttt

SEQ ID NO: 708804 - DNA, 13 bp, C. elegans
caaaaacgatttt

SEQ ID NO: 708805 - DNA, 13 bp, C. elegans
caaaaacgttatt

SEQ ID NO: 708806 - DNA, 13 bp, C. elegans
caaaaacgttcaa

SEQ ID NO: 708807 - DNA, 13 bp, C. elegans
caaaaactacagt

SEQ ID NO: 708808 - DNA, 13 bp, C. elegans
caaaaactagatc

SEQ ID NO: 708809 - DNA, 13 bp, C. elegans
caaaaactagatt

SEQ ID NO: 708810 - DNA, 13 bp, C. elegans
caaaaactatatt

SEQ ID NO: 708811 - DNA, 13 bp, C. elegans
caaaaactcaatt

SEQ ID NO: 708812 - DNA, 13 bp, C. elegans
caaaaactcatat

SEQ ID NO: 708813 - DNA, 13 bp, C. elegans
caaaaactcgaaa

SEQ ID NO: 708814 - DNA, 13 bp, C. elegans
caaaaactcgaat

SEQ ID NO: 708815 - DNA, 13 bp, C. elegans
caaaaactcgagt

SEQ ID NO: 708816 - DNA, 13 bp, C. elegans
caaaaactcgatt

SEQ ID NO: 708817 - DNA, 13 bp, C. elegans
caaaaactcttct

SEQ ID NO: 708818 - DNA, 13 bp, C. elegans
caaaaactgaaac

SEQ ID NO: 708819 - DNA, 13 bp, C. elegans
caaaaactgacaa

SEQ ID NO: 708820 - DNA, 13 bp, C. elegans
caaaaactgagat

SEQ ID NO: 708821 - DNA, 13 bp, C. elegans
caaaaactgattc

SEQ ID NO: 708822 - DNA, 13 bp, C. elegans
caaaaactgtaaa

SEQ ID NO: 708823 - DNA, 13 bp, C. elegans
caaaaactgtctc

SEQ ID NO: 708824 - DNA, 13 bp, C. elegans
caaaaacttatgg

SEQ ID NO: 708825 - DNA, 13 bp, C. elegans
caaaaacttattg

SEQ ID NO: 708826 - DNA, 13 bp, C. elegans
caaaaacttctct

SEQ ID NO: 708827 - DNA, 13 bp, C. elegans
caaaaacttcttt

SEQ ID NO: 708828 - DNA, 13 bp, C. elegans
caaaaacttggaa

SEQ ID NO: 708829 - DNA, 13 bp, C. elegans
caaaaactttcaa

SEQ ID NO: 708830 - DNA, 13 bp, C. elegans
caaaaactttgaa

SEQ ID NO: 708831 - DNA, 13 bp, C. elegans
caaaaactttgct

SEQ ID NO: 708832 - DNA, 13 bp, C. elegans
caaaaactttgta

SEQ ID NO: 708833 - DNA, 13 bp, C. elegans
caaaaacttttac

SEQ ID NO: 708834 - DNA, 13 bp, C. elegans
caaaaacttttca

SEQ ID NO: 708835 - DNA, 13 bp, C. elegans
caaaaagcaatca

SEQ ID NO: 708836 - DNA, 13 bp, C. elegans
caaaaagctgaaa

SEQ ID NO: 708837 - DNA, 13 bp, C. elegans
caaaaagcttaaa

SEQ ID NO: 708838 - DNA, 13 bp, C. elegans
caaaaagcttcca

SEQ ID NO: 708839 - DNA, 13 bp, C. elegans
caaaaagctttca

SEQ ID NO: 708840 - DNA, 13 bp, C. elegans
caaaaaggcacag

SEQ ID NO: 708841 - DNA, 13 bp, C. elegans
caaaaaggtttct

SEQ ID NO: 708842 - DNA, 13 bp, C. elegans
caaaaagtatcaa

SEQ ID NO: 708843 - DNA, 13 bp, C. elegans
caaaaagtattta

SEQ ID NO: 708844 - DNA, 13 bp, C. elegans
caaaaagtatttt

SEQ ID NO: 708845 - DNA, 13 bp, C. elegans
caaaaagtcaact

SEQ ID NO: 708846 - DNA, 13 bp, C. elegans
caaaaagtgaaga

SEQ ID NO: 708847 - DNA, 13 bp, C. elegans
caaaaagtgacaa

SEQ ID NO: 708848 - DNA, 13 bp, C. elegans
caaaaagtgacga

SEQ ID NO: 708849 - DNA, 13 bp, C. elegans
caaaaagtgatga

SEQ ID NO: 708850 - DNA, 13 bp, C. elegans
caaaaagtggcaa

SEQ ID NO: 708851 - DNA, 13 bp, C. elegans
caaaaagtgtatt

SEQ ID NO: 708852 - DNA, 13 bp, C. elegans
caaaaagtgttat

SEQ ID NO: 708853 - DNA, 13 bp, C. elegans
caaaaagtgttgt

SEQ ID NO: 708854 - DNA, 13 bp, C. elegans
caaaaagtgtttg

SEQ ID NO: 708855 - DNA, 13 bp, C. elegans
caaaaagttataa

SEQ ID NO: 708856 - DNA, 13 bp, C. elegans
caaaaagttcatt

SEQ ID NO: 708857 - DNA, 13 bp, C. elegans
caaaaagttgata

SEQ ID NO: 708858 - DNA, 13 bp, C. elegans
caaaaagttgtaa

SEQ ID NO: 708859 - DNA, 13 bp, C. elegans
caaaaagttgtca

SEQ ID NO: 708860 - DNA, 13 bp, C. elegans
caaaaagttgttg

SEQ ID NO: 708861 - DNA, 13 bp, C. elegans
caaaaagtttaaa

SEQ ID NO: 708862 - DNA, 13 bp, C. elegans
caaaaagtttcaa

SEQ ID NO: 708863 - DNA, 13 bp, C. elegans
caaaaagtttgaa

SEQ ID NO: 708864 - DNA, 13 bp, C. elegans
caaaaagtttttg

SEQ ID NO: 708865 - DNA, 13 bp, C. elegans
caaaaataagatt

SEQ ID NO: 708866 - DNA, 14 bp, C. elegans
caaaaataatttcc

SEQ ID NO: 708867 - DNA, 13 bp, C. elegans
caaaaatacagtt

SEQ ID NO: 708868 - DNA, 13 bp, C. elegans
caaaaatacattc

SEQ ID NO: 708869 - DNA, 13 bp, C. elegans
caaaaatacttcc

SEQ ID NO: 708870 - DNA, 13 bp, C. elegans
caaaaatactttc

SEQ ID NO: 708871 - DNA, 13 bp, C. elegans
caaaaataggaga

SEQ ID NO: 708872 - DNA, 13 bp, C. elegans
caaaaataggttt

SEQ ID NO: 708873 - DNA, 13 bp, C. elegans
caaaaatatagtt

SEQ ID NO: 708874 - DNA, 13 bp, C. elegans
caaaaatatctat

SEQ ID NO: 708875 - DNA, 13 bp, C. elegans
caaaaatatgata

SEQ ID NO: 708876 - DNA, 13 bp, C. elegans
caaaaatatgtac

SEQ ID NO: 708877 - DNA, 13 bp, C. elegans
caaaaatattgaa

SEQ ID NO: 708878 - DNA, 13 bp, C. elegans
caaaaatattgat

SEQ ID NO: 708879 - DNA, 13 bp, C. elegans
caaaaatatttga

SEQ ID NO: 708880 - DNA, 13 bp, C. elegans
caaaaatattttc

SEQ ID NO: 708881 - DNA, 13 bp, C. elegans
caaaaatcaagtt

SEQ ID NO: 708882 - DNA, 13 bp, C. elegans
caaaaatcaattt

SEQ ID NO: 708883 - DNA, 13 bp, C. elegans
caaaaatcacatt

SEQ ID NO: 708884 - DNA, 13 bp, C. elegans
caaaaatcatgtt

SEQ ID NO: 708885 - DNA, 13 bp, C. elegans
caaaaatcccaat

SEQ ID NO: 708886 - DNA, 13 bp, C. elegans
caaaaatcgacga

SEQ ID NO: 708887 - DNA, 13 bp, C. elegans
caaaaatcgagaa

SEQ ID NO: 708888 - DNA, 13 bp, C. elegans
caaaaatcgagat

SEQ ID NO: 708889 - DNA, 13 bp, C. elegans
caaaaatcgatga

SEQ ID NO: 708890 - DNA, 13 bp, C. elegans
caaaaatcgattt

SEQ ID NO: 708891 - DNA, 13 bp, C. elegans
caaaaatcgtgaa

SEQ ID NO: 708892 - DNA, 13 bp, C. elegans
caaaaatctaatt

SEQ ID NO: 708893 - DNA, 13 bp, C. elegans
caaaaatctagtt

SEQ ID NO: 708894 - DNA, 13 bp, C. elegans
caaaaatctatat

SEQ ID NO: 708895 - DNA, 13 bp, C. elegans
caaaaatctcagt

SEQ ID NO: 708896 - DNA, 13 bp, C. elegans
caaaaatctcgaa

SEQ ID NO: 708897 - DNA, 13 bp, C. elegans
caaaaatctggaa

SEQ ID NO: 708898 - DNA, 13 bp, C. elegans
caaaaatctttca

SEQ ID NO: 708899 - DNA, 13 bp, C. elegans
caaaaatgaatca

SEQ ID NO: 708900 - DNA, 13 bp, C. elegans
caaaaatgaatgt

SEQ ID NO: 708901 - DNA, 13 bp, C. elegans
caaaaatgaattt

SEQ ID NO: 708902 - DNA, 13 bp, C. elegans
caaaaatgaccga

SEQ ID NO: 708903 - DNA, 13 bp, C. elegans
caaaaatgacgaa

SEQ ID NO: 708904 - DNA, 13 bp, C. elegans
caaaaatgacgtc

SEQ ID NO: 708905 - DNA, 13 bp, C. elegans
caaaaatgagaat

SEQ ID NO: 708906 - DNA, 13 bp, C. elegans
caaaaatgagcaa

SEQ ID NO: 708907 - DNA, 13 bp, C. elegans
caaaaatgaggaa

SEQ ID NO: 708908 - DNA, 13 bp, C. elegans
caaaaatgagttt

SEQ ID NO: 708909 - DNA, 13 bp, C. elegans
caaaaatgatcaa

SEQ ID NO: 708910 - DNA, 13 bp, C. elegans
caaaaatgatcga

SEQ ID NO: 708911 - DNA, 13 bp, C. elegans
caaaaatgctcca

SEQ ID NO: 708912 - DNA, 13 bp, C. elegans
caaaaatgctcga

SEQ ID NO: 708913 - DNA, 13 bp, C. elegans
caaaaatgctctc

SEQ ID NO: 708914 - DNA, 13 bp, C. elegans
caaaaatggaaca

SEQ ID NO: 708915 - DNA, 13 bp, C. elegans
caaaaatggacaa

SEQ ID NO: 708916 - DNA, 13 bp, C. elegans
caaaaatggcaaa

SEQ ID NO: 708917 - DNA, 13 bp, C. elegans
caaaaatgggatt

SEQ ID NO: 708918 - DNA, 13 bp, C. elegans
caaaaatgggcaa

SEQ ID NO: 708919 - DNA, 13 bp, C. elegans
caaaaatggggaa

SEQ ID NO: 708920 - DNA, 13 bp, C. elegans
caaaaatggtcaa

SEQ ID NO: 708921 - DNA, 13 bp, C. elegans
caaaaatggtgaa

SEQ ID NO: 708922 - DNA, 13 bp, C. elegans
caaaaatgtaata

SEQ ID NO: 708923 - DNA, 13 bp, C. elegans
caaaaatgtcatt

SEQ ID NO: 708924 - DNA, 13 bp, C. elegans
caaaaatgtctaa

SEQ ID NO: 708925 - DNA, 13 bp, C. elegans
caaaaatgtgaaa

SEQ ID NO: 708926 - DNA, 13 bp, C. elegans
caaaaatgtgacg

SEQ ID NO: 708927 - DNA, 13 bp, C. elegans
caaaaatgtgcca

SEQ ID NO: 708928 - DNA, 13 bp, C. elegans
caaaaatgtggac

SEQ ID NO: 708929 - DNA, 13 bp, C. elegans
caaaaatgtgtgt

SEQ ID NO: 708930 - DNA, 13 bp, C. elegans
caaaaatgttata

SEQ ID NO: 708931 - DNA, 13 bp, C. elegans
caaaaatgttatt

SEQ ID NO: 708932 - DNA, 13 bp, C. elegans
caaaaatgttgat

SEQ ID NO: 708933 - DNA, 13 bp, C. elegans
caaaaatgttgtt

SEQ ID NO: 708934 - DNA, 13 bp, C. elegans
caaaaattaagat

SEQ ID NO: 708935 - DNA, 13 bp, C. elegans
caaaaattagatg

SEQ ID NO: 708936 - DNA, 13 bp, C. elegans
caaaaattcaagg

SEQ ID NO: 708937 - DNA, 13 bp, C. elegans
caaaaattcaatt

SEQ ID NO: 708938 - DNA, 13 bp, C. elegans
caaaaattcatat

SEQ ID NO: 708939 - DNA, 14 bp, C. elegans
caaaaattccaatt

SEQ ID NO: 708940 - DNA, 13 bp, C. elegans
caaaaattcccaa

SEQ ID NO: 708941 - DNA, 13 bp, C. elegans
caaaaattccgaa

SEQ ID NO: 708942 - DNA, 13 bp, C. elegans
caaaaattccgtt

SEQ ID NO: 708943 - DNA, 13 bp, C. elegans
caaaaattcgaaa

SEQ ID NO: 708944 - DNA, 13 bp, C. elegans
caaaaattcgatt

SEQ ID NO: 708945 - DNA, 13 bp, C. elegans
caaaaattcgttg

SEQ ID NO: 708946 - DNA, 13 bp, C. elegans
caaaaattctaat

SEQ ID NO: 708947 - DNA, 13 bp, C. elegans
caaaaattctaga

SEQ ID NO: 708948 - DNA, 13 bp, C. elegans
caaaaattctgaa

SEQ ID NO: 708949 - DNA, 13 bp, C. elegans
caaaaattcttcg

SEQ ID NO: 708950 - DNA, 13 bp, C. elegans
caaaaattgaaac

SEQ ID NO: 708951 - DNA, 13 bp, C. elegans
caaaaattgaaag

SEQ ID NO: 708952 - DNA, 13 bp, C. elegans
caaaaattgaatt

SEQ ID NO: 708953 - DNA, 13 bp, C. elegans
caaaaattgagaa

SEQ ID NO: 708954 - DNA, 13 bp, C. elegans
caaaaattgagat

SEQ ID NO: 708955 - DNA, 13 bp, C. elegans
caaaaattgcact

SEQ ID NO: 708956 - DNA, 13 bp, C. elegans
caaaaattggaca

SEQ ID NO: 708957 - DNA, 13 bp, C. elegans
caaaaattggcaa

SEQ ID NO: 708958 - DNA, 13 bp, C. elegans
caaaaattgtatt

SEQ ID NO: 708959 - DNA, 13 bp, C. elegans
caaaaattgtcaa

SEQ ID NO: 708960 - DNA, 13 bp, C. elegans
caaaaattgttaa

SEQ ID NO: 708961 - DNA, 13 bp, C. elegans
caaaaattgttca

SEQ ID NO: 708962 - DNA, 13 bp, C. elegans
caaaaattgttga

SEQ ID NO: 708963 - DNA, 13 bp, C. elegans
caaaaattgtttt

SEQ ID NO: 708964 - DNA, 13 bp, C. elegans
caaaaatttcaat

SEQ ID NO: 708965 - DNA, 13 bp, C. elegans
caaaaatttcagt

SEQ ID NO: 708966 - DNA, 13 bp, C. elegans
caaaaatttccga

SEQ ID NO: 708967 - DNA, 13 bp, C. elegans
caaaaatttcgga

SEQ ID NO: 708968 - DNA, 13 bp, C. elegans
caaaaatttcggc

SEQ ID NO: 708969 - DNA, 13 bp, C. elegans
caaaaatttgtca

SEQ ID NO: 708970 - DNA, 13 bp, C. elegans
caaaaatttgtcg

SEQ ID NO: 708971 - DNA, 13 bp, C. elegans
caaaaatttgtta

SEQ ID NO: 708972 - DNA, 13 bp, C. elegans
caaaaattttgat

SEQ ID NO: 708973 - DNA, 13 bp, C. elegans
caaaaatttttgt

SEQ ID NO: 708974 - DNA, 13 bp, C. elegans
caaaacaatgtga

SEQ ID NO: 708975 - DNA, 13 bp, C. elegans
caaaacaattgtt

SEQ ID NO: 708976 - DNA, 13 bp, C. elegans
caaaacaatttat

SEQ ID NO: 708977 - DNA, 13 bp, C. elegans
caaaacaattttg

SEQ ID NO: 708978 - DNA, 13 bp, C. elegans
caaaacacttcaa

SEQ ID NO: 708979 - DNA, 13 bp, C. elegans
caaaacacttttg

SEQ ID NO: 708980 - DNA, 13 bp, C. elegans
caaaacataattt

SEQ ID NO: 708981 - DNA, 13 bp, C. elegans
caaaacatataag

SEQ ID NO: 708982 - DNA, 13 bp, C. elegans
caaaacatgcaaa

SEQ ID NO: 708983 - DNA, 13 bp, C. elegans
caaaacatggtgc

SEQ ID NO: 708984 - DNA, 13 bp, C. elegans
caaaacatgtatt

SEQ ID NO: 708985 - DNA, 13 bp, C. elegans
caaaacatgtgaa

SEQ ID NO: 708986 - DNA, 13 bp, C. elegans
caaaacattattg

SEQ ID NO: 708987 - DNA, 13 bp, C. elegans
caaaacattcatt

SEQ ID NO: 708988 - DNA, 13 bp, C. elegans
caaaacatttttc

SEQ ID NO: 708989 - DNA, 13 bp, C. elegans
caaaacccaattt

SEQ ID NO: 708990 - DNA, 13 bp, C. elegans
caaaaccgagcaa

SEQ ID NO: 708991 - DNA, 13 bp, C. elegans
caaaaccgttcca

SEQ ID NO: 708992 - DNA, 13 bp, C. elegans
caaaacctttaaa

SEQ ID NO: 708993 - DNA, 13 bp, C. elegans
caaaacgaaacat

SEQ ID NO: 708994 - DNA, 13 bp, C. elegans
caaaacgcatttt

SEQ ID NO: 708995 - DNA, 13 bp, C. elegans
caaaacgttcaat

SEQ ID NO: 708996 - DNA, 13 bp, C. elegans
caaaacgttcatc

SEQ ID NO: 708997 - DNA, 13 bp, C. elegans
caaaacgtttatt

SEQ ID NO: 708998 - DNA, 13 bp, C. elegans
caaaactaccgaa

SEQ ID NO: 708999 - DNA, 13 bp, C. elegans
caaaactacggta

SEQ ID NO: 709000 - DNA, 13 bp, C. elegans
caaaactactgta

SEQ ID NO: 709001 - DNA, 13 bp, C. elegans
caaaactagaatt

SEQ ID NO: 709002 - DNA, 13 bp, C. elegans
caaaactattatt

SEQ ID NO: 709003 - DNA, 13 bp, C. elegans
caaaactattcca

SEQ ID NO: 709004 - DNA, 13 bp, C. elegans
caaaactattttt

SEQ ID NO: 709005 - DNA, 13 bp, C. elegans
caaaactcaattt

SEQ ID NO: 709006 - DNA, 13 bp, C. elegans
caaaactcacatt

SEQ ID NO: 709007 - DNA, 13 bp, C. elegans
caaaactcatatt

SEQ ID NO: 709008 - DNA, 13 bp, C. elegans
caaaactccagaa

SEQ ID NO: 709009 - DNA, 13 bp, C. elegans
caaaactcgaaat

SEQ ID NO: 709010 - DNA, 13 bp, C. elegans
caaaactcggaaa

SEQ ID NO: 709011 - DNA, 13 bp, C. elegans
caaaactctaaat

SEQ ID NO: 709012 - DNA, 13 bp, C. elegans
caaaactctcatt

SEQ ID NO: 709013 - DNA, 13 bp, C. elegans
caaaactctctga

SEQ ID NO: 709014 - DNA, 13 bp, C. elegans
caaaactcttttc

SEQ ID NO: 709015 - DNA, 13 bp, C. elegans
caaaactcttttt

SEQ ID NO: 709016 - DNA, 13 bp, C. elegans
caaaactgaagaa

SEQ ID NO: 709017 - DNA, 13 bp, C. elegans
caaaactgactga

SEQ ID NO: 709018 - DNA, 13 bp, C. elegans
caaaactgagaaa

SEQ ID NO: 709019 - DNA, 13 bp, C. elegans
caaaactgataaa

SEQ ID NO: 709020 - DNA, 13 bp, C. elegans
caaaactgcaaat

SEQ ID NO: 709021 - DNA, 13 bp, C. elegans
caaaactgccgaa

SEQ ID NO: 709022 - DNA, 13 bp, C. elegans
caaaactggcaaa

SEQ ID NO: 709023 - DNA, 13 bp, C. elegans
caaaactgtaaat

SEQ ID NO: 709024 - DNA, 13 bp, C. elegans
caaaactgtacgc

SEQ ID NO: 709025 - DNA, 13 bp, C. elegans
caaaactgtgaaa

SEQ ID NO: 709026 - DNA, 13 bp, C. elegans
caaaacttaaact

SEQ ID NO: 709027 - DNA, 13 bp, C. elegans
caaaacttcacaa

SEQ ID NO: 709028 - DNA, 13 bp, C. elegans
caaaacttcagtt

SEQ ID NO: 709029 - DNA, 13 bp, C. elegans
caaaacttcatgg

SEQ ID NO: 709030 - DNA, 13 bp, C. elegans
caaaacttcgaaa

SEQ ID NO: 709031 - DNA, 13 bp, C. elegans
caaaacttctcat

SEQ ID NO: 709032 - DNA, 13 bp, C. elegans
caaaacttcttca

SEQ ID NO: 709033 - DNA, 13 bp, C. elegans
caaaacttgaata

SEQ ID NO: 709034 - DNA, 13 bp, C. elegans
caaaacttgagaa

SEQ ID NO: 709035 - DNA, 13 bp, C. elegans
caaaacttgatat

SEQ ID NO: 709036 - DNA, 13 bp, C. elegans
caaaacttgtcaa

SEQ ID NO: 709037 - DNA, 13 bp, C. elegans
caaaacttgtttc

SEQ ID NO: 709038 - DNA, 13 bp, C. elegans
caaaacttgtttt

SEQ ID NO: 709039 - DNA, 13 bp, C. elegans
caaaactttaaga

SEQ ID NO: 709040 - DNA, 13 bp, C. elegans
caaaactttcaaa

SEQ ID NO: 709041 - DNA, 13 bp, C. elegans
caaaactttcaat

SEQ ID NO: 709042 - DNA, 13 bp, C. elegans
caaaactttcatt

SEQ ID NO: 709043 - DNA, 13 bp, C. elegans
caaaactttctgt

SEQ ID NO: 709044 - DNA, 13 bp, C. elegans
caaaactttcttc

SEQ ID NO: 709045 - DNA, 13 bp, C. elegans
caaaactttgaag

SEQ ID NO: 709046 - DNA, 13 bp, C. elegans
caaaactttgaca

SEQ ID NO: 709047 - DNA, 13 bp, C. elegans
caaaactttgatc

SEQ ID NO: 709048 - DNA, 13 bp, C. elegans
caaaactttgcaa

SEQ ID NO: 709049 - DNA, 13 bp, C. elegans
caaaactttgctt

SEQ ID NO: 709050 - DNA, 13 bp, C. elegans
caaaactttgttt

SEQ ID NO: 709051 - DNA, 13 bp, C. elegans
caaaacttttgaa

SEQ ID NO: 709052 - DNA, 13 bp, C. elegans
caaaactttttca

SEQ ID NO: 709053 - DNA, 13 bp, C. elegans
caaaactttttta

SEQ ID NO: 709054 - DNA, 13 bp, C. elegans
caaaagaaaattc

SEQ ID NO: 709055 - DNA, 13 bp, C. elegans
caaaagaacatga

SEQ ID NO: 709056 - DNA, 13 bp, C. elegans
caaaagaacatgt

SEQ ID NO: 709057 - DNA, 13 bp, C. elegans
caaaagacaaagt

SEQ ID NO: 709058 - DNA, 13 bp, C. elegans
caaaagagaaatg

SEQ ID NO: 709059 - DNA, 13 bp, C. elegans
caaaagatcattg

SEQ ID NO: 709060 - DNA, 13 bp, C. elegans
caaaagatttgaa

SEQ ID NO: 709061 - DNA, 13 bp, C. elegans
caaaagctaaaat

SEQ ID NO: 709062 - DNA, 13 bp, C. elegans
caaaagctgaaat

SEQ ID NO: 709063 - DNA, 13 bp, C. elegans
caaaagctttgaa

SEQ ID NO: 709064 - DNA, 13 bp, C. elegans
caaaaggtgacaa

SEQ ID NO: 709065 - DNA, 13 bp, C. elegans
caaaaggttttat

SEQ ID NO: 709066 - DNA, 13 bp, C. elegans
caaaagtcaaaag

SEQ ID NO: 709067 - DNA, 13 bp, C. elegans
caaaagtcttttt

SEQ ID NO: 709068 - DNA, 13 bp, C. elegans
caaaagtgatttt

SEQ ID NO: 709069 - DNA, 13 bp, C. elegans
caaaagtgcaaaa

SEQ ID NO: 709070 - DNA, 13 bp, C. elegans
caaaagtgccaaa

SEQ ID NO: 709071 - DNA, 13 bp, C. elegans
caaaagttatgaa

SEQ ID NO: 709072 - DNA, 13 bp, C. elegans
caaaagttcaaac

SEQ ID NO: 709073 - DNA, 13 bp, C. elegans
caaaagttcaata

SEQ ID NO: 709074 - DNA, 13 bp, C. elegans
caaaagttcaatt

SEQ ID NO: 709075 - DNA, 13 bp, C. elegans
caaaagttcgcaa

SEQ ID NO: 709076 - DNA, 13 bp, C. elegans
caaaagttgaaaa

SEQ ID NO: 709077 - DNA, 13 bp, C. elegans
caaaagttgaatt

SEQ ID NO: 709078 - DNA, 13 bp, C. elegans
caaaagttgacaa

SEQ ID NO: 709079 - DNA, 13 bp, C. elegans
caaaagttggaaa

SEQ ID NO: 709080 - DNA, 13 bp, C. elegans
caaaagttggcaa

SEQ ID NO: 709081 - DNA, 13 bp, C. elegans
caaaagttgggtc

SEQ ID NO: 709082 - DNA, 13 bp, C. elegans
caaaagtttcaca

SEQ ID NO: 709083 - DNA, 13 bp, C. elegans
caaaagtttgatt

SEQ ID NO: 709084 - DNA, 13 bp, C. elegans
caaaagttttcaa

SEQ ID NO: 709085 - DNA, 13 bp, C. elegans
caaaagttttcag

SEQ ID NO: 709086 - DNA, 13 bp, C. elegans
caaaagttttgaa

SEQ ID NO: 709087 - DNA, 13 bp, C. elegans
caaaagtttttgg

SEQ ID NO: 709088 - DNA, 13 bp, C. elegans
caaaataatcaga

SEQ ID NO: 709089 - DNA, 13 bp, C. elegans
caaaataattgaa

SEQ ID NO: 709090 - DNA, 13 bp, C. elegans
caaaataatttca

SEQ ID NO: 709091 - DNA, 13 bp, C. elegans
caaaatacaagtt

SEQ ID NO: 709092 - DNA, 13 bp, C. elegans
caaaatacacaga

SEQ ID NO: 709093 - DNA, 13 bp, C. elegans
caaaatacacatt

SEQ ID NO: 709094 - DNA, 13 bp, C. elegans
caaaatacatttg

SEQ ID NO: 709095 - DNA, 13 bp, C. elegans
caaaatacgtttt

SEQ ID NO: 709096 - DNA, 13 bp, C. elegans
caaaatactttta

SEQ ID NO: 709097 - DNA, 13 bp, C. elegans
caaaatagtttca

SEQ ID NO: 709098 - DNA, 13 bp, C. elegans
caaaatatcatga

SEQ ID NO: 709099 - DNA, 13 bp, C. elegans
caaaatatcatgt

SEQ ID NO: 709100 - DNA, 13 bp, C. elegans
caaaatatccatt

SEQ ID NO: 709101 - DNA, 13 bp, C. elegans
caaaatatctaca

SEQ ID NO: 709102 - DNA, 13 bp, C. elegans
caaaatatctcga

SEQ ID NO: 709103 - DNA, 13 bp, C. elegans
caaaatatgcaat

SEQ ID NO: 709104 - DNA, 13 bp, C. elegans
caaaatatttatc

SEQ ID NO: 709105 - DNA, 13 bp, C. elegans
caaaatatttgtt

SEQ ID NO: 709106 - DNA, 13 bp, C. elegans
caaaatattttca

SEQ ID NO: 709107 - DNA, 13 bp, C. elegans
caaaatcaaatgt

SEQ ID NO: 709108 - DNA, 13 bp, C. elegans
caaaatcaacttt

SEQ ID NO: 709109 - DNA, 13 bp, C. elegans
caaaatcaagcaa

SEQ ID NO: 709110 - DNA, 13 bp, C. elegans
caaaatcaatcat

SEQ ID NO: 709111 - DNA, 13 bp, C. elegans
caaaatcagacaa

SEQ ID NO: 709112 - DNA, 13 bp, C. elegans
caaaatcagataa

SEQ ID NO: 709113 - DNA, 13 bp, C. elegans
caaaatcagatga

SEQ ID NO: 709114 - DNA, 13 bp, C. elegans
caaaatcatatga

SEQ ID NO: 709115 - DNA, 13 bp, C. elegans
caaaatcatcatt

SEQ ID NO: 709116 - DNA, 13 bp, C. elegans
caaaatcatgaaa

SEQ ID NO: 709117 - DNA, 13 bp, C. elegans
caaaatccccact

SEQ ID NO: 709118 - DNA, 13 bp, C. elegans
caaaatcgaaatc

SEQ ID NO: 709119 - DNA, 13 bp, C. elegans
caaaatcgagaaa

SEQ ID NO: 709120 - DNA, 13 bp, C. elegans
caaaatcgattaa

SEQ ID NO: 709121 - DNA, 13 bp, C. elegans
caaaatcgccaaa

SEQ ID NO: 709122 - DNA, 13 bp, C. elegans
caaaatcgtagaa

SEQ ID NO: 709123 - DNA, 13 bp, C. elegans
caaaatcgttcga

SEQ ID NO: 709124 - DNA, 13 bp, C. elegans
caaaatctacatt

SEQ ID NO: 709125 - DNA, 13 bp, C. elegans
caaaatctccatt

SEQ ID NO: 709126 - DNA, 13 bp, C. elegans
caaaatctcgaat

SEQ ID NO: 709127 - DNA, 13 bp, C. elegans
caaaatctgaaaa

SEQ ID NO: 709128 - DNA, 13 bp, C. elegans
caaaatctgaaac

SEQ ID NO: 709129 - DNA, 13 bp, C. elegans
caaaatctgttga

SEQ ID NO: 709130 - DNA, 13 bp, C. elegans
caaaatcttcatt

SEQ ID NO: 709131 - DNA, 13 bp, C. elegans
caaaatctttttt

SEQ ID NO: 709132 - DNA, 13 bp, C. elegans
caaaatgaacaca

SEQ ID NO: 709133 - DNA, 13 bp, C. elegans
caaaatgaccaaa

SEQ ID NO: 709134 - DNA, 13 bp, C. elegans
caaaatgaccgaa

SEQ ID NO: 709135 - DNA, 13 bp, C. elegans
caaaatgacgaaa

SEQ ID NO: 709136 - DNA, 13 bp, C. elegans
caaaatgagaact

SEQ ID NO: 709137 - DNA, 13 bp, C. elegans
caaaatgagctca

SEQ ID NO: 709138 - DNA, 13 bp, C. elegans
caaaatgattatt

SEQ ID NO: 709139 - DNA, 13 bp, C. elegans
caaaatgattcaa

SEQ ID NO: 709140 - DNA, 13 bp, C. elegans
caaaatgattttt

SEQ ID NO: 709141 - DNA, 13 bp, C. elegans
caaaatgcaacaa

SEQ ID NO: 709142 - DNA, 13 bp, C. elegans
caaaatgcagaaa

SEQ ID NO: 709143 - DNA, 13 bp, C. elegans
caaaatgccggtt

SEQ ID NO: 709144 - DNA, 13 bp, C. elegans
caaaatgcgaaaa

SEQ ID NO: 709145 - DNA, 13 bp, C. elegans
caaaatgctcatt

SEQ ID NO: 709146 - DNA, 13 bp, C. elegans
caaaatgctccaa

SEQ ID NO: 709147 - DNA, 13 bp, C. elegans
caaaatgctgtgt

SEQ ID NO: 709148 - DNA, 13 bp, C. elegans
caaaatgctttaa

SEQ ID NO: 709149 - DNA, 13 bp, C. elegans
caaaatggatttt

SEQ ID NO: 709150 - DNA, 13 bp, C. elegans
caaaatggcaaaa

SEQ ID NO: 709151 - DNA, 13 bp, C. elegans
caaaatggcctag

SEQ ID NO: 709152 - DNA, 13 bp, C. elegans
caaaatgggacac

SEQ ID NO: 709153 - DNA, 13 bp, C. elegans
caaaatgtatatt

SEQ ID NO: 709154 - DNA, 13 bp, C. elegans
caaaatgtcagaa

SEQ ID NO: 709155 - DNA, 13 bp, C. elegans
caaaatgtccaaa

SEQ ID NO: 709156 - DNA, 13 bp, C. elegans
caaaatgtcgtaa

SEQ ID NO: 709157 - DNA, 13 bp, C. elegans
caaaatgtgaaat

SEQ ID NO: 709158 - DNA, 13 bp, C. elegans
caaaatgtgaata

SEQ ID NO: 709159 - DNA, 13 bp, C. elegans
caaaatgtggaaa

SEQ ID NO: 709160 - DNA, 13 bp, C. elegans
caaaatgtggcac

SEQ ID NO: 709161 - DNA, 13 bp, C. elegans
caaaatgtgtaaa

SEQ ID NO: 709162 - DNA, 13 bp, C. elegans
caaaatgtgtgaa

SEQ ID NO: 709163 - DNA, 13 bp, C. elegans
caaaatgttaaaa

SEQ ID NO: 709164 - DNA, 13 bp, C. elegans
caaaatgttacaa

SEQ ID NO: 709165 - DNA, 13 bp, C. elegans
caaaatgttataa

SEQ ID NO: 709166 - DNA, 13 bp, C. elegans
caaaatgttattt

SEQ ID NO: 709167 - DNA, 13 bp, C. elegans
caaaatgttcatt

SEQ ID NO: 709168 - DNA, 13 bp, C. elegans
caaaatgttgaaa

SEQ ID NO: 709169 - DNA, 13 bp, C. elegans
caaaatgttgaat

SEQ ID NO: 709170 - DNA, 13 bp, C. elegans
caaaatgttgcga

SEQ ID NO: 709171 - DNA, 13 bp, C. elegans
caaaatgttgtaa

SEQ ID NO: 709172 - DNA, 13 bp, C. elegans
caaaatgttgttt

SEQ ID NO: 709173 - DNA, 13 bp, C. elegans
caaaatgtttatt

SEQ ID NO: 709174 - DNA, 13 bp, C. elegans
caaaatgtttcaa

SEQ ID NO: 709175 - DNA, 13 bp, C. elegans
caaaatgtttgaa

SEQ ID NO: 709176 - DNA, 13 bp, C. elegans
caaaatgttttca

SEQ ID NO: 709177 - DNA, 13 bp, C. elegans
caaaattaattct

SEQ ID NO: 709178 - DNA, 13 bp, C. elegans
caaaattacaatt

SEQ ID NO: 709179 - DNA, 13 bp, C. elegans
caaaattagaatt

SEQ ID NO: 709180 - DNA, 13 bp, C. elegans
caaaattatcaat

SEQ ID NO: 709181 - DNA, 13 bp, C. elegans
caaaattatgagt

SEQ ID NO: 709182 - DNA, 13 bp, C. elegans
caaaattattcaa

SEQ ID NO: 709183 - DNA, 13 bp, C. elegans
caaaattattcag

SEQ ID NO: 709184 - DNA, 13 bp, C. elegans
caaaattattcat

SEQ ID NO: 709185 - DNA, 13 bp, C. elegans
caaaattattgtt

SEQ ID NO: 709186 - DNA, 13 bp, C. elegans
caaaattatttgt

SEQ ID NO: 709187 - DNA, 14 bp, C. elegans
caaaattcaacttt

SEQ ID NO: 709188 - DNA, 13 bp, C. elegans
caaaattcaagaa

SEQ ID NO: 709189 - DNA, 13 bp, C. elegans
caaaattcaagga

SEQ ID NO: 709190 - DNA, 13 bp, C. elegans
caaaattcaatat

SEQ ID NO: 709191 - DNA, 13 bp, C. elegans
caaaattcacgga

SEQ ID NO: 709192 - DNA, 13 bp, C. elegans
caaaattcacgtt

SEQ ID NO: 709193 - DNA, 13 bp, C. elegans
caaaattcagaaa

SEQ ID NO: 709194 - DNA, 13 bp, C. elegans
caaaattccaatt

SEQ ID NO: 709195 - DNA, 13 bp, C. elegans
caaaattccacaa

SEQ ID NO: 709196 - DNA, 13 bp, C. elegans
caaaattccacca

SEQ ID NO: 709197 - DNA, 13 bp, C. elegans
caaaattcgagat

SEQ ID NO: 709198 - DNA, 13 bp, C. elegans
caaaattcgttca

SEQ ID NO: 709199 - DNA, 13 bp, C. elegans
caaaattctaaat

SEQ ID NO: 709200 - DNA, 13 bp, C. elegans
caaaattctaaca

SEQ ID NO: 709201 - DNA, 13 bp, C. elegans
caaaattctataa

SEQ ID NO: 709202 - DNA, 13 bp, C. elegans
caaaattctcaaa

SEQ ID NO: 709203 - DNA, 13 bp, C. elegans
caaaattctcatt

SEQ ID NO: 709204 - DNA, 13 bp, C. elegans
caaaattctgaaa

SEQ ID NO: 709205 - DNA, 13 bp, C. elegans
caaaattctggaa

SEQ ID NO: 709206 - DNA, 13 bp, C. elegans
caaaattcttgaa

SEQ ID NO: 709207 - DNA, 13 bp, C. elegans
caaaattcttgat

SEQ ID NO: 709208 - DNA, 13 bp, C. elegans
caaaattctttaa

SEQ ID NO: 709209 - DNA, 13 bp, C. elegans
caaaattgaaaat

SEQ ID NO: 709210 - DNA, 13 bp, C. elegans
caaaattgaaatc

SEQ ID NO: 709211 - DNA, 13 bp, C. elegans
caaaattgaaatt

SEQ ID NO: 709212 - DNA, 13 bp, C. elegans
caaaattgaacaa

SEQ ID NO: 709213 - DNA, 13 bp, C. elegans
caaaattgacaaa

SEQ ID NO: 709214 - DNA, 13 bp, C. elegans
caaaattgcataa

SEQ ID NO: 709215 - DNA, 13 bp, C. elegans
caaaattgccgaa

SEQ ID NO: 709216 - DNA, 13 bp, C. elegans
caaaattgctaaa

SEQ ID NO: 709217 - DNA, 13 bp, C. elegans
caaaattggaatt

SEQ ID NO: 709218 - DNA, 13 bp, C. elegans
caaaattggagaa

SEQ ID NO: 709219 - DNA, 13 bp, C. elegans
caaaattggagag

SEQ ID NO: 709220 - DNA, 13 bp, C. elegans
caaaattggccaa

SEQ ID NO: 709221 - DNA, 13 bp, C. elegans
caaaattgtattg

SEQ ID NO: 709222 - DNA, 13 bp, C. elegans
caaaattgtcgat

SEQ ID NO: 709223 - DNA, 13 bp, C. elegans
caaaattgtctga

SEQ ID NO: 709224 - DNA, 13 bp, C. elegans
caaaattgtgaga

SEQ ID NO: 709225 - DNA, 13 bp, C. elegans
caaaattgtgtag

SEQ ID NO: 709226 - DNA, 13 bp, C. elegans
caaaattgttatt

SEQ ID NO: 709227 - DNA, 13 bp, C. elegans
caaaattgttcaa

SEQ ID NO: 709228 - DNA, 13 bp, C. elegans
caaaattgttgaa

SEQ ID NO: 709229 - DNA, 13 bp, C. elegans
caaaattgttttt

SEQ ID NO: 709230 - DNA, 13 bp, C. elegans
caaaatttaagat

SEQ ID NO: 709231 - DNA, 13 bp, C. elegans
caaaatttacact

SEQ ID NO: 709232 - DNA, 13 bp, C. elegans
caaaatttagaga

SEQ ID NO: 709233 - DNA, 13 bp, C. elegans
caaaatttatgaa

SEQ ID NO: 709234 - DNA, 13 bp, C. elegans
caaaatttcaaga

SEQ ID NO: 709235 - DNA, 13 bp, C. elegans
caaaatttcaata

SEQ ID NO: 709236 - DNA, 13 bp, C. elegans
caaaatttcacaa

SEQ ID NO: 709237 - DNA, 14 bp, C. elegans
caaaatttcagatt

SEQ ID NO: 709238 - DNA, 13 bp, C. elegans
caaaatttccaaa

SEQ ID NO: 709239 - DNA, 13 bp, C. elegans
caaaatttccaga

SEQ ID NO: 709240 - DNA, 13 bp, C. elegans
caaaatttccgaa

SEQ ID NO: 709241 - DNA, 13 bp, C. elegans
caaaatttcctac

SEQ ID NO: 709242 - DNA, 13 bp, C. elegans
caaaatttctgaa

SEQ ID NO: 709243 - DNA, 13 bp, C. elegans
caaaatttcttca

SEQ ID NO: 709244 - DNA, 13 bp, C. elegans
caaaatttgaaat

SEQ ID NO: 709245 - DNA, 13 bp, C. elegans
caaaatttgaatt

SEQ ID NO: 709246 - DNA, 13 bp, C. elegans
caaaatttgagct

SEQ ID NO: 709247 - DNA, 13 bp, C. elegans
caaaatttgatga

SEQ ID NO: 709248 - DNA, 13 bp, C. elegans
caaaatttgattt

SEQ ID NO: 709249 - DNA, 13 bp, C. elegans
caaaatttgcatt

SEQ ID NO: 709250 - DNA, 13 bp, C. elegans
caaaatttgccga

SEQ ID NO: 709251 - DNA, 13 bp, C. elegans
caaaatttgcttt

SEQ ID NO: 709252 - DNA, 13 bp, C. elegans
caaaatttggaag

SEQ ID NO: 709253 - DNA, 13 bp, C. elegans
caaaatttggatt

SEQ ID NO: 709254 - DNA, 13 bp, C. elegans
caaaatttggctc

SEQ ID NO: 709255 - DNA, 13 bp, C. elegans
caaaattttacaa

SEQ ID NO: 709256 - DNA, 13 bp, C. elegans
caaaattttatca

SEQ ID NO: 709257 - DNA, 13 bp, C. elegans
caaaattttcaga

SEQ ID NO: 709258 - DNA, 13 bp, C. elegans
caaaattttccaa

SEQ ID NO: 709259 - DNA, 13 bp, C. elegans
caaaattttccga

SEQ ID NO: 709260 - DNA, 13 bp, C. elegans
caaaattttcttt

SEQ ID NO: 709261 - DNA, 13 bp, C. elegans
caaaattttgaaa

SEQ ID NO: 709262 - DNA, 13 bp, C. elegans
caaaattttgatt

SEQ ID NO: 709263 - DNA, 13 bp, C. elegans
caaaattttgcaa

SEQ ID NO: 709264 - DNA, 13 bp, C. elegans
caaaattttgctc

SEQ ID NO: 709265 - DNA, 13 bp, C. elegans
caaaattttgtgt

SEQ ID NO: 709266 - DNA, 13 bp, C. elegans
caaaatttttacc

SEQ ID NO: 709267 - DNA, 13 bp, C. elegans
caaaatttttcaa

SEQ ID NO: 709268 - DNA, 13 bp, C. elegans
caaaatttttgaa

SEQ ID NO: 709269 - DNA, 13 bp, C. elegans
caaaatttttgga

SEQ ID NO: 709270 - DNA, 13 bp, C. elegans
caaaattttttca

SEQ ID NO: 709271 - DNA, 13 bp, C. elegans
caaaattttttga

SEQ ID NO: 709272 - DNA, 13 bp, C. elegans
caaacaaatccag

SEQ ID NO: 709273 - DNA, 13 bp, C. elegans
caaacaatcattt

SEQ ID NO: 709274 - DNA, 13 bp, C. elegans
caaacaatttcat

SEQ ID NO: 709275 - DNA, 13 bp, C. elegans
caaacaattttaa

SEQ ID NO: 709276 - DNA, 13 bp, C. elegans
caaacaattttca

SEQ ID NO: 709277 - DNA, 13 bp, C. elegans
caaacaattttta

SEQ ID NO: 709278 - DNA, 13 bp, C. elegans
caaacacatttta

SEQ ID NO: 709279 - DNA, 13 bp, C. elegans
caaacaccaaatt

SEQ ID NO: 709280 - DNA, 13 bp, C. elegans
caaacaccgaatc

SEQ ID NO: 709281 - DNA, 13 bp, C. elegans
caaacaccgatgt

SEQ ID NO: 709282 - DNA, 13 bp, C. elegans
caaacactcattg

SEQ ID NO: 709283 - DNA, 13 bp, C. elegans
caaacactttttg

SEQ ID NO: 709284 - DNA, 13 bp, C. elegans
caaacatcaattt

SEQ ID NO: 709285 - DNA, 13 bp, C. elegans
caaacatcgaaaa

SEQ ID NO: 709286 - DNA, 13 bp, C. elegans
caaacatctgaaa

SEQ ID NO: 709287 - DNA, 13 bp, C. elegans
caaacatcttttt

SEQ ID NO: 709288 - DNA, 13 bp, C. elegans
caaacatgaatta

SEQ ID NO: 709289 - DNA, 13 bp, C. elegans
caaacattcattt

SEQ ID NO: 709290 - DNA, 13 bp, C. elegans
caaacattgaaaa

SEQ ID NO: 709291 - DNA, 13 bp, C. elegans
caaacattgtttt

SEQ ID NO: 709292 - DNA, 13 bp, C. elegans
caaacatttaaca

SEQ ID NO: 709293 - DNA, 13 bp, C. elegans
caaacatttcaac

SEQ ID NO: 709294 - DNA, 13 bp, C. elegans
caaacatttgaaa

SEQ ID NO: 709295 - DNA, 14 bp, C. elegans
caaacattttcaaa

SEQ ID NO: 709296 - DNA, 13 bp, C. elegans
caaacattttgaa

SEQ ID NO: 709297 - DNA, 13 bp, C. elegans
caaacatttttgc

SEQ ID NO: 709298 - DNA, 13 bp, C. elegans
caaacatttttta

SEQ ID NO: 709299 - DNA, 13 bp, C. elegans
caaaccaactttt

SEQ ID NO: 709300 - DNA, 13 bp, C. elegans
caaaccataatgg

SEQ ID NO: 709301 - DNA, 13 bp, C. elegans
caaacccacaatt

SEQ ID NO: 709302 - DNA, 13 bp, C. elegans
caaacccgtctcg

SEQ ID NO: 709303 - DNA, 14 bp, C. elegans
caaaccgacatggg

SEQ ID NO: 709304 - DNA, 13 bp, C. elegans
caaaccggcaaaa

SEQ ID NO: 709305 - DNA, 13 bp, C. elegans
caaaccggcattt

SEQ ID NO: 709306 - DNA, 13 bp, C. elegans
caaaccttcaaaa

SEQ ID NO: 709307 - DNA, 13 bp, C. elegans
caaacgacaactg

SEQ ID NO: 709308 - DNA, 13 bp, C. elegans
caaacgacactcc

SEQ ID NO: 709309 - DNA, 13 bp, C. elegans
caaacgagagcga

SEQ ID NO: 709310 - DNA, 13 bp, C. elegans
caaacgatttgtt

SEQ ID NO: 709311 - DNA, 13 bp, C. elegans
caaacgctatttt

SEQ ID NO: 709312 - DNA, 13 bp, C. elegans
caaacggcaattg

SEQ ID NO: 709313 - DNA, 13 bp, C. elegans
caaacggttcaaa

SEQ ID NO: 709314 - DNA, 13 bp, C. elegans
caaacgtttaaaa

SEQ ID NO: 709315 - DNA, 13 bp, C. elegans
caaactaactttt

SEQ ID NO: 709316 - DNA, 13 bp, C. elegans
caaactacaaatc

SEQ ID NO: 709317 - DNA, 13 bp, C. elegans
caaactacagtaa

SEQ ID NO: 709318 - DNA, 13 bp, C. elegans
caaactacttttt

SEQ ID NO: 709319 - DNA, 13 bp, C. elegans
caaactcaatttt

SEQ ID NO: 709320 - DNA, 13 bp, C. elegans
caaactccaataa

SEQ ID NO: 709321 - DNA, 13 bp, C. elegans
caaactccgaaaa

SEQ ID NO: 709322 - DNA, 13 bp, C. elegans
caaactcgagacg

SEQ ID NO: 709323 - DNA, 13 bp, C. elegans
caaactctcaaaa

SEQ ID NO: 709324 - DNA, 13 bp, C. elegans
caaactgacaaat

SEQ ID NO: 709325 - DNA, 13 bp, C. elegans
caaactgatcatt

SEQ ID NO: 709326 - DNA, 13 bp, C. elegans
caaactgcaaaaa

SEQ ID NO: 709327 - DNA, 13 bp, C. elegans
caaactgccagaa

SEQ ID NO: 709328 - DNA, 13 bp, C. elegans
caaactgccgagt

SEQ ID NO: 709329 - DNA, 13 bp, C. elegans
caaactgccgatt

SEQ ID NO: 709330 - DNA, 13 bp, C. elegans
caaactggaaaat

SEQ ID NO: 709331 - DNA, 13 bp, C. elegans
caaactggcaaac

SEQ ID NO: 709332 - DNA, 13 bp, C. elegans
caaactggggaaa

SEQ ID NO: 709333 - DNA, 13 bp, C. elegans
caaacttatgaaa

SEQ ID NO: 709334 - DNA, 13 bp, C. elegans
caaacttatgaat

SEQ ID NO: 709335 - DNA, 13 bp, C. elegans
caaacttcaaact

SEQ ID NO: 709336 - DNA, 13 bp, C. elegans
caaacttcaagtt

SEQ ID NO: 709337 - DNA, 13 bp, C. elegans
caaacttcataaa

SEQ ID NO: 709338 - DNA, 13 bp, C. elegans
caaacttccattt

SEQ ID NO: 709339 - DNA, 13 bp, C. elegans
caaacttctgaaa

SEQ ID NO: 709340 - DNA, 13 bp, C. elegans
caaacttcttttt

SEQ ID NO: 709341 - DNA, 13 bp, C. elegans
caaacttgaataa

SEQ ID NO: 709342 - DNA, 13 bp, C. elegans
caaacttgcaaaa

SEQ ID NO: 709343 - DNA, 13 bp, C. elegans
caaacttggacaa

SEQ ID NO: 709344 - DNA, 13 bp, C. elegans
caaacttgggcca

SEQ ID NO: 709345 - DNA, 13 bp, C. elegans
caaactttcaaaa

SEQ ID NO: 709346 - DNA, 13 bp, C. elegans
caaactttcaaat

SEQ ID NO: 709347 - DNA, 13 bp, C. elegans
caaactttccatt

SEQ ID NO: 709348 - DNA, 13 bp, C. elegans
caaactttcgttg

SEQ ID NO: 709349 - DNA, 13 bp, C. elegans
caaactttctgat

SEQ ID NO: 709350 - DNA, 13 bp, C. elegans
caaactttctttc

SEQ ID NO: 709351 - DNA, 13 bp, C. elegans
caaactttggcaa

SEQ ID NO: 709352 - DNA, 13 bp, C. elegans
caaactttgtgca

SEQ ID NO: 709353 - DNA, 13 bp, C. elegans
caaacttttaaaa

SEQ ID NO: 709354 - DNA, 13 bp, C. elegans
caaacttttaaac

SEQ ID NO: 709355 - DNA, 13 bp, C. elegans
caaacttttattc

SEQ ID NO: 709356 - DNA, 13 bp, C. elegans
caaacttttgaaa

SEQ ID NO: 709357 - DNA, 13 bp, C. elegans
caaacttttgttg

SEQ ID NO: 709358 - DNA, 13 bp, C. elegans
caaactttttcaa

SEQ ID NO: 709359 - DNA, 13 bp, C. elegans
caaactttttcta

SEQ ID NO: 709360 - DNA, 13 bp, C. elegans
caaactttttggt

SEQ ID NO: 709361 - DNA, 13 bp, C. elegans
caaacttttttcc

SEQ ID NO: 709362 - DNA, 13 bp, C. elegans
caaagaaaacatt

SEQ ID NO: 709363 - DNA, 13 bp, C. elegans
caaagaaaatatt

SEQ ID NO: 709364 - DNA, 13 bp, C. elegans
caaagaaaatgtg

SEQ ID NO: 709365 - DNA, 13 bp, C. elegans
caaagaaaatttg

SEQ ID NO: 709366 - DNA, 13 bp, C. elegans
caaagaaatgaga

SEQ ID NO: 709367 - DNA, 13 bp, C. elegans
caaagaaatttaa

SEQ ID NO: 709368 - DNA, 13 bp, C. elegans
caaagaaatttga

SEQ ID NO: 709369 - DNA, 13 bp, C. elegans
caaagaattgaaa

SEQ ID NO: 709370 - DNA, 13 bp, C. elegans
caaagaatttaaa

SEQ ID NO: 709371 - DNA, 13 bp, C. elegans
caaagaatttcaa

SEQ ID NO: 709372 - DNA, 13 bp, C. elegans
caaagaattttca

SEQ ID NO: 709373 - DNA, 13 bp, C. elegans
caaagactacaaa

SEQ ID NO: 709374 - DNA, 13 bp, C. elegans
caaagagtactgt

SEQ ID NO: 709375 - DNA, 13 bp, C. elegans
caaagatggaatt

SEQ ID NO: 709376 - DNA, 13 bp, C. elegans
caaagattttcga

SEQ ID NO: 709377 - DNA, 13 bp, C. elegans
caaagatttttca

SEQ ID NO: 709378 - DNA, 13 bp, C. elegans
caaaggatcacaa

SEQ ID NO: 709379 - DNA, 13 bp, C. elegans
caaagtatccaaa

SEQ ID NO: 709380 - DNA, 13 bp, C. elegans
caaagtattgaaa

SEQ ID NO: 709381 - DNA, 13 bp, C. elegans
caaagtatttttt

SEQ ID NO: 709382 - DNA, 13 bp, C. elegans
caaagtcaagaaa

SEQ ID NO: 709383 - DNA, 13 bp, C. elegans
caaagtctgaaaa

SEQ ID NO: 709384 - DNA, 13 bp, C. elegans
caaagtgcagaaa

SEQ ID NO: 709385 - DNA, 13 bp, C. elegans
caaagtggaaaaa

SEQ ID NO: 709386 - DNA, 13 bp, C. elegans
caaagttaaacaa

SEQ ID NO: 709387 - DNA, 13 bp, C. elegans
caaagttaaattt

SEQ ID NO: 709388 - DNA, 13 bp, C. elegans
caaagttatattt

SEQ ID NO: 709389 - DNA, 13 bp, C. elegans
caaagttcaaaaa

SEQ ID NO: 709390 - DNA, 13 bp, C. elegans
caaagttcaaata

SEQ ID NO: 709391 - DNA, 13 bp, C. elegans
caaagttcaacac

SEQ ID NO: 709392 - DNA, 13 bp, C. elegans
caaagttgaaaat

SEQ ID NO: 709393 - DNA, 13 bp, C. elegans
caaagttgcaaaa

SEQ ID NO: 709394 - DNA, 13 bp, C. elegans
caaagtttaataa

SEQ ID NO: 709395 - DNA, 13 bp, C. elegans
caaagtttaattt

SEQ ID NO: 709396 - DNA, 13 bp, C. elegans
caaagtttcataa

SEQ ID NO: 709397 - DNA, 13 bp, C. elegans
caaagtttctcaa

SEQ ID NO: 709398 - DNA, 13 bp, C. elegans
caaagtttgaaaa

SEQ ID NO: 709399 - DNA, 13 bp, C. elegans
caaagtttgcaaa

SEQ ID NO: 709400 - DNA, 13 bp, C. elegans
caaagtttggaaa

SEQ ID NO: 709401 - DNA, 13 bp, C. elegans
caaagttttaaat

SEQ ID NO: 709402 - DNA, 13 bp, C. elegans
caaagttttcaaa

SEQ ID NO: 709403 - DNA, 13 bp, C. elegans
caaagttttgaaa

SEQ ID NO: 709404 - DNA, 13 bp, C. elegans
caaagttttgatg

SEQ ID NO: 709405 - DNA, 13 bp, C. elegans
caaataaaaagtg

SEQ ID NO: 709406 - DNA, 13 bp, C. elegans
caaataaaattgt

SEQ ID NO: 709407 - DNA, 13 bp, C. elegans
caaataaacttca

SEQ ID NO: 709408 - DNA, 13 bp, C. elegans
caaataaagtttt

SEQ ID NO: 709409 - DNA, 13 bp, C. elegans
caaataaatagtt

SEQ ID NO: 709410 - DNA, 13 bp, C. elegans
caaataaatatgt

SEQ ID NO: 709411 - DNA, 13 bp, C. elegans
caaataaattact

SEQ ID NO: 709412 - DNA, 13 bp, C. elegans
caaataaattctc

SEQ ID NO: 709413 - DNA, 13 bp, C. elegans
caaataaattgaa

SEQ ID NO: 709414 - DNA, 13 bp, C. elegans
caaataaattgta

SEQ ID NO: 709415 - DNA, 13 bp, C. elegans
caaataatctttt

SEQ ID NO: 709416 - DNA, 13 bp, C. elegans
caaataatgaaga

SEQ ID NO: 709417 - DNA, 13 bp, C. elegans
caaataattctca

SEQ ID NO: 709418 - DNA, 13 bp, C. elegans
caaataattgaaa

SEQ ID NO: 709419 - DNA, 13 bp, C. elegans
caaatactttatt

SEQ ID NO: 709420 - DNA, 13 bp, C. elegans
caaatacttttaa

SEQ ID NO: 709421 - DNA, 13 bp, C. elegans
caaatagaaatta

SEQ ID NO: 709422 - DNA, 13 bp, C. elegans
caaatatcagaat

SEQ ID NO: 709423 - DNA, 13 bp, C. elegans
caaatatcataat

SEQ ID NO: 709424 - DNA, 13 bp, C. elegans
caaatatcatcat

SEQ ID NO: 709425 - DNA, 13 bp, C. elegans
caaatatcatgat

SEQ ID NO: 709426 - DNA, 13 bp, C. elegans
caaatatcttact

SEQ ID NO: 709427 - DNA, 13 bp, C. elegans
caaatattcaaac

SEQ ID NO: 709428 - DNA, 13 bp, C. elegans
caaatattctgaa

SEQ ID NO: 709429 - DNA, 13 bp, C. elegans
caaatattgaaaa

SEQ ID NO: 709430 - DNA, 13 bp, C. elegans
caaatattgaata

SEQ ID NO: 709431 - DNA, 13 bp, C. elegans
caaatattgattt

SEQ ID NO: 709432 - DNA, 13 bp, C. elegans
caaatattgcaaa

SEQ ID NO: 709433 - DNA, 13 bp, C. elegans
caaatattgcaat

SEQ ID NO: 709434 - DNA, 13 bp, C. elegans
caaatattgtttt

SEQ ID NO: 709435 - DNA, 13 bp, C. elegans
caaatatttcaac

SEQ ID NO: 709436 - DNA, 13 bp, C. elegans
caaatatttcatt

SEQ ID NO: 709437 - DNA, 13 bp, C. elegans
caaatatttgaaa

SEQ ID NO: 709438 - DNA, 13 bp, C. elegans
caaatatttgaac

SEQ ID NO: 709439 - DNA, 13 bp, C. elegans
caaatatttgaca

SEQ ID NO: 709440 - DNA, 13 bp, C. elegans
caaatatttgatt

SEQ ID NO: 709441 - DNA, 13 bp, C. elegans
caaatatttgttg

SEQ ID NO: 709442 - DNA, 13 bp, C. elegans
caaatattttcac

SEQ ID NO: 709443 - DNA, 13 bp, C. elegans
caaatattttgct

SEQ ID NO: 709444 - DNA, 13 bp, C. elegans
caaatcaaacatt

SEQ ID NO: 709445 - DNA, 13 bp, C. elegans
caaatcaacaatt

SEQ ID NO: 709446 - DNA, 13 bp, C. elegans
caaatcaacggaa

SEQ ID NO: 709447 - DNA, 13 bp, C. elegans
caaatcaatccaa

SEQ ID NO: 709448 - DNA, 13 bp, C. elegans
caaatcaatggga

SEQ ID NO: 709449 - DNA, 13 bp, C. elegans
caaatcaatttca

SEQ ID NO: 709450 - DNA, 13 bp, C. elegans
caaatcaattttc

SEQ ID NO: 709451 - DNA, 13 bp, C. elegans
caaatcacgaaaa

SEQ ID NO: 709452 - DNA, 13 bp, C. elegans
caaatcacttttt

SEQ ID NO: 709453 - DNA, 13 bp, C. elegans
caaatcagaaaat

SEQ ID NO: 709454 - DNA, 13 bp, C. elegans
caaatcagaaatt

SEQ ID NO: 709455 - DNA, 13 bp, C. elegans
caaatcagtattt

SEQ ID NO: 709456 - DNA, 13 bp, C. elegans
caaatcattcaaa

SEQ ID NO: 709457 - DNA, 13 bp, C. elegans
caaatccgcaaat

SEQ ID NO: 709458 - DNA, 13 bp, C. elegans
caaatcgacaaac

SEQ ID NO: 709459 - DNA, 13 bp, C. elegans
caaatcgacaatt

SEQ ID NO: 709460 - DNA, 13 bp, C. elegans
caaatcgataatt

SEQ ID NO: 709461 - DNA, 13 bp, C. elegans
caaatcgatattg

SEQ ID NO: 709462 - DNA, 13 bp, C. elegans
caaatcgccaaaa

SEQ ID NO: 709463 - DNA, 13 bp, C. elegans
caaatcgccaaat

SEQ ID NO: 709464 - DNA, 13 bp, C. elegans
caaatcgccagaa

SEQ ID NO: 709465 - DNA, 13 bp, C. elegans
caaatcggaaaac

SEQ ID NO: 709466 - DNA, 13 bp, C. elegans
caaatcggaaaat

SEQ ID NO: 709467 - DNA, 13 bp, C. elegans
caaatcggcaagc

SEQ ID NO: 709468 - DNA, 13 bp, C. elegans
caaatcggcaatt

SEQ ID NO: 709469 - DNA, 13 bp, C. elegans
caaatctacagta

SEQ ID NO: 709470 - DNA, 13 bp, C. elegans
caaatctactttt

SEQ ID NO: 709471 - DNA, 13 bp, C. elegans
caaatctatcaaa

SEQ ID NO: 709472 - DNA, 13 bp, C. elegans
caaatctcaaagt

SEQ ID NO: 709473 - DNA, 13 bp, C. elegans
caaatctccaaaa

SEQ ID NO: 709474 - DNA, 13 bp, C. elegans
caaatctccaatt

SEQ ID NO: 709475 - DNA, 13 bp, C. elegans
caaatctcttttt

SEQ ID NO: 709476 - DNA, 13 bp, C. elegans
caaatctgaaatt

SEQ ID NO: 709477 - DNA, 13 bp, C. elegans
caaatcttccaaa

SEQ ID NO: 709478 - DNA, 13 bp, C. elegans
caaatcttttaaa

SEQ ID NO: 709479 - DNA, 13 bp, C. elegans
caaatgaaaaagt

SEQ ID NO: 709480 - DNA, 13 bp, C. elegans
caaatgaaaatcg

SEQ ID NO: 709481 - DNA, 13 bp, C. elegans
caaatgaacaaat

SEQ ID NO: 709482 - DNA, 13 bp, C. elegans
caaatgaacgaat

SEQ ID NO: 709483 - DNA, 13 bp, C. elegans
caaatgaatattt

SEQ ID NO: 709484 - DNA, 14 bp, C. elegans
caaatgaatgggaa

SEQ ID NO: 709485 - DNA, 13 bp, C. elegans
caaatgagcaaat

SEQ ID NO: 709486 - DNA, 13 bp, C. elegans
caaatgataattt

SEQ ID NO: 709487 - DNA, 13 bp, C. elegans
caaatgatgtttt

SEQ ID NO: 709488 - DNA, 13 bp, C. elegans
caaatgatttttt

SEQ ID NO: 709489 - DNA, 13 bp, C. elegans
caaatgcaacaaa

SEQ ID NO: 709490 - DNA, 13 bp, C. elegans
caaatgcagaaaa

SEQ ID NO: 709491 - DNA, 13 bp, C. elegans
caaatgcattttc

SEQ ID NO: 709492 - DNA, 13 bp, C. elegans
caaatgcgctcca

SEQ ID NO: 709493 - DNA, 13 bp, C. elegans
caaatgctcaaaa

SEQ ID NO: 709494 - DNA, 13 bp, C. elegans
caaatgctcaaat

SEQ ID NO: 709495 - DNA, 13 bp, C. elegans
caaatggaaaatt

SEQ ID NO: 709496 - DNA, 13 bp, C. elegans
caaatggaagagg

SEQ ID NO: 709497 - DNA, 13 bp, C. elegans
caaatggaccaaa

SEQ ID NO: 709498 - DNA, 13 bp, C. elegans
caaatggcaaatc

SEQ ID NO: 709499 - DNA, 13 bp, C. elegans
caaatgggaaaat

SEQ ID NO: 709500 - DNA, 13 bp, C. elegans
caaatgggcaatt

SEQ ID NO: 709501 - DNA, 13 bp, C. elegans
caaatgtatttta

SEQ ID NO: 709502 - DNA, 13 bp, C. elegans
caaatgtgctcca

SEQ ID NO: 709503 - DNA, 13 bp, C. elegans
caaatgtgctcta

SEQ ID NO: 709504 - DNA, 13 bp, C. elegans
caaatgtgttgcg

SEQ ID NO: 709505 - DNA, 13 bp, C. elegans
caaatgtgttttt

SEQ ID NO: 709506 - DNA, 13 bp, C. elegans
caaatgttataaa

SEQ ID NO: 709507 - DNA, 13 bp, C. elegans
caaatgttatcaa

SEQ ID NO: 709508 - DNA, 13 bp, C. elegans
caaatgttccaaa

SEQ ID NO: 709509 - DNA, 13 bp, C. elegans
caaatgtttcata

SEQ ID NO: 709510 - DNA, 13 bp, C. elegans
caaatgttttatt

SEQ ID NO: 709511 - DNA, 13 bp, C. elegans
caaatgttttgtt

SEQ ID NO: 709512 - DNA, 13 bp, C. elegans
caaatgttttttg

SEQ ID NO: 709513 - DNA, 13 bp, C. elegans
caaattaaacttt

SEQ ID NO: 709514 - DNA, 13 bp, C. elegans
caaattaatactt

SEQ ID NO: 709515 - DNA, 13 bp, C. elegans
caaattacaaatt

SEQ ID NO: 709516 - DNA, 13 bp, C. elegans
caaattaccaaat

SEQ ID NO: 709517 - DNA, 13 bp, C. elegans
caaattaccgaaa

SEQ ID NO: 709518 - DNA, 13 bp, C. elegans
caaattagagaaa

SEQ ID NO: 709519 - DNA, 13 bp, C. elegans
caaattatcaatg

SEQ ID NO: 709520 - DNA, 13 bp, C. elegans
caaattatcagtt

SEQ ID NO: 709521 - DNA, 13 bp, C. elegans
caaattatccaaa

SEQ ID NO: 709522 - DNA, 13 bp, C. elegans
caaattatctcaa

SEQ ID NO: 709523 - DNA, 13 bp, C. elegans
caaattattcgaa

SEQ ID NO: 709524 - DNA, 13 bp, C. elegans
caaattattcttt

SEQ ID NO: 709525 - DNA, 13 bp, C. elegans
caaattattgatt

SEQ ID NO: 709526 - DNA, 13 bp, C. elegans
caaattatttcat

SEQ ID NO: 709527 - DNA, 13 bp, C. elegans
caaattattttca

SEQ ID NO: 709528 - DNA, 13 bp, C. elegans
caaattcaaattc

SEQ ID NO: 709529 - DNA, 13 bp, C. elegans
caaattcaacatt

SEQ ID NO: 709530 - DNA, 13 bp, C. elegans
caaattcaacttg

SEQ ID NO: 709531 - DNA, 13 bp, C. elegans
caaattcaagaaa

SEQ ID NO: 709532 - DNA, 13 bp, C. elegans
caaattcaagaat

SEQ ID NO: 709533 - DNA, 13 bp, C. elegans
caaattcactttg

SEQ ID NO: 709534 - DNA, 13 bp, C. elegans
caaattcagttta

SEQ ID NO: 709535 - DNA, 13 bp, C. elegans
caaattcagtttt

SEQ ID NO: 709536 - DNA, 13 bp, C. elegans
caaattcatcaaa

SEQ ID NO: 709537 - DNA, 13 bp, C. elegans
caaattccaaaat

SEQ ID NO: 709538 - DNA, 13 bp, C. elegans
caaattccaacaa

SEQ ID NO: 709539 - DNA, 13 bp, C. elegans
caaattccataaa

SEQ ID NO: 709540 - DNA, 13 bp, C. elegans
caaattcccagaa

SEQ ID NO: 709541 - DNA, 13 bp, C. elegans
caaattcccgaaa

SEQ ID NO: 709542 - DNA, 13 bp, C. elegans
caaattcctattt

SEQ ID NO: 709543 - DNA, 13 bp, C. elegans
caaattcgaaaaa

SEQ ID NO: 709544 - DNA, 13 bp, C. elegans
caaattcggaaaa

SEQ ID NO: 709545 - DNA, 13 bp, C. elegans
caaattcggcaaa

SEQ ID NO: 709546 - DNA, 13 bp, C. elegans
caaattcggcata

SEQ ID NO: 709547 - DNA, 13 bp, C. elegans
caaattcgtgaag

SEQ ID NO: 709548 - DNA, 13 bp, C. elegans
caaattcgttttt

SEQ ID NO: 709549 - DNA, 13 bp, C. elegans
caaattctaaatt

SEQ ID NO: 709550 - DNA, 13 bp, C. elegans
caaattctaattt

SEQ ID NO: 709551 - DNA, 13 bp, C. elegans
caaattctatcaa

SEQ ID NO: 709552 - DNA, 13 bp, C. elegans
caaattctccaaa

SEQ ID NO: 709553 - DNA, 13 bp, C. elegans
caaattcttatat

SEQ ID NO: 709554 - DNA, 13 bp, C. elegans
caaattcttcaaa

SEQ ID NO: 709555 - DNA, 13 bp, C. elegans
caaattcttcaat

SEQ ID NO: 709556 - DNA, 13 bp, C. elegans
caaattcttcatt

SEQ ID NO: 709557 - DNA, 13 bp, C. elegans
caaattcttgttt

SEQ ID NO: 709558 - DNA, 13 bp, C. elegans
caaattgaaaaac

SEQ ID NO: 709559 - DNA, 13 bp, C. elegans
caaattgaaaaca

SEQ ID NO: 709560 - DNA, 13 bp, C. elegans
caaattgaaaatg

SEQ ID NO: 709561 - DNA, 13 bp, C. elegans
caaattgaaagaa

SEQ ID NO: 709562 - DNA, 13 bp, C. elegans
caaattgaaatga

SEQ ID NO: 709563 - DNA, 13 bp, C. elegans
caaattgaaattc

SEQ ID NO: 709564 - DNA, 13 bp, C. elegans
caaattgaacaaa

SEQ ID NO: 709565 - DNA, 13 bp, C. elegans
caaattgaagctc

SEQ ID NO: 709566 - DNA, 13 bp, C. elegans
caaattgaaggaa

SEQ ID NO: 709567 - DNA, 13 bp, C. elegans
caaattgaattga

SEQ ID NO: 709568 - DNA, 13 bp, C. elegans
caaattgaattgt

SEQ ID NO: 709569 - DNA, 13 bp, C. elegans
caaattgacggaa

SEQ ID NO: 709570 - DNA, 13 bp, C. elegans
caaattgataatt

SEQ ID NO: 709571 - DNA, 13 bp, C. elegans
caaattgatcaaa

SEQ ID NO: 709572 - DNA, 13 bp, C. elegans
caaattgattgtt

SEQ ID NO: 709573 - DNA, 13 bp, C. elegans
caaattgattttt

SEQ ID NO: 709574 - DNA, 13 bp, C. elegans
caaattgcagaaa

SEQ ID NO: 709575 - DNA, 13 bp, C. elegans
caaattgccgatt

SEQ ID NO: 709576 - DNA, 13 bp, C. elegans
caaattgccggat

SEQ ID NO: 709577 - DNA, 13 bp, C. elegans
caaattgccggtt

SEQ ID NO: 709578 - DNA, 13 bp, C. elegans
caaattggatttg

SEQ ID NO: 709579 - DNA, 13 bp, C. elegans
caaattggcaatt

SEQ ID NO: 709580 - DNA, 13 bp, C. elegans
caaattggccaaa

SEQ ID NO: 709581 - DNA, 13 bp, C. elegans
caaattgtcaaac

SEQ ID NO: 709582 - DNA, 13 bp, C. elegans
caaattgtcaatt

SEQ ID NO: 709583 - DNA, 13 bp, C. elegans
caaattgtcgtaa

SEQ ID NO: 709584 - DNA, 13 bp, C. elegans
caaattgtgataa

SEQ ID NO: 709585 - DNA, 13 bp, C. elegans
caaattgtgatat

SEQ ID NO: 709586 - DNA, 13 bp, C. elegans
caaattgtgcaaa

SEQ ID NO: 709587 - DNA, 13 bp, C. elegans
caaattgtggaaa

SEQ ID NO: 709588 - DNA, 13 bp, C. elegans
caaattgttcatt

SEQ ID NO: 709589 - DNA, 13 bp, C. elegans
caaattgttgcaa

SEQ ID NO: 709590 - DNA, 13 bp, C. elegans
caaattgtttaat

SEQ ID NO: 709591 - DNA, 13 bp, C. elegans
caaattgtttgca

SEQ ID NO: 709592 - DNA, 13 bp, C. elegans
caaattgttttca

SEQ ID NO: 709593 - DNA, 13 bp, C. elegans
caaattgtttttg

SEQ ID NO: 709594 - DNA, 13 bp, C. elegans
caaatttaaaact

SEQ ID NO: 709595 - DNA, 13 bp, C. elegans
caaatttaattca

SEQ ID NO: 709596 - DNA, 13 bp, C. elegans
caaatttaatttg

SEQ ID NO: 709597 - DNA, 13 bp, C. elegans
caaatttaccgaa

SEQ ID NO: 709598 - DNA, 13 bp, C. elegans
caaatttattgaa

SEQ ID NO: 709599 - DNA, 13 bp, C. elegans
caaatttattgca

SEQ ID NO: 709600 - DNA, 13 bp, C. elegans
caaatttattgtt

SEQ ID NO: 709601 - DNA, 13 bp, C. elegans
caaatttcaaaga

SEQ ID NO: 709602 - DNA, 13 bp, C. elegans
caaatttcaaatt

SEQ ID NO: 709603 - DNA, 14 bp, C. elegans
caaatttcaaattc

SEQ ID NO: 709604 - DNA, 13 bp, C. elegans
caaatttcaattt

SEQ ID NO: 709605 - DNA, 13 bp, C. elegans
caaatttcataat

SEQ ID NO: 709606 - DNA, 13 bp, C. elegans
caaatttcatatt

SEQ ID NO: 709607 - DNA, 13 bp, C. elegans
caaatttcatgtt

SEQ ID NO: 709608 - DNA, 13 bp, C. elegans
caaatttcattat

SEQ ID NO: 709609 - DNA, 13 bp, C. elegans
caaatttcatttt

SEQ ID NO: 709610 - DNA, 13 bp, C. elegans
caaatttccaact

SEQ ID NO: 709611 - DNA, 13 bp, C. elegans
caaatttccaata

SEQ ID NO: 709612 - DNA, 13 bp, C. elegans
caaatttccagcc

SEQ ID NO: 709613 - DNA, 13 bp, C. elegans
caaatttccagtc

SEQ ID NO: 709614 - DNA, 13 bp, C. elegans
caaatttccgatt

SEQ ID NO: 709615 - DNA, 13 bp, C. elegans
caaatttcctgaa

SEQ ID NO: 709616 - DNA, 13 bp, C. elegans
caaatttcgagct

SEQ ID NO: 709617 - DNA, 13 bp, C. elegans
caaatttctgatt

SEQ ID NO: 709618 - DNA, 13 bp, C. elegans
caaatttctgcaa

SEQ ID NO: 709619 - DNA, 13 bp, C. elegans
caaatttcttcaa

SEQ ID NO: 709620 - DNA, 13 bp, C. elegans
caaatttcttgaa

SEQ ID NO: 709621 - DNA, 13 bp, C. elegans
caaatttgaaaaa

SEQ ID NO: 709622 - DNA, 13 bp, C. elegans
caaatttgaaaca

SEQ ID NO: 709623 - DNA, 13 bp, C. elegans
caaatttgaaatt

SEQ ID NO: 709624 - DNA, 13 bp, C. elegans
caaatttgaagaa

SEQ ID NO: 709625 - DNA, 13 bp, C. elegans
caaatttgacaaa

SEQ ID NO: 709626 - DNA, 13 bp, C. elegans
caaatttgataat

SEQ ID NO: 709627 - DNA, 13 bp, C. elegans
caaatttgatgaa

SEQ ID NO: 709628 - DNA, 13 bp, C. elegans
caaatttgcaaaa

SEQ ID NO: 709629 - DNA, 13 bp, C. elegans
caaatttgccaaa

SEQ ID NO: 709630 - DNA, 13 bp, C. elegans
caaatttgccgga

SEQ ID NO: 709631 - DNA, 13 bp, C. elegans
caaatttggaagt

SEQ ID NO: 709632 - DNA, 13 bp, C. elegans
caaatttgtaaaa

SEQ ID NO: 709633 - DNA, 13 bp, C. elegans
caaatttgtaaat

SEQ ID NO: 709634 - DNA, 13 bp, C. elegans
caaatttgtcaaa

SEQ ID NO: 709635 - DNA, 13 bp, C. elegans
caaatttgtgaaa

SEQ ID NO: 709636 - DNA, 13 bp, C. elegans
caaatttgtggaa

SEQ ID NO: 709637 - DNA, 13 bp, C. elegans
caaatttgttaaa

SEQ ID NO: 709638 - DNA, 13 bp, C. elegans
caaatttgttttt

SEQ ID NO: 709639 - DNA, 13 bp, C. elegans
caaattttattag

SEQ ID NO: 709640 - DNA, 13 bp, C. elegans
caaattttcaatt

SEQ ID NO: 709641 - DNA, 13 bp, C. elegans
caaattttcacaa

SEQ ID NO: 709642 - DNA, 13 bp, C. elegans
caaattttcactg

SEQ ID NO: 709643 - DNA, 13 bp, C. elegans
caaattttcagat

SEQ ID NO: 709644 - DNA, 13 bp, C. elegans
caaattttcagtc

SEQ ID NO: 709645 - DNA, 13 bp, C. elegans
caaattttcagtg

SEQ ID NO: 709646 - DNA, 13 bp, C. elegans
caaattttccaaa

SEQ ID NO: 709647 - DNA, 13 bp, C. elegans
caaattttccgaa

SEQ ID NO: 709648 - DNA, 13 bp, C. elegans
caaattttccgat

SEQ ID NO: 709649 - DNA, 13 bp, C. elegans
caaattttcgaaa

SEQ ID NO: 709650 - DNA, 13 bp, C. elegans
caaattttcgcaa

SEQ ID NO: 709651 - DNA, 13 bp, C. elegans
caaattttcggtt

SEQ ID NO: 709652 - DNA, 13 bp, C. elegans
caaattttctaat

SEQ ID NO: 709653 - DNA, 13 bp, C. elegans
caaattttctcaa

SEQ ID NO: 709654 - DNA, 13 bp, C. elegans
caaattttctcag

SEQ ID NO: 709655 - DNA, 13 bp, C. elegans
caaattttctgga

SEQ ID NO: 709656 - DNA, 13 bp, C. elegans
caaattttcttac

SEQ ID NO: 709657 - DNA, 13 bp, C. elegans
caaattttcttta

SEQ ID NO: 709658 - DNA, 13 bp, C. elegans
caaattttgaata

SEQ ID NO: 709659 - DNA, 13 bp, C. elegans
caaattttgagaa

SEQ ID NO: 709660 - DNA, 13 bp, C. elegans
caaattttgagct

SEQ ID NO: 709661 - DNA, 13 bp, C. elegans
caaattttgattt

SEQ ID NO: 709662 - DNA, 13 bp, C. elegans
caaattttgcaaa

SEQ ID NO: 709663 - DNA, 13 bp, C. elegans
caaattttggatt

SEQ ID NO: 709664 - DNA, 13 bp, C. elegans
caaattttgtatt

SEQ ID NO: 709665 - DNA, 13 bp, C. elegans
caaattttgttca

SEQ ID NO: 709666 - DNA, 13 bp, C. elegans
caaattttgttct

SEQ ID NO: 709667 - DNA, 13 bp, C. elegans
caaattttgttga

SEQ ID NO: 709668 - DNA, 13 bp, C. elegans
caaatttttaact

SEQ ID NO: 709669 - DNA, 13 bp, C. elegans
caaatttttatag

SEQ ID NO: 709670 - DNA, 13 bp, C. elegans
caaatttttccag

SEQ ID NO: 709671 - DNA, 13 bp, C. elegans
caaatttttccct

SEQ ID NO: 709672 - DNA, 13 bp, C. elegans
caaatttttcgat

SEQ ID NO: 709673 - DNA, 13 bp, C. elegans
caaatttttctgc

SEQ ID NO: 709674 - DNA, 13 bp, C. elegans
caaatttttgata

SEQ ID NO: 709675 - DNA, 13 bp, C. elegans
caaatttttgatg

SEQ ID NO: 709676 - DNA, 13 bp, C. elegans
caaatttttggca

SEQ ID NO: 709677 - DNA, 13 bp, C. elegans
caaattttttaac

SEQ ID NO: 709678 - DNA, 13 bp, C. elegans
caaattttttcca

SEQ ID NO: 709679 - DNA, 13 bp, C. elegans
caaattttttgtg

SEQ ID NO: 709680 - DNA, 13 bp, C. elegans
caaatttttttga

SEQ ID NO: 709681 - DNA, 13 bp, C. elegans
caacaaaaaagtt

SEQ ID NO: 709682 - DNA, 13 bp, C. elegans
caacaaaaaatcg

SEQ ID NO: 709683 - DNA, 13 bp, C. elegans
caacaaaaaatgc

SEQ ID NO: 709684 - DNA, 13 bp, C. elegans
caacaaaaaatgg

SEQ ID NO: 709685 - DNA, 13 bp, C. elegans
caacaaaaatgga

SEQ ID NO: 709686 - DNA, 13 bp, C. elegans
caacaaaaattgt

SEQ ID NO: 709687 - DNA, 13 bp, C. elegans
caacaaaattgtt

SEQ ID NO: 709688 - DNA, 13 bp, C. elegans
caacaaatcatca

SEQ ID NO: 709689 - DNA, 13 bp, C. elegans
caacaaatcggca

SEQ ID NO: 709690 - DNA, 13 bp, C. elegans
caacaaattgccg

SEQ ID NO: 709691 - DNA, 13 bp, C. elegans
caacaaatttcaa

SEQ ID NO: 709692 - DNA, 13 bp, C. elegans
caacaaatttcca

SEQ ID NO: 709693 - DNA, 13 bp, C. elegans
caacaaattttaa

SEQ ID NO: 709694 - DNA, 13 bp, C. elegans
caacaaattttga

SEQ ID NO: 709695 - DNA, 13 bp, C. elegans
caacaacaacatt

SEQ ID NO: 709696 - DNA, 13 bp, C. elegans
caacaacactttt

SEQ ID NO: 709697 - DNA, 13 bp, C. elegans
caacaacatttca

SEQ ID NO: 709698 - DNA, 13 bp, C. elegans
caacaacgaaagt

SEQ ID NO: 709699 - DNA, 13 bp, C. elegans
caacaataaattt

SEQ ID NO: 709700 - DNA, 13 bp, C. elegans
caacaatattcca

SEQ ID NO: 709701 - DNA, 13 bp, C. elegans
caacaatctgaaa

SEQ ID NO: 709702 - DNA, 13 bp, C. elegans
caacaattaaatt

SEQ ID NO: 709703 - DNA, 13 bp, C. elegans
caacaattattca

SEQ ID NO: 709704 - DNA, 13 bp, C. elegans
caacaattcaaca

SEQ ID NO: 709705 - DNA, 13 bp, C. elegans
caacaattcaatt

SEQ ID NO: 709706 - DNA, 13 bp, C. elegans
caacaattcccag

SEQ ID NO: 709707 - DNA, 13 bp, C. elegans
caacaattgaatt

SEQ ID NO: 709708 - DNA, 13 bp, C. elegans
caacaattgcaaa

SEQ ID NO: 709709 - DNA, 13 bp, C. elegans
caacaatttattt

SEQ ID NO: 709710 - DNA, 13 bp, C. elegans
caacaatttcaaa

SEQ ID NO: 709711 - DNA, 13 bp, C. elegans
caacaatttcacc

SEQ ID NO: 709712 - DNA, 13 bp, C. elegans
caacaatttccag

SEQ ID NO: 709713 - DNA, 13 bp, C. elegans
caacaattttcaa

SEQ ID NO: 709714 - DNA, 13 bp, C. elegans
caacaatttttca

SEQ ID NO: 709715 - DNA, 13 bp, C. elegans
caacacacattta

SEQ ID NO: 709716 - DNA, 13 bp, C. elegans
caacaccaaactt

SEQ ID NO: 709717 - DNA, 13 bp, C. elegans
caacactcttttc

SEQ ID NO: 709718 - DNA, 13 bp, C. elegans
caacactttttgc

SEQ ID NO: 709719 - DNA, 13 bp, C. elegans
caacagaaatcaa

SEQ ID NO: 709720 - DNA, 13 bp, C. elegans
caacagagcaagc

SEQ ID NO: 709721 - DNA, 15 bp, C. elegans
caacagattttggaa

SEQ ID NO: 709722 - DNA, 13 bp, C. elegans
caacagcaaaatt

SEQ ID NO: 709723 - DNA, 13 bp, C. elegans
caacagcttctcc

SEQ ID NO: 709724 - DNA, 13 bp, C. elegans
caacatattttac

SEQ ID NO: 709725 - DNA, 13 bp, C. elegans
caacatattttta

SEQ ID NO: 709726 - DNA, 13 bp, C. elegans
caacattatttca

SEQ ID NO: 709727 - DNA, 13 bp, C. elegans
caacattcaattt

SEQ ID NO: 709728 - DNA, 13 bp, C. elegans
caacatttaaaac

SEQ ID NO: 709729 - DNA, 13 bp, C. elegans
caacatttaataa

SEQ ID NO: 709730 - DNA, 13 bp, C. elegans
caacatttcaatt

SEQ ID NO: 709731 - DNA, 13 bp, C. elegans
caacatttgaaaa

SEQ ID NO: 709732 - DNA, 13 bp, C. elegans
caacattttcatt

SEQ ID NO: 709733 - DNA, 13 bp, C. elegans
caacattttccca

SEQ ID NO: 709734 - DNA, 13 bp, C. elegans
caacattttcgaa

SEQ ID NO: 709735 - DNA, 13 bp, C. elegans
caacattttcttg

SEQ ID NO: 709736 - DNA, 13 bp, C. elegans
caacattttgaga

SEQ ID NO: 709737 - DNA, 13 bp, C. elegans
caacattttgttt

SEQ ID NO: 709738 - DNA, 13 bp, C. elegans
caacatttttcaa

SEQ ID NO: 709739 - DNA, 13 bp, C. elegans
caacatttttgtt

SEQ ID NO: 709740 - DNA, 13 bp, C. elegans
caacattttttat

SEQ ID NO: 709741 - DNA, 13 bp, C. elegans
caaccaaaacatt

SEQ ID NO: 709742 - DNA, 13 bp, C. elegans
caaccaagttgcc

SEQ ID NO: 709743 - DNA, 13 bp, C. elegans
caaccaatatcag

SEQ ID NO: 709744 - DNA, 25 bp, C. elegans
caaccaatatcaggccgccgacatc

SEQ ID NO: 709745 - DNA, 13 bp, C. elegans
caaccaatcagaa

SEQ ID NO: 709746 - DNA, 13 bp, C. elegans
caaccaatcagac

SEQ ID NO: 709747 - DNA, 13 bp, C. elegans
caaccaattttaa

SEQ ID NO: 709748 - DNA, 13 bp, C. elegans
caaccaattttta

SEQ ID NO: 709749 - DNA, 13 bp, C. elegans
caaccatgatctt

SEQ ID NO: 709750 - DNA, 13 bp, C. elegans
caacccagttttg

SEQ ID NO: 709751 - DNA, 13 bp, C. elegans
caaccctacagta

SEQ ID NO: 709752 - DNA, 13 bp, C. elegans
caaccgtttttga

SEQ ID NO: 709753 - DNA, 13 bp, C. elegans
caacctacaaact

SEQ ID NO: 709754 - DNA, 13 bp, C. elegans
caacctcactctg

SEQ ID NO: 709755 - DNA, 13 bp, C. elegans
caacctgatattt

SEQ ID NO: 709756 - DNA, 13 bp, C. elegans
caacgaaaatttg

SEQ ID NO: 709757 - DNA, 13 bp, C. elegans
caacgaaattaaa

SEQ ID NO: 709758 - DNA, 13 bp, C. elegans
caacgacactccg

SEQ ID NO: 709759 - DNA, 13 bp, C. elegans
caacgactggcac

SEQ ID NO: 709760 - DNA, 13 bp, C. elegans
caacgagagtttg

SEQ ID NO: 709761 - DNA, 13 bp, C. elegans
caacgaggaaaat

SEQ ID NO: 709762 - DNA, 13 bp, C. elegans
caacgcttctatg

SEQ ID NO: 709763 - DNA, 13 bp, C. elegans
caacggaaactgt

SEQ ID NO: 709764 - DNA, 13 bp, C. elegans
caacgtagtaaaa

SEQ ID NO: 709765 - DNA, 13 bp, C. elegans
caacgtgaactct

SEQ ID NO: 709766 - DNA, 13 bp, C. elegans
caacgtttttttt

SEQ ID NO: 709767 - DNA, 13 bp, C. elegans
caactaaaattga

SEQ ID NO: 709768 - DNA, 13 bp, C. elegans
caactaacaaatt

SEQ ID NO: 709769 - DNA, 13 bp, C. elegans
caactaccaaatt

SEQ ID NO: 709770 - DNA, 13 bp, C. elegans
caactaccgtacc

SEQ ID NO: 709771 - DNA, 13 bp, C. elegans
caactataatttt

SEQ ID NO: 709772 - DNA, 13 bp, C. elegans
caactatcctatg

SEQ ID NO: 709773 - DNA, 13 bp, C. elegans
caactcaaaagta

SEQ ID NO: 709774 - DNA, 13 bp, C. elegans
caactcaatgtgg

SEQ ID NO: 709775 - DNA, 13 bp, C. elegans
caactcattcaaa

SEQ ID NO: 709776 - DNA, 13 bp, C. elegans
caactcctgaacc

SEQ ID NO: 709777 - DNA, 13 bp, C. elegans
caactctattttc

SEQ ID NO: 709778 - DNA, 13 bp, C. elegans
caactctcactga

SEQ ID NO: 709779 - DNA, 13 bp, C. elegans
caactcttgccaa

SEQ ID NO: 709780 - DNA, 13 bp, C. elegans
caactcttttcaa

SEQ ID NO: 709781 - DNA, 13 bp, C. elegans
caactgaaaagtt

SEQ ID NO: 709782 - DNA, 13 bp, C. elegans
caactgaaatgtt

SEQ ID NO: 709783 - DNA, 13 bp, C. elegans
caactgaaggtag

SEQ ID NO: 709784 - DNA, 13 bp, C. elegans
caactgaatcaac

SEQ ID NO: 709785 - DNA, 13 bp, C. elegans
caactgacaaatt

SEQ ID NO: 709786 - DNA, 13 bp, C. elegans
caactgattttgc

SEQ ID NO: 709787 - DNA, 13 bp, C. elegans
caactgattttgt

SEQ ID NO: 709788 - DNA, 13 bp, C. elegans
caactgcaaaaat

SEQ ID NO: 709789 - DNA, 13 bp, C. elegans
caactgcaaagtt

SEQ ID NO: 709790 - DNA, 13 bp, C. elegans
caactgcgctcca

SEQ ID NO: 709791 - DNA, 13 bp, C. elegans
caactgtgaaaat

SEQ ID NO: 709792 - DNA, 13 bp, C. elegans
caactgttttgaa

SEQ ID NO: 709793 - DNA, 13 bp, C. elegans
caacttattcatg

SEQ ID NO: 709794 - DNA, 13 bp, C. elegans
caacttatttttc

SEQ ID NO: 709795 - DNA, 13 bp, C. elegans
caacttcaaatgt

SEQ ID NO: 709796 - DNA, 13 bp, C. elegans
caacttcaaattt

SEQ ID NO: 709797 - DNA, 13 bp, C. elegans
caacttccaaaat

SEQ ID NO: 709798 - DNA, 13 bp, C. elegans
caacttcggcaac

SEQ ID NO: 709799 - DNA, 13 bp, C. elegans
caacttctacaaa

SEQ ID NO: 709800 - DNA, 13 bp, C. elegans
caacttctatagc

SEQ ID NO: 709801 - DNA, 13 bp, C. elegans
caacttcttaccc

SEQ ID NO: 709802 - DNA, 13 bp, C. elegans
caacttcttatca

SEQ ID NO: 709803 - DNA, 13 bp, C. elegans
caacttcttctca

SEQ ID NO: 709804 - DNA, 13 bp, C. elegans
caacttcttcttc

SEQ ID NO: 709805 - DNA, 13 bp, C. elegans
caacttgacaatt

SEQ ID NO: 709806 - DNA, 13 bp, C. elegans
caacttgataaaa

SEQ ID NO: 709807 - DNA, 13 bp, C. elegans
caacttgatgaaa

SEQ ID NO: 709808 - DNA, 13 bp, C. elegans
caacttgccagaa

SEQ ID NO: 709809 - DNA, 13 bp, C. elegans
caacttgttggaa

SEQ ID NO: 709810 - DNA, 13 bp, C. elegans
caacttgtttttt

SEQ ID NO: 709811 - DNA, 13 bp, C. elegans
caactttaacttt

SEQ ID NO: 709812 - DNA, 13 bp, C. elegans
caactttattcaa

SEQ ID NO: 709813 - DNA, 13 bp, C. elegans
caactttcaattt

SEQ ID NO: 709814 - DNA, 13 bp, C. elegans
caactttcctttt

SEQ ID NO: 709815 - DNA, 13 bp, C. elegans
caactttcgccaa

SEQ ID NO: 709816 - DNA, 13 bp, C. elegans
caactttctcttt

SEQ ID NO: 709817 - DNA, 13 bp, C. elegans
caactttctgaca

SEQ ID NO: 709818 - DNA, 13 bp, C. elegans
caactttctgcca

SEQ ID NO: 709819 - DNA, 13 bp, C. elegans
caactttgaaatt

SEQ ID NO: 709820 - DNA, 13 bp, C. elegans
caactttgaagtt

SEQ ID NO: 709821 - DNA, 13 bp, C. elegans
caactttgacaac

SEQ ID NO: 709822 - DNA, 13 bp, C. elegans
caactttgataat

SEQ ID NO: 709823 - DNA, 13 bp, C. elegans
caactttgcggat

SEQ ID NO: 709824 - DNA, 13 bp, C. elegans
caactttgtgaca

SEQ ID NO: 709825 - DNA, 13 bp, C. elegans
caactttgtgatt

SEQ ID NO: 709826 - DNA, 13 bp, C. elegans
caacttttaattt

SEQ ID NO: 709827 - DNA, 13 bp, C. elegans
caacttttatctt

SEQ ID NO: 709828 - DNA, 13 bp, C. elegans
caacttttcaaaa

SEQ ID NO: 709829 - DNA, 13 bp, C. elegans
caacttttcattt

SEQ ID NO: 709830 - DNA, 13 bp, C. elegans
caacttttccgtg

SEQ ID NO: 709831 - DNA, 13 bp, C. elegans
caacttttcgaaa

SEQ ID NO: 709832 - DNA, 13 bp, C. elegans
caacttttcgaca

SEQ ID NO: 709833 - DNA, 13 bp, C. elegans
caacttttctatt

SEQ ID NO: 709834 - DNA, 13 bp, C. elegans
caacttttgaaac

SEQ ID NO: 709835 - DNA, 13 bp, C. elegans
caacttttgaatt

SEQ ID NO: 709836 - DNA, 13 bp, C. elegans
caacttttgagca

SEQ ID NO: 709837 - DNA, 13 bp, C. elegans
caactttttaatt

SEQ ID NO: 709838 - DNA, 13 bp, C. elegans
caactttttagtt

SEQ ID NO: 709839 - DNA, 13 bp, C. elegans
caactttttcaaa

SEQ ID NO: 709840 - DNA, 13 bp, C. elegans
caactttttctat

SEQ ID NO: 709841 - DNA, 13 bp, C. elegans
caactttttgaaa

SEQ ID NO: 709842 - DNA, 13 bp, C. elegans
caacttttttcca

SEQ ID NO: 709843 - DNA, 13 bp, C. elegans
caacttttttcga

SEQ ID NO: 709844 - DNA, 13 bp, C. elegans
caagaaaaaactc

SEQ ID NO: 709845 - DNA, 13 bp, C. elegans
caagaaaaaagtg

SEQ ID NO: 709846 - DNA, 13 bp, C. elegans
caagaaaaatttt

SEQ ID NO: 709847 - DNA, 13 bp, C. elegans
caagaaaactatt

SEQ ID NO: 709848 - DNA, 13 bp, C. elegans
caagaaaagttta

SEQ ID NO: 709849 - DNA, 13 bp, C. elegans
caagaaaatatgt

SEQ ID NO: 709850 - DNA, 13 bp, C. elegans
caagaaaatcgat

SEQ ID NO: 709851 - DNA, 13 bp, C. elegans
caagaaaatgcat

SEQ ID NO: 709852 - DNA, 13 bp, C. elegans
caagaaaattgag

SEQ ID NO: 709853 - DNA, 13 bp, C. elegans
caagaaaatttga

SEQ ID NO: 709854 - DNA, 13 bp, C. elegans
caagaaacatatt

SEQ ID NO: 709855 - DNA, 13 bp, C. elegans
caagaaactttga

SEQ ID NO: 709856 - DNA, 13 bp, C. elegans
caagaaatattaa

SEQ ID NO: 709857 - DNA, 13 bp, C. elegans
caagaaatattca

SEQ ID NO: 709858 - DNA, 13 bp, C. elegans
caagaaatcaaga

SEQ ID NO: 709859 - DNA, 13 bp, C. elegans
caagaaatgggcg

SEQ ID NO: 709860 - DNA, 13 bp, C. elegans
caagaaattattt

SEQ ID NO: 709861 - DNA, 13 bp, C. elegans
caagaaattcaaa

SEQ ID NO: 709862 - DNA, 13 bp, C. elegans
caagaaattcaga

SEQ ID NO: 709863 - DNA, 13 bp, C. elegans
caagaaattcgtt

SEQ ID NO: 709864 - DNA, 13 bp, C. elegans
caagaaattgatt

SEQ ID NO: 709865 - DNA, 13 bp, C. elegans
caagaaattgcaa

SEQ ID NO: 709866 - DNA, 13 bp, C. elegans
caagaaattgtaa

SEQ ID NO: 709867 - DNA, 13 bp, C. elegans
caagaaatttgaa

SEQ ID NO: 709868 - DNA, 18 bp, C. elegans
caagaactctgtcaccta

SEQ ID NO: 709869 - DNA, 13 bp, C. elegans
caagaagctagag

SEQ ID NO: 709870 - DNA, 13 bp, C. elegans
caagaagcttgcc

SEQ ID NO: 709871 - DNA, 13 bp, C. elegans
caagaatacggta

SEQ ID NO: 709872 - DNA, 13 bp, C. elegans
caagaatcaagaa

SEQ ID NO: 709873 - DNA, 13 bp, C. elegans
caagaatcagttt

SEQ ID NO: 709874 - DNA, 13 bp, C. elegans
caagaattaattc

SEQ ID NO: 709875 - DNA, 13 bp, C. elegans
caagaatttgaat

SEQ ID NO: 709876 - DNA, 13 bp, C. elegans
caagaattttcag

SEQ ID NO: 709877 - DNA, 13 bp, C. elegans
caagaattttctt

SEQ ID NO: 709878 - DNA, 13 bp, C. elegans
caagacgaaattc

SEQ ID NO: 709879 - DNA, 13 bp, C. elegans
caagactattagg

SEQ ID NO: 709880 - DNA, 13 bp, C. elegans
caagagagaactt

SEQ ID NO: 709881 - DNA, 13 bp, C. elegans
caagagatattat

SEQ ID NO: 709882 - DNA, 13 bp, C. elegans
caagagcgagtca

SEQ ID NO: 709883 - DNA, 13 bp, C. elegans
caagagcttcaaa

SEQ ID NO: 709884 - DNA, 13 bp, C. elegans
caagatgagatgg

SEQ ID NO: 709885 - DNA, 13 bp, C. elegans
caagatgttttcg

SEQ ID NO: 709886 - DNA, 13 bp, C. elegans
caagatgttttgc

SEQ ID NO: 709887 - DNA, 13 bp, C. elegans
caagattttattt

SEQ ID NO: 709888 - DNA, 13 bp, C. elegans
caagattttgaat

SEQ ID NO: 709889 - DNA, 13 bp, C. elegans
caagcaaaaattc

SEQ ID NO: 709890 - DNA, 13 bp, C. elegans
caagcagaaatag

SEQ ID NO: 709891 - DNA, 13 bp, C. elegans
caagccaaagcct

SEQ ID NO: 709892 - DNA, 13 bp, C. elegans
caagccacgccca

SEQ ID NO: 709893 - DNA, 13 bp, C. elegans
caagccattcttt

SEQ ID NO: 709894 - DNA, 13 bp, C. elegans
caagccggcaatt

SEQ ID NO: 709895 - DNA, 13 bp, C. elegans
caagcctaagcca

SEQ ID NO: 709896 - DNA, 13 bp, C. elegans
caagcctacaaac

SEQ ID NO: 709897 - DNA, 13 bp, C. elegans
caagcctaccaac

SEQ ID NO: 709898 - DNA, 13 bp, C. elegans
caagcctgagcct

SEQ ID NO: 709899 - DNA, 13 bp, C. elegans
caagctactcatt

SEQ ID NO: 709900 - DNA, 13 bp, C. elegans
caagctcttttgt

SEQ ID NO: 709901 - DNA, 13 bp, C. elegans
caagctgaattca

SEQ ID NO: 709902 - DNA, 13 bp, C. elegans
caagcttttcaaa

SEQ ID NO: 709903 - DNA, 13 bp, C. elegans
caaggaaatgaca

SEQ ID NO: 709904 - DNA, 13 bp, C. elegans
caaggaaattgaa

SEQ ID NO: 709905 - DNA, 13 bp, C. elegans
caaggacaacatt

SEQ ID NO: 709906 - DNA, 13 bp, C. elegans
caaggcactagaa

SEQ ID NO: 709907 - DNA, 13 bp, C. elegans
caaggcgacctac

SEQ ID NO: 709908 - DNA, 14 bp, C. elegans
caaggcttgggtaa

SEQ ID NO: 709909 - DNA, 13 bp, C. elegans
caagggtgtcaat

SEQ ID NO: 709910 - DNA, 13 bp, C. elegans
caagtaccaaaat

SEQ ID NO: 709911 - DNA, 13 bp, C. elegans
caagtacgcattc

SEQ ID NO: 709912 - DNA, 13 bp, C. elegans
caagtaggtcaaa

SEQ ID NO: 709913 - DNA, 13 bp, C. elegans
caagtagtgtcgt

SEQ ID NO: 709914 - DNA, 13 bp, C. elegans
caagtctaataaa

SEQ ID NO: 709915 - DNA, 13 bp, C. elegans
caagtgaaaattg

SEQ ID NO: 709916 - DNA, 13 bp, C. elegans
caagtgcgctcca

SEQ ID NO: 709917 - DNA, 13 bp, C. elegans
caagtgcgctcta

SEQ ID NO: 709918 - DNA, 13 bp, C. elegans
caagtggcgcagt

SEQ ID NO: 709919 - DNA, 13 bp, C. elegans
caagtgggcggag

SEQ ID NO: 709920 - DNA, 13 bp, C. elegans
caagttaatattt

SEQ ID NO: 709921 - DNA, 13 bp, C. elegans
caagttacagtaa

SEQ ID NO: 709922 - DNA, 13 bp, C. elegans
caagttattcaaa

SEQ ID NO: 709923 - DNA, 13 bp, C. elegans
caagttcaaaaaa

SEQ ID NO: 709924 - DNA, 13 bp, C. elegans
caagttgaaacaa

SEQ ID NO: 709925 - DNA, 13 bp, C. elegans
caagttgccggaa

SEQ ID NO: 709926 - DNA, 13 bp, C. elegans
caagttgctcaag

SEQ ID NO: 709927 - DNA, 13 bp, C. elegans
caagttggaaatt

SEQ ID NO: 709928 - DNA, 13 bp, C. elegans
caagttggcaaat

SEQ ID NO: 709929 - DNA, 13 bp, C. elegans
caagttggcggaa

SEQ ID NO: 709930 - DNA, 13 bp, C. elegans
caagttggtcaaa

SEQ ID NO: 709931 - DNA, 13 bp, C. elegans
caagttggtggcc

SEQ ID NO: 709932 - DNA, 13 bp, C. elegans
caagtttcaagtt

SEQ ID NO: 709933 - DNA, 13 bp, C. elegans
caagtttcagaaa

SEQ ID NO: 709934 - DNA, 13 bp, C. elegans
caagtttctaaaa

SEQ ID NO: 709935 - DNA, 13 bp, C. elegans
caagtttcttttt

SEQ ID NO: 709936 - DNA, 13 bp, C. elegans
caagtttgaaaat

SEQ ID NO: 709937 - DNA, 13 bp, C. elegans
caagtttgatgat

SEQ ID NO: 709938 - DNA, 13 bp, C. elegans
caagtttgtaatt

SEQ ID NO: 709939 - DNA, 13 bp, C. elegans
caagttttaaaac

SEQ ID NO: 709940 - DNA, 13 bp, C. elegans
caagttttaggtt

SEQ ID NO: 709941 - DNA, 13 bp, C. elegans
caagttttccaaa

SEQ ID NO: 709942 - DNA, 13 bp, C. elegans
caagttttccgaa

SEQ ID NO: 709943 - DNA, 13 bp, C. elegans
caagttttgaagt

SEQ ID NO: 709944 - DNA, 13 bp, C. elegans
caagttttggcat

SEQ ID NO: 709945 - DNA, 13 bp, C. elegans
caagttttggttt

SEQ ID NO: 709946 - DNA, 13 bp, C. elegans
caagtttttcaaa

SEQ ID NO: 709947 - DNA, 13 bp, C. elegans
caagttttttctc

SEQ ID NO: 709948 - DNA, 13 bp, C. elegans
caagttttttgaa

SEQ ID NO: 709949 - DNA, 13 bp, C. elegans
caagttttttgat

SEQ ID NO: 709950 - DNA, 13 bp, C. elegans
caagtttttttca

SEQ ID NO: 709951 - DNA, 13 bp, C. elegans
caataaaaacctt

SEQ ID NO: 709952 - DNA, 13 bp, C. elegans
caataaaagtgtt

SEQ ID NO: 709953 - DNA, 13 bp, C. elegans
caataaaatctat

SEQ ID NO: 709954 - DNA, 13 bp, C. elegans
caataaaatgtgt

SEQ ID NO: 709955 - DNA, 13 bp, C. elegans
caataaaattcag

SEQ ID NO: 709956 - DNA, 13 bp, C. elegans
caataaaattgat

SEQ ID NO: 709957 - DNA, 13 bp, C. elegans
caataaacactta

SEQ ID NO: 709958 - DNA, 13 bp, C. elegans
caataaataccgt

SEQ ID NO: 709959 - DNA, 13 bp, C. elegans
caataaatacttt

SEQ ID NO: 709960 - DNA, 13 bp, C. elegans
caataaatcagtt

SEQ ID NO: 709961 - DNA, 13 bp, C. elegans
caataaatcatga

SEQ ID NO: 709962 - DNA, 13 bp, C. elegans
caataaatcattt

SEQ ID NO: 709963 - DNA, 13 bp, C. elegans
caataaattattc

SEQ ID NO: 709964 - DNA, 13 bp, C. elegans
caataaattctat

SEQ ID NO: 709965 - DNA, 13 bp, C. elegans
caataaattgctc

SEQ ID NO: 709966 - DNA, 13 bp, C. elegans
caataaattgtaa

SEQ ID NO: 709967 - DNA, 13 bp, C. elegans
caataaatttcca

SEQ ID NO: 709968 - DNA, 13 bp, C. elegans
caataaatttgtt

SEQ ID NO: 709969 - DNA, 13 bp, C. elegans
caataaattttca

SEQ ID NO: 709970 - DNA, 13 bp, C. elegans
caataacagtgaa

SEQ ID NO: 709971 - DNA, 13 bp, C. elegans
caataacttctca

SEQ ID NO: 709972 - DNA, 13 bp, C. elegans
caataactttcaa

SEQ ID NO: 709973 - DNA, 13 bp, C. elegans
caataacttttct

SEQ ID NO: 709974 - DNA, 13 bp, C. elegans
caataactttttt

SEQ ID NO: 709975 - DNA, 13 bp, C. elegans
caataagattcaa

SEQ ID NO: 709976 - DNA, 13 bp, C. elegans
caataattcaatt

SEQ ID NO: 709977 - DNA, 13 bp, C. elegans
caataattctaaa

SEQ ID NO: 709978 - DNA, 13 bp, C. elegans
caataattgtttt

SEQ ID NO: 709979 - DNA, 13 bp, C. elegans
caataatttccca

SEQ ID NO: 709980 - DNA, 13 bp, C. elegans
caataatttgttt

SEQ ID NO: 709981 - DNA, 13 bp, C. elegans
caataattttaca

SEQ ID NO: 709982 - DNA, 13 bp, C. elegans
caataattttgaa

SEQ ID NO: 709983 - DNA, 13 bp, C. elegans
caatacaaaatgc

SEQ ID NO: 709984 - DNA, 13 bp, C. elegans
caatacaattttg

SEQ ID NO: 709985 - DNA, 13 bp, C. elegans
caatacacatttg

SEQ ID NO: 709986 - DNA, 13 bp, C. elegans
caatacattttca

SEQ ID NO: 709987 - DNA, 13 bp, C. elegans
caataccattttt

SEQ ID NO: 709988 - DNA, 13 bp, C. elegans
caatactaatttt

SEQ ID NO: 709989 - DNA, 13 bp, C. elegans
caatactattttt

SEQ ID NO: 709990 - DNA, 13 bp, C. elegans
caatacttttgtg

SEQ ID NO: 709991 - DNA, 13 bp, C. elegans
caatactttttaa

SEQ ID NO: 709992 - DNA, 13 bp, C. elegans
caatactttttca

SEQ ID NO: 709993 - DNA, 13 bp, C. elegans
caatacttttttc

SEQ ID NO: 709994 - DNA, 13 bp, C. elegans
caatagatttttt

SEQ ID NO: 709995 - DNA, 13 bp, C. elegans
caatagttttttt

SEQ ID NO: 709996 - DNA, 13 bp, C. elegans
caatatatttact

SEQ ID NO: 709997 - DNA, 13 bp, C. elegans
caatatatttttg

SEQ ID NO: 709998 - DNA, 13 bp, C. elegans
caatatcaatttt

SEQ ID NO: 709999 - DNA, 13 bp, C. elegans
caatatcgaaaaa

SEQ ID NO: 710000 - DNA, 13 bp, C. elegans
caatatctcaatt

SEQ ID NO: 710001 - DNA, 13 bp, C. elegans
caatatctcttca

SEQ ID NO: 710002 - DNA, 13 bp, C. elegans
caatatgccaaaa

SEQ ID NO: 710003 - DNA, 13 bp, C. elegans
caatatgccgaaa

SEQ ID NO: 710004 - DNA, 13 bp, C. elegans
caatattatcaaa

SEQ ID NO: 710005 - DNA, 13 bp, C. elegans
caatattcaataa

SEQ ID NO: 710006 - DNA, 13 bp, C. elegans
caatattcaatat

SEQ ID NO: 710007 - DNA, 13 bp, C. elegans
caatattcaattt

SEQ ID NO: 710008 - DNA, 13 bp, C. elegans
caatattcataaa

SEQ ID NO: 710009 - DNA, 13 bp, C. elegans
caatattctattc

SEQ ID NO: 710010 - DNA, 13 bp, C. elegans
caatatttatgaa

SEQ ID NO: 710011 - DNA, 13 bp, C. elegans
caatatttatttg

SEQ ID NO: 710012 - DNA, 13 bp, C. elegans
caatatttccaat

SEQ ID NO: 710013 - DNA, 13 bp, C. elegans
caatatttcgaaa

SEQ ID NO: 710014 - DNA, 13 bp, C. elegans
caatatttctatt

SEQ ID NO: 710015 - DNA, 13 bp, C. elegans
caatatttctcaa

SEQ ID NO: 710016 - DNA, 13 bp, C. elegans
caatatttctgaa

SEQ ID NO: 710017 - DNA, 13 bp, C. elegans
caatattttgcag

SEQ ID NO: 710018 - DNA, 13 bp, C. elegans
caatattttgtat

SEQ ID NO: 710019 - DNA, 13 bp, C. elegans
caatatttttgaa

SEQ ID NO: 710020 - DNA, 13 bp, C. elegans
caatattttttca

SEQ ID NO: 710021 - DNA, 13 bp, C. elegans
caatcaaaaagca

SEQ ID NO: 710022 - DNA, 13 bp, C. elegans
caatcaaaactca

SEQ ID NO: 710023 - DNA, 13 bp, C. elegans
caatcaacaattt

SEQ ID NO: 710024 - DNA, 13 bp, C. elegans
caatcaacgaaat

SEQ ID NO: 710025 - DNA, 13 bp, C. elegans
caatcaataattt

SEQ ID NO: 710026 - DNA, 13 bp, C. elegans
caatcaatttcaa

SEQ ID NO: 710027 - DNA, 13 bp, C. elegans
caatcactcaaaa

SEQ ID NO: 710028 - DNA, 13 bp, C. elegans
caatcagaagacc

SEQ ID NO: 710029 - DNA, 13 bp, C. elegans
caatcagtttttg

SEQ ID NO: 710030 - DNA, 13 bp, C. elegans
caatcattcaaaa

SEQ ID NO: 710031 - DNA, 13 bp, C. elegans
caatcatttgaaa

SEQ ID NO: 710032 - DNA, 13 bp, C. elegans
caatcgcaaactt

SEQ ID NO: 710033 - DNA, 13 bp, C. elegans
caatcgcccgccg

SEQ ID NO: 710034 - DNA, 13 bp, C. elegans
caatcgcgctcca

SEQ ID NO: 710035 - DNA, 13 bp, C. elegans
caatcgcgctcta

SEQ ID NO: 710036 - DNA, 13 bp, C. elegans
caatctcacgtga

SEQ ID NO: 710037 - DNA, 13 bp, C. elegans
caatctgccggaa

SEQ ID NO: 710038 - DNA, 13 bp, C. elegans
caatctttatgaa

SEQ ID NO: 710039 - DNA, 13 bp, C. elegans
caatctttcaaaa

SEQ ID NO: 710040 - DNA, 13 bp, C. elegans
caatgaaaaaatg

SEQ ID NO: 710041 - DNA, 13 bp, C. elegans
caatgaaaattga

SEQ ID NO: 710042 - DNA, 13 bp, C. elegans
caatgaaatattt

SEQ ID NO: 710043 - DNA, 13 bp, C. elegans
caatgaaattatc

SEQ ID NO: 710044 - DNA, 13 bp, C. elegans
caatgaaattgtg

SEQ ID NO: 710045 - DNA, 13 bp, C. elegans
caatgaaatttaa

SEQ ID NO: 710046 - DNA, 13 bp, C. elegans
caatgaacaatat

SEQ ID NO: 710047 - DNA, 13 bp, C. elegans
caatgagcaaaag

SEQ ID NO: 710048 - DNA, 13 bp, C. elegans
caatgaggaagac

SEQ ID NO: 710049 - DNA, 13 bp, C. elegans
caatgatcttttg

SEQ ID NO: 710050 - DNA, 13 bp, C. elegans
caatgatgatgat

SEQ ID NO: 710051 - DNA, 14 bp, C. elegans
caatgattcaaaaa

SEQ ID NO: 710052 - DNA, 13 bp, C. elegans
caatgatttcaaa

SEQ ID NO: 710053 - DNA, 13 bp, C. elegans
caatgattttcaa

SEQ ID NO: 710054 - DNA, 13 bp, C. elegans
caatgattttgga

SEQ ID NO: 710055 - DNA, 13 bp, C. elegans
caatgcaccatat

SEQ ID NO: 710056 - DNA, 13 bp, C. elegans
caatgctcgaaat

SEQ ID NO: 710057 - DNA, 13 bp, C. elegans
caatggaaaaatc

SEQ ID NO: 710058 - DNA, 13 bp, C. elegans
caatggaattttc

SEQ ID NO: 710059 - DNA, 16 bp, C. elegans
caatggagcgcgaaaa

SEQ ID NO: 710060 - DNA, 13 bp, C. elegans
caatgggaaaaca

SEQ ID NO: 710061 - DNA, 13 bp, C. elegans
caatggtctcgcc

SEQ ID NO: 710062 - DNA, 13 bp, C. elegans
caatggtgttttt

SEQ ID NO: 710063 - DNA, 13 bp, C. elegans
caatgtaaaatga

SEQ ID NO: 710064 - DNA, 13 bp, C. elegans
caatgtattgaca

SEQ ID NO: 710065 - DNA, 13 bp, C. elegans
caatgtcaaaaat

SEQ ID NO: 710066 - DNA, 13 bp, C. elegans
caatgtcattttt

SEQ ID NO: 710067 - DNA, 13 bp, C. elegans
caatgtgaaacaa

SEQ ID NO: 710068 - DNA, 13 bp, C. elegans
caatgtgccgatt

SEQ ID NO: 710069 - DNA, 13 bp, C. elegans
caatgtgccggaa

SEQ ID NO: 710070 - DNA, 13 bp, C. elegans
caatgtgcgcatt

SEQ ID NO: 710071 - DNA, 13 bp, C. elegans
caatgttcaattt

SEQ ID NO: 710072 - DNA, 13 bp, C. elegans
caatgttcagaaa

SEQ ID NO: 710073 - DNA, 13 bp, C. elegans
caatgttcgattt

SEQ ID NO: 710074 - DNA, 13 bp, C. elegans
caatgtttatttt

SEQ ID NO: 710075 - DNA, 13 bp, C. elegans
caatgtttgaata

SEQ ID NO: 710076 - DNA, 13 bp, C. elegans
caatgttttatat

SEQ ID NO: 710077 - DNA, 13 bp, C. elegans
caatgttttatca

SEQ ID NO: 710078 - DNA, 13 bp, C. elegans
caatgttttccaa

SEQ ID NO: 710079 - DNA, 13 bp, C. elegans
caatgttttgtaa

SEQ ID NO: 710080 - DNA, 13 bp, C. elegans
caatgtttttaca

SEQ ID NO: 710081 - DNA, 13 bp, C. elegans
caattaaaacatt

SEQ ID NO: 710082 - DNA, 13 bp, C. elegans
caattaaaatgaa

SEQ ID NO: 710083 - DNA, 13 bp, C. elegans
caattaaaattga

SEQ ID NO: 710084 - DNA, 13 bp, C. elegans
caattaaagcaaa

SEQ ID NO: 710085 - DNA, 13 bp, C. elegans
caattaacaaatt

SEQ ID NO: 710086 - DNA, 13 bp, C. elegans
caattaacaattt

SEQ ID NO: 710087 - DNA, 13 bp, C. elegans
caattaatcattt

SEQ ID NO: 710088 - DNA, 13 bp, C. elegans
caattaatttctt

SEQ ID NO: 710089 - DNA, 13 bp, C. elegans
caattaattttga

SEQ ID NO: 710090 - DNA, 13 bp, C. elegans
caattaccgtatt

SEQ ID NO: 710091 - DNA, 13 bp, C. elegans
caattacggcaat

SEQ ID NO: 710092 - DNA, 13 bp, C. elegans
caattactatttt

SEQ ID NO: 710093 - DNA, 13 bp, C. elegans
caattactcaatt

SEQ ID NO: 710094 - DNA, 13 bp, C. elegans
caattactcattt

SEQ ID NO: 710095 - DNA, 13 bp, C. elegans
caattacttttta

SEQ ID NO: 710096 - DNA, 13 bp, C. elegans
caattatatttca

SEQ ID NO: 710097 - DNA, 13 bp, C. elegans
caattatcacttt

SEQ ID NO: 710098 - DNA, 13 bp, C. elegans
caattatcagaaa

SEQ ID NO: 710099 - DNA, 13 bp, C. elegans
caattatcgattt

SEQ ID NO: 710100 - DNA, 13 bp, C. elegans
caattattatttg

SEQ ID NO: 710101 - DNA, 13 bp, C. elegans
caattattcaaaa

SEQ ID NO: 710102 - DNA, 13 bp, C. elegans
caattattcaaat

SEQ ID NO: 710103 - DNA, 13 bp, C. elegans
caattattcagaa

SEQ ID NO: 710104 - DNA, 13 bp, C. elegans
caattattctgaa

SEQ ID NO: 710105 - DNA, 13 bp, C. elegans
caattattgaatt

SEQ ID NO: 710106 - DNA, 13 bp, C. elegans
caattattgtatt

SEQ ID NO: 710107 - DNA, 13 bp, C. elegans
caattatttattg

SEQ ID NO: 710108 - DNA, 13 bp, C. elegans
caattatttccaa

SEQ ID NO: 710109 - DNA, 13 bp, C. elegans
caattatttctga

SEQ ID NO: 710110 - DNA, 13 bp, C. elegans
caattatttgtaa

SEQ ID NO: 710111 - DNA, 13 bp, C. elegans
caattatttgttt

SEQ ID NO: 710112 - DNA, 13 bp, C. elegans
caattattttgaa

SEQ ID NO: 710113 - DNA, 13 bp, C. elegans
caattatttttac

SEQ ID NO: 710114 - DNA, 13 bp, C. elegans
caattatttttga

SEQ ID NO: 710115 - DNA, 13 bp, C. elegans
caattcaaacaat

SEQ ID NO: 710116 - DNA, 13 bp, C. elegans
caattcaaacatt

SEQ ID NO: 710117 - DNA, 13 bp, C. elegans
caattcaatgttt

SEQ ID NO: 710118 - DNA, 13 bp, C. elegans
caattcaattgtt

SEQ ID NO: 710119 - DNA, 13 bp, C. elegans
caattcacttttt

SEQ ID NO: 710120 - DNA, 13 bp, C. elegans
caattcatatttt

SEQ ID NO: 710121 - DNA, 13 bp, C. elegans
caattcatgaaaa

SEQ ID NO: 710122 - DNA, 13 bp, C. elegans
caattcatttcta

SEQ ID NO: 710123 - DNA, 13 bp, C. elegans
caattcatttctt

SEQ ID NO: 710124 - DNA, 13 bp, C. elegans
caattcattttaa

SEQ ID NO: 710125 - DNA, 13 bp, C. elegans
caattcatttttc

SEQ ID NO: 710126 - DNA, 13 bp, C. elegans
caattccaattgt

SEQ ID NO: 710127 - DNA, 13 bp, C. elegans
caattccatcaat

SEQ ID NO: 710128 - DNA, 13 bp, C. elegans
caattccatcttt

SEQ ID NO: 710129 - DNA, 13 bp, C. elegans
caattccattttt

SEQ ID NO: 710130 - DNA, 13 bp, C. elegans
caattcccgtttc

SEQ ID NO: 710131 - DNA, 13 bp, C. elegans
caattccgacaaa

SEQ ID NO: 710132 - DNA, 13 bp, C. elegans
caattccggaaaa

SEQ ID NO: 710133 - DNA, 13 bp, C. elegans
caattcctgcaat

SEQ ID NO: 710134 - DNA, 13 bp, C. elegans
caattcgaagaaa

SEQ ID NO: 710135 - DNA, 13 bp, C. elegans
caattcgacaaat

SEQ ID NO: 710136 - DNA, 13 bp, C. elegans
caattcgccaatt

SEQ ID NO: 710137 - DNA, 13 bp, C. elegans
caattcgccgaaa

SEQ ID NO: 710138 - DNA, 13 bp, C. elegans
caattcgccgatt

SEQ ID NO: 710139 - DNA, 13 bp, C. elegans
caattctagaaaa

SEQ ID NO: 710140 - DNA, 13 bp, C. elegans
caattctagtgta

SEQ ID NO: 710141 - DNA, 13 bp, C. elegans
caattctcgaaaa

SEQ ID NO: 710142 - DNA, 13 bp, C. elegans
caattctcgaaat

SEQ ID NO: 710143 - DNA, 13 bp, C. elegans
caattctgaaaaa

SEQ ID NO: 710144 - DNA, 13 bp, C. elegans
caattctggcaaa

SEQ ID NO: 710145 - DNA, 13 bp, C. elegans
caattcttcaaaa

SEQ ID NO: 710146 - DNA, 13 bp, C. elegans
caattcttcaatt

SEQ ID NO: 710147 - DNA, 13 bp, C. elegans
caattcttcattt

SEQ ID NO: 710148 - DNA, 13 bp, C. elegans
caattcttttaaa

SEQ ID NO: 710149 - DNA, 13 bp, C. elegans
caattgaaaatgt

SEQ ID NO: 710150 - DNA, 13 bp, C. elegans
caattgaaacaat

SEQ ID NO: 710151 - DNA, 13 bp, C. elegans
caattgaaacact

SEQ ID NO: 710152 - DNA, 13 bp, C. elegans
caattgaaacatt

SEQ ID NO: 710153 - DNA, 14 bp, C. elegans
caattgaaactcca

SEQ ID NO: 710154 - DNA, 13 bp, C. elegans
caattgaaagctg

SEQ ID NO: 710155 - DNA, 13 bp, C. elegans
caattgaacaatt

SEQ ID NO: 710156 - DNA, 13 bp, C. elegans
caattgaatatat

SEQ ID NO: 710157 - DNA, 13 bp, C. elegans
caattgaatattc

SEQ ID NO: 710158 - DNA, 13 bp, C. elegans
caattgacaaaat

SEQ ID NO: 710159 - DNA, 13 bp, C. elegans
caattgacagttt

SEQ ID NO: 710160 - DNA, 13 bp, C. elegans
caattgacgaaat

SEQ ID NO: 710161 - DNA, 13 bp, C. elegans
caattgatggaaa

SEQ ID NO: 710162 - DNA, 13 bp, C. elegans
caattgattttgc

SEQ ID NO: 710163 - DNA, 13 bp, C. elegans
caattgcaaaaaa

SEQ ID NO: 710164 - DNA, 13 bp, C. elegans
caattgcagaaat

SEQ ID NO: 710165 - DNA, 13 bp, C. elegans
caattgcagttcg

SEQ ID NO: 710166 - DNA, 13 bp, C. elegans
caattgccagaat

SEQ ID NO: 710167 - DNA, 13 bp, C. elegans
caattgccgaaaa

SEQ ID NO: 710168 - DNA, 13 bp, C. elegans
caattgccgattt

SEQ ID NO: 710169 - DNA, 13 bp, C. elegans
caattgctgaaaa

SEQ ID NO: 710170 - DNA, 13 bp, C. elegans
caattgctgaaat

SEQ ID NO: 710171 - DNA, 13 bp, C. elegans
caattggaaaagt

SEQ ID NO: 710172 - DNA, 13 bp, C. elegans
caattgggaaatt

SEQ ID NO: 710173 - DNA, 13 bp, C. elegans
caattgtaaaatt

SEQ ID NO: 710174 - DNA, 13 bp, C. elegans
caattgtagtttg

SEQ ID NO: 710175 - DNA, 13 bp, C. elegans
caattgtatttta

SEQ ID NO: 710176 - DNA, 13 bp, C. elegans
caattgtcaaaaa

SEQ ID NO: 710177 - DNA, 13 bp, C. elegans
caattgtcgaaat

SEQ ID NO: 710178 - DNA, 13 bp, C. elegans
caattgtgttttg

SEQ ID NO: 710179 - DNA, 13 bp, C. elegans
caattgttaaaaa

SEQ ID NO: 710180 - DNA, 13 bp, C. elegans
caattgttgaaat

SEQ ID NO: 710181 - DNA, 13 bp, C. elegans
caattgttgaatt

SEQ ID NO: 710182 - DNA, 13 bp, C. elegans
caattgtttcaat

SEQ ID NO: 710183 - DNA, 13 bp, C. elegans
caattgtttcagc

SEQ ID NO: 710184 - DNA, 13 bp, C. elegans
caattgtttccat

SEQ ID NO: 710185 - DNA, 13 bp, C. elegans
caattgtttgaat

SEQ ID NO: 710186 - DNA, 13 bp, C. elegans
caattgtttgatt

SEQ ID NO: 710187 - DNA, 13 bp, C. elegans
caattgttttcaa

SEQ ID NO: 710188 - DNA, 13 bp, C. elegans
caattgtttttaa

SEQ ID NO: 710189 - DNA, 13 bp, C. elegans
caatttaatttga

SEQ ID NO: 710190 - DNA, 13 bp, C. elegans
caatttacagaaa

SEQ ID NO: 710191 - DNA, 13 bp, C. elegans
caatttaccagaa

SEQ ID NO: 710192 - DNA, 13 bp, C. elegans
caatttaccagtt

SEQ ID NO: 710193 - DNA, 13 bp, C. elegans
caatttacgaaaa

SEQ ID NO: 710194 - DNA, 13 bp, C. elegans
caatttactttta

SEQ ID NO: 710195 - DNA, 13 bp, C. elegans
caatttagaaaaa

SEQ ID NO: 710196 - DNA, 13 bp, C. elegans
caatttatataca

SEQ ID NO: 710197 - DNA, 13 bp, C. elegans
caatttatcgatt

SEQ ID NO: 710198 - DNA, 13 bp, C. elegans
caatttatcttat

SEQ ID NO: 710199 - DNA, 13 bp, C. elegans
caatttatgcaaa

SEQ ID NO: 710200 - DNA, 13 bp, C. elegans
caatttattcaac

SEQ ID NO: 710201 - DNA, 13 bp, C. elegans
caatttattcact

SEQ ID NO: 710202 - DNA, 13 bp, C. elegans
caatttattgcaa

SEQ ID NO: 710203 - DNA, 13 bp, C. elegans
caatttattgtta

SEQ ID NO: 710204 - DNA, 13 bp, C. elegans
caatttatttcag

SEQ ID NO: 710205 - DNA, 13 bp, C. elegans
caatttatttgtt

SEQ ID NO: 710206 - DNA, 13 bp, C. elegans
caatttcaaaaat

SEQ ID NO: 710207 - DNA, 13 bp, C. elegans
caatttcaaagca

SEQ ID NO: 710208 - DNA, 13 bp, C. elegans
caatttcaaatga

SEQ ID NO: 710209 - DNA, 13 bp, C. elegans
caatttcaaatgg

SEQ ID NO: 710210 - DNA, 13 bp, C. elegans
caatttcaacaaa

SEQ ID NO: 710211 - DNA, 13 bp, C. elegans
caatttcaacaac

SEQ ID NO: 710212 - DNA, 13 bp, C. elegans
caatttcaacatt

SEQ ID NO: 710213 - DNA, 13 bp, C. elegans
caatttcaattcc

SEQ ID NO: 710214 - DNA, 13 bp, C. elegans
caatttcaatttc

SEQ ID NO: 710215 - DNA, 13 bp, C. elegans
caatttcaatttt

SEQ ID NO: 710216 - DNA, 13 bp, C. elegans
caatttcatattt

SEQ ID NO: 710217 - DNA, 13 bp, C. elegans
caatttcatgaat

SEQ ID NO: 710218 - DNA, 13 bp, C. elegans
caatttcattgaa

SEQ ID NO: 710219 - DNA, 13 bp, C. elegans
caatttccaacac

SEQ ID NO: 710220 - DNA, 13 bp, C. elegans
caatttccaagtg

SEQ ID NO: 710221 - DNA, 13 bp, C. elegans
caatttccaatat

SEQ ID NO: 710222 - DNA, 13 bp, C. elegans
caatttccacaaa

SEQ ID NO: 710223 - DNA, 13 bp, C. elegans
caatttccacttt

SEQ ID NO: 710224 - DNA, 13 bp, C. elegans
caatttccagaaa

SEQ ID NO: 710225 - DNA, 13 bp, C. elegans
caatttccagcaa

SEQ ID NO: 710226 - DNA, 13 bp, C. elegans
caatttccccatt

SEQ ID NO: 710227 - DNA, 13 bp, C. elegans
caatttcccgatt

SEQ ID NO: 710228 - DNA, 13 bp, C. elegans
caatttcccttcc

SEQ ID NO: 710229 - DNA, 13 bp, C. elegans
caatttccggatt

SEQ ID NO: 710230 - DNA, 13 bp, C. elegans
caatttccgtttt

SEQ ID NO: 710231 - DNA, 13 bp, C. elegans
caatttcctaaaa

SEQ ID NO: 710232 - DNA, 13 bp, C. elegans
caatttcctattt

SEQ ID NO: 710233 - DNA, 13 bp, C. elegans
caatttcctgtca

SEQ ID NO: 710234 - DNA, 13 bp, C. elegans
caatttccttgtt

SEQ ID NO: 710235 - DNA, 13 bp, C. elegans
caatttcgacatt

SEQ ID NO: 710236 - DNA, 13 bp, C. elegans
caatttcgttttt

SEQ ID NO: 710237 - DNA, 13 bp, C. elegans
caatttctaattt

SEQ ID NO: 710238 - DNA, 13 bp, C. elegans
caatttctacttt

SEQ ID NO: 710239 - DNA, 13 bp, C. elegans
caatttctatgaa

SEQ ID NO: 710240 - DNA, 13 bp, C. elegans
caatttctcaaaa

SEQ ID NO: 710241 - DNA, 13 bp, C. elegans
caatttctcaaat

SEQ ID NO: 710242 - DNA, 13 bp, C. elegans
caatttctcgaat

SEQ ID NO: 710243 - DNA, 13 bp, C. elegans
caatttctcgatt

SEQ ID NO: 710244 - DNA, 13 bp, C. elegans
caatttctctcaa

SEQ ID NO: 710245 - DNA, 13 bp, C. elegans
caatttctcttca

SEQ ID NO: 710246 - DNA, 13 bp, C. elegans
caatttctgaagg

SEQ ID NO: 710247 - DNA, 13 bp, C. elegans
caatttctgatat

SEQ ID NO: 710248 - DNA, 13 bp, C. elegans
caatttctgcaat

SEQ ID NO: 710249 - DNA, 13 bp, C. elegans
caatttcttaaaa

SEQ ID NO: 710250 - DNA, 13 bp, C. elegans
caatttcttcatt

SEQ ID NO: 710251 - DNA, 14 bp, C. elegans
caatttctttcaaa

SEQ ID NO: 710252 - DNA, 13 bp, C. elegans
caatttgaaaacc

SEQ ID NO: 710253 - DNA, 13 bp, C. elegans
caatttgaaaata

SEQ ID NO: 710254 - DNA, 13 bp, C. elegans
caatttgaaacag

SEQ ID NO: 710255 - DNA, 13 bp, C. elegans
caatttgaaacat

SEQ ID NO: 710256 - DNA, 13 bp, C. elegans
caatttgaaactt

SEQ ID NO: 710257 - DNA, 13 bp, C. elegans
caatttgaaagtt

SEQ ID NO: 710258 - DNA, 13 bp, C. elegans
caatttgaaattt

SEQ ID NO: 710259 - DNA, 13 bp, C. elegans
caatttgaacttt

SEQ ID NO: 710260 - DNA, 13 bp, C. elegans
caatttgaatatt

SEQ ID NO: 710261 - DNA, 13 bp, C. elegans
caatttgacaata

SEQ ID NO: 710262 - DNA, 13 bp, C. elegans
caatttgacaatt

SEQ ID NO: 710263 - DNA, 13 bp, C. elegans
caatttgagaaaa

SEQ ID NO: 710264 - DNA, 13 bp, C. elegans
caatttgatcaaa

SEQ ID NO: 710265 - DNA, 13 bp, C. elegans
caatttgatctac

SEQ ID NO: 710266 - DNA, 13 bp, C. elegans
caatttgatggaa

SEQ ID NO: 710267 - DNA, 13 bp, C. elegans
caatttgcatttt

SEQ ID NO: 710268 - DNA, 13 bp, C. elegans
caatttgccaaaa

SEQ ID NO: 710269 - DNA, 13 bp, C. elegans
caatttgccaatt

SEQ ID NO: 710270 - DNA, 13 bp, C. elegans
caatttgccagaa

SEQ ID NO: 710271 - DNA, 13 bp, C. elegans
caatttgccattt

SEQ ID NO: 710272 - DNA, 14 bp, C. elegans
caatttgcccattt

SEQ ID NO: 710273 - DNA, 13 bp, C. elegans
caatttgcccgtt

SEQ ID NO: 710274 - DNA, 13 bp, C. elegans
caatttgccgaac

SEQ ID NO: 710275 - DNA, 13 bp, C. elegans
caatttgctaatt

SEQ ID NO: 710276 - DNA, 13 bp, C. elegans
caatttggaaaaa

SEQ ID NO: 710277 - DNA, 13 bp, C. elegans
caatttggaaatt

SEQ ID NO: 710278 - DNA, 13 bp, C. elegans
caatttgtcaaaa

SEQ ID NO: 710279 - DNA, 13 bp, C. elegans
caatttgtcaatt

SEQ ID NO: 710280 - DNA, 13 bp, C. elegans
caatttgtcagtt

SEQ ID NO: 710281 - DNA, 13 bp, C. elegans
caatttgtcgaaa

SEQ ID NO: 710282 - DNA, 13 bp, C. elegans
caatttgtcgtca

SEQ ID NO: 710283 - DNA, 13 bp, C. elegans
caatttgtgaatt

SEQ ID NO: 710284 - DNA, 13 bp, C. elegans
caatttgtgatga

SEQ ID NO: 710285 - DNA, 13 bp, C. elegans
caatttgtgcaaa

SEQ ID NO: 710286 - DNA, 13 bp, C. elegans
caatttgtgcaat

SEQ ID NO: 710287 - DNA, 13 bp, C. elegans
caatttgtgcgca

SEQ ID NO: 710288 - DNA, 13 bp, C. elegans
caatttgttattt

SEQ ID NO: 710289 - DNA, 13 bp, C. elegans
caatttgttgaaa

SEQ ID NO: 710290 - DNA, 13 bp, C. elegans
caatttgtttcca

SEQ ID NO: 710291 - DNA, 13 bp, C. elegans
caattttaaagtt

SEQ ID NO: 710292 - DNA, 13 bp, C. elegans
caattttaacaat

SEQ ID NO: 710293 - DNA, 13 bp, C. elegans
caattttaagaat

SEQ ID NO: 710294 - DNA, 13 bp, C. elegans
caattttaagtga

SEQ ID NO: 710295 - DNA, 13 bp, C. elegans
caattttaataac

SEQ ID NO: 710296 - DNA, 13 bp, C. elegans
caattttaattca

SEQ ID NO: 710297 - DNA, 13 bp, C. elegans
caattttacaaaa

SEQ ID NO: 710298 - DNA, 13 bp, C. elegans
caattttacagaa

SEQ ID NO: 710299 - DNA, 13 bp, C. elegans
caattttacattt

SEQ ID NO: 710300 - DNA, 13 bp, C. elegans
caattttagaaca

SEQ ID NO: 710301 - DNA, 13 bp, C. elegans
caattttagaatt

SEQ ID NO: 710302 - DNA, 13 bp, C. elegans
caattttagctga

SEQ ID NO: 710303 - DNA, 13 bp, C. elegans
caattttatacaa

SEQ ID NO: 710304 - DNA, 13 bp, C. elegans
caattttatcaca

SEQ ID NO: 710305 - DNA, 13 bp, C. elegans
caattttatcatc

SEQ ID NO: 710306 - DNA, 13 bp, C. elegans
caattttattcaa

SEQ ID NO: 710307 - DNA, 13 bp, C. elegans
caattttattcat

SEQ ID NO: 710308 - DNA, 13 bp, C. elegans
caattttattcga

SEQ ID NO: 710309 - DNA, 13 bp, C. elegans
caattttattgat

SEQ ID NO: 710310 - DNA, 13 bp, C. elegans
caattttcaaact

SEQ ID NO: 710311 - DNA, 13 bp, C. elegans
caattttcaacta

SEQ ID NO: 710312 - DNA, 13 bp, C. elegans
caattttcaactt

SEQ ID NO: 710313 - DNA, 13 bp, C. elegans
caattttcaagaa

SEQ ID NO: 710314 - DNA, 13 bp, C. elegans
caattttcaataa

SEQ ID NO: 710315 - DNA, 13 bp, C. elegans
caattttcaatat

SEQ ID NO: 710316 - DNA, 13 bp, C. elegans
caattttcaatcg

SEQ ID NO: 710317 - DNA, 13 bp, C. elegans
caattttcaattt

SEQ ID NO: 710318 - DNA, 13 bp, C. elegans
caattttcacaaa

SEQ ID NO: 710319 - DNA, 13 bp, C. elegans
caattttcacatt

SEQ ID NO: 710320 - DNA, 13 bp, C. elegans
caattttcacttt

SEQ ID NO: 710321 - DNA, 13 bp, C. elegans
caattttcagaaa

SEQ ID NO: 710322 - DNA, 13 bp, C. elegans
caattttcagaga

SEQ ID NO: 710323 - DNA, 13 bp, C. elegans
caattttcatata

SEQ ID NO: 710324 - DNA, 13 bp, C. elegans
caattttcatatt

SEQ ID NO: 710325 - DNA, 13 bp, C. elegans
caattttcatcaa

SEQ ID NO: 710326 - DNA, 13 bp, C. elegans
caattttcatgtt

SEQ ID NO: 710327 - DNA, 13 bp, C. elegans
caattttcattaa

SEQ ID NO: 710328 - DNA, 13 bp, C. elegans
caattttcattga

SEQ ID NO: 710329 - DNA, 13 bp, C. elegans
caattttccaact

SEQ ID NO: 710330 - DNA, 13 bp, C. elegans
caattttccaatt

SEQ ID NO: 710331 - DNA, 13 bp, C. elegans
caattttccagaa

SEQ ID NO: 710332 - DNA, 13 bp, C. elegans
caattttccatca

SEQ ID NO: 710333 - DNA, 13 bp, C. elegans
caattttcccatt

SEQ ID NO: 710334 - DNA, 13 bp, C. elegans
caattttccgaaa

SEQ ID NO: 710335 - DNA, 13 bp, C. elegans
caattttccgcca

SEQ ID NO: 710336 - DNA, 13 bp, C. elegans
caattttcctcat

SEQ ID NO: 710337 - DNA, 13 bp, C. elegans
caattttcctgaa

SEQ ID NO: 710338 - DNA, 13 bp, C. elegans
caattttcgagtt

SEQ ID NO: 710339 - DNA, 13 bp, C. elegans
caattttcgattt

SEQ ID NO: 710340 - DNA, 13 bp, C. elegans
caattttcgcaat

SEQ ID NO: 710341 - DNA, 13 bp, C. elegans
caattttcgcatt

SEQ ID NO: 710342 - DNA, 13 bp, C. elegans
caattttcggaat

SEQ ID NO: 710343 - DNA, 13 bp, C. elegans
caattttctaaat

SEQ ID NO: 710344 - DNA, 13 bp, C. elegans
caattttctagct

SEQ ID NO: 710345 - DNA, 13 bp, C. elegans
caattttctattc

SEQ ID NO: 710346 - DNA, 13 bp, C. elegans
caattttctcaaa

SEQ ID NO: 710347 - DNA, 13 bp, C. elegans
caattttctcaca

SEQ ID NO: 710348 - DNA, 13 bp, C. elegans
caattttctcatt

SEQ ID NO: 710349 - DNA, 13 bp, C. elegans
caattttctctgt

SEQ ID NO: 710350 - DNA, 13 bp, C. elegans
caattttctgttt

SEQ ID NO: 710351 - DNA, 13 bp, C. elegans
caattttcttata

SEQ ID NO: 710352 - DNA, 13 bp, C. elegans
caattttcttcaa

SEQ ID NO: 710353 - DNA, 13 bp, C. elegans
caattttcttgaa

SEQ ID NO: 710354 - DNA, 13 bp, C. elegans
caattttcttgtt

SEQ ID NO: 710355 - DNA, 13 bp, C. elegans
caattttctttgt

SEQ ID NO: 710356 - DNA, 13 bp, C. elegans
caattttgaacaa

SEQ ID NO: 710357 - DNA, 13 bp, C. elegans
caattttgaagca

SEQ ID NO: 710358 - DNA, 13 bp, C. elegans
caattttgaatga

SEQ ID NO: 710359 - DNA, 13 bp, C. elegans
caattttgaatgt

SEQ ID NO: 710360 - DNA, 13 bp, C. elegans
caattttgaattt

SEQ ID NO: 710361 - DNA, 13 bp, C. elegans
caattttgataat

SEQ ID NO: 710362 - DNA, 13 bp, C. elegans
caattttgatcat

SEQ ID NO: 710363 - DNA, 13 bp, C. elegans
caattttgatttt

SEQ ID NO: 710364 - DNA, 13 bp, C. elegans
caattttgcaatt

SEQ ID NO: 710365 - DNA, 13 bp, C. elegans
caattttgcagtt

SEQ ID NO: 710366 - DNA, 13 bp, C. elegans
caattttgcattt

SEQ ID NO: 710367 - DNA, 13 bp, C. elegans
caattttgccggt

SEQ ID NO: 710368 - DNA, 14 bp, C. elegans
caattttggaaaaa

SEQ ID NO: 710369 - DNA, 13 bp, C. elegans
caattttggagaa

SEQ ID NO: 710370 - DNA, 13 bp, C. elegans
caattttggagca

SEQ ID NO: 710371 - DNA, 13 bp, C. elegans
caattttggagct

SEQ ID NO: 710372 - DNA, 13 bp, C. elegans
caattttggataa

SEQ ID NO: 710373 - DNA, 13 bp, C. elegans
caattttggatgt

SEQ ID NO: 710374 - DNA, 13 bp, C. elegans
caattttggcaaa

SEQ ID NO: 710375 - DNA, 13 bp, C. elegans
caattttgtaaaa

SEQ ID NO: 710376 - DNA, 13 bp, C. elegans
caattttgtaatt

SEQ ID NO: 710377 - DNA, 13 bp, C. elegans
caattttgtgaat

SEQ ID NO: 710378 - DNA, 13 bp, C. elegans
caattttgtgcca

SEQ ID NO: 710379 - DNA, 13 bp, C. elegans
caattttgtgtca

SEQ ID NO: 710380 - DNA, 13 bp, C. elegans
caattttgtgttt

SEQ ID NO: 710381 - DNA, 13 bp, C. elegans
caattttgttcaa

SEQ ID NO: 710382 - DNA, 13 bp, C. elegans
caattttgtttat

SEQ ID NO: 710383 - DNA, 13 bp, C. elegans
caatttttaaagc

SEQ ID NO: 710384 - DNA, 13 bp, C. elegans
caatttttaatct

SEQ ID NO: 710385 - DNA, 13 bp, C. elegans
caatttttacatt

SEQ ID NO: 710386 - DNA, 13 bp, C. elegans
caatttttagttt

SEQ ID NO: 710387 - DNA, 13 bp, C. elegans
caatttttatgat

SEQ ID NO: 710388 - DNA, 13 bp, C. elegans
caatttttattga

SEQ ID NO: 710389 - DNA, 13 bp, C. elegans
caatttttatttg

SEQ ID NO: 710390 - DNA, 13 bp, C. elegans
caatttttcacta

SEQ ID NO: 710391 - DNA, 13 bp, C. elegans
caatttttcatag

SEQ ID NO: 710392 - DNA, 13 bp, C. elegans
caatttttccaat

SEQ ID NO: 710393 - DNA, 13 bp, C. elegans
caatttttccatt

SEQ ID NO: 710394 - DNA, 13 bp, C. elegans
caatttttcctca

SEQ ID NO: 710395 - DNA, 13 bp, C. elegans
caatttttcggtt

SEQ ID NO: 710396 - DNA, 13 bp, C. elegans
caatttttctcta

SEQ ID NO: 710397 - DNA, 13 bp, C. elegans
caatttttctgtt

SEQ ID NO: 710398 - DNA, 13 bp, C. elegans
caatttttgaagt

SEQ ID NO: 710399 - DNA, 13 bp, C. elegans
caatttttgaata

SEQ ID NO: 710400 - DNA, 13 bp, C. elegans
caatttttgaatg

SEQ ID NO: 710401 - DNA, 13 bp, C. elegans
caatttttgacta

SEQ ID NO: 710402 - DNA, 13 bp, C. elegans
caatttttgagga

SEQ ID NO: 710403 - DNA, 13 bp, C. elegans
caatttttgagtt

SEQ ID NO: 710404 - DNA, 13 bp, C. elegans
caatttttgataa

SEQ ID NO: 710405 - DNA, 13 bp, C. elegans
caatttttgatag

SEQ ID NO: 710406 - DNA, 13 bp, C. elegans
caatttttgattt

SEQ ID NO: 710407 - DNA, 13 bp, C. elegans
caatttttgcaaa

SEQ ID NO: 710408 - DNA, 13 bp, C. elegans
caatttttgcgta

SEQ ID NO: 710409 - DNA, 13 bp, C. elegans
caatttttggaaa

SEQ ID NO: 710410 - DNA, 13 bp, C. elegans
caatttttggcaa

SEQ ID NO: 710411 - DNA, 13 bp, C. elegans
caatttttggcgg

SEQ ID NO: 710412 - DNA, 13 bp, C. elegans
caatttttggttg

SEQ ID NO: 710413 - DNA, 13 bp, C. elegans
caatttttggttt

SEQ ID NO: 710414 - DNA, 13 bp, C. elegans
caatttttgtaaa

SEQ ID NO: 710415 - DNA, 13 bp, C. elegans
caatttttgtcat

SEQ ID NO: 710416 - DNA, 13 bp, C. elegans
caatttttgtcta

SEQ ID NO: 710417 - DNA, 13 bp, C. elegans
caatttttgtctt

SEQ ID NO: 710418 - DNA, 13 bp, C. elegans
caatttttgtgct

SEQ ID NO: 710419 - DNA, 13 bp, C. elegans
caatttttgttgg

SEQ ID NO: 710420 - DNA, 13 bp, C. elegans
caatttttgttta

SEQ ID NO: 710421 - DNA, 13 bp, C. elegans
caattttttaaag

SEQ ID NO: 710422 - DNA, 13 bp, C. elegans
caattttttacat

SEQ ID NO: 710423 - DNA, 13 bp, C. elegans
caattttttagtt

SEQ ID NO: 710424 - DNA, 13 bp, C. elegans
caattttttcata

SEQ ID NO: 710425 - DNA, 13 bp, C. elegans
caattttttccag

SEQ ID NO: 710426 - DNA, 13 bp, C. elegans
caattttttcggt

SEQ ID NO: 710427 - DNA, 13 bp, C. elegans
caattttttctga

SEQ ID NO: 710428 - DNA, 13 bp, C. elegans
caattttttctgc

SEQ ID NO: 710429 - DNA, 13 bp, C. elegans
caattttttgaat

SEQ ID NO: 710430 - DNA, 13 bp, C. elegans
caattttttgata

SEQ ID NO: 710431 - DNA, 13 bp, C. elegans
caattttttgatt

SEQ ID NO: 710432 - DNA, 13 bp, C. elegans
caattttttgcac

SEQ ID NO: 710433 - DNA, 13 bp, C. elegans
caattttttgctt

SEQ ID NO: 710434 - DNA, 13 bp, C. elegans
caattttttggaa

SEQ ID NO: 710435 - DNA, 13 bp, C. elegans
caattttttgtga

SEQ ID NO: 710436 - DNA, 13 bp, C. elegans
caattttttgttg

SEQ ID NO: 710437 - DNA, 13 bp, C. elegans
caatttttttcgg

SEQ ID NO: 710438 - DNA, 13 bp, C. elegans
caatttttttgag

SEQ ID NO: 710439 - DNA, 13 bp, C. elegans
caattttttttag

SEQ ID NO: 710440 - DNA, 13 bp, C. elegans
cacaaaaaaagtt

SEQ ID NO: 710441 - DNA, 13 bp, C. elegans
cacaaaaaatgta

SEQ ID NO: 710442 - DNA, 13 bp, C. elegans
cacaaaaactcga

SEQ ID NO: 710443 - DNA, 13 bp, C. elegans
cacaaaaagttga

SEQ ID NO: 710444 - DNA, 13 bp, C. elegans
cacaaaaatccat

SEQ ID NO: 710445 - DNA, 13 bp, C. elegans
cacaaaaatgatt

SEQ ID NO: 710446 - DNA, 13 bp, C. elegans
cacaaaaatgcaa

SEQ ID NO: 710447 - DNA, 13 bp, C. elegans
cacaaaaatgcca

SEQ ID NO: 710448 - DNA, 13 bp, C. elegans
cacaaaaatgcct

SEQ ID NO: 710449 - DNA, 13 bp, C. elegans
cacaaaaatgctc

SEQ ID NO: 710450 - DNA, 13 bp, C. elegans
cacaaaaattgaa

SEQ ID NO: 710451 - DNA, 13 bp, C. elegans
cacaaaaattgga

SEQ ID NO: 710452 - DNA, 13 bp, C. elegans
cacaaaactcaat

SEQ ID NO: 710453 - DNA, 13 bp, C. elegans
cacaaaactgttc

SEQ ID NO: 710454 - DNA, 13 bp, C. elegans
cacaaaacttttt

SEQ ID NO: 710455 - DNA, 13 bp, C. elegans
cacaaaagttcaa

SEQ ID NO: 710456 - DNA, 13 bp, C. elegans
cacaaaagtttca

SEQ ID NO: 710457 - DNA, 13 bp, C. elegans
cacaaaatattca

SEQ ID NO: 710458 - DNA, 13 bp, C. elegans
cacaaaatgatgt

SEQ ID NO: 710459 - DNA, 13 bp, C. elegans
cacaaaattcact

SEQ ID NO: 710460 - DNA, 13 bp, C. elegans
cacaaaattctaa

SEQ ID NO: 710461 - DNA, 13 bp, C. elegans
cacaaaattgatt

SEQ ID NO: 710462 - DNA, 13 bp, C. elegans
cacaaaatttcaa

SEQ ID NO: 710463 - DNA, 13 bp, C. elegans
cacaaaatttgca

SEQ ID NO: 710464 - DNA, 13 bp, C. elegans
cacaaaatttgct

SEQ ID NO: 710465 - DNA, 13 bp, C. elegans
cacaaaatttgta

SEQ ID NO: 710466 - DNA, 13 bp, C. elegans
cacaaaattttaa

SEQ ID NO: 710467 - DNA, 13 bp, C. elegans
cacaaaattttca

SEQ ID NO: 710468 - DNA, 13 bp, C. elegans
cacaaaattttct

SEQ ID NO: 710469 - DNA, 13 bp, C. elegans
cacaaaattttga

SEQ ID NO: 710470 - DNA, 13 bp, C. elegans
cacaaacattttt

SEQ ID NO: 710471 - DNA, 13 bp, C. elegans
cacaaactctact

SEQ ID NO: 710472 - DNA, 13 bp, C. elegans
cacaaactgtact

SEQ ID NO: 710473 - DNA, 13 bp, C. elegans
cacaaagagcaca

SEQ ID NO: 710474 - DNA, 13 bp, C. elegans
cacaaagctcaat

SEQ ID NO: 710475 - DNA, 13 bp, C. elegans
cacaaagttttta

SEQ ID NO: 710476 - DNA, 13 bp, C. elegans
cacaaataaaagt

SEQ ID NO: 710477 - DNA, 13 bp, C. elegans
cacaaatgaaatt

SEQ ID NO: 710478 - DNA, 13 bp, C. elegans
cacaaatgtatta

SEQ ID NO: 710479 - DNA, 13 bp, C. elegans
cacaaattctgaa

SEQ ID NO: 710480 - DNA, 13 bp, C. elegans
cacaaattgccaa

SEQ ID NO: 710481 - DNA, 13 bp, C. elegans
cacaaattggaac

SEQ ID NO: 710482 - DNA, 13 bp, C. elegans
cacaaatttatca

SEQ ID NO: 710483 - DNA, 13 bp, C. elegans
cacaaatttattc

SEQ ID NO: 710484 - DNA, 13 bp, C. elegans
cacaaatttgata

SEQ ID NO: 710485 - DNA, 13 bp, C. elegans
cacaaatttggaa

SEQ ID NO: 710486 - DNA, 13 bp, C. elegans
cacaaatttgttt

SEQ ID NO: 710487 - DNA, 13 bp, C. elegans
cacaaattttatt

SEQ ID NO: 710488 - DNA, 13 bp, C. elegans
cacaaatttttaa

SEQ ID NO: 710489 - DNA, 13 bp, C. elegans
cacaaatttttgt

SEQ ID NO: 710490 - DNA, 13 bp, C. elegans
cacaacaaaatga

SEQ ID NO: 710491 - DNA, 14 bp, C. elegans
cacaacacatgcca

SEQ ID NO: 710492 - DNA, 13 bp, C. elegans
cacaacatatttg

SEQ ID NO: 710493 - DNA, 13 bp, C. elegans
cacaacatttcta

SEQ ID NO: 710494 - DNA, 13 bp, C. elegans
cacaacattttta

SEQ ID NO: 710495 - DNA, 14 bp, C. elegans
cacaactggaatga

SEQ ID NO: 710496 - DNA, 13 bp, C. elegans
cacaacttttatt

SEQ ID NO: 710497 - DNA, 13 bp, C. elegans
cacaactttttca

SEQ ID NO: 710498 - DNA, 13 bp, C. elegans
cacaagaaaacat

SEQ ID NO: 710499 - DNA, 13 bp, C. elegans
cacaagttcaaaa

SEQ ID NO: 710500 - DNA, 13 bp, C. elegans
cacaataattttc

SEQ ID NO: 710501 - DNA, 13 bp, C. elegans
cacaatcagtttt

SEQ ID NO: 710502 - DNA, 13 bp, C. elegans
cacaattatcaaa

SEQ ID NO: 710503 - DNA, 13 bp, C. elegans
cacaattcaactt

SEQ ID NO: 710504 - DNA, 13 bp, C. elegans
cacaattcatttt

SEQ ID NO: 710505 - DNA, 13 bp, C. elegans
cacaattcttttt

SEQ ID NO: 710506 - DNA, 13 bp, C. elegans
cacaattgtttgt

SEQ ID NO: 710507 - DNA, 13 bp, C. elegans
cacaatttatcaa

SEQ ID NO: 710508 - DNA, 13 bp, C. elegans
cacaatttatttt

SEQ ID NO: 710509 - DNA, 13 bp, C. elegans
cacaatttcaatt

SEQ ID NO: 710510 - DNA, 13 bp, C. elegans
cacaatttccttt

SEQ ID NO: 710511 - DNA, 13 bp, C. elegans
cacaatttgccgt

SEQ ID NO: 710512 - DNA, 13 bp, C. elegans
cacaatttgtcct

SEQ ID NO: 710513 - DNA, 13 bp, C. elegans
cacaattttaaaa

SEQ ID NO: 710514 - DNA, 13 bp, C. elegans
cacaattttctgt

SEQ ID NO: 710515 - DNA, 13 bp, C. elegans
cacaattttcttg

SEQ ID NO: 710516 - DNA, 13 bp, C. elegans
cacaatttttatc

SEQ ID NO: 710517 - DNA, 13 bp, C. elegans
cacaatttttcat

SEQ ID NO: 710518 - DNA, 14 bp, C. elegans
cacaatttttccta

SEQ ID NO: 710519 - DNA, 13 bp, C. elegans
cacaatttttgga

SEQ ID NO: 710520 - DNA, 13 bp, C. elegans
cacaatttttgtg

SEQ ID NO: 710521 - DNA, 13 bp, C. elegans
cacacaaagctca

SEQ ID NO: 710522 - DNA, 13 bp, C. elegans
cacacaaatattc

SEQ ID NO: 710523 - DNA, 13 bp, C. elegans
cacacaatttcac

SEQ ID NO: 710524 - DNA, 13 bp, C. elegans
cacacaatttttt

SEQ ID NO: 710525 - DNA, 13 bp, C. elegans
cacacacaaattt

SEQ ID NO: 710526 - DNA, 13 bp, C. elegans
cacacacacaatt

SEQ ID NO: 710527 - DNA, 13 bp, C. elegans
cacacacacacgg

SEQ ID NO: 710528 - DNA, 13 bp, C. elegans
cacacacacactt

SEQ ID NO: 710529 - DNA, 13 bp, C. elegans
cacacacacatag

SEQ ID NO: 710530 - DNA, 13 bp, C. elegans
cacacacacatct

SEQ ID NO: 710531 - DNA, 13 bp, C. elegans
cacacacacattc

SEQ ID NO: 710532 - DNA, 13 bp, C. elegans
cacacacacattg

SEQ ID NO: 710533 - DNA, 13 bp, C. elegans
cacacacactctc

SEQ ID NO: 710534 - DNA, 13 bp, C. elegans
cacacacattttc

SEQ ID NO: 710535 - DNA, 13 bp, C. elegans
cacacaccttttt

SEQ ID NO: 710536 - DNA, 13 bp, C. elegans
cacacatacacat

SEQ ID NO: 710537 - DNA, 13 bp, C. elegans
cacacatacactt

SEQ ID NO: 710538 - DNA, 13 bp, C. elegans
cacacatacatac

SEQ ID NO: 710539 - DNA, 13 bp, C. elegans
cacacatcttttt

SEQ ID NO: 710540 - DNA, 13 bp, C. elegans
cacacattttcaa

SEQ ID NO: 710541 - DNA, 13 bp, C. elegans
cacacattttcca

SEQ ID NO: 710542 - DNA, 13 bp, C. elegans
cacaccaagctac

SEQ ID NO: 710543 - DNA, 13 bp, C. elegans
cacaccttttctt

SEQ ID NO: 710544 - DNA, 13 bp, C. elegans
cacacgaaaaacg

SEQ ID NO: 710545 - DNA, 13 bp, C. elegans
cacactatttctc

SEQ ID NO: 710546 - DNA, 13 bp, C. elegans
cacactatttttc

SEQ ID NO: 710547 - DNA, 13 bp, C. elegans
cacactctctcac

SEQ ID NO: 710548 - DNA, 13 bp, C. elegans
cacactctctcgc

SEQ ID NO: 710549 - DNA, 13 bp, C. elegans
cacactctctcgt

SEQ ID NO: 710550 - DNA, 13 bp, C. elegans
cacactctttttc

SEQ ID NO: 710551 - DNA, 13 bp, C. elegans
cacacttctcctc

SEQ ID NO: 710552 - DNA, 13 bp, C. elegans
cacactttatttt

SEQ ID NO: 710553 - DNA, 13 bp, C. elegans
cacacttttttga

SEQ ID NO: 710554 - DNA, 13 bp, C. elegans
cacagaacgaatg

SEQ ID NO: 710555 - DNA, 13 bp, C. elegans
cacagaataattt

SEQ ID NO: 710556 - DNA, 13 bp, C. elegans
cacagatttttaa

SEQ ID NO: 710557 - DNA, 13 bp, C. elegans
cacagtctcctca

SEQ ID NO: 710558 - DNA, 13 bp, C. elegans
cacagttttaatt

SEQ ID NO: 710559 - DNA, 13 bp, C. elegans
cacagttttcaag

SEQ ID NO: 710560 - DNA, 13 bp, C. elegans
cacataaatattc

SEQ ID NO: 710561 - DNA, 13 bp, C. elegans
cacataaatttta

SEQ ID NO: 710562 - DNA, 13 bp, C. elegans
cacataatttgat

SEQ ID NO: 710563 - DNA, 13 bp, C. elegans
cacataatttttt

SEQ ID NO: 710564 - DNA, 13 bp, C. elegans
cacatacacacat

SEQ ID NO: 710565 - DNA, 13 bp, C. elegans
cacatatatattt

SEQ ID NO: 710566 - DNA, 13 bp, C. elegans
cacatatgccaaa

SEQ ID NO: 710567 - DNA, 13 bp, C. elegans
cacatattttcga

SEQ ID NO: 710568 - DNA, 13 bp, C. elegans
cacatatttttga

SEQ ID NO: 710569 - DNA, 13 bp, C. elegans
cacatccatcttt

SEQ ID NO: 710570 - DNA, 13 bp, C. elegans
cacatcttcttct

SEQ ID NO: 710571 - DNA, 13 bp, C. elegans
cacattaattttg

SEQ ID NO: 710572 - DNA, 13 bp, C. elegans
cacattattcaaa

SEQ ID NO: 710573 - DNA, 13 bp, C. elegans
cacattcactttt

SEQ ID NO: 710574 - DNA, 13 bp, C. elegans
cacattgttttct

SEQ ID NO: 710575 - DNA, 13 bp, C. elegans
cacatttataaat

SEQ ID NO: 710576 - DNA, 13 bp, C. elegans
cacatttattgaa

SEQ ID NO: 710577 - DNA, 13 bp, C. elegans
cacatttatttta

SEQ ID NO: 710578 - DNA, 13 bp, C. elegans
cacatttcccatg

SEQ ID NO: 710579 - DNA, 13 bp, C. elegans
cacatttctctca

SEQ ID NO: 710580 - DNA, 13 bp, C. elegans
cacatttcttatt

SEQ ID NO: 710581 - DNA, 13 bp, C. elegans
cacatttgaactt

SEQ ID NO: 710582 - DNA, 13 bp, C. elegans
cacatttgaccac

SEQ ID NO: 710583 - DNA, 13 bp, C. elegans
cacatttggttta

SEQ ID NO: 710584 - DNA, 13 bp, C. elegans
cacatttgtcacc

SEQ ID NO: 710585 - DNA, 13 bp, C. elegans
cacattttattta

SEQ ID NO: 710586 - DNA, 13 bp, C. elegans
cacattttcaaaa

SEQ ID NO: 710587 - DNA, 13 bp, C. elegans
cacattttcaatc

SEQ ID NO: 710588 - DNA, 13 bp, C. elegans
cacattttcccaa

SEQ ID NO: 710589 - DNA, 13 bp, C. elegans
cacattttccttt

SEQ ID NO: 710590 - DNA, 13 bp, C. elegans
cacattttcgaaa

SEQ ID NO: 710591 - DNA, 13 bp, C. elegans
cacattttctagt

SEQ ID NO: 710592 - DNA, 13 bp, C. elegans
cacattttctgaa

SEQ ID NO: 710593 - DNA, 13 bp, C. elegans
cacattttcttat

SEQ ID NO: 710594 - DNA, 13 bp, C. elegans
cacattttgagat

SEQ ID NO: 710595 - DNA, 13 bp, C. elegans
cacattttgatat

SEQ ID NO: 710596 - DNA, 13 bp, C. elegans
cacattttggaat

SEQ ID NO: 710597 - DNA, 13 bp, C. elegans
cacattttggttt

SEQ ID NO: 710598 - DNA, 13 bp, C. elegans
cacatttttaaaa

SEQ ID NO: 710599 - DNA, 13 bp, C. elegans
cacatttttagca

SEQ ID NO: 710600 - DNA, 13 bp, C. elegans
cacatttttataa

SEQ ID NO: 710601 - DNA, 13 bp, C. elegans
cacatttttcatt

SEQ ID NO: 710602 - DNA, 13 bp, C. elegans
cacatttttccaa

SEQ ID NO: 710603 - DNA, 13 bp, C. elegans
cacatttttcgga

SEQ ID NO: 710604 - DNA, 13 bp, C. elegans
cacatttttctaa

SEQ ID NO: 710605 - DNA, 13 bp, C. elegans
cacatttttctca

SEQ ID NO: 710606 - DNA, 13 bp, C. elegans
cacatttttgaaa

SEQ ID NO: 710607 - DNA, 13 bp, C. elegans
cacatttttgaat

SEQ ID NO: 710608 - DNA, 13 bp, C. elegans
cacatttttgtga

SEQ ID NO: 710609 - DNA, 13 bp, C. elegans
cacattttttaat

SEQ ID NO: 710610 - DNA, 13 bp, C. elegans
cacattttttcat

SEQ ID NO: 710611 - DNA, 13 bp, C. elegans
cacattttttgat

SEQ ID NO: 710612 - DNA, 13 bp, C. elegans
cacattttttggc

SEQ ID NO: 710613 - DNA, 13 bp, C. elegans
cacattttttgtg

SEQ ID NO: 710614 - DNA, 13 bp, C. elegans
caccaaaaattgt

SEQ ID NO: 710615 - DNA, 13 bp, C. elegans
caccaaacttcaa

SEQ ID NO: 710616 - DNA, 13 bp, C. elegans
caccaaatttttt

SEQ ID NO: 710617 - DNA, 13 bp, C. elegans
caccaacttccaa

SEQ ID NO: 710618 - DNA, 13 bp, C. elegans
caccaactttaaa

SEQ ID NO: 710619 - DNA, 13 bp, C. elegans
caccaagtgaaaa

SEQ ID NO: 710620 - DNA, 13 bp, C. elegans
caccaattatttt

SEQ ID NO: 710621 - DNA, 13 bp, C. elegans
caccaatttgaaa

SEQ ID NO: 710622 - DNA, 13 bp, C. elegans
caccaattttctt

SEQ ID NO: 710623 - DNA, 13 bp, C. elegans
caccaatttttgt

SEQ ID NO: 710624 - DNA, 13 bp, C. elegans
caccacaaaaatt

SEQ ID NO: 710625 - DNA, 13 bp, C. elegans
caccacaatgggt

SEQ ID NO: 710626 - DNA, 14 bp, C. elegans
caccacagtctctc

SEQ ID NO: 710627 - DNA, 13 bp, C. elegans
caccacgaaaagt

SEQ ID NO: 710628 - DNA, 13 bp, C. elegans
caccacgtggttt

SEQ ID NO: 710629 - DNA, 13 bp, C. elegans
caccagtttactc

SEQ ID NO: 710630 - DNA, 14 bp, C. elegans
caccatatatttta

SEQ ID NO: 710631 - DNA, 13 bp, C. elegans
caccatcaactcc

SEQ ID NO: 710632 - DNA, 13 bp, C. elegans
caccatgtttcaa

SEQ ID NO: 710633 - DNA, 13 bp, C. elegans
cacccaaattcca

SEQ ID NO: 710634 - DNA, 13 bp, C. elegans
cacccaccacatt

SEQ ID NO: 710635 - DNA, 13 bp, C. elegans
cacccctgatcta

SEQ ID NO: 710636 - DNA, 13 bp, C. elegans
cacccgacatcta

SEQ ID NO: 710637 - DNA, 13 bp, C. elegans
cacccgattttac

SEQ ID NO: 710638 - DNA, 13 bp, C. elegans
cacccgcattttt

SEQ ID NO: 710639 - DNA, 13 bp, C. elegans
caccgaaaatgcg

SEQ ID NO: 710640 - DNA, 13 bp, C. elegans
caccgaaaatgtg

SEQ ID NO: 710641 - DNA, 13 bp, C. elegans
caccgattttcta

SEQ ID NO: 710642 - DNA, 13 bp, C. elegans
cacctattttgaa

SEQ ID NO: 710643 - DNA, 13 bp, C. elegans
cacctcactaatt

SEQ ID NO: 710644 - DNA, 13 bp, C. elegans
cacctgcgtctct

SEQ ID NO: 710645 - DNA, 13 bp, C. elegans
cacctttaaagat

SEQ ID NO: 710646 - DNA, 13 bp, C. elegans
cacctttaaagga

SEQ ID NO: 710647 - DNA, 13 bp, C. elegans
cacctttttgccg

SEQ ID NO: 710648 - DNA, 13 bp, C. elegans
cacgaaaaattca

SEQ ID NO: 710649 - DNA, 14 bp, C. elegans
cacgaaagatctca

SEQ ID NO: 710650 - DNA, 13 bp, C. elegans
cacgaaattctga

SEQ ID NO: 710651 - DNA, 13 bp, C. elegans
cacgaatttcaaa

SEQ ID NO: 710652 - DNA, 13 bp, C. elegans
cacgacaaatatt

SEQ ID NO: 710653 - DNA, 13 bp, C. elegans
cacgagctccgta

SEQ ID NO: 710654 - DNA, 13 bp, C. elegans
cacgatttcattt

SEQ ID NO: 710655 - DNA, 13 bp, C. elegans
cacgattttttaa

SEQ ID NO: 710656 - DNA, 13 bp, C. elegans
cacgcaacgcagc

SEQ ID NO: 710657 - DNA, 13 bp, C. elegans
cacgcagttttct

SEQ ID NO: 710658 - DNA, 24 bp, C. elegans
cacgcgctgcggtgaaattcctct

SEQ ID NO: 710659 - DNA, 13 bp, C. elegans
cacggaaaaatgg

SEQ ID NO: 710660 - DNA, 13 bp, C. elegans
cacggaaaagttg

SEQ ID NO: 710661 - DNA, 13 bp, C. elegans
cacggacaaatgc

SEQ ID NO: 710662 - DNA, 14 bp, C. elegans
cacggcccgagaag

SEQ ID NO: 710663 - DNA, 13 bp, C. elegans
cacggcggccgac

SEQ ID NO: 710664 - DNA, 17 bp, C. elegans
cacggcgtgtaaattgg

SEQ ID NO: 710665 - DNA, 16 bp, C. elegans
cacggttctgtgggcg

SEQ ID NO: 710666 - DNA, 13 bp, C. elegans
cacgtgatgccag

SEQ ID NO: 710667 - DNA, 13 bp, C. elegans
cacgtgatgtcag

SEQ ID NO: 710668 - DNA, 13 bp, C. elegans
cacgtggaaatga

SEQ ID NO: 710669 - DNA, 13 bp, C. elegans
cacgtggtgccag

SEQ ID NO: 710670 - DNA, 13 bp, C. elegans
cacgtggtgtcag

SEQ ID NO: 710671 - DNA, 13 bp, C. elegans
cacgtgtagtaca

SEQ ID NO: 710672 - DNA, 13 bp, C. elegans
cacgtttactttt

SEQ ID NO: 710673 - DNA, 13 bp, C. elegans
cacgttttcaaga

SEQ ID NO: 710674 - DNA, 13 bp, C. elegans
cacgttttcattt

SEQ ID NO: 710675 - DNA, 13 bp, C. elegans
cacgttttccaaa

SEQ ID NO: 710676 - DNA, 13 bp, C. elegans
cacgtttttaatt

SEQ ID NO: 710677 - DNA, 13 bp, C. elegans
cacgtttttattt

SEQ ID NO: 710678 - DNA, 13 bp, C. elegans
cacgttttttatt

SEQ ID NO: 710679 - DNA, 13 bp, C. elegans
cacgttttttctc

SEQ ID NO: 710680 - DNA, 13 bp, C. elegans
cactaaaaatagt

SEQ ID NO: 710681 - DNA, 13 bp, C. elegans
cactaaaaattgt

SEQ ID NO: 710682 - DNA, 13 bp, C. elegans
cactaaaacattt

SEQ ID NO: 710683 - DNA, 13 bp, C. elegans
cactaaaatttaa

SEQ ID NO: 710684 - DNA, 13 bp, C. elegans
cactaaattttga

SEQ ID NO: 710685 - DNA, 13 bp, C. elegans
cactaattatttt

SEQ ID NO: 710686 - DNA, 13 bp, C. elegans
cactaatttattt

SEQ ID NO: 710687 - DNA, 13 bp, C. elegans
cactaattttcga

SEQ ID NO: 710688 - DNA, 13 bp, C. elegans
cactacagtagtc

SEQ ID NO: 710689 - DNA, 13 bp, C. elegans
cactattcaacaa

SEQ ID NO: 710690 - DNA, 13 bp, C. elegans
cactatttctctc

SEQ ID NO: 710691 - DNA, 13 bp, C. elegans
cactcaaaattaa

SEQ ID NO: 710692 - DNA, 13 bp, C. elegans
cactcacacacat

SEQ ID NO: 710693 - DNA, 13 bp, C. elegans
cactcactcactc

SEQ ID NO: 710694 - DNA, 13 bp, C. elegans
cactcatcatttt

SEQ ID NO: 710695 - DNA, 13 bp, C. elegans
cactccagaattt

SEQ ID NO: 710696 - DNA, 13 bp, C. elegans
cactcctttgcac

SEQ ID NO: 710697 - DNA, 33 bp, C. elegans
cactcgtgacgcagacggagaagtcatcacccc

SEQ ID NO: 710698 - DNA, 13 bp, C. elegans
cactctcactctc

SEQ ID NO: 710699 - DNA, 28 bp, C. elegans
cactctctaactatctacactctctgta

SEQ ID NO: 710700 - DNA, 13 bp, C. elegans
cactctctcattt

SEQ ID NO: 710701 - DNA, 13 bp, C. elegans
cactgaaaaagtg

SEQ ID NO: 710702 - DNA, 13 bp, C. elegans
cactgaaaacatg

SEQ ID NO: 710703 - DNA, 13 bp, C. elegans
cactgaaaatcga

SEQ ID NO: 710704 - DNA, 13 bp, C. elegans
cactgaaattgaa

SEQ ID NO: 710705 - DNA, 13 bp, C. elegans
cactgacaaaaga

SEQ ID NO: 710706 - DNA, 13 bp, C. elegans
cactgacaaaatt

SEQ ID NO: 710707 - DNA, 13 bp, C. elegans
cactgaccaaaaa

SEQ ID NO: 710708 - DNA, 13 bp, C. elegans
cactgaccaaact

SEQ ID NO: 710709 - DNA, 13 bp, C. elegans
cactgactgaaaa

SEQ ID NO: 710710 - DNA, 13 bp, C. elegans
cactgagccattt

SEQ ID NO: 710711 - DNA, 13 bp, C. elegans
cactgataatttt

SEQ ID NO: 710712 - DNA, 13 bp, C. elegans
cactgatttcagt

SEQ ID NO: 710713 - DNA, 13 bp, C. elegans
cactgattttttc

SEQ ID NO: 710714 - DNA, 13 bp, C. elegans
cactgattttttg

SEQ ID NO: 710715 - DNA, 13 bp, C. elegans
cactgcaaaattt

SEQ ID NO: 710716 - DNA, 14 bp, C. elegans
cactgcaacttttt

SEQ ID NO: 710717 - DNA, 27 bp, C. elegans
cactgcaactttttcctcacgagggac

SEQ ID NO: 710718 - DNA, 13 bp, C. elegans
cactggagcactt

SEQ ID NO: 710719 - DNA, 13 bp, C. elegans
cactggcgctgct

SEQ ID NO: 710720 - DNA, 13 bp, C. elegans
cactgggaattgt

SEQ ID NO: 710721 - DNA, 13 bp, C. elegans
cactggttttcaa

SEQ ID NO: 710722 - DNA, 13 bp, C. elegans
cactgttcaaaaa

SEQ ID NO: 710723 - DNA, 13 bp, C. elegans
cactgttcaattt

SEQ ID NO: 710724 - DNA, 13 bp, C. elegans
cactgtttttatt

SEQ ID NO: 710725 - DNA, 13 bp, C. elegans
cacttaaaaactt

SEQ ID NO: 710726 - DNA, 13 bp, C. elegans
cacttaaaactgt

SEQ ID NO: 710727 - DNA, 13 bp, C. elegans
cacttaaaattgt

SEQ ID NO: 710728 - DNA, 13 bp, C. elegans
cacttaaactctt

SEQ ID NO: 710729 - DNA, 13 bp, C. elegans
cacttaattgtta

SEQ ID NO: 710730 - DNA, 13 bp, C. elegans
cacttataaaaat

SEQ ID NO: 710731 - DNA, 13 bp, C. elegans
cacttatttaaaa

SEQ ID NO: 710732 - DNA, 13 bp, C. elegans
cacttcaaaccaa

SEQ ID NO: 710733 - DNA, 13 bp, C. elegans
cacttcaaatcaa

SEQ ID NO: 710734 - DNA, 13 bp, C. elegans
cacttcatttttc

SEQ ID NO: 710735 - DNA, 13 bp, C. elegans
cacttcccacaca

SEQ ID NO: 710736 - DNA, 13 bp, C. elegans
cacttgcatcatc

SEQ ID NO: 710737 - DNA, 13 bp, C. elegans
cacttgccggttt

SEQ ID NO: 710738 - DNA, 13 bp, C. elegans
cacttggaaattg

SEQ ID NO: 710739 - DNA, 13 bp, C. elegans
cacttgtattttt

SEQ ID NO: 710740 - DNA, 13 bp, C. elegans
cacttgttctttt

SEQ ID NO: 710741 - DNA, 13 bp, C. elegans
cactttaaaacaa

SEQ ID NO: 710742 - DNA, 13 bp, C. elegans
cactttaatgttt

SEQ ID NO: 710743 - DNA, 13 bp, C. elegans
cactttactccaa

SEQ ID NO: 710744 - DNA, 13 bp, C. elegans
cactttataattt

SEQ ID NO: 710745 - DNA, 13 bp, C. elegans
cactttcaaatta

SEQ ID NO: 710746 - DNA, 13 bp, C. elegans
cactttcactttt

SEQ ID NO: 710747 - DNA, 13 bp, C. elegans
cactttccaaaat

SEQ ID NO: 710748 - DNA, 13 bp, C. elegans
cactttccgtttt

SEQ ID NO: 710749 - DNA, 13 bp, C. elegans
cactttcgttttt

SEQ ID NO: 710750 - DNA, 13 bp, C. elegans
cactttctcattt

SEQ ID NO: 710751 - DNA, 13 bp, C. elegans
cactttctgcaaa

SEQ ID NO: 710752 - DNA, 13 bp, C. elegans
cactttcttctca

SEQ ID NO: 710753 - DNA, 13 bp, C. elegans
cactttgaaaact

SEQ ID NO: 710754 - DNA, 13 bp, C. elegans
cactttgacacca

SEQ ID NO: 710755 - DNA, 13 bp, C. elegans
cactttgacagct

SEQ ID NO: 710756 - DNA, 13 bp, C. elegans
cactttgccggaa

SEQ ID NO: 710757 - DNA, 13 bp, C. elegans
cactttggcaact

SEQ ID NO: 710758 - DNA, 13 bp, C. elegans
cacttttaaaaat

SEQ ID NO: 710759 - DNA, 13 bp, C. elegans
cacttttagattt

SEQ ID NO: 710760 - DNA, 13 bp, C. elegans
cacttttataatt

SEQ ID NO: 710761 - DNA, 13 bp, C. elegans
cacttttcacaaa

SEQ ID NO: 710762 - DNA, 13 bp, C. elegans
cacttttcatatt

SEQ ID NO: 710763 - DNA, 13 bp, C. elegans
cacttttccaatt

SEQ ID NO: 710764 - DNA, 13 bp, C. elegans
cacttttcgaatt

SEQ ID NO: 710765 - DNA, 13 bp, C. elegans
cacttttcgattt

SEQ ID NO: 710766 - DNA, 13 bp, C. elegans
cacttttcttcaa

SEQ ID NO: 710767 - DNA, 13 bp, C. elegans
cacttttcttgtt

SEQ ID NO: 710768 - DNA, 13 bp, C. elegans
cacttttctttgt

SEQ ID NO: 710769 - DNA, 13 bp, C. elegans
cacttttgaaaaa

SEQ ID NO: 710770 - DNA, 13 bp, C. elegans
cacttttgaattg

SEQ ID NO: 710771 - DNA, 13 bp, C. elegans
cacttttgacttt

SEQ ID NO: 710772 - DNA, 13 bp, C. elegans
cacttttgagaaa

SEQ ID NO: 710773 - DNA, 13 bp, C. elegans
cacttttgcattt

SEQ ID NO: 710774 - DNA, 13 bp, C. elegans
cacttttgttttc

SEQ ID NO: 710775 - DNA, 13 bp, C. elegans
cacttttgttttg

SEQ ID NO: 710776 - DNA, 13 bp, C. elegans
cactttttaattg

SEQ ID NO: 710777 - DNA, 13 bp, C. elegans
cactttttataat

SEQ ID NO: 710778 - DNA, 13 bp, C. elegans
cactttttatatc

SEQ ID NO: 710779 - DNA, 13 bp, C. elegans
cactttttcaaat

SEQ ID NO: 710780 - DNA, 13 bp, C. elegans
cactttttcatca

SEQ ID NO: 710781 - DNA, 13 bp, C. elegans
cactttttcgaat

SEQ ID NO: 710782 - DNA, 13 bp, C. elegans
cactttttctcaa

SEQ ID NO: 710783 - DNA, 13 bp, C. elegans
cactttttcttgt

SEQ ID NO: 710784 - DNA, 13 bp, C. elegans
cactttttgactc

SEQ ID NO: 710785 - DNA, 13 bp, C. elegans
cactttttgagaa

SEQ ID NO: 710786 - DNA, 13 bp, C. elegans
cactttttgctca

SEQ ID NO: 710787 - DNA, 13 bp, C. elegans
cactttttgcttt

SEQ ID NO: 710788 - DNA, 13 bp, C. elegans
cactttttgtaga

SEQ ID NO: 710789 - DNA, 13 bp, C. elegans
cactttttgtgca

SEQ ID NO: 710790 - DNA, 13 bp, C. elegans
cacttttttaatg

SEQ ID NO: 710791 - DNA, 13 bp, C. elegans
cacttttttccca

SEQ ID NO: 710792 - DNA, 13 bp, C. elegans
cacttttttcccg

SEQ ID NO: 710793 - DNA, 13 bp, C. elegans
cacttttttgcaa

SEQ ID NO: 710794 - DNA, 13 bp, C. elegans
cacttttttgtgt

SEQ ID NO: 710795 - DNA, 13 bp, C. elegans
cacttttttttgc

SEQ ID NO: 710796 - DNA, 13 bp, C. elegans
cacttttttttgg

SEQ ID NO: 710797 - DNA, 13 bp, C. elegans
cagaaaaaatcga

SEQ ID NO: 710798 - DNA, 13 bp, C. elegans
cagaaaaaatgtt

SEQ ID NO: 710799 - DNA, 13 bp, C. elegans
cagaaaaaattga

SEQ ID NO: 710800 - DNA, 13 bp, C. elegans
cagaaaaacaatt

SEQ ID NO: 710801 - DNA, 13 bp, C. elegans
cagaaaaacgttt

SEQ ID NO: 710802 - DNA, 13 bp, C. elegans
cagaaaaactatt

SEQ ID NO: 710803 - DNA, 13 bp, C. elegans
cagaaaaagaatt

SEQ ID NO: 710804 - DNA, 13 bp, C. elegans
cagaaaaagaggc

SEQ ID NO: 710805 - DNA, 13 bp, C. elegans
cagaaaaagctga

SEQ ID NO: 710806 - DNA, 13 bp, C. elegans
cagaaaaatattt

SEQ ID NO: 710807 - DNA, 13 bp, C. elegans
cagaaaaatcgat

SEQ ID NO: 710808 - DNA, 13 bp, C. elegans
cagaaaaatctac

SEQ ID NO: 710809 - DNA, 13 bp, C. elegans
cagaaaaatctga

SEQ ID NO: 710810 - DNA, 13 bp, C. elegans
cagaaaaatgggc

SEQ ID NO: 710811 - DNA, 13 bp, C. elegans
cagaaaaatggtt

SEQ ID NO: 710812 - DNA, 13 bp, C. elegans
cagaaaaatgttt

SEQ ID NO: 710813 - DNA, 13 bp, C. elegans
cagaaaaattatt

SEQ ID NO: 710814 - DNA, 13 bp, C. elegans
cagaaaaattgat

SEQ ID NO: 710815 - DNA, 13 bp, C. elegans
cagaaaaattgta

SEQ ID NO: 710816 - DNA, 13 bp, C. elegans
cagaaaaatttaa

SEQ ID NO: 710817 - DNA, 13 bp, C. elegans
cagaaaaatttca

SEQ ID NO: 710818 - DNA, 13 bp, C. elegans
cagaaaacatatt

SEQ ID NO: 710819 - DNA, 13 bp, C. elegans
cagaaaaccaaat

SEQ ID NO: 710820 - DNA, 13 bp, C. elegans
cagaaaaccggca

SEQ ID NO: 710821 - DNA, 13 bp, C. elegans
cagaaaacgtttt

SEQ ID NO: 710822 - DNA, 13 bp, C. elegans
cagaaaactcggc

SEQ ID NO: 710823 - DNA, 13 bp, C. elegans
cagaaaactttga

SEQ ID NO: 710824 - DNA, 13 bp, C. elegans
cagaaaagtgttt

SEQ ID NO: 710825 - DNA, 13 bp, C. elegans
cagaaaagttttc

SEQ ID NO: 710826 - DNA, 13 bp, C. elegans
cagaaaataaact

SEQ ID NO: 710827 - DNA, 13 bp, C. elegans
cagaaaataatta

SEQ ID NO: 710828 - DNA, 13 bp, C. elegans
cagaaaataattt

SEQ ID NO: 710829 - DNA, 13 bp, C. elegans
cagaaaatagaat

SEQ ID NO: 710830 - DNA, 13 bp, C. elegans
cagaaaatatcat

SEQ ID NO: 710831 - DNA, 13 bp, C. elegans
cagaaaatcaatt

SEQ ID NO: 710832 - DNA, 13 bp, C. elegans
cagaaaatcttaa

SEQ ID NO: 710833 - DNA, 13 bp, C. elegans
cagaaaatgaaga

SEQ ID NO: 710834 - DNA, 13 bp, C. elegans
cagaaaatgaatt

SEQ ID NO: 710835 - DNA, 13 bp, C. elegans
cagaaaatgatga

SEQ ID NO: 710836 - DNA, 13 bp, C. elegans
cagaaaatgccaa

SEQ ID NO: 710837 - DNA, 13 bp, C. elegans
cagaaaatgtaga

SEQ ID NO: 710838 - DNA, 13 bp, C. elegans
cagaaaatgtgaa

SEQ ID NO: 710839 - DNA, 13 bp, C. elegans
cagaaaatgttga

SEQ ID NO: 710840 - DNA, 13 bp, C. elegans
cagaaaattatga

SEQ ID NO: 710841 - DNA, 13 bp, C. elegans
cagaaaattcaat

SEQ ID NO: 710842 - DNA, 13 bp, C. elegans
cagaaaattctat

SEQ ID NO: 710843 - DNA, 13 bp, C. elegans
cagaaaattgaaa

SEQ ID NO: 710844 - DNA, 13 bp, C. elegans
cagaaaattgcag

SEQ ID NO: 710845 - DNA, 13 bp, C. elegans
cagaaaattgccg

SEQ ID NO: 710846 - DNA, 13 bp, C. elegans
cagaaaattggaa

SEQ ID NO: 710847 - DNA, 13 bp, C. elegans
cagaaaattgtca

SEQ ID NO: 710848 - DNA, 14 bp, C. elegans
cagaaaattgtgaa

SEQ ID NO: 710849 - DNA, 13 bp, C. elegans
cagaaaatttaaa

SEQ ID NO: 710850 - DNA, 13 bp, C. elegans
cagaaaatttcaa

SEQ ID NO: 710851 - DNA, 14 bp, C. elegans
cagaaaattttcaa

SEQ ID NO: 710852 - DNA, 13 bp, C. elegans
cagaaacagtaat

SEQ ID NO: 710853 - DNA, 13 bp, C. elegans
cagaaacattaaa

SEQ ID NO: 710854 - DNA, 13 bp, C. elegans
cagaaactagaaa

SEQ ID NO: 710855 - DNA, 13 bp, C. elegans
cagaaactcaaaa

SEQ ID NO: 710856 - DNA, 13 bp, C. elegans
cagaaagttcaaa

SEQ ID NO: 710857 - DNA, 13 bp, C. elegans
cagaaagttctgg

SEQ ID NO: 710858 - DNA, 13 bp, C. elegans
cagaaagttgaca

SEQ ID NO: 710859 - DNA, 13 bp, C. elegans
cagaaagttttca

SEQ ID NO: 710860 - DNA, 13 bp, C. elegans
cagaaataaattt

SEQ ID NO: 710861 - DNA, 13 bp, C. elegans
cagaaatatgaaa

SEQ ID NO: 710862 - DNA, 13 bp, C. elegans
cagaaatcaaaat

SEQ ID NO: 710863 - DNA, 13 bp, C. elegans
cagaaatgtcaaa

SEQ ID NO: 710864 - DNA, 13 bp, C. elegans
cagaaatgttttt

SEQ ID NO: 710865 - DNA, 13 bp, C. elegans
cagaaattaatca

SEQ ID NO: 710866 - DNA, 13 bp, C. elegans
cagaaattaattt

SEQ ID NO: 710867 - DNA, 13 bp, C. elegans
cagaaattatcaa

SEQ ID NO: 710868 - DNA, 13 bp, C. elegans
cagaaattattat

SEQ ID NO: 710869 - DNA, 13 bp, C. elegans
cagaaattcaatt

SEQ ID NO: 710870 - DNA, 13 bp, C. elegans
cagaaattcgaaa

SEQ ID NO: 710871 - DNA, 13 bp, C. elegans
cagaaattgacaa

SEQ ID NO: 710872 - DNA, 13 bp, C. elegans
cagaaattgatga

SEQ ID NO: 710873 - DNA, 13 bp, C. elegans
cagaaattgtgaa

SEQ ID NO: 710874 - DNA, 13 bp, C. elegans
cagaaatttattg

SEQ ID NO: 710875 - DNA, 13 bp, C. elegans
cagaaatttcaga

SEQ ID NO: 710876 - DNA, 13 bp, C. elegans
cagaaatttcgaa

SEQ ID NO: 710877 - DNA, 13 bp, C. elegans
cagaaattttcaa

SEQ ID NO: 710878 - DNA, 13 bp, C. elegans
cagaaattttgaa

SEQ ID NO: 710879 - DNA, 13 bp, C. elegans
cagaaattttttt

SEQ ID NO: 710880 - DNA, 13 bp, C. elegans
cagaacacttttt

SEQ ID NO: 710881 - DNA, 13 bp, C. elegans
cagaacattcaaa

SEQ ID NO: 710882 - DNA, 13 bp, C. elegans
cagaacatttaaa

SEQ ID NO: 710883 - DNA, 13 bp, C. elegans
cagaacattttct

SEQ ID NO: 710884 - DNA, 13 bp, C. elegans
cagaacatttttc

SEQ ID NO: 710885 - DNA, 13 bp, C. elegans
cagaagaaaatta

SEQ ID NO: 710886 - DNA, 14 bp, C. elegans
cagaagagagctga

SEQ ID NO: 710887 - DNA, 14 bp, C. elegans
cagaagatattgag

SEQ ID NO: 710888 - DNA, 13 bp, C. elegans
cagaagattttga

SEQ ID NO: 710889 - DNA, 13 bp, C. elegans
cagaagccaaaac

SEQ ID NO: 710890 - DNA, 13 bp, C. elegans
cagaagctccaga

SEQ ID NO: 710891 - DNA, 13 bp, C. elegans
cagaagtttcttt

SEQ ID NO: 710892 - DNA, 15 bp, C. elegans
cagaataatttactc

SEQ ID NO: 710893 - DNA, 13 bp, C. elegans
cagaatacaaaag

SEQ ID NO: 710894 - DNA, 13 bp, C. elegans
cagaatatcaaaa

SEQ ID NO: 710895 - DNA, 13 bp, C. elegans
cagaatatgccaa

SEQ ID NO: 710896 - DNA, 13 bp, C. elegans
cagaatattgaaa

SEQ ID NO: 710897 - DNA, 13 bp, C. elegans
cagaatattgtgt

SEQ ID NO: 710898 - DNA, 13 bp, C. elegans
cagaatattttta

SEQ ID NO: 710899 - DNA, 13 bp, C. elegans
cagaatcagaaaa

SEQ ID NO: 710900 - DNA, 13 bp, C. elegans
cagaattcaaaaa

SEQ ID NO: 710901 - DNA, 13 bp, C. elegans
cagaattcagaaa

SEQ ID NO: 710902 - DNA, 13 bp, C. elegans
cagaattctgaga

SEQ ID NO: 710903 - DNA, 13 bp, C. elegans
cagaattgaaaaa

SEQ ID NO: 710904 - DNA, 13 bp, C. elegans
cagaattgaaatt

SEQ ID NO: 710905 - DNA, 13 bp, C. elegans
cagaattgaagtt

SEQ ID NO: 710906 - DNA, 13 bp, C. elegans
cagaattggaaaa

SEQ ID NO: 710907 - DNA, 13 bp, C. elegans
cagaatttaacca

SEQ ID NO: 710908 - DNA, 13 bp, C. elegans
cagaatttaccaa

SEQ ID NO: 710909 - DNA, 13 bp, C. elegans
cagaatttcagaa

SEQ ID NO: 710910 - DNA, 13 bp, C. elegans
cagaatttcataa

SEQ ID NO: 710911 - DNA, 13 bp, C. elegans
cagaatttcgaaa

SEQ ID NO: 710912 - DNA, 13 bp, C. elegans
cagaatttcgtgt

SEQ ID NO: 710913 - DNA, 13 bp, C. elegans
cagaatttctttt

SEQ ID NO: 710914 - DNA, 13 bp, C. elegans
cagaatttgccga

SEQ ID NO: 710915 - DNA, 13 bp, C. elegans
cagaattttaaaa

SEQ ID NO: 710916 - DNA, 13 bp, C. elegans
cagaattttacaa

SEQ ID NO: 710917 - DNA, 13 bp, C. elegans
cagaattttcaat

SEQ ID NO: 710918 - DNA, 13 bp, C. elegans
cagaattttctca

SEQ ID NO: 710919 - DNA, 13 bp, C. elegans
cagaattttgaaa

SEQ ID NO: 710920 - DNA, 13 bp, C. elegans
cagaattttgaga

SEQ ID NO: 710921 - DNA, 13 bp, C. elegans
cagaattttgagc

SEQ ID NO: 710922 - DNA, 13 bp, C. elegans
cagaattttgtaa

SEQ ID NO: 710923 - DNA, 13 bp, C. elegans
cagaattttgtgg

SEQ ID NO: 710924 - DNA, 13 bp, C. elegans
cagacaaaacatt

SEQ ID NO: 710925 - DNA, 13 bp, C. elegans
cagacaagaattt

SEQ ID NO: 710926 - DNA, 13 bp, C. elegans
cagacaattctga

SEQ ID NO: 710927 - DNA, 13 bp, C. elegans
cagacacgaaatt

SEQ ID NO: 710928 - DNA, 13 bp, C. elegans
cagacgacgagag

SEQ ID NO: 710929 - DNA, 13 bp, C. elegans
cagacggagaagt

SEQ ID NO: 710930 - DNA, 13 bp, C. elegans
cagagaaactgaa

SEQ ID NO: 710931 - DNA, 13 bp, C. elegans
cagagaaatagag

SEQ ID NO: 710932 - DNA, 13 bp, C. elegans
cagagaaatcaaa

SEQ ID NO: 710933 - DNA, 13 bp, C. elegans
cagagcttttgaa

SEQ ID NO: 710934 - DNA, 13 bp, C. elegans
cagagttcaaaaa

SEQ ID NO: 710935 - DNA, 13 bp, C. elegans
cagataaattatt

SEQ ID NO: 710936 - DNA, 13 bp, C. elegans
cagataattttga

SEQ ID NO: 710937 - DNA, 13 bp, C. elegans
cagatataaattt

SEQ ID NO: 710938 - DNA, 13 bp, C. elegans
cagatattttcat

SEQ ID NO: 710939 - DNA, 13 bp, C. elegans
cagatcccctttt

SEQ ID NO: 710940 - DNA, 13 bp, C. elegans
cagatcctgaaaa

SEQ ID NO: 710941 - DNA, 13 bp, C. elegans
cagatcttcaaaa

SEQ ID NO: 710942 - DNA, 13 bp, C. elegans
cagatgaaaaaat

SEQ ID NO: 710943 - DNA, 13 bp, C. elegans
cagattctaaatt

SEQ ID NO: 710944 - DNA, 13 bp, C. elegans
cagattgccaaaa

SEQ ID NO: 710945 - DNA, 13 bp, C. elegans
cagatttaaaaaa

SEQ ID NO: 710946 - DNA, 13 bp, C. elegans
cagatttatattt

SEQ ID NO: 710947 - DNA, 13 bp, C. elegans
cagatttcgaaaa

SEQ ID NO: 710948 - DNA, 13 bp, C. elegans
cagatttctgaaa

SEQ ID NO: 710949 - DNA, 13 bp, C. elegans
cagatttgaaaaa

SEQ ID NO: 710950 - DNA, 13 bp, C. elegans
cagattttattta

SEQ ID NO: 710951 - DNA, 13 bp, C. elegans
cagattttcagtt

SEQ ID NO: 710952 - DNA, 13 bp, C. elegans
cagattttcataa

SEQ ID NO: 710953 - DNA, 13 bp, C. elegans
cagattttccaaa

SEQ ID NO: 710954 - DNA, 13 bp, C. elegans
cagattttccaat

SEQ ID NO: 710955 - DNA, 13 bp, C. elegans
cagattttcttca

SEQ ID NO: 710956 - DNA, 13 bp, C. elegans
cagattttgattt

SEQ ID NO: 710957 - DNA, 13 bp, C. elegans
cagattttgtaaa

SEQ ID NO: 710958 - DNA, 13 bp, C. elegans
cagattttttccc

SEQ ID NO: 710959 - DNA, 13 bp, C. elegans
cagatttttttag

SEQ ID NO: 710960 - DNA, 13 bp, C. elegans
cagcaaaaaaagt

SEQ ID NO: 710961 - DNA, 13 bp, C. elegans
cagcaaaaatcga

SEQ ID NO: 710962 - DNA, 13 bp, C. elegans
cagcaaaattttt

SEQ ID NO: 710963 - DNA, 13 bp, C. elegans
cagcaacagcagc

SEQ ID NO: 710964 - DNA, 13 bp, C. elegans
cagcagcagcaga

SEQ ID NO: 710965 - DNA, 13 bp, C. elegans
cagcagcagcagt

SEQ ID NO: 710966 - DNA, 13 bp, C. elegans
cagcagctggaaa

SEQ ID NO: 710967 - DNA, 13 bp, C. elegans
cagcaggataatg

SEQ ID NO: 710968 - DNA, 13 bp, C. elegans
cagcagtttttgg

SEQ ID NO: 710969 - DNA, 13 bp, C. elegans
cagccaaagtttt

SEQ ID NO: 710970 - DNA, 13 bp, C. elegans
cagccagtatttt

SEQ ID NO: 710971 - DNA, 13 bp, C. elegans
cagccgacacttc

SEQ ID NO: 710972 - DNA, 13 bp, C. elegans
cagccgacatcta

SEQ ID NO: 710973 - DNA, 13 bp, C. elegans
cagccgacatctc

SEQ ID NO: 710974 - DNA, 13 bp, C. elegans
cagcgaaaaaatt

SEQ ID NO: 710975 - DNA, 13 bp, C. elegans
cagcggacatttt

SEQ ID NO: 710976 - DNA, 13 bp, C. elegans
cagcgtctggaac

SEQ ID NO: 710977 - DNA, 13 bp, C. elegans
cagctcatatctc

SEQ ID NO: 710978 - DNA, 13 bp, C. elegans
cagctcattttca

SEQ ID NO: 710979 - DNA, 13 bp, C. elegans
cagctcgccgaga

SEQ ID NO: 710980 - DNA, 13 bp, C. elegans
cagctgctggatt

SEQ ID NO: 710981 - DNA, 13 bp, C. elegans
cagcttcaaactg

SEQ ID NO: 710982 - DNA, 15 bp, C. elegans
cagcttctgatccaa

SEQ ID NO: 710983 - DNA, 13 bp, C. elegans
cagctttaaaatg

SEQ ID NO: 710984 - DNA, 13 bp, C. elegans
cagctttaatcct

SEQ ID NO: 710985 - DNA, 13 bp, C. elegans
cagctttcaaaaa

SEQ ID NO: 710986 - DNA, 13 bp, C. elegans
cagcttttgaaaa

SEQ ID NO: 710987 - DNA, 13 bp, C. elegans
cagctttttttga

SEQ ID NO: 710988 - DNA, 13 bp, C. elegans
caggaaaaatcaa

SEQ ID NO: 710989 - DNA, 13 bp, C. elegans
caggaaaacaatt

SEQ ID NO: 710990 - DNA, 13 bp, C. elegans
caggaaaacttgt

SEQ ID NO: 710991 - DNA, 13 bp, C. elegans
caggaaaatgttt

SEQ ID NO: 710992 - DNA, 13 bp, C. elegans
caggaaaattctt

SEQ ID NO: 710993 - DNA, 13 bp, C. elegans
caggaaacaattt

SEQ ID NO: 710994 - DNA, 13 bp, C. elegans
caggaaacttgag

SEQ ID NO: 710995 - DNA, 13 bp, C. elegans
caggaaattggaa

SEQ ID NO: 710996 - DNA, 13 bp, C. elegans
caggaatttttca

SEQ ID NO: 710997 - DNA, 13 bp, C. elegans
caggagcagtatt

SEQ ID NO: 710998 - DNA, 14 bp, C. elegans
caggatttgaagca

SEQ ID NO: 710999 - DNA, 13 bp, C. elegans
caggcaaatcggc

SEQ ID NO: 711000 - DNA, 13 bp, C. elegans
caggcaggcaggc

SEQ ID NO: 711001 - DNA, 13 bp, C. elegans
caggcggaaaaca

SEQ ID NO: 711002 - DNA, 13 bp, C. elegans
caggcgtcaggcc

SEQ ID NO: 711003 - DNA, 14 bp, C. elegans
caggctggaggcct

SEQ ID NO: 711004 - DNA, 13 bp, C. elegans
caggctgtcccat

SEQ ID NO: 711005 - DNA, 13 bp, C. elegans
caggctgtctcat

SEQ ID NO: 711006 - DNA, 13 bp, C. elegans
cagggctgagcag

SEQ ID NO: 711007 - DNA, 14 bp, C. elegans
cagggctgggacca

SEQ ID NO: 711008 - DNA, 15 bp, C. elegans
cagggtggcccataa

SEQ ID NO: 711009 - DNA, 13 bp, C. elegans
cagggttactgta

SEQ ID NO: 711010 - DNA, 13 bp, C. elegans
caggtaggcaagc

SEQ ID NO: 711011 - DNA, 13 bp, C. elegans
caggttgtcccat

SEQ ID NO: 711012 - DNA, 13 bp, C. elegans
caggtttttttaa

SEQ ID NO: 711013 - DNA, 13 bp, C. elegans
cagtaaaaaagtg

SEQ ID NO: 711014 - DNA, 13 bp, C. elegans
cagtaaccctaaa

SEQ ID NO: 711015 - DNA, 13 bp, C. elegans
cagtaataaaatt

SEQ ID NO: 711016 - DNA, 13 bp, C. elegans
cagtaatccttaa

SEQ ID NO: 711017 - DNA, 13 bp, C. elegans
cagtaatcttcaa

SEQ ID NO: 711018 - DNA, 13 bp, C. elegans
cagtaatgatatc

SEQ ID NO: 711019 - DNA, 13 bp, C. elegans
cagtaattcttca

SEQ ID NO: 711020 - DNA, 13 bp, C. elegans
cagtaattttgaa

SEQ ID NO: 711021 - DNA, 14 bp, C. elegans
cagtacaattttga

SEQ ID NO: 711022 - DNA, 13 bp, C. elegans
cagtacacctaca

SEQ ID NO: 711023 - DNA, 13 bp, C. elegans
cagtacatctaca

SEQ ID NO: 711024 - DNA, 13 bp, C. elegans
cagtactttgaca

SEQ ID NO: 711025 - DNA, 13 bp, C. elegans
cagtagatcaata

SEQ ID NO: 711026 - DNA, 13 bp, C. elegans
cagtaggtacaag

SEQ ID NO: 711027 - DNA, 13 bp, C. elegans
cagtagtagtagt

SEQ ID NO: 711028 - DNA, 13 bp, C. elegans
cagtatccctaca

SEQ ID NO: 711029 - DNA, 13 bp, C. elegans
cagtattaaattt

SEQ ID NO: 711030 - DNA, 13 bp, C. elegans
cagtatttctcaa

SEQ ID NO: 711031 - DNA, 13 bp, C. elegans
cagtcaaatttca

SEQ ID NO: 711032 - DNA, 13 bp, C. elegans
cagtcagaaattt

SEQ ID NO: 711033 - DNA, 13 bp, C. elegans
cagtcattttcag

SEQ ID NO: 711034 - DNA, 13 bp, C. elegans
cagtcgtaaaatt

SEQ ID NO: 711035 - DNA, 13 bp, C. elegans
cagtctgcgtctc

SEQ ID NO: 711036 - DNA, 13 bp, C. elegans
cagtcttctatat

SEQ ID NO: 711037 - DNA, 13 bp, C. elegans
cagtgaaaaagtg

SEQ ID NO: 711038 - DNA, 13 bp, C. elegans
cagtgaaaaataa

SEQ ID NO: 711039 - DNA, 13 bp, C. elegans
cagtgaaaacatt

SEQ ID NO: 711040 - DNA, 13 bp, C. elegans
cagtgaaaatata

SEQ ID NO: 711041 - DNA, 13 bp, C. elegans
cagtgaaaatcaa

SEQ ID NO: 711042 - DNA, 13 bp, C. elegans
cagtgaacaattt

SEQ ID NO: 711043 - DNA, 13 bp, C. elegans
cagtgaataaaaa

SEQ ID NO: 711044 - DNA, 13 bp, C. elegans
cagtgaggaaatt

SEQ ID NO: 711045 - DNA, 13 bp, C. elegans
cagtgatattttt

SEQ ID NO: 711046 - DNA, 13 bp, C. elegans
cagtgattgttac

SEQ ID NO: 711047 - DNA, 13 bp, C. elegans
cagtgcaaatgaa

SEQ ID NO: 711048 - DNA, 14 bp, C. elegans
cagtgcacatttga

SEQ ID NO: 711049 - DNA, 13 bp, C. elegans
cagtgcatttttt

SEQ ID NO: 711050 - DNA, 13 bp, C. elegans
cagtggaaatttg

SEQ ID NO: 711051 - DNA, 13 bp, C. elegans
cagtggaaatttt

SEQ ID NO: 711052 - DNA, 13 bp, C. elegans
cagtggagaaatt

SEQ ID NO: 711053 - DNA, 13 bp, C. elegans
cagtggagcgatg

SEQ ID NO: 711054 - DNA, 13 bp, C. elegans
cagtggattttgt

SEQ ID NO: 711055 - DNA, 13 bp, C. elegans
cagtggatttttg

SEQ ID NO: 711056 - DNA, 13 bp, C. elegans
cagtgggatcacc

SEQ ID NO: 711057 - DNA, 13 bp, C. elegans
cagtggttttttt

SEQ ID NO: 711058 - DNA, 13 bp, C. elegans
cagtgtatttttt

SEQ ID NO: 711059 - DNA, 13 bp, C. elegans
cagtgtcaaatat

SEQ ID NO: 711060 - DNA, 13 bp, C. elegans
cagtgtttttgaa

SEQ ID NO: 711061 - DNA, 13 bp, C. elegans
cagttaaaaataa

SEQ ID NO: 711062 - DNA, 13 bp, C. elegans
cagttaaactttt

SEQ ID NO: 711063 - DNA, 13 bp, C. elegans
cagttaataaaaa

SEQ ID NO: 711064 - DNA, 13 bp, C. elegans
cagttaattattt

SEQ ID NO: 711065 - DNA, 13 bp, C. elegans
cagttaatttaaa

SEQ ID NO: 711066 - DNA, 13 bp, C. elegans
cagttaattttta

SEQ ID NO: 711067 - DNA, 13 bp, C. elegans
cagttaatttttc

SEQ ID NO: 711068 - DNA, 14 bp, C. elegans
cagttacaactgat

SEQ ID NO: 711069 - DNA, 13 bp, C. elegans
cagttacttttta

SEQ ID NO: 711070 - DNA, 13 bp, C. elegans
cagttatttttta

SEQ ID NO: 711071 - DNA, 13 bp, C. elegans
cagttcaaaaatt

SEQ ID NO: 711072 - DNA, 13 bp, C. elegans
cagttcaaagtgc

SEQ ID NO: 711073 - DNA, 13 bp, C. elegans
cagttcattttga

SEQ ID NO: 711074 - DNA, 13 bp, C. elegans
cagttctacaaaa

SEQ ID NO: 711075 - DNA, 13 bp, C. elegans
cagttctattttt

SEQ ID NO: 711076 - DNA, 13 bp, C. elegans
cagttctcaaaat

SEQ ID NO: 711077 - DNA, 13 bp, C. elegans
cagttctcaattt

SEQ ID NO: 711078 - DNA, 13 bp, C. elegans
cagttctcatttt

SEQ ID NO: 711079 - DNA, 13 bp, C. elegans
cagttgaaaaatc

SEQ ID NO: 711080 - DNA, 13 bp, C. elegans
cagttgaccgttt

SEQ ID NO: 711081 - DNA, 13 bp, C. elegans
cagttgagatgtc

SEQ ID NO: 711082 - DNA, 13 bp, C. elegans
cagttgagttttt

SEQ ID NO: 711083 - DNA, 13 bp, C. elegans
cagttggtggaga

SEQ ID NO: 711084 - DNA, 13 bp, C. elegans
cagttgtattttt

SEQ ID NO: 711085 - DNA, 13 bp, C. elegans
cagttgttatttt

SEQ ID NO: 711086 - DNA, 13 bp, C. elegans
cagttgttttaaa

SEQ ID NO: 711087 - DNA, 13 bp, C. elegans
cagtttaaaaaaa

SEQ ID NO: 711088 - DNA, 13 bp, C. elegans
cagtttaccaaaa

SEQ ID NO: 711089 - DNA, 13 bp, C. elegans
cagtttatcaaaa

SEQ ID NO: 711090 - DNA, 13 bp, C. elegans
cagtttcaaaata

SEQ ID NO: 711091 - DNA, 13 bp, C. elegans
cagtttcaaactt

SEQ ID NO: 711092 - DNA, 13 bp, C. elegans
cagtttcaatatt

SEQ ID NO: 711093 - DNA, 13 bp, C. elegans
cagtttcattttg

SEQ ID NO: 711094 - DNA, 13 bp, C. elegans
cagtttcattttt

SEQ ID NO: 711095 - DNA, 13 bp, C. elegans
cagtttccaaaaa

SEQ ID NO: 711096 - DNA, 13 bp, C. elegans
cagtttccaaatt

SEQ ID NO: 711097 - DNA, 13 bp, C. elegans
cagtttcggaaaa

SEQ ID NO: 711098 - DNA, 13 bp, C. elegans
cagtttctgtgta

SEQ ID NO: 711099 - DNA, 13 bp, C. elegans
cagtttctttttc

SEQ ID NO: 711100 - DNA, 13 bp, C. elegans
cagtttgaggtgt

SEQ ID NO: 711101 - DNA, 13 bp, C. elegans
cagtttgccagaa

SEQ ID NO: 711102 - DNA, 13 bp, C. elegans
cagtttgtcaatt

SEQ ID NO: 711103 - DNA, 13 bp, C. elegans
cagttttagtatt

SEQ ID NO: 711104 - DNA, 13 bp, C. elegans
cagttttattaaa

SEQ ID NO: 711105 - DNA, 13 bp, C. elegans
cagttttattatt

SEQ ID NO: 711106 - DNA, 13 bp, C. elegans
cagttttattgtt

SEQ ID NO: 711107 - DNA, 13 bp, C. elegans
cagttttatttga

SEQ ID NO: 711108 - DNA, 13 bp, C. elegans
cagttttcaaaaa

SEQ ID NO: 711109 - DNA, 13 bp, C. elegans
cagttttcaaatt

SEQ ID NO: 711110 - DNA, 13 bp, C. elegans
cagttttcaagtt

SEQ ID NO: 711111 - DNA, 13 bp, C. elegans
cagttttcagaaa

SEQ ID NO: 711112 - DNA, 13 bp, C. elegans
cagttttcatttt

SEQ ID NO: 711113 - DNA, 13 bp, C. elegans
cagttttccatca

SEQ ID NO: 711114 - DNA, 13 bp, C. elegans
cagttttcgaaaa

SEQ ID NO: 711115 - DNA, 13 bp, C. elegans
cagttttctattt

SEQ ID NO: 711116 - DNA, 13 bp, C. elegans
cagttttcttctt

SEQ ID NO: 711117 - DNA, 13 bp, C. elegans
cagttttcttgtt

SEQ ID NO: 711118 - DNA, 13 bp, C. elegans
cagttttcttttg

SEQ ID NO: 711119 - DNA, 13 bp, C. elegans
cagttttgaactt

SEQ ID NO: 711120 - DNA, 13 bp, C. elegans
cagttttgagatg

SEQ ID NO: 711121 - DNA, 13 bp, C. elegans
cagttttgccgcc

SEQ ID NO: 711122 - DNA, 13 bp, C. elegans
cagttttgctcca

SEQ ID NO: 711123 - DNA, 13 bp, C. elegans
cagttttgttgtt

SEQ ID NO: 711124 - DNA, 13 bp, C. elegans
cagtttttaagtt

SEQ ID NO: 711125 - DNA, 13 bp, C. elegans
cagtttttaattt

SEQ ID NO: 711126 - DNA, 13 bp, C. elegans
cagtttttacaat

SEQ ID NO: 711127 - DNA, 13 bp, C. elegans
cagtttttatatt

SEQ ID NO: 711128 - DNA, 13 bp, C. elegans
cagtttttattca

SEQ ID NO: 711129 - DNA, 13 bp, C. elegans
cagtttttcaaaa

SEQ ID NO: 711130 - DNA, 13 bp, C. elegans
cagtttttcagat

SEQ ID NO: 711131 - DNA, 13 bp, C. elegans
cagtttttcataa

SEQ ID NO: 711132 - DNA, 13 bp, C. elegans
cagtttttccaga

SEQ ID NO: 711133 - DNA, 13 bp, C. elegans
cagtttttctgta

SEQ ID NO: 711134 - DNA, 13 bp, C. elegans
cagtttttcttgt

SEQ ID NO: 711135 - DNA, 13 bp, C. elegans
cagtttttgagca

SEQ ID NO: 711136 - DNA, 13 bp, C. elegans
cagtttttgccac

SEQ ID NO: 711137 - DNA, 13 bp, C. elegans
cagtttttgccat

SEQ ID NO: 711138 - DNA, 14 bp, C. elegans
cagtttttgcgtat

SEQ ID NO: 711139 - DNA, 13 bp, C. elegans
cagtttttgtaat

SEQ ID NO: 711140 - DNA, 13 bp, C. elegans
cagtttttgtaga

SEQ ID NO: 711141 - DNA, 13 bp, C. elegans
cagtttttgttat

SEQ ID NO: 711142 - DNA, 13 bp, C. elegans
cagtttttgttga

SEQ ID NO: 711143 - DNA, 13 bp, C. elegans
cagttttttaatc

SEQ ID NO: 711144 - DNA, 13 bp, C. elegans
cagttttttcttc

SEQ ID NO: 711145 - DNA, 13 bp, C. elegans
cagttttttggca

SEQ ID NO: 711146 - DNA, 13 bp, C. elegans
cagttttttgtaa

SEQ ID NO: 711147 - DNA, 13 bp, C. elegans
cataaaaaaggtt

SEQ ID NO: 711148 - DNA, 13 bp, C. elegans
cataaaaacatgt

SEQ ID NO: 711149 - DNA, 13 bp, C. elegans
cataaaaatcgat

SEQ ID NO: 711150 - DNA, 13 bp, C. elegans
cataaaaattgtg

SEQ ID NO: 711151 - DNA, 13 bp, C. elegans
cataaaacaaagt

SEQ ID NO: 711152 - DNA, 13 bp, C. elegans
cataaaacttgtt

SEQ ID NO: 711153 - DNA, 13 bp, C. elegans
cataaaataatgt

SEQ ID NO: 711154 - DNA, 13 bp, C. elegans
cataaaatatgat

SEQ ID NO: 711155 - DNA, 13 bp, C. elegans
cataaaatcgtat

SEQ ID NO: 711156 - DNA, 13 bp, C. elegans
cataaaattcaat

SEQ ID NO: 711157 - DNA, 13 bp, C. elegans
cataaaattcgaa

SEQ ID NO: 711158 - DNA, 13 bp, C. elegans
cataaacatgttt

SEQ ID NO: 711159 - DNA, 13 bp, C. elegans
cataaactgttat

SEQ ID NO: 711160 - DNA, 13 bp, C. elegans
cataaactttttt

SEQ ID NO: 711161 - DNA, 13 bp, C. elegans
cataaatcgacac

SEQ ID NO: 711162 - DNA, 14 bp, C. elegans
cataaatctcttca

SEQ ID NO: 711163 - DNA, 13 bp, C. elegans
cataaatgtattt

SEQ ID NO: 711164 - DNA, 13 bp, C. elegans
cataaatgtttaa

SEQ ID NO: 711165 - DNA, 13 bp, C. elegans
cataaattatcaa

SEQ ID NO: 711166 - DNA, 13 bp, C. elegans
cataaattcaaat

SEQ ID NO: 711167 - DNA, 13 bp, C. elegans
cataaattgaaat

SEQ ID NO: 711168 - DNA, 13 bp, C. elegans
cataaattgtcat

SEQ ID NO: 711169 - DNA, 13 bp, C. elegans
cataaattgtttt

SEQ ID NO: 711170 - DNA, 13 bp, C. elegans
cataaatttctga

SEQ ID NO: 711171 - DNA, 13 bp, C. elegans
cataaatttgaaa

SEQ ID NO: 711172 - DNA, 13 bp, C. elegans
cataaattttcag

SEQ ID NO: 711173 - DNA, 13 bp, C. elegans
cataaattttgaa

SEQ ID NO: 711174 - DNA, 13 bp, C. elegans
cataacaattttt

SEQ ID NO: 711175 - DNA, 13 bp, C. elegans
cataactttaaaa

SEQ ID NO: 711176 - DNA, 13 bp, C. elegans
cataatatcatca

SEQ ID NO: 711177 - DNA, 13 bp, C. elegans
cataattaattgt

SEQ ID NO: 711178 - DNA, 13 bp, C. elegans
cataattatgctt

SEQ ID NO: 711179 - DNA, 13 bp, C. elegans
cataattatgggc

SEQ ID NO: 711180 - DNA, 13 bp, C. elegans
cataatttcaatt

SEQ ID NO: 711181 - DNA, 13 bp, C. elegans
cataattttctca

SEQ ID NO: 711182 - DNA, 13 bp, C. elegans
cataattttctta

SEQ ID NO: 711183 - DNA, 13 bp, C. elegans
cataattttgaag

SEQ ID NO: 711184 - DNA, 13 bp, C. elegans
cataattttgact

SEQ ID NO: 711185 - DNA, 13 bp, C. elegans
cataatttttcat

SEQ ID NO: 711186 - DNA, 13 bp, C. elegans
cataatttttgaa

SEQ ID NO: 711187 - DNA, 13 bp, C. elegans
cataatttttttg

SEQ ID NO: 711188 - DNA, 13 bp, C. elegans
catacaataccca

SEQ ID NO: 711189 - DNA, 13 bp, C. elegans
catacatatacat

SEQ ID NO: 711190 - DNA, 13 bp, C. elegans
catacatatttat

SEQ ID NO: 711191 - DNA, 13 bp, C. elegans
catacccaacttt

SEQ ID NO: 711192 - DNA, 13 bp, C. elegans
catacgtttttat

SEQ ID NO: 711193 - DNA, 13 bp, C. elegans
catactaattttc

SEQ ID NO: 711194 - DNA, 13 bp, C. elegans
catactcgaattt

SEQ ID NO: 711195 - DNA, 13 bp, C. elegans
catactttttctg

SEQ ID NO: 711196 - DNA, 13 bp, C. elegans
catactttttgtt

SEQ ID NO: 711197 - DNA, 13 bp, C. elegans
catagaattttat

SEQ ID NO: 711198 - DNA, 13 bp, C. elegans
catagagtaaaat

SEQ ID NO: 711199 - DNA, 13 bp, C. elegans
catagttttcttc

SEQ ID NO: 711200 - DNA, 13 bp, C. elegans
catagtttttctc

SEQ ID NO: 711201 - DNA, 13 bp, C. elegans
catagtttttgat

SEQ ID NO: 711202 - DNA, 13 bp, C. elegans
catagttttttga

SEQ ID NO: 711203 - DNA, 13 bp, C. elegans
catataaaaatgt

SEQ ID NO: 711204 - DNA, 13 bp, C. elegans
catataaaatcag

SEQ ID NO: 711205 - DNA, 13 bp, C. elegans
catataaaatttg

SEQ ID NO: 711206 - DNA, 13 bp, C. elegans
catatacatatat

SEQ ID NO: 711207 - DNA, 13 bp, C. elegans
catataccgtata

SEQ ID NO: 711208 - DNA, 13 bp, C. elegans
catatactaaaat

SEQ ID NO: 711209 - DNA, 13 bp, C. elegans
catatatatatac

SEQ ID NO: 711210 - DNA, 13 bp, C. elegans
catatatattttc

SEQ ID NO: 711211 - DNA, 13 bp, C. elegans
catatatgtatat

SEQ ID NO: 711212 - DNA, 13 bp, C. elegans
catatattttcag

SEQ ID NO: 711213 - DNA, 13 bp, C. elegans
catatcattaact

SEQ ID NO: 711214 - DNA, 19 bp, C. elegans
catatctggggtagattta

SEQ ID NO: 711215 - DNA, 13 bp, C. elegans
catatgatcatat

SEQ ID NO: 711216 - DNA, 13 bp, C. elegans
catatgattttac

SEQ ID NO: 711217 - DNA, 13 bp, C. elegans
catatgatttttc

SEQ ID NO: 711218 - DNA, 13 bp, C. elegans
catatgtttcgtt

SEQ ID NO: 711219 - DNA, 13 bp, C. elegans
catattattcaaa

SEQ ID NO: 711220 - DNA, 13 bp, C. elegans
catattcaaataa

SEQ ID NO: 711221 - DNA, 13 bp, C. elegans
catattcatattc

SEQ ID NO: 711222 - DNA, 13 bp, C. elegans
catattccaccaa

SEQ ID NO: 711223 - DNA, 13 bp, C. elegans
catattcgaaaaa

SEQ ID NO: 711224 - DNA, 13 bp, C. elegans
catattctcaata

SEQ ID NO: 711225 - DNA, 13 bp, C. elegans
catattgcaattt

SEQ ID NO: 711226 - DNA, 13 bp, C. elegans
catattgctgttt

SEQ ID NO: 711227 - DNA, 13 bp, C. elegans
catatttcaagaa

SEQ ID NO: 711228 - DNA, 13 bp, C. elegans
catatttcaattg

SEQ ID NO: 711229 - DNA, 13 bp, C. elegans
catatttcagaat

SEQ ID NO: 711230 - DNA, 13 bp, C. elegans
catatttctaatt

SEQ ID NO: 711231 - DNA, 13 bp, C. elegans
catatttctgata

SEQ ID NO: 711232 - DNA, 13 bp, C. elegans
catattttcaaca

SEQ ID NO: 711233 - DNA, 13 bp, C. elegans
catattttcatat

SEQ ID NO: 711234 - DNA, 13 bp, C. elegans
catattttccata

SEQ ID NO: 711235 - DNA, 13 bp, C. elegans
catattttctcaa

SEQ ID NO: 711236 - DNA, 13 bp, C. elegans
catattttgccaa

SEQ ID NO: 711237 - DNA, 13 bp, C. elegans
catattttgtata

SEQ ID NO: 711238 - DNA, 13 bp, C. elegans
catattttgttca

SEQ ID NO: 711239 - DNA, 13 bp, C. elegans
catatttttcaaa

SEQ ID NO: 711240 - DNA, 13 bp, C. elegans
catatttttccaa

SEQ ID NO: 711241 - DNA, 13 bp, C. elegans
catatttttgaaa

SEQ ID NO: 711242 - DNA, 13 bp, C. elegans
catatttttgttc

SEQ ID NO: 711243 - DNA, 13 bp, C. elegans
catattttttcca

SEQ ID NO: 711244 - DNA, 13 bp, C. elegans
catatttttttag

SEQ ID NO: 711245 - DNA, 13 bp, C. elegans
catcaaaaactat

SEQ ID NO: 711246 - DNA, 13 bp, C. elegans
catcaaaaactga

SEQ ID NO: 711247 - DNA, 13 bp, C. elegans
catcaaaaagtat

SEQ ID NO: 711248 - DNA, 13 bp, C. elegans
catcaaaaagttt

SEQ ID NO: 711249 - DNA, 13 bp, C. elegans
catcaaaaatcac

SEQ ID NO: 711250 - DNA, 13 bp, C. elegans
catcaaaaattgg

SEQ ID NO: 711251 - DNA, 30 bp, C. elegans
catcaaaactcgccgagttatggagcttaa

SEQ ID NO: 711252 - DNA, 13 bp, C. elegans
catcaaaatcaac

SEQ ID NO: 711253 - DNA, 13 bp, C. elegans
catcaaaatttcg

SEQ ID NO: 711254 - DNA, 13 bp, C. elegans
catcaaactttta

SEQ ID NO: 711255 - DNA, 13 bp, C. elegans
catcaaattccca

SEQ ID NO: 711256 - DNA, 13 bp, C. elegans
catcaaattccta

SEQ ID NO: 711257 - DNA, 13 bp, C. elegans
catcaaattcgaa

SEQ ID NO: 711258 - DNA, 13 bp, C. elegans
catcaaattgaat

SEQ ID NO: 711259 - DNA, 13 bp, C. elegans
catcaaattgata

SEQ ID NO: 711260 - DNA, 13 bp, C. elegans
catcaactcccaa

SEQ ID NO: 711261 - DNA, 13 bp, C. elegans
catcaacttcaaa

SEQ ID NO: 711262 - DNA, 13 bp, C. elegans
catcaagttgttt

SEQ ID NO: 711263 - DNA, 13 bp, C. elegans
catcaatataaac

SEQ ID NO: 711264 - DNA, 13 bp, C. elegans
catcaatccgaaa

SEQ ID NO: 711265 - DNA, 13 bp, C. elegans
catcaatttgttt

SEQ ID NO: 711266 - DNA, 13 bp, C. elegans
catcaattttcac

SEQ ID NO: 711267 - DNA, 13 bp, C. elegans
catcaatttttca

SEQ ID NO: 711268 - DNA, 13 bp, C. elegans
catcaattttttc

SEQ ID NO: 711269 - DNA, 13 bp, C. elegans
catcaccaactcc

SEQ ID NO: 711270 - DNA, 13 bp, C. elegans
catcaccatcatc

SEQ ID NO: 711271 - DNA, 13 bp, C. elegans
catcagaatcaat

SEQ ID NO: 711272 - DNA, 13 bp, C. elegans
catcaggaagagc

SEQ ID NO: 711273 - DNA, 13 bp, C. elegans
catcaggtgggag

SEQ ID NO: 711274 - DNA, 13 bp, C. elegans
catcagttttaat

SEQ ID NO: 711275 - DNA, 13 bp, C. elegans
catcagtttttga

SEQ ID NO: 711276 - DNA, 13 bp, C. elegans
catcatattttac

SEQ ID NO: 711277 - DNA, 17 bp, C. elegans
catcatcaaccatctcc

SEQ ID NO: 711278 - DNA, 13 bp, C. elegans
catcatcatcaac

SEQ ID NO: 711279 - DNA, 13 bp, C. elegans
catcatcatcagc

SEQ ID NO: 711280 - DNA, 13 bp, C. elegans
catcatcatcatc

SEQ ID NO: 711281 - DNA, 13 bp, C. elegans
catcatcattatc

SEQ ID NO: 711282 - DNA, 13 bp, C. elegans
catcatcattatt

SEQ ID NO: 711283 - DNA, 13 bp, C. elegans
catcatcatttca

SEQ ID NO: 711284 - DNA, 13 bp, C. elegans
catcatcgtcatc

SEQ ID NO: 711285 - DNA, 13 bp, C. elegans
catcatcttcatc

SEQ ID NO: 711286 - DNA, 13 bp, C. elegans
catcattaatttt

SEQ ID NO: 711287 - DNA, 13 bp, C. elegans
catcatttcattt

SEQ ID NO: 711288 - DNA, 13 bp, C. elegans
catcattttcaac

SEQ ID NO: 711289 - DNA, 13 bp, C. elegans
catcattttccaa

SEQ ID NO: 711290 - DNA, 13 bp, C. elegans
catcattttggaa

SEQ ID NO: 711291 - DNA, 13 bp, C. elegans
catcatttttcaa

SEQ ID NO: 711292 - DNA, 13 bp, C. elegans
catcatttttcac

SEQ ID NO: 711293 - DNA, 13 bp, C. elegans
catcatttttcga

SEQ ID NO: 711294 - DNA, 13 bp, C. elegans
catcatttttgta

SEQ ID NO: 711295 - DNA, 13 bp, C. elegans
catcatttttgtt

SEQ ID NO: 711296 - DNA, 13 bp, C. elegans
catcattttttga

SEQ ID NO: 711297 - DNA, 13 bp, C. elegans
catcattttttgt

SEQ ID NO: 711298 - DNA, 14 bp, C. elegans
catccaatggattt

SEQ ID NO: 711299 - DNA, 13 bp, C. elegans
catcccttcaaat

SEQ ID NO: 711300 - DNA, 13 bp, C. elegans
catccgttttttt

SEQ ID NO: 711301 - DNA, 13 bp, C. elegans
catcctagttttt

SEQ ID NO: 711302 - DNA, 13 bp, C. elegans
catcctatgaatt

SEQ ID NO: 711303 - DNA, 13 bp, C. elegans
catcgaaaagcac

SEQ ID NO: 711304 - DNA, 13 bp, C. elegans
catcgaaaattga

SEQ ID NO: 711305 - DNA, 13 bp, C. elegans
catcgacttttaa

SEQ ID NO: 711306 - DNA, 16 bp, C. elegans
catcgaggtgagaccc

SEQ ID NO: 711307 - DNA, 13 bp, C. elegans
catcgatctgaaa

SEQ ID NO: 711308 - DNA, 13 bp, C. elegans
catcgattttttt

SEQ ID NO: 711309 - DNA, 13 bp, C. elegans
catcgcatttttt

SEQ ID NO: 711310 - DNA, 13 bp, C. elegans
catcgtcgtcgtc

SEQ ID NO: 711311 - DNA, 13 bp, C. elegans
catcgtcttcttc

SEQ ID NO: 711312 - DNA, 13 bp, C. elegans
catcgttttattt

SEQ ID NO: 711313 - DNA, 14 bp, C. elegans
catctacagtaacc

SEQ ID NO: 711314 - DNA, 13 bp, C. elegans
catctactggtct

SEQ ID NO: 711315 - DNA, 13 bp, C. elegans
catctagaaaatt

SEQ ID NO: 711316 - DNA, 13 bp, C. elegans
catctatttcatc

SEQ ID NO: 711317 - DNA, 13 bp, C. elegans
catctatttttca

SEQ ID NO: 711318 - DNA, 13 bp, C. elegans
catctcaaatatt

SEQ ID NO: 711319 - DNA, 13 bp, C. elegans
catctcaactgat

SEQ ID NO: 711320 - DNA, 13 bp, C. elegans
catctcaatagaa

SEQ ID NO: 711321 - DNA, 13 bp, C. elegans
catctcacggatt

SEQ ID NO: 711322 - DNA, 13 bp, C. elegans
catctcacgggtt

SEQ ID NO: 711323 - DNA, 13 bp, C. elegans
catctccaatctt

SEQ ID NO: 711324 - DNA, 13 bp, C. elegans
catctccattttt

SEQ ID NO: 711325 - DNA, 13 bp, C. elegans
catctcgatttca

SEQ ID NO: 711326 - DNA, 13 bp, C. elegans
catctcttttact

SEQ ID NO: 711327 - DNA, 13 bp, C. elegans
catctgatcaaat

SEQ ID NO: 711328 - DNA, 13 bp, C. elegans
catctgcaaaaaa

SEQ ID NO: 711329 - DNA, 13 bp, C. elegans
catctggtttctg

SEQ ID NO: 711330 - DNA, 13 bp, C. elegans
catctgtaactat

SEQ ID NO: 711331 - DNA, 13 bp, C. elegans
catcttcaaactc

SEQ ID NO: 711332 - DNA, 13 bp, C. elegans
catcttcaagaaa

SEQ ID NO: 711333 - DNA, 13 bp, C. elegans
catcttcttcatc

SEQ ID NO: 711334 - DNA, 13 bp, C. elegans
catctttgaaatt

SEQ ID NO: 711335 - DNA, 13 bp, C. elegans
catcttttcatct

SEQ ID NO: 711336 - DNA, 13 bp, C. elegans
catcttttgaaaa

SEQ ID NO: 711337 - DNA, 13 bp, C. elegans
catcttttgatct

SEQ ID NO: 711338 - DNA, 13 bp, C. elegans
catgaaaaaatga

SEQ ID NO: 711339 - DNA, 13 bp, C. elegans
catgaaaaactga

SEQ ID NO: 711340 - DNA, 13 bp, C. elegans
catgaaaaacttt

SEQ ID NO: 711341 - DNA, 13 bp, C. elegans
catgaaaaatcaa

SEQ ID NO: 711342 - DNA, 13 bp, C. elegans
catgaaaactgaa

SEQ ID NO: 711343 - DNA, 13 bp, C. elegans
catgaaaatatca

SEQ ID NO: 711344 - DNA, 13 bp, C. elegans
catgaaaattatt

SEQ ID NO: 711345 - DNA, 13 bp, C. elegans
catgaaaattgaa

SEQ ID NO: 711346 - DNA, 13 bp, C. elegans
catgaaacatgtt

SEQ ID NO: 711347 - DNA, 13 bp, C. elegans
catgaaatcaaaa

SEQ ID NO: 711348 - DNA, 15 bp, C. elegans
catgaagtcacacgg

SEQ ID NO: 711349 - DNA, 13 bp, C. elegans
catgaataagtta

SEQ ID NO: 711350 - DNA, 13 bp, C. elegans
catgaattttgaa

SEQ ID NO: 711351 - DNA, 13 bp, C. elegans
catgacttttttt

SEQ ID NO: 711352 - DNA, 13 bp, C. elegans
catgatattttca

SEQ ID NO: 711353 - DNA, 13 bp, C. elegans
catgatcaaaatt

SEQ ID NO: 711354 - DNA, 13 bp, C. elegans
catgattatactt

SEQ ID NO: 711355 - DNA, 13 bp, C. elegans
catgattatcgat

SEQ ID NO: 711356 - DNA, 13 bp, C. elegans
catgattttcaaa

SEQ ID NO: 711357 - DNA, 13 bp, C. elegans
catgcacacattt

SEQ ID NO: 711358 - DNA, 13 bp, C. elegans
catgcatttttaa

SEQ ID NO: 711359 - DNA, 13 bp, C. elegans
catgcgcctttaa

SEQ ID NO: 711360 - DNA, 13 bp, C. elegans
catgctctaatgc

SEQ ID NO: 711361 - DNA, 13 bp, C. elegans
catggcctagaaa

SEQ ID NO: 711362 - DNA, 13 bp, C. elegans
catgggaaatgtg

SEQ ID NO: 711363 - DNA, 13 bp, C. elegans
catggtgcatcga

SEQ ID NO: 711364 - DNA, 13 bp, C. elegans
catggttaagagt

SEQ ID NO: 711365 - DNA, 13 bp, C. elegans
catgtatgtattt

SEQ ID NO: 711366 - DNA, 13 bp, C. elegans
catgtattcagtg

SEQ ID NO: 711367 - DNA, 13 bp, C. elegans
catgtatttcagt

SEQ ID NO: 711368 - DNA, 13 bp, C. elegans
catgtcaaaaaaa

SEQ ID NO: 711369 - DNA, 15 bp, C. elegans
catgtgaaacgtggc

SEQ ID NO: 711370 - DNA, 15 bp, C. elegans
catgtgagcaactca

SEQ ID NO: 711371 - DNA, 13 bp, C. elegans
catgtgctctttt

SEQ ID NO: 711372 - DNA, 13 bp, C. elegans
catgttccaagaa

SEQ ID NO: 711373 - DNA, 13 bp, C. elegans
catgtttatactt

SEQ ID NO: 711374 - DNA, 13 bp, C. elegans
catgtttcaaaag

SEQ ID NO: 711375 - DNA, 13 bp, C. elegans
catgtttcaattt

SEQ ID NO: 711376 - DNA, 13 bp, C. elegans
catgttttattta

SEQ ID NO: 711377 - DNA, 13 bp, C. elegans
catgttttcaaga

SEQ ID NO: 711378 - DNA, 13 bp, C. elegans
catgttttcagtt

SEQ ID NO: 711379 - DNA, 13 bp, C. elegans
catgttttcattt

SEQ ID NO: 711380 - DNA, 13 bp, C. elegans
catgtttttatat

SEQ ID NO: 711381 - DNA, 13 bp, C. elegans
catgtttttatgt

SEQ ID NO: 711382 - DNA, 13 bp, C. elegans
catgtttttattg

SEQ ID NO: 711383 - DNA, 13 bp, C. elegans
catgtttttcagt

SEQ ID NO: 711384 - DNA, 13 bp, C. elegans
catgtttttgaaa

SEQ ID NO: 711385 - DNA, 13 bp, C. elegans
catgtttttttca

SEQ ID NO: 711386 - DNA, 13 bp, C. elegans
cattaaaaactga

SEQ ID NO: 711387 - DNA, 13 bp, C. elegans
cattaaaaatagt

SEQ ID NO: 711388 - DNA, 13 bp, C. elegans
cattaaaaatcgg

SEQ ID NO: 711389 - DNA, 13 bp, C. elegans
cattaaaaatgaa

SEQ ID NO: 711390 - DNA, 13 bp, C. elegans
cattaaaaattca

SEQ ID NO: 711391 - DNA, 13 bp, C. elegans
cattaaaattcga

SEQ ID NO: 711392 - DNA, 13 bp, C. elegans
cattaaaatttga

SEQ ID NO: 711393 - DNA, 13 bp, C. elegans
cattaaattttga

SEQ ID NO: 711394 - DNA, 13 bp, C. elegans
cattaactttttc

SEQ ID NO: 711395 - DNA, 13 bp, C. elegans
cattaatcatttt

SEQ ID NO: 711396 - DNA, 13 bp, C. elegans
cattaatgttttt

SEQ ID NO: 711397 - DNA, 13 bp, C. elegans
cattaattcaatt

SEQ ID NO: 711398 - DNA, 13 bp, C. elegans
cattaattgtttt

SEQ ID NO: 711399 - DNA, 13 bp, C. elegans
cattacagtttga

SEQ ID NO: 711400 - DNA, 13 bp, C. elegans
cattactgaaaaa

SEQ ID NO: 711401 - DNA, 13 bp, C. elegans
cattacttttaaa

SEQ ID NO: 711402 - DNA, 13 bp, C. elegans
cattatatttttg

SEQ ID NO: 711403 - DNA, 13 bp, C. elegans
cattatcagtttt

SEQ ID NO: 711404 - DNA, 13 bp, C. elegans
cattatcatcatc

SEQ ID NO: 711405 - DNA, 13 bp, C. elegans
cattatcattatt

SEQ ID NO: 711406 - DNA, 13 bp, C. elegans
cattatccatcaa

SEQ ID NO: 711407 - DNA, 13 bp, C. elegans
cattattcaattt

SEQ ID NO: 711408 - DNA, 13 bp, C. elegans
cattattgaattc

SEQ ID NO: 711409 - DNA, 13 bp, C. elegans
cattatttcaatt

SEQ ID NO: 711410 - DNA, 13 bp, C. elegans
cattattttgttg

SEQ ID NO: 711411 - DNA, 13 bp, C. elegans
cattcaaaaactt

SEQ ID NO: 711412 - DNA, 13 bp, C. elegans
cattcaaaaagtg

SEQ ID NO: 711413 - DNA, 13 bp, C. elegans
cattcaaaagttc

SEQ ID NO: 711414 - DNA, 13 bp, C. elegans
cattcaaaatttc

SEQ ID NO: 711415 - DNA, 13 bp, C. elegans
cattcaaagaatt

SEQ ID NO: 711416 - DNA, 13 bp, C. elegans
cattcaaatataa

SEQ ID NO: 711417 - DNA, 13 bp, C. elegans
cattcaaattgat

SEQ ID NO: 711418 - DNA, 13 bp, C. elegans
cattcaaatttga

SEQ ID NO: 711419 - DNA, 13 bp, C. elegans
cattcaattaatt

SEQ ID NO: 711420 - DNA, 13 bp, C. elegans
cattcaattattt

SEQ ID NO: 711421 - DNA, 13 bp, C. elegans
cattcaattgaaa

SEQ ID NO: 711422 - DNA, 13 bp, C. elegans
cattcaattgtga

SEQ ID NO: 711423 - DNA, 13 bp, C. elegans
cattcaattttaa

SEQ ID NO: 711424 - DNA, 13 bp, C. elegans
cattcaatttttc

SEQ ID NO: 711425 - DNA, 13 bp, C. elegans
cattcacatttct

SEQ ID NO: 711426 - DNA, 13 bp, C. elegans
cattcacttttca

SEQ ID NO: 711427 - DNA, 13 bp, C. elegans
cattcattcattc

SEQ ID NO: 711428 - DNA, 13 bp, C. elegans
cattcattgtttt

SEQ ID NO: 711429 - DNA, 13 bp, C. elegans
cattcatttcaaa

SEQ ID NO: 711430 - DNA, 13 bp, C. elegans
cattcatttctca

SEQ ID NO: 711431 - DNA, 13 bp, C. elegans
cattcatttcttc

SEQ ID NO: 711432 - DNA, 13 bp, C. elegans
cattcatttgtct

SEQ ID NO: 711433 - DNA, 13 bp, C. elegans
cattcattttcta

SEQ ID NO: 711434 - DNA, 13 bp, C. elegans
cattcattttgaa

SEQ ID NO: 711435 - DNA, 13 bp, C. elegans
cattcatttttgt

SEQ ID NO: 711436 - DNA, 13 bp, C. elegans
cattccaaatttt

SEQ ID NO: 711437 - DNA, 13 bp, C. elegans
cattccaattttc

SEQ ID NO: 711438 - DNA, 13 bp, C. elegans
cattccagaaaac

SEQ ID NO: 711439 - DNA, 13 bp, C. elegans
cattccagaactt

SEQ ID NO: 711440 - DNA, 13 bp, C. elegans
cattcccaaaaaa

SEQ ID NO: 711441 - DNA, 14 bp, C. elegans
cattcccatacata

SEQ ID NO: 711442 - DNA, 13 bp, C. elegans
cattccgcataaa

SEQ ID NO: 711443 - DNA, 13 bp, C. elegans
cattcctgaaaaa

SEQ ID NO: 711444 - DNA, 13 bp, C. elegans
cattcctttgcac

SEQ ID NO: 711445 - DNA, 13 bp, C. elegans
cattcgaaaaagt

SEQ ID NO: 711446 - DNA, 13 bp, C. elegans
cattcgatttcaa

SEQ ID NO: 711447 - DNA, 13 bp, C. elegans
cattcgatttttc

SEQ ID NO: 711448 - DNA, 13 bp, C. elegans
cattcgtttttaa

SEQ ID NO: 711449 - DNA, 13 bp, C. elegans
cattcgttttttc

SEQ ID NO: 711450 - DNA, 13 bp, C. elegans
cattctcaaaatt

SEQ ID NO: 711451 - DNA, 13 bp, C. elegans
cattctcatgatc

SEQ ID NO: 711452 - DNA, 13 bp, C. elegans
cattctcattctc

SEQ ID NO: 711453 - DNA, 13 bp, C. elegans
cattctctccaat

SEQ ID NO: 711454 - DNA, 13 bp, C. elegans
cattctgaaaatc

SEQ ID NO: 711455 - DNA, 13 bp, C. elegans
cattctgattttt

SEQ ID NO: 711456 - DNA, 13 bp, C. elegans
cattcttttaaat

SEQ ID NO: 711457 - DNA, 13 bp, C. elegans
cattctttttgaa

SEQ ID NO: 711458 - DNA, 13 bp, C. elegans
cattgaaaatgaa

SEQ ID NO: 711459 - DNA, 13 bp, C. elegans
cattgaaacagaa

SEQ ID NO: 711460 - DNA, 13 bp, C. elegans
cattgaaattcga

SEQ ID NO: 711461 - DNA, 13 bp, C. elegans
cattgaaattttt

SEQ ID NO: 711462 - DNA, 13 bp, C. elegans
cattgaacagttt

SEQ ID NO: 711463 - DNA, 13 bp, C. elegans
cattgaataataa

SEQ ID NO: 711464 - DNA, 13 bp, C. elegans
cattgacaagtcg

SEQ ID NO: 711465 - DNA, 13 bp, C. elegans
cattgataatttg

SEQ ID NO: 711466 - DNA, 13 bp, C. elegans
cattgatttgtct

SEQ ID NO: 711467 - DNA, 13 bp, C. elegans
cattgatttgttt

SEQ ID NO: 711468 - DNA, 13 bp, C. elegans
cattgattttcag

SEQ ID NO: 711469 - DNA, 14 bp, C. elegans
cattgatttttcat

SEQ ID NO: 711470 - DNA, 13 bp, C. elegans
cattgcacacaca

SEQ ID NO: 711471 - DNA, 13 bp, C. elegans
cattgcatatttt

SEQ ID NO: 711472 - DNA, 13 bp, C. elegans
cattgctcagctt

SEQ ID NO: 711473 - DNA, 13 bp, C. elegans
cattgctgaatga

SEQ ID NO: 711474 - DNA, 13 bp, C. elegans
cattggaaaaaag

SEQ ID NO: 711475 - DNA, 13 bp, C. elegans
cattgggagccga

SEQ ID NO: 711476 - DNA, 13 bp, C. elegans
cattggtgctatt

SEQ ID NO: 711477 - DNA, 13 bp, C. elegans
cattgtcaactga

SEQ ID NO: 711478 - DNA, 14 bp, C. elegans
cattgtggtgagac

SEQ ID NO: 711479 - DNA, 13 bp, C. elegans
cattgttattatt

SEQ ID NO: 711480 - DNA, 13 bp, C. elegans
cattgttcaaaat

SEQ ID NO: 711481 - DNA, 13 bp, C. elegans
cattgttcaactt

SEQ ID NO: 711482 - DNA, 13 bp, C. elegans
cattgttcgcttg

SEQ ID NO: 711483 - DNA, 13 bp, C. elegans
cattgttgaaatt

SEQ ID NO: 711484 - DNA, 13 bp, C. elegans
cattgttgttttc

SEQ ID NO: 711485 - DNA, 13 bp, C. elegans
cattgttttttcc

SEQ ID NO: 711486 - DNA, 13 bp, C. elegans
catttaaaaaagt

SEQ ID NO: 711487 - DNA, 13 bp, C. elegans
catttaaaaaatg

SEQ ID NO: 711488 - DNA, 13 bp, C. elegans
catttaaaagttt

SEQ ID NO: 711489 - DNA, 13 bp, C. elegans
catttaaagcaaa

SEQ ID NO: 711490 - DNA, 13 bp, C. elegans
catttaaagccaa

SEQ ID NO: 711491 - DNA, 13 bp, C. elegans
catttaatcattt

SEQ ID NO: 711492 - DNA, 13 bp, C. elegans
catttacaatttt

SEQ ID NO: 711493 - DNA, 13 bp, C. elegans
catttaccaaaaa

SEQ ID NO: 711494 - DNA, 13 bp, C. elegans
catttactgaaaa

SEQ ID NO: 711495 - DNA, 13 bp, C. elegans
catttagacaaaa

SEQ ID NO: 711496 - DNA, 13 bp, C. elegans
catttatagacaa

SEQ ID NO: 711497 - DNA, 13 bp, C. elegans
catttatagattt

SEQ ID NO: 711498 - DNA, 13 bp, C. elegans
catttatcatttc

SEQ ID NO: 711499 - DNA, 13 bp, C. elegans
catttatcttgct

SEQ ID NO: 711500 - DNA, 13 bp, C. elegans
catttattcatat

SEQ ID NO: 711501 - DNA, 13 bp, C. elegans
catttattggctt

SEQ ID NO: 711502 - DNA, 13 bp, C. elegans
catttattgtatt

SEQ ID NO: 711503 - DNA, 13 bp, C. elegans
catttatttacaa

SEQ ID NO: 711504 - DNA, 13 bp, C. elegans
catttatttcaat

SEQ ID NO: 711505 - DNA, 13 bp, C. elegans
catttatttcagc

SEQ ID NO: 711506 - DNA, 13 bp, C. elegans
catttatttcgaa

SEQ ID NO: 711507 - DNA, 13 bp, C. elegans
catttatttgaat

SEQ ID NO: 711508 - DNA, 13 bp, C. elegans
catttattttgca

SEQ ID NO: 711509 - DNA, 13 bp, C. elegans
catttattttgta

SEQ ID NO: 711510 - DNA, 13 bp, C. elegans
catttatttttag

SEQ ID NO: 711511 - DNA, 13 bp, C. elegans
catttatttttga

SEQ ID NO: 711512 - DNA, 13 bp, C. elegans
catttcaaaaatt

SEQ ID NO: 711513 - DNA, 13 bp, C. elegans
catttcaaaagtt

SEQ ID NO: 711514 - DNA, 13 bp, C. elegans
catttcaaacaaa

SEQ ID NO: 711515 - DNA, 13 bp, C. elegans
catttcaaattaa

SEQ ID NO: 711516 - DNA, 13 bp, C. elegans
catttcaaatttt

SEQ ID NO: 711517 - DNA, 13 bp, C. elegans
catttcaataaat

SEQ ID NO: 711518 - DNA, 13 bp, C. elegans
catttcaatgaaa

SEQ ID NO: 711519 - DNA, 13 bp, C. elegans
catttcaattcta

SEQ ID NO: 711520 - DNA, 13 bp, C. elegans
catttcaatttat

SEQ ID NO: 711521 - DNA, 13 bp, C. elegans
catttcaatttga

SEQ ID NO: 711522 - DNA, 13 bp, C. elegans
catttcaattttc

SEQ ID NO: 711523 - DNA, 13 bp, C. elegans
catttcacatttt

SEQ ID NO: 711524 - DNA, 13 bp, C. elegans
catttcacttttc

SEQ ID NO: 711525 - DNA, 13 bp, C. elegans
catttcagtttga

SEQ ID NO: 711526 - DNA, 13 bp, C. elegans
catttcataattt

SEQ ID NO: 711527 - DNA, 13 bp, C. elegans
catttcatagttt

SEQ ID NO: 711528 - DNA, 13 bp, C. elegans
catttcatattta

SEQ ID NO: 711529 - DNA, 13 bp, C. elegans
catttcattttca

SEQ ID NO: 711530 - DNA, 13 bp, C. elegans
catttccaacaaa

SEQ ID NO: 711531 - DNA, 13 bp, C. elegans
catttccataatt

SEQ ID NO: 711532 - DNA, 13 bp, C. elegans
catttccatttca

SEQ ID NO: 711533 - DNA, 13 bp, C. elegans
catttcccaaaaa

SEQ ID NO: 711534 - DNA, 13 bp, C. elegans
catttcccacact

SEQ ID NO: 711535 - DNA, 13 bp, C. elegans
catttcccatttc

SEQ ID NO: 711536 - DNA, 13 bp, C. elegans
catttccttttca

SEQ ID NO: 711537 - DNA, 13 bp, C. elegans
catttcgatttat

SEQ ID NO: 711538 - DNA, 13 bp, C. elegans
catttcgcattat

SEQ ID NO: 711539 - DNA, 13 bp, C. elegans
catttctaaatgt

SEQ ID NO: 711540 - DNA, 13 bp, C. elegans
catttctactttg

SEQ ID NO: 711541 - DNA, 13 bp, C. elegans
catttctattaaa

SEQ ID NO: 711542 - DNA, 13 bp, C. elegans
catttctcaaaaa

SEQ ID NO: 711543 - DNA, 13 bp, C. elegans
catttctcaagtt

SEQ ID NO: 711544 - DNA, 13 bp, C. elegans
catttctcaattt

SEQ ID NO: 711545 - DNA, 13 bp, C. elegans
catttctcacatt

SEQ ID NO: 711546 - DNA, 13 bp, C. elegans
catttctcattca

SEQ ID NO: 711547 - DNA, 13 bp, C. elegans
catttctccattt

SEQ ID NO: 711548 - DNA, 13 bp, C. elegans
catttctcgacat

SEQ ID NO: 711549 - DNA, 13 bp, C. elegans
catttctcgtttt

SEQ ID NO: 711550 - DNA, 13 bp, C. elegans
catttctctcaaa

SEQ ID NO: 711551 - DNA, 13 bp, C. elegans
catttctgaacaa

SEQ ID NO: 711552 - DNA, 13 bp, C. elegans
catttctgcattt

SEQ ID NO: 711553 - DNA, 13 bp, C. elegans
catttctggaaaa

SEQ ID NO: 711554 - DNA, 13 bp, C. elegans
catttcttcacaa

SEQ ID NO: 711555 - DNA, 13 bp, C. elegans
catttcttgcaaa

SEQ ID NO: 711556 - DNA, 13 bp, C. elegans
catttctttcaaa

SEQ ID NO: 711557 - DNA, 13 bp, C. elegans
catttctttcaat

SEQ ID NO: 711558 - DNA, 13 bp, C. elegans
catttgaaagaag

SEQ ID NO: 711559 - DNA, 13 bp, C. elegans
catttgaaagctc

SEQ ID NO: 711560 - DNA, 13 bp, C. elegans
catttgaaagctg

SEQ ID NO: 711561 - DNA, 13 bp, C. elegans
catttgaaattcc

SEQ ID NO: 711562 - DNA, 13 bp, C. elegans
catttgaaattga

SEQ ID NO: 711563 - DNA, 13 bp, C. elegans
catttgaaattgt

SEQ ID NO: 711564 - DNA, 13 bp, C. elegans
catttgaaatttt

SEQ ID NO: 711565 - DNA, 13 bp, C. elegans
catttgaacaaat

SEQ ID NO: 711566 - DNA, 13 bp, C. elegans
catttgaagataa

SEQ ID NO: 711567 - DNA, 13 bp, C. elegans
catttgaagcaaa

SEQ ID NO: 711568 - DNA, 13 bp, C. elegans
catttgaatttat

SEQ ID NO: 711569 - DNA, 13 bp, C. elegans
catttgaatttcc

SEQ ID NO: 711570 - DNA, 13 bp, C. elegans
catttgaccactt

SEQ ID NO: 711571 - DNA, 13 bp, C. elegans
catttgatttgaa

SEQ ID NO: 711572 - DNA, 13 bp, C. elegans
catttgattttca

SEQ ID NO: 711573 - DNA, 13 bp, C. elegans
catttgcaatttt

SEQ ID NO: 711574 - DNA, 13 bp, C. elegans
catttgcactgaa

SEQ ID NO: 711575 - DNA, 13 bp, C. elegans
catttgcattttc

SEQ ID NO: 711576 - DNA, 13 bp, C. elegans
catttgccaccgg

SEQ ID NO: 711577 - DNA, 13 bp, C. elegans
catttgccgaaat

SEQ ID NO: 711578 - DNA, 13 bp, C. elegans
catttggaaaaca

SEQ ID NO: 711579 - DNA, 13 bp, C. elegans
catttggaatcga

SEQ ID NO: 711580 - DNA, 13 bp, C. elegans
catttggagcaat

SEQ ID NO: 711581 - DNA, 13 bp, C. elegans
catttggagcatt

SEQ ID NO: 711582 - DNA, 13 bp, C. elegans
catttggcaagtt

SEQ ID NO: 711583 - DNA, 13 bp, C. elegans
catttggttcata

SEQ ID NO: 711584 - DNA, 13 bp, C. elegans
catttgtattatt

SEQ ID NO: 711585 - DNA, 13 bp, C. elegans
catttgtctacat

SEQ ID NO: 711586 - DNA, 13 bp, C. elegans
catttgttcattt

SEQ ID NO: 711587 - DNA, 13 bp, C. elegans
catttgttgaaaa

SEQ ID NO: 711588 - DNA, 13 bp, C. elegans
catttgtttattc

SEQ ID NO: 711589 - DNA, 13 bp, C. elegans
cattttaaaactt

SEQ ID NO: 711590 - DNA, 13 bp, C. elegans
cattttaaaagtt

SEQ ID NO: 711591 - DNA, 13 bp, C. elegans
cattttaaaattg

SEQ ID NO: 711592 - DNA, 13 bp, C. elegans
cattttaagatat

SEQ ID NO: 711593 - DNA, 13 bp, C. elegans
cattttaagcatt

SEQ ID NO: 711594 - DNA, 13 bp, C. elegans
cattttaagtttt

SEQ ID NO: 711595 - DNA, 13 bp, C. elegans
cattttaatgtaa

SEQ ID NO: 711596 - DNA, 13 bp, C. elegans
cattttaatttca

SEQ ID NO: 711597 - DNA, 13 bp, C. elegans
cattttacaaaaa

SEQ ID NO: 711598 - DNA, 13 bp, C. elegans
cattttacaacaa

SEQ ID NO: 711599 - DNA, 13 bp, C. elegans
cattttacaattt

SEQ ID NO: 711600 - DNA, 13 bp, C. elegans
cattttagtttga

SEQ ID NO: 711601 - DNA, 13 bp, C. elegans
cattttatatgaa

SEQ ID NO: 711602 - DNA, 13 bp, C. elegans
cattttatcaatt

SEQ ID NO: 711603 - DNA, 13 bp, C. elegans
cattttatccaaa

SEQ ID NO: 711604 - DNA, 13 bp, C. elegans
cattttatcgatt

SEQ ID NO: 711605 - DNA, 13 bp, C. elegans
cattttatgtgtt

SEQ ID NO: 711606 - DNA, 13 bp, C. elegans
cattttattgatt

SEQ ID NO: 711607 - DNA, 13 bp, C. elegans
cattttattgtaa

SEQ ID NO: 711608 - DNA, 13 bp, C. elegans
cattttattgtta

SEQ ID NO: 711609 - DNA, 13 bp, C. elegans
cattttatttgac

SEQ ID NO: 711610 - DNA, 13 bp, C. elegans
cattttcaaaaat

SEQ ID NO: 711611 - DNA, 13 bp, C. elegans
cattttcaaaaca

SEQ ID NO: 711612 - DNA, 13 bp, C. elegans
cattttcaaacaa

SEQ ID NO: 711613 - DNA, 13 bp, C. elegans
cattttcaaagta

SEQ ID NO: 711614 - DNA, 13 bp, C. elegans
cattttcaaatta

SEQ ID NO: 711615 - DNA, 13 bp, C. elegans
cattttcaacaaa

SEQ ID NO: 711616 - DNA, 13 bp, C. elegans
cattttcaacatt

SEQ ID NO: 711617 - DNA, 13 bp, C. elegans
cattttcaacgtg

SEQ ID NO: 711618 - DNA, 13 bp, C. elegans
cattttcaacttg

SEQ ID NO: 711619 - DNA, 13 bp, C. elegans
cattttcaagaaa

SEQ ID NO: 711620 - DNA, 13 bp, C. elegans
cattttcaagaat

SEQ ID NO: 711621 - DNA, 13 bp, C. elegans
cattttcaagtac

SEQ ID NO: 711622 - DNA, 13 bp, C. elegans
cattttcaatatt

SEQ ID NO: 711623 - DNA, 13 bp, C. elegans
cattttcaatcac

SEQ ID NO: 711624 - DNA, 13 bp, C. elegans
cattttcaatgaa

SEQ ID NO: 711625 - DNA, 13 bp, C. elegans
cattttcaattcg

SEQ ID NO: 711626 - DNA, 13 bp, C. elegans
cattttcaatttc

SEQ ID NO: 711627 - DNA, 13 bp, C. elegans
cattttcacaaaa

SEQ ID NO: 711628 - DNA, 13 bp, C. elegans
cattttcacaaat

SEQ ID NO: 711629 - DNA, 13 bp, C. elegans
cattttcacaaga

SEQ ID NO: 711630 - DNA, 13 bp, C. elegans
cattttcactttg

SEQ ID NO: 711631 - DNA, 13 bp, C. elegans
cattttcagaata

SEQ ID NO: 711632 - DNA, 13 bp, C. elegans
cattttcagactt

SEQ ID NO: 711633 - DNA, 13 bp, C. elegans
cattttcagccaa

SEQ ID NO: 711634 - DNA, 13 bp, C. elegans
cattttcagcctt

SEQ ID NO: 711635 - DNA, 13 bp, C. elegans
cattttcagtaga

SEQ ID NO: 711636 - DNA, 13 bp, C. elegans
cattttcagtcat

SEQ ID NO: 711637 - DNA, 13 bp, C. elegans
cattttcagtctt

SEQ ID NO: 711638 - DNA, 13 bp, C. elegans
cattttcagtgat

SEQ ID NO: 711639 - DNA, 13 bp, C. elegans
cattttcagttaa

SEQ ID NO: 711640 - DNA, 13 bp, C. elegans
cattttcataact

SEQ ID NO: 711641 - DNA, 13 bp, C. elegans
cattttcataatt

SEQ ID NO: 711642 - DNA, 13 bp, C. elegans
cattttcatcaaa

SEQ ID NO: 711643 - DNA, 13 bp, C. elegans
cattttcattgaa

SEQ ID NO: 711644 - DNA, 13 bp, C. elegans
cattttccaaaaa

SEQ ID NO: 711645 - DNA, 13 bp, C. elegans
cattttccaaaat

SEQ ID NO: 711646 - DNA, 13 bp, C. elegans
cattttccaacaa

SEQ ID NO: 711647 - DNA, 13 bp, C. elegans
cattttccaactt

SEQ ID NO: 711648 - DNA, 13 bp, C. elegans
cattttccaataa

SEQ ID NO: 711649 - DNA, 13 bp, C. elegans
cattttccaattt

SEQ ID NO: 711650 - DNA, 13 bp, C. elegans
cattttccacaca

SEQ ID NO: 711651 - DNA, 13 bp, C. elegans
cattttccatcat

SEQ ID NO: 711652 - DNA, 13 bp, C. elegans
cattttccatctt

SEQ ID NO: 711653 - DNA, 13 bp, C. elegans
cattttccattga

SEQ ID NO: 711654 - DNA, 13 bp, C. elegans
cattttccattta

SEQ ID NO: 711655 - DNA, 13 bp, C. elegans
cattttcccatca

SEQ ID NO: 711656 - DNA, 13 bp, C. elegans
cattttccccact

SEQ ID NO: 711657 - DNA, 13 bp, C. elegans
cattttcccgttt

SEQ ID NO: 711658 - DNA, 13 bp, C. elegans
cattttccgaact

SEQ ID NO: 711659 - DNA, 13 bp, C. elegans
cattttccgagtt

SEQ ID NO: 711660 - DNA, 13 bp, C. elegans
cattttccttatc

SEQ ID NO: 711661 - DNA, 13 bp, C. elegans
cattttcgaagaa

SEQ ID NO: 711662 - DNA, 13 bp, C. elegans
cattttcgatatt

SEQ ID NO: 711663 - DNA, 13 bp, C. elegans
cattttcgatcat

SEQ ID NO: 711664 - DNA, 13 bp, C. elegans
cattttcgcaatt

SEQ ID NO: 711665 - DNA, 13 bp, C. elegans
cattttcgcattt

SEQ ID NO: 711666 - DNA, 13 bp, C. elegans
cattttcggaaaa

SEQ ID NO: 711667 - DNA, 13 bp, C. elegans
cattttcggcaat

SEQ ID NO: 711668 - DNA, 13 bp, C. elegans
cattttcggtgcc

SEQ ID NO: 711669 - DNA, 13 bp, C. elegans
cattttcgtattt

SEQ ID NO: 711670 - DNA, 13 bp, C. elegans
cattttcgtgttt

SEQ ID NO: 711671 - DNA, 13 bp, C. elegans
cattttctaagcc

SEQ ID NO: 711672 - DNA, 13 bp, C. elegans
cattttctacaat

SEQ ID NO: 711673 - DNA, 13 bp, C. elegans
cattttctacatt

SEQ ID NO: 711674 - DNA, 13 bp, C. elegans
cattttctatata

SEQ ID NO: 711675 - DNA, 13 bp, C. elegans
cattttctatgtt

SEQ ID NO: 711676 - DNA, 13 bp, C. elegans
cattttctattga

SEQ ID NO: 711677 - DNA, 13 bp, C. elegans
cattttctatttg

SEQ ID NO: 711678 - DNA, 13 bp, C. elegans
cattttctcaaaa

SEQ ID NO: 711679 - DNA, 13 bp, C. elegans
cattttctcacct

SEQ ID NO: 711680 - DNA, 13 bp, C. elegans
cattttctcatca

SEQ ID NO: 711681 - DNA, 13 bp, C. elegans
cattttctcccgt

SEQ ID NO: 711682 - DNA, 13 bp, C. elegans
cattttctctaaa

SEQ ID NO: 711683 - DNA, 13 bp, C. elegans
cattttctgaaaa

SEQ ID NO: 711684 - DNA, 13 bp, C. elegans
cattttctgcatt

SEQ ID NO: 711685 - DNA, 13 bp, C. elegans
cattttctggatt

SEQ ID NO: 711686 - DNA, 13 bp, C. elegans
cattttcttcgtt

SEQ ID NO: 711687 - DNA, 13 bp, C. elegans
cattttcttgcca

SEQ ID NO: 711688 - DNA, 13 bp, C. elegans
cattttctttgat

SEQ ID NO: 711689 - DNA, 13 bp, C. elegans
cattttgaaaaga

SEQ ID NO: 711690 - DNA, 13 bp, C. elegans
cattttgaaatga

SEQ ID NO: 711691 - DNA, 13 bp, C. elegans
cattttgaagtga

SEQ ID NO: 711692 - DNA, 13 bp, C. elegans
cattttgaagtgc

SEQ ID NO: 711693 - DNA, 13 bp, C. elegans
cattttgaataaa

SEQ ID NO: 711694 - DNA, 13 bp, C. elegans
cattttgacacca

SEQ ID NO: 711695 - DNA, 13 bp, C. elegans
cattttgaccatt

SEQ ID NO: 711696 - DNA, 13 bp, C. elegans
cattttgagcatt

SEQ ID NO: 711697 - DNA, 13 bp, C. elegans
cattttgatcaat

SEQ ID NO: 711698 - DNA, 13 bp, C. elegans
cattttgatttca

SEQ ID NO: 711699 - DNA, 13 bp, C. elegans
cattttgatttta

SEQ ID NO: 711700 - DNA, 13 bp, C. elegans
cattttgcaaaat

SEQ ID NO: 711701 - DNA, 13 bp, C. elegans
cattttgcaaatt

SEQ ID NO: 711702 - DNA, 13 bp, C. elegans
cattttgcaagaa

SEQ ID NO: 711703 - DNA, 13 bp, C. elegans
cattttgcatatt

SEQ ID NO: 711704 - DNA, 13 bp, C. elegans
cattttgcatttc

SEQ ID NO: 711705 - DNA, 13 bp, C. elegans
cattttgcatttg

SEQ ID NO: 711706 - DNA, 13 bp, C. elegans
cattttgccaaaa

SEQ ID NO: 711707 - DNA, 13 bp, C. elegans
cattttgccattt

SEQ ID NO: 711708 - DNA, 13 bp, C. elegans
cattttgccgatt

SEQ ID NO: 711709 - DNA, 13 bp, C. elegans
cattttgctcact

SEQ ID NO: 711710 - DNA, 13 bp, C. elegans
cattttgctcatt

SEQ ID NO: 711711 - DNA, 13 bp, C. elegans
cattttgctccaa

SEQ ID NO: 711712 - DNA, 13 bp, C. elegans
cattttgctcttt

SEQ ID NO: 711713 - DNA, 13 bp, C. elegans
cattttggaagaa

SEQ ID NO: 711714 - DNA, 13 bp, C. elegans
cattttggaagta

SEQ ID NO: 711715 - DNA, 13 bp, C. elegans
cattttggagcaa

SEQ ID NO: 711716 - DNA, 13 bp, C. elegans
cattttggagcat

SEQ ID NO: 711717 - DNA, 13 bp, C. elegans
cattttggcacca

SEQ ID NO: 711718 - DNA, 13 bp, C. elegans
cattttggctcgg

SEQ ID NO: 711719 - DNA, 13 bp, C. elegans
cattttgggattt

SEQ ID NO: 711720 - DNA, 13 bp, C. elegans
cattttgggccta

SEQ ID NO: 711721 - DNA, 13 bp, C. elegans
cattttgggggga

SEQ ID NO: 711722 - DNA, 13 bp, C. elegans
cattttgtacttg

SEQ ID NO: 711723 - DNA, 13 bp, C. elegans
cattttgtagaat

SEQ ID NO: 711724 - DNA, 13 bp, C. elegans
cattttgtcattt

SEQ ID NO: 711725 - DNA, 13 bp, C. elegans
cattttgtggatt

SEQ ID NO: 711726 - DNA, 13 bp, C. elegans
cattttgtttcta

SEQ ID NO: 711727 - DNA, 13 bp, C. elegans
catttttaaagtg

SEQ ID NO: 711728 - DNA, 13 bp, C. elegans
catttttaagatt

SEQ ID NO: 711729 - DNA, 13 bp, C. elegans
catttttaagctt

SEQ ID NO: 711730 - DNA, 13 bp, C. elegans
catttttaattca

SEQ ID NO: 711731 - DNA, 13 bp, C. elegans
catttttacactt

SEQ ID NO: 711732 - DNA, 13 bp, C. elegans
catttttaccaaa

SEQ ID NO: 711733 - DNA, 13 bp, C. elegans
catttttaccatt

SEQ ID NO: 711734 - DNA, 13 bp, C. elegans
catttttacccct

SEQ ID NO: 711735 - DNA, 13 bp, C. elegans
catttttagtcat

SEQ ID NO: 711736 - DNA, 13 bp, C. elegans
catttttatagaa

SEQ ID NO: 711737 - DNA, 13 bp, C. elegans
catttttatcaaa

SEQ ID NO: 711738 - DNA, 13 bp, C. elegans
catttttatgatt

SEQ ID NO: 711739 - DNA, 13 bp, C. elegans
catttttatgtta

SEQ ID NO: 711740 - DNA, 13 bp, C. elegans
catttttattcaa

SEQ ID NO: 711741 - DNA, 13 bp, C. elegans
catttttattgat

SEQ ID NO: 711742 - DNA, 13 bp, C. elegans
catttttattgca

SEQ ID NO: 711743 - DNA, 14 bp, C. elegans
catttttcaaaaac

SEQ ID NO: 711744 - DNA, 13 bp, C. elegans
catttttcaaagt

SEQ ID NO: 711745 - DNA, 13 bp, C. elegans
catttttcaaatt

SEQ ID NO: 711746 - DNA, 13 bp, C. elegans
catttttcaagcc

SEQ ID NO: 711747 - DNA, 13 bp, C. elegans
catttttcacaaa

SEQ ID NO: 711748 - DNA, 13 bp, C. elegans
catttttcacaga

SEQ ID NO: 711749 - DNA, 13 bp, C. elegans
catttttcaccaa

SEQ ID NO: 711750 - DNA, 13 bp, C. elegans
catttttcagctt

SEQ ID NO: 711751 - DNA, 13 bp, C. elegans
catttttcataga

SEQ ID NO: 711752 - DNA, 13 bp, C. elegans
catttttcatcaa

SEQ ID NO: 711753 - DNA, 13 bp, C. elegans
catttttcatcat

SEQ ID NO: 711754 - DNA, 13 bp, C. elegans
catttttcatgca

SEQ ID NO: 711755 - DNA, 13 bp, C. elegans
catttttcattaa

SEQ ID NO: 711756 - DNA, 13 bp, C. elegans
catttttcattcc

SEQ ID NO: 711757 - DNA, 13 bp, C. elegans
catttttccaata

SEQ ID NO: 711758 - DNA, 13 bp, C. elegans
catttttccacat

SEQ ID NO: 711759 - DNA, 13 bp, C. elegans
catttttccagca

SEQ ID NO: 711760 - DNA, 13 bp, C. elegans
catttttccagtt

SEQ ID NO: 711761 - DNA, 13 bp, C. elegans
catttttcccaat

SEQ ID NO: 711762 - DNA, 13 bp, C. elegans
catttttcctcca

SEQ ID NO: 711763 - DNA, 13 bp, C. elegans
catttttcctgtt

SEQ ID NO: 711764 - DNA, 13 bp, C. elegans
catttttcgaaga

SEQ ID NO: 711765 - DNA, 13 bp, C. elegans
catttttcgaatt

SEQ ID NO: 711766 - DNA, 13 bp, C. elegans
catttttcgattt

SEQ ID NO: 711767 - DNA, 13 bp, C. elegans
catttttcgcaat

SEQ ID NO: 711768 - DNA, 13 bp, C. elegans
catttttcggaga

SEQ ID NO: 711769 - DNA, 13 bp, C. elegans
catttttcgggtt

SEQ ID NO: 711770 - DNA, 13 bp, C. elegans
catttttcggttt

SEQ ID NO: 711771 - DNA, 13 bp, C. elegans
catttttcgtcat

SEQ ID NO: 711772 - DNA, 13 bp, C. elegans
catttttcgtgat

SEQ ID NO: 711773 - DNA, 13 bp, C. elegans
catttttctccaa

SEQ ID NO: 711774 - DNA, 13 bp, C. elegans
catttttctccca

SEQ ID NO: 711775 - DNA, 13 bp, C. elegans
catttttctcgtt

SEQ ID NO: 711776 - DNA, 13 bp, C. elegans
catttttctctca

SEQ ID NO: 711777 - DNA, 13 bp, C. elegans
catttttctgaaa

SEQ ID NO: 711778 - DNA, 13 bp, C. elegans
catttttctgact

SEQ ID NO: 711779 - DNA, 13 bp, C. elegans
catttttctgatc

SEQ ID NO: 711780 - DNA, 13 bp, C. elegans
catttttctggaa

SEQ ID NO: 711781 - DNA, 13 bp, C. elegans
catttttctgtta

SEQ ID NO: 711782 - DNA, 13 bp, C. elegans
catttttcttgta

SEQ ID NO: 711783 - DNA, 13 bp, C. elegans
catttttgaaaaa

SEQ ID NO: 711784 - DNA, 13 bp, C. elegans
catttttgaacat

SEQ ID NO: 711785 - DNA, 13 bp, C. elegans
catttttgaacga

SEQ ID NO: 711786 - DNA, 13 bp, C. elegans
catttttgaagaa

SEQ ID NO: 711787 - DNA, 13 bp, C. elegans
catttttgagcca

SEQ ID NO: 711788 - DNA, 13 bp, C. elegans
catttttgagctt

SEQ ID NO: 711789 - DNA, 13 bp, C. elegans
catttttgatatt

SEQ ID NO: 711790 - DNA, 13 bp, C. elegans
catttttgatcta

SEQ ID NO: 711791 - DNA, 13 bp, C. elegans
catttttgatgat

SEQ ID NO: 711792 - DNA, 13 bp, C. elegans
catttttgattga

SEQ ID NO: 711793 - DNA, 13 bp, C. elegans
catttttgcaatt

SEQ ID NO: 711794 - DNA, 13 bp, C. elegans
catttttgcagtt

SEQ ID NO: 711795 - DNA, 13 bp, C. elegans
catttttgcattg

SEQ ID NO: 711796 - DNA, 13 bp, C. elegans
catttttgcattt

SEQ ID NO: 711797 - DNA, 13 bp, C. elegans
catttttgcccaa

SEQ ID NO: 711798 - DNA, 13 bp, C. elegans
catttttgcgttt

SEQ ID NO: 711799 - DNA, 13 bp, C. elegans
catttttgctatt

SEQ ID NO: 711800 - DNA, 13 bp, C. elegans
catttttggaaaa

SEQ ID NO: 711801 - DNA, 13 bp, C. elegans
catttttggaatt

SEQ ID NO: 711802 - DNA, 13 bp, C. elegans
catttttggattt

SEQ ID NO: 711803 - DNA, 13 bp, C. elegans
catttttggcgaa

SEQ ID NO: 711804 - DNA, 13 bp, C. elegans
catttttggctta

SEQ ID NO: 711805 - DNA, 13 bp, C. elegans
catttttggtgac

SEQ ID NO: 711806 - DNA, 13 bp, C. elegans
catttttgtacaa

SEQ ID NO: 711807 - DNA, 13 bp, C. elegans
catttttgtagtt

SEQ ID NO: 711808 - DNA, 13 bp, C. elegans
catttttgtataa

SEQ ID NO: 711809 - DNA, 13 bp, C. elegans
catttttgtatga

SEQ ID NO: 711810 - DNA, 13 bp, C. elegans
catttttgtatgt

SEQ ID NO: 711811 - DNA, 13 bp, C. elegans
catttttgtatta

SEQ ID NO: 711812 - DNA, 13 bp, C. elegans
catttttgtcgaa

SEQ ID NO: 711813 - DNA, 13 bp, C. elegans
catttttgtgcaa

SEQ ID NO: 711814 - DNA, 13 bp, C. elegans
catttttgtgtat

SEQ ID NO: 711815 - DNA, 13 bp, C. elegans
catttttgttaaa

SEQ ID NO: 711816 - DNA, 13 bp, C. elegans
catttttgttcaa

SEQ ID NO: 711817 - DNA, 13 bp, C. elegans
catttttgttcat

SEQ ID NO: 711818 - DNA, 13 bp, C. elegans
catttttgttctg

SEQ ID NO: 711819 - DNA, 13 bp, C. elegans
catttttgtttaa

SEQ ID NO: 711820 - DNA, 13 bp, C. elegans
catttttgtttca

SEQ ID NO: 711821 - DNA, 14 bp, C. elegans
catttttgtttcaa

SEQ ID NO: 711822 - DNA, 13 bp, C. elegans
cattttttaactc

SEQ ID NO: 711823 - DNA, 13 bp, C. elegans
cattttttaatca

SEQ ID NO: 711824 - DNA, 13 bp, C. elegans
cattttttacccc

SEQ ID NO: 711825 - DNA, 13 bp, C. elegans
cattttttatcaa

SEQ ID NO: 711826 - DNA, 13 bp, C. elegans
cattttttcaaaa

SEQ ID NO: 711827 - DNA, 13 bp, C. elegans
cattttttcaaga

SEQ ID NO: 711828 - DNA, 13 bp, C. elegans
cattttttcatca

SEQ ID NO: 711829 - DNA, 13 bp, C. elegans
cattttttccaaa

SEQ ID NO: 711830 - DNA, 13 bp, C. elegans
cattttttccact

SEQ ID NO: 711831 - DNA, 13 bp, C. elegans
cattttttccagt

SEQ ID NO: 711832 - DNA, 13 bp, C. elegans
cattttttcccaa

SEQ ID NO: 711833 - DNA, 13 bp, C. elegans
cattttttcccat

SEQ ID NO: 711834 - DNA, 13 bp, C. elegans
cattttttccggt

SEQ ID NO: 711835 - DNA, 13 bp, C. elegans
cattttttcgaaa

SEQ ID NO: 711836 - DNA, 13 bp, C. elegans
cattttttcgcaa

SEQ ID NO: 711837 - DNA, 13 bp, C. elegans
cattttttcgctt

SEQ ID NO: 711838 - DNA, 13 bp, C. elegans
cattttttcgtaa

SEQ ID NO: 711839 - DNA, 13 bp, C. elegans
cattttttcgtgt

SEQ ID NO: 711840 - DNA, 13 bp, C. elegans
cattttttctcaa

SEQ ID NO: 711841 - DNA, 13 bp, C. elegans
cattttttgaaaa

SEQ ID NO: 711842 - DNA, 13 bp, C. elegans
cattttttgaaac

SEQ ID NO: 711843 - DNA, 13 bp, C. elegans
cattttttgaaga

SEQ ID NO: 711844 - DNA, 13 bp, C. elegans
cattttttgaatt

SEQ ID NO: 711845 - DNA, 13 bp, C. elegans
cattttttgacga

SEQ ID NO: 711846 - DNA, 13 bp, C. elegans
cattttttgagcc

SEQ ID NO: 711847 - DNA, 13 bp, C. elegans
cattttttgagtc

SEQ ID NO: 711848 - DNA, 13 bp, C. elegans
cattttttgcaat

SEQ ID NO: 711849 - DNA, 13 bp, C. elegans
cattttttgcaca

SEQ ID NO: 711850 - DNA, 13 bp, C. elegans
cattttttgcact

SEQ ID NO: 711851 - DNA, 13 bp, C. elegans
cattttttgcagt

SEQ ID NO: 711852 - DNA, 13 bp, C. elegans
cattttttgccaa

SEQ ID NO: 711853 - DNA, 13 bp, C. elegans
cattttttgcctt

SEQ ID NO: 711854 - DNA, 13 bp, C. elegans
cattttttggctg

SEQ ID NO: 711855 - DNA, 13 bp, C. elegans
cattttttggtgt

SEQ ID NO: 711856 - DNA, 13 bp, C. elegans
cattttttgtaat

SEQ ID NO: 711857 - DNA, 13 bp, C. elegans
catttttttacag

SEQ ID NO: 711858 - DNA, 13 bp, C. elegans
catttttttatga

SEQ ID NO: 711859 - DNA, 13 bp, C. elegans
catttttttgaat

SEQ ID NO: 711860 - DNA, 13 bp, C. elegans
catttttttgata

SEQ ID NO: 711861 - DNA, 13 bp, C. elegans
catttttttgcaa

SEQ ID NO: 711862 - DNA, 13 bp, C. elegans
catttttttggaa

SEQ ID NO: 711863 - DNA, 13 bp, C. elegans
catttttttgtca

SEQ ID NO: 711864 - DNA, 13 bp, C. elegans
catttttttgtga

SEQ ID NO: 711865 - DNA, 13 bp, C. elegans
cattttttttccg

SEQ ID NO: 711866 - DNA, 13 bp, C. elegans
cattttttttcgc

SEQ ID NO: 711867 - DNA, 13 bp, C. elegans
cattttttttgca

SEQ ID NO: 711868 - DNA, 13 bp, C. elegans
ccaaaaaaaatgt

SEQ ID NO: 711869 - DNA, 13 bp, C. elegans
ccaaaaaaacctt

SEQ ID NO: 711870 - DNA, 13 bp, C. elegans
ccaaaaaaagtga

SEQ ID NO: 711871 - DNA, 13 bp, C. elegans
ccaaaaaaagttc

SEQ ID NO: 711872 - DNA, 13 bp, C. elegans
ccaaaaaaattgt

SEQ ID NO: 711873 - DNA, 13 bp, C. elegans
ccaaaaaacattt

SEQ ID NO: 711874 - DNA, 13 bp, C. elegans
ccaaaaaacctct

SEQ ID NO: 711875 - DNA, 13 bp, C. elegans
ccaaaaaactttt

SEQ ID NO: 711876 - DNA, 13 bp, C. elegans
ccaaaaaagtcac

SEQ ID NO: 711877 - DNA, 13 bp, C. elegans
ccaaaaaagttga

SEQ ID NO: 711878 - DNA, 13 bp, C. elegans
ccaaaaaatacga

SEQ ID NO: 711879 - DNA, 13 bp, C. elegans
ccaaaaaatcatt

SEQ ID NO: 711880 - DNA, 13 bp, C. elegans
ccaaaaaatctca

SEQ ID NO: 711881 - DNA, 13 bp, C. elegans
ccaaaaaatgtga

SEQ ID NO: 711882 - DNA, 13 bp, C. elegans
ccaaaaaatgtta

SEQ ID NO: 711883 - DNA, 13 bp, C. elegans
ccaaaaaattagc

SEQ ID NO: 711884 - DNA, 13 bp, C. elegans
ccaaaaaattcga

SEQ ID NO: 711885 - DNA, 13 bp, C. elegans
ccaaaaaatttat

SEQ ID NO: 711886 - DNA, 13 bp, C. elegans
ccaaaaacatttt

SEQ ID NO: 711887 - DNA, 13 bp, C. elegans
ccaaaaacgcata

SEQ ID NO: 711888 - DNA, 13 bp, C. elegans
ccaaaaactcgaa

SEQ ID NO: 711889 - DNA, 13 bp, C. elegans
ccaaaaacttgta

SEQ ID NO: 711890 - DNA, 13 bp, C. elegans
ccaaaaacttttg

SEQ ID NO: 711891 - DNA, 13 bp, C. elegans
ccaaaaagaaagt

SEQ ID NO: 711892 - DNA, 13 bp, C. elegans
ccaaaaagagtga

SEQ ID NO: 711893 - DNA, 13 bp, C. elegans
ccaaaaagtccaa

SEQ ID NO: 711894 - DNA, 13 bp, C. elegans
ccaaaaagtttcc

SEQ ID NO: 711895 - DNA, 13 bp, C. elegans
ccaaaaagtttga

SEQ ID NO: 711896 - DNA, 13 bp, C. elegans
ccaaaaagtttgt

SEQ ID NO: 711897 - DNA, 13 bp, C. elegans
ccaaaaatcatcg

SEQ ID NO: 711898 - DNA, 13 bp, C. elegans
ccaaaaatcgata

SEQ ID NO: 711899 - DNA, 13 bp, C. elegans
ccaaaaatcgctt

SEQ ID NO: 711900 - DNA, 13 bp, C. elegans
ccaaaaatcgtaa

SEQ ID NO: 711901 - DNA, 13 bp, C. elegans
ccaaaaatctcaa

SEQ ID NO: 711902 - DNA, 13 bp, C. elegans
ccaaaaatctgaa

SEQ ID NO: 711903 - DNA, 13 bp, C. elegans
ccaaaaatgctaa

SEQ ID NO: 711904 - DNA, 13 bp, C. elegans
ccaaaaatgctca

SEQ ID NO: 711905 - DNA, 13 bp, C. elegans
ccaaaaatggaaa

SEQ ID NO: 711906 - DNA, 13 bp, C. elegans
ccaaaaatgtgct

SEQ ID NO: 711907 - DNA, 13 bp, C. elegans
ccaaaaatgttaa

SEQ ID NO: 711908 - DNA, 13 bp, C. elegans
ccaaaaatgtttc

SEQ ID NO: 711909 - DNA, 13 bp, C. elegans
ccaaaaatgtttt

SEQ ID NO: 711910 - DNA, 13 bp, C. elegans
ccaaaaattaaag

SEQ ID NO: 711911 - DNA, 13 bp, C. elegans
ccaaaaattagca

SEQ ID NO: 711912 - DNA, 13 bp, C. elegans
ccaaaaattatca

SEQ ID NO: 711913 - DNA, 13 bp, C. elegans
ccaaaaattatta

SEQ ID NO: 711914 - DNA, 13 bp, C. elegans
ccaaaaattcaat

SEQ ID NO: 711915 - DNA, 13 bp, C. elegans
ccaaaaattccaa

SEQ ID NO: 711916 - DNA, 13 bp, C. elegans
ccaaaaattctca

SEQ ID NO: 711917 - DNA, 13 bp, C. elegans
ccaaaaattgaag

SEQ ID NO: 711918 - DNA, 13 bp, C. elegans
ccaaaaattgact

SEQ ID NO: 711919 - DNA, 13 bp, C. elegans
ccaaaaattgaga

SEQ ID NO: 711920 - DNA, 13 bp, C. elegans
ccaaaaattggtt

SEQ ID NO: 711921 - DNA, 13 bp, C. elegans
ccaaaaattgtaa

SEQ ID NO: 711922 - DNA, 13 bp, C. elegans
ccaaaaattgttc

SEQ ID NO: 711923 - DNA, 13 bp, C. elegans
ccaaaaattgttt

SEQ ID NO: 711924 - DNA, 13 bp, C. elegans
ccaaaaatttatg

SEQ ID NO: 711925 - DNA, 13 bp, C. elegans
ccaaaaattttca

SEQ ID NO: 711926 - DNA, 13 bp, C. elegans
ccaaaacaccgga

SEQ ID NO: 711927 - DNA, 13 bp, C. elegans
ccaaaaccaaatt

SEQ ID NO: 711928 - DNA, 13 bp, C. elegans
ccaaaactttgag

SEQ ID NO: 711929 - DNA, 13 bp, C. elegans
ccaaaactttgtc

SEQ ID NO: 711930 - DNA, 13 bp, C. elegans
ccaaaacttttca

SEQ ID NO: 711931 - DNA, 13 bp, C. elegans
ccaaaagaaattt

SEQ ID NO: 711932 - DNA, 13 bp, C. elegans
ccaaaagaccatc

SEQ ID NO: 711933 - DNA, 13 bp, C. elegans
ccaaaagctgttt

SEQ ID NO: 711934 - DNA, 13 bp, C. elegans
ccaaaagttgccg

SEQ ID NO: 711935 - DNA, 13 bp, C. elegans
ccaaaatatagaa

SEQ ID NO: 711936 - DNA, 13 bp, C. elegans
ccaaaatatgcaa

SEQ ID NO: 711937 - DNA, 13 bp, C. elegans
ccaaaatattgaa

SEQ ID NO: 711938 - DNA, 13 bp, C. elegans
ccaaaatattgtt

SEQ ID NO: 711939 - DNA, 13 bp, C. elegans
ccaaaatatttat

SEQ ID NO: 711940 - DNA, 13 bp, C. elegans
ccaaaatattttt

SEQ ID NO: 711941 - DNA, 13 bp, C. elegans
ccaaaatcgaatt

SEQ ID NO: 711942 - DNA, 13 bp, C. elegans
ccaaaatcgtatt

SEQ ID NO: 711943 - DNA, 13 bp, C. elegans
ccaaaatctgaaa

SEQ ID NO: 711944 - DNA, 13 bp, C. elegans
ccaaaatgaacaa

SEQ ID NO: 711945 - DNA, 13 bp, C. elegans
ccaaaatgacact

SEQ ID NO: 711946 - DNA, 13 bp, C. elegans
ccaaaatgagaca

SEQ ID NO: 711947 - DNA, 15 bp, C. elegans
ccaaaatgatccaaa

SEQ ID NO: 711948 - DNA, 13 bp, C. elegans
ccaaaatgctcca

SEQ ID NO: 711949 - DNA, 13 bp, C. elegans
ccaaaatggcaaa

SEQ ID NO: 711950 - DNA, 13 bp, C. elegans
ccaaaatggtttt

SEQ ID NO: 711951 - DNA, 13 bp, C. elegans
ccaaaatgttcca

SEQ ID NO: 711952 - DNA, 13 bp, C. elegans
ccaaaatgtttga

SEQ ID NO: 711953 - DNA, 13 bp, C. elegans
ccaaaatgttttt

SEQ ID NO: 711954 - DNA, 13 bp, C. elegans
ccaaaattagaaa

SEQ ID NO: 711955 - DNA, 13 bp, C. elegans
ccaaaattccata

SEQ ID NO: 711956 - DNA, 13 bp, C. elegans
ccaaaattccatt

SEQ ID NO: 711957 - DNA, 13 bp, C. elegans
ccaaaattcgatt

SEQ ID NO: 711958 - DNA, 13 bp, C. elegans
ccaaaattgaatt

SEQ ID NO: 711959 - DNA, 13 bp, C. elegans
ccaaaattgccga

SEQ ID NO: 711960 - DNA, 13 bp, C. elegans
ccaaaattgtatt

SEQ ID NO: 711961 - DNA, 13 bp, C. elegans
ccaaaatttacca

SEQ ID NO: 711962 - DNA, 13 bp, C. elegans
ccaaaatttccaa

SEQ ID NO: 711963 - DNA, 13 bp, C. elegans
ccaaaatttccgg

SEQ ID NO: 711964 - DNA, 13 bp, C. elegans
ccaaaatttcttt

SEQ ID NO: 711965 - DNA, 13 bp, C. elegans
ccaaaatttgaag

SEQ ID NO: 711966 - DNA, 13 bp, C. elegans
ccaaaatttggaa

SEQ ID NO: 711967 - DNA, 14 bp, C. elegans
ccaaaattttcaaa

SEQ ID NO: 711968 - DNA, 13 bp, C. elegans
ccaaaattttgaa

SEQ ID NO: 711969 - DNA, 13 bp, C. elegans
ccaaaattttgta

SEQ ID NO: 711970 - DNA, 13 bp, C. elegans
ccaaaattttgtt

SEQ ID NO: 711971 - DNA, 13 bp, C. elegans
ccaaaatttttat

SEQ ID NO: 711972 - DNA, 13 bp, C. elegans
ccaaaattttttc

SEQ ID NO: 711973 - DNA, 13 bp, C. elegans
ccaaaattttttt

SEQ ID NO: 711974 - DNA, 13 bp, C. elegans
ccaaacaaaatgc

SEQ ID NO: 711975 - DNA, 13 bp, C. elegans
ccaaacatcaatt

SEQ ID NO: 711976 - DNA, 13 bp, C. elegans
ccaaacattcaaa

SEQ ID NO: 711977 - DNA, 13 bp, C. elegans
ccaaacctatatc

SEQ ID NO: 711978 - DNA, 13 bp, C. elegans
ccaaactattttc

SEQ ID NO: 711979 - DNA, 13 bp, C. elegans
ccaaacttgtaaa

SEQ ID NO: 711980 - DNA, 13 bp, C. elegans
ccaaactttgaaa

SEQ ID NO: 711981 - DNA, 13 bp, C. elegans
ccaaacttttccc

SEQ ID NO: 711982 - DNA, 13 bp, C. elegans
ccaaagaaattcg

SEQ ID NO: 711983 - DNA, 13 bp, C. elegans
ccaaagtcagtga

SEQ ID NO: 711984 - DNA, 13 bp, C. elegans
ccaaagttttgcc

SEQ ID NO: 711985 - DNA, 13 bp, C. elegans
ccaaataaattca

SEQ ID NO: 711986 - DNA, 13 bp, C. elegans
ccaaataatttaa

SEQ ID NO: 711987 - DNA, 13 bp, C. elegans
ccaaatcagcttg

SEQ ID NO: 711988 - DNA, 13 bp, C. elegans
ccaaatgccgaga

SEQ ID NO: 711989 - DNA, 13 bp, C. elegans
ccaaatgccgagt

SEQ ID NO: 711990 - DNA, 13 bp, C. elegans
ccaaatgtatagt

SEQ ID NO: 711991 - DNA, 13 bp, C. elegans
ccaaatgttccaa

SEQ ID NO: 711992 - DNA, 13 bp, C. elegans
ccaaattatttga

SEQ ID NO: 711993 - DNA, 13 bp, C. elegans
ccaaattcaacca

SEQ ID NO: 711994 - DNA, 13 bp, C. elegans
ccaaattcaattt

SEQ ID NO: 711995 - DNA, 13 bp, C. elegans
ccaaattgccgat

SEQ ID NO: 711996 - DNA, 13 bp, C. elegans
ccaaattgtcgag

SEQ ID NO: 711997 - DNA, 13 bp, C. elegans
ccaaattgttcat

SEQ ID NO: 711998 - DNA, 13 bp, C. elegans
ccaaattgtttta

SEQ ID NO: 711999 - DNA, 13 bp, C. elegans
ccaaattgttttt

SEQ ID NO: 712000 - DNA, 13 bp, C. elegans
ccaaatttaaaac

SEQ ID NO: 712001 - DNA, 13 bp, C. elegans
ccaaatttaattt

SEQ ID NO: 712002 - DNA, 13 bp, C. elegans
ccaaatttataaa

SEQ ID NO: 712003 - DNA, 13 bp, C. elegans
ccaaatttcataa

SEQ ID NO: 712004 - DNA, 13 bp, C. elegans
ccaaatttcatac

SEQ ID NO: 712005 - DNA, 13 bp, C. elegans
ccaaatttccatc

SEQ ID NO: 712006 - DNA, 13 bp, C. elegans
ccaaatttcgatt

SEQ ID NO: 712007 - DNA, 13 bp, C. elegans
ccaaatttctcaa

SEQ ID NO: 712008 - DNA, 13 bp, C. elegans
ccaaatttcttga

SEQ ID NO: 712009 - DNA, 13 bp, C. elegans
ccaaatttgcccc

SEQ ID NO: 712010 - DNA, 13 bp, C. elegans
ccaaatttgtgaa

SEQ ID NO: 712011 - DNA, 13 bp, C. elegans
ccaaattttaaga

SEQ ID NO: 712012 - DNA, 13 bp, C. elegans
ccaaattttcatg

SEQ ID NO: 712013 - DNA, 13 bp, C. elegans
ccaaattttccaa

SEQ ID NO: 712014 - DNA, 13 bp, C. elegans
ccaaattttcttg

SEQ ID NO: 712015 - DNA, 13 bp, C. elegans
ccaaattttgtaa

SEQ ID NO: 712016 - DNA, 13 bp, C. elegans
ccaaatttttaaa

SEQ ID NO: 712017 - DNA, 13 bp, C. elegans
ccaaatttttgta

SEQ ID NO: 712018 - DNA, 13 bp, C. elegans
ccaaattttttta

SEQ ID NO: 712019 - DNA, 13 bp, C. elegans
ccaaatttttttc

SEQ ID NO: 712020 - DNA, 13 bp, C. elegans
ccaaatttttttg

SEQ ID NO: 712021 - DNA, 13 bp, C. elegans
ccaacaaaaagtt

SEQ ID NO: 712022 - DNA, 13 bp, C. elegans
ccaacaaattttt

SEQ ID NO: 712023 - DNA, 13 bp, C. elegans
ccaacacttcttc

SEQ ID NO: 712024 - DNA, 13 bp, C. elegans
ccaacagttttca

SEQ ID NO: 712025 - DNA, 13 bp, C. elegans
ccaacattgaaaa

SEQ ID NO: 712026 - DNA, 13 bp, C. elegans
ccaacattttcca

SEQ ID NO: 712027 - DNA, 13 bp, C. elegans
ccaacattttctg

SEQ ID NO: 712028 - DNA, 13 bp, C. elegans
ccaacatttttta

SEQ ID NO: 712029 - DNA, 13 bp, C. elegans
ccaacattttttt

SEQ ID NO: 712030 - DNA, 13 bp, C. elegans
ccaaccaacaatt

SEQ ID NO: 712031 - DNA, 13 bp, C. elegans
ccaactatcctat

SEQ ID NO: 712032 - DNA, 13 bp, C. elegans
ccaactctttgct

SEQ ID NO: 712033 - DNA, 13 bp, C. elegans
ccaactgaattca

SEQ ID NO: 712034 - DNA, 13 bp, C. elegans
ccaactgataaga

SEQ ID NO: 712035 - DNA, 13 bp, C. elegans
ccaactgcaaaaa

SEQ ID NO: 712036 - DNA, 13 bp, C. elegans
ccaacttatcaat

SEQ ID NO: 712037 - DNA, 13 bp, C. elegans
ccaacttcaaatc

SEQ ID NO: 712038 - DNA, 13 bp, C. elegans
ccaacttctatag

SEQ ID NO: 712039 - DNA, 14 bp, C. elegans
ccaacttgtatttt

SEQ ID NO: 712040 - DNA, 13 bp, C. elegans
ccaactttccaaa

SEQ ID NO: 712041 - DNA, 13 bp, C. elegans
ccaactttggtct

SEQ ID NO: 712042 - DNA, 13 bp, C. elegans
ccaactttttctt

SEQ ID NO: 712043 - DNA, 13 bp, C. elegans
ccaactttttgag

SEQ ID NO: 712044 - DNA, 13 bp, C. elegans
ccaagaaaaaagt

SEQ ID NO: 712045 - DNA, 13 bp, C. elegans
ccaagaaaaaatg

SEQ ID NO: 712046 - DNA, 13 bp, C. elegans
ccaagaaaccagt

SEQ ID NO: 712047 - DNA, 13 bp, C. elegans
ccaagacgtcttt

SEQ ID NO: 712048 - DNA, 13 bp, C. elegans
ccaagagcttcaa

SEQ ID NO: 712049 - DNA, 13 bp, C. elegans
ccaagcacatcta

SEQ ID NO: 712050 - DNA, 13 bp, C. elegans
ccaagtgcaaact

SEQ ID NO: 712051 - DNA, 13 bp, C. elegans
ccaagttaatatt

SEQ ID NO: 712052 - DNA, 13 bp, C. elegans
ccaagttttcaaa

SEQ ID NO: 712053 - DNA, 13 bp, C. elegans
ccaataaaaatct

SEQ ID NO: 712054 - DNA, 13 bp, C. elegans
ccaataaaatgaa

SEQ ID NO: 712055 - DNA, 13 bp, C. elegans
ccaataaatatat

SEQ ID NO: 712056 - DNA, 13 bp, C. elegans
ccaataaattttt

SEQ ID NO: 712057 - DNA, 13 bp, C. elegans
ccaataatcttag

SEQ ID NO: 712058 - DNA, 13 bp, C. elegans
ccaataattttca

SEQ ID NO: 712059 - DNA, 13 bp, C. elegans
ccaataccaaccg

SEQ ID NO: 712060 - DNA, 13 bp, C. elegans
ccaatatatttat

SEQ ID NO: 712061 - DNA, 13 bp, C. elegans
ccaatatttcgaa

SEQ ID NO: 712062 - DNA, 13 bp, C. elegans
ccaatattttatt

SEQ ID NO: 712063 - DNA, 13 bp, C. elegans
ccaatattttcaa

SEQ ID NO: 712064 - DNA, 13 bp, C. elegans
ccaatatttttcc

SEQ ID NO: 712065 - DNA, 13 bp, C. elegans
ccaatcaatatca

SEQ ID NO: 712066 - DNA, 13 bp, C. elegans
ccaatcagatgga

SEQ ID NO: 712067 - DNA, 13 bp, C. elegans
ccaatcagcaatt

SEQ ID NO: 712068 - DNA, 13 bp, C. elegans
ccaatcatttttc

SEQ ID NO: 712069 - DNA, 13 bp, C. elegans
ccaatctaaaaat

SEQ ID NO: 712070 - DNA, 13 bp, C. elegans
ccaatgagaattt

SEQ ID NO: 712071 - DNA, 13 bp, C. elegans
ccaatgatttatc

SEQ ID NO: 712072 - DNA, 13 bp, C. elegans
ccaatggaaaaat

SEQ ID NO: 712073 - DNA, 13 bp, C. elegans
ccaatggattttc

SEQ ID NO: 712074 - DNA, 13 bp, C. elegans
ccaattattttac

SEQ ID NO: 712075 - DNA, 13 bp, C. elegans
ccaattcaatttc

SEQ ID NO: 712076 - DNA, 13 bp, C. elegans
ccaattccaattt

SEQ ID NO: 712077 - DNA, 13 bp, C. elegans
ccaattctcactt

SEQ ID NO: 712078 - DNA, 13 bp, C. elegans
ccaattgaaaatt

SEQ ID NO: 712079 - DNA, 13 bp, C. elegans
ccaattgccaaaa

SEQ ID NO: 712080 - DNA, 13 bp, C. elegans
ccaattggacatc

SEQ ID NO: 712081 - DNA, 13 bp, C. elegans
ccaattggatttg

SEQ ID NO: 712082 - DNA, 13 bp, C. elegans
ccaatttataatt

SEQ ID NO: 712083 - DNA, 13 bp, C. elegans
ccaatttatgttt

SEQ ID NO: 712084 - DNA, 13 bp, C. elegans
ccaatttcaaaat

SEQ ID NO: 712085 - DNA, 13 bp, C. elegans
ccaatttctattt

SEQ ID NO: 712086 - DNA, 13 bp, C. elegans
ccaatttctgaac

SEQ ID NO: 712087 - DNA, 13 bp, C. elegans
ccaatttcttttc

SEQ ID NO: 712088 - DNA, 13 bp, C. elegans
ccaatttgaaaaa

SEQ ID NO: 712089 - DNA, 13 bp, C. elegans
ccaatttgaataa

SEQ ID NO: 712090 - DNA, 13 bp, C. elegans
ccaatttgccaat

SEQ ID NO: 712091 - DNA, 13 bp, C. elegans
ccaattttaaatt

SEQ ID NO: 712092 - DNA, 13 bp, C. elegans
ccaattttatcaa

SEQ ID NO: 712093 - DNA, 13 bp, C. elegans
ccaattttatgtt

SEQ ID NO: 712094 - DNA, 14 bp, C. elegans
ccaattttcaaaaa

SEQ ID NO: 712095 - DNA, 13 bp, C. elegans
ccaattttcaata

SEQ ID NO: 712096 - DNA, 13 bp, C. elegans
ccaattttcagca

SEQ ID NO: 712097 - DNA, 13 bp, C. elegans
ccaattttccaat

SEQ ID NO: 712098 - DNA, 13 bp, C. elegans
ccaattttccagc

SEQ ID NO: 712099 - DNA, 13 bp, C. elegans
ccaattttccatt

SEQ ID NO: 712100 - DNA, 13 bp, C. elegans
ccaattttcccca

SEQ ID NO: 712101 - DNA, 13 bp, C. elegans
ccaattttctagt

SEQ ID NO: 712102 - DNA, 13 bp, C. elegans
ccaattttctcat

SEQ ID NO: 712103 - DNA, 13 bp, C. elegans
ccaattttctcga

SEQ ID NO: 712104 - DNA, 13 bp, C. elegans
ccaattttctctt

SEQ ID NO: 712105 - DNA, 13 bp, C. elegans
ccaattttctgaa

SEQ ID NO: 712106 - DNA, 13 bp, C. elegans
ccaattttctgca

SEQ ID NO: 712107 - DNA, 13 bp, C. elegans
ccaattttctgtg

SEQ ID NO: 712108 - DNA, 13 bp, C. elegans
ccaattttcttgt

SEQ ID NO: 712109 - DNA, 13 bp, C. elegans
ccaattttgactt

SEQ ID NO: 712110 - DNA, 13 bp, C. elegans
ccaattttggaat

SEQ ID NO: 712111 - DNA, 13 bp, C. elegans
ccaatttttaccc

SEQ ID NO: 712112 - DNA, 13 bp, C. elegans
ccaatttttccca

SEQ ID NO: 712113 - DNA, 13 bp, C. elegans
ccaatttttcctg

SEQ ID NO: 712114 - DNA, 13 bp, C. elegans
ccaatttttctag

SEQ ID NO: 712115 - DNA, 13 bp, C. elegans
ccaatttttctct

SEQ ID NO: 712116 - DNA, 13 bp, C. elegans
ccaatttttgtag

SEQ ID NO: 712117 - DNA, 13 bp, C. elegans
ccaattttttaaa

SEQ ID NO: 712118 - DNA, 13 bp, C. elegans
ccaattttttcca

SEQ ID NO: 712119 - DNA, 13 bp, C. elegans
ccaattttttgaa

SEQ ID NO: 712120 - DNA, 13 bp, C. elegans
ccaatttttttaa

SEQ ID NO: 712121 - DNA, 13 bp, C. elegans
ccaatttttttca

SEQ ID NO: 712122 - DNA, 13 bp, C. elegans
ccaatttttttga

SEQ ID NO: 712123 - DNA, 13 bp, C. elegans
ccaatttttttgc

SEQ ID NO: 712124 - DNA, 13 bp, C. elegans
ccacaaaatcatc

SEQ ID NO: 712125 - DNA, 13 bp, C. elegans
ccacaaaattttt

SEQ ID NO: 712126 - DNA, 13 bp, C. elegans
ccacaaattgccg

SEQ ID NO: 712127 - DNA, 13 bp, C. elegans
ccacaaattttct

SEQ ID NO: 712128 - DNA, 13 bp, C. elegans
ccacaattccaca

SEQ ID NO: 712129 - DNA, 13 bp, C. elegans
ccacaatttgccg

SEQ ID NO: 712130 - DNA, 13 bp, C. elegans
ccacaattttttt

SEQ ID NO: 712131 - DNA, 13 bp, C. elegans
ccacacactctct

SEQ ID NO: 712132 - DNA, 14 bp, C. elegans
ccacagaagccaaa

SEQ ID NO: 712133 - DNA, 13 bp, C. elegans
ccacagagagaca

SEQ ID NO: 712134 - DNA, 13 bp, C. elegans
ccacattttgaag

SEQ ID NO: 712135 - DNA, 13 bp, C. elegans
ccacattttgttt

SEQ ID NO: 712136 - DNA, 13 bp, C. elegans
ccacattttttgt

SEQ ID NO: 712137 - DNA, 16 bp, C. elegans
ccaccaaaaaggtttc

SEQ ID NO: 712138 - DNA, 13 bp, C. elegans
ccaccaaaaattg

SEQ ID NO: 712139 - DNA, 13 bp, C. elegans
ccaccaaaatgtt

SEQ ID NO: 712140 - DNA, 13 bp, C. elegans
ccaccaactggaa

SEQ ID NO: 712141 - DNA, 13 bp, C. elegans
ccaccaacttcaa

SEQ ID NO: 712142 - DNA, 13 bp, C. elegans
ccaccaacttgaa

SEQ ID NO: 712143 - DNA, 13 bp, C. elegans
ccaccaacttttt

SEQ ID NO: 712144 - DNA, 13 bp, C. elegans
ccaccaattttct

SEQ ID NO: 712145 - DNA, 17 bp, C. elegans
ccaccaccagctccagc

SEQ ID NO: 712146 - DNA, 13 bp, C. elegans
ccaccaccatcat

SEQ ID NO: 712147 - DNA, 13 bp, C. elegans
ccaccactttttt

SEQ ID NO: 712148 - DNA, 13 bp, C. elegans
ccaccatatttta

SEQ ID NO: 712149 - DNA, 13 bp, C. elegans
ccaccattttttt

SEQ ID NO: 712150 - DNA, 13 bp, C. elegans
ccaccgaaaatgt

SEQ ID NO: 712151 - DNA, 13 bp, C. elegans
ccaccgtcacaag

SEQ ID NO: 712152 - DNA, 13 bp, C. elegans
ccacctttaaaaa

SEQ ID NO: 712153 - DNA, 13 bp, C. elegans
ccacctttaagaa

SEQ ID NO: 712154 - DNA, 13 bp, C. elegans
ccacctttttgcc

SEQ ID NO: 712155 - DNA, 13 bp, C. elegans
ccacgaaaactac

SEQ ID NO: 712156 - DNA, 13 bp, C. elegans
ccacgacaaattt

SEQ ID NO: 712157 - DNA, 13 bp, C. elegans
ccacgatgacaat

SEQ ID NO: 712158 - DNA, 13 bp, C. elegans
ccacgcaggcaac

SEQ ID NO: 712159 - DNA, 13 bp, C. elegans
ccacgcccatttt

SEQ ID NO: 712160 - DNA, 13 bp, C. elegans
ccacgcctatttt

SEQ ID NO: 712161 - DNA, 13 bp, C. elegans
ccacgcgctcaac

SEQ ID NO: 712162 - DNA, 13 bp, C. elegans
ccacgcgttgtcc

SEQ ID NO: 712163 - DNA, 13 bp, C. elegans
ccacgtggagtca

SEQ ID NO: 712164 - DNA, 13 bp, C. elegans
ccacgtggatttt

SEQ ID NO: 712165 - DNA, 13 bp, C. elegans
ccacgtggcaaaa

SEQ ID NO: 712166 - DNA, 13 bp, C. elegans
ccacgtggtgcca

SEQ ID NO: 712167 - DNA, 13 bp, C. elegans
ccacgtggttttt

SEQ ID NO: 712168 - DNA, 13 bp, C. elegans
ccacgttgcaaaa

SEQ ID NO: 712169 - DNA, 13 bp, C. elegans
ccactaaagtttt

SEQ ID NO: 712170 - DNA, 13 bp, C. elegans
ccactacagtaac

SEQ ID NO: 712171 - DNA, 13 bp, C. elegans
ccactatatttta

SEQ ID NO: 712172 - DNA, 13 bp, C. elegans
ccactcatatttt

SEQ ID NO: 712173 - DNA, 13 bp, C. elegans
ccactgaactttt

SEQ ID NO: 712174 - DNA, 13 bp, C. elegans
ccacttatttcaa

SEQ ID NO: 712175 - DNA, 13 bp, C. elegans
ccacttcatctga

SEQ ID NO: 712176 - DNA, 13 bp, C. elegans
ccacttctcatct

SEQ ID NO: 712177 - DNA, 13 bp, C. elegans
ccacttcttggct

SEQ ID NO: 712178 - DNA, 13 bp, C. elegans
ccactttaaattg

SEQ ID NO: 712179 - DNA, 13 bp, C. elegans
ccactttcatttt

SEQ ID NO: 712180 - DNA, 13 bp, C. elegans
ccactttgcaaaa

SEQ ID NO: 712181 - DNA, 13 bp, C. elegans
ccacttttcctcg

SEQ ID NO: 712182 - DNA, 13 bp, C. elegans
ccacttttcgaat

SEQ ID NO: 712183 - DNA, 13 bp, C. elegans
ccacttttgaaaa

SEQ ID NO: 712184 - DNA, 13 bp, C. elegans
ccactttttgatt

SEQ ID NO: 712185 - DNA, 13 bp, C. elegans
ccacttttttgcc

SEQ ID NO: 712186 - DNA, 13 bp, C. elegans
ccacttttttgga

SEQ ID NO: 712187 - DNA, 13 bp, C. elegans
ccagaaaaatgtg

SEQ ID NO: 712188 - DNA, 13 bp, C. elegans
ccagaaaaattag

SEQ ID NO: 712189 - DNA, 13 bp, C. elegans
ccagaaaagttgt

SEQ ID NO: 712190 - DNA, 13 bp, C. elegans
ccagaaaatcgat

SEQ ID NO: 712191 - DNA, 13 bp, C. elegans
ccagaaaatgaaa

SEQ ID NO: 712192 - DNA, 13 bp, C. elegans
ccagaaaatgcca

SEQ ID NO: 712193 - DNA, 13 bp, C. elegans
ccagaaaattctg

SEQ ID NO: 712194 - DNA, 13 bp, C. elegans
ccagaaatacggt

SEQ ID NO: 712195 - DNA, 13 bp, C. elegans
ccagaaattaaaa

SEQ ID NO: 712196 - DNA, 13 bp, C. elegans
ccagaaattattg

SEQ ID NO: 712197 - DNA, 13 bp, C. elegans
ccagaaatttcta

SEQ ID NO: 712198 - DNA, 13 bp, C. elegans
ccagaaatttgcc

SEQ ID NO: 712199 - DNA, 13 bp, C. elegans
ccagaaccaaaat

SEQ ID NO: 712200 - DNA, 13 bp, C. elegans
ccagaactttcta

SEQ ID NO: 712201 - DNA, 13 bp, C. elegans
ccagaagactttt

SEQ ID NO: 712202 - DNA, 13 bp, C. elegans
ccagaagcccgtg

SEQ ID NO: 712203 - DNA, 13 bp, C. elegans
ccagaagctgcta

SEQ ID NO: 712204 - DNA, 13 bp, C. elegans
ccagaagtacgca

SEQ ID NO: 712205 - DNA, 13 bp, C. elegans
ccagaagtttatc

SEQ ID NO: 712206 - DNA, 13 bp, C. elegans
ccagacgcgaaat

SEQ ID NO: 712207 - DNA, 13 bp, C. elegans
ccagagagcttct

SEQ ID NO: 712208 - DNA, 13 bp, C. elegans
ccagatgtgtgtt

SEQ ID NO: 712209 - DNA, 13 bp, C. elegans
ccagcaaattggc

SEQ ID NO: 712210 - DNA, 13 bp, C. elegans
ccagcaactccca

SEQ ID NO: 712211 - DNA, 22 bp, C. elegans
ccagcccttcgggaatggggat

SEQ ID NO: 712212 - DNA, 13 bp, C. elegans
ccagccgctgaca

SEQ ID NO: 712213 - DNA, 13 bp, C. elegans
ccagctaccgtat

SEQ ID NO: 712214 - DNA, 13 bp, C. elegans
ccagctatcgcat

SEQ ID NO: 712215 - DNA, 17 bp, C. elegans
ccagctccagctccagc

SEQ ID NO: 712216 - DNA, 13 bp, C. elegans
ccagcttcttctc

SEQ ID NO: 712217 - DNA, 13 bp, C. elegans
ccaggaaaagagg

SEQ ID NO: 712218 - DNA, 13 bp, C. elegans
ccaggaaaatgtg

SEQ ID NO: 712219 - DNA, 13 bp, C. elegans
ccaggaggccgtg

SEQ ID NO: 712220 - DNA, 13 bp, C. elegans
ccagggttccagg

SEQ ID NO: 712221 - DNA, 13 bp, C. elegans
ccaggtctcgaca

SEQ ID NO: 712222 - DNA, 13 bp, C. elegans
ccaggttactgta

SEQ ID NO: 712223 - DNA, 13 bp, C. elegans
ccaggttgtccca

SEQ ID NO: 712224 - DNA, 13 bp, C. elegans
ccagtcggagcac

SEQ ID NO: 712225 - DNA, 13 bp, C. elegans
ccagtgcattttt

SEQ ID NO: 712226 - DNA, 13 bp, C. elegans
ccagtggagaaat

SEQ ID NO: 712227 - DNA, 13 bp, C. elegans
ccagtttcattca

SEQ ID NO: 712228 - DNA, 13 bp, C. elegans
ccagtttgaaaaa

SEQ ID NO: 712229 - DNA, 13 bp, C. elegans
ccagttttaaaaa

SEQ ID NO: 712230 - DNA, 13 bp, C. elegans
ccagttttcttca

SEQ ID NO: 712231 - DNA, 13 bp, C. elegans
ccagtttttcaat

SEQ ID NO: 712232 - DNA, 13 bp, C. elegans
ccagtttttgact

SEQ ID NO: 712233 - DNA, 13 bp, C. elegans
ccagttttttgtt

SEQ ID NO: 712234 - DNA, 13 bp, C. elegans
ccataaaaaagtt

SEQ ID NO: 712235 - DNA, 13 bp, C. elegans
ccataaaaattat

SEQ ID NO: 712236 - DNA, 13 bp, C. elegans
ccataaacttttt

SEQ ID NO: 712237 - DNA, 13 bp, C. elegans
ccataactttttt

SEQ ID NO: 712238 - DNA, 13 bp, C. elegans
ccataattatgcg

SEQ ID NO: 712239 - DNA, 13 bp, C. elegans
ccatactaatttt

SEQ ID NO: 712240 - DNA, 17 bp, C. elegans
ccatagtctgcggaaaa

SEQ ID NO: 712241 - DNA, 13 bp, C. elegans
ccatatattttat

SEQ ID NO: 712242 - DNA, 13 bp, C. elegans
ccatattcaccat

SEQ ID NO: 712243 - DNA, 13 bp, C. elegans
ccatattccacca

SEQ ID NO: 712244 - DNA, 13 bp, C. elegans
ccatattttcata

SEQ ID NO: 712245 - DNA, 13 bp, C. elegans
ccatcaaaaacta

SEQ ID NO: 712246 - DNA, 13 bp, C. elegans
ccatcaaaaatcg

SEQ ID NO: 712247 - DNA, 13 bp, C. elegans
ccatcaaaactcg

SEQ ID NO: 712248 - DNA, 13 bp, C. elegans
ccatcaagtgtct

SEQ ID NO: 712249 - DNA, 13 bp, C. elegans
ccatcaatttttc

SEQ ID NO: 712250 - DNA, 13 bp, C. elegans
ccatcaatttttt

SEQ ID NO: 712251 - DNA, 13 bp, C. elegans
ccatcacttttca

SEQ ID NO: 712252 - DNA, 13 bp, C. elegans
ccatcatatttta

SEQ ID NO: 712253 - DNA, 13 bp, C. elegans
ccatcatcatcac

SEQ ID NO: 712254 - DNA, 13 bp, C. elegans
ccatcattcaaat

SEQ ID NO: 712255 - DNA, 13 bp, C. elegans
ccatccaccagca

SEQ ID NO: 712256 - DNA, 13 bp, C. elegans
ccatccatccatc

SEQ ID NO: 712257 - DNA, 13 bp, C. elegans
ccatcgtattcgc

SEQ ID NO: 712258 - DNA, 13 bp, C. elegans
ccatctgcgtctc

SEQ ID NO: 712259 - DNA, 13 bp, C. elegans
ccatctttttcaa

SEQ ID NO: 712260 - DNA, 13 bp, C. elegans
ccatgacagaaat

SEQ ID NO: 712261 - DNA, 13 bp, C. elegans
ccatgattctcag

SEQ ID NO: 712262 - DNA, 13 bp, C. elegans
ccatggtattcga

SEQ ID NO: 712263 - DNA, 13 bp, C. elegans
ccatgttttattt

SEQ ID NO: 712264 - DNA, 13 bp, C. elegans
ccattaatttttg

SEQ ID NO: 712265 - DNA, 13 bp, C. elegans
ccattagtgtcca

SEQ ID NO: 712266 - DNA, 13 bp, C. elegans
ccattcaaatttt

SEQ ID NO: 712267 - DNA, 13 bp, C. elegans
ccattcaatttga

SEQ ID NO: 712268 - DNA, 13 bp, C. elegans
ccattcagatttt

SEQ ID NO: 712269 - DNA, 13 bp, C. elegans
ccattcattcatt

SEQ ID NO: 712270 - DNA, 13 bp, C. elegans
ccattccagaact

SEQ ID NO: 712271 - DNA, 13 bp, C. elegans
ccattcgaacggc

SEQ ID NO: 712272 - DNA, 13 bp, C. elegans
ccattcgattcca

SEQ ID NO: 712273 - DNA, 13 bp, C. elegans
ccattgacaatct

SEQ ID NO: 712274 - DNA, 13 bp, C. elegans
ccattggcgctac

SEQ ID NO: 712275 - DNA, 13 bp, C. elegans
ccattgtcaactg

SEQ ID NO: 712276 - DNA, 13 bp, C. elegans
ccatttattcaaa

SEQ ID NO: 712277 - DNA, 13 bp, C. elegans
ccatttccaattt

SEQ ID NO: 712278 - DNA, 13 bp, C. elegans
ccatttccatttt

SEQ ID NO: 712279 - DNA, 13 bp, C. elegans
ccattttaaatat

SEQ ID NO: 712280 - DNA, 13 bp, C. elegans
ccattttaataaa

SEQ ID NO: 712281 - DNA, 13 bp, C. elegans
ccattttagagga

SEQ ID NO: 712282 - DNA, 13 bp, C. elegans
ccattttcaaatt

SEQ ID NO: 712283 - DNA, 13 bp, C. elegans
ccattttcaacaa

SEQ ID NO: 712284 - DNA, 13 bp, C. elegans
ccattttcaattt

SEQ ID NO: 712285 - DNA, 13 bp, C. elegans
ccattttcacttt

SEQ ID NO: 712286 - DNA, 14 bp, C. elegans
ccattttcagcaca

SEQ ID NO: 712287 - DNA, 13 bp, C. elegans
ccattttcagtca

SEQ ID NO: 712288 - DNA, 13 bp, C. elegans
ccattttccttcg

SEQ ID NO: 712289 - DNA, 13 bp, C. elegans
ccattttctgtca

SEQ ID NO: 712290 - DNA, 13 bp, C. elegans
ccattttctgttt

SEQ ID NO: 712291 - DNA, 13 bp, C. elegans
ccattttcttcca

SEQ ID NO: 712292 - DNA, 13 bp, C. elegans
ccattttctttaa

SEQ ID NO: 712293 - DNA, 13 bp, C. elegans
ccattttgtataa

SEQ ID NO: 712294 - DNA, 13 bp, C. elegans
ccattttgttttg

SEQ ID NO: 712295 - DNA, 13 bp, C. elegans
ccatttttatgtt

SEQ ID NO: 712296 - DNA, 13 bp, C. elegans
ccatttttcaaat

SEQ ID NO: 712297 - DNA, 13 bp, C. elegans
ccatttttcactt

SEQ ID NO: 712298 - DNA, 13 bp, C. elegans
ccatttttcataa

SEQ ID NO: 712299 - DNA, 13 bp, C. elegans
ccatttttcatca

SEQ ID NO: 712300 - DNA, 13 bp, C. elegans
ccatttttccaaa

SEQ ID NO: 712301 - DNA, 13 bp, C. elegans
ccatttttccata

SEQ ID NO: 712302 - DNA, 13 bp, C. elegans
ccatttttccgat

SEQ ID NO: 712303 - DNA, 13 bp, C. elegans
ccatttttccggc

SEQ ID NO: 712304 - DNA, 13 bp, C. elegans
ccatttttcgatt

SEQ ID NO: 712305 - DNA, 13 bp, C. elegans
ccatttttcgttt

SEQ ID NO: 712306 - DNA, 13 bp, C. elegans
ccatttttctgaa

SEQ ID NO: 712307 - DNA, 13 bp, C. elegans
ccatttttctgtg

SEQ ID NO: 712308 - DNA, 13 bp, C. elegans
ccatttttgaatt

SEQ ID NO: 712309 - DNA, 13 bp, C. elegans
ccatttttgctca

SEQ ID NO: 712310 - DNA, 13 bp, C. elegans
ccatttttggcaa

SEQ ID NO: 712311 - DNA, 13 bp, C. elegans
ccattttttcaaa

SEQ ID NO: 712312 - DNA, 13 bp, C. elegans
ccattttttcgca

SEQ ID NO: 712313 - DNA, 13 bp, C. elegans
ccattttttctaa

SEQ ID NO: 712314 - DNA, 13 bp, C. elegans
ccattttttgaac

SEQ ID NO: 712315 - DNA, 13 bp, C. elegans
ccattttttgatt

SEQ ID NO: 712316 - DNA, 13 bp, C. elegans
ccattttttgtaa

SEQ ID NO: 712317 - DNA, 13 bp, C. elegans
ccattttttgtga

SEQ ID NO: 712318 - DNA, 13 bp, C. elegans
ccattttttgttg

SEQ ID NO: 712319 - DNA, 13 bp, C. elegans
ccatttttttctg

SEQ ID NO: 712320 - DNA, 13 bp, C. elegans
cccaaaaaggaga

SEQ ID NO: 712321 - DNA, 13 bp, C. elegans
cccaaaaagtgtc

SEQ ID NO: 712322 - DNA, 13 bp, C. elegans
cccaaaaatggtc

SEQ ID NO: 712323 - DNA, 13 bp, C. elegans
cccaaaaatgtga

SEQ ID NO: 712324 - DNA, 13 bp, C. elegans
cccaaaaattcca

SEQ ID NO: 712325 - DNA, 13 bp, C. elegans
cccaaaaattgtg

SEQ ID NO: 712326 - DNA, 13 bp, C. elegans
cccaaaaccggac

SEQ ID NO: 712327 - DNA, 13 bp, C. elegans
cccaaaatgtttt

SEQ ID NO: 712328 - DNA, 13 bp, C. elegans
cccaaaatttcga

SEQ ID NO: 712329 - DNA, 13 bp, C. elegans
cccaaagttagac

SEQ ID NO: 712330 - DNA, 13 bp, C. elegans
cccaaattgttca

SEQ ID NO: 712331 - DNA, 13 bp, C. elegans
cccaaatttccag

SEQ ID NO: 712332 - DNA, 13 bp, C. elegans
cccaaattttcag

SEQ ID NO: 712333 - DNA, 13 bp, C. elegans
cccaaattttttt

SEQ ID NO: 712334 - DNA, 13 bp, C. elegans
cccaagcccaagc

SEQ ID NO: 712335 - DNA, 13 bp, C. elegans
cccaagttttcaa

SEQ ID NO: 712336 - DNA, 13 bp, C. elegans
cccaattctcact

SEQ ID NO: 712337 - DNA, 13 bp, C. elegans
cccaatttttatc

SEQ ID NO: 712338 - DNA, 14 bp, C. elegans
cccaattttttgtt

SEQ ID NO: 712339 - DNA, 13 bp, C. elegans
cccacaaaatcat

SEQ ID NO: 712340 - DNA, 13 bp, C. elegans
cccacaaactcta

SEQ ID NO: 712341 - DNA, 13 bp, C. elegans
cccacaattctca

SEQ ID NO: 712342 - DNA, 13 bp, C. elegans
cccacagaagcca

SEQ ID NO: 712343 - DNA, 15 bp, C. elegans
cccacagcgagttaa

SEQ ID NO: 712344 - DNA, 17 bp, C. elegans
cccacagggtgtagtcc

SEQ ID NO: 712345 - DNA, 13 bp, C. elegans
cccacatttttcg

SEQ ID NO: 712346 - DNA, 13 bp, C. elegans
cccacgatttcat

SEQ ID NO: 712347 - DNA, 13 bp, C. elegans
cccacgtggtgtc

SEQ ID NO: 712348 - DNA, 13 bp, C. elegans
cccactatttttt

SEQ ID NO: 712349 - DNA, 13 bp, C. elegans
cccacttctcatc

SEQ ID NO: 712350 - DNA, 13 bp, C. elegans
cccacttcttggt

SEQ ID NO: 712351 - DNA, 13 bp, C. elegans
cccactttccaac

SEQ ID NO: 712352 - DNA, 13 bp, C. elegans
cccataaaatggt

SEQ ID NO: 712353 - DNA, 13 bp, C. elegans
cccataaatcgac

SEQ ID NO: 712354 - DNA, 13 bp, C. elegans
cccatcacctgac

SEQ ID NO: 712355 - DNA, 13 bp, C. elegans
cccatcacggttt

SEQ ID NO: 712356 - DNA, 13 bp, C. elegans
cccatctcggttt

SEQ ID NO: 712357 - DNA, 13 bp, C. elegans
cccatcttcaaac

SEQ ID NO: 712358 - DNA, 13 bp, C. elegans
cccatgtcttaaa

SEQ ID NO: 712359 - DNA, 13 bp, C. elegans
cccattacggttt

SEQ ID NO: 712360 - DNA, 19 bp, C. elegans
cccattccacaggccagtc

SEQ ID NO: 712361 - DNA, 13 bp, C. elegans
cccatttctgcaa

SEQ ID NO: 712362 - DNA, 13 bp, C. elegans
cccattttctatt

SEQ ID NO: 712363 - DNA, 13 bp, C. elegans
cccattttgcttt

SEQ ID NO: 712364 - DNA, 14 bp, C. elegans
cccatttttcaaaa

SEQ ID NO: 712365 - DNA, 13 bp, C. elegans
cccatttttcgaa

SEQ ID NO: 712366 - DNA, 13 bp, C. elegans
cccattttttagt

SEQ ID NO: 712367 - DNA, 13 bp, C. elegans
cccattttttcga

SEQ ID NO: 712368 - DNA, 13 bp, C. elegans
cccattttttctg

SEQ ID NO: 712369 - DNA, 14 bp, C. elegans
ccccaaacctatat

SEQ ID NO: 712370 - DNA, 13 bp, C. elegans
ccccaattggaca

SEQ ID NO: 712371 - DNA, 13 bp, C. elegans
ccccatattggct

SEQ ID NO: 712372 - DNA, 13 bp, C. elegans
ccccatccgcatc

SEQ ID NO: 712373 - DNA, 13 bp, C. elegans
ccccattttttgt

SEQ ID NO: 712374 - DNA, 13 bp, C. elegans
ccccatttttttg

SEQ ID NO: 712375 - DNA, 13 bp, C. elegans
cccccacaaattt

SEQ ID NO: 712376 - DNA, 13 bp, C. elegans
ccccctttaaagt

SEQ ID NO: 712377 - DNA, 13 bp, C. elegans
ccccgactttttt

SEQ ID NO: 712378 - DNA, 13 bp, C. elegans
ccccgattttacc

SEQ ID NO: 712379 - DNA, 14 bp, C. elegans
cccctcggagacct

SEQ ID NO: 712380 - DNA, 13 bp, C. elegans
cccctctgatttt

SEQ ID NO: 712381 - DNA, 13 bp, C. elegans
cccgaaaaaagtt

SEQ ID NO: 712382 - DNA, 13 bp, C. elegans
cccgaaaaacata

SEQ ID NO: 712383 - DNA, 13 bp, C. elegans
cccgaaaaatatt

SEQ ID NO: 712384 - DNA, 13 bp, C. elegans
cccgaaaaatcaa

SEQ ID NO: 712385 - DNA, 14 bp, C. elegans
cccgaccatatccc

SEQ ID NO: 712386 - DNA, 13 bp, C. elegans
cccgaggagaagt

SEQ ID NO: 712387 - DNA, 13 bp, C. elegans
cccgatttgccga

SEQ ID NO: 712388 - DNA, 13 bp, C. elegans
cccgcaaaatgtc

SEQ ID NO: 712389 - DNA, 13 bp, C. elegans
cccgcaaatcggc

SEQ ID NO: 712390 - DNA, 13 bp, C. elegans
cccgcaacgaaaa

SEQ ID NO: 712391 - DNA, 13 bp, C. elegans
cccgccaaaaagt

SEQ ID NO: 712392 - DNA, 13 bp, C. elegans
cccgccaaaaata

SEQ ID NO: 712393 - DNA, 13 bp, C. elegans
cccgccaaaacat

SEQ ID NO: 712394 - DNA, 13 bp, C. elegans
cccgccaaaatta

SEQ ID NO: 712395 - DNA, 13 bp, C. elegans
cccgccaaaattg

SEQ ID NO: 712396 - DNA, 13 bp, C. elegans
cccgccaaacttt

SEQ ID NO: 712397 - DNA, 13 bp, C. elegans
cccgccaaatttt

SEQ ID NO: 712398 - DNA, 13 bp, C. elegans
cccgccaattttt

SEQ ID NO: 712399 - DNA, 13 bp, C. elegans
cccgcccacaatt

SEQ ID NO: 712400 - DNA, 13 bp, C. elegans
cccgccgaaaatt

SEQ ID NO: 712401 - DNA, 13 bp, C. elegans
cccgcgtggcagg

SEQ ID NO: 712402 - DNA, 13 bp, C. elegans
cccggacagagag

SEQ ID NO: 712403 - DNA, 13 bp, C. elegans
cccggtagatgtc

SEQ ID NO: 712404 - DNA, 13 bp, C. elegans
cccggtctcgacg

SEQ ID NO: 712405 - DNA, 13 bp, C. elegans
cccgtaaatcgac

SEQ ID NO: 712406 - DNA, 13 bp, C. elegans
cccgtaaatcggc

SEQ ID NO: 712407 - DNA, 13 bp, C. elegans
cccgtgagctgtc

SEQ ID NO: 712408 - DNA, 13 bp, C. elegans
cccgttttcaaca

SEQ ID NO: 712409 - DNA, 13 bp, C. elegans
cccgttttctttg

SEQ ID NO: 712410 - DNA, 13 bp, C. elegans
cccgttttttcca

SEQ ID NO: 712411 - DNA, 13 bp, C. elegans
ccctattcttgcc

SEQ ID NO: 712412 - DNA, 13 bp, C. elegans
ccctatttttttg

SEQ ID NO: 712413 - DNA, 13 bp, C. elegans
ccctcaagccttc

SEQ ID NO: 712414 - DNA, 13 bp, C. elegans
ccctcattttaat

SEQ ID NO: 712415 - DNA, 13 bp, C. elegans
ccctcattttcaa

SEQ ID NO: 712416 - DNA, 13 bp, C. elegans
ccctccaaaattt

SEQ ID NO: 712417 - DNA, 13 bp, C. elegans
ccctccagaagcc

SEQ ID NO: 712418 - DNA, 13 bp, C. elegans
ccctctaaaaact

SEQ ID NO: 712419 - DNA, 13 bp, C. elegans
ccctgaaatttca

SEQ ID NO: 712420 - DNA, 13 bp, C. elegans
cccttaattttca

SEQ ID NO: 712421 - DNA, 13 bp, C. elegans
cccttcaacagcc

SEQ ID NO: 712422 - DNA, 14 bp, C. elegans
cccttccaccattg

SEQ ID NO: 712423 - DNA, 13 bp, C. elegans
ccctttaccattt

SEQ ID NO: 712424 - DNA, 13 bp, C. elegans
ccgaaaaaaaatg

SEQ ID NO: 712425 - DNA, 13 bp, C. elegans
ccgaaaaaatcga

SEQ ID NO: 712426 - DNA, 13 bp, C. elegans
ccgaaaaacttga

SEQ ID NO: 712427 - DNA, 13 bp, C. elegans
ccgaaaaatcgga

SEQ ID NO: 712428 - DNA, 13 bp, C. elegans
ccgaaaaatgaaa

SEQ ID NO: 712429 - DNA, 13 bp, C. elegans
ccgaaaaattcaa

SEQ ID NO: 712430 - DNA, 13 bp, C. elegans
ccgaaaaattcta

SEQ ID NO: 712431 - DNA, 13 bp, C. elegans
ccgaaaacaattt

SEQ ID NO: 712432 - DNA, 13 bp, C. elegans
ccgaaaactttaa

SEQ ID NO: 712433 - DNA, 13 bp, C. elegans
ccgaaaagttgcc

SEQ ID NO: 712434 - DNA, 13 bp, C. elegans
ccgaaaatcaaaa

SEQ ID NO: 712435 - DNA, 13 bp, C. elegans
ccgaaaatccatt

SEQ ID NO: 712436 - DNA, 13 bp, C. elegans
ccgaaaatcgata

SEQ ID NO: 712437 - DNA, 13 bp, C. elegans
ccgaaaatcgatt

SEQ ID NO: 712438 - DNA, 13 bp, C. elegans
ccgaaaatctaaa

SEQ ID NO: 712439 - DNA, 13 bp, C. elegans
ccgaaaatctcaa

SEQ ID NO: 712440 - DNA, 13 bp, C. elegans
ccgaaaattaaaa

SEQ ID NO: 712441 - DNA, 13 bp, C. elegans
ccgaaaattatga

SEQ ID NO: 712442 - DNA, 13 bp, C. elegans
ccgaaaattcaca

SEQ ID NO: 712443 - DNA, 13 bp, C. elegans
ccgaaaattccca

SEQ ID NO: 712444 - DNA, 13 bp, C. elegans
ccgaaaattcgaa

SEQ ID NO: 712445 - DNA, 13 bp, C. elegans
ccgaaaattgccg

SEQ ID NO: 712446 - DNA, 13 bp, C. elegans
ccgaaaattgtcg

SEQ ID NO: 712447 - DNA, 14 bp, C. elegans
ccgaaaatttcaat

SEQ ID NO: 712448 - DNA, 13 bp, C. elegans
ccgaaaattttct

SEQ ID NO: 712449 - DNA, 13 bp, C. elegans
ccgaaaatttttt

SEQ ID NO: 712450 - DNA, 13 bp, C. elegans
ccgaaatctgaga

SEQ ID NO: 712451 - DNA, 13 bp, C. elegans
ccgaaatctggaa

SEQ ID NO: 712452 - DNA, 13 bp, C. elegans
ccgaaattatcga

SEQ ID NO: 712453 - DNA, 13 bp, C. elegans
ccgaaattccaaa

SEQ ID NO: 712454 - DNA, 13 bp, C. elegans
ccgaaattgaaat

SEQ ID NO: 712455 - DNA, 13 bp, C. elegans
ccgaaattgaaga

SEQ ID NO: 712456 - DNA, 13 bp, C. elegans
ccgaaattggaaa

SEQ ID NO: 712457 - DNA, 13 bp, C. elegans
ccgaaatttgtaa

SEQ ID NO: 712458 - DNA, 13 bp, C. elegans
ccgaaattttatt

SEQ ID NO: 712459 - DNA, 13 bp, C. elegans
ccgaaggatcaca

SEQ ID NO: 712460 - DNA, 13 bp, C. elegans
ccgaagttgactt

SEQ ID NO: 712461 - DNA, 13 bp, C. elegans
ccgaatatcaaaa

SEQ ID NO: 712462 - DNA, 13 bp, C. elegans
ccgaatattttaa

SEQ ID NO: 712463 - DNA, 13 bp, C. elegans
ccgaatcttacga

SEQ ID NO: 712464 - DNA, 13 bp, C. elegans
ccgaatttcatga

SEQ ID NO: 712465 - DNA, 13 bp, C. elegans
ccgaattttcaaa

SEQ ID NO: 712466 - DNA, 13 bp, C. elegans
ccgacaattttcc

SEQ ID NO: 712467 - DNA, 13 bp, C. elegans
ccgacaattttga

SEQ ID NO: 712468 - DNA, 13 bp, C. elegans
ccgacacttttcg

SEQ ID NO: 712469 - DNA, 13 bp, C. elegans
ccgacagccgaca

SEQ ID NO: 712470 - DNA, 13 bp, C. elegans
ccgacatctcgtg

SEQ ID NO: 712471 - DNA, 13 bp, C. elegans
ccgacattttacg

SEQ ID NO: 712472 - DNA, 13 bp, C. elegans
ccgacattttctg

SEQ ID NO: 712473 - DNA, 13 bp, C. elegans
ccgaccaatcagc

SEQ ID NO: 712474 - DNA, 13 bp, C. elegans
ccgaccacatccc

SEQ ID NO: 712475 - DNA, 23 bp, C. elegans
ccgaccttctgtgtgttagacag

SEQ ID NO: 712476 - DNA, 30 bp, C. elegans
ccgactccatcaccgacaagaagattcgtg

SEQ ID NO: 712477 - DNA, 29 bp, C. elegans
ccgactgcaccaattctagttcaagcgaa

SEQ ID NO: 712478 - DNA, 13 bp, C. elegans
ccgacttcaagaa

SEQ ID NO: 712479 - DNA, 13 bp, C. elegans
ccgactttttggc

SEQ ID NO: 712480 - DNA, 13 bp, C. elegans
ccgagagcaccag

SEQ ID NO: 712481 - DNA, 13 bp, C. elegans
ccgagaggagtac

SEQ ID NO: 712482 - DNA, 13 bp, C. elegans
ccgagatataaac

SEQ ID NO: 712483 - DNA, 13 bp, C. elegans
ccgagatataagc

SEQ ID NO: 712484 - DNA, 13 bp, C. elegans
ccgagatggctct

SEQ ID NO: 712485 - DNA, 13 bp, C. elegans
ccgagctcggcaa

SEQ ID NO: 712486 - DNA, 13 bp, C. elegans
ccgagtttgccga

SEQ ID NO: 712487 - DNA, 13 bp, C. elegans
ccgagttttctta

SEQ ID NO: 712488 - DNA, 13 bp, C. elegans
ccgagtttttgat

SEQ ID NO: 712489 - DNA, 13 bp, C. elegans
ccgatatttcgaa

SEQ ID NO: 712490 - DNA, 13 bp, C. elegans
ccgatctgccgga

SEQ ID NO: 712491 - DNA, 13 bp, C. elegans
ccgatgttgctcg

SEQ ID NO: 712492 - DNA, 13 bp, C. elegans
ccgattaattttt

SEQ ID NO: 712493 - DNA, 13 bp, C. elegans
ccgattgaaattt

SEQ ID NO: 712494 - DNA, 13 bp, C. elegans
ccgattgccgaaa

SEQ ID NO: 712495 - DNA, 13 bp, C. elegans
ccgatttcatttt

SEQ ID NO: 712496 - DNA, 13 bp, C. elegans
ccgatttgaatga

SEQ ID NO: 712497 - DNA, 13 bp, C. elegans
ccgatttgcaaaa

SEQ ID NO: 712498 - DNA, 13 bp, C. elegans
ccgatttgcaaga

SEQ ID NO: 712499 - DNA, 13 bp, C. elegans
ccgatttgccatt

SEQ ID NO: 712500 - DNA, 13 bp, C. elegans
ccgatttgctgga

SEQ ID NO: 712501 - DNA, 13 bp, C. elegans
ccgattttcaatt

SEQ ID NO: 712502 - DNA, 13 bp, C. elegans
ccgatttttattt

SEQ ID NO: 712503 - DNA, 13 bp, C. elegans
ccgatttttcgca

SEQ ID NO: 712504 - DNA, 14 bp, C. elegans
ccgattttttaaat

SEQ ID NO: 712505 - DNA, 13 bp, C. elegans
ccgattttttcca

SEQ ID NO: 712506 - DNA, 13 bp, C. elegans
ccgcaaaaatatt

SEQ ID NO: 712507 - DNA, 13 bp, C. elegans
ccgcaaatcaacc

SEQ ID NO: 712508 - DNA, 13 bp, C. elegans
ccgcaatttttcc

SEQ ID NO: 712509 - DNA, 13 bp, C. elegans
ccgcatgttttgt

SEQ ID NO: 712510 - DNA, 13 bp, C. elegans
ccgccaaaatgtt

SEQ ID NO: 712511 - DNA, 13 bp, C. elegans
ccgccaagttaca

SEQ ID NO: 712512 - DNA, 13 bp, C. elegans
ccgccaatatttt

SEQ ID NO: 712513 - DNA, 13 bp, C. elegans
ccgccaattgaac

SEQ ID NO: 712514 - DNA, 13 bp, C. elegans
ccgccagcttcct

SEQ ID NO: 712515 - DNA, 13 bp, C. elegans
ccgcccacaaaat

SEQ ID NO: 712516 - DNA, 13 bp, C. elegans
ccgcccacacctg

SEQ ID NO: 712517 - DNA, 13 bp, C. elegans
ccgcccactttcc

SEQ ID NO: 712518 - DNA, 13 bp, C. elegans
ccgcccacttttc

SEQ ID NO: 712519 - DNA, 14 bp, C. elegans
ccgcccactttttc

SEQ ID NO: 712520 - DNA, 13 bp, C. elegans
ccgcccatttctt

SEQ ID NO: 712521 - DNA, 13 bp, C. elegans
ccgcccattttct

SEQ ID NO: 712522 - DNA, 13 bp, C. elegans
ccgccccttttgt

SEQ ID NO: 712523 - DNA, 13 bp, C. elegans
ccgcctattttct

SEQ ID NO: 712524 - DNA, 13 bp, C. elegans
ccgcctgtatctc

SEQ ID NO: 712525 - DNA, 13 bp, C. elegans
ccgcgaattctgg

SEQ ID NO: 712526 - DNA, 17 bp, C. elegans
ccgcgcctacggcgcgg

SEQ ID NO: 712527 - DNA, 13 bp, C. elegans
ccgcggagatata

SEQ ID NO: 712528 - DNA, 13 bp, C. elegans
ccgctgaaaaagt

SEQ ID NO: 712529 - DNA, 13 bp, C. elegans
ccgctgaaatttt

SEQ ID NO: 712530 - DNA, 13 bp, C. elegans
ccgctgatttttt

SEQ ID NO: 712531 - DNA, 13 bp, C. elegans
ccgcttcaaagtt

SEQ ID NO: 712532 - DNA, 13 bp, C. elegans
ccggaaaactcaa

SEQ ID NO: 712533 - DNA, 13 bp, C. elegans
ccggaaacttcaa

SEQ ID NO: 712534 - DNA, 13 bp, C. elegans
ccggaaactttca

SEQ ID NO: 712535 - DNA, 13 bp, C. elegans
ccggaaatcaaaa

SEQ ID NO: 712536 - DNA, 13 bp, C. elegans
ccggaaatcagaa

SEQ ID NO: 712537 - DNA, 13 bp, C. elegans
ccggaaatgttca

SEQ ID NO: 712538 - DNA, 13 bp, C. elegans
ccggaaatgttta

SEQ ID NO: 712539 - DNA, 13 bp, C. elegans
ccggaaatgtttt

SEQ ID NO: 712540 - DNA, 13 bp, C. elegans
ccggaaattcaaa

SEQ ID NO: 712541 - DNA, 13 bp, C. elegans
ccggaaattccca

SEQ ID NO: 712542 - DNA, 13 bp, C. elegans
ccggaaattctga

SEQ ID NO: 712543 - DNA, 13 bp, C. elegans
ccggaaattttga

SEQ ID NO: 712544 - DNA, 14 bp, C. elegans
ccggaacttatttg

SEQ ID NO: 712545 - DNA, 13 bp, C. elegans
ccggaatggaaaa

SEQ ID NO: 712546 - DNA, 13 bp, C. elegans
ccggaatggaaat

SEQ ID NO: 712547 - DNA, 13 bp, C. elegans
ccggaattcaaaa

SEQ ID NO: 712548 - DNA, 14 bp, C. elegans
ccggaattccataa

SEQ ID NO: 712549 - DNA, 13 bp, C. elegans
ccggaatttttaa

SEQ ID NO: 712550 - DNA, 13 bp, C. elegans
ccggagagcaaaa

SEQ ID NO: 712551 - DNA, 14 bp, C. elegans
ccggaggcgcggtc

SEQ ID NO: 712552 - DNA, 13 bp, C. elegans
ccggatatcaatt

SEQ ID NO: 712553 - DNA, 13 bp, C. elegans
ccggatattttca

SEQ ID NO: 712554 - DNA, 13 bp, C. elegans
ccggcaaaaaatc

SEQ ID NO: 712555 - DNA, 13 bp, C. elegans
ccggcaaaatcgg

SEQ ID NO: 712556 - DNA, 13 bp, C. elegans
ccggcaaatcaga

SEQ ID NO: 712557 - DNA, 13 bp, C. elegans
ccggcaaattcga

SEQ ID NO: 712558 - DNA, 13 bp, C. elegans
ccggcaaattgat

SEQ ID NO: 712559 - DNA, 13 bp, C. elegans
ccggcaattgtcg

SEQ ID NO: 712560 - DNA, 13 bp, C. elegans
ccggcaatttccg

SEQ ID NO: 712561 - DNA, 13 bp, C. elegans
ccggcaatttgtc

SEQ ID NO: 712562 - DNA, 13 bp, C. elegans
ccggcaattttcc

SEQ ID NO: 712563 - DNA, 13 bp, C. elegans
ccgggattgaaaa

SEQ ID NO: 712564 - DNA, 13 bp, C. elegans
ccgggtaccgtat

SEQ ID NO: 712565 - DNA, 13 bp, C. elegans
ccgggttactgta

SEQ ID NO: 712566 - DNA, 13 bp, C. elegans
ccgggttcaattc

SEQ ID NO: 712567 - DNA, 13 bp, C. elegans
ccggtcttgacac

SEQ ID NO: 712568 - DNA, 13 bp, C. elegans
ccggtgtttgcgt

SEQ ID NO: 712569 - DNA, 13 bp, C. elegans
ccggttactgtag

SEQ ID NO: 712570 - DNA, 13 bp, C. elegans
ccggttcaatttt

SEQ ID NO: 712571 - DNA, 13 bp, C. elegans
ccggtttcgcttt

SEQ ID NO: 712572 - DNA, 13 bp, C. elegans
ccggtttctcttt

SEQ ID NO: 712573 - DNA, 13 bp, C. elegans
ccggtttgctgaa

SEQ ID NO: 712574 - DNA, 13 bp, C. elegans
ccggtttgtcgat

SEQ ID NO: 712575 - DNA, 13 bp, C. elegans
ccggttttcaaaa

SEQ ID NO: 712576 - DNA, 13 bp, C. elegans
ccggttttcgaaa

SEQ ID NO: 712577 - DNA, 13 bp, C. elegans
ccgtaagatgtcg

SEQ ID NO: 712578 - DNA, 14 bp, C. elegans
ccgtaaggtgtcgg

SEQ ID NO: 712579 - DNA, 13 bp, C. elegans
ccgtatcattttg

SEQ ID NO: 712580 - DNA, 13 bp, C. elegans
ccgtattttctct

SEQ ID NO: 712581 - DNA, 13 bp, C. elegans
ccgtatttttatt

SEQ ID NO: 712582 - DNA, 13 bp, C. elegans
ccgtattttttgt

SEQ ID NO: 712583 - DNA, 13 bp, C. elegans
ccgtcaaaaagtg

SEQ ID NO: 712584 - DNA, 13 bp, C. elegans
ccgtcaaagtaga

SEQ ID NO: 712585 - DNA, 13 bp, C. elegans
ccgtcgaatttgt

SEQ ID NO: 712586 - DNA, 13 bp, C. elegans
ccgtcgtcgtcgt

SEQ ID NO: 712587 - DNA, 13 bp, C. elegans
ccgtctaattttg

SEQ ID NO: 712588 - DNA, 14 bp, C. elegans
ccgtgctcggcaaa

SEQ ID NO: 712589 - DNA, 13 bp, C. elegans
ccgtggtgagacc

SEQ ID NO: 712590 - DNA, 13 bp, C. elegans
ccgttttcaaaaa

SEQ ID NO: 712591 - DNA, 13 bp, C. elegans
ccgtttttaaaat

SEQ ID NO: 712592 - DNA, 13 bp, C. elegans
ccgttttttcgaa

SEQ ID NO: 712593 - DNA, 13 bp, C. elegans
cctaaaaataatt

SEQ ID NO: 712594 - DNA, 13 bp, C. elegans
cctaaaaatcgat

SEQ ID NO: 712595 - DNA, 13 bp, C. elegans
cctaaaaatgtga

SEQ ID NO: 712596 - DNA, 13 bp, C. elegans
cctaaaataatga

SEQ ID NO: 712597 - DNA, 13 bp, C. elegans
cctaaaattagtt

SEQ ID NO: 712598 - DNA, 13 bp, C. elegans
cctaaactttttt

SEQ ID NO: 712599 - DNA, 13 bp, C. elegans
cctaaataatttt

SEQ ID NO: 712600 - DNA, 13 bp, C. elegans
cctaacgagaccc

SEQ ID NO: 712601 - DNA, 13 bp, C. elegans
cctaagcctaaaa

SEQ ID NO: 712602 - DNA, 13 bp, C. elegans
cctaagcctaagt

SEQ ID NO: 712603 - DNA, 13 bp, C. elegans
cctaatttattta

SEQ ID NO: 712604 - DNA, 13 bp, C. elegans
cctaattttcaat

SEQ ID NO: 712605 - DNA, 13 bp, C. elegans
cctaatttttagc

SEQ ID NO: 712606 - DNA, 13 bp, C. elegans
cctaatttttctg

SEQ ID NO: 712607 - DNA, 13 bp, C. elegans
cctaattttttaa

SEQ ID NO: 712608 - DNA, 13 bp, C. elegans
cctacaatgtttc

SEQ ID NO: 712609 - DNA, 13 bp, C. elegans
cctacagtaaccc

SEQ ID NO: 712610 - DNA, 13 bp, C. elegans
cctacagtaacct

SEQ ID NO: 712611 - DNA, 13 bp, C. elegans
cctacagtaatca

SEQ ID NO: 712612 - DNA, 13 bp, C. elegans
cctacagtaatcc

SEQ ID NO: 712613 - DNA, 13 bp, C. elegans
cctacagtaattc

SEQ ID NO: 712614 - DNA, 13 bp, C. elegans
cctacagtacccc

SEQ ID NO: 712615 - DNA, 13 bp, C. elegans
cctacagtactcc

SEQ ID NO: 712616 - DNA, 13 bp, C. elegans
cctaccgcctatt

SEQ ID NO: 712617 - DNA, 13 bp, C. elegans
cctaccgtacccc

SEQ ID NO: 712618 - DNA, 13 bp, C. elegans
cctacctacctac

SEQ ID NO: 712619 - DNA, 13 bp, C. elegans
cctacctactgcc

SEQ ID NO: 712620 - DNA, 13 bp, C. elegans
cctacctatccta

SEQ ID NO: 712621 - DNA, 13 bp, C. elegans
cctacgcctgcct

SEQ ID NO: 712622 - DNA, 14 bp, C. elegans
cctactggaatatt

SEQ ID NO: 712623 - DNA, 13 bp, C. elegans
cctacttgcctgc

SEQ ID NO: 712624 - DNA, 13 bp, C. elegans
cctacttttctgg

SEQ ID NO: 712625 - DNA, 13 bp, C. elegans
cctacttttttaa

SEQ ID NO: 712626 - DNA, 13 bp, C. elegans
cctagaaaatcaa

SEQ ID NO: 712627 - DNA, 13 bp, C. elegans
cctaggccaccac

SEQ ID NO: 712628 - DNA, 13 bp, C. elegans
cctagttttatga

SEQ ID NO: 712629 - DNA, 13 bp, C. elegans
cctatactgcatt

SEQ ID NO: 712630 - DNA, 13 bp, C. elegans
cctatttaaaatt

SEQ ID NO: 712631 - DNA, 13 bp, C. elegans
cctatttgaattt

SEQ ID NO: 712632 - DNA, 13 bp, C. elegans
cctattttatgcc

SEQ ID NO: 712633 - DNA, 13 bp, C. elegans
cctatttttccag

SEQ ID NO: 712634 - DNA, 13 bp, C. elegans
cctatttttgcct

SEQ ID NO: 712635 - DNA, 13 bp, C. elegans
cctattttttcca

SEQ ID NO: 712636 - DNA, 13 bp, C. elegans
cctcaaaaaactt

SEQ ID NO: 712637 - DNA, 13 bp, C. elegans
cctcaaaagtacg

SEQ ID NO: 712638 - DNA, 13 bp, C. elegans
cctcaaccaacat

SEQ ID NO: 712639 - DNA, 13 bp, C. elegans
cctcaaccaatgt

SEQ ID NO: 712640 - DNA, 13 bp, C. elegans
cctcaaccatttt

SEQ ID NO: 712641 - DNA, 13 bp, C. elegans
cctcaactatttt

SEQ ID NO: 712642 - DNA, 13 bp, C. elegans
cctcaattttcag

SEQ ID NO: 712643 - DNA, 13 bp, C. elegans
cctcacttgtctc

SEQ ID NO: 712644 - DNA, 13 bp, C. elegans
cctcatcatcatc

SEQ ID NO: 712645 - DNA, 13 bp, C. elegans
cctcatttgaatt

SEQ ID NO: 712646 - DNA, 13 bp, C. elegans
cctcattttttca

SEQ ID NO: 712647 - DNA, 13 bp, C. elegans
cctcattttttgt

SEQ ID NO: 712648 - DNA, 13 bp, C. elegans
cctccaaaatatt

SEQ ID NO: 712649 - DNA, 13 bp, C. elegans
cctcccgcatttt

SEQ ID NO: 712650 - DNA, 13 bp, C. elegans
cctcctcaaactt

SEQ ID NO: 712651 - DNA, 13 bp, C. elegans
cctcctttaaagt

SEQ ID NO: 712652 - DNA, 13 bp, C. elegans
cctcgaaaatact

SEQ ID NO: 712653 - DNA, 13 bp, C. elegans
cctcgaaatttca

SEQ ID NO: 712654 - DNA, 15 bp, C. elegans
cctcggagaccttcc

SEQ ID NO: 712655 - DNA, 13 bp, C. elegans
cctctaatagtat

SEQ ID NO: 712656 - DNA, 13 bp, C. elegans
cctctgccgctaa

SEQ ID NO: 712657 - DNA, 13 bp, C. elegans
cctctgcgtctct

SEQ ID NO: 712658 - DNA, 13 bp, C. elegans
cctcttttttaaa

SEQ ID NO: 712659 - DNA, 13 bp, C. elegans
cctgaaaaaattg

SEQ ID NO: 712660 - DNA, 13 bp, C. elegans
cctgaaaaatcaa

SEQ ID NO: 712661 - DNA, 13 bp, C. elegans
cctgaaaaatgaa

SEQ ID NO: 712662 - DNA, 13 bp, C. elegans
cctgaaagttgcc

SEQ ID NO: 712663 - DNA, 13 bp, C. elegans
cctgaaattccgg

SEQ ID NO: 712664 - DNA, 13 bp, C. elegans
cctgaaattttgt

SEQ ID NO: 712665 - DNA, 13 bp, C. elegans
cctgaattaatta

SEQ ID NO: 712666 - DNA, 13 bp, C. elegans
cctgacaccactt

SEQ ID NO: 712667 - DNA, 13 bp, C. elegans
cctgattccaaat

SEQ ID NO: 712668 - DNA, 13 bp, C. elegans
cctgattttatat

SEQ ID NO: 712669 - DNA, 13 bp, C. elegans
cctgccagcaatt

SEQ ID NO: 712670 - DNA, 13 bp, C. elegans
cctgcctactttt

SEQ ID NO: 712671 - DNA, 13 bp, C. elegans
cctgcctatgtgc

SEQ ID NO: 712672 - DNA, 13 bp, C. elegans
cctgcctgcctac

SEQ ID NO: 712673 - DNA, 13 bp, C. elegans
cctgcctgcctat

SEQ ID NO: 712674 - DNA, 13 bp, C. elegans
cctgcctgtctgc

SEQ ID NO: 712675 - DNA, 13 bp, C. elegans
cctgcgtatattt

SEQ ID NO: 712676 - DNA, 13 bp, C. elegans
cctgcgtctctct

SEQ ID NO: 712677 - DNA, 13 bp, C. elegans
cctgcgtctcttc

SEQ ID NO: 712678 - DNA, 13 bp, C. elegans
cctgcgtgctttt

SEQ ID NO: 712679 - DNA, 13 bp, C. elegans
cctgctctgcttg

SEQ ID NO: 712680 - DNA, 13 bp, C. elegans
cctggagtgttca

SEQ ID NO: 712681 - DNA, 13 bp, C. elegans
cctggcaccacgt

SEQ ID NO: 712682 - DNA, 37 bp, C. elegans
cctgggctcaattttgctccgaacttagtgccgtttt

SEQ ID NO: 712683 - DNA, 13 bp, C. elegans
cctgttgaacttg

SEQ ID NO: 712684 - DNA, 13 bp, C. elegans
ccttaaaattgca

SEQ ID NO: 712685 - DNA, 13 bp, C. elegans
ccttatgattttc

SEQ ID NO: 712686 - DNA, 13 bp, C. elegans
ccttattcaaaaa

SEQ ID NO: 712687 - DNA, 13 bp, C. elegans
ccttcaaaatatt

SEQ ID NO: 712688 - DNA, 13 bp, C. elegans
ccttcaaatttaa

SEQ ID NO: 712689 - DNA, 13 bp, C. elegans
ccttcaattttct

SEQ ID NO: 712690 - DNA, 13 bp, C. elegans
ccttctcattgac

SEQ ID NO: 712691 - DNA, 13 bp, C. elegans
ccttctgaaaaat

SEQ ID NO: 712692 - DNA, 13 bp, C. elegans
ccttctgtaaaac

SEQ ID NO: 712693 - DNA, 13 bp, C. elegans
ccttgaaaaaatg

SEQ ID NO: 712694 - DNA, 13 bp, C. elegans
ccttgaaaagaga

SEQ ID NO: 712695 - DNA, 13 bp, C. elegans
ccttgcccaaaaa

SEQ ID NO: 712696 - DNA, 13 bp, C. elegans
ccttgctctttgc

SEQ ID NO: 712697 - DNA, 13 bp, C. elegans
ccttgtgcctacc

SEQ ID NO: 712698 - DNA, 13 bp, C. elegans
ccttgtttttcaa

SEQ ID NO: 712699 - DNA, 13 bp, C. elegans
cctttaaaaatta

SEQ ID NO: 712700 - DNA, 13 bp, C. elegans
cctttaaaataaa

SEQ ID NO: 712701 - DNA, 13 bp, C. elegans
cctttaaaatttt

SEQ ID NO: 712702 - DNA, 15 bp, C. elegans
cctttaaaggcgcac

SEQ ID NO: 712703 - DNA, 13 bp, C. elegans
cctttctcattga

SEQ ID NO: 712704 - DNA, 13 bp, C. elegans
ccttttcacattt

SEQ ID NO: 712705 - DNA, 13 bp, C. elegans
ccttttcgggaat

SEQ ID NO: 712706 - DNA, 14 bp, C. elegans
ccttttcgttgctc

SEQ ID NO: 712707 - DNA, 13 bp, C. elegans
ccttttgaaatat

SEQ ID NO: 712708 - DNA, 13 bp, C. elegans
ccttttgctcatt

SEQ ID NO: 712709 - DNA, 13 bp, C. elegans
cctttttattaaa

SEQ ID NO: 712710 - DNA, 13 bp, C. elegans
cctttttcaaaaa

SEQ ID NO: 712711 - DNA, 13 bp, C. elegans
cctttttcagaat

SEQ ID NO: 712712 - DNA, 13 bp, C. elegans
cctttttgaaatt

SEQ ID NO: 712713 - DNA, 13 bp, C. elegans
cctttttgaattt

SEQ ID NO: 712714 - DNA, 13 bp, C. elegans
ccttttttcaaat

SEQ ID NO: 712715 - DNA, 13 bp, C. elegans
ccttttttcatga

SEQ ID NO: 712716 - DNA, 13 bp, C. elegans
ccttttttcatgt

SEQ ID NO: 712717 - DNA, 13 bp, C. elegans
cgaaaaaaaactg

SEQ ID NO: 712718 - DNA, 13 bp, C. elegans
cgaaaaaaaattc

SEQ ID NO: 712719 - DNA, 13 bp, C. elegans
cgaaaaaaatgct

SEQ ID NO: 712720 - DNA, 13 bp, C. elegans
cgaaaaaaatgtc

SEQ ID NO: 712721 - DNA, 13 bp, C. elegans
cgaaaaaactaat

SEQ ID NO: 712722 - DNA, 13 bp, C. elegans
cgaaaaaactcaa

SEQ ID NO: 712723 - DNA, 13 bp, C. elegans
cgaaaaaagttag

SEQ ID NO: 712724 - DNA, 13 bp, C. elegans
cgaaaaaagttca

SEQ ID NO: 712725 - DNA, 13 bp, C. elegans
cgaaaaaataatt

SEQ ID NO: 712726 - DNA, 13 bp, C. elegans
cgaaaaaatattg

SEQ ID NO: 712727 - DNA, 13 bp, C. elegans
cgaaaaaatcaga

SEQ ID NO: 712728 - DNA, 13 bp, C. elegans
cgaaaaaatcata

SEQ ID NO: 712729 - DNA, 13 bp, C. elegans
cgaaaaaatcgag

SEQ ID NO: 712730 - DNA, 13 bp, C. elegans
cgaaaaaatcggt

SEQ ID NO: 712731 - DNA, 13 bp, C. elegans
cgaaaaaatctga

SEQ ID NO: 712732 - DNA, 13 bp, C. elegans
cgaaaaaatgaga

SEQ ID NO: 712733 - DNA, 13 bp, C. elegans
cgaaaaaatgcac

SEQ ID NO: 712734 - DNA, 13 bp, C. elegans
cgaaaaaatggag

SEQ ID NO: 712735 - DNA, 13 bp, C. elegans
cgaaaaaattgaa

SEQ ID NO: 712736 - DNA, 13 bp, C. elegans
cgaaaaaattgta

SEQ ID NO: 712737 - DNA, 13 bp, C. elegans
cgaaaaaccgaca

SEQ ID NO: 712738 - DNA, 13 bp, C. elegans
cgaaaaacgaaat

SEQ ID NO: 712739 - DNA, 13 bp, C. elegans
cgaaaaactagaa

SEQ ID NO: 712740 - DNA, 13 bp, C. elegans
cgaaaaactataa

SEQ ID NO: 712741 - DNA, 13 bp, C. elegans
cgaaaaactcgat

SEQ ID NO: 712742 - DNA, 13 bp, C. elegans
cgaaaaacttgga

SEQ ID NO: 712743 - DNA, 13 bp, C. elegans
cgaaaaagaaatg

SEQ ID NO: 712744 - DNA, 13 bp, C. elegans
cgaaaaagacatt

SEQ ID NO: 712745 - DNA, 13 bp, C. elegans
cgaaaaagtacaa

SEQ ID NO: 712746 - DNA, 13 bp, C. elegans
cgaaaaagtattt

SEQ ID NO: 712747 - DNA, 13 bp, C. elegans
cgaaaaagttttg

SEQ ID NO: 712748 - DNA, 13 bp, C. elegans
cgaaaaataattt

SEQ ID NO: 712749 - DNA, 13 bp, C. elegans
cgaaaaataccaa

SEQ ID NO: 712750 - DNA, 13 bp, C. elegans
cgaaaaatatttt

SEQ ID NO: 712751 - DNA, 13 bp, C. elegans
cgaaaaatcaata

SEQ ID NO: 712752 - DNA, 13 bp, C. elegans
cgaaaaatcgatg

SEQ ID NO: 712753 - DNA, 13 bp, C. elegans
cgaaaaatctaca

SEQ ID NO: 712754 - DNA, 13 bp, C. elegans
cgaaaaatcttga

SEQ ID NO: 712755 - DNA, 13 bp, C. elegans
cgaaaaatgaaat

SEQ ID NO: 712756 - DNA, 13 bp, C. elegans
cgaaaaatgagaa

SEQ ID NO: 712757 - DNA, 13 bp, C. elegans
cgaaaaatgcggg

SEQ ID NO: 712758 - DNA, 13 bp, C. elegans
cgaaaaatggata

SEQ ID NO: 712759 - DNA, 13 bp, C. elegans
cgaaaaatgtagt

SEQ ID NO: 712760 - DNA, 13 bp, C. elegans
cgaaaaatgtcaa

SEQ ID NO: 712761 - DNA, 13 bp, C. elegans
cgaaaaatgtgtt

SEQ ID NO: 712762 - DNA, 13 bp, C. elegans
cgaaaaatgttgg

SEQ ID NO: 712763 - DNA, 13 bp, C. elegans
cgaaaaattatga

SEQ ID NO: 712764 - DNA, 14 bp, C. elegans
cgaaaaattcaaat

SEQ ID NO: 712765 - DNA, 13 bp, C. elegans
cgaaaaattcaga

SEQ ID NO: 712766 - DNA, 13 bp, C. elegans
cgaaaaattcatt

SEQ ID NO: 712767 - DNA, 13 bp, C. elegans
cgaaaaattgaaa

SEQ ID NO: 712768 - DNA, 13 bp, C. elegans
cgaaaaatttgat

SEQ ID NO: 712769 - DNA, 13 bp, C. elegans
cgaaaacaaattt

SEQ ID NO: 712770 - DNA, 13 bp, C. elegans
cgaaaacaataat

SEQ ID NO: 712771 - DNA, 13 bp, C. elegans
cgaaaacaatttt

SEQ ID NO: 712772 - DNA, 13 bp, C. elegans
cgaaaactcgaaa

SEQ ID NO: 712773 - DNA, 13 bp, C. elegans
cgaaaactggaaa

SEQ ID NO: 712774 - DNA, 13 bp, C. elegans
cgaaaactttcaa

SEQ ID NO: 712775 - DNA, 13 bp, C. elegans
cgaaaagaaaact

SEQ ID NO: 712776 - DNA, 13 bp, C. elegans
cgaaaagttagaa

SEQ ID NO: 712777 - DNA, 13 bp, C. elegans
cgaaaagttcaat

SEQ ID NO: 712778 - DNA, 13 bp, C. elegans
cgaaaagttgaaa

SEQ ID NO: 712779 - DNA, 13 bp, C. elegans
cgaaaagttttca

SEQ ID NO: 712780 - DNA, 13 bp, C. elegans
cgaaaatattttc

SEQ ID NO: 712781 - DNA, 13 bp, C. elegans
cgaaaatcaaaat

SEQ ID NO: 712782 - DNA, 13 bp, C. elegans
cgaaaatcattgg

SEQ ID NO: 712783 - DNA, 13 bp, C. elegans
cgaaaatcccaaa

SEQ ID NO: 712784 - DNA, 13 bp, C. elegans
cgaaaatcgaaaa

SEQ ID NO: 712785 - DNA, 13 bp, C. elegans
cgaaaatcgaaat

SEQ ID NO: 712786 - DNA, 13 bp, C. elegans
cgaaaatcgataa

SEQ ID NO: 712787 - DNA, 13 bp, C. elegans
cgaaaatcgcaaa

SEQ ID NO: 712788 - DNA, 13 bp, C. elegans
cgaaaatctgaaa

SEQ ID NO: 712789 - DNA, 13 bp, C. elegans
cgaaaatcttcaa

SEQ ID NO: 712790 - DNA, 13 bp, C. elegans
cgaaaatgcaaaa

SEQ ID NO: 712791 - DNA, 13 bp, C. elegans
cgaaaattaattt

SEQ ID NO: 712792 - DNA, 13 bp, C. elegans
cgaaaattatcga

SEQ ID NO: 712793 - DNA, 13 bp, C. elegans
cgaaaattatttt

SEQ ID NO: 712794 - DNA, 13 bp, C. elegans
cgaaaattcaaat

SEQ ID NO: 712795 - DNA, 13 bp, C. elegans
cgaaaattcagaa

SEQ ID NO: 712796 - DNA, 13 bp, C. elegans
cgaaaattcagtt

SEQ ID NO: 712797 - DNA, 13 bp, C. elegans
cgaaaattcattg

SEQ ID NO: 712798 - DNA, 13 bp, C. elegans
cgaaaattcgaga

SEQ ID NO: 712799 - DNA, 13 bp, C. elegans
cgaaaattctcat

SEQ ID NO: 712800 - DNA, 13 bp, C. elegans
cgaaaattctttt

SEQ ID NO: 712801 - DNA, 13 bp, C. elegans
cgaaaattgagga

SEQ ID NO: 712802 - DNA, 13 bp, C. elegans
cgaaaattgagtg

SEQ ID NO: 712803 - DNA, 13 bp, C. elegans
cgaaaattgattt

SEQ ID NO: 712804 - DNA, 13 bp, C. elegans
cgaaaattgctca

SEQ ID NO: 712805 - DNA, 13 bp, C. elegans
cgaaaattggctc

SEQ ID NO: 712806 - DNA, 13 bp, C. elegans
cgaaaattgtcat

SEQ ID NO: 712807 - DNA, 13 bp, C. elegans
cgaaaattgtctg

SEQ ID NO: 712808 - DNA, 13 bp, C. elegans
cgaaaattgttga

SEQ ID NO: 712809 - DNA, 13 bp, C. elegans
cgaaaattgtttt

SEQ ID NO: 712810 - DNA, 13 bp, C. elegans
cgaaaatttacaa

SEQ ID NO: 712811 - DNA, 13 bp, C. elegans
cgaaaatttcaga

SEQ ID NO: 712812 - DNA, 13 bp, C. elegans
cgaaaatttgaat

SEQ ID NO: 712813 - DNA, 13 bp, C. elegans
cgaaaatttgatt

SEQ ID NO: 712814 - DNA, 13 bp, C. elegans
cgaaaatttgcaa

SEQ ID NO: 712815 - DNA, 13 bp, C. elegans
cgaaaatttgcat

SEQ ID NO: 712816 - DNA, 13 bp, C. elegans
cgaaaatttggag

SEQ ID NO: 712817 - DNA, 13 bp, C. elegans
cgaaaatttggat

SEQ ID NO: 712818 - DNA, 13 bp, C. elegans
cgaaaatttgttt

SEQ ID NO: 712819 - DNA, 13 bp, C. elegans
cgaaaattttcaa

SEQ ID NO: 712820 - DNA, 13 bp, C. elegans
cgaaacaacgatg

SEQ ID NO: 712821 - DNA, 13 bp, C. elegans
cgaaacagttttt

SEQ ID NO: 712822 - DNA, 13 bp, C. elegans
cgaaacatcacaa

SEQ ID NO: 712823 - DNA, 13 bp, C. elegans
cgaaacatgaaaa

SEQ ID NO: 712824 - DNA, 13 bp, C. elegans
cgaaacatttcaa

SEQ ID NO: 712825 - DNA, 13 bp, C. elegans
cgaaacattttga

SEQ ID NO: 712826 - DNA, 13 bp, C. elegans
cgaaacgaattcc

SEQ ID NO: 712827 - DNA, 13 bp, C. elegans
cgaaaggttggtg

SEQ ID NO: 712828 - DNA, 13 bp, C. elegans
cgaaagttgtcga

SEQ ID NO: 712829 - DNA, 13 bp, C. elegans
cgaaagtttgaaa

SEQ ID NO: 712830 - DNA, 13 bp, C. elegans
cgaaagtttgaag

SEQ ID NO: 712831 - DNA, 13 bp, C. elegans
cgaaataattttt

SEQ ID NO: 712832 - DNA, 13 bp, C. elegans
cgaaatatcggaa

SEQ ID NO: 712833 - DNA, 13 bp, C. elegans
cgaaatatgaaat

SEQ ID NO: 712834 - DNA, 13 bp, C. elegans
cgaaatatgaatt

SEQ ID NO: 712835 - DNA, 13 bp, C. elegans
cgaaatatttcaa

SEQ ID NO: 712836 - DNA, 13 bp, C. elegans
cgaaatattttca

SEQ ID NO: 712837 - DNA, 13 bp, C. elegans
cgaaatcagttga

SEQ ID NO: 712838 - DNA, 13 bp, C. elegans
cgaaatcgtgaaa

SEQ ID NO: 712839 - DNA, 13 bp, C. elegans
cgaaatgaaatga

SEQ ID NO: 712840 - DNA, 13 bp, C. elegans
cgaaattaaaaat

SEQ ID NO: 712841 - DNA, 13 bp, C. elegans
cgaaattaattga

SEQ ID NO: 712842 - DNA, 13 bp, C. elegans
cgaaattataatt

SEQ ID NO: 712843 - DNA, 13 bp, C. elegans
cgaaattcagaat

SEQ ID NO: 712844 - DNA, 13 bp, C. elegans
cgaaattccgaaa

SEQ ID NO: 712845 - DNA, 13 bp, C. elegans
cgaaattcgaatt

SEQ ID NO: 712846 - DNA, 13 bp, C. elegans
cgaaattcgttca

SEQ ID NO: 712847 - DNA, 13 bp, C. elegans
cgaaattctcgtg

SEQ ID NO: 712848 - DNA, 13 bp, C. elegans
cgaaattcttcaa

SEQ ID NO: 712849 - DNA, 13 bp, C. elegans
cgaaattgaaaat

SEQ ID NO: 712850 - DNA, 13 bp, C. elegans
cgaaattgataaa

SEQ ID NO: 712851 - DNA, 13 bp, C. elegans
cgaaattggaaat

SEQ ID NO: 712852 - DNA, 13 bp, C. elegans
cgaaattggctca

SEQ ID NO: 712853 - DNA, 13 bp, C. elegans
cgaaattgttgaa

SEQ ID NO: 712854 - DNA, 13 bp, C. elegans
cgaaatttcattt

SEQ ID NO: 712855 - DNA, 13 bp, C. elegans
cgaaatttccaat

SEQ ID NO: 712856 - DNA, 13 bp, C. elegans
cgaaatttcggaa

SEQ ID NO: 712857 - DNA, 13 bp, C. elegans
cgaaatttgaatt

SEQ ID NO: 712858 - DNA, 13 bp, C. elegans
cgaaatttgttta

SEQ ID NO: 712859 - DNA, 13 bp, C. elegans
cgaaattttcaat

SEQ ID NO: 712860 - DNA, 13 bp, C. elegans
cgaaattttgaaa

SEQ ID NO: 712861 - DNA, 14 bp, C. elegans
cgaaattttgaaaa

SEQ ID NO: 712862 - DNA, 13 bp, C. elegans
cgaaattttgcat

SEQ ID NO: 712863 - DNA, 13 bp, C. elegans
cgaaattttggga

SEQ ID NO: 712864 - DNA, 13 bp, C. elegans
cgaaatttttgat

SEQ ID NO: 712865 - DNA, 13 bp, C. elegans
cgaaatttttttc

SEQ ID NO: 712866 - DNA, 13 bp, C. elegans
cgaacaaaaattg

SEQ ID NO: 712867 - DNA, 13 bp, C. elegans
cgaacaaaattaa

SEQ ID NO: 712868 - DNA, 13 bp, C. elegans
cgaacatcgaact

SEQ ID NO: 712869 - DNA, 13 bp, C. elegans
cgaacatttcaaa

SEQ ID NO: 712870 - DNA, 13 bp, C. elegans
cgaacgagttcaa

SEQ ID NO: 712871 - DNA, 13 bp, C. elegans
cgaacgtgtcggc

SEQ ID NO: 712872 - DNA, 13 bp, C. elegans
cgaacgttttcag

SEQ ID NO: 712873 - DNA, 13 bp, C. elegans
cgaactgcaattg

SEQ ID NO: 712874 - DNA, 13 bp, C. elegans
cgaacttgccgga

SEQ ID NO: 712875 - DNA, 13 bp, C. elegans
cgaagaaaaaatg

SEQ ID NO: 712876 - DNA, 13 bp, C. elegans
cgaagaaaaaatt

SEQ ID NO: 712877 - DNA, 13 bp, C. elegans
cgaagaaaaactt

SEQ ID NO: 712878 - DNA, 13 bp, C. elegans
cgaagaaaacccc

SEQ ID NO: 712879 - DNA, 13 bp, C. elegans
cgaagaaaatgaa

SEQ ID NO: 712880 - DNA, 13 bp, C. elegans
cgaagaaaattaa

SEQ ID NO: 712881 - DNA, 13 bp, C. elegans
cgaagaaatcgaa

SEQ ID NO: 712882 - DNA, 13 bp, C. elegans
cgaagaatttttt

SEQ ID NO: 712883 - DNA, 13 bp, C. elegans
cgaaggaaagtgg

SEQ ID NO: 712884 - DNA, 13 bp, C. elegans
cgaataaaataat

SEQ ID NO: 712885 - DNA, 13 bp, C. elegans
cgaataagaataa

SEQ ID NO: 712886 - DNA, 13 bp, C. elegans
cgaataattatta

SEQ ID NO: 712887 - DNA, 13 bp, C. elegans
cgaataattttct

SEQ ID NO: 712888 - DNA, 13 bp, C. elegans
cgaataattttga

SEQ ID NO: 712889 - DNA, 13 bp, C. elegans
cgaatagaatatt

SEQ ID NO: 712890 - DNA, 13 bp, C. elegans
cgaatatcaaaat

SEQ ID NO: 712891 - DNA, 13 bp, C. elegans
cgaatatcaatgt

SEQ ID NO: 712892 - DNA, 13 bp, C. elegans
cgaatatttcaaa

SEQ ID NO: 712893 - DNA, 13 bp, C. elegans
cgaatatttgaaa

SEQ ID NO: 712894 - DNA, 13 bp, C. elegans
cgaatcacatttc

SEQ ID NO: 712895 - DNA, 13 bp, C. elegans
cgaatcactgatt

SEQ ID NO: 712896 - DNA, 13 bp, C. elegans
cgaatgtgtaata

SEQ ID NO: 712897 - DNA, 14 bp, C. elegans
cgaatgttccagaa

SEQ ID NO: 712898 - DNA, 13 bp, C. elegans
cgaattaattttt

SEQ ID NO: 712899 - DNA, 13 bp, C. elegans
cgaattcaaaatt

SEQ ID NO: 712900 - DNA, 13 bp, C. elegans
cgaattccaaaaa

SEQ ID NO: 712901 - DNA, 13 bp, C. elegans
cgaattccgcatt

SEQ ID NO: 712902 - DNA, 13 bp, C. elegans
cgaattgaaaatg

SEQ ID NO: 712903 - DNA, 13 bp, C. elegans
cgaattgcaaaaa

SEQ ID NO: 712904 - DNA, 13 bp, C. elegans
cgaattgccgaga

SEQ ID NO: 712905 - DNA, 13 bp, C. elegans
cgaatttaattat

SEQ ID NO: 712906 - DNA, 13 bp, C. elegans
cgaatttatcgac

SEQ ID NO: 712907 - DNA, 13 bp, C. elegans
cgaatttattgaa

SEQ ID NO: 712908 - DNA, 13 bp, C. elegans
cgaatttatttaa

SEQ ID NO: 712909 - DNA, 13 bp, C. elegans
cgaatttcaaaat

SEQ ID NO: 712910 - DNA, 13 bp, C. elegans
cgaatttcaattt

SEQ ID NO: 712911 - DNA, 13 bp, C. elegans
cgaatttcataat

SEQ ID NO: 712912 - DNA, 13 bp, C. elegans
cgaatttcatatt

SEQ ID NO: 712913 - DNA, 13 bp, C. elegans
cgaatttcatgtt

SEQ ID NO: 712914 - DNA, 13 bp, C. elegans
cgaatttccattt

SEQ ID NO: 712915 - DNA, 13 bp, C. elegans
cgaatttcgaatt

SEQ ID NO: 712916 - DNA, 13 bp, C. elegans
cgaatttcgtaat

SEQ ID NO: 712917 - DNA, 13 bp, C. elegans
cgaatttcgtttt

SEQ ID NO: 712918 - DNA, 13 bp, C. elegans
cgaatttctacga

SEQ ID NO: 712919 - DNA, 13 bp, C. elegans
cgaatttctattt

SEQ ID NO: 712920 - DNA, 13 bp, C. elegans
cgaatttctcaat

SEQ ID NO: 712921 - DNA, 13 bp, C. elegans
cgaatttcttcaa

SEQ ID NO: 712922 - DNA, 13 bp, C. elegans
cgaatttgataat

SEQ ID NO: 712923 - DNA, 13 bp, C. elegans
cgaatttgccgat

SEQ ID NO: 712924 - DNA, 13 bp, C. elegans
cgaatttgtcgaa

SEQ ID NO: 712925 - DNA, 13 bp, C. elegans
cgaattttatggt

SEQ ID NO: 712926 - DNA, 13 bp, C. elegans
cgaattttattga

SEQ ID NO: 712927 - DNA, 13 bp, C. elegans
cgaattttcagtc

SEQ ID NO: 712928 - DNA, 13 bp, C. elegans
cgaattttcagtt

SEQ ID NO: 712929 - DNA, 13 bp, C. elegans
cgaattttcatga

SEQ ID NO: 712930 - DNA, 13 bp, C. elegans
cgaattttccaaa

SEQ ID NO: 712931 - DNA, 13 bp, C. elegans
cgaattttgaaaa

SEQ ID NO: 712932 - DNA, 13 bp, C. elegans
cgaattttgaagt

SEQ ID NO: 712933 - DNA, 13 bp, C. elegans
cgaattttgttat

SEQ ID NO: 712934 - DNA, 13 bp, C. elegans
cgaatttttaact

SEQ ID NO: 712935 - DNA, 13 bp, C. elegans
cgaatttttcaat

SEQ ID NO: 712936 - DNA, 13 bp, C. elegans
cgaatttttcaga

SEQ ID NO: 712937 - DNA, 13 bp, C. elegans
cgaatttttcgaa

SEQ ID NO: 712938 - DNA, 13 bp, C. elegans
cgaattttttatt

SEQ ID NO: 712939 - DNA, 13 bp, C. elegans
cgaattttttgat

SEQ ID NO: 712940 - DNA, 13 bp, C. elegans
cgaatttttttaa

SEQ ID NO: 712941 - DNA, 13 bp, C. elegans
cgaatttttttga

SEQ ID NO: 712942 - DNA, 13 bp, C. elegans
cgacaaaagtttg

SEQ ID NO: 712943 - DNA, 13 bp, C. elegans
cgacaaacttttg

SEQ ID NO: 712944 - DNA, 13 bp, C. elegans
cgacaaatcggca

SEQ ID NO: 712945 - DNA, 13 bp, C. elegans
cgacaaatcggta

SEQ ID NO: 712946 - DNA, 13 bp, C. elegans
cgacaaattgccg

SEQ ID NO: 712947 - DNA, 13 bp, C. elegans
cgacaaatttccg

SEQ ID NO: 712948 - DNA, 13 bp, C. elegans
cgacaaatttgtg

SEQ ID NO: 712949 - DNA, 13 bp, C. elegans
cgacaaatttttg

SEQ ID NO: 712950 - DNA, 13 bp, C. elegans
cgacaagaagatt

SEQ ID NO: 712951 - DNA, 13 bp, C. elegans
cgacaatttttcg

SEQ ID NO: 712952 - DNA, 13 bp, C. elegans
cgacaatttttgt

SEQ ID NO: 712953 - DNA, 13 bp, C. elegans
cgacaattttttt

SEQ ID NO: 712954 - DNA, 13 bp, C. elegans
cgacacgaaaatt

SEQ ID NO: 712955 - DNA, 13 bp, C. elegans
cgacacgacaagt

SEQ ID NO: 712956 - DNA, 13 bp, C. elegans
cgacattcaaaaa

SEQ ID NO: 712957 - DNA, 13 bp, C. elegans
cgaccaacgcctc

SEQ ID NO: 712958 - DNA, 13 bp, C. elegans
cgacgaaaagtta

SEQ ID NO: 712959 - DNA, 13 bp, C. elegans
cgacgaaaatcgg

SEQ ID NO: 712960 - DNA, 13 bp, C. elegans
cgacgacgaagag

SEQ ID NO: 712961 - DNA, 13 bp, C. elegans
cgacgacgacaac

SEQ ID NO: 712962 - DNA, 13 bp, C. elegans
cgacgacgacgac

SEQ ID NO: 712963 - DNA, 13 bp, C. elegans
cgacgctactcca

SEQ ID NO: 712964 - DNA, 13 bp, C. elegans
cgacgtcgtcgag

SEQ ID NO: 712965 - DNA, 13 bp, C. elegans
cgacgtttttttt

SEQ ID NO: 712966 - DNA, 13 bp, C. elegans
cgactaaaaatta

SEQ ID NO: 712967 - DNA, 13 bp, C. elegans
cgactaaaaattt

SEQ ID NO: 712968 - DNA, 13 bp, C. elegans
cgactgtaactca

SEQ ID NO: 712969 - DNA, 13 bp, C. elegans
cgacttctggagc

SEQ ID NO: 712970 - DNA, 13 bp, C. elegans
cgacttgtcaatg

SEQ ID NO: 712971 - DNA, 13 bp, C. elegans
cgactttttggca

SEQ ID NO: 712972 - DNA, 13 bp, C. elegans
cgagaaaaagaat

SEQ ID NO: 712973 - DNA, 13 bp, C. elegans
cgagaaaaagatc

SEQ ID NO: 712974 - DNA, 13 bp, C. elegans
cgagaaaatcaat

SEQ ID NO: 712975 - DNA, 13 bp, C. elegans
cgagaaaatcgat

SEQ ID NO: 712976 - DNA, 13 bp, C. elegans
cgagaaaatgcaa

SEQ ID NO: 712977 - DNA, 13 bp, C. elegans
cgagaaaattgga

SEQ ID NO: 712978 - DNA, 13 bp, C. elegans
cgagaaacgcgca

SEQ ID NO: 712979 - DNA, 13 bp, C. elegans
cgagaaagtttga

SEQ ID NO: 712980 - DNA, 14 bp, C. elegans
cgagaaatgcgcca

SEQ ID NO: 712981 - DNA, 13 bp, C. elegans
cgagaagaaaaat

SEQ ID NO: 712982 - DNA, 13 bp, C. elegans
cgagaagttggaa

SEQ ID NO: 712983 - DNA, 13 bp, C. elegans
cgagaataccact

SEQ ID NO: 712984 - DNA, 13 bp, C. elegans
cgagaattttcga

SEQ ID NO: 712985 - DNA, 13 bp, C. elegans
cgagaccggctac

SEQ ID NO: 712986 - DNA, 13 bp, C. elegans
cgagagcttcaaa

SEQ ID NO: 712987 - DNA, 13 bp, C. elegans
cgagatatttcat

SEQ ID NO: 712988 - DNA, 13 bp, C. elegans
cgagatctccatc

SEQ ID NO: 712989 - DNA, 13 bp, C. elegans
cgagatttatgga

SEQ ID NO: 712990 - DNA, 13 bp, C. elegans
cgagctcggcgaa

SEQ ID NO: 712991 - DNA, 14 bp, C. elegans
cgaggaatgtacga

SEQ ID NO: 712992 - DNA, 13 bp, C. elegans
cgaggaattcaaa

SEQ ID NO: 712993 - DNA, 13 bp, C. elegans
cgaggaattcgaa

SEQ ID NO: 712994 - DNA, 15 bp, C. elegans
cgaggagacgtggaa

SEQ ID NO: 712995 - DNA, 13 bp, C. elegans
cgaggtgctcaag

SEQ ID NO: 712996 - DNA, 13 bp, C. elegans
cgaggttactgta

SEQ ID NO: 712997 - DNA, 13 bp, C. elegans
cgagtcaaaaagt

SEQ ID NO: 712998 - DNA, 13 bp, C. elegans
cgagtcaaaatgg

SEQ ID NO: 712999 - DNA, 13 bp, C. elegans
cgagttttcaaaa

SEQ ID NO: 713000 - DNA, 13 bp, C. elegans
cgagttttctgaa

SEQ ID NO: 713001 - DNA, 13 bp, C. elegans
cgagtttttgcga

SEQ ID NO: 713002 - DNA, 13 bp, C. elegans
cgagttttttcac

SEQ ID NO: 713003 - DNA, 13 bp, C. elegans
cgagttttttcag

SEQ ID NO: 713004 - DNA, 13 bp, C. elegans
cgataaaaattaa

SEQ ID NO: 713005 - DNA, 13 bp, C. elegans
cgataaaattcaa

SEQ ID NO: 713006 - DNA, 13 bp, C. elegans
cgataaattttta

SEQ ID NO: 713007 - DNA, 13 bp, C. elegans
cgataacgagttc

SEQ ID NO: 713008 - DNA, 13 bp, C. elegans
cgataactttgaa

SEQ ID NO: 713009 - DNA, 13 bp, C. elegans
cgataattcattt

SEQ ID NO: 713010 - DNA, 13 bp, C. elegans
cgataatttctca

SEQ ID NO: 713011 - DNA, 13 bp, C. elegans
cgataatttttgt

SEQ ID NO: 713012 - DNA, 13 bp, C. elegans
cgatacatttttg

SEQ ID NO: 713013 - DNA, 13 bp, C. elegans
cgatagaaaatca

SEQ ID NO: 713014 - DNA, 13 bp, C. elegans
cgatattcaaaaa

SEQ ID NO: 713015 - DNA, 13 bp, C. elegans
cgatatttcgaaa

SEQ ID NO: 713016 - DNA, 13 bp, C. elegans
cgatattttccaa

SEQ ID NO: 713017 - DNA, 13 bp, C. elegans
cgatatttttgga

SEQ ID NO: 713018 - DNA, 13 bp, C. elegans
cgatattttttag

SEQ ID NO: 713019 - DNA, 13 bp, C. elegans
cgatcaaagttca

SEQ ID NO: 713020 - DNA, 13 bp, C. elegans
cgatcatcatcat

SEQ ID NO: 713021 - DNA, 14 bp, C. elegans
cgatcgcaccgtat

SEQ ID NO: 713022 - DNA, 13 bp, C. elegans
cgatgaaaaaatt

SEQ ID NO: 713023 - DNA, 13 bp, C. elegans
cgatgaaaaacga

SEQ ID NO: 713024 - DNA, 13 bp, C. elegans
cgatgaaattatt

SEQ ID NO: 713025 - DNA, 13 bp, C. elegans
cgatgaaattgaa

SEQ ID NO: 713026 - DNA, 13 bp, C. elegans
cgatgagaaaaaa

SEQ ID NO: 713027 - DNA, 13 bp, C. elegans
cgatgatgatgat

SEQ ID NO: 713028 - DNA, 13 bp, C. elegans
cgatgatttcaaa

SEQ ID NO: 713029 - DNA, 13 bp, C. elegans
cgatgatttttca

SEQ ID NO: 713030 - DNA, 13 bp, C. elegans
cgatgatttttgg

SEQ ID NO: 713031 - DNA, 13 bp, C. elegans
cgatgcaccataa

SEQ ID NO: 713032 - DNA, 13 bp, C. elegans
cgatgcaccatat

SEQ ID NO: 713033 - DNA, 13 bp, C. elegans
cgatgcaccatgt

SEQ ID NO: 713034 - DNA, 13 bp, C. elegans
cgatgcgggcaca

SEQ ID NO: 713035 - DNA, 13 bp, C. elegans
cgatgctccgaaa

SEQ ID NO: 713036 - DNA, 13 bp, C. elegans
cgatgctctttgt

SEQ ID NO: 713037 - DNA, 13 bp, C. elegans
cgatggctcgttt

SEQ ID NO: 713038 - DNA, 13 bp, C. elegans
cgattaaataaat

SEQ ID NO: 713039 - DNA, 13 bp, C. elegans
cgattatcgattt

SEQ ID NO: 713040 - DNA, 14 bp, C. elegans
cgattatgaacaag

SEQ ID NO: 713041 - DNA, 13 bp, C. elegans
cgattattgattt

SEQ ID NO: 713042 - DNA, 13 bp, C. elegans
cgattattttact

SEQ ID NO: 713043 - DNA, 13 bp, C. elegans
cgattcagaatat

SEQ ID NO: 713044 - DNA, 13 bp, C. elegans
cgattccggcaaa

SEQ ID NO: 713045 - DNA, 13 bp, C. elegans
cgattgtaatttt

SEQ ID NO: 713046 - DNA, 13 bp, C. elegans
cgatttaccgatt

SEQ ID NO: 713047 - DNA, 13 bp, C. elegans
cgatttacgagct

SEQ ID NO: 713048 - DNA, 13 bp, C. elegans
cgatttatttgtt

SEQ ID NO: 713049 - DNA, 13 bp, C. elegans
cgatttatttttg

SEQ ID NO: 713050 - DNA, 13 bp, C. elegans
cgatttcaaactt

SEQ ID NO: 713051 - DNA, 13 bp, C. elegans
cgatttcaaatgt

SEQ ID NO: 713052 - DNA, 13 bp, C. elegans
cgatttcattttt

SEQ ID NO: 713053 - DNA, 13 bp, C. elegans
cgatttcttcaaa

SEQ ID NO: 713054 - DNA, 13 bp, C. elegans
cgatttgcaaaat

SEQ ID NO: 713055 - DNA, 13 bp, C. elegans
cgatttgccattt

SEQ ID NO: 713056 - DNA, 13 bp, C. elegans
cgatttgcgcaag

SEQ ID NO: 713057 - DNA, 13 bp, C. elegans
cgatttgctagaa

SEQ ID NO: 713058 - DNA, 13 bp, C. elegans
cgatttgctccgc

SEQ ID NO: 713059 - DNA, 13 bp, C. elegans
cgatttgctgaaa

SEQ ID NO: 713060 - DNA, 13 bp, C. elegans
cgatttgctgttt

SEQ ID NO: 713061 - DNA, 13 bp, C. elegans
cgatttgtacagc

SEQ ID NO: 713062 - DNA, 13 bp, C. elegans
cgatttgtcaaaa

SEQ ID NO: 713063 - DNA, 13 bp, C. elegans
cgatttgtcgttt

SEQ ID NO: 713064 - DNA, 13 bp, C. elegans
cgattttaataaa

SEQ ID NO: 713065 - DNA, 13 bp, C. elegans
cgattttatggaa

SEQ ID NO: 713066 - DNA, 13 bp, C. elegans
cgattttattttc

SEQ ID NO: 713067 - DNA, 13 bp, C. elegans
cgattttcaaaaa

SEQ ID NO: 713068 - DNA, 13 bp, C. elegans
cgattttcaaaat

SEQ ID NO: 713069 - DNA, 13 bp, C. elegans
cgattttcaacaa

SEQ ID NO: 713070 - DNA, 13 bp, C. elegans
cgattttcaacga

SEQ ID NO: 713071 - DNA, 13 bp, C. elegans
cgattttcaagaa

SEQ ID NO: 713072 - DNA, 13 bp, C. elegans
cgattttcaattt

SEQ ID NO: 713073 - DNA, 13 bp, C. elegans
cgattttcagaaa

SEQ ID NO: 713074 - DNA, 13 bp, C. elegans
cgattttcagcaa

SEQ ID NO: 713075 - DNA, 13 bp, C. elegans
cgattttccaaaa

SEQ ID NO: 713076 - DNA, 13 bp, C. elegans
cgattttccaatt

SEQ ID NO: 713077 - DNA, 13 bp, C. elegans
cgattttccagaa

SEQ ID NO: 713078 - DNA, 13 bp, C. elegans
cgattttccgaga

SEQ ID NO: 713079 - DNA, 13 bp, C. elegans
cgattttcgaaat

SEQ ID NO: 713080 - DNA, 13 bp, C. elegans
cgattttcgagtt

SEQ ID NO: 713081 - DNA, 13 bp, C. elegans
cgattttcggcaa

SEQ ID NO: 713082 - DNA, 13 bp, C. elegans
cgattttcgtcga

SEQ ID NO: 713083 - DNA, 13 bp, C. elegans
cgattttctattt

SEQ ID NO: 713084 - DNA, 13 bp, C. elegans
cgattttctccga

SEQ ID NO: 713085 - DNA, 13 bp, C. elegans
cgattttctctga

SEQ ID NO: 713086 - DNA, 13 bp, C. elegans
cgattttcttgtt

SEQ ID NO: 713087 - DNA, 13 bp, C. elegans
cgattttggagat

SEQ ID NO: 713088 - DNA, 13 bp, C. elegans
cgattttgtactt

SEQ ID NO: 713089 - DNA, 13 bp, C. elegans
cgatttttaacat

SEQ ID NO: 713090 - DNA, 13 bp, C. elegans
cgatttttaagca

SEQ ID NO: 713091 - DNA, 13 bp, C. elegans
cgatttttaatgt

SEQ ID NO: 713092 - DNA, 13 bp, C. elegans
cgatttttaccaa

SEQ ID NO: 713093 - DNA, 13 bp, C. elegans
cgatttttactaa

SEQ ID NO: 713094 - DNA, 13 bp, C. elegans
cgatttttagatt

SEQ ID NO: 713095 - DNA, 13 bp, C. elegans
cgatttttatatt

SEQ ID NO: 713096 - DNA, 13 bp, C. elegans
cgatttttcaaaa

SEQ ID NO: 713097 - DNA, 13 bp, C. elegans
cgatttttcaata

SEQ ID NO: 713098 - DNA, 13 bp, C. elegans
cgatttttcaccg

SEQ ID NO: 713099 - DNA, 13 bp, C. elegans
cgatttttcagaa

SEQ ID NO: 713100 - DNA, 13 bp, C. elegans
cgatttttcatag

SEQ ID NO: 713101 - DNA, 13 bp, C. elegans
cgatttttccgaa

SEQ ID NO: 713102 - DNA, 13 bp, C. elegans
cgatttttcgaat

SEQ ID NO: 713103 - DNA, 13 bp, C. elegans
cgatttttcgtca

SEQ ID NO: 713104 - DNA, 14 bp, C. elegans
cgatttttctcatc

SEQ ID NO: 713105 - DNA, 13 bp, C. elegans
cgatttttctcca

SEQ ID NO: 713106 - DNA, 13 bp, C. elegans
cgatttttctgga

SEQ ID NO: 713107 - DNA, 13 bp, C. elegans
cgatttttcttac

SEQ ID NO: 713108 - DNA, 13 bp, C. elegans
cgatttttgacat

SEQ ID NO: 713109 - DNA, 13 bp, C. elegans
cgatttttgacga

SEQ ID NO: 713110 - DNA, 13 bp, C. elegans
cgatttttgatct

SEQ ID NO: 713111 - DNA, 13 bp, C. elegans
cgatttttgattt

SEQ ID NO: 713112 - DNA, 13 bp, C. elegans
cgatttttggatt

SEQ ID NO: 713113 - DNA, 13 bp, C. elegans
cgatttttgtact

SEQ ID NO: 713114 - DNA, 13 bp, C. elegans
cgatttttgtgaa

SEQ ID NO: 713115 - DNA, 13 bp, C. elegans
cgatttttgtgtg

SEQ ID NO: 713116 - DNA, 13 bp, C. elegans
cgatttttgttca

SEQ ID NO: 713117 - DNA, 13 bp, C. elegans
cgattttttaaaa

SEQ ID NO: 713118 - DNA, 13 bp, C. elegans
cgattttttcaat

SEQ ID NO: 713119 - DNA, 13 bp, C. elegans
cgattttttcaca

SEQ ID NO: 713120 - DNA, 13 bp, C. elegans
cgattttttccca

SEQ ID NO: 713121 - DNA, 13 bp, C. elegans
cgattttttccta

SEQ ID NO: 713122 - DNA, 13 bp, C. elegans
cgattttttcgaa

SEQ ID NO: 713123 - DNA, 13 bp, C. elegans
cgattttttgaaa

SEQ ID NO: 713124 - DNA, 13 bp, C. elegans
cgattttttgaat

SEQ ID NO: 713125 - DNA, 13 bp, C. elegans
cgatttttttcgt

SEQ ID NO: 713126 - DNA, 13 bp, C. elegans
cgatttttttgat

SEQ ID NO: 713127 - DNA, 13 bp, C. elegans
cgcaaaaattgaa

SEQ ID NO: 713128 - DNA, 13 bp, C. elegans
cgcaaaaattgtc

SEQ ID NO: 713129 - DNA, 13 bp, C. elegans
cgcaaaatttcac

SEQ ID NO: 713130 - DNA, 13 bp, C. elegans
cgcaaaattttgc

SEQ ID NO: 713131 - DNA, 13 bp, C. elegans
cgcaaagtttgaa

SEQ ID NO: 713132 - DNA, 13 bp, C. elegans
cgcaaatttcaaa

SEQ ID NO: 713133 - DNA, 13 bp, C. elegans
cgcaacacatttg

SEQ ID NO: 713134 - DNA, 15 bp, C. elegans
cgcaagcctcgcacg

SEQ ID NO: 713135 - DNA, 20 bp, C. elegans
cgcaaggcgcgaaacttgtt

SEQ ID NO: 713136 - DNA, 13 bp, C. elegans
cgcaattctcgat

SEQ ID NO: 713137 - DNA, 13 bp, C. elegans
cgcaatttttgta

SEQ ID NO: 713138 - DNA, 13 bp, C. elegans
cgcacacaaacct

SEQ ID NO: 713139 - DNA, 13 bp, C. elegans
cgcacactttttc

SEQ ID NO: 713140 - DNA, 13 bp, C. elegans
cgcagaaaaatgc

SEQ ID NO: 713141 - DNA, 13 bp, C. elegans
cgcagaattctca

SEQ ID NO: 713142 - DNA, 13 bp, C. elegans
cgcagacttttca

SEQ ID NO: 713143 - DNA, 13 bp, C. elegans
cgcagcaccaaaa

SEQ ID NO: 713144 - DNA, 13 bp, C. elegans
cgcatatgtatgt

SEQ ID NO: 713145 - DNA, 13 bp, C. elegans
cgcattttaactg

SEQ ID NO: 713146 - DNA, 13 bp, C. elegans
cgcatttttttgt

SEQ ID NO: 713147 - DNA, 13 bp, C. elegans
cgccaaaaaaatt

SEQ ID NO: 713148 - DNA, 13 bp, C. elegans
cgccaaaaacttg

SEQ ID NO: 713149 - DNA, 13 bp, C. elegans
cgccaaaaatttt

SEQ ID NO: 713150 - DNA, 13 bp, C. elegans
cgccaaatttttt

SEQ ID NO: 713151 - DNA, 13 bp, C. elegans
cgccaacttgccg

SEQ ID NO: 713152 - DNA, 13 bp, C. elegans
cgccaattttccg

SEQ ID NO: 713153 - DNA, 13 bp, C. elegans
cgccaatttttca

SEQ ID NO: 713154 - DNA, 13 bp, C. elegans
cgccacgcgcatc

SEQ ID NO: 713155 - DNA, 13 bp, C. elegans
cgccatttttttt

SEQ ID NO: 713156 - DNA, 13 bp, C. elegans
cgcccaactgcta

SEQ ID NO: 713157 - DNA, 13 bp, C. elegans
cgcccacaaaatg

SEQ ID NO: 713158 - DNA, 14 bp, C. elegans
cgcccacgatttca

SEQ ID NO: 713159 - DNA, 13 bp, C. elegans
cgcccacttttga

SEQ ID NO: 713160 - DNA, 14 bp, C. elegans
cgcccataaaatgg

SEQ ID NO: 713161 - DNA, 13 bp, C. elegans
cgcccatatcttg

SEQ ID NO: 713162 - DNA, 13 bp, C. elegans
cgcccatttattg

SEQ ID NO: 713163 - DNA, 13 bp, C. elegans
cgccccctatttt

SEQ ID NO: 713164 - DNA, 13 bp, C. elegans
cgcccgacatttt

SEQ ID NO: 713165 - DNA, 13 bp, C. elegans
cgcccttttggtg

SEQ ID NO: 713166 - DNA, 13 bp, C. elegans
cgccgaattcagt

SEQ ID NO: 713167 - DNA, 13 bp, C. elegans
cgccgaattcgcc

SEQ ID NO: 713168 - DNA, 13 bp, C. elegans
cgccggcctcacg

SEQ ID NO: 713169 - DNA, 13 bp, C. elegans
cgccgtccatcga

SEQ ID NO: 713170 - DNA, 13 bp, C. elegans
cgcctacctacct

SEQ ID NO: 713171 - DNA, 13 bp, C. elegans
cgcctactttttt

SEQ ID NO: 713172 - DNA, 13 bp, C. elegans
cgcctccctttaa

SEQ ID NO: 713173 - DNA, 13 bp, C. elegans
cgcctctatttct

SEQ ID NO: 713174 - DNA, 13 bp, C. elegans
cgcctgcatggaa

SEQ ID NO: 713175 - DNA, 13 bp, C. elegans
cgcctgcgtctcc

SEQ ID NO: 713176 - DNA, 13 bp, C. elegans
cgccttgtaggca

SEQ ID NO: 713177 - DNA, 13 bp, C. elegans
cgcgaaattcaaa

SEQ ID NO: 713178 - DNA, 13 bp, C. elegans
cgcgaaattcgaa

SEQ ID NO: 713179 - DNA, 13 bp, C. elegans
cgcgatgcgtaat

SEQ ID NO: 713180 - DNA, 13 bp, C. elegans
cgcgccgagaccc

SEQ ID NO: 713181 - DNA, 13 bp, C. elegans
cgcgcgcacctct

SEQ ID NO: 713182 - DNA, 13 bp, C. elegans
cgcgctccattga

SEQ ID NO: 713183 - DNA, 13 bp, C. elegans
cgcgctccgttgg

SEQ ID NO: 713184 - DNA, 13 bp, C. elegans
cgcgctctattga

SEQ ID NO: 713185 - DNA, 13 bp, C. elegans
cgcggaacccaaa

SEQ ID NO: 713186 - DNA, 13 bp, C. elegans
cgcgggaatttag

SEQ ID NO: 713187 - DNA, 13 bp, C. elegans
cgcgggttacggt

SEQ ID NO: 713188 - DNA, 13 bp, C. elegans
cgcggtgagaccc

SEQ ID NO: 713189 - DNA, 15 bp, C. elegans
cgcggtttacctgtg

SEQ ID NO: 713190 - DNA, 13 bp, C. elegans
cgcgtcgagaccc

SEQ ID NO: 713191 - DNA, 17 bp, C. elegans
cgcgtcgcggctcgttt

SEQ ID NO: 713192 - DNA, 13 bp, C. elegans
cgctacagtaacc

SEQ ID NO: 713193 - DNA, 13 bp, C. elegans
cgctacgagatat

SEQ ID NO: 713194 - DNA, 13 bp, C. elegans
cgctactccatct

SEQ ID NO: 713195 - DNA, 13 bp, C. elegans
cgctattttcttc

SEQ ID NO: 713196 - DNA, 13 bp, C. elegans
cgctatttttgta

SEQ ID NO: 713197 - DNA, 13 bp, C. elegans
cgctcactttttt

SEQ ID NO: 713198 - DNA, 13 bp, C. elegans
cgctccaaaaacc

SEQ ID NO: 713199 - DNA, 13 bp, C. elegans
cgctccaccgaac

SEQ ID NO: 713200 - DNA, 13 bp, C. elegans
cgctccactgcac

SEQ ID NO: 713201 - DNA, 13 bp, C. elegans
cgctccatcgcac

SEQ ID NO: 713202 - DNA, 13 bp, C. elegans
cgctctactgata

SEQ ID NO: 713203 - DNA, 13 bp, C. elegans
cgctctgcgtctc

SEQ ID NO: 713204 - DNA, 13 bp, C. elegans
cgctgaaaaagtt

SEQ ID NO: 713205 - DNA, 13 bp, C. elegans
cgctgaaaaatca

SEQ ID NO: 713206 - DNA, 13 bp, C. elegans
cgctgaaacttgt

SEQ ID NO: 713207 - DNA, 13 bp, C. elegans
cgctgcaagaccc

SEQ ID NO: 713208 - DNA, 13 bp, C. elegans
cgctgcgacaccg

SEQ ID NO: 713209 - DNA, 13 bp, C. elegans
cgctggtgtcgat

SEQ ID NO: 713210 - DNA, 13 bp, C. elegans
cgctttttcaatt

SEQ ID NO: 713211 - DNA, 13 bp, C. elegans
cgcttttttctca

SEQ ID NO: 713212 - DNA, 13 bp, C. elegans
cggaaaaaacttt

SEQ ID NO: 713213 - DNA, 13 bp, C. elegans
cggaaaaaatccg

SEQ ID NO: 713214 - DNA, 13 bp, C. elegans
cggaaaaacgaca

SEQ ID NO: 713215 - DNA, 13 bp, C. elegans
cggaaaaatccaa

SEQ ID NO: 713216 - DNA, 13 bp, C. elegans
cggaaaaatcgat

SEQ ID NO: 713217 - DNA, 13 bp, C. elegans
cggaaaaatcgga

SEQ ID NO: 713218 - DNA, 13 bp, C. elegans
cggaaaaatctac

SEQ ID NO: 713219 - DNA, 13 bp, C. elegans
cggaaaacggaaa

SEQ ID NO: 713220 - DNA, 13 bp, C. elegans
cggaaaacggcaa

SEQ ID NO: 713221 - DNA, 13 bp, C. elegans
cggaaaacgtaga

SEQ ID NO: 713222 - DNA, 13 bp, C. elegans
cggaaaacgtgtt

SEQ ID NO: 713223 - DNA, 13 bp, C. elegans
cggaaaacttaaa

SEQ ID NO: 713224 - DNA, 13 bp, C. elegans
cggaaaataagaa

SEQ ID NO: 713225 - DNA, 13 bp, C. elegans
cggaaaatcaaca

SEQ ID NO: 713226 - DNA, 13 bp, C. elegans
cggaaaatcaata

SEQ ID NO: 713227 - DNA, 14 bp, C. elegans
cggaaaatcagaaa

SEQ ID NO: 713228 - DNA, 13 bp, C. elegans
cggaaaatctgaa

SEQ ID NO: 713229 - DNA, 13 bp, C. elegans
cggaaaatgagaa

SEQ ID NO: 713230 - DNA, 13 bp, C. elegans
cggaaaatgggaa

SEQ ID NO: 713231 - DNA, 13 bp, C. elegans
cggaaaatgttca

SEQ ID NO: 713232 - DNA, 13 bp, C. elegans
cggaaaattataa

SEQ ID NO: 713233 - DNA, 13 bp, C. elegans
cggaaaattcaaa

SEQ ID NO: 713234 - DNA, 13 bp, C. elegans
cggaaaattgaag

SEQ ID NO: 713235 - DNA, 13 bp, C. elegans
cggaaaattgata

SEQ ID NO: 713236 - DNA, 13 bp, C. elegans
cggaaaattgccg

SEQ ID NO: 713237 - DNA, 13 bp, C. elegans
cggaaaattgtga

SEQ ID NO: 713238 - DNA, 13 bp, C. elegans
cggaaaatttcaa

SEQ ID NO: 713239 - DNA, 13 bp, C. elegans
cggaaaattttga

SEQ ID NO: 713240 - DNA, 13 bp, C. elegans
cggaaagctgaca

SEQ ID NO: 713241 - DNA, 13 bp, C. elegans
cggaaatattttt

SEQ ID NO: 713242 - DNA, 13 bp, C. elegans
cggaaatgtttat

SEQ ID NO: 713243 - DNA, 13 bp, C. elegans
cggaaattattga

SEQ ID NO: 713244 - DNA, 15 bp, C. elegans
cggaaattcaaaaat

SEQ ID NO: 713245 - DNA, 13 bp, C. elegans
cggaaattcacaa

SEQ ID NO: 713246 - DNA, 13 bp, C. elegans
cggaaattcgaaa

SEQ ID NO: 713247 - DNA, 13 bp, C. elegans
cggaaattcgaat

SEQ ID NO: 713248 - DNA, 13 bp, C. elegans
cggaaattctcaa

SEQ ID NO: 713249 - DNA, 13 bp, C. elegans
cggaaattgaatt

SEQ ID NO: 713250 - DNA, 13 bp, C. elegans
cggaaattgtaca

SEQ ID NO: 713251 - DNA, 13 bp, C. elegans
cggaaattgtcaa

SEQ ID NO: 713252 - DNA, 13 bp, C. elegans
cggaaattgtttt

SEQ ID NO: 713253 - DNA, 13 bp, C. elegans
cggaaatttaaat

SEQ ID NO: 713254 - DNA, 13 bp, C. elegans
cggaaatttcaaa

SEQ ID NO: 713255 - DNA, 13 bp, C. elegans
cggaaatttccaa

SEQ ID NO: 713256 - DNA, 13 bp, C. elegans
cggaaatttctga

SEQ ID NO: 713257 - DNA, 13 bp, C. elegans
cggaaatttggat

SEQ ID NO: 713258 - DNA, 13 bp, C. elegans
cggaaattttcga

SEQ ID NO: 713259 - DNA, 13 bp, C. elegans
cggaaattttgaa

SEQ ID NO: 713260 - DNA, 13 bp, C. elegans
cggaactgaaatt

SEQ ID NO: 713261 - DNA, 13 bp, C. elegans
cggaagattattt

SEQ ID NO: 713262 - DNA, 13 bp, C. elegans
cggaagttaattt

SEQ ID NO: 713263 - DNA, 13 bp, C. elegans
cggaagttttcaa

SEQ ID NO: 713264 - DNA, 13 bp, C. elegans
cggaagtttttga

SEQ ID NO: 713265 - DNA, 13 bp, C. elegans
cggaatcagttga

SEQ ID NO: 713266 - DNA, 13 bp, C. elegans
cggaatcgaaaga

SEQ ID NO: 713267 - DNA, 13 bp, C. elegans
cggaattgaaaac

SEQ ID NO: 713268 - DNA, 13 bp, C. elegans
cggaattgaaaag

SEQ ID NO: 713269 - DNA, 13 bp, C. elegans
cggaattgaaatt

SEQ ID NO: 713270 - DNA, 13 bp, C. elegans
cggaattgaatat

SEQ ID NO: 713271 - DNA, 13 bp, C. elegans
cggaattggaaat

SEQ ID NO: 713272 - DNA, 13 bp, C. elegans
cggaatttttgaa

SEQ ID NO: 713273 - DNA, 13 bp, C. elegans
cggacttgaactc

SEQ ID NO: 713274 - DNA, 13 bp, C. elegans
cggagagcaaaat

SEQ ID NO: 713275 - DNA, 13 bp, C. elegans
cggagatcaattt

SEQ ID NO: 713276 - DNA, 13 bp, C. elegans
cggagattttcaa

SEQ ID NO: 713277 - DNA, 13 bp, C. elegans
cggagcgcgtttg

SEQ ID NO: 713278 - DNA, 13 bp, C. elegans
cggagcgtcgttg

SEQ ID NO: 713279 - DNA, 13 bp, C. elegans
cggagctgaagga

SEQ ID NO: 713280 - DNA, 13 bp, C. elegans
cggagcttaattt

SEQ ID NO: 713281 - DNA, 13 bp, C. elegans
cggagtgtcgttg

SEQ ID NO: 713282 - DNA, 13 bp, C. elegans
cggatatcaaatt

SEQ ID NO: 713283 - DNA, 13 bp, C. elegans
cggatatcaattt

SEQ ID NO: 713284 - DNA, 13 bp, C. elegans
cggatatttgatt

SEQ ID NO: 713285 - DNA, 13 bp, C. elegans
cggatattttcaa

SEQ ID NO: 713286 - DNA, 13 bp, C. elegans
cggatcattgact

SEQ ID NO: 713287 - DNA, 13 bp, C. elegans
cggattttgcttt

SEQ ID NO: 713288 - DNA, 13 bp, C. elegans
cggattttttcca

SEQ ID NO: 713289 - DNA, 13 bp, C. elegans
cggattttttcga

SEQ ID NO: 713290 - DNA, 13 bp, C. elegans
cggatttttttca

SEQ ID NO: 713291 - DNA, 13 bp, C. elegans
cggcaaaatcggc

SEQ ID NO: 713292 - DNA, 13 bp, C. elegans
cggcaaatcgccg

SEQ ID NO: 713293 - DNA, 13 bp, C. elegans
cggcaaatggccg

SEQ ID NO: 713294 - DNA, 13 bp, C. elegans
cggcaaattgatt

SEQ ID NO: 713295 - DNA, 13 bp, C. elegans
cggcaaattgtga

SEQ ID NO: 713296 - DNA, 13 bp, C. elegans
cggcaaattttga

SEQ ID NO: 713297 - DNA, 13 bp, C. elegans
cggcaacattttg

SEQ ID NO: 713298 - DNA, 13 bp, C. elegans
cggcaaccggcaa

SEQ ID NO: 713299 - DNA, 13 bp, C. elegans
cggcaattgcaga

SEQ ID NO: 713300 - DNA, 13 bp, C. elegans
cggcaattgccga

SEQ ID NO: 713301 - DNA, 13 bp, C. elegans
cggcaatttgtga

SEQ ID NO: 713302 - DNA, 13 bp, C. elegans
cggcaattttcga

SEQ ID NO: 713303 - DNA, 13 bp, C. elegans
cggcagatgtcgg

SEQ ID NO: 713304 - DNA, 13 bp, C. elegans
cggcagcagtatg

SEQ ID NO: 713305 - DNA, 13 bp, C. elegans
cggcatatgccga

SEQ ID NO: 713306 - DNA, 13 bp, C. elegans
cggcatttgccga

SEQ ID NO: 713307 - DNA, 13 bp, C. elegans
cggccaaaattta

SEQ ID NO: 713308 - DNA, 13 bp, C. elegans
cggccgacacctc

SEQ ID NO: 713309 - DNA, 13 bp, C. elegans
cggccgacatctt

SEQ ID NO: 713310 - DNA, 13 bp, C. elegans
cggccgctccaaa

SEQ ID NO: 713311 - DNA, 13 bp, C. elegans
cggcgaacggcga

SEQ ID NO: 713312 - DNA, 13 bp, C. elegans
cggcgcgcggaac

SEQ ID NO: 713313 - DNA, 13 bp, C. elegans
cggcgggaaattc

SEQ ID NO: 713314 - DNA, 13 bp, C. elegans
cggcgtgaggccc

SEQ ID NO: 713315 - DNA, 13 bp, C. elegans
cggctaattcggc

SEQ ID NO: 713316 - DNA, 13 bp, C. elegans
cggctcgaaaaat

SEQ ID NO: 713317 - DNA, 13 bp, C. elegans
cggctgaaatatg

SEQ ID NO: 713318 - DNA, 14 bp, C. elegans
cggctggaaacaat

SEQ ID NO: 713319 - DNA, 13 bp, C. elegans
cggcttgatctac

SEQ ID NO: 713320 - DNA, 13 bp, C. elegans
cgggaaaaaataa

SEQ ID NO: 713321 - DNA, 13 bp, C. elegans
cgggaaaacgaat

SEQ ID NO: 713322 - DNA, 13 bp, C. elegans
cgggaaaatcaaa

SEQ ID NO: 713323 - DNA, 13 bp, C. elegans
cgggaaatttcaa

SEQ ID NO: 713324 - DNA, 13 bp, C. elegans
cgggacccgaaaa

SEQ ID NO: 713325 - DNA, 13 bp, C. elegans
cgggagaaaagac

SEQ ID NO: 713326 - DNA, 13 bp, C. elegans
cgggagcacaaaa

SEQ ID NO: 713327 - DNA, 13 bp, C. elegans
cgggatattcaaa

SEQ ID NO: 713328 - DNA, 13 bp, C. elegans
cgggatttttcaa

SEQ ID NO: 713329 - DNA, 13 bp, C. elegans
cggggaattcgaa

SEQ ID NO: 713330 - DNA, 13 bp, C. elegans
cgggtaattcata

SEQ ID NO: 713331 - DNA, 13 bp, C. elegans
cgggttactgtag

SEQ ID NO: 713332 - DNA, 13 bp, C. elegans
cggtaattttcaa

SEQ ID NO: 713333 - DNA, 13 bp, C. elegans
cggtatttatgta

SEQ ID NO: 713334 - DNA, 13 bp, C. elegans
cggtattttcaga

SEQ ID NO: 713335 - DNA, 13 bp, C. elegans
cggtcaaagtttt

SEQ ID NO: 713336 - DNA, 13 bp, C. elegans
cggtcaagtttca

SEQ ID NO: 713337 - DNA, 13 bp, C. elegans
cggtcattttgga

SEQ ID NO: 713338 - DNA, 13 bp, C. elegans
cggtcgtcaaaaa

SEQ ID NO: 713339 - DNA, 13 bp, C. elegans
cggtctattttct

SEQ ID NO: 713340 - DNA, 13 bp, C. elegans
cggtctcgacacg

SEQ ID NO: 713341 - DNA, 13 bp, C. elegans
cggtgaaaaatga

SEQ ID NO: 713342 - DNA, 13 bp, C. elegans
cggtgaaaattga

SEQ ID NO: 713343 - DNA, 13 bp, C. elegans
cggtgaaaattgc

SEQ ID NO: 713344 - DNA, 13 bp, C. elegans
cggtgaaagtggt

SEQ ID NO: 713345 - DNA, 13 bp, C. elegans
cggtgcaaaattt

SEQ ID NO: 713346 - DNA, 13 bp, C. elegans
cggtggaaaataa

SEQ ID NO: 713347 - DNA, 13 bp, C. elegans
cggtggttttgga

SEQ ID NO: 713348 - DNA, 13 bp, C. elegans
cggtgtgatctac

SEQ ID NO: 713349 - DNA, 13 bp, C. elegans
cggtgtttgcgta

SEQ ID NO: 713350 - DNA, 13 bp, C. elegans
cggtgttttcaga

SEQ ID NO: 713351 - DNA, 13 bp, C. elegans
cggttagctcagt

SEQ ID NO: 713352 - DNA, 13 bp, C. elegans
cggtttactggca

SEQ ID NO: 713353 - DNA, 13 bp, C. elegans
cggtttcaaaatt

SEQ ID NO: 713354 - DNA, 13 bp, C. elegans
cggtttcagggcc

SEQ ID NO: 713355 - DNA, 13 bp, C. elegans
cggtttgacctac

SEQ ID NO: 713356 - DNA, 13 bp, C. elegans
cggtttgatctac

SEQ ID NO: 713357 - DNA, 13 bp, C. elegans
cggtttgccaaat

SEQ ID NO: 713358 - DNA, 13 bp, C. elegans
cggttttaaaaat

SEQ ID NO: 713359 - DNA, 13 bp, C. elegans
cggttttatcaaa

SEQ ID NO: 713360 - DNA, 13 bp, C. elegans
cggttttgccgcc

SEQ ID NO: 713361 - DNA, 13 bp, C. elegans
cggtttttatgtt

SEQ ID NO: 713362 - DNA, 13 bp, C. elegans
cggtttttcaaaa

SEQ ID NO: 713363 - DNA, 13 bp, C. elegans
cgtaaaaaattaa

SEQ ID NO: 713364 - DNA, 13 bp, C. elegans
cgtaaacctacac

SEQ ID NO: 713365 - DNA, 13 bp, C. elegans
cgtaaatccacac

SEQ ID NO: 713366 - DNA, 13 bp, C. elegans
cgtaaatcgacac

SEQ ID NO: 713367 - DNA, 13 bp, C. elegans
cgtaaattgacac

SEQ ID NO: 713368 - DNA, 13 bp, C. elegans
cgtaataaaatgc

SEQ ID NO: 713369 - DNA, 13 bp, C. elegans
cgtaatccatcat

SEQ ID NO: 713370 - DNA, 14 bp, C. elegans
cgtaatgccaattt

SEQ ID NO: 713371 - DNA, 13 bp, C. elegans
cgtacaattttgc

SEQ ID NO: 713372 - DNA, 13 bp, C. elegans
cgtagatcaaacc

SEQ ID NO: 713373 - DNA, 13 bp, C. elegans
cgtagatcaaagc

SEQ ID NO: 713374 - DNA, 13 bp, C. elegans
cgtagcgaaaact

SEQ ID NO: 713375 - DNA, 13 bp, C. elegans
cgtaggcaggcat

SEQ ID NO: 713376 - DNA, 13 bp, C. elegans
cgtatatatatat

SEQ ID NO: 713377 - DNA, 13 bp, C. elegans
cgtatcaaaaatt

SEQ ID NO: 713378 - DNA, 13 bp, C. elegans
cgtatcattttgt

SEQ ID NO: 713379 - DNA, 13 bp, C. elegans
cgtatctcgaaaa

SEQ ID NO: 713380 - DNA, 14 bp, C. elegans
cgtattgcaagcca

SEQ ID NO: 713381 - DNA, 13 bp, C. elegans
cgtattgtgcaac

SEQ ID NO: 713382 - DNA, 13 bp, C. elegans
cgtatttctttta

SEQ ID NO: 713383 - DNA, 13 bp, C. elegans
cgtatttttggtg

SEQ ID NO: 713384 - DNA, 13 bp, C. elegans
cgtatttttgttg

SEQ ID NO: 713385 - DNA, 13 bp, C. elegans
cgtattttttcga

SEQ ID NO: 713386 - DNA, 13 bp, C. elegans
cgtcaaaaaatgt

SEQ ID NO: 713387 - DNA, 13 bp, C. elegans
cgtcaaaaataaa

SEQ ID NO: 713388 - DNA, 13 bp, C. elegans
cgtcaaatatatt

SEQ ID NO: 713389 - DNA, 13 bp, C. elegans
cgtcaaatatgat

SEQ ID NO: 713390 - DNA, 14 bp, C. elegans
cgtcaaatatgctg

SEQ ID NO: 713391 - DNA, 13 bp, C. elegans
cgtcaaatgtgat

SEQ ID NO: 713392 - DNA, 13 bp, C. elegans
cgtcaaatttggt

SEQ ID NO: 713393 - DNA, 13 bp, C. elegans
cgtcaaattttga

SEQ ID NO: 713394 - DNA, 13 bp, C. elegans
cgtcaacggagct

SEQ ID NO: 713395 - DNA, 13 bp, C. elegans
cgtcacaattttc

SEQ ID NO: 713396 - DNA, 13 bp, C. elegans
cgtcacatttttg

SEQ ID NO: 713397 - DNA, 13 bp, C. elegans
cgtcacctgcgtg

SEQ ID NO: 713398 - DNA, 13 bp, C. elegans
cgtcacttttttt

SEQ ID NO: 713399 - DNA, 13 bp, C. elegans
cgtcatcatcatc

SEQ ID NO: 713400 - DNA, 13 bp, C. elegans
cgtcatcattttt

SEQ ID NO: 713401 - DNA, 13 bp, C. elegans
cgtcattttctac

SEQ ID NO: 713402 - DNA, 13 bp, C. elegans
cgtcatttttttc

SEQ ID NO: 713403 - DNA, 13 bp, C. elegans
cgtccgaaccgga

SEQ ID NO: 713404 - DNA, 13 bp, C. elegans
cgtcgattttgtg

SEQ ID NO: 713405 - DNA, 13 bp, C. elegans
cgtcgtcggatcg

SEQ ID NO: 713406 - DNA, 13 bp, C. elegans
cgtcgtcgtcgtc

SEQ ID NO: 713407 - DNA, 13 bp, C. elegans
cgtcgtcgtcgtt

SEQ ID NO: 713408 - DNA, 13 bp, C. elegans
cgtcgtcgtcttc

SEQ ID NO: 713409 - DNA, 13 bp, C. elegans
cgtcgtcttcttc

SEQ ID NO: 713410 - DNA, 13 bp, C. elegans
cgtctaaaaatga

SEQ ID NO: 713411 - DNA, 13 bp, C. elegans
cgtctaattttgg

SEQ ID NO: 713412 - DNA, 13 bp, C. elegans
cgtctacgtaata

SEQ ID NO: 713413 - DNA, 13 bp, C. elegans
cgtctgaaaatac

SEQ ID NO: 713414 - DNA, 13 bp, C. elegans
cgtctgaaaatgg

SEQ ID NO: 713415 - DNA, 13 bp, C. elegans
cgtctggaaccta

SEQ ID NO: 713416 - DNA, 13 bp, C. elegans
cgtctggataata

SEQ ID NO: 713417 - DNA, 13 bp, C. elegans
cgtctgtgtaata

SEQ ID NO: 713418 - DNA, 13 bp, C. elegans
cgtctttcgattc

SEQ ID NO: 713419 - DNA, 13 bp, C. elegans
cgtgaactttttg

SEQ ID NO: 713420 - DNA, 13 bp, C. elegans
cgtgaattttcaa

SEQ ID NO: 713421 - DNA, 13 bp, C. elegans
cgtgaatttttaa

SEQ ID NO: 713422 - DNA, 13 bp, C. elegans
cgtgacaacttca

SEQ ID NO: 713423 - DNA, 13 bp, C. elegans
cgtgacaagaccc

SEQ ID NO: 713424 - DNA, 13 bp, C. elegans
cgtgagacgtcgg

SEQ ID NO: 713425 - DNA, 13 bp, C. elegans
cgtgaggtgccgc

SEQ ID NO: 713426 - DNA, 13 bp, C. elegans
cgtgatgacgtca

SEQ ID NO: 713427 - DNA, 13 bp, C. elegans
cgtgattttttga

SEQ ID NO: 713428 - DNA, 13 bp, C. elegans
cgtgcacctttaa

SEQ ID NO: 713429 - DNA, 13 bp, C. elegans
cgtgccttggcgc

SEQ ID NO: 713430 - DNA, 13 bp, C. elegans
cgtgcgcctttaa

SEQ ID NO: 713431 - DNA, 14 bp, C. elegans
cgtgctgacgtcac

SEQ ID NO: 713432 - DNA, 13 bp, C. elegans
cgtggagtacacg

SEQ ID NO: 713433 - DNA, 13 bp, C. elegans
cgtggcaaatgtg

SEQ ID NO: 713434 - DNA, 13 bp, C. elegans
cgtggcctagaaa

SEQ ID NO: 713435 - DNA, 13 bp, C. elegans
cgtggcgagaccc

SEQ ID NO: 713436 - DNA, 13 bp, C. elegans
cgtggtaagaccc

SEQ ID NO: 713437 - DNA, 13 bp, C. elegans
cgtggtgagacct

SEQ ID NO: 713438 - DNA, 13 bp, C. elegans
cgtggtgccagag

SEQ ID NO: 713439 - DNA, 13 bp, C. elegans
cgtggtgtcagaa

SEQ ID NO: 713440 - DNA, 13 bp, C. elegans
cgtggtttggagc

SEQ ID NO: 713441 - DNA, 13 bp, C. elegans
cgtgtagaacttt

SEQ ID NO: 713442 - DNA, 13 bp, C. elegans
cgtgtattttttg

SEQ ID NO: 713443 - DNA, 13 bp, C. elegans
cgtgtcgagaccg

SEQ ID NO: 713444 - DNA, 13 bp, C. elegans
cgtgtcgagacct

SEQ ID NO: 713445 - DNA, 13 bp, C. elegans
cgtgtgacgtcac

SEQ ID NO: 713446 - DNA, 13 bp, C. elegans
cgtgtgcctttaa

SEQ ID NO: 713447 - DNA, 13 bp, C. elegans
cgtgtgctgacgt

SEQ ID NO: 713448 - DNA, 17 bp, C. elegans
cgtgttctcagctttct

SEQ ID NO: 713449 - DNA, 13 bp, C. elegans
cgtgttgagaccg

SEQ ID NO: 713450 - DNA, 13 bp, C. elegans
cgtgttgtttagc

SEQ ID NO: 713451 - DNA, 13 bp, C. elegans
cgtgtttttgtgc

SEQ ID NO: 713452 - DNA, 13 bp, C. elegans
cgttaaaaaacga

SEQ ID NO: 713453 - DNA, 13 bp, C. elegans
cgttaattttgaa

SEQ ID NO: 713454 - DNA, 13 bp, C. elegans
cgttactttttca

SEQ ID NO: 713455 - DNA, 13 bp, C. elegans
cgttatttaaaaa

SEQ ID NO: 713456 - DNA, 13 bp, C. elegans
cgttattttgaaa

SEQ ID NO: 713457 - DNA, 13 bp, C. elegans
cgttcaagtttga

SEQ ID NO: 713458 - DNA, 13 bp, C. elegans
cgttcaattttca

SEQ ID NO: 713459 - DNA, 13 bp, C. elegans
cgttcaccaaatt

SEQ ID NO: 713460 - DNA, 13 bp, C. elegans
cgttccatctgca

SEQ ID NO: 713461 - DNA, 13 bp, C. elegans
cgttccattttct

SEQ ID NO: 713462 - DNA, 13 bp, C. elegans
cgttcgaaactac

SEQ ID NO: 713463 - DNA, 13 bp, C. elegans
cgttcggcaatcg

SEQ ID NO: 713464 - DNA, 13 bp, C. elegans
cgttcttaaccat

SEQ ID NO: 713465 - DNA, 13 bp, C. elegans
cgttgaatatgaa

SEQ ID NO: 713466 - DNA, 13 bp, C. elegans
cgttgatctacaa

SEQ ID NO: 713467 - DNA, 13 bp, C. elegans
cgttgattgagat

SEQ ID NO: 713468 - DNA, 13 bp, C. elegans
cgttgattggtcg

SEQ ID NO: 713469 - DNA, 13 bp, C. elegans
cgttgcgtgttgc

SEQ ID NO: 713470 - DNA, 13 bp, C. elegans
cgttgttattttg

SEQ ID NO: 713471 - DNA, 13 bp, C. elegans
cgtttcaaaaaaa

SEQ ID NO: 713472 - DNA, 13 bp, C. elegans
cgtttctttgatt

SEQ ID NO: 713473 - DNA, 13 bp, C. elegans
cgtttgactgaat

SEQ ID NO: 713474 - DNA, 13 bp, C. elegans
cgtttgccaattt

SEQ ID NO: 713475 - DNA, 13 bp, C. elegans
cgttttaaaataa

SEQ ID NO: 713476 - DNA, 13 bp, C. elegans
cgttttaaacttg

SEQ ID NO: 713477 - DNA, 13 bp, C. elegans
cgttttattaatt

SEQ ID NO: 713478 - DNA, 13 bp, C. elegans
cgttttattttca

SEQ ID NO: 713479 - DNA, 13 bp, C. elegans
cgttttcaaacaa

SEQ ID NO: 713480 - DNA, 13 bp, C. elegans
cgttttcaaataa

SEQ ID NO: 713481 - DNA, 13 bp, C. elegans
cgttttcaacttg

SEQ ID NO: 713482 - DNA, 13 bp, C. elegans
cgttttcaagatc

SEQ ID NO: 713483 - DNA, 13 bp, C. elegans
cgttttcaatttt

SEQ ID NO: 713484 - DNA, 13 bp, C. elegans
cgttttcagcttt

SEQ ID NO: 713485 - DNA, 13 bp, C. elegans
cgttttccaagct

SEQ ID NO: 713486 - DNA, 13 bp, C. elegans
cgttttcggaaaa

SEQ ID NO: 713487 - DNA, 13 bp, C. elegans
cgttttctcaaaa

SEQ ID NO: 713488 - DNA, 13 bp, C. elegans
cgttttcttttga

SEQ ID NO: 713489 - DNA, 13 bp, C. elegans
cgttttgaaagtg

SEQ ID NO: 713490 - DNA, 13 bp, C. elegans
cgttttggcgcct

SEQ ID NO: 713491 - DNA, 13 bp, C. elegans
cgttttgggcgct

SEQ ID NO: 713492 - DNA, 13 bp, C. elegans
cgttttgtcagtt

SEQ ID NO: 713493 - DNA, 13 bp, C. elegans
cgttttgtttaaa

SEQ ID NO: 713494 - DNA, 13 bp, C. elegans
cgtttttcaaaaa

SEQ ID NO: 713495 - DNA, 13 bp, C. elegans
cgtttttcaaatt

SEQ ID NO: 713496 - DNA, 13 bp, C. elegans
cgtttttcaagat

SEQ ID NO: 713497 - DNA, 13 bp, C. elegans
cgtttttcaatga

SEQ ID NO: 713498 - DNA, 13 bp, C. elegans
cgtttttcaatgt

SEQ ID NO: 713499 - DNA, 13 bp, C. elegans
cgtttttcacatt

SEQ ID NO: 713500 - DNA, 13 bp, C. elegans
cgtttttcaccaa

SEQ ID NO: 713501 - DNA, 13 bp, C. elegans
cgtttttcaccga

SEQ ID NO: 713502 - DNA, 13 bp, C. elegans
cgtttttcatcga

SEQ ID NO: 713503 - DNA, 13 bp, C. elegans
cgtttttccaatt

SEQ ID NO: 713504 - DNA, 13 bp, C. elegans
cgtttttcttcaa

SEQ ID NO: 713505 - DNA, 13 bp, C. elegans
cgtttttctttca

SEQ ID NO: 713506 - DNA, 13 bp, C. elegans
cgtttttgaaaaa

SEQ ID NO: 713507 - DNA, 13 bp, C. elegans
cgtttttgattgt

SEQ ID NO: 713508 - DNA, 13 bp, C. elegans
cgtttttggcaaa

SEQ ID NO: 713509 - DNA, 13 bp, C. elegans
cgtttttgtttca

SEQ ID NO: 713510 - DNA, 13 bp, C. elegans
cgttttttaatgt

SEQ ID NO: 713511 - DNA, 13 bp, C. elegans
cgttttttatgaa

SEQ ID NO: 713512 - DNA, 13 bp, C. elegans
cgttttttgaaaa

SEQ ID NO: 713513 - DNA, 13 bp, C. elegans
cgttttttgaatt

SEQ ID NO: 713514 - DNA, 13 bp, C. elegans
cgttttttgtagt

SEQ ID NO: 713515 - DNA, 13 bp, C. elegans
cgtttttttgcaa

SEQ ID NO: 713516 - DNA, 13 bp, C. elegans
cgtttttttgtaa

SEQ ID NO: 713517 - DNA, 13 bp, C. elegans
ctaaaaaactttt

SEQ ID NO: 713518 - DNA, 13 bp, C. elegans
ctaaaaaatcgtg

SEQ ID NO: 713519 - DNA, 13 bp, C. elegans
ctaaaaaatctga

SEQ ID NO: 713520 - DNA, 13 bp, C. elegans
ctaaaaacggaaa

SEQ ID NO: 713521 - DNA, 13 bp, C. elegans
ctaaaaactgttt

SEQ ID NO: 713522 - DNA, 13 bp, C. elegans
ctaaaaacttcaa

SEQ ID NO: 713523 - DNA, 13 bp, C. elegans
ctaaaaagaccaa

SEQ ID NO: 713524 - DNA, 13 bp, C. elegans
ctaaaaagttgtt

SEQ ID NO: 713525 - DNA, 13 bp, C. elegans
ctaaaaatattct

SEQ ID NO: 713526 - DNA, 13 bp, C. elegans
ctaaaaatcaaga

SEQ ID NO: 713527 - DNA, 13 bp, C. elegans
ctaaaaatccatt

SEQ ID NO: 713528 - DNA, 13 bp, C. elegans
ctaaaaatctgaa

SEQ ID NO: 713529 - DNA, 13 bp, C. elegans
ctaaaaatgcaaa

SEQ ID NO: 713530 - DNA, 13 bp, C. elegans
ctaaaaatgcaga

SEQ ID NO: 713531 - DNA, 13 bp, C. elegans
ctaaaaattatca

SEQ ID NO: 713532 - DNA, 13 bp, C. elegans
ctaaaaattcata

SEQ ID NO: 713533 - DNA, 13 bp, C. elegans
ctaaaaattcttg

SEQ ID NO: 713534 - DNA, 13 bp, C. elegans
ctaaaaattgtct

SEQ ID NO: 713535 - DNA, 13 bp, C. elegans
ctaaaaattttga

SEQ ID NO: 713536 - DNA, 13 bp, C. elegans
ctaaaactaccaa

SEQ ID NO: 713537 - DNA, 13 bp, C. elegans
ctaaaactattaa

SEQ ID NO: 713538 - DNA, 13 bp, C. elegans
ctaaaactattga

SEQ ID NO: 713539 - DNA, 13 bp, C. elegans
ctaaaacttcaaa

SEQ ID NO: 713540 - DNA, 13 bp, C. elegans
ctaaaactttgaa

SEQ ID NO: 713541 - DNA, 13 bp, C. elegans
ctaaaagaaaacg

SEQ ID NO: 713542 - DNA, 13 bp, C. elegans
ctaaaagttgata

SEQ ID NO: 713543 - DNA, 13 bp, C. elegans
ctaaaagttttat

SEQ ID NO: 713544 - DNA, 13 bp, C. elegans
ctaaaatattcaa

SEQ ID NO: 713545 - DNA, 13 bp, C. elegans
ctaaaatcactca

SEQ ID NO: 713546 - DNA, 13 bp, C. elegans
ctaaaatcgattt

SEQ ID NO: 713547 - DNA, 13 bp, C. elegans
ctaaaatctcaaa

SEQ ID NO: 713548 - DNA, 13 bp, C. elegans
ctaaaatcttgaa

SEQ ID NO: 713549 - DNA, 13 bp, C. elegans
ctaaaattatgac

SEQ ID NO: 713550 - DNA, 13 bp, C. elegans
ctaaaattcataa

SEQ ID NO: 713551 - DNA, 13 bp, C. elegans
ctaaaattgaagt

SEQ ID NO: 713552 - DNA, 13 bp, C. elegans
ctaaaattggaaa

SEQ ID NO: 713553 - DNA, 13 bp, C. elegans
ctaaaattggaac

SEQ ID NO: 713554 - DNA, 13 bp, C. elegans
ctaaaatttctca

SEQ ID NO: 713555 - DNA, 13 bp, C. elegans
ctaaaatttgaaa

SEQ ID NO: 713556 - DNA, 13 bp, C. elegans
ctaaaattttcag

SEQ ID NO: 713557 - DNA, 13 bp, C. elegans
ctaaaccaatatc

SEQ ID NO: 713558 - DNA, 13 bp, C. elegans
ctaaactctgaaa

SEQ ID NO: 713559 - DNA, 13 bp, C. elegans
ctaaactttttaa

SEQ ID NO: 713560 - DNA, 13 bp, C. elegans
ctaaagaacgaat

SEQ ID NO: 713561 - DNA, 13 bp, C. elegans
ctaaagttgaaaa

SEQ ID NO: 713562 - DNA, 13 bp, C. elegans
ctaaagtttcaaa

SEQ ID NO: 713563 - DNA, 13 bp, C. elegans
ctaaatacttgtt

SEQ ID NO: 713564 - DNA, 13 bp, C. elegans
ctaaatattcaaa

SEQ ID NO: 713565 - DNA, 13 bp, C. elegans
ctaaatatttttc

SEQ ID NO: 713566 - DNA, 13 bp, C. elegans
ctaaatcaacgaa

SEQ ID NO: 713567 - DNA, 13 bp, C. elegans
ctaaatgttttct

SEQ ID NO: 713568 - DNA, 13 bp, C. elegans
ctaaattgttcaa

SEQ ID NO: 713569 - DNA, 13 bp, C. elegans
ctaaatttatttc

SEQ ID NO: 713570 - DNA, 13 bp, C. elegans
ctaaatttctgaa

SEQ ID NO: 713571 - DNA, 13 bp, C. elegans
ctaaatttgaaaa

SEQ ID NO: 713572 - DNA, 13 bp, C. elegans
ctaaatttgaatt

SEQ ID NO: 713573 - DNA, 13 bp, C. elegans
ctaaattttccaa

SEQ ID NO: 713574 - DNA, 13 bp, C. elegans
ctaaatttttggc

SEQ ID NO: 713575 - DNA, 13 bp, C. elegans
ctaacaaaatatt

SEQ ID NO: 713576 - DNA, 13 bp, C. elegans
ctaacaatacatt

SEQ ID NO: 713577 - DNA, 13 bp, C. elegans
ctaacaatttgta

SEQ ID NO: 713578 - DNA, 13 bp, C. elegans
ctaaccatttttt

SEQ ID NO: 713579 - DNA, 13 bp, C. elegans
ctaactgcctgat

SEQ ID NO: 713580 - DNA, 13 bp, C. elegans
ctaacttcatagc

SEQ ID NO: 713581 - DNA, 13 bp, C. elegans
ctaactttcaaaa

SEQ ID NO: 713582 - DNA, 13 bp, C. elegans
ctaactttgaaaa

SEQ ID NO: 713583 - DNA, 13 bp, C. elegans
ctaactttgggaa

SEQ ID NO: 713584 - DNA, 13 bp, C. elegans
ctaacttttaagt

SEQ ID NO: 713585 - DNA, 13 bp, C. elegans
ctaactttttcaa

SEQ ID NO: 713586 - DNA, 13 bp, C. elegans
ctaagccaatcta

SEQ ID NO: 713587 - DNA, 13 bp, C. elegans
ctaataaaagttt

SEQ ID NO: 713588 - DNA, 13 bp, C. elegans
ctaataagtttta

SEQ ID NO: 713589 - DNA, 13 bp, C. elegans
ctaataatgaatt

SEQ ID NO: 713590 - DNA, 13 bp, C. elegans
ctaataattattc

SEQ ID NO: 713591 - DNA, 13 bp, C. elegans
ctaatagtaagca

SEQ ID NO: 713592 - DNA, 13 bp, C. elegans
ctaatagtaagtt

SEQ ID NO: 713593 - DNA, 13 bp, C. elegans
ctaatagtcttgc

SEQ ID NO: 713594 - DNA, 13 bp, C. elegans
ctaatcagttatt

SEQ ID NO: 713595 - DNA, 13 bp, C. elegans
ctaattattgatt

SEQ ID NO: 713596 - DNA, 13 bp, C. elegans
ctaattcgatttt

SEQ ID NO: 713597 - DNA, 13 bp, C. elegans
ctaattctaattt

SEQ ID NO: 713598 - DNA, 13 bp, C. elegans
ctaattgtaagtt

SEQ ID NO: 713599 - DNA, 13 bp, C. elegans
ctaattgttttat

SEQ ID NO: 713600 - DNA, 13 bp, C. elegans
ctaattttagaaa

SEQ ID NO: 713601 - DNA, 13 bp, C. elegans
ctaattttcgaac

SEQ ID NO: 713602 - DNA, 13 bp, C. elegans
ctaattttgaagc

SEQ ID NO: 713603 - DNA, 13 bp, C. elegans
ctaattttgagta

SEQ ID NO: 713604 - DNA, 13 bp, C. elegans
ctaatttttattg

SEQ ID NO: 713605 - DNA, 13 bp, C. elegans
ctaatttttcaca

SEQ ID NO: 713606 - DNA, 13 bp, C. elegans
ctaatttttctaa

SEQ ID NO: 713607 - DNA, 13 bp, C. elegans
ctaatttttgtta

SEQ ID NO: 713608 - DNA, 13 bp, C. elegans
ctaatttttgttc

SEQ ID NO: 713609 - DNA, 13 bp, C. elegans
ctaattttttggt

SEQ ID NO: 713610 - DNA, 13 bp, C. elegans
ctaatttttttga

SEQ ID NO: 713611 - DNA, 13 bp, C. elegans
ctacaaaaaaggc

SEQ ID NO: 713612 - DNA, 13 bp, C. elegans
ctacaaaaagttt

SEQ ID NO: 713613 - DNA, 13 bp, C. elegans
ctacaaaaatgct

SEQ ID NO: 713614 - DNA, 13 bp, C. elegans
ctacaaaactaca

SEQ ID NO: 713615 - DNA, 13 bp, C. elegans
ctacaaaagttta

SEQ ID NO: 713616 - DNA, 13 bp, C. elegans
ctacaaaatgata

SEQ ID NO: 713617 - DNA, 13 bp, C. elegans
ctacaaaattcga

SEQ ID NO: 713618 - DNA, 13 bp, C. elegans
ctacaaaattgcc

SEQ ID NO: 713619 - DNA, 13 bp, C. elegans
ctacaaacctaca

SEQ ID NO: 713620 - DNA, 14 bp, C. elegans
ctacaaactacaac

SEQ ID NO: 713621 - DNA, 14 bp, C. elegans
ctacaaactacact

SEQ ID NO: 713622 - DNA, 13 bp, C. elegans
ctacaaactacgg

SEQ ID NO: 713623 - DNA, 13 bp, C. elegans
ctacaaactatga

SEQ ID NO: 713624 - DNA, 13 bp, C. elegans
ctacaaacttgtt

SEQ ID NO: 713625 - DNA, 13 bp, C. elegans
ctacaaagttgtt

SEQ ID NO: 713626 - DNA, 13 bp, C. elegans
ctacaaatgaata

SEQ ID NO: 713627 - DNA, 13 bp, C. elegans
ctacaaattgtta

SEQ ID NO: 713628 - DNA, 13 bp, C. elegans
ctacaactactac

SEQ ID NO: 713629 - DNA, 13 bp, C. elegans
ctacaactcattt

SEQ ID NO: 713630 - DNA, 13 bp, C. elegans
ctacaataatcct

SEQ ID NO: 713631 - DNA, 13 bp, C. elegans
ctacaatgtttta

SEQ ID NO: 713632 - DNA, 13 bp, C. elegans
ctacaattggatc

SEQ ID NO: 713633 - DNA, 13 bp, C. elegans
ctacaatttgtat

SEQ ID NO: 713634 - DNA, 13 bp, C. elegans
ctacacaaaattt

SEQ ID NO: 713635 - DNA, 13 bp, C. elegans
ctacacaattttg

SEQ ID NO: 713636 - DNA, 13 bp, C. elegans
ctacaccaaaagg

SEQ ID NO: 713637 - DNA, 13 bp, C. elegans
ctacacgcctacc

SEQ ID NO: 713638 - DNA, 13 bp, C. elegans
ctacactattttc

SEQ ID NO: 713639 - DNA, 13 bp, C. elegans
ctacagaaaaatc

SEQ ID NO: 713640 - DNA, 13 bp, C. elegans
ctacagcaaccct

SEQ ID NO: 713641 - DNA, 13 bp, C. elegans
ctacagtaaccaa

SEQ ID NO: 713642 - DNA, 13 bp, C. elegans
ctacagtaaccct

SEQ ID NO: 713643 - DNA, 13 bp, C. elegans
ctacagtaaccta

SEQ ID NO: 713644 - DNA, 13 bp, C. elegans
ctacagtaactat

SEQ ID NO: 713645 - DNA, 13 bp, C. elegans
ctacagtaactct

SEQ ID NO: 713646 - DNA, 13 bp, C. elegans
ctacagtaatcca

SEQ ID NO: 713647 - DNA, 13 bp, C. elegans
ctacagtaatcct

SEQ ID NO: 713648 - DNA, 13 bp, C. elegans
ctacagtaatcgt

SEQ ID NO: 713649 - DNA, 13 bp, C. elegans
ctacagtaatctc

SEQ ID NO: 713650 - DNA, 13 bp, C. elegans
ctacagtaatctt

SEQ ID NO: 713651 - DNA, 13 bp, C. elegans
ctacagtacccca

SEQ ID NO: 713652 - DNA, 13 bp, C. elegans
ctacagtaccccc

SEQ ID NO: 713653 - DNA, 13 bp, C. elegans
ctacagtaccctc

SEQ ID NO: 713654 - DNA, 13 bp, C. elegans
ctacagtaccctg

SEQ ID NO: 713655 - DNA, 13 bp, C. elegans
ctacagtacctct

SEQ ID NO: 713656 - DNA, 13 bp, C. elegans
ctacagtacctta

SEQ ID NO: 713657 - DNA, 13 bp, C. elegans
ctacagtactact

SEQ ID NO: 713658 - DNA, 13 bp, C. elegans
ctacagtactcct

SEQ ID NO: 713659 - DNA, 13 bp, C. elegans
ctacagtactctt

SEQ ID NO: 713660 - DNA, 13 bp, C. elegans
ctacagtagtcct

SEQ ID NO: 713661 - DNA, 13 bp, C. elegans
ctacagtagtctt

SEQ ID NO: 713662 - DNA, 13 bp, C. elegans
ctacagtatccca

SEQ ID NO: 713663 - DNA, 13 bp, C. elegans
ctacagtatccct

SEQ ID NO: 713664 - DNA, 13 bp, C. elegans
ctacagtattcct

SEQ ID NO: 713665 - DNA, 13 bp, C. elegans
ctacagtgcattt

SEQ ID NO: 713666 - DNA, 13 bp, C. elegans
ctacagtttttga

SEQ ID NO: 713667 - DNA, 13 bp, C. elegans
ctacatttatctt

SEQ ID NO: 713668 - DNA, 13 bp, C. elegans
ctacattttcaat

SEQ ID NO: 713669 - DNA, 13 bp, C. elegans
ctacattttctca

SEQ ID NO: 713670 - DNA, 13 bp, C. elegans
ctacattttgtta

SEQ ID NO: 713671 - DNA, 13 bp, C. elegans
ctacatttttctc

SEQ ID NO: 713672 - DNA, 13 bp, C. elegans
ctaccatttttaa

SEQ ID NO: 713673 - DNA, 13 bp, C. elegans
ctaccgtaaccca

SEQ ID NO: 713674 - DNA, 13 bp, C. elegans
ctaccgtaaccct

SEQ ID NO: 713675 - DNA, 13 bp, C. elegans
ctaccgtaccacc

SEQ ID NO: 713676 - DNA, 13 bp, C. elegans
ctaccgtacccct

SEQ ID NO: 713677 - DNA, 13 bp, C. elegans
ctaccgtatgcct

SEQ ID NO: 713678 - DNA, 13 bp, C. elegans
ctacctacctact

SEQ ID NO: 713679 - DNA, 13 bp, C. elegans
ctacctgattttc

SEQ ID NO: 713680 - DNA, 13 bp, C. elegans
ctacctgcctaca

SEQ ID NO: 713681 - DNA, 13 bp, C. elegans
ctacgagatattt

SEQ ID NO: 713682 - DNA, 13 bp, C. elegans
ctacgatttttgt

SEQ ID NO: 713683 - DNA, 13 bp, C. elegans
ctacgtgcctaca

SEQ ID NO: 713684 - DNA, 13 bp, C. elegans
ctacgtgcctacc

SEQ ID NO: 713685 - DNA, 13 bp, C. elegans
ctactaaaaatgc

SEQ ID NO: 713686 - DNA, 13 bp, C. elegans
ctactacagaata

SEQ ID NO: 713687 - DNA, 13 bp, C. elegans
ctactacagtacc

SEQ ID NO: 713688 - DNA, 13 bp, C. elegans
ctactactactat

SEQ ID NO: 713689 - DNA, 13 bp, C. elegans
ctactctactttt

SEQ ID NO: 713690 - DNA, 13 bp, C. elegans
ctactgtagtgct

SEQ ID NO: 713691 - DNA, 13 bp, C. elegans
ctacttcaaaaaa

SEQ ID NO: 713692 - DNA, 13 bp, C. elegans
ctactttcaaaga

SEQ ID NO: 713693 - DNA, 13 bp, C. elegans
ctacttttcgagc

SEQ ID NO: 713694 - DNA, 13 bp, C. elegans
ctacttttttcga

SEQ ID NO: 713695 - DNA, 13 bp, C. elegans
ctacttttttgaa

SEQ ID NO: 713696 - DNA, 13 bp, C. elegans
ctagaaaaaaacg

SEQ ID NO: 713697 - DNA, 13 bp, C. elegans
ctagaaaaaccta

SEQ ID NO: 713698 - DNA, 13 bp, C. elegans
ctagaaaaactcg

SEQ ID NO: 713699 - DNA, 13 bp, C. elegans
ctagaaaaatcga

SEQ ID NO: 713700 - DNA, 13 bp, C. elegans
ctagaaaacaatt

SEQ ID NO: 713701 - DNA, 13 bp, C. elegans
ctagaaaataatt

SEQ ID NO: 713702 - DNA, 13 bp, C. elegans
ctagaaaatattt

SEQ ID NO: 713703 - DNA, 13 bp, C. elegans
ctagaaaatccga

SEQ ID NO: 713704 - DNA, 13 bp, C. elegans
ctagaaaattcca

SEQ ID NO: 713705 - DNA, 13 bp, C. elegans
ctagaaaattcgg

SEQ ID NO: 713706 - DNA, 13 bp, C. elegans
ctagaaaccaaaa

SEQ ID NO: 713707 - DNA, 13 bp, C. elegans
ctagaaacctcta

SEQ ID NO: 713708 - DNA, 13 bp, C. elegans
ctagaaagtttta

SEQ ID NO: 713709 - DNA, 13 bp, C. elegans
ctagaaatattga

SEQ ID NO: 713710 - DNA, 13 bp, C. elegans
ctagaaatctcaa

SEQ ID NO: 713711 - DNA, 13 bp, C. elegans
ctagaaatgtatt

SEQ ID NO: 713712 - DNA, 13 bp, C. elegans
ctagaaatttcca

SEQ ID NO: 713713 - DNA, 13 bp, C. elegans
ctagaaattttta

SEQ ID NO: 713714 - DNA, 13 bp, C. elegans
ctagaagcttctg

SEQ ID NO: 713715 - DNA, 13 bp, C. elegans
ctagaagtttcta

SEQ ID NO: 713716 - DNA, 13 bp, C. elegans
ctagaattgtttt

SEQ ID NO: 713717 - DNA, 13 bp, C. elegans
ctagaattttcaa

SEQ ID NO: 713718 - DNA, 13 bp, C. elegans
ctagaattttttt

SEQ ID NO: 713719 - DNA, 13 bp, C. elegans
ctagacttttcca

SEQ ID NO: 713720 - DNA, 13 bp, C. elegans
ctagattaatttt

SEQ ID NO: 713721 - DNA, 13 bp, C. elegans
ctagattttctag

SEQ ID NO: 713722 - DNA, 13 bp, C. elegans
ctagatttttaac

SEQ ID NO: 713723 - DNA, 13 bp, C. elegans
ctagatttttaat

SEQ ID NO: 713724 - DNA, 13 bp, C. elegans
ctagattttttct

SEQ ID NO: 713725 - DNA, 13 bp, C. elegans
ctagcaaaaattg

SEQ ID NO: 713726 - DNA, 13 bp, C. elegans
ctagccaatatgg

SEQ ID NO: 713727 - DNA, 22 bp, C. elegans
ctagctccgcaggcagctgaaa

SEQ ID NO: 713728 - DNA, 13 bp, C. elegans
ctagctttttcta

SEQ ID NO: 713729 - DNA, 13 bp, C. elegans
ctaggccaccaac

SEQ ID NO: 713730 - DNA, 13 bp, C. elegans
ctaggccaccata

SEQ ID NO: 713731 - DNA, 13 bp, C. elegans
ctaggcctaagcc

SEQ ID NO: 713732 - DNA, 13 bp, C. elegans
ctagtctaaacat

SEQ ID NO: 713733 - DNA, 13 bp, C. elegans
ctagttttagttt

SEQ ID NO: 713734 - DNA, 13 bp, C. elegans
ctagttttcaaat

SEQ ID NO: 713735 - DNA, 13 bp, C. elegans
ctagttttcaatt

SEQ ID NO: 713736 - DNA, 13 bp, C. elegans
ctagttttcattt

SEQ ID NO: 713737 - DNA, 13 bp, C. elegans
ctagttttcgatt

SEQ ID NO: 713738 - DNA, 13 bp, C. elegans
ctagttttctcaa

SEQ ID NO: 713739 - DNA, 13 bp, C. elegans
ctagttttgattt

SEQ ID NO: 713740 - DNA, 13 bp, C. elegans
ctagttttggatt

SEQ ID NO: 713741 - DNA, 13 bp, C. elegans
ctagtttttaaat

SEQ ID NO: 713742 - DNA, 13 bp, C. elegans
ctagtttttcttc

SEQ ID NO: 713743 - DNA, 13 bp, C. elegans
ctataaaaaatag

SEQ ID NO: 713744 - DNA, 13 bp, C. elegans
ctataaaagtttt

SEQ ID NO: 713745 - DNA, 13 bp, C. elegans
ctataaacatttt

SEQ ID NO: 713746 - DNA, 13 bp, C. elegans
ctataaatgttcc

SEQ ID NO: 713747 - DNA, 13 bp, C. elegans
ctataaattgaaa

SEQ ID NO: 713748 - DNA, 13 bp, C. elegans
ctataaattggca

SEQ ID NO: 713749 - DNA, 13 bp, C. elegans
ctataggaccccc

SEQ ID NO: 713750 - DNA, 13 bp, C. elegans
ctatagttttttg

SEQ ID NO: 713751 - DNA, 13 bp, C. elegans
ctatataaggaga

SEQ ID NO: 713752 - DNA, 13 bp, C. elegans
ctatatttccaaa

SEQ ID NO: 713753 - DNA, 13 bp, C. elegans
ctatatttgattt

SEQ ID NO: 713754 - DNA, 13 bp, C. elegans
ctatattttcaag

SEQ ID NO: 713755 - DNA, 13 bp, C. elegans
ctatattttgaaa

SEQ ID NO: 713756 - DNA, 13 bp, C. elegans
ctatattttgtca

SEQ ID NO: 713757 - DNA, 13 bp, C. elegans
ctatcaaaaaatt

SEQ ID NO: 713758 - DNA, 13 bp, C. elegans
ctatcaaaaagtt

SEQ ID NO: 713759 - DNA, 13 bp, C. elegans
ctatcaaaaattg

SEQ ID NO: 713760 - DNA, 13 bp, C. elegans
ctatcaaaatgtt

SEQ ID NO: 713761 - DNA, 13 bp, C. elegans
ctatcaaacaatt

SEQ ID NO: 713762 - DNA, 13 bp, C. elegans
ctatcaaatttga

SEQ ID NO: 713763 - DNA, 13 bp, C. elegans
ctatcaagaaact

SEQ ID NO: 713764 - DNA, 13 bp, C. elegans
ctatcaagctgac

SEQ ID NO: 713765 - DNA, 13 bp, C. elegans
ctatcgaatggca

SEQ ID NO: 713766 - DNA, 13 bp, C. elegans
ctatcgattttta

SEQ ID NO: 713767 - DNA, 13 bp, C. elegans
ctatgaaaaaata

SEQ ID NO: 713768 - DNA, 13 bp, C. elegans
ctatgaataaatt

SEQ ID NO: 713769 - DNA, 13 bp, C. elegans
ctatgaatgttcc

SEQ ID NO: 713770 - DNA, 13 bp, C. elegans
ctatgacgtcact

SEQ ID NO: 713771 - DNA, 13 bp, C. elegans
ctatgagaaaaaa

SEQ ID NO: 713772 - DNA, 13 bp, C. elegans
ctatgatctttca

SEQ ID NO: 713773 - DNA, 13 bp, C. elegans
ctatgatttttca

SEQ ID NO: 713774 - DNA, 13 bp, C. elegans
ctatgcaaaaaat

SEQ ID NO: 713775 - DNA, 13 bp, C. elegans
ctatgtaaaaatg

SEQ ID NO: 713776 - DNA, 13 bp, C. elegans
ctatgtataattt

SEQ ID NO: 713777 - DNA, 13 bp, C. elegans
ctatgtctatgcc

SEQ ID NO: 713778 - DNA, 13 bp, C. elegans
ctatgttcaaaaa

SEQ ID NO: 713779 - DNA, 13 bp, C. elegans
ctattaaaattga

SEQ ID NO: 713780 - DNA, 13 bp, C. elegans
ctattaatattgc

SEQ ID NO: 713781 - DNA, 14 bp, C. elegans
ctattagagactgc

SEQ ID NO: 713782 - DNA, 13 bp, C. elegans
ctattagtattgc

SEQ ID NO: 713783 - DNA, 13 bp, C. elegans
ctattatattttg

SEQ ID NO: 713784 - DNA, 13 bp, C. elegans
ctattatcgaaaa

SEQ ID NO: 713785 - DNA, 13 bp, C. elegans
ctattattgattt

SEQ ID NO: 713786 - DNA, 13 bp, C. elegans
ctattcaaaacat

SEQ ID NO: 713787 - DNA, 13 bp, C. elegans
ctattcaaattca

SEQ ID NO: 713788 - DNA, 13 bp, C. elegans
ctattcaacaaaa

SEQ ID NO: 713789 - DNA, 13 bp, C. elegans
ctattcactattt

SEQ ID NO: 713790 - DNA, 13 bp, C. elegans
ctattccaaactc

SEQ ID NO: 713791 - DNA, 13 bp, C. elegans
ctattcgaaaata

SEQ ID NO: 713792 - DNA, 13 bp, C. elegans
ctattcgaaattt

SEQ ID NO: 713793 - DNA, 13 bp, C. elegans
ctattgaaaatta

SEQ ID NO: 713794 - DNA, 13 bp, C. elegans
ctattgaattttt

SEQ ID NO: 713795 - DNA, 13 bp, C. elegans
ctattgattttgt

SEQ ID NO: 713796 - DNA, 13 bp, C. elegans
ctattgatttttg

SEQ ID NO: 713797 - DNA, 13 bp, C. elegans
ctattggaatttt

SEQ ID NO: 713798 - DNA, 13 bp, C. elegans
ctatttagaatat

SEQ ID NO: 713799 - DNA, 13 bp, C. elegans
ctatttattgatt

SEQ ID NO: 713800 - DNA, 13 bp, C. elegans
ctatttatttcaa

SEQ ID NO: 713801 - DNA, 13 bp, C. elegans
ctatttcaatatt

SEQ ID NO: 713802 - DNA, 13 bp, C. elegans
ctatttcacaatt

SEQ ID NO: 713803 - DNA, 13 bp, C. elegans
ctatttcagaaaa

SEQ ID NO: 713804 - DNA, 13 bp, C. elegans
ctatttcagtgat

SEQ ID NO: 713805 - DNA, 13 bp, C. elegans
ctatttctaaatt

SEQ ID NO: 713806 - DNA, 13 bp, C. elegans
ctatttctcaatt

SEQ ID NO: 713807 - DNA, 13 bp, C. elegans
ctatttgaaaaat

SEQ ID NO: 713808 - DNA, 13 bp, C. elegans
ctatttgaatttc

SEQ ID NO: 713809 - DNA, 13 bp, C. elegans
ctatttgccgaaa

SEQ ID NO: 713810 - DNA, 13 bp, C. elegans
ctatttggaaagt

SEQ ID NO: 713811 - DNA, 13 bp, C. elegans
ctatttggtgctc

SEQ ID NO: 713812 - DNA, 13 bp, C. elegans
ctattttattcca

SEQ ID NO: 713813 - DNA, 13 bp, C. elegans
ctattttcaatta

SEQ ID NO: 713814 - DNA, 13 bp, C. elegans
ctattttcagcaa

SEQ ID NO: 713815 - DNA, 13 bp, C. elegans
ctattttctatca

SEQ ID NO: 713816 - DNA, 13 bp, C. elegans
ctattttgaaaat

SEQ ID NO: 713817 - DNA, 13 bp, C. elegans
ctattttgagaat

SEQ ID NO: 713818 - DNA, 13 bp, C. elegans
ctattttggaaaa

SEQ ID NO: 713819 - DNA, 13 bp, C. elegans
ctattttggaaag

SEQ ID NO: 713820 - DNA, 13 bp, C. elegans
ctatttttagcta

SEQ ID NO: 713821 - DNA, 13 bp, C. elegans
ctatttttcaaat

SEQ ID NO: 713822 - DNA, 13 bp, C. elegans
ctatttttccaat

SEQ ID NO: 713823 - DNA, 13 bp, C. elegans
ctatttttctcac

SEQ ID NO: 713824 - DNA, 13 bp, C. elegans
ctatttttcttga

SEQ ID NO: 713825 - DNA, 13 bp, C. elegans
ctattttttctga

SEQ ID NO: 713826 - DNA, 13 bp, C. elegans
ctcaaaaaaagtt

SEQ ID NO: 713827 - DNA, 13 bp, C. elegans
ctcaaaaaactgt

SEQ ID NO: 713828 - DNA, 13 bp, C. elegans
ctcaaaaaaggaa

SEQ ID NO: 713829 - DNA, 13 bp, C. elegans
ctcaaaaaatgac

SEQ ID NO: 713830 - DNA, 13 bp, C. elegans
ctcaaaaaattga

SEQ ID NO: 713831 - DNA, 13 bp, C. elegans
ctcaaaaacaaga

SEQ ID NO: 713832 - DNA, 13 bp, C. elegans
ctcaaaaaccgaa

SEQ ID NO: 713833 - DNA, 13 bp, C. elegans
ctcaaaaacggtt

SEQ ID NO: 713834 - DNA, 13 bp, C. elegans
ctcaaaaactcac

SEQ ID NO: 713835 - DNA, 13 bp, C. elegans
ctcaaaaactcat

SEQ ID NO: 713836 - DNA, 13 bp, C. elegans
ctcaaaaactgaa

SEQ ID NO: 713837 - DNA, 13 bp, C. elegans
ctcaaaaacttac

SEQ ID NO: 713838 - DNA, 13 bp, C. elegans
ctcaaaaacttcc

SEQ ID NO: 713839 - DNA, 13 bp, C. elegans
ctcaaaaactttg

SEQ ID NO: 713840 - DNA, 13 bp, C. elegans
ctcaaaaagtgtt

SEQ ID NO: 713841 - DNA, 13 bp, C. elegans
ctcaaaaataagt

SEQ ID NO: 713842 - DNA, 13 bp, C. elegans
ctcaaaaatacgg

SEQ ID NO: 713843 - DNA, 13 bp, C. elegans
ctcaaaaatagtt

SEQ ID NO: 713844 - DNA, 13 bp, C. elegans
ctcaaaaatatga

SEQ ID NO: 713845 - DNA, 13 bp, C. elegans
ctcaaaaatcaat

SEQ ID NO: 713846 - DNA, 13 bp, C. elegans
ctcaaaaatccga

SEQ ID NO: 713847 - DNA, 13 bp, C. elegans
ctcaaaaatcgat

SEQ ID NO: 713848 - DNA, 13 bp, C. elegans
ctcaaaaatcgct

SEQ ID NO: 713849 - DNA, 13 bp, C. elegans
ctcaaaaatggag

SEQ ID NO: 713850 - DNA, 13 bp, C. elegans
ctcaaaaattcga

SEQ ID NO: 713851 - DNA, 13 bp, C. elegans
ctcaaaaattgaa

SEQ ID NO: 713852 - DNA, 13 bp, C. elegans
ctcaaaaattgca

SEQ ID NO: 713853 - DNA, 13 bp, C. elegans
ctcaaaaatttcc

SEQ ID NO: 713854 - DNA, 13 bp, C. elegans
ctcaaaactcaaa

SEQ ID NO: 713855 - DNA, 13 bp, C. elegans
ctcaaaactccaa

SEQ ID NO: 713856 - DNA, 13 bp, C. elegans
ctcaaaacttgaa

SEQ ID NO: 713857 - DNA, 13 bp, C. elegans
ctcaaaagattac

SEQ ID NO: 713858 - DNA, 13 bp, C. elegans
ctcaaaagcagaa

SEQ ID NO: 713859 - DNA, 13 bp, C. elegans
ctcaaaagctcat

SEQ ID NO: 713860 - DNA, 13 bp, C. elegans
ctcaaaagctcgt

SEQ ID NO: 713861 - DNA, 13 bp, C. elegans
ctcaaaatacttt

SEQ ID NO: 713862 - DNA, 13 bp, C. elegans
ctcaaaatatctc

SEQ ID NO: 713863 - DNA, 13 bp, C. elegans
ctcaaaatcaata

SEQ ID NO: 713864 - DNA, 13 bp, C. elegans
ctcaaaatccaaa

SEQ ID NO: 713865 - DNA, 13 bp, C. elegans
ctcaaaatcctca

SEQ ID NO: 713866 - DNA, 13 bp, C. elegans
ctcaaaatcgcgt

SEQ ID NO: 713867 - DNA, 13 bp, C. elegans
ctcaaaatgtgca

SEQ ID NO: 713868 - DNA, 13 bp, C. elegans
ctcaaaatgtttt

SEQ ID NO: 713869 - DNA, 13 bp, C. elegans
ctcaaaattcgaa

SEQ ID NO: 713870 - DNA, 13 bp, C. elegans
ctcaaaattgatc

SEQ ID NO: 713871 - DNA, 13 bp, C. elegans
ctcaaaattgatt

SEQ ID NO: 713872 - DNA, 13 bp, C. elegans
ctcaaaatttatc

SEQ ID NO: 713873 - DNA, 13 bp, C. elegans
ctcaaaatttcca

SEQ ID NO: 713874 - DNA, 13 bp, C. elegans
ctcaaaattttca

SEQ ID NO: 713875 - DNA, 13 bp, C. elegans
ctcaaacttcaaa

SEQ ID NO: 713876 - DNA, 13 bp, C. elegans
ctcaaacttcaat

SEQ ID NO: 713877 - DNA, 13 bp, C. elegans
ctcaaacttccaa

SEQ ID NO: 713878 - DNA, 13 bp, C. elegans
ctcaaactttttt

SEQ ID NO: 713879 - DNA, 13 bp, C. elegans
ctcaaagtgcagt

SEQ ID NO: 713880 - DNA, 13 bp, C. elegans
ctcaaatattcaa

SEQ ID NO: 713881 - DNA, 13 bp, C. elegans
ctcaaatattttc

SEQ ID NO: 713882 - DNA, 13 bp, C. elegans
ctcaaatattttt

SEQ ID NO: 713883 - DNA, 13 bp, C. elegans
ctcaaattgtaaa

SEQ ID NO: 713884 - DNA, 13 bp, C. elegans
ctcaaatttaaaa

SEQ ID NO: 713885 - DNA, 13 bp, C. elegans
ctcaaatttcctg

SEQ ID NO: 713886 - DNA, 13 bp, C. elegans
ctcaaatttcgaa

SEQ ID NO: 713887 - DNA, 13 bp, C. elegans
ctcaaatttcggc

SEQ ID NO: 713888 - DNA, 13 bp, C. elegans
ctcaaatttcttc

SEQ ID NO: 713889 - DNA, 13 bp, C. elegans
ctcaaattttcac

SEQ ID NO: 713890 - DNA, 13 bp, C. elegans
ctcaaattttcag

SEQ ID NO: 713891 - DNA, 14 bp, C. elegans
ctcaaattttgaat

SEQ ID NO: 713892 - DNA, 13 bp, C. elegans
ctcaaattttggt

SEQ ID NO: 713893 - DNA, 13 bp, C. elegans
ctcaacaatatta

SEQ ID NO: 713894 - DNA, 13 bp, C. elegans
ctcaaccaaaatc

SEQ ID NO: 713895 - DNA, 13 bp, C. elegans
ctcaaccaaattc

SEQ ID NO: 713896 - DNA, 13 bp, C. elegans
ctcaaccaagttt

SEQ ID NO: 713897 - DNA, 13 bp, C. elegans
ctcaaccaatttc

SEQ ID NO: 713898 - DNA, 13 bp, C. elegans
ctcaaccattttt

SEQ ID NO: 713899 - DNA, 13 bp, C. elegans
ctcaacgtcgttg

SEQ ID NO: 713900 - DNA, 13 bp, C. elegans
ctcaactctgaac

SEQ ID NO: 713901 - DNA, 13 bp, C. elegans
ctcaacttcaaaa

SEQ ID NO: 713902 - DNA, 13 bp, C. elegans
ctcaacttttgtt

SEQ ID NO: 713903 - DNA, 13 bp, C. elegans
ctcaactttttca

SEQ ID NO: 713904 - DNA, 13 bp, C. elegans
ctcaagaaacata

SEQ ID NO: 713905 - DNA, 13 bp, C. elegans
ctcaagaaatatt

SEQ ID NO: 713906 - DNA, 13 bp, C. elegans
ctcaagaattcaa

SEQ ID NO: 713907 - DNA, 13 bp, C. elegans
ctcaagtgaatca

SEQ ID NO: 713908 - DNA, 13 bp, C. elegans
ctcaatacagttt

SEQ ID NO: 713909 - DNA, 13 bp, C. elegans
ctcaatatcttct

SEQ ID NO: 713910 - DNA, 13 bp, C. elegans
ctcaatatttaga

SEQ ID NO: 713911 - DNA, 13 bp, C. elegans
ctcaatatttgaa

SEQ ID NO: 713912 - DNA, 13 bp, C. elegans
ctcaatcaaaaat

SEQ ID NO: 713913 - DNA, 13 bp, C. elegans
ctcaatcaatcaa

SEQ ID NO: 713914 - DNA, 13 bp, C. elegans
ctcaatcagtttt

SEQ ID NO: 713915 - DNA, 13 bp, C. elegans
ctcaattcatttt

SEQ ID NO: 713916 - DNA, 13 bp, C. elegans
ctcaatttccatt

SEQ ID NO: 713917 - DNA, 13 bp, C. elegans
ctcaatttcctcc

SEQ ID NO: 713918 - DNA, 13 bp, C. elegans
ctcaatttcttca

SEQ ID NO: 713919 - DNA, 13 bp, C. elegans
ctcaatttgttca

SEQ ID NO: 713920 - DNA, 13 bp, C. elegans
ctcaatttgttgt

SEQ ID NO: 713921 - DNA, 13 bp, C. elegans
ctcaattttaatt

SEQ ID NO: 713922 - DNA, 13 bp, C. elegans
ctcaattttcaca

SEQ ID NO: 713923 - DNA, 13 bp, C. elegans
ctcaattttcact

SEQ ID NO: 713924 - DNA, 13 bp, C. elegans
ctcaattttcatc

SEQ ID NO: 713925 - DNA, 13 bp, C. elegans
ctcaattttccac

SEQ ID NO: 713926 - DNA, 13 bp, C. elegans
ctcaattttcgaa

SEQ ID NO: 713927 - DNA, 13 bp, C. elegans
ctcaattttctcg

SEQ ID NO: 713928 - DNA, 13 bp, C. elegans
ctcaattttctgt

SEQ ID NO: 713929 - DNA, 13 bp, C. elegans
ctcaattttgaaa

SEQ ID NO: 713930 - DNA, 13 bp, C. elegans
ctcaattttgtgt

SEQ ID NO: 713931 - DNA, 13 bp, C. elegans
ctcaatttttaaa

SEQ ID NO: 713932 - DNA, 13 bp, C. elegans
ctcaatttttaac

SEQ ID NO: 713933 - DNA, 13 bp, C. elegans
ctcaatttttcaa

SEQ ID NO: 713934 - DNA, 13 bp, C. elegans
ctcaatttttcca

SEQ ID NO: 713935 - DNA, 13 bp, C. elegans
ctcaatttttccc

SEQ ID NO: 713936 - DNA, 13 bp, C. elegans
ctcaatttttccg

SEQ ID NO: 713937 - DNA, 13 bp, C. elegans
ctcaatttttcct

SEQ ID NO: 713938 - DNA, 13 bp, C. elegans
ctcaatttttcga

SEQ ID NO: 713939 - DNA, 13 bp, C. elegans
ctcaatttttgaa

SEQ ID NO: 713940 - DNA, 13 bp, C. elegans
ctcaattttttga

SEQ ID NO: 713941 - DNA, 13 bp, C. elegans
ctcaattttttgt

SEQ ID NO: 713942 - DNA, 13 bp, C. elegans
ctcacaaaaatca

SEQ ID NO: 713943 - DNA, 13 bp, C. elegans
ctcacaatcagaa

SEQ ID NO: 713944 - DNA, 13 bp, C. elegans
ctcacaatcagtc

SEQ ID NO: 713945 - DNA, 13 bp, C. elegans
ctcacaatcagtt

SEQ ID NO: 713946 - DNA, 13 bp, C. elegans
ctcacaattgaat

SEQ ID NO: 713947 - DNA, 13 bp, C. elegans
ctcacactacaaa

SEQ ID NO: 713948 - DNA, 13 bp, C. elegans
ctcacatccatct

SEQ ID NO: 713949 - DNA, 13 bp, C. elegans
ctcacatttccca

SEQ ID NO: 713950 - DNA, 14 bp, C. elegans
ctcaccgagagctt

SEQ ID NO: 713951 - DNA, 13 bp, C. elegans
ctcaccgagcaca

SEQ ID NO: 713952 - DNA, 13 bp, C. elegans
ctcacctcagttt

SEQ ID NO: 713953 - DNA, 13 bp, C. elegans
ctcacgatatctt

SEQ ID NO: 713954 - DNA, 13 bp, C. elegans
ctcactattcaac

SEQ ID NO: 713955 - DNA, 13 bp, C. elegans
ctcactattttct

SEQ ID NO: 713956 - DNA, 13 bp, C. elegans
ctcactcgggtca

SEQ ID NO: 713957 - DNA, 13 bp, C. elegans
ctcactctctcac

SEQ ID NO: 713958 - DNA, 13 bp, C. elegans
ctcactggcgcta

SEQ ID NO: 713959 - DNA, 13 bp, C. elegans
ctcactttttgtt

SEQ ID NO: 713960 - DNA, 13 bp, C. elegans
ctcagaaaatgtt

SEQ ID NO: 713961 - DNA, 13 bp, C. elegans
ctcagaaagtttg

SEQ ID NO: 713962 - DNA, 13 bp, C. elegans
ctcagaacttagt

SEQ ID NO: 713963 - DNA, 18 bp, C. elegans
ctcagacaaacgcttagt

SEQ ID NO: 713964 - DNA, 13 bp, C. elegans
ctcagctctcttc

SEQ ID NO: 713965 - DNA, 13 bp, C. elegans
ctcagttttcacc

SEQ ID NO: 713966 - DNA, 13 bp, C. elegans
ctcagttttcatc

SEQ ID NO: 713967 - DNA, 13 bp, C. elegans
ctcagtttttgtc

SEQ ID NO: 713968 - DNA, 13 bp, C. elegans
ctcagtttttttg

SEQ ID NO: 713969 - DNA, 13 bp, C. elegans
ctcataaaatttg

SEQ ID NO: 713970 - DNA, 13 bp, C. elegans
ctcataaatattt

SEQ ID NO: 713971 - DNA, 13 bp, C. elegans
ctcataactcctt

SEQ ID NO: 713972 - DNA, 13 bp, C. elegans
ctcataacttttt

SEQ ID NO: 713973 - DNA, 13 bp, C. elegans
ctcataatttaaa

SEQ ID NO: 713974 - DNA, 13 bp, C. elegans
ctcataatttatt

SEQ ID NO: 713975 - DNA, 13 bp, C. elegans
ctcataattttgt

SEQ ID NO: 713976 - DNA, 13 bp, C. elegans
ctcatagtcagtt

SEQ ID NO: 713977 - DNA, 13 bp, C. elegans
ctcatattccggt

SEQ ID NO: 713978 - DNA, 13 bp, C. elegans
ctcatattttgcc

SEQ ID NO: 713979 - DNA, 13 bp, C. elegans
ctcatcgattaca

SEQ ID NO: 713980 - DNA, 13 bp, C. elegans
ctcatctccaaaa

SEQ ID NO: 713981 - DNA, 13 bp, C. elegans
ctcattcaaacat

SEQ ID NO: 713982 - DNA, 13 bp, C. elegans
ctcattccaaaaa

SEQ ID NO: 713983 - DNA, 13 bp, C. elegans
ctcattgcctacc

SEQ ID NO: 713984 - DNA, 13 bp, C. elegans
ctcatttcaattg

SEQ ID NO: 713985 - DNA, 13 bp, C. elegans
ctcatttccaaat

SEQ ID NO: 713986 - DNA, 16 bp, C. elegans
ctcatttcggtttgat

SEQ ID NO: 713987 - DNA, 13 bp, C. elegans
ctcatttctaatt

SEQ ID NO: 713988 - DNA, 13 bp, C. elegans
ctcatttctcatt

SEQ ID NO: 713989 - DNA, 13 bp, C. elegans
ctcattttcaaat

SEQ ID NO: 713990 - DNA, 13 bp, C. elegans
ctcattttcagct

SEQ ID NO: 713991 - DNA, 13 bp, C. elegans
ctcattttcagtt

SEQ ID NO: 713992 - DNA, 13 bp, C. elegans
ctcattttgaaaa

SEQ ID NO: 713993 - DNA, 13 bp, C. elegans
ctcattttgcaaa

SEQ ID NO: 713994 - DNA, 13 bp, C. elegans
ctcattttgctct

SEQ ID NO: 713995 - DNA, 13 bp, C. elegans
ctcattttggagg

SEQ ID NO: 713996 - DNA, 13 bp, C. elegans
ctcatttttcacc

SEQ ID NO: 713997 - DNA, 13 bp, C. elegans
ctcatttttgaat

SEQ ID NO: 713998 - DNA, 13 bp, C. elegans
ctcatttttgttc

SEQ ID NO: 713999 - DNA, 13 bp, C. elegans
ctcattttttcca

SEQ ID NO: 714000 - DNA, 13 bp, C. elegans
ctcattttttcgc

SEQ ID NO: 714001 - DNA, 13 bp, C. elegans
ctcattttttctg

SEQ ID NO: 714002 - DNA, 13 bp, C. elegans
ctccaaaaaacat

SEQ ID NO: 714003 - DNA, 13 bp, C. elegans
ctccaaaaaaccg

SEQ ID NO: 714004 - DNA, 13 bp, C. elegans
ctccaaaaatatt

SEQ ID NO: 714005 - DNA, 13 bp, C. elegans
ctccaaaaattgc

SEQ ID NO: 714006 - DNA, 13 bp, C. elegans
ctccaaaaattgt

SEQ ID NO: 714007 - DNA, 13 bp, C. elegans
ctccaaaactctc

SEQ ID NO: 714008 - DNA, 13 bp, C. elegans
ctccaaaagaaca

SEQ ID NO: 714009 - DNA, 13 bp, C. elegans
ctccaaaatattt

SEQ ID NO: 714010 - DNA, 13 bp, C. elegans
ctccaaaccaata

SEQ ID NO: 714011 - DNA, 13 bp, C. elegans
ctccaaaccgcca

SEQ ID NO: 714012 - DNA, 13 bp, C. elegans
ctccaaaggttga

SEQ ID NO: 714013 - DNA, 13 bp, C. elegans
ctccaaagtcaaa

SEQ ID NO: 714014 - DNA, 13 bp, C. elegans
ctccaaatgaacc

SEQ ID NO: 714015 - DNA, 13 bp, C. elegans
ctccaaattttcc

SEQ ID NO: 714016 - DNA, 13 bp, C. elegans
ctccaaattttct

SEQ ID NO: 714017 - DNA, 13 bp, C. elegans
ctccaacaatttt

SEQ ID NO: 714018 - DNA, 13 bp, C. elegans
ctccaatatttta

SEQ ID NO: 714019 - DNA, 13 bp, C. elegans
ctccaatgaagca

SEQ ID NO: 714020 - DNA, 13 bp, C. elegans
ctccaattttcag

SEQ ID NO: 714021 - DNA, 13 bp, C. elegans
ctccaattttggt

SEQ ID NO: 714022 - DNA, 13 bp, C. elegans
ctccaattttgtt

SEQ ID NO: 714023 - DNA, 13 bp, C. elegans
ctccaatttttca

SEQ ID NO: 714024 - DNA, 13 bp, C. elegans
ctccacactctct

SEQ ID NO: 714025 - DNA, 13 bp, C. elegans
ctccaccagacac

SEQ ID NO: 714026 - DNA, 14 bp, C. elegans
ctccaccagcttca

SEQ ID NO: 714027 - DNA, 13 bp, C. elegans
ctccacccatttc

SEQ ID NO: 714028 - DNA, 13 bp, C. elegans
ctccaccttcaat

SEQ ID NO: 714029 - DNA, 13 bp, C. elegans
ctccacgaggagt

SEQ ID NO: 714030 - DNA, 14 bp, C. elegans
ctccacgtggacaa

SEQ ID NO: 714031 - DNA, 13 bp, C. elegans
ctccacttttaaa

SEQ ID NO: 714032 - DNA, 13 bp, C. elegans
ctccacttttaat

SEQ ID NO: 714033 - DNA, 17 bp, C. elegans
ctccagaaccaagctca

SEQ ID NO: 714034 - DNA, 13 bp, C. elegans
ctccagttaagga

SEQ ID NO: 714035 - DNA, 13 bp, C. elegans
ctccatcttcaaa

SEQ ID NO: 714036 - DNA, 13 bp, C. elegans
ctccattgataat

SEQ ID NO: 714037 - DNA, 13 bp, C. elegans
ctccattgatctg

SEQ ID NO: 714038 - DNA, 13 bp, C. elegans
ctccattttctca

SEQ ID NO: 714039 - DNA, 13 bp, C. elegans
ctcccaaaattcc

SEQ ID NO: 714040 - DNA, 13 bp, C. elegans
ctcccaatttttc

SEQ ID NO: 714041 - DNA, 13 bp, C. elegans
ctcccagaaaaat

SEQ ID NO: 714042 - DNA, 13 bp, C. elegans
ctcccgcactttt

SEQ ID NO: 714043 - DNA, 13 bp, C. elegans
ctcccgccaaaaa

SEQ ID NO: 714044 - DNA, 22 bp, C. elegans
ctccctattagacttgcactcc

SEQ ID NO: 714045 - DNA, 13 bp, C. elegans
ctccgaaaaatga

SEQ ID NO: 714046 - DNA, 13 bp, C. elegans
ctccgaaaaatgc

SEQ ID NO: 714047 - DNA, 13 bp, C. elegans
ctccgaaattccg

SEQ ID NO: 714048 - DNA, 13 bp, C. elegans
ctccgaattccta

SEQ ID NO: 714049 - DNA, 13 bp, C. elegans
ctccgagatattt

SEQ ID NO: 714050 - DNA, 13 bp, C. elegans
ctccgatattccg

SEQ ID NO: 714051 - DNA, 13 bp, C. elegans
ctccgcccacaaa

SEQ ID NO: 714052 - DNA, 14 bp, C. elegans
ctccgcccactttc

SEQ ID NO: 714053 - DNA, 13 bp, C. elegans
ctccgcccatttc

SEQ ID NO: 714054 - DNA, 13 bp, C. elegans
ctccgcccatttg

SEQ ID NO: 714055 - DNA, 13 bp, C. elegans
ctccgcccccaaa

SEQ ID NO: 714056 - DNA, 13 bp, C. elegans
ctccgcccccaat

SEQ ID NO: 714057 - DNA, 13 bp, C. elegans
ctcctgcattttt

SEQ ID NO: 714058 - DNA, 13 bp, C. elegans
ctcctgctctcag

SEQ ID NO: 714059 - DNA, 13 bp, C. elegans
ctccttctttaaa

SEQ ID NO: 714060 - DNA, 13 bp, C. elegans
ctcgaaaaagaaa

SEQ ID NO: 714061 - DNA, 13 bp, C. elegans
ctcgaaaataaat

SEQ ID NO: 714062 - DNA, 13 bp, C. elegans
ctcgaaaatcgaa

SEQ ID NO: 714063 - DNA, 13 bp, C. elegans
ctcgaaaatctca

SEQ ID NO: 714064 - DNA, 13 bp, C. elegans
ctcgaaaatgttt

SEQ ID NO: 714065 - DNA, 13 bp, C. elegans
ctcgaaaatttcc

SEQ ID NO: 714066 - DNA, 13 bp, C. elegans
ctcgaaaatttga

SEQ ID NO: 714067 - DNA, 13 bp, C. elegans
ctcgaaacgaaaa

SEQ ID NO: 714068 - DNA, 13 bp, C. elegans
ctcgaattttcag

SEQ ID NO: 714069 - DNA, 13 bp, C. elegans
ctcgaattttcca

SEQ ID NO: 714070 - DNA, 13 bp, C. elegans
ctcgacaactcat

SEQ ID NO: 714071 - DNA, 13 bp, C. elegans
ctcgaccaacaaa

SEQ ID NO: 714072 - DNA, 30 bp, C. elegans
ctcgacgacgtcgacgagtacatctacctc

SEQ ID NO: 714073 - DNA, 13 bp, C. elegans
ctcgagaaaattc

SEQ ID NO: 714074 - DNA, 13 bp, C. elegans
ctcgagaagtaca

SEQ ID NO: 714075 - DNA, 13 bp, C. elegans
ctcgaggagaagt

SEQ ID NO: 714076 - DNA, 13 bp, C. elegans
ctcgattttcgaa

SEQ ID NO: 714077 - DNA, 13 bp, C. elegans
ctcgattttttga

SEQ ID NO: 714078 - DNA, 13 bp, C. elegans
ctcgatttttttg

SEQ ID NO: 714079 - DNA, 13 bp, C. elegans
ctcgccgcgattt

SEQ ID NO: 714080 - DNA, 13 bp, C. elegans
ctcgctcgacaac

SEQ ID NO: 714081 - DNA, 13 bp, C. elegans
ctcgctctattga

SEQ ID NO: 714082 - DNA, 13 bp, C. elegans
ctcgctgattggt

SEQ ID NO: 714083 - DNA, 13 bp, C. elegans
ctcgctgtctgcg

SEQ ID NO: 714084 - DNA, 13 bp, C. elegans
ctcggaaaatgga

SEQ ID NO: 714085 - DNA, 13 bp, C. elegans
ctcggaaattttg

SEQ ID NO: 714086 - DNA, 13 bp, C. elegans
ctcggcatttggc

SEQ ID NO: 714087 - DNA, 13 bp, C. elegans
ctcggccacggcc

SEQ ID NO: 714088 - DNA, 13 bp, C. elegans
ctcggcgtttgcc

SEQ ID NO: 714089 - DNA, 18 bp, C. elegans
ctcggcgtttgccgccag

SEQ ID NO: 714090 - DNA, 13 bp, C. elegans
ctcggttcatttt

SEQ ID NO: 714091 - DNA, 13 bp, C. elegans
ctcgtaatttttt

SEQ ID NO: 714092 - DNA, 13 bp, C. elegans
ctcgtcgagagct

SEQ ID NO: 714093 - DNA, 13 bp, C. elegans
ctcgtgagcccgt

SEQ ID NO: 714094 - DNA, 13 bp, C. elegans
ctcgttgaaaaaa

SEQ ID NO: 714095 - DNA, 13 bp, C. elegans
ctcgttgtctgcg

SEQ ID NO: 714096 - DNA, 13 bp, C. elegans
ctcgtttttaaaa

SEQ ID NO: 714097 - DNA, 13 bp, C. elegans
ctcgttttttgaa

SEQ ID NO: 714098 - DNA, 13 bp, C. elegans
ctctaaaaaccaa

SEQ ID NO: 714099 - DNA, 13 bp, C. elegans
ctctaaaaacttc

SEQ ID NO: 714100 - DNA, 13 bp, C. elegans
ctctaaaaacttt

SEQ ID NO: 714101 - DNA, 13 bp, C. elegans
ctctaaaaatgaa

SEQ ID NO: 714102 - DNA, 13 bp, C. elegans
ctctaaaattgtc

SEQ ID NO: 714103 - DNA, 13 bp, C. elegans
ctctaaactctct

SEQ ID NO: 714104 - DNA, 13 bp, C. elegans
ctctaaatctctc

SEQ ID NO: 714105 - DNA, 13 bp, C. elegans
ctctaataattat

SEQ ID NO: 714106 - DNA, 13 bp, C. elegans
ctctaatatttca

SEQ ID NO: 714107 - DNA, 13 bp, C. elegans
ctctaatgttctg

SEQ ID NO: 714108 - DNA, 13 bp, C. elegans
ctctaattggttg

SEQ ID NO: 714109 - DNA, 13 bp, C. elegans
ctctaattttctg

SEQ ID NO: 714110 - DNA, 13 bp, C. elegans
ctctaattttgaa

SEQ ID NO: 714111 - DNA, 13 bp, C. elegans
ctctacaatgttt

SEQ ID NO: 714112 - DNA, 13 bp, C. elegans
ctctacacttctc

SEQ ID NO: 714113 - DNA, 13 bp, C. elegans
ctctactttgaca

SEQ ID NO: 714114 - DNA, 13 bp, C. elegans
ctctagttgtcat

SEQ ID NO: 714115 - DNA, 13 bp, C. elegans
ctctattagactt

SEQ ID NO: 714116 - DNA, 13 bp, C. elegans
ctctattggattc

SEQ ID NO: 714117 - DNA, 13 bp, C. elegans
ctctattgtcaaa

SEQ ID NO: 714118 - DNA, 13 bp, C. elegans
ctctatttctctg

SEQ ID NO: 714119 - DNA, 13 bp, C. elegans
ctctattttccag

SEQ ID NO: 714120 - DNA, 13 bp, C. elegans
ctctatttttgtg

SEQ ID NO: 714121 - DNA, 13 bp, C. elegans
ctctcaaatattt

SEQ ID NO: 714122 - DNA, 13 bp, C. elegans
ctctcaactttaa

SEQ ID NO: 714123 - DNA, 13 bp, C. elegans
ctctcaatctctc

SEQ ID NO: 714124 - DNA, 13 bp, C. elegans
ctctcactgtctg

SEQ ID NO: 714125 - DNA, 13 bp, C. elegans
ctctcagtgagct

SEQ ID NO: 714126 - DNA, 13 bp, C. elegans
ctctcagttttca

SEQ ID NO: 714127 - DNA, 13 bp, C. elegans
ctctcattactca

SEQ ID NO: 714128 - DNA, 13 bp, C. elegans
ctctcattcattt

SEQ ID NO: 714129 - DNA, 13 bp, C. elegans
ctctcatttttca

SEQ ID NO: 714130 - DNA, 13 bp, C. elegans
ctctccaaaaaat

SEQ ID NO: 714131 - DNA, 13 bp, C. elegans
ctctccaatcaaa

SEQ ID NO: 714132 - DNA, 13 bp, C. elegans
ctctcgaaaaaag

SEQ ID NO: 714133 - DNA, 14 bp, C. elegans
ctctcgattcgagc

SEQ ID NO: 714134 - DNA, 13 bp, C. elegans
ctctcggcgagct

SEQ ID NO: 714135 - DNA, 13 bp, C. elegans
ctctcgtaaatcg

SEQ ID NO: 714136 - DNA, 13 bp, C. elegans
ctctctcaatttt

SEQ ID NO: 714137 - DNA, 13 bp, C. elegans
ctctctctctcag

SEQ ID NO: 714138 - DNA, 13 bp, C. elegans
ctctctctctgtg

SEQ ID NO: 714139 - DNA, 13 bp, C. elegans
ctctctggtttca

SEQ ID NO: 714140 - DNA, 13 bp, C. elegans
ctctcttataata

SEQ ID NO: 714141 - DNA, 13 bp, C. elegans
ctctgaaaaaagt

SEQ ID NO: 714142 - DNA, 13 bp, C. elegans
ctctgaaaattcc

SEQ ID NO: 714143 - DNA, 13 bp, C. elegans
ctctgaaaattct

SEQ ID NO: 714144 - DNA, 13 bp, C. elegans
ctctgaaactaaa

SEQ ID NO: 714145 - DNA, 13 bp, C. elegans
ctctgaaataaaa

SEQ ID NO: 714146 - DNA, 13 bp, C. elegans
ctctgaaattcaa

SEQ ID NO: 714147 - DNA, 13 bp, C. elegans
ctctgaaattctt

SEQ ID NO: 714148 - DNA, 13 bp, C. elegans
ctctgaaatttcc

SEQ ID NO: 714149 - DNA, 13 bp, C. elegans
ctctgaacaataa

SEQ ID NO: 714150 - DNA, 13 bp, C. elegans
ctctgaatttcaa

SEQ ID NO: 714151 - DNA, 13 bp, C. elegans
ctctgacaccaag

SEQ ID NO: 714152 - DNA, 13 bp, C. elegans
ctctgatttttct

SEQ ID NO: 714153 - DNA, 13 bp, C. elegans
ctctgccatttca

SEQ ID NO: 714154 - DNA, 13 bp, C. elegans
ctctgcgcctcca

SEQ ID NO: 714155 - DNA, 13 bp, C. elegans
ctctgcgtctctc

SEQ ID NO: 714156 - DNA, 13 bp, C. elegans
ctctgcgtctctt

SEQ ID NO: 714157 - DNA, 13 bp, C. elegans
ctctggaatgttc

SEQ ID NO: 714158 - DNA, 13 bp, C. elegans
ctctggcgccaac

SEQ ID NO: 714159 - DNA, 13 bp, C. elegans
ctctgtcattttt

SEQ ID NO: 714160 - DNA, 13 bp, C. elegans
ctcttaaaattaa

SEQ ID NO: 714161 - DNA, 13 bp, C. elegans
ctcttacaattag

SEQ ID NO: 714162 - DNA, 13 bp, C. elegans
ctcttacagactt

SEQ ID NO: 714163 - DNA, 13 bp, C. elegans
ctcttcaaaactt

SEQ ID NO: 714164 - DNA, 13 bp, C. elegans
ctcttcaaaagac

SEQ ID NO: 714165 - DNA, 13 bp, C. elegans
ctcttcaaaagtt

SEQ ID NO: 714166 - DNA, 13 bp, C. elegans
ctcttcaaaattt

SEQ ID NO: 714167 - DNA, 13 bp, C. elegans
ctcttcaactttt

SEQ ID NO: 714168 - DNA, 13 bp, C. elegans
ctcttcaatttct

SEQ ID NO: 714169 - DNA, 13 bp, C. elegans
ctcttccacggcc

SEQ ID NO: 714170 - DNA, 13 bp, C. elegans
ctcttccaggatt

SEQ ID NO: 714171 - DNA, 13 bp, C. elegans
ctcttcccacaaa

SEQ ID NO: 714172 - DNA, 13 bp, C. elegans
ctcttcgtccatc

SEQ ID NO: 714173 - DNA, 13 bp, C. elegans
ctcttcttctcaa

SEQ ID NO: 714174 - DNA, 13 bp, C. elegans
ctctttaaatgac

SEQ ID NO: 714175 - DNA, 13 bp, C. elegans
ctctttcacaaat

SEQ ID NO: 714176 - DNA, 13 bp, C. elegans
ctctttctgaata

SEQ ID NO: 714177 - DNA, 13 bp, C. elegans
ctctttggcttca

SEQ ID NO: 714178 - DNA, 13 bp, C. elegans
ctcttttaaaaat

SEQ ID NO: 714179 - DNA, 13 bp, C. elegans
ctcttttcccgca

SEQ ID NO: 714180 - DNA, 13 bp, C. elegans
ctctttttccaat

SEQ ID NO: 714181 - DNA, 13 bp, C. elegans
ctctttttctcaa

SEQ ID NO: 714182 - DNA, 13 bp, C. elegans
ctcttttttgcat

SEQ ID NO: 714183 - DNA, 13 bp, C. elegans
ctctttttttcga

SEQ ID NO: 714184 - DNA, 13 bp, C. elegans
ctctttttttgca

SEQ ID NO: 714185 - DNA, 13 bp, C. elegans
ctgaaaaaaaacc

SEQ ID NO: 714186 - DNA, 13 bp, C. elegans
ctgaaaaaaaccc

SEQ ID NO: 714187 - DNA, 13 bp, C. elegans
ctgaaaaaaactg

SEQ ID NO: 714188 - DNA, 13 bp, C. elegans
ctgaaaaaacaat

SEQ ID NO: 714189 - DNA, 13 bp, C. elegans
ctgaaaaaagaag

SEQ ID NO: 714190 - DNA, 13 bp, C. elegans
ctgaaaaaagtaa

SEQ ID NO: 714191 - DNA, 13 bp, C. elegans
ctgaaaaaagtcg

SEQ ID NO: 714192 - DNA, 13 bp, C. elegans
ctgaaaaaatatg

SEQ ID NO: 714193 - DNA, 13 bp, C. elegans
ctgaaaaaatccg

SEQ ID NO: 714194 - DNA, 13 bp, C. elegans
ctgaaaaaatgca

SEQ ID NO: 714195 - DNA, 13 bp, C. elegans
ctgaaaaaatgga

SEQ ID NO: 714196 - DNA, 13 bp, C. elegans
ctgaaaaaattac

SEQ ID NO: 714197 - DNA, 13 bp, C. elegans
ctgaaaaaatttg

SEQ ID NO: 714198 - DNA, 13 bp, C. elegans
ctgaaaaacaaat

SEQ ID NO: 714199 - DNA, 13 bp, C. elegans
ctgaaaaacacga

SEQ ID NO: 714200 - DNA, 13 bp, C. elegans
ctgaaaaacagtt

SEQ ID NO: 714201 - DNA, 13 bp, C. elegans
ctgaaaaacatga

SEQ ID NO: 714202 - DNA, 13 bp, C. elegans
ctgaaaaacattg

SEQ ID NO: 714203 - DNA, 13 bp, C. elegans
ctgaaaaacgacc

SEQ ID NO: 714204 - DNA, 13 bp, C. elegans
ctgaaaaacgttt

SEQ ID NO: 714205 - DNA, 13 bp, C. elegans
ctgaaaaactgca

SEQ ID NO: 714206 - DNA, 13 bp, C. elegans
ctgaaaaactgta

SEQ ID NO: 714207 - DNA, 13 bp, C. elegans
ctgaaaaagaaac

SEQ ID NO: 714208 - DNA, 13 bp, C. elegans
ctgaaaaaggaat

SEQ ID NO: 714209 - DNA, 13 bp, C. elegans
ctgaaaaagtcaa

SEQ ID NO: 714210 - DNA, 13 bp, C. elegans
ctgaaaaagtgaa

SEQ ID NO: 714211 - DNA, 13 bp, C. elegans
ctgaaaaagttga

SEQ ID NO: 714212 - DNA, 13 bp, C. elegans
ctgaaaaagttgt

SEQ ID NO: 714213 - DNA, 13 bp, C. elegans
ctgaaaaagtttc

SEQ ID NO: 714214 - DNA, 13 bp, C. elegans
ctgaaaaagtttt

SEQ ID NO: 714215 - DNA, 13 bp, C. elegans
ctgaaaaataacg

SEQ ID NO: 714216 - DNA, 13 bp, C. elegans
ctgaaaaatactt

SEQ ID NO: 714217 - DNA, 13 bp, C. elegans
ctgaaaaatataa

SEQ ID NO: 714218 - DNA, 13 bp, C. elegans
ctgaaaaatatga

SEQ ID NO: 714219 - DNA, 13 bp, C. elegans
ctgaaaaatattc

SEQ ID NO: 714220 - DNA, 13 bp, C. elegans
ctgaaaaatcaaa

SEQ ID NO: 714221 - DNA, 13 bp, C. elegans
ctgaaaaatcgaa

SEQ ID NO: 714222 - DNA, 13 bp, C. elegans
ctgaaaaatcgtt

SEQ ID NO: 714223 - DNA, 13 bp, C. elegans
ctgaaaaatctca

SEQ ID NO: 714224 - DNA, 13 bp, C. elegans
ctgaaaaatgcaa

SEQ ID NO: 714225 - DNA, 13 bp, C. elegans
ctgaaaaatgcta

SEQ ID NO: 714226 - DNA, 13 bp, C. elegans
ctgaaaaatgtga

SEQ ID NO: 714227 - DNA, 13 bp, C. elegans
ctgaaaaattact

SEQ ID NO: 714228 - DNA, 13 bp, C. elegans
ctgaaaaattcga

SEQ ID NO: 714229 - DNA, 13 bp, C. elegans
ctgaaaaatttaa

SEQ ID NO: 714230 - DNA, 13 bp, C. elegans
ctgaaaaatttga

SEQ ID NO: 714231 - DNA, 13 bp, C. elegans
ctgaaaacaaaac

SEQ ID NO: 714232 - DNA, 13 bp, C. elegans
ctgaaaacaaatt

SEQ ID NO: 714233 - DNA, 13 bp, C. elegans
ctgaaaacaatat

SEQ ID NO: 714234 - DNA, 13 bp, C. elegans
ctgaaaacaccga

SEQ ID NO: 714235 - DNA, 13 bp, C. elegans
ctgaaaacattat

SEQ ID NO: 714236 - DNA, 13 bp, C. elegans
ctgaaaaccattt

SEQ ID NO: 714237 - DNA, 13 bp, C. elegans
ctgaaaacccaaa

SEQ ID NO: 714238 - DNA, 13 bp, C. elegans
ctgaaaacccaat

SEQ ID NO: 714239 - DNA, 13 bp, C. elegans
ctgaaaaccttaa

SEQ ID NO: 714240 - DNA, 13 bp, C. elegans
ctgaaaacgaaat

SEQ ID NO: 714241 - DNA, 13 bp, C. elegans
ctgaaaacgcaaa

SEQ ID NO: 714242 - DNA, 13 bp, C. elegans
ctgaaaacgtctg

SEQ ID NO: 714243 - DNA, 13 bp, C. elegans
ctgaaaactaatt

SEQ ID NO: 714244 - DNA, 13 bp, C. elegans
ctgaaaactcaaa

SEQ ID NO: 714245 - DNA, 13 bp, C. elegans
ctgaaaactgaaa

SEQ ID NO: 714246 - DNA, 13 bp, C. elegans
ctgaaaacttgtt

SEQ ID NO: 714247 - DNA, 13 bp, C. elegans
ctgaaaacttttc

SEQ ID NO: 714248 - DNA, 13 bp, C. elegans
ctgaaaacttttg

SEQ ID NO: 714249 - DNA, 13 bp, C. elegans
ctgaaaacttttt

SEQ ID NO: 714250 - DNA, 13 bp, C. elegans
ctgaaaagatttt

SEQ ID NO: 714251 - DNA, 13 bp, C. elegans
ctgaaaagcgaaa

SEQ ID NO: 714252 - DNA, 13 bp, C. elegans
ctgaaaagctgaa

SEQ ID NO: 714253 - DNA, 13 bp, C. elegans
ctgaaaagcttta

SEQ ID NO: 714254 - DNA, 13 bp, C. elegans
ctgaaaaggaaaa

SEQ ID NO: 714255 - DNA, 13 bp, C. elegans
ctgaaaagtgttt

SEQ ID NO: 714256 - DNA, 13 bp, C. elegans
ctgaaaagttcaa

SEQ ID NO: 714257 - DNA, 14 bp, C. elegans
ctgaaaagttttca

SEQ ID NO: 714258 - DNA, 13 bp, C. elegans
ctgaaaataaaac

SEQ ID NO: 714259 - DNA, 13 bp, C. elegans
ctgaaaataaaat

SEQ ID NO: 714260 - DNA, 13 bp, C. elegans
ctgaaaataaatt

SEQ ID NO: 714261 - DNA, 13 bp, C. elegans
ctgaaaataagaa

SEQ ID NO: 714262 - DNA, 13 bp, C. elegans
ctgaaaataataa

SEQ ID NO: 714263 - DNA, 13 bp, C. elegans
ctgaaaataattc

SEQ ID NO: 714264 - DNA, 13 bp, C. elegans
ctgaaaatacaaa

SEQ ID NO: 714265 - DNA, 13 bp, C. elegans
ctgaaaatataaa

SEQ ID NO: 714266 - DNA, 13 bp, C. elegans
ctgaaaatatagt

SEQ ID NO: 714267 - DNA, 13 bp, C. elegans
ctgaaaatatata

SEQ ID NO: 714268 - DNA, 13 bp, C. elegans
ctgaaaatatatt

SEQ ID NO: 714269 - DNA, 13 bp, C. elegans
ctgaaaatatcaa

SEQ ID NO: 714270 - DNA, 13 bp, C. elegans
ctgaaaatatcga

SEQ ID NO: 714271 - DNA, 13 bp, C. elegans
ctgaaaatatgca

SEQ ID NO: 714272 - DNA, 13 bp, C. elegans
ctgaaaatatggt

SEQ ID NO: 714273 - DNA, 13 bp, C. elegans
ctgaaaatattat

SEQ ID NO: 714274 - DNA, 13 bp, C. elegans
ctgaaaatattca

SEQ ID NO: 714275 - DNA, 13 bp, C. elegans
ctgaaaatcaaat

SEQ ID NO: 714276 - DNA, 13 bp, C. elegans
ctgaaaatcaaca

SEQ ID NO: 714277 - DNA, 13 bp, C. elegans
ctgaaaatcaact

SEQ ID NO: 714278 - DNA, 13 bp, C. elegans
ctgaaaatcaatt

SEQ ID NO: 714279 - DNA, 13 bp, C. elegans
ctgaaaatcataa

SEQ ID NO: 714280 - DNA, 13 bp, C. elegans
ctgaaaatcattc

SEQ ID NO: 714281 - DNA, 13 bp, C. elegans
ctgaaaatcattt

SEQ ID NO: 714282 - DNA, 13 bp, C. elegans
ctgaaaatccaat

SEQ ID NO: 714283 - DNA, 13 bp, C. elegans
ctgaaaatcgaat

SEQ ID NO: 714284 - DNA, 13 bp, C. elegans
ctgaaaatcttga

SEQ ID NO: 714285 - DNA, 13 bp, C. elegans
ctgaaaatgaaat

SEQ ID NO: 714286 - DNA, 13 bp, C. elegans
ctgaaaatgaata

SEQ ID NO: 714287 - DNA, 13 bp, C. elegans
ctgaaaatgaatt

SEQ ID NO: 714288 - DNA, 13 bp, C. elegans
ctgaaaatgactt

SEQ ID NO: 714289 - DNA, 13 bp, C. elegans
ctgaaaatgagaa

SEQ ID NO: 714290 - DNA, 13 bp, C. elegans
ctgaaaatgataa

SEQ ID NO: 714291 - DNA, 13 bp, C. elegans
ctgaaaatgatgg

SEQ ID NO: 714292 - DNA, 13 bp, C. elegans
ctgaaaatgcaaa

SEQ ID NO: 714293 - DNA, 13 bp, C. elegans
ctgaaaatgcgta

SEQ ID NO: 714294 - DNA, 13 bp, C. elegans
ctgaaaatggaaa

SEQ ID NO: 714295 - DNA, 13 bp, C. elegans
ctgaaaatggaat

SEQ ID NO: 714296 - DNA, 13 bp, C. elegans
ctgaaaatggcag

SEQ ID NO: 714297 - DNA, 13 bp, C. elegans
ctgaaaatgggat

SEQ ID NO: 714298 - DNA, 13 bp, C. elegans
ctgaaaatgtaga

SEQ ID NO: 714299 - DNA, 13 bp, C. elegans
ctgaaaatgtatt

SEQ ID NO: 714300 - DNA, 13 bp, C. elegans
ctgaaaatgtgaa

SEQ ID NO: 714301 - DNA, 13 bp, C. elegans
ctgaaaatgttag

SEQ ID NO: 714302 - DNA, 13 bp, C. elegans
ctgaaaatgttta

SEQ ID NO: 714303 - DNA, 13 bp, C. elegans
ctgaaaatgtttc

SEQ ID NO: 714304 - DNA, 13 bp, C. elegans
ctgaaaatgtttt

SEQ ID NO: 714305 - DNA, 13 bp, C. elegans
ctgaaaattaaat

SEQ ID NO: 714306 - DNA, 13 bp, C. elegans
ctgaaaattaggt

SEQ ID NO: 714307 - DNA, 13 bp, C. elegans
ctgaaaattatac

SEQ ID NO: 714308 - DNA, 13 bp, C. elegans
ctgaaaattattt

SEQ ID NO: 714309 - DNA, 13 bp, C. elegans
ctgaaaattcagt

SEQ ID NO: 714310 - DNA, 13 bp, C. elegans
ctgaaaattcgtt

SEQ ID NO: 714311 - DNA, 13 bp, C. elegans
ctgaaaattctta

SEQ ID NO: 714312 - DNA, 13 bp, C. elegans
ctgaaaattcttt

SEQ ID NO: 714313 - DNA, 13 bp, C. elegans
ctgaaaattgaaa

SEQ ID NO: 714314 - DNA, 13 bp, C. elegans
ctgaaaattgaat

SEQ ID NO: 714315 - DNA, 13 bp, C. elegans
ctgaaaattgtga

SEQ ID NO: 714316 - DNA, 13 bp, C. elegans
ctgaaaatttaat

SEQ ID NO: 714317 - DNA, 13 bp, C. elegans
ctgaaaatttagt

SEQ ID NO: 714318 - DNA, 13 bp, C. elegans
ctgaaaatttctc

SEQ ID NO: 714319 - DNA, 13 bp, C. elegans
ctgaaaatttgaa

SEQ ID NO: 714320 - DNA, 13 bp, C. elegans
ctgaaaatttgga

SEQ ID NO: 714321 - DNA, 13 bp, C. elegans
ctgaaaatttgtc

SEQ ID NO: 714322 - DNA, 13 bp, C. elegans
ctgaaaatttgtg

SEQ ID NO: 714323 - DNA, 13 bp, C. elegans
ctgaaaattttaa

SEQ ID NO: 714324 - DNA, 13 bp, C. elegans
ctgaaaattttct

SEQ ID NO: 714325 - DNA, 13 bp, C. elegans
ctgaaaattttga

SEQ ID NO: 714326 - DNA, 13 bp, C. elegans
ctgaaaattttgg

SEQ ID NO: 714327 - DNA, 13 bp, C. elegans
ctgaaaattttgt

SEQ ID NO: 714328 - DNA, 13 bp, C. elegans
ctgaaaattttta

SEQ ID NO: 714329 - DNA, 13 bp, C. elegans
ctgaaaatttttc

SEQ ID NO: 714330 - DNA, 13 bp, C. elegans
ctgaaacaaaagt

SEQ ID NO: 714331 - DNA, 13 bp, C. elegans
ctgaaacaaaatt

SEQ ID NO: 714332 - DNA, 13 bp, C. elegans
ctgaaacaatcaa

SEQ ID NO: 714333 - DNA, 13 bp, C. elegans
ctgaaacagagaa

SEQ ID NO: 714334 - DNA, 13 bp, C. elegans
ctgaaacaggaaa

SEQ ID NO: 714335 - DNA, 13 bp, C. elegans
ctgaaacagtaaa

SEQ ID NO: 714336 - DNA, 13 bp, C. elegans
ctgaaacagtgat

SEQ ID NO: 714337 - DNA, 13 bp, C. elegans
ctgaaacataatt

SEQ ID NO: 714338 - DNA, 13 bp, C. elegans
ctgaaacatgcaa

SEQ ID NO: 714339 - DNA, 13 bp, C. elegans
ctgaaacatttaa

SEQ ID NO: 714340 - DNA, 13 bp, C. elegans
ctgaaacattttt

SEQ ID NO: 714341 - DNA, 13 bp, C. elegans
ctgaaacctgaaa

SEQ ID NO: 714342 - DNA, 13 bp, C. elegans
ctgaaactaaaaa

SEQ ID NO: 714343 - DNA, 13 bp, C. elegans
ctgaaactgaatt

SEQ ID NO: 714344 - DNA, 13 bp, C. elegans
ctgaaactgataa

SEQ ID NO: 714345 - DNA, 13 bp, C. elegans
ctgaaactgtaaa

SEQ ID NO: 714346 - DNA, 13 bp, C. elegans
ctgaaactgtttt

SEQ ID NO: 714347 - DNA, 13 bp, C. elegans
ctgaaacttgaaa

SEQ ID NO: 714348 - DNA, 13 bp, C. elegans
ctgaaacttgtcg

SEQ ID NO: 714349 - DNA, 13 bp, C. elegans
ctgaaacttttta

SEQ ID NO: 714350 - DNA, 13 bp, C. elegans
ctgaaactttttg

SEQ ID NO: 714351 - DNA, 13 bp, C. elegans
ctgaaactttttt

SEQ ID NO: 714352 - DNA, 13 bp, C. elegans
ctgaaagaaaata

SEQ ID NO: 714353 - DNA, 13 bp, C. elegans
ctgaaagaaaatt

SEQ ID NO: 714354 - DNA, 13 bp, C. elegans
ctgaaagcttgaa

SEQ ID NO: 714355 - DNA, 13 bp, C. elegans
ctgaaagtacctg

SEQ ID NO: 714356 - DNA, 13 bp, C. elegans
ctgaaagtataaa

SEQ ID NO: 714357 - DNA, 13 bp, C. elegans
ctgaaagtcaaat

SEQ ID NO: 714358 - DNA, 13 bp, C. elegans
ctgaaagttcaaa

SEQ ID NO: 714359 - DNA, 13 bp, C. elegans
ctgaaagttcaat

SEQ ID NO: 714360 - DNA, 13 bp, C. elegans
ctgaaagttccaa

SEQ ID NO: 714361 - DNA, 13 bp, C. elegans
ctgaaagttttat

SEQ ID NO: 714362 - DNA, 13 bp, C. elegans
ctgaaataaaaca

SEQ ID NO: 714363 - DNA, 13 bp, C. elegans
ctgaaataaacaa

SEQ ID NO: 714364 - DNA, 13 bp, C. elegans
ctgaaataaagaa

SEQ ID NO: 714365 - DNA, 13 bp, C. elegans
ctgaaataaatga

SEQ ID NO: 714366 - DNA, 13 bp, C. elegans
ctgaaataaattc

SEQ ID NO: 714367 - DNA, 13 bp, C. elegans
ctgaaataatcta

SEQ ID NO: 714368 - DNA, 13 bp, C. elegans
ctgaaataatttc

SEQ ID NO: 714369 - DNA, 13 bp, C. elegans
ctgaaatactgaa

SEQ ID NO: 714370 - DNA, 13 bp, C. elegans
ctgaaatatgaat

SEQ ID NO: 714371 - DNA, 13 bp, C. elegans
ctgaaatattaat

SEQ ID NO: 714372 - DNA, 13 bp, C. elegans
ctgaaatattgtt

SEQ ID NO: 714373 - DNA, 13 bp, C. elegans
ctgaaatatttca

SEQ ID NO: 714374 - DNA, 13 bp, C. elegans
ctgaaatatttcc

SEQ ID NO: 714375 - DNA, 13 bp, C. elegans
ctgaaatatttga

SEQ ID NO: 714376 - DNA, 13 bp, C. elegans
ctgaaatatttta

SEQ ID NO: 714377 - DNA, 13 bp, C. elegans
ctgaaatattttc

SEQ ID NO: 714378 - DNA, 13 bp, C. elegans
ctgaaatcattat

SEQ ID NO: 714379 - DNA, 13 bp, C. elegans
ctgaaatctaaaa

SEQ ID NO: 714380 - DNA, 13 bp, C. elegans
ctgaaatctccaa

SEQ ID NO: 714381 - DNA, 13 bp, C. elegans
ctgaaatctgaaa

SEQ ID NO: 714382 - DNA, 13 bp, C. elegans
ctgaaatctttga

SEQ ID NO: 714383 - DNA, 13 bp, C. elegans
ctgaaatgaaatt

SEQ ID NO: 714384 - DNA, 13 bp, C. elegans
ctgaaatgtaaaa

SEQ ID NO: 714385 - DNA, 13 bp, C. elegans
ctgaaatgttcta

SEQ ID NO: 714386 - DNA, 13 bp, C. elegans
ctgaaatgttgtt

SEQ ID NO: 714387 - DNA, 13 bp, C. elegans
ctgaaatgtttaa

SEQ ID NO: 714388 - DNA, 13 bp, C. elegans
ctgaaattaaaaa

SEQ ID NO: 714389 - DNA, 13 bp, C. elegans
ctgaaattaaaat

SEQ ID NO: 714390 - DNA, 13 bp, C. elegans
ctgaaattaaaga

SEQ ID NO: 714391 - DNA, 13 bp, C. elegans
ctgaaattacaaa

SEQ ID NO: 714392 - DNA, 13 bp, C. elegans
ctgaaattagcga

SEQ ID NO: 714393 - DNA, 13 bp, C. elegans
ctgaaattaggaa

SEQ ID NO: 714394 - DNA, 13 bp, C. elegans
ctgaaattagtat

SEQ ID NO: 714395 - DNA, 13 bp, C. elegans
ctgaaattagttt

SEQ ID NO: 714396 - DNA, 13 bp, C. elegans
ctgaaattatact

SEQ ID NO: 714397 - DNA, 13 bp, C. elegans
ctgaaattatatt

SEQ ID NO: 714398 - DNA, 13 bp, C. elegans
ctgaaattatcga

SEQ ID NO: 714399 - DNA, 13 bp, C. elegans
ctgaaattattac

SEQ ID NO: 714400 - DNA, 13 bp, C. elegans
ctgaaattattat

SEQ ID NO: 714401 - DNA, 13 bp, C. elegans
ctgaaattattta

SEQ ID NO: 714402 - DNA, 13 bp, C. elegans
ctgaaattatttc

SEQ ID NO: 714403 - DNA, 13 bp, C. elegans
ctgaaattcaata

SEQ ID NO: 714404 - DNA, 13 bp, C. elegans
ctgaaattcaatg

SEQ ID NO: 714405 - DNA, 13 bp, C. elegans
ctgaaattcagaa

SEQ ID NO: 714406 - DNA, 13 bp, C. elegans
ctgaaattcattt

SEQ ID NO: 714407 - DNA, 13 bp, C. elegans
ctgaaattccagt

SEQ ID NO: 714408 - DNA, 13 bp, C. elegans
ctgaaattccgga

SEQ ID NO: 714409 - DNA, 13 bp, C. elegans
ctgaaattcgaat

SEQ ID NO: 714410 - DNA, 13 bp, C. elegans
ctgaaattctata

SEQ ID NO: 714411 - DNA, 13 bp, C. elegans
ctgaaattgaaaa

SEQ ID NO: 714412 - DNA, 13 bp, C. elegans
ctgaaattgaaat

SEQ ID NO: 714413 - DNA, 13 bp, C. elegans
ctgaaattgagat

SEQ ID NO: 714414 - DNA, 13 bp, C. elegans
ctgaaattgataa

SEQ ID NO: 714415 - DNA, 13 bp, C. elegans
ctgaaattgatga

SEQ ID NO: 714416 - DNA, 13 bp, C. elegans
ctgaaattgattt

SEQ ID NO: 714417 - DNA, 13 bp, C. elegans
ctgaaattggaaa

SEQ ID NO: 714418 - DNA, 13 bp, C. elegans
ctgaaattggaga

SEQ ID NO: 714419 - DNA, 13 bp, C. elegans
ctgaaattgttaa

SEQ ID NO: 714420 - DNA, 13 bp, C. elegans
ctgaaattgtttt

SEQ ID NO: 714421 - DNA, 13 bp, C. elegans
ctgaaatttaaaa

SEQ ID NO: 714422 - DNA, 13 bp, C. elegans
ctgaaatttaatg

SEQ ID NO: 714423 - DNA, 13 bp, C. elegans
ctgaaatttaatt

SEQ ID NO: 714424 - DNA, 13 bp, C. elegans
ctgaaatttattt

SEQ ID NO: 714425 - DNA, 13 bp, C. elegans
ctgaaatttcaaa

SEQ ID NO: 714426 - DNA, 13 bp, C. elegans
ctgaaatttcaga

SEQ ID NO: 714427 - DNA, 13 bp, C. elegans
ctgaaatttctca

SEQ ID NO: 714428 - DNA, 13 bp, C. elegans
ctgaaatttctgc

SEQ ID NO: 714429 - DNA, 13 bp, C. elegans
ctgaaatttgaga

SEQ ID NO: 714430 - DNA, 13 bp, C. elegans
ctgaaatttgcaa

SEQ ID NO: 714431 - DNA, 13 bp, C. elegans
ctgaaatttgttc

SEQ ID NO: 714432 - DNA, 13 bp, C. elegans
ctgaaatttgttt

SEQ ID NO: 714433 - DNA, 13 bp, C. elegans
ctgaaattttaaa

SEQ ID NO: 714434 - DNA, 13 bp, C. elegans
ctgaaattttaat

SEQ ID NO: 714435 - DNA, 13 bp, C. elegans
ctgaaattttctg

SEQ ID NO: 714436 - DNA, 13 bp, C. elegans
ctgaaattttgaa

SEQ ID NO: 714437 - DNA, 13 bp, C. elegans
ctgaaatttttcg

SEQ ID NO: 714438 - DNA, 13 bp, C. elegans
ctgaaatttttgt

SEQ ID NO: 714439 - DNA, 13 bp, C. elegans
ctgaaatttttta

SEQ ID NO: 714440 - DNA, 13 bp, C. elegans
ctgaaattttttc

SEQ ID NO: 714441 - DNA, 13 bp, C. elegans
ctgaaattttttt

SEQ ID NO: 714442 - DNA, 13 bp, C. elegans
ctgaacaaaaaca

SEQ ID NO: 714443 - DNA, 13 bp, C. elegans
ctgaacaactttt

SEQ ID NO: 714444 - DNA, 13 bp, C. elegans
ctgaacaatttat

SEQ ID NO: 714445 - DNA, 13 bp, C. elegans
ctgaacaatttga

SEQ ID NO: 714446 - DNA, 13 bp, C. elegans
ctgaacacaaaaa

SEQ ID NO: 714447 - DNA, 13 bp, C. elegans
ctgaacagtttta

SEQ ID NO: 714448 - DNA, 13 bp, C. elegans
ctgaacattgaaa

SEQ ID NO: 714449 - DNA, 13 bp, C. elegans
ctgaacatttcaa

SEQ ID NO: 714450 - DNA, 13 bp, C. elegans
ctgaacatttttt

SEQ ID NO: 714451 - DNA, 13 bp, C. elegans
ctgaacctttttt

SEQ ID NO: 714452 - DNA, 13 bp, C. elegans
ctgaactcatttc

SEQ ID NO: 714453 - DNA, 13 bp, C. elegans
ctgaactgttttt

SEQ ID NO: 714454 - DNA, 13 bp, C. elegans
ctgaacttttgaa

SEQ ID NO: 714455 - DNA, 13 bp, C. elegans
ctgaagaaatgta

SEQ ID NO: 714456 - DNA, 13 bp, C. elegans
ctgaagaagacca

SEQ ID NO: 714457 - DNA, 13 bp, C. elegans
ctgaagaatcaaa

SEQ ID NO: 714458 - DNA, 13 bp, C. elegans
ctgaagcttcaaa

SEQ ID NO: 714459 - DNA, 13 bp, C. elegans
ctgaaggatcaga

SEQ ID NO: 714460 - DNA, 13 bp, C. elegans
ctgaataaaaaac

SEQ ID NO: 714461 - DNA, 13 bp, C. elegans
ctgaataactttt

SEQ ID NO: 714462 - DNA, 13 bp, C. elegans
ctgaataataatt

SEQ ID NO: 714463 - DNA, 13 bp, C. elegans
ctgaataatttga

SEQ ID NO: 714464 - DNA, 13 bp, C. elegans
ctgaatacacgtg

SEQ ID NO: 714465 - DNA, 13 bp, C. elegans
ctgaatacatgat

SEQ ID NO: 714466 - DNA, 13 bp, C. elegans
ctgaatacatttt

SEQ ID NO: 714467 - DNA, 13 bp, C. elegans
ctgaatataaaat

SEQ ID NO: 714468 - DNA, 13 bp, C. elegans
ctgaatatcataa

SEQ ID NO: 714469 - DNA, 13 bp, C. elegans
ctgaatatctgaa

SEQ ID NO: 714470 - DNA, 13 bp, C. elegans
ctgaatatttaaa

SEQ ID NO: 714471 - DNA, 13 bp, C. elegans
ctgaatgccgagt

SEQ ID NO: 714472 - DNA, 13 bp, C. elegans
ctgaattagttcc

SEQ ID NO: 714473 - DNA, 13 bp, C. elegans
ctgaattatattt

SEQ ID NO: 714474 - DNA, 13 bp, C. elegans
ctgaattcatttt

SEQ ID NO: 714475 - DNA, 13 bp, C. elegans
ctgaattcgaatt

SEQ ID NO: 714476 - DNA, 13 bp, C. elegans
ctgaatttaattt

SEQ ID NO: 714477 - DNA, 13 bp, C. elegans
ctgaatttagaaa

SEQ ID NO: 714478 - DNA, 13 bp, C. elegans
ctgaatttctgaa

SEQ ID NO: 714479 - DNA, 13 bp, C. elegans
ctgaatttgaatt

SEQ ID NO: 714480 - DNA, 13 bp, C. elegans
ctgaatttgctca

SEQ ID NO: 714481 - DNA, 13 bp, C. elegans
ctgaattttatat

SEQ ID NO: 714482 - DNA, 13 bp, C. elegans
ctgaattttattt

SEQ ID NO: 714483 - DNA, 13 bp, C. elegans
ctgaattttcaca

SEQ ID NO: 714484 - DNA, 13 bp, C. elegans
ctgaattttctat

SEQ ID NO: 714485 - DNA, 13 bp, C. elegans
ctgaatttttcta

SEQ ID NO: 714486 - DNA, 13 bp, C. elegans
ctgaatttttctt

SEQ ID NO: 714487 - DNA, 13 bp, C. elegans
ctgaatttttgaa

SEQ ID NO: 714488 - DNA, 13 bp, C. elegans
ctgaattttttaa

SEQ ID NO: 714489 - DNA, 13 bp, C. elegans
ctgacaaaaaata

SEQ ID NO: 714490 - DNA, 13 bp, C. elegans
ctgacaaaaacta

SEQ ID NO: 714491 - DNA, 13 bp, C. elegans
ctgacaaaatatg

SEQ ID NO: 714492 - DNA, 13 bp, C. elegans
ctgacaaactttt

SEQ ID NO: 714493 - DNA, 13 bp, C. elegans
ctgacaccaagtg

SEQ ID NO: 714494 - DNA, 13 bp, C. elegans
ctgacaccacgtg

SEQ ID NO: 714495 - DNA, 13 bp, C. elegans
ctgacaccacttg

SEQ ID NO: 714496 - DNA, 13 bp, C. elegans
ctgacactttctc

SEQ ID NO: 714497 - DNA, 13 bp, C. elegans
ctgacattttttg

SEQ ID NO: 714498 - DNA, 13 bp, C. elegans
ctgaccaaagaaa

SEQ ID NO: 714499 - DNA, 13 bp, C. elegans
ctgagaaaaaaat

SEQ ID NO: 714500 - DNA, 13 bp, C. elegans
ctgagaaaaagaa

SEQ ID NO: 714501 - DNA, 13 bp, C. elegans
ctgagaaacaatt

SEQ ID NO: 714502 - DNA, 13 bp, C. elegans
ctgagaacaattt

SEQ ID NO: 714503 - DNA, 13 bp, C. elegans
ctgagaatgcgta

SEQ ID NO: 714504 - DNA, 13 bp, C. elegans
ctgagatatgagc

SEQ ID NO: 714505 - DNA, 13 bp, C. elegans
ctgagccaaagcc

SEQ ID NO: 714506 - DNA, 13 bp, C. elegans
ctgagccattcgg

SEQ ID NO: 714507 - DNA, 13 bp, C. elegans
ctgagctacagta

SEQ ID NO: 714508 - DNA, 13 bp, C. elegans
ctgagctcggcaa

SEQ ID NO: 714509 - DNA, 13 bp, C. elegans
ctgagtagcgact

SEQ ID NO: 714510 - DNA, 13 bp, C. elegans
ctgataaaaaatt

SEQ ID NO: 714511 - DNA, 13 bp, C. elegans
ctgataaaatatt

SEQ ID NO: 714512 - DNA, 13 bp, C. elegans
ctgataaataaaa

SEQ ID NO: 714513 - DNA, 13 bp, C. elegans
ctgataaataatt

SEQ ID NO: 714514 - DNA, 13 bp, C. elegans
ctgataaatattt

SEQ ID NO: 714515 - DNA, 13 bp, C. elegans
ctgataaattgta

SEQ ID NO: 714516 - DNA, 13 bp, C. elegans
ctgataaattttc

SEQ ID NO: 714517 - DNA, 13 bp, C. elegans
ctgataagaaaat

SEQ ID NO: 714518 - DNA, 13 bp, C. elegans
ctgataatatttt

SEQ ID NO: 714519 - DNA, 13 bp, C. elegans
ctgataatgataa

SEQ ID NO: 714520 - DNA, 13 bp, C. elegans
ctgataattgaaa

SEQ ID NO: 714521 - DNA, 13 bp, C. elegans
ctgataattttaa

SEQ ID NO: 714522 - DNA, 13 bp, C. elegans
ctgatatcatttt

SEQ ID NO: 714523 - DNA, 13 bp, C. elegans
ctgatattcaaaa

SEQ ID NO: 714524 - DNA, 13 bp, C. elegans
ctgatattttgaa

SEQ ID NO: 714525 - DNA, 13 bp, C. elegans
ctgatgaataaat

SEQ ID NO: 714526 - DNA, 13 bp, C. elegans
ctgatgccgaata

SEQ ID NO: 714527 - DNA, 13 bp, C. elegans
ctgatggtttttt

SEQ ID NO: 714528 - DNA, 13 bp, C. elegans
ctgattattgatt

SEQ ID NO: 714529 - DNA, 13 bp, C. elegans
ctgattcagcaaa

SEQ ID NO: 714530 - DNA, 13 bp, C. elegans
ctgattccaaaaa

SEQ ID NO: 714531 - DNA, 13 bp, C. elegans
ctgattccgaata

SEQ ID NO: 714532 - DNA, 13 bp, C. elegans
ctgattctgaaaa

SEQ ID NO: 714533 - DNA, 13 bp, C. elegans
ctgattcttccga

SEQ ID NO: 714534 - DNA, 13 bp, C. elegans
ctgattggtcgca

SEQ ID NO: 714535 - DNA, 13 bp, C. elegans
ctgattggtcgtg

SEQ ID NO: 714536 - DNA, 13 bp, C. elegans
ctgattggttcaa

SEQ ID NO: 714537 - DNA, 13 bp, C. elegans
ctgattggttcga

SEQ ID NO: 714538 - DNA, 13 bp, C. elegans
ctgattggttgaa

SEQ ID NO: 714539 - DNA, 13 bp, C. elegans
ctgattggttttg

SEQ ID NO: 714540 - DNA, 13 bp, C. elegans
ctgattggttttt

SEQ ID NO: 714541 - DNA, 13 bp, C. elegans
ctgattgtgagaa

SEQ ID NO: 714542 - DNA, 13 bp, C. elegans
ctgattgtgagca

SEQ ID NO: 714543 - DNA, 13 bp, C. elegans
ctgatttcaaaaa

SEQ ID NO: 714544 - DNA, 13 bp, C. elegans
ctgatttccattt

SEQ ID NO: 714545 - DNA, 13 bp, C. elegans
ctgatttccgttt

SEQ ID NO: 714546 - DNA, 13 bp, C. elegans
ctgatttcttgtt

SEQ ID NO: 714547 - DNA, 13 bp, C. elegans
ctgattttcaatt

SEQ ID NO: 714548 - DNA, 13 bp, C. elegans
ctgattttgaaat

SEQ ID NO: 714549 - DNA, 13 bp, C. elegans
ctgattttgtctt

SEQ ID NO: 714550 - DNA, 13 bp, C. elegans
ctgatttttcaaa

SEQ ID NO: 714551 - DNA, 13 bp, C. elegans
ctgatttttcttc

SEQ ID NO: 714552 - DNA, 13 bp, C. elegans
ctgattttttcct

SEQ ID NO: 714553 - DNA, 13 bp, C. elegans
ctgattttttgta

SEQ ID NO: 714554 - DNA, 13 bp, C. elegans
ctgattttttgtg

SEQ ID NO: 714555 - DNA, 13 bp, C. elegans
ctgatttttttaa

SEQ ID NO: 714556 - DNA, 13 bp, C. elegans
ctgatttttttcc

SEQ ID NO: 714557 - DNA, 13 bp, C. elegans
ctgcaaaaaataa

SEQ ID NO: 714558 - DNA, 13 bp, C. elegans
ctgcaaaaaatcg

SEQ ID NO: 714559 - DNA, 13 bp, C. elegans
ctgcaaaaataga

SEQ ID NO: 714560 - DNA, 13 bp, C. elegans
ctgcaaaaatatt

SEQ ID NO: 714561 - DNA, 13 bp, C. elegans
ctgcaaaaatcga

SEQ ID NO: 714562 - DNA, 13 bp, C. elegans
ctgcaaaaccaat

SEQ ID NO: 714563 - DNA, 13 bp, C. elegans
ctgcaaaagaaaa

SEQ ID NO: 714564 - DNA, 13 bp, C. elegans
ctgcaaaattgtt

SEQ ID NO: 714565 - DNA, 13 bp, C. elegans
ctgcaaactacaa

SEQ ID NO: 714566 - DNA, 13 bp, C. elegans
ctgcaaatttaaa

SEQ ID NO: 714567 - DNA, 13 bp, C. elegans
ctgcaaatttcag

SEQ ID NO: 714568 - DNA, 13 bp, C. elegans
ctgcaattatttt

SEQ ID NO: 714569 - DNA, 13 bp, C. elegans
ctgcaatttttat

SEQ ID NO: 714570 - DNA, 13 bp, C. elegans
ctgcacagaaagc

SEQ ID NO: 714571 - DNA, 13 bp, C. elegans
ctgcacatttttt

SEQ ID NO: 714572 - DNA, 13 bp, C. elegans
ctgcactctcccc

SEQ ID NO: 714573 - DNA, 13 bp, C. elegans
ctgcagaaatttt

SEQ ID NO: 714574 - DNA, 13 bp, C. elegans
ctgcagaattttc

SEQ ID NO: 714575 - DNA, 13 bp, C. elegans
ctgcatttatttt

SEQ ID NO: 714576 - DNA, 13 bp, C. elegans
ctgcatttgaagc

SEQ ID NO: 714577 - DNA, 13 bp, C. elegans
ctgcattttttat

SEQ ID NO: 714578 - DNA, 13 bp, C. elegans
ctgccaaaaaaaa

SEQ ID NO: 714579 - DNA, 13 bp, C. elegans
ctgccaaaaaata

SEQ ID NO: 714580 - DNA, 13 bp, C. elegans
ctgccaaagttga

SEQ ID NO: 714581 - DNA, 13 bp, C. elegans
ctgccaacaattt

SEQ ID NO: 714582 - DNA, 13 bp, C. elegans
ctgccaatatttt

SEQ ID NO: 714583 - DNA, 13 bp, C. elegans
ctgccacgtcatc

SEQ ID NO: 714584 - DNA, 13 bp, C. elegans
ctgccgatttgcc

SEQ ID NO: 714585 - DNA, 13 bp, C. elegans
ctgcctgcctata

SEQ ID NO: 714586 - DNA, 13 bp, C. elegans
ctgccttcagaaa

SEQ ID NO: 714587 - DNA, 13 bp, C. elegans
ctgcgcctttaaa

SEQ ID NO: 714588 - DNA, 13 bp, C. elegans
ctgcgtctctcac

SEQ ID NO: 714589 - DNA, 13 bp, C. elegans
ctgcgtctctcat

SEQ ID NO: 714590 - DNA, 13 bp, C. elegans
ctgcgtctctccc

SEQ ID NO: 714591 - DNA, 13 bp, C. elegans
ctgcgtctctcgt

SEQ ID NO: 714592 - DNA, 13 bp, C. elegans
ctgcgtctcttca

SEQ ID NO: 714593 - DNA, 13 bp, C. elegans
ctgcgtctcttcg

SEQ ID NO: 714594 - DNA, 13 bp, C. elegans
ctgcgtctcttgc

SEQ ID NO: 714595 - DNA, 14 bp, C. elegans
ctgcgtggcgtgta

SEQ ID NO: 714596 - DNA, 13 bp, C. elegans
ctgctaattttct

SEQ ID NO: 714597 - DNA, 13 bp, C. elegans
ctgctactgctgc

SEQ ID NO: 714598 - DNA, 13 bp, C. elegans
ctgctcaaaaaat

SEQ ID NO: 714599 - DNA, 13 bp, C. elegans
ctgctcaaaaatt

SEQ ID NO: 714600 - DNA, 13 bp, C. elegans
ctgctcatttttc

SEQ ID NO: 714601 - DNA, 13 bp, C. elegans
ctgctgcatattt

SEQ ID NO: 714602 - DNA, 13 bp, C. elegans
ctgctgccgccgc

SEQ ID NO: 714603 - DNA, 13 bp, C. elegans
ctgctgctactgc

SEQ ID NO: 714604 - DNA, 13 bp, C. elegans
ctgctgctgcttc

SEQ ID NO: 714605 - DNA, 13 bp, C. elegans
ctgctgcttctgc

SEQ ID NO: 714606 - DNA, 13 bp, C. elegans
ctgctgtttcaaa

SEQ ID NO: 714607 - DNA, 13 bp, C. elegans
ctgcttagatgct

SEQ ID NO: 714608 - DNA, 13 bp, C. elegans
ctgcttgaacttg

SEQ ID NO: 714609 - DNA, 13 bp, C. elegans
ctggaaaaaagga

SEQ ID NO: 714610 - DNA, 13 bp, C. elegans
ctggaaaaaatca

SEQ ID NO: 714611 - DNA, 13 bp, C. elegans
ctggaaaaaattt

SEQ ID NO: 714612 - DNA, 13 bp, C. elegans
ctggaaaaataat

SEQ ID NO: 714613 - DNA, 13 bp, C. elegans
ctggaaaaatagg

SEQ ID NO: 714614 - DNA, 13 bp, C. elegans
ctggaaaaatatc

SEQ ID NO: 714615 - DNA, 13 bp, C. elegans
ctggaaaaatcga

SEQ ID NO: 714616 - DNA, 13 bp, C. elegans
ctggaaaaatctg

SEQ ID NO: 714617 - DNA, 13 bp, C. elegans
ctggaaaaattcg

SEQ ID NO: 714618 - DNA, 13 bp, C. elegans
ctggaaaaattga

SEQ ID NO: 714619 - DNA, 13 bp, C. elegans
ctggaaaactcaa

SEQ ID NO: 714620 - DNA, 13 bp, C. elegans
ctggaaaagaaaa

SEQ ID NO: 714621 - DNA, 13 bp, C. elegans
ctggaaaagttta

SEQ ID NO: 714622 - DNA, 13 bp, C. elegans
ctggaaaataaac

SEQ ID NO: 714623 - DNA, 13 bp, C. elegans
ctggaaaatatgt

SEQ ID NO: 714624 - DNA, 13 bp, C. elegans
ctggaaaatcaaa

SEQ ID NO: 714625 - DNA, 13 bp, C. elegans
ctggaaaatccca

SEQ ID NO: 714626 - DNA, 13 bp, C. elegans
ctggaaaatcgga

SEQ ID NO: 714627 - DNA, 13 bp, C. elegans
ctggaaaatcggc

SEQ ID NO: 714628 - DNA, 13 bp, C. elegans
ctggaaaatctga

SEQ ID NO: 714629 - DNA, 13 bp, C. elegans
ctggaaaatgaaa

SEQ ID NO: 714630 - DNA, 13 bp, C. elegans
ctggaaaatgtga

SEQ ID NO: 714631 - DNA, 13 bp, C. elegans
ctggaaaatgttt

SEQ ID NO: 714632 - DNA, 13 bp, C. elegans
ctggaaaattcaa

SEQ ID NO: 714633 - DNA, 13 bp, C. elegans
ctggaaaattcgg

SEQ ID NO: 714634 - DNA, 13 bp, C. elegans
ctggaaaattgga

SEQ ID NO: 714635 - DNA, 13 bp, C. elegans
ctggaaacaaaaa

SEQ ID NO: 714636 - DNA, 13 bp, C. elegans
ctggaaacaaatt

SEQ ID NO: 714637 - DNA, 13 bp, C. elegans
ctggaaacaattt

SEQ ID NO: 714638 - DNA, 13 bp, C. elegans
ctggaaacttcca

SEQ ID NO: 714639 - DNA, 13 bp, C. elegans
ctggaaactttta

SEQ ID NO: 714640 - DNA, 13 bp, C. elegans
ctggaaagaaaaa

SEQ ID NO: 714641 - DNA, 13 bp, C. elegans
ctggaaatatgaa

SEQ ID NO: 714642 - DNA, 13 bp, C. elegans
ctggaaatattga

SEQ ID NO: 714643 - DNA, 13 bp, C. elegans
ctggaaatatttt

SEQ ID NO: 714644 - DNA, 13 bp, C. elegans
ctggaaatgaaaa

SEQ ID NO: 714645 - DNA, 13 bp, C. elegans
ctggaaatggaaa

SEQ ID NO: 714646 - DNA, 13 bp, C. elegans
ctggaaatgtttg

SEQ ID NO: 714647 - DNA, 13 bp, C. elegans
ctggaaattagaa

SEQ ID NO: 714648 - DNA, 13 bp, C. elegans
ctggaaattccaa

SEQ ID NO: 714649 - DNA, 13 bp, C. elegans
ctggaaattcttg

SEQ ID NO: 714650 - DNA, 13 bp, C. elegans
ctggaaattgaaa

SEQ ID NO: 714651 - DNA, 13 bp, C. elegans
ctggaaattgtat

SEQ ID NO: 714652 - DNA, 13 bp, C. elegans
ctggaaatttata

SEQ ID NO: 714653 - DNA, 13 bp, C. elegans
ctggaaatttcaa

SEQ ID NO: 714654 - DNA, 13 bp, C. elegans
ctggaaatttcta

SEQ ID NO: 714655 - DNA, 13 bp, C. elegans
ctggaaattttag

SEQ ID NO: 714656 - DNA, 13 bp, C. elegans
ctggaaattttcg

SEQ ID NO: 714657 - DNA, 13 bp, C. elegans
ctggaacactcca

SEQ ID NO: 714658 - DNA, 13 bp, C. elegans
ctggaacattcca

SEQ ID NO: 714659 - DNA, 13 bp, C. elegans
ctggaacatttca

SEQ ID NO: 714660 - DNA, 13 bp, C. elegans
ctggaactatttc

SEQ ID NO: 714661 - DNA, 13 bp, C. elegans
ctggaagaaaaaa

SEQ ID NO: 714662 - DNA, 13 bp, C. elegans
ctggaagaaaaat

SEQ ID NO: 714663 - DNA, 13 bp, C. elegans
ctggaagaatttg

SEQ ID NO: 714664 - DNA, 13 bp, C. elegans
ctggaagaatttt

SEQ ID NO: 714665 - DNA, 13 bp, C. elegans
ctggaagtttctg

SEQ ID NO: 714666 - DNA, 13 bp, C. elegans
ctggaagttttga

SEQ ID NO: 714667 - DNA, 13 bp, C. elegans
ctggaatattcta

SEQ ID NO: 714668 - DNA, 13 bp, C. elegans
ctggaatatttca

SEQ ID NO: 714669 - DNA, 13 bp, C. elegans
ctggaatggttaa

SEQ ID NO: 714670 - DNA, 13 bp, C. elegans
ctggaattatttt

SEQ ID NO: 714671 - DNA, 13 bp, C. elegans
ctggaattcaatt

SEQ ID NO: 714672 - DNA, 13 bp, C. elegans
ctggaattcagaa

SEQ ID NO: 714673 - DNA, 13 bp, C. elegans
ctggaattgaaat

SEQ ID NO: 714674 - DNA, 13 bp, C. elegans
ctggaattggaaa

SEQ ID NO: 714675 - DNA, 13 bp, C. elegans
ctggaattttatt

SEQ ID NO: 714676 - DNA, 13 bp, C. elegans
ctggaattttgga

SEQ ID NO: 714677 - DNA, 15 bp, C. elegans
ctggagaaagatatg

SEQ ID NO: 714678 - DNA, 13 bp, C. elegans
ctggagatgcagc

SEQ ID NO: 714679 - DNA, 13 bp, C. elegans
ctggagctggagc

SEQ ID NO: 714680 - DNA, 13 bp, C. elegans
ctggagctggtgg

SEQ ID NO: 714681 - DNA, 13 bp, C. elegans
ctggagttgatgg

SEQ ID NO: 714682 - DNA, 13 bp, C. elegans
ctggattgttcaa

SEQ ID NO: 714683 - DNA, 13 bp, C. elegans
ctggcaaaccggc

SEQ ID NO: 714684 - DNA, 13 bp, C. elegans
ctggcaaattgtc

SEQ ID NO: 714685 - DNA, 13 bp, C. elegans
ctggcaccacgtg

SEQ ID NO: 714686 - DNA, 13 bp, C. elegans
ctggcgcgaaaat

SEQ ID NO: 714687 - DNA, 13 bp, C. elegans
ctggcgcgcgcac

SEQ ID NO: 714688 - DNA, 13 bp, C. elegans
ctggcggcaaaat

SEQ ID NO: 714689 - DNA, 13 bp, C. elegans
ctggctcattttg

SEQ ID NO: 714690 - DNA, 13 bp, C. elegans
ctgggcggcaatt

SEQ ID NO: 714691 - DNA, 13 bp, C. elegans
ctgggctgcattc

SEQ ID NO: 714692 - DNA, 13 bp, C. elegans
ctgggtctcgcca

SEQ ID NO: 714693 - DNA, 13 bp, C. elegans
ctggtatatttgg

SEQ ID NO: 714694 - DNA, 13 bp, C. elegans
ctggtgtttgcgt

SEQ ID NO: 714695 - DNA, 13 bp, C. elegans
ctggttgaatttg

SEQ ID NO: 714696 - DNA, 13 bp, C. elegans
ctggtttctgaat

SEQ ID NO: 714697 - DNA, 13 bp, C. elegans
ctggttttcaaaa

SEQ ID NO: 714698 - DNA, 13 bp, C. elegans
ctggttttcaaat

SEQ ID NO: 714699 - DNA, 13 bp, C. elegans
ctgtaaaaagttg

SEQ ID NO: 714700 - DNA, 13 bp, C. elegans
ctgtaaaaatctg

SEQ ID NO: 714701 - DNA, 13 bp, C. elegans
ctgtaaaaattca

SEQ ID NO: 714702 - DNA, 13 bp, C. elegans
ctgtaaaattaaa

SEQ ID NO: 714703 - DNA, 13 bp, C. elegans
ctgtaaaattcat

SEQ ID NO: 714704 - DNA, 13 bp, C. elegans
ctgtaaaattttt

SEQ ID NO: 714705 - DNA, 13 bp, C. elegans
ctgtaaataaaaa

SEQ ID NO: 714706 - DNA, 13 bp, C. elegans
ctgtaaatttaaa

SEQ ID NO: 714707 - DNA, 13 bp, C. elegans
ctgtaaatttgaa

SEQ ID NO: 714708 - DNA, 13 bp, C. elegans
ctgtaaattttga

SEQ ID NO: 714709 - DNA, 13 bp, C. elegans
ctgtaactgctca

SEQ ID NO: 714710 - DNA, 13 bp, C. elegans
ctgtaactttgaa

SEQ ID NO: 714711 - DNA, 13 bp, C. elegans
ctgtaactttgct

SEQ ID NO: 714712 - DNA, 13 bp, C. elegans
ctgtaacttttaa

SEQ ID NO: 714713 - DNA, 13 bp, C. elegans
ctgtaattatttg

SEQ ID NO: 714714 - DNA, 13 bp, C. elegans
ctgtaatttcaac

SEQ ID NO: 714715 - DNA, 13 bp, C. elegans
ctgtaatttgttc

SEQ ID NO: 714716 - DNA, 13 bp, C. elegans
ctgtaattttcag

SEQ ID NO: 714717 - DNA, 13 bp, C. elegans
ctgtaatttttat

SEQ ID NO: 714718 - DNA, 13 bp, C. elegans
ctgtacatataca

SEQ ID NO: 714719 - DNA, 13 bp, C. elegans
ctgtacttttttc

SEQ ID NO: 714720 - DNA, 13 bp, C. elegans
ctgtagaaataat

SEQ ID NO: 714721 - DNA, 13 bp, C. elegans
ctgtagaaatact

SEQ ID NO: 714722 - DNA, 13 bp, C. elegans
ctgtagatgtgct

SEQ ID NO: 714723 - DNA, 14 bp, C. elegans
ctgtagcgccaaaa

SEQ ID NO: 714724 - DNA, 13 bp, C. elegans
ctgtaggaatttt

SEQ ID NO: 714725 - DNA, 13 bp, C. elegans
ctgtaggcaggca

SEQ ID NO: 714726 - DNA, 13 bp, C. elegans
ctgtagtttaaag

SEQ ID NO: 714727 - DNA, 13 bp, C. elegans
ctgtagtttttac

SEQ ID NO: 714728 - DNA, 13 bp, C. elegans
ctgtataaaattt

SEQ ID NO: 714729 - DNA, 13 bp, C. elegans
ctgtatataaaaa

SEQ ID NO: 714730 - DNA, 13 bp, C. elegans
ctgtattcaagta

SEQ ID NO: 714731 - DNA, 13 bp, C. elegans
ctgtatttcttgt

SEQ ID NO: 714732 - DNA, 13 bp, C. elegans
ctgtatttttcaa

SEQ ID NO: 714733 - DNA, 13 bp, C. elegans
ctgtcaaaaagtg

SEQ ID NO: 714734 - DNA, 13 bp, C. elegans
ctgtcaaaattcg

SEQ ID NO: 714735 - DNA, 13 bp, C. elegans
ctgtcaattttta

SEQ ID NO: 714736 - DNA, 13 bp, C. elegans
ctgtcgtattttt

SEQ ID NO: 714737 - DNA, 13 bp, C. elegans
ctgtctgcgctct

SEQ ID NO: 714738 - DNA, 13 bp, C. elegans
ctgtctgtgtctc

SEQ ID NO: 714739 - DNA, 13 bp, C. elegans
ctgtgaaaattaa

SEQ ID NO: 714740 - DNA, 13 bp, C. elegans
ctgtgaaatttta

SEQ ID NO: 714741 - DNA, 13 bp, C. elegans
ctgtgaatttttg

SEQ ID NO: 714742 - DNA, 13 bp, C. elegans
ctgtgacgtcacg

SEQ ID NO: 714743 - DNA, 13 bp, C. elegans
ctgtgagcttttt

SEQ ID NO: 714744 - DNA, 13 bp, C. elegans
ctgtgatttttcc

SEQ ID NO: 714745 - DNA, 13 bp, C. elegans
ctgtgatttttga

SEQ ID NO: 714746 - DNA, 13 bp, C. elegans
ctgtgattttttg

SEQ ID NO: 714747 - DNA, 13 bp, C. elegans
ctgtgcaaaaaaa

SEQ ID NO: 714748 - DNA, 13 bp, C. elegans
ctgtgcaaccgga

SEQ ID NO: 714749 - DNA, 13 bp, C. elegans
ctgtgcaatttgt

SEQ ID NO: 714750 - DNA, 13 bp, C. elegans
ctgtgcattttgt

SEQ ID NO: 714751 - DNA, 13 bp, C. elegans
ctgtggaaaatac

SEQ ID NO: 714752 - DNA, 13 bp, C. elegans
ctgtgtaattttt

SEQ ID NO: 714753 - DNA, 13 bp, C. elegans
ctgtgtatcgatt

SEQ ID NO: 714754 - DNA, 13 bp, C. elegans
ctgttaaattttg

SEQ ID NO: 714755 - DNA, 13 bp, C. elegans
ctgttatagtttt

SEQ ID NO: 714756 - DNA, 13 bp, C. elegans
ctgttatttttaa

SEQ ID NO: 714757 - DNA, 13 bp, C. elegans
ctgttatttttca

SEQ ID NO: 714758 - DNA, 13 bp, C. elegans
ctgttcaaatttt

SEQ ID NO: 714759 - DNA, 13 bp, C. elegans
ctgttcaattgaa

SEQ ID NO: 714760 - DNA, 13 bp, C. elegans
ctgttcaattgga

SEQ ID NO: 714761 - DNA, 13 bp, C. elegans
ctgttcatatctc

SEQ ID NO: 714762 - DNA, 13 bp, C. elegans
ctgttcattttta

SEQ ID NO: 714763 - DNA, 13 bp, C. elegans
ctgttgaaattgt

SEQ ID NO: 714764 - DNA, 13 bp, C. elegans
ctgttgacaatat

SEQ ID NO: 714765 - DNA, 31 bp, C. elegans
ctgttggaaggccgccgatgcgatggactga

SEQ ID NO: 714766 - DNA, 13 bp, C. elegans
ctgtttcaaagaa

SEQ ID NO: 714767 - DNA, 13 bp, C. elegans
ctgtttcaaatgt

SEQ ID NO: 714768 - DNA, 13 bp, C. elegans
ctgtttcaaatta

SEQ ID NO: 714769 - DNA, 13 bp, C. elegans
ctgtttcaacatg

SEQ ID NO: 714770 - DNA, 13 bp, C. elegans
ctgtttcaatttt

SEQ ID NO: 714771 - DNA, 13 bp, C. elegans
ctgtttcacaaaa

SEQ ID NO: 714772 - DNA, 13 bp, C. elegans
ctgtttcacgttg

SEQ ID NO: 714773 - DNA, 13 bp, C. elegans
ctgtttcataatt

SEQ ID NO: 714774 - DNA, 13 bp, C. elegans
ctgtttcatgttg

SEQ ID NO: 714775 - DNA, 13 bp, C. elegans
ctgtttcatttca

SEQ ID NO: 714776 - DNA, 13 bp, C. elegans
ctgtttccaattt

SEQ ID NO: 714777 - DNA, 13 bp, C. elegans
ctgttttaaacat

SEQ ID NO: 714778 - DNA, 13 bp, C. elegans
ctgtttttcaaat

SEQ ID NO: 714779 - DNA, 13 bp, C. elegans
ctgtttttcaatt

SEQ ID NO: 714780 - DNA, 13 bp, C. elegans
ctgtttttgaaaa

SEQ ID NO: 714781 - DNA, 13 bp, C. elegans
ctgtttttggaaa

SEQ ID NO: 714782 - DNA, 13 bp, C. elegans
ctgttttttgaga

SEQ ID NO: 714783 - DNA, 13 bp, C. elegans
ctgtttttttaaa

SEQ ID NO: 714784 - DNA, 13 bp, C. elegans
cttaaaaacatat

SEQ ID NO: 714785 - DNA, 13 bp, C. elegans
cttaaaaattggc

SEQ ID NO: 714786 - DNA, 13 bp, C. elegans
cttaaaacatttt

SEQ ID NO: 714787 - DNA, 13 bp, C. elegans
cttaaaactgtgc

SEQ ID NO: 714788 - DNA, 13 bp, C. elegans
cttaaaagtggag

SEQ ID NO: 714789 - DNA, 13 bp, C. elegans
cttaaaatcagaa

SEQ ID NO: 714790 - DNA, 13 bp, C. elegans
cttaaaatcattg

SEQ ID NO: 714791 - DNA, 13 bp, C. elegans
cttaaaattgaat

SEQ ID NO: 714792 - DNA, 13 bp, C. elegans
cttaaaattgctc

SEQ ID NO: 714793 - DNA, 13 bp, C. elegans
cttaaacattttt

SEQ ID NO: 714794 - DNA, 13 bp, C. elegans
cttaaaggcgcac

SEQ ID NO: 714795 - DNA, 13 bp, C. elegans
cttaaatcaaatt

SEQ ID NO: 714796 - DNA, 13 bp, C. elegans
cttaaatcaattt

SEQ ID NO: 714797 - DNA, 13 bp, C. elegans
cttaaatttaaga

SEQ ID NO: 714798 - DNA, 13 bp, C. elegans
cttaaatttcgaa

SEQ ID NO: 714799 - DNA, 13 bp, C. elegans
cttaacaattttt

SEQ ID NO: 714800 - DNA, 13 bp, C. elegans
cttaaccaaatga

SEQ ID NO: 714801 - DNA, 13 bp, C. elegans
cttaactgaaaaa

SEQ ID NO: 714802 - DNA, 13 bp, C. elegans
cttaactttttga

SEQ ID NO: 714803 - DNA, 13 bp, C. elegans
cttaatactttgt

SEQ ID NO: 714804 - DNA, 13 bp, C. elegans
cttaatctcaaaa

SEQ ID NO: 714805 - DNA, 13 bp, C. elegans
cttacaatgtatt

SEQ ID NO: 714806 - DNA, 13 bp, C. elegans
cttacaattagtt

SEQ ID NO: 714807 - DNA, 13 bp, C. elegans
cttacattttcaa

SEQ ID NO: 714808 - DNA, 13 bp, C. elegans
cttactagttttt

SEQ ID NO: 714809 - DNA, 13 bp, C. elegans
cttactattagtt

SEQ ID NO: 714810 - DNA, 13 bp, C. elegans
cttactttttcaa

SEQ ID NO: 714811 - DNA, 13 bp, C. elegans
cttataaaaaatc

SEQ ID NO: 714812 - DNA, 13 bp, C. elegans
cttataagcttat

SEQ ID NO: 714813 - DNA, 13 bp, C. elegans
cttataatttcta

SEQ ID NO: 714814 - DNA, 13 bp, C. elegans
cttatcaatttgt

SEQ ID NO: 714815 - DNA, 13 bp, C. elegans
cttatcagtgttt

SEQ ID NO: 714816 - DNA, 13 bp, C. elegans
cttatcagttgat

SEQ ID NO: 714817 - DNA, 13 bp, C. elegans
cttatcagtttgt

SEQ ID NO: 714818 - DNA, 13 bp, C. elegans
cttatccaaaaat

SEQ ID NO: 714819 - DNA, 13 bp, C. elegans
cttatgaaaactt

SEQ ID NO: 714820 - DNA, 13 bp, C. elegans
cttatgaattttt

SEQ ID NO: 714821 - DNA, 13 bp, C. elegans
cttatttcaaaaa

SEQ ID NO: 714822 - DNA, 13 bp, C. elegans
cttatttggaaat

SEQ ID NO: 714823 - DNA, 13 bp, C. elegans
cttattttcagaa

SEQ ID NO: 714824 - DNA, 13 bp, C. elegans
cttattttctcaa

SEQ ID NO: 714825 - DNA, 13 bp, C. elegans
cttatttttcaaa

SEQ ID NO: 714826 - DNA, 13 bp, C. elegans
cttcaaaaaatcc

SEQ ID NO: 714827 - DNA, 13 bp, C. elegans
cttcaaaaaccaa

SEQ ID NO: 714828 - DNA, 13 bp, C. elegans
cttcaaaaatatt

SEQ ID NO: 714829 - DNA, 13 bp, C. elegans
cttcaaaaatcga

SEQ ID NO: 714830 - DNA, 13 bp, C. elegans
cttcaaaaatctc

SEQ ID NO: 714831 - DNA, 13 bp, C. elegans
cttcaaaaattca

SEQ ID NO: 714832 - DNA, 13 bp, C. elegans
cttcaaaaattta

SEQ ID NO: 714833 - DNA, 13 bp, C. elegans
cttcaaaaatttt

SEQ ID NO: 714834 - DNA, 13 bp, C. elegans
cttcaaaacaaga

SEQ ID NO: 714835 - DNA, 13 bp, C. elegans
cttcaaaactttc

SEQ ID NO: 714836 - DNA, 13 bp, C. elegans
cttcaaaagaaaa

SEQ ID NO: 714837 - DNA, 13 bp, C. elegans
cttcaaaagctga

SEQ ID NO: 714838 - DNA, 13 bp, C. elegans
cttcaaaataaca

SEQ ID NO: 714839 - DNA, 13 bp, C. elegans
cttcaaaatccaa

SEQ ID NO: 714840 - DNA, 13 bp, C. elegans
cttcaaaatctga

SEQ ID NO: 714841 - DNA, 13 bp, C. elegans
cttcaaaatgacc

SEQ ID NO: 714842 - DNA, 13 bp, C. elegans
cttcaaaattgag

SEQ ID NO: 714843 - DNA, 13 bp, C. elegans
cttcaaaattgga

SEQ ID NO: 714844 - DNA, 13 bp, C. elegans
cttcaaaccaaaa

SEQ ID NO: 714845 - DNA, 13 bp, C. elegans
cttcaaactattt

SEQ ID NO: 714846 - DNA, 13 bp, C. elegans
cttcaaacttttt

SEQ ID NO: 714847 - DNA, 13 bp, C. elegans
cttcaaagatttt

SEQ ID NO: 714848 - DNA, 13 bp, C. elegans
cttcaaaggatca

SEQ ID NO: 714849 - DNA, 13 bp, C. elegans
cttcaaaggcgca

SEQ ID NO: 714850 - DNA, 13 bp, C. elegans
cttcaaataattt

SEQ ID NO: 714851 - DNA, 13 bp, C. elegans
cttcaaatatgaa

SEQ ID NO: 714852 - DNA, 13 bp, C. elegans
cttcaaatattaa

SEQ ID NO: 714853 - DNA, 13 bp, C. elegans
cttcaaatcaact

SEQ ID NO: 714854 - DNA, 13 bp, C. elegans
cttcaaatcctgc

SEQ ID NO: 714855 - DNA, 13 bp, C. elegans
cttcaaatcgaaa

SEQ ID NO: 714856 - DNA, 13 bp, C. elegans
cttcaaattcaaa

SEQ ID NO: 714857 - DNA, 13 bp, C. elegans
cttcaaattctaa

SEQ ID NO: 714858 - DNA, 13 bp, C. elegans
cttcaaattgaat

SEQ ID NO: 714859 - DNA, 13 bp, C. elegans
cttcaacaaactc

SEQ ID NO: 714860 - DNA, 13 bp, C. elegans
cttcaactgacaa

SEQ ID NO: 714861 - DNA, 13 bp, C. elegans
cttcaacttttaa

SEQ ID NO: 714862 - DNA, 13 bp, C. elegans
cttcaagaaaatt

SEQ ID NO: 714863 - DNA, 13 bp, C. elegans
cttcaagaagtct

SEQ ID NO: 714864 - DNA, 13 bp, C. elegans
cttcaagtttttc

SEQ ID NO: 714865 - DNA, 13 bp, C. elegans
cttcaatcaaaat

SEQ ID NO: 714866 - DNA, 13 bp, C. elegans
cttcaattaattt

SEQ ID NO: 714867 - DNA, 13 bp, C. elegans
cttcaattattat

SEQ ID NO: 714868 - DNA, 13 bp, C. elegans
cttcaattcattt

SEQ ID NO: 714869 - DNA, 13 bp, C. elegans
cttcaatttgaat

SEQ ID NO: 714870 - DNA, 13 bp, C. elegans
cttcaatttgacc

SEQ ID NO: 714871 - DNA, 13 bp, C. elegans
cttcaattttcag

SEQ ID NO: 714872 - DNA, 13 bp, C. elegans
cttcaattttcca

SEQ ID NO: 714873 - DNA, 13 bp, C. elegans
cttcaattttcta

SEQ ID NO: 714874 - DNA, 13 bp, C. elegans
cttcacaaaatat

SEQ ID NO: 714875 - DNA, 13 bp, C. elegans
cttcacataataa

SEQ ID NO: 714876 - DNA, 13 bp, C. elegans
cttcaccatattt

SEQ ID NO: 714877 - DNA, 13 bp, C. elegans
cttcacgaatttg

SEQ ID NO: 714878 - DNA, 13 bp, C. elegans
cttcactggtttt

SEQ ID NO: 714879 - DNA, 13 bp, C. elegans
cttcactttcaaa

SEQ ID NO: 714880 - DNA, 13 bp, C. elegans
cttcagaaaaata

SEQ ID NO: 714881 - DNA, 13 bp, C. elegans
cttcagaaaaatc

SEQ ID NO: 714882 - DNA, 13 bp, C. elegans
cttcagctccgaa

SEQ ID NO: 714883 - DNA, 13 bp, C. elegans
cttcagttcaaaa

SEQ ID NO: 714884 - DNA, 13 bp, C. elegans
cttcagtttctct

SEQ ID NO: 714885 - DNA, 13 bp, C. elegans
cttcatcatcatc

SEQ ID NO: 714886 - DNA, 13 bp, C. elegans
cttcattatttgt

SEQ ID NO: 714887 - DNA, 13 bp, C. elegans
cttcatttcaaaa

SEQ ID NO: 714888 - DNA, 13 bp, C. elegans
cttcatttgttcc

SEQ ID NO: 714889 - DNA, 13 bp, C. elegans
cttcattttaata

SEQ ID NO: 714890 - DNA, 13 bp, C. elegans
cttcattttcaac

SEQ ID NO: 714891 - DNA, 13 bp, C. elegans
cttcattttccca

SEQ ID NO: 714892 - DNA, 13 bp, C. elegans
cttcattttttga

SEQ ID NO: 714893 - DNA, 13 bp, C. elegans
cttccaaaacatt

SEQ ID NO: 714894 - DNA, 13 bp, C. elegans
cttccaaaatgtt

SEQ ID NO: 714895 - DNA, 13 bp, C. elegans
cttccaaaattgt

SEQ ID NO: 714896 - DNA, 13 bp, C. elegans
cttccaaataact

SEQ ID NO: 714897 - DNA, 13 bp, C. elegans
cttccaaatttat

SEQ ID NO: 714898 - DNA, 13 bp, C. elegans
cttccaaccatat

SEQ ID NO: 714899 - DNA, 13 bp, C. elegans
cttccaactttaa

SEQ ID NO: 714900 - DNA, 13 bp, C. elegans
cttccaatcctgc

SEQ ID NO: 714901 - DNA, 13 bp, C. elegans
cttccaattattg

SEQ ID NO: 714902 - DNA, 13 bp, C. elegans
cttccaatttctc

SEQ ID NO: 714903 - DNA, 13 bp, C. elegans
cttccaattttcc

SEQ ID NO: 714904 - DNA, 13 bp, C. elegans
cttccacttttca

SEQ ID NO: 714905 - DNA, 13 bp, C. elegans
cttccagttttat

SEQ ID NO: 714906 - DNA, 13 bp, C. elegans
cttccatgtaggc

SEQ ID NO: 714907 - DNA, 13 bp, C. elegans
cttcccaccatat

SEQ ID NO: 714908 - DNA, 19 bp, C. elegans
cttccctacatcccagttt

SEQ ID NO: 714909 - DNA, 13 bp, C. elegans
cttccgaaaaatg

SEQ ID NO: 714910 - DNA, 13 bp, C. elegans
cttccgatctttg

SEQ ID NO: 714911 - DNA, 13 bp, C. elegans
cttccgtacaaac

SEQ ID NO: 714912 - DNA, 13 bp, C. elegans
cttccgttgtgtt

SEQ ID NO: 714913 - DNA, 13 bp, C. elegans
cttcctgccaaca

SEQ ID NO: 714914 - DNA, 13 bp, C. elegans
cttcgaaaaatgc

SEQ ID NO: 714915 - DNA, 13 bp, C. elegans
cttcgaaataaaa

SEQ ID NO: 714916 - DNA, 13 bp, C. elegans
cttcgaaatattt

SEQ ID NO: 714917 - DNA, 13 bp, C. elegans
cttcgagaaataa

SEQ ID NO: 714918 - DNA, 13 bp, C. elegans
cttcgagaccggg

SEQ ID NO: 714919 - DNA, 13 bp, C. elegans
cttcgctacgaga

SEQ ID NO: 714920 - DNA, 13 bp, C. elegans
cttcgtaaatcta

SEQ ID NO: 714921 - DNA, 13 bp, C. elegans
cttcgtatttttc

SEQ ID NO: 714922 - DNA, 13 bp, C. elegans
cttcgtcgtcgaa

SEQ ID NO: 714923 - DNA, 13 bp, C. elegans
cttctaaaaaata

SEQ ID NO: 714924 - DNA, 13 bp, C. elegans
cttctaaaaatcg

SEQ ID NO: 714925 - DNA, 13 bp, C. elegans
cttctaataaaaa

SEQ ID NO: 714926 - DNA, 13 bp, C. elegans
cttctaatttttg

SEQ ID NO: 714927 - DNA, 13 bp, C. elegans
cttctacagtaac

SEQ ID NO: 714928 - DNA, 13 bp, C. elegans
cttctacagtacc

SEQ ID NO: 714929 - DNA, 13 bp, C. elegans
cttctagaatatt

SEQ ID NO: 714930 - DNA, 13 bp, C. elegans
cttctattagtat

SEQ ID NO: 714931 - DNA, 13 bp, C. elegans
cttctattttctg

SEQ ID NO: 714932 - DNA, 13 bp, C. elegans
cttctatttttga

SEQ ID NO: 714933 - DNA, 13 bp, C. elegans
cttctcaaaaaat

SEQ ID NO: 714934 - DNA, 13 bp, C. elegans
cttctcaaaaact

SEQ ID NO: 714935 - DNA, 13 bp, C. elegans
cttctcaaaataa

SEQ ID NO: 714936 - DNA, 13 bp, C. elegans
cttctcaaaatca

SEQ ID NO: 714937 - DNA, 13 bp, C. elegans
cttctcaacattt

SEQ ID NO: 714938 - DNA, 13 bp, C. elegans
cttctcaactgat

SEQ ID NO: 714939 - DNA, 13 bp, C. elegans
cttctcaatttat

SEQ ID NO: 714940 - DNA, 13 bp, C. elegans
cttctcaatttct

SEQ ID NO: 714941 - DNA, 13 bp, C. elegans
cttctccgtctgc

SEQ ID NO: 714942 - DNA, 13 bp, C. elegans
cttctcctcgtgg

SEQ ID NO: 714943 - DNA, 13 bp, C. elegans
cttctctcaattg

SEQ ID NO: 714944 - DNA, 13 bp, C. elegans
cttctctcaattt

SEQ ID NO: 714945 - DNA, 13 bp, C. elegans
cttctctcataaa

SEQ ID NO: 714946 - DNA, 13 bp, C. elegans
cttctctcgattg

SEQ ID NO: 714947 - DNA, 13 bp, C. elegans
cttctgaaaaaga

SEQ ID NO: 714948 - DNA, 13 bp, C. elegans
cttctgaaaaatt

SEQ ID NO: 714949 - DNA, 13 bp, C. elegans
cttctgaaaatta

SEQ ID NO: 714950 - DNA, 13 bp, C. elegans
cttctgaaatatt

SEQ ID NO: 714951 - DNA, 13 bp, C. elegans
cttctgaatgaaa

SEQ ID NO: 714952 - DNA, 13 bp, C. elegans
cttctggaaaaaa

SEQ ID NO: 714953 - DNA, 13 bp, C. elegans
cttctgtttacta

SEQ ID NO: 714954 - DNA, 13 bp, C. elegans
cttcttaacaaac

SEQ ID NO: 714955 - DNA, 13 bp, C. elegans
cttcttacccaag

SEQ ID NO: 714956 - DNA, 13 bp, C. elegans
cttcttcaaaaat

SEQ ID NO: 714957 - DNA, 13 bp, C. elegans
cttcttcaaatga

SEQ ID NO: 714958 - DNA, 13 bp, C. elegans
cttcttccaaatt

SEQ ID NO: 714959 - DNA, 18 bp, C. elegans
cttcttccccaagtttgg

SEQ ID NO: 714960 - DNA, 13 bp, C. elegans
cttcttctcaaat

SEQ ID NO: 714961 - DNA, 13 bp, C. elegans
cttcttctcaatt

SEQ ID NO: 714962 - DNA, 13 bp, C. elegans
cttcttctccaat

SEQ ID NO: 714963 - DNA, 13 bp, C. elegans
cttcttcttcaaa

SEQ ID NO: 714964 - DNA, 13 bp, C. elegans
cttcttcttcaat

SEQ ID NO: 714965 - DNA, 13 bp, C. elegans
cttcttgaaaaat

SEQ ID NO: 714966 - DNA, 13 bp, C. elegans
cttcttgaaattt

SEQ ID NO: 714967 - DNA, 13 bp, C. elegans
cttcttgccattt

SEQ ID NO: 714968 - DNA, 13 bp, C. elegans
cttcttttctaaa

SEQ ID NO: 714969 - DNA, 13 bp, C. elegans
cttgaaaaaatga

SEQ ID NO: 714970 - DNA, 13 bp, C. elegans
cttgaaaaactat

SEQ ID NO: 714971 - DNA, 13 bp, C. elegans
cttgaaaaactga

SEQ ID NO: 714972 - DNA, 13 bp, C. elegans
cttgaaaaaggaa

SEQ ID NO: 714973 - DNA, 13 bp, C. elegans
cttgaaaaataat

SEQ ID NO: 714974 - DNA, 13 bp, C. elegans
cttgaaaaatcga

SEQ ID NO: 714975 - DNA, 13 bp, C. elegans
cttgaaaactgag

SEQ ID NO: 714976 - DNA, 13 bp, C. elegans
cttgaaaacttga

SEQ ID NO: 714977 - DNA, 13 bp, C. elegans
cttgaaaagcttt

SEQ ID NO: 714978 - DNA, 13 bp, C. elegans
cttgaaaataaaa

SEQ ID NO: 714979 - DNA, 13 bp, C. elegans
cttgaaaattcca

SEQ ID NO: 714980 - DNA, 13 bp, C. elegans
cttgaaaatttca

SEQ ID NO: 714981 - DNA, 13 bp, C. elegans
cttgaaaattttc

SEQ ID NO: 714982 - DNA, 13 bp, C. elegans
cttgaaacagaaa

SEQ ID NO: 714983 - DNA, 13 bp, C. elegans
cttgaaagaaaaa

SEQ ID NO: 714984 - DNA, 13 bp, C. elegans
cttgaaattgaaa

SEQ ID NO: 714985 - DNA, 13 bp, C. elegans
cttgaaatttata

SEQ ID NO: 714986 - DNA, 13 bp, C. elegans
cttgaaatttttg

SEQ ID NO: 714987 - DNA, 13 bp, C. elegans
cttgaactagaat

SEQ ID NO: 714988 - DNA, 13 bp, C. elegans
cttgaactttgaa

SEQ ID NO: 714989 - DNA, 13 bp, C. elegans
cttgaagaacgga

SEQ ID NO: 714990 - DNA, 13 bp, C. elegans
cttgaataaaact

SEQ ID NO: 714991 - DNA, 13 bp, C. elegans
cttgaataaatat

SEQ ID NO: 714992 - DNA, 13 bp, C. elegans
cttgaataatttg

SEQ ID NO: 714993 - DNA, 13 bp, C. elegans
cttgaatataaaa

SEQ ID NO: 714994 - DNA, 13 bp, C. elegans
cttgaattatttt

SEQ ID NO: 714995 - DNA, 13 bp, C. elegans
cttgaatttattt

SEQ ID NO: 714996 - DNA, 13 bp, C. elegans
cttgacaaacttc

SEQ ID NO: 714997 - DNA, 13 bp, C. elegans
cttgactacacag

SEQ ID NO: 714998 - DNA, 13 bp, C. elegans
cttgactaccgta

SEQ ID NO: 714999 - DNA, 13 bp, C. elegans
cttgagaaatgtg

SEQ ID NO: 715000 - DNA, 13 bp, C. elegans
cttgagattcaaa

SEQ ID NO: 715001 - DNA, 13 bp, C. elegans
cttgatatatttt

SEQ ID NO: 715002 - DNA, 13 bp, C. elegans
cttgattcaaaaa

SEQ ID NO: 715003 - DNA, 13 bp, C. elegans
cttgattctcaaa

SEQ ID NO: 715004 - DNA, 13 bp, C. elegans
cttgattgatttt

SEQ ID NO: 715005 - DNA, 13 bp, C. elegans
cttgatttcaaaa

SEQ ID NO: 715006 - DNA, 13 bp, C. elegans
cttgatttttctc

SEQ ID NO: 715007 - DNA, 13 bp, C. elegans
cttgatttttctg

SEQ ID NO: 715008 - DNA, 13 bp, C. elegans
cttgcaatttatt

SEQ ID NO: 715009 - DNA, 13 bp, C. elegans
cttgcaattttaa

SEQ ID NO: 715010 - DNA, 13 bp, C. elegans
cttgcacatgagt

SEQ ID NO: 715011 - DNA, 13 bp, C. elegans
cttgcagcttttg

SEQ ID NO: 715012 - DNA, 13 bp, C. elegans
cttgcatttttct

SEQ ID NO: 715013 - DNA, 13 bp, C. elegans
cttgccggaagtt

SEQ ID NO: 715014 - DNA, 13 bp, C. elegans
cttgcgcaaatcg

SEQ ID NO: 715015 - DNA, 13 bp, C. elegans
cttggaaattgtt

SEQ ID NO: 715016 - DNA, 13 bp, C. elegans
cttggaactggag

SEQ ID NO: 715017 - DNA, 13 bp, C. elegans
cttggagttgatc

SEQ ID NO: 715018 - DNA, 13 bp, C. elegans
cttggcgcttttc

SEQ ID NO: 715019 - DNA, 13 bp, C. elegans
cttggctcatagc

SEQ ID NO: 715020 - DNA, 17 bp, C. elegans
cttggctcctactgact

SEQ ID NO: 715021 - DNA, 13 bp, C. elegans
cttggtcaaaaag

SEQ ID NO: 715022 - DNA, 13 bp, C. elegans
cttgtaatttttc

SEQ ID NO: 715023 - DNA, 13 bp, C. elegans
cttgtagatcaaa

SEQ ID NO: 715024 - DNA, 14 bp, C. elegans
cttgtccgtatcgt

SEQ ID NO: 715025 - DNA, 13 bp, C. elegans
cttgtcttcagtt

SEQ ID NO: 715026 - DNA, 13 bp, C. elegans
cttgtgaattttc

SEQ ID NO: 715027 - DNA, 13 bp, C. elegans
cttgtgtttttca

SEQ ID NO: 715028 - DNA, 13 bp, C. elegans
cttgttgaaacag

SEQ ID NO: 715029 - DNA, 13 bp, C. elegans
cttgttgcaaaaa

SEQ ID NO: 715030 - DNA, 13 bp, C. elegans
cttgttggaaaaa

SEQ ID NO: 715031 - DNA, 13 bp, C. elegans
cttgttttaaatt

SEQ ID NO: 715032 - DNA, 13 bp, C. elegans
cttgttttcccat

SEQ ID NO: 715033 - DNA, 13 bp, C. elegans
cttgttttgaatt

SEQ ID NO: 715034 - DNA, 13 bp, C. elegans
cttgtttttaaat

SEQ ID NO: 715035 - DNA, 13 bp, C. elegans
cttgtttttcaaa

SEQ ID NO: 715036 - DNA, 13 bp, C. elegans
ctttaaaacatgc

SEQ ID NO: 715037 - DNA, 13 bp, C. elegans
ctttaaaatacct

SEQ ID NO: 715038 - DNA, 13 bp, C. elegans
ctttaaaattgta

SEQ ID NO: 715039 - DNA, 13 bp, C. elegans
ctttaaaatttcc

SEQ ID NO: 715040 - DNA, 13 bp, C. elegans
ctttaaagaataa

SEQ ID NO: 715041 - DNA, 13 bp, C. elegans
ctttaaaggcgca

SEQ ID NO: 715042 - DNA, 13 bp, C. elegans
ctttaaaggcgcg

SEQ ID NO: 715043 - DNA, 13 bp, C. elegans
ctttaaatcaaaa

SEQ ID NO: 715044 - DNA, 13 bp, C. elegans
ctttaaatctaaa

SEQ ID NO: 715045 - DNA, 13 bp, C. elegans
ctttaaattcaaa

SEQ ID NO: 715046 - DNA, 13 bp, C. elegans
ctttaaatttcct

SEQ ID NO: 715047 - DNA, 13 bp, C. elegans
ctttaaatttctc

SEQ ID NO: 715048 - DNA, 13 bp, C. elegans
ctttaaattttcc

SEQ ID NO: 715049 - DNA, 13 bp, C. elegans
ctttaacaatttt

SEQ ID NO: 715050 - DNA, 13 bp, C. elegans
ctttaacttttca

SEQ ID NO: 715051 - DNA, 13 bp, C. elegans
ctttaataaaaac

SEQ ID NO: 715052 - DNA, 13 bp, C. elegans
ctttaataatttc

SEQ ID NO: 715053 - DNA, 13 bp, C. elegans
ctttaatttctaa

SEQ ID NO: 715054 - DNA, 13 bp, C. elegans
ctttaattttgaa

SEQ ID NO: 715055 - DNA, 13 bp, C. elegans
ctttaattttgta

SEQ ID NO: 715056 - DNA, 13 bp, C. elegans
ctttacaaaaata

SEQ ID NO: 715057 - DNA, 13 bp, C. elegans
ctttacaaaagtt

SEQ ID NO: 715058 - DNA, 13 bp, C. elegans
ctttacattttca

SEQ ID NO: 715059 - DNA, 13 bp, C. elegans
ctttaccacttct

SEQ ID NO: 715060 - DNA, 13 bp, C. elegans
ctttacttttcaa

SEQ ID NO: 715061 - DNA, 13 bp, C. elegans
ctttagatatttt

SEQ ID NO: 715062 - DNA, 13 bp, C. elegans
ctttagtggtttt

SEQ ID NO: 715063 - DNA, 13 bp, C. elegans
ctttatcaaaatg

SEQ ID NO: 715064 - DNA, 13 bp, C. elegans
ctttatcgagaac

SEQ ID NO: 715065 - DNA, 13 bp, C. elegans
ctttatgcaaaaa

SEQ ID NO: 715066 - DNA, 13 bp, C. elegans
ctttattcaaaaa

SEQ ID NO: 715067 - DNA, 13 bp, C. elegans
ctttattgaaaaa

SEQ ID NO: 715068 - DNA, 13 bp, C. elegans
ctttatttcaaaa

SEQ ID NO: 715069 - DNA, 13 bp, C. elegans
ctttatttcaaat

SEQ ID NO: 715070 - DNA, 13 bp, C. elegans
ctttatttgaaaa

SEQ ID NO: 715071 - DNA, 13 bp, C. elegans
ctttcaaaaaaag

SEQ ID NO: 715072 - DNA, 13 bp, C. elegans
ctttcaaaaacat

SEQ ID NO: 715073 - DNA, 13 bp, C. elegans
ctttcaaaaattg

SEQ ID NO: 715074 - DNA, 13 bp, C. elegans
ctttcaaaactca

SEQ ID NO: 715075 - DNA, 13 bp, C. elegans
ctttcaaaatttt

SEQ ID NO: 715076 - DNA, 13 bp, C. elegans
ctttcaaacaaat

SEQ ID NO: 715077 - DNA, 13 bp, C. elegans
ctttcaaataaca

SEQ ID NO: 715078 - DNA, 13 bp, C. elegans
ctttcaaataagc

SEQ ID NO: 715079 - DNA, 13 bp, C. elegans
ctttcaaataata

SEQ ID NO: 715080 - DNA, 13 bp, C. elegans
ctttcaaatgaaa

SEQ ID NO: 715081 - DNA, 13 bp, C. elegans
ctttcaaatgttc

SEQ ID NO: 715082 - DNA, 13 bp, C. elegans
ctttcaaatgttt

SEQ ID NO: 715083 - DNA, 13 bp, C. elegans
ctttcaacaaaat

SEQ ID NO: 715084 - DNA, 13 bp, C. elegans
ctttcaagaaaat

SEQ ID NO: 715085 - DNA, 13 bp, C. elegans
ctttcaattaaat

SEQ ID NO: 715086 - DNA, 13 bp, C. elegans
ctttcaatttcca

SEQ ID NO: 715087 - DNA, 13 bp, C. elegans
ctttcaatttttg

SEQ ID NO: 715088 - DNA, 13 bp, C. elegans
ctttcacacattt

SEQ ID NO: 715089 - DNA, 13 bp, C. elegans
ctttcacactttt

SEQ ID NO: 715090 - DNA, 13 bp, C. elegans
ctttcactttttg

SEQ ID NO: 715091 - DNA, 13 bp, C. elegans
ctttcagaaaaca

SEQ ID NO: 715092 - DNA, 13 bp, C. elegans
ctttcagaatttg

SEQ ID NO: 715093 - DNA, 13 bp, C. elegans
ctttcagattttt

SEQ ID NO: 715094 - DNA, 13 bp, C. elegans
ctttcagttttca

SEQ ID NO: 715095 - DNA, 13 bp, C. elegans
ctttcagttttct

SEQ ID NO: 715096 - DNA, 13 bp, C. elegans
ctttcataaaact

SEQ ID NO: 715097 - DNA, 13 bp, C. elegans
ctttcatgaattt

SEQ ID NO: 715098 - DNA, 13 bp, C. elegans
ctttcatgttttc

SEQ ID NO: 715099 - DNA, 13 bp, C. elegans
ctttcattcaaaa

SEQ ID NO: 715100 - DNA, 13 bp, C. elegans
ctttcattgaatt

SEQ ID NO: 715101 - DNA, 13 bp, C. elegans
ctttcatttaagt

SEQ ID NO: 715102 - DNA, 13 bp, C. elegans
ctttcatttgaca

SEQ ID NO: 715103 - DNA, 13 bp, C. elegans
ctttcattttatg

SEQ ID NO: 715104 - DNA, 13 bp, C. elegans
ctttcattttgca

SEQ ID NO: 715105 - DNA, 13 bp, C. elegans
ctttccaaattct

SEQ ID NO: 715106 - DNA, 13 bp, C. elegans
ctttccaaccaat

SEQ ID NO: 715107 - DNA, 13 bp, C. elegans
ctttccaatattt

SEQ ID NO: 715108 - DNA, 13 bp, C. elegans
ctttccactgaaa

SEQ ID NO: 715109 - DNA, 13 bp, C. elegans
ctttccagaattt

SEQ ID NO: 715110 - DNA, 13 bp, C. elegans
ctttccgatacaa

SEQ ID NO: 715111 - DNA, 13 bp, C. elegans
ctttcgatttttc

SEQ ID NO: 715112 - DNA, 13 bp, C. elegans
ctttcggaggaaa

SEQ ID NO: 715113 - DNA, 13 bp, C. elegans
ctttctacaaaaa

SEQ ID NO: 715114 - DNA, 13 bp, C. elegans
ctttctagctcaa

SEQ ID NO: 715115 - DNA, 13 bp, C. elegans
ctttctcaaaatt

SEQ ID NO: 715116 - DNA, 13 bp, C. elegans
ctttctcaatttc

SEQ ID NO: 715117 - DNA, 13 bp, C. elegans
ctttctcattgaa

SEQ ID NO: 715118 - DNA, 13 bp, C. elegans
ctttctctcaatt

SEQ ID NO: 715119 - DNA, 13 bp, C. elegans
ctttctgaaaata

SEQ ID NO: 715120 - DNA, 13 bp, C. elegans
ctttctgccaaac

SEQ ID NO: 715121 - DNA, 13 bp, C. elegans
ctttcttcaaaat

SEQ ID NO: 715122 - DNA, 13 bp, C. elegans
ctttcttcaataa

SEQ ID NO: 715123 - DNA, 13 bp, C. elegans
ctttcttggaaaa

SEQ ID NO: 715124 - DNA, 14 bp, C. elegans
ctttctttcaaaaa

SEQ ID NO: 715125 - DNA, 13 bp, C. elegans
ctttgaaaaaaaa

SEQ ID NO: 715126 - DNA, 13 bp, C. elegans
ctttgaaaataaa

SEQ ID NO: 715127 - DNA, 13 bp, C. elegans
ctttgaaaatctg

SEQ ID NO: 715128 - DNA, 13 bp, C. elegans
ctttgaaaatttg

SEQ ID NO: 715129 - DNA, 13 bp, C. elegans
ctttgaaacaatt

SEQ ID NO: 715130 - DNA, 13 bp, C. elegans
ctttgaaactgaa

SEQ ID NO: 715131 - DNA, 13 bp, C. elegans
ctttgaaagaaaa

SEQ ID NO: 715132 - DNA, 13 bp, C. elegans
ctttgaaatcttt

SEQ ID NO: 715133 - DNA, 13 bp, C. elegans
ctttgaaatttcc

SEQ ID NO: 715134 - DNA, 13 bp, C. elegans
ctttgaaattttt

SEQ ID NO: 715135 - DNA, 13 bp, C. elegans
ctttgaacatttt

SEQ ID NO: 715136 - DNA, 13 bp, C. elegans
ctttgaactgaaa

SEQ ID NO: 715137 - DNA, 13 bp, C. elegans
ctttgaagaaata

SEQ ID NO: 715138 - DNA, 13 bp, C. elegans
ctttgaagctgaa

SEQ ID NO: 715139 - DNA, 13 bp, C. elegans
ctttgaatttcat

SEQ ID NO: 715140 - DNA, 13 bp, C. elegans
ctttgaatttgtt

SEQ ID NO: 715141 - DNA, 13 bp, C. elegans
ctttgactttaaa

SEQ ID NO: 715142 - DNA, 13 bp, C. elegans
ctttgagcgattc

SEQ ID NO: 715143 - DNA, 13 bp, C. elegans
ctttgataattta

SEQ ID NO: 715144 - DNA, 13 bp, C. elegans
ctttgatgttcaa

SEQ ID NO: 715145 - DNA, 13 bp, C. elegans
ctttgatttcaaa

SEQ ID NO: 715146 - DNA, 13 bp, C. elegans
ctttgattttcta

SEQ ID NO: 715147 - DNA, 13 bp, C. elegans
ctttgcaaaattt

SEQ ID NO: 715148 - DNA, 13 bp, C. elegans
ctttgcatttttc

SEQ ID NO: 715149 - DNA, 13 bp, C. elegans
ctttgcctacctc

SEQ ID NO: 715150 - DNA, 13 bp, C. elegans
ctttgctcattga

SEQ ID NO: 715151 - DNA, 13 bp, C. elegans
ctttgctcattgt

SEQ ID NO: 715152 - DNA, 13 bp, C. elegans
ctttgctcatttt

SEQ ID NO: 715153 - DNA, 13 bp, C. elegans
ctttgctttttag

SEQ ID NO: 715154 - DNA, 13 bp, C. elegans
ctttggaaaaaaa

SEQ ID NO: 715155 - DNA, 13 bp, C. elegans
ctttggaaattga

SEQ ID NO: 715156 - DNA, 13 bp, C. elegans
ctttggcaaaact

SEQ ID NO: 715157 - DNA, 13 bp, C. elegans
ctttggctttggc

SEQ ID NO: 715158 - DNA, 13 bp, C. elegans
ctttgggaattta

SEQ ID NO: 715159 - DNA, 13 bp, C. elegans
ctttggtgcagcc

SEQ ID NO: 715160 - DNA, 13 bp, C. elegans
ctttgtaaatcta

SEQ ID NO: 715161 - DNA, 13 bp, C. elegans
ctttgtaataaaa

SEQ ID NO: 715162 - DNA, 13 bp, C. elegans
ctttgtattttca

SEQ ID NO: 715163 - DNA, 13 bp, C. elegans
ctttgtgcagttt

SEQ ID NO: 715164 - DNA, 13 bp, C. elegans
ctttgttctgaaa

SEQ ID NO: 715165 - DNA, 13 bp, C. elegans
cttttaaaaactt

SEQ ID NO: 715166 - DNA, 13 bp, C. elegans
cttttaaacgatt

SEQ ID NO: 715167 - DNA, 13 bp, C. elegans
cttttaaagtatt

SEQ ID NO: 715168 - DNA, 13 bp, C. elegans
cttttaacaattt

SEQ ID NO: 715169 - DNA, 13 bp, C. elegans
cttttaacctgcc

SEQ ID NO: 715170 - DNA, 13 bp, C. elegans
cttttaactttca

SEQ ID NO: 715171 - DNA, 13 bp, C. elegans
cttttaatggaaa

SEQ ID NO: 715172 - DNA, 13 bp, C. elegans
cttttaattgtaa

SEQ ID NO: 715173 - DNA, 13 bp, C. elegans
cttttaatttcaa

SEQ ID NO: 715174 - DNA, 13 bp, C. elegans
cttttacgacttt

SEQ ID NO: 715175 - DNA, 13 bp, C. elegans
cttttactttgaa

SEQ ID NO: 715176 - DNA, 13 bp, C. elegans
cttttatacaaaa

SEQ ID NO: 715177 - DNA, 13 bp, C. elegans
cttttatatacat

SEQ ID NO: 715178 - DNA, 13 bp, C. elegans
cttttatcgaaaa

SEQ ID NO: 715179 - DNA, 13 bp, C. elegans
cttttcaaaaatt

SEQ ID NO: 715180 - DNA, 13 bp, C. elegans
cttttcaaaactt

SEQ ID NO: 715181 - DNA, 13 bp, C. elegans
cttttcaaataat

SEQ ID NO: 715182 - DNA, 13 bp, C. elegans
cttttcaaattca

SEQ ID NO: 715183 - DNA, 13 bp, C. elegans
cttttcaaattcc

SEQ ID NO: 715184 - DNA, 13 bp, C. elegans
cttttcaaattga

SEQ ID NO: 715185 - DNA, 13 bp, C. elegans
cttttcaacaaaa

SEQ ID NO: 715186 - DNA, 13 bp, C. elegans
cttttcaaccaat

SEQ ID NO: 715187 - DNA, 13 bp, C. elegans
cttttcaactgtt

SEQ ID NO: 715188 - DNA, 13 bp, C. elegans
cttttcaatagtt

SEQ ID NO: 715189 - DNA, 13 bp, C. elegans
cttttcaatattc

SEQ ID NO: 715190 - DNA, 13 bp, C. elegans
cttttcacatatt

SEQ ID NO: 715191 - DNA, 13 bp, C. elegans
cttttcagacatt

SEQ ID NO: 715192 - DNA, 13 bp, C. elegans
cttttcagagaaa

SEQ ID NO: 715193 - DNA, 13 bp, C. elegans
cttttcagataaa

SEQ ID NO: 715194 - DNA, 13 bp, C. elegans
cttttcaggtttc

SEQ ID NO: 715195 - DNA, 13 bp, C. elegans
cttttcagttttc

SEQ ID NO: 715196 - DNA, 13 bp, C. elegans
cttttcattcaaa

SEQ ID NO: 715197 - DNA, 13 bp, C. elegans
cttttcatttcaa

SEQ ID NO: 715198 - DNA, 13 bp, C. elegans
cttttcatttgat

SEQ ID NO: 715199 - DNA, 13 bp, C. elegans
cttttccaaaaat

SEQ ID NO: 715200 - DNA, 13 bp, C. elegans
cttttccaacaaa

SEQ ID NO: 715201 - DNA, 13 bp, C. elegans
cttttccacgttt

SEQ ID NO: 715202 - DNA, 13 bp, C. elegans
cttttccatttca

SEQ ID NO: 715203 - DNA, 13 bp, C. elegans
cttttcccaaaag

SEQ ID NO: 715204 - DNA, 13 bp, C. elegans
cttttcccgattt

SEQ ID NO: 715205 - DNA, 13 bp, C. elegans
cttttccgaaaaa

SEQ ID NO: 715206 - DNA, 13 bp, C. elegans
cttttccgtgtca

SEQ ID NO: 715207 - DNA, 13 bp, C. elegans
cttttcctcaatt

SEQ ID NO: 715208 - DNA, 13 bp, C. elegans
cttttccttaaaa

SEQ ID NO: 715209 - DNA, 13 bp, C. elegans
cttttcgaaaata

SEQ ID NO: 715210 - DNA, 13 bp, C. elegans
cttttcgaccaat

SEQ ID NO: 715211 - DNA, 13 bp, C. elegans
cttttcgactttt

SEQ ID NO: 715212 - DNA, 13 bp, C. elegans
cttttcgagattt

SEQ ID NO: 715213 - DNA, 13 bp, C. elegans
cttttcgcattta

SEQ ID NO: 715214 - DNA, 13 bp, C. elegans
cttttcgttgcct

SEQ ID NO: 715215 - DNA, 13 bp, C. elegans
cttttctaataaa

SEQ ID NO: 715216 - DNA, 13 bp, C. elegans
cttttctcaaaat

SEQ ID NO: 715217 - DNA, 13 bp, C. elegans
cttttctcagttt

SEQ ID NO: 715218 - DNA, 13 bp, C. elegans
cttttctcgaaaa

SEQ ID NO: 715219 - DNA, 13 bp, C. elegans
cttttctcgattt

SEQ ID NO: 715220 - DNA, 13 bp, C. elegans
cttttctctcgaa

SEQ ID NO: 715221 - DNA, 13 bp, C. elegans
cttttctgaaaat

SEQ ID NO: 715222 - DNA, 13 bp, C. elegans
cttttctgcaact

SEQ ID NO: 715223 - DNA, 13 bp, C. elegans
cttttctggaaaa

SEQ ID NO: 715224 - DNA, 13 bp, C. elegans
cttttctgtactt

SEQ ID NO: 715225 - DNA, 13 bp, C. elegans
cttttctgtgaaa

SEQ ID NO: 715226 - DNA, 13 bp, C. elegans
cttttcttaaaaa

SEQ ID NO: 715227 - DNA, 13 bp, C. elegans
cttttcttatcaa

SEQ ID NO: 715228 - DNA, 13 bp, C. elegans
cttttcttgtcaa

SEQ ID NO: 715229 - DNA, 13 bp, C. elegans
cttttcttttgaa

SEQ ID NO: 715230 - DNA, 13 bp, C. elegans
cttttgaaaatca

SEQ ID NO: 715231 - DNA, 13 bp, C. elegans
cttttgaaacatg

SEQ ID NO: 715232 - DNA, 13 bp, C. elegans
cttttgaaatctt

SEQ ID NO: 715233 - DNA, 13 bp, C. elegans
cttttgaagtgaa

SEQ ID NO: 715234 - DNA, 13 bp, C. elegans
cttttgaagtgat

SEQ ID NO: 715235 - DNA, 13 bp, C. elegans
cttttgaattttc

SEQ ID NO: 715236 - DNA, 13 bp, C. elegans
cttttgaggaaat

SEQ ID NO: 715237 - DNA, 13 bp, C. elegans
cttttgataaata

SEQ ID NO: 715238 - DNA, 13 bp, C. elegans
cttttgatattct

SEQ ID NO: 715239 - DNA, 13 bp, C. elegans
cttttgatttgaa

SEQ ID NO: 715240 - DNA, 14 bp, C. elegans
cttttgattttcaa

SEQ ID NO: 715241 - DNA, 13 bp, C. elegans
cttttgcaataat

SEQ ID NO: 715242 - DNA, 13 bp, C. elegans
cttttgcacttat

SEQ ID NO: 715243 - DNA, 13 bp, C. elegans
cttttgcattttc

SEQ ID NO: 715244 - DNA, 13 bp, C. elegans
cttttgccgaaca

SEQ ID NO: 715245 - DNA, 13 bp, C. elegans
cttttgctcattg

SEQ ID NO: 715246 - DNA, 13 bp, C. elegans
cttttgctgaaaa

SEQ ID NO: 715247 - DNA, 13 bp, C. elegans
cttttggaatttt

SEQ ID NO: 715248 - DNA, 13 bp, C. elegans
cttttgtacaaaa

SEQ ID NO: 715249 - DNA, 13 bp, C. elegans
cttttgtagtttg

SEQ ID NO: 715250 - DNA, 13 bp, C. elegans
cttttgtgactat

SEQ ID NO: 715251 - DNA, 13 bp, C. elegans
cttttgtgatatt

SEQ ID NO: 715252 - DNA, 13 bp, C. elegans
cttttgttaaaca

SEQ ID NO: 715253 - DNA, 13 bp, C. elegans
cttttgttgctta

SEQ ID NO: 715254 - DNA, 13 bp, C. elegans
ctttttaaaaaac

SEQ ID NO: 715255 - DNA, 13 bp, C. elegans
ctttttaaaaatc

SEQ ID NO: 715256 - DNA, 13 bp, C. elegans
ctttttaaacaaa

SEQ ID NO: 715257 - DNA, 13 bp, C. elegans
ctttttaaagctt

SEQ ID NO: 715258 - DNA, 13 bp, C. elegans
ctttttaaattga

SEQ ID NO: 715259 - DNA, 13 bp, C. elegans
ctttttaaatttg

SEQ ID NO: 715260 - DNA, 13 bp, C. elegans
ctttttaagaaaa

SEQ ID NO: 715261 - DNA, 13 bp, C. elegans
ctttttaagattt

SEQ ID NO: 715262 - DNA, 13 bp, C. elegans
ctttttaatgtta

SEQ ID NO: 715263 - DNA, 13 bp, C. elegans
ctttttacaaaaa

SEQ ID NO: 715264 - DNA, 13 bp, C. elegans
ctttttaggccaa

SEQ ID NO: 715265 - DNA, 13 bp, C. elegans
ctttttagttgaa

SEQ ID NO: 715266 - DNA, 13 bp, C. elegans
ctttttatacaac

SEQ ID NO: 715267 - DNA, 13 bp, C. elegans
ctttttatgcaaa

SEQ ID NO: 715268 - DNA, 13 bp, C. elegans
ctttttattcaaa

SEQ ID NO: 715269 - DNA, 13 bp, C. elegans
ctttttattcgaa

SEQ ID NO: 715270 - DNA, 13 bp, C. elegans
ctttttcaaaaga

SEQ ID NO: 715271 - DNA, 13 bp, C. elegans
ctttttcaaaatg

SEQ ID NO: 715272 - DNA, 13 bp, C. elegans
ctttttcaaagat

SEQ ID NO: 715273 - DNA, 13 bp, C. elegans
ctttttcaaataa

SEQ ID NO: 715274 - DNA, 13 bp, C. elegans
ctttttcaaatat

SEQ ID NO: 715275 - DNA, 13 bp, C. elegans
ctttttcaacaaa

SEQ ID NO: 715276 - DNA, 13 bp, C. elegans
ctttttcaatgaa

SEQ ID NO: 715277 - DNA, 13 bp, C. elegans
ctttttcacacaa

SEQ ID NO: 715278 - DNA, 13 bp, C. elegans
ctttttcactcaa

SEQ ID NO: 715279 - DNA, 13 bp, C. elegans
ctttttcagttgt

SEQ ID NO: 715280 - DNA, 13 bp, C. elegans
ctttttccaacaa

SEQ ID NO: 715281 - DNA, 13 bp, C. elegans
ctttttccaactt

SEQ ID NO: 715282 - DNA, 13 bp, C. elegans
ctttttccaataa

SEQ ID NO: 715283 - DNA, 13 bp, C. elegans
ctttttccatcaa

SEQ ID NO: 715284 - DNA, 13 bp, C. elegans
ctttttccatcat

SEQ ID NO: 715285 - DNA, 13 bp, C. elegans
ctttttcccaaac

SEQ ID NO: 715286 - DNA, 13 bp, C. elegans
ctttttcccaatt

SEQ ID NO: 715287 - DNA, 13 bp, C. elegans
ctttttccttcaa

SEQ ID NO: 715288 - DNA, 13 bp, C. elegans
ctttttcgacttt

SEQ ID NO: 715289 - DNA, 13 bp, C. elegans
ctttttcgataaa

SEQ ID NO: 715290 - DNA, 13 bp, C. elegans
ctttttcgatatt

SEQ ID NO: 715291 - DNA, 13 bp, C. elegans
ctttttcgattgt

SEQ ID NO: 715292 - DNA, 13 bp, C. elegans
ctttttcgctact

SEQ ID NO: 715293 - DNA, 13 bp, C. elegans
ctttttcggtgaa

SEQ ID NO: 715294 - DNA, 13 bp, C. elegans
ctttttcgtcaaa

SEQ ID NO: 715295 - DNA, 13 bp, C. elegans
ctttttcgtcatt

SEQ ID NO: 715296 - DNA, 13 bp, C. elegans
ctttttctcagaa

SEQ ID NO: 715297 - DNA, 13 bp, C. elegans
ctttttctccaat

SEQ ID NO: 715298 - DNA, 13 bp, C. elegans
ctttttctcccaa

SEQ ID NO: 715299 - DNA, 13 bp, C. elegans
ctttttctgaaac

SEQ ID NO: 715300 - DNA, 13 bp, C. elegans
ctttttctgtaat

SEQ ID NO: 715301 - DNA, 13 bp, C. elegans
ctttttctgtgat

SEQ ID NO: 715302 - DNA, 13 bp, C. elegans
ctttttcttgaat

SEQ ID NO: 715303 - DNA, 13 bp, C. elegans
ctttttgaaaaag

SEQ ID NO: 715304 - DNA, 13 bp, C. elegans
ctttttgaaaatt

SEQ ID NO: 715305 - DNA, 13 bp, C. elegans
ctttttgaacatg

SEQ ID NO: 715306 - DNA, 13 bp, C. elegans
ctttttgaacttt

SEQ ID NO: 715307 - DNA, 13 bp, C. elegans
ctttttgaatcaa

SEQ ID NO: 715308 - DNA, 13 bp, C. elegans
ctttttgaatgaa

SEQ ID NO: 715309 - DNA, 13 bp, C. elegans
ctttttgactact

SEQ ID NO: 715310 - DNA, 13 bp, C. elegans
ctttttgagagaa

SEQ ID NO: 715311 - DNA, 13 bp, C. elegans
ctttttgcacatt

SEQ ID NO: 715312 - DNA, 13 bp, C. elegans
ctttttgcattta

SEQ ID NO: 715313 - DNA, 13 bp, C. elegans
ctttttgccattt

SEQ ID NO: 715314 - DNA, 13 bp, C. elegans
ctttttgcccaaa

SEQ ID NO: 715315 - DNA, 13 bp, C. elegans
ctttttgccttat

SEQ ID NO: 715316 - DNA, 13 bp, C. elegans
ctttttgctcatt

SEQ ID NO: 715317 - DNA, 13 bp, C. elegans
ctttttgctttaa

SEQ ID NO: 715318 - DNA, 13 bp, C. elegans
ctttttggaaaaa

SEQ ID NO: 715319 - DNA, 13 bp, C. elegans
ctttttggaaatg

SEQ ID NO: 715320 - DNA, 13 bp, C. elegans
ctttttggaaatt

SEQ ID NO: 715321 - DNA, 14 bp, C. elegans
ctttttggaagaaa

SEQ ID NO: 715322 - DNA, 13 bp, C. elegans
ctttttggagaaa

SEQ ID NO: 715323 - DNA, 13 bp, C. elegans
ctttttggcaaaa

SEQ ID NO: 715324 - DNA, 13 bp, C. elegans
ctttttgtcactt

SEQ ID NO: 715325 - DNA, 13 bp, C. elegans
ctttttgtccaaa

SEQ ID NO: 715326 - DNA, 13 bp, C. elegans
ctttttgttagct

SEQ ID NO: 715327 - DNA, 13 bp, C. elegans
ctttttgttcaaa

SEQ ID NO: 715328 - DNA, 13 bp, C. elegans
ctttttgttgcaa

SEQ ID NO: 715329 - DNA, 13 bp, C. elegans
ctttttgtttcca

SEQ ID NO: 715330 - DNA, 13 bp, C. elegans
cttttttaaaaga

SEQ ID NO: 715331 - DNA, 13 bp, C. elegans
cttttttaaaatc

SEQ ID NO: 715332 - DNA, 13 bp, C. elegans
cttttttaatgta

SEQ ID NO: 715333 - DNA, 13 bp, C. elegans
cttttttaattga

SEQ ID NO: 715334 - DNA, 13 bp, C. elegans
cttttttagaatt

SEQ ID NO: 715335 - DNA, 13 bp, C. elegans
cttttttatctga

SEQ ID NO: 715336 - DNA, 13 bp, C. elegans
cttttttcaaacg

SEQ ID NO: 715337 - DNA, 13 bp, C. elegans
cttttttcaagtt

SEQ ID NO: 715338 - DNA, 13 bp, C. elegans
cttttttccagaa

SEQ ID NO: 715339 - DNA, 13 bp, C. elegans
cttttttccagtt

SEQ ID NO: 715340 - DNA, 13 bp, C. elegans
cttttttcgaaat

SEQ ID NO: 715341 - DNA, 13 bp, C. elegans
cttttttcgaacg

SEQ ID NO: 715342 - DNA, 13 bp, C. elegans
cttttttcgagtt

SEQ ID NO: 715343 - DNA, 13 bp, C. elegans
cttttttcgatga

SEQ ID NO: 715344 - DNA, 13 bp, C. elegans
cttttttcggatt

SEQ ID NO: 715345 - DNA, 13 bp, C. elegans
cttttttcggtga

SEQ ID NO: 715346 - DNA, 13 bp, C. elegans
cttttttctaaac

SEQ ID NO: 715347 - DNA, 13 bp, C. elegans
cttttttctacaa

SEQ ID NO: 715348 - DNA, 13 bp, C. elegans
cttttttctacgt

SEQ ID NO: 715349 - DNA, 13 bp, C. elegans
cttttttctgcaa

SEQ ID NO: 715350 - DNA, 13 bp, C. elegans
cttttttctgcat

SEQ ID NO: 715351 - DNA, 13 bp, C. elegans
cttttttctgtaa

SEQ ID NO: 715352 - DNA, 13 bp, C. elegans
cttttttgaaaac

SEQ ID NO: 715353 - DNA, 13 bp, C. elegans
cttttttgacatt

SEQ ID NO: 715354 - DNA, 13 bp, C. elegans
cttttttgagatt

SEQ ID NO: 715355 - DNA, 13 bp, C. elegans
cttttttgatcta

SEQ ID NO: 715356 - DNA, 13 bp, C. elegans
cttttttgcaatt

SEQ ID NO: 715357 - DNA, 13 bp, C. elegans
cttttttgcatta

SEQ ID NO: 715358 - DNA, 13 bp, C. elegans
cttttttgccgaa

SEQ ID NO: 715359 - DNA, 13 bp, C. elegans
cttttttgcgaaa

SEQ ID NO: 715360 - DNA, 13 bp, C. elegans
cttttttgctgaa

SEQ ID NO: 715361 - DNA, 13 bp, C. elegans
cttttttggaatt

SEQ ID NO: 715362 - DNA, 13 bp, C. elegans
cttttttggcaat

SEQ ID NO: 715363 - DNA, 13 bp, C. elegans
cttttttggtaat

SEQ ID NO: 715364 - DNA, 13 bp, C. elegans
cttttttgtagct

SEQ ID NO: 715365 - DNA, 13 bp, C. elegans
cttttttgtgaat

SEQ ID NO: 715366 - DNA, 13 bp, C. elegans
cttttttgtgata

SEQ ID NO: 715367 - DNA, 13 bp, C. elegans
cttttttgtgatg

SEQ ID NO: 715368 - DNA, 13 bp, C. elegans
ctttttttaaatg

SEQ ID NO: 715369 - DNA, 13 bp, C. elegans
ctttttttaatcg

SEQ ID NO: 715370 - DNA, 13 bp, C. elegans
ctttttttacaaa

SEQ ID NO: 715371 - DNA, 13 bp, C. elegans
ctttttttccaaa

SEQ ID NO: 715372 - DNA, 13 bp, C. elegans
ctttttttccaga

SEQ ID NO: 715373 - DNA, 13 bp, C. elegans
ctttttttccagt

SEQ ID NO: 715374 - DNA, 13 bp, C. elegans
ctttttttcctga

SEQ ID NO: 715375 - DNA, 13 bp, C. elegans
ctttttttcgagt

SEQ ID NO: 715376 - DNA, 13 bp, C. elegans
ctttttttcggaa

SEQ ID NO: 715377 - DNA, 13 bp, C. elegans
ctttttttgacat

SEQ ID NO: 715378 - DNA, 13 bp, C. elegans
ctttttttgcaag

SEQ ID NO: 715379 - DNA, 13 bp, C. elegans
ctttttttgctca

SEQ ID NO: 715380 - DNA, 13 bp, C. elegans
ctttttttggaaa

SEQ ID NO: 715381 - DNA, 13 bp, C. elegans
ctttttttggaat

SEQ ID NO: 715382 - DNA, 13 bp, C. elegans
ctttttttgtcaa

SEQ ID NO: 715383 - DNA, 13 bp, C. elegans
ctttttttgtcga

SEQ ID NO: 715384 - DNA, 13 bp, C. elegans
cttttttttagaa

SEQ ID NO: 715385 - DNA, 13 bp, C. elegans
cttttttttagga

SEQ ID NO: 715386 - DNA, 13 bp, C. elegans
gaaaaaaaacgtt

SEQ ID NO: 715387 - DNA, 13 bp, C. elegans
gaaaaaaacattt

SEQ ID NO: 715388 - DNA, 13 bp, C. elegans
gaaaaaaacgatt

SEQ ID NO: 715389 - DNA, 13 bp, C. elegans
gaaaaaaacgttt

SEQ ID NO: 715390 - DNA, 13 bp, C. elegans
gaaaaaaagtttc

SEQ ID NO: 715391 - DNA, 13 bp, C. elegans
gaaaaaaatgcac

SEQ ID NO: 715392 - DNA, 13 bp, C. elegans
gaaaaaaatgtca

SEQ ID NO: 715393 - DNA, 13 bp, C. elegans
gaaaaaaatgttg

SEQ ID NO: 715394 - DNA, 13 bp, C. elegans
gaaaaaaatttca

SEQ ID NO: 715395 - DNA, 13 bp, C. elegans
gaaaaaacaattt

SEQ ID NO: 715396 - DNA, 13 bp, C. elegans
gaaaaaacactga

SEQ ID NO: 715397 - DNA, 13 bp, C. elegans
gaaaaaacatcga

SEQ ID NO: 715398 - DNA, 13 bp, C. elegans
gaaaaaacatttt

SEQ ID NO: 715399 - DNA, 13 bp, C. elegans
gaaaaaaccattt

SEQ ID NO: 715400 - DNA, 13 bp, C. elegans
gaaaaaaccgttt

SEQ ID NO: 715401 - DNA, 13 bp, C. elegans
gaaaaaacgagtt

SEQ ID NO: 715402 - DNA, 13 bp, C. elegans
gaaaaaactccaa

SEQ ID NO: 715403 - DNA, 13 bp, C. elegans
gaaaaaacttgaa

SEQ ID NO: 715404 - DNA, 13 bp, C. elegans
gaaaaaagagttc

SEQ ID NO: 715405 - DNA, 13 bp, C. elegans
gaaaaaagatgca

SEQ ID NO: 715406 - DNA, 13 bp, C. elegans
gaaaaaagctgaa

SEQ ID NO: 715407 - DNA, 13 bp, C. elegans
gaaaaaaggagct

SEQ ID NO: 715408 - DNA, 13 bp, C. elegans
gaaaaaaggtgtg

SEQ ID NO: 715409 - DNA, 13 bp, C. elegans
gaaaaaagtgatt

SEQ ID NO: 715410 - DNA, 13 bp, C. elegans
gaaaaaagtgcaa

SEQ ID NO: 715411 - DNA, 13 bp, C. elegans
gaaaaaagttatg

SEQ ID NO: 715412 - DNA, 13 bp, C. elegans
gaaaaaagttcca

SEQ ID NO: 715413 - DNA, 13 bp, C. elegans
gaaaaaagttcta

SEQ ID NO: 715414 - DNA, 13 bp, C. elegans
gaaaaaagttgca

SEQ ID NO: 715415 - DNA, 13 bp, C. elegans
gaaaaaagtttca

SEQ ID NO: 715416 - DNA, 13 bp, C. elegans
gaaaaaatacgat

SEQ ID NO: 715417 - DNA, 13 bp, C. elegans
gaaaaaatatccg

SEQ ID NO: 715418 - DNA, 13 bp, C. elegans
gaaaaaatcactt

SEQ ID NO: 715419 - DNA, 13 bp, C. elegans
gaaaaaatcagct

SEQ ID NO: 715420 - DNA, 13 bp, C. elegans
gaaaaaatcattt

SEQ ID NO: 715421 - DNA, 13 bp, C. elegans
gaaaaaatcgatc

SEQ ID NO: 715422 - DNA, 13 bp, C. elegans
gaaaaaatctata

SEQ ID NO: 715423 - DNA, 13 bp, C. elegans
gaaaaaatctgaa

SEQ ID NO: 715424 - DNA, 13 bp, C. elegans
gaaaaaatgagtt

SEQ ID NO: 715425 - DNA, 13 bp, C. elegans
gaaaaaatgattt

SEQ ID NO: 715426 - DNA, 13 bp, C. elegans
gaaaaaatgcact

SEQ ID NO: 715427 - DNA, 13 bp, C. elegans
gaaaaaatgctaa

SEQ ID NO: 715428 - DNA, 13 bp, C. elegans
gaaaaaatggatt

SEQ ID NO: 715429 - DNA, 13 bp, C. elegans
gaaaaaatggttt

SEQ ID NO: 715430 - DNA, 13 bp, C. elegans
gaaaaaatgtcac

SEQ ID NO: 715431 - DNA, 13 bp, C. elegans
gaaaaaatgtgtt

SEQ ID NO: 715432 - DNA, 13 bp, C. elegans
gaaaaaatgttct

SEQ ID NO: 715433 - DNA, 13 bp, C. elegans
gaaaaaatgttga

SEQ ID NO: 715434 - DNA, 13 bp, C. elegans
gaaaaaattaact

SEQ ID NO: 715435 - DNA, 13 bp, C. elegans
gaaaaaattcccg

SEQ ID NO: 715436 - DNA, 13 bp, C. elegans
gaaaaaatttcaa

SEQ ID NO: 715437 - DNA, 13 bp, C. elegans
gaaaaaattttct

SEQ ID NO: 715438 - DNA, 13 bp, C. elegans
gaaaaaattttga

SEQ ID NO: 715439 - DNA, 13 bp, C. elegans
gaaaaacaaattg

SEQ ID NO: 715440 - DNA, 13 bp, C. elegans
gaaaaacaacatt

SEQ ID NO: 715441 - DNA, 13 bp, C. elegans
gaaaaacaatttt

SEQ ID NO: 715442 - DNA, 13 bp, C. elegans
gaaaaacagtttt

SEQ ID NO: 715443 - DNA, 13 bp, C. elegans
gaaaaacatctaa

SEQ ID NO: 715444 - DNA, 13 bp, C. elegans
gaaaaacattcaa

SEQ ID NO: 715445 - DNA, 13 bp, C. elegans
gaaaaacattgaa

SEQ ID NO: 715446 - DNA, 13 bp, C. elegans
gaaaaacatttaa

SEQ ID NO: 715447 - DNA, 13 bp, C. elegans
gaaaaaccaacat

SEQ ID NO: 715448 - DNA, 13 bp, C. elegans
gaaaaaccaagtt

SEQ ID NO: 715449 - DNA, 13 bp, C. elegans
gaaaaaccagatt

SEQ ID NO: 715450 - DNA, 13 bp, C. elegans
gaaaaaccatcaa

SEQ ID NO: 715451 - DNA, 13 bp, C. elegans
gaaaaaccgacga

SEQ ID NO: 715452 - DNA, 13 bp, C. elegans
gaaaaaccgataa

SEQ ID NO: 715453 - DNA, 13 bp, C. elegans
gaaaaaccgtcaa

SEQ ID NO: 715454 - DNA, 13 bp, C. elegans
gaaaaacgaaatt

SEQ ID NO: 715455 - DNA, 13 bp, C. elegans
gaaaaacgaatat

SEQ ID NO: 715456 - DNA, 13 bp, C. elegans
gaaaaacgagcca

SEQ ID NO: 715457 - DNA, 13 bp, C. elegans
gaaaaacggtctg

SEQ ID NO: 715458 - DNA, 13 bp, C. elegans
gaaaaacgtgatt

SEQ ID NO: 715459 - DNA, 13 bp, C. elegans
gaaaaactaattt

SEQ ID NO: 715460 - DNA, 13 bp, C. elegans
gaaaaactacgaa

SEQ ID NO: 715461 - DNA, 13 bp, C. elegans
gaaaaactaggaa

SEQ ID NO: 715462 - DNA, 13 bp, C. elegans
gaaaaactcaatt

SEQ ID NO: 715463 - DNA, 13 bp, C. elegans
gaaaaactccaat

SEQ ID NO: 715464 - DNA, 13 bp, C. elegans
gaaaaactcgaat

SEQ ID NO: 715465 - DNA, 13 bp, C. elegans
gaaaaactctaaa

SEQ ID NO: 715466 - DNA, 13 bp, C. elegans
gaaaaactcttcc

SEQ ID NO: 715467 - DNA, 13 bp, C. elegans
gaaaaactgaaga

SEQ ID NO: 715468 - DNA, 13 bp, C. elegans
gaaaaactgaatt

SEQ ID NO: 715469 - DNA, 13 bp, C. elegans
gaaaaactggaaa

SEQ ID NO: 715470 - DNA, 13 bp, C. elegans
gaaaaactgtaat

SEQ ID NO: 715471 - DNA, 13 bp, C. elegans
gaaaaactgttgc

SEQ ID NO: 715472 - DNA, 13 bp, C. elegans
gaaaaactgtttc

SEQ ID NO: 715473 - DNA, 13 bp, C. elegans
gaaaaacttatca

SEQ ID NO: 715474 - DNA, 13 bp, C. elegans
gaaaaacttattt

SEQ ID NO: 715475 - DNA, 13 bp, C. elegans
gaaaaactttgaa

SEQ ID NO: 715476 - DNA, 13 bp, C. elegans
gaaaaactttttt

SEQ ID NO: 715477 - DNA, 13 bp, C. elegans
gaaaaagaatcca

SEQ ID NO: 715478 - DNA, 13 bp, C. elegans
gaaaaagacattc

SEQ ID NO: 715479 - DNA, 13 bp, C. elegans
gaaaaagaggatt

SEQ ID NO: 715480 - DNA, 13 bp, C. elegans
gaaaaagagtttg

SEQ ID NO: 715481 - DNA, 13 bp, C. elegans
gaaaaagatgcaa

SEQ ID NO: 715482 - DNA, 13 bp, C. elegans
gaaaaagcattca

SEQ ID NO: 715483 - DNA, 13 bp, C. elegans
gaaaaagccaaat

SEQ ID NO: 715484 - DNA, 13 bp, C. elegans
gaaaaagccatcg

SEQ ID NO: 715485 - DNA, 13 bp, C. elegans
gaaaaagcgataa

SEQ ID NO: 715486 - DNA, 13 bp, C. elegans
gaaaaagctagaa

SEQ ID NO: 715487 - DNA, 13 bp, C. elegans
gaaaaagctcaga

SEQ ID NO: 715488 - DNA, 13 bp, C. elegans
gaaaaagcttcaa

SEQ ID NO: 715489 - DNA, 13 bp, C. elegans
gaaaaaggaattt

SEQ ID NO: 715490 - DNA, 13 bp, C. elegans
gaaaaagtagatt

SEQ ID NO: 715491 - DNA, 13 bp, C. elegans
gaaaaagtcaata

SEQ ID NO: 715492 - DNA, 13 bp, C. elegans
gaaaaagtcaatt

SEQ ID NO: 715493 - DNA, 13 bp, C. elegans
gaaaaagtcacaa

SEQ ID NO: 715494 - DNA, 13 bp, C. elegans
gaaaaagtcgatt

SEQ ID NO: 715495 - DNA, 13 bp, C. elegans
gaaaaagtcgttt

SEQ ID NO: 715496 - DNA, 13 bp, C. elegans
gaaaaagtctaaa

SEQ ID NO: 715497 - DNA, 13 bp, C. elegans
gaaaaagtgaatt

SEQ ID NO: 715498 - DNA, 13 bp, C. elegans
gaaaaagtgagat

SEQ ID NO: 715499 - DNA, 13 bp, C. elegans
gaaaaagtgagtt

SEQ ID NO: 715500 - DNA, 13 bp, C. elegans
gaaaaagtgcatt

SEQ ID NO: 715501 - DNA, 13 bp, C. elegans
gaaaaagtggaat

SEQ ID NO: 715502 - DNA, 13 bp, C. elegans
gaaaaagtggatt

SEQ ID NO: 715503 - DNA, 13 bp, C. elegans
gaaaaagtgttca

SEQ ID NO: 715504 - DNA, 13 bp, C. elegans
gaaaaagttagat

SEQ ID NO: 715505 - DNA, 13 bp, C. elegans
gaaaaagttcaga

SEQ ID NO: 715506 - DNA, 13 bp, C. elegans
gaaaaagttgcaa

SEQ ID NO: 715507 - DNA, 13 bp, C. elegans
gaaaaagttgcag

SEQ ID NO: 715508 - DNA, 13 bp, C. elegans
gaaaaagttggaa

SEQ ID NO: 715509 - DNA, 13 bp, C. elegans
gaaaaagttggga

SEQ ID NO: 715510 - DNA, 13 bp, C. elegans
gaaaaagtttcga

SEQ ID NO: 715511 - DNA, 13 bp, C. elegans
gaaaaagttttaa

SEQ ID NO: 715512 - DNA, 13 bp, C. elegans
gaaaaagtttttt

SEQ ID NO: 715513 - DNA, 13 bp, C. elegans
gaaaaataatgtg

SEQ ID NO: 715514 - DNA, 13 bp, C. elegans
gaaaaatacaatt

SEQ ID NO: 715515 - DNA, 13 bp, C. elegans
gaaaaatacagct

SEQ ID NO: 715516 - DNA, 13 bp, C. elegans
gaaaaataccaat

SEQ ID NO: 715517 - DNA, 13 bp, C. elegans
gaaaaatagttga

SEQ ID NO: 715518 - DNA, 13 bp, C. elegans
gaaaaatatagtt

SEQ ID NO: 715519 - DNA, 13 bp, C. elegans
gaaaaatatatgt

SEQ ID NO: 715520 - DNA, 13 bp, C. elegans
gaaaaatatcgat

SEQ ID NO: 715521 - DNA, 13 bp, C. elegans
gaaaaatattcaa

SEQ ID NO: 715522 - DNA, 13 bp, C. elegans
gaaaaatattcac

SEQ ID NO: 715523 - DNA, 13 bp, C. elegans
gaaaaatcaaatc

SEQ ID NO: 715524 - DNA, 13 bp, C. elegans
gaaaaatcaaatt

SEQ ID NO: 715525 - DNA, 13 bp, C. elegans
gaaaaatcaatca

SEQ ID NO: 715526 - DNA, 13 bp, C. elegans
gaaaaatcaatga

SEQ ID NO: 715527 - DNA, 13 bp, C. elegans
gaaaaatcaatgg

SEQ ID NO: 715528 - DNA, 13 bp, C. elegans
gaaaaatcacaat

SEQ ID NO: 715529 - DNA, 13 bp, C. elegans
gaaaaatcacagt

SEQ ID NO: 715530 - DNA, 13 bp, C. elegans
gaaaaatcacatt

SEQ ID NO: 715531 - DNA, 13 bp, C. elegans
gaaaaatcactaa

SEQ ID NO: 715532 - DNA, 13 bp, C. elegans
gaaaaatcactga

SEQ ID NO: 715533 - DNA, 13 bp, C. elegans
gaaaaatcagaat

SEQ ID NO: 715534 - DNA, 13 bp, C. elegans
gaaaaatcatcaa

SEQ ID NO: 715535 - DNA, 13 bp, C. elegans
gaaaaatcatgtt

SEQ ID NO: 715536 - DNA, 13 bp, C. elegans
gaaaaatcattca

SEQ ID NO: 715537 - DNA, 13 bp, C. elegans
gaaaaatcattga

SEQ ID NO: 715538 - DNA, 13 bp, C. elegans
gaaaaatcatttt

SEQ ID NO: 715539 - DNA, 13 bp, C. elegans
gaaaaatccaaat

SEQ ID NO: 715540 - DNA, 13 bp, C. elegans
gaaaaatccaatt

SEQ ID NO: 715541 - DNA, 13 bp, C. elegans
gaaaaatccccaa

SEQ ID NO: 715542 - DNA, 13 bp, C. elegans
gaaaaatcgaatt

SEQ ID NO: 715543 - DNA, 13 bp, C. elegans
gaaaaatcgacaa

SEQ ID NO: 715544 - DNA, 13 bp, C. elegans
gaaaaatcgagtt

SEQ ID NO: 715545 - DNA, 14 bp, C. elegans
gaaaaatcgataat

SEQ ID NO: 715546 - DNA, 13 bp, C. elegans
gaaaaatcgccaa

SEQ ID NO: 715547 - DNA, 13 bp, C. elegans
gaaaaatcggatt

SEQ ID NO: 715548 - DNA, 13 bp, C. elegans
gaaaaatcggtga

SEQ ID NO: 715549 - DNA, 13 bp, C. elegans
gaaaaatcgtttg

SEQ ID NO: 715550 - DNA, 14 bp, C. elegans
gaaaaatcgttttt

SEQ ID NO: 715551 - DNA, 13 bp, C. elegans
gaaaaatctaaat

SEQ ID NO: 715552 - DNA, 13 bp, C. elegans
gaaaaatctaatt

SEQ ID NO: 715553 - DNA, 13 bp, C. elegans
gaaaaatctactt

SEQ ID NO: 715554 - DNA, 13 bp, C. elegans
gaaaaatctataa

SEQ ID NO: 715555 - DNA, 13 bp, C. elegans
gaaaaatctccaa

SEQ ID NO: 715556 - DNA, 13 bp, C. elegans
gaaaaatctctga

SEQ ID NO: 715557 - DNA, 13 bp, C. elegans
gaaaaatctgcaa

SEQ ID NO: 715558 - DNA, 13 bp, C. elegans
gaaaaatgaaact

SEQ ID NO: 715559 - DNA, 13 bp, C. elegans
gaaaaatgaattt

SEQ ID NO: 715560 - DNA, 13 bp, C. elegans
gaaaaatgaccga

SEQ ID NO: 715561 - DNA, 13 bp, C. elegans
gaaaaatgacgga

SEQ ID NO: 715562 - DNA, 13 bp, C. elegans
gaaaaatgagttt

SEQ ID NO: 715563 - DNA, 13 bp, C. elegans
gaaaaatgatagt

SEQ ID NO: 715564 - DNA, 13 bp, C. elegans
gaaaaatgatcga

SEQ ID NO: 715565 - DNA, 13 bp, C. elegans
gaaaaatgatgat

SEQ ID NO: 715566 - DNA, 13 bp, C. elegans
gaaaaatgattga

SEQ ID NO: 715567 - DNA, 13 bp, C. elegans
gaaaaatgatttg

SEQ ID NO: 715568 - DNA, 13 bp, C. elegans
gaaaaatgatttt

SEQ ID NO: 715569 - DNA, 13 bp, C. elegans
gaaaaatgcaaac

SEQ ID NO: 715570 - DNA, 13 bp, C. elegans
gaaaaatgcaatg

SEQ ID NO: 715571 - DNA, 13 bp, C. elegans
gaaaaatgccatt

SEQ ID NO: 715572 - DNA, 13 bp, C. elegans
gaaaaatgcgatt

SEQ ID NO: 715573 - DNA, 13 bp, C. elegans
gaaaaatgcggga

SEQ ID NO: 715574 - DNA, 13 bp, C. elegans
gaaaaatgctgaa

SEQ ID NO: 715575 - DNA, 13 bp, C. elegans
gaaaaatggaact

SEQ ID NO: 715576 - DNA, 13 bp, C. elegans
gaaaaatggaatt

SEQ ID NO: 715577 - DNA, 13 bp, C. elegans
gaaaaatggacga

SEQ ID NO: 715578 - DNA, 13 bp, C. elegans
gaaaaatggagat

SEQ ID NO: 715579 - DNA, 13 bp, C. elegans
gaaaaatggagtt

SEQ ID NO: 715580 - DNA, 13 bp, C. elegans
gaaaaatggatta

SEQ ID NO: 715581 - DNA, 13 bp, C. elegans
gaaaaatggcaac

SEQ ID NO: 715582 - DNA, 13 bp, C. elegans
gaaaaatggcaat

SEQ ID NO: 715583 - DNA, 13 bp, C. elegans
gaaaaatggccgt

SEQ ID NO: 715584 - DNA, 13 bp, C. elegans
gaaaaatggcgaa

SEQ ID NO: 715585 - DNA, 13 bp, C. elegans
gaaaaatgggatt

SEQ ID NO: 715586 - DNA, 13 bp, C. elegans
gaaaaatggtgaa

SEQ ID NO: 715587 - DNA, 13 bp, C. elegans
gaaaaatggtgat

SEQ ID NO: 715588 - DNA, 13 bp, C. elegans
gaaaaatggttca

SEQ ID NO: 715589 - DNA, 13 bp, C. elegans
gaaaaatgtacta

SEQ ID NO: 715590 - DNA, 13 bp, C. elegans
gaaaaatgtatga

SEQ ID NO: 715591 - DNA, 13 bp, C. elegans
gaaaaatgtcaac

SEQ ID NO: 715592 - DNA, 13 bp, C. elegans
gaaaaatgtcaga

SEQ ID NO: 715593 - DNA, 13 bp, C. elegans
gaaaaatgtcctc

SEQ ID NO: 715594 - DNA, 13 bp, C. elegans
gaaaaatgtcgaa

SEQ ID NO: 715595 - DNA, 13 bp, C. elegans
gaaaaatgtcggc

SEQ ID NO: 715596 - DNA, 13 bp, C. elegans
gaaaaatgtgaac

SEQ ID NO: 715597 - DNA, 13 bp, C. elegans
gaaaaatgtggat

SEQ ID NO: 715598 - DNA, 13 bp, C. elegans
gaaaaatgttaga

SEQ ID NO: 715599 - DNA, 13 bp, C. elegans
gaaaaatgttcat

SEQ ID NO: 715600 - DNA, 13 bp, C. elegans
gaaaaatgttgaa

SEQ ID NO: 715601 - DNA, 14 bp, C. elegans
gaaaaatgttgaat

SEQ ID NO: 715602 - DNA, 13 bp, C. elegans
gaaaaatgttgat

SEQ ID NO: 715603 - DNA, 13 bp, C. elegans
gaaaaatgttgct

SEQ ID NO: 715604 - DNA, 13 bp, C. elegans
gaaaaatgtttaa

SEQ ID NO: 715605 - DNA, 13 bp, C. elegans
gaaaaatgtttca

SEQ ID NO: 715606 - DNA, 13 bp, C. elegans
gaaaaattacatt

SEQ ID NO: 715607 - DNA, 13 bp, C. elegans
gaaaaattactaa

SEQ ID NO: 715608 - DNA, 13 bp, C. elegans
gaaaaattactga

SEQ ID NO: 715609 - DNA, 13 bp, C. elegans
gaaaaattagcaa

SEQ ID NO: 715610 - DNA, 13 bp, C. elegans
gaaaaattatcga

SEQ ID NO: 715611 - DNA, 13 bp, C. elegans
gaaaaattatgga

SEQ ID NO: 715612 - DNA, 13 bp, C. elegans
gaaaaattattga

SEQ ID NO: 715613 - DNA, 13 bp, C. elegans
gaaaaattattgt

SEQ ID NO: 715614 - DNA, 13 bp, C. elegans
gaaaaattcaaat

SEQ ID NO: 715615 - DNA, 13 bp, C. elegans
gaaaaattcaata

SEQ ID NO: 715616 - DNA, 13 bp, C. elegans
gaaaaattcactg

SEQ ID NO: 715617 - DNA, 13 bp, C. elegans
gaaaaattcagaa

SEQ ID NO: 715618 - DNA, 13 bp, C. elegans
gaaaaattcattt

SEQ ID NO: 715619 - DNA, 13 bp, C. elegans
gaaaaattccaat

SEQ ID NO: 715620 - DNA, 13 bp, C. elegans
gaaaaattcgaaa

SEQ ID NO: 715621 - DNA, 13 bp, C. elegans
gaaaaattcggaa

SEQ ID NO: 715622 - DNA, 13 bp, C. elegans
gaaaaattcgtga

SEQ ID NO: 715623 - DNA, 13 bp, C. elegans
gaaaaattctagt

SEQ ID NO: 715624 - DNA, 13 bp, C. elegans
gaaaaattctttg

SEQ ID NO: 715625 - DNA, 13 bp, C. elegans
gaaaaattgaatt

SEQ ID NO: 715626 - DNA, 13 bp, C. elegans
gaaaaattgacaa

SEQ ID NO: 715627 - DNA, 13 bp, C. elegans
gaaaaattgagtt

SEQ ID NO: 715628 - DNA, 13 bp, C. elegans
gaaaaattgatga

SEQ ID NO: 715629 - DNA, 13 bp, C. elegans
gaaaaattgcgtt

SEQ ID NO: 715630 - DNA, 13 bp, C. elegans
gaaaaattggaag

SEQ ID NO: 715631 - DNA, 13 bp, C. elegans
gaaaaattggaat

SEQ ID NO: 715632 - DNA, 13 bp, C. elegans
gaaaaattggaga

SEQ ID NO: 715633 - DNA, 13 bp, C. elegans
gaaaaattgggaa

SEQ ID NO: 715634 - DNA, 13 bp, C. elegans
gaaaaattggtgt

SEQ ID NO: 715635 - DNA, 13 bp, C. elegans
gaaaaattggttt

SEQ ID NO: 715636 - DNA, 13 bp, C. elegans
gaaaaattgtcaa

SEQ ID NO: 715637 - DNA, 14 bp, C. elegans
gaaaaattgtcaaa

SEQ ID NO: 715638 - DNA, 13 bp, C. elegans
gaaaaattgtgaa

SEQ ID NO: 715639 - DNA, 13 bp, C. elegans
gaaaaattgtgac

SEQ ID NO: 715640 - DNA, 13 bp, C. elegans
gaaaaattgtttt

SEQ ID NO: 715641 - DNA, 13 bp, C. elegans
gaaaaatttcaat

SEQ ID NO: 715642 - DNA, 13 bp, C. elegans
gaaaaatttcata

SEQ ID NO: 715643 - DNA, 13 bp, C. elegans
gaaaaatttccaa

SEQ ID NO: 715644 - DNA, 13 bp, C. elegans
gaaaaatttccag

SEQ ID NO: 715645 - DNA, 13 bp, C. elegans
gaaaaatttcgga

SEQ ID NO: 715646 - DNA, 13 bp, C. elegans
gaaaaatttctaa

SEQ ID NO: 715647 - DNA, 13 bp, C. elegans
gaaaaatttctga

SEQ ID NO: 715648 - DNA, 13 bp, C. elegans
gaaaaatttgttt

SEQ ID NO: 715649 - DNA, 13 bp, C. elegans
gaaaaattttcag

SEQ ID NO: 715650 - DNA, 13 bp, C. elegans
gaaaaattttcgt

SEQ ID NO: 715651 - DNA, 13 bp, C. elegans
gaaaaattttgaa

SEQ ID NO: 715652 - DNA, 13 bp, C. elegans
gaaaacaaagtga

SEQ ID NO: 715653 - DNA, 13 bp, C. elegans
gaaaacaacaatt

SEQ ID NO: 715654 - DNA, 13 bp, C. elegans
gaaaacaacagtt

SEQ ID NO: 715655 - DNA, 13 bp, C. elegans
gaaaacaagaatt

SEQ ID NO: 715656 - DNA, 13 bp, C. elegans
gaaaacaagtatt

SEQ ID NO: 715657 - DNA, 13 bp, C. elegans
gaaaacaagtgtt

SEQ ID NO: 715658 - DNA, 13 bp, C. elegans
gaaaacaatgaat

SEQ ID NO: 715659 - DNA, 13 bp, C. elegans
gaaaacaattatt

SEQ ID NO: 715660 - DNA, 13 bp, C. elegans
gaaaacaatttgt

SEQ ID NO: 715661 - DNA, 13 bp, C. elegans
gaaaacacaattt

SEQ ID NO: 715662 - DNA, 13 bp, C. elegans
gaaaacagtctca

SEQ ID NO: 715663 - DNA, 13 bp, C. elegans
gaaaacagtttga

SEQ ID NO: 715664 - DNA, 13 bp, C. elegans
gaaaacataatta

SEQ ID NO: 715665 - DNA, 13 bp, C. elegans
gaaaacatcagaa

SEQ ID NO: 715666 - DNA, 13 bp, C. elegans
gaaaacatcattt

SEQ ID NO: 715667 - DNA, 13 bp, C. elegans
gaaaacatctaaa

SEQ ID NO: 715668 - DNA, 13 bp, C. elegans
gaaaacattatca

SEQ ID NO: 715669 - DNA, 13 bp, C. elegans
gaaaacattatga

SEQ ID NO: 715670 - DNA, 13 bp, C. elegans
gaaaacattattc

SEQ ID NO: 715671 - DNA, 13 bp, C. elegans
gaaaacattcaaa

SEQ ID NO: 715672 - DNA, 13 bp, C. elegans
gaaaacattgaaa

SEQ ID NO: 715673 - DNA, 13 bp, C. elegans
gaaaacattgatt

SEQ ID NO: 715674 - DNA, 13 bp, C. elegans
gaaaacatttcaa

SEQ ID NO: 715675 - DNA, 13 bp, C. elegans
gaaaacatttgaa

SEQ ID NO: 715676 - DNA, 13 bp, C. elegans
gaaaacattttgg

SEQ ID NO: 715677 - DNA, 13 bp, C. elegans
gaaaaccaattga

SEQ ID NO: 715678 - DNA, 13 bp, C. elegans
gaaaaccactgaa

SEQ ID NO: 715679 - DNA, 13 bp, C. elegans
gaaaaccagtaaa

SEQ ID NO: 715680 - DNA, 13 bp, C. elegans
gaaaaccagtgaa

SEQ ID NO: 715681 - DNA, 13 bp, C. elegans
gaaaaccatcaaa

SEQ ID NO: 715682 - DNA, 13 bp, C. elegans
gaaaaccattata

SEQ ID NO: 715683 - DNA, 13 bp, C. elegans
gaaaaccccgaaa

SEQ ID NO: 715684 - DNA, 13 bp, C. elegans
gaaaaccggcaat

SEQ ID NO: 715685 - DNA, 13 bp, C. elegans
gaaaaccggtttt

SEQ ID NO: 715686 - DNA, 13 bp, C. elegans
gaaaacctcaaaa

SEQ ID NO: 715687 - DNA, 13 bp, C. elegans
gaaaacctcaaat

SEQ ID NO: 715688 - DNA, 13 bp, C. elegans
gaaaacctcaatt

SEQ ID NO: 715689 - DNA, 13 bp, C. elegans
gaaaacctcatat

SEQ ID NO: 715690 - DNA, 13 bp, C. elegans
gaaaacctgaaaa

SEQ ID NO: 715691 - DNA, 13 bp, C. elegans
gaaaacctgcaaa

SEQ ID NO: 715692 - DNA, 13 bp, C. elegans
gaaaacctttttt

SEQ ID NO: 715693 - DNA, 13 bp, C. elegans
gaaaacgaaaatg

SEQ ID NO: 715694 - DNA, 13 bp, C. elegans
gaaaacgaaaatt

SEQ ID NO: 715695 - DNA, 13 bp, C. elegans
gaaaacgaaattt

SEQ ID NO: 715696 - DNA, 13 bp, C. elegans
gaaaacgaacaat

SEQ ID NO: 715697 - DNA, 13 bp, C. elegans
gaaaacgaatgat

SEQ ID NO: 715698 - DNA, 13 bp, C. elegans
gaaaacgaatttt

SEQ ID NO: 715699 - DNA, 13 bp, C. elegans
gaaaacgagaaat

SEQ ID NO: 715700 - DNA, 13 bp, C. elegans
gaaaacgctcaaa

SEQ ID NO: 715701 - DNA, 13 bp, C. elegans
gaaaacgctgaaa

SEQ ID NO: 715702 - DNA, 13 bp, C. elegans
gaaaacgcttttt

SEQ ID NO: 715703 - DNA, 13 bp, C. elegans
gaaaacgtaataa

SEQ ID NO: 715704 - DNA, 13 bp, C. elegans
gaaaacgtgaaaa

SEQ ID NO: 715705 - DNA, 13 bp, C. elegans
gaaaacgtggaaa

SEQ ID NO: 715706 - DNA, 13 bp, C. elegans
gaaaacgtgtttt

SEQ ID NO: 715707 - DNA, 13 bp, C. elegans
gaaaacgttcgaa

SEQ ID NO: 715708 - DNA, 13 bp, C. elegans
gaaaacgttgaaa

SEQ ID NO: 715709 - DNA, 13 bp, C. elegans
gaaaacgtttcaa

SEQ ID NO: 715710 - DNA, 13 bp, C. elegans
gaaaacgtttttt

SEQ ID NO: 715711 - DNA, 13 bp, C. elegans
gaaaactaaatat

SEQ ID NO: 715712 - DNA, 13 bp, C. elegans
gaaaactaaattt

SEQ ID NO: 715713 - DNA, 13 bp, C. elegans
gaaaactacgaaa

SEQ ID NO: 715714 - DNA, 13 bp, C. elegans
gaaaactagagaa

SEQ ID NO: 715715 - DNA, 13 bp, C. elegans
gaaaactagattt

SEQ ID NO: 715716 - DNA, 13 bp, C. elegans
gaaaactatatat

SEQ ID NO: 715717 - DNA, 13 bp, C. elegans
gaaaactattaaa

SEQ ID NO: 715718 - DNA, 13 bp, C. elegans
gaaaactatttga

SEQ ID NO: 715719 - DNA, 13 bp, C. elegans
gaaaactcaaatt

SEQ ID NO: 715720 - DNA, 13 bp, C. elegans
gaaaactcaactt

SEQ ID NO: 715721 - DNA, 13 bp, C. elegans
gaaaactcagatt

SEQ ID NO: 715722 - DNA, 13 bp, C. elegans
gaaaactcataaa

SEQ ID NO: 715723 - DNA, 13 bp, C. elegans
gaaaactccaaaa

SEQ ID NO: 715724 - DNA, 13 bp, C. elegans
gaaaactcgaata

SEQ ID NO: 715725 - DNA, 13 bp, C. elegans
gaaaactcgattt

SEQ ID NO: 715726 - DNA, 13 bp, C. elegans
gaaaactctaatt

SEQ ID NO: 715727 - DNA, 13 bp, C. elegans
gaaaactctcgaa

SEQ ID NO: 715728 - DNA, 13 bp, C. elegans
gaaaactcttcaa

SEQ ID NO: 715729 - DNA, 13 bp, C. elegans
gaaaactcttcca

SEQ ID NO: 715730 - DNA, 13 bp, C. elegans
gaaaactcttttt

SEQ ID NO: 715731 - DNA, 13 bp, C. elegans
gaaaactgaaaga

SEQ ID NO: 715732 - DNA, 13 bp, C. elegans
gaaaactgaaagt

SEQ ID NO: 715733 - DNA, 13 bp, C. elegans
gaaaactgaagaa

SEQ ID NO: 715734 - DNA, 13 bp, C. elegans
gaaaactgacaaa

SEQ ID NO: 715735 - DNA, 13 bp, C. elegans
gaaaactgataaa

SEQ ID NO: 715736 - DNA, 13 bp, C. elegans
gaaaactgcaaaa

SEQ ID NO: 715737 - DNA, 13 bp, C. elegans
gaaaactgcagaa

SEQ ID NO: 715738 - DNA, 13 bp, C. elegans
gaaaactgccgga

SEQ ID NO: 715739 - DNA, 13 bp, C. elegans
gaaaactgctgaa

SEQ ID NO: 715740 - DNA, 13 bp, C. elegans
gaaaactggaaaa

SEQ ID NO: 715741 - DNA, 13 bp, C. elegans
gaaaactggaaga

SEQ ID NO: 715742 - DNA, 13 bp, C. elegans
gaaaactggaatt

SEQ ID NO: 715743 - DNA, 13 bp, C. elegans
gaaaactgggaaa

SEQ ID NO: 715744 - DNA, 13 bp, C. elegans
gaaaactggtaaa

SEQ ID NO: 715745 - DNA, 13 bp, C. elegans
gaaaactgtaaat

SEQ ID NO: 715746 - DNA, 13 bp, C. elegans
gaaaactgtcaaa

SEQ ID NO: 715747 - DNA, 13 bp, C. elegans
gaaaactgtgatt

SEQ ID NO: 715748 - DNA, 13 bp, C. elegans
gaaaactgttgtt

SEQ ID NO: 715749 - DNA, 13 bp, C. elegans
gaaaacttaaaga

SEQ ID NO: 715750 - DNA, 13 bp, C. elegans
gaaaacttaattt

SEQ ID NO: 715751 - DNA, 13 bp, C. elegans
gaaaacttatgaa

SEQ ID NO: 715752 - DNA, 13 bp, C. elegans
gaaaacttcataa

SEQ ID NO: 715753 - DNA, 13 bp, C. elegans
gaaaacttcttta

SEQ ID NO: 715754 - DNA, 13 bp, C. elegans
gaaaacttgaaaa

SEQ ID NO: 715755 - DNA, 13 bp, C. elegans
gaaaacttgaatt

SEQ ID NO: 715756 - DNA, 13 bp, C. elegans
gaaaacttgccaa

SEQ ID NO: 715757 - DNA, 13 bp, C. elegans
gaaaacttggaaa

SEQ ID NO: 715758 - DNA, 13 bp, C. elegans
gaaaacttggaat

SEQ ID NO: 715759 - DNA, 13 bp, C. elegans
gaaaactttcatt

SEQ ID NO: 715760 - DNA, 13 bp, C. elegans
gaaaactttcggc

SEQ ID NO: 715761 - DNA, 13 bp, C. elegans
gaaaactttgaaa

SEQ ID NO: 715762 - DNA, 13 bp, C. elegans
gaaaactttggtt

SEQ ID NO: 715763 - DNA, 13 bp, C. elegans
gaaaacttttatt

SEQ ID NO: 715764 - DNA, 13 bp, C. elegans
gaaaacttttctt

SEQ ID NO: 715765 - DNA, 13 bp, C. elegans
gaaaactttttcg

SEQ ID NO: 715766 - DNA, 13 bp, C. elegans
gaaaacttttttt

SEQ ID NO: 715767 - DNA, 13 bp, C. elegans
gaaaagaaacatt

SEQ ID NO: 715768 - DNA, 13 bp, C. elegans
gaaaagaaatcga

SEQ ID NO: 715769 - DNA, 13 bp, C. elegans
gaaaagaaattgt

SEQ ID NO: 715770 - DNA, 13 bp, C. elegans
gaaaagaacaatt

SEQ ID NO: 715771 - DNA, 13 bp, C. elegans
gaaaagaagattt

SEQ ID NO: 715772 - DNA, 13 bp, C. elegans
gaaaagaatttga

SEQ ID NO: 715773 - DNA, 13 bp, C. elegans
gaaaagacgcaga

SEQ ID NO: 715774 - DNA, 13 bp, C. elegans
gaaaagagcaatt

SEQ ID NO: 715775 - DNA, 13 bp, C. elegans
gaaaagatcatga

SEQ ID NO: 715776 - DNA, 13 bp, C. elegans
gaaaagatgaact

SEQ ID NO: 715777 - DNA, 13 bp, C. elegans
gaaaagattcatt

SEQ ID NO: 715778 - DNA, 13 bp, C. elegans
gaaaagatttatt

SEQ ID NO: 715779 - DNA, 13 bp, C. elegans
gaaaagattttga

SEQ ID NO: 715780 - DNA, 13 bp, C. elegans
gaaaagcacccaa

SEQ ID NO: 715781 - DNA, 13 bp, C. elegans
gaaaagcgccaag

SEQ ID NO: 715782 - DNA, 13 bp, C. elegans
gaaaagcggaaat

SEQ ID NO: 715783 - DNA, 13 bp, C. elegans
gaaaagcggcaaa

SEQ ID NO: 715784 - DNA, 13 bp, C. elegans
gaaaagctacaaa

SEQ ID NO: 715785 - DNA, 13 bp, C. elegans
gaaaagcttggaa

SEQ ID NO: 715786 - DNA, 13 bp, C. elegans
gaaaaggagacgt

SEQ ID NO: 715787 - DNA, 13 bp, C. elegans
gaaaaggcaaaat

SEQ ID NO: 715788 - DNA, 13 bp, C. elegans
gaaaaggttcaaa

SEQ ID NO: 715789 - DNA, 13 bp, C. elegans
gaaaaggttttga

SEQ ID NO: 715790 - DNA, 13 bp, C. elegans
gaaaagtaaattt

SEQ ID NO: 715791 - DNA, 13 bp, C. elegans
gaaaagtacattt

SEQ ID NO: 715792 - DNA, 13 bp, C. elegans
gaaaagtacccaa

SEQ ID NO: 715793 - DNA, 13 bp, C. elegans
gaaaagtaccgaa

SEQ ID NO: 715794 - DNA, 13 bp, C. elegans
gaaaagtatacat

SEQ ID NO: 715795 - DNA, 13 bp, C. elegans
gaaaagtatgaat

SEQ ID NO: 715796 - DNA, 13 bp, C. elegans
gaaaagtattatt

SEQ ID NO: 715797 - DNA, 13 bp, C. elegans
gaaaagtcaattt

SEQ ID NO: 715798 - DNA, 13 bp, C. elegans
gaaaagtcgaaaa

SEQ ID NO: 715799 - DNA, 13 bp, C. elegans
gaaaagtctgaaa

SEQ ID NO: 715800 - DNA, 13 bp, C. elegans
gaaaagtctggaa

SEQ ID NO: 715801 - DNA, 13 bp, C. elegans
gaaaagtgaaagt

SEQ ID NO: 715802 - DNA, 13 bp, C. elegans
gaaaagtgaaatt

SEQ ID NO: 715803 - DNA, 13 bp, C. elegans
gaaaagtgaacaa

SEQ ID NO: 715804 - DNA, 13 bp, C. elegans
gaaaagtgatatt

SEQ ID NO: 715805 - DNA, 13 bp, C. elegans
gaaaagtgatcaa

SEQ ID NO: 715806 - DNA, 13 bp, C. elegans
gaaaagtgatgaa

SEQ ID NO: 715807 - DNA, 13 bp, C. elegans
gaaaagtgatttc

SEQ ID NO: 715808 - DNA, 13 bp, C. elegans
gaaaagtgcaatt

SEQ ID NO: 715809 - DNA, 13 bp, C. elegans
gaaaagtgcactt

SEQ ID NO: 715810 - DNA, 13 bp, C. elegans
gaaaagtggccaa

SEQ ID NO: 715811 - DNA, 13 bp, C. elegans
gaaaagtgtagtt

SEQ ID NO: 715812 - DNA, 13 bp, C. elegans
gaaaagtgtgaga

SEQ ID NO: 715813 - DNA, 13 bp, C. elegans
gaaaagtgtgcaa

SEQ ID NO: 715814 - DNA, 13 bp, C. elegans
gaaaagtgtttga

SEQ ID NO: 715815 - DNA, 13 bp, C. elegans
gaaaagttaaatt

SEQ ID NO: 715816 - DNA, 13 bp, C. elegans
gaaaagttaattt

SEQ ID NO: 715817 - DNA, 13 bp, C. elegans
gaaaagttcaaaa

SEQ ID NO: 715818 - DNA, 13 bp, C. elegans
gaaaagttccggc

SEQ ID NO: 715819 - DNA, 13 bp, C. elegans
gaaaagttcggtc

SEQ ID NO: 715820 - DNA, 13 bp, C. elegans
gaaaagttgaaga

SEQ ID NO: 715821 - DNA, 13 bp, C. elegans
gaaaagttgaatg

SEQ ID NO: 715822 - DNA, 13 bp, C. elegans
gaaaagttgatga

SEQ ID NO: 715823 - DNA, 13 bp, C. elegans
gaaaagttgctaa

SEQ ID NO: 715824 - DNA, 13 bp, C. elegans
gaaaagttggaaa

SEQ ID NO: 715825 - DNA, 13 bp, C. elegans
gaaaagttggaga

SEQ ID NO: 715826 - DNA, 13 bp, C. elegans
gaaaagttgtatt

SEQ ID NO: 715827 - DNA, 13 bp, C. elegans
gaaaagttgtcaa

SEQ ID NO: 715828 - DNA, 13 bp, C. elegans
gaaaagttgttaa

SEQ ID NO: 715829 - DNA, 13 bp, C. elegans
gaaaagttgttga

SEQ ID NO: 715830 - DNA, 13 bp, C. elegans
gaaaagttgttgt

SEQ ID NO: 715831 - DNA, 13 bp, C. elegans
gaaaagtttagtt

SEQ ID NO: 715832 - DNA, 13 bp, C. elegans
gaaaagtttatgg

SEQ ID NO: 715833 - DNA, 13 bp, C. elegans
gaaaagtttccaa

SEQ ID NO: 715834 - DNA, 13 bp, C. elegans
gaaaagtttggaa

SEQ ID NO: 715835 - DNA, 13 bp, C. elegans
gaaaagtttgttt

SEQ ID NO: 715836 - DNA, 13 bp, C. elegans
gaaaagttttcaa

SEQ ID NO: 715837 - DNA, 14 bp, C. elegans
gaaaagttttcgaa

SEQ ID NO: 715838 - DNA, 13 bp, C. elegans
gaaaagttttggc

SEQ ID NO: 715839 - DNA, 13 bp, C. elegans
gaaaagtttttgc

SEQ ID NO: 715840 - DNA, 13 bp, C. elegans
gaaaagttttttt

SEQ ID NO: 715841 - DNA, 13 bp, C. elegans
gaaaataaacttt

SEQ ID NO: 715842 - DNA, 13 bp, C. elegans
gaaaataaatcga

SEQ ID NO: 715843 - DNA, 13 bp, C. elegans
gaaaataacattg

SEQ ID NO: 715844 - DNA, 13 bp, C. elegans
gaaaataatgatc

SEQ ID NO: 715845 - DNA, 13 bp, C. elegans
gaaaatacatgaa

SEQ ID NO: 715846 - DNA, 13 bp, C. elegans
gaaaatacattta

SEQ ID NO: 715847 - DNA, 13 bp, C. elegans
gaaaataccaaat

SEQ ID NO: 715848 - DNA, 13 bp, C. elegans
gaaaatactcaaa

SEQ ID NO: 715849 - DNA, 13 bp, C. elegans
gaaaatactcttc

SEQ ID NO: 715850 - DNA, 13 bp, C. elegans
gaaaatacttttt

SEQ ID NO: 715851 - DNA, 13 bp, C. elegans
gaaaatagatttt

SEQ ID NO: 715852 - DNA, 13 bp, C. elegans
gaaaatagctata

SEQ ID NO: 715853 - DNA, 13 bp, C. elegans
gaaaataggattt

SEQ ID NO: 715854 - DNA, 13 bp, C. elegans
gaaaataggtttt

SEQ ID NO: 715855 - DNA, 13 bp, C. elegans
gaaaatagtcaaa

SEQ ID NO: 715856 - DNA, 13 bp, C. elegans
gaaaatagttgaa

SEQ ID NO: 715857 - DNA, 13 bp, C. elegans
gaaaatatattgc

SEQ ID NO: 715858 - DNA, 13 bp, C. elegans
gaaaatatatttg

SEQ ID NO: 715859 - DNA, 13 bp, C. elegans
gaaaatatcaact

SEQ ID NO: 715860 - DNA, 13 bp, C. elegans
gaaaatatcagaa

SEQ ID NO: 715861 - DNA, 13 bp, C. elegans
gaaaatatcatat

SEQ ID NO: 715862 - DNA, 13 bp, C. elegans
gaaaatatcattc

SEQ ID NO: 715863 - DNA, 13 bp, C. elegans
gaaaatatccaaa

SEQ ID NO: 715864 - DNA, 13 bp, C. elegans
gaaaatatcgaat

SEQ ID NO: 715865 - DNA, 13 bp, C. elegans
gaaaatatcggaa

SEQ ID NO: 715866 - DNA, 13 bp, C. elegans
gaaaatatctgaa

SEQ ID NO: 715867 - DNA, 13 bp, C. elegans
gaaaatatgagct

SEQ ID NO: 715868 - DNA, 13 bp, C. elegans
gaaaatatgcatt

SEQ ID NO: 715869 - DNA, 13 bp, C. elegans
gaaaatatgggaa

SEQ ID NO: 715870 - DNA, 13 bp, C. elegans
gaaaatatggttt

SEQ ID NO: 715871 - DNA, 13 bp, C. elegans
gaaaatatgtgaa

SEQ ID NO: 715872 - DNA, 13 bp, C. elegans
gaaaatatgtgtt

SEQ ID NO: 715873 - DNA, 13 bp, C. elegans
gaaaatatgtttt

SEQ ID NO: 715874 - DNA, 13 bp, C. elegans
gaaaatattacaa

SEQ ID NO: 715875 - DNA, 13 bp, C. elegans
gaaaatattcata

SEQ ID NO: 715876 - DNA, 13 bp, C. elegans
gaaaatattccaa

SEQ ID NO: 715877 - DNA, 13 bp, C. elegans
gaaaatattcgat

SEQ ID NO: 715878 - DNA, 13 bp, C. elegans
gaaaatattgaag

SEQ ID NO: 715879 - DNA, 13 bp, C. elegans
gaaaatattgatt

SEQ ID NO: 715880 - DNA, 13 bp, C. elegans
gaaaatattggaa

SEQ ID NO: 715881 - DNA, 13 bp, C. elegans
gaaaatatttctt

SEQ ID NO: 715882 - DNA, 13 bp, C. elegans
gaaaatatttgaa

SEQ ID NO: 715883 - DNA, 13 bp, C. elegans
gaaaatattttca

SEQ ID NO: 715884 - DNA, 13 bp, C. elegans
gaaaatattttcc

SEQ ID NO: 715885 - DNA, 13 bp, C. elegans
gaaaatatttttg

SEQ ID NO: 715886 - DNA, 13 bp, C. elegans
gaaaatcaaagtt

SEQ ID NO: 715887 - DNA, 13 bp, C. elegans
gaaaatcaaattt

SEQ ID NO: 715888 - DNA, 13 bp, C. elegans
gaaaatcaacatt

SEQ ID NO: 715889 - DNA, 13 bp, C. elegans
gaaaatcaatgtt

SEQ ID NO: 715890 - DNA, 13 bp, C. elegans
gaaaatcaattca

SEQ ID NO: 715891 - DNA, 13 bp, C. elegans
gaaaatcaatttt

SEQ ID NO: 715892 - DNA, 13 bp, C. elegans
gaaaatcacaaat

SEQ ID NO: 715893 - DNA, 13 bp, C. elegans
gaaaatcacattt

SEQ ID NO: 715894 - DNA, 13 bp, C. elegans
gaaaatcaccaaa

SEQ ID NO: 715895 - DNA, 13 bp, C. elegans
gaaaatcacttga

SEQ ID NO: 715896 - DNA, 13 bp, C. elegans
gaaaatcactttt

SEQ ID NO: 715897 - DNA, 13 bp, C. elegans
gaaaatcagaaat

SEQ ID NO: 715898 - DNA, 13 bp, C. elegans
gaaaatcagaatt

SEQ ID NO: 715899 - DNA, 13 bp, C. elegans
gaaaatcagattt

SEQ ID NO: 715900 - DNA, 13 bp, C. elegans
gaaaatcaggaat

SEQ ID NO: 715901 - DNA, 13 bp, C. elegans
gaaaatcatcaaa

SEQ ID NO: 715902 - DNA, 13 bp, C. elegans
gaaaatcatttaa

SEQ ID NO: 715903 - DNA, 13 bp, C. elegans
gaaaatcattttt

SEQ ID NO: 715904 - DNA, 13 bp, C. elegans
gaaaatccaaata

SEQ ID NO: 715905 - DNA, 13 bp, C. elegans
gaaaatccagaaa

SEQ ID NO: 715906 - DNA, 13 bp, C. elegans
gaaaatccagatt

SEQ ID NO: 715907 - DNA, 13 bp, C. elegans
gaaaatccataac

SEQ ID NO: 715908 - DNA, 13 bp, C. elegans
gaaaatccatatt

SEQ ID NO: 715909 - DNA, 13 bp, C. elegans
gaaaatccatgtt

SEQ ID NO: 715910 - DNA, 13 bp, C. elegans
gaaaatccatttc

SEQ ID NO: 715911 - DNA, 13 bp, C. elegans
gaaaatcccaaaa

SEQ ID NO: 715912 - DNA, 13 bp, C. elegans
gaaaatccgaaaa

SEQ ID NO: 715913 - DNA, 13 bp, C. elegans
gaaaatccgagaa

SEQ ID NO: 715914 - DNA, 13 bp, C. elegans
gaaaatccgtttt

SEQ ID NO: 715915 - DNA, 13 bp, C. elegans
gaaaatcgaaaat

SEQ ID NO: 715916 - DNA, 13 bp, C. elegans
gaaaatcgaactt

SEQ ID NO: 715917 - DNA, 13 bp, C. elegans
gaaaatcgaagaa

SEQ ID NO: 715918 - DNA, 13 bp, C. elegans
gaaaatcgaataa

SEQ ID NO: 715919 - DNA, 13 bp, C. elegans
gaaaatcgacaaa

SEQ ID NO: 715920 - DNA, 13 bp, C. elegans
gaaaatcgagatc

SEQ ID NO: 715921 - DNA, 13 bp, C. elegans
gaaaatcgagatt

SEQ ID NO: 715922 - DNA, 13 bp, C. elegans
gaaaatcgagttt

SEQ ID NO: 715923 - DNA, 13 bp, C. elegans
gaaaatcgataaa

SEQ ID NO: 715924 - DNA, 13 bp, C. elegans
gaaaatcgatgaa

SEQ ID NO: 715925 - DNA, 13 bp, C. elegans
gaaaatcgatgat

SEQ ID NO: 715926 - DNA, 13 bp, C. elegans
gaaaatcgatgtt

SEQ ID NO: 715927 - DNA, 13 bp, C. elegans
gaaaatcgattaa

SEQ ID NO: 715928 - DNA, 13 bp, C. elegans
gaaaatcgattga

SEQ ID NO: 715929 - DNA, 13 bp, C. elegans
gaaaatcgatttt

SEQ ID NO: 715930 - DNA, 13 bp, C. elegans
gaaaatcgcaaaa

SEQ ID NO: 715931 - DNA, 13 bp, C. elegans
gaaaatcgcactg

SEQ ID NO: 715932 - DNA, 13 bp, C. elegans
gaaaatcgcattt

SEQ ID NO: 715933 - DNA, 13 bp, C. elegans
gaaaatcgccaaa

SEQ ID NO: 715934 - DNA, 13 bp, C. elegans
gaaaatcgccgat

SEQ ID NO: 715935 - DNA, 13 bp, C. elegans
gaaaatcggaaaa

SEQ ID NO: 715936 - DNA, 13 bp, C. elegans
gaaaatcggaaat

SEQ ID NO: 715937 - DNA, 13 bp, C. elegans
gaaaatcggaatt

SEQ ID NO: 715938 - DNA, 13 bp, C. elegans
gaaaatcggcaaa

SEQ ID NO: 715939 - DNA, 13 bp, C. elegans
gaaaatcggcaac

SEQ ID NO: 715940 - DNA, 13 bp, C. elegans
gaaaatcggtttt

SEQ ID NO: 715941 - DNA, 13 bp, C. elegans
gaaaatcgttgaa

SEQ ID NO: 715942 - DNA, 13 bp, C. elegans
gaaaatcgttttg

SEQ ID NO: 715943 - DNA, 13 bp, C. elegans
gaaaatctaaaat

SEQ ID NO: 715944 - DNA, 13 bp, C. elegans
gaaaatctaattt

SEQ ID NO: 715945 - DNA, 13 bp, C. elegans
gaaaatctacaat

SEQ ID NO: 715946 - DNA, 13 bp, C. elegans
gaaaatctacagt

SEQ ID NO: 715947 - DNA, 13 bp, C. elegans
gaaaatctacgaa

SEQ ID NO: 715948 - DNA, 13 bp, C. elegans
gaaaatctattaa

SEQ ID NO: 715949 - DNA, 13 bp, C. elegans
gaaaatctcaaaa

SEQ ID NO: 715950 - DNA, 13 bp, C. elegans
gaaaatctcaatt

SEQ ID NO: 715951 - DNA, 13 bp, C. elegans
gaaaatctcataa

SEQ ID NO: 715952 - DNA, 14 bp, C. elegans
gaaaatctgaaaat

SEQ ID NO: 715953 - DNA, 13 bp, C. elegans
gaaaatctgaaat

SEQ ID NO: 715954 - DNA, 13 bp, C. elegans
gaaaatctgaata

SEQ ID NO: 715955 - DNA, 13 bp, C. elegans
gaaaatctgagat

SEQ ID NO: 715956 - DNA, 13 bp, C. elegans
gaaaatctgattt

SEQ ID NO: 715957 - DNA, 13 bp, C. elegans
gaaaatctgcatt

SEQ ID NO: 715958 - DNA, 14 bp, C. elegans
gaaaatctggaaaa

SEQ ID NO: 715959 - DNA, 13 bp, C. elegans
gaaaatcttaaaa

SEQ ID NO: 715960 - DNA, 13 bp, C. elegans
gaaaatcttaatt

SEQ ID NO: 715961 - DNA, 13 bp, C. elegans
gaaaatcttgaat

SEQ ID NO: 715962 - DNA, 13 bp, C. elegans
gaaaatcttgatt

SEQ ID NO: 715963 - DNA, 13 bp, C. elegans
gaaaatcttgcaa

SEQ ID NO: 715964 - DNA, 13 bp, C. elegans
gaaaatctttcaa

SEQ ID NO: 715965 - DNA, 13 bp, C. elegans
gaaaatctttgaa

SEQ ID NO: 715966 - DNA, 13 bp, C. elegans
gaaaatgaaattt

SEQ ID NO: 715967 - DNA, 13 bp, C. elegans
gaaaatgaacgaa

SEQ ID NO: 715968 - DNA, 13 bp, C. elegans
gaaaatgaattat

SEQ ID NO: 715969 - DNA, 13 bp, C. elegans
gaaaatgaattca

SEQ ID NO: 715970 - DNA, 13 bp, C. elegans
gaaaatgaatttt

SEQ ID NO: 715971 - DNA, 13 bp, C. elegans
gaaaatgacgaat

SEQ ID NO: 715972 - DNA, 13 bp, C. elegans
gaaaatgacggaa

SEQ ID NO: 715973 - DNA, 13 bp, C. elegans
gaaaatgagaatg

SEQ ID NO: 715974 - DNA, 13 bp, C. elegans
gaaaatgagaatt

SEQ ID NO: 715975 - DNA, 13 bp, C. elegans
gaaaatgataaca

SEQ ID NO: 715976 - DNA, 13 bp, C. elegans
gaaaatgataatt

SEQ ID NO: 715977 - DNA, 13 bp, C. elegans
gaaaatgatattt

SEQ ID NO: 715978 - DNA, 13 bp, C. elegans
gaaaatgatcgaa

SEQ ID NO: 715979 - DNA, 13 bp, C. elegans
gaaaatgatgaag

SEQ ID NO: 715980 - DNA, 13 bp, C. elegans
gaaaatgatgaat

SEQ ID NO: 715981 - DNA, 13 bp, C. elegans
gaaaatgatgatg

SEQ ID NO: 715982 - DNA, 13 bp, C. elegans
gaaaatgatggaa

SEQ ID NO: 715983 - DNA, 13 bp, C. elegans
gaaaatgatgttt

SEQ ID NO: 715984 - DNA, 13 bp, C. elegans
gaaaatgatttaa

SEQ ID NO: 715985 - DNA, 13 bp, C. elegans
gaaaatgcaagaa

SEQ ID NO: 715986 - DNA, 13 bp, C. elegans
gaaaatgcacatt

SEQ ID NO: 715987 - DNA, 13 bp, C. elegans
gaaaatgcacttt

SEQ ID NO: 715988 - DNA, 13 bp, C. elegans
gaaaatgcatatt

SEQ ID NO: 715989 - DNA, 13 bp, C. elegans
gaaaatgccaaaa

SEQ ID NO: 715990 - DNA, 13 bp, C. elegans
gaaaatgccaatt

SEQ ID NO: 715991 - DNA, 13 bp, C. elegans
gaaaatgcctgaa

SEQ ID NO: 715992 - DNA, 13 bp, C. elegans
gaaaatgcgaaaa

SEQ ID NO: 715993 - DNA, 13 bp, C. elegans
gaaaatgcgcaaa

SEQ ID NO: 715994 - DNA, 13 bp, C. elegans
gaaaatgcgtcaa

SEQ ID NO: 715995 - DNA, 13 bp, C. elegans
gaaaatgctccaa

SEQ ID NO: 715996 - DNA, 14 bp, C. elegans
gaaaatgctcgaaa

SEQ ID NO: 715997 - DNA, 13 bp, C. elegans
gaaaatgctttaa

SEQ ID NO: 715998 - DNA, 13 bp, C. elegans
gaaaatggaaatc

SEQ ID NO: 715999 - DNA, 13 bp, C. elegans
gaaaatggagatt

SEQ ID NO: 716000 - DNA, 13 bp, C. elegans
gaaaatggagcag

SEQ ID NO: 716001 - DNA, 13 bp, C. elegans
gaaaatggcattt

SEQ ID NO: 716002 - DNA, 13 bp, C. elegans
gaaaatggccaaa

SEQ ID NO: 716003 - DNA, 13 bp, C. elegans
gaaaatggcctag

SEQ ID NO: 716004 - DNA, 13 bp, C. elegans
gaaaatgggattt

SEQ ID NO: 716005 - DNA, 13 bp, C. elegans
gaaaatggggatt

SEQ ID NO: 716006 - DNA, 13 bp, C. elegans
gaaaatgggtgaa

SEQ ID NO: 716007 - DNA, 13 bp, C. elegans
gaaaatgtaccaa

SEQ ID NO: 716008 - DNA, 13 bp, C. elegans
gaaaatgtactat

SEQ ID NO: 716009 - DNA, 13 bp, C. elegans
gaaaatgtataat

SEQ ID NO: 716010 - DNA, 13 bp, C. elegans
gaaaatgtataga

SEQ ID NO: 716011 - DNA, 13 bp, C. elegans
gaaaatgtatcat

SEQ ID NO: 716012 - DNA, 13 bp, C. elegans
gaaaatgtatcga

SEQ ID NO: 716013 - DNA, 13 bp, C. elegans
gaaaatgtatgaa

SEQ ID NO: 716014 - DNA, 13 bp, C. elegans
gaaaatgtatgta

SEQ ID NO: 716015 - DNA, 13 bp, C. elegans
gaaaatgtattat

SEQ ID NO: 716016 - DNA, 13 bp, C. elegans
gaaaatgtattca

SEQ ID NO: 716017 - DNA, 13 bp, C. elegans
gaaaatgtatttt

SEQ ID NO: 716018 - DNA, 13 bp, C. elegans
gaaaatgtcaaaa

SEQ ID NO: 716019 - DNA, 13 bp, C. elegans
gaaaatgtcagat

SEQ ID NO: 716020 - DNA, 13 bp, C. elegans
gaaaatgtcatta

SEQ ID NO: 716021 - DNA, 13 bp, C. elegans
gaaaatgtcattt

SEQ ID NO: 716022 - DNA, 13 bp, C. elegans
gaaaatgtcgaaa

SEQ ID NO: 716023 - DNA, 13 bp, C. elegans
gaaaatgtgaaac

SEQ ID NO: 716024 - DNA, 13 bp, C. elegans
gaaaatgtgaaat

SEQ ID NO: 716025 - DNA, 13 bp, C. elegans
gaaaatgtgagaa

SEQ ID NO: 716026 - DNA, 13 bp, C. elegans
gaaaatgtgcaaa

SEQ ID NO: 716027 - DNA, 13 bp, C. elegans
gaaaatgtgcatt

SEQ ID NO: 716028 - DNA, 13 bp, C. elegans
gaaaatgtggttt

SEQ ID NO: 716029 - DNA, 13 bp, C. elegans
gaaaatgtgtgtt

SEQ ID NO: 716030 - DNA, 13 bp, C. elegans
gaaaatgtgttga

SEQ ID NO: 716031 - DNA, 13 bp, C. elegans
gaaaatgttaatt

SEQ ID NO: 716032 - DNA, 13 bp, C. elegans
gaaaatgttactt

SEQ ID NO: 716033 - DNA, 13 bp, C. elegans
gaaaatgttataa

SEQ ID NO: 716034 - DNA, 13 bp, C. elegans
gaaaatgttattt

SEQ ID NO: 716035 - DNA, 13 bp, C. elegans
gaaaatgttcgaa

SEQ ID NO: 716036 - DNA, 13 bp, C. elegans
gaaaatgttgaaa

SEQ ID NO: 716037 - DNA, 13 bp, C. elegans
gaaaatgttgaga

SEQ ID NO: 716038 - DNA, 13 bp, C. elegans
gaaaatgtttaat

SEQ ID NO: 716039 - DNA, 13 bp, C. elegans
gaaaatgtttatt

SEQ ID NO: 716040 - DNA, 13 bp, C. elegans
gaaaatgtttcat

SEQ ID NO: 716041 - DNA, 13 bp, C. elegans
gaaaatgtttgaa

SEQ ID NO: 716042 - DNA, 13 bp, C. elegans
gaaaatgtttgac

SEQ ID NO: 716043 - DNA, 13 bp, C. elegans
gaaaatgtttttt

SEQ ID NO: 716044 - DNA, 13 bp, C. elegans
gaaaattaactga

SEQ ID NO: 716045 - DNA, 13 bp, C. elegans
gaaaattaagttt

SEQ ID NO: 716046 - DNA, 13 bp, C. elegans
gaaaattacaatt

SEQ ID NO: 716047 - DNA, 13 bp, C. elegans
gaaaattacagat

SEQ ID NO: 716048 - DNA, 13 bp, C. elegans
gaaaattagccaa

SEQ ID NO: 716049 - DNA, 13 bp, C. elegans
gaaaattagctta

SEQ ID NO: 716050 - DNA, 13 bp, C. elegans
gaaaattagtatt

SEQ ID NO: 716051 - DNA, 13 bp, C. elegans
gaaaattagtgaa

SEQ ID NO: 716052 - DNA, 13 bp, C. elegans
gaaaattagtgga

SEQ ID NO: 716053 - DNA, 13 bp, C. elegans
gaaaattagtttt

SEQ ID NO: 716054 - DNA, 13 bp, C. elegans
gaaaattatcaaa

SEQ ID NO: 716055 - DNA, 13 bp, C. elegans
gaaaattatcact

SEQ ID NO: 716056 - DNA, 13 bp, C. elegans
gaaaattatgaga

SEQ ID NO: 716057 - DNA, 13 bp, C. elegans
gaaaattattaga

SEQ ID NO: 716058 - DNA, 13 bp, C. elegans
gaaaattattgat

SEQ ID NO: 716059 - DNA, 13 bp, C. elegans
gaaaattatttga

SEQ ID NO: 716060 - DNA, 13 bp, C. elegans
gaaaattattttc

SEQ ID NO: 716061 - DNA, 13 bp, C. elegans
gaaaattcaaatt

SEQ ID NO: 716062 - DNA, 13 bp, C. elegans
gaaaattcaacaa

SEQ ID NO: 716063 - DNA, 13 bp, C. elegans
gaaaattcaataa

SEQ ID NO: 716064 - DNA, 13 bp, C. elegans
gaaaattcaatat

SEQ ID NO: 716065 - DNA, 13 bp, C. elegans
gaaaattcaatga

SEQ ID NO: 716066 - DNA, 13 bp, C. elegans
gaaaattcaattt

SEQ ID NO: 716067 - DNA, 13 bp, C. elegans
gaaaattcagcgt

SEQ ID NO: 716068 - DNA, 13 bp, C. elegans
gaaaattcagttt

SEQ ID NO: 716069 - DNA, 13 bp, C. elegans
gaaaattcataaa

SEQ ID NO: 716070 - DNA, 13 bp, C. elegans
gaaaattcatttt

SEQ ID NO: 716071 - DNA, 13 bp, C. elegans
gaaaattccaaaa

SEQ ID NO: 716072 - DNA, 13 bp, C. elegans
gaaaattccagtt

SEQ ID NO: 716073 - DNA, 13 bp, C. elegans
gaaaattccattg

SEQ ID NO: 716074 - DNA, 13 bp, C. elegans
gaaaattcccaaa

SEQ ID NO: 716075 - DNA, 13 bp, C. elegans
gaaaattccgatt

SEQ ID NO: 716076 - DNA, 13 bp, C. elegans
gaaaattccggaa

SEQ ID NO: 716077 - DNA, 13 bp, C. elegans
gaaaattccgttt

SEQ ID NO: 716078 - DNA, 15 bp, C. elegans
gaaaattcgaaaatt

SEQ ID NO: 716079 - DNA, 13 bp, C. elegans
gaaaattcgaaat

SEQ ID NO: 716080 - DNA, 13 bp, C. elegans
gaaaattcgaatt

SEQ ID NO: 716081 - DNA, 13 bp, C. elegans
gaaaattcgagtt

SEQ ID NO: 716082 - DNA, 13 bp, C. elegans
gaaaattcgataa

SEQ ID NO: 716083 - DNA, 13 bp, C. elegans
gaaaattcgatat

SEQ ID NO: 716084 - DNA, 13 bp, C. elegans
gaaaattcgattt

SEQ ID NO: 716085 - DNA, 13 bp, C. elegans
gaaaattcggcaa

SEQ ID NO: 716086 - DNA, 13 bp, C. elegans
gaaaattcggtca

SEQ ID NO: 716087 - DNA, 13 bp, C. elegans
gaaaattctaaaa

SEQ ID NO: 716088 - DNA, 13 bp, C. elegans
gaaaattctagaa

SEQ ID NO: 716089 - DNA, 13 bp, C. elegans
gaaaattctcatt

SEQ ID NO: 716090 - DNA, 13 bp, C. elegans
gaaaattctgaaa

SEQ ID NO: 716091 - DNA, 13 bp, C. elegans
gaaaattgaaaac

SEQ ID NO: 716092 - DNA, 13 bp, C. elegans
gaaaattgaaagt

SEQ ID NO: 716093 - DNA, 13 bp, C. elegans
gaaaattgaaatt

SEQ ID NO: 716094 - DNA, 13 bp, C. elegans
gaaaattgaacaa

SEQ ID NO: 716095 - DNA, 13 bp, C. elegans
gaaaattgaacat

SEQ ID NO: 716096 - DNA, 13 bp, C. elegans
gaaaattgaagct

SEQ ID NO: 716097 - DNA, 13 bp, C. elegans
gaaaattgaatat

SEQ ID NO: 716098 - DNA, 13 bp, C. elegans
gaaaattgacaat

SEQ ID NO: 716099 - DNA, 13 bp, C. elegans
gaaaattgacaca

SEQ ID NO: 716100 - DNA, 13 bp, C. elegans
gaaaattgacatt

SEQ ID NO: 716101 - DNA, 13 bp, C. elegans
gaaaattgacgaa

SEQ ID NO: 716102 - DNA, 13 bp, C. elegans
gaaaattgacgat

SEQ ID NO: 716103 - DNA, 13 bp, C. elegans
gaaaattgactga

SEQ ID NO: 716104 - DNA, 13 bp, C. elegans
gaaaattgagctc

SEQ ID NO: 716105 - DNA, 13 bp, C. elegans
gaaaattgagttt

SEQ ID NO: 716106 - DNA, 13 bp, C. elegans
gaaaattgatata

SEQ ID NO: 716107 - DNA, 13 bp, C. elegans
gaaaattgatgat

SEQ ID NO: 716108 - DNA, 13 bp, C. elegans
gaaaattgcaaaa

SEQ ID NO: 716109 - DNA, 13 bp, C. elegans
gaaaattgcaatt

SEQ ID NO: 716110 - DNA, 13 bp, C. elegans
gaaaattgcactt

SEQ ID NO: 716111 - DNA, 13 bp, C. elegans
gaaaattgcagaa

SEQ ID NO: 716112 - DNA, 13 bp, C. elegans
gaaaattgcagat

SEQ ID NO: 716113 - DNA, 13 bp, C. elegans
gaaaattgcagtt

SEQ ID NO: 716114 - DNA, 13 bp, C. elegans
gaaaattgcgaaa

SEQ ID NO: 716115 - DNA, 13 bp, C. elegans
gaaaattgcgatt

SEQ ID NO: 716116 - DNA, 13 bp, C. elegans
gaaaattgcggaa

SEQ ID NO: 716117 - DNA, 13 bp, C. elegans
gaaaattgcgttt

SEQ ID NO: 716118 - DNA, 13 bp, C. elegans
gaaaattgctaaa

SEQ ID NO: 716119 - DNA, 13 bp, C. elegans
gaaaattgctgat

SEQ ID NO: 716120 - DNA, 13 bp, C. elegans
gaaaattgcttta

SEQ ID NO: 716121 - DNA, 13 bp, C. elegans
gaaaattggaaac

SEQ ID NO: 716122 - DNA, 13 bp, C. elegans
gaaaattggaaat

SEQ ID NO: 716123 - DNA, 13 bp, C. elegans
gaaaattggaaga

SEQ ID NO: 716124 - DNA, 13 bp, C. elegans
gaaaattggaatt

SEQ ID NO: 716125 - DNA, 13 bp, C. elegans
gaaaattggagga

SEQ ID NO: 716126 - DNA, 13 bp, C. elegans
gaaaattggcgaa

SEQ ID NO: 716127 - DNA, 13 bp, C. elegans
gaaaattggctaa

SEQ ID NO: 716128 - DNA, 13 bp, C. elegans
gaaaattgggatt

SEQ ID NO: 716129 - DNA, 13 bp, C. elegans
gaaaattggtaaa

SEQ ID NO: 716130 - DNA, 13 bp, C. elegans
gaaaattggtgtt

SEQ ID NO: 716131 - DNA, 13 bp, C. elegans
gaaaattgtaata

SEQ ID NO: 716132 - DNA, 13 bp, C. elegans
gaaaattgtagaa

SEQ ID NO: 716133 - DNA, 13 bp, C. elegans
gaaaattgtcaaa

SEQ ID NO: 716134 - DNA, 13 bp, C. elegans
gaaaattgttcga

SEQ ID NO: 716135 - DNA, 13 bp, C. elegans
gaaaattgttgaa

SEQ ID NO: 716136 - DNA, 13 bp, C. elegans
gaaaattgttgtt

SEQ ID NO: 716137 - DNA, 13 bp, C. elegans
gaaaattgtttat

SEQ ID NO: 716138 - DNA, 13 bp, C. elegans
gaaaattgtttga

SEQ ID NO: 716139 - DNA, 13 bp, C. elegans
gaaaatttaaagg

SEQ ID NO: 716140 - DNA, 13 bp, C. elegans
gaaaatttagaat

SEQ ID NO: 716141 - DNA, 13 bp, C. elegans
gaaaatttataac

SEQ ID NO: 716142 - DNA, 13 bp, C. elegans
gaaaatttattgt

SEQ ID NO: 716143 - DNA, 13 bp, C. elegans
gaaaatttcaaag

SEQ ID NO: 716144 - DNA, 13 bp, C. elegans
gaaaatttcaatt

SEQ ID NO: 716145 - DNA, 13 bp, C. elegans
gaaaatttcagaa

SEQ ID NO: 716146 - DNA, 13 bp, C. elegans
gaaaatttcagtt

SEQ ID NO: 716147 - DNA, 13 bp, C. elegans
gaaaatttcattt

SEQ ID NO: 716148 - DNA, 13 bp, C. elegans
gaaaatttccaaa

SEQ ID NO: 716149 - DNA, 13 bp, C. elegans
gaaaatttccatt

SEQ ID NO: 716150 - DNA, 13 bp, C. elegans
gaaaatttccgtc

SEQ ID NO: 716151 - DNA, 13 bp, C. elegans
gaaaatttcgaaa

SEQ ID NO: 716152 - DNA, 13 bp, C. elegans
gaaaatttcgaat

SEQ ID NO: 716153 - DNA, 13 bp, C. elegans
gaaaatttcggtt

SEQ ID NO: 716154 - DNA, 13 bp, C. elegans
gaaaatttcgtaa

SEQ ID NO: 716155 - DNA, 13 bp, C. elegans
gaaaatttgaaat

SEQ ID NO: 716156 - DNA, 13 bp, C. elegans
gaaaatttgaaga

SEQ ID NO: 716157 - DNA, 13 bp, C. elegans
gaaaatttgacaa

SEQ ID NO: 716158 - DNA, 13 bp, C. elegans
gaaaatttgagaa

SEQ ID NO: 716159 - DNA, 13 bp, C. elegans
gaaaatttgcatg

SEQ ID NO: 716160 - DNA, 13 bp, C. elegans
gaaaatttgctca

SEQ ID NO: 716161 - DNA, 13 bp, C. elegans
gaaaatttggaat

SEQ ID NO: 716162 - DNA, 13 bp, C. elegans
gaaaatttggttt

SEQ ID NO: 716163 - DNA, 13 bp, C. elegans
gaaaattttagaa

SEQ ID NO: 716164 - DNA, 13 bp, C. elegans
gaaaattttcgat

SEQ ID NO: 716165 - DNA, 13 bp, C. elegans
gaaaattttctat

SEQ ID NO: 716166 - DNA, 13 bp, C. elegans
gaaaattttgaga

SEQ ID NO: 716167 - DNA, 13 bp, C. elegans
gaaaattttgcag

SEQ ID NO: 716168 - DNA, 13 bp, C. elegans
gaaaattttgtga

SEQ ID NO: 716169 - DNA, 13 bp, C. elegans
gaaaattttgttt

SEQ ID NO: 716170 - DNA, 13 bp, C. elegans
gaaaatttttgaa

SEQ ID NO: 716171 - DNA, 13 bp, C. elegans
gaaaatttttgat

SEQ ID NO: 716172 - DNA, 13 bp, C. elegans
gaaacaaaaatcg

SEQ ID NO: 716173 - DNA, 13 bp, C. elegans
gaaacaaaattat

SEQ ID NO: 716174 - DNA, 13 bp, C. elegans
gaaacaaatgttt

SEQ ID NO: 716175 - DNA, 13 bp, C. elegans
gaaacaaattata

SEQ ID NO: 716176 - DNA, 13 bp, C. elegans
gaaacaaattcaa

SEQ ID NO: 716177 - DNA, 13 bp, C. elegans
gaaacaaattttg

SEQ ID NO: 716178 - DNA, 13 bp, C. elegans
gaaacaacgatgc

SEQ ID NO: 716179 - DNA, 13 bp, C. elegans
gaaacaacttttt

SEQ ID NO: 716180 - DNA, 13 bp, C. elegans
gaaacaataattg

SEQ ID NO: 716181 - DNA, 13 bp, C. elegans
gaaacaatctgaa

SEQ ID NO: 716182 - DNA, 13 bp, C. elegans
gaaacaatgcaaa

SEQ ID NO: 716183 - DNA, 13 bp, C. elegans
gaaacaatggaaa

SEQ ID NO: 716184 - DNA, 13 bp, C. elegans
gaaacaattacaa

SEQ ID NO: 716185 - DNA, 13 bp, C. elegans
gaaacaattccaa

SEQ ID NO: 716186 - DNA, 13 bp, C. elegans
gaaacaattgaaa

SEQ ID NO: 716187 - DNA, 13 bp, C. elegans
gaaacaattggaa

SEQ ID NO: 716188 - DNA, 13 bp, C. elegans
gaaacaatttatt

SEQ ID NO: 716189 - DNA, 13 bp, C. elegans
gaaacaatttgga

SEQ ID NO: 716190 - DNA, 13 bp, C. elegans
gaaacaatttttt

SEQ ID NO: 716191 - DNA, 13 bp, C. elegans
gaaacacaaattt

SEQ ID NO: 716192 - DNA, 13 bp, C. elegans
gaaacacaatttt

SEQ ID NO: 716193 - DNA, 13 bp, C. elegans
gaaacacacaagt

SEQ ID NO: 716194 - DNA, 13 bp, C. elegans
gaaacaccatttt

SEQ ID NO: 716195 - DNA, 13 bp, C. elegans
gaaacactcaaaa

SEQ ID NO: 716196 - DNA, 13 bp, C. elegans
gaaacacttcaaa

SEQ ID NO: 716197 - DNA, 13 bp, C. elegans
gaaacacttgaaa

SEQ ID NO: 716198 - DNA, 13 bp, C. elegans
gaaacactttttt

SEQ ID NO: 716199 - DNA, 13 bp, C. elegans
gaaacagaaacta

SEQ ID NO: 716200 - DNA, 13 bp, C. elegans
gaaacagattttt

SEQ ID NO: 716201 - DNA, 13 bp, C. elegans
gaaacagctcaaa

SEQ ID NO: 716202 - DNA, 13 bp, C. elegans
gaaacagtaaata

SEQ ID NO: 716203 - DNA, 13 bp, C. elegans
gaaacagtaactt

SEQ ID NO: 716204 - DNA, 13 bp, C. elegans
gaaacagtagaaa

SEQ ID NO: 716205 - DNA, 13 bp, C. elegans
gaaacagtcgaaa

SEQ ID NO: 716206 - DNA, 13 bp, C. elegans
gaaacagtgaaac

SEQ ID NO: 716207 - DNA, 13 bp, C. elegans
gaaacagtgaaca

SEQ ID NO: 716208 - DNA, 13 bp, C. elegans
gaaacagtgattt

SEQ ID NO: 716209 - DNA, 13 bp, C. elegans
gaaacagttgttt

SEQ ID NO: 716210 - DNA, 13 bp, C. elegans
gaaacagtttcag

SEQ ID NO: 716211 - DNA, 13 bp, C. elegans
gaaacataaattt

SEQ ID NO: 716212 - DNA, 13 bp, C. elegans
gaaacatcaactt

SEQ ID NO: 716213 - DNA, 13 bp, C. elegans
gaaacatcacaaa

SEQ ID NO: 716214 - DNA, 13 bp, C. elegans
gaaacatcacttt

SEQ ID NO: 716215 - DNA, 13 bp, C. elegans
gaaacatcatttt

SEQ ID NO: 716216 - DNA, 13 bp, C. elegans
gaaacatcttttt

SEQ ID NO: 716217 - DNA, 13 bp, C. elegans
gaaacatgaaatt

SEQ ID NO: 716218 - DNA, 13 bp, C. elegans
gaaacatgcgaaa

SEQ ID NO: 716219 - DNA, 13 bp, C. elegans
gaaacatggaaaa

SEQ ID NO: 716220 - DNA, 13 bp, C. elegans
gaaacatggtttt

SEQ ID NO: 716221 - DNA, 13 bp, C. elegans
gaaacatgttaaa

SEQ ID NO: 716222 - DNA, 13 bp, C. elegans
gaaacattaaata

SEQ ID NO: 716223 - DNA, 13 bp, C. elegans
gaaacattacaaa

SEQ ID NO: 716224 - DNA, 13 bp, C. elegans
gaaacattagaaa

SEQ ID NO: 716225 - DNA, 13 bp, C. elegans
gaaacattcaaag

SEQ ID NO: 716226 - DNA, 13 bp, C. elegans
gaaacattcagaa

SEQ ID NO: 716227 - DNA, 13 bp, C. elegans
gaaacattgaaaa

SEQ ID NO: 716228 - DNA, 13 bp, C. elegans
gaaacattgaaat

SEQ ID NO: 716229 - DNA, 13 bp, C. elegans
gaaacattgattt

SEQ ID NO: 716230 - DNA, 13 bp, C. elegans
gaaacatttccaa

SEQ ID NO: 716231 - DNA, 13 bp, C. elegans
gaaacatttcttt

SEQ ID NO: 716232 - DNA, 13 bp, C. elegans
gaaacatttggaa

SEQ ID NO: 716233 - DNA, 13 bp, C. elegans
gaaacattttatt

SEQ ID NO: 716234 - DNA, 13 bp, C. elegans
gaaacattttcta

SEQ ID NO: 716235 - DNA, 13 bp, C. elegans
gaaacattttctt

SEQ ID NO: 716236 - DNA, 13 bp, C. elegans
gaaacattttgtt

SEQ ID NO: 716237 - DNA, 13 bp, C. elegans
gaaacatttttaa

SEQ ID NO: 716238 - DNA, 13 bp, C. elegans
gaaacatttttta

SEQ ID NO: 716239 - DNA, 13 bp, C. elegans
gaaacattttttt

SEQ ID NO: 716240 - DNA, 13 bp, C. elegans
gaaaccaactctt

SEQ ID NO: 716241 - DNA, 13 bp, C. elegans
gaaaccaattatt

SEQ ID NO: 716242 - DNA, 13 bp, C. elegans
gaaaccattaaaa

SEQ ID NO: 716243 - DNA, 13 bp, C. elegans
gaaacccttcgtg

SEQ ID NO: 716244 - DNA, 13 bp, C. elegans
gaaacctcaaaat

SEQ ID NO: 716245 - DNA, 13 bp, C. elegans
gaaacctgaattt

SEQ ID NO: 716246 - DNA, 13 bp, C. elegans
gaaaccttgaaaa

SEQ ID NO: 716247 - DNA, 13 bp, C. elegans
gaaacgaaagttt

SEQ ID NO: 716248 - DNA, 13 bp, C. elegans
gaaacgagacact

SEQ ID NO: 716249 - DNA, 13 bp, C. elegans
gaaacgatacgat

SEQ ID NO: 716250 - DNA, 13 bp, C. elegans
gaaacgcagagaa

SEQ ID NO: 716251 - DNA, 13 bp, C. elegans
gaaacgcgctcca

SEQ ID NO: 716252 - DNA, 13 bp, C. elegans
gaaacgctcgcca

SEQ ID NO: 716253 - DNA, 13 bp, C. elegans
gaaacggcccgaa

SEQ ID NO: 716254 - DNA, 13 bp, C. elegans
gaaacgggaaaat

SEQ ID NO: 716255 - DNA, 13 bp, C. elegans
gaaacgtctgaaa

SEQ ID NO: 716256 - DNA, 13 bp, C. elegans
gaaacgtggaaaa

SEQ ID NO: 716257 - DNA, 13 bp, C. elegans
gaaacgttatttt

SEQ ID NO: 716258 - DNA, 13 bp, C. elegans
gaaacgtttcgaa

SEQ ID NO: 716259 - DNA, 13 bp, C. elegans
gaaactaaaacct

SEQ ID NO: 716260 - DNA, 13 bp, C. elegans
gaaactaaaactt

SEQ ID NO: 716261 - DNA, 13 bp, C. elegans
gaaactaataaat

SEQ ID NO: 716262 - DNA, 115 bp, C. elegans
gaaactacaatgcgaccctgggcacttcaaaatgtgggccgtggcttcgtgtttcagcaggataacgatcctaagcatacttctcttcatgtgcgttcctggtttcaacgtcgtc

SEQ ID NO: 716263 - DNA, 13 bp, C. elegans
gaaactaccgtaa

SEQ ID NO: 716264 - DNA, 13 bp, C. elegans
gaaactactgaaa

SEQ ID NO: 716265 - DNA, 13 bp, C. elegans
gaaactatagaaa

SEQ ID NO: 716266 - DNA, 13 bp, C. elegans
gaaactatcaaaa

SEQ ID NO: 716267 - DNA, 13 bp, C. elegans
gaaactatgtttt

SEQ ID NO: 716268 - DNA, 13 bp, C. elegans
gaaactattggaa

SEQ ID NO: 716269 - DNA, 13 bp, C. elegans
gaaactcaaattt

SEQ ID NO: 716270 - DNA, 13 bp, C. elegans
gaaactcacaatt

SEQ ID NO: 716271 - DNA, 13 bp, C. elegans
gaaactcagaaat

SEQ ID NO: 716272 - DNA, 13 bp, C. elegans
gaaactcataaaa

SEQ ID NO: 716273 - DNA, 13 bp, C. elegans
gaaactcataact

SEQ ID NO: 716274 - DNA, 13 bp, C. elegans
gaaactcatttaa

SEQ ID NO: 716275 - DNA, 13 bp, C. elegans
gaaactcgaaaaa

SEQ ID NO: 716276 - DNA, 13 bp, C. elegans
gaaactcgaaaac

SEQ ID NO: 716277 - DNA, 13 bp, C. elegans
gaaactcgaaaat

SEQ ID NO: 716278 - DNA, 13 bp, C. elegans
gaaactcggaaaa

SEQ ID NO: 716279 - DNA, 13 bp, C. elegans
gaaactctaattt

SEQ ID NO: 716280 - DNA, 13 bp, C. elegans
gaaactgaaagtt

SEQ ID NO: 716281 - DNA, 13 bp, C. elegans
gaaactgaacaat

SEQ ID NO: 716282 - DNA, 13 bp, C. elegans
gaaactgaatttt

SEQ ID NO: 716283 - DNA, 13 bp, C. elegans
gaaactgataaaa

SEQ ID NO: 716284 - DNA, 13 bp, C. elegans
gaaactgataaat

SEQ ID NO: 716285 - DNA, 13 bp, C. elegans
gaaactgatgaaa

SEQ ID NO: 716286 - DNA, 13 bp, C. elegans
gaaactgattgaa

SEQ ID NO: 716287 - DNA, 13 bp, C. elegans
gaaactgcaaaaa

SEQ ID NO: 716288 - DNA, 13 bp, C. elegans
gaaactgcaattt

SEQ ID NO: 716289 - DNA, 13 bp, C. elegans
gaaactgcagaaa

SEQ ID NO: 716290 - DNA, 13 bp, C. elegans
gaaactggttttt

SEQ ID NO: 716291 - DNA, 13 bp, C. elegans
gaaacttaaaagt

SEQ ID NO: 716292 - DNA, 13 bp, C. elegans
gaaacttaatttt

SEQ ID NO: 716293 - DNA, 13 bp, C. elegans
gaaacttcaaaaa

SEQ ID NO: 716294 - DNA, 13 bp, C. elegans
gaaacttcaacaa

SEQ ID NO: 716295 - DNA, 13 bp, C. elegans
gaaacttcacttt

SEQ ID NO: 716296 - DNA, 13 bp, C. elegans
gaaacttccaaaa

SEQ ID NO: 716297 - DNA, 13 bp, C. elegans
gaaacttccagaa

SEQ ID NO: 716298 - DNA, 13 bp, C. elegans
gaaacttctcaaa

SEQ ID NO: 716299 - DNA, 13 bp, C. elegans
gaaacttctgaaa

SEQ ID NO: 716300 - DNA, 13 bp, C. elegans
gaaacttctgcaa

SEQ ID NO: 716301 - DNA, 13 bp, C. elegans
gaaacttgaaaaa

SEQ ID NO: 716302 - DNA, 13 bp, C. elegans
gaaacttgaaaag

SEQ ID NO: 716303 - DNA, 13 bp, C. elegans
gaaacttgtagtt

SEQ ID NO: 716304 - DNA, 13 bp, C. elegans
gaaacttgtgaaa

SEQ ID NO: 716305 - DNA, 13 bp, C. elegans
gaaacttgttttt

SEQ ID NO: 716306 - DNA, 13 bp, C. elegans
gaaactttaaaaa

SEQ ID NO: 716307 - DNA, 13 bp, C. elegans
gaaactttaacaa

SEQ ID NO: 716308 - DNA, 13 bp, C. elegans
gaaactttacaaa

SEQ ID NO: 716309 - DNA, 13 bp, C. elegans
gaaactttcaatt

SEQ ID NO: 716310 - DNA, 13 bp, C. elegans
gaaactttcacat

SEQ ID NO: 716311 - DNA, 13 bp, C. elegans
gaaactttccgaa

SEQ ID NO: 716312 - DNA, 13 bp, C. elegans
gaaactttgaaaa

SEQ ID NO: 716313 - DNA, 13 bp, C. elegans
gaaactttgaaat

SEQ ID NO: 716314 - DNA, 13 bp, C. elegans
gaaacttttatga

SEQ ID NO: 716315 - DNA, 13 bp, C. elegans
gaaacttttatta

SEQ ID NO: 716316 - DNA, 13 bp, C. elegans
gaaacttttcaaa

SEQ ID NO: 716317 - DNA, 13 bp, C. elegans
gaaacttttgaaa

SEQ ID NO: 716318 - DNA, 13 bp, C. elegans
gaaacttttgatc

SEQ ID NO: 716319 - DNA, 13 bp, C. elegans
gaaactttttctt

SEQ ID NO: 716320 - DNA, 13 bp, C. elegans
gaaactttttttt

SEQ ID NO: 716321 - DNA, 13 bp, C. elegans
gaaagaaaaacgt

SEQ ID NO: 716322 - DNA, 13 bp, C. elegans
gaaagaaaacatt

SEQ ID NO: 716323 - DNA, 13 bp, C. elegans
gaaagaaaacttt

SEQ ID NO: 716324 - DNA, 13 bp, C. elegans
gaaagaaaagttc

SEQ ID NO: 716325 - DNA, 13 bp, C. elegans
gaaagaaacaatt

SEQ ID NO: 716326 - DNA, 13 bp, C. elegans
gaaagaaattcag

SEQ ID NO: 716327 - DNA, 13 bp, C. elegans
gaaagaatatatt

SEQ ID NO: 716328 - DNA, 13 bp, C. elegans
gaaagaatttgaa

SEQ ID NO: 716329 - DNA, 13 bp, C. elegans
gaaagaatttttt

SEQ ID NO: 716330 - DNA, 13 bp, C. elegans
gaaagacatttat

SEQ ID NO: 716331 - DNA, 13 bp, C. elegans
gaaagaccatgaa

SEQ ID NO: 716332 - DNA, 14 bp, C. elegans
gaaagacggcttgt

SEQ ID NO: 716333 - DNA, 13 bp, C. elegans
gaaagagaaaact

SEQ ID NO: 716334 - DNA, 13 bp, C. elegans
gaaagagcttaaa

SEQ ID NO: 716335 - DNA, 13 bp, C. elegans
gaaagatcaaaga

SEQ ID NO: 716336 - DNA, 13 bp, C. elegans
gaaagatcgaaaa

SEQ ID NO: 716337 - DNA, 13 bp, C. elegans
gaaagatgaaatt

SEQ ID NO: 716338 - DNA, 13 bp, C. elegans
gaaagatgttttt

SEQ ID NO: 716339 - DNA, 13 bp, C. elegans
gaaagattggagc

SEQ ID NO: 716340 - DNA, 13 bp, C. elegans
gaaagattttgaa

SEQ ID NO: 716341 - DNA, 13 bp, C. elegans
gaaagcatttcaa

SEQ ID NO: 716342 - DNA, 13 bp, C. elegans
gaaagccagtcaa

SEQ ID NO: 716343 - DNA, 13 bp, C. elegans
gaaagctatcaaa

SEQ ID NO: 716344 - DNA, 13 bp, C. elegans
gaaagctgaaaaa

SEQ ID NO: 716345 - DNA, 13 bp, C. elegans
gaaagctgacatt

SEQ ID NO: 716346 - DNA, 13 bp, C. elegans
gaaagcttcaaaa

SEQ ID NO: 716347 - DNA, 13 bp, C. elegans
gaaagcttgaaat

SEQ ID NO: 716348 - DNA, 13 bp, C. elegans
gaaagctttaaaa

SEQ ID NO: 716349 - DNA, 13 bp, C. elegans
gaaaggttcaaat

SEQ ID NO: 716350 - DNA, 13 bp, C. elegans
gaaagtatgtatt

SEQ ID NO: 716351 - DNA, 13 bp, C. elegans
gaaagtattcaaa

SEQ ID NO: 716352 - DNA, 13 bp, C. elegans
gaaagtatttcaa

SEQ ID NO: 716353 - DNA, 13 bp, C. elegans
gaaagtattttaa

SEQ ID NO: 716354 - DNA, 13 bp, C. elegans
gaaagtcaaattt

SEQ ID NO: 716355 - DNA, 13 bp, C. elegans
gaaagtcgaccaa

SEQ ID NO: 716356 - DNA, 13 bp, C. elegans
gaaagtctgaaaa

SEQ ID NO: 716357 - DNA, 13 bp, C. elegans
gaaagtgcgctct

SEQ ID NO: 716358 - DNA, 13 bp, C. elegans
gaaagtgcgtcaa

SEQ ID NO: 716359 - DNA, 14 bp, C. elegans
gaaagtggagagtt

SEQ ID NO: 716360 - DNA, 13 bp, C. elegans
gaaagtggctgaa

SEQ ID NO: 716361 - DNA, 13 bp, C. elegans
gaaagtgggcgtg

SEQ ID NO: 716362 - DNA, 13 bp, C. elegans
gaaagtgtcagca

SEQ ID NO: 716363 - DNA, 13 bp, C. elegans
gaaagtgttgaaa

SEQ ID NO: 716364 - DNA, 13 bp, C. elegans
gaaagttacaaaa

SEQ ID NO: 716365 - DNA, 13 bp, C. elegans
gaaagttatattt

SEQ ID NO: 716366 - DNA, 13 bp, C. elegans
gaaagttatttga

SEQ ID NO: 716367 - DNA, 13 bp, C. elegans
gaaagttcaaaat

SEQ ID NO: 716368 - DNA, 13 bp, C. elegans
gaaagttcaacaa

SEQ ID NO: 716369 - DNA, 13 bp, C. elegans
gaaagttcagaaa

SEQ ID NO: 716370 - DNA, 13 bp, C. elegans
gaaagttcgaaaa

SEQ ID NO: 716371 - DNA, 13 bp, C. elegans
gaaagttcgaaat

SEQ ID NO: 716372 - DNA, 13 bp, C. elegans
gaaagttcgagaa

SEQ ID NO: 716373 - DNA, 13 bp, C. elegans
gaaagttcttaaa

SEQ ID NO: 716374 - DNA, 13 bp, C. elegans
gaaagttgaaaat

SEQ ID NO: 716375 - DNA, 13 bp, C. elegans
gaaagttgaaatt

SEQ ID NO: 716376 - DNA, 13 bp, C. elegans
gaaagttgaagaa

SEQ ID NO: 716377 - DNA, 13 bp, C. elegans
gaaagttgacaat

SEQ ID NO: 716378 - DNA, 13 bp, C. elegans
gaaagttgataat

SEQ ID NO: 716379 - DNA, 13 bp, C. elegans
gaaagttgatttt

SEQ ID NO: 716380 - DNA, 13 bp, C. elegans
gaaagttgcaaat

SEQ ID NO: 716381 - DNA, 13 bp, C. elegans
gaaagttgccgaa

SEQ ID NO: 716382 - DNA, 13 bp, C. elegans
gaaagttggaaaa

SEQ ID NO: 716383 - DNA, 13 bp, C. elegans
gaaagtttaaaat

SEQ ID NO: 716384 - DNA, 13 bp, C. elegans
gaaagtttacaaa

SEQ ID NO: 716385 - DNA, 13 bp, C. elegans
gaaagtttcaaaa

SEQ ID NO: 716386 - DNA, 13 bp, C. elegans
gaaagtttcaaat

SEQ ID NO: 716387 - DNA, 13 bp, C. elegans
gaaagtttctaga

SEQ ID NO: 716388 - DNA, 13 bp, C. elegans
gaaagtttgaaaa

SEQ ID NO: 716389 - DNA, 13 bp, C. elegans
gaaagtttgaaat

SEQ ID NO: 716390 - DNA, 13 bp, C. elegans
gaaagtttgaatt

SEQ ID NO: 716391 - DNA, 13 bp, C. elegans
gaaagtttgattt

SEQ ID NO: 716392 - DNA, 13 bp, C. elegans
gaaagttttagat

SEQ ID NO: 716393 - DNA, 13 bp, C. elegans
gaaagttttcaat

SEQ ID NO: 716394 - DNA, 13 bp, C. elegans
gaaagttttcata

SEQ ID NO: 716395 - DNA, 13 bp, C. elegans
gaaagttttcgaa

SEQ ID NO: 716396 - DNA, 13 bp, C. elegans
gaaagttttgaaa

SEQ ID NO: 716397 - DNA, 13 bp, C. elegans
gaaagttttgaat

SEQ ID NO: 716398 - DNA, 13 bp, C. elegans
gaaagttttgtat

SEQ ID NO: 716399 - DNA, 13 bp, C. elegans
gaaagtttttagt

SEQ ID NO: 716400 - DNA, 13 bp, C. elegans
gaaagtttttcaa

SEQ ID NO: 716401 - DNA, 13 bp, C. elegans
gaaagttttttat

SEQ ID NO: 716402 - DNA, 13 bp, C. elegans
gaaataaaacttt

SEQ ID NO: 716403 - DNA, 13 bp, C. elegans
gaaataaacatat

SEQ ID NO: 716404 - DNA, 13 bp, C. elegans
gaaataaacgatt

SEQ ID NO: 716405 - DNA, 13 bp, C. elegans
gaaataaactgtt

SEQ ID NO: 716406 - DNA, 13 bp, C. elegans
gaaataaagtatt

SEQ ID NO: 716407 - DNA, 13 bp, C. elegans
gaaataaattcaa

SEQ ID NO: 716408 - DNA, 13 bp, C. elegans
gaaataaattttc

SEQ ID NO: 716409 - DNA, 13 bp, C. elegans
gaaataacgttca

SEQ ID NO: 716410 - DNA, 13 bp, C. elegans
gaaataactacaa

SEQ ID NO: 716411 - DNA, 13 bp, C. elegans
gaaataagacatt

SEQ ID NO: 716412 - DNA, 13 bp, C. elegans
gaaataatcgaaa

SEQ ID NO: 716413 - DNA, 13 bp, C. elegans
gaaataatgcgaa

SEQ ID NO: 716414 - DNA, 13 bp, C. elegans
gaaataatggagt

SEQ ID NO: 716415 - DNA, 13 bp, C. elegans
gaaataattggtt

SEQ ID NO: 716416 - DNA, 13 bp, C. elegans
gaaataattttct

SEQ ID NO: 716417 - DNA, 13 bp, C. elegans
gaaatacaacttt

SEQ ID NO: 716418 - DNA, 13 bp, C. elegans
gaaatacaatagc

SEQ ID NO: 716419 - DNA, 13 bp, C. elegans
gaaatacattaaa

SEQ ID NO: 716420 - DNA, 13 bp, C. elegans
gaaataccgaaaa

SEQ ID NO: 716421 - DNA, 13 bp, C. elegans
gaaatacgatttt

SEQ ID NO: 716422 - DNA, 13 bp, C. elegans
gaaatactataaa

SEQ ID NO: 716423 - DNA, 13 bp, C. elegans
gaaatactcaaaa

SEQ ID NO: 716424 - DNA, 13 bp, C. elegans
gaaatacttgaaa

SEQ ID NO: 716425 - DNA, 13 bp, C. elegans
gaaatagtcattt

SEQ ID NO: 716426 - DNA, 13 bp, C. elegans
gaaatagttggaa

SEQ ID NO: 716427 - DNA, 13 bp, C. elegans
gaaatataaatct

SEQ ID NO: 716428 - DNA, 13 bp, C. elegans
gaaatataacatt

SEQ ID NO: 716429 - DNA, 13 bp, C. elegans
gaaatatatgttt

SEQ ID NO: 716430 - DNA, 13 bp, C. elegans
gaaatatattcaa

SEQ ID NO: 716431 - DNA, 13 bp, C. elegans
gaaatatcacaaa

SEQ ID NO: 716432 - DNA, 13 bp, C. elegans
gaaatatcataaa

SEQ ID NO: 716433 - DNA, 13 bp, C. elegans
gaaatatcgaaaa

SEQ ID NO: 716434 - DNA, 13 bp, C. elegans
gaaatatcgattt

SEQ ID NO: 716435 - DNA, 13 bp, C. elegans
gaaatatcttttt

SEQ ID NO: 716436 - DNA, 13 bp, C. elegans
gaaatatgaagtt

SEQ ID NO: 716437 - DNA, 13 bp, C. elegans
gaaatatgaatat

SEQ ID NO: 716438 - DNA, 13 bp, C. elegans
gaaatatgatttt

SEQ ID NO: 716439 - DNA, 13 bp, C. elegans
gaaatatgcaaaa

SEQ ID NO: 716440 - DNA, 13 bp, C. elegans
gaaatatgcacaa

SEQ ID NO: 716441 - DNA, 13 bp, C. elegans
gaaatatgcattt

SEQ ID NO: 716442 - DNA, 13 bp, C. elegans
gaaatatgggaaa

SEQ ID NO: 716443 - DNA, 13 bp, C. elegans
gaaatatgtcaaa

SEQ ID NO: 716444 - DNA, 13 bp, C. elegans
gaaatatgtgaaa

SEQ ID NO: 716445 - DNA, 13 bp, C. elegans
gaaatatgttttc

SEQ ID NO: 716446 - DNA, 13 bp, C. elegans
gaaatattcaaaa

SEQ ID NO: 716447 - DNA, 13 bp, C. elegans
gaaatattcaatt

SEQ ID NO: 716448 - DNA, 13 bp, C. elegans
gaaatattcgaaa

SEQ ID NO: 716449 - DNA, 13 bp, C. elegans
gaaatattcgatt

SEQ ID NO: 716450 - DNA, 13 bp, C. elegans
gaaatattgaact

SEQ ID NO: 716451 - DNA, 13 bp, C. elegans
gaaatattgaaga

SEQ ID NO: 716452 - DNA, 13 bp, C. elegans
gaaatattggaaa

SEQ ID NO: 716453 - DNA, 13 bp, C. elegans
gaaatattggaga

SEQ ID NO: 716454 - DNA, 13 bp, C. elegans
gaaatattgtgaa

SEQ ID NO: 716455 - DNA, 13 bp, C. elegans
gaaatattgtttt

SEQ ID NO: 716456 - DNA, 13 bp, C. elegans
gaaatatttacaa

SEQ ID NO: 716457 - DNA, 13 bp, C. elegans
gaaatatttatga

SEQ ID NO: 716458 - DNA, 13 bp, C. elegans
gaaatatttcaga

SEQ ID NO: 716459 - DNA, 13 bp, C. elegans
gaaatatttgaaa

SEQ ID NO: 716460 - DNA, 13 bp, C. elegans
gaaatattttaga

SEQ ID NO: 716461 - DNA, 13 bp, C. elegans
gaaatattttgcc

SEQ ID NO: 716462 - DNA, 13 bp, C. elegans
gaaatatttttgt

SEQ ID NO: 716463 - DNA, 13 bp, C. elegans
gaaatattttttc

SEQ ID NO: 716464 - DNA, 13 bp, C. elegans
gaaatcaaaaatt

SEQ ID NO: 716465 - DNA, 13 bp, C. elegans
gaaatcaaatatt

SEQ ID NO: 716466 - DNA, 13 bp, C. elegans
gaaatcaaattct

SEQ ID NO: 716467 - DNA, 13 bp, C. elegans
gaaatcaaatttt

SEQ ID NO: 716468 - DNA, 13 bp, C. elegans
gaaatcaaccaaa

SEQ ID NO: 716469 - DNA, 14 bp, C. elegans
gaaatcaagaaatt

SEQ ID NO: 716470 - DNA, 13 bp, C. elegans
gaaatcaagattt

SEQ ID NO: 716471 - DNA, 13 bp, C. elegans
gaaatcaatgaaa

SEQ ID NO: 716472 - DNA, 13 bp, C. elegans
gaaatcacgaaaa

SEQ ID NO: 716473 - DNA, 13 bp, C. elegans
gaaatcactaaaa

SEQ ID NO: 716474 - DNA, 13 bp, C. elegans
gaaatcagggaaa

SEQ ID NO: 716475 - DNA, 13 bp, C. elegans
gaaatcagttgaa

SEQ ID NO: 716476 - DNA, 13 bp, C. elegans
gaaatcatcaaat

SEQ ID NO: 716477 - DNA, 13 bp, C. elegans
gaaatcatcaatt

SEQ ID NO: 716478 - DNA, 13 bp, C. elegans
gaaatcatcagaa

SEQ ID NO: 716479 - DNA, 13 bp, C. elegans
gaaatcatccaaa

SEQ ID NO: 716480 - DNA, 13 bp, C. elegans
gaaatcatcgaaa

SEQ ID NO: 716481 - DNA, 13 bp, C. elegans
gaaatcattaaaa

SEQ ID NO: 716482 - DNA, 13 bp, C. elegans
gaaatcattttta

SEQ ID NO: 716483 - DNA, 13 bp, C. elegans
gaaatcatttttt

SEQ ID NO: 716484 - DNA, 13 bp, C. elegans
gaaatccaaaatt

SEQ ID NO: 716485 - DNA, 13 bp, C. elegans
gaaatccaccgaa

SEQ ID NO: 716486 - DNA, 13 bp, C. elegans
gaaatccatattt

SEQ ID NO: 716487 - DNA, 13 bp, C. elegans
gaaatcccaatcc

SEQ ID NO: 716488 - DNA, 13 bp, C. elegans
gaaatccgagaaa

SEQ ID NO: 716489 - DNA, 13 bp, C. elegans
gaaatccgtgttt

SEQ ID NO: 716490 - DNA, 13 bp, C. elegans
gaaatcctgaaaa

SEQ ID NO: 716491 - DNA, 14 bp, C. elegans
gaaatccttacaat

SEQ ID NO: 716492 - DNA, 13 bp, C. elegans
gaaatcgaaaaat

SEQ ID NO: 716493 - DNA, 13 bp, C. elegans
gaaatcgaaataa

SEQ ID NO: 716494 - DNA, 13 bp, C. elegans
gaaatcgaagaaa

SEQ ID NO: 716495 - DNA, 13 bp, C. elegans
gaaatcgacaatt

SEQ ID NO: 716496 - DNA, 13 bp, C. elegans
gaaatcgaccaaa

SEQ ID NO: 716497 - DNA, 13 bp, C. elegans
gaaatcgagaaaa

SEQ ID NO: 716498 - DNA, 13 bp, C. elegans
gaaatcgatgaaa

SEQ ID NO: 716499 - DNA, 13 bp, C. elegans
gaaatcgattgaa

SEQ ID NO: 716500 - DNA, 13 bp, C. elegans
gaaatcgctaaaa

SEQ ID NO: 716501 - DNA, 13 bp, C. elegans
gaaatcgttgaaa

SEQ ID NO: 716502 - DNA, 13 bp, C. elegans
gaaatctaagaaa

SEQ ID NO: 716503 - DNA, 13 bp, C. elegans
gaaatctagaaaa

SEQ ID NO: 716504 - DNA, 13 bp, C. elegans
gaaatctatgaag

SEQ ID NO: 716505 - DNA, 13 bp, C. elegans
gaaatctattcca

SEQ ID NO: 716506 - DNA, 13 bp, C. elegans
gaaatctccaaaa

SEQ ID NO: 716507 - DNA, 13 bp, C. elegans
gaaatctcgaaaa

SEQ ID NO: 716508 - DNA, 13 bp, C. elegans
gaaatctcttttt

SEQ ID NO: 716509 - DNA, 13 bp, C. elegans
gaaatctgaaaat

SEQ ID NO: 716510 - DNA, 13 bp, C. elegans
gaaatctgaaatt

SEQ ID NO: 716511 - DNA, 13 bp, C. elegans
gaaatctgagaaa

SEQ ID NO: 716512 - DNA, 13 bp, C. elegans
gaaatctggaaaa

SEQ ID NO: 716513 - DNA, 13 bp, C. elegans
gaaatctggaatt

SEQ ID NO: 716514 - DNA, 13 bp, C. elegans
gaaatctgtaaat

SEQ ID NO: 716515 - DNA, 13 bp, C. elegans
gaaatcttaaaaa

SEQ ID NO: 716516 - DNA, 13 bp, C. elegans
gaaatcttcaatt

SEQ ID NO: 716517 - DNA, 13 bp, C. elegans
gaaatcttctcaa

SEQ ID NO: 716518 - DNA, 13 bp, C. elegans
gaaatcttgaatt

SEQ ID NO: 716519 - DNA, 13 bp, C. elegans
gaaatcttgcaaa

SEQ ID NO: 716520 - DNA, 13 bp, C. elegans
gaaatctttaaaa

SEQ ID NO: 716521 - DNA, 13 bp, C. elegans
gaaatctttcaaa

SEQ ID NO: 716522 - DNA, 13 bp, C. elegans
gaaatcttttttt

SEQ ID NO: 716523 - DNA, 13 bp, C. elegans
gaaatgaaacatt

SEQ ID NO: 716524 - DNA, 13 bp, C. elegans
gaaatgaaattga

SEQ ID NO: 716525 - DNA, 13 bp, C. elegans
gaaatgaacgaat

SEQ ID NO: 716526 - DNA, 13 bp, C. elegans
gaaatgaagaagt

SEQ ID NO: 716527 - DNA, 13 bp, C. elegans
gaaatgaatgttt

SEQ ID NO: 716528 - DNA, 13 bp, C. elegans
gaaatgaattatt

SEQ ID NO: 716529 - DNA, 13 bp, C. elegans
gaaatgaatttga

SEQ ID NO: 716530 - DNA, 13 bp, C. elegans
gaaatgaattttt

SEQ ID NO: 716531 - DNA, 13 bp, C. elegans
gaaatgacaaaat

SEQ ID NO: 716532 - DNA, 13 bp, C. elegans
gaaatgacaaatt

SEQ ID NO: 716533 - DNA, 13 bp, C. elegans
gaaatgacaatta

SEQ ID NO: 716534 - DNA, 13 bp, C. elegans
gaaatgacagaaa

SEQ ID NO: 716535 - DNA, 13 bp, C. elegans
gaaatgacgagaa

SEQ ID NO: 716536 - DNA, 13 bp, C. elegans
gaaatgagacact

SEQ ID NO: 716537 - DNA, 13 bp, C. elegans
gaaatgagcaatt

SEQ ID NO: 716538 - DNA, 13 bp, C. elegans
gaaatgatcaaaa

SEQ ID NO: 716539 - DNA, 13 bp, C. elegans
gaaatgatctaca

SEQ ID NO: 716540 - DNA, 13 bp, C. elegans
gaaatgatgagaa

SEQ ID NO: 716541 - DNA, 13 bp, C. elegans
gaaatgatgataa

SEQ ID NO: 716542 - DNA, 13 bp, C. elegans
gaaatgattattt

SEQ ID NO: 716543 - DNA, 13 bp, C. elegans
gaaatgatttttt

SEQ ID NO: 716544 - DNA, 13 bp, C. elegans
gaaatgcaaaaat

SEQ ID NO: 716545 - DNA, 13 bp, C. elegans
gaaatgcaaattt

SEQ ID NO: 716546 - DNA, 13 bp, C. elegans
gaaatgcaagaaa

SEQ ID NO: 716547 - DNA, 13 bp, C. elegans
gaaatgcgaaaaa

SEQ ID NO: 716548 - DNA, 13 bp, C. elegans
gaaatgctagaaa

SEQ ID NO: 716549 - DNA, 14 bp, C. elegans
gaaatgctcaaaaa

SEQ ID NO: 716550 - DNA, 13 bp, C. elegans
gaaatgctcgatt

SEQ ID NO: 716551 - DNA, 13 bp, C. elegans
gaaatgctttgaa

SEQ ID NO: 716552 - DNA, 13 bp, C. elegans
gaaatggaagagt

SEQ ID NO: 716553 - DNA, 13 bp, C. elegans
gaaatgggaattt

SEQ ID NO: 716554 - DNA, 13 bp, C. elegans
gaaatgggacact

SEQ ID NO: 716555 - DNA, 13 bp, C. elegans
gaaatgggacatt

SEQ ID NO: 716556 - DNA, 13 bp, C. elegans
gaaatgggcggag

SEQ ID NO: 716557 - DNA, 13 bp, C. elegans
gaaatggtgtttt

SEQ ID NO: 716558 - DNA, 13 bp, C. elegans
gaaatggttttaa

SEQ ID NO: 716559 - DNA, 13 bp, C. elegans
gaaatggtttttt

SEQ ID NO: 716560 - DNA, 13 bp, C. elegans
gaaatgtaaactt

SEQ ID NO: 716561 - DNA, 13 bp, C. elegans
gaaatgtagaatt

SEQ ID NO: 716562 - DNA, 13 bp, C. elegans
gaaatgtatcaaa

SEQ ID NO: 716563 - DNA, 13 bp, C. elegans
gaaatgtatccga

SEQ ID NO: 716564 - DNA, 13 bp, C. elegans
gaaatgtatcttt

SEQ ID NO: 716565 - DNA, 13 bp, C. elegans
gaaatgtatgtat

SEQ ID NO: 716566 - DNA, 13 bp, C. elegans
gaaatgtatgttt

SEQ ID NO: 716567 - DNA, 13 bp, C. elegans
gaaatgtattttt

SEQ ID NO: 716568 - DNA, 13 bp, C. elegans
gaaatgtcaaaaa

SEQ ID NO: 716569 - DNA, 13 bp, C. elegans
gaaatgtcagaaa

SEQ ID NO: 716570 - DNA, 13 bp, C. elegans
gaaatgtctattt

SEQ ID NO: 716571 - DNA, 13 bp, C. elegans
gaaatgtctgcaa

SEQ ID NO: 716572 - DNA, 13 bp, C. elegans
gaaatgtgaaatt

SEQ ID NO: 716573 - DNA, 13 bp, C. elegans
gaaatgtgatatt

SEQ ID NO: 716574 - DNA, 13 bp, C. elegans
gaaatgtgatgaa

SEQ ID NO: 716575 - DNA, 13 bp, C. elegans
gaaatgtgccaaa

SEQ ID NO: 716576 - DNA, 13 bp, C. elegans
gaaatgtgtagtt

SEQ ID NO: 716577 - DNA, 13 bp, C. elegans
gaaatgtgtgtgt

SEQ ID NO: 716578 - DNA, 13 bp, C. elegans
gaaatgtgtgttt

SEQ ID NO: 716579 - DNA, 13 bp, C. elegans
gaaatgtgtttta

SEQ ID NO: 716580 - DNA, 13 bp, C. elegans
gaaatgttaaatt

SEQ ID NO: 716581 - DNA, 13 bp, C. elegans
gaaatgttcaaaa

SEQ ID NO: 716582 - DNA, 13 bp, C. elegans
gaaatgttcaatt

SEQ ID NO: 716583 - DNA, 13 bp, C. elegans
gaaatgttctgaa

SEQ ID NO: 716584 - DNA, 13 bp, C. elegans
gaaatgttgaact

SEQ ID NO: 716585 - DNA, 13 bp, C. elegans
gaaatgttgattt

SEQ ID NO: 716586 - DNA, 13 bp, C. elegans
gaaatgttgcttt

SEQ ID NO: 716587 - DNA, 13 bp, C. elegans
gaaatgtttaaaa

SEQ ID NO: 716588 - DNA, 13 bp, C. elegans
gaaatgtttatat

SEQ ID NO: 716589 - DNA, 13 bp, C. elegans
gaaatgtttattg

SEQ ID NO: 716590 - DNA, 13 bp, C. elegans
gaaatgtttcaaa

SEQ ID NO: 716591 - DNA, 13 bp, C. elegans
gaaatgtttcaag

SEQ ID NO: 716592 - DNA, 13 bp, C. elegans
gaaatgtttcaat

SEQ ID NO: 716593 - DNA, 13 bp, C. elegans
gaaatgtttgaaa

SEQ ID NO: 716594 - DNA, 13 bp, C. elegans
gaaatgttttgaa

SEQ ID NO: 716595 - DNA, 13 bp, C. elegans
gaaattaaaagtt

SEQ ID NO: 716596 - DNA, 13 bp, C. elegans
gaaattaaacatt

SEQ ID NO: 716597 - DNA, 13 bp, C. elegans
gaaattaaatctt

SEQ ID NO: 716598 - DNA, 13 bp, C. elegans
gaaattaaatttg

SEQ ID NO: 716599 - DNA, 13 bp, C. elegans
gaaattaacagaa

SEQ ID NO: 716600 - DNA, 13 bp, C. elegans
gaaattaatattc

SEQ ID NO: 716601 - DNA, 13 bp, C. elegans
gaaattaatggaa

SEQ ID NO: 716602 - DNA, 13 bp, C. elegans
gaaattacgattt

SEQ ID NO: 716603 - DNA, 13 bp, C. elegans
gaaattactaaaa

SEQ ID NO: 716604 - DNA, 13 bp, C. elegans
gaaattacttttt

SEQ ID NO: 716605 - DNA, 13 bp, C. elegans
gaaattataactt

SEQ ID NO: 716606 - DNA, 13 bp, C. elegans
gaaattatatgaa

SEQ ID NO: 716607 - DNA, 13 bp, C. elegans
gaaattatatttg

SEQ ID NO: 716608 - DNA, 13 bp, C. elegans
gaaattatcaaaa

SEQ ID NO: 716609 - DNA, 13 bp, C. elegans
gaaattatcaaat

SEQ ID NO: 716610 - DNA, 13 bp, C. elegans
gaaattatcaccc

SEQ ID NO: 716611 - DNA, 13 bp, C. elegans
gaaattatcgatt

SEQ ID NO: 716612 - DNA, 13 bp, C. elegans
gaaattatgtgaa

SEQ ID NO: 716613 - DNA, 13 bp, C. elegans
gaaattattacaa

SEQ ID NO: 716614 - DNA, 13 bp, C. elegans
gaaattattattc

SEQ ID NO: 716615 - DNA, 13 bp, C. elegans
gaaattattcaaa

SEQ ID NO: 716616 - DNA, 13 bp, C. elegans
gaaattattgaaa

SEQ ID NO: 716617 - DNA, 13 bp, C. elegans
gaaattattgata

SEQ ID NO: 716618 - DNA, 13 bp, C. elegans
gaaattattggaa

SEQ ID NO: 716619 - DNA, 13 bp, C. elegans
gaaattcaaaaag

SEQ ID NO: 716620 - DNA, 13 bp, C. elegans
gaaattcaaaaat

SEQ ID NO: 716621 - DNA, 13 bp, C. elegans
gaaattcaaacat

SEQ ID NO: 716622 - DNA, 13 bp, C. elegans
gaaattcaaataa

SEQ ID NO: 716623 - DNA, 13 bp, C. elegans
gaaattcaaatag

SEQ ID NO: 716624 - DNA, 13 bp, C. elegans
gaaattcaaatca

SEQ ID NO: 716625 - DNA, 13 bp, C. elegans
gaaattcaaatgt

SEQ ID NO: 716626 - DNA, 13 bp, C. elegans
gaaattcaaattt

SEQ ID NO: 716627 - DNA, 13 bp, C. elegans
gaaattcaagttt

SEQ ID NO: 716628 - DNA, 13 bp, C. elegans
gaaattcaatatt

SEQ ID NO: 716629 - DNA, 13 bp, C. elegans
gaaattcaatgaa

SEQ ID NO: 716630 - DNA, 13 bp, C. elegans
gaaattcaattaa

SEQ ID NO: 716631 - DNA, 13 bp, C. elegans
gaaattcaattgt

SEQ ID NO: 716632 - DNA, 13 bp, C. elegans
gaaattcacaaaa

SEQ ID NO: 716633 - DNA, 13 bp, C. elegans
gaaattcacaatt

SEQ ID NO: 716634 - DNA, 13 bp, C. elegans
gaaattcactgaa

SEQ ID NO: 716635 - DNA, 13 bp, C. elegans
gaaattcactttt

SEQ ID NO: 716636 - DNA, 13 bp, C. elegans
gaaattcagaaaa

SEQ ID NO: 716637 - DNA, 13 bp, C. elegans
gaaattcagaaat

SEQ ID NO: 716638 - DNA, 13 bp, C. elegans
gaaattcagtttt

SEQ ID NO: 716639 - DNA, 13 bp, C. elegans
gaaattcataaac

SEQ ID NO: 716640 - DNA, 13 bp, C. elegans
gaaattcatatta

SEQ ID NO: 716641 - DNA, 13 bp, C. elegans
gaaattcattgaa

SEQ ID NO: 716642 - DNA, 13 bp, C. elegans
gaaattccaacaa

SEQ ID NO: 716643 - DNA, 13 bp, C. elegans
gaaattccacaaa

SEQ ID NO: 716644 - DNA, 13 bp, C. elegans
gaaattcccgcca

SEQ ID NO: 716645 - DNA, 13 bp, C. elegans
gaaattccgaaaa

SEQ ID NO: 716646 - DNA, 13 bp, C. elegans
gaaattcctggaa

SEQ ID NO: 716647 - DNA, 13 bp, C. elegans
gaaattcgaaaaa

SEQ ID NO: 716648 - DNA, 13 bp, C. elegans
gaaattcgaacat

SEQ ID NO: 716649 - DNA, 13 bp, C. elegans
gaaattcgaattt

SEQ ID NO: 716650 - DNA, 13 bp, C. elegans
gaaattcgatgaa

SEQ ID NO: 716651 - DNA, 13 bp, C. elegans
gaaattcgatgtt

SEQ ID NO: 716652 - DNA, 13 bp, C. elegans
gaaattcgatttt

SEQ ID NO: 716653 - DNA, 13 bp, C. elegans
gaaattcgccgaa

SEQ ID NO: 716654 - DNA, 13 bp, C. elegans
gaaattcggaatt

SEQ ID NO: 716655 - DNA, 13 bp, C. elegans
gaaattcggtgtt

SEQ ID NO: 716656 - DNA, 13 bp, C. elegans
gaaattcggtttt

SEQ ID NO: 716657 - DNA, 13 bp, C. elegans
gaaattcgtgaaa

SEQ ID NO: 716658 - DNA, 13 bp, C. elegans
gaaattctcccaa

SEQ ID NO: 716659 - DNA, 13 bp, C. elegans
gaaattctcgatt

SEQ ID NO: 716660 - DNA, 13 bp, C. elegans
gaaattctcgttt

SEQ ID NO: 716661 - DNA, 13 bp, C. elegans
gaaattctcttac

SEQ ID NO: 716662 - DNA, 13 bp, C. elegans
gaaattctgaaat

SEQ ID NO: 716663 - DNA, 13 bp, C. elegans
gaaattctgacaa

SEQ ID NO: 716664 - DNA, 13 bp, C. elegans
gaaattctgagaa

SEQ ID NO: 716665 - DNA, 13 bp, C. elegans
gaaattctgataa

SEQ ID NO: 716666 - DNA, 13 bp, C. elegans
gaaattctgcaaa

SEQ ID NO: 716667 - DNA, 13 bp, C. elegans
gaaattctgcatt

SEQ ID NO: 716668 - DNA, 13 bp, C. elegans
gaaattcttattt

SEQ ID NO: 716669 - DNA, 13 bp, C. elegans
gaaattcttcaaa

SEQ ID NO: 716670 - DNA, 13 bp, C. elegans
gaaattcttcaat

SEQ ID NO: 716671 - DNA, 13 bp, C. elegans
gaaattctttttc

SEQ ID NO: 716672 - DNA, 13 bp, C. elegans
gaaattctttttt

SEQ ID NO: 716673 - DNA, 13 bp, C. elegans
gaaattgaaaatc

SEQ ID NO: 716674 - DNA, 13 bp, C. elegans
gaaattgaaaatt

SEQ ID NO: 716675 - DNA, 13 bp, C. elegans
gaaattgaaattc

SEQ ID NO: 716676 - DNA, 13 bp, C. elegans
gaaattgaacaaa

SEQ ID NO: 716677 - DNA, 13 bp, C. elegans
gaaattgaacaat

SEQ ID NO: 716678 - DNA, 13 bp, C. elegans
gaaattgaagatt

SEQ ID NO: 716679 - DNA, 13 bp, C. elegans
gaaattgaagcaa

SEQ ID NO: 716680 - DNA, 13 bp, C. elegans
gaaattgaaggaa

SEQ ID NO: 716681 - DNA, 13 bp, C. elegans
gaaattgaagttt

SEQ ID NO: 716682 - DNA, 13 bp, C. elegans
gaaattgaatata

SEQ ID NO: 716683 - DNA, 13 bp, C. elegans
gaaattgaatcaa

SEQ ID NO: 716684 - DNA, 13 bp, C. elegans
gaaattgaatttt

SEQ ID NO: 716685 - DNA, 13 bp, C. elegans
gaaattgacaatt

SEQ ID NO: 716686 - DNA, 13 bp, C. elegans
gaaattgagaaac

SEQ ID NO: 716687 - DNA, 13 bp, C. elegans
gaaattgagaaat

SEQ ID NO: 716688 - DNA, 13 bp, C. elegans
gaaattgagaatt

SEQ ID NO: 716689 - DNA, 13 bp, C. elegans
gaaattgatgata

SEQ ID NO: 716690 - DNA, 13 bp, C. elegans
gaaattgattaaa

SEQ ID NO: 716691 - DNA, 13 bp, C. elegans
gaaattgattttt

SEQ ID NO: 716692 - DNA, 13 bp, C. elegans
gaaattgcaagaa

SEQ ID NO: 716693 - DNA, 13 bp, C. elegans
gaaattgcaattt

SEQ ID NO: 716694 - DNA, 13 bp, C. elegans
gaaattgcacttt

SEQ ID NO: 716695 - DNA, 13 bp, C. elegans
gaaattgcattct

SEQ ID NO: 716696 - DNA, 13 bp, C. elegans
gaaattgccaaaa

SEQ ID NO: 716697 - DNA, 13 bp, C. elegans
gaaattgccaatt

SEQ ID NO: 716698 - DNA, 13 bp, C. elegans
gaaattgccgaaa

SEQ ID NO: 716699 - DNA, 13 bp, C. elegans
gaaattgcgaaaa

SEQ ID NO: 716700 - DNA, 13 bp, C. elegans
gaaattgctcaat

SEQ ID NO: 716701 - DNA, 13 bp, C. elegans
gaaattgctttca

SEQ ID NO: 716702 - DNA, 13 bp, C. elegans
gaaattggaaaat

SEQ ID NO: 716703 - DNA, 13 bp, C. elegans
gaaattggaaatt

SEQ ID NO: 716704 - DNA, 13 bp, C. elegans
gaaattggagaaa

SEQ ID NO: 716705 - DNA, 13 bp, C. elegans
gaaattggccaaa

SEQ ID NO: 716706 - DNA, 13 bp, C. elegans
gaaattggcgaaa

SEQ ID NO: 716707 - DNA, 13 bp, C. elegans
gaaattggctgaa

SEQ ID NO: 716708 - DNA, 13 bp, C. elegans
gaaattgggaaaa

SEQ ID NO: 716709 - DNA, 13 bp, C. elegans
gaaattgggaaat

SEQ ID NO: 716710 - DNA, 13 bp, C. elegans
gaaattgggagaa

SEQ ID NO: 716711 - DNA, 13 bp, C. elegans
gaaattggggaaa

SEQ ID NO: 716712 - DNA, 13 bp, C. elegans
gaaattggtattt

SEQ ID NO: 716713 - DNA, 13 bp, C. elegans
gaaattgtaaatt

SEQ ID NO: 716714 - DNA, 13 bp, C. elegans
gaaattgtaatta

SEQ ID NO: 716715 - DNA, 13 bp, C. elegans
gaaattgtacaac

SEQ ID NO: 716716 - DNA, 13 bp, C. elegans
gaaattgtagaaa

SEQ ID NO: 716717 - DNA, 13 bp, C. elegans
gaaattgtatgta

SEQ ID NO: 716718 - DNA, 13 bp, C. elegans
gaaattgtattat

SEQ ID NO: 716719 - DNA, 13 bp, C. elegans
gaaattgtcaaaa

SEQ ID NO: 716720 - DNA, 13 bp, C. elegans
gaaattgtcaaat

SEQ ID NO: 716721 - DNA, 13 bp, C. elegans
gaaattgtcaatt

SEQ ID NO: 716722 - DNA, 13 bp, C. elegans
gaaattgtcattt

SEQ ID NO: 716723 - DNA, 13 bp, C. elegans
gaaattgtgaatt

SEQ ID NO: 716724 - DNA, 13 bp, C. elegans
gaaattgtgattt

SEQ ID NO: 716725 - DNA, 13 bp, C. elegans
gaaattgtttgaa

SEQ ID NO: 716726 - DNA, 13 bp, C. elegans
gaaattgttttag

SEQ ID NO: 716727 - DNA, 14 bp, C. elegans
gaaattgttttcaa

SEQ ID NO: 716728 - DNA, 13 bp, C. elegans
gaaattgtttttg

SEQ ID NO: 716729 - DNA, 13 bp, C. elegans
gaaatttaacaat

SEQ ID NO: 716730 - DNA, 13 bp, C. elegans
gaaatttaagttt

SEQ ID NO: 716731 - DNA, 13 bp, C. elegans
gaaatttaatgaa

SEQ ID NO: 716732 - DNA, 13 bp, C. elegans
gaaatttacaaat

SEQ ID NO: 716733 - DNA, 13 bp, C. elegans
gaaatttacattt

SEQ ID NO: 716734 - DNA, 13 bp, C. elegans
gaaatttacgaaa

SEQ ID NO: 716735 - DNA, 13 bp, C. elegans
gaaatttagattt

SEQ ID NO: 716736 - DNA, 13 bp, C. elegans
gaaatttagctga

SEQ ID NO: 716737 - DNA, 13 bp, C. elegans
gaaatttagtaaa

SEQ ID NO: 716738 - DNA, 13 bp, C. elegans
gaaatttagtttt

SEQ ID NO: 716739 - DNA, 13 bp, C. elegans
gaaatttatcgat

SEQ ID NO: 716740 - DNA, 13 bp, C. elegans
gaaatttatgaaa

SEQ ID NO: 716741 - DNA, 13 bp, C. elegans
gaaatttatgatt

SEQ ID NO: 716742 - DNA, 13 bp, C. elegans
gaaatttattgat

SEQ ID NO: 716743 - DNA, 13 bp, C. elegans
gaaatttcaaaaa

SEQ ID NO: 716744 - DNA, 13 bp, C. elegans
gaaatttcaaact

SEQ ID NO: 716745 - DNA, 13 bp, C. elegans
gaaatttcaaatt

SEQ ID NO: 716746 - DNA, 13 bp, C. elegans
gaaatttcaatgt

SEQ ID NO: 716747 - DNA, 13 bp, C. elegans
gaaatttcaattc

SEQ ID NO: 716748 - DNA, 13 bp, C. elegans
gaaatttcaattt

SEQ ID NO: 716749 - DNA, 13 bp, C. elegans
gaaatttcacaca

SEQ ID NO: 716750 - DNA, 13 bp, C. elegans
gaaatttcacatt

SEQ ID NO: 716751 - DNA, 13 bp, C. elegans
gaaatttcagatt

SEQ ID NO: 716752 - DNA, 13 bp, C. elegans
gaaatttcagctg

SEQ ID NO: 716753 - DNA, 13 bp, C. elegans
gaaatttcagtaa

SEQ ID NO: 716754 - DNA, 13 bp, C. elegans
gaaatttcagttt

SEQ ID NO: 716755 - DNA, 13 bp, C. elegans
gaaatttcatatt

SEQ ID NO: 716756 - DNA, 13 bp, C. elegans
gaaatttccaaaa

SEQ ID NO: 716757 - DNA, 13 bp, C. elegans
gaaatttccaaca

SEQ ID NO: 716758 - DNA, 13 bp, C. elegans
gaaatttccacaa

SEQ ID NO: 716759 - DNA, 13 bp, C. elegans
gaaatttcctaaa

SEQ ID NO: 716760 - DNA, 13 bp, C. elegans
gaaatttcgaaaa

SEQ ID NO: 716761 - DNA, 13 bp, C. elegans
gaaatttcgtcaa

SEQ ID NO: 716762 - DNA, 13 bp, C. elegans
gaaatttcgttca

SEQ ID NO: 716763 - DNA, 13 bp, C. elegans
gaaatttctaaaa

SEQ ID NO: 716764 - DNA, 13 bp, C. elegans
gaaatttctaatt

SEQ ID NO: 716765 - DNA, 13 bp, C. elegans
gaaatttctggaa

SEQ ID NO: 716766 - DNA, 13 bp, C. elegans
gaaatttctttca

SEQ ID NO: 716767 - DNA, 13 bp, C. elegans
gaaatttgaaaat

SEQ ID NO: 716768 - DNA, 13 bp, C. elegans
gaaatttgaagaa

SEQ ID NO: 716769 - DNA, 13 bp, C. elegans
gaaatttgaagat

SEQ ID NO: 716770 - DNA, 13 bp, C. elegans
gaaatttgaagtt

SEQ ID NO: 716771 - DNA, 13 bp, C. elegans
gaaatttgaattt

SEQ ID NO: 716772 - DNA, 13 bp, C. elegans
gaaatttgacaat

SEQ ID NO: 716773 - DNA, 13 bp, C. elegans
gaaatttgagaat

SEQ ID NO: 716774 - DNA, 13 bp, C. elegans
gaaatttgataaa

SEQ ID NO: 716775 - DNA, 13 bp, C. elegans
gaaatttgatgaa

SEQ ID NO: 716776 - DNA, 13 bp, C. elegans
gaaatttgattaa

SEQ ID NO: 716777 - DNA, 13 bp, C. elegans
gaaatttgcaatt

SEQ ID NO: 716778 - DNA, 13 bp, C. elegans
gaaatttgcataa

SEQ ID NO: 716779 - DNA, 13 bp, C. elegans
gaaatttgccgat

SEQ ID NO: 716780 - DNA, 13 bp, C. elegans
gaaatttgcgttt

SEQ ID NO: 716781 - DNA, 13 bp, C. elegans
gaaatttgcttta

SEQ ID NO: 716782 - DNA, 13 bp, C. elegans
gaaatttggaatc

SEQ ID NO: 716783 - DNA, 13 bp, C. elegans
gaaatttggattt

SEQ ID NO: 716784 - DNA, 13 bp, C. elegans
gaaatttgggaat

SEQ ID NO: 716785 - DNA, 13 bp, C. elegans
gaaatttggtaat

SEQ ID NO: 716786 - DNA, 13 bp, C. elegans
gaaatttgtaatt

SEQ ID NO: 716787 - DNA, 13 bp, C. elegans
gaaatttgtataa

SEQ ID NO: 716788 - DNA, 13 bp, C. elegans
gaaatttgtatgt

SEQ ID NO: 716789 - DNA, 13 bp, C. elegans
gaaatttgtttga

SEQ ID NO: 716790 - DNA, 13 bp, C. elegans
gaaatttgtttta

SEQ ID NO: 716791 - DNA, 13 bp, C. elegans
gaaatttgttttg

SEQ ID NO: 716792 - DNA, 13 bp, C. elegans
gaaattttacaat

SEQ ID NO: 716793 - DNA, 13 bp, C. elegans
gaaattttacgga

SEQ ID NO: 716794 - DNA, 13 bp, C. elegans
gaaattttagatt

SEQ ID NO: 716795 - DNA, 13 bp, C. elegans
gaaattttaggcc

SEQ ID NO: 716796 - DNA, 13 bp, C. elegans
gaaattttatcga

SEQ ID NO: 716797 - DNA, 13 bp, C. elegans
gaaattttatgaa

SEQ ID NO: 716798 - DNA, 13 bp, C. elegans
gaaattttattca

SEQ ID NO: 716799 - DNA, 13 bp, C. elegans
gaaattttcaaag

SEQ ID NO: 716800 - DNA, 13 bp, C. elegans
gaaattttcaagc

SEQ ID NO: 716801 - DNA, 13 bp, C. elegans
gaaattttcaatt

SEQ ID NO: 716802 - DNA, 13 bp, C. elegans
gaaattttcagct

SEQ ID NO: 716803 - DNA, 13 bp, C. elegans
gaaattttcagtt

SEQ ID NO: 716804 - DNA, 13 bp, C. elegans
gaaattttcattt

SEQ ID NO: 716805 - DNA, 13 bp, C. elegans
gaaattttccgaa

SEQ ID NO: 716806 - DNA, 14 bp, C. elegans
gaaattttcgagaa

SEQ ID NO: 716807 - DNA, 13 bp, C. elegans
gaaattttcgttt

SEQ ID NO: 716808 - DNA, 13 bp, C. elegans
gaaattttctaat

SEQ ID NO: 716809 - DNA, 13 bp, C. elegans
gaaattttgaaaa

SEQ ID NO: 716810 - DNA, 13 bp, C. elegans
gaaattttgaatt

SEQ ID NO: 716811 - DNA, 13 bp, C. elegans
gaaattttgagct

SEQ ID NO: 716812 - DNA, 13 bp, C. elegans
gaaattttgattt

SEQ ID NO: 716813 - DNA, 13 bp, C. elegans
gaaattttgccat

SEQ ID NO: 716814 - DNA, 13 bp, C. elegans
gaaattttggtag

SEQ ID NO: 716815 - DNA, 13 bp, C. elegans
gaaattttggtga

SEQ ID NO: 716816 - DNA, 13 bp, C. elegans
gaaattttgtcga

SEQ ID NO: 716817 - DNA, 13 bp, C. elegans
gaaattttgtgaa

SEQ ID NO: 716818 - DNA, 13 bp, C. elegans
gaaattttgtgtg

SEQ ID NO: 716819 - DNA, 13 bp, C. elegans
gaaatttttcaaa

SEQ ID NO: 716820 - DNA, 13 bp, C. elegans
gaaatttttctga

SEQ ID NO: 716821 - DNA, 13 bp, C. elegans
gaaatttttgaaa

SEQ ID NO: 716822 - DNA, 13 bp, C. elegans
gaaatttttgaac

SEQ ID NO: 716823 - DNA, 13 bp, C. elegans
gaaatttttgaat

SEQ ID NO: 716824 - DNA, 13 bp, C. elegans
gaaatttttgagt

SEQ ID NO: 716825 - DNA, 13 bp, C. elegans
gaaatttttggaa

SEQ ID NO: 716826 - DNA, 13 bp, C. elegans
gaaatttttggcc

SEQ ID NO: 716827 - DNA, 13 bp, C. elegans
gaaattttttccc

SEQ ID NO: 716828 - DNA, 13 bp, C. elegans
gaaattttttctc

SEQ ID NO: 716829 - DNA, 13 bp, C. elegans
gaaattttttgaa

SEQ ID NO: 716830 - DNA, 13 bp, C. elegans
gaaattttttgat

SEQ ID NO: 716831 - DNA, 13 bp, C. elegans
gaacaaaaagttc

SEQ ID NO: 716832 - DNA, 13 bp, C. elegans
gaacaaaaatcat

SEQ ID NO: 716833 - DNA, 13 bp, C. elegans
gaacaaaaatctt

SEQ ID NO: 716834 - DNA, 13 bp, C. elegans
gaacaaaacacat

SEQ ID NO: 716835 - DNA, 13 bp, C. elegans
gaacaaaatcgag

SEQ ID NO: 716836 - DNA, 13 bp, C. elegans
gaacaaattattt

SEQ ID NO: 716837 - DNA, 13 bp, C. elegans
gaacaaattgtga

SEQ ID NO: 716838 - DNA, 13 bp, C. elegans
gaacaaatttaaa

SEQ ID NO: 716839 - DNA, 13 bp, C. elegans
gaacaaatttaat

SEQ ID NO: 716840 - DNA, 13 bp, C. elegans
gaacaaatttcgt

SEQ ID NO: 716841 - DNA, 13 bp, C. elegans
gaacaacaaattt

SEQ ID NO: 716842 - DNA, 13 bp, C. elegans
gaacaactttgta

SEQ ID NO: 716843 - DNA, 13 bp, C. elegans
gaacaagttgaaa

SEQ ID NO: 716844 - DNA, 13 bp, C. elegans
gaacaagtttttt

SEQ ID NO: 716845 - DNA, 13 bp, C. elegans
gaacaatattgat

SEQ ID NO: 716846 - DNA, 13 bp, C. elegans
gaacaatccagaa

SEQ ID NO: 716847 - DNA, 13 bp, C. elegans
gaacaattatttt

SEQ ID NO: 716848 - DNA, 13 bp, C. elegans
gaacaattcaatt

SEQ ID NO: 716849 - DNA, 13 bp, C. elegans
gaacaattgaaaa

SEQ ID NO: 716850 - DNA, 13 bp, C. elegans
gaacaatttaaat

SEQ ID NO: 716851 - DNA, 13 bp, C. elegans
gaacaatttaagt

SEQ ID NO: 716852 - DNA, 13 bp, C. elegans
gaacaatttctga

SEQ ID NO: 716853 - DNA, 13 bp, C. elegans
gaacaatttgaaa

SEQ ID NO: 716854 - DNA, 13 bp, C. elegans
gaacaatttgaga

SEQ ID NO: 716855 - DNA, 13 bp, C. elegans
gaacaatttgcat

SEQ ID NO: 716856 - DNA, 13 bp, C. elegans
gaacaatttttaa

SEQ ID NO: 716857 - DNA, 13 bp, C. elegans
gaacaatttttga

SEQ ID NO: 716858 - DNA, 13 bp, C. elegans
gaacacaattatt

SEQ ID NO: 716859 - DNA, 13 bp, C. elegans
gaacacatcaaaa

SEQ ID NO: 716860 - DNA, 13 bp, C. elegans
gaacacattttcc

SEQ ID NO: 716861 - DNA, 13 bp, C. elegans
gaacacgatgtct

SEQ ID NO: 716862 - DNA, 13 bp, C. elegans
gaacactaaattc

SEQ ID NO: 716863 - DNA, 13 bp, C. elegans
gaacactccagaa

SEQ ID NO: 716864 - DNA, 13 bp, C. elegans
gaacacttaaaaa

SEQ ID NO: 716865 - DNA, 13 bp, C. elegans
gaacagttttgaa

SEQ ID NO: 716866 - DNA, 13 bp, C. elegans
gaacagttttttg

SEQ ID NO: 716867 - DNA, 13 bp, C. elegans
gaacatatgtatt

SEQ ID NO: 716868 - DNA, 13 bp, C. elegans
gaacatccaaaaa

SEQ ID NO: 716869 - DNA, 13 bp, C. elegans
gaacatctgaaaa

SEQ ID NO: 716870 - DNA, 13 bp, C. elegans
gaacatggtgcat

SEQ ID NO: 716871 - DNA, 13 bp, C. elegans
gaacatgtttttg

SEQ ID NO: 716872 - DNA, 13 bp, C. elegans
gaacattccagaa

SEQ ID NO: 716873 - DNA, 13 bp, C. elegans
gaacattccattt

SEQ ID NO: 716874 - DNA, 13 bp, C. elegans
gaacattgaaatt

SEQ ID NO: 716875 - DNA, 13 bp, C. elegans
gaacattgaacaa

SEQ ID NO: 716876 - DNA, 13 bp, C. elegans
gaacattgagaaa

SEQ ID NO: 716877 - DNA, 13 bp, C. elegans
gaacattgatttt

SEQ ID NO: 716878 - DNA, 13 bp, C. elegans
gaacattgcaaaa

SEQ ID NO: 716879 - DNA, 13 bp, C. elegans
gaacattgttttt

SEQ ID NO: 716880 - DNA, 13 bp, C. elegans
gaacatttataaa

SEQ ID NO: 716881 - DNA, 13 bp, C. elegans
gaacatttcaatt

SEQ ID NO: 716882 - DNA, 13 bp, C. elegans
gaacatttcagaa

SEQ ID NO: 716883 - DNA, 13 bp, C. elegans
gaacatttcgaaa

SEQ ID NO: 716884 - DNA, 13 bp, C. elegans
gaacatttctaaa

SEQ ID NO: 716885 - DNA, 13 bp, C. elegans
gaacattttaaaa

SEQ ID NO: 716886 - DNA, 13 bp, C. elegans
gaacattttagaa

SEQ ID NO: 716887 - DNA, 13 bp, C. elegans
gaacattttcatt

SEQ ID NO: 716888 - DNA, 13 bp, C. elegans
gaacattttctaa

SEQ ID NO: 716889 - DNA, 13 bp, C. elegans
gaacattttggaa

SEQ ID NO: 716890 - DNA, 13 bp, C. elegans
gaacattttgtca

SEQ ID NO: 716891 - DNA, 13 bp, C. elegans
gaacatttttaaa

SEQ ID NO: 716892 - DNA, 13 bp, C. elegans
gaacatttttaat

SEQ ID NO: 716893 - DNA, 13 bp, C. elegans
gaacatttttgat

SEQ ID NO: 716894 - DNA, 13 bp, C. elegans
gaacattttttaa

SEQ ID NO: 716895 - DNA, 13 bp, C. elegans
gaacattttttca

SEQ ID NO: 716896 - DNA, 13 bp, C. elegans
gaacatttttttt

SEQ ID NO: 716897 - DNA, 13 bp, C. elegans
gaaccaaaacttc

SEQ ID NO: 716898 - DNA, 13 bp, C. elegans
gaaccaaagattt

SEQ ID NO: 716899 - DNA, 13 bp, C. elegans
gaaccaagtgcaa

SEQ ID NO: 716900 - DNA, 13 bp, C. elegans
gaaccctaaaaaa

SEQ ID NO: 716901 - DNA, 13 bp, C. elegans
gaacccttttttt

SEQ ID NO: 716902 - DNA, 13 bp, C. elegans
gaacgaatgttga

SEQ ID NO: 716903 - DNA, 13 bp, C. elegans
gaacgaattttgt

SEQ ID NO: 716904 - DNA, 13 bp, C. elegans
gaacgattttata

SEQ ID NO: 716905 - DNA, 13 bp, C. elegans
gaacggagttata

SEQ ID NO: 716906 - DNA, 13 bp, C. elegans
gaacgggaaacaa

SEQ ID NO: 716907 - DNA, 13 bp, C. elegans
gaacgggaaattt

SEQ ID NO: 716908 - DNA, 13 bp, C. elegans
gaacgtgctgacg

SEQ ID NO: 716909 - DNA, 13 bp, C. elegans
gaacgttttaaaa

SEQ ID NO: 716910 - DNA, 13 bp, C. elegans
gaactaatttttt

SEQ ID NO: 716911 - DNA, 13 bp, C. elegans
gaactacagtaat

SEQ ID NO: 716912 - DNA, 13 bp, C. elegans
gaactataaaaac

SEQ ID NO: 716913 - DNA, 13 bp, C. elegans
gaactattgattt

SEQ ID NO: 716914 - DNA, 13 bp, C. elegans
gaactatttgaat

SEQ ID NO: 716915 - DNA, 13 bp, C. elegans
gaactcgaatttg

SEQ ID NO: 716916 - DNA, 13 bp, C. elegans
gaactctgaaatt

SEQ ID NO: 716917 - DNA, 13 bp, C. elegans
gaactcttccatc

SEQ ID NO: 716918 - DNA, 13 bp, C. elegans
gaactgcaattgc

SEQ ID NO: 716919 - DNA, 13 bp, C. elegans
gaactgccaaaaa

SEQ ID NO: 716920 - DNA, 13 bp, C. elegans
gaactgttttttt

SEQ ID NO: 716921 - DNA, 13 bp, C. elegans
gaacttaattttt

SEQ ID NO: 716922 - DNA, 13 bp, C. elegans
gaacttattgaca

SEQ ID NO: 716923 - DNA, 13 bp, C. elegans
gaacttcaaaata

SEQ ID NO: 716924 - DNA, 13 bp, C. elegans
gaacttcaaaatt

SEQ ID NO: 716925 - DNA, 13 bp, C. elegans
gaacttgctttcg

SEQ ID NO: 716926 - DNA, 13 bp, C. elegans
gaacttggaaaaa

SEQ ID NO: 716927 - DNA, 13 bp, C. elegans
gaactttaagttt

SEQ ID NO: 716928 - DNA, 13 bp, C. elegans
gaactttaattta

SEQ ID NO: 716929 - DNA, 13 bp, C. elegans
gaactttataaaa

SEQ ID NO: 716930 - DNA, 13 bp, C. elegans
gaactttcaaaac

SEQ ID NO: 716931 - DNA, 13 bp, C. elegans
gaactttccaaat

SEQ ID NO: 716932 - DNA, 13 bp, C. elegans
gaactttccagaa

SEQ ID NO: 716933 - DNA, 13 bp, C. elegans
gaactttgaaatt

SEQ ID NO: 716934 - DNA, 13 bp, C. elegans
gaactttgaacat

SEQ ID NO: 716935 - DNA, 13 bp, C. elegans
gaactttgaattt

SEQ ID NO: 716936 - DNA, 13 bp, C. elegans
gaactttgccgca

SEQ ID NO: 716937 - DNA, 13 bp, C. elegans
gaactttggtttt

SEQ ID NO: 716938 - DNA, 13 bp, C. elegans
gaacttttcgaac

SEQ ID NO: 716939 - DNA, 13 bp, C. elegans
gaacttttcttcc

SEQ ID NO: 716940 - DNA, 13 bp, C. elegans
gaacttttgaaga

SEQ ID NO: 716941 - DNA, 13 bp, C. elegans
gaacttttggaaa

SEQ ID NO: 716942 - DNA, 13 bp, C. elegans
gaacttttgttgc

SEQ ID NO: 716943 - DNA, 13 bp, C. elegans
gaactttttcaaa

SEQ ID NO: 716944 - DNA, 13 bp, C. elegans
gaactttttcaat

SEQ ID NO: 716945 - DNA, 13 bp, C. elegans
gaactttttcgat

SEQ ID NO: 716946 - DNA, 13 bp, C. elegans
gaactttttcttt

SEQ ID NO: 716947 - DNA, 13 bp, C. elegans
gaactttttgaaa

SEQ ID NO: 716948 - DNA, 13 bp, C. elegans
gaactttttggat

SEQ ID NO: 716949 - DNA, 13 bp, C. elegans
gaacttttttaga

SEQ ID NO: 716950 - DNA, 13 bp, C. elegans
gaacttttttatt

SEQ ID NO: 716951 - DNA, 13 bp, C. elegans
gaagaaaaaactc

SEQ ID NO: 716952 - DNA, 13 bp, C. elegans
gaagaaaaaagtc

SEQ ID NO: 716953 - DNA, 13 bp, C. elegans
gaagaaaaacgta

SEQ ID NO: 716954 - DNA, 13 bp, C. elegans
gaagaaaaatcag

SEQ ID NO: 716955 - DNA, 13 bp, C. elegans
gaagaaaactgaa

SEQ ID NO: 716956 - DNA, 13 bp, C. elegans
gaagaaaactgat

SEQ ID NO: 716957 - DNA, 13 bp, C. elegans
gaagaaaacttga

SEQ ID NO: 716958 - DNA, 13 bp, C. elegans
gaagaaaagttga

SEQ ID NO: 716959 - DNA, 13 bp, C. elegans
gaagaaaatcgaa

SEQ ID NO: 716960 - DNA, 13 bp, C. elegans
gaagaaaattcga

SEQ ID NO: 716961 - DNA, 13 bp, C. elegans
gaagaaacaactt

SEQ ID NO: 716962 - DNA, 13 bp, C. elegans
gaagaaacttgaa

SEQ ID NO: 716963 - DNA, 13 bp, C. elegans
gaagaaacttttt

SEQ ID NO: 716964 - DNA, 13 bp, C. elegans
gaagaaatagatt

SEQ ID NO: 716965 - DNA, 13 bp, C. elegans
gaagaaatatttg

SEQ ID NO: 716966 - DNA, 13 bp, C. elegans
gaagaaattatga

SEQ ID NO: 716967 - DNA, 13 bp, C. elegans
gaagaaattcgaa

SEQ ID NO: 716968 - DNA, 13 bp, C. elegans
gaagaaattctga

SEQ ID NO: 716969 - DNA, 13 bp, C. elegans
gaagaaatttgaa

SEQ ID NO: 716970 - DNA, 13 bp, C. elegans
gaagaaatttttt

SEQ ID NO: 716971 - DNA, 13 bp, C. elegans
gaagaacattttc

SEQ ID NO: 716972 - DNA, 13 bp, C. elegans
gaagaacctgatg

SEQ ID NO: 716973 - DNA, 13 bp, C. elegans
gaagaacggatcg

SEQ ID NO: 716974 - DNA, 13 bp, C. elegans
gaagaactttttt

SEQ ID NO: 716975 - DNA, 13 bp, C. elegans
gaagaagaagcac

SEQ ID NO: 716976 - DNA, 13 bp, C. elegans
gaagaagaagctg

SEQ ID NO: 716977 - DNA, 13 bp, C. elegans
gaagaagaagtat

SEQ ID NO: 716978 - DNA, 13 bp, C. elegans
gaagaagacaaat

SEQ ID NO: 716979 - DNA, 13 bp, C. elegans
gaagaagacgatg

SEQ ID NO: 716980 - DNA, 13 bp, C. elegans
gaagaagacgttg

SEQ ID NO: 716981 - DNA, 13 bp, C. elegans
gaagaaggccttt

SEQ ID NO: 716982 - DNA, 13 bp, C. elegans
gaagaagttgaaa

SEQ ID NO: 716983 - DNA, 13 bp, C. elegans
gaagaataatatt

SEQ ID NO: 716984 - DNA, 13 bp, C. elegans
gaagaatcagaac

SEQ ID NO: 716985 - DNA, 13 bp, C. elegans
gaagaatgtacgt

SEQ ID NO: 716986 - DNA, 13 bp, C. elegans
gaagaattcaaat

SEQ ID NO: 716987 - DNA, 13 bp, C. elegans
gaagaattcgaat

SEQ ID NO: 716988 - DNA, 13 bp, C. elegans
gaagaattgaaga

SEQ ID NO: 716989 - DNA, 13 bp, C. elegans
gaagaattggaaa

SEQ ID NO: 716990 - DNA, 13 bp, C. elegans
gaagaatttcaaa

SEQ ID NO: 716991 - DNA, 13 bp, C. elegans
gaagaatttgagt

SEQ ID NO: 716992 - DNA, 13 bp, C. elegans
gaagaattttgaa

SEQ ID NO: 716993 - DNA, 13 bp, C. elegans
gaagaatttttga

SEQ ID NO: 716994 - DNA, 13 bp, C. elegans
gaagacgacgacg

SEQ ID NO: 716995 - DNA, 13 bp, C. elegans
gaagactacaaac

SEQ ID NO: 716996 - DNA, 13 bp, C. elegans
gaagagacacaga

SEQ ID NO: 716997 - DNA, 13 bp, C. elegans
gaagagaccacca

SEQ ID NO: 716998 - DNA, 13 bp, C. elegans
gaagagacgcaga

SEQ ID NO: 716999 - DNA, 13 bp, C. elegans
gaagagacgcagg

SEQ ID NO: 717000 - DNA, 13 bp, C. elegans
gaagagacgtaga

SEQ ID NO: 717001 - DNA, 13 bp, C. elegans
gaagagatgcaga

SEQ ID NO: 717002 - DNA, 13 bp, C. elegans
gaagagattaaga

SEQ ID NO: 717003 - DNA, 13 bp, C. elegans
gaagagttcgaag

SEQ ID NO: 717004 - DNA, 13 bp, C. elegans
gaagagttttcaa

SEQ ID NO: 717005 - DNA, 13 bp, C. elegans
gaagagtttttga

SEQ ID NO: 717006 - DNA, 13 bp, C. elegans
gaagataactttt

SEQ ID NO: 717007 - DNA, 13 bp, C. elegans
gaagatatcaata

SEQ ID NO: 717008 - DNA, 13 bp, C. elegans
gaagatatttgga

SEQ ID NO: 717009 - DNA, 13 bp, C. elegans
gaagatgaagcag

SEQ ID NO: 717010 - DNA, 13 bp, C. elegans
gaagatgagcaat

SEQ ID NO: 717011 - DNA, 13 bp, C. elegans
gaagatgatgaag

SEQ ID NO: 717012 - DNA, 13 bp, C. elegans
gaagatgatgatg

SEQ ID NO: 717013 - DNA, 13 bp, C. elegans
gaagatgattttt

SEQ ID NO: 717014 - DNA, 13 bp, C. elegans
gaagattactgta

SEQ ID NO: 717015 - DNA, 13 bp, C. elegans
gaagattgagatt

SEQ ID NO: 717016 - DNA, 13 bp, C. elegans
gaagatttcaaaa

SEQ ID NO: 717017 - DNA, 13 bp, C. elegans
gaagatttcaaat

SEQ ID NO: 717018 - DNA, 13 bp, C. elegans
gaagatttcaatt

SEQ ID NO: 717019 - DNA, 13 bp, C. elegans
gaagatttctgaa

SEQ ID NO: 717020 - DNA, 13 bp, C. elegans
gaagatttgaaaa

SEQ ID NO: 717021 - DNA, 13 bp, C. elegans
gaagattttcaaa

SEQ ID NO: 717022 - DNA, 13 bp, C. elegans
gaagattttcgaa

SEQ ID NO: 717023 - DNA, 13 bp, C. elegans
gaagattttgaat

SEQ ID NO: 717024 - DNA, 14 bp, C. elegans
gaagattttgagaa

SEQ ID NO: 717025 - DNA, 13 bp, C. elegans
gaagatttttata

SEQ ID NO: 717026 - DNA, 13 bp, C. elegans
gaagatttttgga

SEQ ID NO: 717027 - DNA, 13 bp, C. elegans
gaagcaaaaatca

SEQ ID NO: 717028 - DNA, 13 bp, C. elegans
gaagcaaaatttc

SEQ ID NO: 717029 - DNA, 13 bp, C. elegans
gaagcaaacattt

SEQ ID NO: 717030 - DNA, 13 bp, C. elegans
gaagcaaacgcgc

SEQ ID NO: 717031 - DNA, 13 bp, C. elegans
gaagcacttaaaa

SEQ ID NO: 717032 - DNA, 13 bp, C. elegans
gaagcagcagcag

SEQ ID NO: 717033 - DNA, 13 bp, C. elegans
gaagcagccgaca

SEQ ID NO: 717034 - DNA, 13 bp, C. elegans
gaagcatgaaaaa

SEQ ID NO: 717035 - DNA, 13 bp, C. elegans
gaagcattttgaa

SEQ ID NO: 717036 - DNA, 13 bp, C. elegans
gaagcatttttga

SEQ ID NO: 717037 - DNA, 13 bp, C. elegans
gaagccagaaatc

SEQ ID NO: 717038 - DNA, 13 bp, C. elegans
gaagcgaaaacta

SEQ ID NO: 717039 - DNA, 13 bp, C. elegans
gaagcggccgaca

SEQ ID NO: 717040 - DNA, 13 bp, C. elegans
gaagcgtttttaa

SEQ ID NO: 717041 - DNA, 13 bp, C. elegans
gaagctaaaaatg

SEQ ID NO: 717042 - DNA, 13 bp, C. elegans
gaagctacagtaa

SEQ ID NO: 717043 - DNA, 13 bp, C. elegans
gaagctatcaaaa

SEQ ID NO: 717044 - DNA, 13 bp, C. elegans
gaagctattgcca

SEQ ID NO: 717045 - DNA, 13 bp, C. elegans
gaagctcaaatca

SEQ ID NO: 717046 - DNA, 13 bp, C. elegans
gaagctgaagaag

SEQ ID NO: 717047 - DNA, 13 bp, C. elegans
gaagctgaaggat

SEQ ID NO: 717048 - DNA, 13 bp, C. elegans
gaagctgctattt

SEQ ID NO: 717049 - DNA, 13 bp, C. elegans
gaagcttaaaaaa

SEQ ID NO: 717050 - DNA, 13 bp, C. elegans
gaagcttaaaatt

SEQ ID NO: 717051 - DNA, 13 bp, C. elegans
gaagcttccaaaa

SEQ ID NO: 717052 - DNA, 13 bp, C. elegans
gaagcttgaaaca

SEQ ID NO: 717053 - DNA, 13 bp, C. elegans
gaagcttttggaa

SEQ ID NO: 717054 - DNA, 13 bp, C. elegans
gaaggaaaattat

SEQ ID NO: 717055 - DNA, 13 bp, C. elegans
gaaggaaatcatt

SEQ ID NO: 717056 - DNA, 13 bp, C. elegans
gaaggaatattgg

SEQ ID NO: 717057 - DNA, 13 bp, C. elegans
gaaggaatatttt

SEQ ID NO: 717058 - DNA, 13 bp, C. elegans
gaaggatcagaac

SEQ ID NO: 717059 - DNA, 13 bp, C. elegans
gaaggatcagaag

SEQ ID NO: 717060 - DNA, 13 bp, C. elegans
gaaggattcaaaa

SEQ ID NO: 717061 - DNA, 13 bp, C. elegans
gaagggagataca

SEQ ID NO: 717062 - DNA, 13 bp, C. elegans
gaaggtatgtgtg

SEQ ID NO: 717063 - DNA, 13 bp, C. elegans
gaaggtggtgaaa

SEQ ID NO: 717064 - DNA, 13 bp, C. elegans
gaaggttctagaa

SEQ ID NO: 717065 - DNA, 13 bp, C. elegans
gaaggttttggaa

SEQ ID NO: 717066 - DNA, 14 bp, C. elegans
gaagtaaaaccaag

SEQ ID NO: 717067 - DNA, 13 bp, C. elegans
gaagtacaaaatc

SEQ ID NO: 717068 - DNA, 13 bp, C. elegans
gaagtattaaaac

SEQ ID NO: 717069 - DNA, 13 bp, C. elegans
gaagtattcaaaa

SEQ ID NO: 717070 - DNA, 13 bp, C. elegans
gaagtcattcttt

SEQ ID NO: 717071 - DNA, 13 bp, C. elegans
gaagtcatttttt

SEQ ID NO: 717072 - DNA, 13 bp, C. elegans
gaagtcggccaaa

SEQ ID NO: 717073 - DNA, 13 bp, C. elegans
gaagtctcattat

SEQ ID NO: 717074 - DNA, 13 bp, C. elegans
gaagtcttcaaaa

SEQ ID NO: 717075 - DNA, 13 bp, C. elegans
gaagtgaagaagc

SEQ ID NO: 717076 - DNA, 13 bp, C. elegans
gaagtggagcaat

SEQ ID NO: 717077 - DNA, 13 bp, C. elegans
gaagtgggcggag

SEQ ID NO: 717078 - DNA, 13 bp, C. elegans
gaagtgtacatgt

SEQ ID NO: 717079 - DNA, 13 bp, C. elegans
gaagtgtgttttt

SEQ ID NO: 717080 - DNA, 13 bp, C. elegans
gaagttaccaaaa

SEQ ID NO: 717081 - DNA, 13 bp, C. elegans
gaagttatcgatt

SEQ ID NO: 717082 - DNA, 13 bp, C. elegans
gaagttcaaattt

SEQ ID NO: 717083 - DNA, 13 bp, C. elegans
gaagttcctcaaa

SEQ ID NO: 717084 - DNA, 13 bp, C. elegans
gaagttcgaaaaa

SEQ ID NO: 717085 - DNA, 13 bp, C. elegans
gaagttctaaaaa

SEQ ID NO: 717086 - DNA, 13 bp, C. elegans
gaagttctcattt

SEQ ID NO: 717087 - DNA, 13 bp, C. elegans
gaagttctgaaaa

SEQ ID NO: 717088 - DNA, 13 bp, C. elegans
gaagttgataaaa

SEQ ID NO: 717089 - DNA, 13 bp, C. elegans
gaagttgccaaag

SEQ ID NO: 717090 - DNA, 13 bp, C. elegans
gaagttgccggaa

SEQ ID NO: 717091 - DNA, 13 bp, C. elegans
gaagttggaaaca

SEQ ID NO: 717092 - DNA, 13 bp, C. elegans
gaagttgttgaaa

SEQ ID NO: 717093 - DNA, 13 bp, C. elegans
gaagtttaatttt

SEQ ID NO: 717094 - DNA, 13 bp, C. elegans
gaagtttacaaaa

SEQ ID NO: 717095 - DNA, 13 bp, C. elegans
gaagtttatctca

SEQ ID NO: 717096 - DNA, 13 bp, C. elegans
gaagtttcaattc

SEQ ID NO: 717097 - DNA, 13 bp, C. elegans
gaagtttcctttt

SEQ ID NO: 717098 - DNA, 13 bp, C. elegans
gaagtttctaaaa

SEQ ID NO: 717099 - DNA, 13 bp, C. elegans
gaagtttctgacg

SEQ ID NO: 717100 - DNA, 13 bp, C. elegans
gaagtttcttgaa

SEQ ID NO: 717101 - DNA, 13 bp, C. elegans
gaagtttgaaaaa

SEQ ID NO: 717102 - DNA, 13 bp, C. elegans
gaagtttgaaatt

SEQ ID NO: 717103 - DNA, 13 bp, C. elegans
gaagtttgaagaa

SEQ ID NO: 717104 - DNA, 13 bp, C. elegans
gaagtttgagaaa

SEQ ID NO: 717105 - DNA, 13 bp, C. elegans
gaagtttgattga

SEQ ID NO: 717106 - DNA, 13 bp, C. elegans
gaagtttggaaaa

SEQ ID NO: 717107 - DNA, 13 bp, C. elegans
gaagtttggaaat

SEQ ID NO: 717108 - DNA, 13 bp, C. elegans
gaagttttactat

SEQ ID NO: 717109 - DNA, 13 bp, C. elegans
gaagttttcaatt

SEQ ID NO: 717110 - DNA, 13 bp, C. elegans
gaagttttggaaa

SEQ ID NO: 717111 - DNA, 13 bp, C. elegans
gaagtttttcgaa

SEQ ID NO: 717112 - DNA, 13 bp, C. elegans
gaagtttttcttc

SEQ ID NO: 717113 - DNA, 13 bp, C. elegans
gaagtttttgaag

SEQ ID NO: 717114 - DNA, 13 bp, C. elegans
gaagtttttgaga

SEQ ID NO: 717115 - DNA, 13 bp, C. elegans
gaagtttttggaa

SEQ ID NO: 717116 - DNA, 13 bp, C. elegans
gaataaaaaagcg

SEQ ID NO: 717117 - DNA, 13 bp, C. elegans
gaataaaaattca

SEQ ID NO: 717118 - DNA, 13 bp, C. elegans
gaataaaaatttc

SEQ ID NO: 717119 - DNA, 13 bp, C. elegans
gaataaaagtttt

SEQ ID NO: 717120 - DNA, 13 bp, C. elegans
gaataaaattcaa

SEQ ID NO: 717121 - DNA, 13 bp, C. elegans
gaataaagttttg

SEQ ID NO: 717122 - DNA, 13 bp, C. elegans
gaataaatacagt

SEQ ID NO: 717123 - DNA, 13 bp, C. elegans
gaataaatcgaaa

SEQ ID NO: 717124 - DNA, 13 bp, C. elegans
gaataaatgcaaa

SEQ ID NO: 717125 - DNA, 13 bp, C. elegans
gaataaattgcaa

SEQ ID NO: 717126 - DNA, 13 bp, C. elegans
gaataacaataat

SEQ ID NO: 717127 - DNA, 13 bp, C. elegans
gaataacatttaa

SEQ ID NO: 717128 - DNA, 13 bp, C. elegans
gaataactgaaat

SEQ ID NO: 717129 - DNA, 13 bp, C. elegans
gaataactttaaa

SEQ ID NO: 717130 - DNA, 13 bp, C. elegans
gaataactttttc

SEQ ID NO: 717131 - DNA, 13 bp, C. elegans
gaataataaacgc

SEQ ID NO: 717132 - DNA, 13 bp, C. elegans
gaataatatttca

SEQ ID NO: 717133 - DNA, 13 bp, C. elegans
gaataatcaattt

SEQ ID NO: 717134 - DNA, 13 bp, C. elegans
gaataatctcaaa

SEQ ID NO: 717135 - DNA, 13 bp, C. elegans
gaataatgatgaa

SEQ ID NO: 717136 - DNA, 13 bp, C. elegans
gaataatgttgaa

SEQ ID NO: 717137 - DNA, 13 bp, C. elegans
gaataatgtttca

SEQ ID NO: 717138 - DNA, 13 bp, C. elegans
gaataattgaatt

SEQ ID NO: 717139 - DNA, 13 bp, C. elegans
gaataattgcaaa

SEQ ID NO: 717140 - DNA, 13 bp, C. elegans
gaataatttgttt

SEQ ID NO: 717141 - DNA, 13 bp, C. elegans
gaataatttttgt

SEQ ID NO: 717142 - DNA, 13 bp, C. elegans
gaatacacaaaag

SEQ ID NO: 717143 - DNA, 13 bp, C. elegans
gaataccgtattt

SEQ ID NO: 717144 - DNA, 13 bp, C. elegans
gaatacgattttg

SEQ ID NO: 717145 - DNA, 13 bp, C. elegans
gaatacggtaggt

SEQ ID NO: 717146 - DNA, 13 bp, C. elegans
gaatactacattt

SEQ ID NO: 717147 - DNA, 13 bp, C. elegans
gaatactttcaaa

SEQ ID NO: 717148 - DNA, 13 bp, C. elegans
gaatacttttttc

SEQ ID NO: 717149 - DNA, 13 bp, C. elegans
gaatataaatgtt

SEQ ID NO: 717150 - DNA, 13 bp, C. elegans
gaatataatcact

SEQ ID NO: 717151 - DNA, 13 bp, C. elegans
gaatatatttgga

SEQ ID NO: 717152 - DNA, 13 bp, C. elegans
gaatatcagaaaa

SEQ ID NO: 717153 - DNA, 13 bp, C. elegans
gaatatcataatg

SEQ ID NO: 717154 - DNA, 13 bp, C. elegans
gaatatccaaaaa

SEQ ID NO: 717155 - DNA, 13 bp, C. elegans
gaatatcgtaata

SEQ ID NO: 717156 - DNA, 13 bp, C. elegans
gaatatgaaaaca

SEQ ID NO: 717157 - DNA, 13 bp, C. elegans
gaatatgaatatg

SEQ ID NO: 717158 - DNA, 13 bp, C. elegans
gaatatgaatatt

SEQ ID NO: 717159 - DNA, 13 bp, C. elegans
gaatatgaatgaa

SEQ ID NO: 717160 - DNA, 13 bp, C. elegans
gaatatgagcaat

SEQ ID NO: 717161 - DNA, 13 bp, C. elegans
gaatatgataaga

SEQ ID NO: 717162 - DNA, 13 bp, C. elegans
gaatatggaaaat

SEQ ID NO: 717163 - DNA, 13 bp, C. elegans
gaatatgtgaaaa

SEQ ID NO: 717164 - DNA, 13 bp, C. elegans
gaatattaatttc

SEQ ID NO: 717165 - DNA, 13 bp, C. elegans
gaatattacaaaa

SEQ ID NO: 717166 - DNA, 13 bp, C. elegans
gaatattcaaaat

SEQ ID NO: 717167 - DNA, 13 bp, C. elegans
gaatattcaagaa

SEQ ID NO: 717168 - DNA, 13 bp, C. elegans
gaatattcagaaa

SEQ ID NO: 717169 - DNA, 13 bp, C. elegans
gaatattcgaaaa

SEQ ID NO: 717170 - DNA, 13 bp, C. elegans
gaatattctggaa

SEQ ID NO: 717171 - DNA, 13 bp, C. elegans
gaatattgaaaac

SEQ ID NO: 717172 - DNA, 13 bp, C. elegans
gaatattgaaaca

SEQ ID NO: 717173 - DNA, 13 bp, C. elegans
gaatattgaaagt

SEQ ID NO: 717174 - DNA, 13 bp, C. elegans
gaatattgaaatt

SEQ ID NO: 717175 - DNA, 13 bp, C. elegans
gaatattgttaat

SEQ ID NO: 717176 - DNA, 13 bp, C. elegans
gaatatttcaaaa

SEQ ID NO: 717177 - DNA, 13 bp, C. elegans
gaatatttcaatt

SEQ ID NO: 717178 - DNA, 13 bp, C. elegans
gaatatttcagtt

SEQ ID NO: 717179 - DNA, 13 bp, C. elegans
gaatatttcattt

SEQ ID NO: 717180 - DNA, 13 bp, C. elegans
gaatatttctttt

SEQ ID NO: 717181 - DNA, 13 bp, C. elegans
gaatatttgatga

SEQ ID NO: 717182 - DNA, 13 bp, C. elegans
gaatatttggaaa

SEQ ID NO: 717183 - DNA, 13 bp, C. elegans
gaatatttgtatt

SEQ ID NO: 717184 - DNA, 13 bp, C. elegans
gaatatttgttga

SEQ ID NO: 717185 - DNA, 13 bp, C. elegans
gaatattttacta

SEQ ID NO: 717186 - DNA, 13 bp, C. elegans
gaatattttcaat

SEQ ID NO: 717187 - DNA, 13 bp, C. elegans
gaatattttccga

SEQ ID NO: 717188 - DNA, 13 bp, C. elegans
gaatattttctga

SEQ ID NO: 717189 - DNA, 13 bp, C. elegans
gaatatttttaca

SEQ ID NO: 717190 - DNA, 13 bp, C. elegans
gaatattttttga

SEQ ID NO: 717191 - DNA, 13 bp, C. elegans
gaatcaaaaaatt

SEQ ID NO: 717192 - DNA, 13 bp, C. elegans
gaatcaaaaatca

SEQ ID NO: 717193 - DNA, 13 bp, C. elegans
gaatcaaaaatct

SEQ ID NO: 717194 - DNA, 13 bp, C. elegans
gaatcaaaatcaa

SEQ ID NO: 717195 - DNA, 13 bp, C. elegans
gaatcaaagttta

SEQ ID NO: 717196 - DNA, 13 bp, C. elegans
gaatcaaatttta

SEQ ID NO: 717197 - DNA, 13 bp, C. elegans
gaatcaagttttt

SEQ ID NO: 717198 - DNA, 13 bp, C. elegans
gaatcaatcaaaa

SEQ ID NO: 717199 - DNA, 13 bp, C. elegans
gaatcaattattt

SEQ ID NO: 717200 - DNA, 13 bp, C. elegans
gaatcaatttgaa

SEQ ID NO: 717201 - DNA, 18 bp, C. elegans
gaatcacacatgcctccc

SEQ ID NO: 717202 - DNA, 13 bp, C. elegans
gaatcaccaaaaa

SEQ ID NO: 717203 - DNA, 13 bp, C. elegans
gaatcactttttt

SEQ ID NO: 717204 - DNA, 13 bp, C. elegans
gaatcagcaccag

SEQ ID NO: 717205 - DNA, 13 bp, C. elegans
gaatcagtgaaaa

SEQ ID NO: 717206 - DNA, 13 bp, C. elegans
gaatcataaaagt

SEQ ID NO: 717207 - DNA, 13 bp, C. elegans
gaatcatataaaa

SEQ ID NO: 717208 - DNA, 13 bp, C. elegans
gaatcattgtttc

SEQ ID NO: 717209 - DNA, 13 bp, C. elegans
gaatcattttctt

SEQ ID NO: 717210 - DNA, 13 bp, C. elegans
gaatccaagtttt

SEQ ID NO: 717211 - DNA, 15 bp, C. elegans
gaatcgaaaaatcga

SEQ ID NO: 717212 - DNA, 13 bp, C. elegans
gaatcgaagaaaa

SEQ ID NO: 717213 - DNA, 13 bp, C. elegans
gaatcgctcaaag

SEQ ID NO: 717214 - DNA, 13 bp, C. elegans
gaatcggcggaaa

SEQ ID NO: 717215 - DNA, 13 bp, C. elegans
gaatctgaaaaaa

SEQ ID NO: 717216 - DNA, 13 bp, C. elegans
gaatctgtgaaaa

SEQ ID NO: 717217 - DNA, 13 bp, C. elegans
gaatctgttggac

SEQ ID NO: 717218 - DNA, 13 bp, C. elegans
gaatcttcaaaaa

SEQ ID NO: 717219 - DNA, 13 bp, C. elegans
gaatcttctgaaa

SEQ ID NO: 717220 - DNA, 13 bp, C. elegans
gaatcttctggaa

SEQ ID NO: 717221 - DNA, 13 bp, C. elegans
gaatcttgaattt

SEQ ID NO: 717222 - DNA, 13 bp, C. elegans
gaatcttttgaaa

SEQ ID NO: 717223 - DNA, 13 bp, C. elegans
gaatgaaaaattg

SEQ ID NO: 717224 - DNA, 13 bp, C. elegans
gaatgaaacattt

SEQ ID NO: 717225 - DNA, 13 bp, C. elegans
gaatgaaagtgaa

SEQ ID NO: 717226 - DNA, 13 bp, C. elegans
gaatgaaatatta

SEQ ID NO: 717227 - DNA, 13 bp, C. elegans
gaatgaacatttt

SEQ ID NO: 717228 - DNA, 13 bp, C. elegans
gaatgaatggaaa

SEQ ID NO: 717229 - DNA, 13 bp, C. elegans
gaatgaattcaaa

SEQ ID NO: 717230 - DNA, 13 bp, C. elegans
gaatgaatttcaa

SEQ ID NO: 717231 - DNA, 13 bp, C. elegans
gaatgaatttgaa

SEQ ID NO: 717232 - DNA, 13 bp, C. elegans
gaatgacatgctc

SEQ ID NO: 717233 - DNA, 13 bp, C. elegans
gaatgacgtcatt

SEQ ID NO: 717234 - DNA, 13 bp, C. elegans
gaatgactgaaaa

SEQ ID NO: 717235 - DNA, 13 bp, C. elegans
gaatgagaaaagt

SEQ ID NO: 717236 - DNA, 13 bp, C. elegans
gaatgattcattt

SEQ ID NO: 717237 - DNA, 13 bp, C. elegans
gaatgattttaaa

SEQ ID NO: 717238 - DNA, 13 bp, C. elegans
gaatgatttttaa

SEQ ID NO: 717239 - DNA, 13 bp, C. elegans
gaatgccaatatt

SEQ ID NO: 717240 - DNA, 13 bp, C. elegans
gaatgccgttttt

SEQ ID NO: 717241 - DNA, 13 bp, C. elegans
gaatgctccagaa

SEQ ID NO: 717242 - DNA, 13 bp, C. elegans
gaatggaaaagtt

SEQ ID NO: 717243 - DNA, 13 bp, C. elegans
gaatggaaaattt

SEQ ID NO: 717244 - DNA, 13 bp, C. elegans
gaatggaaattga

SEQ ID NO: 717245 - DNA, 13 bp, C. elegans
gaatggagaacaa

SEQ ID NO: 717246 - DNA, 13 bp, C. elegans
gaatgggaaaata

SEQ ID NO: 717247 - DNA, 13 bp, C. elegans
gaatgtataataa

SEQ ID NO: 717248 - DNA, 13 bp, C. elegans
gaatgtctaaaaa

SEQ ID NO: 717249 - DNA, 13 bp, C. elegans
gaatgtctcattt

SEQ ID NO: 717250 - DNA, 13 bp, C. elegans
gaatgtgcaaaag

SEQ ID NO: 717251 - DNA, 13 bp, C. elegans
gaatgtgctcaaa

SEQ ID NO: 717252 - DNA, 13 bp, C. elegans
gaatgtggaaaaa

SEQ ID NO: 717253 - DNA, 13 bp, C. elegans
gaatgttccaaaa

SEQ ID NO: 717254 - DNA, 14 bp, C. elegans
gaatgttccagaat

SEQ ID NO: 717255 - DNA, 13 bp, C. elegans
gaatgttctggaa

SEQ ID NO: 717256 - DNA, 13 bp, C. elegans
gaatgttctgttg

SEQ ID NO: 717257 - DNA, 13 bp, C. elegans
gaatgtttaaaaa

SEQ ID NO: 717258 - DNA, 13 bp, C. elegans
gaatgtttatttc

SEQ ID NO: 717259 - DNA, 13 bp, C. elegans
gaatgtttcaatt

SEQ ID NO: 717260 - DNA, 13 bp, C. elegans
gaatgttttagaa

SEQ ID NO: 717261 - DNA, 13 bp, C. elegans
gaatgttttcata

SEQ ID NO: 717262 - DNA, 13 bp, C. elegans
gaatgtttttgaa

SEQ ID NO: 717263 - DNA, 13 bp, C. elegans
gaattaaaatttc

SEQ ID NO: 717264 - DNA, 13 bp, C. elegans
gaattaaagaatt

SEQ ID NO: 717265 - DNA, 13 bp, C. elegans
gaattaaatttga

SEQ ID NO: 717266 - DNA, 13 bp, C. elegans
gaattaacttttg

SEQ ID NO: 717267 - DNA, 13 bp, C. elegans
gaattaattgaat

SEQ ID NO: 717268 - DNA, 13 bp, C. elegans
gaattaattgttt

SEQ ID NO: 717269 - DNA, 13 bp, C. elegans
gaattactgaaaa

SEQ ID NO: 717270 - DNA, 13 bp, C. elegans
gaattactgaaat

SEQ ID NO: 717271 - DNA, 13 bp, C. elegans
gaattatcaaaaa

SEQ ID NO: 717272 - DNA, 13 bp, C. elegans
gaattatcgaaaa

SEQ ID NO: 717273 - DNA, 13 bp, C. elegans
gaattatgatttt

SEQ ID NO: 717274 - DNA, 13 bp, C. elegans
gaattattagaaa

SEQ ID NO: 717275 - DNA, 13 bp, C. elegans
gaattattcaaaa

SEQ ID NO: 717276 - DNA, 13 bp, C. elegans
gaattattcttga

SEQ ID NO: 717277 - DNA, 13 bp, C. elegans
gaattattgagaa

SEQ ID NO: 717278 - DNA, 13 bp, C. elegans
gaattattgcaaa

SEQ ID NO: 717279 - DNA, 13 bp, C. elegans
gaattattggaaa

SEQ ID NO: 717280 - DNA, 13 bp, C. elegans
gaattatttgaaa

SEQ ID NO: 717281 - DNA, 13 bp, C. elegans
gaattatttgaat

SEQ ID NO: 717282 - DNA, 13 bp, C. elegans
gaattattttcta

SEQ ID NO: 717283 - DNA, 13 bp, C. elegans
gaattatttttga

SEQ ID NO: 717284 - DNA, 13 bp, C. elegans
gaattcaaaaaat

SEQ ID NO: 717285 - DNA, 13 bp, C. elegans
gaattcaaaatta

SEQ ID NO: 717286 - DNA, 13 bp, C. elegans
gaattcaaagaaa

SEQ ID NO: 717287 - DNA, 13 bp, C. elegans
gaattcaaatatt

SEQ ID NO: 717288 - DNA, 13 bp, C. elegans
gaattcaaatgtt

SEQ ID NO: 717289 - DNA, 13 bp, C. elegans
gaattcaatttat

SEQ ID NO: 717290 - DNA, 13 bp, C. elegans
gaattcacaattt

SEQ ID NO: 717291 - DNA, 13 bp, C. elegans
gaattcagaaaat

SEQ ID NO: 717292 - DNA, 13 bp, C. elegans
gaattcagaattt

SEQ ID NO: 717293 - DNA, 13 bp, C. elegans
gaattcagatatt

SEQ ID NO: 717294 - DNA, 13 bp, C. elegans
gaattcagcaaaa

SEQ ID NO: 717295 - DNA, 13 bp, C. elegans
gaattcagctcat

SEQ ID NO: 717296 - DNA, 13 bp, C. elegans
gaattcatatttt

SEQ ID NO: 717297 - DNA, 13 bp, C. elegans
gaattcatcaaaa

SEQ ID NO: 717298 - DNA, 13 bp, C. elegans
gaattcatgaaat

SEQ ID NO: 717299 - DNA, 13 bp, C. elegans
gaattcattattt

SEQ ID NO: 717300 - DNA, 13 bp, C. elegans
gaattccaaaaaa

SEQ ID NO: 717301 - DNA, 13 bp, C. elegans
gaattccaaaatt

SEQ ID NO: 717302 - DNA, 13 bp, C. elegans
gaattccaatttc

SEQ ID NO: 717303 - DNA, 13 bp, C. elegans
gaattcccaccaa

SEQ ID NO: 717304 - DNA, 13 bp, C. elegans
gaattccgaaaaa

SEQ ID NO: 717305 - DNA, 13 bp, C. elegans
gaattcctcgcca

SEQ ID NO: 717306 - DNA, 13 bp, C. elegans
gaattcctgaaaa

SEQ ID NO: 717307 - DNA, 13 bp, C. elegans
gaattcgaaaaat

SEQ ID NO: 717308 - DNA, 13 bp, C. elegans
gaattcgagtttt

SEQ ID NO: 717309 - DNA, 13 bp, C. elegans
gaattcgccgaaa

SEQ ID NO: 717310 - DNA, 13 bp, C. elegans
gaattcggctaaa

SEQ ID NO: 717311 - DNA, 13 bp, C. elegans
gaattcgtgaaaa

SEQ ID NO: 717312 - DNA, 13 bp, C. elegans
gaattcgtttttt

SEQ ID NO: 717313 - DNA, 13 bp, C. elegans
gaattctatattt

SEQ ID NO: 717314 - DNA, 13 bp, C. elegans
gaattctcaattt

SEQ ID NO: 717315 - DNA, 13 bp, C. elegans
gaattctgaacaa

SEQ ID NO: 717316 - DNA, 13 bp, C. elegans
gaattctggaaaa

SEQ ID NO: 717317 - DNA, 13 bp, C. elegans
gaattctggaatt

SEQ ID NO: 717318 - DNA, 13 bp, C. elegans
gaattctgtgaaa

SEQ ID NO: 717319 - DNA, 13 bp, C. elegans
gaattcttcaaaa

SEQ ID NO: 717320 - DNA, 13 bp, C. elegans
gaattcttcaaat

SEQ ID NO: 717321 - DNA, 13 bp, C. elegans
gaattcttgaaat

SEQ ID NO: 717322 - DNA, 13 bp, C. elegans
gaattcttggaaa

SEQ ID NO: 717323 - DNA, 13 bp, C. elegans
gaattcttttgaa

SEQ ID NO: 717324 - DNA, 13 bp, C. elegans
gaattgaaaaaac

SEQ ID NO: 717325 - DNA, 13 bp, C. elegans
gaattgaaaaatt

SEQ ID NO: 717326 - DNA, 13 bp, C. elegans
gaattgaaaactt

SEQ ID NO: 717327 - DNA, 13 bp, C. elegans
gaattgaaaatat

SEQ ID NO: 717328 - DNA, 13 bp, C. elegans
gaattgaaagttt

SEQ ID NO: 717329 - DNA, 13 bp, C. elegans
gaattgaaatttc

SEQ ID NO: 717330 - DNA, 13 bp, C. elegans
gaattgaacaaaa

SEQ ID NO: 717331 - DNA, 13 bp, C. elegans
gaattgaacaatt

SEQ ID NO: 717332 - DNA, 13 bp, C. elegans
gaattgaaccaac

SEQ ID NO: 717333 - DNA, 13 bp, C. elegans
gaattgaactcat

SEQ ID NO: 717334 - DNA, 13 bp, C. elegans
gaattgaagaatt

SEQ ID NO: 717335 - DNA, 13 bp, C. elegans
gaattgaatttga

SEQ ID NO: 717336 - DNA, 13 bp, C. elegans
gaattgagaatat

SEQ ID NO: 717337 - DNA, 13 bp, C. elegans
gaattgaggaaaa

SEQ ID NO: 717338 - DNA, 13 bp, C. elegans
gaattgataattt

SEQ ID NO: 717339 - DNA, 13 bp, C. elegans
gaattgcaataaa

SEQ ID NO: 717340 - DNA, 13 bp, C. elegans
gaattgccaaaaa

SEQ ID NO: 717341 - DNA, 13 bp, C. elegans
gaattgccagaat

SEQ ID NO: 717342 - DNA, 13 bp, C. elegans
gaattgccggttt

SEQ ID NO: 717343 - DNA, 13 bp, C. elegans
gaattggaaaata

SEQ ID NO: 717344 - DNA, 13 bp, C. elegans
gaattggcaaatt

SEQ ID NO: 717345 - DNA, 13 bp, C. elegans
gaattgggaaatt

SEQ ID NO: 717346 - DNA, 13 bp, C. elegans
gaattgtgtattt

SEQ ID NO: 717347 - DNA, 13 bp, C. elegans
gaattgttgaaaa

SEQ ID NO: 717348 - DNA, 13 bp, C. elegans
gaattgttgaaac

SEQ ID NO: 717349 - DNA, 13 bp, C. elegans
gaattgtttcaat

SEQ ID NO: 717350 - DNA, 13 bp, C. elegans
gaattgttttaaa

SEQ ID NO: 717351 - DNA, 13 bp, C. elegans
gaattgtttttga

SEQ ID NO: 717352 - DNA, 13 bp, C. elegans
gaatttaaacaaa

SEQ ID NO: 717353 - DNA, 13 bp, C. elegans
gaatttaaatagt

SEQ ID NO: 717354 - DNA, 13 bp, C. elegans
gaatttaatcaaa

SEQ ID NO: 717355 - DNA, 13 bp, C. elegans
gaatttaattgaa

SEQ ID NO: 717356 - DNA, 13 bp, C. elegans
gaatttacaaaaa

SEQ ID NO: 717357 - DNA, 13 bp, C. elegans
gaatttagctaaa

SEQ ID NO: 717358 - DNA, 13 bp, C. elegans
gaatttataaagt

SEQ ID NO: 717359 - DNA, 13 bp, C. elegans
gaatttatatgaa

SEQ ID NO: 717360 - DNA, 13 bp, C. elegans
gaatttatcaaat

SEQ ID NO: 717361 - DNA, 13 bp, C. elegans
gaatttatcattt

SEQ ID NO: 717362 - DNA, 14 bp, C. elegans
gaatttatcgattt

SEQ ID NO: 717363 - DNA, 13 bp, C. elegans
gaatttatgaaaa

SEQ ID NO: 717364 - DNA, 13 bp, C. elegans
gaatttattcaaa

SEQ ID NO: 717365 - DNA, 13 bp, C. elegans
gaatttcaaacat

SEQ ID NO: 717366 - DNA, 13 bp, C. elegans
gaatttcaaataa

SEQ ID NO: 717367 - DNA, 13 bp, C. elegans
gaatttcaaatga

SEQ ID NO: 717368 - DNA, 13 bp, C. elegans
gaatttcaaatgt

SEQ ID NO: 717369 - DNA, 13 bp, C. elegans
gaatttcaacaaa

SEQ ID NO: 717370 - DNA, 13 bp, C. elegans
gaatttcaacttt

SEQ ID NO: 717371 - DNA, 13 bp, C. elegans
gaatttcaatgtt

SEQ ID NO: 717372 - DNA, 13 bp, C. elegans
gaatttcaatttt

SEQ ID NO: 717373 - DNA, 13 bp, C. elegans
gaatttcagaatt

SEQ ID NO: 717374 - DNA, 13 bp, C. elegans
gaatttcagacat

SEQ ID NO: 717375 - DNA, 13 bp, C. elegans
gaatttcagcaat

SEQ ID NO: 717376 - DNA, 13 bp, C. elegans
gaatttcataaaa

SEQ ID NO: 717377 - DNA, 13 bp, C. elegans
gaatttcatagaa

SEQ ID NO: 717378 - DNA, 13 bp, C. elegans
gaatttcatataa

SEQ ID NO: 717379 - DNA, 13 bp, C. elegans
gaatttcatatta

SEQ ID NO: 717380 - DNA, 13 bp, C. elegans
gaatttcatcaaa

SEQ ID NO: 717381 - DNA, 13 bp, C. elegans
gaatttcatgatg

SEQ ID NO: 717382 - DNA, 13 bp, C. elegans
gaatttcatggaa

SEQ ID NO: 717383 - DNA, 14 bp, C. elegans
gaatttcatgtttt

SEQ ID NO: 717384 - DNA, 13 bp, C. elegans
gaatttccaaatt

SEQ ID NO: 717385 - DNA, 13 bp, C. elegans
gaatttccaatat

SEQ ID NO: 717386 - DNA, 13 bp, C. elegans
gaatttccagtca

SEQ ID NO: 717387 - DNA, 13 bp, C. elegans
gaatttccagtga

SEQ ID NO: 717388 - DNA, 13 bp, C. elegans
gaatttccatatt

SEQ ID NO: 717389 - DNA, 13 bp, C. elegans
gaatttccatttt

SEQ ID NO: 717390 - DNA, 13 bp, C. elegans
gaatttcccgaaa

SEQ ID NO: 717391 - DNA, 13 bp, C. elegans
gaatttcccgcct

SEQ ID NO: 717392 - DNA, 13 bp, C. elegans
gaatttccctcaa

SEQ ID NO: 717393 - DNA, 13 bp, C. elegans
gaatttccgaatt

SEQ ID NO: 717394 - DNA, 13 bp, C. elegans
gaatttcctccaa

SEQ ID NO: 717395 - DNA, 13 bp, C. elegans
gaatttcgagaaa

SEQ ID NO: 717396 - DNA, 13 bp, C. elegans
gaatttcgataat

SEQ ID NO: 717397 - DNA, 13 bp, C. elegans
gaatttcgcattg

SEQ ID NO: 717398 - DNA, 13 bp, C. elegans
gaatttctaaaaa

SEQ ID NO: 717399 - DNA, 13 bp, C. elegans
gaatttctagaat

SEQ ID NO: 717400 - DNA, 13 bp, C. elegans
gaatttctcacaa

SEQ ID NO: 717401 - DNA, 13 bp, C. elegans
gaatttctcattt

SEQ ID NO: 717402 - DNA, 13 bp, C. elegans
gaatttctgaaaa

SEQ ID NO: 717403 - DNA, 13 bp, C. elegans
gaatttctgaaga

SEQ ID NO: 717404 - DNA, 13 bp, C. elegans
gaatttctggaat

SEQ ID NO: 717405 - DNA, 13 bp, C. elegans
gaatttgaaacaa

SEQ ID NO: 717406 - DNA, 13 bp, C. elegans
gaatttgaacttt

SEQ ID NO: 717407 - DNA, 14 bp, C. elegans
gaatttgaagaaat

SEQ ID NO: 717408 - DNA, 13 bp, C. elegans
gaatttgaaggaa

SEQ ID NO: 717409 - DNA, 13 bp, C. elegans
gaatttgaatgaa

SEQ ID NO: 717410 - DNA, 13 bp, C. elegans
gaatttgaatttg

SEQ ID NO: 717411 - DNA, 13 bp, C. elegans
gaatttgacggaa

SEQ ID NO: 717412 - DNA, 13 bp, C. elegans
gaatttgagaatt

SEQ ID NO: 717413 - DNA, 13 bp, C. elegans
gaatttgataatg

SEQ ID NO: 717414 - DNA, 13 bp, C. elegans
gaatttgatggaa

SEQ ID NO: 717415 - DNA, 13 bp, C. elegans
gaatttgatttaa

SEQ ID NO: 717416 - DNA, 13 bp, C. elegans
gaatttgcaattt

SEQ ID NO: 717417 - DNA, 14 bp, C. elegans
gaatttgccaaaaa

SEQ ID NO: 717418 - DNA, 13 bp, C. elegans
gaatttgccaatt

SEQ ID NO: 717419 - DNA, 13 bp, C. elegans
gaatttgccgaac

SEQ ID NO: 717420 - DNA, 13 bp, C. elegans
gaatttgccggtt

SEQ ID NO: 717421 - DNA, 13 bp, C. elegans
gaatttgctgaaa

SEQ ID NO: 717422 - DNA, 13 bp, C. elegans
gaatttgcttatt

SEQ ID NO: 717423 - DNA, 13 bp, C. elegans
gaatttggaaatt

SEQ ID NO: 717424 - DNA, 13 bp, C. elegans
gaatttggaagaa

SEQ ID NO: 717425 - DNA, 13 bp, C. elegans
gaatttggaattt

SEQ ID NO: 717426 - DNA, 13 bp, C. elegans
gaatttgtagaaa

SEQ ID NO: 717427 - DNA, 13 bp, C. elegans
gaatttgtagaat

SEQ ID NO: 717428 - DNA, 13 bp, C. elegans
gaatttgtgaaaa

SEQ ID NO: 717429 - DNA, 13 bp, C. elegans
gaatttgtgaaat

SEQ ID NO: 717430 - DNA, 13 bp, C. elegans
gaatttgtgaatt

SEQ ID NO: 717431 - DNA, 13 bp, C. elegans
gaatttgttgaaa

SEQ ID NO: 717432 - DNA, 13 bp, C. elegans
gaatttgtttcaa

SEQ ID NO: 717433 - DNA, 13 bp, C. elegans
gaattttaaacaa

SEQ ID NO: 717434 - DNA, 13 bp, C. elegans
gaattttaattca

SEQ ID NO: 717435 - DNA, 13 bp, C. elegans
gaattttaattga

SEQ ID NO: 717436 - DNA, 13 bp, C. elegans
gaattttaccaaa

SEQ ID NO: 717437 - DNA, 13 bp, C. elegans
gaattttagaaat

SEQ ID NO: 717438 - DNA, 13 bp, C. elegans
gaattttagaatt

SEQ ID NO: 717439 - DNA, 13 bp, C. elegans
gaattttagcaaa

SEQ ID NO: 717440 - DNA, 13 bp, C. elegans
gaattttagtgtt

SEQ ID NO: 717441 - DNA, 14 bp, C. elegans
gaattttatcgatt

SEQ ID NO: 717442 - DNA, 13 bp, C. elegans
gaattttatgatt

SEQ ID NO: 717443 - DNA, 13 bp, C. elegans
gaattttatgtgt

SEQ ID NO: 717444 - DNA, 13 bp, C. elegans
gaattttattgat

SEQ ID NO: 717445 - DNA, 13 bp, C. elegans
gaattttcaaaaa

SEQ ID NO: 717446 - DNA, 13 bp, C. elegans
gaattttcaaagt

SEQ ID NO: 717447 - DNA, 13 bp, C. elegans
gaattttcaaatt

SEQ ID NO: 717448 - DNA, 13 bp, C. elegans
gaattttcaacca

SEQ ID NO: 717449 - DNA, 13 bp, C. elegans
gaattttcaactt

SEQ ID NO: 717450 - DNA, 13 bp, C. elegans
gaattttcagaaa

SEQ ID NO: 717451 - DNA, 13 bp, C. elegans
gaattttcagaat

SEQ ID NO: 717452 - DNA, 13 bp, C. elegans
gaattttcagtta

SEQ ID NO: 717453 - DNA, 13 bp, C. elegans
gaattttcatcga

SEQ ID NO: 717454 - DNA, 13 bp, C. elegans
gaattttcattca

SEQ ID NO: 717455 - DNA, 13 bp, C. elegans
gaattttcattga

SEQ ID NO: 717456 - DNA, 13 bp, C. elegans
gaattttccacaa

SEQ ID NO: 717457 - DNA, 13 bp, C. elegans
gaattttccagaa

SEQ ID NO: 717458 - DNA, 13 bp, C. elegans
gaattttccagta

SEQ ID NO: 717459 - DNA, 13 bp, C. elegans
gaattttcccgaa

SEQ ID NO: 717460 - DNA, 13 bp, C. elegans
gaattttcgaaat

SEQ ID NO: 717461 - DNA, 13 bp, C. elegans
gaattttcgatga

SEQ ID NO: 717462 - DNA, 13 bp, C. elegans
gaattttcggatt

SEQ ID NO: 717463 - DNA, 13 bp, C. elegans
gaattttcgtatt

SEQ ID NO: 717464 - DNA, 13 bp, C. elegans
gaattttctaata

SEQ ID NO: 717465 - DNA, 13 bp, C. elegans
gaattttctagaa

SEQ ID NO: 717466 - DNA, 13 bp, C. elegans
gaattttctcaaa

SEQ ID NO: 717467 - DNA, 13 bp, C. elegans
gaattttctctat

SEQ ID NO: 717468 - DNA, 13 bp, C. elegans
gaattttctgaaa

SEQ ID NO: 717469 - DNA, 13 bp, C. elegans
gaattttctggaa

SEQ ID NO: 717470 - DNA, 13 bp, C. elegans
gaattttgaaaag

SEQ ID NO: 717471 - DNA, 13 bp, C. elegans
gaattttgaaact

SEQ ID NO: 717472 - DNA, 13 bp, C. elegans
gaattttgaaata

SEQ ID NO: 717473 - DNA, 13 bp, C. elegans
gaattttgaaatt

SEQ ID NO: 717474 - DNA, 13 bp, C. elegans
gaattttgaacaa

SEQ ID NO: 717475 - DNA, 13 bp, C. elegans
gaattttgaatat

SEQ ID NO: 717476 - DNA, 13 bp, C. elegans
gaattttgaatgt

SEQ ID NO: 717477 - DNA, 13 bp, C. elegans
gaattttgaattt

SEQ ID NO: 717478 - DNA, 13 bp, C. elegans
gaattttgacaaa

SEQ ID NO: 717479 - DNA, 13 bp, C. elegans
gaattttgatgtt

SEQ ID NO: 717480 - DNA, 13 bp, C. elegans
gaattttgcaaaa

SEQ ID NO: 717481 - DNA, 13 bp, C. elegans
gaattttgcctat

SEQ ID NO: 717482 - DNA, 13 bp, C. elegans
gaattttgctcaa

SEQ ID NO: 717483 - DNA, 13 bp, C. elegans
gaattttggaaac

SEQ ID NO: 717484 - DNA, 13 bp, C. elegans
gaattttggaatt

SEQ ID NO: 717485 - DNA, 13 bp, C. elegans
gaattttggagaa

SEQ ID NO: 717486 - DNA, 13 bp, C. elegans
gaattttggcaaa

SEQ ID NO: 717487 - DNA, 13 bp, C. elegans
gaattttgggaat

SEQ ID NO: 717488 - DNA, 13 bp, C. elegans
gaattttgtcaaa

SEQ ID NO: 717489 - DNA, 13 bp, C. elegans
gaattttgtgaaa

SEQ ID NO: 717490 - DNA, 13 bp, C. elegans
gaattttgtgaat

SEQ ID NO: 717491 - DNA, 13 bp, C. elegans
gaattttgtgcat

SEQ ID NO: 717492 - DNA, 13 bp, C. elegans
gaattttgttgaa

SEQ ID NO: 717493 - DNA, 13 bp, C. elegans
gaattttgtttga

SEQ ID NO: 717494 - DNA, 13 bp, C. elegans
gaatttttaaact

SEQ ID NO: 717495 - DNA, 13 bp, C. elegans
gaatttttacata

SEQ ID NO: 717496 - DNA, 13 bp, C. elegans
gaatttttatcaa

SEQ ID NO: 717497 - DNA, 13 bp, C. elegans
gaatttttattcc

SEQ ID NO: 717498 - DNA, 13 bp, C. elegans
gaatttttcaagt

SEQ ID NO: 717499 - DNA, 13 bp, C. elegans
gaatttttcaatt

SEQ ID NO: 717500 - DNA, 13 bp, C. elegans
gaatttttcacat

SEQ ID NO: 717501 - DNA, 13 bp, C. elegans
gaatttttcattg

SEQ ID NO: 717502 - DNA, 13 bp, C. elegans
gaatttttcccat

SEQ ID NO: 717503 - DNA, 13 bp, C. elegans
gaatttttcctat

SEQ ID NO: 717504 - DNA, 13 bp, C. elegans
gaatttttcgatt

SEQ ID NO: 717505 - DNA, 13 bp, C. elegans
gaatttttcgttt

SEQ ID NO: 717506 - DNA, 13 bp, C. elegans
gaatttttctcga

SEQ ID NO: 717507 - DNA, 13 bp, C. elegans
gaatttttctgaa

SEQ ID NO: 717508 - DNA, 13 bp, C. elegans
gaatttttctgtt

SEQ ID NO: 717509 - DNA, 13 bp, C. elegans
gaatttttgaaaa

SEQ ID NO: 717510 - DNA, 13 bp, C. elegans
gaatttttgaagt

SEQ ID NO: 717511 - DNA, 13 bp, C. elegans
gaatttttgaata

SEQ ID NO: 717512 - DNA, 13 bp, C. elegans
gaatttttgaatg

SEQ ID NO: 717513 - DNA, 13 bp, C. elegans
gaatttttgacaa

SEQ ID NO: 717514 - DNA, 14 bp, C. elegans
gaatttttggaaaa

SEQ ID NO: 717515 - DNA, 13 bp, C. elegans
gaatttttggaag

SEQ ID NO: 717516 - DNA, 13 bp, C. elegans
gaatttttggaat

SEQ ID NO: 717517 - DNA, 13 bp, C. elegans
gaatttttgtgga

SEQ ID NO: 717518 - DNA, 13 bp, C. elegans
gaatttttgttca

SEQ ID NO: 717519 - DNA, 13 bp, C. elegans
gaattttttactg

SEQ ID NO: 717520 - DNA, 13 bp, C. elegans
gaattttttcatc

SEQ ID NO: 717521 - DNA, 13 bp, C. elegans
gaattttttccca

SEQ ID NO: 717522 - DNA, 13 bp, C. elegans
gaattttttcgga

SEQ ID NO: 717523 - DNA, 13 bp, C. elegans
gaattttttctca

SEQ ID NO: 717524 - DNA, 14 bp, C. elegans
gaattttttctgaa

SEQ ID NO: 717525 - DNA, 13 bp, C. elegans
gaattttttgccc

SEQ ID NO: 717526 - DNA, 13 bp, C. elegans
gaattttttgtaa

SEQ ID NO: 717527 - DNA, 13 bp, C. elegans
gaatttttttatc

SEQ ID NO: 717528 - DNA, 13 bp, C. elegans
gaatttttttccg

SEQ ID NO: 717529 - DNA, 13 bp, C. elegans
gacaaaaaatcga

SEQ ID NO: 717530 - DNA, 13 bp, C. elegans
gacaaaaactcaa

SEQ ID NO: 717531 - DNA, 13 bp, C. elegans
gacaaaaatattt

SEQ ID NO: 717532 - DNA, 13 bp, C. elegans
gacaaaaatcata

SEQ ID NO: 717533 - DNA, 13 bp, C. elegans
gacaaaaatccac

SEQ ID NO: 717534 - DNA, 13 bp, C. elegans
gacaaaaatgagc

SEQ ID NO: 717535 - DNA, 13 bp, C. elegans
gacaaaaatgtac

SEQ ID NO: 717536 - DNA, 13 bp, C. elegans
gacaaaaatgttt

SEQ ID NO: 717537 - DNA, 13 bp, C. elegans
gacaaaagagctt

SEQ ID NO: 717538 - DNA, 13 bp, C. elegans
gacaaaatccact

SEQ ID NO: 717539 - DNA, 13 bp, C. elegans
gacaaaatcccca

SEQ ID NO: 717540 - DNA, 13 bp, C. elegans
gacaaaatcgaaa

SEQ ID NO: 717541 - DNA, 13 bp, C. elegans
gacaaaattccca

SEQ ID NO: 717542 - DNA, 13 bp, C. elegans
gacaaagtattaa

SEQ ID NO: 717543 - DNA, 13 bp, C. elegans
gacaaatcaattt

SEQ ID NO: 717544 - DNA, 13 bp, C. elegans
gacaaatcgaaaa

SEQ ID NO: 717545 - DNA, 13 bp, C. elegans
gacaaattatcaa

SEQ ID NO: 717546 - DNA, 13 bp, C. elegans
gacaaattgacaa

SEQ ID NO: 717547 - DNA, 13 bp, C. elegans
gacaaattgccaa

SEQ ID NO: 717548 - DNA, 13 bp, C. elegans
gacaaattgccgg

SEQ ID NO: 717549 - DNA, 13 bp, C. elegans
gacaaatttcgaa

SEQ ID NO: 717550 - DNA, 13 bp, C. elegans
gacaacaaaaatt

SEQ ID NO: 717551 - DNA, 13 bp, C. elegans
gacaacattttgt

SEQ ID NO: 717552 - DNA, 14 bp, C. elegans
gacaactcctatct

SEQ ID NO: 717553 - DNA, 13 bp, C. elegans
gacaacttttcga

SEQ ID NO: 717554 - DNA, 13 bp, C. elegans
gacaactttttat

SEQ ID NO: 717555 - DNA, 13 bp, C. elegans
gacaactttttgg

SEQ ID NO: 717556 - DNA, 13 bp, C. elegans
gacaagaaataca

SEQ ID NO: 717557 - DNA, 13 bp, C. elegans
gacaaggaaaaat

SEQ ID NO: 717558 - DNA, 13 bp, C. elegans
gacaagtcaaatt

SEQ ID NO: 717559 - DNA, 13 bp, C. elegans
gacaagttggtca

SEQ ID NO: 717560 - DNA, 13 bp, C. elegans
gacaatacaattt

SEQ ID NO: 717561 - DNA, 13 bp, C. elegans
gacaatatggaaa

SEQ ID NO: 717562 - DNA, 13 bp, C. elegans
gacaatcaaataa

SEQ ID NO: 717563 - DNA, 13 bp, C. elegans
gacaattagatga

SEQ ID NO: 717564 - DNA, 13 bp, C. elegans
gacaattattatt

SEQ ID NO: 717565 - DNA, 13 bp, C. elegans
gacaattgtcaaa

SEQ ID NO: 717566 - DNA, 13 bp, C. elegans
gacaatttccggc

SEQ ID NO: 717567 - DNA, 13 bp, C. elegans
gacaatttgacaa

SEQ ID NO: 717568 - DNA, 13 bp, C. elegans
gacaatttgtcga

SEQ ID NO: 717569 - DNA, 13 bp, C. elegans
gacaattttgaac

SEQ ID NO: 717570 - DNA, 13 bp, C. elegans
gacaatttttcag

SEQ ID NO: 717571 - DNA, 13 bp, C. elegans
gacaatttttgtt

SEQ ID NO: 717572 - DNA, 13 bp, C. elegans
gacaatttttttt

SEQ ID NO: 717573 - DNA, 13 bp, C. elegans
gacacaaaaaagt

SEQ ID NO: 717574 - DNA, 13 bp, C. elegans
gacacaaaattaa

SEQ ID NO: 717575 - DNA, 13 bp, C. elegans
gacacagctgaaa

SEQ ID NO: 717576 - DNA, 13 bp, C. elegans
gacacagctgaag

SEQ ID NO: 717577 - DNA, 13 bp, C. elegans
gacacagttttaa

SEQ ID NO: 717578 - DNA, 13 bp, C. elegans
gacacattgagca

SEQ ID NO: 717579 - DNA, 13 bp, C. elegans
gacacctcacggg

SEQ ID NO: 717580 - DNA, 13 bp, C. elegans
gacaccttaaaaa

SEQ ID NO: 717581 - DNA, 13 bp, C. elegans
gacacgcccactt

SEQ ID NO: 717582 - DNA, 13 bp, C. elegans
gacacggaaaagt

SEQ ID NO: 717583 - DNA, 13 bp, C. elegans
gacactacagtag

SEQ ID NO: 717584 - DNA, 14 bp, C. elegans
gacactctgatacc

SEQ ID NO: 717585 - DNA, 13 bp, C. elegans
gacactctggcac

SEQ ID NO: 717586 - DNA, 13 bp, C. elegans
gacactttgacac

SEQ ID NO: 717587 - DNA, 13 bp, C. elegans
gacactttttcga

SEQ ID NO: 717588 - DNA, 13 bp, C. elegans
gacacttttttat

SEQ ID NO: 717589 - DNA, 13 bp, C. elegans
gacactttttttg

SEQ ID NO: 717590 - DNA, 13 bp, C. elegans
gacagaataccgg

SEQ ID NO: 717591 - DNA, 13 bp, C. elegans
gacagaatatcat

SEQ ID NO: 717592 - DNA, 13 bp, C. elegans
gacagctcgccac

SEQ ID NO: 717593 - DNA, 13 bp, C. elegans
gacagcttctgtc

SEQ ID NO: 717594 - DNA, 15 bp, C. elegans
gacagtacaattttg

SEQ ID NO: 717595 - DNA, 13 bp, C. elegans
gacataatcaaaa

SEQ ID NO: 717596 - DNA, 13 bp, C. elegans
gacatcaaaaaag

SEQ ID NO: 717597 - DNA, 13 bp, C. elegans
gacatctcaactg

SEQ ID NO: 717598 - DNA, 13 bp, C. elegans
gacatctcacgag

SEQ ID NO: 717599 - DNA, 13 bp, C. elegans
gacatctcactgg

SEQ ID NO: 717600 - DNA, 15 bp, C. elegans
gacattatccatcac

SEQ ID NO: 717601 - DNA, 13 bp, C. elegans
gacattctgaaat

SEQ ID NO: 717602 - DNA, 13 bp, C. elegans
gacattctgacac

SEQ ID NO: 717603 - DNA, 13 bp, C. elegans
gacattgacaagt

SEQ ID NO: 717604 - DNA, 13 bp, C. elegans
gacattgctttgg

SEQ ID NO: 717605 - DNA, 13 bp, C. elegans
gacatttattaaa

SEQ ID NO: 717606 - DNA, 13 bp, C. elegans
gacatttggaatc

SEQ ID NO: 717607 - DNA, 13 bp, C. elegans
gacattttatttt

SEQ ID NO: 717608 - DNA, 13 bp, C. elegans
gacattttctccc

SEQ ID NO: 717609 - DNA, 13 bp, C. elegans
gacattttgaaaa

SEQ ID NO: 717610 - DNA, 13 bp, C. elegans
gacattttgagaa

SEQ ID NO: 717611 - DNA, 13 bp, C. elegans
gacatttttcaaa

SEQ ID NO: 717612 - DNA, 13 bp, C. elegans
gacatttttgaaa

SEQ ID NO: 717613 - DNA, 13 bp, C. elegans
gacattttttatg

SEQ ID NO: 717614 - DNA, 13 bp, C. elegans
gacattttttgtt

SEQ ID NO: 717615 - DNA, 13 bp, C. elegans
gacatttttttgt

SEQ ID NO: 717616 - DNA, 13 bp, C. elegans
gacattttttttg

SEQ ID NO: 717617 - DNA, 13 bp, C. elegans
gaccaaaatattc

SEQ ID NO: 717618 - DNA, 13 bp, C. elegans
gaccaacttatca

SEQ ID NO: 717619 - DNA, 13 bp, C. elegans
gaccaatcagcga

SEQ ID NO: 717620 - DNA, 13 bp, C. elegans
gaccacaatttat

SEQ ID NO: 717621 - DNA, 13 bp, C. elegans
gaccagaataaat

SEQ ID NO: 717622 - DNA, 13 bp, C. elegans
gaccattttgtat

SEQ ID NO: 717623 - DNA, 13 bp, C. elegans
gacccaaaatttc

SEQ ID NO: 717624 - DNA, 13 bp, C. elegans
gacccaaatattt

SEQ ID NO: 717625 - DNA, 13 bp, C. elegans
gacccaattttta

SEQ ID NO: 717626 - DNA, 13 bp, C. elegans
gaccccccgtttt

SEQ ID NO: 717627 - DNA, 22 bp, C. elegans
gacccgccagaagctccagaca

SEQ ID NO: 717628 - DNA, 13 bp, C. elegans
gaccgaaattttc

SEQ ID NO: 717629 - DNA, 13 bp, C. elegans
gaccgacttgtca

SEQ ID NO: 717630 - DNA, 13 bp, C. elegans
gacctacaaaaaa

SEQ ID NO: 717631 - DNA, 13 bp, C. elegans
gacctacttttta

SEQ ID NO: 717632 - DNA, 13 bp, C. elegans
gacctcaaaaaag

SEQ ID NO: 717633 - DNA, 13 bp, C. elegans
gacgaaaaactac

SEQ ID NO: 717634 - DNA, 13 bp, C. elegans
gacgaaaattgaa

SEQ ID NO: 717635 - DNA, 13 bp, C. elegans
gacgaagaagacg

SEQ ID NO: 717636 - DNA, 13 bp, C. elegans
gacgaatttcatg

SEQ ID NO: 717637 - DNA, 13 bp, C. elegans
gacgacaaaatgc

SEQ ID NO: 717638 - DNA, 13 bp, C. elegans
gacgacaatttca

SEQ ID NO: 717639 - DNA, 13 bp, C. elegans
gacgaccaaccaa

SEQ ID NO: 717640 - DNA, 13 bp, C. elegans
gacgacgacgatg

SEQ ID NO: 717641 - DNA, 13 bp, C. elegans
gacgagcaaaata

SEQ ID NO: 717642 - DNA, 13 bp, C. elegans
gacgagcctgaaa

SEQ ID NO: 717643 - DNA, 13 bp, C. elegans
gacgaggaaaatc

SEQ ID NO: 717644 - DNA, 13 bp, C. elegans
gacgattttcgag

SEQ ID NO: 717645 - DNA, 14 bp, C. elegans
gacgattttggaga

SEQ ID NO: 717646 - DNA, 13 bp, C. elegans
gacgatttttctt

SEQ ID NO: 717647 - DNA, 13 bp, C. elegans
gacgcagaaaaat

SEQ ID NO: 717648 - DNA, 13 bp, C. elegans
gacgcagacacac

SEQ ID NO: 717649 - DNA, 13 bp, C. elegans
gacgggaaattta

SEQ ID NO: 717650 - DNA, 13 bp, C. elegans
gacgtcaagaaag

SEQ ID NO: 717651 - DNA, 13 bp, C. elegans
gacgtcacaaaaa

SEQ ID NO: 717652 - DNA, 13 bp, C. elegans
gacgtcacaaatt

SEQ ID NO: 717653 - DNA, 13 bp, C. elegans
gacgtcacacttg

SEQ ID NO: 717654 - DNA, 14 bp, C. elegans
gacgtcacagcgca

SEQ ID NO: 717655 - DNA, 13 bp, C. elegans
gacgtcacttgtt

SEQ ID NO: 717656 - DNA, 14 bp, C. elegans
gacgtccaaggaaa

SEQ ID NO: 717657 - DNA, 13 bp, C. elegans
gacgtcggctgct

SEQ ID NO: 717658 - DNA, 13 bp, C. elegans
gacgtcttcttct

SEQ ID NO: 717659 - DNA, 13 bp, C. elegans
gacgtcttctttt

SEQ ID NO: 717660 - DNA, 13 bp, C. elegans
gacgttgtttttt

SEQ ID NO: 717661 - DNA, 13 bp, C. elegans
gacgttttttcca

SEQ ID NO: 717662 - DNA, 13 bp, C. elegans
gactaagaaaatg

SEQ ID NO: 717663 - DNA, 13 bp, C. elegans
gactacaaactat

SEQ ID NO: 717664 - DNA, 13 bp, C. elegans
gactacagtaacc

SEQ ID NO: 717665 - DNA, 13 bp, C. elegans
gactacagtaatc

SEQ ID NO: 717666 - DNA, 13 bp, C. elegans
gactactgtagag

SEQ ID NO: 717667 - DNA, 13 bp, C. elegans
gactactgtagca

SEQ ID NO: 717668 - DNA, 13 bp, C. elegans
gactactgtagtg

SEQ ID NO: 717669 - DNA, 13 bp, C. elegans
gactagaaatcaa

SEQ ID NO: 717670 - DNA, 13 bp, C. elegans
gactatttgaaaa

SEQ ID NO: 717671 - DNA, 13 bp, C. elegans
gactatttggaaa

SEQ ID NO: 717672 - DNA, 13 bp, C. elegans
gactcaaaatgtg

SEQ ID NO: 717673 - DNA, 13 bp, C. elegans
gactcatttttca

SEQ ID NO: 717674 - DNA, 13 bp, C. elegans
gactccgcccatt

SEQ ID NO: 717675 - DNA, 13 bp, C. elegans
gactcctctcgga

SEQ ID NO: 717676 - DNA, 13 bp, C. elegans
gactcgagactat

SEQ ID NO: 717677 - DNA, 13 bp, C. elegans
gactctttttttg

SEQ ID NO: 717678 - DNA, 13 bp, C. elegans
gactgaaaatgaa

SEQ ID NO: 717679 - DNA, 13 bp, C. elegans
gactgaaaatgtg

SEQ ID NO: 717680 - DNA, 13 bp, C. elegans
gactgaaaatgtt

SEQ ID NO: 717681 - DNA, 13 bp, C. elegans
gactgaaaatttg

SEQ ID NO: 717682 - DNA, 13 bp, C. elegans
gactgaatatcat

SEQ ID NO: 717683 - DNA, 13 bp, C. elegans
gactgccacgtca

SEQ ID NO: 717684 - DNA, 13 bp, C. elegans
gactgtaaataaa

SEQ ID NO: 717685 - DNA, 13 bp, C. elegans
gactgtgatgatg

SEQ ID NO: 717686 - DNA, 13 bp, C. elegans
gacttactattag

SEQ ID NO: 717687 - DNA, 13 bp, C. elegans
gacttcaaatttt

SEQ ID NO: 717688 - DNA, 13 bp, C. elegans
gacttctcaaaaa

SEQ ID NO: 717689 - DNA, 13 bp, C. elegans
gacttctcgccat

SEQ ID NO: 717690 - DNA, 13 bp, C. elegans
gacttgtttcaaa

SEQ ID NO: 717691 - DNA, 13 bp, C. elegans
gactttaaattga

SEQ ID NO: 717692 - DNA, 13 bp, C. elegans
gactttctgacac

SEQ ID NO: 717693 - DNA, 13 bp, C. elegans
gactttggcaaaa

SEQ ID NO: 717694 - DNA, 13 bp, C. elegans
gacttttcaaatt

SEQ ID NO: 717695 - DNA, 13 bp, C. elegans
gacttttcagaat

SEQ ID NO: 717696 - DNA, 13 bp, C. elegans
gacttttccaaaa

SEQ ID NO: 717697 - DNA, 13 bp, C. elegans
gacttttcgaaaa

SEQ ID NO: 717698 - DNA, 13 bp, C. elegans
gacttttctctac

SEQ ID NO: 717699 - DNA, 13 bp, C. elegans
gacttttcttaaa

SEQ ID NO: 717700 - DNA, 13 bp, C. elegans
gacttttgaaaaa

SEQ ID NO: 717701 - DNA, 13 bp, C. elegans
gacttttgaattt

SEQ ID NO: 717702 - DNA, 13 bp, C. elegans
gactttttcaatt

SEQ ID NO: 717703 - DNA, 13 bp, C. elegans
gactttttgaatt

SEQ ID NO: 717704 - DNA, 13 bp, C. elegans
gactttttgctca

SEQ ID NO: 717705 - DNA, 13 bp, C. elegans
gacttttttaaaa

SEQ ID NO: 717706 - DNA, 13 bp, C. elegans
gacttttttgttg

SEQ ID NO: 717707 - DNA, 13 bp, C. elegans
gactttttttgta

SEQ ID NO: 717708 - DNA, 13 bp, C. elegans
gacttttttttaa

SEQ ID NO: 717709 - DNA, 13 bp, C. elegans
gacttttttttca

SEQ ID NO: 717710 - DNA, 13 bp, C. elegans
gagaaaaaaagct

SEQ ID NO: 717711 - DNA, 13 bp, C. elegans
gagaaaaaaggtt

SEQ ID NO: 717712 - DNA, 13 bp, C. elegans
gagaaaaaatttt

SEQ ID NO: 717713 - DNA, 13 bp, C. elegans
gagaaaaacaatt

SEQ ID NO: 717714 - DNA, 13 bp, C. elegans
gagaaaaagttca

SEQ ID NO: 717715 - DNA, 13 bp, C. elegans
gagaaaaatattt

SEQ ID NO: 717716 - DNA, 13 bp, C. elegans
gagaaaaatcaat

SEQ ID NO: 717717 - DNA, 13 bp, C. elegans
gagaaaaatgcga

SEQ ID NO: 717718 - DNA, 13 bp, C. elegans
gagaaaaatgttt

SEQ ID NO: 717719 - DNA, 13 bp, C. elegans
gagaaaaattcga

SEQ ID NO: 717720 - DNA, 13 bp, C. elegans
gagaaaaattggt

SEQ ID NO: 717721 - DNA, 13 bp, C. elegans
gagaaaaatttga

SEQ ID NO: 717722 - DNA, 13 bp, C. elegans
gagaaaacgagac

SEQ ID NO: 717723 - DNA, 13 bp, C. elegans
gagaaaacgtttt

SEQ ID NO: 717724 - DNA, 13 bp, C. elegans
gagaaaactcggc

SEQ ID NO: 717725 - DNA, 13 bp, C. elegans
gagaaaacttgaa

SEQ ID NO: 717726 - DNA, 13 bp, C. elegans
gagaaaagacgca

SEQ ID NO: 717727 - DNA, 13 bp, C. elegans
gagaaaagtacaa

SEQ ID NO: 717728 - DNA, 13 bp, C. elegans
gagaaaagtatga

SEQ ID NO: 717729 - DNA, 13 bp, C. elegans
gagaaaagtcaat

SEQ ID NO: 717730 - DNA, 13 bp, C. elegans
gagaaaatacagt

SEQ ID NO: 717731 - DNA, 13 bp, C. elegans
gagaaaatatcga

SEQ ID NO: 717732 - DNA, 13 bp, C. elegans
gagaaaatatgga

SEQ ID NO: 717733 - DNA, 13 bp, C. elegans
gagaaaatcattt

SEQ ID NO: 717734 - DNA, 13 bp, C. elegans
gagaaaatgcaga

SEQ ID NO: 717735 - DNA, 13 bp, C. elegans
gagaaaatgctca

SEQ ID NO: 717736 - DNA, 13 bp, C. elegans
gagaaaatggcct

SEQ ID NO: 717737 - DNA, 13 bp, C. elegans
gagaaaatgtaga

SEQ ID NO: 717738 - DNA, 13 bp, C. elegans
gagaaaatgtcaa

SEQ ID NO: 717739 - DNA, 13 bp, C. elegans
gagaaaatttgaa

SEQ ID NO: 717740 - DNA, 13 bp, C. elegans
gagaaaattttgg

SEQ ID NO: 717741 - DNA, 13 bp, C. elegans
gagaaacaatttt

SEQ ID NO: 717742 - DNA, 13 bp, C. elegans
gagaaactgaagt

SEQ ID NO: 717743 - DNA, 13 bp, C. elegans
gagaaacttattt

SEQ ID NO: 717744 - DNA, 13 bp, C. elegans
gagaaagatatgc

SEQ ID NO: 717745 - DNA, 13 bp, C. elegans
gagaaaggaatac

SEQ ID NO: 717746 - DNA, 13 bp, C. elegans
gagaaagttctga

SEQ ID NO: 717747 - DNA, 13 bp, C. elegans
gagaaagttggag

SEQ ID NO: 717748 - DNA, 13 bp, C. elegans
gagaaataaacga

SEQ ID NO: 717749 - DNA, 13 bp, C. elegans
gagaaataaattt

SEQ ID NO: 717750 - DNA, 13 bp, C. elegans
gagaaataattga

SEQ ID NO: 717751 - DNA, 13 bp, C. elegans
gagaaatacattt

SEQ ID NO: 717752 - DNA, 13 bp, C. elegans
gagaaatactcaa

SEQ ID NO: 717753 - DNA, 13 bp, C. elegans
gagaaatatattt

SEQ ID NO: 717754 - DNA, 13 bp, C. elegans
gagaaatatgaga

SEQ ID NO: 717755 - DNA, 13 bp, C. elegans
gagaaatccaaaa

SEQ ID NO: 717756 - DNA, 13 bp, C. elegans
gagaaatgacgag

SEQ ID NO: 717757 - DNA, 13 bp, C. elegans
gagaaatgagcaa

SEQ ID NO: 717758 - DNA, 13 bp, C. elegans
gagaaattaccaa

SEQ ID NO: 717759 - DNA, 13 bp, C. elegans
gagaaattatcga

SEQ ID NO: 717760 - DNA, 13 bp, C. elegans
gagaaattattaa

SEQ ID NO: 717761 - DNA, 13 bp, C. elegans
gagaaattcaatt

SEQ ID NO: 717762 - DNA, 13 bp, C. elegans
gagaaattcgatt

SEQ ID NO: 717763 - DNA, 13 bp, C. elegans
gagaaattgaaag

SEQ ID NO: 717764 - DNA, 13 bp, C. elegans
gagaaattggaaa

SEQ ID NO: 717765 - DNA, 13 bp, C. elegans
gagaaattgtcaa

SEQ ID NO: 717766 - DNA, 13 bp, C. elegans
gagaaattgtgaa

SEQ ID NO: 717767 - DNA, 13 bp, C. elegans
gagaaatttgaat

SEQ ID NO: 717768 - DNA, 13 bp, C. elegans
gagaaattttatt

SEQ ID NO: 717769 - DNA, 13 bp, C. elegans
gagaaattttgga

SEQ ID NO: 717770 - DNA, 13 bp, C. elegans
gagaaattttttt

SEQ ID NO: 717771 - DNA, 13 bp, C. elegans
gagaacaaaacat

SEQ ID NO: 717772 - DNA, 13 bp, C. elegans
gagaacatttcaa

SEQ ID NO: 717773 - DNA, 13 bp, C. elegans
gagaacctacgcc

SEQ ID NO: 717774 - DNA, 13 bp, C. elegans
gagaactcgaatt

SEQ ID NO: 717775 - DNA, 13 bp, C. elegans
gagaacttttgaa

SEQ ID NO: 717776 - DNA, 13 bp, C. elegans
gagaagaaacgca

SEQ ID NO: 717777 - DNA, 13 bp, C. elegans
gagaagaacattt

SEQ ID NO: 717778 - DNA, 13 bp, C. elegans
gagaagccagaaa

SEQ ID NO: 717779 - DNA, 13 bp, C. elegans
gagaagtcgaatt

SEQ ID NO: 717780 - DNA, 13 bp, C. elegans
gagaagtgtacat

SEQ ID NO: 717781 - DNA, 13 bp, C. elegans
gagaagttcccga

SEQ ID NO: 717782 - DNA, 13 bp, C. elegans
gagaagttgaagt

SEQ ID NO: 717783 - DNA, 13 bp, C. elegans
gagaagttgagaa

SEQ ID NO: 717784 - DNA, 13 bp, C. elegans
gagaataaatttt

SEQ ID NO: 717785 - DNA, 13 bp, C. elegans
gagaatacaattt

SEQ ID NO: 717786 - DNA, 13 bp, C. elegans
gagaatcaaaata

SEQ ID NO: 717787 - DNA, 13 bp, C. elegans
gagaatcaagaga

SEQ ID NO: 717788 - DNA, 13 bp, C. elegans
gagaatgcaaaaa

SEQ ID NO: 717789 - DNA, 13 bp, C. elegans
gagaatgtgaaaa

SEQ ID NO: 717790 - DNA, 13 bp, C. elegans
gagaatgttcaaa

SEQ ID NO: 717791 - DNA, 13 bp, C. elegans
gagaattagagaa

SEQ ID NO: 717792 - DNA, 14 bp, C. elegans
gagaattatggaga

SEQ ID NO: 717793 - DNA, 13 bp, C. elegans
gagaattcaaaat

SEQ ID NO: 717794 - DNA, 13 bp, C. elegans
gagaattcaaata

SEQ ID NO: 717795 - DNA, 13 bp, C. elegans
gagaattcgaatt

SEQ ID NO: 717796 - DNA, 13 bp, C. elegans
gagaattcttttt

SEQ ID NO: 717797 - DNA, 13 bp, C. elegans
gagaattgaaatt

SEQ ID NO: 717798 - DNA, 13 bp, C. elegans
gagaattgagaga

SEQ ID NO: 717799 - DNA, 13 bp, C. elegans
gagaattgatttt

SEQ ID NO: 717800 - DNA, 13 bp, C. elegans
gagaattgcggga

SEQ ID NO: 717801 - DNA, 13 bp, C. elegans
gagaattggaaaa

SEQ ID NO: 717802 - DNA, 13 bp, C. elegans
gagaatttagaaa

SEQ ID NO: 717803 - DNA, 13 bp, C. elegans
gagaatttcattt

SEQ ID NO: 717804 - DNA, 13 bp, C. elegans
gagaatttgaaaa

SEQ ID NO: 717805 - DNA, 13 bp, C. elegans
gagaattttgtgt

SEQ ID NO: 717806 - DNA, 13 bp, C. elegans
gagaatttttata

SEQ ID NO: 717807 - DNA, 13 bp, C. elegans
gagaattttttta

SEQ ID NO: 717808 - DNA, 13 bp, C. elegans
gagacaaaaatta

SEQ ID NO: 717809 - DNA, 13 bp, C. elegans
gagacaagcgaaa

SEQ ID NO: 717810 - DNA, 13 bp, C. elegans
gagacattctgac

SEQ ID NO: 717811 - DNA, 13 bp, C. elegans
gagacccaatttt

SEQ ID NO: 717812 - DNA, 13 bp, C. elegans
gagacctttaaaa

SEQ ID NO: 717813 - DNA, 13 bp, C. elegans
gagacgcagaatg

SEQ ID NO: 717814 - DNA, 13 bp, C. elegans
gagacgcagacgg

SEQ ID NO: 717815 - DNA, 13 bp, C. elegans
gagacgcagactt

SEQ ID NO: 717816 - DNA, 13 bp, C. elegans
gagacgcagagaa

SEQ ID NO: 717817 - DNA, 13 bp, C. elegans
gagacgcagagtt

SEQ ID NO: 717818 - DNA, 13 bp, C. elegans
gagacgcagatat

SEQ ID NO: 717819 - DNA, 13 bp, C. elegans
gagacgcaggaaa

SEQ ID NO: 717820 - DNA, 13 bp, C. elegans
gagactatttgaa

SEQ ID NO: 717821 - DNA, 13 bp, C. elegans
gagactgaaaaaa

SEQ ID NO: 717822 - DNA, 13 bp, C. elegans
gagagaaaatcga

SEQ ID NO: 717823 - DNA, 13 bp, C. elegans
gagagaaattgaa

SEQ ID NO: 717824 - DNA, 13 bp, C. elegans
gagagaagcactt

SEQ ID NO: 717825 - DNA, 13 bp, C. elegans
gagagaagctcta

SEQ ID NO: 717826 - DNA, 13 bp, C. elegans
gagagacgcagac

SEQ ID NO: 717827 - DNA, 13 bp, C. elegans
gagagacgcagag

SEQ ID NO: 717828 - DNA, 13 bp, C. elegans
gagagagcgtggg

SEQ ID NO: 717829 - DNA, 13 bp, C. elegans
gagagattgagag

SEQ ID NO: 717830 - DNA, 13 bp, C. elegans
gagagatttagag

SEQ ID NO: 717831 - DNA, 13 bp, C. elegans
gagagccgaaaaa

SEQ ID NO: 717832 - DNA, 13 bp, C. elegans
gagagcctgaaaa

SEQ ID NO: 717833 - DNA, 13 bp, C. elegans
gagagcgcagaca

SEQ ID NO: 717834 - DNA, 13 bp, C. elegans
gagagcgcagaga

SEQ ID NO: 717835 - DNA, 13 bp, C. elegans
gagagctatcaaa

SEQ ID NO: 717836 - DNA, 17 bp, C. elegans
gagagcttcttccagac

SEQ ID NO: 717837 - DNA, 13 bp, C. elegans
gagagtgcagaga

SEQ ID NO: 717838 - DNA, 13 bp, C. elegans
gagagtgtgtgtg

SEQ ID NO: 717839 - DNA, 13 bp, C. elegans
gagagttcaaatg

SEQ ID NO: 717840 - DNA, 13 bp, C. elegans
gagagttgaactc

SEQ ID NO: 717841 - DNA, 13 bp, C. elegans
gagagtttgaaat

SEQ ID NO: 717842 - DNA, 13 bp, C. elegans
gagagttttgttt

SEQ ID NO: 717843 - DNA, 13 bp, C. elegans
gagagtttttgaa

SEQ ID NO: 717844 - DNA, 13 bp, C. elegans
gagataattgaaa

SEQ ID NO: 717845 - DNA, 14 bp, C. elegans
gagatacagttcgt

SEQ ID NO: 717846 - DNA, 13 bp, C. elegans
gagatataaacgt

SEQ ID NO: 717847 - DNA, 13 bp, C. elegans
gagatatcatcag

SEQ ID NO: 717848 - DNA, 13 bp, C. elegans
gagatatgaacag

SEQ ID NO: 717849 - DNA, 13 bp, C. elegans
gagatattatttt

SEQ ID NO: 717850 - DNA, 13 bp, C. elegans
gagatatttcaaa

SEQ ID NO: 717851 - DNA, 13 bp, C. elegans
gagatatttgaaa

SEQ ID NO: 717852 - DNA, 13 bp, C. elegans
gagatattttgat

SEQ ID NO: 717853 - DNA, 13 bp, C. elegans
gagatctggaaaa

SEQ ID NO: 717854 - DNA, 13 bp, C. elegans
gagatggacagtg

SEQ ID NO: 717855 - DNA, 13 bp, C. elegans
gagatgttttgaa

SEQ ID NO: 717856 - DNA, 13 bp, C. elegans
gagattaattttt

SEQ ID NO: 717857 - DNA, 13 bp, C. elegans
gagattcagaaaa

SEQ ID NO: 717858 - DNA, 13 bp, C. elegans
gagattgctcgca

SEQ ID NO: 717859 - DNA, 13 bp, C. elegans
gagatttcaaaaa

SEQ ID NO: 717860 - DNA, 13 bp, C. elegans
gagatttcgaaaa

SEQ ID NO: 717861 - DNA, 13 bp, C. elegans
gagatttctgaaa

SEQ ID NO: 717862 - DNA, 13 bp, C. elegans
gagatttgtcaaa

SEQ ID NO: 717863 - DNA, 13 bp, C. elegans
gagattttcaaaa

SEQ ID NO: 717864 - DNA, 14 bp, C. elegans
gagattttcgcaca

SEQ ID NO: 717865 - DNA, 13 bp, C. elegans
gagattttgaaaa

SEQ ID NO: 717866 - DNA, 13 bp, C. elegans
gagattttgaaat

SEQ ID NO: 717867 - DNA, 13 bp, C. elegans
gagattttggcac

SEQ ID NO: 717868 - DNA, 13 bp, C. elegans
gagatttttttca

SEQ ID NO: 717869 - DNA, 13 bp, C. elegans
gagcaaaaaatcg

SEQ ID NO: 717870 - DNA, 13 bp, C. elegans
gagcaaaaagtga

SEQ ID NO: 717871 - DNA, 13 bp, C. elegans
gagcaaaaatcga

SEQ ID NO: 717872 - DNA, 13 bp, C. elegans
gagcaaaatttga

SEQ ID NO: 717873 - DNA, 13 bp, C. elegans
gagcaaacttttt

SEQ ID NO: 717874 - DNA, 13 bp, C. elegans
gagcaaatgcaca

SEQ ID NO: 717875 - DNA, 14 bp, C. elegans
gagcaacatcggat

SEQ ID NO: 717876 - DNA, 13 bp, C. elegans
gagcaagagagca

SEQ ID NO: 717877 - DNA, 13 bp, C. elegans
gagcaatgtcgca

SEQ ID NO: 717878 - DNA, 13 bp, C. elegans
gagcaattctaca

SEQ ID NO: 717879 - DNA, 13 bp, C. elegans
gagcaatttcaaa

SEQ ID NO: 717880 - DNA, 13 bp, C. elegans
gagcaatttcaag

SEQ ID NO: 717881 - DNA, 13 bp, C. elegans
gagcacaaaactg

SEQ ID NO: 717882 - DNA, 13 bp, C. elegans
gagcacacttttt

SEQ ID NO: 717883 - DNA, 13 bp, C. elegans
gagcacattttca

SEQ ID NO: 717884 - DNA, 13 bp, C. elegans
gagcacattttga

SEQ ID NO: 717885 - DNA, 13 bp, C. elegans
gagcacattttgt

SEQ ID NO: 717886 - DNA, 13 bp, C. elegans
gagcaccaaaaag

SEQ ID NO: 717887 - DNA, 13 bp, C. elegans
gagcaccaccagg

SEQ ID NO: 717888 - DNA, 13 bp, C. elegans
gagcacgtttgca

SEQ ID NO: 717889 - DNA, 13 bp, C. elegans
gagcactttgagc

SEQ ID NO: 717890 - DNA, 13 bp, C. elegans
gagcattctttga

SEQ ID NO: 717891 - DNA, 13 bp, C. elegans
gagcattttattt

SEQ ID NO: 717892 - DNA, 13 bp, C. elegans
gagcattttcatt

SEQ ID NO: 717893 - DNA, 13 bp, C. elegans
gagcatttttcaa

SEQ ID NO: 717894 - DNA, 13 bp, C. elegans
gagcatttttctg

SEQ ID NO: 717895 - DNA, 13 bp, C. elegans
gagccaatttcga

SEQ ID NO: 717896 - DNA, 13 bp, C. elegans
gagccaattttcg

SEQ ID NO: 717897 - DNA, 13 bp, C. elegans
gagccaatttttt

SEQ ID NO: 717898 - DNA, 14 bp, C. elegans
gagcctttccaatt

SEQ ID NO: 717899 - DNA, 13 bp, C. elegans
gagcgatgggaca

SEQ ID NO: 717900 - DNA, 13 bp, C. elegans
gagcgattttttt

SEQ ID NO: 717901 - DNA, 13 bp, C. elegans
gagcgcaattgca

SEQ ID NO: 717902 - DNA, 13 bp, C. elegans
gagcgcacttgca

SEQ ID NO: 717903 - DNA, 13 bp, C. elegans
gagcgcatttgca

SEQ ID NO: 717904 - DNA, 13 bp, C. elegans
gagcgcgcttgca

SEQ ID NO: 717905 - DNA, 13 bp, C. elegans
gagcgcgtttcca

SEQ ID NO: 717906 - DNA, 13 bp, C. elegans
gagcgtatttgca

SEQ ID NO: 717907 - DNA, 13 bp, C. elegans
gagctaaaattga

SEQ ID NO: 717908 - DNA, 13 bp, C. elegans
gagctaatttttg

SEQ ID NO: 717909 - DNA, 13 bp, C. elegans
gagctacagtaac

SEQ ID NO: 717910 - DNA, 13 bp, C. elegans
gagctcaaaaagt

SEQ ID NO: 717911 - DNA, 13 bp, C. elegans
gagctcacggagc

SEQ ID NO: 717912 - DNA, 13 bp, C. elegans
gagctcagaaaaa

SEQ ID NO: 717913 - DNA, 13 bp, C. elegans
gagctccaaagtc

SEQ ID NO: 717914 - DNA, 13 bp, C. elegans
gagctccgcgagc

SEQ ID NO: 717915 - DNA, 13 bp, C. elegans
gagctcggatgat

SEQ ID NO: 717916 - DNA, 14 bp, C. elegans
gagctcggcaattt

SEQ ID NO: 717917 - DNA, 13 bp, C. elegans
gagctctcaaaga

SEQ ID NO: 717918 - DNA, 13 bp, C. elegans
gagctctgcaaat

SEQ ID NO: 717919 - DNA, 13 bp, C. elegans
gagctctttgagc

SEQ ID NO: 717920 - DNA, 13 bp, C. elegans
gagctgaaaaatg

SEQ ID NO: 717921 - DNA, 13 bp, C. elegans
gagctgaaaattt

SEQ ID NO: 717922 - DNA, 13 bp, C. elegans
gagctgaaatatt

SEQ ID NO: 717923 - DNA, 15 bp, C. elegans
gagctgaagattcag

SEQ ID NO: 717924 - DNA, 13 bp, C. elegans
gagctggtggtgg

SEQ ID NO: 717925 - DNA, 13 bp, C. elegans
gagcttctctcga

SEQ ID NO: 717926 - DNA, 13 bp, C. elegans
gagcttcttcttc

SEQ ID NO: 717927 - DNA, 13 bp, C. elegans
gagcttgaaaaga

SEQ ID NO: 717928 - DNA, 13 bp, C. elegans
gagctttcaaata

SEQ ID NO: 717929 - DNA, 13 bp, C. elegans
gaggaaaaagttg

SEQ ID NO: 717930 - DNA, 13 bp, C. elegans
gaggaaaaattca

SEQ ID NO: 717931 - DNA, 13 bp, C. elegans
gaggaaaatgtga

SEQ ID NO: 717932 - DNA, 13 bp, C. elegans
gaggaattgaaaa

SEQ ID NO: 717933 - DNA, 13 bp, C. elegans
gaggaatttgaat

SEQ ID NO: 717934 - DNA, 14 bp, C. elegans
gaggactcaaaatt

SEQ ID NO: 717935 - DNA, 13 bp, C. elegans
gaggagacgcaga

SEQ ID NO: 717936 - DNA, 13 bp, C. elegans
gaggagcactttg

SEQ ID NO: 717937 - DNA, 13 bp, C. elegans
gaggattactgta

SEQ ID NO: 717938 - DNA, 13 bp, C. elegans
gaggatttgaaga

SEQ ID NO: 717939 - DNA, 13 bp, C. elegans
gaggcatgtgtga

SEQ ID NO: 717940 - DNA, 13 bp, C. elegans
gaggctggcggag

SEQ ID NO: 717941 - DNA, 13 bp, C. elegans
gagggaaatttaa

SEQ ID NO: 717942 - DNA, 23 bp, C. elegans
gaggggccgacaagtttcagcgg

SEQ ID NO: 717943 - DNA, 13 bp, C. elegans
gaggtcgccgcaa

SEQ ID NO: 717944 - DNA, 13 bp, C. elegans
gaggttatattaa

SEQ ID NO: 717945 - DNA, 13 bp, C. elegans
gaggtttaaaaaa

SEQ ID NO: 717946 - DNA, 13 bp, C. elegans
gaggtttgtgtgc

SEQ ID NO: 717947 - DNA, 13 bp, C. elegans
gagtaacaaaatt

SEQ ID NO: 717948 - DNA, 13 bp, C. elegans
gagtaattgccac

SEQ ID NO: 717949 - DNA, 13 bp, C. elegans
gagtaccgtattt

SEQ ID NO: 717950 - DNA, 13 bp, C. elegans
gagtacggtagtt

SEQ ID NO: 717951 - DNA, 13 bp, C. elegans
gagtactgtaaaa

SEQ ID NO: 717952 - DNA, 13 bp, C. elegans
gagtactgtaact

SEQ ID NO: 717953 - DNA, 13 bp, C. elegans
gagtactgtagct

SEQ ID NO: 717954 - DNA, 13 bp, C. elegans
gagtactgtaggg

SEQ ID NO: 717955 - DNA, 13 bp, C. elegans
gagtactgtagtt

SEQ ID NO: 717956 - DNA, 13 bp, C. elegans
gagtactgtattt

SEQ ID NO: 717957 - DNA, 13 bp, C. elegans
gagtagcaccagt

SEQ ID NO: 717958 - DNA, 13 bp, C. elegans
gagtatacaatgt

SEQ ID NO: 717959 - DNA, 13 bp, C. elegans
gagtattcaaaaa

SEQ ID NO: 717960 - DNA, 13 bp, C. elegans
gagtattttcaaa

SEQ ID NO: 717961 - DNA, 13 bp, C. elegans
gagtattttgaaa

SEQ ID NO: 717962 - DNA, 13 bp, C. elegans
gagtcaaaaagtg

SEQ ID NO: 717963 - DNA, 13 bp, C. elegans
gagtcaaatatca

SEQ ID NO: 717964 - DNA, 13 bp, C. elegans
gagtcaaattgaa

SEQ ID NO: 717965 - DNA, 13 bp, C. elegans
gagtcaattttca

SEQ ID NO: 717966 - DNA, 13 bp, C. elegans
gagtgaaatatat

SEQ ID NO: 717967 - DNA, 13 bp, C. elegans
gagtgaataataa

SEQ ID NO: 717968 - DNA, 13 bp, C. elegans
gagtgaattttca

SEQ ID NO: 717969 - DNA, 13 bp, C. elegans
gagtgacgtcatt

SEQ ID NO: 717970 - DNA, 13 bp, C. elegans
gagtgaggctgaa

SEQ ID NO: 717971 - DNA, 13 bp, C. elegans
gagtgataagaaa

SEQ ID NO: 717972 - DNA, 13 bp, C. elegans
gagtgcaaaacta

SEQ ID NO: 717973 - DNA, 13 bp, C. elegans
gagtggagattca

SEQ ID NO: 717974 - DNA, 13 bp, C. elegans
gagtgtatgtgtg

SEQ ID NO: 717975 - DNA, 13 bp, C. elegans
gagtgtcgtagtt

SEQ ID NO: 717976 - DNA, 13 bp, C. elegans
gagtgtctcgttt

SEQ ID NO: 717977 - DNA, 13 bp, C. elegans
gagttaaaaaatg

SEQ ID NO: 717978 - DNA, 13 bp, C. elegans
gagttaaaaattt

SEQ ID NO: 717979 - DNA, 13 bp, C. elegans
gagttatcaattt

SEQ ID NO: 717980 - DNA, 13 bp, C. elegans
gagttatcgattt

SEQ ID NO: 717981 - DNA, 13 bp, C. elegans
gagttcaaaaata

SEQ ID NO: 717982 - DNA, 13 bp, C. elegans
gagttcaaaagat

SEQ ID NO: 717983 - DNA, 13 bp, C. elegans
gagttcatttttt

SEQ ID NO: 717984 - DNA, 13 bp, C. elegans
gagttcgaaaaat

SEQ ID NO: 717985 - DNA, 13 bp, C. elegans
gagttgttcaaac

SEQ ID NO: 717986 - DNA, 13 bp, C. elegans
gagtttcaattaa

SEQ ID NO: 717987 - DNA, 13 bp, C. elegans
gagtttccaaaat

SEQ ID NO: 717988 - DNA, 13 bp, C. elegans
gagtttcttcaaa

SEQ ID NO: 717989 - DNA, 13 bp, C. elegans
gagtttgaagaaa

SEQ ID NO: 717990 - DNA, 13 bp, C. elegans
gagtttggaaatt

SEQ ID NO: 717991 - DNA, 13 bp, C. elegans
gagtttgttgaag

SEQ ID NO: 717992 - DNA, 13 bp, C. elegans
gagttttaaattt

SEQ ID NO: 717993 - DNA, 13 bp, C. elegans
gagttttaggcat

SEQ ID NO: 717994 - DNA, 13 bp, C. elegans
gagttttagtcat

SEQ ID NO: 717995 - DNA, 13 bp, C. elegans
gagttttatttga

SEQ ID NO: 717996 - DNA, 13 bp, C. elegans
gagttttcaataa

SEQ ID NO: 717997 - DNA, 13 bp, C. elegans
gagttttcaattt

SEQ ID NO: 717998 - DNA, 13 bp, C. elegans
gagttttcagaca

SEQ ID NO: 717999 - DNA, 13 bp, C. elegans
gagttttcgagaa

SEQ ID NO: 718000 - DNA, 13 bp, C. elegans
gagttttctcaat

SEQ ID NO: 718001 - DNA, 13 bp, C. elegans
gagttttctcttc

SEQ ID NO: 718002 - DNA, 13 bp, C. elegans
gagttttcttatt

SEQ ID NO: 718003 - DNA, 13 bp, C. elegans
gagttttgaacaa

SEQ ID NO: 718004 - DNA, 13 bp, C. elegans
gagttttgaattt

SEQ ID NO: 718005 - DNA, 13 bp, C. elegans
gagttttggaaaa

SEQ ID NO: 718006 - DNA, 13 bp, C. elegans
gagttttgtcagt

SEQ ID NO: 718007 - DNA, 13 bp, C. elegans
gagtttttgagaa

SEQ ID NO: 718008 - DNA, 13 bp, C. elegans
gagtttttgggct

SEQ ID NO: 718009 - DNA, 13 bp, C. elegans
gagttttttatgg

SEQ ID NO: 718010 - DNA, 13 bp, C. elegans
gagttttttccaa

SEQ ID NO: 718011 - DNA, 13 bp, C. elegans
gagttttttgaat

SEQ ID NO: 718012 - DNA, 13 bp, C. elegans
gataaaaaggcgg

SEQ ID NO: 718013 - DNA, 13 bp, C. elegans
gataaaaatcaat

SEQ ID NO: 718014 - DNA, 13 bp, C. elegans
gataaaaattcaa

SEQ ID NO: 718015 - DNA, 13 bp, C. elegans
gataaaaattgga

SEQ ID NO: 718016 - DNA, 13 bp, C. elegans
gataaaatcaaag

SEQ ID NO: 718017 - DNA, 13 bp, C. elegans
gataaaatctcaa

SEQ ID NO: 718018 - DNA, 13 bp, C. elegans
gataaaattgtaa

SEQ ID NO: 718019 - DNA, 13 bp, C. elegans
gataaacttgaaa

SEQ ID NO: 718020 - DNA, 13 bp, C. elegans
gataaataattga

SEQ ID NO: 718021 - DNA, 13 bp, C. elegans
gataaatacattt

SEQ ID NO: 718022 - DNA, 13 bp, C. elegans
gataaatattcaa

SEQ ID NO: 718023 - DNA, 13 bp, C. elegans
gataaatcgaaaa

SEQ ID NO: 718024 - DNA, 13 bp, C. elegans
gataaatgaatga

SEQ ID NO: 718025 - DNA, 13 bp, C. elegans
gataaattcagaa

SEQ ID NO: 718026 - DNA, 13 bp, C. elegans
gataaattcatta

SEQ ID NO: 718027 - DNA, 13 bp, C. elegans
gataaattcgaaa

SEQ ID NO: 718028 - DNA, 13 bp, C. elegans
gataaattctttt

SEQ ID NO: 718029 - DNA, 13 bp, C. elegans
gataaatttcaaa

SEQ ID NO: 718030 - DNA, 13 bp, C. elegans
gataaccgatttt

SEQ ID NO: 718031 - DNA, 13 bp, C. elegans
gataacttttttt

SEQ ID NO: 718032 - DNA, 13 bp, C. elegans
gataagaaggatc

SEQ ID NO: 718033 - DNA, 13 bp, C. elegans
gataagttttatt

SEQ ID NO: 718034 - DNA, 13 bp, C. elegans
gataatcaacttg

SEQ ID NO: 718035 - DNA, 13 bp, C. elegans
gataatcaataaa

SEQ ID NO: 718036 - DNA, 13 bp, C. elegans
gataatgaaaatt

SEQ ID NO: 718037 - DNA, 13 bp, C. elegans
gataatgataatg

SEQ ID NO: 718038 - DNA, 13 bp, C. elegans
gataatgtttcaa

SEQ ID NO: 718039 - DNA, 13 bp, C. elegans
gataattatcgat

SEQ ID NO: 718040 - DNA, 13 bp, C. elegans
gataattcaataa

SEQ ID NO: 718041 - DNA, 13 bp, C. elegans
gataattcaattt

SEQ ID NO: 718042 - DNA, 13 bp, C. elegans
gataattctaaaa

SEQ ID NO: 718043 - DNA, 13 bp, C. elegans
gataattgataat

SEQ ID NO: 718044 - DNA, 13 bp, C. elegans
gataatttattga

SEQ ID NO: 718045 - DNA, 13 bp, C. elegans
gataatttcaatt

SEQ ID NO: 718046 - DNA, 13 bp, C. elegans
gataatttcagaa

SEQ ID NO: 718047 - DNA, 13 bp, C. elegans
gataatttccaaa

SEQ ID NO: 718048 - DNA, 13 bp, C. elegans
gataatttcgaat

SEQ ID NO: 718049 - DNA, 13 bp, C. elegans
gataatttgaatt

SEQ ID NO: 718050 - DNA, 13 bp, C. elegans
gataatttggaaa

SEQ ID NO: 718051 - DNA, 13 bp, C. elegans
gataatttgtaaa

SEQ ID NO: 718052 - DNA, 13 bp, C. elegans
gataatttgtgaa

SEQ ID NO: 718053 - DNA, 13 bp, C. elegans
gataattttgaaa

SEQ ID NO: 718054 - DNA, 13 bp, C. elegans
gataattttgaat

SEQ ID NO: 718055 - DNA, 13 bp, C. elegans
gataattttgata

SEQ ID NO: 718056 - DNA, 13 bp, C. elegans
gataatttttgag

SEQ ID NO: 718057 - DNA, 13 bp, C. elegans
gatacaaattgta

SEQ ID NO: 718058 - DNA, 13 bp, C. elegans
gatacattttcaa

SEQ ID NO: 718059 - DNA, 13 bp, C. elegans
gatacattttcca

SEQ ID NO: 718060 - DNA, 13 bp, C. elegans
gatacccattttc

SEQ ID NO: 718061 - DNA, 13 bp, C. elegans
gatactgtagttt

SEQ ID NO: 718062 - DNA, 13 bp, C. elegans
gatagaaaattga

SEQ ID NO: 718063 - DNA, 14 bp, C. elegans
gataggaatacggt

SEQ ID NO: 718064 - DNA, 13 bp, C. elegans
gatataaaatgtt

SEQ ID NO: 718065 - DNA, 13 bp, C. elegans
gatataatttttc

SEQ ID NO: 718066 - DNA, 13 bp, C. elegans
gatatacatactt

SEQ ID NO: 718067 - DNA, 13 bp, C. elegans
gatatagctgttt

SEQ ID NO: 718068 - DNA, 13 bp, C. elegans
gatatagttttat

SEQ ID NO: 718069 - DNA, 13 bp, C. elegans
gatatatgtatat

SEQ ID NO: 718070 - DNA, 13 bp, C. elegans
gatatattttcaa

SEQ ID NO: 718071 - DNA, 13 bp, C. elegans
gatatattttcca

SEQ ID NO: 718072 - DNA, 13 bp, C. elegans
gatatcaattttc

SEQ ID NO: 718073 - DNA, 13 bp, C. elegans
gatatcataataa

SEQ ID NO: 718074 - DNA, 13 bp, C. elegans
gatatcatatttt

SEQ ID NO: 718075 - DNA, 13 bp, C. elegans
gatatccactttt

SEQ ID NO: 718076 - DNA, 13 bp, C. elegans
gatatctctaaaa

SEQ ID NO: 718077 - DNA, 13 bp, C. elegans
gatatctctattc

SEQ ID NO: 718078 - DNA, 13 bp, C. elegans
gatatgaatgcac

SEQ ID NO: 718079 - DNA, 13 bp, C. elegans
gatatgcttccaa

SEQ ID NO: 718080 - DNA, 13 bp, C. elegans
gatatggcgattt

SEQ ID NO: 718081 - DNA, 13 bp, C. elegans
gatatgtatattt

SEQ ID NO: 718082 - DNA, 13 bp, C. elegans
gatatgtttgtgt

SEQ ID NO: 718083 - DNA, 13 bp, C. elegans
gatattacaaaaa

SEQ ID NO: 718084 - DNA, 13 bp, C. elegans
gatattcaaatga

SEQ ID NO: 718085 - DNA, 13 bp, C. elegans
gatattcaattat

SEQ ID NO: 718086 - DNA, 13 bp, C. elegans
gatattcagaaaa

SEQ ID NO: 718087 - DNA, 13 bp, C. elegans
gatattcagaaat

SEQ ID NO: 718088 - DNA, 13 bp, C. elegans
gatattcagacaa

SEQ ID NO: 718089 - DNA, 13 bp, C. elegans
gatattccaagtt

SEQ ID NO: 718090 - DNA, 13 bp, C. elegans
gatattcggaaaa

SEQ ID NO: 718091 - DNA, 13 bp, C. elegans
gatattcgtgttt

SEQ ID NO: 718092 - DNA, 13 bp, C. elegans
gatattctcaaaa

SEQ ID NO: 718093 - DNA, 13 bp, C. elegans
gatattgaaaaag

SEQ ID NO: 718094 - DNA, 13 bp, C. elegans
gatattgaatttt

SEQ ID NO: 718095 - DNA, 13 bp, C. elegans
gatattggcaaaa

SEQ ID NO: 718096 - DNA, 13 bp, C. elegans
gatattggtttga

SEQ ID NO: 718097 - DNA, 13 bp, C. elegans
gatattgttgtaa

SEQ ID NO: 718098 - DNA, 13 bp, C. elegans
gatatttcaaaaa

SEQ ID NO: 718099 - DNA, 13 bp, C. elegans
gatatttcatatt

SEQ ID NO: 718100 - DNA, 13 bp, C. elegans
gatatttcatttt

SEQ ID NO: 718101 - DNA, 13 bp, C. elegans
gatatttcgaaaa

SEQ ID NO: 718102 - DNA, 14 bp, C. elegans
gatatttcgagagc

SEQ ID NO: 718103 - DNA, 13 bp, C. elegans
gatatttgaatat

SEQ ID NO: 718104 - DNA, 13 bp, C. elegans
gatatttgcaaaa

SEQ ID NO: 718105 - DNA, 13 bp, C. elegans
gatatttggattt

SEQ ID NO: 718106 - DNA, 13 bp, C. elegans
gatatttgtttga

SEQ ID NO: 718107 - DNA, 13 bp, C. elegans
gatattttatttc

SEQ ID NO: 718108 - DNA, 13 bp, C. elegans
gatattttcaatt

SEQ ID NO: 718109 - DNA, 13 bp, C. elegans
gatattttccaaa

SEQ ID NO: 718110 - DNA, 13 bp, C. elegans
gatattttgaaaa

SEQ ID NO: 718111 - DNA, 13 bp, C. elegans
gatattttgaaga

SEQ ID NO: 718112 - DNA, 13 bp, C. elegans
gatattttgatgt

SEQ ID NO: 718113 - DNA, 13 bp, C. elegans
gatattttgtaaa

SEQ ID NO: 718114 - DNA, 13 bp, C. elegans
gatatttttagag

SEQ ID NO: 718115 - DNA, 13 bp, C. elegans
gatatttttctat

SEQ ID NO: 718116 - DNA, 13 bp, C. elegans
gatatttttcttg

SEQ ID NO: 718117 - DNA, 13 bp, C. elegans
gatatttttgaat

SEQ ID NO: 718118 - DNA, 13 bp, C. elegans
gatcaaaaatcaa

SEQ ID NO: 718119 - DNA, 13 bp, C. elegans
gatcaaaaatcga

SEQ ID NO: 718120 - DNA, 13 bp, C. elegans
gatcaaaacgaaa

SEQ ID NO: 718121 - DNA, 13 bp, C. elegans
gatcaaaactcaa

SEQ ID NO: 718122 - DNA, 13 bp, C. elegans
gatcaaaatcaaa

SEQ ID NO: 718123 - DNA, 13 bp, C. elegans
gatcaaaatgtga

SEQ ID NO: 718124 - DNA, 13 bp, C. elegans
gatcaaacaattt

SEQ ID NO: 718125 - DNA, 13 bp, C. elegans
gatcaaacagtaa

SEQ ID NO: 718126 - DNA, 13 bp, C. elegans
gatcaaaccaaaa

SEQ ID NO: 718127 - DNA, 13 bp, C. elegans
gatcaaactgtaa

SEQ ID NO: 718128 - DNA, 13 bp, C. elegans
gatcaaacttcaa

SEQ ID NO: 718129 - DNA, 13 bp, C. elegans
gatcaaagcaaaa

SEQ ID NO: 718130 - DNA, 13 bp, C. elegans
gatcaaagcgaaa

SEQ ID NO: 718131 - DNA, 13 bp, C. elegans
gatcaaagttcaa

SEQ ID NO: 718132 - DNA, 13 bp, C. elegans
gatcaaatcaaaa

SEQ ID NO: 718133 - DNA, 13 bp, C. elegans
gatcaaattttga

SEQ ID NO: 718134 - DNA, 13 bp, C. elegans
gatcaagccgaaa

SEQ ID NO: 718135 - DNA, 13 bp, C. elegans
gatcaagtcaagg

SEQ ID NO: 718136 - DNA, 13 bp, C. elegans
gatcaattaaaga

SEQ ID NO: 718137 - DNA, 13 bp, C. elegans
gatcacatccact

SEQ ID NO: 718138 - DNA, 13 bp, C. elegans
gatcaccggaaga

SEQ ID NO: 718139 - DNA, 13 bp, C. elegans
gatcactgaaata

SEQ ID NO: 718140 - DNA, 13 bp, C. elegans
gatcagaaaacaa

SEQ ID NO: 718141 - DNA, 13 bp, C. elegans
gatcagaaaatat

SEQ ID NO: 718142 - DNA, 13 bp, C. elegans
gatcagcttgtga

SEQ ID NO: 718143 - DNA, 13 bp, C. elegans
gatcagtttcaaa

SEQ ID NO: 718144 - DNA, 13 bp, C. elegans
gatcagtttgata

SEQ ID NO: 718145 - DNA, 13 bp, C. elegans
gatcatcaggagg

SEQ ID NO: 718146 - DNA, 13 bp, C. elegans
gatcatctttttt

SEQ ID NO: 718147 - DNA, 13 bp, C. elegans
gatcatggtgcat

SEQ ID NO: 718148 - DNA, 13 bp, C. elegans
gatcattcagctc

SEQ ID NO: 718149 - DNA, 13 bp, C. elegans
gatcatttttctt

SEQ ID NO: 718150 - DNA, 13 bp, C. elegans
gatcatttttgaa

SEQ ID NO: 718151 - DNA, 13 bp, C. elegans
gatccaaaacaac

SEQ ID NO: 718152 - DNA, 13 bp, C. elegans
gatccgacgacga

SEQ ID NO: 718153 - DNA, 13 bp, C. elegans
gatccgagaagcc

SEQ ID NO: 718154 - DNA, 13 bp, C. elegans
gatccggaaaacg

SEQ ID NO: 718155 - DNA, 13 bp, C. elegans
gatcctttccaaa

SEQ ID NO: 718156 - DNA, 13 bp, C. elegans
gatcgaatttttt

SEQ ID NO: 718157 - DNA, 13 bp, C. elegans
gatcgattgataa

SEQ ID NO: 718158 - DNA, 13 bp, C. elegans
gatcgcacaaaaa

SEQ ID NO: 718159 - DNA, 13 bp, C. elegans
gatcgggatggat

SEQ ID NO: 718160 - DNA, 13 bp, C. elegans
gatcgtggtgaga

SEQ ID NO: 718161 - DNA, 13 bp, C. elegans
gatctacaaaaat

SEQ ID NO: 718162 - DNA, 13 bp, C. elegans
gatctacaaaaca

SEQ ID NO: 718163 - DNA, 13 bp, C. elegans
gatctacagaaaa

SEQ ID NO: 718164 - DNA, 13 bp, C. elegans
gatctacctagat

SEQ ID NO: 718165 - DNA, 13 bp, C. elegans
gatctacgaaaaa

SEQ ID NO: 718166 - DNA, 13 bp, C. elegans
gatctacgagaat

SEQ ID NO: 718167 - DNA, 13 bp, C. elegans
gatctagtttttg

SEQ ID NO: 718168 - DNA, 13 bp, C. elegans
gatctcaaaagtt

SEQ ID NO: 718169 - DNA, 13 bp, C. elegans
gatctcaaaataa

SEQ ID NO: 718170 - DNA, 13 bp, C. elegans
gatctcaaaatat

SEQ ID NO: 718171 - DNA, 13 bp, C. elegans
gatctcaccacga

SEQ ID NO: 718172 - DNA, 13 bp, C. elegans
gatctctcaaaaa

SEQ ID NO: 718173 - DNA, 13 bp, C. elegans
gatctctccaaaa

SEQ ID NO: 718174 - DNA, 13 bp, C. elegans
gatctctgaaatt

SEQ ID NO: 718175 - DNA, 13 bp, C. elegans
gatctgaaaaatg

SEQ ID NO: 718176 - DNA, 13 bp, C. elegans
gatctgatttttt

SEQ ID NO: 718177 - DNA, 13 bp, C. elegans
gatcttccagcta

SEQ ID NO: 718178 - DNA, 13 bp, C. elegans
gatcttcgaaaat

SEQ ID NO: 718179 - DNA, 13 bp, C. elegans
gatcttcttttcg

SEQ ID NO: 718180 - DNA, 13 bp, C. elegans
gatctttaaaaaa

SEQ ID NO: 718181 - DNA, 13 bp, C. elegans
gatctttgagagc

SEQ ID NO: 718182 - DNA, 13 bp, C. elegans
gatctttgtaaaa

SEQ ID NO: 718183 - DNA, 13 bp, C. elegans
gatcttttgattt

SEQ ID NO: 718184 - DNA, 13 bp, C. elegans
gatctttttttaa

SEQ ID NO: 718185 - DNA, 13 bp, C. elegans
gatgaaaaagtga

SEQ ID NO: 718186 - DNA, 13 bp, C. elegans
gatgaaaatcaca

SEQ ID NO: 718187 - DNA, 13 bp, C. elegans
gatgaaaatcgaa

SEQ ID NO: 718188 - DNA, 13 bp, C. elegans
gatgaaacttctt

SEQ ID NO: 718189 - DNA, 13 bp, C. elegans
gatgaaatgaatc

SEQ ID NO: 718190 - DNA, 13 bp, C. elegans
gatgaaattatcg

SEQ ID NO: 718191 - DNA, 13 bp, C. elegans
gatgaagaagacg

SEQ ID NO: 718192 - DNA, 13 bp, C. elegans
gatgaagtttcaa

SEQ ID NO: 718193 - DNA, 13 bp, C. elegans
gatgaataaaatt

SEQ ID NO: 718194 - DNA, 13 bp, C. elegans
gatgaatattgtg

SEQ ID NO: 718195 - DNA, 13 bp, C. elegans
gatgaatattttc

SEQ ID NO: 718196 - DNA, 13 bp, C. elegans
gatgaatgtgaaa

SEQ ID NO: 718197 - DNA, 13 bp, C. elegans
gatgaatttccaa

SEQ ID NO: 718198 - DNA, 13 bp, C. elegans
gatgaatttctaa

SEQ ID NO: 718199 - DNA, 13 bp, C. elegans
gatgaatttgcaa

SEQ ID NO: 718200 - DNA, 13 bp, C. elegans
gatgaattttcaa

SEQ ID NO: 718201 - DNA, 13 bp, C. elegans
gatgacgatgatg

SEQ ID NO: 718202 - DNA, 13 bp, C. elegans
gatgacgatggaa

SEQ ID NO: 718203 - DNA, 13 bp, C. elegans
gatgacgtcacaa

SEQ ID NO: 718204 - DNA, 13 bp, C. elegans
gatgacgtcacat

SEQ ID NO: 718205 - DNA, 13 bp, C. elegans
gatgacgtcatca

SEQ ID NO: 718206 - DNA, 13 bp, C. elegans
gatgacgtcattt

SEQ ID NO: 718207 - DNA, 13 bp, C. elegans
gatgagaaaaatg

SEQ ID NO: 718208 - DNA, 13 bp, C. elegans
gatgagatggtga

SEQ ID NO: 718209 - DNA, 13 bp, C. elegans
gatgatgaagaag

SEQ ID NO: 718210 - DNA, 13 bp, C. elegans
gatgatgataatg

SEQ ID NO: 718211 - DNA, 13 bp, C. elegans
gatgatgatgaca

SEQ ID NO: 718212 - DNA, 13 bp, C. elegans
gatgatgatgagg

SEQ ID NO: 718213 - DNA, 13 bp, C. elegans
gatgatgatgatg

SEQ ID NO: 718214 - DNA, 13 bp, C. elegans
gatgatgatgatt

SEQ ID NO: 718215 - DNA, 13 bp, C. elegans
gatgatgatggtg

SEQ ID NO: 718216 - DNA, 13 bp, C. elegans
gatgatgcaagtg

SEQ ID NO: 718217 - DNA, 13 bp, C. elegans
gatgatggtggtg

SEQ ID NO: 718218 - DNA, 13 bp, C. elegans
gatgatgttgatg

SEQ ID NO: 718219 - DNA, 13 bp, C. elegans
gatgattcaaaaa

SEQ ID NO: 718220 - DNA, 13 bp, C. elegans
gatgattctagaa

SEQ ID NO: 718221 - DNA, 13 bp, C. elegans
gatgattgcaaca

SEQ ID NO: 718222 - DNA, 13 bp, C. elegans
gatgatttgaaaa

SEQ ID NO: 718223 - DNA, 13 bp, C. elegans
gatgatttgtatg

SEQ ID NO: 718224 - DNA, 13 bp, C. elegans
gatgcaagcgcgc

SEQ ID NO: 718225 - DNA, 13 bp, C. elegans
gatgcaagtgaat

SEQ ID NO: 718226 - DNA, 13 bp, C. elegans
gatgcaatactaa

SEQ ID NO: 718227 - DNA, 13 bp, C. elegans
gatgcaccatgag

SEQ ID NO: 718228 - DNA, 14 bp, C. elegans
gatgctccgatgtt

SEQ ID NO: 718229 - DNA, 14 bp, C. elegans
gatgctcgtgaagt

SEQ ID NO: 718230 - DNA, 13 bp, C. elegans
gatgctgaaagta

SEQ ID NO: 718231 - DNA, 13 bp, C. elegans
gatgctgaaatta

SEQ ID NO: 718232 - DNA, 13 bp, C. elegans
gatgctgaagcta

SEQ ID NO: 718233 - DNA, 13 bp, C. elegans
gatggaaaactga

SEQ ID NO: 718234 - DNA, 13 bp, C. elegans
gatggaaattgaa

SEQ ID NO: 718235 - DNA, 15 bp, C. elegans
gatggagtcgaagtg

SEQ ID NO: 718236 - DNA, 13 bp, C. elegans
gatggccaaaaaa

SEQ ID NO: 718237 - DNA, 13 bp, C. elegans
gatggccgaaagg

SEQ ID NO: 718238 - DNA, 13 bp, C. elegans
gatggctgaaaaa

SEQ ID NO: 718239 - DNA, 13 bp, C. elegans
gatggctttttca

SEQ ID NO: 718240 - DNA, 13 bp, C. elegans
gatgggtctcgac

SEQ ID NO: 718241 - DNA, 13 bp, C. elegans
gatgggtcttacc

SEQ ID NO: 718242 - DNA, 13 bp, C. elegans
gatgtaccacttg

SEQ ID NO: 718243 - DNA, 13 bp, C. elegans
gatgtattcgaat

SEQ ID NO: 718244 - DNA, 13 bp, C. elegans
gatgtcacatttt

SEQ ID NO: 718245 - DNA, 13 bp, C. elegans
gatgtccaattgg

SEQ ID NO: 718246 - DNA, 13 bp, C. elegans
gatgtccattttc

SEQ ID NO: 718247 - DNA, 13 bp, C. elegans
gatgtcccattac

SEQ ID NO: 718248 - DNA, 13 bp, C. elegans
gatgtccttttaa

SEQ ID NO: 718249 - DNA, 13 bp, C. elegans
gatgtcggttgct

SEQ ID NO: 718250 - DNA, 13 bp, C. elegans
gatgtggaattcg

SEQ ID NO: 718251 - DNA, 13 bp, C. elegans
gatgttatagaaa

SEQ ID NO: 718252 - DNA, 13 bp, C. elegans
gatgttcaaaatt

SEQ ID NO: 718253 - DNA, 13 bp, C. elegans
gatgttccaaaaa

SEQ ID NO: 718254 - DNA, 13 bp, C. elegans
gatgttcgatgga

SEQ ID NO: 718255 - DNA, 13 bp, C. elegans
gatgtttcagttt

SEQ ID NO: 718256 - DNA, 13 bp, C. elegans
gatgttttaaatt

SEQ ID NO: 718257 - DNA, 13 bp, C. elegans
gatgttttagaat

SEQ ID NO: 718258 - DNA, 13 bp, C. elegans
gatgttttcaaga

SEQ ID NO: 718259 - DNA, 13 bp, C. elegans
gatgttttccatt

SEQ ID NO: 718260 - DNA, 13 bp, C. elegans
gatgtttttcaaa

SEQ ID NO: 718261 - DNA, 13 bp, C. elegans
gattaaaataaac

SEQ ID NO: 718262 - DNA, 13 bp, C. elegans
gattaaaattgaa

SEQ ID NO: 718263 - DNA, 22 bp, C. elegans
gattaaaggacgatccgttctt

SEQ ID NO: 718264 - DNA, 30 bp, C. elegans
gattaaaggacgatccgttcttcaagtgct

SEQ ID NO: 718265 - DNA, 42 bp, C. elegans
gattaaaggacgatccgttcttcaagtgctatgcactgcgga

SEQ ID NO: 718266 - DNA, 13 bp, C. elegans
gattaaaggatta

SEQ ID NO: 718267 - DNA, 13 bp, C. elegans
gattaacaaaata

SEQ ID NO: 718268 - DNA, 13 bp, C. elegans
gattaactattga

SEQ ID NO: 718269 - DNA, 13 bp, C. elegans
gattaataaatga

SEQ ID NO: 718270 - DNA, 13 bp, C. elegans
gattacggtagtc

SEQ ID NO: 718271 - DNA, 13 bp, C. elegans
gattactgtaaat

SEQ ID NO: 718272 - DNA, 13 bp, C. elegans
gattactgtactt

SEQ ID NO: 718273 - DNA, 13 bp, C. elegans
gattactgtagat

SEQ ID NO: 718274 - DNA, 13 bp, C. elegans
gattactgtagcc

SEQ ID NO: 718275 - DNA, 13 bp, C. elegans
gattactgtattt

SEQ ID NO: 718276 - DNA, 13 bp, C. elegans
gattatcgatttt

SEQ ID NO: 718277 - DNA, 13 bp, C. elegans
gattattatcaat

SEQ ID NO: 718278 - DNA, 13 bp, C. elegans
gattattcaattt

SEQ ID NO: 718279 - DNA, 13 bp, C. elegans
gattattctgaaa

SEQ ID NO: 718280 - DNA, 13 bp, C. elegans
gattattggaaaa

SEQ ID NO: 718281 - DNA, 13 bp, C. elegans
gattattggagtt

SEQ ID NO: 718282 - DNA, 13 bp, C. elegans
gattattgtagga

SEQ ID NO: 718283 - DNA, 13 bp, C. elegans
gattatttcgaaa

SEQ ID NO: 718284 - DNA, 13 bp, C. elegans
gattattttattc

SEQ ID NO: 718285 - DNA, 13 bp, C. elegans
gattattttcaga

SEQ ID NO: 718286 - DNA, 13 bp, C. elegans
gattatttttcaa

SEQ ID NO: 718287 - DNA, 13 bp, C. elegans
gattcaaaaagtt

SEQ ID NO: 718288 - DNA, 13 bp, C. elegans
gattcaaaacatt

SEQ ID NO: 718289 - DNA, 13 bp, C. elegans
gattcaaatttga

SEQ ID NO: 718290 - DNA, 13 bp, C. elegans
gattcaatttcaa

SEQ ID NO: 718291 - DNA, 13 bp, C. elegans
gattcagaaaaga

SEQ ID NO: 718292 - DNA, 13 bp, C. elegans
gattcagaatata

SEQ ID NO: 718293 - DNA, 13 bp, C. elegans
gattcattcaaaa

SEQ ID NO: 718294 - DNA, 13 bp, C. elegans
gattcattgtttt

SEQ ID NO: 718295 - DNA, 13 bp, C. elegans
gattccaaaaact

SEQ ID NO: 718296 - DNA, 13 bp, C. elegans
gattccatcaaaa

SEQ ID NO: 718297 - DNA, 13 bp, C. elegans
gattcgaaaaaaa

SEQ ID NO: 718298 - DNA, 13 bp, C. elegans
gattcgcacgaat

SEQ ID NO: 718299 - DNA, 13 bp, C. elegans
gattcgccccgcc

SEQ ID NO: 718300 - DNA, 13 bp, C. elegans
gattcgccggaaa

SEQ ID NO: 718301 - DNA, 13 bp, C. elegans
gattctaaaaatt

SEQ ID NO: 718302 - DNA, 13 bp, C. elegans
gattctcaaacta

SEQ ID NO: 718303 - DNA, 13 bp, C. elegans
gattctcactttt

SEQ ID NO: 718304 - DNA, 13 bp, C. elegans
gattctctggaaa

SEQ ID NO: 718305 - DNA, 13 bp, C. elegans
gattcttatcaaa

SEQ ID NO: 718306 - DNA, 13 bp, C. elegans
gattcttcttctt

SEQ ID NO: 718307 - DNA, 13 bp, C. elegans
gattctttaaaaa

SEQ ID NO: 718308 - DNA, 13 bp, C. elegans
gattctttccgcc

SEQ ID NO: 718309 - DNA, 13 bp, C. elegans
gattctttgattt

SEQ ID NO: 718310 - DNA, 13 bp, C. elegans
gattgaaaataat

SEQ ID NO: 718311 - DNA, 13 bp, C. elegans
gattgaaattgaa

SEQ ID NO: 718312 - DNA, 13 bp, C. elegans
gattgaatttgaa

SEQ ID NO: 718313 - DNA, 13 bp, C. elegans
gattgacaaaaaa

SEQ ID NO: 718314 - DNA, 13 bp, C. elegans
gattgataagaaa

SEQ ID NO: 718315 - DNA, 13 bp, C. elegans
gattgataataat

SEQ ID NO: 718316 - DNA, 13 bp, C. elegans
gattgatcaattt

SEQ ID NO: 718317 - DNA, 13 bp, C. elegans
gattgatctacgt

SEQ ID NO: 718318 - DNA, 13 bp, C. elegans
gattgatttgaaa

SEQ ID NO: 718319 - DNA, 13 bp, C. elegans
gattgatttgatt

SEQ ID NO: 718320 - DNA, 13 bp, C. elegans
gattggaaaaacg

SEQ ID NO: 718321 - DNA, 13 bp, C. elegans
gattggaaaataa

SEQ ID NO: 718322 - DNA, 13 bp, C. elegans
gattggagctctt

SEQ ID NO: 718323 - DNA, 13 bp, C. elegans
gattggttcgaaa

SEQ ID NO: 718324 - DNA, 13 bp, C. elegans
gattggttggaaa

SEQ ID NO: 718325 - DNA, 13 bp, C. elegans
gattggtttttaa

SEQ ID NO: 718326 - DNA, 13 bp, C. elegans
gattgtaattgca

SEQ ID NO: 718327 - DNA, 13 bp, C. elegans
gattgtattttca

SEQ ID NO: 718328 - DNA, 13 bp, C. elegans
gatttaactgaaa

SEQ ID NO: 718329 - DNA, 13 bp, C. elegans
gatttacaaaata

SEQ ID NO: 718330 - DNA, 13 bp, C. elegans
gatttacaatttt

SEQ ID NO: 718331 - DNA, 13 bp, C. elegans
gatttacaggagc

SEQ ID NO: 718332 - DNA, 13 bp, C. elegans
gatttaccaaatt

SEQ ID NO: 718333 - DNA, 13 bp, C. elegans
gatttacgagaat

SEQ ID NO: 718334 - DNA, 13 bp, C. elegans
gatttacgagatt

SEQ ID NO: 718335 - DNA, 21 bp, C. elegans
gatttacggcgcgttgcgtgt

SEQ ID NO: 718336 - DNA, 13 bp, C. elegans
gatttatcaaaaa

SEQ ID NO: 718337 - DNA, 13 bp, C. elegans
gatttatcgattt

SEQ ID NO: 718338 - DNA, 13 bp, C. elegans
gatttatcggaaa

SEQ ID NO: 718339 - DNA, 13 bp, C. elegans
gatttatctgaaa

SEQ ID NO: 718340 - DNA, 13 bp, C. elegans
gatttatgaataa

SEQ ID NO: 718341 - DNA, 13 bp, C. elegans
gatttatgagaaa

SEQ ID NO: 718342 - DNA, 13 bp, C. elegans
gatttatgcaaaa

SEQ ID NO: 718343 - DNA, 13 bp, C. elegans
gatttatgggctc

SEQ ID NO: 718344 - DNA, 13 bp, C. elegans
gatttattcgaaa

SEQ ID NO: 718345 - DNA, 13 bp, C. elegans
gatttattgcttt

SEQ ID NO: 718346 - DNA, 13 bp, C. elegans
gatttatttcatt

SEQ ID NO: 718347 - DNA, 13 bp, C. elegans
gatttcaaaaaag

SEQ ID NO: 718348 - DNA, 13 bp, C. elegans
gatttcaaaaata

SEQ ID NO: 718349 - DNA, 13 bp, C. elegans
gatttcaaagttt

SEQ ID NO: 718350 - DNA, 13 bp, C. elegans
gatttcaaataat

SEQ ID NO: 718351 - DNA, 13 bp, C. elegans
gatttcaaatcaa

SEQ ID NO: 718352 - DNA, 13 bp, C. elegans
gatttcaaattaa

SEQ ID NO: 718353 - DNA, 13 bp, C. elegans
gatttcaaatttt

SEQ ID NO: 718354 - DNA, 13 bp, C. elegans
gatttcaacaaaa

SEQ ID NO: 718355 - DNA, 13 bp, C. elegans
gatttcaactaca

SEQ ID NO: 718356 - DNA, 13 bp, C. elegans
gatttcaatattt

SEQ ID NO: 718357 - DNA, 13 bp, C. elegans
gatttcagaaaaa

SEQ ID NO: 718358 - DNA, 13 bp, C. elegans
gatttcagaagtt

SEQ ID NO: 718359 - DNA, 13 bp, C. elegans
gatttcagttgta

SEQ ID NO: 718360 - DNA, 13 bp, C. elegans
gatttcatatttt

SEQ ID NO: 718361 - DNA, 13 bp, C. elegans
gatttccaaaatt

SEQ ID NO: 718362 - DNA, 13 bp, C. elegans
gatttccaaactt

SEQ ID NO: 718363 - DNA, 13 bp, C. elegans
gatttccaagaaa

SEQ ID NO: 718364 - DNA, 13 bp, C. elegans
gatttccagaatt

SEQ ID NO: 718365 - DNA, 13 bp, C. elegans
gatttcccggaaa

SEQ ID NO: 718366 - DNA, 13 bp, C. elegans
gatttccttaaaa

SEQ ID NO: 718367 - DNA, 13 bp, C. elegans
gatttcgcaattt

SEQ ID NO: 718368 - DNA, 13 bp, C. elegans
gatttctaaaatt

SEQ ID NO: 718369 - DNA, 13 bp, C. elegans
gatttctcagaaa

SEQ ID NO: 718370 - DNA, 13 bp, C. elegans
gatttctcatcaa

SEQ ID NO: 718371 - DNA, 13 bp, C. elegans
gatttctcgaaaa

SEQ ID NO: 718372 - DNA, 13 bp, C. elegans
gatttctcgattt

SEQ ID NO: 718373 - DNA, 13 bp, C. elegans
gatttctcgtttt

SEQ ID NO: 718374 - DNA, 13 bp, C. elegans
gatttctctaaaa

SEQ ID NO: 718375 - DNA, 13 bp, C. elegans
gatttctggaatt

SEQ ID NO: 718376 - DNA, 13 bp, C. elegans
gatttctgtcaaa

SEQ ID NO: 718377 - DNA, 13 bp, C. elegans
gatttcttcattt

SEQ ID NO: 718378 - DNA, 13 bp, C. elegans
gatttcttctccc

SEQ ID NO: 718379 - DNA, 13 bp, C. elegans
gatttcttttaat

SEQ ID NO: 718380 - DNA, 13 bp, C. elegans
gatttgaaaatga

SEQ ID NO: 718381 - DNA, 13 bp, C. elegans
gatttgaaaattt

SEQ ID NO: 718382 - DNA, 13 bp, C. elegans
gatttgaaacttt

SEQ ID NO: 718383 - DNA, 13 bp, C. elegans
gatttgaaagaaa

SEQ ID NO: 718384 - DNA, 13 bp, C. elegans
gatttgaaataaa

SEQ ID NO: 718385 - DNA, 13 bp, C. elegans
gatttgaaatttt

SEQ ID NO: 718386 - DNA, 13 bp, C. elegans
gatttgaagaaaa

SEQ ID NO: 718387 - DNA, 13 bp, C. elegans
gatttgaagaaca

SEQ ID NO: 718388 - DNA, 13 bp, C. elegans
gatttgaatgaaa

SEQ ID NO: 718389 - DNA, 13 bp, C. elegans
gatttgacgacaa

SEQ ID NO: 718390 - DNA, 13 bp, C. elegans
gatttgagaatta

SEQ ID NO: 718391 - DNA, 13 bp, C. elegans
gatttgataattt

SEQ ID NO: 718392 - DNA, 13 bp, C. elegans
gatttgatctacg

SEQ ID NO: 718393 - DNA, 13 bp, C. elegans
gatttgatcttca

SEQ ID NO: 718394 - DNA, 13 bp, C. elegans
gatttgatgaaaa

SEQ ID NO: 718395 - DNA, 13 bp, C. elegans
gatttgcaagaaa

SEQ ID NO: 718396 - DNA, 13 bp, C. elegans
gatttgcaataaa

SEQ ID NO: 718397 - DNA, 13 bp, C. elegans
gatttgccaaaat

SEQ ID NO: 718398 - DNA, 13 bp, C. elegans
gatttgccagaaa

SEQ ID NO: 718399 - DNA, 13 bp, C. elegans
gatttgccagaat

SEQ ID NO: 718400 - DNA, 13 bp, C. elegans
gatttgccgaaat

SEQ ID NO: 718401 - DNA, 13 bp, C. elegans
gatttgccgattt

SEQ ID NO: 718402 - DNA, 13 bp, C. elegans
gatttgccgcaaa

SEQ ID NO: 718403 - DNA, 13 bp, C. elegans
gatttgccggttt

SEQ ID NO: 718404 - DNA, 13 bp, C. elegans
gatttgctccatc

SEQ ID NO: 718405 - DNA, 13 bp, C. elegans
gatttgctggaaa

SEQ ID NO: 718406 - DNA, 13 bp, C. elegans
gatttggattttg

SEQ ID NO: 718407 - DNA, 13 bp, C. elegans
gatttggcgaatt

SEQ ID NO: 718408 - DNA, 13 bp, C. elegans
gatttggcttagg

SEQ ID NO: 718409 - DNA, 13 bp, C. elegans
gatttggtaaaac

SEQ ID NO: 718410 - DNA, 13 bp, C. elegans
gatttggttaaaa

SEQ ID NO: 718411 - DNA, 13 bp, C. elegans
gatttgtaaaaaa

SEQ ID NO: 718412 - DNA, 13 bp, C. elegans
gatttgtaaattt

SEQ ID NO: 718413 - DNA, 13 bp, C. elegans
gatttgtcagaaa

SEQ ID NO: 718414 - DNA, 13 bp, C. elegans
gatttgtcgacaa

SEQ ID NO: 718415 - DNA, 13 bp, C. elegans
gatttgtcggaaa

SEQ ID NO: 718416 - DNA, 13 bp, C. elegans
gatttgtgaaatt

SEQ ID NO: 718417 - DNA, 13 bp, C. elegans
gatttgttcaatt

SEQ ID NO: 718418 - DNA, 13 bp, C. elegans
gatttgttgaaaa

SEQ ID NO: 718419 - DNA, 13 bp, C. elegans
gatttgtttcaat

SEQ ID NO: 718420 - DNA, 13 bp, C. elegans
gatttgttttaaa

SEQ ID NO: 718421 - DNA, 13 bp, C. elegans
gatttgttttcta

SEQ ID NO: 718422 - DNA, 13 bp, C. elegans
gattttaaagaaa

SEQ ID NO: 718423 - DNA, 13 bp, C. elegans
gattttaacataa

SEQ ID NO: 718424 - DNA, 13 bp, C. elegans
gattttaagattt

SEQ ID NO: 718425 - DNA, 13 bp, C. elegans
gattttaatcaat

SEQ ID NO: 718426 - DNA, 13 bp, C. elegans
gattttaattgta

SEQ ID NO: 718427 - DNA, 13 bp, C. elegans
gattttacagttt

SEQ ID NO: 718428 - DNA, 13 bp, C. elegans
gattttactattt

SEQ ID NO: 718429 - DNA, 13 bp, C. elegans
gattttatagaaa

SEQ ID NO: 718430 - DNA, 13 bp, C. elegans
gattttatcgaaa

SEQ ID NO: 718431 - DNA, 13 bp, C. elegans
gattttatttgaa

SEQ ID NO: 718432 - DNA, 13 bp, C. elegans
gattttcaaaaat

SEQ ID NO: 718433 - DNA, 13 bp, C. elegans
gattttcaaaatt

SEQ ID NO: 718434 - DNA, 13 bp, C. elegans
gattttcaaagaa

SEQ ID NO: 718435 - DNA, 13 bp, C. elegans
gattttcaaatct

SEQ ID NO: 718436 - DNA, 13 bp, C. elegans
gattttcaactga

SEQ ID NO: 718437 - DNA, 13 bp, C. elegans
gattttcaacttt

SEQ ID NO: 718438 - DNA, 13 bp, C. elegans
gattttcaagaaa

SEQ ID NO: 718439 - DNA, 13 bp, C. elegans
gattttcaagcaa

SEQ ID NO: 718440 - DNA, 13 bp, C. elegans
gattttcaatatt

SEQ ID NO: 718441 - DNA, 13 bp, C. elegans
gattttcacattt

SEQ ID NO: 718442 - DNA, 13 bp, C. elegans
gattttcacgatt

SEQ ID NO: 718443 - DNA, 13 bp, C. elegans
gattttcagaatt

SEQ ID NO: 718444 - DNA, 13 bp, C. elegans
gattttcagacaa

SEQ ID NO: 718445 - DNA, 13 bp, C. elegans
gattttcagctaa

SEQ ID NO: 718446 - DNA, 13 bp, C. elegans
gattttcagtatt

SEQ ID NO: 718447 - DNA, 13 bp, C. elegans
gattttcagttga

SEQ ID NO: 718448 - DNA, 13 bp, C. elegans
gattttcagtttt

SEQ ID NO: 718449 - DNA, 13 bp, C. elegans
gattttcatcaat

SEQ ID NO: 718450 - DNA, 13 bp, C. elegans
gattttcattatt

SEQ ID NO: 718451 - DNA, 13 bp, C. elegans
gattttcattgaa

SEQ ID NO: 718452 - DNA, 13 bp, C. elegans
gattttcatttgc

SEQ ID NO: 718453 - DNA, 13 bp, C. elegans
gattttcattttc

SEQ ID NO: 718454 - DNA, 13 bp, C. elegans
gattttccaaatt

SEQ ID NO: 718455 - DNA, 13 bp, C. elegans
gattttccactaa

SEQ ID NO: 718456 - DNA, 13 bp, C. elegans
gattttccaggaa

SEQ ID NO: 718457 - DNA, 13 bp, C. elegans
gattttccgaaaa

SEQ ID NO: 718458 - DNA, 13 bp, C. elegans
gattttccgaatt

SEQ ID NO: 718459 - DNA, 13 bp, C. elegans
gattttccgattt

SEQ ID NO: 718460 - DNA, 13 bp, C. elegans
gattttccggaag

SEQ ID NO: 718461 - DNA, 13 bp, C. elegans
gattttcctaatt

SEQ ID NO: 718462 - DNA, 13 bp, C. elegans
gattttcctattt

SEQ ID NO: 718463 - DNA, 13 bp, C. elegans
gattttcctcttt

SEQ ID NO: 718464 - DNA, 13 bp, C. elegans
gattttcgaaaaa

SEQ ID NO: 718465 - DNA, 13 bp, C. elegans
gattttcgaagaa

SEQ ID NO: 718466 - DNA, 13 bp, C. elegans
gattttcgagaaa

SEQ ID NO: 718467 - DNA, 13 bp, C. elegans
gattttcgatgtt

SEQ ID NO: 718468 - DNA, 13 bp, C. elegans
gattttcgcaaaa

SEQ ID NO: 718469 - DNA, 13 bp, C. elegans
gattttcgcattt

SEQ ID NO: 718470 - DNA, 13 bp, C. elegans
gattttcggcaaa

SEQ ID NO: 718471 - DNA, 13 bp, C. elegans
gattttcggtgaa

SEQ ID NO: 718472 - DNA, 13 bp, C. elegans
gattttcgtattt

SEQ ID NO: 718473 - DNA, 13 bp, C. elegans
gattttctaattt

SEQ ID NO: 718474 - DNA, 13 bp, C. elegans
gattttctagttt

SEQ ID NO: 718475 - DNA, 13 bp, C. elegans
gattttctatcaa

SEQ ID NO: 718476 - DNA, 13 bp, C. elegans
gattttctcaaca

SEQ ID NO: 718477 - DNA, 13 bp, C. elegans
gattttctcaatt

SEQ ID NO: 718478 - DNA, 13 bp, C. elegans
gattttctgaaaa

SEQ ID NO: 718479 - DNA, 13 bp, C. elegans
gattttctgaagt

SEQ ID NO: 718480 - DNA, 13 bp, C. elegans
gattttctgcatt

SEQ ID NO: 718481 - DNA, 13 bp, C. elegans
gattttctggaaa

SEQ ID NO: 718482 - DNA, 13 bp, C. elegans
gattttctggcaa

SEQ ID NO: 718483 - DNA, 13 bp, C. elegans
gattttcttaaaa

SEQ ID NO: 718484 - DNA, 13 bp, C. elegans
gattttcttcaat

SEQ ID NO: 718485 - DNA, 13 bp, C. elegans
gattttcttccaa

SEQ ID NO: 718486 - DNA, 13 bp, C. elegans
gattttcttcgtt

SEQ ID NO: 718487 - DNA, 13 bp, C. elegans
gattttcttgatt

SEQ ID NO: 718488 - DNA, 13 bp, C. elegans
gattttctttaat

SEQ ID NO: 718489 - DNA, 13 bp, C. elegans
gattttctttgaa

SEQ ID NO: 718490 - DNA, 13 bp, C. elegans
gattttcttttaa

SEQ ID NO: 718491 - DNA, 13 bp, C. elegans
gattttgaaaact

SEQ ID NO: 718492 - DNA, 13 bp, C. elegans
gattttgaaaatt

SEQ ID NO: 718493 - DNA, 13 bp, C. elegans
gattttgaataat

SEQ ID NO: 718494 - DNA, 13 bp, C. elegans
gattttgagaaat

SEQ ID NO: 718495 - DNA, 13 bp, C. elegans
gattttgagagaa

SEQ ID NO: 718496 - DNA, 13 bp, C. elegans
gattttgataaga

SEQ ID NO: 718497 - DNA, 13 bp, C. elegans
gattttgatgaaa

SEQ ID NO: 718498 - DNA, 13 bp, C. elegans
gattttgatgaat

SEQ ID NO: 718499 - DNA, 13 bp, C. elegans
gattttgatgaga

SEQ ID NO: 718500 - DNA, 13 bp, C. elegans
gattttgatgatt

SEQ ID NO: 718501 - DNA, 13 bp, C. elegans
gattttgatttaa

SEQ ID NO: 718502 - DNA, 13 bp, C. elegans
gattttgcattaa

SEQ ID NO: 718503 - DNA, 13 bp, C. elegans
gattttgctgaaa

SEQ ID NO: 718504 - DNA, 13 bp, C. elegans
gattttggaaaaa

SEQ ID NO: 718505 - DNA, 13 bp, C. elegans
gattttggaaatg

SEQ ID NO: 718506 - DNA, 13 bp, C. elegans
gattttggaagaa

SEQ ID NO: 718507 - DNA, 13 bp, C. elegans
gattttggaattt

SEQ ID NO: 718508 - DNA, 13 bp, C. elegans
gattttggagatg

SEQ ID NO: 718509 - DNA, 13 bp, C. elegans
gattttggaggaa

SEQ ID NO: 718510 - DNA, 13 bp, C. elegans
gattttggattaa

SEQ ID NO: 718511 - DNA, 13 bp, C. elegans
gattttggattta

SEQ ID NO: 718512 - DNA, 13 bp, C. elegans
gattttggccgat

SEQ ID NO: 718513 - DNA, 13 bp, C. elegans
gattttggtcaaa

SEQ ID NO: 718514 - DNA, 13 bp, C. elegans
gattttggttcaa

SEQ ID NO: 718515 - DNA, 13 bp, C. elegans
gattttgtaaatg

SEQ ID NO: 718516 - DNA, 13 bp, C. elegans
gattttgtagaaa

SEQ ID NO: 718517 - DNA, 13 bp, C. elegans
gattttgttcact

SEQ ID NO: 718518 - DNA, 13 bp, C. elegans
gattttgttgaaa

SEQ ID NO: 718519 - DNA, 13 bp, C. elegans
gattttgttgaga

SEQ ID NO: 718520 - DNA, 13 bp, C. elegans
gattttgtttaaa

SEQ ID NO: 718521 - DNA, 13 bp, C. elegans
gattttgtttgaa

SEQ ID NO: 718522 - DNA, 13 bp, C. elegans
gatttttaaacga

SEQ ID NO: 718523 - DNA, 13 bp, C. elegans
gatttttaagaaa

SEQ ID NO: 718524 - DNA, 13 bp, C. elegans
gatttttaagcta

SEQ ID NO: 718525 - DNA, 13 bp, C. elegans
gatttttaatcaa

SEQ ID NO: 718526 - DNA, 13 bp, C. elegans
gatttttaattca

SEQ ID NO: 718527 - DNA, 13 bp, C. elegans
gatttttaattga

SEQ ID NO: 718528 - DNA, 13 bp, C. elegans
gatttttactgaa

SEQ ID NO: 718529 - DNA, 13 bp, C. elegans
gatttttaggcca

SEQ ID NO: 718530 - DNA, 13 bp, C. elegans
gatttttatagaa

SEQ ID NO: 718531 - DNA, 13 bp, C. elegans
gatttttatgaaa

SEQ ID NO: 718532 - DNA, 13 bp, C. elegans
gatttttatggaa

SEQ ID NO: 718533 - DNA, 13 bp, C. elegans
gatttttatgtaa

SEQ ID NO: 718534 - DNA, 13 bp, C. elegans
gatttttattgaa

SEQ ID NO: 718535 - DNA, 13 bp, C. elegans
gatttttatttca

SEQ ID NO: 718536 - DNA, 13 bp, C. elegans
gatttttcaaaaa

SEQ ID NO: 718537 - DNA, 13 bp, C. elegans
gatttttcaaaat

SEQ ID NO: 718538 - DNA, 13 bp, C. elegans
gatttttcaaagc

SEQ ID NO: 718539 - DNA, 13 bp, C. elegans
gatttttcaacaa

SEQ ID NO: 718540 - DNA, 13 bp, C. elegans
gatttttcaagaa

SEQ ID NO: 718541 - DNA, 13 bp, C. elegans
gatttttcaagag

SEQ ID NO: 718542 - DNA, 13 bp, C. elegans
gatttttcaagga

SEQ ID NO: 718543 - DNA, 13 bp, C. elegans
gatttttcaattc

SEQ ID NO: 718544 - DNA, 13 bp, C. elegans
gatttttcaattt

SEQ ID NO: 718545 - DNA, 13 bp, C. elegans
gatttttcacatt

SEQ ID NO: 718546 - DNA, 13 bp, C. elegans
gatttttcagatt

SEQ ID NO: 718547 - DNA, 13 bp, C. elegans
gatttttcaggaa

SEQ ID NO: 718548 - DNA, 13 bp, C. elegans
gatttttcataat

SEQ ID NO: 718549 - DNA, 13 bp, C. elegans
gatttttcatcaa

SEQ ID NO: 718550 - DNA, 13 bp, C. elegans
gatttttcatgtt

SEQ ID NO: 718551 - DNA, 13 bp, C. elegans
gatttttcattaa

SEQ ID NO: 718552 - DNA, 13 bp, C. elegans
gatttttcattga

SEQ ID NO: 718553 - DNA, 13 bp, C. elegans
gatttttccaaga

SEQ ID NO: 718554 - DNA, 13 bp, C. elegans
gatttttccaatt

SEQ ID NO: 718555 - DNA, 13 bp, C. elegans
gatttttccattt

SEQ ID NO: 718556 - DNA, 14 bp, C. elegans
gatttttcccgttt

SEQ ID NO: 718557 - DNA, 13 bp, C. elegans
gatttttcgacaa

SEQ ID NO: 718558 - DNA, 13 bp, C. elegans
gatttttcgattt

SEQ ID NO: 718559 - DNA, 13 bp, C. elegans
gatttttcgcttt

SEQ ID NO: 718560 - DNA, 13 bp, C. elegans
gatttttcggatt

SEQ ID NO: 718561 - DNA, 13 bp, C. elegans
gatttttcgtgtt

SEQ ID NO: 718562 - DNA, 13 bp, C. elegans
gatttttctaatt

SEQ ID NO: 718563 - DNA, 13 bp, C. elegans
gatttttctagaa

SEQ ID NO: 718564 - DNA, 13 bp, C. elegans
gatttttctagat

SEQ ID NO: 718565 - DNA, 13 bp, C. elegans
gatttttctataa

SEQ ID NO: 718566 - DNA, 13 bp, C. elegans
gatttttctatat

SEQ ID NO: 718567 - DNA, 13 bp, C. elegans
gatttttctcatt

SEQ ID NO: 718568 - DNA, 13 bp, C. elegans
gatttttctgatt

SEQ ID NO: 718569 - DNA, 13 bp, C. elegans
gatttttctttaa

SEQ ID NO: 718570 - DNA, 13 bp, C. elegans
gatttttctttca

SEQ ID NO: 718571 - DNA, 13 bp, C. elegans
gatttttgaaaaa

SEQ ID NO: 718572 - DNA, 13 bp, C. elegans
gatttttgaaaat

SEQ ID NO: 718573 - DNA, 13 bp, C. elegans
gatttttgaaatt

SEQ ID NO: 718574 - DNA, 13 bp, C. elegans
gatttttgaacaa

SEQ ID NO: 718575 - DNA, 13 bp, C. elegans
gatttttgacaaa

SEQ ID NO: 718576 - DNA, 13 bp, C. elegans
gatttttgagatt

SEQ ID NO: 718577 - DNA, 13 bp, C. elegans
gatttttgatata

SEQ ID NO: 718578 - DNA, 13 bp, C. elegans
gatttttgattca

SEQ ID NO: 718579 - DNA, 13 bp, C. elegans
gatttttgcaaaa

SEQ ID NO: 718580 - DNA, 13 bp, C. elegans
gatttttgcccaa

SEQ ID NO: 718581 - DNA, 13 bp, C. elegans
gatttttgcgatt

SEQ ID NO: 718582 - DNA, 13 bp, C. elegans
gatttttgcttga

SEQ ID NO: 718583 - DNA, 13 bp, C. elegans
gatttttggaaaa

SEQ ID NO: 718584 - DNA, 13 bp, C. elegans
gatttttggcaat

SEQ ID NO: 718585 - DNA, 13 bp, C. elegans
gatttttggtaaa

SEQ ID NO: 718586 - DNA, 13 bp, C. elegans
gatttttgtcaaa

SEQ ID NO: 718587 - DNA, 13 bp, C. elegans
gatttttgtcgaa

SEQ ID NO: 718588 - DNA, 13 bp, C. elegans
gatttttgtgaaa

SEQ ID NO: 718589 - DNA, 13 bp, C. elegans
gatttttgtgcaa

SEQ ID NO: 718590 - DNA, 13 bp, C. elegans
gatttttgtggaa

SEQ ID NO: 718591 - DNA, 13 bp, C. elegans
gattttttaaact

SEQ ID NO: 718592 - DNA, 13 bp, C. elegans
gattttttcgaaa

SEQ ID NO: 718593 - DNA, 13 bp, C. elegans
gattttttcggaa

SEQ ID NO: 718594 - DNA, 13 bp, C. elegans
gattttttcggtt

SEQ ID NO: 718595 - DNA, 13 bp, C. elegans
gattttttcgtgt

SEQ ID NO: 718596 - DNA, 13 bp, C. elegans
gattttttgaaaa

SEQ ID NO: 718597 - DNA, 13 bp, C. elegans
gattttttgacaa

SEQ ID NO: 718598 - DNA, 13 bp, C. elegans
gattttttgccca

SEQ ID NO: 718599 - DNA, 13 bp, C. elegans
gattttttgcgat

SEQ ID NO: 718600 - DNA, 13 bp, C. elegans
gattttttggaaa

SEQ ID NO: 718601 - DNA, 13 bp, C. elegans
gattttttgtaaa

SEQ ID NO: 718602 - DNA, 13 bp, C. elegans
gattttttgtgaa

SEQ ID NO: 718603 - DNA, 13 bp, C. elegans
gattttttgtgga

SEQ ID NO: 718604 - DNA, 13 bp, C. elegans
gatttttttagaa

SEQ ID NO: 718605 - DNA, 13 bp, C. elegans
gatttttttccaa

SEQ ID NO: 718606 - DNA, 13 bp, C. elegans
gatttttttctaa

SEQ ID NO: 718607 - DNA, 13 bp, C. elegans
gatttttttggaa

SEQ ID NO: 718608 - DNA, 13 bp, C. elegans
gattttttttccg

SEQ ID NO: 718609 - DNA, 14 bp, C. elegans
gattttttttcgaa

SEQ ID NO: 718610 - DNA, 13 bp, C. elegans
gcaaaaaaacctt

SEQ ID NO: 718611 - DNA, 13 bp, C. elegans
gcaaaaaagtgtg

SEQ ID NO: 718612 - DNA, 13 bp, C. elegans
gcaaaaaatattt

SEQ ID NO: 718613 - DNA, 13 bp, C. elegans
gcaaaaaatcaag

SEQ ID NO: 718614 - DNA, 13 bp, C. elegans
gcaaaaaatcgaa

SEQ ID NO: 718615 - DNA, 13 bp, C. elegans
gcaaaaaatggaa

SEQ ID NO: 718616 - DNA, 13 bp, C. elegans
gcaaaaaatgtac

SEQ ID NO: 718617 - DNA, 13 bp, C. elegans
gcaaaaaattatt

SEQ ID NO: 718618 - DNA, 13 bp, C. elegans
gcaaaaagaaatt

SEQ ID NO: 718619 - DNA, 13 bp, C. elegans
gcaaaaaggtttc

SEQ ID NO: 718620 - DNA, 13 bp, C. elegans
gcaaaaagttgaa

SEQ ID NO: 718621 - DNA, 13 bp, C. elegans
gcaaaaatagatg

SEQ ID NO: 718622 - DNA, 13 bp, C. elegans
gcaaaaatcaaag

SEQ ID NO: 718623 - DNA, 13 bp, C. elegans
gcaaaaatcaata

SEQ ID NO: 718624 - DNA, 13 bp, C. elegans
gcaaaaatcgcaa

SEQ ID NO: 718625 - DNA, 13 bp, C. elegans
gcaaaaatctcaa

SEQ ID NO: 718626 - DNA, 13 bp, C. elegans
gcaaaaatctcga

SEQ ID NO: 718627 - DNA, 13 bp, C. elegans
gcaaaaatgccaa

SEQ ID NO: 718628 - DNA, 13 bp, C. elegans
gcaaaaatggaat

SEQ ID NO: 718629 - DNA, 13 bp, C. elegans
gcaaaaattaaat

SEQ ID NO: 718630 - DNA, 13 bp, C. elegans
gcaaaaattaaca

SEQ ID NO: 718631 - DNA, 13 bp, C. elegans
gcaaaaattgaat

SEQ ID NO: 718632 - DNA, 13 bp, C. elegans
gcaaaaattgttt

SEQ ID NO: 718633 - DNA, 13 bp, C. elegans
gcaaaaatttcaa

SEQ ID NO: 718634 - DNA, 13 bp, C. elegans
gcaaaaattttga

SEQ ID NO: 718635 - DNA, 13 bp, C. elegans
gcaaaacaattta

SEQ ID NO: 718636 - DNA, 13 bp, C. elegans
gcaaaacgtgttg

SEQ ID NO: 718637 - DNA, 13 bp, C. elegans
gcaaaacttcaaa

SEQ ID NO: 718638 - DNA, 13 bp, C. elegans
gcaaaacttgaaa

SEQ ID NO: 718639 - DNA, 13 bp, C. elegans
gcaaaacttgaat

SEQ ID NO: 718640 - DNA, 13 bp, C. elegans
gcaaaagctcaaa

SEQ ID NO: 718641 - DNA, 13 bp, C. elegans
gcaaaagttcggc

SEQ ID NO: 718642 - DNA, 13 bp, C. elegans
gcaaaatatcttg

SEQ ID NO: 718643 - DNA, 13 bp, C. elegans
gcaaaatattatt

SEQ ID NO: 718644 - DNA, 13 bp, C. elegans
gcaaaatattcaa

SEQ ID NO: 718645 - DNA, 13 bp, C. elegans
gcaaaatcaaaat

SEQ ID NO: 718646 - DNA, 13 bp, C. elegans
gcaaaatcgattt

SEQ ID NO: 718647 - DNA, 13 bp, C. elegans
gcaaaatgccaaa

SEQ ID NO: 718648 - DNA, 13 bp, C. elegans
gcaaaatggcaaa

SEQ ID NO: 718649 - DNA, 13 bp, C. elegans
gcaaaatgtatta

SEQ ID NO: 718650 - DNA, 13 bp, C. elegans
gcaaaatgtattt

SEQ ID NO: 718651 - DNA, 13 bp, C. elegans
gcaaaatgtgcaa

SEQ ID NO: 718652 - DNA, 13 bp, C. elegans
gcaaaatgtgttg

SEQ ID NO: 718653 - DNA, 13 bp, C. elegans
gcaaaatgttgga

SEQ ID NO: 718654 - DNA, 13 bp, C. elegans
gcaaaatgtttct

SEQ ID NO: 718655 - DNA, 13 bp, C. elegans
gcaaaatgttttt

SEQ ID NO: 718656 - DNA, 13 bp, C. elegans
gcaaaattacgct

SEQ ID NO: 718657 - DNA, 13 bp, C. elegans
gcaaaattcacaa

SEQ ID NO: 718658 - DNA, 13 bp, C. elegans
gcaaaattcacat

SEQ ID NO: 718659 - DNA, 13 bp, C. elegans
gcaaaattctcta

SEQ ID NO: 718660 - DNA, 13 bp, C. elegans
gcaaaattggcaa

SEQ ID NO: 718661 - DNA, 13 bp, C. elegans
gcaaaattgtcaa

SEQ ID NO: 718662 - DNA, 13 bp, C. elegans
gcaaaatttcgca

SEQ ID NO: 718663 - DNA, 13 bp, C. elegans
gcaaaatttttaa

SEQ ID NO: 718664 - DNA, 13 bp, C. elegans
gcaaacaatttga

SEQ ID NO: 718665 - DNA, 13 bp, C. elegans
gcaaacacgctcc

SEQ ID NO: 718666 - DNA, 13 bp, C. elegans
gcaaacgattttt

SEQ ID NO: 718667 - DNA, 13 bp, C. elegans
gcaaacgcacaaa

SEQ ID NO: 718668 - DNA, 13 bp, C. elegans
gcaaacgcgctcc

SEQ ID NO: 718669 - DNA, 13 bp, C. elegans
gcaaacgcgctct

SEQ ID NO: 718670 - DNA, 13 bp, C. elegans
gcaaacggaaaat

SEQ ID NO: 718671 - DNA, 13 bp, C. elegans
gcaaacggcaaaa

SEQ ID NO: 718672 - DNA, 13 bp, C. elegans
gcaaactgccaaa

SEQ ID NO: 718673 - DNA, 13 bp, C. elegans
gcaaactggcaat

SEQ ID NO: 718674 - DNA, 13 bp, C. elegans
gcaaacttcaaaa

SEQ ID NO: 718675 - DNA, 13 bp, C. elegans
gcaaactttcaat

SEQ ID NO: 718676 - DNA, 13 bp, C. elegans
gcaaagaaaattg

SEQ ID NO: 718677 - DNA, 13 bp, C. elegans
gcaaagcggcaaa

SEQ ID NO: 718678 - DNA, 13 bp, C. elegans
gcaaagtgatcaa

SEQ ID NO: 718679 - DNA, 13 bp, C. elegans
gcaaagttcaaaa

SEQ ID NO: 718680 - DNA, 13 bp, C. elegans
gcaaagttctcaa

SEQ ID NO: 718681 - DNA, 13 bp, C. elegans
gcaaataatttat

SEQ ID NO: 718682 - DNA, 13 bp, C. elegans
gcaaataggaaaa

SEQ ID NO: 718683 - DNA, 13 bp, C. elegans
gcaaatatatttt

SEQ ID NO: 718684 - DNA, 13 bp, C. elegans
gcaaatatcatca

SEQ ID NO: 718685 - DNA, 13 bp, C. elegans
gcaaatattcaaa

SEQ ID NO: 718686 - DNA, 13 bp, C. elegans
gcaaatattgaaa

SEQ ID NO: 718687 - DNA, 13 bp, C. elegans
gcaaatattttaa

SEQ ID NO: 718688 - DNA, 13 bp, C. elegans
gcaaatcagaaat

SEQ ID NO: 718689 - DNA, 13 bp, C. elegans
gcaaatcagcaaa

SEQ ID NO: 718690 - DNA, 13 bp, C. elegans
gcaaatcagcaag

SEQ ID NO: 718691 - DNA, 13 bp, C. elegans
gcaaatcagctaa

SEQ ID NO: 718692 - DNA, 13 bp, C. elegans
gcaaatccgcaaa

SEQ ID NO: 718693 - DNA, 13 bp, C. elegans
gcaaatcgatttt

SEQ ID NO: 718694 - DNA, 13 bp, C. elegans
gcaaatcgccaat

SEQ ID NO: 718695 - DNA, 13 bp, C. elegans
gcaaatcgccgaa

SEQ ID NO: 718696 - DNA, 13 bp, C. elegans
gcaaatcggaaaa

SEQ ID NO: 718697 - DNA, 13 bp, C. elegans
gcaaatcgtcaat

SEQ ID NO: 718698 - DNA, 13 bp, C. elegans
gcaaatgaaaaat

SEQ ID NO: 718699 - DNA, 13 bp, C. elegans
gcaaatgacaaaa

SEQ ID NO: 718700 - DNA, 13 bp, C. elegans
gcaaatgcataca

SEQ ID NO: 718701 - DNA, 13 bp, C. elegans
gcaaatgcgctct

SEQ ID NO: 718702 - DNA, 13 bp, C. elegans
gcaaatggaaaaa

SEQ ID NO: 718703 - DNA, 13 bp, C. elegans
gcaaatgggaaaa

SEQ ID NO: 718704 - DNA, 13 bp, C. elegans
gcaaatgggcaaa

SEQ ID NO: 718705 - DNA, 13 bp, C. elegans
gcaaattccaaaa

SEQ ID NO: 718706 - DNA, 13 bp, C. elegans
gcaaattcgacaa

SEQ ID NO: 718707 - DNA, 13 bp, C. elegans
gcaaattcggaaa

SEQ ID NO: 718708 - DNA, 13 bp, C. elegans
gcaaattgaattt

SEQ ID NO: 718709 - DNA, 13 bp, C. elegans
gcaaattgccgat

SEQ ID NO: 718710 - DNA, 13 bp, C. elegans
gcaaattgccggt

SEQ ID NO: 718711 - DNA, 13 bp, C. elegans
gcaaattgtcaaa

SEQ ID NO: 718712 - DNA, 13 bp, C. elegans
gcaaattgtcgga

SEQ ID NO: 718713 - DNA, 13 bp, C. elegans
gcaaattgttcat

SEQ ID NO: 718714 - DNA, 13 bp, C. elegans
gcaaatttcaatt

SEQ ID NO: 718715 - DNA, 13 bp, C. elegans
gcaaatttcattt

SEQ ID NO: 718716 - DNA, 13 bp, C. elegans
gcaaatttccaaa

SEQ ID NO: 718717 - DNA, 13 bp, C. elegans
gcaaatttcttta

SEQ ID NO: 718718 - DNA, 13 bp, C. elegans
gcaaatttgaaag

SEQ ID NO: 718719 - DNA, 13 bp, C. elegans
gcaaatttgaatt

SEQ ID NO: 718720 - DNA, 13 bp, C. elegans
gcaaatttgattt

SEQ ID NO: 718721 - DNA, 13 bp, C. elegans
gcaaattttaatt

SEQ ID NO: 718722 - DNA, 13 bp, C. elegans
gcaaattttcttt

SEQ ID NO: 718723 - DNA, 13 bp, C. elegans
gcaaatttttttg

SEQ ID NO: 718724 - DNA, 13 bp, C. elegans
gcaacaactttga

SEQ ID NO: 718725 - DNA, 13 bp, C. elegans
gcaacagtttttc

SEQ ID NO: 718726 - DNA, 13 bp, C. elegans
gcaacataaatat

SEQ ID NO: 718727 - DNA, 13 bp, C. elegans
gcaacatttttca

SEQ ID NO: 718728 - DNA, 13 bp, C. elegans
gcaacatttttga

SEQ ID NO: 718729 - DNA, 13 bp, C. elegans
gcaacattttttt

SEQ ID NO: 718730 - DNA, 13 bp, C. elegans
gcaaccgacatct

SEQ ID NO: 718731 - DNA, 13 bp, C. elegans
gcaaccggcaatt

SEQ ID NO: 718732 - DNA, 13 bp, C. elegans
gcaacgcagtttt

SEQ ID NO: 718733 - DNA, 13 bp, C. elegans
gcaacgcgaccgc

SEQ ID NO: 718734 - DNA, 13 bp, C. elegans
gcaactatctttt

SEQ ID NO: 718735 - DNA, 13 bp, C. elegans
gcaacttgccgga

SEQ ID NO: 718736 - DNA, 13 bp, C. elegans
gcaactttgaaaa

SEQ ID NO: 718737 - DNA, 13 bp, C. elegans
gcaacttttcaaa

SEQ ID NO: 718738 - DNA, 13 bp, C. elegans
gcaacttttcgaa

SEQ ID NO: 718739 - DNA, 13 bp, C. elegans
gcaactttttgaa

SEQ ID NO: 718740 - DNA, 13 bp, C. elegans
gcaactttttgat

SEQ ID NO: 718741 - DNA, 13 bp, C. elegans
gcaactttttttt

SEQ ID NO: 718742 - DNA, 13 bp, C. elegans
gcaagaaaaacat

SEQ ID NO: 718743 - DNA, 13 bp, C. elegans
gcaagaaaatcga

SEQ ID NO: 718744 - DNA, 13 bp, C. elegans
gcaagaaaatctg

SEQ ID NO: 718745 - DNA, 13 bp, C. elegans
gcaagaaatttca

SEQ ID NO: 718746 - DNA, 19 bp, C. elegans
gcaagacgaataagtgcca

SEQ ID NO: 718747 - DNA, 13 bp, C. elegans
gcaagactttggc

SEQ ID NO: 718748 - DNA, 13 bp, C. elegans
gcaagagaaacga

SEQ ID NO: 718749 - DNA, 13 bp, C. elegans
gcaagcgcgctct

SEQ ID NO: 718750 - DNA, 13 bp, C. elegans
gcaagttccgatg

SEQ ID NO: 718751 - DNA, 13 bp, C. elegans
gcaagtttcaaaa

SEQ ID NO: 718752 - DNA, 13 bp, C. elegans
gcaagtttccaaa

SEQ ID NO: 718753 - DNA, 13 bp, C. elegans
gcaatactaatag

SEQ ID NO: 718754 - DNA, 13 bp, C. elegans
gcaatatgcattc

SEQ ID NO: 718755 - DNA, 13 bp, C. elegans
gcaatatgccaaa

SEQ ID NO: 718756 - DNA, 13 bp, C. elegans
gcaatatgccgaa

SEQ ID NO: 718757 - DNA, 13 bp, C. elegans
gcaatattttggt

SEQ ID NO: 718758 - DNA, 13 bp, C. elegans
gcaatcgcgctcc

SEQ ID NO: 718759 - DNA, 13 bp, C. elegans
gcaatgaactttt

SEQ ID NO: 718760 - DNA, 13 bp, C. elegans
gcaatgaattttt

SEQ ID NO: 718761 - DNA, 15 bp, C. elegans
gcaatgcgccgcacg

SEQ ID NO: 718762 - DNA, 13 bp, C. elegans
gcaatgtgccgga

SEQ ID NO: 718763 - DNA, 13 bp, C. elegans
gcaattaaaagtt

SEQ ID NO: 718764 - DNA, 13 bp, C. elegans
gcaattcaaaaat

SEQ ID NO: 718765 - DNA, 13 bp, C. elegans
gcaattcaatttt

SEQ ID NO: 718766 - DNA, 13 bp, C. elegans
gcaattcattttt

SEQ ID NO: 718767 - DNA, 13 bp, C. elegans
gcaattccggcaa

SEQ ID NO: 718768 - DNA, 13 bp, C. elegans
gcaattcgagatt

SEQ ID NO: 718769 - DNA, 13 bp, C. elegans
gcaattcgccgat

SEQ ID NO: 718770 - DNA, 13 bp, C. elegans
gcaattcggcaaa

SEQ ID NO: 718771 - DNA, 13 bp, C. elegans
gcaattcggcgaa

SEQ ID NO: 718772 - DNA, 13 bp, C. elegans
gcaattctacaaa

SEQ ID NO: 718773 - DNA, 13 bp, C. elegans
gcaattgaaacaa

SEQ ID NO: 718774 - DNA, 13 bp, C. elegans
gcaattgacaatt

SEQ ID NO: 718775 - DNA, 13 bp, C. elegans
gcaattgccgaag

SEQ ID NO: 718776 - DNA, 13 bp, C. elegans
gcaattgctgaaa

SEQ ID NO: 718777 - DNA, 13 bp, C. elegans
gcaattggaaatt

SEQ ID NO: 718778 - DNA, 14 bp, C. elegans
gcaattggcgaatt

SEQ ID NO: 718779 - DNA, 14 bp, C. elegans
gcaattgtcaaaat

SEQ ID NO: 718780 - DNA, 13 bp, C. elegans
gcaatttaatttt

SEQ ID NO: 718781 - DNA, 13 bp, C. elegans
gcaatttatcgat

SEQ ID NO: 718782 - DNA, 13 bp, C. elegans
gcaatttattatt

SEQ ID NO: 718783 - DNA, 13 bp, C. elegans
gcaatttcaaatt

SEQ ID NO: 718784 - DNA, 13 bp, C. elegans
gcaatttcaatca

SEQ ID NO: 718785 - DNA, 13 bp, C. elegans
gcaatttcggaaa

SEQ ID NO: 718786 - DNA, 13 bp, C. elegans
gcaatttctccac

SEQ ID NO: 718787 - DNA, 13 bp, C. elegans
gcaatttgcaaaa

SEQ ID NO: 718788 - DNA, 13 bp, C. elegans
gcaatttgcagaa

SEQ ID NO: 718789 - DNA, 13 bp, C. elegans
gcaatttgcggat

SEQ ID NO: 718790 - DNA, 13 bp, C. elegans
gcaatttgctgat

SEQ ID NO: 718791 - DNA, 13 bp, C. elegans
gcaatttggaatt

SEQ ID NO: 718792 - DNA, 13 bp, C. elegans
gcaatttgtcaat

SEQ ID NO: 718793 - DNA, 13 bp, C. elegans
gcaatttgtcgat

SEQ ID NO: 718794 - DNA, 13 bp, C. elegans
gcaatttgtcggt

SEQ ID NO: 718795 - DNA, 13 bp, C. elegans
gcaattttaatat

SEQ ID NO: 718796 - DNA, 13 bp, C. elegans
gcaattttacaaa

SEQ ID NO: 718797 - DNA, 13 bp, C. elegans
gcaattttcaaat

SEQ ID NO: 718798 - DNA, 13 bp, C. elegans
gcaattttcaact

SEQ ID NO: 718799 - DNA, 13 bp, C. elegans
gcaattttcagaa

SEQ ID NO: 718800 - DNA, 13 bp, C. elegans
gcaattttccaat

SEQ ID NO: 718801 - DNA, 13 bp, C. elegans
gcaattttctgat

SEQ ID NO: 718802 - DNA, 13 bp, C. elegans
gcaattttctgca

SEQ ID NO: 718803 - DNA, 13 bp, C. elegans
gcaattttctgcc

SEQ ID NO: 718804 - DNA, 13 bp, C. elegans
gcaattttgaatt

SEQ ID NO: 718805 - DNA, 13 bp, C. elegans
gcaatttttaatt

SEQ ID NO: 718806 - DNA, 13 bp, C. elegans
gcaatttttatga

SEQ ID NO: 718807 - DNA, 13 bp, C. elegans
gcaatttttcaat

SEQ ID NO: 718808 - DNA, 13 bp, C. elegans
gcaatttttcgat

SEQ ID NO: 718809 - DNA, 14 bp, C. elegans
gcaatttttgaaat

SEQ ID NO: 718810 - DNA, 13 bp, C. elegans
gcaatttttgata

SEQ ID NO: 718811 - DNA, 13 bp, C. elegans
gcaatttttggaa

SEQ ID NO: 718812 - DNA, 13 bp, C. elegans
gcaattttttaat

SEQ ID NO: 718813 - DNA, 13 bp, C. elegans
gcaattttttatt

SEQ ID NO: 718814 - DNA, 13 bp, C. elegans
gcaattttttcaa

SEQ ID NO: 718815 - DNA, 13 bp, C. elegans
gcaattttttgtt

SEQ ID NO: 718816 - DNA, 13 bp, C. elegans
gcaatttttttca

SEQ ID NO: 718817 - DNA, 13 bp, C. elegans
gcaattttttttg

SEQ ID NO: 718818 - DNA, 13 bp, C. elegans
gcacaaaaaattc

SEQ ID NO: 718819 - DNA, 13 bp, C. elegans
gcacaaaattctg

SEQ ID NO: 718820 - DNA, 13 bp, C. elegans
gcacaaattaaaa

SEQ ID NO: 718821 - DNA, 13 bp, C. elegans
gcacaattgcacg

SEQ ID NO: 718822 - DNA, 13 bp, C. elegans
gcacaattttaag

SEQ ID NO: 718823 - DNA, 13 bp, C. elegans
gcacacatcaaaa

SEQ ID NO: 718824 - DNA, 13 bp, C. elegans
gcacacattttcg

SEQ ID NO: 718825 - DNA, 13 bp, C. elegans
gcacaggttttca

SEQ ID NO: 718826 - DNA, 13 bp, C. elegans
gcacatttacttg

SEQ ID NO: 718827 - DNA, 13 bp, C. elegans
gcacatttttcag

SEQ ID NO: 718828 - DNA, 13 bp, C. elegans
gcaccatatttga

SEQ ID NO: 718829 - DNA, 13 bp, C. elegans
gcaccgccaaaaa

SEQ ID NO: 718830 - DNA, 13 bp, C. elegans
gcacctccattag

SEQ ID NO: 718831 - DNA, 29 bp, C. elegans
gcacgcaacgcagcacgcaacgcagcacg

SEQ ID NO: 718832 - DNA, 13 bp, C. elegans
gcacgggagaaaa

SEQ ID NO: 718833 - DNA, 13 bp, C. elegans
gcacgtattttgt

SEQ ID NO: 718834 - DNA, 13 bp, C. elegans
gcactatttgagg

SEQ ID NO: 718835 - DNA, 13 bp, C. elegans
gcactcaatattt

SEQ ID NO: 718836 - DNA, 13 bp, C. elegans
gcactctgacacc

SEQ ID NO: 718837 - DNA, 13 bp, C. elegans
gcactgaccaaaa

SEQ ID NO: 718838 - DNA, 13 bp, C. elegans
gcactgaccaatt

SEQ ID NO: 718839 - DNA, 13 bp, C. elegans
gcactgtgccaaa

SEQ ID NO: 718840 - DNA, 13 bp, C. elegans
gcacttttcaata

SEQ ID NO: 718841 - DNA, 13 bp, C. elegans
gcagaaaaatgcg

SEQ ID NO: 718842 - DNA, 13 bp, C. elegans
gcagaaaattatt

SEQ ID NO: 718843 - DNA, 13 bp, C. elegans
gcagaaattcata

SEQ ID NO: 718844 - DNA, 13 bp, C. elegans
gcagaaattcgaa

SEQ ID NO: 718845 - DNA, 13 bp, C. elegans
gcagaattcaaaa

SEQ ID NO: 718846 - DNA, 13 bp, C. elegans
gcagaattctcaa

SEQ ID NO: 718847 - DNA, 13 bp, C. elegans
gcagaattttcat

SEQ ID NO: 718848 - DNA, 13 bp, C. elegans
gcagacaaaaagt

SEQ ID NO: 718849 - DNA, 13 bp, C. elegans
gcagacatttctc

SEQ ID NO: 718850 - DNA, 13 bp, C. elegans
gcagacttctcaa

SEQ ID NO: 718851 - DNA, 13 bp, C. elegans
gcagagaaacgag

SEQ ID NO: 718852 - DNA, 13 bp, C. elegans
gcagatgctaaaa

SEQ ID NO: 718853 - DNA, 13 bp, C. elegans
gcagcatatgtat

SEQ ID NO: 718854 - DNA, 13 bp, C. elegans
gcagcattagttt

SEQ ID NO: 718855 - DNA, 13 bp, C. elegans
gcagccgacaaaa

SEQ ID NO: 718856 - DNA, 13 bp, C. elegans
gcagccgacactt

SEQ ID NO: 718857 - DNA, 13 bp, C. elegans
gcagccgacatct

SEQ ID NO: 718858 - DNA, 13 bp, C. elegans
gcagccgacattt

SEQ ID NO: 718859 - DNA, 13 bp, C. elegans
gcagccgacgctt

SEQ ID NO: 718860 - DNA, 13 bp, C. elegans
gcagccgacgttt

SEQ ID NO: 718861 - DNA, 13 bp, C. elegans
gcagcggttggaa

SEQ ID NO: 718862 - DNA, 13 bp, C. elegans
gcagctaaatttt

SEQ ID NO: 718863 - DNA, 13 bp, C. elegans
gcaggcaggcata

SEQ ID NO: 718864 - DNA, 13 bp, C. elegans
gcaggtttgccga

SEQ ID NO: 718865 - DNA, 13 bp, C. elegans
gcagtcaaaaagt

SEQ ID NO: 718866 - DNA, 13 bp, C. elegans
gcagtccatgaca

SEQ ID NO: 718867 - DNA, 14 bp, C. elegans
gcagtctctattag

SEQ ID NO: 718868 - DNA, 13 bp, C. elegans
gcagtgaaagtgg

SEQ ID NO: 718869 - DNA, 13 bp, C. elegans
gcagtgccaaact

SEQ ID NO: 718870 - DNA, 13 bp, C. elegans
gcagtttgcagat

SEQ ID NO: 718871 - DNA, 13 bp, C. elegans
gcatacttttttg

SEQ ID NO: 718872 - DNA, 13 bp, C. elegans
gcatatgaagaat

SEQ ID NO: 718873 - DNA, 13 bp, C. elegans
gcatattgccggt

SEQ ID NO: 718874 - DNA, 13 bp, C. elegans
gcatatttatcat

SEQ ID NO: 718875 - DNA, 13 bp, C. elegans
gcatcaaaatagc

SEQ ID NO: 718876 - DNA, 13 bp, C. elegans
gcatcaaattttg

SEQ ID NO: 718877 - DNA, 13 bp, C. elegans
gcatcatcaacat

SEQ ID NO: 718878 - DNA, 13 bp, C. elegans
gcatccaattttg

SEQ ID NO: 718879 - DNA, 13 bp, C. elegans
gcatggatttatt

SEQ ID NO: 718880 - DNA, 13 bp, C. elegans
gcattatcttttt

SEQ ID NO: 718881 - DNA, 13 bp, C. elegans
gcattatttttat

SEQ ID NO: 718882 - DNA, 13 bp, C. elegans
gcattcaattttg

SEQ ID NO: 718883 - DNA, 13 bp, C. elegans
gcattcggcattc

SEQ ID NO: 718884 - DNA, 13 bp, C. elegans
gcattctccgaat

SEQ ID NO: 718885 - DNA, 13 bp, C. elegans
gcattctcggaat

SEQ ID NO: 718886 - DNA, 13 bp, C. elegans
gcattgaaacctg

SEQ ID NO: 718887 - DNA, 13 bp, C. elegans
gcattgtagtttc

SEQ ID NO: 718888 - DNA, 13 bp, C. elegans
gcatttaaaattt

SEQ ID NO: 718889 - DNA, 13 bp, C. elegans
gcatttaattttg

SEQ ID NO: 718890 - DNA, 13 bp, C. elegans
gcatttattgatt

SEQ ID NO: 718891 - DNA, 13 bp, C. elegans
gcatttcaaaaga

SEQ ID NO: 718892 - DNA, 13 bp, C. elegans
gcatttgaagaaa

SEQ ID NO: 718893 - DNA, 13 bp, C. elegans
gcatttgagaaaa

SEQ ID NO: 718894 - DNA, 13 bp, C. elegans
gcattttatttga

SEQ ID NO: 718895 - DNA, 13 bp, C. elegans
gcattttcagtta

SEQ ID NO: 718896 - DNA, 13 bp, C. elegans
gcattttcatcaa

SEQ ID NO: 718897 - DNA, 13 bp, C. elegans
gcattttccaaaa

SEQ ID NO: 718898 - DNA, 13 bp, C. elegans
gcattttcggcat

SEQ ID NO: 718899 - DNA, 13 bp, C. elegans
gcattttctggta

SEQ ID NO: 718900 - DNA, 13 bp, C. elegans
gcattttgaagaa

SEQ ID NO: 718901 - DNA, 13 bp, C. elegans
gcatttttaaatt

SEQ ID NO: 718902 - DNA, 13 bp, C. elegans
gcatttttaatga

SEQ ID NO: 718903 - DNA, 13 bp, C. elegans
gcatttttattct

SEQ ID NO: 718904 - DNA, 13 bp, C. elegans
gcatttttcaaaa

SEQ ID NO: 718905 - DNA, 13 bp, C. elegans
gcatttttctaca

SEQ ID NO: 718906 - DNA, 13 bp, C. elegans
gcatttttcttga

SEQ ID NO: 718907 - DNA, 13 bp, C. elegans
gcatttttgacaa

SEQ ID NO: 718908 - DNA, 13 bp, C. elegans
gcatttttgcgtg

SEQ ID NO: 718909 - DNA, 13 bp, C. elegans
gcatttttggata

SEQ ID NO: 718910 - DNA, 13 bp, C. elegans
gcattttttgcat

SEQ ID NO: 718911 - DNA, 13 bp, C. elegans
gcattttttggcc

SEQ ID NO: 718912 - DNA, 13 bp, C. elegans
gcattttttggga

SEQ ID NO: 718913 - DNA, 13 bp, C. elegans
gcattttttgtat

SEQ ID NO: 718914 - DNA, 13 bp, C. elegans
gcattttttttca

SEQ ID NO: 718915 - DNA, 13 bp, C. elegans
gccaaaaaaatat

SEQ ID NO: 718916 - DNA, 13 bp, C. elegans
gccaaaaagtggc

SEQ ID NO: 718917 - DNA, 13 bp, C. elegans
gccaaaaatagaa

SEQ ID NO: 718918 - DNA, 13 bp, C. elegans
gccaaaaatatgg

SEQ ID NO: 718919 - DNA, 13 bp, C. elegans
gccaaaaatgaaa

SEQ ID NO: 718920 - DNA, 13 bp, C. elegans
gccaaaaatgttt

SEQ ID NO: 718921 - DNA, 13 bp, C. elegans
gccaaaaattcga

SEQ ID NO: 718922 - DNA, 13 bp, C. elegans
gccaaaaattgtt

SEQ ID NO: 718923 - DNA, 13 bp, C. elegans
gccaaaaattttg

SEQ ID NO: 718924 - DNA, 13 bp, C. elegans
gccaaaactgaaa

SEQ ID NO: 718925 - DNA, 13 bp, C. elegans
gccaaaacttcaa

SEQ ID NO: 718926 - DNA, 13 bp, C. elegans
gccaaaatattga

SEQ ID NO: 718927 - DNA, 13 bp, C. elegans
gccaaaatcaaaa

SEQ ID NO: 718928 - DNA, 13 bp, C. elegans
gccaaaatgaaaa

SEQ ID NO: 718929 - DNA, 13 bp, C. elegans
gccaaaattggca

SEQ ID NO: 718930 - DNA, 13 bp, C. elegans
gccaaaatttctt

SEQ ID NO: 718931 - DNA, 13 bp, C. elegans
gccaaaattttga

SEQ ID NO: 718932 - DNA, 13 bp, C. elegans
gccaaaatttttt

SEQ ID NO: 718933 - DNA, 13 bp, C. elegans
gccaaactcggaa

SEQ ID NO: 718934 - DNA, 13 bp, C. elegans
gccaaacttcaaa

SEQ ID NO: 718935 - DNA, 13 bp, C. elegans
gccaaatgccaac

SEQ ID NO: 718936 - DNA, 13 bp, C. elegans
gccaaatttgaaa

SEQ ID NO: 718937 - DNA, 13 bp, C. elegans
gccaaattttcaa

SEQ ID NO: 718938 - DNA, 13 bp, C. elegans
gccaacatttttt

SEQ ID NO: 718939 - DNA, 13 bp, C. elegans
gccaacgtgaatt

SEQ ID NO: 718940 - DNA, 13 bp, C. elegans
gccaattggattt

SEQ ID NO: 718941 - DNA, 13 bp, C. elegans
gccaatttcaaat

SEQ ID NO: 718942 - DNA, 13 bp, C. elegans
gccaatttgccaa

SEQ ID NO: 718943 - DNA, 13 bp, C. elegans
gccaattttcaat

SEQ ID NO: 718944 - DNA, 13 bp, C. elegans
gccaattttctga

SEQ ID NO: 718945 - DNA, 13 bp, C. elegans
gccaattttgagc

SEQ ID NO: 718946 - DNA, 13 bp, C. elegans
gccaatttttttc

SEQ ID NO: 718947 - DNA, 13 bp, C. elegans
gccacaacaaaat

SEQ ID NO: 718948 - DNA, 13 bp, C. elegans
gccacaacacatg

SEQ ID NO: 718949 - DNA, 13 bp, C. elegans
gccacacacccct

SEQ ID NO: 718950 - DNA, 13 bp, C. elegans
gccaccagaaata

SEQ ID NO: 718951 - DNA, 13 bp, C. elegans
gccacgcccactt

SEQ ID NO: 718952 - DNA, 13 bp, C. elegans
gccacgccccttt

SEQ ID NO: 718953 - DNA, 13 bp, C. elegans
gccacgtggcatt

SEQ ID NO: 718954 - DNA, 13 bp, C. elegans
gccacgtggcttt

SEQ ID NO: 718955 - DNA, 13 bp, C. elegans
gccactcactata

SEQ ID NO: 718956 - DNA, 13 bp, C. elegans
gccacttttcaat

SEQ ID NO: 718957 - DNA, 13 bp, C. elegans
gccacttttccgt

SEQ ID NO: 718958 - DNA, 13 bp, C. elegans
gccactttttttt

SEQ ID NO: 718959 - DNA, 13 bp, C. elegans
gccagaattccgt

SEQ ID NO: 718960 - DNA, 13 bp, C. elegans
gccagagtcacta

SEQ ID NO: 718961 - DNA, 13 bp, C. elegans
gccagataatttg

SEQ ID NO: 718962 - DNA, 44 bp, C. elegans
gccagcaaaatgctccaagaactcgtacaaaaatgctctgaagt

SEQ ID NO: 718963 - DNA, 13 bp, C. elegans
gccagtttgaaat

SEQ ID NO: 718964 - DNA, 13 bp, C. elegans
gccataattcaaa

SEQ ID NO: 718965 - DNA, 13 bp, C. elegans
gccatattggatt

SEQ ID NO: 718966 - DNA, 13 bp, C. elegans
gccattattcaaa

SEQ ID NO: 718967 - DNA, 13 bp, C. elegans
gccattattcttc

SEQ ID NO: 718968 - DNA, 13 bp, C. elegans
gccattctgtcat

SEQ ID NO: 718969 - DNA, 13 bp, C. elegans
gccatttgaaatt

SEQ ID NO: 718970 - DNA, 13 bp, C. elegans
gccatttttccaa

SEQ ID NO: 718971 - DNA, 13 bp, C. elegans
gccatttttcttg

SEQ ID NO: 718972 - DNA, 13 bp, C. elegans
gccattttttttg

SEQ ID NO: 718973 - DNA, 13 bp, C. elegans
gcccaaaaacttg

SEQ ID NO: 718974 - DNA, 13 bp, C. elegans
gcccaaaatttgg

SEQ ID NO: 718975 - DNA, 13 bp, C. elegans
gcccaattttttt

SEQ ID NO: 718976 - DNA, 13 bp, C. elegans
gcccacaattctc

SEQ ID NO: 718977 - DNA, 13 bp, C. elegans
gcccacctctggt

SEQ ID NO: 718978 - DNA, 13 bp, C. elegans
gcccacttttttc

SEQ ID NO: 718979 - DNA, 13 bp, C. elegans
gccccgcccactt

SEQ ID NO: 718980 - DNA, 13 bp, C. elegans
gccccgcccattt

SEQ ID NO: 718981 - DNA, 13 bp, C. elegans
gccccgccttttt

SEQ ID NO: 718982 - DNA, 13 bp, C. elegans
gcccggcaaattt

SEQ ID NO: 718983 - DNA, 13 bp, C. elegans
gccctcaaacctg

SEQ ID NO: 718984 - DNA, 13 bp, C. elegans
gccctcaaacttg

SEQ ID NO: 718985 - DNA, 13 bp, C. elegans
gccgaaaaattcg

SEQ ID NO: 718986 - DNA, 13 bp, C. elegans
gccgaaaacttcc

SEQ ID NO: 718987 - DNA, 13 bp, C. elegans
gccgaaaataaat

SEQ ID NO: 718988 - DNA, 13 bp, C. elegans
gccgaaaatctcg

SEQ ID NO: 718989 - DNA, 13 bp, C. elegans
gccgaaaatggaa

SEQ ID NO: 718990 - DNA, 13 bp, C. elegans
gccgaaaattcaa

SEQ ID NO: 718991 - DNA, 13 bp, C. elegans
gccgaaaatttgg

SEQ ID NO: 718992 - DNA, 13 bp, C. elegans
gccgaaaattttc

SEQ ID NO: 718993 - DNA, 13 bp, C. elegans
gccgaaaattttg

SEQ ID NO: 718994 - DNA, 13 bp, C. elegans
gccgaaactgaaa

SEQ ID NO: 718995 - DNA, 13 bp, C. elegans
gccgaaatgggac

SEQ ID NO: 718996 - DNA, 13 bp, C. elegans
gccgaaatttcca

SEQ ID NO: 718997 - DNA, 13 bp, C. elegans
gccgaaatttgaa

SEQ ID NO: 718998 - DNA, 13 bp, C. elegans
gccgaaattttgc

SEQ ID NO: 718999 - DNA, 13 bp, C. elegans
gccgaacaaggag

SEQ ID NO: 719000 - DNA, 16 bp, C. elegans
gccgaagttgccgaac

SEQ ID NO: 719001 - DNA, 13 bp, C. elegans
gccgaatggtaaa

SEQ ID NO: 719002 - DNA, 13 bp, C. elegans
gccgaattgccgg

SEQ ID NO: 719003 - DNA, 14 bp, C. elegans
gccgaatttgccgt

SEQ ID NO: 719004 - DNA, 13 bp, C. elegans
gccgacacaattt

SEQ ID NO: 719005 - DNA, 13 bp, C. elegans
gccgacacttcac

SEQ ID NO: 719006 - DNA, 13 bp, C. elegans
gccgacatctcac

SEQ ID NO: 719007 - DNA, 13 bp, C. elegans
gccgacatctcat

SEQ ID NO: 719008 - DNA, 13 bp, C. elegans
gccgacatttcac

SEQ ID NO: 719009 - DNA, 13 bp, C. elegans
gccgacgtcacat

SEQ ID NO: 719010 - DNA, 13 bp, C. elegans
gccgacttgccga

SEQ ID NO: 719011 - DNA, 14 bp, C. elegans
gccgagcacggcaa

SEQ ID NO: 719012 - DNA, 13 bp, C. elegans
gccgagtcaaaat

SEQ ID NO: 719013 - DNA, 13 bp, C. elegans
gccgagtttttag

SEQ ID NO: 719014 - DNA, 13 bp, C. elegans
gccgagtttttga

SEQ ID NO: 719015 - DNA, 13 bp, C. elegans
gccgattgccgct

SEQ ID NO: 719016 - DNA, 13 bp, C. elegans
gccgattttaggc

SEQ ID NO: 719017 - DNA, 13 bp, C. elegans
gccgcacagccct

SEQ ID NO: 719018 - DNA, 13 bp, C. elegans
gccgcacagtcct

SEQ ID NO: 719019 - DNA, 13 bp, C. elegans
gccgccgtgaaaa

SEQ ID NO: 719020 - DNA, 13 bp, C. elegans
gccgctgcgacat

SEQ ID NO: 719021 - DNA, 13 bp, C. elegans
gccggaaaaacgg

SEQ ID NO: 719022 - DNA, 13 bp, C. elegans
gccggaaaaatgg

SEQ ID NO: 719023 - DNA, 13 bp, C. elegans
gccggaaatattt

SEQ ID NO: 719024 - DNA, 13 bp, C. elegans
gccggaaatcaaa

SEQ ID NO: 719025 - DNA, 13 bp, C. elegans
gccggaaatgtct

SEQ ID NO: 719026 - DNA, 13 bp, C. elegans
gccggaaattttc

SEQ ID NO: 719027 - DNA, 13 bp, C. elegans
gccggaattcaaa

SEQ ID NO: 719028 - DNA, 13 bp, C. elegans
gccggaattttcg

SEQ ID NO: 719029 - DNA, 13 bp, C. elegans
gccggaatttttt

SEQ ID NO: 719030 - DNA, 13 bp, C. elegans
gcctaaaaattga

SEQ ID NO: 719031 - DNA, 13 bp, C. elegans
gcctaaaatttga

SEQ ID NO: 719032 - DNA, 13 bp, C. elegans
gcctaaacctaaa

SEQ ID NO: 719033 - DNA, 13 bp, C. elegans
gcctaagcctaat

SEQ ID NO: 719034 - DNA, 13 bp, C. elegans
gcctaagtctaaa

SEQ ID NO: 719035 - DNA, 13 bp, C. elegans
gcctaattttttt

SEQ ID NO: 719036 - DNA, 13 bp, C. elegans
gcctacatggaag

SEQ ID NO: 719037 - DNA, 13 bp, C. elegans
gcctacatgtcta

SEQ ID NO: 719038 - DNA, 13 bp, C. elegans
gcctacctaccgc

SEQ ID NO: 719039 - DNA, 13 bp, C. elegans
gcctacctgccta

SEQ ID NO: 719040 - DNA, 13 bp, C. elegans
gcctaccttgtgc

SEQ ID NO: 719041 - DNA, 13 bp, C. elegans
gcctacgcctacc

SEQ ID NO: 719042 - DNA, 13 bp, C. elegans
gcctacgtggaag

SEQ ID NO: 719043 - DNA, 13 bp, C. elegans
gcctagaaaccca

SEQ ID NO: 719044 - DNA, 13 bp, C. elegans
gcctagaaatccc

SEQ ID NO: 719045 - DNA, 13 bp, C. elegans
gcctatgcctaaa

SEQ ID NO: 719046 - DNA, 13 bp, C. elegans
gcctatttcatgc

SEQ ID NO: 719047 - DNA, 13 bp, C. elegans
gcctcaaaaaatg

SEQ ID NO: 719048 - DNA, 13 bp, C. elegans
gcctcaaccaaaa

SEQ ID NO: 719049 - DNA, 13 bp, C. elegans
gcctcaaccaaat

SEQ ID NO: 719050 - DNA, 13 bp, C. elegans
gcctcaaccaaca

SEQ ID NO: 719051 - DNA, 13 bp, C. elegans
gcctcaaccaaga

SEQ ID NO: 719052 - DNA, 13 bp, C. elegans
gcctcaaccaatg

SEQ ID NO: 719053 - DNA, 13 bp, C. elegans
gcctccctttaaa

SEQ ID NO: 719054 - DNA, 13 bp, C. elegans
gcctcgaaaattt

SEQ ID NO: 719055 - DNA, 13 bp, C. elegans
gcctctcgcctca

SEQ ID NO: 719056 - DNA, 13 bp, C. elegans
gcctgaaatttaa

SEQ ID NO: 719057 - DNA, 13 bp, C. elegans
gcctgcatggaag

SEQ ID NO: 719058 - DNA, 13 bp, C. elegans
gcctgcctacttg

SEQ ID NO: 719059 - DNA, 13 bp, C. elegans
gcctggcaccatg

SEQ ID NO: 719060 - DNA, 13 bp, C. elegans
gccttcaaaaaaa

SEQ ID NO: 719061 - DNA, 13 bp, C. elegans
gccttgacgcaat

SEQ ID NO: 719062 - DNA, 13 bp, C. elegans
gcctttaaagttg

SEQ ID NO: 719063 - DNA, 13 bp, C. elegans
gcgaaaaaatcaa

SEQ ID NO: 719064 - DNA, 13 bp, C. elegans
gcgaaaaaattaa

SEQ ID NO: 719065 - DNA, 13 bp, C. elegans
gcgaaaagctcat

SEQ ID NO: 719066 - DNA, 13 bp, C. elegans
gcgaaaagttcaa

SEQ ID NO: 719067 - DNA, 13 bp, C. elegans
gcgaaaatatcaa

SEQ ID NO: 719068 - DNA, 13 bp, C. elegans
gcgaaaatatcga

SEQ ID NO: 719069 - DNA, 13 bp, C. elegans
gcgaaaattcaaa

SEQ ID NO: 719070 - DNA, 13 bp, C. elegans
gcgaaaattgaat

SEQ ID NO: 719071 - DNA, 13 bp, C. elegans
gcgaaaattttaa

SEQ ID NO: 719072 - DNA, 13 bp, C. elegans
gcgaaatttgaaa

SEQ ID NO: 719073 - DNA, 13 bp, C. elegans
gcgaaattttgga

SEQ ID NO: 719074 - DNA, 13 bp, C. elegans
gcgaacgattttt

SEQ ID NO: 719075 - DNA, 13 bp, C. elegans
gcgaacggcgaat

SEQ ID NO: 719076 - DNA, 14 bp, C. elegans
gcgaatcacctgtg

SEQ ID NO: 719077 - DNA, 13 bp, C. elegans
gcgaattctggag

SEQ ID NO: 719078 - DNA, 13 bp, C. elegans
gcgaatttaaaaa

SEQ ID NO: 719079 - DNA, 13 bp, C. elegans
gcgacaatttttt

SEQ ID NO: 719080 - DNA, 13 bp, C. elegans
gcgacatttcttt

SEQ ID NO: 719081 - DNA, 13 bp, C. elegans
gcgaccaatcagc

SEQ ID NO: 719082 - DNA, 15 bp, C. elegans
gcgactggtggttgc

SEQ ID NO: 719083 - DNA, 13 bp, C. elegans
gcgagaaattcga

SEQ ID NO: 719084 - DNA, 13 bp, C. elegans
gcgagaaatttga

SEQ ID NO: 719085 - DNA, 13 bp, C. elegans
gcgagaccaatga

SEQ ID NO: 719086 - DNA, 14 bp, C. elegans
gcgagaccaatgac

SEQ ID NO: 719087 - DNA, 13 bp, C. elegans
gcgagagacgcag

SEQ ID NO: 719088 - DNA, 13 bp, C. elegans
gcgagttttgatg

SEQ ID NO: 719089 - DNA, 13 bp, C. elegans
gcgatattcaatt

SEQ ID NO: 719090 - DNA, 13 bp, C. elegans
gcgatgagcacaa

SEQ ID NO: 719091 - DNA, 13 bp, C. elegans
gcgatttttttct

SEQ ID NO: 719092 - DNA, 13 bp, C. elegans
gcgcaaaaaagtt

SEQ ID NO: 719093 - DNA, 13 bp, C. elegans
gcgcatttctagt

SEQ ID NO: 719094 - DNA, 14 bp, C. elegans
gcgccaaaagtacg

SEQ ID NO: 719095 - DNA, 13 bp, C. elegans
gcgccaaattcaa

SEQ ID NO: 719096 - DNA, 13 bp, C. elegans
gcgccaaggcacg

SEQ ID NO: 719097 - DNA, 13 bp, C. elegans
gcgcccgacattt

SEQ ID NO: 719098 - DNA, 13 bp, C. elegans
gcgccctccttta

SEQ ID NO: 719099 - DNA, 13 bp, C. elegans
gcgccttcaaaga

SEQ ID NO: 719100 - DNA, 13 bp, C. elegans
gcgcctttaaaga

SEQ ID NO: 719101 - DNA, 13 bp, C. elegans
gcgcgaaattttg

SEQ ID NO: 719102 - DNA, 13 bp, C. elegans
gcgcgagcatttt

SEQ ID NO: 719103 - DNA, 13 bp, C. elegans
gcgcgcgcgcgaa

SEQ ID NO: 719104 - DNA, 13 bp, C. elegans
gcgcgctccaatg

SEQ ID NO: 719105 - DNA, 13 bp, C. elegans
gcgcgcttgcaca

SEQ ID NO: 719106 - DNA, 13 bp, C. elegans
gcgcggaacccaa

SEQ ID NO: 719107 - DNA, 13 bp, C. elegans
gcgcggtgagacc

SEQ ID NO: 719108 - DNA, 17 bp, C. elegans
gcgcgtgctccgactgg

SEQ ID NO: 719109 - DNA, 14 bp, C. elegans
gcgctcaacaaatc

SEQ ID NO: 719110 - DNA, 13 bp, C. elegans
gcgctctaccgca

SEQ ID NO: 719111 - DNA, 13 bp, C. elegans
gcggaaaaaattg

SEQ ID NO: 719112 - DNA, 15 bp, C. elegans
gcggaaaaactcaaa

SEQ ID NO: 719113 - DNA, 13 bp, C. elegans
gcggaaaacaata

SEQ ID NO: 719114 - DNA, 13 bp, C. elegans
gcggaaaacgatt

SEQ ID NO: 719115 - DNA, 14 bp, C. elegans
gcggaaaattcgaa

SEQ ID NO: 719116 - DNA, 13 bp, C. elegans
gcggaacctcgaa

SEQ ID NO: 719117 - DNA, 13 bp, C. elegans
gcggaattttcag

SEQ ID NO: 719118 - DNA, 13 bp, C. elegans
gcggagtttacaa

SEQ ID NO: 719119 - DNA, 13 bp, C. elegans
gcggccataactt

SEQ ID NO: 719120 - DNA, 13 bp, C. elegans
gcggccgacaatt

SEQ ID NO: 719121 - DNA, 13 bp, C. elegans
gcggccgacactt

SEQ ID NO: 719122 - DNA, 13 bp, C. elegans
gcggccgacatct

SEQ ID NO: 719123 - DNA, 13 bp, C. elegans
gcggcgcggaacc

SEQ ID NO: 719124 - DNA, 13 bp, C. elegans
gcggcggcagcag

SEQ ID NO: 719125 - DNA, 13 bp, C. elegans
gcggctcgttttt

SEQ ID NO: 719126 - DNA, 13 bp, C. elegans
gcgggaaactcaa

SEQ ID NO: 719127 - DNA, 13 bp, C. elegans
gcgggaaattgaa

SEQ ID NO: 719128 - DNA, 13 bp, C. elegans
gcgggaattcaaa

SEQ ID NO: 719129 - DNA, 13 bp, C. elegans
gcggggattgaac

SEQ ID NO: 719130 - DNA, 13 bp, C. elegans
gcggggtactgta

SEQ ID NO: 719131 - DNA, 13 bp, C. elegans
gcgggttacggta

SEQ ID NO: 719132 - DNA, 13 bp, C. elegans
gcgggttactgta

SEQ ID NO: 719133 - DNA, 13 bp, C. elegans
gcggttttggagc

SEQ ID NO: 719134 - DNA, 13 bp, C. elegans
gcggttttttgct

SEQ ID NO: 719135 - DNA, 13 bp, C. elegans
gcgtatcttgaaa

SEQ ID NO: 719136 - DNA, 13 bp, C. elegans
gcgtattgcgcaa

SEQ ID NO: 719137 - DNA, 13 bp, C. elegans
gcgtcaaatctgg

SEQ ID NO: 719138 - DNA, 13 bp, C. elegans
gcgtccgacactt

SEQ ID NO: 719139 - DNA, 13 bp, C. elegans
gcgtctctcctcc

SEQ ID NO: 719140 - DNA, 13 bp, C. elegans
gcgtgcggaagcg

SEQ ID NO: 719141 - DNA, 14 bp, C. elegans
gcgtgctgacgtca

SEQ ID NO: 719142 - DNA, 13 bp, C. elegans
gcgtggcgagacc

SEQ ID NO: 719143 - DNA, 13 bp, C. elegans
gcgtggtgagacc

SEQ ID NO: 719144 - DNA, 13 bp, C. elegans
gcgtggttcgatt

SEQ ID NO: 719145 - DNA, 14 bp, C. elegans
gcgttgcggtcgcg

SEQ ID NO: 719146 - DNA, 23 bp, C. elegans
gcgttgcgtgtcgcgtcgcggct

SEQ ID NO: 719147 - DNA, 13 bp, C. elegans
gcgttttaatttt

SEQ ID NO: 719148 - DNA, 13 bp, C. elegans
gcgtttttctcaa

SEQ ID NO: 719149 - DNA, 13 bp, C. elegans
gctaaaaatcaaa

SEQ ID NO: 719150 - DNA, 13 bp, C. elegans
gctaaaaatcgat

SEQ ID NO: 719151 - DNA, 13 bp, C. elegans
gctaaaacaattt

SEQ ID NO: 719152 - DNA, 13 bp, C. elegans
gctaaaatcaaaa

SEQ ID NO: 719153 - DNA, 13 bp, C. elegans
gctaaataaaatt

SEQ ID NO: 719154 - DNA, 13 bp, C. elegans
gctaaatattttc

SEQ ID NO: 719155 - DNA, 13 bp, C. elegans
gctaaattcaaat

SEQ ID NO: 719156 - DNA, 13 bp, C. elegans
gctaaattttttt

SEQ ID NO: 719157 - DNA, 13 bp, C. elegans
gctaattcaattt

SEQ ID NO: 719158 - DNA, 13 bp, C. elegans
gctaattttaatt

SEQ ID NO: 719159 - DNA, 13 bp, C. elegans
gctaattttttcg

SEQ ID NO: 719160 - DNA, 13 bp, C. elegans
gctacaaaaacaa

SEQ ID NO: 719161 - DNA, 13 bp, C. elegans
gctacaaactaca

SEQ ID NO: 719162 - DNA, 13 bp, C. elegans
gctacagtaaccc

SEQ ID NO: 719163 - DNA, 13 bp, C. elegans
gctacagtaatca

SEQ ID NO: 719164 - DNA, 13 bp, C. elegans
gctacagtaccca

SEQ ID NO: 719165 - DNA, 13 bp, C. elegans
gctacagtactcc

SEQ ID NO: 719166 - DNA, 13 bp, C. elegans
gctacagtagtca

SEQ ID NO: 719167 - DNA, 13 bp, C. elegans
gctacattacttg

SEQ ID NO: 719168 - DNA, 13 bp, C. elegans
gctaccgtaaccc

SEQ ID NO: 719169 - DNA, 13 bp, C. elegans
gctaccgtaatcc

SEQ ID NO: 719170 - DNA, 13 bp, C. elegans
gctaccgtacccc

SEQ ID NO: 719171 - DNA, 13 bp, C. elegans
gctactgtagttt

SEQ ID NO: 719172 - DNA, 13 bp, C. elegans
gctagtttttcta

SEQ ID NO: 719173 - DNA, 13 bp, C. elegans
gctataaactaca

SEQ ID NO: 719174 - DNA, 13 bp, C. elegans
gctatagaagttg

SEQ ID NO: 719175 - DNA, 13 bp, C. elegans
gctatattaatag

SEQ ID NO: 719176 - DNA, 13 bp, C. elegans
gctatattttgtt

SEQ ID NO: 719177 - DNA, 22 bp, C. elegans
gctatgcactgcggatctggga

SEQ ID NO: 719178 - DNA, 13 bp, C. elegans
gctattattttca

SEQ ID NO: 719179 - DNA, 82 bp, C. elegans
gctattttgatgcttaaacagacatactacgcggaacttattcagaaaccagatgtgtgttaagaattcagtagttttggtg

SEQ ID NO: 719180 - DNA, 13 bp, C. elegans
gctcaaaaaatgg

SEQ ID NO: 719181 - DNA, 13 bp, C. elegans
gctcaaaaactgc

SEQ ID NO: 719182 - DNA, 13 bp, C. elegans
gctcaaaaatata

SEQ ID NO: 719183 - DNA, 13 bp, C. elegans
gctcaaaaatgac

SEQ ID NO: 719184 - DNA, 13 bp, C. elegans
gctcaaaaatgtt

SEQ ID NO: 719185 - DNA, 13 bp, C. elegans
gctcaaaaatttt

SEQ ID NO: 719186 - DNA, 13 bp, C. elegans
gctcaaaacaaaa

SEQ ID NO: 719187 - DNA, 13 bp, C. elegans
gctcaaaataatt

SEQ ID NO: 719188 - DNA, 13 bp, C. elegans
gctcaaaatgctc

SEQ ID NO: 719189 - DNA, 13 bp, C. elegans
gctcaaaattcca

SEQ ID NO: 719190 - DNA, 13 bp, C. elegans
gctcaaaattcga

SEQ ID NO: 719191 - DNA, 13 bp, C. elegans
gctcaaaattgaa

SEQ ID NO: 719192 - DNA, 13 bp, C. elegans
gctcaaaattgcg

SEQ ID NO: 719193 - DNA, 13 bp, C. elegans
gctcaaaattgtc

SEQ ID NO: 719194 - DNA, 13 bp, C. elegans
gctcaaagagaaa

SEQ ID NO: 719195 - DNA, 13 bp, C. elegans
gctcaaatcaatt

SEQ ID NO: 719196 - DNA, 13 bp, C. elegans
gctcaaattcaaa

SEQ ID NO: 719197 - DNA, 13 bp, C. elegans
gctcaaattttgt

SEQ ID NO: 719198 - DNA, 13 bp, C. elegans
gctcaatcaactc

SEQ ID NO: 719199 - DNA, 13 bp, C. elegans
gctcaatgagctc

SEQ ID NO: 719200 - DNA, 13 bp, C. elegans
gctcaatgtgctc

SEQ ID NO: 719201 - DNA, 13 bp, C. elegans
gctcacggagctc

SEQ ID NO: 719202 - DNA, 13 bp, C. elegans
gctcacggtgctc

SEQ ID NO: 719203 - DNA, 13 bp, C. elegans
gctcaggattttg

SEQ ID NO: 719204 - DNA, 15 bp, C. elegans
gctcaggctcaggct

SEQ ID NO: 719205 - DNA, 13 bp, C. elegans
gctcatatctcat

SEQ ID NO: 719206 - DNA, 13 bp, C. elegans
gctcatcttcaga

SEQ ID NO: 719207 - DNA, 13 bp, C. elegans
gctcattgagcac

SEQ ID NO: 719208 - DNA, 13 bp, C. elegans
gctcattgagctc

SEQ ID NO: 719209 - DNA, 13 bp, C. elegans
gctcatttgtttt

SEQ ID NO: 719210 - DNA, 13 bp, C. elegans
gctcattttcagc

SEQ ID NO: 719211 - DNA, 13 bp, C. elegans
gctcattttgggt

SEQ ID NO: 719212 - DNA, 13 bp, C. elegans
gctcatttttaat

SEQ ID NO: 719213 - DNA, 13 bp, C. elegans
gctcatttttcaa

SEQ ID NO: 719214 - DNA, 13 bp, C. elegans
gctcatttttcca

SEQ ID NO: 719215 - DNA, 13 bp, C. elegans
gctccaaaaaaca

SEQ ID NO: 719216 - DNA, 13 bp, C. elegans
gctccaaaccacg

SEQ ID NO: 719217 - DNA, 13 bp, C. elegans
gctccaaataact

SEQ ID NO: 719218 - DNA, 14 bp, C. elegans
gctccaacgaacga

SEQ ID NO: 719219 - DNA, 14 bp, C. elegans
gctccaatctttct

SEQ ID NO: 719220 - DNA, 13 bp, C. elegans
gctccaatgagaa

SEQ ID NO: 719221 - DNA, 13 bp, C. elegans
gctccaattttca

SEQ ID NO: 719222 - DNA, 13 bp, C. elegans
gctccaccgcaca

SEQ ID NO: 719223 - DNA, 13 bp, C. elegans
gctccacttattc

SEQ ID NO: 719224 - DNA, 15 bp, C. elegans
gctccagaaccttct

SEQ ID NO: 719225 - DNA, 13 bp, C. elegans
gctccagaagagc

SEQ ID NO: 719226 - DNA, 13 bp, C. elegans
gctccagaagtcg

SEQ ID NO: 719227 - DNA, 13 bp, C. elegans
gctccagctccag

SEQ ID NO: 719228 - DNA, 13 bp, C. elegans
gctccattgagaa

SEQ ID NO: 719229 - DNA, 14 bp, C. elegans
gctccattggcaat

SEQ ID NO: 719230 - DNA, 13 bp, C. elegans
gctccgcccacat

SEQ ID NO: 719231 - DNA, 13 bp, C. elegans
gctccgcccacta

SEQ ID NO: 719232 - DNA, 13 bp, C. elegans
gctccgcccactt

SEQ ID NO: 719233 - DNA, 13 bp, C. elegans
gctccgcccattt

SEQ ID NO: 719234 - DNA, 13 bp, C. elegans
gctccgccccttt

SEQ ID NO: 719235 - DNA, 13 bp, C. elegans
gctccgccctttt

SEQ ID NO: 719236 - DNA, 13 bp, C. elegans
gctccgcgagcat

SEQ ID NO: 719237 - DNA, 13 bp, C. elegans
gctccgcgagccc

SEQ ID NO: 719238 - DNA, 13 bp, C. elegans
gctccgcgagctc

SEQ ID NO: 719239 - DNA, 13 bp, C. elegans
gctccgtaaatcg

SEQ ID NO: 719240 - DNA, 13 bp, C. elegans
gctccgtgagcac

SEQ ID NO: 719241 - DNA, 13 bp, C. elegans
gctcgaaaaatga

SEQ ID NO: 719242 - DNA, 13 bp, C. elegans
gctcgaaaaatgg

SEQ ID NO: 719243 - DNA, 13 bp, C. elegans
gctcgaaaatatt

SEQ ID NO: 719244 - DNA, 13 bp, C. elegans
gctcgaaaattga

SEQ ID NO: 719245 - DNA, 13 bp, C. elegans
gctcgaaatttga

SEQ ID NO: 719246 - DNA, 13 bp, C. elegans
gctcgaggtgctc

SEQ ID NO: 719247 - DNA, 13 bp, C. elegans
gctcgattttcaa

SEQ ID NO: 719248 - DNA, 13 bp, C. elegans
gctcgattttcga

SEQ ID NO: 719249 - DNA, 13 bp, C. elegans
gctcgatttttga

SEQ ID NO: 719250 - DNA, 14 bp, C. elegans
gctcgccactgacg

SEQ ID NO: 719251 - DNA, 13 bp, C. elegans
gctcgccgagagc

SEQ ID NO: 719252 - DNA, 13 bp, C. elegans
gctcgccgagcac

SEQ ID NO: 719253 - DNA, 13 bp, C. elegans
gctcgcgaggaga

SEQ ID NO: 719254 - DNA, 13 bp, C. elegans
gctcgcgccgaga

SEQ ID NO: 719255 - DNA, 13 bp, C. elegans
gctcgcggagcac

SEQ ID NO: 719256 - DNA, 13 bp, C. elegans
gctcgcggagccc

SEQ ID NO: 719257 - DNA, 13 bp, C. elegans
gctcgcggagctc

SEQ ID NO: 719258 - DNA, 13 bp, C. elegans
gctcggcgagcag

SEQ ID NO: 719259 - DNA, 13 bp, C. elegans
gctcggttttagt

SEQ ID NO: 719260 - DNA, 13 bp, C. elegans
gctcggttttgtt

SEQ ID NO: 719261 - DNA, 13 bp, C. elegans
gctcgtgtactcc

SEQ ID NO: 719262 - DNA, 13 bp, C. elegans
gctctactgataa

SEQ ID NO: 719263 - DNA, 13 bp, C. elegans
gctctattgagaa

SEQ ID NO: 719264 - DNA, 13 bp, C. elegans
gctctattgcaca

SEQ ID NO: 719265 - DNA, 13 bp, C. elegans
gctctcaaagatc

SEQ ID NO: 719266 - DNA, 13 bp, C. elegans
gctctcgaaatat

SEQ ID NO: 719267 - DNA, 13 bp, C. elegans
gctctctgaatgc

SEQ ID NO: 719268 - DNA, 13 bp, C. elegans
gctcttcctgatg

SEQ ID NO: 719269 - DNA, 13 bp, C. elegans
gctctttttatat

SEQ ID NO: 719270 - DNA, 13 bp, C. elegans
gctgaaaaccaat

SEQ ID NO: 719271 - DNA, 13 bp, C. elegans
gctgaaaatcaca

SEQ ID NO: 719272 - DNA, 13 bp, C. elegans
gctgaaaatgtaa

SEQ ID NO: 719273 - DNA, 13 bp, C. elegans
gctgaaaatgtac

SEQ ID NO: 719274 - DNA, 13 bp, C. elegans
gctgaaaatgtgt

SEQ ID NO: 719275 - DNA, 13 bp, C. elegans
gctgaaacaattg

SEQ ID NO: 719276 - DNA, 13 bp, C. elegans
gctgaaactagtg

SEQ ID NO: 719277 - DNA, 13 bp, C. elegans
gctgaaattaaaa

SEQ ID NO: 719278 - DNA, 13 bp, C. elegans
gctgaacaaaaga

SEQ ID NO: 719279 - DNA, 13 bp, C. elegans
gctgaataaattt

SEQ ID NO: 719280 - DNA, 13 bp, C. elegans
gctgaattcaaaa

SEQ ID NO: 719281 - DNA, 13 bp, C. elegans
gctgaattcaatt

SEQ ID NO: 719282 - DNA, 13 bp, C. elegans
gctgacattctct

SEQ ID NO: 719283 - DNA, 13 bp, C. elegans
gctgatattgata

SEQ ID NO: 719284 - DNA, 13 bp, C. elegans
gctgatattgttg

SEQ ID NO: 719285 - DNA, 13 bp, C. elegans
gctgattaaaaaa

SEQ ID NO: 719286 - DNA, 13 bp, C. elegans
gctgattggtcga

SEQ ID NO: 719287 - DNA, 13 bp, C. elegans
gctgattggtcgc

SEQ ID NO: 719288 - DNA, 13 bp, C. elegans
gctgatttttcat

SEQ ID NO: 719289 - DNA, 13 bp, C. elegans
gctgcgcctttaa

SEQ ID NO: 719290 - DNA, 13 bp, C. elegans
gctgcgtaaatcg

SEQ ID NO: 719291 - DNA, 13 bp, C. elegans
gctgctcaaaaat

SEQ ID NO: 719292 - DNA, 13 bp, C. elegans
gctgctgctgcta

SEQ ID NO: 719293 - DNA, 13 bp, C. elegans
gctgctgctgctc

SEQ ID NO: 719294 - DNA, 13 bp, C. elegans
gctgctgctgttg

SEQ ID NO: 719295 - DNA, 13 bp, C. elegans
gctgctgttgctg

SEQ ID NO: 719296 - DNA, 13 bp, C. elegans
gctgcttctgctg

SEQ ID NO: 719297 - DNA, 13 bp, C. elegans
gctggaaactatt

SEQ ID NO: 719298 - DNA, 15 bp, C. elegans
gctggaagtgaggtt

SEQ ID NO: 719299 - DNA, 13 bp, C. elegans
gctggaatcaaaa

SEQ ID NO: 719300 - DNA, 13 bp, C. elegans
gctggaattcaaa

SEQ ID NO: 719301 - DNA, 13 bp, C. elegans
gctggcctaaatt

SEQ ID NO: 719302 - DNA, 13 bp, C. elegans
gctgggagcccta

SEQ ID NO: 719303 - DNA, 13 bp, C. elegans
gctggttcgaatc

SEQ ID NO: 719304 - DNA, 13 bp, C. elegans
gctgtatttttca

SEQ ID NO: 719305 - DNA, 13 bp, C. elegans
gctgtctcttcaa

SEQ ID NO: 719306 - DNA, 13 bp, C. elegans
gctgtggacgagg

SEQ ID NO: 719307 - DNA, 13 bp, C. elegans
gctgtttcaaatt

SEQ ID NO: 719308 - DNA, 13 bp, C. elegans
gctgttttaaatc

SEQ ID NO: 719309 - DNA, 13 bp, C. elegans
gctgtttttttca

SEQ ID NO: 719310 - DNA, 13 bp, C. elegans
gcttaaaatttac

SEQ ID NO: 719311 - DNA, 13 bp, C. elegans
gcttaaataaaaa

SEQ ID NO: 719312 - DNA, 13 bp, C. elegans
gcttaaattttta

SEQ ID NO: 719313 - DNA, 13 bp, C. elegans
gcttaatttaaaa

SEQ ID NO: 719314 - DNA, 13 bp, C. elegans
gcttagacttagg

SEQ ID NO: 719315 - DNA, 13 bp, C. elegans
gcttaggcgtagg

SEQ ID NO: 719316 - DNA, 13 bp, C. elegans
gcttaggcttagg

SEQ ID NO: 719317 - DNA, 13 bp, C. elegans
gcttaggtttagg

SEQ ID NO: 719318 - DNA, 13 bp, C. elegans
gcttatatctcgg

SEQ ID NO: 719319 - DNA, 13 bp, C. elegans
gcttatatttcag

SEQ ID NO: 719320 - DNA, 13 bp, C. elegans
gcttattgcacca

SEQ ID NO: 719321 - DNA, 13 bp, C. elegans
gcttatttgaaag

SEQ ID NO: 719322 - DNA, 13 bp, C. elegans
gcttattttgaag

SEQ ID NO: 719323 - DNA, 13 bp, C. elegans
gcttcaaaaattg

SEQ ID NO: 719324 - DNA, 13 bp, C. elegans
gcttcaaaatgag

SEQ ID NO: 719325 - DNA, 13 bp, C. elegans
gcttcaaaattca

SEQ ID NO: 719326 - DNA, 13 bp, C. elegans
gcttcaaattgaa

SEQ ID NO: 719327 - DNA, 13 bp, C. elegans
gcttcacagaata

SEQ ID NO: 719328 - DNA, 14 bp, C. elegans
gcttcaccatattt

SEQ ID NO: 719329 - DNA, 13 bp, C. elegans
gcttcatttgaaa

SEQ ID NO: 719330 - DNA, 13 bp, C. elegans
gcttccaaataac

SEQ ID NO: 719331 - DNA, 13 bp, C. elegans
gcttccaattttt

SEQ ID NO: 719332 - DNA, 13 bp, C. elegans
gcttcgagatatt

SEQ ID NO: 719333 - DNA, 13 bp, C. elegans
gcttcgttagatc

SEQ ID NO: 719334 - DNA, 13 bp, C. elegans
gcttctagctcaa

SEQ ID NO: 719335 - DNA, 13 bp, C. elegans
gcttctatttaga

SEQ ID NO: 719336 - DNA, 13 bp, C. elegans
gcttctcattttg

SEQ ID NO: 719337 - DNA, 13 bp, C. elegans
gcttctcctttca

SEQ ID NO: 719338 - DNA, 13 bp, C. elegans
gcttctcggatcg

SEQ ID NO: 719339 - DNA, 13 bp, C. elegans
gcttcttgcccaa

SEQ ID NO: 719340 - DNA, 13 bp, C. elegans
gcttcttttgaaa

SEQ ID NO: 719341 - DNA, 13 bp, C. elegans
gcttgaaaaaaaa

SEQ ID NO: 719342 - DNA, 13 bp, C. elegans
gcttgaaaaattg

SEQ ID NO: 719343 - DNA, 13 bp, C. elegans
gcttgatttttga

SEQ ID NO: 719344 - DNA, 13 bp, C. elegans
gcttgcgcgtttc

SEQ ID NO: 719345 - DNA, 13 bp, C. elegans
gcttggaatttgc

SEQ ID NO: 719346 - DNA, 13 bp, C. elegans
gctttaacttttt

SEQ ID NO: 719347 - DNA, 13 bp, C. elegans
gctttaatttcag

SEQ ID NO: 719348 - DNA, 13 bp, C. elegans
gctttattacttg

SEQ ID NO: 719349 - DNA, 13 bp, C. elegans
gctttatttcaga

SEQ ID NO: 719350 - DNA, 13 bp, C. elegans
gctttcaaagaaa

SEQ ID NO: 719351 - DNA, 13 bp, C. elegans
gctttcaatgtgt

SEQ ID NO: 719352 - DNA, 13 bp, C. elegans
gctttcagaatgt

SEQ ID NO: 719353 - DNA, 13 bp, C. elegans
gctttgaaaaact

SEQ ID NO: 719354 - DNA, 13 bp, C. elegans
gctttgaaaacat

SEQ ID NO: 719355 - DNA, 13 bp, C. elegans
gctttgttcaaaa

SEQ ID NO: 719356 - DNA, 13 bp, C. elegans
gcttttaaaaatg

SEQ ID NO: 719357 - DNA, 13 bp, C. elegans
gcttttaaattaa

SEQ ID NO: 719358 - DNA, 13 bp, C. elegans
gcttttatgaaaa

SEQ ID NO: 719359 - DNA, 13 bp, C. elegans
gcttttattgatt

SEQ ID NO: 719360 - DNA, 13 bp, C. elegans
gcttttcaaaagt

SEQ ID NO: 719361 - DNA, 13 bp, C. elegans
gcttttcagaatt

SEQ ID NO: 719362 - DNA, 13 bp, C. elegans
gcttttcattctt

SEQ ID NO: 719363 - DNA, 13 bp, C. elegans
gcttttgaagaaa

SEQ ID NO: 719364 - DNA, 13 bp, C. elegans
gcttttgaagagg

SEQ ID NO: 719365 - DNA, 13 bp, C. elegans
gcttttggaattt

SEQ ID NO: 719366 - DNA, 13 bp, C. elegans
gctttttaatcaa

SEQ ID NO: 719367 - DNA, 13 bp, C. elegans
gctttttacaaag

SEQ ID NO: 719368 - DNA, 13 bp, C. elegans
gctttttcaaact

SEQ ID NO: 719369 - DNA, 13 bp, C. elegans
gctttttcaacaa

SEQ ID NO: 719370 - DNA, 13 bp, C. elegans
gctttttgattga

SEQ ID NO: 719371 - DNA, 13 bp, C. elegans
gctttttggagca

SEQ ID NO: 719372 - DNA, 13 bp, C. elegans
gcttttttaaaaa

SEQ ID NO: 719373 - DNA, 13 bp, C. elegans
gcttttttctcga

SEQ ID NO: 719374 - DNA, 13 bp, C. elegans
gcttttttgaaat

SEQ ID NO: 719375 - DNA, 13 bp, C. elegans
gcttttttgttga

SEQ ID NO: 719376 - DNA, 13 bp, C. elegans
gctttttttaaat

SEQ ID NO: 719377 - DNA, 13 bp, C. elegans
gctttttttcgaa

SEQ ID NO: 719378 - DNA, 13 bp, C. elegans
gctttttttgtaa

SEQ ID NO: 719379 - DNA, 13 bp, C. elegans
gcttttttttcaa

SEQ ID NO: 719380 - DNA, 13 bp, C. elegans
ggaaaaaaactat

SEQ ID NO: 719381 - DNA, 13 bp, C. elegans
ggaaaaaaatcag

SEQ ID NO: 719382 - DNA, 13 bp, C. elegans
ggaaaaaacggca

SEQ ID NO: 719383 - DNA, 13 bp, C. elegans
ggaaaaaagtgct

SEQ ID NO: 719384 - DNA, 13 bp, C. elegans
ggaaaaaagtttg

SEQ ID NO: 719385 - DNA, 13 bp, C. elegans
ggaaaaaatattt

SEQ ID NO: 719386 - DNA, 13 bp, C. elegans
ggaaaaaatcgaa

SEQ ID NO: 719387 - DNA, 13 bp, C. elegans
ggaaaaaatcgat

SEQ ID NO: 719388 - DNA, 13 bp, C. elegans
ggaaaaaatgaac

SEQ ID NO: 719389 - DNA, 13 bp, C. elegans
ggaaaaaatttca

SEQ ID NO: 719390 - DNA, 13 bp, C. elegans
ggaaaaaccgtgc

SEQ ID NO: 719391 - DNA, 13 bp, C. elegans
ggaaaaactggaa

SEQ ID NO: 719392 - DNA, 13 bp, C. elegans
ggaaaaagtgaat

SEQ ID NO: 719393 - DNA, 13 bp, C. elegans
ggaaaaagttcaa

SEQ ID NO: 719394 - DNA, 13 bp, C. elegans
ggaaaaagttgca

SEQ ID NO: 719395 - DNA, 13 bp, C. elegans
ggaaaaatacgat

SEQ ID NO: 719396 - DNA, 13 bp, C. elegans
ggaaaaatatctg

SEQ ID NO: 719397 - DNA, 13 bp, C. elegans
ggaaaaatattcc

SEQ ID NO: 719398 - DNA, 13 bp, C. elegans
ggaaaaatattta

SEQ ID NO: 719399 - DNA, 13 bp, C. elegans
ggaaaaatatttt

SEQ ID NO: 719400 - DNA, 13 bp, C. elegans
ggaaaaatcaaca

SEQ ID NO: 719401 - DNA, 13 bp, C. elegans
ggaaaaatcacag

SEQ ID NO: 719402 - DNA, 13 bp, C. elegans
ggaaaaatcgaaa

SEQ ID NO: 719403 - DNA, 13 bp, C. elegans
ggaaaaatcgaga

SEQ ID NO: 719404 - DNA, 14 bp, C. elegans
ggaaaaatcgatat

SEQ ID NO: 719405 - DNA, 13 bp, C. elegans
ggaaaaatcgatg

SEQ ID NO: 719406 - DNA, 13 bp, C. elegans
ggaaaaatcgatt

SEQ ID NO: 719407 - DNA, 13 bp, C. elegans
ggaaaaatctaaa

SEQ ID NO: 719408 - DNA, 13 bp, C. elegans
ggaaaaatctact

SEQ ID NO: 719409 - DNA, 14 bp, C. elegans
ggaaaaatctgaaa

SEQ ID NO: 719410 - DNA, 13 bp, C. elegans
ggaaaaatgagat

SEQ ID NO: 719411 - DNA, 13 bp, C. elegans
ggaaaaatggaat

SEQ ID NO: 719412 - DNA, 13 bp, C. elegans
ggaaaaatgtgaa

SEQ ID NO: 719413 - DNA, 13 bp, C. elegans
ggaaaaatgttaa

SEQ ID NO: 719414 - DNA, 13 bp, C. elegans
ggaaaaatgttga

SEQ ID NO: 719415 - DNA, 13 bp, C. elegans
ggaaaaattcccg

SEQ ID NO: 719416 - DNA, 13 bp, C. elegans
ggaaaaattgatt

SEQ ID NO: 719417 - DNA, 13 bp, C. elegans
ggaaaaattggat

SEQ ID NO: 719418 - DNA, 13 bp, C. elegans
ggaaaaatttgga

SEQ ID NO: 719419 - DNA, 13 bp, C. elegans
ggaaaacaatatt

SEQ ID NO: 719420 - DNA, 13 bp, C. elegans
ggaaaacactttt

SEQ ID NO: 719421 - DNA, 13 bp, C. elegans
ggaaaacatattt

SEQ ID NO: 719422 - DNA, 13 bp, C. elegans
ggaaaacatcaaa

SEQ ID NO: 719423 - DNA, 13 bp, C. elegans
ggaaaacatgtta

SEQ ID NO: 719424 - DNA, 13 bp, C. elegans
ggaaaacattgaa

SEQ ID NO: 719425 - DNA, 13 bp, C. elegans
ggaaaacattttt

SEQ ID NO: 719426 - DNA, 13 bp, C. elegans
ggaaaacgataaa

SEQ ID NO: 719427 - DNA, 13 bp, C. elegans
ggaaaactcgaaa

SEQ ID NO: 719428 - DNA, 13 bp, C. elegans
ggaaaactctgga

SEQ ID NO: 719429 - DNA, 13 bp, C. elegans
ggaaaactcttac

SEQ ID NO: 719430 - DNA, 13 bp, C. elegans
ggaaaactcttcc

SEQ ID NO: 719431 - DNA, 13 bp, C. elegans
ggaaaactggatt

SEQ ID NO: 719432 - DNA, 13 bp, C. elegans
ggaaaactgtgaa

SEQ ID NO: 719433 - DNA, 13 bp, C. elegans
ggaaaacttgaaa

SEQ ID NO: 719434 - DNA, 13 bp, C. elegans
ggaaaagctcaaa

SEQ ID NO: 719435 - DNA, 13 bp, C. elegans
ggaaaagcttgaa

SEQ ID NO: 719436 - DNA, 13 bp, C. elegans
ggaaaagtctgaa

SEQ ID NO: 719437 - DNA, 13 bp, C. elegans
ggaaaagttgaga

SEQ ID NO: 719438 - DNA, 13 bp, C. elegans
ggaaaatactttt

SEQ ID NO: 719439 - DNA, 13 bp, C. elegans
ggaaaatataatt

SEQ ID NO: 719440 - DNA, 13 bp, C. elegans
ggaaaatatcgat

SEQ ID NO: 719441 - DNA, 13 bp, C. elegans
ggaaaatattcat

SEQ ID NO: 719442 - DNA, 13 bp, C. elegans
ggaaaatattttt

SEQ ID NO: 719443 - DNA, 13 bp, C. elegans
ggaaaatcaaaag

SEQ ID NO: 719444 - DNA, 13 bp, C. elegans
ggaaaatcaaaat

SEQ ID NO: 719445 - DNA, 13 bp, C. elegans
ggaaaatcacaaa

SEQ ID NO: 719446 - DNA, 13 bp, C. elegans
ggaaaatccaaaa

SEQ ID NO: 719447 - DNA, 13 bp, C. elegans
ggaaaatccatct

SEQ ID NO: 719448 - DNA, 13 bp, C. elegans
ggaaaatcgaatt

SEQ ID NO: 719449 - DNA, 13 bp, C. elegans
ggaaaatcgataa

SEQ ID NO: 719450 - DNA, 13 bp, C. elegans
ggaaaatctcgaa

SEQ ID NO: 719451 - DNA, 13 bp, C. elegans
ggaaaatctgaaa

SEQ ID NO: 719452 - DNA, 13 bp, C. elegans
ggaaaatcttgaa

SEQ ID NO: 719453 - DNA, 13 bp, C. elegans
ggaaaatgagatt

SEQ ID NO: 719454 - DNA, 13 bp, C. elegans
ggaaaatgataag

SEQ ID NO: 719455 - DNA, 13 bp, C. elegans
ggaaaatgattaa

SEQ ID NO: 719456 - DNA, 13 bp, C. elegans
ggaaaatgatttt

SEQ ID NO: 719457 - DNA, 13 bp, C. elegans
ggaaaatgcaaaa

SEQ ID NO: 719458 - DNA, 13 bp, C. elegans
ggaaaatggcaaa

SEQ ID NO: 719459 - DNA, 13 bp, C. elegans
ggaaaatgtcaat

SEQ ID NO: 719460 - DNA, 13 bp, C. elegans
ggaaaatgtgacg

SEQ ID NO: 719461 - DNA, 13 bp, C. elegans
ggaaaatgtgatt

SEQ ID NO: 719462 - DNA, 14 bp, C. elegans
ggaaaatgtggaaa

SEQ ID NO: 719463 - DNA, 13 bp, C. elegans
ggaaaatgttgca

SEQ ID NO: 719464 - DNA, 13 bp, C. elegans
ggaaaattatcaa

SEQ ID NO: 719465 - DNA, 13 bp, C. elegans
ggaaaattcaaat

SEQ ID NO: 719466 - DNA, 13 bp, C. elegans
ggaaaattccatt

SEQ ID NO: 719467 - DNA, 13 bp, C. elegans
ggaaaattcgaaa

SEQ ID NO: 719468 - DNA, 13 bp, C. elegans
ggaaaattcgata

SEQ ID NO: 719469 - DNA, 13 bp, C. elegans
ggaaaattcggaa

SEQ ID NO: 719470 - DNA, 13 bp, C. elegans
ggaaaattctcga

SEQ ID NO: 719471 - DNA, 13 bp, C. elegans
ggaaaattctgga

SEQ ID NO: 719472 - DNA, 13 bp, C. elegans
ggaaaattcttac

SEQ ID NO: 719473 - DNA, 13 bp, C. elegans
ggaaaattgattt

SEQ ID NO: 719474 - DNA, 13 bp, C. elegans
ggaaaattgcaaa

SEQ ID NO: 719475 - DNA, 13 bp, C. elegans
ggaaaattgtaaa

SEQ ID NO: 719476 - DNA, 13 bp, C. elegans
ggaaaattgtcaa

SEQ ID NO: 719477 - DNA, 13 bp, C. elegans
ggaaaattgtcgg

SEQ ID NO: 719478 - DNA, 13 bp, C. elegans
ggaaaattgtgaa

SEQ ID NO: 719479 - DNA, 13 bp, C. elegans
ggaaaattgttga

SEQ ID NO: 719480 - DNA, 13 bp, C. elegans
ggaaaatttaaat

SEQ ID NO: 719481 - DNA, 13 bp, C. elegans
ggaaaatttgaat

SEQ ID NO: 719482 - DNA, 13 bp, C. elegans
ggaaacaaaatat

SEQ ID NO: 719483 - DNA, 13 bp, C. elegans
ggaaacaaattga

SEQ ID NO: 719484 - DNA, 13 bp, C. elegans
ggaaacaagtatt

SEQ ID NO: 719485 - DNA, 13 bp, C. elegans
ggaaacaataaat

SEQ ID NO: 719486 - DNA, 13 bp, C. elegans
ggaaacaattttt

SEQ ID NO: 719487 - DNA, 13 bp, C. elegans
ggaaacagtaaaa

SEQ ID NO: 719488 - DNA, 13 bp, C. elegans
ggaaacatatatt

SEQ ID NO: 719489 - DNA, 13 bp, C. elegans
ggaaacatttcaa

SEQ ID NO: 719490 - DNA, 13 bp, C. elegans
ggaaacgaaaatt

SEQ ID NO: 719491 - DNA, 13 bp, C. elegans
ggaaacgggaatt

SEQ ID NO: 719492 - DNA, 13 bp, C. elegans
ggaaactcaaaaa

SEQ ID NO: 719493 - DNA, 13 bp, C. elegans
ggaaactcaattt

SEQ ID NO: 719494 - DNA, 13 bp, C. elegans
ggaaactgagaaa

SEQ ID NO: 719495 - DNA, 13 bp, C. elegans
ggaaacttcttga

SEQ ID NO: 719496 - DNA, 13 bp, C. elegans
ggaaactttcaaa

SEQ ID NO: 719497 - DNA, 13 bp, C. elegans
ggaaactttttat

SEQ ID NO: 719498 - DNA, 13 bp, C. elegans
ggaaactttttga

SEQ ID NO: 719499 - DNA, 13 bp, C. elegans
ggaaagccgtgta

SEQ ID NO: 719500 - DNA, 13 bp, C. elegans
ggaaagtgacgaa

SEQ ID NO: 719501 - DNA, 13 bp, C. elegans
ggaaagttcaaat

SEQ ID NO: 719502 - DNA, 13 bp, C. elegans
ggaaagtttgtga

SEQ ID NO: 719503 - DNA, 13 bp, C. elegans
ggaaataataatt

SEQ ID NO: 719504 - DNA, 13 bp, C. elegans
ggaaataatttta

SEQ ID NO: 719505 - DNA, 13 bp, C. elegans
ggaaataattttt

SEQ ID NO: 719506 - DNA, 13 bp, C. elegans
ggaaatacgcaaa

SEQ ID NO: 719507 - DNA, 13 bp, C. elegans
ggaaatataaatt

SEQ ID NO: 719508 - DNA, 13 bp, C. elegans
ggaaatatcaatt

SEQ ID NO: 719509 - DNA, 13 bp, C. elegans
ggaaatatcgaaa

SEQ ID NO: 719510 - DNA, 13 bp, C. elegans
ggaaatatggaaa

SEQ ID NO: 719511 - DNA, 14 bp, C. elegans
ggaaatattcaaaa

SEQ ID NO: 719512 - DNA, 13 bp, C. elegans
ggaaatatttatt

SEQ ID NO: 719513 - DNA, 13 bp, C. elegans
ggaaatattttca

SEQ ID NO: 719514 - DNA, 13 bp, C. elegans
ggaaatattttga

SEQ ID NO: 719515 - DNA, 13 bp, C. elegans
ggaaatcaacaaa

SEQ ID NO: 719516 - DNA, 13 bp, C. elegans
ggaaatcagaatt

SEQ ID NO: 719517 - DNA, 13 bp, C. elegans
ggaaatcagtttt

SEQ ID NO: 719518 - DNA, 13 bp, C. elegans
ggaaatcatttat

SEQ ID NO: 719519 - DNA, 13 bp, C. elegans
ggaaatcgaaaaa

SEQ ID NO: 719520 - DNA, 13 bp, C. elegans
ggaaatcgaaatt

SEQ ID NO: 719521 - DNA, 13 bp, C. elegans
ggaaatcttcaat

SEQ ID NO: 719522 - DNA, 13 bp, C. elegans
ggaaatcttgcaa

SEQ ID NO: 719523 - DNA, 13 bp, C. elegans
ggaaatgaaaatt

SEQ ID NO: 719524 - DNA, 13 bp, C. elegans
ggaaatgaacatt

SEQ ID NO: 719525 - DNA, 13 bp, C. elegans
ggaaatgaagaat

SEQ ID NO: 719526 - DNA, 13 bp, C. elegans
ggaaatgatgaaa

SEQ ID NO: 719527 - DNA, 13 bp, C. elegans
ggaaatgtataaa

SEQ ID NO: 719528 - DNA, 13 bp, C. elegans
ggaaatgtcaaaa

SEQ ID NO: 719529 - DNA, 13 bp, C. elegans
ggaaatgtttcta

SEQ ID NO: 719530 - DNA, 13 bp, C. elegans
ggaaatgtttgat

SEQ ID NO: 719531 - DNA, 13 bp, C. elegans
ggaaatgtttgga

SEQ ID NO: 719532 - DNA, 13 bp, C. elegans
ggaaatgtttttt

SEQ ID NO: 719533 - DNA, 13 bp, C. elegans
ggaaattaaaatt

SEQ ID NO: 719534 - DNA, 13 bp, C. elegans
ggaaattaaattt

SEQ ID NO: 719535 - DNA, 13 bp, C. elegans
ggaaattaacatt

SEQ ID NO: 719536 - DNA, 13 bp, C. elegans
ggaaattaacttt

SEQ ID NO: 719537 - DNA, 13 bp, C. elegans
ggaaattaatttt

SEQ ID NO: 719538 - DNA, 13 bp, C. elegans
ggaaattatcgat

SEQ ID NO: 719539 - DNA, 13 bp, C. elegans
ggaaattcaaaaa

SEQ ID NO: 719540 - DNA, 13 bp, C. elegans
ggaaattcaaaac

SEQ ID NO: 719541 - DNA, 14 bp, C. elegans
ggaaattcaaaata

SEQ ID NO: 719542 - DNA, 14 bp, C. elegans
ggaaattcaaaatt

SEQ ID NO: 719543 - DNA, 13 bp, C. elegans
ggaaattcaattt

SEQ ID NO: 719544 - DNA, 13 bp, C. elegans
ggaaattcacatt

SEQ ID NO: 719545 - DNA, 13 bp, C. elegans
ggaaattcagaat

SEQ ID NO: 719546 - DNA, 13 bp, C. elegans
ggaaattcagttt

SEQ ID NO: 719547 - DNA, 13 bp, C. elegans
ggaaattccagaa

SEQ ID NO: 719548 - DNA, 13 bp, C. elegans
ggaaattctcaat

SEQ ID NO: 719549 - DNA, 13 bp, C. elegans
ggaaattctggaa

SEQ ID NO: 719550 - DNA, 13 bp, C. elegans
ggaaattgaaaat

SEQ ID NO: 719551 - DNA, 13 bp, C. elegans
ggaaattgaaaga

SEQ ID NO: 719552 - DNA, 13 bp, C. elegans
ggaaattgaaata

SEQ ID NO: 719553 - DNA, 13 bp, C. elegans
ggaaattgaaatt

SEQ ID NO: 719554 - DNA, 13 bp, C. elegans
ggaaattgaataa

SEQ ID NO: 719555 - DNA, 13 bp, C. elegans
ggaaattgaggaa

SEQ ID NO: 719556 - DNA, 13 bp, C. elegans
ggaaattgagttt

SEQ ID NO: 719557 - DNA, 13 bp, C. elegans
ggaaattgataaa

SEQ ID NO: 719558 - DNA, 13 bp, C. elegans
ggaaattgccgaa

SEQ ID NO: 719559 - DNA, 13 bp, C. elegans
ggaaattgcgaaa

SEQ ID NO: 719560 - DNA, 13 bp, C. elegans
ggaaattgctgaa

SEQ ID NO: 719561 - DNA, 13 bp, C. elegans
ggaaattgcttta

SEQ ID NO: 719562 - DNA, 13 bp, C. elegans
ggaaattggagaa

SEQ ID NO: 719563 - DNA, 13 bp, C. elegans
ggaaattggattt

SEQ ID NO: 719564 - DNA, 13 bp, C. elegans
ggaaattggtgaa

SEQ ID NO: 719565 - DNA, 13 bp, C. elegans
ggaaattgtagaa

SEQ ID NO: 719566 - DNA, 13 bp, C. elegans
ggaaattgtcaat

SEQ ID NO: 719567 - DNA, 13 bp, C. elegans
ggaaattgtggaa

SEQ ID NO: 719568 - DNA, 13 bp, C. elegans
ggaaattgtgtga

SEQ ID NO: 719569 - DNA, 13 bp, C. elegans
ggaaatttaaatt

SEQ ID NO: 719570 - DNA, 13 bp, C. elegans
ggaaatttaattt

SEQ ID NO: 719571 - DNA, 13 bp, C. elegans
ggaaatttcaaac

SEQ ID NO: 719572 - DNA, 13 bp, C. elegans
ggaaatttcaatt

SEQ ID NO: 719573 - DNA, 13 bp, C. elegans
ggaaatttcacaa

SEQ ID NO: 719574 - DNA, 13 bp, C. elegans
ggaaatttccaat

SEQ ID NO: 719575 - DNA, 13 bp, C. elegans
ggaaatttccgat

SEQ ID NO: 719576 - DNA, 13 bp, C. elegans
ggaaatttccggc

SEQ ID NO: 719577 - DNA, 13 bp, C. elegans
ggaaatttcgttt

SEQ ID NO: 719578 - DNA, 13 bp, C. elegans
ggaaatttgatta

SEQ ID NO: 719579 - DNA, 13 bp, C. elegans
ggaaatttgattt

SEQ ID NO: 719580 - DNA, 13 bp, C. elegans
ggaaatttgcaaa

SEQ ID NO: 719581 - DNA, 14 bp, C. elegans
ggaaatttggaaaa

SEQ ID NO: 719582 - DNA, 13 bp, C. elegans
ggaaatttgtatt

SEQ ID NO: 719583 - DNA, 13 bp, C. elegans
ggaaatttgtttt

SEQ ID NO: 719584 - DNA, 13 bp, C. elegans
ggaaattttagtt

SEQ ID NO: 719585 - DNA, 13 bp, C. elegans
ggaaattttattt

SEQ ID NO: 719586 - DNA, 13 bp, C. elegans
ggaaattttcatt

SEQ ID NO: 719587 - DNA, 13 bp, C. elegans
ggaaattttcgat

SEQ ID NO: 719588 - DNA, 13 bp, C. elegans
ggaaattttctaa

SEQ ID NO: 719589 - DNA, 13 bp, C. elegans
ggaaattttggtt

SEQ ID NO: 719590 - DNA, 13 bp, C. elegans
ggaaatttttaat

SEQ ID NO: 719591 - DNA, 13 bp, C. elegans
ggaaatttttaga

SEQ ID NO: 719592 - DNA, 13 bp, C. elegans
ggaaatttttcga

SEQ ID NO: 719593 - DNA, 13 bp, C. elegans
ggaaattttttga

SEQ ID NO: 719594 - DNA, 13 bp, C. elegans
ggaaatttttttg

SEQ ID NO: 719595 - DNA, 13 bp, C. elegans
ggaacaaacggaa

SEQ ID NO: 719596 - DNA, 13 bp, C. elegans
ggaacaaatgaaa

SEQ ID NO: 719597 - DNA, 13 bp, C. elegans
ggaacaaatgtat

SEQ ID NO: 719598 - DNA, 13 bp, C. elegans
ggaacaaatttca

SEQ ID NO: 719599 - DNA, 13 bp, C. elegans
ggaacactaaatt

SEQ ID NO: 719600 - DNA, 13 bp, C. elegans
ggaacatgcccaa

SEQ ID NO: 719601 - DNA, 13 bp, C. elegans
ggaacattttgga

SEQ ID NO: 719602 - DNA, 13 bp, C. elegans
ggaacggctcaaa

SEQ ID NO: 719603 - DNA, 13 bp, C. elegans
ggaactacagtac

SEQ ID NO: 719604 - DNA, 13 bp, C. elegans
ggaactatttcta

SEQ ID NO: 719605 - DNA, 13 bp, C. elegans
ggaactatttttt

SEQ ID NO: 719606 - DNA, 13 bp, C. elegans
ggaactggaaaaa

SEQ ID NO: 719607 - DNA, 13 bp, C. elegans
ggaacttcaaaat

SEQ ID NO: 719608 - DNA, 13 bp, C. elegans
ggaacttgaaatt

SEQ ID NO: 719609 - DNA, 13 bp, C. elegans
ggaacttgatttt

SEQ ID NO: 719610 - DNA, 13 bp, C. elegans
ggaacttttggaa

SEQ ID NO: 719611 - DNA, 13 bp, C. elegans
ggaagaaatgtat

SEQ ID NO: 719612 - DNA, 13 bp, C. elegans
ggaagaaattcgt

SEQ ID NO: 719613 - DNA, 13 bp, C. elegans
ggaagaccagaac

SEQ ID NO: 719614 - DNA, 13 bp, C. elegans
ggaagactacaga

SEQ ID NO: 719615 - DNA, 13 bp, C. elegans
ggaagagaaaatt

SEQ ID NO: 719616 - DNA, 13 bp, C. elegans
ggaagagacgcag

SEQ ID NO: 719617 - DNA, 13 bp, C. elegans
ggaagagttcgaa

SEQ ID NO: 719618 - DNA, 14 bp, C. elegans
ggaagatgaagttt

SEQ ID NO: 719619 - DNA, 13 bp, C. elegans
ggaagatttttta

SEQ ID NO: 719620 - DNA, 13 bp, C. elegans
ggaaggctctgaa

SEQ ID NO: 719621 - DNA, 13 bp, C. elegans
ggaaggtctccga

SEQ ID NO: 719622 - DNA, 13 bp, C. elegans
ggaagtggagcaa

SEQ ID NO: 719623 - DNA, 13 bp, C. elegans
ggaagttcctcaa

SEQ ID NO: 719624 - DNA, 13 bp, C. elegans
ggaagttgaaaaa

SEQ ID NO: 719625 - DNA, 13 bp, C. elegans
ggaagtttatttt

SEQ ID NO: 719626 - DNA, 13 bp, C. elegans
ggaagtttcagaa

SEQ ID NO: 719627 - DNA, 13 bp, C. elegans
ggaagtttgaatt

SEQ ID NO: 719628 - DNA, 13 bp, C. elegans
ggaagttttgaaa

SEQ ID NO: 719629 - DNA, 13 bp, C. elegans
ggaataaatattt

SEQ ID NO: 719630 - DNA, 13 bp, C. elegans
ggaatacagtttt

SEQ ID NO: 719631 - DNA, 13 bp, C. elegans
ggaatacgaaaaa

SEQ ID NO: 719632 - DNA, 13 bp, C. elegans
ggaatatattttt

SEQ ID NO: 719633 - DNA, 13 bp, C. elegans
ggaatatcagaaa

SEQ ID NO: 719634 - DNA, 13 bp, C. elegans
ggaatatctgaaa

SEQ ID NO: 719635 - DNA, 13 bp, C. elegans
ggaatatgtgaaa

SEQ ID NO: 719636 - DNA, 13 bp, C. elegans
ggaatattctgaa

SEQ ID NO: 719637 - DNA, 13 bp, C. elegans
ggaatattgttgg

SEQ ID NO: 719638 - DNA, 13 bp, C. elegans
ggaatatttgaaa

SEQ ID NO: 719639 - DNA, 13 bp, C. elegans
ggaatcaaaaaat

SEQ ID NO: 719640 - DNA, 13 bp, C. elegans
ggaatcaagagaa

SEQ ID NO: 719641 - DNA, 13 bp, C. elegans
ggaatcgctctaa

SEQ ID NO: 719642 - DNA, 13 bp, C. elegans
ggaatcttgttcg

SEQ ID NO: 719643 - DNA, 13 bp, C. elegans
ggaatcttttttt

SEQ ID NO: 719644 - DNA, 13 bp, C. elegans
ggaatgtcagcat

SEQ ID NO: 719645 - DNA, 13 bp, C. elegans
ggaatgtttaaaa

SEQ ID NO: 719646 - DNA, 13 bp, C. elegans
ggaatgtttcaaa

SEQ ID NO: 719647 - DNA, 13 bp, C. elegans
ggaattaaaaatt

SEQ ID NO: 719648 - DNA, 13 bp, C. elegans
ggaattaaaattg

SEQ ID NO: 719649 - DNA, 13 bp, C. elegans
ggaattaaatttt

SEQ ID NO: 719650 - DNA, 13 bp, C. elegans
ggaattcaaaatt

SEQ ID NO: 719651 - DNA, 13 bp, C. elegans
ggaattcaaattg

SEQ ID NO: 719652 - DNA, 13 bp, C. elegans
ggaattcaaattt

SEQ ID NO: 719653 - DNA, 13 bp, C. elegans
ggaattcaagaca

SEQ ID NO: 719654 - DNA, 13 bp, C. elegans
ggaattcaatttt

SEQ ID NO: 719655 - DNA, 13 bp, C. elegans
ggaattcagaaaa

SEQ ID NO: 719656 - DNA, 13 bp, C. elegans
ggaattcatctac

SEQ ID NO: 719657 - DNA, 13 bp, C. elegans
ggaattccaattt

SEQ ID NO: 719658 - DNA, 13 bp, C. elegans
ggaattccataat

SEQ ID NO: 719659 - DNA, 13 bp, C. elegans
ggaattcgaattt

SEQ ID NO: 719660 - DNA, 13 bp, C. elegans
ggaattcggagct

SEQ ID NO: 719661 - DNA, 13 bp, C. elegans
ggaattctatttt

SEQ ID NO: 719662 - DNA, 13 bp, C. elegans
ggaattgaagatt

SEQ ID NO: 719663 - DNA, 13 bp, C. elegans
ggaattgaatatt

SEQ ID NO: 719664 - DNA, 13 bp, C. elegans
ggaattgaatgaa

SEQ ID NO: 719665 - DNA, 13 bp, C. elegans
ggaattgccaaaa

SEQ ID NO: 719666 - DNA, 13 bp, C. elegans
ggaattggaaact

SEQ ID NO: 719667 - DNA, 13 bp, C. elegans
ggaattgggaaat

SEQ ID NO: 719668 - DNA, 13 bp, C. elegans
ggaatttacgtta

SEQ ID NO: 719669 - DNA, 13 bp, C. elegans
ggaatttattgaa

SEQ ID NO: 719670 - DNA, 13 bp, C. elegans
ggaatttattgga

SEQ ID NO: 719671 - DNA, 13 bp, C. elegans
ggaatttcagaaa

SEQ ID NO: 719672 - DNA, 13 bp, C. elegans
ggaatttcatttt

SEQ ID NO: 719673 - DNA, 13 bp, C. elegans
ggaatttcggagc

SEQ ID NO: 719674 - DNA, 13 bp, C. elegans
ggaatttctaaaa

SEQ ID NO: 719675 - DNA, 13 bp, C. elegans
ggaatttgaaaaa

SEQ ID NO: 719676 - DNA, 13 bp, C. elegans
ggaatttgaatat

SEQ ID NO: 719677 - DNA, 13 bp, C. elegans
ggaatttgaattt

SEQ ID NO: 719678 - DNA, 13 bp, C. elegans
ggaatttgagaaa

SEQ ID NO: 719679 - DNA, 13 bp, C. elegans
ggaatttgccgat

SEQ ID NO: 719680 - DNA, 13 bp, C. elegans
ggaattttaagat

SEQ ID NO: 719681 - DNA, 13 bp, C. elegans
ggaattttacttt

SEQ ID NO: 719682 - DNA, 13 bp, C. elegans
ggaattttatatt

SEQ ID NO: 719683 - DNA, 13 bp, C. elegans
ggaattttcaatt

SEQ ID NO: 719684 - DNA, 13 bp, C. elegans
ggaattttgtatg

SEQ ID NO: 719685 - DNA, 13 bp, C. elegans
ggaattttgttta

SEQ ID NO: 719686 - DNA, 13 bp, C. elegans
ggaatttttcaaa

SEQ ID NO: 719687 - DNA, 14 bp, C. elegans
ggaatttttcaaaa

SEQ ID NO: 719688 - DNA, 13 bp, C. elegans
ggaatttttgcat

SEQ ID NO: 719689 - DNA, 13 bp, C. elegans
ggaatttttttgg

SEQ ID NO: 719690 - DNA, 13 bp, C. elegans
ggaattttttttc

SEQ ID NO: 719691 - DNA, 13 bp, C. elegans
ggacaaaatcaat

SEQ ID NO: 719692 - DNA, 13 bp, C. elegans
ggacaaaggcaaa

SEQ ID NO: 719693 - DNA, 13 bp, C. elegans
ggacaaatacatt

SEQ ID NO: 719694 - DNA, 13 bp, C. elegans
ggacaaatgcatt

SEQ ID NO: 719695 - DNA, 13 bp, C. elegans
ggacaacctgaca

SEQ ID NO: 719696 - DNA, 13 bp, C. elegans
ggacaacctggca

SEQ ID NO: 719697 - DNA, 13 bp, C. elegans
ggacaacgcgtgg

SEQ ID NO: 719698 - DNA, 13 bp, C. elegans
ggacaactgttaa

SEQ ID NO: 719699 - DNA, 13 bp, C. elegans
ggacaagttcaac

SEQ ID NO: 719700 - DNA, 13 bp, C. elegans
ggacatcacgttt

SEQ ID NO: 719701 - DNA, 13 bp, C. elegans
ggacatggtgcat

SEQ ID NO: 719702 - DNA, 13 bp, C. elegans
ggacatttgtttt

SEQ ID NO: 719703 - DNA, 13 bp, C. elegans
ggacatttttcaa

SEQ ID NO: 719704 - DNA, 13 bp, C. elegans
ggacattttttga

SEQ ID NO: 719705 - DNA, 14 bp, C. elegans
ggaccaaatggacc

SEQ ID NO: 719706 - DNA, 13 bp, C. elegans
ggaccaatcagcg

SEQ ID NO: 719707 - DNA, 13 bp, C. elegans
ggaccattttggg

SEQ ID NO: 719708 - DNA, 13 bp, C. elegans
ggacccaaatttt

SEQ ID NO: 719709 - DNA, 13 bp, C. elegans
ggacgattttgaa

SEQ ID NO: 719710 - DNA, 13 bp, C. elegans
ggactacgctcag

SEQ ID NO: 719711 - DNA, 13 bp, C. elegans
ggactcaaaattg

SEQ ID NO: 719712 - DNA, 13 bp, C. elegans
ggactcgaacccc

SEQ ID NO: 719713 - DNA, 13 bp, C. elegans
ggactttctgact

SEQ ID NO: 719714 - DNA, 13 bp, C. elegans
ggactttttggaa

SEQ ID NO: 719715 - DNA, 13 bp, C. elegans
ggactttttggac

SEQ ID NO: 719716 - DNA, 13 bp, C. elegans
ggagaaaaatcgg

SEQ ID NO: 719717 - DNA, 13 bp, C. elegans
ggagaaagtgtca

SEQ ID NO: 719718 - DNA, 13 bp, C. elegans
ggagaaatgaatg

SEQ ID NO: 719719 - DNA, 13 bp, C. elegans
ggagaagagacac

SEQ ID NO: 719720 - DNA, 13 bp, C. elegans
ggagaagagacgc

SEQ ID NO: 719721 - DNA, 13 bp, C. elegans
ggagaagctgttg

SEQ ID NO: 719722 - DNA, 13 bp, C. elegans
ggagaatctgaaa

SEQ ID NO: 719723 - DNA, 13 bp, C. elegans
ggagaattcgaat

SEQ ID NO: 719724 - DNA, 13 bp, C. elegans
ggagaatttgaat

SEQ ID NO: 719725 - DNA, 13 bp, C. elegans
ggagacgcagaca

SEQ ID NO: 719726 - DNA, 13 bp, C. elegans
ggagacgcaggca

SEQ ID NO: 719727 - DNA, 31 bp, C. elegans
ggagacgtacagttgagggctatatcttgta

SEQ ID NO: 719728 - DNA, 13 bp, C. elegans
ggagagacgcaga

SEQ ID NO: 719729 - DNA, 13 bp, C. elegans
ggagatacgaaaa

SEQ ID NO: 719730 - DNA, 13 bp, C. elegans
ggagatcaaacca

SEQ ID NO: 719731 - DNA, 13 bp, C. elegans
ggagatcaaaccg

SEQ ID NO: 719732 - DNA, 13 bp, C. elegans
ggagatctggaaa

SEQ ID NO: 719733 - DNA, 13 bp, C. elegans
ggagatgctggaa

SEQ ID NO: 719734 - DNA, 13 bp, C. elegans
ggagattcaaatt

SEQ ID NO: 719735 - DNA, 13 bp, C. elegans
ggagcaaaactga

SEQ ID NO: 719736 - DNA, 13 bp, C. elegans
ggagcaccaccag

SEQ ID NO: 719737 - DNA, 13 bp, C. elegans
ggagcacctaatt

SEQ ID NO: 719738 - DNA, 13 bp, C. elegans
ggagcactttgaa

SEQ ID NO: 719739 - DNA, 13 bp, C. elegans
ggagcagaagatt

SEQ ID NO: 719740 - DNA, 13 bp, C. elegans
ggagcagcaacaa

SEQ ID NO: 719741 - DNA, 13 bp, C. elegans
ggagcattttgaa

SEQ ID NO: 719742 - DNA, 13 bp, C. elegans
ggagcgcgcttgc

SEQ ID NO: 719743 - DNA, 13 bp, C. elegans
ggagcgcgtttgc

SEQ ID NO: 719744 - DNA, 13 bp, C. elegans
ggagctgaaaacc

SEQ ID NO: 719745 - DNA, 13 bp, C. elegans
ggagctgaaaact

SEQ ID NO: 719746 - DNA, 14 bp, C. elegans
ggagctggagctgg

SEQ ID NO: 719747 - DNA, 13 bp, C. elegans
ggagcttcaaaat

SEQ ID NO: 719748 - DNA, 13 bp, C. elegans
ggaggaaaattga

SEQ ID NO: 719749 - DNA, 13 bp, C. elegans
ggaggaaaatttt

SEQ ID NO: 719750 - DNA, 13 bp, C. elegans
ggagtactgtaat

SEQ ID NO: 719751 - DNA, 13 bp, C. elegans
ggagtagcgcaag

SEQ ID NO: 719752 - DNA, 13 bp, C. elegans
ggagtatcgtcaa

SEQ ID NO: 719753 - DNA, 13 bp, C. elegans
ggagtgcaagtct

SEQ ID NO: 719754 - DNA, 13 bp, C. elegans
ggagtgcaatact

SEQ ID NO: 719755 - DNA, 13 bp, C. elegans
ggagttacttttt

SEQ ID NO: 719756 - DNA, 13 bp, C. elegans
ggagttataaaaa

SEQ ID NO: 719757 - DNA, 13 bp, C. elegans
ggagttgatggtg

SEQ ID NO: 719758 - DNA, 13 bp, C. elegans
ggataaaagttaa

SEQ ID NO: 719759 - DNA, 13 bp, C. elegans
ggataaatttgaa

SEQ ID NO: 719760 - DNA, 13 bp, C. elegans
ggataatttattt

SEQ ID NO: 719761 - DNA, 13 bp, C. elegans
ggatacatttctt

SEQ ID NO: 719762 - DNA, 13 bp, C. elegans
ggatatattttta

SEQ ID NO: 719763 - DNA, 13 bp, C. elegans
ggatatcaatttg

SEQ ID NO: 719764 - DNA, 13 bp, C. elegans
ggatattcaaatt

SEQ ID NO: 719765 - DNA, 13 bp, C. elegans
ggatattttcaat

SEQ ID NO: 719766 - DNA, 13 bp, C. elegans
ggatattttctaa

SEQ ID NO: 719767 - DNA, 13 bp, C. elegans
ggatctaggatct

SEQ ID NO: 719768 - DNA, 13 bp, C. elegans
ggatctagttttt

SEQ ID NO: 719769 - DNA, 13 bp, C. elegans
ggatgaaaattga

SEQ ID NO: 719770 - DNA, 13 bp, C. elegans
ggatgatgatgat

SEQ ID NO: 719771 - DNA, 13 bp, C. elegans
ggatgcttatatc

SEQ ID NO: 719772 - DNA, 13 bp, C. elegans
ggatggattggga

SEQ ID NO: 719773 - DNA, 13 bp, C. elegans
ggatgggcggcaa

SEQ ID NO: 719774 - DNA, 14 bp, C. elegans
ggatgggctggaca

SEQ ID NO: 719775 - DNA, 13 bp, C. elegans
ggatgttatgaaa

SEQ ID NO: 719776 - DNA, 13 bp, C. elegans
ggatgttgtcggg

SEQ ID NO: 719777 - DNA, 13 bp, C. elegans
ggattaaaacatt

SEQ ID NO: 719778 - DNA, 13 bp, C. elegans
ggattaaaggatt

SEQ ID NO: 719779 - DNA, 13 bp, C. elegans
ggattacggtagt

SEQ ID NO: 719780 - DNA, 13 bp, C. elegans
ggattactgtaac

SEQ ID NO: 719781 - DNA, 13 bp, C. elegans
ggattactgtaga

SEQ ID NO: 719782 - DNA, 13 bp, C. elegans
ggattactgtagc

SEQ ID NO: 719783 - DNA, 13 bp, C. elegans
ggattactgtatt

SEQ ID NO: 719784 - DNA, 14 bp, C. elegans
ggattcgcgtcgcc

SEQ ID NO: 719785 - DNA, 13 bp, C. elegans
ggattctactgta

SEQ ID NO: 719786 - DNA, 13 bp, C. elegans
ggattcttttatt

SEQ ID NO: 719787 - DNA, 13 bp, C. elegans
ggattgatctacg

SEQ ID NO: 719788 - DNA, 13 bp, C. elegans
ggatttaaaattt

SEQ ID NO: 719789 - DNA, 13 bp, C. elegans
ggatttatcgatt

SEQ ID NO: 719790 - DNA, 13 bp, C. elegans
ggatttattcaga

SEQ ID NO: 719791 - DNA, 13 bp, C. elegans
ggatttcaatggt

SEQ ID NO: 719792 - DNA, 13 bp, C. elegans
ggatttcagattt

SEQ ID NO: 719793 - DNA, 13 bp, C. elegans
ggatttcctcaaa

SEQ ID NO: 719794 - DNA, 13 bp, C. elegans
ggatttcttgaaa

SEQ ID NO: 719795 - DNA, 13 bp, C. elegans
ggatttgagaaaa

SEQ ID NO: 719796 - DNA, 13 bp, C. elegans
ggatttgccgaat

SEQ ID NO: 719797 - DNA, 13 bp, C. elegans
ggatttgccggaa

SEQ ID NO: 719798 - DNA, 13 bp, C. elegans
ggatttggaaaaa

SEQ ID NO: 719799 - DNA, 13 bp, C. elegans
ggatttgttcgat

SEQ ID NO: 719800 - DNA, 13 bp, C. elegans
ggattttaaaaaa

SEQ ID NO: 719801 - DNA, 13 bp, C. elegans
ggattttaagaaa

SEQ ID NO: 719802 - DNA, 13 bp, C. elegans
ggattttaatatt

SEQ ID NO: 719803 - DNA, 13 bp, C. elegans
ggattttatgtta

SEQ ID NO: 719804 - DNA, 13 bp, C. elegans
ggattttattcaa

SEQ ID NO: 719805 - DNA, 13 bp, C. elegans
ggattttcaataa

SEQ ID NO: 719806 - DNA, 13 bp, C. elegans
ggattttccaaac

SEQ ID NO: 719807 - DNA, 13 bp, C. elegans
ggattttcctttt

SEQ ID NO: 719808 - DNA, 13 bp, C. elegans
ggattttctaatt

SEQ ID NO: 719809 - DNA, 13 bp, C. elegans
ggattttctggaa

SEQ ID NO: 719810 - DNA, 13 bp, C. elegans
ggattttgaaaaa

SEQ ID NO: 719811 - DNA, 13 bp, C. elegans
ggattttgaaatt

SEQ ID NO: 719812 - DNA, 13 bp, C. elegans
ggattttgaactt

SEQ ID NO: 719813 - DNA, 13 bp, C. elegans
ggattttgcaaaa

SEQ ID NO: 719814 - DNA, 13 bp, C. elegans
ggattttgcttca

SEQ ID NO: 719815 - DNA, 13 bp, C. elegans
ggattttggaaaa

SEQ ID NO: 719816 - DNA, 13 bp, C. elegans
ggattttgtaaat

SEQ ID NO: 719817 - DNA, 13 bp, C. elegans
ggatttttaaagg

SEQ ID NO: 719818 - DNA, 13 bp, C. elegans
ggatttttaaatt

SEQ ID NO: 719819 - DNA, 13 bp, C. elegans
ggatttttcattt

SEQ ID NO: 719820 - DNA, 13 bp, C. elegans
ggatttttcgttt

SEQ ID NO: 719821 - DNA, 13 bp, C. elegans
ggatttttcttta

SEQ ID NO: 719822 - DNA, 13 bp, C. elegans
ggatttttgaaaa

SEQ ID NO: 719823 - DNA, 13 bp, C. elegans
ggatttttgagtg

SEQ ID NO: 719824 - DNA, 13 bp, C. elegans
ggatttttgcaat

SEQ ID NO: 719825 - DNA, 13 bp, C. elegans
ggatttttggatt

SEQ ID NO: 719826 - DNA, 13 bp, C. elegans
ggattttttaaat

SEQ ID NO: 719827 - DNA, 13 bp, C. elegans
ggattttttataa

SEQ ID NO: 719828 - DNA, 13 bp, C. elegans
ggattttttctga

SEQ ID NO: 719829 - DNA, 13 bp, C. elegans
ggcaaaaaatcga

SEQ ID NO: 719830 - DNA, 13 bp, C. elegans
ggcaaaaactgag

SEQ ID NO: 719831 - DNA, 13 bp, C. elegans
ggcaaaaatcaat

SEQ ID NO: 719832 - DNA, 13 bp, C. elegans
ggcaaaattcaaa

SEQ ID NO: 719833 - DNA, 13 bp, C. elegans
ggcaaaattgcac

SEQ ID NO: 719834 - DNA, 13 bp, C. elegans
ggcaaaattgttc

SEQ ID NO: 719835 - DNA, 13 bp, C. elegans
ggcaaaattttga

SEQ ID NO: 719836 - DNA, 15 bp, C. elegans
ggcaaactcttccat

SEQ ID NO: 719837 - DNA, 43 bp, C. elegans
ggcaaatactgaaatactaccttgtgttaatactacttttgct

SEQ ID NO: 719838 - DNA, 13 bp, C. elegans
ggcaaatcaacaa

SEQ ID NO: 719839 - DNA, 13 bp, C. elegans
ggcaaatcgcaaa

SEQ ID NO: 719840 - DNA, 13 bp, C. elegans
ggcaaatcggaaa

SEQ ID NO: 719841 - DNA, 13 bp, C. elegans
ggcaaatcggcaa

SEQ ID NO: 719842 - DNA, 13 bp, C. elegans
ggcaaattgattt

SEQ ID NO: 719843 - DNA, 13 bp, C. elegans
ggcaaattgccag

SEQ ID NO: 719844 - DNA, 13 bp, C. elegans
ggcaaattgcctg

SEQ ID NO: 719845 - DNA, 13 bp, C. elegans
ggcaaattggcaa

SEQ ID NO: 719846 - DNA, 13 bp, C. elegans
ggcaaattgtcaa

SEQ ID NO: 719847 - DNA, 13 bp, C. elegans
ggcaaatttaccg

SEQ ID NO: 719848 - DNA, 13 bp, C. elegans
ggcaaatttgcaa

SEQ ID NO: 719849 - DNA, 13 bp, C. elegans
ggcaaattttgag

SEQ ID NO: 719850 - DNA, 13 bp, C. elegans
ggcaacaaattag

SEQ ID NO: 719851 - DNA, 13 bp, C. elegans
ggcaacatttgaa

SEQ ID NO: 719852 - DNA, 13 bp, C. elegans
ggcaatcggcaat

SEQ ID NO: 719853 - DNA, 13 bp, C. elegans
ggcaatcggcgat

SEQ ID NO: 719854 - DNA, 13 bp, C. elegans
ggcaatgtgccaa

SEQ ID NO: 719855 - DNA, 13 bp, C. elegans
ggcaattcaaaat

SEQ ID NO: 719856 - DNA, 13 bp, C. elegans
ggcaattccagca

SEQ ID NO: 719857 - DNA, 13 bp, C. elegans
ggcaattcggcaa

SEQ ID NO: 719858 - DNA, 13 bp, C. elegans
ggcaattgcagtt

SEQ ID NO: 719859 - DNA, 13 bp, C. elegans
ggcaattgccgtt

SEQ ID NO: 719860 - DNA, 13 bp, C. elegans
ggcaattggaaat

SEQ ID NO: 719861 - DNA, 13 bp, C. elegans
ggcaattggcaat

SEQ ID NO: 719862 - DNA, 13 bp, C. elegans
ggcaatttcaaaa

SEQ ID NO: 719863 - DNA, 13 bp, C. elegans
ggcaatttccgcc

SEQ ID NO: 719864 - DNA, 13 bp, C. elegans
ggcaatttgaaaa

SEQ ID NO: 719865 - DNA, 13 bp, C. elegans
ggcaatttgccaa

SEQ ID NO: 719866 - DNA, 13 bp, C. elegans
ggcaatttgtgaa

SEQ ID NO: 719867 - DNA, 13 bp, C. elegans
ggcaattttctaa

SEQ ID NO: 719868 - DNA, 13 bp, C. elegans
ggcaatttttttc

SEQ ID NO: 719869 - DNA, 13 bp, C. elegans
ggcaatttttttt

SEQ ID NO: 719870 - DNA, 13 bp, C. elegans
ggcacaaaaatcg

SEQ ID NO: 719871 - DNA, 13 bp, C. elegans
ggcacacaatttt

SEQ ID NO: 719872 - DNA, 13 bp, C. elegans
ggcacacacacac

SEQ ID NO: 719873 - DNA, 13 bp, C. elegans
ggcacagtttcaa

SEQ ID NO: 719874 - DNA, 13 bp, C. elegans
ggcacttgccggt

SEQ ID NO: 719875 - DNA, 16 bp, C. elegans
ggcagagttctcaact

SEQ ID NO: 719876 - DNA, 13 bp, C. elegans
ggcaggatttgaa

SEQ ID NO: 719877 - DNA, 13 bp, C. elegans
ggcaggcaggcat

SEQ ID NO: 719878 - DNA, 13 bp, C. elegans
ggcagttgccgaa

SEQ ID NO: 719879 - DNA, 13 bp, C. elegans
ggcatatcggcaa

SEQ ID NO: 719880 - DNA, 13 bp, C. elegans
ggcatgttggggg

SEQ ID NO: 719881 - DNA, 13 bp, C. elegans
ggcattccaaaaa

SEQ ID NO: 719882 - DNA, 13 bp, C. elegans
ggcatttgccgaa

SEQ ID NO: 719883 - DNA, 13 bp, C. elegans
ggcattttcattt

SEQ ID NO: 719884 - DNA, 13 bp, C. elegans
ggcattttgccaa

SEQ ID NO: 719885 - DNA, 13 bp, C. elegans
ggcattttgccga

SEQ ID NO: 719886 - DNA, 13 bp, C. elegans
ggcatttttcggc

SEQ ID NO: 719887 - DNA, 13 bp, C. elegans
ggccaaactttgg

SEQ ID NO: 719888 - DNA, 13 bp, C. elegans
ggccaaagtttgg

SEQ ID NO: 719889 - DNA, 19 bp, C. elegans
ggccaatcccccgagttgg

SEQ ID NO: 719890 - DNA, 13 bp, C. elegans
ggccaccaaaaag

SEQ ID NO: 719891 - DNA, 13 bp, C. elegans
ggccaccaaattc

SEQ ID NO: 719892 - DNA, 14 bp, C. elegans
ggccaccactaccg

SEQ ID NO: 719893 - DNA, 13 bp, C. elegans
ggccaccgatttt

SEQ ID NO: 719894 - DNA, 13 bp, C. elegans
ggccacgtggcaa

SEQ ID NO: 719895 - DNA, 13 bp, C. elegans
ggccgagccaaaa

SEQ ID NO: 719896 - DNA, 13 bp, C. elegans
ggccgcagtacac

SEQ ID NO: 719897 - DNA, 13 bp, C. elegans
ggccgccgtgaaa

SEQ ID NO: 719898 - DNA, 13 bp, C. elegans
ggcctcgccacga

SEQ ID NO: 719899 - DNA, 19 bp, C. elegans
ggccttcattccgagatga

SEQ ID NO: 719900 - DNA, 13 bp, C. elegans
ggcgaaaaaatca

SEQ ID NO: 719901 - DNA, 13 bp, C. elegans
ggcgaaaaatcga

SEQ ID NO: 719902 - DNA, 13 bp, C. elegans
ggcgaaaaatgga

SEQ ID NO: 719903 - DNA, 13 bp, C. elegans
ggcgaaaatcaaa

SEQ ID NO: 719904 - DNA, 13 bp, C. elegans
ggcgaaaatggaa

SEQ ID NO: 719905 - DNA, 13 bp, C. elegans
ggcgaaaattcaa

SEQ ID NO: 719906 - DNA, 15 bp, C. elegans
ggcgaaactcggaaa

SEQ ID NO: 719907 - DNA, 13 bp, C. elegans
ggcgatcgccgat

SEQ ID NO: 719908 - DNA, 13 bp, C. elegans
ggcgattgtcaat

SEQ ID NO: 719909 - DNA, 13 bp, C. elegans
ggcgccaactctc

SEQ ID NO: 719910 - DNA, 13 bp, C. elegans
ggcgcgaaattca

SEQ ID NO: 719911 - DNA, 13 bp, C. elegans
ggcggaaaatcga

SEQ ID NO: 719912 - DNA, 13 bp, C. elegans
ggcggaaaattca

SEQ ID NO: 719913 - DNA, 13 bp, C. elegans
ggcggagcgtttt

SEQ ID NO: 719914 - DNA, 13 bp, C. elegans
ggcggctcaaaaa

SEQ ID NO: 719915 - DNA, 13 bp, C. elegans
ggcgggaatttca

SEQ ID NO: 719916 - DNA, 13 bp, C. elegans
ggcgggaatttga

SEQ ID NO: 719917 - DNA, 13 bp, C. elegans
ggcgtgttcaacc

SEQ ID NO: 719918 - DNA, 13 bp, C. elegans
ggctaatttttga

SEQ ID NO: 719919 - DNA, 13 bp, C. elegans
ggctaccgtaacc

SEQ ID NO: 719920 - DNA, 13 bp, C. elegans
ggctcaaaaaatg

SEQ ID NO: 719921 - DNA, 13 bp, C. elegans
ggctcaaaaagct

SEQ ID NO: 719922 - DNA, 13 bp, C. elegans
ggctcaaagagct

SEQ ID NO: 719923 - DNA, 13 bp, C. elegans
ggctcaaatgaac

SEQ ID NO: 719924 - DNA, 13 bp, C. elegans
ggctcaatgagct

SEQ ID NO: 719925 - DNA, 13 bp, C. elegans
ggctcacgagatg

SEQ ID NO: 719926 - DNA, 13 bp, C. elegans
ggctcaggattat

SEQ ID NO: 719927 - DNA, 13 bp, C. elegans
ggctcgatttttg

SEQ ID NO: 719928 - DNA, 13 bp, C. elegans
ggctcgtttttca

SEQ ID NO: 719929 - DNA, 13 bp, C. elegans
ggctcttgaaaaa

SEQ ID NO: 719930 - DNA, 13 bp, C. elegans
ggctgaaaataaa

SEQ ID NO: 719931 - DNA, 13 bp, C. elegans
ggctgaaaatgag

SEQ ID NO: 719932 - DNA, 13 bp, C. elegans
ggctgaaaatgtg

SEQ ID NO: 719933 - DNA, 13 bp, C. elegans
ggctgctgctgct

SEQ ID NO: 719934 - DNA, 13 bp, C. elegans
ggctgtctcatta

SEQ ID NO: 719935 - DNA, 13 bp, C. elegans
ggcttactattag

SEQ ID NO: 719936 - DNA, 13 bp, C. elegans
ggcttcacactat

SEQ ID NO: 719937 - DNA, 13 bp, C. elegans
ggcttcgaacaag

SEQ ID NO: 719938 - DNA, 13 bp, C. elegans
ggcttgatctacg

SEQ ID NO: 719939 - DNA, 14 bp, C. elegans
ggcttgcgaaaaaa

SEQ ID NO: 719940 - DNA, 13 bp, C. elegans
ggcttgggtttat

SEQ ID NO: 719941 - DNA, 13 bp, C. elegans
ggctttcgaaaaa

SEQ ID NO: 719942 - DNA, 13 bp, C. elegans
ggcttttcaaaaa

SEQ ID NO: 719943 - DNA, 13 bp, C. elegans
gggaaaaaatatt

SEQ ID NO: 719944 - DNA, 13 bp, C. elegans
gggaaaaaatgca

SEQ ID NO: 719945 - DNA, 13 bp, C. elegans
gggaaaaccgaaa

SEQ ID NO: 719946 - DNA, 13 bp, C. elegans
gggaaaagctgaa

SEQ ID NO: 719947 - DNA, 13 bp, C. elegans
gggaaaatattga

SEQ ID NO: 719948 - DNA, 13 bp, C. elegans
gggaaaatcaaat

SEQ ID NO: 719949 - DNA, 13 bp, C. elegans
gggaaaatgtata

SEQ ID NO: 719950 - DNA, 13 bp, C. elegans
gggaaaattcaaa

SEQ ID NO: 719951 - DNA, 13 bp, C. elegans
gggaaaattgaaa

SEQ ID NO: 719952 - DNA, 13 bp, C. elegans
gggaaaattgatt

SEQ ID NO: 719953 - DNA, 13 bp, C. elegans
gggaaaattggaa

SEQ ID NO: 719954 - DNA, 13 bp, C. elegans
gggaaaatttgga

SEQ ID NO: 719955 - DNA, 13 bp, C. elegans
gggaaagtcgtgt

SEQ ID NO: 719956 - DNA, 13 bp, C. elegans
gggaaatatcgat

SEQ ID NO: 719957 - DNA, 13 bp, C. elegans
gggaaatattttt

SEQ ID NO: 719958 - DNA, 13 bp, C. elegans
gggaaatcaataa

SEQ ID NO: 719959 - DNA, 13 bp, C. elegans
gggaaatcgaaaa

SEQ ID NO: 719960 - DNA, 13 bp, C. elegans
gggaaatcggaaa

SEQ ID NO: 719961 - DNA, 13 bp, C. elegans
gggaaatcttgca

SEQ ID NO: 719962 - DNA, 13 bp, C. elegans
gggaaattattga

SEQ ID NO: 719963 - DNA, 13 bp, C. elegans
gggaaattcaaaa

SEQ ID NO: 719964 - DNA, 13 bp, C. elegans
gggaaattgttaa

SEQ ID NO: 719965 - DNA, 13 bp, C. elegans
gggaaatttgaaa

SEQ ID NO: 719966 - DNA, 13 bp, C. elegans
gggaacaaatgaa

SEQ ID NO: 719967 - DNA, 13 bp, C. elegans
gggaacttcaaaa

SEQ ID NO: 719968 - DNA, 13 bp, C. elegans
gggaagagttgga

SEQ ID NO: 719969 - DNA, 13 bp, C. elegans
gggaataaatata

SEQ ID NO: 719970 - DNA, 13 bp, C. elegans
gggaattcaaaaa

SEQ ID NO: 719971 - DNA, 13 bp, C. elegans
gggaattcaaaat

SEQ ID NO: 719972 - DNA, 13 bp, C. elegans
gggaattcaattt

SEQ ID NO: 719973 - DNA, 13 bp, C. elegans
gggaattcgaatt

SEQ ID NO: 719974 - DNA, 13 bp, C. elegans
gggaattgaaatt

SEQ ID NO: 719975 - DNA, 13 bp, C. elegans
gggaatttaaaat

SEQ ID NO: 719976 - DNA, 13 bp, C. elegans
gggaatttcaatt

SEQ ID NO: 719977 - DNA, 13 bp, C. elegans
gggaatttctgga

SEQ ID NO: 719978 - DNA, 13 bp, C. elegans
gggaatttgaatt

SEQ ID NO: 719979 - DNA, 13 bp, C. elegans
gggaattttgaat

SEQ ID NO: 719980 - DNA, 13 bp, C. elegans
gggaatttttcgc

SEQ ID NO: 719981 - DNA, 13 bp, C. elegans
gggaatttttgaa

SEQ ID NO: 719982 - DNA, 13 bp, C. elegans
gggaattttttgc

SEQ ID NO: 719983 - DNA, 13 bp, C. elegans
gggacatgacttc

SEQ ID NO: 719984 - DNA, 13 bp, C. elegans
gggacatgtttca

SEQ ID NO: 719985 - DNA, 13 bp, C. elegans
gggacccaaaatt

SEQ ID NO: 719986 - DNA, 13 bp, C. elegans
gggagaaaactga

SEQ ID NO: 719987 - DNA, 13 bp, C. elegans
gggagcaccacca

SEQ ID NO: 719988 - DNA, 13 bp, C. elegans
gggaggtgtcggc

SEQ ID NO: 719989 - DNA, 13 bp, C. elegans
gggagtcttcttg

SEQ ID NO: 719990 - DNA, 13 bp, C. elegans
gggatactgtaga

SEQ ID NO: 719991 - DNA, 13 bp, C. elegans
gggatatgttttt

SEQ ID NO: 719992 - DNA, 13 bp, C. elegans
gggattactgtag

SEQ ID NO: 719993 - DNA, 13 bp, C. elegans
gggattcaaattt

SEQ ID NO: 719994 - DNA, 13 bp, C. elegans
gggattttatgtt

SEQ ID NO: 719995 - DNA, 13 bp, C. elegans
gggatttttcaaa

SEQ ID NO: 719996 - DNA, 13 bp, C. elegans
gggattttttata

SEQ ID NO: 719997 - DNA, 13 bp, C. elegans
gggcaaaaattga

SEQ ID NO: 719998 - DNA, 13 bp, C. elegans
gggcagcctgaca

SEQ ID NO: 719999 - DNA, 13 bp, C. elegans
gggcatcgaaaag

SEQ ID NO: 720000 - DNA, 13 bp, C. elegans
gggccaaagtttg

SEQ ID NO: 720001 - DNA, 13 bp, C. elegans
gggcggagcgttt

SEQ ID NO: 720002 - DNA, 13 bp, C. elegans
gggcggagctaat

SEQ ID NO: 720003 - DNA, 13 bp, C. elegans
gggcggagtcaag

SEQ ID NO: 720004 - DNA, 13 bp, C. elegans
gggcggagtctgt

SEQ ID NO: 720005 - DNA, 13 bp, C. elegans
gggctcacggagc

SEQ ID NO: 720006 - DNA, 13 bp, C. elegans
gggctccgcgagc

SEQ ID NO: 720007 - DNA, 13 bp, C. elegans
gggctcgcggagc

SEQ ID NO: 720008 - DNA, 13 bp, C. elegans
gggctctcaaaga

SEQ ID NO: 720009 - DNA, 13 bp, C. elegans
gggcttaggttta

SEQ ID NO: 720010 - DNA, 13 bp, C. elegans
ggggaaaaatcta

SEQ ID NO: 720011 - DNA, 13 bp, C. elegans
ggggaaaatgttt

SEQ ID NO: 720012 - DNA, 14 bp, C. elegans
ggggaacctctgcc

SEQ ID NO: 720013 - DNA, 13 bp, C. elegans
ggggaagaagctg

SEQ ID NO: 720014 - DNA, 13 bp, C. elegans
ggggactagaaaa

SEQ ID NO: 720015 - DNA, 13 bp, C. elegans
ggggagacgcaga

SEQ ID NO: 720016 - DNA, 13 bp, C. elegans
ggggattttgaaa

SEQ ID NO: 720017 - DNA, 13 bp, C. elegans
ggggcacaaaatg

SEQ ID NO: 720018 - DNA, 13 bp, C. elegans
ggggcggagcgta

SEQ ID NO: 720019 - DNA, 13 bp, C. elegans
ggggtacggtaga

SEQ ID NO: 720020 - DNA, 13 bp, C. elegans
ggggtcgaacctg

SEQ ID NO: 720021 - DNA, 13 bp, C. elegans
ggggttactgtag

SEQ ID NO: 720022 - DNA, 13 bp, C. elegans
ggggttcgagtcc

SEQ ID NO: 720023 - DNA, 13 bp, C. elegans
ggggttttcttcg

SEQ ID NO: 720024 - DNA, 13 bp, C. elegans
gggtactgtactt

SEQ ID NO: 720025 - DNA, 13 bp, C. elegans
gggtactgtagaa

SEQ ID NO: 720026 - DNA, 13 bp, C. elegans
gggtactgtagag

SEQ ID NO: 720027 - DNA, 13 bp, C. elegans
gggtactgtagcc

SEQ ID NO: 720028 - DNA, 13 bp, C. elegans
gggtactgtagga

SEQ ID NO: 720029 - DNA, 13 bp, C. elegans
gggtactgtagtt

SEQ ID NO: 720030 - DNA, 13 bp, C. elegans
gggtataacaacg

SEQ ID NO: 720031 - DNA, 13 bp, C. elegans
gggtcccgtcacg

SEQ ID NO: 720032 - DNA, 13 bp, C. elegans
gggtctcacagcg

SEQ ID NO: 720033 - DNA, 13 bp, C. elegans
gggtctcaccgcg

SEQ ID NO: 720034 - DNA, 13 bp, C. elegans
gggtctcatcacg

SEQ ID NO: 720035 - DNA, 13 bp, C. elegans
gggtctcgccacg

SEQ ID NO: 720036 - DNA, 13 bp, C. elegans
gggtctcggcacg

SEQ ID NO: 720037 - DNA, 13 bp, C. elegans
gggtctcgttagg

SEQ ID NO: 720038 - DNA, 13 bp, C. elegans
gggtcttgacacg

SEQ ID NO: 720039 - DNA, 15 bp, C. elegans
gggtctttccacgat

SEQ ID NO: 720040 - DNA, 13 bp, C. elegans
gggtgcgcggcaa

SEQ ID NO: 720041 - DNA, 13 bp, C. elegans
gggttactgtaac

SEQ ID NO: 720042 - DNA, 13 bp, C. elegans
gggttactgtacc

SEQ ID NO: 720043 - DNA, 13 bp, C. elegans
gggttactgtagg

SEQ ID NO: 720044 - DNA, 13 bp, C. elegans
gggttactgtagt

SEQ ID NO: 720045 - DNA, 13 bp, C. elegans
gggttcaattccc

SEQ ID NO: 720046 - DNA, 13 bp, C. elegans
gggttcgagcccc

SEQ ID NO: 720047 - DNA, 13 bp, C. elegans
gggttttgacgaa

SEQ ID NO: 720048 - DNA, 13 bp, C. elegans
gggttttgtattc

SEQ ID NO: 720049 - DNA, 13 bp, C. elegans
gggttttttaatg

SEQ ID NO: 720050 - DNA, 13 bp, C. elegans
ggtaaaatgtgga

SEQ ID NO: 720051 - DNA, 13 bp, C. elegans
ggtaaaccggcaa

SEQ ID NO: 720052 - DNA, 13 bp, C. elegans
ggtaaattgaaaa

SEQ ID NO: 720053 - DNA, 13 bp, C. elegans
ggtaatctaccaa

SEQ ID NO: 720054 - DNA, 13 bp, C. elegans
ggtaattcaaata

SEQ ID NO: 720055 - DNA, 13 bp, C. elegans
ggtaatttcggca

SEQ ID NO: 720056 - DNA, 13 bp, C. elegans
ggtaatttggcac

SEQ ID NO: 720057 - DNA, 13 bp, C. elegans
ggtaatttttgta

SEQ ID NO: 720058 - DNA, 13 bp, C. elegans
ggtaccgaaatct

SEQ ID NO: 720059 - DNA, 13 bp, C. elegans
ggtaccgtacttt

SEQ ID NO: 720060 - DNA, 13 bp, C. elegans
ggtacctcctgat

SEQ ID NO: 720061 - DNA, 13 bp, C. elegans
ggtactccacctt

SEQ ID NO: 720062 - DNA, 13 bp, C. elegans
ggtactccatctt

SEQ ID NO: 720063 - DNA, 13 bp, C. elegans
ggtactgtagatg

SEQ ID NO: 720064 - DNA, 13 bp, C. elegans
ggtactgtagctg

SEQ ID NO: 720065 - DNA, 13 bp, C. elegans
ggtactgtagttt

SEQ ID NO: 720066 - DNA, 13 bp, C. elegans
ggtacttttcgat

SEQ ID NO: 720067 - DNA, 13 bp, C. elegans
ggtagatcaaaaa

SEQ ID NO: 720068 - DNA, 13 bp, C. elegans
ggtagatcaaaat

SEQ ID NO: 720069 - DNA, 13 bp, C. elegans
ggtagcacagaaa

SEQ ID NO: 720070 - DNA, 13 bp, C. elegans
ggtagttttggac

SEQ ID NO: 720071 - DNA, 13 bp, C. elegans
ggtatatttgaca

SEQ ID NO: 720072 - DNA, 13 bp, C. elegans
ggtattactgtaa

SEQ ID NO: 720073 - DNA, 13 bp, C. elegans
ggtattactgtag

SEQ ID NO: 720074 - DNA, 13 bp, C. elegans
ggtattctgtcag

SEQ ID NO: 720075 - DNA, 13 bp, C. elegans
ggtattttggaaa

SEQ ID NO: 720076 - DNA, 13 bp, C. elegans
ggtcatttttcat

SEQ ID NO: 720077 - DNA, 13 bp, C. elegans
ggtcccaccacga

SEQ ID NO: 720078 - DNA, 13 bp, C. elegans
ggtcccaccgcga

SEQ ID NO: 720079 - DNA, 13 bp, C. elegans
ggtcccgccacga

SEQ ID NO: 720080 - DNA, 13 bp, C. elegans
ggtccgcaaacac

SEQ ID NO: 720081 - DNA, 13 bp, C. elegans
ggtcctgacacga

SEQ ID NO: 720082 - DNA, 13 bp, C. elegans
ggtcggagagatt

SEQ ID NO: 720083 - DNA, 13 bp, C. elegans
ggtcgttttggat

SEQ ID NO: 720084 - DNA, 13 bp, C. elegans
ggtctaagcctaa

SEQ ID NO: 720085 - DNA, 13 bp, C. elegans
ggtctcaacacga

SEQ ID NO: 720086 - DNA, 13 bp, C. elegans
ggtctcacaacga

SEQ ID NO: 720087 - DNA, 13 bp, C. elegans
ggtctcacagcga

SEQ ID NO: 720088 - DNA, 13 bp, C. elegans
ggtctcaccacaa

SEQ ID NO: 720089 - DNA, 13 bp, C. elegans
ggtctcaccacga

SEQ ID NO: 720090 - DNA, 13 bp, C. elegans
ggtctcaccacgg

SEQ ID NO: 720091 - DNA, 13 bp, C. elegans
ggtctcatcacga

SEQ ID NO: 720092 - DNA, 13 bp, C. elegans
ggtctcgaaacga

SEQ ID NO: 720093 - DNA, 13 bp, C. elegans
ggtctcgaagcga

SEQ ID NO: 720094 - DNA, 13 bp, C. elegans
ggtctcgacacga

SEQ ID NO: 720095 - DNA, 13 bp, C. elegans
ggtctcgacgcga

SEQ ID NO: 720096 - DNA, 13 bp, C. elegans
ggtctcgcaacga

SEQ ID NO: 720097 - DNA, 13 bp, C. elegans
ggtctcgcagcga

SEQ ID NO: 720098 - DNA, 13 bp, C. elegans
ggtctcgccacga

SEQ ID NO: 720099 - DNA, 13 bp, C. elegans
ggtctcgccacgc

SEQ ID NO: 720100 - DNA, 13 bp, C. elegans
ggtctcgccacgt

SEQ ID NO: 720101 - DNA, 13 bp, C. elegans
ggtctcgccgcga

SEQ ID NO: 720102 - DNA, 13 bp, C. elegans
ggtctcgtagcga

SEQ ID NO: 720103 - DNA, 13 bp, C. elegans
ggtctcgtcacga

SEQ ID NO: 720104 - DNA, 13 bp, C. elegans
ggtctctccacga

SEQ ID NO: 720105 - DNA, 13 bp, C. elegans
ggtctgcccaggg

SEQ ID NO: 720106 - DNA, 13 bp, C. elegans
ggtctgctaaata

SEQ ID NO: 720107 - DNA, 13 bp, C. elegans
ggtcttaccacga

SEQ ID NO: 720108 - DNA, 13 bp, C. elegans
ggtcttcttcatt

SEQ ID NO: 720109 - DNA, 13 bp, C. elegans
ggtcttgaaacga

SEQ ID NO: 720110 - DNA, 13 bp, C. elegans
ggtcttgaagcga

SEQ ID NO: 720111 - DNA, 13 bp, C. elegans
ggtcttgacacga

SEQ ID NO: 720112 - DNA, 14 bp, C. elegans
ggtcttgacacgac

SEQ ID NO: 720113 - DNA, 13 bp, C. elegans
ggtcttgcaacga

SEQ ID NO: 720114 - DNA, 13 bp, C. elegans
ggtcttgcagcga

SEQ ID NO: 720115 - DNA, 13 bp, C. elegans
ggtcttgccacga

SEQ ID NO: 720116 - DNA, 13 bp, C. elegans
ggtcttgccgcgc

SEQ ID NO: 720117 - DNA, 13 bp, C. elegans
ggtgaaaaattga

SEQ ID NO: 720118 - DNA, 13 bp, C. elegans
ggtgaaaatgtgg

SEQ ID NO: 720119 - DNA, 13 bp, C. elegans
ggtgaaagaatca

SEQ ID NO: 720120 - DNA, 13 bp, C. elegans
ggtgaaagtggtc

SEQ ID NO: 720121 - DNA, 13 bp, C. elegans
ggtgaaattgaaa

SEQ ID NO: 720122 - DNA, 13 bp, C. elegans
ggtgaaatttgaa

SEQ ID NO: 720123 - DNA, 13 bp, C. elegans
ggtgacaaatgtg

SEQ ID NO: 720124 - DNA, 13 bp, C. elegans
ggtgagacccatc

SEQ ID NO: 720125 - DNA, 14 bp, C. elegans
ggtgctacattggt

SEQ ID NO: 720126 - DNA, 13 bp, C. elegans
ggtgctactccac

SEQ ID NO: 720127 - DNA, 13 bp, C. elegans
ggtggaaaaatga

SEQ ID NO: 720128 - DNA, 13 bp, C. elegans
ggtggagaagctg

SEQ ID NO: 720129 - DNA, 13 bp, C. elegans
ggtggcattgaaa

SEQ ID NO: 720130 - DNA, 13 bp, C. elegans
ggtggccgaagtt

SEQ ID NO: 720131 - DNA, 13 bp, C. elegans
ggtggccgagaaa

SEQ ID NO: 720132 - DNA, 13 bp, C. elegans
ggtggccgagttt

SEQ ID NO: 720133 - DNA, 13 bp, C. elegans
ggtggcctagaaa

SEQ ID NO: 720134 - DNA, 13 bp, C. elegans
ggtggcctaggat

SEQ ID NO: 720135 - DNA, 13 bp, C. elegans
ggtggtcaaaaaa

SEQ ID NO: 720136 - DNA, 13 bp, C. elegans
ggtggtgtcaaaa

SEQ ID NO: 720137 - DNA, 13 bp, C. elegans
ggtgtcaaaatga

SEQ ID NO: 720138 - DNA, 13 bp, C. elegans
ggtgtcggctgca

SEQ ID NO: 720139 - DNA, 13 bp, C. elegans
ggtgtgcactttt

SEQ ID NO: 720140 - DNA, 13 bp, C. elegans
ggtgtttgcacag

SEQ ID NO: 720141 - DNA, 13 bp, C. elegans
ggtgtttgcggac

SEQ ID NO: 720142 - DNA, 13 bp, C. elegans
ggttaaaaaatga

SEQ ID NO: 720143 - DNA, 13 bp, C. elegans
ggttaaaaatttg

SEQ ID NO: 720144 - DNA, 13 bp, C. elegans
ggttacggtagaa

SEQ ID NO: 720145 - DNA, 13 bp, C. elegans
ggttacggtagcc

SEQ ID NO: 720146 - DNA, 13 bp, C. elegans
ggttacggtagct

SEQ ID NO: 720147 - DNA, 13 bp, C. elegans
ggttactgtaaca

SEQ ID NO: 720148 - DNA, 13 bp, C. elegans
ggttactgtaaga

SEQ ID NO: 720149 - DNA, 13 bp, C. elegans
ggttactgtaagt

SEQ ID NO: 720150 - DNA, 13 bp, C. elegans
ggttactgtagaa

SEQ ID NO: 720151 - DNA, 13 bp, C. elegans
ggttactgtagac

SEQ ID NO: 720152 - DNA, 13 bp, C. elegans
ggttactgtagat

SEQ ID NO: 720153 - DNA, 13 bp, C. elegans
ggttactgtagcc

SEQ ID NO: 720154 - DNA, 13 bp, C. elegans
ggttactgtaggt

SEQ ID NO: 720155 - DNA, 13 bp, C. elegans
ggttactgtagtt

SEQ ID NO: 720156 - DNA, 13 bp, C. elegans
ggttatttggaag

SEQ ID NO: 720157 - DNA, 13 bp, C. elegans
ggttcaatttttc

SEQ ID NO: 720158 - DNA, 13 bp, C. elegans
ggttcaatttttt

SEQ ID NO: 720159 - DNA, 13 bp, C. elegans
ggttcagaaattg

SEQ ID NO: 720160 - DNA, 13 bp, C. elegans
ggttcatttggag

SEQ ID NO: 720161 - DNA, 13 bp, C. elegans
ggttccagacgtt

SEQ ID NO: 720162 - DNA, 13 bp, C. elegans
ggttccgcgccgc

SEQ ID NO: 720163 - DNA, 13 bp, C. elegans
ggttctgaatttt

SEQ ID NO: 720164 - DNA, 13 bp, C. elegans
ggttctggagatt

SEQ ID NO: 720165 - DNA, 23 bp, C. elegans
ggttgaaccggaagtctttgtga

SEQ ID NO: 720166 - DNA, 13 bp, C. elegans
ggttgccgaaaag

SEQ ID NO: 720167 - DNA, 13 bp, C. elegans
ggttgccgaaatt

SEQ ID NO: 720168 - DNA, 13 bp, C. elegans
ggttgccggaaat

SEQ ID NO: 720169 - DNA, 13 bp, C. elegans
ggtttaaaaataa

SEQ ID NO: 720170 - DNA, 13 bp, C. elegans
ggtttaaaagtgg

SEQ ID NO: 720171 - DNA, 13 bp, C. elegans
ggtttaaatattt

SEQ ID NO: 720172 - DNA, 13 bp, C. elegans
ggtttataggttt

SEQ ID NO: 720173 - DNA, 13 bp, C. elegans
ggtttatcaaaaa

SEQ ID NO: 720174 - DNA, 13 bp, C. elegans
ggtttcaaaatgt

SEQ ID NO: 720175 - DNA, 13 bp, C. elegans
ggtttcaccacga

SEQ ID NO: 720176 - DNA, 13 bp, C. elegans
ggtttcacttttt

SEQ ID NO: 720177 - DNA, 13 bp, C. elegans
ggtttcattaaaa

SEQ ID NO: 720178 - DNA, 13 bp, C. elegans
ggtttcgccacga

SEQ ID NO: 720179 - DNA, 13 bp, C. elegans
ggtttctaggcca

SEQ ID NO: 720180 - DNA, 13 bp, C. elegans
ggtttctgaatta

SEQ ID NO: 720181 - DNA, 13 bp, C. elegans
ggtttctttgaaa

SEQ ID NO: 720182 - DNA, 13 bp, C. elegans
ggtttgacctaca

SEQ ID NO: 720183 - DNA, 13 bp, C. elegans
ggtttgcactttt

SEQ ID NO: 720184 - DNA, 13 bp, C. elegans
ggtttgccaaaaa

SEQ ID NO: 720185 - DNA, 13 bp, C. elegans
ggtttgcggattt

SEQ ID NO: 720186 - DNA, 13 bp, C. elegans
ggtttggcaaaaa

SEQ ID NO: 720187 - DNA, 13 bp, C. elegans
ggttttatcaaaa

SEQ ID NO: 720188 - DNA, 13 bp, C. elegans
ggttttcaaaaaa

SEQ ID NO: 720189 - DNA, 13 bp, C. elegans
ggttttcaaaact

SEQ ID NO: 720190 - DNA, 13 bp, C. elegans
ggttttcaaagaa

SEQ ID NO: 720191 - DNA, 13 bp, C. elegans
ggttttcaagttt

SEQ ID NO: 720192 - DNA, 13 bp, C. elegans
ggttttcaattat

SEQ ID NO: 720193 - DNA, 13 bp, C. elegans
ggttttcagtcaa

SEQ ID NO: 720194 - DNA, 13 bp, C. elegans
ggttttcatgttt

SEQ ID NO: 720195 - DNA, 13 bp, C. elegans
ggttttccgattt

SEQ ID NO: 720196 - DNA, 13 bp, C. elegans
ggttttccggaaa

SEQ ID NO: 720197 - DNA, 13 bp, C. elegans
ggttttcggcaaa

SEQ ID NO: 720198 - DNA, 13 bp, C. elegans
ggttttctgaaaa

SEQ ID NO: 720199 - DNA, 13 bp, C. elegans
ggttttgaaacaa

SEQ ID NO: 720200 - DNA, 13 bp, C. elegans
ggttttgaaactg

SEQ ID NO: 720201 - DNA, 13 bp, C. elegans
ggttttgaacatt

SEQ ID NO: 720202 - DNA, 13 bp, C. elegans
ggttttgcaaatt

SEQ ID NO: 720203 - DNA, 13 bp, C. elegans
ggttttggaagtt

SEQ ID NO: 720204 - DNA, 13 bp, C. elegans
ggttttgtattcc

SEQ ID NO: 720205 - DNA, 13 bp, C. elegans
ggtttttaacttt

SEQ ID NO: 720206 - DNA, 13 bp, C. elegans
ggtttttaataat

SEQ ID NO: 720207 - DNA, 13 bp, C. elegans
ggtttttactgaa

SEQ ID NO: 720208 - DNA, 13 bp, C. elegans
ggtttttatataa

SEQ ID NO: 720209 - DNA, 13 bp, C. elegans
ggtttttccttgc

SEQ ID NO: 720210 - DNA, 13 bp, C. elegans
ggtttttctttaa

SEQ ID NO: 720211 - DNA, 13 bp, C. elegans
ggtttttctttca

SEQ ID NO: 720212 - DNA, 13 bp, C. elegans
ggtttttgaacaa

SEQ ID NO: 720213 - DNA, 13 bp, C. elegans
ggtttttgaagtt

SEQ ID NO: 720214 - DNA, 13 bp, C. elegans
ggtttttggagcg

SEQ ID NO: 720215 - DNA, 13 bp, C. elegans
ggtttttgtcaaa

SEQ ID NO: 720216 - DNA, 13 bp, C. elegans
ggtttttgttcaa

SEQ ID NO: 720217 - DNA, 13 bp, C. elegans
ggttttttaaaaa

SEQ ID NO: 720218 - DNA, 13 bp, C. elegans
ggttttttaaaac

SEQ ID NO: 720219 - DNA, 13 bp, C. elegans
ggttttttattcc

SEQ ID NO: 720220 - DNA, 13 bp, C. elegans
ggttttttcctga

SEQ ID NO: 720221 - DNA, 13 bp, C. elegans
ggttttttcgatt

SEQ ID NO: 720222 - DNA, 13 bp, C. elegans
ggttttttggaaa

SEQ ID NO: 720223 - DNA, 13 bp, C. elegans
ggttttttgtgaa

SEQ ID NO: 720224 - DNA, 13 bp, C. elegans
ggtttttttcgga

SEQ ID NO: 720225 - DNA, 13 bp, C. elegans
ggttttttttcag

SEQ ID NO: 720226 - DNA, 13 bp, C. elegans
gtaaaaaagtacg

SEQ ID NO: 720227 - DNA, 13 bp, C. elegans
gtaaaaaatacgg

SEQ ID NO: 720228 - DNA, 13 bp, C. elegans
gtaaaaaattcaa

SEQ ID NO: 720229 - DNA, 13 bp, C. elegans
gtaaaaaattcca

SEQ ID NO: 720230 - DNA, 13 bp, C. elegans
gtaaaaactcaaa

SEQ ID NO: 720231 - DNA, 13 bp, C. elegans
gtaaaaagctata

SEQ ID NO: 720232 - DNA, 13 bp, C. elegans
gtaaaaagtattt

SEQ ID NO: 720233 - DNA, 13 bp, C. elegans
gtaaaaagtcaaa

SEQ ID NO: 720234 - DNA, 13 bp, C. elegans
gtaaaaatgagtg

SEQ ID NO: 720235 - DNA, 13 bp, C. elegans
gtaaaaattattg

SEQ ID NO: 720236 - DNA, 13 bp, C. elegans
gtaaaaattgtga

SEQ ID NO: 720237 - DNA, 13 bp, C. elegans
gtaaaaatttgaa

SEQ ID NO: 720238 - DNA, 14 bp, C. elegans
gtaaaacagtccaa

SEQ ID NO: 720239 - DNA, 13 bp, C. elegans
gtaaaactgcaaa

SEQ ID NO: 720240 - DNA, 13 bp, C. elegans
gtaaaagagcaac

SEQ ID NO: 720241 - DNA, 13 bp, C. elegans
gtaaaagatacga

SEQ ID NO: 720242 - DNA, 13 bp, C. elegans
gtaaaagttgaaa

SEQ ID NO: 720243 - DNA, 13 bp, C. elegans
gtaaaatatggtg

SEQ ID NO: 720244 - DNA, 13 bp, C. elegans
gtaaaatatgttt

SEQ ID NO: 720245 - DNA, 13 bp, C. elegans
gtaaaatcatttt

SEQ ID NO: 720246 - DNA, 13 bp, C. elegans
gtaaaatcgataa

SEQ ID NO: 720247 - DNA, 13 bp, C. elegans
gtaaaattcgaga

SEQ ID NO: 720248 - DNA, 13 bp, C. elegans
gtaaaattgataa

SEQ ID NO: 720249 - DNA, 13 bp, C. elegans
gtaaaattgctcc

SEQ ID NO: 720250 - DNA, 13 bp, C. elegans
gtaaaattggaaa

SEQ ID NO: 720251 - DNA, 13 bp, C. elegans
gtaaaattgtttt

SEQ ID NO: 720252 - DNA, 13 bp, C. elegans
gtaaaatttaatg

SEQ ID NO: 720253 - DNA, 13 bp, C. elegans
gtaaaatttggca

SEQ ID NO: 720254 - DNA, 13 bp, C. elegans
gtaaaatttttga

SEQ ID NO: 720255 - DNA, 13 bp, C. elegans
gtaaactcaaaaa

SEQ ID NO: 720256 - DNA, 13 bp, C. elegans
gtaaactgccaaa

SEQ ID NO: 720257 - DNA, 13 bp, C. elegans
gtaaacttttttt

SEQ ID NO: 720258 - DNA, 13 bp, C. elegans
gtaaagtttaaaa

SEQ ID NO: 720259 - DNA, 13 bp, C. elegans
gtaaatactattt

SEQ ID NO: 720260 - DNA, 13 bp, C. elegans
gtaaatatattgg

SEQ ID NO: 720261 - DNA, 13 bp, C. elegans
gtaaatattttga

SEQ ID NO: 720262 - DNA, 13 bp, C. elegans
gtaaatcgacaac

SEQ ID NO: 720263 - DNA, 13 bp, C. elegans
gtaaatcgacaca

SEQ ID NO: 720264 - DNA, 13 bp, C. elegans
gtaaatcggcaaa

SEQ ID NO: 720265 - DNA, 13 bp, C. elegans
gtaaatcgtcaaa

SEQ ID NO: 720266 - DNA, 13 bp, C. elegans
gtaaatctacaag

SEQ ID NO: 720267 - DNA, 13 bp, C. elegans
gtaaatctgaaat

SEQ ID NO: 720268 - DNA, 13 bp, C. elegans
gtaaatcttcaaa

SEQ ID NO: 720269 - DNA, 13 bp, C. elegans
gtaaatgcaaaaa

SEQ ID NO: 720270 - DNA, 13 bp, C. elegans
gtaaatgtgtgtc

SEQ ID NO: 720271 - DNA, 13 bp, C. elegans
gtaaattattctg

SEQ ID NO: 720272 - DNA, 13 bp, C. elegans
gtaaattcaaatt

SEQ ID NO: 720273 - DNA, 13 bp, C. elegans
gtaaatttacaaa

SEQ ID NO: 720274 - DNA, 13 bp, C. elegans
gtaaatttagttt

SEQ ID NO: 720275 - DNA, 13 bp, C. elegans
gtaaatttcaaaa

SEQ ID NO: 720276 - DNA, 13 bp, C. elegans
gtaaatttccgaa

SEQ ID NO: 720277 - DNA, 13 bp, C. elegans
gtaaatttgaaaa

SEQ ID NO: 720278 - DNA, 13 bp, C. elegans
gtaaattttcaaa

SEQ ID NO: 720279 - DNA, 13 bp, C. elegans
gtaaatttttcaa

SEQ ID NO: 720280 - DNA, 13 bp, C. elegans
gtaacaatcactg

SEQ ID NO: 720281 - DNA, 13 bp, C. elegans
gtaactatttttc

SEQ ID NO: 720282 - DNA, 13 bp, C. elegans
gtaacttcagttt

SEQ ID NO: 720283 - DNA, 13 bp, C. elegans
gtaactttatttt

SEQ ID NO: 720284 - DNA, 13 bp, C. elegans
gtaactttttcaa

SEQ ID NO: 720285 - DNA, 13 bp, C. elegans
gtaactttttgaa

SEQ ID NO: 720286 - DNA, 13 bp, C. elegans
gtaagaagttggc

SEQ ID NO: 720287 - DNA, 13 bp, C. elegans
gtaagatattttt

SEQ ID NO: 720288 - DNA, 13 bp, C. elegans
gtaagattttatt

SEQ ID NO: 720289 - DNA, 13 bp, C. elegans
gtaagtttttctt

SEQ ID NO: 720290 - DNA, 13 bp, C. elegans
gtaagtttttgta

SEQ ID NO: 720291 - DNA, 13 bp, C. elegans
gtaagttttttca

SEQ ID NO: 720292 - DNA, 13 bp, C. elegans
gtaatattttgag

SEQ ID NO: 720293 - DNA, 13 bp, C. elegans
gtaatcatttaaa

SEQ ID NO: 720294 - DNA, 13 bp, C. elegans
gtaatcgaatatt

SEQ ID NO: 720295 - DNA, 13 bp, C. elegans
gtaatctttaaag

SEQ ID NO: 720296 - DNA, 13 bp, C. elegans
gtaatgggacaac

SEQ ID NO: 720297 - DNA, 13 bp, C. elegans
gtaatgtcggaaa

SEQ ID NO: 720298 - DNA, 13 bp, C. elegans
gtaattattgaaa

SEQ ID NO: 720299 - DNA, 13 bp, C. elegans
gtaattattgatt

SEQ ID NO: 720300 - DNA, 13 bp, C. elegans
gtaattcaaaaaa

SEQ ID NO: 720301 - DNA, 13 bp, C. elegans
gtaattcaatttt

SEQ ID NO: 720302 - DNA, 13 bp, C. elegans
gtaattcatatat

SEQ ID NO: 720303 - DNA, 13 bp, C. elegans
gtaattcatgtat

SEQ ID NO: 720304 - DNA, 13 bp, C. elegans
gtaattggaaatt

SEQ ID NO: 720305 - DNA, 13 bp, C. elegans
gtaattggaattt

SEQ ID NO: 720306 - DNA, 13 bp, C. elegans
gtaatttaaagaa

SEQ ID NO: 720307 - DNA, 13 bp, C. elegans
gtaatttattgaa

SEQ ID NO: 720308 - DNA, 13 bp, C. elegans
gtaatttatttga

SEQ ID NO: 720309 - DNA, 13 bp, C. elegans
gtaatttcaaatt

SEQ ID NO: 720310 - DNA, 13 bp, C. elegans
gtaatttctgatt

SEQ ID NO: 720311 - DNA, 13 bp, C. elegans
gtaatttgaaaaa

SEQ ID NO: 720312 - DNA, 13 bp, C. elegans
gtaatttgctcag

SEQ ID NO: 720313 - DNA, 13 bp, C. elegans
gtaatttggaaac

SEQ ID NO: 720314 - DNA, 13 bp, C. elegans
gtaattttaattc

SEQ ID NO: 720315 - DNA, 13 bp, C. elegans
gtaattttcaaaa

SEQ ID NO: 720316 - DNA, 13 bp, C. elegans
gtaattttcaaat

SEQ ID NO: 720317 - DNA, 13 bp, C. elegans
gtaattttcacaa

SEQ ID NO: 720318 - DNA, 13 bp, C. elegans
gtaattttccttt

SEQ ID NO: 720319 - DNA, 13 bp, C. elegans
gtaattttgcaac

SEQ ID NO: 720320 - DNA, 13 bp, C. elegans
gtaatttttcgat

SEQ ID NO: 720321 - DNA, 13 bp, C. elegans
gtaatttttctac

SEQ ID NO: 720322 - DNA, 13 bp, C. elegans
gtaattttttctc

SEQ ID NO: 720323 - DNA, 13 bp, C. elegans
gtacaaaacattt

SEQ ID NO: 720324 - DNA, 13 bp, C. elegans
gtacaaaactaat

SEQ ID NO: 720325 - DNA, 13 bp, C. elegans
gtacaaaattaaa

SEQ ID NO: 720326 - DNA, 13 bp, C. elegans
gtacaagaagctt

SEQ ID NO: 720327 - DNA, 13 bp, C. elegans
gtacacacacaca

SEQ ID NO: 720328 - DNA, 13 bp, C. elegans
gtacacatacaat

SEQ ID NO: 720329 - DNA, 13 bp, C. elegans
gtacagtaaccca

SEQ ID NO: 720330 - DNA, 13 bp, C. elegans
gtacagtaaccct

SEQ ID NO: 720331 - DNA, 13 bp, C. elegans
gtacatttcaaaa

SEQ ID NO: 720332 - DNA, 13 bp, C. elegans
gtacatttgtttt

SEQ ID NO: 720333 - DNA, 13 bp, C. elegans
gtacattttgaaa

SEQ ID NO: 720334 - DNA, 13 bp, C. elegans
gtacatttttctt

SEQ ID NO: 720335 - DNA, 13 bp, C. elegans
gtaccacttgccg

SEQ ID NO: 720336 - DNA, 13 bp, C. elegans
gtacctcctgatg

SEQ ID NO: 720337 - DNA, 13 bp, C. elegans
gtacctgaaaatc

SEQ ID NO: 720338 - DNA, 13 bp, C. elegans
gtacgcaaacacc

SEQ ID NO: 720339 - DNA, 13 bp, C. elegans
gtacgcaaacact

SEQ ID NO: 720340 - DNA, 13 bp, C. elegans
gtactatttaaag

SEQ ID NO: 720341 - DNA, 14 bp, C. elegans
gtactcctctcgga

SEQ ID NO: 720342 - DNA, 13 bp, C. elegans
gtactgcacaaca

SEQ ID NO: 720343 - DNA, 13 bp, C. elegans
gtactgtaaaatt

SEQ ID NO: 720344 - DNA, 13 bp, C. elegans
gtactgtaagagt

SEQ ID NO: 720345 - DNA, 13 bp, C. elegans
gtactgtaagggt

SEQ ID NO: 720346 - DNA, 13 bp, C. elegans
gtactgtaatggt

SEQ ID NO: 720347 - DNA, 13 bp, C. elegans
gtactgtagaagt

SEQ ID NO: 720348 - DNA, 13 bp, C. elegans
gtactgtagctat

SEQ ID NO: 720349 - DNA, 13 bp, C. elegans
gtactgtagttat

SEQ ID NO: 720350 - DNA, 13 bp, C. elegans
gtacttttccttt

SEQ ID NO: 720351 - DNA, 13 bp, C. elegans
gtacttttctgaa

SEQ ID NO: 720352 - DNA, 13 bp, C. elegans
gtacttttttaaa

SEQ ID NO: 720353 - DNA, 13 bp, C. elegans
gtacttttttgaa

SEQ ID NO: 720354 - DNA, 13 bp, C. elegans
gtagaaataaatt

SEQ ID NO: 720355 - DNA, 13 bp, C. elegans
gtagaacattttt

SEQ ID NO: 720356 - DNA, 13 bp, C. elegans
gtagaattcgaat

SEQ ID NO: 720357 - DNA, 13 bp, C. elegans
gtagaattgctcc

SEQ ID NO: 720358 - DNA, 13 bp, C. elegans
gtagaatttcaga

SEQ ID NO: 720359 - DNA, 13 bp, C. elegans
gtagaattttaga

SEQ ID NO: 720360 - DNA, 13 bp, C. elegans
gtagaatttttct

SEQ ID NO: 720361 - DNA, 13 bp, C. elegans
gtagacaaaaact

SEQ ID NO: 720362 - DNA, 13 bp, C. elegans
gtagagaaatatt

SEQ ID NO: 720363 - DNA, 13 bp, C. elegans
gtagagcacattt

SEQ ID NO: 720364 - DNA, 13 bp, C. elegans
gtagagcgcgttt

SEQ ID NO: 720365 - DNA, 13 bp, C. elegans
gtagagtcaaaaa

SEQ ID NO: 720366 - DNA, 13 bp, C. elegans
gtagatcaaaaat

SEQ ID NO: 720367 - DNA, 13 bp, C. elegans
gtagatcaaaaga

SEQ ID NO: 720368 - DNA, 13 bp, C. elegans
gtagatcaagcaa

SEQ ID NO: 720369 - DNA, 13 bp, C. elegans
gtagatcaagccg

SEQ ID NO: 720370 - DNA, 13 bp, C. elegans
gtagatcaagtcg

SEQ ID NO: 720371 - DNA, 13 bp, C. elegans
gtagattcaaaaa

SEQ ID NO: 720372 - DNA, 13 bp, C. elegans
gtagattctttcc

SEQ ID NO: 720373 - DNA, 13 bp, C. elegans
gtagatttgccga

SEQ ID NO: 720374 - DNA, 13 bp, C. elegans
gtagatttttctg

SEQ ID NO: 720375 - DNA, 13 bp, C. elegans
gtagcacattttt

SEQ ID NO: 720376 - DNA, 13 bp, C. elegans
gtagccggtctcg

SEQ ID NO: 720377 - DNA, 13 bp, C. elegans
gtagcgccagtgg

SEQ ID NO: 720378 - DNA, 13 bp, C. elegans
gtaggagtacttt

SEQ ID NO: 720379 - DNA, 13 bp, C. elegans
gtaggcaagcagg

SEQ ID NO: 720380 - DNA, 13 bp, C. elegans
gtaggcaggcatg

SEQ ID NO: 720381 - DNA, 13 bp, C. elegans
gtaggcatgaggt

SEQ ID NO: 720382 - DNA, 13 bp, C. elegans
gtaggcatgccta

SEQ ID NO: 720383 - DNA, 13 bp, C. elegans
gtaggcttactgt

SEQ ID NO: 720384 - DNA, 13 bp, C. elegans
gtaggtaggcacg

SEQ ID NO: 720385 - DNA, 13 bp, C. elegans
gtaggtcaaaaat

SEQ ID NO: 720386 - DNA, 13 bp, C. elegans
gtaggtcaaatta

SEQ ID NO: 720387 - DNA, 13 bp, C. elegans
gtaggtcaagtta

SEQ ID NO: 720388 - DNA, 13 bp, C. elegans
gtaggtcaatggg

SEQ ID NO: 720389 - DNA, 13 bp, C. elegans
gtagtaaaagaga

SEQ ID NO: 720390 - DNA, 14 bp, C. elegans
gtagtagtactgta

SEQ ID NO: 720391 - DNA, 13 bp, C. elegans
gtagtatttgtag

SEQ ID NO: 720392 - DNA, 13 bp, C. elegans
gtagtggtactgt

SEQ ID NO: 720393 - DNA, 14 bp, C. elegans
gtagtgtcggaaaa

SEQ ID NO: 720394 - DNA, 13 bp, C. elegans
gtagttggaagag

SEQ ID NO: 720395 - DNA, 13 bp, C. elegans
gtagtttatctca

SEQ ID NO: 720396 - DNA, 13 bp, C. elegans
gtagtttctgatt

SEQ ID NO: 720397 - DNA, 13 bp, C. elegans
gtagtttgtagcc

SEQ ID NO: 720398 - DNA, 13 bp, C. elegans
gtagtttttcatt

SEQ ID NO: 720399 - DNA, 13 bp, C. elegans
gtagttttttgaa

SEQ ID NO: 720400 - DNA, 13 bp, C. elegans
gtataaaaattca

SEQ ID NO: 720401 - DNA, 13 bp, C. elegans
gtataaagttcag

SEQ ID NO: 720402 - DNA, 13 bp, C. elegans
gtatacaatttaa

SEQ ID NO: 720403 - DNA, 13 bp, C. elegans
gtatacaattttc

SEQ ID NO: 720404 - DNA, 13 bp, C. elegans
gtatatatgtata

SEQ ID NO: 720405 - DNA, 13 bp, C. elegans
gtatatttatcat

SEQ ID NO: 720406 - DNA, 13 bp, C. elegans
gtatatttcaaaa

SEQ ID NO: 720407 - DNA, 13 bp, C. elegans
gtatcaatacatg

SEQ ID NO: 720408 - DNA, 13 bp, C. elegans
gtatcagcaaaaa

SEQ ID NO: 720409 - DNA, 13 bp, C. elegans
gtatcatgtttca

SEQ ID NO: 720410 - DNA, 13 bp, C. elegans
gtatcattatgtg

SEQ ID NO: 720411 - DNA, 13 bp, C. elegans
gtatccggtctcg

SEQ ID NO: 720412 - DNA, 13 bp, C. elegans
gtatcgagaaatg

SEQ ID NO: 720413 - DNA, 13 bp, C. elegans
gtatcgatttttt

SEQ ID NO: 720414 - DNA, 13 bp, C. elegans
gtatctattttta

SEQ ID NO: 720415 - DNA, 13 bp, C. elegans
gtatctcgaaaac

SEQ ID NO: 720416 - DNA, 13 bp, C. elegans
gtatgccaatcta

SEQ ID NO: 720417 - DNA, 13 bp, C. elegans
gtatgctaaataa

SEQ ID NO: 720418 - DNA, 13 bp, C. elegans
gtatgtaaaaatt

SEQ ID NO: 720419 - DNA, 13 bp, C. elegans
gtatgtaccaact

SEQ ID NO: 720420 - DNA, 13 bp, C. elegans
gtatgtattatat

SEQ ID NO: 720421 - DNA, 13 bp, C. elegans
gtatgtttaaaaa

SEQ ID NO: 720422 - DNA, 13 bp, C. elegans
gtatgttttcaat

SEQ ID NO: 720423 - DNA, 13 bp, C. elegans
gtattaaaacatt

SEQ ID NO: 720424 - DNA, 13 bp, C. elegans
gtattatattttc

SEQ ID NO: 720425 - DNA, 13 bp, C. elegans
gtattcaaaataa

SEQ ID NO: 720426 - DNA, 13 bp, C. elegans
gtattcaaataaa

SEQ ID NO: 720427 - DNA, 13 bp, C. elegans
gtattcaagaagt

SEQ ID NO: 720428 - DNA, 13 bp, C. elegans
gtattcatttaaa

SEQ ID NO: 720429 - DNA, 13 bp, C. elegans
gtattcattttat

SEQ ID NO: 720430 - DNA, 13 bp, C. elegans
gtattcattttca

SEQ ID NO: 720431 - DNA, 13 bp, C. elegans
gtattccaaaaaa

SEQ ID NO: 720432 - DNA, 13 bp, C. elegans
gtattccttgttc

SEQ ID NO: 720433 - DNA, 13 bp, C. elegans
gtattcctttctc

SEQ ID NO: 720434 - DNA, 13 bp, C. elegans
gtattctagcaat

SEQ ID NO: 720435 - DNA, 13 bp, C. elegans
gtattgaaaattt

SEQ ID NO: 720436 - DNA, 13 bp, C. elegans
gtattgagcaaca

SEQ ID NO: 720437 - DNA, 13 bp, C. elegans
gtattggacagcc

SEQ ID NO: 720438 - DNA, 13 bp, C. elegans
gtattgtttaaaa

SEQ ID NO: 720439 - DNA, 13 bp, C. elegans
gtatttagaaaaa

SEQ ID NO: 720440 - DNA, 13 bp, C. elegans
gtatttattgcat

SEQ ID NO: 720441 - DNA, 13 bp, C. elegans
gtatttatttcag

SEQ ID NO: 720442 - DNA, 13 bp, C. elegans
gtatttatttgaa

SEQ ID NO: 720443 - DNA, 13 bp, C. elegans
gtatttcatattt

SEQ ID NO: 720444 - DNA, 13 bp, C. elegans
gtatttcctattt

SEQ ID NO: 720445 - DNA, 13 bp, C. elegans
gtatttcctctaa

SEQ ID NO: 720446 - DNA, 13 bp, C. elegans
gtatttctacagt

SEQ ID NO: 720447 - DNA, 13 bp, C. elegans
gtatttctcaaaa

SEQ ID NO: 720448 - DNA, 13 bp, C. elegans
gtatttgaaaaaa

SEQ ID NO: 720449 - DNA, 13 bp, C. elegans
gtatttgaaaata

SEQ ID NO: 720450 - DNA, 13 bp, C. elegans
gtatttgaacaat

SEQ ID NO: 720451 - DNA, 13 bp, C. elegans
gtatttgaacatt

SEQ ID NO: 720452 - DNA, 13 bp, C. elegans
gtatttgaataaa

SEQ ID NO: 720453 - DNA, 13 bp, C. elegans
gtattttaaacat

SEQ ID NO: 720454 - DNA, 13 bp, C. elegans
gtattttaacatt

SEQ ID NO: 720455 - DNA, 13 bp, C. elegans
gtattttaagaaa

SEQ ID NO: 720456 - DNA, 13 bp, C. elegans
gtattttatttca

SEQ ID NO: 720457 - DNA, 13 bp, C. elegans
gtattttcaaatt

SEQ ID NO: 720458 - DNA, 13 bp, C. elegans
gtattttccaaca

SEQ ID NO: 720459 - DNA, 13 bp, C. elegans
gtattttccacag

SEQ ID NO: 720460 - DNA, 13 bp, C. elegans
gtattttcccaaa

SEQ ID NO: 720461 - DNA, 13 bp, C. elegans
gtattttctctat

SEQ ID NO: 720462 - DNA, 13 bp, C. elegans
gtattttctggta

SEQ ID NO: 720463 - DNA, 13 bp, C. elegans
gtattttcttcaa

SEQ ID NO: 720464 - DNA, 13 bp, C. elegans
gtattttgaaaca

SEQ ID NO: 720465 - DNA, 13 bp, C. elegans
gtattttgacgaa

SEQ ID NO: 720466 - DNA, 13 bp, C. elegans
gtattttgataaa

SEQ ID NO: 720467 - DNA, 13 bp, C. elegans
gtattttgcattt

SEQ ID NO: 720468 - DNA, 13 bp, C. elegans
gtattttgtgaga

SEQ ID NO: 720469 - DNA, 13 bp, C. elegans
gtattttgttgaa

SEQ ID NO: 720470 - DNA, 13 bp, C. elegans
gtatttttacaaa

SEQ ID NO: 720471 - DNA, 13 bp, C. elegans
gtatttttcaaaa

SEQ ID NO: 720472 - DNA, 13 bp, C. elegans
gtatttttcaaac

SEQ ID NO: 720473 - DNA, 13 bp, C. elegans
gtatttttcaaat

SEQ ID NO: 720474 - DNA, 13 bp, C. elegans
gtatttttcattc

SEQ ID NO: 720475 - DNA, 13 bp, C. elegans
gtatttttgaagc

SEQ ID NO: 720476 - DNA, 13 bp, C. elegans
gtatttttgacta

SEQ ID NO: 720477 - DNA, 13 bp, C. elegans
gtatttttggagc

SEQ ID NO: 720478 - DNA, 13 bp, C. elegans
gtattttttgtcg

SEQ ID NO: 720479 - DNA, 13 bp, C. elegans
gtcaaaaaacttt

SEQ ID NO: 720480 - DNA, 13 bp, C. elegans
gtcaaaaaatgga

SEQ ID NO: 720481 - DNA, 13 bp, C. elegans
gtcaaaaacgggc

SEQ ID NO: 720482 - DNA, 13 bp, C. elegans
gtcaaaaagtcaa

SEQ ID NO: 720483 - DNA, 13 bp, C. elegans
gtcaaaaagtgtt

SEQ ID NO: 720484 - DNA, 13 bp, C. elegans
gtcaaaaatcgat

SEQ ID NO: 720485 - DNA, 13 bp, C. elegans
gtcaaaaatgacg

SEQ ID NO: 720486 - DNA, 13 bp, C. elegans
gtcaaaaatgaga

SEQ ID NO: 720487 - DNA, 13 bp, C. elegans
gtcaaaaattgaa

SEQ ID NO: 720488 - DNA, 13 bp, C. elegans
gtcaaaagtgaaa

SEQ ID NO: 720489 - DNA, 13 bp, C. elegans
gtcaaaatctttt

SEQ ID NO: 720490 - DNA, 13 bp, C. elegans
gtcaaaatttaaa

SEQ ID NO: 720491 - DNA, 13 bp, C. elegans
gtcaaagagaagg

SEQ ID NO: 720492 - DNA, 13 bp, C. elegans
gtcaaagatctaa

SEQ ID NO: 720493 - DNA, 13 bp, C. elegans
gtcaaagttttgg

SEQ ID NO: 720494 - DNA, 13 bp, C. elegans
gtcaaatatatgg

SEQ ID NO: 720495 - DNA, 13 bp, C. elegans
gtcaaatatgatg

SEQ ID NO: 720496 - DNA, 13 bp, C. elegans
gtcaaatcaacgc

SEQ ID NO: 720497 - DNA, 13 bp, C. elegans
gtcaaatgaaaga

SEQ ID NO: 720498 - DNA, 13 bp, C. elegans
gtcaaatgtgttg

SEQ ID NO: 720499 - DNA, 13 bp, C. elegans
gtcaaattatcaa

SEQ ID NO: 720500 - DNA, 13 bp, C. elegans
gtcaaattgaagg

SEQ ID NO: 720501 - DNA, 13 bp, C. elegans
gtcaaattgccgg

SEQ ID NO: 720502 - DNA, 13 bp, C. elegans
gtcaaattggcaa

SEQ ID NO: 720503 - DNA, 13 bp, C. elegans
gtcaaattttcag

SEQ ID NO: 720504 - DNA, 13 bp, C. elegans
gtcaaattttcat

SEQ ID NO: 720505 - DNA, 13 bp, C. elegans
gtcaaattttttt

SEQ ID NO: 720506 - DNA, 13 bp, C. elegans
gtcaacttccaaa

SEQ ID NO: 720507 - DNA, 13 bp, C. elegans
gtcaagaaagcca

SEQ ID NO: 720508 - DNA, 14 bp, C. elegans
gtcaagcggctgga

SEQ ID NO: 720509 - DNA, 13 bp, C. elegans
gtcaataaaaaat

SEQ ID NO: 720510 - DNA, 13 bp, C. elegans
gtcaatcactcgt

SEQ ID NO: 720511 - DNA, 13 bp, C. elegans
gtcaatgcaatat

SEQ ID NO: 720512 - DNA, 13 bp, C. elegans
gtcaatgttttaa

SEQ ID NO: 720513 - DNA, 13 bp, C. elegans
gtcaattatttaa

SEQ ID NO: 720514 - DNA, 13 bp, C. elegans
gtcaattgacaaa

SEQ ID NO: 720515 - DNA, 13 bp, C. elegans
gtcaatttgtttt

SEQ ID NO: 720516 - DNA, 13 bp, C. elegans
gtcaattttgaaa

SEQ ID NO: 720517 - DNA, 13 bp, C. elegans
gtcaattttgagt

SEQ ID NO: 720518 - DNA, 13 bp, C. elegans
gtcaatttttcct

SEQ ID NO: 720519 - DNA, 13 bp, C. elegans
gtcacaaaaaatt

SEQ ID NO: 720520 - DNA, 13 bp, C. elegans
gtcacaaaagttt

SEQ ID NO: 720521 - DNA, 13 bp, C. elegans
gtcacaaaatatt

SEQ ID NO: 720522 - DNA, 13 bp, C. elegans
gtcacaaatgtat

SEQ ID NO: 720523 - DNA, 13 bp, C. elegans
gtcacaacttttt

SEQ ID NO: 720524 - DNA, 13 bp, C. elegans
gtcacaagttcac

SEQ ID NO: 720525 - DNA, 13 bp, C. elegans
gtcacaattttct

SEQ ID NO: 720526 - DNA, 13 bp, C. elegans
gtcacaatttttc

SEQ ID NO: 720527 - DNA, 13 bp, C. elegans
gtcacacattttt

SEQ ID NO: 720528 - DNA, 13 bp, C. elegans
gtcacacttttct

SEQ ID NO: 720529 - DNA, 13 bp, C. elegans
gtcacagactaca

SEQ ID NO: 720530 - DNA, 13 bp, C. elegans
gtcacatttttct

SEQ ID NO: 720531 - DNA, 13 bp, C. elegans
gtcactatatttg

SEQ ID NO: 720532 - DNA, 13 bp, C. elegans
gtcactctctaac

SEQ ID NO: 720533 - DNA, 13 bp, C. elegans
gtcactctttttg

SEQ ID NO: 720534 - DNA, 13 bp, C. elegans
gtcactttttgtt

SEQ ID NO: 720535 - DNA, 13 bp, C. elegans
gtcagaaaaatgt

SEQ ID NO: 720536 - DNA, 13 bp, C. elegans
gtcagaaaattat

SEQ ID NO: 720537 - DNA, 13 bp, C. elegans
gtcagaaacttcg

SEQ ID NO: 720538 - DNA, 13 bp, C. elegans
gtcagcggctggt

SEQ ID NO: 720539 - DNA, 13 bp, C. elegans
gtcagcgggaaaa

SEQ ID NO: 720540 - DNA, 13 bp, C. elegans
gtcaggcaggtag

SEQ ID NO: 720541 - DNA, 13 bp, C. elegans
gtcagtgcaaaat

SEQ ID NO: 720542 - DNA, 13 bp, C. elegans
gtcagttcttctt

SEQ ID NO: 720543 - DNA, 13 bp, C. elegans
gtcagttgaaatt

SEQ ID NO: 720544 - DNA, 13 bp, C. elegans
gtcagtttttcga

SEQ ID NO: 720545 - DNA, 13 bp, C. elegans
gtcagtttttgga

SEQ ID NO: 720546 - DNA, 13 bp, C. elegans
gtcataaaaaatg

SEQ ID NO: 720547 - DNA, 13 bp, C. elegans
gtcatcaactaaa

SEQ ID NO: 720548 - DNA, 13 bp, C. elegans
gtcatcaactttt

SEQ ID NO: 720549 - DNA, 13 bp, C. elegans
gtcatcatcatca

SEQ ID NO: 720550 - DNA, 13 bp, C. elegans
gtcatcattttct

SEQ ID NO: 720551 - DNA, 13 bp, C. elegans
gtcatgattatac

SEQ ID NO: 720552 - DNA, 13 bp, C. elegans
gtcatggtgcatc

SEQ ID NO: 720553 - DNA, 13 bp, C. elegans
gtcattaattttt

SEQ ID NO: 720554 - DNA, 13 bp, C. elegans
gtcattttcttga

SEQ ID NO: 720555 - DNA, 13 bp, C. elegans
gtcattttggcac

SEQ ID NO: 720556 - DNA, 13 bp, C. elegans
gtcatttttaaaa

SEQ ID NO: 720557 - DNA, 13 bp, C. elegans
gtcatttttctaa

SEQ ID NO: 720558 - DNA, 13 bp, C. elegans
gtcatttttctct

SEQ ID NO: 720559 - DNA, 13 bp, C. elegans
gtcatttttcttc

SEQ ID NO: 720560 - DNA, 13 bp, C. elegans
gtcatttttgaca

SEQ ID NO: 720561 - DNA, 13 bp, C. elegans
gtcatttttggcc

SEQ ID NO: 720562 - DNA, 13 bp, C. elegans
gtcatttttgtga

SEQ ID NO: 720563 - DNA, 13 bp, C. elegans
gtccaaaaccacc

SEQ ID NO: 720564 - DNA, 13 bp, C. elegans
gtccaaaactacc

SEQ ID NO: 720565 - DNA, 13 bp, C. elegans
gtccaaaatttca

SEQ ID NO: 720566 - DNA, 13 bp, C. elegans
gtccaactgaaat

SEQ ID NO: 720567 - DNA, 13 bp, C. elegans
gtccatgctcatc

SEQ ID NO: 720568 - DNA, 13 bp, C. elegans
gtccattttccat

SEQ ID NO: 720569 - DNA, 13 bp, C. elegans
gtccattttgtgg

SEQ ID NO: 720570 - DNA, 13 bp, C. elegans
gtcccactttact

SEQ ID NO: 720571 - DNA, 13 bp, C. elegans
gtcccatcacgaa

SEQ ID NO: 720572 - DNA, 14 bp, C. elegans
gtcccattacgatt

SEQ ID NO: 720573 - DNA, 13 bp, C. elegans
gtcccgatttttg

SEQ ID NO: 720574 - DNA, 13 bp, C. elegans
gtccgaagttgac

SEQ ID NO: 720575 - DNA, 13 bp, C. elegans
gtccgattttgac

SEQ ID NO: 720576 - DNA, 13 bp, C. elegans
gtccgcaaacacc

SEQ ID NO: 720577 - DNA, 13 bp, C. elegans
gtccgtgtgaagt

SEQ ID NO: 720578 - DNA, 13 bp, C. elegans
gtcctccattgat

SEQ ID NO: 720579 - DNA, 13 bp, C. elegans
gtcgaaaaaaaat

SEQ ID NO: 720580 - DNA, 13 bp, C. elegans
gtcgaaaaacata

SEQ ID NO: 720581 - DNA, 13 bp, C. elegans
gtcgaaaaatcaa

SEQ ID NO: 720582 - DNA, 13 bp, C. elegans
gtcgaaaaatcga

SEQ ID NO: 720583 - DNA, 13 bp, C. elegans
gtcgaaattttaa

SEQ ID NO: 720584 - DNA, 13 bp, C. elegans
gtcgaaggaaggg

SEQ ID NO: 720585 - DNA, 13 bp, C. elegans
gtcgaatttgtcg

SEQ ID NO: 720586 - DNA, 13 bp, C. elegans
gtcgagaccagat

SEQ ID NO: 720587 - DNA, 13 bp, C. elegans
gtcgaggaaaccg

SEQ ID NO: 720588 - DNA, 13 bp, C. elegans
gtcgatcaaaaat

SEQ ID NO: 720589 - DNA, 13 bp, C. elegans
gtcgatttacaga

SEQ ID NO: 720590 - DNA, 13 bp, C. elegans
gtcgatttcaaaa

SEQ ID NO: 720591 - DNA, 14 bp, C. elegans
gtcgatttcaacgg

SEQ ID NO: 720592 - DNA, 13 bp, C. elegans
gtcgcatgttcga

SEQ ID NO: 720593 - DNA, 13 bp, C. elegans
gtcgccgcaaggc

SEQ ID NO: 720594 - DNA, 13 bp, C. elegans
gtcgcgtcgcggc

SEQ ID NO: 720595 - DNA, 13 bp, C. elegans
gtcgctgattggt

SEQ ID NO: 720596 - DNA, 14 bp, C. elegans
gtcggcagggaata

SEQ ID NO: 720597 - DNA, 13 bp, C. elegans
gtcggctgtcggc

SEQ ID NO: 720598 - DNA, 13 bp, C. elegans
gtcggtggaggat

SEQ ID NO: 720599 - DNA, 13 bp, C. elegans
gtcgtccaaaaaa

SEQ ID NO: 720600 - DNA, 13 bp, C. elegans
gtcgtcgtcgtct

SEQ ID NO: 720601 - DNA, 13 bp, C. elegans
gtcgtcgtcgttt

SEQ ID NO: 720602 - DNA, 13 bp, C. elegans
gtcgtgcgttgaa

SEQ ID NO: 720603 - DNA, 13 bp, C. elegans
gtcgtttcgagac

SEQ ID NO: 720604 - DNA, 13 bp, C. elegans
gtcgttttcattt

SEQ ID NO: 720605 - DNA, 13 bp, C. elegans
gtctaaaaataaa

SEQ ID NO: 720606 - DNA, 13 bp, C. elegans
gtctaacttgcaa

SEQ ID NO: 720607 - DNA, 13 bp, C. elegans
gtctacaaagggc

SEQ ID NO: 720608 - DNA, 13 bp, C. elegans
gtctacatgccta

SEQ ID NO: 720609 - DNA, 13 bp, C. elegans
gtctagtctagtc

SEQ ID NO: 720610 - DNA, 13 bp, C. elegans
gtctatttttcaa

SEQ ID NO: 720611 - DNA, 13 bp, C. elegans
gtctcaaatttta

SEQ ID NO: 720612 - DNA, 14 bp, C. elegans
gtctcaccacgata

SEQ ID NO: 720613 - DNA, 13 bp, C. elegans
gtctccagtcgat

SEQ ID NO: 720614 - DNA, 13 bp, C. elegans
gtctccgaggggc

SEQ ID NO: 720615 - DNA, 13 bp, C. elegans
gtctcgaaacgaa

SEQ ID NO: 720616 - DNA, 13 bp, C. elegans
gtctcgatgcgtc

SEQ ID NO: 720617 - DNA, 13 bp, C. elegans
gtctcgcaacgat

SEQ ID NO: 720618 - DNA, 13 bp, C. elegans
gtctcgccacgat

SEQ ID NO: 720619 - DNA, 13 bp, C. elegans
gtctcgttttctc

SEQ ID NO: 720620 - DNA, 13 bp, C. elegans
gtctcgtttttca

SEQ ID NO: 720621 - DNA, 13 bp, C. elegans
gtctctcactctc

SEQ ID NO: 720622 - DNA, 13 bp, C. elegans
gtctctcccactt

SEQ ID NO: 720623 - DNA, 13 bp, C. elegans
gtctctctcactc

SEQ ID NO: 720624 - DNA, 13 bp, C. elegans
gtctctcttcgcc

SEQ ID NO: 720625 - DNA, 13 bp, C. elegans
gtctctgcgtctc

SEQ ID NO: 720626 - DNA, 13 bp, C. elegans
gtctcttcgtctc

SEQ ID NO: 720627 - DNA, 13 bp, C. elegans
gtctcttcgtctt

SEQ ID NO: 720628 - DNA, 13 bp, C. elegans
gtctgaaaaatct

SEQ ID NO: 720629 - DNA, 13 bp, C. elegans
gtctgaaaatgaa

SEQ ID NO: 720630 - DNA, 13 bp, C. elegans
gtctgaaagttga

SEQ ID NO: 720631 - DNA, 13 bp, C. elegans
gtctgaaataaaa

SEQ ID NO: 720632 - DNA, 13 bp, C. elegans
gtctgcgtctcgt

SEQ ID NO: 720633 - DNA, 13 bp, C. elegans
gtctgcgtctctc

SEQ ID NO: 720634 - DNA, 13 bp, C. elegans
gtctggaaattct

SEQ ID NO: 720635 - DNA, 13 bp, C. elegans
gtctgtgacgtca

SEQ ID NO: 720636 - DNA, 13 bp, C. elegans
gtcttaccacgaa

SEQ ID NO: 720637 - DNA, 13 bp, C. elegans
gtcttcagataca

SEQ ID NO: 720638 - DNA, 13 bp, C. elegans
gtcttccaaaaaa

SEQ ID NO: 720639 - DNA, 13 bp, C. elegans
gtcttccattttc

SEQ ID NO: 720640 - DNA, 13 bp, C. elegans
gtcttctatataa

SEQ ID NO: 720641 - DNA, 13 bp, C. elegans
gtcttcttcattt

SEQ ID NO: 720642 - DNA, 13 bp, C. elegans
gtcttcttcttca

SEQ ID NO: 720643 - DNA, 13 bp, C. elegans
gtcttgtaaaaaa

SEQ ID NO: 720644 - DNA, 13 bp, C. elegans
gtctttcaaaatt

SEQ ID NO: 720645 - DNA, 13 bp, C. elegans
gtctttcatttga

SEQ ID NO: 720646 - DNA, 13 bp, C. elegans
gtcttttgaagag

SEQ ID NO: 720647 - DNA, 13 bp, C. elegans
gtgaaaaaatgca

SEQ ID NO: 720648 - DNA, 13 bp, C. elegans
gtgaaaaacaaga

SEQ ID NO: 720649 - DNA, 13 bp, C. elegans
gtgaaaaacattt

SEQ ID NO: 720650 - DNA, 13 bp, C. elegans
gtgaaaaacgaaa

SEQ ID NO: 720651 - DNA, 13 bp, C. elegans
gtgaaaaactgaa

SEQ ID NO: 720652 - DNA, 13 bp, C. elegans
gtgaaaaagatga

SEQ ID NO: 720653 - DNA, 13 bp, C. elegans
gtgaaaaagtgcc

SEQ ID NO: 720654 - DNA, 13 bp, C. elegans
gtgaaaaatattt

SEQ ID NO: 720655 - DNA, 13 bp, C. elegans
gtgaaaaatcagc

SEQ ID NO: 720656 - DNA, 13 bp, C. elegans
gtgaaaaatcttt

SEQ ID NO: 720657 - DNA, 13 bp, C. elegans
gtgaaaaatgacg

SEQ ID NO: 720658 - DNA, 13 bp, C. elegans
gtgaaaaattgga

SEQ ID NO: 720659 - DNA, 13 bp, C. elegans
gtgaaaaccgaaa

SEQ ID NO: 720660 - DNA, 13 bp, C. elegans
gtgaaaactgaat

SEQ ID NO: 720661 - DNA, 13 bp, C. elegans
gtgaaaactgaga

SEQ ID NO: 720662 - DNA, 13 bp, C. elegans
gtgaaaatcgaaa

SEQ ID NO: 720663 - DNA, 13 bp, C. elegans
gtgaaaatctttc

SEQ ID NO: 720664 - DNA, 13 bp, C. elegans
gtgaaaatgtttc

SEQ ID NO: 720665 - DNA, 13 bp, C. elegans
gtgaaaattcaca

SEQ ID NO: 720666 - DNA, 13 bp, C. elegans
gtgaaaattcctc

SEQ ID NO: 720667 - DNA, 13 bp, C. elegans
gtgaaaattgaaa

SEQ ID NO: 720668 - DNA, 13 bp, C. elegans
gtgaaaattgtat

SEQ ID NO: 720669 - DNA, 13 bp, C. elegans
gtgaaaattgttg

SEQ ID NO: 720670 - DNA, 13 bp, C. elegans
gtgaaaatttcga

SEQ ID NO: 720671 - DNA, 13 bp, C. elegans
gtgaaaatttgga

SEQ ID NO: 720672 - DNA, 13 bp, C. elegans
gtgaaaattttga

SEQ ID NO: 720673 - DNA, 13 bp, C. elegans
gtgaaacagaaaa

SEQ ID NO: 720674 - DNA, 13 bp, C. elegans
gtgaaacagaatt

SEQ ID NO: 720675 - DNA, 13 bp, C. elegans
gtgaaacatcaaa

SEQ ID NO: 720676 - DNA, 13 bp, C. elegans
gtgaaaccagaga

SEQ ID NO: 720677 - DNA, 13 bp, C. elegans
gtgaaagaaaatt

SEQ ID NO: 720678 - DNA, 13 bp, C. elegans
gtgaaataataat

SEQ ID NO: 720679 - DNA, 13 bp, C. elegans
gtgaaattcaaaa

SEQ ID NO: 720680 - DNA, 13 bp, C. elegans
gtgaaattcgaaa

SEQ ID NO: 720681 - DNA, 13 bp, C. elegans
gtgaaattgcaaa

SEQ ID NO: 720682 - DNA, 13 bp, C. elegans
gtgaaatttcaaa

SEQ ID NO: 720683 - DNA, 13 bp, C. elegans
gtgaaatttgaaa

SEQ ID NO: 720684 - DNA, 13 bp, C. elegans
gtgaaattttcaa

SEQ ID NO: 720685 - DNA, 13 bp, C. elegans
gtgaacaactttt

SEQ ID NO: 720686 - DNA, 13 bp, C. elegans
gtgaacggtcaga

SEQ ID NO: 720687 - DNA, 13 bp, C. elegans
gtgaactacaaaa

SEQ ID NO: 720688 - DNA, 13 bp, C. elegans
gtgaagaaaaatg

SEQ ID NO: 720689 - DNA, 13 bp, C. elegans
gtgaagaaaatat

SEQ ID NO: 720690 - DNA, 13 bp, C. elegans
gtgaagccagaga

SEQ ID NO: 720691 - DNA, 13 bp, C. elegans
gtgaagcgtttca

SEQ ID NO: 720692 - DNA, 13 bp, C. elegans
gtgaagctgaaaa

SEQ ID NO: 720693 - DNA, 13 bp, C. elegans
gtgaataaattat

SEQ ID NO: 720694 - DNA, 13 bp, C. elegans
gtgaataataaac

SEQ ID NO: 720695 - DNA, 13 bp, C. elegans
gtgaatattgatt

SEQ ID NO: 720696 - DNA, 13 bp, C. elegans
gtgaatcaaaacc

SEQ ID NO: 720697 - DNA, 13 bp, C. elegans
gtgaatttttaca

SEQ ID NO: 720698 - DNA, 13 bp, C. elegans
gtgacaaaaactg

SEQ ID NO: 720699 - DNA, 13 bp, C. elegans
gtgacacgtggca

SEQ ID NO: 720700 - DNA, 13 bp, C. elegans
gtgacattttgaa

SEQ ID NO: 720701 - DNA, 26 bp, C. elegans
gtgaccaaaggagttcgacaaggaga

SEQ ID NO: 720702 - DNA, 13 bp, C. elegans
gtgacgtcacaac

SEQ ID NO: 720703 - DNA, 13 bp, C. elegans
gtgacgtcacaga

SEQ ID NO: 720704 - DNA, 13 bp, C. elegans
gtgacgtcagcaa

SEQ ID NO: 720705 - DNA, 13 bp, C. elegans
gtgacgtcataaa

SEQ ID NO: 720706 - DNA, 13 bp, C. elegans
gtgacgtcataat

SEQ ID NO: 720707 - DNA, 13 bp, C. elegans
gtgacgtcatact

SEQ ID NO: 720708 - DNA, 13 bp, C. elegans
gtgacgtcatcac

SEQ ID NO: 720709 - DNA, 13 bp, C. elegans
gtgacgtcattat

SEQ ID NO: 720710 - DNA, 13 bp, C. elegans
gtgacgtcatttt

SEQ ID NO: 720711 - DNA, 13 bp, C. elegans
gtgagaaaataat

SEQ ID NO: 720712 - DNA, 13 bp, C. elegans
gtgagaaaatggc

SEQ ID NO: 720713 - DNA, 13 bp, C. elegans
gtgagaaattgaa

SEQ ID NO: 720714 - DNA, 13 bp, C. elegans
gtgagaatgaaaa

SEQ ID NO: 720715 - DNA, 13 bp, C. elegans
gtgagagacgcag

SEQ ID NO: 720716 - DNA, 13 bp, C. elegans
gtgagatgtcggc

SEQ ID NO: 720717 - DNA, 13 bp, C. elegans
gtgagcatttttt

SEQ ID NO: 720718 - DNA, 13 bp, C. elegans
gtgagctttttga

SEQ ID NO: 720719 - DNA, 13 bp, C. elegans
gtgaggaaattgt

SEQ ID NO: 720720 - DNA, 13 bp, C. elegans
gtgagtattttga

SEQ ID NO: 720721 - DNA, 13 bp, C. elegans
gtgagtttgaaag

SEQ ID NO: 720722 - DNA, 13 bp, C. elegans
gtgagttttatat

SEQ ID NO: 720723 - DNA, 13 bp, C. elegans
gtgagttttatta

SEQ ID NO: 720724 - DNA, 13 bp, C. elegans
gtgagttttcatt

SEQ ID NO: 720725 - DNA, 13 bp, C. elegans
gtgagtttttcga

SEQ ID NO: 720726 - DNA, 13 bp, C. elegans
gtgagtttttgaa

SEQ ID NO: 720727 - DNA, 13 bp, C. elegans
gtgataaaaatat

SEQ ID NO: 720728 - DNA, 13 bp, C. elegans
gtgataattattt

SEQ ID NO: 720729 - DNA, 13 bp, C. elegans
gtgatattctaag

SEQ ID NO: 720730 - DNA, 13 bp, C. elegans
gtgatcaactaaa

SEQ ID NO: 720731 - DNA, 13 bp, C. elegans
gtgatcatttttc

SEQ ID NO: 720732 - DNA, 13 bp, C. elegans
gtgatctaaaact

SEQ ID NO: 720733 - DNA, 13 bp, C. elegans
gtgatgaataaat

SEQ ID NO: 720734 - DNA, 13 bp, C. elegans
gtgatgatgatgg

SEQ ID NO: 720735 - DNA, 13 bp, C. elegans
gtgatgttgaaaa

SEQ ID NO: 720736 - DNA, 13 bp, C. elegans
gtgatttcagaaa

SEQ ID NO: 720737 - DNA, 14 bp, C. elegans
gtgatttgaaaaaa

SEQ ID NO: 720738 - DNA, 13 bp, C. elegans
gtgatttgggaat

SEQ ID NO: 720739 - DNA, 13 bp, C. elegans
gtgattttcaaaa

SEQ ID NO: 720740 - DNA, 13 bp, C. elegans
gtgattttccaga

SEQ ID NO: 720741 - DNA, 13 bp, C. elegans
gtgattttcgtaa

SEQ ID NO: 720742 - DNA, 13 bp, C. elegans
gtgatttttaaaa

SEQ ID NO: 720743 - DNA, 13 bp, C. elegans
gtgatttttctca

SEQ ID NO: 720744 - DNA, 13 bp, C. elegans
gtgatttttttca

SEQ ID NO: 720745 - DNA, 13 bp, C. elegans
gtgatttttttgc

SEQ ID NO: 720746 - DNA, 13 bp, C. elegans
gtgcaaaaggcaa

SEQ ID NO: 720747 - DNA, 13 bp, C. elegans
gtgcaaacttggc

SEQ ID NO: 720748 - DNA, 13 bp, C. elegans
gtgcaaattttga

SEQ ID NO: 720749 - DNA, 13 bp, C. elegans
gtgcaacactaat

SEQ ID NO: 720750 - DNA, 13 bp, C. elegans
gtgcaattttcga

SEQ ID NO: 720751 - DNA, 13 bp, C. elegans
gtgcaatttttca

SEQ ID NO: 720752 - DNA, 13 bp, C. elegans
gtgcacaattgaa

SEQ ID NO: 720753 - DNA, 13 bp, C. elegans
gtgcacatttgaa

SEQ ID NO: 720754 - DNA, 13 bp, C. elegans
gtgcactgaccaa

SEQ ID NO: 720755 - DNA, 13 bp, C. elegans
gtgcacttttaaa

SEQ ID NO: 720756 - DNA, 13 bp, C. elegans
gtgcatcgaagaa

SEQ ID NO: 720757 - DNA, 13 bp, C. elegans
gtgcatcgactga

SEQ ID NO: 720758 - DNA, 13 bp, C. elegans
gtgcattttattt

SEQ ID NO: 720759 - DNA, 13 bp, C. elegans
gtgcatttttcag

SEQ ID NO: 720760 - DNA, 13 bp, C. elegans
gtgcatttttgaa

SEQ ID NO: 720761 - DNA, 13 bp, C. elegans
gtgccaaattttt

SEQ ID NO: 720762 - DNA, 13 bp, C. elegans
gtgccacgtcatc

SEQ ID NO: 720763 - DNA, 13 bp, C. elegans
gtgccaggttgtc

SEQ ID NO: 720764 - DNA, 19 bp, C. elegans
gtgccagtaaaccgcgttt

SEQ ID NO: 720765 - DNA, 13 bp, C. elegans
gtgccgcgtcgcg

SEQ ID NO: 720766 - DNA, 13 bp, C. elegans
gtgccggaattga

SEQ ID NO: 720767 - DNA, 13 bp, C. elegans
gtgcctacaaggc

SEQ ID NO: 720768 - DNA, 13 bp, C. elegans
gtgcctcatttcg

SEQ ID NO: 720769 - DNA, 22 bp, C. elegans
gtgcgatcgggtaaaagtaaac

SEQ ID NO: 720770 - DNA, 13 bp, C. elegans
gtgcgcaaggcac

SEQ ID NO: 720771 - DNA, 13 bp, C. elegans
gtgcgctccactg

SEQ ID NO: 720772 - DNA, 13 bp, C. elegans
gtgcggtagagcg

SEQ ID NO: 720773 - DNA, 13 bp, C. elegans
gtgcggtggttgc

SEQ ID NO: 720774 - DNA, 13 bp, C. elegans
gtgctactccacc

SEQ ID NO: 720775 - DNA, 13 bp, C. elegans
gtgctatttggtg

SEQ ID NO: 720776 - DNA, 13 bp, C. elegans
gtgctcaaagtgc

SEQ ID NO: 720777 - DNA, 13 bp, C. elegans
gtgctcaaattgg

SEQ ID NO: 720778 - DNA, 13 bp, C. elegans
gtgctcaatgtgc

SEQ ID NO: 720779 - DNA, 13 bp, C. elegans
gtgctcacggagc

SEQ ID NO: 720780 - DNA, 13 bp, C. elegans
gtgctcagtgagc

SEQ ID NO: 720781 - DNA, 13 bp, C. elegans
gtgctcattgagc

SEQ ID NO: 720782 - DNA, 13 bp, C. elegans
gtgctcattgtgc

SEQ ID NO: 720783 - DNA, 13 bp, C. elegans
gtgctccaaaaaa

SEQ ID NO: 720784 - DNA, 13 bp, C. elegans
gtgctccaaaaag

SEQ ID NO: 720785 - DNA, 13 bp, C. elegans
gtgctccgcgagc

SEQ ID NO: 720786 - DNA, 13 bp, C. elegans
gtgctccgtgagc

SEQ ID NO: 720787 - DNA, 13 bp, C. elegans
gtgctctctctct

SEQ ID NO: 720788 - DNA, 13 bp, C. elegans
gtgctctttctct

SEQ ID NO: 720789 - DNA, 13 bp, C. elegans
gtgctgacgtcac

SEQ ID NO: 720790 - DNA, 13 bp, C. elegans
gtgctggtggatg

SEQ ID NO: 720791 - DNA, 13 bp, C. elegans
gtgctttctgtcg

SEQ ID NO: 720792 - DNA, 13 bp, C. elegans
gtggaaaaactga

SEQ ID NO: 720793 - DNA, 13 bp, C. elegans
gtggaaaaatatc

SEQ ID NO: 720794 - DNA, 13 bp, C. elegans
gtggaaaaatcac

SEQ ID NO: 720795 - DNA, 13 bp, C. elegans
gtggaaaatctga

SEQ ID NO: 720796 - DNA, 13 bp, C. elegans
gtggaaaattgaa

SEQ ID NO: 720797 - DNA, 13 bp, C. elegans
gtggaaaatttaa

SEQ ID NO: 720798 - DNA, 13 bp, C. elegans
gtggaaaatttga

SEQ ID NO: 720799 - DNA, 13 bp, C. elegans
gtggaaagtcaaa

SEQ ID NO: 720800 - DNA, 13 bp, C. elegans
gtggaaatcaaaa

SEQ ID NO: 720801 - DNA, 13 bp, C. elegans
gtggaaatttgat

SEQ ID NO: 720802 - DNA, 13 bp, C. elegans
gtggaaattttaa

SEQ ID NO: 720803 - DNA, 13 bp, C. elegans
gtggaactatttt

SEQ ID NO: 720804 - DNA, 13 bp, C. elegans
gtggaagaggttt

SEQ ID NO: 720805 - DNA, 13 bp, C. elegans
gtggaattttttc

SEQ ID NO: 720806 - DNA, 13 bp, C. elegans
gtggacgaggaat

SEQ ID NO: 720807 - DNA, 13 bp, C. elegans
gtggagaactttc

SEQ ID NO: 720808 - DNA, 13 bp, C. elegans
gtggagaattcga

SEQ ID NO: 720809 - DNA, 13 bp, C. elegans
gtggagacgcaga

SEQ ID NO: 720810 - DNA, 13 bp, C. elegans
gtggagcagaaaa

SEQ ID NO: 720811 - DNA, 13 bp, C. elegans
gtggagcgatggg

SEQ ID NO: 720812 - DNA, 13 bp, C. elegans
gtggagcgcactt

SEQ ID NO: 720813 - DNA, 13 bp, C. elegans
gtggagtacacga

SEQ ID NO: 720814 - DNA, 13 bp, C. elegans
gtggagtcagaat

SEQ ID NO: 720815 - DNA, 13 bp, C. elegans
gtggattactgta

SEQ ID NO: 720816 - DNA, 13 bp, C. elegans
gtggattttttga

SEQ ID NO: 720817 - DNA, 14 bp, C. elegans
gtggcaaatgtgct

SEQ ID NO: 720818 - DNA, 13 bp, C. elegans
gtggccgagaaaa

SEQ ID NO: 720819 - DNA, 13 bp, C. elegans
gtggccgagtttt

SEQ ID NO: 720820 - DNA, 13 bp, C. elegans
gtggccgtgaaaa

SEQ ID NO: 720821 - DNA, 13 bp, C. elegans
gtggcctagaaat

SEQ ID NO: 720822 - DNA, 13 bp, C. elegans
gtgggcggagcct

SEQ ID NO: 720823 - DNA, 13 bp, C. elegans
gtgggcggagtct

SEQ ID NO: 720824 - DNA, 13 bp, C. elegans
gtgggcggcaaat

SEQ ID NO: 720825 - DNA, 13 bp, C. elegans
gtgggtacggtag

SEQ ID NO: 720826 - DNA, 14 bp, C. elegans
gtgggtctcgccac

SEQ ID NO: 720827 - DNA, 13 bp, C. elegans
gtgggtggcaatt

SEQ ID NO: 720828 - DNA, 13 bp, C. elegans
gtggtaaaaactg

SEQ ID NO: 720829 - DNA, 13 bp, C. elegans
gtggtgaaaactg

SEQ ID NO: 720830 - DNA, 13 bp, C. elegans
gtggttttcaaca

SEQ ID NO: 720831 - DNA, 13 bp, C. elegans
gtggttttctcct

SEQ ID NO: 720832 - DNA, 13 bp, C. elegans
gtggttttggaaa

SEQ ID NO: 720833 - DNA, 13 bp, C. elegans
gtgtaaattttca

SEQ ID NO: 720834 - DNA, 13 bp, C. elegans
gtgtaacattcta

SEQ ID NO: 720835 - DNA, 13 bp, C. elegans
gtgtaatttgtgc

SEQ ID NO: 720836 - DNA, 13 bp, C. elegans
gtgtacaaaaaat

SEQ ID NO: 720837 - DNA, 19 bp, C. elegans
gtgtactccacacggacaa

SEQ ID NO: 720838 - DNA, 14 bp, C. elegans
gtgtactcctcgag

SEQ ID NO: 720839 - DNA, 13 bp, C. elegans
gtgtactgttatt

SEQ ID NO: 720840 - DNA, 13 bp, C. elegans
gtgtagatttacg

SEQ ID NO: 720841 - DNA, 28 bp, C. elegans
gtgtaggtctcatcaagacgcatcgaga

SEQ ID NO: 720842 - DNA, 13 bp, C. elegans
gtgtagtcctctc

SEQ ID NO: 720843 - DNA, 13 bp, C. elegans
gtgtagttttcaa

SEQ ID NO: 720844 - DNA, 13 bp, C. elegans
gtgtatatttacg

SEQ ID NO: 720845 - DNA, 13 bp, C. elegans
gtgtattgggtta

SEQ ID NO: 720846 - DNA, 13 bp, C. elegans
gtgtatttttcca

SEQ ID NO: 720847 - DNA, 13 bp, C. elegans
gtgtcaaaatgac

SEQ ID NO: 720848 - DNA, 13 bp, C. elegans
gtgtcaaaattaa

SEQ ID NO: 720849 - DNA, 13 bp, C. elegans
gtgtcaataaaaa

SEQ ID NO: 720850 - DNA, 13 bp, C. elegans
gtgtcagaatgtc

SEQ ID NO: 720851 - DNA, 13 bp, C. elegans
gtgtcaggatgtc

SEQ ID NO: 720852 - DNA, 13 bp, C. elegans
gtgtcattttgaa

SEQ ID NO: 720853 - DNA, 13 bp, C. elegans
gtgtcgatttacg

SEQ ID NO: 720854 - DNA, 13 bp, C. elegans
gtgtcggccgctt

SEQ ID NO: 720855 - DNA, 13 bp, C. elegans
gtgtctattttta

SEQ ID NO: 720856 - DNA, 14 bp, C. elegans
gtgtctcaccacga

SEQ ID NO: 720857 - DNA, 13 bp, C. elegans
gtgtctctagata

SEQ ID NO: 720858 - DNA, 13 bp, C. elegans
gtgtctgcgtctc

SEQ ID NO: 720859 - DNA, 13 bp, C. elegans
gtgtctggtggag

SEQ ID NO: 720860 - DNA, 13 bp, C. elegans
gtgtctttttgaa

SEQ ID NO: 720861 - DNA, 13 bp, C. elegans
gtgtgaaaataaa

SEQ ID NO: 720862 - DNA, 13 bp, C. elegans
gtgtgaaattcaa

SEQ ID NO: 720863 - DNA, 13 bp, C. elegans
gtgtgaattttca

SEQ ID NO: 720864 - DNA, 13 bp, C. elegans
gtgtgagagagag

SEQ ID NO: 720865 - DNA, 13 bp, C. elegans
gtgtgcaaaatgt

SEQ ID NO: 720866 - DNA, 13 bp, C. elegans
gtgtgcgccttca

SEQ ID NO: 720867 - DNA, 13 bp, C. elegans
gtgtgcggataac

SEQ ID NO: 720868 - DNA, 13 bp, C. elegans
gtgtgcggcaaat

SEQ ID NO: 720869 - DNA, 13 bp, C. elegans
gtgtgtagaagtg

SEQ ID NO: 720870 - DNA, 14 bp, C. elegans
gtgtgtatatgtac

SEQ ID NO: 720871 - DNA, 13 bp, C. elegans
gtgtgtgtgctca

SEQ ID NO: 720872 - DNA, 13 bp, C. elegans
gtgtgtgtgtgcc

SEQ ID NO: 720873 - DNA, 13 bp, C. elegans
gtgttaattaaaa

SEQ ID NO: 720874 - DNA, 13 bp, C. elegans
gtgttagaaaaaa

SEQ ID NO: 720875 - DNA, 13 bp, C. elegans
gtgttatcaaaaa

SEQ ID NO: 720876 - DNA, 13 bp, C. elegans
gtgttattttgaa

SEQ ID NO: 720877 - DNA, 13 bp, C. elegans
gtgttcaaccaat

SEQ ID NO: 720878 - DNA, 13 bp, C. elegans
gtgttcccataat

SEQ ID NO: 720879 - DNA, 13 bp, C. elegans
gtgttcgaaaatt

SEQ ID NO: 720880 - DNA, 13 bp, C. elegans
gtgttcggtataa

SEQ ID NO: 720881 - DNA, 13 bp, C. elegans
gtgttctagaaaa

SEQ ID NO: 720882 - DNA, 15 bp, C. elegans
gtgttctcagcattc

SEQ ID NO: 720883 - DNA, 13 bp, C. elegans
gtgttcttttgaa

SEQ ID NO: 720884 - DNA, 13 bp, C. elegans
gtgttgaatattt

SEQ ID NO: 720885 - DNA, 13 bp, C. elegans
gtgtttcaaattt

SEQ ID NO: 720886 - DNA, 13 bp, C. elegans
gtgtttcattttc

SEQ ID NO: 720887 - DNA, 14 bp, C. elegans
gtgtttgcacagaa

SEQ ID NO: 720888 - DNA, 13 bp, C. elegans
gtgtttgcgtact

SEQ ID NO: 720889 - DNA, 13 bp, C. elegans
gtgttttaaaaat

SEQ ID NO: 720890 - DNA, 13 bp, C. elegans
gtgttttaactat

SEQ ID NO: 720891 - DNA, 13 bp, C. elegans
gtgttttggaaaa

SEQ ID NO: 720892 - DNA, 13 bp, C. elegans
gtgtttttagaca

SEQ ID NO: 720893 - DNA, 13 bp, C. elegans
gtgtttttgagaa

SEQ ID NO: 720894 - DNA, 13 bp, C. elegans
gtgttttttgaaa

SEQ ID NO: 720895 - DNA, 13 bp, C. elegans
gttaaaaaatact

SEQ ID NO: 720896 - DNA, 13 bp, C. elegans
gttaaaaactcaa

SEQ ID NO: 720897 - DNA, 13 bp, C. elegans
gttaaaaattcaa

SEQ ID NO: 720898 - DNA, 13 bp, C. elegans
gttaaaaattcga

SEQ ID NO: 720899 - DNA, 13 bp, C. elegans
gttaaaaattgtt

SEQ ID NO: 720900 - DNA, 13 bp, C. elegans
gttaaaactcaaa

SEQ ID NO: 720901 - DNA, 13 bp, C. elegans
gttaaaagttgaa

SEQ ID NO: 720902 - DNA, 13 bp, C. elegans
gttaaaatcaatt

SEQ ID NO: 720903 - DNA, 13 bp, C. elegans
gttaaaatctcaa

SEQ ID NO: 720904 - DNA, 13 bp, C. elegans
gttaaaatgtttc

SEQ ID NO: 720905 - DNA, 13 bp, C. elegans
gttaaaattcaaa

SEQ ID NO: 720906 - DNA, 13 bp, C. elegans
gttaaaattccaa

SEQ ID NO: 720907 - DNA, 13 bp, C. elegans
gttaaacaatttt

SEQ ID NO: 720908 - DNA, 13 bp, C. elegans
gttaaacactttt

SEQ ID NO: 720909 - DNA, 13 bp, C. elegans
gttaaactttttc

SEQ ID NO: 720910 - DNA, 13 bp, C. elegans
gttaaatacaaac

SEQ ID NO: 720911 - DNA, 13 bp, C. elegans
gttaaatttctga

SEQ ID NO: 720912 - DNA, 13 bp, C. elegans
gttaaattttaca

SEQ ID NO: 720913 - DNA, 13 bp, C. elegans
gttaacaaacttt

SEQ ID NO: 720914 - DNA, 13 bp, C. elegans
gttaacaactttt

SEQ ID NO: 720915 - DNA, 13 bp, C. elegans
gttaactaacaaa

SEQ ID NO: 720916 - DNA, 13 bp, C. elegans
gttaactgaagaa

SEQ ID NO: 720917 - DNA, 13 bp, C. elegans
gttaacttcaaaa

SEQ ID NO: 720918 - DNA, 13 bp, C. elegans
gttaagctttttt

SEQ ID NO: 720919 - DNA, 13 bp, C. elegans
gttaatattctga

SEQ ID NO: 720920 - DNA, 13 bp, C. elegans
gttaatggaaaaa

SEQ ID NO: 720921 - DNA, 13 bp, C. elegans
gttaattatttca

SEQ ID NO: 720922 - DNA, 13 bp, C. elegans
gttaatttatttc

SEQ ID NO: 720923 - DNA, 13 bp, C. elegans
gttaatttcaagt

SEQ ID NO: 720924 - DNA, 13 bp, C. elegans
gttaatttttcaa

SEQ ID NO: 720925 - DNA, 13 bp, C. elegans
gttacaatgaaaa

SEQ ID NO: 720926 - DNA, 13 bp, C. elegans
gttacagaaaaaa

SEQ ID NO: 720927 - DNA, 13 bp, C. elegans
gttacagtaatcc

SEQ ID NO: 720928 - DNA, 13 bp, C. elegans
gttacagtactct

SEQ ID NO: 720929 - DNA, 13 bp, C. elegans
gttacatttttgt

SEQ ID NO: 720930 - DNA, 13 bp, C. elegans
gttacgcaaattt

SEQ ID NO: 720931 - DNA, 13 bp, C. elegans
gttactgtagaat

SEQ ID NO: 720932 - DNA, 13 bp, C. elegans
gttactgtagatg

SEQ ID NO: 720933 - DNA, 13 bp, C. elegans
gttactgtagctg

SEQ ID NO: 720934 - DNA, 13 bp, C. elegans
gttactgtaggtt

SEQ ID NO: 720935 - DNA, 13 bp, C. elegans
gttagatttcaaa

SEQ ID NO: 720936 - DNA, 14 bp, C. elegans
gttaggctccgccc

SEQ ID NO: 720937 - DNA, 16 bp, C. elegans
gttagtcctcctttaa

SEQ ID NO: 720938 - DNA, 13 bp, C. elegans
gttagttttgaat

SEQ ID NO: 720939 - DNA, 13 bp, C. elegans
gttagtttttaaa

SEQ ID NO: 720940 - DNA, 13 bp, C. elegans
gttataattccct

SEQ ID NO: 720941 - DNA, 13 bp, C. elegans
gttatatctcaaa

SEQ ID NO: 720942 - DNA, 13 bp, C. elegans
gttatcaaaaata

SEQ ID NO: 720943 - DNA, 13 bp, C. elegans
gttatcacacctt

SEQ ID NO: 720944 - DNA, 13 bp, C. elegans
gttatcatatttt

SEQ ID NO: 720945 - DNA, 13 bp, C. elegans
gttatcatttttc

SEQ ID NO: 720946 - DNA, 13 bp, C. elegans
gttatcgattttc

SEQ ID NO: 720947 - DNA, 13 bp, C. elegans
gttatcttcaaaa

SEQ ID NO: 720948 - DNA, 13 bp, C. elegans
gttattaatgaaa

SEQ ID NO: 720949 - DNA, 13 bp, C. elegans
gttattatttcag

SEQ ID NO: 720950 - DNA, 13 bp, C. elegans
gttattatttgaa

SEQ ID NO: 720951 - DNA, 13 bp, C. elegans
gttattcaaaaat

SEQ ID NO: 720952 - DNA, 13 bp, C. elegans
gttattcaaaagt

SEQ ID NO: 720953 - DNA, 13 bp, C. elegans
gttattcaaataa

SEQ ID NO: 720954 - DNA, 13 bp, C. elegans
gttattcaagtaa

SEQ ID NO: 720955 - DNA, 13 bp, C. elegans
gttattcaatttt

SEQ ID NO: 720956 - DNA, 13 bp, C. elegans
gttattcacaaaa

SEQ ID NO: 720957 - DNA, 13 bp, C. elegans
gttattccaaaaa

SEQ ID NO: 720958 - DNA, 13 bp, C. elegans
gttattcgaaaat

SEQ ID NO: 720959 - DNA, 13 bp, C. elegans
gttattctaaaaa

SEQ ID NO: 720960 - DNA, 13 bp, C. elegans
gttattgaaattg

SEQ ID NO: 720961 - DNA, 13 bp, C. elegans
gttattgtacctt

SEQ ID NO: 720962 - DNA, 13 bp, C. elegans
gttatttgaaagc

SEQ ID NO: 720963 - DNA, 13 bp, C. elegans
gttattttaaaga

SEQ ID NO: 720964 - DNA, 13 bp, C. elegans
gttattttctgat

SEQ ID NO: 720965 - DNA, 13 bp, C. elegans
gttatttttctga

SEQ ID NO: 720966 - DNA, 13 bp, C. elegans
gttcaaaaaagtt

SEQ ID NO: 720967 - DNA, 13 bp, C. elegans
gttcaaaaaatga

SEQ ID NO: 720968 - DNA, 13 bp, C. elegans
gttcaaaaacaag

SEQ ID NO: 720969 - DNA, 13 bp, C. elegans
gttcaaaaactga

SEQ ID NO: 720970 - DNA, 13 bp, C. elegans
gttcaaaaacttc

SEQ ID NO: 720971 - DNA, 13 bp, C. elegans
gttcaaaaagtca

SEQ ID NO: 720972 - DNA, 13 bp, C. elegans
gttcaaaaagttc

SEQ ID NO: 720973 - DNA, 13 bp, C. elegans
gttcaaaaatcga

SEQ ID NO: 720974 - DNA, 13 bp, C. elegans
gttcaaaaatgga

SEQ ID NO: 720975 - DNA, 13 bp, C. elegans
gttcaaaatacaa

SEQ ID NO: 720976 - DNA, 13 bp, C. elegans
gttcaaaatgctc

SEQ ID NO: 720977 - DNA, 13 bp, C. elegans
gttcaaaatgtaa

SEQ ID NO: 720978 - DNA, 13 bp, C. elegans
gttcaaaatgttt

SEQ ID NO: 720979 - DNA, 13 bp, C. elegans
gttcaaaattcgc

SEQ ID NO: 720980 - DNA, 13 bp, C. elegans
gttcaaaatttgt

SEQ ID NO: 720981 - DNA, 13 bp, C. elegans
gttcaaaattttt

SEQ ID NO: 720982 - DNA, 13 bp, C. elegans
gttcaaacttcaa

SEQ ID NO: 720983 - DNA, 13 bp, C. elegans
gttcaaagaatgc

SEQ ID NO: 720984 - DNA, 13 bp, C. elegans
gttcaaagttttg

SEQ ID NO: 720985 - DNA, 13 bp, C. elegans
gttcaaatgtttt

SEQ ID NO: 720986 - DNA, 13 bp, C. elegans
gttcaaattcaga

SEQ ID NO: 720987 - DNA, 13 bp, C. elegans
gttcaaattctaa

SEQ ID NO: 720988 - DNA, 13 bp, C. elegans
gttcaaatttaaa

SEQ ID NO: 720989 - DNA, 13 bp, C. elegans
gttcaaatttcca

SEQ ID NO: 720990 - DNA, 13 bp, C. elegans
gttcaaatttgca

SEQ ID NO: 720991 - DNA, 13 bp, C. elegans
gttcaaattttga

SEQ ID NO: 720992 - DNA, 13 bp, C. elegans
gttcaacagattt

SEQ ID NO: 720993 - DNA, 13 bp, C. elegans
gttcaactaacaa

SEQ ID NO: 720994 - DNA, 13 bp, C. elegans
gttcaacttttgt

SEQ ID NO: 720995 - DNA, 13 bp, C. elegans
gttcaagaaatca

SEQ ID NO: 720996 - DNA, 13 bp, C. elegans
gttcaaggttttt

SEQ ID NO: 720997 - DNA, 13 bp, C. elegans
gttcaataaataa

SEQ ID NO: 720998 - DNA, 13 bp, C. elegans
gttcaatatttaa

SEQ ID NO: 720999 - DNA, 13 bp, C. elegans
gttcaatgatttt

SEQ ID NO: 721000 - DNA, 13 bp, C. elegans
gttcaattaaaaa

SEQ ID NO: 721001 - DNA, 13 bp, C. elegans
gttcaattaattt

SEQ ID NO: 721002 - DNA, 13 bp, C. elegans
gttcaattgtttt

SEQ ID NO: 721003 - DNA, 13 bp, C. elegans
gttcaattttatc

SEQ ID NO: 721004 - DNA, 13 bp, C. elegans
gttcaattttcat

SEQ ID NO: 721005 - DNA, 13 bp, C. elegans
gttcaatttttca

SEQ ID NO: 721006 - DNA, 13 bp, C. elegans
gttcaatttttgt

SEQ ID NO: 721007 - DNA, 13 bp, C. elegans
gttcacaaaatct

SEQ ID NO: 721008 - DNA, 13 bp, C. elegans
gttcacaataaaa

SEQ ID NO: 721009 - DNA, 13 bp, C. elegans
gttcaccaaaatt

SEQ ID NO: 721010 - DNA, 14 bp, C. elegans
gttcaccaatcggc

SEQ ID NO: 721011 - DNA, 13 bp, C. elegans
gttcactgttatt

SEQ ID NO: 721012 - DNA, 13 bp, C. elegans
gttcactttttga

SEQ ID NO: 721013 - DNA, 13 bp, C. elegans
gttcacttttttc

SEQ ID NO: 721014 - DNA, 13 bp, C. elegans
gttcacttttttg

SEQ ID NO: 721015 - DNA, 13 bp, C. elegans
gttcagaaagaaa

SEQ ID NO: 721016 - DNA, 13 bp, C. elegans
gttcagaaattgg

SEQ ID NO: 721017 - DNA, 13 bp, C. elegans
gttcagagccttc

SEQ ID NO: 721018 - DNA, 13 bp, C. elegans
gttcagatcaaat

SEQ ID NO: 721019 - DNA, 13 bp, C. elegans
gttcagcatagtc

SEQ ID NO: 721020 - DNA, 13 bp, C. elegans
gttcagtattttt

SEQ ID NO: 721021 - DNA, 13 bp, C. elegans
gttcagtggagcg

SEQ ID NO: 721022 - DNA, 13 bp, C. elegans
gttcagtgtccga

SEQ ID NO: 721023 - DNA, 13 bp, C. elegans
gttcagtttgaaa

SEQ ID NO: 721024 - DNA, 13 bp, C. elegans
gttcagttttgtt

SEQ ID NO: 721025 - DNA, 13 bp, C. elegans
gttcatatgaata

SEQ ID NO: 721026 - DNA, 13 bp, C. elegans
gttcatattttat

SEQ ID NO: 721027 - DNA, 13 bp, C. elegans
gttcatcacgtca

SEQ ID NO: 721028 - DNA, 13 bp, C. elegans
gttcatcttttct

SEQ ID NO: 721029 - DNA, 13 bp, C. elegans
gttcatgatactc

SEQ ID NO: 721030 - DNA, 13 bp, C. elegans
gttcatggtacaa

SEQ ID NO: 721031 - DNA, 13 bp, C. elegans
gttcatttcaaaa

SEQ ID NO: 721032 - DNA, 13 bp, C. elegans
gttcatttgagca

SEQ ID NO: 721033 - DNA, 13 bp, C. elegans
gttcattttgaaa

SEQ ID NO: 721034 - DNA, 13 bp, C. elegans
gttcattttttca

SEQ ID NO: 721035 - DNA, 13 bp, C. elegans
gttccaaaaaaaa

SEQ ID NO: 721036 - DNA, 13 bp, C. elegans
gttccaactgaaa

SEQ ID NO: 721037 - DNA, 13 bp, C. elegans
gttccaagttttg

SEQ ID NO: 721038 - DNA, 13 bp, C. elegans
gttccagaacatt

SEQ ID NO: 721039 - DNA, 13 bp, C. elegans
gttcccatactta

SEQ ID NO: 721040 - DNA, 13 bp, C. elegans
gttccgacgacaa

SEQ ID NO: 721041 - DNA, 15 bp, C. elegans
gttccgcgcgccgct

SEQ ID NO: 721042 - DNA, 13 bp, C. elegans
gttcctttgaaat

SEQ ID NO: 721043 - DNA, 13 bp, C. elegans
gttcgaaaaacga

SEQ ID NO: 721044 - DNA, 13 bp, C. elegans
gttcgaaaaccgt

SEQ ID NO: 721045 - DNA, 13 bp, C. elegans
gttcgaaatcgtt

SEQ ID NO: 721046 - DNA, 13 bp, C. elegans
gttcgaaattaca

SEQ ID NO: 721047 - DNA, 13 bp, C. elegans
gttcgaagacgct

SEQ ID NO: 721048 - DNA, 13 bp, C. elegans
gttcgaattttta

SEQ ID NO: 721049 - DNA, 13 bp, C. elegans
gttcgaatttttt

SEQ ID NO: 721050 - DNA, 13 bp, C. elegans
gttcgacccccac

SEQ ID NO: 721051 - DNA, 13 bp, C. elegans
gttcgagtttttc

SEQ ID NO: 721052 - DNA, 13 bp, C. elegans
gttcgctgcaaat

SEQ ID NO: 721053 - DNA, 13 bp, C. elegans
gttcggcaacttc

SEQ ID NO: 721054 - DNA, 13 bp, C. elegans
gttcggccaccaa

SEQ ID NO: 721055 - DNA, 13 bp, C. elegans
gttcgtttaaaaa

SEQ ID NO: 721056 - DNA, 13 bp, C. elegans
gttctaaatttga

SEQ ID NO: 721057 - DNA, 13 bp, C. elegans
gttctaaattttg

SEQ ID NO: 721058 - DNA, 13 bp, C. elegans
gttctaattttta

SEQ ID NO: 721059 - DNA, 13 bp, C. elegans
gttctagaacttt

SEQ ID NO: 721060 - DNA, 13 bp, C. elegans
gttctcaaaaatc

SEQ ID NO: 721061 - DNA, 14 bp, C. elegans
gttctcaactgatt

SEQ ID NO: 721062 - DNA, 13 bp, C. elegans
gttctcaaggaat

SEQ ID NO: 721063 - DNA, 13 bp, C. elegans
gttctcctaattt

SEQ ID NO: 721064 - DNA, 13 bp, C. elegans
gttctcgataaag

SEQ ID NO: 721065 - DNA, 13 bp, C. elegans
gttctctcaaaaa

SEQ ID NO: 721066 - DNA, 13 bp, C. elegans
gttctgaaaaaca

SEQ ID NO: 721067 - DNA, 13 bp, C. elegans
gttctgaaaaagt

SEQ ID NO: 721068 - DNA, 13 bp, C. elegans
gttctgaaaattt

SEQ ID NO: 721069 - DNA, 13 bp, C. elegans
gttctgaaacatt

SEQ ID NO: 721070 - DNA, 13 bp, C. elegans
gttctgaaacttt

SEQ ID NO: 721071 - DNA, 13 bp, C. elegans
gttctgaaattct

SEQ ID NO: 721072 - DNA, 13 bp, C. elegans
gttctgataattt

SEQ ID NO: 721073 - DNA, 13 bp, C. elegans
gttctgattcttc

SEQ ID NO: 721074 - DNA, 13 bp, C. elegans
gttctgctaattt

SEQ ID NO: 721075 - DNA, 13 bp, C. elegans
gttctggaacttt

SEQ ID NO: 721076 - DNA, 13 bp, C. elegans
gttctggaatcaa

SEQ ID NO: 721077 - DNA, 13 bp, C. elegans
gttctggaatggt

SEQ ID NO: 721078 - DNA, 13 bp, C. elegans
gttctgtttcaaa

SEQ ID NO: 721079 - DNA, 13 bp, C. elegans
gttcttcaagcgc

SEQ ID NO: 721080 - DNA, 13 bp, C. elegans
gttcttcacaaaa

SEQ ID NO: 721081 - DNA, 13 bp, C. elegans
gttcttccaaaaa

SEQ ID NO: 721082 - DNA, 13 bp, C. elegans
gttcttcccacaa

SEQ ID NO: 721083 - DNA, 13 bp, C. elegans
gttcttctcaaaa

SEQ ID NO: 721084 - DNA, 13 bp, C. elegans
gttcttctcattt

SEQ ID NO: 721085 - DNA, 13 bp, C. elegans
gttcttcttgaaa

SEQ ID NO: 721086 - DNA, 13 bp, C. elegans
gttctttcaaaaa

SEQ ID NO: 721087 - DNA, 13 bp, C. elegans
gttctttttcaaa

SEQ ID NO: 721088 - DNA, 14 bp, C. elegans
gttcttttttgaaa

SEQ ID NO: 721089 - DNA, 13 bp, C. elegans
gttgaaaaacttt

SEQ ID NO: 721090 - DNA, 13 bp, C. elegans
gttgaaaaagtat

SEQ ID NO: 721091 - DNA, 13 bp, C. elegans
gttgaaaaagttg

SEQ ID NO: 721092 - DNA, 13 bp, C. elegans
gttgaaaaatcac

SEQ ID NO: 721093 - DNA, 13 bp, C. elegans
gttgaaaaatgaa

SEQ ID NO: 721094 - DNA, 13 bp, C. elegans
gttgaaaaatgat

SEQ ID NO: 721095 - DNA, 13 bp, C. elegans
gttgaaaaattga

SEQ ID NO: 721096 - DNA, 13 bp, C. elegans
gttgaaaactgat

SEQ ID NO: 721097 - DNA, 13 bp, C. elegans
gttgaaaacttct

SEQ ID NO: 721098 - DNA, 13 bp, C. elegans
gttgaaaaggaaa

SEQ ID NO: 721099 - DNA, 13 bp, C. elegans
gttgaaaatattt

SEQ ID NO: 721100 - DNA, 13 bp, C. elegans
gttgaaaatcaaa

SEQ ID NO: 721101 - DNA, 13 bp, C. elegans
gttgaaaatcgat

SEQ ID NO: 721102 - DNA, 13 bp, C. elegans
gttgaaaatgaaa

SEQ ID NO: 721103 - DNA, 13 bp, C. elegans
gttgaaaatggaa

SEQ ID NO: 721104 - DNA, 13 bp, C. elegans
gttgaaaatgtat

SEQ ID NO: 721105 - DNA, 13 bp, C. elegans
gttgaaaatgttt

SEQ ID NO: 721106 - DNA, 13 bp, C. elegans
gttgaaaattgaa

SEQ ID NO: 721107 - DNA, 13 bp, C. elegans
gttgaaaattttc

SEQ ID NO: 721108 - DNA, 13 bp, C. elegans
gttgaaacaaaaa

SEQ ID NO: 721109 - DNA, 13 bp, C. elegans
gttgaaacagaaa

SEQ ID NO: 721110 - DNA, 13 bp, C. elegans
gttgaaacagtga

SEQ ID NO: 721111 - DNA, 13 bp, C. elegans
gttgaaactgaaa

SEQ ID NO: 721112 - DNA, 13 bp, C. elegans
gttgaaatcctga

SEQ ID NO: 721113 - DNA, 13 bp, C. elegans
gttgaaattaaaa

SEQ ID NO: 721114 - DNA, 13 bp, C. elegans
gttgaaattgaat

SEQ ID NO: 721115 - DNA, 13 bp, C. elegans
gttgaaattggaa

SEQ ID NO: 721116 - DNA, 13 bp, C. elegans
gttgaaattgtga

SEQ ID NO: 721117 - DNA, 13 bp, C. elegans
gttgaaatttcca

SEQ ID NO: 721118 - DNA, 13 bp, C. elegans
gttgaaattttga

SEQ ID NO: 721119 - DNA, 13 bp, C. elegans
gttgaacatttgt

SEQ ID NO: 721120 - DNA, 13 bp, C. elegans
gttgaacttgact

SEQ ID NO: 721121 - DNA, 13 bp, C. elegans
gttgaacttgtcc

SEQ ID NO: 721122 - DNA, 13 bp, C. elegans
gttgaagaatttg

SEQ ID NO: 721123 - DNA, 13 bp, C. elegans
gttgaataaagtt

SEQ ID NO: 721124 - DNA, 13 bp, C. elegans
gttgaatttaatt

SEQ ID NO: 721125 - DNA, 13 bp, C. elegans
gttgaatttgaat

SEQ ID NO: 721126 - DNA, 13 bp, C. elegans
gttgaatttggaa

SEQ ID NO: 721127 - DNA, 13 bp, C. elegans
gttgactgttttt

SEQ ID NO: 721128 - DNA, 13 bp, C. elegans
gttgagaagtctg

SEQ ID NO: 721129 - DNA, 13 bp, C. elegans
gttgagtttttga

SEQ ID NO: 721130 - DNA, 13 bp, C. elegans
gttgatcactttt

SEQ ID NO: 721131 - DNA, 14 bp, C. elegans
gttgatctacaaaa

SEQ ID NO: 721132 - DNA, 13 bp, C. elegans
gttgatgactttt

SEQ ID NO: 721133 - DNA, 13 bp, C. elegans
gttgattttgaaa

SEQ ID NO: 721134 - DNA, 13 bp, C. elegans
gttgattttttca

SEQ ID NO: 721135 - DNA, 13 bp, C. elegans
gttgcaaaattct

SEQ ID NO: 721136 - DNA, 13 bp, C. elegans
gttgcaaataatt

SEQ ID NO: 721137 - DNA, 13 bp, C. elegans
gttgcaacaaaaa

SEQ ID NO: 721138 - DNA, 13 bp, C. elegans
gttgcaattttta

SEQ ID NO: 721139 - DNA, 21 bp, C. elegans
gttgcagaaatgggcgtattg

SEQ ID NO: 721140 - DNA, 13 bp, C. elegans
gttgcatttttaa

SEQ ID NO: 721141 - DNA, 13 bp, C. elegans
gttgcatttttct

SEQ ID NO: 721142 - DNA, 13 bp, C. elegans
gttgccgagttgg

SEQ ID NO: 721143 - DNA, 13 bp, C. elegans
gttgccggaattg

SEQ ID NO: 721144 - DNA, 13 bp, C. elegans
gttgctaaaaaat

SEQ ID NO: 721145 - DNA, 13 bp, C. elegans
gttgctcgaaaac

SEQ ID NO: 721146 - DNA, 13 bp, C. elegans
gttgctgcgagat

SEQ ID NO: 721147 - DNA, 13 bp, C. elegans
gttggaaaaagaa

SEQ ID NO: 721148 - DNA, 13 bp, C. elegans
gttggaaaacgtt

SEQ ID NO: 721149 - DNA, 13 bp, C. elegans
gttggaaactttt

SEQ ID NO: 721150 - DNA, 13 bp, C. elegans
gttggaaagtggg

SEQ ID NO: 721151 - DNA, 13 bp, C. elegans
gttggaaattgtt

SEQ ID NO: 721152 - DNA, 13 bp, C. elegans
gttggcaaaaaat

SEQ ID NO: 721153 - DNA, 14 bp, C. elegans
gttgggagttgctg

SEQ ID NO: 721154 - DNA, 13 bp, C. elegans
gttgggtcatttc

SEQ ID NO: 721155 - DNA, 13 bp, C. elegans
gttgggtgaaaaa

SEQ ID NO: 721156 - DNA, 13 bp, C. elegans
gttggtcaaaaag

SEQ ID NO: 721157 - DNA, 13 bp, C. elegans
gttggtcaaattt

SEQ ID NO: 721158 - DNA, 13 bp, C. elegans
gttggtcgaaaag

SEQ ID NO: 721159 - DNA, 13 bp, C. elegans
gttggttcaattc

SEQ ID NO: 721160 - DNA, 13 bp, C. elegans
gttggttgaaaaa

SEQ ID NO: 721161 - DNA, 13 bp, C. elegans
gttgtaatttaaa

SEQ ID NO: 721162 - DNA, 14 bp, C. elegans
gttgtagtttgtag

SEQ ID NO: 721163 - DNA, 13 bp, C. elegans
gttgtatatttac

SEQ ID NO: 721164 - DNA, 13 bp, C. elegans
gttgtatttttca

SEQ ID NO: 721165 - DNA, 13 bp, C. elegans
gttgtcgaagtta

SEQ ID NO: 721166 - DNA, 13 bp, C. elegans
gttgtcgatttac

SEQ ID NO: 721167 - DNA, 13 bp, C. elegans
gttgtcgtcgtcg

SEQ ID NO: 721168 - DNA, 13 bp, C. elegans
gttgtctgaaaat

SEQ ID NO: 721169 - DNA, 13 bp, C. elegans
gttgtgaagtttt

SEQ ID NO: 721170 - DNA, 13 bp, C. elegans
gttgtgacgtcat

SEQ ID NO: 721171 - DNA, 13 bp, C. elegans
gttgtgagtggaa

SEQ ID NO: 721172 - DNA, 13 bp, C. elegans
gttgtgttggcaa

SEQ ID NO: 721173 - DNA, 13 bp, C. elegans
gttgttaaaattt

SEQ ID NO: 721174 - DNA, 13 bp, C. elegans
gttgttcagaaat

SEQ ID NO: 721175 - DNA, 13 bp, C. elegans
gttgttctcaaaa

SEQ ID NO: 721176 - DNA, 13 bp, C. elegans
gttgttggaaaaa

SEQ ID NO: 721177 - DNA, 13 bp, C. elegans
gttgtttgaaaaa

SEQ ID NO: 721178 - DNA, 13 bp, C. elegans
gttgtttttcgaa

SEQ ID NO: 721179 - DNA, 13 bp, C. elegans
gtttaaaaaattg

SEQ ID NO: 721180 - DNA, 13 bp, C. elegans
gtttaaaacactt

SEQ ID NO: 721181 - DNA, 13 bp, C. elegans
gtttaaaataaag

SEQ ID NO: 721182 - DNA, 13 bp, C. elegans
gtttaaaatgtat

SEQ ID NO: 721183 - DNA, 13 bp, C. elegans
gtttaaaattcaa

SEQ ID NO: 721184 - DNA, 13 bp, C. elegans
gtttaaaatttca

SEQ ID NO: 721185 - DNA, 13 bp, C. elegans
gtttaaaatttga

SEQ ID NO: 721186 - DNA, 13 bp, C. elegans
gtttaaacaaatt

SEQ ID NO: 721187 - DNA, 13 bp, C. elegans
gtttaaagatttt

SEQ ID NO: 721188 - DNA, 13 bp, C. elegans
gtttaaagtaaaa

SEQ ID NO: 721189 - DNA, 13 bp, C. elegans
gtttaaatgtatt

SEQ ID NO: 721190 - DNA, 13 bp, C. elegans
gtttaaccttttt

SEQ ID NO: 721191 - DNA, 13 bp, C. elegans
gtttaacttttta

SEQ ID NO: 721192 - DNA, 13 bp, C. elegans
gtttaatacattt

SEQ ID NO: 721193 - DNA, 13 bp, C. elegans
gtttaatcgaaaa

SEQ ID NO: 721194 - DNA, 13 bp, C. elegans
gtttaatgcaaaa

SEQ ID NO: 721195 - DNA, 13 bp, C. elegans
gtttaattttcag

SEQ ID NO: 721196 - DNA, 13 bp, C. elegans
gtttacaaaattt

SEQ ID NO: 721197 - DNA, 13 bp, C. elegans
gtttacaactttt

SEQ ID NO: 721198 - DNA, 13 bp, C. elegans
gtttacaatttta

SEQ ID NO: 721199 - DNA, 13 bp, C. elegans
gtttacacttttt

SEQ ID NO: 721200 - DNA, 13 bp, C. elegans
gtttacagaaaaa

SEQ ID NO: 721201 - DNA, 13 bp, C. elegans
gtttaccgatttg

SEQ ID NO: 721202 - DNA, 13 bp, C. elegans
gtttagaaaataa

SEQ ID NO: 721203 - DNA, 13 bp, C. elegans
gtttagaaaattc

SEQ ID NO: 721204 - DNA, 13 bp, C. elegans
gtttagaataaaa

SEQ ID NO: 721205 - DNA, 13 bp, C. elegans
gtttagcattttc

SEQ ID NO: 721206 - DNA, 13 bp, C. elegans
gtttaggaaaaat

SEQ ID NO: 721207 - DNA, 13 bp, C. elegans
gtttaggcttagg

SEQ ID NO: 721208 - DNA, 13 bp, C. elegans
gtttatatttgaa

SEQ ID NO: 721209 - DNA, 13 bp, C. elegans
gtttatcaaaaaa

SEQ ID NO: 721210 - DNA, 13 bp, C. elegans
gtttatcaatttt

SEQ ID NO: 721211 - DNA, 13 bp, C. elegans
gtttatccaattt

SEQ ID NO: 721212 - DNA, 13 bp, C. elegans
gtttatcgatttt

SEQ ID NO: 721213 - DNA, 13 bp, C. elegans
gtttatctagttt

SEQ ID NO: 721214 - DNA, 13 bp, C. elegans
gtttatgaaatat

SEQ ID NO: 721215 - DNA, 13 bp, C. elegans
gtttatggaaaag

SEQ ID NO: 721216 - DNA, 13 bp, C. elegans
gtttattacaaga

SEQ ID NO: 721217 - DNA, 13 bp, C. elegans
gtttattagacaa

SEQ ID NO: 721218 - DNA, 13 bp, C. elegans
gtttattcagttt

SEQ ID NO: 721219 - DNA, 13 bp, C. elegans
gtttattgaaact

SEQ ID NO: 721220 - DNA, 13 bp, C. elegans
gtttatttaactt

SEQ ID NO: 721221 - DNA, 13 bp, C. elegans
gtttattttactc

SEQ ID NO: 721222 - DNA, 13 bp, C. elegans
gtttattttggaa

SEQ ID NO: 721223 - DNA, 13 bp, C. elegans
gtttcaaaaaatt

SEQ ID NO: 721224 - DNA, 13 bp, C. elegans
gtttcaaaaatct

SEQ ID NO: 721225 - DNA, 13 bp, C. elegans
gtttcaaaaatta

SEQ ID NO: 721226 - DNA, 13 bp, C. elegans
gtttcaaaaattc

SEQ ID NO: 721227 - DNA, 13 bp, C. elegans
gtttcaaaaattg

SEQ ID NO: 721228 - DNA, 13 bp, C. elegans
gtttcaaaacatt

SEQ ID NO: 721229 - DNA, 13 bp, C. elegans
gtttcaaaagaaa

SEQ ID NO: 721230 - DNA, 13 bp, C. elegans
gtttcaaaagaat

SEQ ID NO: 721231 - DNA, 13 bp, C. elegans
gtttcaaaagtta

SEQ ID NO: 721232 - DNA, 13 bp, C. elegans
gtttcaaaagttc

SEQ ID NO: 721233 - DNA, 13 bp, C. elegans
gtttcaaaagttt

SEQ ID NO: 721234 - DNA, 13 bp, C. elegans
gtttcaaaataaa

SEQ ID NO: 721235 - DNA, 13 bp, C. elegans
gtttcaaaatgaa

SEQ ID NO: 721236 - DNA, 13 bp, C. elegans
gtttcaaaattca

SEQ ID NO: 721237 - DNA, 13 bp, C. elegans
gtttcaaaattga

SEQ ID NO: 721238 - DNA, 13 bp, C. elegans
gtttcaaaatttg

SEQ ID NO: 721239 - DNA, 13 bp, C. elegans
gtttcaaactaca

SEQ ID NO: 721240 - DNA, 13 bp, C. elegans
gtttcaaactttc

SEQ ID NO: 721241 - DNA, 13 bp, C. elegans
gtttcaaagtgaa

SEQ ID NO: 721242 - DNA, 13 bp, C. elegans
gtttcaaagtgtt

SEQ ID NO: 721243 - DNA, 13 bp, C. elegans
gtttcaaataata

SEQ ID NO: 721244 - DNA, 13 bp, C. elegans
gtttcaaatagtt

SEQ ID NO: 721245 - DNA, 13 bp, C. elegans
gtttcaaatcttt

SEQ ID NO: 721246 - DNA, 13 bp, C. elegans
gtttcaaattaaa

SEQ ID NO: 721247 - DNA, 13 bp, C. elegans
gtttcaaattata

SEQ ID NO: 721248 - DNA, 13 bp, C. elegans
gtttcaaattgaa

SEQ ID NO: 721249 - DNA, 13 bp, C. elegans
gtttcaaattgtg

SEQ ID NO: 721250 - DNA, 13 bp, C. elegans
gtttcaaattgtt

SEQ ID NO: 721251 - DNA, 13 bp, C. elegans
gtttcaaccaaaa

SEQ ID NO: 721252 - DNA, 13 bp, C. elegans
gtttcaagaaaat

SEQ ID NO: 721253 - DNA, 13 bp, C. elegans
gtttcaagctttt

SEQ ID NO: 721254 - DNA, 13 bp, C. elegans
gtttcaataaaaa

SEQ ID NO: 721255 - DNA, 13 bp, C. elegans
gtttcaataaagt

SEQ ID NO: 721256 - DNA, 13 bp, C. elegans
gtttcaataatat

SEQ ID NO: 721257 - DNA, 13 bp, C. elegans
gtttcaatacaaa

SEQ ID NO: 721258 - DNA, 13 bp, C. elegans
gtttcaatatgtt

SEQ ID NO: 721259 - DNA, 13 bp, C. elegans
gtttcaatattta

SEQ ID NO: 721260 - DNA, 13 bp, C. elegans
gtttcaatatttt

SEQ ID NO: 721261 - DNA, 13 bp, C. elegans
gtttcaatcaatt

SEQ ID NO: 721262 - DNA, 13 bp, C. elegans
gtttcaatcgatt

SEQ ID NO: 721263 - DNA, 13 bp, C. elegans
gtttcaattattc

SEQ ID NO: 721264 - DNA, 13 bp, C. elegans
gtttcaattcaat

SEQ ID NO: 721265 - DNA, 13 bp, C. elegans
gtttcaattgtgc

SEQ ID NO: 721266 - DNA, 13 bp, C. elegans
gtttcaatttaaa

SEQ ID NO: 721267 - DNA, 13 bp, C. elegans
gtttcaatttaat

SEQ ID NO: 721268 - DNA, 13 bp, C. elegans
gtttcaatttgaa

SEQ ID NO: 721269 - DNA, 13 bp, C. elegans
gtttcaatttgat

SEQ ID NO: 721270 - DNA, 13 bp, C. elegans
gtttcaattttat

SEQ ID NO: 721271 - DNA, 14 bp, C. elegans
gtttcaattttcaa

SEQ ID NO: 721272 - DNA, 13 bp, C. elegans
gtttcaatttttg

SEQ ID NO: 721273 - DNA, 13 bp, C. elegans
gtttcacaaaaat

SEQ ID NO: 721274 - DNA, 13 bp, C. elegans
gtttcacaagttt

SEQ ID NO: 721275 - DNA, 13 bp, C. elegans
gtttcacaatttt

SEQ ID NO: 721276 - DNA, 13 bp, C. elegans
gtttcacactttt

SEQ ID NO: 721277 - DNA, 13 bp, C. elegans
gtttcacattttt

SEQ ID NO: 721278 - DNA, 13 bp, C. elegans
gtttcactaattt

SEQ ID NO: 721279 - DNA, 13 bp, C. elegans
gtttcactatttc

SEQ ID NO: 721280 - DNA, 13 bp, C. elegans
gtttcactatttt

SEQ ID NO: 721281 - DNA, 13 bp, C. elegans
gtttcacttattt

SEQ ID NO: 721282 - DNA, 13 bp, C. elegans
gtttcagaaaatt

SEQ ID NO: 721283 - DNA, 13 bp, C. elegans
gtttcagaaagtt

SEQ ID NO: 721284 - DNA, 13 bp, C. elegans
gtttcagacagtt

SEQ ID NO: 721285 - DNA, 13 bp, C. elegans
gtttcagataaat

SEQ ID NO: 721286 - DNA, 13 bp, C. elegans
gtttcaggcaatt

SEQ ID NO: 721287 - DNA, 13 bp, C. elegans
gtttcagtcattt

SEQ ID NO: 721288 - DNA, 13 bp, C. elegans
gtttcagtgcatt

SEQ ID NO: 721289 - DNA, 13 bp, C. elegans
gtttcagtgtttt

SEQ ID NO: 721290 - DNA, 13 bp, C. elegans
gtttcagttcaaa

SEQ ID NO: 721291 - DNA, 13 bp, C. elegans
gtttcagttgttt

SEQ ID NO: 721292 - DNA, 13 bp, C. elegans
gtttcagtttcaa

SEQ ID NO: 721293 - DNA, 13 bp, C. elegans
gtttcagttttat

SEQ ID NO: 721294 - DNA, 13 bp, C. elegans
gtttcataagttt

SEQ ID NO: 721295 - DNA, 13 bp, C. elegans
gtttcataatgtt

SEQ ID NO: 721296 - DNA, 13 bp, C. elegans
gtttcatcaagtt

SEQ ID NO: 721297 - DNA, 13 bp, C. elegans
gtttcatgatcga

SEQ ID NO: 721298 - DNA, 13 bp, C. elegans
gtttcatggtttt

SEQ ID NO: 721299 - DNA, 13 bp, C. elegans
gtttcatgttttc

SEQ ID NO: 721300 - DNA, 13 bp, C. elegans
gtttcattatatt

SEQ ID NO: 721301 - DNA, 13 bp, C. elegans
gtttcattcaaaa

SEQ ID NO: 721302 - DNA, 13 bp, C. elegans
gtttcatttaaat

SEQ ID NO: 721303 - DNA, 13 bp, C. elegans
gtttcatttggaa

SEQ ID NO: 721304 - DNA, 13 bp, C. elegans
gtttcattttcac

SEQ ID NO: 721305 - DNA, 13 bp, C. elegans
gtttcattttcat

SEQ ID NO: 721306 - DNA, 13 bp, C. elegans
gtttcattttctc

SEQ ID NO: 721307 - DNA, 13 bp, C. elegans
gtttccaaaaaaa

SEQ ID NO: 721308 - DNA, 13 bp, C. elegans
gtttccaaaattc

SEQ ID NO: 721309 - DNA, 13 bp, C. elegans
gtttccaaacaaa

SEQ ID NO: 721310 - DNA, 13 bp, C. elegans
gtttccaacaaaa

SEQ ID NO: 721311 - DNA, 13 bp, C. elegans
gtttccaattgtt

SEQ ID NO: 721312 - DNA, 13 bp, C. elegans
gtttccagaaaat

SEQ ID NO: 721313 - DNA, 13 bp, C. elegans
gtttccagaagtt

SEQ ID NO: 721314 - DNA, 13 bp, C. elegans
gtttccatttctt

SEQ ID NO: 721315 - DNA, 13 bp, C. elegans
gtttccattttct

SEQ ID NO: 721316 - DNA, 13 bp, C. elegans
gtttccatttttc

SEQ ID NO: 721317 - DNA, 13 bp, C. elegans
gtttcccaaaaaa

SEQ ID NO: 721318 - DNA, 13 bp, C. elegans
gtttcccaaaaat

SEQ ID NO: 721319 - DNA, 13 bp, C. elegans
gtttcccattttt

SEQ ID NO: 721320 - DNA, 13 bp, C. elegans
gtttcccgatttg

SEQ ID NO: 721321 - DNA, 13 bp, C. elegans
gtttccgtcttat

SEQ ID NO: 721322 - DNA, 13 bp, C. elegans
gtttcgaacattt

SEQ ID NO: 721323 - DNA, 13 bp, C. elegans
gtttcgaattttc

SEQ ID NO: 721324 - DNA, 13 bp, C. elegans
gtttcgacaattt

SEQ ID NO: 721325 - DNA, 13 bp, C. elegans
gtttcgacatttt

SEQ ID NO: 721326 - DNA, 13 bp, C. elegans
gtttcgatatttt

SEQ ID NO: 721327 - DNA, 13 bp, C. elegans
gtttcgattttaa

SEQ ID NO: 721328 - DNA, 13 bp, C. elegans
gtttcgattttat

SEQ ID NO: 721329 - DNA, 13 bp, C. elegans
gtttcggaaaaaa

SEQ ID NO: 721330 - DNA, 13 bp, C. elegans
gtttcgtttttca

SEQ ID NO: 721331 - DNA, 13 bp, C. elegans
gtttctaaaacat

SEQ ID NO: 721332 - DNA, 13 bp, C. elegans
gtttctaaacaaa

SEQ ID NO: 721333 - DNA, 13 bp, C. elegans
gtttctaaacatt

SEQ ID NO: 721334 - DNA, 13 bp, C. elegans
gtttctaaatttg

SEQ ID NO: 721335 - DNA, 13 bp, C. elegans
gtttctaacattt

SEQ ID NO: 721336 - DNA, 13 bp, C. elegans
gtttctagaaaca

SEQ ID NO: 721337 - DNA, 13 bp, C. elegans
gtttctcaatttt

SEQ ID NO: 721338 - DNA, 13 bp, C. elegans
gtttctcatattt

SEQ ID NO: 721339 - DNA, 13 bp, C. elegans
gtttctcatcaaa

SEQ ID NO: 721340 - DNA, 13 bp, C. elegans
gtttctcattatt

SEQ ID NO: 721341 - DNA, 13 bp, C. elegans
gtttctccaaaat

SEQ ID NO: 721342 - DNA, 13 bp, C. elegans
gtttctcgatttt

SEQ ID NO: 721343 - DNA, 13 bp, C. elegans
gtttctctaaaaa

SEQ ID NO: 721344 - DNA, 13 bp, C. elegans
gtttctgaaaatt

SEQ ID NO: 721345 - DNA, 13 bp, C. elegans
gtttctgaaatat

SEQ ID NO: 721346 - DNA, 13 bp, C. elegans
gtttctgaaattt

SEQ ID NO: 721347 - DNA, 13 bp, C. elegans
gtttctgaagaaa

SEQ ID NO: 721348 - DNA, 13 bp, C. elegans
gtttctgaatatt

SEQ ID NO: 721349 - DNA, 13 bp, C. elegans
gtttctggaaaaa

SEQ ID NO: 721350 - DNA, 13 bp, C. elegans
gtttctggaaaat

SEQ ID NO: 721351 - DNA, 13 bp, C. elegans
gtttctggctcga

SEQ ID NO: 721352 - DNA, 13 bp, C. elegans
gtttctgtaaaaa

SEQ ID NO: 721353 - DNA, 13 bp, C. elegans
gtttctgtgtaaa

SEQ ID NO: 721354 - DNA, 13 bp, C. elegans
gtttctgtttcaa

SEQ ID NO: 721355 - DNA, 13 bp, C. elegans
gtttctgttttaa

SEQ ID NO: 721356 - DNA, 13 bp, C. elegans
gtttcttaaattt

SEQ ID NO: 721357 - DNA, 13 bp, C. elegans
gtttcttatcatt

SEQ ID NO: 721358 - DNA, 13 bp, C. elegans
gtttcttcaaata

SEQ ID NO: 721359 - DNA, 13 bp, C. elegans
gtttcttccaaaa

SEQ ID NO: 721360 - DNA, 13 bp, C. elegans
gtttcttgaattt

SEQ ID NO: 721361 - DNA, 13 bp, C. elegans
gtttcttggaaat

SEQ ID NO: 721362 - DNA, 13 bp, C. elegans
gtttctttcgaaa

SEQ ID NO: 721363 - DNA, 13 bp, C. elegans
gtttcttttgaaa

SEQ ID NO: 721364 - DNA, 13 bp, C. elegans
gtttctttttaaa

SEQ ID NO: 721365 - DNA, 13 bp, C. elegans
gtttctttttcac

SEQ ID NO: 721366 - DNA, 13 bp, C. elegans
gtttgaaaaagga

SEQ ID NO: 721367 - DNA, 13 bp, C. elegans
gtttgaaaacaaa

SEQ ID NO: 721368 - DNA, 13 bp, C. elegans
gtttgaaaactat

SEQ ID NO: 721369 - DNA, 13 bp, C. elegans
gtttgaaaatttt

SEQ ID NO: 721370 - DNA, 13 bp, C. elegans
gtttgaaacttta

SEQ ID NO: 721371 - DNA, 13 bp, C. elegans
gtttgaaagattt

SEQ ID NO: 721372 - DNA, 13 bp, C. elegans
gtttgaaagttca

SEQ ID NO: 721373 - DNA, 13 bp, C. elegans
gtttgaaagttga

SEQ ID NO: 721374 - DNA, 13 bp, C. elegans
gtttgaaataaat

SEQ ID NO: 721375 - DNA, 13 bp, C. elegans
gtttgaaataatt

SEQ ID NO: 721376 - DNA, 13 bp, C. elegans
gtttgaaatattc

SEQ ID NO: 721377 - DNA, 13 bp, C. elegans
gtttgaaatcaaa

SEQ ID NO: 721378 - DNA, 13 bp, C. elegans
gtttgaaattgaa

SEQ ID NO: 721379 - DNA, 13 bp, C. elegans
gtttgaaattgtt

SEQ ID NO: 721380 - DNA, 13 bp, C. elegans
gtttgaaatttct

SEQ ID NO: 721381 - DNA, 13 bp, C. elegans
gtttgaacttttt

SEQ ID NO: 721382 - DNA, 13 bp, C. elegans
gtttgaagaaaat

SEQ ID NO: 721383 - DNA, 13 bp, C. elegans
gtttgaataattt

SEQ ID NO: 721384 - DNA, 13 bp, C. elegans
gtttgaatattca

SEQ ID NO: 721385 - DNA, 13 bp, C. elegans
gtttgaatcattt

SEQ ID NO: 721386 - DNA, 13 bp, C. elegans
gtttgaattaatt

SEQ ID NO: 721387 - DNA, 13 bp, C. elegans
gtttgaattcaaa

SEQ ID NO: 721388 - DNA, 13 bp, C. elegans
gtttgaattgaat

SEQ ID NO: 721389 - DNA, 13 bp, C. elegans
gtttgaatttgaa

SEQ ID NO: 721390 - DNA, 13 bp, C. elegans
gtttgacaacttt

SEQ ID NO: 721391 - DNA, 13 bp, C. elegans
gtttgacagaaaa

SEQ ID NO: 721392 - DNA, 13 bp, C. elegans
gtttgacctacaa

SEQ ID NO: 721393 - DNA, 13 bp, C. elegans
gtttgactgaaaa

SEQ ID NO: 721394 - DNA, 13 bp, C. elegans
gtttgagaatcaa

SEQ ID NO: 721395 - DNA, 13 bp, C. elegans
gtttgagtaaata

SEQ ID NO: 721396 - DNA, 13 bp, C. elegans
gtttgataaaaaa

SEQ ID NO: 721397 - DNA, 13 bp, C. elegans
gtttgatagaaaa

SEQ ID NO: 721398 - DNA, 13 bp, C. elegans
gtttgatctacca

SEQ ID NO: 721399 - DNA, 13 bp, C. elegans
gtttgatctactt

SEQ ID NO: 721400 - DNA, 13 bp, C. elegans
gtttgattcaatt

SEQ ID NO: 721401 - DNA, 13 bp, C. elegans
gtttgattgaatt

SEQ ID NO: 721402 - DNA, 13 bp, C. elegans
gtttgcaaaaaaa

SEQ ID NO: 721403 - DNA, 13 bp, C. elegans
gtttgcaaaaatg

SEQ ID NO: 721404 - DNA, 13 bp, C. elegans
gtttgcaagaaaa

SEQ ID NO: 721405 - DNA, 13 bp, C. elegans
gtttgcacaattt

SEQ ID NO: 721406 - DNA, 13 bp, C. elegans
gtttgcaggaaat

SEQ ID NO: 721407 - DNA, 13 bp, C. elegans
gtttgccacaaaa

SEQ ID NO: 721408 - DNA, 13 bp, C. elegans
gtttgccgaattt

SEQ ID NO: 721409 - DNA, 13 bp, C. elegans
gtttgccgagcac

SEQ ID NO: 721410 - DNA, 13 bp, C. elegans
gtttgcggacttt

SEQ ID NO: 721411 - DNA, 13 bp, C. elegans
gtttgctggaaat

SEQ ID NO: 721412 - DNA, 13 bp, C. elegans
gtttgctttttaa

SEQ ID NO: 721413 - DNA, 13 bp, C. elegans
gtttggaaaataa

SEQ ID NO: 721414 - DNA, 13 bp, C. elegans
gtttggaaaatct

SEQ ID NO: 721415 - DNA, 13 bp, C. elegans
gtttggaacattt

SEQ ID NO: 721416 - DNA, 13 bp, C. elegans
gtttggaatgttt

SEQ ID NO: 721417 - DNA, 13 bp, C. elegans
gtttggaattttc

SEQ ID NO: 721418 - DNA, 13 bp, C. elegans
gtttggagcttct

SEQ ID NO: 721419 - DNA, 13 bp, C. elegans
gtttggagctttt

SEQ ID NO: 721420 - DNA, 13 bp, C. elegans
gtttggatttaaa

SEQ ID NO: 721421 - DNA, 13 bp, C. elegans
gtttggcaaattt

SEQ ID NO: 721422 - DNA, 13 bp, C. elegans
gtttggcagaaag

SEQ ID NO: 721423 - DNA, 13 bp, C. elegans
gtttggcgggaaa

SEQ ID NO: 721424 - DNA, 13 bp, C. elegans
gtttgggaaaaat

SEQ ID NO: 721425 - DNA, 13 bp, C. elegans
gtttggtcatttt

SEQ ID NO: 721426 - DNA, 13 bp, C. elegans
gtttgtacatttt

SEQ ID NO: 721427 - DNA, 13 bp, C. elegans
gtttgtcgatttg

SEQ ID NO: 721428 - DNA, 13 bp, C. elegans
gtttgttgaaaat

SEQ ID NO: 721429 - DNA, 13 bp, C. elegans
gtttgttgaataa

SEQ ID NO: 721430 - DNA, 13 bp, C. elegans
gtttgttggaaaa

SEQ ID NO: 721431 - DNA, 13 bp, C. elegans
gtttgtttttcaa

SEQ ID NO: 721432 - DNA, 13 bp, C. elegans
gttttaaaagttt

SEQ ID NO: 721433 - DNA, 13 bp, C. elegans
gttttaaaattcc

SEQ ID NO: 721434 - DNA, 13 bp, C. elegans
gttttaaactttt

SEQ ID NO: 721435 - DNA, 13 bp, C. elegans
gttttaaagaaac

SEQ ID NO: 721436 - DNA, 13 bp, C. elegans
gttttaaagtttc

SEQ ID NO: 721437 - DNA, 13 bp, C. elegans
gttttaaatcatt

SEQ ID NO: 721438 - DNA, 13 bp, C. elegans
gttttaacagaaa

SEQ ID NO: 721439 - DNA, 13 bp, C. elegans
gttttaaccaatt

SEQ ID NO: 721440 - DNA, 13 bp, C. elegans
gttttaacgccta

SEQ ID NO: 721441 - DNA, 13 bp, C. elegans
gttttaagaaaaa

SEQ ID NO: 721442 - DNA, 13 bp, C. elegans
gttttaagcgttt

SEQ ID NO: 721443 - DNA, 13 bp, C. elegans
gttttaataattg

SEQ ID NO: 721444 - DNA, 13 bp, C. elegans
gttttaatcaata

SEQ ID NO: 721445 - DNA, 13 bp, C. elegans
gttttaatcattt

SEQ ID NO: 721446 - DNA, 13 bp, C. elegans
gttttaatgaaaa

SEQ ID NO: 721447 - DNA, 13 bp, C. elegans
gttttaatgtaaa

SEQ ID NO: 721448 - DNA, 13 bp, C. elegans
gttttaattgaaa

SEQ ID NO: 721449 - DNA, 13 bp, C. elegans
gttttacaaaaaa

SEQ ID NO: 721450 - DNA, 13 bp, C. elegans
gttttacaaaatt

SEQ ID NO: 721451 - DNA, 13 bp, C. elegans
gttttacaattta

SEQ ID NO: 721452 - DNA, 13 bp, C. elegans
gttttacacaatt

SEQ ID NO: 721453 - DNA, 13 bp, C. elegans
gttttacagtttt

SEQ ID NO: 721454 - DNA, 13 bp, C. elegans
gttttacatgttt

SEQ ID NO: 721455 - DNA, 13 bp, C. elegans
gttttaccctttt

SEQ ID NO: 721456 - DNA, 13 bp, C. elegans
gttttacgaattt

SEQ ID NO: 721457 - DNA, 13 bp, C. elegans
gttttactgaaaa

SEQ ID NO: 721458 - DNA, 13 bp, C. elegans
gttttagaggaaa

SEQ ID NO: 721459 - DNA, 13 bp, C. elegans
gttttagtcatta

SEQ ID NO: 721460 - DNA, 14 bp, C. elegans
gttttatcacaact

SEQ ID NO: 721461 - DNA, 13 bp, C. elegans
gttttatcataaa

SEQ ID NO: 721462 - DNA, 13 bp, C. elegans
gttttatcataat

SEQ ID NO: 721463 - DNA, 13 bp, C. elegans
gttttatcatatt

SEQ ID NO: 721464 - DNA, 13 bp, C. elegans
gttttatcatgat

SEQ ID NO: 721465 - DNA, 13 bp, C. elegans
gttttatgaaaaa

SEQ ID NO: 721466 - DNA, 13 bp, C. elegans
gttttatgaaata

SEQ ID NO: 721467 - DNA, 13 bp, C. elegans
gttttatgataat

SEQ ID NO: 721468 - DNA, 13 bp, C. elegans
gttttatgcattt

SEQ ID NO: 721469 - DNA, 13 bp, C. elegans
gttttatgtcaaa

SEQ ID NO: 721470 - DNA, 13 bp, C. elegans
gttttattattac

SEQ ID NO: 721471 - DNA, 13 bp, C. elegans
gttttattcaaaa

SEQ ID NO: 721472 - DNA, 13 bp, C. elegans
gttttattcagaa

SEQ ID NO: 721473 - DNA, 13 bp, C. elegans
gttttattccagt

SEQ ID NO: 721474 - DNA, 13 bp, C. elegans
gttttattcttca

SEQ ID NO: 721475 - DNA, 13 bp, C. elegans
gttttattgaaat

SEQ ID NO: 721476 - DNA, 13 bp, C. elegans
gttttattggaaa

SEQ ID NO: 721477 - DNA, 13 bp, C. elegans
gttttatttatca

SEQ ID NO: 721478 - DNA, 13 bp, C. elegans
gttttatttcaaa

SEQ ID NO: 721479 - DNA, 13 bp, C. elegans
gttttatttcgaa

SEQ ID NO: 721480 - DNA, 13 bp, C. elegans
gttttatttgaaa

SEQ ID NO: 721481 - DNA, 13 bp, C. elegans
gttttatttggaa

SEQ ID NO: 721482 - DNA, 13 bp, C. elegans
gttttattttcaa

SEQ ID NO: 721483 - DNA, 13 bp, C. elegans
gttttcaaaaaaa

SEQ ID NO: 721484 - DNA, 14 bp, C. elegans
gttttcaaaaaagt

SEQ ID NO: 721485 - DNA, 13 bp, C. elegans
gttttcaaaaagt

SEQ ID NO: 721486 - DNA, 13 bp, C. elegans
gttttcaaaaata

SEQ ID NO: 721487 - DNA, 14 bp, C. elegans
gttttcaaaaatac

SEQ ID NO: 721488 - DNA, 13 bp, C. elegans
gttttcaaaacaa

SEQ ID NO: 721489 - DNA, 13 bp, C. elegans
gttttcaaacatt

SEQ ID NO: 721490 - DNA, 13 bp, C. elegans
gttttcaaacttt

SEQ ID NO: 721491 - DNA, 13 bp, C. elegans
gttttcaaagatt

SEQ ID NO: 721492 - DNA, 13 bp, C. elegans
gttttcaaagttt

SEQ ID NO: 721493 - DNA, 13 bp, C. elegans
gttttcaaatgga

SEQ ID NO: 721494 - DNA, 13 bp, C. elegans
gttttcaaatgtt

SEQ ID NO: 721495 - DNA, 13 bp, C. elegans
gttttcaaattgt

SEQ ID NO: 721496 - DNA, 13 bp, C. elegans
gttttcaaatttt

SEQ ID NO: 721497 - DNA, 13 bp, C. elegans
gttttcaacacaa

SEQ ID NO: 721498 - DNA, 13 bp, C. elegans
gttttcaacgatt

SEQ ID NO: 721499 - DNA, 13 bp, C. elegans
gttttcaactgat

SEQ ID NO: 721500 - DNA, 13 bp, C. elegans
gttttcaactttt

SEQ ID NO: 721501 - DNA, 13 bp, C. elegans
gttttcaagaaga

SEQ ID NO: 721502 - DNA, 13 bp, C. elegans
gttttcaagttaa

SEQ ID NO: 721503 - DNA, 13 bp, C. elegans
gttttcaataaaa

SEQ ID NO: 721504 - DNA, 13 bp, C. elegans
gttttcaatacga

SEQ ID NO: 721505 - DNA, 13 bp, C. elegans
gttttcaatgtgt

SEQ ID NO: 721506 - DNA, 13 bp, C. elegans
gttttcaatgttt

SEQ ID NO: 721507 - DNA, 13 bp, C. elegans
gttttcaatttat

SEQ ID NO: 721508 - DNA, 13 bp, C. elegans
gttttcaattttc

SEQ ID NO: 721509 - DNA, 13 bp, C. elegans
gttttcacaactt

SEQ ID NO: 721510 - DNA, 13 bp, C. elegans
gttttcacagaaa

SEQ ID NO: 721511 - DNA, 13 bp, C. elegans
gttttcaccactt

SEQ ID NO: 721512 - DNA, 13 bp, C. elegans
gttttcactcaat

SEQ ID NO: 721513 - DNA, 13 bp, C. elegans
gttttcagaagtt

SEQ ID NO: 721514 - DNA, 13 bp, C. elegans
gttttcagcttca

SEQ ID NO: 721515 - DNA, 13 bp, C. elegans
gttttcaggatct

SEQ ID NO: 721516 - DNA, 13 bp, C. elegans
gttttcaggtttt

SEQ ID NO: 721517 - DNA, 13 bp, C. elegans
gttttcagtcaat

SEQ ID NO: 721518 - DNA, 13 bp, C. elegans
gttttcagtcatt

SEQ ID NO: 721519 - DNA, 13 bp, C. elegans
gttttcagtgaaa

SEQ ID NO: 721520 - DNA, 13 bp, C. elegans
gttttcagttatt

SEQ ID NO: 721521 - DNA, 13 bp, C. elegans
gttttcatcaaaa

SEQ ID NO: 721522 - DNA, 13 bp, C. elegans
gttttcatcattt

SEQ ID NO: 721523 - DNA, 13 bp, C. elegans
gttttcatcgatt

SEQ ID NO: 721524 - DNA, 13 bp, C. elegans
gttttcatgaatt

SEQ ID NO: 721525 - DNA, 13 bp, C. elegans
gttttcatggaaa

SEQ ID NO: 721526 - DNA, 13 bp, C. elegans
gttttcatgtttc

SEQ ID NO: 721527 - DNA, 13 bp, C. elegans
gttttcattaata

SEQ ID NO: 721528 - DNA, 13 bp, C. elegans
gttttcattcatt

SEQ ID NO: 721529 - DNA, 13 bp, C. elegans
gttttcattgaat

SEQ ID NO: 721530 - DNA, 13 bp, C. elegans
gttttcattgatt

SEQ ID NO: 721531 - DNA, 13 bp, C. elegans
gttttcattttcc

SEQ ID NO: 721532 - DNA, 13 bp, C. elegans
gttttccaaaaaa

SEQ ID NO: 721533 - DNA, 13 bp, C. elegans
gttttccaattag

SEQ ID NO: 721534 - DNA, 13 bp, C. elegans
gttttccaattct

SEQ ID NO: 721535 - DNA, 13 bp, C. elegans
gttttccataatt

SEQ ID NO: 721536 - DNA, 13 bp, C. elegans
gttttccatgttt

SEQ ID NO: 721537 - DNA, 13 bp, C. elegans
gttttccattcat

SEQ ID NO: 721538 - DNA, 13 bp, C. elegans
gttttccatttct

SEQ ID NO: 721539 - DNA, 13 bp, C. elegans
gttttccatttgt

SEQ ID NO: 721540 - DNA, 13 bp, C. elegans
gttttccattttc

SEQ ID NO: 721541 - DNA, 13 bp, C. elegans
gttttcccaattt

SEQ ID NO: 721542 - DNA, 13 bp, C. elegans
gttttccccaaaa

SEQ ID NO: 721543 - DNA, 13 bp, C. elegans
gttttcccgccaa

SEQ ID NO: 721544 - DNA, 13 bp, C. elegans
gttttccgaaatt

SEQ ID NO: 721545 - DNA, 13 bp, C. elegans
gttttccgaattt

SEQ ID NO: 721546 - DNA, 13 bp, C. elegans
gttttccgagaaa

SEQ ID NO: 721547 - DNA, 13 bp, C. elegans
gttttcctaattt

SEQ ID NO: 721548 - DNA, 13 bp, C. elegans
gttttcgaaaaaa

SEQ ID NO: 721549 - DNA, 13 bp, C. elegans
gttttcgaaagtt

SEQ ID NO: 721550 - DNA, 13 bp, C. elegans
gttttcgaaatta

SEQ ID NO: 721551 - DNA, 13 bp, C. elegans
gttttcgaacgtc

SEQ ID NO: 721552 - DNA, 13 bp, C. elegans
gttttcgaacttt

SEQ ID NO: 721553 - DNA, 13 bp, C. elegans
gttttcgaattta

SEQ ID NO: 721554 - DNA, 13 bp, C. elegans
gttttcgaatttt

SEQ ID NO: 721555 - DNA, 13 bp, C. elegans
gttttcgagaaaa

SEQ ID NO: 721556 - DNA, 13 bp, C. elegans
gttttcgagcaac

SEQ ID NO: 721557 - DNA, 13 bp, C. elegans
gttttcgctgaaa

SEQ ID NO: 721558 - DNA, 13 bp, C. elegans
gttttcgcttcga

SEQ ID NO: 721559 - DNA, 13 bp, C. elegans
gttttcggtgtat

SEQ ID NO: 721560 - DNA, 13 bp, C. elegans
gttttctaacttt

SEQ ID NO: 721561 - DNA, 13 bp, C. elegans
gttttctacaaat

SEQ ID NO: 721562 - DNA, 13 bp, C. elegans
gttttctagaaat

SEQ ID NO: 721563 - DNA, 13 bp, C. elegans
gttttctagtccc

SEQ ID NO: 721564 - DNA, 13 bp, C. elegans
gttttctattatc

SEQ ID NO: 721565 - DNA, 13 bp, C. elegans
gttttctcaagaa

SEQ ID NO: 721566 - DNA, 13 bp, C. elegans
gttttctcatcaa

SEQ ID NO: 721567 - DNA, 13 bp, C. elegans
gttttctcatttc

SEQ ID NO: 721568 - DNA, 13 bp, C. elegans
gttttctcctaaa

SEQ ID NO: 721569 - DNA, 13 bp, C. elegans
gttttctcgaaaa

SEQ ID NO: 721570 - DNA, 13 bp, C. elegans
gttttctcgatga

SEQ ID NO: 721571 - DNA, 13 bp, C. elegans
gttttctgaaaga

SEQ ID NO: 721572 - DNA, 13 bp, C. elegans
gttttctgagatt

SEQ ID NO: 721573 - DNA, 13 bp, C. elegans
gttttctgcattt

SEQ ID NO: 721574 - DNA, 13 bp, C. elegans
gttttctggaagt

SEQ ID NO: 721575 - DNA, 13 bp, C. elegans
gttttctgtcatt

SEQ ID NO: 721576 - DNA, 13 bp, C. elegans
gttttctgttaaa

SEQ ID NO: 721577 - DNA, 13 bp, C. elegans
gttttctgttcaa

SEQ ID NO: 721578 - DNA, 13 bp, C. elegans
gttttctgtttca

SEQ ID NO: 721579 - DNA, 13 bp, C. elegans
gttttcttataat

SEQ ID NO: 721580 - DNA, 13 bp, C. elegans
gttttcttcactt

SEQ ID NO: 721581 - DNA, 13 bp, C. elegans
gttttcttgcaaa

SEQ ID NO: 721582 - DNA, 13 bp, C. elegans
gttttctttccaa

SEQ ID NO: 721583 - DNA, 13 bp, C. elegans
gttttctttcgat

SEQ ID NO: 721584 - DNA, 13 bp, C. elegans
gttttcttttacc

SEQ ID NO: 721585 - DNA, 13 bp, C. elegans
gttttcttttcca

SEQ ID NO: 721586 - DNA, 13 bp, C. elegans
gttttgaaaaata

SEQ ID NO: 721587 - DNA, 13 bp, C. elegans
gttttgaaacttt

SEQ ID NO: 721588 - DNA, 13 bp, C. elegans
gttttgaaattaa

SEQ ID NO: 721589 - DNA, 13 bp, C. elegans
gttttgaaattta

SEQ ID NO: 721590 - DNA, 13 bp, C. elegans
gttttgaaatttc

SEQ ID NO: 721591 - DNA, 14 bp, C. elegans
gttttgaaatttca

SEQ ID NO: 721592 - DNA, 13 bp, C. elegans
gttttgaagaaaa

SEQ ID NO: 721593 - DNA, 13 bp, C. elegans
gttttgaagttat

SEQ ID NO: 721594 - DNA, 13 bp, C. elegans
gttttgaataaaa

SEQ ID NO: 721595 - DNA, 13 bp, C. elegans
gttttgaatgaat

SEQ ID NO: 721596 - DNA, 13 bp, C. elegans
gttttgaatgttc

SEQ ID NO: 721597 - DNA, 13 bp, C. elegans
gttttgaatttga

SEQ ID NO: 721598 - DNA, 13 bp, C. elegans
gttttgaattttc

SEQ ID NO: 721599 - DNA, 13 bp, C. elegans
gttttgacagaaa

SEQ ID NO: 721600 - DNA, 13 bp, C. elegans
gttttgactattt

SEQ ID NO: 721601 - DNA, 13 bp, C. elegans
gttttgagcattt

SEQ ID NO: 721602 - DNA, 13 bp, C. elegans
gttttgaggtttc

SEQ ID NO: 721603 - DNA, 13 bp, C. elegans
gttttgataagtt

SEQ ID NO: 721604 - DNA, 13 bp, C. elegans
gttttgataatat

SEQ ID NO: 721605 - DNA, 13 bp, C. elegans
gttttgatatttc

SEQ ID NO: 721606 - DNA, 13 bp, C. elegans
gttttgatcattt

SEQ ID NO: 721607 - DNA, 13 bp, C. elegans
gttttgatttaaa

SEQ ID NO: 721608 - DNA, 13 bp, C. elegans
gttttgcaaaaat

SEQ ID NO: 721609 - DNA, 13 bp, C. elegans
gttttgcaattaa

SEQ ID NO: 721610 - DNA, 13 bp, C. elegans
gttttgcaattat

SEQ ID NO: 721611 - DNA, 13 bp, C. elegans
gttttgcaatttt

SEQ ID NO: 721612 - DNA, 13 bp, C. elegans
gttttgcacattt

SEQ ID NO: 721613 - DNA, 13 bp, C. elegans
gttttgcattttc

SEQ ID NO: 721614 - DNA, 13 bp, C. elegans
gttttgccagttt

SEQ ID NO: 721615 - DNA, 13 bp, C. elegans
gttttgccatttt

SEQ ID NO: 721616 - DNA, 13 bp, C. elegans
gttttgcccaaaa

SEQ ID NO: 721617 - DNA, 13 bp, C. elegans
gttttgcctattt

SEQ ID NO: 721618 - DNA, 13 bp, C. elegans
gttttgctaaatt

SEQ ID NO: 721619 - DNA, 13 bp, C. elegans
gttttgcttcaaa

SEQ ID NO: 721620 - DNA, 13 bp, C. elegans
gttttgcttgaaa

SEQ ID NO: 721621 - DNA, 13 bp, C. elegans
gttttggaaaaaa

SEQ ID NO: 721622 - DNA, 13 bp, C. elegans
gttttggaaaaat

SEQ ID NO: 721623 - DNA, 13 bp, C. elegans
gttttggaagaaa

SEQ ID NO: 721624 - DNA, 13 bp, C. elegans
gttttggaatttg

SEQ ID NO: 721625 - DNA, 13 bp, C. elegans
gttttggagcggt

SEQ ID NO: 721626 - DNA, 13 bp, C. elegans
gttttggcaaaaa

SEQ ID NO: 721627 - DNA, 13 bp, C. elegans
gttttggcagatt

SEQ ID NO: 721628 - DNA, 13 bp, C. elegans
gttttggcatttt

SEQ ID NO: 721629 - DNA, 13 bp, C. elegans
gttttggtaaaaa

SEQ ID NO: 721630 - DNA, 13 bp, C. elegans
gttttggtaaaat

SEQ ID NO: 721631 - DNA, 13 bp, C. elegans
gttttggtcaaaa

SEQ ID NO: 721632 - DNA, 13 bp, C. elegans
gttttggtcaatt

SEQ ID NO: 721633 - DNA, 13 bp, C. elegans
gttttgtacaaaa

SEQ ID NO: 721634 - DNA, 13 bp, C. elegans
gttttgtagaaaa

SEQ ID NO: 721635 - DNA, 13 bp, C. elegans
gttttgtcaaatt

SEQ ID NO: 721636 - DNA, 13 bp, C. elegans
gttttgttaaaac

SEQ ID NO: 721637 - DNA, 13 bp, C. elegans
gttttgttaaagt

SEQ ID NO: 721638 - DNA, 13 bp, C. elegans
gttttgttaaata

SEQ ID NO: 721639 - DNA, 13 bp, C. elegans
gttttgttcaaca

SEQ ID NO: 721640 - DNA, 13 bp, C. elegans
gttttgtttcaaa

SEQ ID NO: 721641 - DNA, 13 bp, C. elegans
gtttttaaaaact

SEQ ID NO: 721642 - DNA, 13 bp, C. elegans
gtttttaaaaatg

SEQ ID NO: 721643 - DNA, 13 bp, C. elegans
gtttttaaaagtt

SEQ ID NO: 721644 - DNA, 13 bp, C. elegans
gtttttaaacaaa

SEQ ID NO: 721645 - DNA, 13 bp, C. elegans
gtttttaaatgga

SEQ ID NO: 721646 - DNA, 13 bp, C. elegans
gtttttaaattga

SEQ ID NO: 721647 - DNA, 13 bp, C. elegans
gtttttaacgaaa

SEQ ID NO: 721648 - DNA, 13 bp, C. elegans
gtttttaaggaaa

SEQ ID NO: 721649 - DNA, 13 bp, C. elegans
gtttttaatcatt

SEQ ID NO: 721650 - DNA, 13 bp, C. elegans
gtttttaatcgaa

SEQ ID NO: 721651 - DNA, 13 bp, C. elegans
gtttttactcaaa

SEQ ID NO: 721652 - DNA, 13 bp, C. elegans
gtttttactcatt

SEQ ID NO: 721653 - DNA, 13 bp, C. elegans
gtttttagaaagt

SEQ ID NO: 721654 - DNA, 13 bp, C. elegans
gtttttagaatgc

SEQ ID NO: 721655 - DNA, 13 bp, C. elegans
gtttttaggaatt

SEQ ID NO: 721656 - DNA, 13 bp, C. elegans
gtttttaggccaa

SEQ ID NO: 721657 - DNA, 13 bp, C. elegans
gtttttatcaact

SEQ ID NO: 721658 - DNA, 13 bp, C. elegans
gtttttatctaat

SEQ ID NO: 721659 - DNA, 13 bp, C. elegans
gtttttattgcaa

SEQ ID NO: 721660 - DNA, 13 bp, C. elegans
gtttttattggaa

SEQ ID NO: 721661 - DNA, 13 bp, C. elegans
gtttttatttcaa

SEQ ID NO: 721662 - DNA, 13 bp, C. elegans
gtttttatttcga

SEQ ID NO: 721663 - DNA, 13 bp, C. elegans
gtttttcaaaaaa

SEQ ID NO: 721664 - DNA, 13 bp, C. elegans
gtttttcaaaaat

SEQ ID NO: 721665 - DNA, 13 bp, C. elegans
gtttttcaaagaa

SEQ ID NO: 721666 - DNA, 13 bp, C. elegans
gtttttcaacaaa

SEQ ID NO: 721667 - DNA, 13 bp, C. elegans
gtttttcaagaaa

SEQ ID NO: 721668 - DNA, 13 bp, C. elegans
gtttttcaattca

SEQ ID NO: 721669 - DNA, 13 bp, C. elegans
gtttttcaattta

SEQ ID NO: 721670 - DNA, 14 bp, C. elegans
gtttttcacaaaat

SEQ ID NO: 721671 - DNA, 13 bp, C. elegans
gtttttcacagaa

SEQ ID NO: 721672 - DNA, 13 bp, C. elegans
gtttttcaccgat

SEQ ID NO: 721673 - DNA, 13 bp, C. elegans
gtttttcactgaa

SEQ ID NO: 721674 - DNA, 13 bp, C. elegans
gtttttcagaagt

SEQ ID NO: 721675 - DNA, 13 bp, C. elegans
gtttttcagacaa

SEQ ID NO: 721676 - DNA, 13 bp, C. elegans
gtttttcagagtt

SEQ ID NO: 721677 - DNA, 13 bp, C. elegans
gtttttcagcact

SEQ ID NO: 721678 - DNA, 13 bp, C. elegans
gtttttcagtgat

SEQ ID NO: 721679 - DNA, 13 bp, C. elegans
gtttttcagttca

SEQ ID NO: 721680 - DNA, 13 bp, C. elegans
gtttttcatcatt

SEQ ID NO: 721681 - DNA, 15 bp, C. elegans
gtttttcatcgattt

SEQ ID NO: 721682 - DNA, 15 bp, C. elegans
gtttttcatgaaaaa

SEQ ID NO: 721683 - DNA, 13 bp, C. elegans
gtttttcatgatt

SEQ ID NO: 721684 - DNA, 13 bp, C. elegans
gtttttcatgcaa

SEQ ID NO: 721685 - DNA, 13 bp, C. elegans
gtttttcattaaa

SEQ ID NO: 721686 - DNA, 13 bp, C. elegans
gtttttcatttaa

SEQ ID NO: 721687 - DNA, 13 bp, C. elegans
gtttttcatttga

SEQ ID NO: 721688 - DNA, 13 bp, C. elegans
gtttttccaaaaa

SEQ ID NO: 721689 - DNA, 13 bp, C. elegans
gtttttccaaatt

SEQ ID NO: 721690 - DNA, 13 bp, C. elegans
gtttttcccagaa

SEQ ID NO: 721691 - DNA, 13 bp, C. elegans
gtttttccgatat

SEQ ID NO: 721692 - DNA, 13 bp, C. elegans
gtttttccggaaa

SEQ ID NO: 721693 - DNA, 13 bp, C. elegans
gtttttcgaaaac

SEQ ID NO: 721694 - DNA, 13 bp, C. elegans
gtttttcgaaaat

SEQ ID NO: 721695 - DNA, 13 bp, C. elegans
gtttttcgaacat

SEQ ID NO: 721696 - DNA, 13 bp, C. elegans
gtttttcgaataa

SEQ ID NO: 721697 - DNA, 13 bp, C. elegans
gtttttcgacgca

SEQ ID NO: 721698 - DNA, 13 bp, C. elegans
gtttttcgagatt

SEQ ID NO: 721699 - DNA, 13 bp, C. elegans
gtttttcgcaatt

SEQ ID NO: 721700 - DNA, 13 bp, C. elegans
gtttttcgccaaa

SEQ ID NO: 721701 - DNA, 13 bp, C. elegans
gtttttcggcaaa

SEQ ID NO: 721702 - DNA, 13 bp, C. elegans
gtttttcgttcaa

SEQ ID NO: 721703 - DNA, 13 bp, C. elegans
gtttttctagttg

SEQ ID NO: 721704 - DNA, 13 bp, C. elegans
gtttttctataaa

SEQ ID NO: 721705 - DNA, 13 bp, C. elegans
gtttttctatgta

SEQ ID NO: 721706 - DNA, 13 bp, C. elegans
gtttttctattga

SEQ ID NO: 721707 - DNA, 13 bp, C. elegans
gtttttctcaaaa

SEQ ID NO: 721708 - DNA, 13 bp, C. elegans
gtttttctcaata

SEQ ID NO: 721709 - DNA, 13 bp, C. elegans
gtttttctcacaa

SEQ ID NO: 721710 - DNA, 13 bp, C. elegans
gtttttctcacga

SEQ ID NO: 721711 - DNA, 13 bp, C. elegans
gtttttctcactt

SEQ ID NO: 721712 - DNA, 13 bp, C. elegans
gtttttctcagtt

SEQ ID NO: 721713 - DNA, 13 bp, C. elegans
gtttttctctcta

SEQ ID NO: 721714 - DNA, 13 bp, C. elegans
gtttttctgaaaa

SEQ ID NO: 721715 - DNA, 13 bp, C. elegans
gtttttctgaatt

SEQ ID NO: 721716 - DNA, 14 bp, C. elegans
gtttttctgcaaat

SEQ ID NO: 721717 - DNA, 13 bp, C. elegans
gtttttctgcatt

SEQ ID NO: 721718 - DNA, 13 bp, C. elegans
gtttttctgtaat

SEQ ID NO: 721719 - DNA, 13 bp, C. elegans
gtttttctgtagt

SEQ ID NO: 721720 - DNA, 13 bp, C. elegans
gtttttctgttca

SEQ ID NO: 721721 - DNA, 13 bp, C. elegans
gtttttcttccat

SEQ ID NO: 721722 - DNA, 14 bp, C. elegans
gtttttcttgaaat

SEQ ID NO: 721723 - DNA, 13 bp, C. elegans
gtttttgaaaagt

SEQ ID NO: 721724 - DNA, 13 bp, C. elegans
gtttttgaaaatg

SEQ ID NO: 721725 - DNA, 13 bp, C. elegans
gtttttgaaacat

SEQ ID NO: 721726 - DNA, 13 bp, C. elegans
gtttttgaaagat

SEQ ID NO: 721727 - DNA, 13 bp, C. elegans
gtttttgaaatta

SEQ ID NO: 721728 - DNA, 13 bp, C. elegans
gtttttgaaattg

SEQ ID NO: 721729 - DNA, 13 bp, C. elegans
gtttttgaacaaa

SEQ ID NO: 721730 - DNA, 13 bp, C. elegans
gtttttgaacaat

SEQ ID NO: 721731 - DNA, 13 bp, C. elegans
gtttttgaagaaa

SEQ ID NO: 721732 - DNA, 13 bp, C. elegans
gtttttgaagcaa

SEQ ID NO: 721733 - DNA, 13 bp, C. elegans
gtttttgaagtga

SEQ ID NO: 721734 - DNA, 13 bp, C. elegans
gtttttgaagttg

SEQ ID NO: 721735 - DNA, 13 bp, C. elegans
gtttttgaataat

SEQ ID NO: 721736 - DNA, 13 bp, C. elegans
gtttttgaataca

SEQ ID NO: 721737 - DNA, 13 bp, C. elegans
gtttttgaattca

SEQ ID NO: 721738 - DNA, 13 bp, C. elegans
gtttttgaattgg

SEQ ID NO: 721739 - DNA, 13 bp, C. elegans
gtttttgaccaaa

SEQ ID NO: 721740 - DNA, 13 bp, C. elegans
gtttttgagagaa

SEQ ID NO: 721741 - DNA, 13 bp, C. elegans
gtttttgagtgaa

SEQ ID NO: 721742 - DNA, 13 bp, C. elegans
gtttttgataaat

SEQ ID NO: 721743 - DNA, 13 bp, C. elegans
gtttttgatataa

SEQ ID NO: 721744 - DNA, 13 bp, C. elegans
gtttttgatggaa

SEQ ID NO: 721745 - DNA, 13 bp, C. elegans
gtttttgattaaa

SEQ ID NO: 721746 - DNA, 13 bp, C. elegans
gtttttgatttca

SEQ ID NO: 721747 - DNA, 13 bp, C. elegans
gtttttgcaaaaa

SEQ ID NO: 721748 - DNA, 13 bp, C. elegans
gtttttgcaacaa

SEQ ID NO: 721749 - DNA, 13 bp, C. elegans
gtttttgcaagtt

SEQ ID NO: 721750 - DNA, 13 bp, C. elegans
gtttttgcagatt

SEQ ID NO: 721751 - DNA, 13 bp, C. elegans
gtttttgccaatt

SEQ ID NO: 721752 - DNA, 13 bp, C. elegans
gtttttgctcatt

SEQ ID NO: 721753 - DNA, 13 bp, C. elegans
gtttttgctgaaa

SEQ ID NO: 721754 - DNA, 13 bp, C. elegans
gtttttggaaaaa

SEQ ID NO: 721755 - DNA, 13 bp, C. elegans
gtttttggaacat

SEQ ID NO: 721756 - DNA, 13 bp, C. elegans
gtttttggcaaaa

SEQ ID NO: 721757 - DNA, 13 bp, C. elegans
gtttttggcaatt

SEQ ID NO: 721758 - DNA, 13 bp, C. elegans
gtttttggcattt

SEQ ID NO: 721759 - DNA, 13 bp, C. elegans
gtttttggcggga

SEQ ID NO: 721760 - DNA, 13 bp, C. elegans
gtttttggctaaa

SEQ ID NO: 721761 - DNA, 13 bp, C. elegans
gtttttggtggaa

SEQ ID NO: 721762 - DNA, 13 bp, C. elegans
gtttttggtttca

SEQ ID NO: 721763 - DNA, 13 bp, C. elegans
gtttttgtaaatg

SEQ ID NO: 721764 - DNA, 13 bp, C. elegans
gtttttgtagatc

SEQ ID NO: 721765 - DNA, 13 bp, C. elegans
gtttttgtatact

SEQ ID NO: 721766 - DNA, 13 bp, C. elegans
gtttttgtcaaat

SEQ ID NO: 721767 - DNA, 13 bp, C. elegans
gtttttgtgaaaa

SEQ ID NO: 721768 - DNA, 13 bp, C. elegans
gtttttgtgaaat

SEQ ID NO: 721769 - DNA, 13 bp, C. elegans
gtttttgtggcaa

SEQ ID NO: 721770 - DNA, 13 bp, C. elegans
gtttttgtgtaaa

SEQ ID NO: 721771 - DNA, 13 bp, C. elegans
gtttttgtgtcga

SEQ ID NO: 721772 - DNA, 13 bp, C. elegans
gtttttgtgtgaa

SEQ ID NO: 721773 - DNA, 13 bp, C. elegans
gtttttgttaaaa

SEQ ID NO: 721774 - DNA, 13 bp, C. elegans
gtttttgttccaa

SEQ ID NO: 721775 - DNA, 13 bp, C. elegans
gtttttgttcgaa

SEQ ID NO: 721776 - DNA, 13 bp, C. elegans
gtttttgtttcaa

SEQ ID NO: 721777 - DNA, 13 bp, C. elegans
gttttttaacgat

SEQ ID NO: 721778 - DNA, 13 bp, C. elegans
gttttttaagaaa

SEQ ID NO: 721779 - DNA, 13 bp, C. elegans
gttttttaatgca

SEQ ID NO: 721780 - DNA, 13 bp, C. elegans
gttttttagacaa

SEQ ID NO: 721781 - DNA, 13 bp, C. elegans
gttttttagcatt

SEQ ID NO: 721782 - DNA, 13 bp, C. elegans
gttttttatcgaa

SEQ ID NO: 721783 - DNA, 13 bp, C. elegans
gttttttattcag

SEQ ID NO: 721784 - DNA, 13 bp, C. elegans
gttttttcaaaat

SEQ ID NO: 721785 - DNA, 13 bp, C. elegans
gttttttcaagaa

SEQ ID NO: 721786 - DNA, 13 bp, C. elegans
gttttttcacaat

SEQ ID NO: 721787 - DNA, 13 bp, C. elegans
gttttttccaaca

SEQ ID NO: 721788 - DNA, 13 bp, C. elegans
gttttttccaata

SEQ ID NO: 721789 - DNA, 13 bp, C. elegans
gttttttcctaat

SEQ ID NO: 721790 - DNA, 13 bp, C. elegans
gttttttcgaatt

SEQ ID NO: 721791 - DNA, 13 bp, C. elegans
gttttttcgtgat

SEQ ID NO: 721792 - DNA, 13 bp, C. elegans
gttttttctaata

SEQ ID NO: 721793 - DNA, 13 bp, C. elegans
gttttttctacga

SEQ ID NO: 721794 - DNA, 13 bp, C. elegans
gttttttctaggc

SEQ ID NO: 721795 - DNA, 13 bp, C. elegans
gttttttctcaaa

SEQ ID NO: 721796 - DNA, 13 bp, C. elegans
gttttttctcaat

SEQ ID NO: 721797 - DNA, 13 bp, C. elegans
gttttttctcata

SEQ ID NO: 721798 - DNA, 13 bp, C. elegans
gttttttctccat

SEQ ID NO: 721799 - DNA, 13 bp, C. elegans
gttttttctctca

SEQ ID NO: 721800 - DNA, 14 bp, C. elegans
gttttttctgaaaa

SEQ ID NO: 721801 - DNA, 13 bp, C. elegans
gttttttgaactt

SEQ ID NO: 721802 - DNA, 13 bp, C. elegans
gttttttgaagaa

SEQ ID NO: 721803 - DNA, 13 bp, C. elegans
gttttttgagcaa

SEQ ID NO: 721804 - DNA, 13 bp, C. elegans
gttttttgataaa

SEQ ID NO: 721805 - DNA, 13 bp, C. elegans
gttttttgatagc

SEQ ID NO: 721806 - DNA, 13 bp, C. elegans
gttttttgatatc

SEQ ID NO: 721807 - DNA, 13 bp, C. elegans
gttttttgcaagt

SEQ ID NO: 721808 - DNA, 13 bp, C. elegans
gttttttgcagaa

SEQ ID NO: 721809 - DNA, 13 bp, C. elegans
gttttttgccaat

SEQ ID NO: 721810 - DNA, 13 bp, C. elegans
gttttttggagga

SEQ ID NO: 721811 - DNA, 13 bp, C. elegans
gttttttggcaga

SEQ ID NO: 721812 - DNA, 13 bp, C. elegans
gttttttgggaat

SEQ ID NO: 721813 - DNA, 13 bp, C. elegans
gttttttgtgaaa

SEQ ID NO: 721814 - DNA, 13 bp, C. elegans
gttttttgtgcca

SEQ ID NO: 721815 - DNA, 13 bp, C. elegans
gttttttgttcaa

SEQ ID NO: 721816 - DNA, 13 bp, C. elegans
gtttttttaaaac

SEQ ID NO: 721817 - DNA, 13 bp, C. elegans
gtttttttaaaag

SEQ ID NO: 721818 - DNA, 13 bp, C. elegans
gtttttttcaaaa

SEQ ID NO: 721819 - DNA, 13 bp, C. elegans
gtttttttcaaat

SEQ ID NO: 721820 - DNA, 13 bp, C. elegans
gtttttttcaata

SEQ ID NO: 721821 - DNA, 14 bp, C. elegans
gtttttttcgaaaa

SEQ ID NO: 721822 - DNA, 13 bp, C. elegans
gtttttttcgaga

SEQ ID NO: 721823 - DNA, 13 bp, C. elegans
gtttttttcggga

SEQ ID NO: 721824 - DNA, 13 bp, C. elegans
gtttttttctaaa

SEQ ID NO: 721825 - DNA, 13 bp, C. elegans
gtttttttctcac

SEQ ID NO: 721826 - DNA, 13 bp, C. elegans
gtttttttctgca

SEQ ID NO: 721827 - DNA, 13 bp, C. elegans
gtttttttctgga

SEQ ID NO: 721828 - DNA, 13 bp, C. elegans
gtttttttgaaaa

SEQ ID NO: 721829 - DNA, 13 bp, C. elegans
gtttttttgcaaa

SEQ ID NO: 721830 - DNA, 13 bp, C. elegans
gtttttttgcgaa

SEQ ID NO: 721831 - DNA, 13 bp, C. elegans
gtttttttgcgat

SEQ ID NO: 721832 - DNA, 13 bp, C. elegans
gtttttttgctga

SEQ ID NO: 721833 - DNA, 13 bp, C. elegans
gtttttttggaag

SEQ ID NO: 721834 - DNA, 13 bp, C. elegans
gtttttttggcaa

SEQ ID NO: 721835 - DNA, 13 bp, C. elegans
gttttttttcaaa

SEQ ID NO: 721836 - DNA, 13 bp, C. elegans
gttttttttgcca

SEQ ID NO: 721837 - DNA, 13 bp, C. elegans
taaaaaaaactgt

SEQ ID NO: 721838 - DNA, 13 bp, C. elegans
taaaaaaacttga

SEQ ID NO: 721839 - DNA, 13 bp, C. elegans
taaaaaacacgat

SEQ ID NO: 721840 - DNA, 13 bp, C. elegans
taaaaaacgagtt

SEQ ID NO: 721841 - DNA, 13 bp, C. elegans
taaaaaacgatga

SEQ ID NO: 721842 - DNA, 13 bp, C. elegans
taaaaaacgtttt

SEQ ID NO: 721843 - DNA, 13 bp, C. elegans
taaaaaacttgtt

SEQ ID NO: 721844 - DNA, 13 bp, C. elegans
taaaaaagcttga

SEQ ID NO: 721845 - DNA, 13 bp, C. elegans
taaaaaaggattt

SEQ ID NO: 721846 - DNA, 13 bp, C. elegans
taaaaaagtcatt

SEQ ID NO: 721847 - DNA, 13 bp, C. elegans
taaaaaagttcga

SEQ ID NO: 721848 - DNA, 13 bp, C. elegans
taaaaaagttgtc

SEQ ID NO: 721849 - DNA, 13 bp, C. elegans
taaaaaagtttga

SEQ ID NO: 721850 - DNA, 13 bp, C. elegans
taaaaaatccgaa

SEQ ID NO: 721851 - DNA, 13 bp, C. elegans
taaaaaatccgat

SEQ ID NO: 721852 - DNA, 13 bp, C. elegans
taaaaaatcgata

SEQ ID NO: 721853 - DNA, 13 bp, C. elegans
taaaaaatcgtca

SEQ ID NO: 721854 - DNA, 13 bp, C. elegans
taaaaaatgcaga

SEQ ID NO: 721855 - DNA, 13 bp, C. elegans
taaaaaatgctca

SEQ ID NO: 721856 - DNA, 13 bp, C. elegans
taaaaaattcgaa

SEQ ID NO: 721857 - DNA, 13 bp, C. elegans
taaaaaatttcga

SEQ ID NO: 721858 - DNA, 13 bp, C. elegans
taaaaacaatgtt

SEQ ID NO: 721859 - DNA, 13 bp, C. elegans
taaaaacaattga

SEQ ID NO: 721860 - DNA, 13 bp, C. elegans
taaaaacacattt

SEQ ID NO: 721861 - DNA, 13 bp, C. elegans
taaaaacatttga

SEQ ID NO: 721862 - DNA, 13 bp, C. elegans
taaaaacattttc

SEQ ID NO: 721863 - DNA, 13 bp, C. elegans
taaaaacattttg

SEQ ID NO: 721864 - DNA, 13 bp, C. elegans
taaaaaccacatt

SEQ ID NO: 721865 - DNA, 13 bp, C. elegans
taaaaaccctgaa

SEQ ID NO: 721866 - DNA, 13 bp, C. elegans
taaaaaccgattt

SEQ ID NO: 721867 - DNA, 13 bp, C. elegans
taaaaaccgcaaa

SEQ ID NO: 721868 - DNA, 13 bp, C. elegans
taaaaacctgaaa

SEQ ID NO: 721869 - DNA, 13 bp, C. elegans
taaaaacggattt

SEQ ID NO: 721870 - DNA, 13 bp, C. elegans
taaaaactactgt

SEQ ID NO: 721871 - DNA, 13 bp, C. elegans
taaaaactacttt

SEQ ID NO: 721872 - DNA, 13 bp, C. elegans
taaaaactattct

SEQ ID NO: 721873 - DNA, 13 bp, C. elegans
taaaaactcattt

SEQ ID NO: 721874 - DNA, 13 bp, C. elegans
taaaaactcttaa

SEQ ID NO: 721875 - DNA, 13 bp, C. elegans
taaaaactgaaat

SEQ ID NO: 721876 - DNA, 13 bp, C. elegans
taaaaactgaagt

SEQ ID NO: 721877 - DNA, 13 bp, C. elegans
taaaaactgattt

SEQ ID NO: 721878 - DNA, 13 bp, C. elegans
taaaaactgcaat

SEQ ID NO: 721879 - DNA, 13 bp, C. elegans
taaaaactgtaaa

SEQ ID NO: 721880 - DNA, 13 bp, C. elegans
taaaaactgtgaa

SEQ ID NO: 721881 - DNA, 13 bp, C. elegans
taaaaacttccag

SEQ ID NO: 721882 - DNA, 13 bp, C. elegans
taaaaacttcgaa

SEQ ID NO: 721883 - DNA, 13 bp, C. elegans
taaaaacttgtta

SEQ ID NO: 721884 - DNA, 13 bp, C. elegans
taaaaactttgaa

SEQ ID NO: 721885 - DNA, 13 bp, C. elegans
taaaaagcaattt

SEQ ID NO: 721886 - DNA, 13 bp, C. elegans
taaaaagctcaaa

SEQ ID NO: 721887 - DNA, 13 bp, C. elegans
taaaaagcttaaa

SEQ ID NO: 721888 - DNA, 13 bp, C. elegans
taaaaagctttaa

SEQ ID NO: 721889 - DNA, 13 bp, C. elegans
taaaaagttgaat

SEQ ID NO: 721890 - DNA, 13 bp, C. elegans
taaaaagttgatg

SEQ ID NO: 721891 - DNA, 13 bp, C. elegans
taaaaagttttga

SEQ ID NO: 721892 - DNA, 13 bp, C. elegans
taaaaatacttga

SEQ ID NO: 721893 - DNA, 13 bp, C. elegans
taaaaatatcagt

SEQ ID NO: 721894 - DNA, 13 bp, C. elegans
taaaaatatggat

SEQ ID NO: 721895 - DNA, 13 bp, C. elegans
taaaaatatttgg

SEQ ID NO: 721896 - DNA, 13 bp, C. elegans
taaaaatcaagtt

SEQ ID NO: 721897 - DNA, 13 bp, C. elegans
taaaaatcaatag

SEQ ID NO: 721898 - DNA, 13 bp, C. elegans
taaaaatcacaga

SEQ ID NO: 721899 - DNA, 13 bp, C. elegans
taaaaatcacatt

SEQ ID NO: 721900 - DNA, 13 bp, C. elegans
taaaaatccaatt

SEQ ID NO: 721901 - DNA, 13 bp, C. elegans
taaaaatccagaa

SEQ ID NO: 721902 - DNA, 13 bp, C. elegans
taaaaatccattt

SEQ ID NO: 721903 - DNA, 13 bp, C. elegans
taaaaatcgaaca

SEQ ID NO: 721904 - DNA, 13 bp, C. elegans
taaaaatcgaaga

SEQ ID NO: 721905 - DNA, 13 bp, C. elegans
taaaaatcgaatt

SEQ ID NO: 721906 - DNA, 13 bp, C. elegans
taaaaatcgagaa

SEQ ID NO: 721907 - DNA, 13 bp, C. elegans
taaaaatcgataa

SEQ ID NO: 721908 - DNA, 13 bp, C. elegans
taaaaatcggatt

SEQ ID NO: 721909 - DNA, 13 bp, C. elegans
taaaaatcgtaat

SEQ ID NO: 721910 - DNA, 13 bp, C. elegans
taaaaatctcaat

SEQ ID NO: 721911 - DNA, 13 bp, C. elegans
taaaaatctgaat

SEQ ID NO: 721912 - DNA, 13 bp, C. elegans
taaaaatctgcaa

SEQ ID NO: 721913 - DNA, 13 bp, C. elegans
taaaaatcttcat

SEQ ID NO: 721914 - DNA, 13 bp, C. elegans
taaaaatgacatg

SEQ ID NO: 721915 - DNA, 13 bp, C. elegans
taaaaatgagttt

SEQ ID NO: 721916 - DNA, 13 bp, C. elegans
taaaaatgatgac

SEQ ID NO: 721917 - DNA, 13 bp, C. elegans
taaaaatgcctaa

SEQ ID NO: 721918 - DNA, 13 bp, C. elegans
taaaaatgcgatt

SEQ ID NO: 721919 - DNA, 13 bp, C. elegans
taaaaatgctcaa

SEQ ID NO: 721920 - DNA, 13 bp, C. elegans
taaaaatgggatt

SEQ ID NO: 721921 - DNA, 13 bp, C. elegans
taaaaatggtaat

SEQ ID NO: 721922 - DNA, 13 bp, C. elegans
taaaaatgtagga

SEQ ID NO: 721923 - DNA, 13 bp, C. elegans
taaaaatgttagt

SEQ ID NO: 721924 - DNA, 13 bp, C. elegans
taaaaatgttcaa

SEQ ID NO: 721925 - DNA, 13 bp, C. elegans
taaaaatgttgga

SEQ ID NO: 721926 - DNA, 13 bp, C. elegans
taaaaattcaaga

SEQ ID NO: 721927 - DNA, 13 bp, C. elegans
taaaaattcacat

SEQ ID NO: 721928 - DNA, 13 bp, C. elegans
taaaaattcagat

SEQ ID NO: 721929 - DNA, 13 bp, C. elegans
taaaaattcgatt

SEQ ID NO: 721930 - DNA, 13 bp, C. elegans
taaaaattctgaa

SEQ ID NO: 721931 - DNA, 13 bp, C. elegans
taaaaattctgtt

SEQ ID NO: 721932 - DNA, 13 bp, C. elegans
taaaaattgcaat

SEQ ID NO: 721933 - DNA, 13 bp, C. elegans
taaaaattgcatt

SEQ ID NO: 721934 - DNA, 13 bp, C. elegans
taaaaattgctca

SEQ ID NO: 721935 - DNA, 13 bp, C. elegans
taaaaattggaat

SEQ ID NO: 721936 - DNA, 13 bp, C. elegans
taaaaattggtga

SEQ ID NO: 721937 - DNA, 13 bp, C. elegans
taaaaattggttt

SEQ ID NO: 721938 - DNA, 13 bp, C. elegans
taaaaattgtgtt

SEQ ID NO: 721939 - DNA, 13 bp, C. elegans
taaaaattgttga

SEQ ID NO: 721940 - DNA, 13 bp, C. elegans
taaaaatttcggc

SEQ ID NO: 721941 - DNA, 13 bp, C. elegans
taaaaatttgcaa

SEQ ID NO: 721942 - DNA, 13 bp, C. elegans
taaaaattttctg

SEQ ID NO: 721943 - DNA, 13 bp, C. elegans
taaaacaaagttt

SEQ ID NO: 721944 - DNA, 13 bp, C. elegans
taaaacaacattt

SEQ ID NO: 721945 - DNA, 13 bp, C. elegans
taaaacaatttca

SEQ ID NO: 721946 - DNA, 13 bp, C. elegans
taaaacaatttga

SEQ ID NO: 721947 - DNA, 13 bp, C. elegans
taaaacacatttt

SEQ ID NO: 721948 - DNA, 13 bp, C. elegans
taaaacactctaa

SEQ ID NO: 721949 - DNA, 13 bp, C. elegans
taaaacagtattt

SEQ ID NO: 721950 - DNA, 13 bp, C. elegans
taaaacagtttct

SEQ ID NO: 721951 - DNA, 13 bp, C. elegans
taaaacagttttt

SEQ ID NO: 721952 - DNA, 13 bp, C. elegans
taaaacatatgaa

SEQ ID NO: 721953 - DNA, 13 bp, C. elegans
taaaacatcattt

SEQ ID NO: 721954 - DNA, 13 bp, C. elegans
taaaacatccacg

SEQ ID NO: 721955 - DNA, 13 bp, C. elegans
taaaacatggttt

SEQ ID NO: 721956 - DNA, 13 bp, C. elegans
taaaacattttga

SEQ ID NO: 721957 - DNA, 13 bp, C. elegans
taaaaccaaaagt

SEQ ID NO: 721958 - DNA, 13 bp, C. elegans
taaaaccaaggcg

SEQ ID NO: 721959 - DNA, 13 bp, C. elegans
taaaacccaattt

SEQ ID NO: 721960 - DNA, 13 bp, C. elegans
taaaacctagaaa

SEQ ID NO: 721961 - DNA, 13 bp, C. elegans
taaaacctttttt

SEQ ID NO: 721962 - DNA, 13 bp, C. elegans
taaaacgaatttt

SEQ ID NO: 721963 - DNA, 13 bp, C. elegans
taaaacgattcaa

SEQ ID NO: 721964 - DNA, 13 bp, C. elegans
taaaacgtcttga

SEQ ID NO: 721965 - DNA, 13 bp, C. elegans
taaaacgttcaaa

SEQ ID NO: 721966 - DNA, 13 bp, C. elegans
taaaacgttttat

SEQ ID NO: 721967 - DNA, 13 bp, C. elegans
taaaactactcaa

SEQ ID NO: 721968 - DNA, 13 bp, C. elegans
taaaactatcact

SEQ ID NO: 721969 - DNA, 13 bp, C. elegans
taaaactattcaa

SEQ ID NO: 721970 - DNA, 13 bp, C. elegans
taaaactcaaatt

SEQ ID NO: 721971 - DNA, 13 bp, C. elegans
taaaactcatttt

SEQ ID NO: 721972 - DNA, 13 bp, C. elegans
taaaactcgaaaa

SEQ ID NO: 721973 - DNA, 13 bp, C. elegans
taaaactcgattt

SEQ ID NO: 721974 - DNA, 13 bp, C. elegans
taaaactgaagaa

SEQ ID NO: 721975 - DNA, 13 bp, C. elegans
taaaactggaaaa

SEQ ID NO: 721976 - DNA, 13 bp, C. elegans
taaaactggaaat

SEQ ID NO: 721977 - DNA, 13 bp, C. elegans
taaaactgttgat

SEQ ID NO: 721978 - DNA, 13 bp, C. elegans
taaaactgtttag

SEQ ID NO: 721979 - DNA, 13 bp, C. elegans
taaaacttattct

SEQ ID NO: 721980 - DNA, 13 bp, C. elegans
taaaacttcattt

SEQ ID NO: 721981 - DNA, 13 bp, C. elegans
taaaacttgcaaa

SEQ ID NO: 721982 - DNA, 13 bp, C. elegans
taaaacttgtata

SEQ ID NO: 721983 - DNA, 13 bp, C. elegans
taaaacttttcaa

SEQ ID NO: 721984 - DNA, 13 bp, C. elegans
taaaacttttgaa

SEQ ID NO: 721985 - DNA, 13 bp, C. elegans
taaaactttttga

SEQ ID NO: 721986 - DNA, 13 bp, C. elegans
taaaagagttcaa

SEQ ID NO: 721987 - DNA, 13 bp, C. elegans
taaaagcaaaatt

SEQ ID NO: 721988 - DNA, 13 bp, C. elegans
taaaagccatttt

SEQ ID NO: 721989 - DNA, 13 bp, C. elegans
taaaagcgaaaat

SEQ ID NO: 721990 - DNA, 13 bp, C. elegans
taaaagctacatt

SEQ ID NO: 721991 - DNA, 13 bp, C. elegans
taaaagctcatat

SEQ ID NO: 721992 - DNA, 13 bp, C. elegans
taaaagctcattt

SEQ ID NO: 721993 - DNA, 13 bp, C. elegans
taaaagctgaaaa

SEQ ID NO: 721994 - DNA, 13 bp, C. elegans
taaaagctgttat

SEQ ID NO: 721995 - DNA, 13 bp, C. elegans
taaaagctttcaa

SEQ ID NO: 721996 - DNA, 13 bp, C. elegans
taaaaggtggagt

SEQ ID NO: 721997 - DNA, 13 bp, C. elegans
taaaagtagattt

SEQ ID NO: 721998 - DNA, 13 bp, C. elegans
taaaagtcaaatt

SEQ ID NO: 721999 - DNA, 13 bp, C. elegans
taaaagtcgaaaa

SEQ ID NO: 722000 - DNA, 13 bp, C. elegans
taaaagtgataat

SEQ ID NO: 722001 - DNA, 13 bp, C. elegans
taaaagtggtcaa

SEQ ID NO: 722002 - DNA, 13 bp, C. elegans
taaaagttacaaa

SEQ ID NO: 722003 - DNA, 13 bp, C. elegans
taaaagttattca

SEQ ID NO: 722004 - DNA, 13 bp, C. elegans
taaaagttcagaa

SEQ ID NO: 722005 - DNA, 13 bp, C. elegans
taaaagttctcaa

SEQ ID NO: 722006 - DNA, 13 bp, C. elegans
taaaagttctgaa

SEQ ID NO: 722007 - DNA, 13 bp, C. elegans
taaaagttgcatt

SEQ ID NO: 722008 - DNA, 13 bp, C. elegans
taaaagtttcaat

SEQ ID NO: 722009 - DNA, 13 bp, C. elegans
taaaagtttccaa

SEQ ID NO: 722010 - DNA, 13 bp, C. elegans
taaaagtttcgaa

SEQ ID NO: 722011 - DNA, 13 bp, C. elegans
taaaagtttgaaa

SEQ ID NO: 722012 - DNA, 13 bp, C. elegans
taaaagtttgatt

SEQ ID NO: 722013 - DNA, 13 bp, C. elegans
taaaagttttcag

SEQ ID NO: 722014 - DNA, 13 bp, C. elegans
taaaagttttgaa

SEQ ID NO: 722015 - DNA, 13 bp, C. elegans
taaaataaactcg

SEQ ID NO: 722016 - DNA, 13 bp, C. elegans
taaaataacttca

SEQ ID NO: 722017 - DNA, 13 bp, C. elegans
taaaataatctca

SEQ ID NO: 722018 - DNA, 13 bp, C. elegans
taaaataatctga

SEQ ID NO: 722019 - DNA, 13 bp, C. elegans
taaaataatcttc

SEQ ID NO: 722020 - DNA, 13 bp, C. elegans
taaaatacacttt

SEQ ID NO: 722021 - DNA, 13 bp, C. elegans
taaaatacggtac

SEQ ID NO: 722022 - DNA, 13 bp, C. elegans
taaaatagcaatt

SEQ ID NO: 722023 - DNA, 13 bp, C. elegans
taaaatagttttc

SEQ ID NO: 722024 - DNA, 13 bp, C. elegans
taaaatatactgt

SEQ ID NO: 722025 - DNA, 13 bp, C. elegans
taaaatatcgatt

SEQ ID NO: 722026 - DNA, 13 bp, C. elegans
taaaatatggttt

SEQ ID NO: 722027 - DNA, 13 bp, C. elegans
taaaatattctca

SEQ ID NO: 722028 - DNA, 13 bp, C. elegans
taaaatattctgt

SEQ ID NO: 722029 - DNA, 13 bp, C. elegans
taaaatattggaa

SEQ ID NO: 722030 - DNA, 13 bp, C. elegans
taaaatatttggt

SEQ ID NO: 722031 - DNA, 13 bp, C. elegans
taaaatcaagaat

SEQ ID NO: 722032 - DNA, 13 bp, C. elegans
taaaatcaaggaa

SEQ ID NO: 722033 - DNA, 13 bp, C. elegans
taaaatcacaatt

SEQ ID NO: 722034 - DNA, 13 bp, C. elegans
taaaatcacgatt

SEQ ID NO: 722035 - DNA, 13 bp, C. elegans
taaaatcactcat

SEQ ID NO: 722036 - DNA, 13 bp, C. elegans
taaaatcatcatt

SEQ ID NO: 722037 - DNA, 13 bp, C. elegans
taaaatcattcat

SEQ ID NO: 722038 - DNA, 13 bp, C. elegans
taaaatcattgaa

SEQ ID NO: 722039 - DNA, 13 bp, C. elegans
taaaatccaattt

SEQ ID NO: 722040 - DNA, 13 bp, C. elegans
taaaatcctaatt

SEQ ID NO: 722041 - DNA, 13 bp, C. elegans
taaaatcctattt

SEQ ID NO: 722042 - DNA, 13 bp, C. elegans
taaaatcgaagaa

SEQ ID NO: 722043 - DNA, 13 bp, C. elegans
taaaatcgaattt

SEQ ID NO: 722044 - DNA, 13 bp, C. elegans
taaaatcgacaaa

SEQ ID NO: 722045 - DNA, 13 bp, C. elegans
taaaatcgagaaa

SEQ ID NO: 722046 - DNA, 13 bp, C. elegans
taaaatcgatgaa

SEQ ID NO: 722047 - DNA, 13 bp, C. elegans
taaaatcggaatt

SEQ ID NO: 722048 - DNA, 13 bp, C. elegans
taaaatcgttttt

SEQ ID NO: 722049 - DNA, 13 bp, C. elegans
taaaatctcattt

SEQ ID NO: 722050 - DNA, 13 bp, C. elegans
taaaatctccaat

SEQ ID NO: 722051 - DNA, 13 bp, C. elegans
taaaatctccatt

SEQ ID NO: 722052 - DNA, 13 bp, C. elegans
taaaatctctgaa

SEQ ID NO: 722053 - DNA, 13 bp, C. elegans
taaaatctgaaaa

SEQ ID NO: 722054 - DNA, 13 bp, C. elegans
taaaatctgattt

SEQ ID NO: 722055 - DNA, 13 bp, C. elegans
taaaatctgtaaa

SEQ ID NO: 722056 - DNA, 13 bp, C. elegans
taaaatgacacaa

SEQ ID NO: 722057 - DNA, 13 bp, C. elegans
taaaatgatctaa

SEQ ID NO: 722058 - DNA, 13 bp, C. elegans
taaaatgcaccaa

SEQ ID NO: 722059 - DNA, 13 bp, C. elegans
taaaatggaacaa

SEQ ID NO: 722060 - DNA, 13 bp, C. elegans
taaaatggtttga

SEQ ID NO: 722061 - DNA, 13 bp, C. elegans
taaaatgtaaact

SEQ ID NO: 722062 - DNA, 13 bp, C. elegans
taaaatgtattca

SEQ ID NO: 722063 - DNA, 13 bp, C. elegans
taaaatgtattga

SEQ ID NO: 722064 - DNA, 13 bp, C. elegans
taaaatgtgtatt

SEQ ID NO: 722065 - DNA, 13 bp, C. elegans
taaaatgttctga

SEQ ID NO: 722066 - DNA, 13 bp, C. elegans
taaaatgttgctt

SEQ ID NO: 722067 - DNA, 13 bp, C. elegans
taaaatgtttatg

SEQ ID NO: 722068 - DNA, 13 bp, C. elegans
taaaatgtttcaa

SEQ ID NO: 722069 - DNA, 13 bp, C. elegans
taaaatgtttgag

SEQ ID NO: 722070 - DNA, 13 bp, C. elegans
taaaatgtttttc

SEQ ID NO: 722071 - DNA, 13 bp, C. elegans
taaaattacaaga

SEQ ID NO: 722072 - DNA, 13 bp, C. elegans
taaaattatcgta

SEQ ID NO: 722073 - DNA, 13 bp, C. elegans
taaaattatggaa

SEQ ID NO: 722074 - DNA, 13 bp, C. elegans
taaaattcaagca

SEQ ID NO: 722075 - DNA, 13 bp, C. elegans
taaaattcaagtt

SEQ ID NO: 722076 - DNA, 13 bp, C. elegans
taaaattcacaga

SEQ ID NO: 722077 - DNA, 13 bp, C. elegans
taaaattcacttt

SEQ ID NO: 722078 - DNA, 13 bp, C. elegans
taaaattcagttt

SEQ ID NO: 722079 - DNA, 13 bp, C. elegans
taaaattcatttc

SEQ ID NO: 722080 - DNA, 13 bp, C. elegans
taaaattcctatt

SEQ ID NO: 722081 - DNA, 13 bp, C. elegans
taaaattccttaa

SEQ ID NO: 722082 - DNA, 13 bp, C. elegans
taaaattcgaaaa

SEQ ID NO: 722083 - DNA, 13 bp, C. elegans
taaaattcgagca

SEQ ID NO: 722084 - DNA, 13 bp, C. elegans
taaaattcgcaaa

SEQ ID NO: 722085 - DNA, 13 bp, C. elegans
taaaattcggaaa

SEQ ID NO: 722086 - DNA, 13 bp, C. elegans
taaaattgaatgt

SEQ ID NO: 722087 - DNA, 13 bp, C. elegans
taaaattgagatt

SEQ ID NO: 722088 - DNA, 13 bp, C. elegans
taaaattgcaaaa

SEQ ID NO: 722089 - DNA, 13 bp, C. elegans
taaaattgcaaat

SEQ ID NO: 722090 - DNA, 13 bp, C. elegans
taaaattgccaaa

SEQ ID NO: 722091 - DNA, 13 bp, C. elegans
taaaattgctcaa

SEQ ID NO: 722092 - DNA, 13 bp, C. elegans
taaaattgcttta

SEQ ID NO: 722093 - DNA, 13 bp, C. elegans
taaaattggagtt

SEQ ID NO: 722094 - DNA, 13 bp, C. elegans
taaaattggtatt

SEQ ID NO: 722095 - DNA, 13 bp, C. elegans
taaaattggttga

SEQ ID NO: 722096 - DNA, 13 bp, C. elegans
taaaattggtttt

SEQ ID NO: 722097 - DNA, 13 bp, C. elegans
taaaattgtgata

SEQ ID NO: 722098 - DNA, 13 bp, C. elegans
taaaattgtgatt

SEQ ID NO: 722099 - DNA, 13 bp, C. elegans
taaaattgttcaa

SEQ ID NO: 722100 - DNA, 14 bp, C. elegans
taaaattgttcatt

SEQ ID NO: 722101 - DNA, 13 bp, C. elegans
taaaattgttcta

SEQ ID NO: 722102 - DNA, 13 bp, C. elegans
taaaattgttgat

SEQ ID NO: 722103 - DNA, 13 bp, C. elegans
taaaattgtttca

SEQ ID NO: 722104 - DNA, 13 bp, C. elegans
taaaattgtttga

SEQ ID NO: 722105 - DNA, 13 bp, C. elegans
taaaattgttttg

SEQ ID NO: 722106 - DNA, 13 bp, C. elegans
taaaatttacaca

SEQ ID NO: 722107 - DNA, 13 bp, C. elegans
taaaatttatgtg

SEQ ID NO: 722108 - DNA, 13 bp, C. elegans
taaaatttcaagt

SEQ ID NO: 722109 - DNA, 13 bp, C. elegans
taaaatttcagaa

SEQ ID NO: 722110 - DNA, 13 bp, C. elegans
taaaatttccaaa

SEQ ID NO: 722111 - DNA, 13 bp, C. elegans
taaaatttcccaa

SEQ ID NO: 722112 - DNA, 13 bp, C. elegans
taaaatttccttt

SEQ ID NO: 722113 - DNA, 13 bp, C. elegans
taaaatttcgaat

SEQ ID NO: 722114 - DNA, 13 bp, C. elegans
taaaatttcggaa

SEQ ID NO: 722115 - DNA, 13 bp, C. elegans
taaaatttctgaa

SEQ ID NO: 722116 - DNA, 13 bp, C. elegans
taaaatttctgtt

SEQ ID NO: 722117 - DNA, 13 bp, C. elegans
taaaatttggcaa

SEQ ID NO: 722118 - DNA, 13 bp, C. elegans
taaaatttgtgaa

SEQ ID NO: 722119 - DNA, 13 bp, C. elegans
taaaattttcaag

SEQ ID NO: 722120 - DNA, 13 bp, C. elegans
taaaattttcgaa

SEQ ID NO: 722121 - DNA, 14 bp, C. elegans
taaaattttcgaaa

SEQ ID NO: 722122 - DNA, 13 bp, C. elegans
taaaatttttcca

SEQ ID NO: 722123 - DNA, 13 bp, C. elegans
taaaatttttgac

SEQ ID NO: 722124 - DNA, 13 bp, C. elegans
taaaattttttgg

SEQ ID NO: 722125 - DNA, 13 bp, C. elegans
taaacaaaagttt

SEQ ID NO: 722126 - DNA, 13 bp, C. elegans
taaacaaaattag

SEQ ID NO: 722127 - DNA, 13 bp, C. elegans
taaacaaattctt

SEQ ID NO: 722128 - DNA, 13 bp, C. elegans
taaacaaatttca

SEQ ID NO: 722129 - DNA, 13 bp, C. elegans
taaacaacttcaa

SEQ ID NO: 722130 - DNA, 13 bp, C. elegans
taaacaatgtttt

SEQ ID NO: 722131 - DNA, 13 bp, C. elegans
taaacaatttcta

SEQ ID NO: 722132 - DNA, 13 bp, C. elegans
taaacaatttgaa

SEQ ID NO: 722133 - DNA, 13 bp, C. elegans
taaacaattttct

SEQ ID NO: 722134 - DNA, 13 bp, C. elegans
taaacacagtttt

SEQ ID NO: 722135 - DNA, 13 bp, C. elegans
taaacacgaatat

SEQ ID NO: 722136 - DNA, 13 bp, C. elegans
taaacactccaaa

SEQ ID NO: 722137 - DNA, 13 bp, C. elegans
taaacacttttta

SEQ ID NO: 722138 - DNA, 13 bp, C. elegans
taaacactttttg

SEQ ID NO: 722139 - DNA, 13 bp, C. elegans
taaacatatttct

SEQ ID NO: 722140 - DNA, 13 bp, C. elegans
taaacatgaattt

SEQ ID NO: 722141 - DNA, 13 bp, C. elegans
taaacatgatttc

SEQ ID NO: 722142 - DNA, 13 bp, C. elegans
taaacatggtgca

SEQ ID NO: 722143 - DNA, 13 bp, C. elegans
taaacattcaata

SEQ ID NO: 722144 - DNA, 13 bp, C. elegans
taaacatttatca

SEQ ID NO: 722145 - DNA, 13 bp, C. elegans
taaacatttattc

SEQ ID NO: 722146 - DNA, 13 bp, C. elegans
taaacatttcaaa

SEQ ID NO: 722147 - DNA, 13 bp, C. elegans
taaacatttgttt

SEQ ID NO: 722148 - DNA, 13 bp, C. elegans
taaacattttccc

SEQ ID NO: 722149 - DNA, 13 bp, C. elegans
taaacattttcgg

SEQ ID NO: 722150 - DNA, 13 bp, C. elegans
taaacattttgca

SEQ ID NO: 722151 - DNA, 13 bp, C. elegans
taaacatttttac

SEQ ID NO: 722152 - DNA, 13 bp, C. elegans
taaacatttttca

SEQ ID NO: 722153 - DNA, 13 bp, C. elegans
taaacatttttcc

SEQ ID NO: 722154 - DNA, 13 bp, C. elegans
taaacatttttgg

SEQ ID NO: 722155 - DNA, 13 bp, C. elegans
taaacatttttgt

SEQ ID NO: 722156 - DNA, 13 bp, C. elegans
taaaccattttat

SEQ ID NO: 722157 - DNA, 13 bp, C. elegans
taaaccatttttt

SEQ ID NO: 722158 - DNA, 13 bp, C. elegans
taaacctagattt

SEQ ID NO: 722159 - DNA, 13 bp, C. elegans
taaacctcaaaat

SEQ ID NO: 722160 - DNA, 13 bp, C. elegans
taaacgaaaaatt

SEQ ID NO: 722161 - DNA, 13 bp, C. elegans
taaacgatacaat

SEQ ID NO: 722162 - DNA, 13 bp, C. elegans
taaacggaaaatt

SEQ ID NO: 722163 - DNA, 13 bp, C. elegans
taaacgtgttttt

SEQ ID NO: 722164 - DNA, 13 bp, C. elegans
taaacgttttcat

SEQ ID NO: 722165 - DNA, 13 bp, C. elegans
taaacgtttttct

SEQ ID NO: 722166 - DNA, 13 bp, C. elegans
taaactccgccag

SEQ ID NO: 722167 - DNA, 13 bp, C. elegans
taaactgaaaatt

SEQ ID NO: 722168 - DNA, 13 bp, C. elegans
taaactgacaatc

SEQ ID NO: 722169 - DNA, 13 bp, C. elegans
taaactggaaatt

SEQ ID NO: 722170 - DNA, 13 bp, C. elegans
taaactggtattt

SEQ ID NO: 722171 - DNA, 13 bp, C. elegans
taaactgttttgt

SEQ ID NO: 722172 - DNA, 13 bp, C. elegans
taaacttaaagtt

SEQ ID NO: 722173 - DNA, 13 bp, C. elegans
taaacttcagaaa

SEQ ID NO: 722174 - DNA, 13 bp, C. elegans
taaacttccattt

SEQ ID NO: 722175 - DNA, 13 bp, C. elegans
taaacttcgaaat

SEQ ID NO: 722176 - DNA, 13 bp, C. elegans
taaacttctgaaa

SEQ ID NO: 722177 - DNA, 13 bp, C. elegans
taaacttgaaagt

SEQ ID NO: 722178 - DNA, 13 bp, C. elegans
taaacttgagaaa

SEQ ID NO: 722179 - DNA, 13 bp, C. elegans
taaactttcaaaa

SEQ ID NO: 722180 - DNA, 13 bp, C. elegans
taaactttcaatt

SEQ ID NO: 722181 - DNA, 13 bp, C. elegans
taaactttcatca

SEQ ID NO: 722182 - DNA, 13 bp, C. elegans
taaactttgaaaa

SEQ ID NO: 722183 - DNA, 13 bp, C. elegans
taaacttttcaaa

SEQ ID NO: 722184 - DNA, 13 bp, C. elegans
taaacttttctga

SEQ ID NO: 722185 - DNA, 13 bp, C. elegans
taaacttttcttc

SEQ ID NO: 722186 - DNA, 13 bp, C. elegans
taaacttttgttt

SEQ ID NO: 722187 - DNA, 13 bp, C. elegans
taaagaaaatgtg

SEQ ID NO: 722188 - DNA, 13 bp, C. elegans
taaagaaatttct

SEQ ID NO: 722189 - DNA, 13 bp, C. elegans
taaagaacaagtt

SEQ ID NO: 722190 - DNA, 13 bp, C. elegans
taaagaagtttta

SEQ ID NO: 722191 - DNA, 13 bp, C. elegans
taaagaagttttt

SEQ ID NO: 722192 - DNA, 13 bp, C. elegans
taaagaatactgt

SEQ ID NO: 722193 - DNA, 13 bp, C. elegans
taaagaatatatg

SEQ ID NO: 722194 - DNA, 13 bp, C. elegans
taaagaattactg

SEQ ID NO: 722195 - DNA, 13 bp, C. elegans
taaagaattttgt

SEQ ID NO: 722196 - DNA, 13 bp, C. elegans
taaagacttccgg

SEQ ID NO: 722197 - DNA, 13 bp, C. elegans
taaagatttggat

SEQ ID NO: 722198 - DNA, 13 bp, C. elegans
taaagattttttc

SEQ ID NO: 722199 - DNA, 13 bp, C. elegans
taaagcaaaaatt

SEQ ID NO: 722200 - DNA, 13 bp, C. elegans
taaagcaaaatta

SEQ ID NO: 722201 - DNA, 13 bp, C. elegans
taaagcaaaattc

SEQ ID NO: 722202 - DNA, 13 bp, C. elegans
taaagcaaatttt

SEQ ID NO: 722203 - DNA, 13 bp, C. elegans
taaagcaattttt

SEQ ID NO: 722204 - DNA, 13 bp, C. elegans
taaagcagccgac

SEQ ID NO: 722205 - DNA, 13 bp, C. elegans
taaagcatttatt

SEQ ID NO: 722206 - DNA, 13 bp, C. elegans
taaagcatttcaa

SEQ ID NO: 722207 - DNA, 13 bp, C. elegans
taaagcattttca

SEQ ID NO: 722208 - DNA, 13 bp, C. elegans
taaagcatttttc

SEQ ID NO: 722209 - DNA, 13 bp, C. elegans
taaagccaaaatt

SEQ ID NO: 722210 - DNA, 13 bp, C. elegans
taaagctattttt

SEQ ID NO: 722211 - DNA, 13 bp, C. elegans
taaagctcaaaaa

SEQ ID NO: 722212 - DNA, 13 bp, C. elegans
taaagctctgaaa

SEQ ID NO: 722213 - DNA, 13 bp, C. elegans
taaagctgaaaac

SEQ ID NO: 722214 - DNA, 13 bp, C. elegans
taaagcttcaaaa

SEQ ID NO: 722215 - DNA, 13 bp, C. elegans
taaagcttttgaa

SEQ ID NO: 722216 - DNA, 14 bp, C. elegans
taaaggcgcacgcc

SEQ ID NO: 722217 - DNA, 13 bp, C. elegans
taaaggttttttc

SEQ ID NO: 722218 - DNA, 13 bp, C. elegans
taaagtaattgaa

SEQ ID NO: 722219 - DNA, 13 bp, C. elegans
taaagtaatttca

SEQ ID NO: 722220 - DNA, 13 bp, C. elegans
taaagtattttca

SEQ ID NO: 722221 - DNA, 13 bp, C. elegans
taaagtgaacaaa

SEQ ID NO: 722222 - DNA, 13 bp, C. elegans
taaagtgattttt

SEQ ID NO: 722223 - DNA, 13 bp, C. elegans
taaagtgttttgt

SEQ ID NO: 722224 - DNA, 13 bp, C. elegans
taaagttaaaact

SEQ ID NO: 722225 - DNA, 13 bp, C. elegans
taaagttaaagtt

SEQ ID NO: 722226 - DNA, 13 bp, C. elegans
taaagttaaattg

SEQ ID NO: 722227 - DNA, 13 bp, C. elegans
taaagttagtagt

SEQ ID NO: 722228 - DNA, 13 bp, C. elegans
taaagttattgaa

SEQ ID NO: 722229 - DNA, 13 bp, C. elegans
taaagttcaaatt

SEQ ID NO: 722230 - DNA, 13 bp, C. elegans
taaagttccaaaa

SEQ ID NO: 722231 - DNA, 13 bp, C. elegans
taaagttctattt

SEQ ID NO: 722232 - DNA, 13 bp, C. elegans
taaagttgacaaa

SEQ ID NO: 722233 - DNA, 13 bp, C. elegans
taaagttgattga

SEQ ID NO: 722234 - DNA, 13 bp, C. elegans
taaagttgatttt

SEQ ID NO: 722235 - DNA, 13 bp, C. elegans
taaagttgttgaa

SEQ ID NO: 722236 - DNA, 13 bp, C. elegans
taaagttgtttca

SEQ ID NO: 722237 - DNA, 13 bp, C. elegans
taaagtttaactt

SEQ ID NO: 722238 - DNA, 13 bp, C. elegans
taaagtttcagaa

SEQ ID NO: 722239 - DNA, 13 bp, C. elegans
taaagtttctttt

SEQ ID NO: 722240 - DNA, 13 bp, C. elegans
taaagtttgaaaa

SEQ ID NO: 722241 - DNA, 13 bp, C. elegans
taaagtttgaaca

SEQ ID NO: 722242 - DNA, 13 bp, C. elegans
taaagtttgatgt

SEQ ID NO: 722243 - DNA, 13 bp, C. elegans
taaagttttcttt

SEQ ID NO: 722244 - DNA, 13 bp, C. elegans
taaagttttgaaa

SEQ ID NO: 722245 - DNA, 13 bp, C. elegans
taaataaaaacgt

SEQ ID NO: 722246 - DNA, 13 bp, C. elegans
taaataaaacgtt

SEQ ID NO: 722247 - DNA, 13 bp, C. elegans
taaataaatctcc

SEQ ID NO: 722248 - DNA, 13 bp, C. elegans
taaataaatttcc

SEQ ID NO: 722249 - DNA, 13 bp, C. elegans
taaataactgaaa

SEQ ID NO: 722250 - DNA, 13 bp, C. elegans
taaataagattgt

SEQ ID NO: 722251 - DNA, 13 bp, C. elegans
taaataatgaaca

SEQ ID NO: 722252 - DNA, 13 bp, C. elegans
taaataattgtgt

SEQ ID NO: 722253 - DNA, 13 bp, C. elegans
taaataattgttc

SEQ ID NO: 722254 - DNA, 13 bp, C. elegans
taaatacacttat

SEQ ID NO: 722255 - DNA, 13 bp, C. elegans
taaatacattgaa

SEQ ID NO: 722256 - DNA, 13 bp, C. elegans
taaatacattttc

SEQ ID NO: 722257 - DNA, 13 bp, C. elegans
taaataccgtatt

SEQ ID NO: 722258 - DNA, 13 bp, C. elegans
taaatacgaagaa

SEQ ID NO: 722259 - DNA, 13 bp, C. elegans
taaatagagaatt

SEQ ID NO: 722260 - DNA, 13 bp, C. elegans
taaatatattacc

SEQ ID NO: 722261 - DNA, 13 bp, C. elegans
taaatatcacaat

SEQ ID NO: 722262 - DNA, 13 bp, C. elegans
taaatatccaaat

SEQ ID NO: 722263 - DNA, 13 bp, C. elegans
taaatatctgaaa

SEQ ID NO: 722264 - DNA, 13 bp, C. elegans
taaatatgcattt

SEQ ID NO: 722265 - DNA, 13 bp, C. elegans
taaatatggattt

SEQ ID NO: 722266 - DNA, 13 bp, C. elegans
taaatatgtttca

SEQ ID NO: 722267 - DNA, 13 bp, C. elegans
taaatattaggtt

SEQ ID NO: 722268 - DNA, 13 bp, C. elegans
taaatattccaaa

SEQ ID NO: 722269 - DNA, 13 bp, C. elegans
taaatattccatt

SEQ ID NO: 722270 - DNA, 13 bp, C. elegans
taaatattcgatt

SEQ ID NO: 722271 - DNA, 13 bp, C. elegans
taaatattcgttt

SEQ ID NO: 722272 - DNA, 13 bp, C. elegans
taaatattttcag

SEQ ID NO: 722273 - DNA, 13 bp, C. elegans
taaatattttgtg

SEQ ID NO: 722274 - DNA, 13 bp, C. elegans
taaatcaaaatga

SEQ ID NO: 722275 - DNA, 13 bp, C. elegans
taaatcaaagaat

SEQ ID NO: 722276 - DNA, 13 bp, C. elegans
taaatcaagaaat

SEQ ID NO: 722277 - DNA, 13 bp, C. elegans
taaatcagtgaaa

SEQ ID NO: 722278 - DNA, 13 bp, C. elegans
taaatcatcaatt

SEQ ID NO: 722279 - DNA, 13 bp, C. elegans
taaatcatttgaa

SEQ ID NO: 722280 - DNA, 13 bp, C. elegans
taaatccacacaa

SEQ ID NO: 722281 - DNA, 13 bp, C. elegans
taaatcgaaatgg

SEQ ID NO: 722282 - DNA, 13 bp, C. elegans
taaatcgacacaa

SEQ ID NO: 722283 - DNA, 13 bp, C. elegans
taaatcggatttt

SEQ ID NO: 722284 - DNA, 13 bp, C. elegans
taaatcggctaat

SEQ ID NO: 722285 - DNA, 13 bp, C. elegans
taaatctaagcct

SEQ ID NO: 722286 - DNA, 13 bp, C. elegans
taaatctacacag

SEQ ID NO: 722287 - DNA, 13 bp, C. elegans
taaatctattttg

SEQ ID NO: 722288 - DNA, 13 bp, C. elegans
taaatctcttcaa

SEQ ID NO: 722289 - DNA, 13 bp, C. elegans
taaatctgaaaat

SEQ ID NO: 722290 - DNA, 13 bp, C. elegans
taaatctgaaact

SEQ ID NO: 722291 - DNA, 13 bp, C. elegans
taaatctgaaagt

SEQ ID NO: 722292 - DNA, 13 bp, C. elegans
taaatcttgcaaa

SEQ ID NO: 722293 - DNA, 13 bp, C. elegans
taaatgaaaattg

SEQ ID NO: 722294 - DNA, 13 bp, C. elegans
taaatgaagatta

SEQ ID NO: 722295 - DNA, 13 bp, C. elegans
taaatgaagattt

SEQ ID NO: 722296 - DNA, 13 bp, C. elegans
taaatgaagttga

SEQ ID NO: 722297 - DNA, 13 bp, C. elegans
taaatgcaaaatg

SEQ ID NO: 722298 - DNA, 13 bp, C. elegans
taaatgcaaattt

SEQ ID NO: 722299 - DNA, 13 bp, C. elegans
taaatgccaaaaa

SEQ ID NO: 722300 - DNA, 13 bp, C. elegans
taaatgcgaaaaa

SEQ ID NO: 722301 - DNA, 13 bp, C. elegans
taaatgctcaaaa

SEQ ID NO: 722302 - DNA, 13 bp, C. elegans
taaatgctgaaac

SEQ ID NO: 722303 - DNA, 13 bp, C. elegans
taaatgctttttt

SEQ ID NO: 722304 - DNA, 13 bp, C. elegans
taaatggaaatat

SEQ ID NO: 722305 - DNA, 13 bp, C. elegans
taaatggtcgttt

SEQ ID NO: 722306 - DNA, 13 bp, C. elegans
taaatgtacattt

SEQ ID NO: 722307 - DNA, 13 bp, C. elegans
taaatgtatttca

SEQ ID NO: 722308 - DNA, 13 bp, C. elegans
taaatgtatttgt

SEQ ID NO: 722309 - DNA, 13 bp, C. elegans
taaatgtgaaagt

SEQ ID NO: 722310 - DNA, 13 bp, C. elegans
taaatgtgcaaaa

SEQ ID NO: 722311 - DNA, 13 bp, C. elegans
taaatgtgtgttg

SEQ ID NO: 722312 - DNA, 13 bp, C. elegans
taaatgttctcaa

SEQ ID NO: 722313 - DNA, 13 bp, C. elegans
taaatgttcttaa

SEQ ID NO: 722314 - DNA, 13 bp, C. elegans
taaatgtttcaaa

SEQ ID NO: 722315 - DNA, 13 bp, C. elegans
taaatgtttgaac

SEQ ID NO: 722316 - DNA, 13 bp, C. elegans
taaatgtttgaat

SEQ ID NO: 722317 - DNA, 13 bp, C. elegans
taaatgtttgctt

SEQ ID NO: 722318 - DNA, 13 bp, C. elegans
taaatgttttaca

SEQ ID NO: 722319 - DNA, 13 bp, C. elegans
taaatgttttcta

SEQ ID NO: 722320 - DNA, 13 bp, C. elegans
taaatgttttgaa

SEQ ID NO: 722321 - DNA, 14 bp, C. elegans
taaatgttttttct

SEQ ID NO: 722322 - DNA, 13 bp, C. elegans
taaattacagaaa

SEQ ID NO: 722323 - DNA, 13 bp, C. elegans
taaattagcattt

SEQ ID NO: 722324 - DNA, 13 bp, C. elegans
taaattagtttga

SEQ ID NO: 722325 - DNA, 13 bp, C. elegans
taaattatcgatt

SEQ ID NO: 722326 - DNA, 13 bp, C. elegans
taaattatctgaa

SEQ ID NO: 722327 - DNA, 13 bp, C. elegans
taaattatgagtt

SEQ ID NO: 722328 - DNA, 13 bp, C. elegans
taaattattcacc

SEQ ID NO: 722329 - DNA, 13 bp, C. elegans
taaattattctgt

SEQ ID NO: 722330 - DNA, 13 bp, C. elegans
taaattattgcaa

SEQ ID NO: 722331 - DNA, 13 bp, C. elegans
taaattattttcg

SEQ ID NO: 722332 - DNA, 13 bp, C. elegans
taaattcaaagtt

SEQ ID NO: 722333 - DNA, 13 bp, C. elegans
taaattcaacatt

SEQ ID NO: 722334 - DNA, 13 bp, C. elegans
taaattcacaatt

SEQ ID NO: 722335 - DNA, 13 bp, C. elegans
taaattcactaaa

SEQ ID NO: 722336 - DNA, 13 bp, C. elegans
taaattcagtttt

SEQ ID NO: 722337 - DNA, 13 bp, C. elegans
taaattccagaaa

SEQ ID NO: 722338 - DNA, 13 bp, C. elegans
taaattccatttt

SEQ ID NO: 722339 - DNA, 13 bp, C. elegans
taaattccgaaat

SEQ ID NO: 722340 - DNA, 13 bp, C. elegans
taaattcctcatc

SEQ ID NO: 722341 - DNA, 13 bp, C. elegans
taaattcgaaaaa

SEQ ID NO: 722342 - DNA, 13 bp, C. elegans
taaattcgaataa

SEQ ID NO: 722343 - DNA, 13 bp, C. elegans
taaattcgtattt

SEQ ID NO: 722344 - DNA, 13 bp, C. elegans
taaattcttcaat

SEQ ID NO: 722345 - DNA, 13 bp, C. elegans
taaattctttcaa

SEQ ID NO: 722346 - DNA, 13 bp, C. elegans
taaattctttgaa

SEQ ID NO: 722347 - DNA, 13 bp, C. elegans
taaattgaaaatc

SEQ ID NO: 722348 - DNA, 13 bp, C. elegans
taaattgaaagat

SEQ ID NO: 722349 - DNA, 13 bp, C. elegans
taaattgaacaaa

SEQ ID NO: 722350 - DNA, 13 bp, C. elegans
taaattgaatcaa

SEQ ID NO: 722351 - DNA, 13 bp, C. elegans
taaattgccgatt

SEQ ID NO: 722352 - DNA, 13 bp, C. elegans
taaattgctggaa

SEQ ID NO: 722353 - DNA, 13 bp, C. elegans
taaattggaattt

SEQ ID NO: 722354 - DNA, 13 bp, C. elegans
taaattggatttt

SEQ ID NO: 722355 - DNA, 13 bp, C. elegans
taaattggcaaat

SEQ ID NO: 722356 - DNA, 13 bp, C. elegans
taaattgtactac

SEQ ID NO: 722357 - DNA, 13 bp, C. elegans
taaattgtatact

SEQ ID NO: 722358 - DNA, 13 bp, C. elegans
taaattgtggttt

SEQ ID NO: 722359 - DNA, 13 bp, C. elegans
taaattgttactt

SEQ ID NO: 722360 - DNA, 13 bp, C. elegans
taaattgttgcaa

SEQ ID NO: 722361 - DNA, 13 bp, C. elegans
taaattgtttcaa

SEQ ID NO: 722362 - DNA, 13 bp, C. elegans
taaattgttttca

SEQ ID NO: 722363 - DNA, 13 bp, C. elegans
taaatttatgtga

SEQ ID NO: 722364 - DNA, 13 bp, C. elegans
taaatttatttcg

SEQ ID NO: 722365 - DNA, 13 bp, C. elegans
taaatttcaaaca

SEQ ID NO: 722366 - DNA, 13 bp, C. elegans
taaatttcaactg

SEQ ID NO: 722367 - DNA, 13 bp, C. elegans
taaatttcatcaa

SEQ ID NO: 722368 - DNA, 13 bp, C. elegans
taaatttccaaaa

SEQ ID NO: 722369 - DNA, 13 bp, C. elegans
taaatttccaatt

SEQ ID NO: 722370 - DNA, 13 bp, C. elegans
taaatttccagaa

SEQ ID NO: 722371 - DNA, 13 bp, C. elegans
taaatttccccaa

SEQ ID NO: 722372 - DNA, 13 bp, C. elegans
taaatttccctcc

SEQ ID NO: 722373 - DNA, 14 bp, C. elegans
taaatttcgaattt

SEQ ID NO: 722374 - DNA, 13 bp, C. elegans
taaatttctccaa

SEQ ID NO: 722375 - DNA, 13 bp, C. elegans
taaatttctcgaa

SEQ ID NO: 722376 - DNA, 13 bp, C. elegans
taaatttctgaaa

SEQ ID NO: 722377 - DNA, 13 bp, C. elegans
taaatttcttcca

SEQ ID NO: 722378 - DNA, 13 bp, C. elegans
taaatttgacaaa

SEQ ID NO: 722379 - DNA, 13 bp, C. elegans
taaatttgacatt

SEQ ID NO: 722380 - DNA, 13 bp, C. elegans
taaatttgagaaa

SEQ ID NO: 722381 - DNA, 13 bp, C. elegans
taaatttgcaaaa

SEQ ID NO: 722382 - DNA, 13 bp, C. elegans
taaatttgccgaa

SEQ ID NO: 722383 - DNA, 13 bp, C. elegans
taaatttggaaca

SEQ ID NO: 722384 - DNA, 13 bp, C. elegans
taaatttgtagaa

SEQ ID NO: 722385 - DNA, 13 bp, C. elegans
taaatttgtagtt

SEQ ID NO: 722386 - DNA, 13 bp, C. elegans
taaattttaagct

SEQ ID NO: 722387 - DNA, 13 bp, C. elegans
taaattttcacat

SEQ ID NO: 722388 - DNA, 13 bp, C. elegans
taaattttccaaa

SEQ ID NO: 722389 - DNA, 13 bp, C. elegans
taaattttcccaa

SEQ ID NO: 722390 - DNA, 14 bp, C. elegans
taaattttctcaaa

SEQ ID NO: 722391 - DNA, 13 bp, C. elegans
taaattttgagta

SEQ ID NO: 722392 - DNA, 13 bp, C. elegans
taaattttgatca

SEQ ID NO: 722393 - DNA, 13 bp, C. elegans
taaattttgatga

SEQ ID NO: 722394 - DNA, 13 bp, C. elegans
taaattttggaaa

SEQ ID NO: 722395 - DNA, 13 bp, C. elegans
taaattttggtgt

SEQ ID NO: 722396 - DNA, 13 bp, C. elegans
taaattttgtaga

SEQ ID NO: 722397 - DNA, 13 bp, C. elegans
taaattttgtgaa

SEQ ID NO: 722398 - DNA, 13 bp, C. elegans
taaattttgttga

SEQ ID NO: 722399 - DNA, 13 bp, C. elegans
taaatttttcgtt

SEQ ID NO: 722400 - DNA, 13 bp, C. elegans
taaatttttcttg

SEQ ID NO: 722401 - DNA, 13 bp, C. elegans
taaatttttgaga

SEQ ID NO: 722402 - DNA, 13 bp, C. elegans
taaattttttgca

SEQ ID NO: 722403 - DNA, 13 bp, C. elegans
taaatttttttcg

SEQ ID NO: 722404 - DNA, 13 bp, C. elegans
taacaaaaaatgt

SEQ ID NO: 722405 - DNA, 13 bp, C. elegans
taacaaaaactga

SEQ ID NO: 722406 - DNA, 13 bp, C. elegans
taacaaaaatttc

SEQ ID NO: 722407 - DNA, 13 bp, C. elegans
taacaaaacattt

SEQ ID NO: 722408 - DNA, 13 bp, C. elegans
taacaaaatttga

SEQ ID NO: 722409 - DNA, 13 bp, C. elegans
taacaacttgaaa

SEQ ID NO: 722410 - DNA, 13 bp, C. elegans
taacaataaattg

SEQ ID NO: 722411 - DNA, 13 bp, C. elegans
taacaataacatt

SEQ ID NO: 722412 - DNA, 13 bp, C. elegans
taacaatatgttt

SEQ ID NO: 722413 - DNA, 13 bp, C. elegans
taacaatttctgg

SEQ ID NO: 722414 - DNA, 13 bp, C. elegans
taacaatttgatt

SEQ ID NO: 722415 - DNA, 13 bp, C. elegans
taacaattttaca

SEQ ID NO: 722416 - DNA, 13 bp, C. elegans
taacaattttcca

SEQ ID NO: 722417 - DNA, 13 bp, C. elegans
taacaatttttgt

SEQ ID NO: 722418 - DNA, 13 bp, C. elegans
taacacggtttca

SEQ ID NO: 722419 - DNA, 13 bp, C. elegans
taacacttttcaa

SEQ ID NO: 722420 - DNA, 13 bp, C. elegans
taacagttatttt

SEQ ID NO: 722421 - DNA, 13 bp, C. elegans
taacagttttaaa

SEQ ID NO: 722422 - DNA, 13 bp, C. elegans
taacataaaatcc

SEQ ID NO: 722423 - DNA, 13 bp, C. elegans
taacatacaattt

SEQ ID NO: 722424 - DNA, 13 bp, C. elegans
taacatcggccaa

SEQ ID NO: 722425 - DNA, 13 bp, C. elegans
taacatgacaaaa

SEQ ID NO: 722426 - DNA, 13 bp, C. elegans
taacatgtttatt

SEQ ID NO: 722427 - DNA, 13 bp, C. elegans
taacattccaaaa

SEQ ID NO: 722428 - DNA, 13 bp, C. elegans
taacattgaaaaa

SEQ ID NO: 722429 - DNA, 13 bp, C. elegans
taacattgaaatt

SEQ ID NO: 722430 - DNA, 13 bp, C. elegans
taacatttatttc

SEQ ID NO: 722431 - DNA, 13 bp, C. elegans
taacatttcaatt

SEQ ID NO: 722432 - DNA, 13 bp, C. elegans
taacatttccaaa

SEQ ID NO: 722433 - DNA, 13 bp, C. elegans
taacatttccatt

SEQ ID NO: 722434 - DNA, 13 bp, C. elegans
taacattttcaaa

SEQ ID NO: 722435 - DNA, 13 bp, C. elegans
taacattttcaga

SEQ ID NO: 722436 - DNA, 13 bp, C. elegans
taacattttctaa

SEQ ID NO: 722437 - DNA, 13 bp, C. elegans
taacattttgaaa

SEQ ID NO: 722438 - DNA, 13 bp, C. elegans
taacatttttcaa

SEQ ID NO: 722439 - DNA, 13 bp, C. elegans
taacatttttctg

SEQ ID NO: 722440 - DNA, 13 bp, C. elegans
taaccaattattt

SEQ ID NO: 722441 - DNA, 13 bp, C. elegans
taaccattttcat

SEQ ID NO: 722442 - DNA, 13 bp, C. elegans
taacccaattctc

SEQ ID NO: 722443 - DNA, 13 bp, C. elegans
taacccaattttt

SEQ ID NO: 722444 - DNA, 13 bp, C. elegans
taaccccaaaaat

SEQ ID NO: 722445 - DNA, 13 bp, C. elegans
taaccgaaaaatc

SEQ ID NO: 722446 - DNA, 13 bp, C. elegans
taacctagatatt

SEQ ID NO: 722447 - DNA, 13 bp, C. elegans
taacgaaaatttg

SEQ ID NO: 722448 - DNA, 13 bp, C. elegans
taacgattttttt

SEQ ID NO: 722449 - DNA, 13 bp, C. elegans
taacggatttttc

SEQ ID NO: 722450 - DNA, 13 bp, C. elegans
taacgtaattttt

SEQ ID NO: 722451 - DNA, 13 bp, C. elegans
taactaaaacttt

SEQ ID NO: 722452 - DNA, 13 bp, C. elegans
taactaattttca

SEQ ID NO: 722453 - DNA, 13 bp, C. elegans
taactataaaact

SEQ ID NO: 722454 - DNA, 13 bp, C. elegans
taactattcgaaa

SEQ ID NO: 722455 - DNA, 13 bp, C. elegans
taactatttgttt

SEQ ID NO: 722456 - DNA, 13 bp, C. elegans
taactattttgtt

SEQ ID NO: 722457 - DNA, 13 bp, C. elegans
taactcaaaaact

SEQ ID NO: 722458 - DNA, 13 bp, C. elegans
taactcaagaata

SEQ ID NO: 722459 - DNA, 13 bp, C. elegans
taactcaattttg

SEQ ID NO: 722460 - DNA, 13 bp, C. elegans
taactcccccatc

SEQ ID NO: 722461 - DNA, 13 bp, C. elegans
taactctgaaact

SEQ ID NO: 722462 - DNA, 13 bp, C. elegans
taactgaaaaaat

SEQ ID NO: 722463 - DNA, 13 bp, C. elegans
taactgaaacatt

SEQ ID NO: 722464 - DNA, 13 bp, C. elegans
taactgaaatttc

SEQ ID NO: 722465 - DNA, 13 bp, C. elegans
taactgaactttt

SEQ ID NO: 722466 - DNA, 13 bp, C. elegans
taactgataaata

SEQ ID NO: 722467 - DNA, 13 bp, C. elegans
taactgataattt

SEQ ID NO: 722468 - DNA, 13 bp, C. elegans
taactgtgaaaat

SEQ ID NO: 722469 - DNA, 13 bp, C. elegans
taacttaaaattc

SEQ ID NO: 722470 - DNA, 13 bp, C. elegans
taacttacaaaat

SEQ ID NO: 722471 - DNA, 13 bp, C. elegans
taacttattttca

SEQ ID NO: 722472 - DNA, 13 bp, C. elegans
taacttcaaattt

SEQ ID NO: 722473 - DNA, 13 bp, C. elegans
taacttcaacttt

SEQ ID NO: 722474 - DNA, 13 bp, C. elegans
taacttcaagttt

SEQ ID NO: 722475 - DNA, 13 bp, C. elegans
taacttcaattta

SEQ ID NO: 722476 - DNA, 13 bp, C. elegans
taacttcagaaat

SEQ ID NO: 722477 - DNA, 13 bp, C. elegans
taacttccaattt

SEQ ID NO: 722478 - DNA, 13 bp, C. elegans
taacttcggaata

SEQ ID NO: 722479 - DNA, 13 bp, C. elegans
taacttctacaaa

SEQ ID NO: 722480 - DNA, 13 bp, C. elegans
taacttgcttcaa

SEQ ID NO: 722481 - DNA, 13 bp, C. elegans
taacttggcacat

SEQ ID NO: 722482 - DNA, 13 bp, C. elegans
taacttggcttaa

SEQ ID NO: 722483 - DNA, 13 bp, C. elegans
taactttgaaaaa

SEQ ID NO: 722484 - DNA, 13 bp, C. elegans
taactttgaaaat

SEQ ID NO: 722485 - DNA, 13 bp, C. elegans
taactttgtattt

SEQ ID NO: 722486 - DNA, 13 bp, C. elegans
taacttttatttg

SEQ ID NO: 722487 - DNA, 13 bp, C. elegans
taacttttctcaa

SEQ ID NO: 722488 - DNA, 13 bp, C. elegans
taacttttctgaa

SEQ ID NO: 722489 - DNA, 13 bp, C. elegans
taacttttgataa

SEQ ID NO: 722490 - DNA, 13 bp, C. elegans
taacttttgattt

SEQ ID NO: 722491 - DNA, 13 bp, C. elegans
taacttttgtatt

SEQ ID NO: 722492 - DNA, 13 bp, C. elegans
taactttttggta

SEQ ID NO: 722493 - DNA, 13 bp, C. elegans
taacttttttcag

SEQ ID NO: 722494 - DNA, 13 bp, C. elegans
taacttttttgag

SEQ ID NO: 722495 - DNA, 13 bp, C. elegans
taagaaaatggcg

SEQ ID NO: 722496 - DNA, 13 bp, C. elegans
taagaaacaattt

SEQ ID NO: 722497 - DNA, 13 bp, C. elegans
taagaacaatatg

SEQ ID NO: 722498 - DNA, 13 bp, C. elegans
taagaatattgaa

SEQ ID NO: 722499 - DNA, 13 bp, C. elegans
taagaattcaaaa

SEQ ID NO: 722500 - DNA, 13 bp, C. elegans
taagaattgcaaa

SEQ ID NO: 722501 - DNA, 13 bp, C. elegans
taagaattgtttt

SEQ ID NO: 722502 - DNA, 13 bp, C. elegans
taagaatttgaaa

SEQ ID NO: 722503 - DNA, 13 bp, C. elegans
taagaatttgttt

SEQ ID NO: 722504 - DNA, 13 bp, C. elegans
taagacatgggct

SEQ ID NO: 722505 - DNA, 13 bp, C. elegans
taagacatttttg

SEQ ID NO: 722506 - DNA, 13 bp, C. elegans
taagactgaactg

SEQ ID NO: 722507 - DNA, 13 bp, C. elegans
taagacttttttg

SEQ ID NO: 722508 - DNA, 13 bp, C. elegans
taagagatatcgc

SEQ ID NO: 722509 - DNA, 13 bp, C. elegans
taagattcaaaaa

SEQ ID NO: 722510 - DNA, 13 bp, C. elegans
taagattttccaa

SEQ ID NO: 722511 - DNA, 13 bp, C. elegans
taagattttcttt

SEQ ID NO: 722512 - DNA, 13 bp, C. elegans
taagattttgaaa

SEQ ID NO: 722513 - DNA, 13 bp, C. elegans
taagccaaaaaag

SEQ ID NO: 722514 - DNA, 13 bp, C. elegans
taagcccaagcct

SEQ ID NO: 722515 - DNA, 13 bp, C. elegans
taagccccgccca

SEQ ID NO: 722516 - DNA, 13 bp, C. elegans
taagccgaagcct

SEQ ID NO: 722517 - DNA, 13 bp, C. elegans
taagcctaaaaat

SEQ ID NO: 722518 - DNA, 13 bp, C. elegans
taagcctaaaatt

SEQ ID NO: 722519 - DNA, 13 bp, C. elegans
taagcctaagccc

SEQ ID NO: 722520 - DNA, 13 bp, C. elegans
taagcctgaacct

SEQ ID NO: 722521 - DNA, 13 bp, C. elegans
taagcgatttttg

SEQ ID NO: 722522 - DNA, 13 bp, C. elegans
taagctccgccca

SEQ ID NO: 722523 - DNA, 13 bp, C. elegans
taagctgaaaaaa

SEQ ID NO: 722524 - DNA, 13 bp, C. elegans
taagcttaaacct

SEQ ID NO: 722525 - DNA, 13 bp, C. elegans
taagcttaagtct

SEQ ID NO: 722526 - DNA, 13 bp, C. elegans
taagcttgaaatc

SEQ ID NO: 722527 - DNA, 13 bp, C. elegans
taagctttttcaa

SEQ ID NO: 722528 - DNA, 13 bp, C. elegans
taaggaaaatgtt

SEQ ID NO: 722529 - DNA, 13 bp, C. elegans
taaggaaagattt

SEQ ID NO: 722530 - DNA, 13 bp, C. elegans
taaggttactgta

SEQ ID NO: 722531 - DNA, 13 bp, C. elegans
taaggttttgaaa

SEQ ID NO: 722532 - DNA, 13 bp, C. elegans
taagtaagtaagt

SEQ ID NO: 722533 - DNA, 13 bp, C. elegans
taagtaggtcaaa

SEQ ID NO: 722534 - DNA, 13 bp, C. elegans
taagtatgaaatt

SEQ ID NO: 722535 - DNA, 13 bp, C. elegans
taagtcaaaaaat

SEQ ID NO: 722536 - DNA, 13 bp, C. elegans
taagtctgagcct

SEQ ID NO: 722537 - DNA, 13 bp, C. elegans
taagtgaaatttt

SEQ ID NO: 722538 - DNA, 13 bp, C. elegans
taagtgtgtgttg

SEQ ID NO: 722539 - DNA, 13 bp, C. elegans
taagttattttct

SEQ ID NO: 722540 - DNA, 13 bp, C. elegans
taagttgttgaaa

SEQ ID NO: 722541 - DNA, 13 bp, C. elegans
taagtttaggctt

SEQ ID NO: 722542 - DNA, 13 bp, C. elegans
taagtttatcaaa

SEQ ID NO: 722543 - DNA, 13 bp, C. elegans
taagttttatgaa

SEQ ID NO: 722544 - DNA, 13 bp, C. elegans
taagttttccaaa

SEQ ID NO: 722545 - DNA, 13 bp, C. elegans
taagttttgatat

SEQ ID NO: 722546 - DNA, 13 bp, C. elegans
taagtttttggca

SEQ ID NO: 722547 - DNA, 13 bp, C. elegans
taagtttttgtac

SEQ ID NO: 722548 - DNA, 13 bp, C. elegans
taataaaaattgc

SEQ ID NO: 722549 - DNA, 13 bp, C. elegans
taataaaactatc

SEQ ID NO: 722550 - DNA, 13 bp, C. elegans
taataaaactgtt

SEQ ID NO: 722551 - DNA, 13 bp, C. elegans
taataaactagaa

SEQ ID NO: 722552 - DNA, 13 bp, C. elegans
taataaatgttca

SEQ ID NO: 722553 - DNA, 13 bp, C. elegans
taataaggttttt

SEQ ID NO: 722554 - DNA, 13 bp, C. elegans
taataatcgtttt

SEQ ID NO: 722555 - DNA, 13 bp, C. elegans
taataatgaaaca

SEQ ID NO: 722556 - DNA, 13 bp, C. elegans
taataatgttttc

SEQ ID NO: 722557 - DNA, 13 bp, C. elegans
taataattctcaa

SEQ ID NO: 722558 - DNA, 13 bp, C. elegans
taataattcttct

SEQ ID NO: 722559 - DNA, 13 bp, C. elegans
taataattgccta

SEQ ID NO: 722560 - DNA, 13 bp, C. elegans
taataattttcag

SEQ ID NO: 722561 - DNA, 13 bp, C. elegans
taataattttcca

SEQ ID NO: 722562 - DNA, 13 bp, C. elegans
taataatttttcg

SEQ ID NO: 722563 - DNA, 13 bp, C. elegans
taatacacaagta

SEQ ID NO: 722564 - DNA, 13 bp, C. elegans
taatacacaattt

SEQ ID NO: 722565 - DNA, 13 bp, C. elegans
taataccaatttt

SEQ ID NO: 722566 - DNA, 13 bp, C. elegans
taatagtaatagt

SEQ ID NO: 722567 - DNA, 13 bp, C. elegans
taatagtcttgca

SEQ ID NO: 722568 - DNA, 13 bp, C. elegans
taatagtttttga

SEQ ID NO: 722569 - DNA, 13 bp, C. elegans
taatatcaaagtt

SEQ ID NO: 722570 - DNA, 13 bp, C. elegans
taatatccgatat

SEQ ID NO: 722571 - DNA, 13 bp, C. elegans
taatattccattt

SEQ ID NO: 722572 - DNA, 13 bp, C. elegans
taatattctcaaa

SEQ ID NO: 722573 - DNA, 13 bp, C. elegans
taatattctcatt

SEQ ID NO: 722574 - DNA, 13 bp, C. elegans
taatattctgaaa

SEQ ID NO: 722575 - DNA, 13 bp, C. elegans
taatattggaaaa

SEQ ID NO: 722576 - DNA, 13 bp, C. elegans
taatattggaatt

SEQ ID NO: 722577 - DNA, 13 bp, C. elegans
taatattgtttca

SEQ ID NO: 722578 - DNA, 13 bp, C. elegans
taatatttattgg

SEQ ID NO: 722579 - DNA, 13 bp, C. elegans
taatatttcagtt

SEQ ID NO: 722580 - DNA, 13 bp, C. elegans
taatatttcgatt

SEQ ID NO: 722581 - DNA, 13 bp, C. elegans
taatattttctga

SEQ ID NO: 722582 - DNA, 13 bp, C. elegans
taatattttgttc

SEQ ID NO: 722583 - DNA, 13 bp, C. elegans
taatatttttcgg

SEQ ID NO: 722584 - DNA, 13 bp, C. elegans
taatcaaaaagtt

SEQ ID NO: 722585 - DNA, 13 bp, C. elegans
taatcaaaaatgt

SEQ ID NO: 722586 - DNA, 13 bp, C. elegans
taatcaaaatttc

SEQ ID NO: 722587 - DNA, 13 bp, C. elegans
taatcaaactttt

SEQ ID NO: 722588 - DNA, 13 bp, C. elegans
taatcaaagttaa

SEQ ID NO: 722589 - DNA, 13 bp, C. elegans
taatcaaattgtg

SEQ ID NO: 722590 - DNA, 13 bp, C. elegans
taatcaacaattt

SEQ ID NO: 722591 - DNA, 13 bp, C. elegans
taatcaagttttt

SEQ ID NO: 722592 - DNA, 13 bp, C. elegans
taatcaatcaata

SEQ ID NO: 722593 - DNA, 13 bp, C. elegans
taatcaatcattt

SEQ ID NO: 722594 - DNA, 13 bp, C. elegans
taatcactttttg

SEQ ID NO: 722595 - DNA, 13 bp, C. elegans
taatcagaaaata

SEQ ID NO: 722596 - DNA, 13 bp, C. elegans
taatcagcaaaaa

SEQ ID NO: 722597 - DNA, 13 bp, C. elegans
taatcataatcat

SEQ ID NO: 722598 - DNA, 13 bp, C. elegans
taatcataattgt

SEQ ID NO: 722599 - DNA, 13 bp, C. elegans
taatcatacattt

SEQ ID NO: 722600 - DNA, 13 bp, C. elegans
taatcatcatcaa

SEQ ID NO: 722601 - DNA, 13 bp, C. elegans
taatcatttgaat

SEQ ID NO: 722602 - DNA, 13 bp, C. elegans
taatcattttcag

SEQ ID NO: 722603 - DNA, 13 bp, C. elegans
taatcattttgtt

SEQ ID NO: 722604 - DNA, 13 bp, C. elegans
taatccaactttt

SEQ ID NO: 722605 - DNA, 13 bp, C. elegans
taatccatcaaat

SEQ ID NO: 722606 - DNA, 13 bp, C. elegans
taatccatcattt

SEQ ID NO: 722607 - DNA, 13 bp, C. elegans
taatccatctttt

SEQ ID NO: 722608 - DNA, 13 bp, C. elegans
taatcccacagta

SEQ ID NO: 722609 - DNA, 13 bp, C. elegans
taatcgaaaattt

SEQ ID NO: 722610 - DNA, 13 bp, C. elegans
taatcgacttttc

SEQ ID NO: 722611 - DNA, 13 bp, C. elegans
taatcgagaacta

SEQ ID NO: 722612 - DNA, 13 bp, C. elegans
taatcgataaaaa

SEQ ID NO: 722613 - DNA, 13 bp, C. elegans
taatcggaaaaat

SEQ ID NO: 722614 - DNA, 13 bp, C. elegans
taatcggcaaaaa

SEQ ID NO: 722615 - DNA, 13 bp, C. elegans
taatcgtttttaa

SEQ ID NO: 722616 - DNA, 13 bp, C. elegans
taatctaaatgaa

SEQ ID NO: 722617 - DNA, 13 bp, C. elegans
taatctacataaa

SEQ ID NO: 722618 - DNA, 13 bp, C. elegans
taatctatgaaaa

SEQ ID NO: 722619 - DNA, 13 bp, C. elegans
taatctctgaaaa

SEQ ID NO: 722620 - DNA, 13 bp, C. elegans
taatctgaaattt

SEQ ID NO: 722621 - DNA, 13 bp, C. elegans
taatgaaaaattg

SEQ ID NO: 722622 - DNA, 13 bp, C. elegans
taatgaaaattgg

SEQ ID NO: 722623 - DNA, 13 bp, C. elegans
taatgaaacaatt

SEQ ID NO: 722624 - DNA, 13 bp, C. elegans
taatgaaacttct

SEQ ID NO: 722625 - DNA, 13 bp, C. elegans
taatgaattcaaa

SEQ ID NO: 722626 - DNA, 13 bp, C. elegans
taatgaattgaaa

SEQ ID NO: 722627 - DNA, 13 bp, C. elegans
taatgatacattt

SEQ ID NO: 722628 - DNA, 13 bp, C. elegans
taatgatattttg

SEQ ID NO: 722629 - DNA, 13 bp, C. elegans
taatgatgatgat

SEQ ID NO: 722630 - DNA, 13 bp, C. elegans
taatgatttgaaa

SEQ ID NO: 722631 - DNA, 13 bp, C. elegans
taatgatttttga

SEQ ID NO: 722632 - DNA, 13 bp, C. elegans
taatgcaaatttt

SEQ ID NO: 722633 - DNA, 13 bp, C. elegans
taatgcaacaaaa

SEQ ID NO: 722634 - DNA, 13 bp, C. elegans
taatgcattttga

SEQ ID NO: 722635 - DNA, 13 bp, C. elegans
taatgcatttttt

SEQ ID NO: 722636 - DNA, 13 bp, C. elegans
taatgctaatttt

SEQ ID NO: 722637 - DNA, 13 bp, C. elegans
taatgctacagta

SEQ ID NO: 722638 - DNA, 13 bp, C. elegans
taatggaaaatat

SEQ ID NO: 722639 - DNA, 13 bp, C. elegans
taatggattttca

SEQ ID NO: 722640 - DNA, 13 bp, C. elegans
taatggccaaaat

SEQ ID NO: 722641 - DNA, 13 bp, C. elegans
taatgtattgaaa

SEQ ID NO: 722642 - DNA, 13 bp, C. elegans
taatgtcggaaaa

SEQ ID NO: 722643 - DNA, 13 bp, C. elegans
taatgtctcattc

SEQ ID NO: 722644 - DNA, 13 bp, C. elegans
taatgtgaaataa

SEQ ID NO: 722645 - DNA, 13 bp, C. elegans
taatgtgcatgtt

SEQ ID NO: 722646 - DNA, 13 bp, C. elegans
taatgtgttcttt

SEQ ID NO: 722647 - DNA, 13 bp, C. elegans
taatgttcaatta

SEQ ID NO: 722648 - DNA, 13 bp, C. elegans
taatgttcattaa

SEQ ID NO: 722649 - DNA, 13 bp, C. elegans
taatgttgcaaaa

SEQ ID NO: 722650 - DNA, 13 bp, C. elegans
taatgtttcacat

SEQ ID NO: 722651 - DNA, 13 bp, C. elegans
taatgtttcagaa

SEQ ID NO: 722652 - DNA, 13 bp, C. elegans
taatgtttttgaa

SEQ ID NO: 722653 - DNA, 13 bp, C. elegans
taattaaaatcga

SEQ ID NO: 722654 - DNA, 13 bp, C. elegans
taattaatttcag

SEQ ID NO: 722655 - DNA, 13 bp, C. elegans
taattaatttctc

SEQ ID NO: 722656 - DNA, 13 bp, C. elegans
taattatgtgaaa

SEQ ID NO: 722657 - DNA, 13 bp, C. elegans
taattatgtttca

SEQ ID NO: 722658 - DNA, 13 bp, C. elegans
taattattggaat

SEQ ID NO: 722659 - DNA, 13 bp, C. elegans
taattatttccag

SEQ ID NO: 722660 - DNA, 13 bp, C. elegans
taattattttcag

SEQ ID NO: 722661 - DNA, 13 bp, C. elegans
taattcaaaatca

SEQ ID NO: 722662 - DNA, 13 bp, C. elegans
taattcaaaattg

SEQ ID NO: 722663 - DNA, 13 bp, C. elegans
taattcaaattag

SEQ ID NO: 722664 - DNA, 13 bp, C. elegans
taattcaagaaaa

SEQ ID NO: 722665 - DNA, 13 bp, C. elegans
taattcaatagtt

SEQ ID NO: 722666 - DNA, 13 bp, C. elegans
taattcaatgttt

SEQ ID NO: 722667 - DNA, 13 bp, C. elegans
taattcaattact

SEQ ID NO: 722668 - DNA, 13 bp, C. elegans
taattcaattcaa

SEQ ID NO: 722669 - DNA, 13 bp, C. elegans
taattcaattcat

SEQ ID NO: 722670 - DNA, 13 bp, C. elegans
taattcaattttg

SEQ ID NO: 722671 - DNA, 13 bp, C. elegans
taattcagaattt

SEQ ID NO: 722672 - DNA, 13 bp, C. elegans
taattcatatttg

SEQ ID NO: 722673 - DNA, 13 bp, C. elegans
taattcatcaatt

SEQ ID NO: 722674 - DNA, 13 bp, C. elegans
taattcatgaaaa

SEQ ID NO: 722675 - DNA, 13 bp, C. elegans
taattcatgtatg

SEQ ID NO: 722676 - DNA, 13 bp, C. elegans
taattcatgttga

SEQ ID NO: 722677 - DNA, 13 bp, C. elegans
taattcatttttg

SEQ ID NO: 722678 - DNA, 13 bp, C. elegans
taattccaaattt

SEQ ID NO: 722679 - DNA, 13 bp, C. elegans
taattccgatgat

SEQ ID NO: 722680 - DNA, 13 bp, C. elegans
taattcctaattt

SEQ ID NO: 722681 - DNA, 13 bp, C. elegans
taattcctattta

SEQ ID NO: 722682 - DNA, 13 bp, C. elegans
taattcgaaaaaa

SEQ ID NO: 722683 - DNA, 13 bp, C. elegans
taattcgaagttt

SEQ ID NO: 722684 - DNA, 13 bp, C. elegans
taattcgattttt

SEQ ID NO: 722685 - DNA, 13 bp, C. elegans
taattctatcaaa

SEQ ID NO: 722686 - DNA, 13 bp, C. elegans
taattctcaaaat

SEQ ID NO: 722687 - DNA, 13 bp, C. elegans
taattctcaattt

SEQ ID NO: 722688 - DNA, 13 bp, C. elegans
taattctcagttt

SEQ ID NO: 722689 - DNA, 13 bp, C. elegans
taattctccaaaa

SEQ ID NO: 722690 - DNA, 13 bp, C. elegans
taattctccaatt

SEQ ID NO: 722691 - DNA, 13 bp, C. elegans
taattctcggttt

SEQ ID NO: 722692 - DNA, 13 bp, C. elegans
taattctgaaatt

SEQ ID NO: 722693 - DNA, 13 bp, C. elegans
taattctgggttt

SEQ ID NO: 722694 - DNA, 13 bp, C. elegans
taattcttgaatt

SEQ ID NO: 722695 - DNA, 13 bp, C. elegans
taattgaattgat

SEQ ID NO: 722696 - DNA, 13 bp, C. elegans
taattgacaaaat

SEQ ID NO: 722697 - DNA, 13 bp, C. elegans
taattgacatttt

SEQ ID NO: 722698 - DNA, 13 bp, C. elegans
taattgataagaa

SEQ ID NO: 722699 - DNA, 13 bp, C. elegans
taattgatgaaat

SEQ ID NO: 722700 - DNA, 13 bp, C. elegans
taattgctcagaa

SEQ ID NO: 722701 - DNA, 13 bp, C. elegans
taattggaaaatg

SEQ ID NO: 722702 - DNA, 13 bp, C. elegans
taattggaaactt

SEQ ID NO: 722703 - DNA, 13 bp, C. elegans
taattggaaatat

SEQ ID NO: 722704 - DNA, 13 bp, C. elegans
taattggaaattt

SEQ ID NO: 722705 - DNA, 13 bp, C. elegans
taattgtaaaagt

SEQ ID NO: 722706 - DNA, 13 bp, C. elegans
taattgtaagttt

SEQ ID NO: 722707 - DNA, 13 bp, C. elegans
taattgtattcaa

SEQ ID NO: 722708 - DNA, 13 bp, C. elegans
taattgtcaaaaa

SEQ ID NO: 722709 - DNA, 13 bp, C. elegans
taattgtcatatt

SEQ ID NO: 722710 - DNA, 13 bp, C. elegans
taattgttatttc

SEQ ID NO: 722711 - DNA, 13 bp, C. elegans
taattgttcaact

SEQ ID NO: 722712 - DNA, 13 bp, C. elegans
taattgtttccaa

SEQ ID NO: 722713 - DNA, 13 bp, C. elegans
taattgtttgaaa

SEQ ID NO: 722714 - DNA, 13 bp, C. elegans
taattgtttgcaa

SEQ ID NO: 722715 - DNA, 13 bp, C. elegans
taattgttttcta

SEQ ID NO: 722716 - DNA, 13 bp, C. elegans
taattgttttgaa

SEQ ID NO: 722717 - DNA, 13 bp, C. elegans
taatttaagccac

SEQ ID NO: 722718 - DNA, 13 bp, C. elegans
taatttactcatt

SEQ ID NO: 722719 - DNA, 13 bp, C. elegans
taatttactctct

SEQ ID NO: 722720 - DNA, 13 bp, C. elegans
taatttagtttca

SEQ ID NO: 722721 - DNA, 13 bp, C. elegans
taatttatcagaa

SEQ ID NO: 722722 - DNA, 13 bp, C. elegans
taatttattcatc

SEQ ID NO: 722723 - DNA, 13 bp, C. elegans
taatttattctga

SEQ ID NO: 722724 - DNA, 13 bp, C. elegans
taatttattgctt

SEQ ID NO: 722725 - DNA, 13 bp, C. elegans
taatttatttcac

SEQ ID NO: 722726 - DNA, 13 bp, C. elegans
taatttcaaacaa

SEQ ID NO: 722727 - DNA, 13 bp, C. elegans
taatttcaagaat

SEQ ID NO: 722728 - DNA, 13 bp, C. elegans
taatttcaggcaa

SEQ ID NO: 722729 - DNA, 13 bp, C. elegans
taatttcaggctt

SEQ ID NO: 722730 - DNA, 13 bp, C. elegans
taatttcatcaat

SEQ ID NO: 722731 - DNA, 13 bp, C. elegans
taatttcatcatt

SEQ ID NO: 722732 - DNA, 13 bp, C. elegans
taatttcattgaa

SEQ ID NO: 722733 - DNA, 13 bp, C. elegans
taatttcattttg

SEQ ID NO: 722734 - DNA, 13 bp, C. elegans
taatttccaaaag

SEQ ID NO: 722735 - DNA, 13 bp, C. elegans
taatttccaaaat

SEQ ID NO: 722736 - DNA, 13 bp, C. elegans
taatttccaacaa

SEQ ID NO: 722737 - DNA, 13 bp, C. elegans
taatttccaactt

SEQ ID NO: 722738 - DNA, 13 bp, C. elegans
taatttccaattt

SEQ ID NO: 722739 - DNA, 13 bp, C. elegans
taatttccatgtt

SEQ ID NO: 722740 - DNA, 13 bp, C. elegans
taatttccgtttt

SEQ ID NO: 722741 - DNA, 13 bp, C. elegans
taatttcgaaatt

SEQ ID NO: 722742 - DNA, 13 bp, C. elegans
taatttcgaagat

SEQ ID NO: 722743 - DNA, 13 bp, C. elegans
taatttctacaaa

SEQ ID NO: 722744 - DNA, 13 bp, C. elegans
taatttctagatt

SEQ ID NO: 722745 - DNA, 13 bp, C. elegans
taatttctccatt

SEQ ID NO: 722746 - DNA, 13 bp, C. elegans
taatttctgaaaa

SEQ ID NO: 722747 - DNA, 13 bp, C. elegans
taatttctgatca

SEQ ID NO: 722748 - DNA, 13 bp, C. elegans
taatttctgcaaa

SEQ ID NO: 722749 - DNA, 13 bp, C. elegans
taatttctggctt

SEQ ID NO: 722750 - DNA, 13 bp, C. elegans
taatttgaaactt

SEQ ID NO: 722751 - DNA, 13 bp, C. elegans
taatttgaaagtt

SEQ ID NO: 722752 - DNA, 13 bp, C. elegans
taatttgaacttt

SEQ ID NO: 722753 - DNA, 13 bp, C. elegans
taatttgaatgaa

SEQ ID NO: 722754 - DNA, 13 bp, C. elegans
taatttgaatttc

SEQ ID NO: 722755 - DNA, 13 bp, C. elegans
taatttgattcaa

SEQ ID NO: 722756 - DNA, 13 bp, C. elegans
taatttgcaattt

SEQ ID NO: 722757 - DNA, 13 bp, C. elegans
taatttgcacttg

SEQ ID NO: 722758 - DNA, 13 bp, C. elegans
taatttgcgatgt

SEQ ID NO: 722759 - DNA, 13 bp, C. elegans
taatttggcaatt

SEQ ID NO: 722760 - DNA, 13 bp, C. elegans
taatttggcattt

SEQ ID NO: 722761 - DNA, 13 bp, C. elegans
taatttggcggtt

SEQ ID NO: 722762 - DNA, 13 bp, C. elegans
taatttgtttcaa

SEQ ID NO: 722763 - DNA, 13 bp, C. elegans
taatttgtttcag

SEQ ID NO: 722764 - DNA, 13 bp, C. elegans
taattttacgatt

SEQ ID NO: 722765 - DNA, 13 bp, C. elegans
taattttaggcaa

SEQ ID NO: 722766 - DNA, 13 bp, C. elegans
taattttagtgaa

SEQ ID NO: 722767 - DNA, 13 bp, C. elegans
taattttcaaagt

SEQ ID NO: 722768 - DNA, 13 bp, C. elegans
taattttcaagct

SEQ ID NO: 722769 - DNA, 13 bp, C. elegans
taattttcacatt

SEQ ID NO: 722770 - DNA, 13 bp, C. elegans
taattttcaccaa

SEQ ID NO: 722771 - DNA, 13 bp, C. elegans
taattttcagatt

SEQ ID NO: 722772 - DNA, 13 bp, C. elegans
taattttcagcat

SEQ ID NO: 722773 - DNA, 13 bp, C. elegans
taattttcaggcc

SEQ ID NO: 722774 - DNA, 13 bp, C. elegans
taattttcataac

SEQ ID NO: 722775 - DNA, 13 bp, C. elegans
taattttcatacc

SEQ ID NO: 722776 - DNA, 13 bp, C. elegans
taattttccaaaa

SEQ ID NO: 722777 - DNA, 13 bp, C. elegans
taattttccaaat

SEQ ID NO: 722778 - DNA, 13 bp, C. elegans
taattttccagtt

SEQ ID NO: 722779 - DNA, 13 bp, C. elegans
taattttccgaca

SEQ ID NO: 722780 - DNA, 13 bp, C. elegans
taattttcgatat

SEQ ID NO: 722781 - DNA, 13 bp, C. elegans
taattttcgattc

SEQ ID NO: 722782 - DNA, 13 bp, C. elegans
taattttctagat

SEQ ID NO: 722783 - DNA, 13 bp, C. elegans
taattttctatgt

SEQ ID NO: 722784 - DNA, 13 bp, C. elegans
taattttctgcca

SEQ ID NO: 722785 - DNA, 13 bp, C. elegans
taattttgaactt

SEQ ID NO: 722786 - DNA, 13 bp, C. elegans
taattttgacatt

SEQ ID NO: 722787 - DNA, 13 bp, C. elegans
taattttgatatc

SEQ ID NO: 722788 - DNA, 13 bp, C. elegans
taattttgatgat

SEQ ID NO: 722789 - DNA, 13 bp, C. elegans
taattttgcaatt

SEQ ID NO: 722790 - DNA, 13 bp, C. elegans
taattttggaaaa

SEQ ID NO: 722791 - DNA, 13 bp, C. elegans
taattttggaatt

SEQ ID NO: 722792 - DNA, 13 bp, C. elegans
taattttgggcaa

SEQ ID NO: 722793 - DNA, 13 bp, C. elegans
taattttggtgct

SEQ ID NO: 722794 - DNA, 14 bp, C. elegans
taatttttcagttt

SEQ ID NO: 722795 - DNA, 13 bp, C. elegans
taatttttcattg

SEQ ID NO: 722796 - DNA, 13 bp, C. elegans
taatttttccaaa

SEQ ID NO: 722797 - DNA, 13 bp, C. elegans
taatttttcccta

SEQ ID NO: 722798 - DNA, 13 bp, C. elegans
taatttttcgtta

SEQ ID NO: 722799 - DNA, 13 bp, C. elegans
taatttttctaca

SEQ ID NO: 722800 - DNA, 14 bp, C. elegans
taatttttctcgaa

SEQ ID NO: 722801 - DNA, 13 bp, C. elegans
taatttttctctg

SEQ ID NO: 722802 - DNA, 13 bp, C. elegans
taatttttctgaa

SEQ ID NO: 722803 - DNA, 13 bp, C. elegans
taatttttctgat

SEQ ID NO: 722804 - DNA, 13 bp, C. elegans
taatttttgcaaa

SEQ ID NO: 722805 - DNA, 13 bp, C. elegans
taatttttgcaat

SEQ ID NO: 722806 - DNA, 13 bp, C. elegans
taatttttggaaa

SEQ ID NO: 722807 - DNA, 13 bp, C. elegans
taatttttgggcg

SEQ ID NO: 722808 - DNA, 13 bp, C. elegans
taatttttgttca

SEQ ID NO: 722809 - DNA, 13 bp, C. elegans
taattttttcgat

SEQ ID NO: 722810 - DNA, 13 bp, C. elegans
taattttttctga

SEQ ID NO: 722811 - DNA, 13 bp, C. elegans
taattttttgctc

SEQ ID NO: 722812 - DNA, 13 bp, C. elegans
tacaaaaaaagtt

SEQ ID NO: 722813 - DNA, 13 bp, C. elegans
tacaaaaactttt

SEQ ID NO: 722814 - DNA, 13 bp, C. elegans
tacaaaaagtatc

SEQ ID NO: 722815 - DNA, 13 bp, C. elegans
tacaaaaataagt

SEQ ID NO: 722816 - DNA, 13 bp, C. elegans
tacaaaaatatga

SEQ ID NO: 722817 - DNA, 13 bp, C. elegans
tacaaaaatcgat

SEQ ID NO: 722818 - DNA, 13 bp, C. elegans
tacaaaaatgttt

SEQ ID NO: 722819 - DNA, 13 bp, C. elegans
tacaaaacaaatg

SEQ ID NO: 722820 - DNA, 13 bp, C. elegans
tacaaaacatttt

SEQ ID NO: 722821 - DNA, 13 bp, C. elegans
tacaaaactttaa

SEQ ID NO: 722822 - DNA, 13 bp, C. elegans
tacaaaatcattt

SEQ ID NO: 722823 - DNA, 13 bp, C. elegans
tacaaaatctcaa

SEQ ID NO: 722824 - DNA, 13 bp, C. elegans
tacaaaatgacat

SEQ ID NO: 722825 - DNA, 13 bp, C. elegans
tacaaaatgttta

SEQ ID NO: 722826 - DNA, 13 bp, C. elegans
tacaaaattcttc

SEQ ID NO: 722827 - DNA, 13 bp, C. elegans
tacaaaattgttc

SEQ ID NO: 722828 - DNA, 13 bp, C. elegans
tacaaaattgttt

SEQ ID NO: 722829 - DNA, 13 bp, C. elegans
tacaaaatttcga

SEQ ID NO: 722830 - DNA, 13 bp, C. elegans
tacaaacggacgg

SEQ ID NO: 722831 - DNA, 13 bp, C. elegans
tacaaactaattt

SEQ ID NO: 722832 - DNA, 13 bp, C. elegans
tacaaactacaac

SEQ ID NO: 722833 - DNA, 13 bp, C. elegans
tacaaactacatg

SEQ ID NO: 722834 - DNA, 13 bp, C. elegans
tacaaacttgttc

SEQ ID NO: 722835 - DNA, 13 bp, C. elegans
tacaaacttgttt

SEQ ID NO: 722836 - DNA, 13 bp, C. elegans
tacaaacttttat

SEQ ID NO: 722837 - DNA, 13 bp, C. elegans
tacaaactttttt

SEQ ID NO: 722838 - DNA, 13 bp, C. elegans
tacaaagaataca

SEQ ID NO: 722839 - DNA, 13 bp, C. elegans
tacaaagagcatc

SEQ ID NO: 722840 - DNA, 13 bp, C. elegans
tacaaagtacaaa

SEQ ID NO: 722841 - DNA, 13 bp, C. elegans
tacaaagtattca

SEQ ID NO: 722842 - DNA, 13 bp, C. elegans
tacaaagttaaaa

SEQ ID NO: 722843 - DNA, 13 bp, C. elegans
tacaaagttcaaa

SEQ ID NO: 722844 - DNA, 13 bp, C. elegans
tacaaagtttttg

SEQ ID NO: 722845 - DNA, 13 bp, C. elegans
tacaaataatgtt

SEQ ID NO: 722846 - DNA, 13 bp, C. elegans
tacaaataatttc

SEQ ID NO: 722847 - DNA, 13 bp, C. elegans
tacaaatactaca

SEQ ID NO: 722848 - DNA, 13 bp, C. elegans
tacaaatatgaaa

SEQ ID NO: 722849 - DNA, 13 bp, C. elegans
tacaaatctcaat

SEQ ID NO: 722850 - DNA, 13 bp, C. elegans
tacaaatgatttt

SEQ ID NO: 722851 - DNA, 13 bp, C. elegans
tacaaattacaat

SEQ ID NO: 722852 - DNA, 13 bp, C. elegans
tacaaattcaata

SEQ ID NO: 722853 - DNA, 13 bp, C. elegans
tacaaattcattt

SEQ ID NO: 722854 - DNA, 13 bp, C. elegans
tacaaattgtttc

SEQ ID NO: 722855 - DNA, 13 bp, C. elegans
tacaaatttccaa

SEQ ID NO: 722856 - DNA, 13 bp, C. elegans
tacaaatttgaat

SEQ ID NO: 722857 - DNA, 13 bp, C. elegans
tacaaattttgtt

SEQ ID NO: 722858 - DNA, 13 bp, C. elegans
tacaacatatttg

SEQ ID NO: 722859 - DNA, 13 bp, C. elegans
tacaacattttcc

SEQ ID NO: 722860 - DNA, 13 bp, C. elegans
tacaacattttct

SEQ ID NO: 722861 - DNA, 13 bp, C. elegans
tacaactacagta

SEQ ID NO: 722862 - DNA, 13 bp, C. elegans
tacaactcatttt

SEQ ID NO: 722863 - DNA, 14 bp, C. elegans
tacaaggttccatg

SEQ ID NO: 722864 - DNA, 13 bp, C. elegans
tacaagttttgaa

SEQ ID NO: 722865 - DNA, 13 bp, C. elegans
tacaagttttggt

SEQ ID NO: 722866 - DNA, 13 bp, C. elegans
tacaataaattca

SEQ ID NO: 722867 - DNA, 13 bp, C. elegans
tacaataattttg

SEQ ID NO: 722868 - DNA, 13 bp, C. elegans
tacaatattctaa

SEQ ID NO: 722869 - DNA, 23 bp, C. elegans
tacaatcaacgctggcctatact

SEQ ID NO: 722870 - DNA, 13 bp, C. elegans
tacaatctacaaa

SEQ ID NO: 722871 - DNA, 13 bp, C. elegans
tacaatgtattct

SEQ ID NO: 722872 - DNA, 13 bp, C. elegans
tacaatgtttcaa

SEQ ID NO: 722873 - DNA, 14 bp, C. elegans
tacaatgttttatt

SEQ ID NO: 722874 - DNA, 13 bp, C. elegans
tacaattattttc

SEQ ID NO: 722875 - DNA, 13 bp, C. elegans
tacaattcaaatt

SEQ ID NO: 722876 - DNA, 13 bp, C. elegans
tacaattgaaaaa

SEQ ID NO: 722877 - DNA, 13 bp, C. elegans
tacaattgttttc

SEQ ID NO: 722878 - DNA, 13 bp, C. elegans
tacaattgttttt

SEQ ID NO: 722879 - DNA, 13 bp, C. elegans
tacaatttcaaaa

SEQ ID NO: 722880 - DNA, 13 bp, C. elegans
tacaatttcaatt

SEQ ID NO: 722881 - DNA, 13 bp, C. elegans
tacaatttcacaa

SEQ ID NO: 722882 - DNA, 13 bp, C. elegans
tacaatttcagaa

SEQ ID NO: 722883 - DNA, 13 bp, C. elegans
tacaatttccaaa

SEQ ID NO: 722884 - DNA, 13 bp, C. elegans
tacaatttgaaac

SEQ ID NO: 722885 - DNA, 13 bp, C. elegans
tacaattttagtt

SEQ ID NO: 722886 - DNA, 13 bp, C. elegans
tacaattttcact

SEQ ID NO: 722887 - DNA, 13 bp, C. elegans
tacaattttccaa

SEQ ID NO: 722888 - DNA, 13 bp, C. elegans
tacaattttggcc

SEQ ID NO: 722889 - DNA, 13 bp, C. elegans
tacaatttttaca

SEQ ID NO: 722890 - DNA, 13 bp, C. elegans
tacaattttttgc

SEQ ID NO: 722891 - DNA, 13 bp, C. elegans
tacaattttttgt

SEQ ID NO: 722892 - DNA, 13 bp, C. elegans
tacacaaaagtat

SEQ ID NO: 722893 - DNA, 13 bp, C. elegans
tacacaaaattga

SEQ ID NO: 722894 - DNA, 13 bp, C. elegans
tacacaatttcaa

SEQ ID NO: 722895 - DNA, 13 bp, C. elegans
tacacaattttca

SEQ ID NO: 722896 - DNA, 13 bp, C. elegans
tacacaatttttt

SEQ ID NO: 722897 - DNA, 13 bp, C. elegans
tacacagaaactg

SEQ ID NO: 722898 - DNA, 13 bp, C. elegans
tacacatctggaa

SEQ ID NO: 722899 - DNA, 13 bp, C. elegans
tacacattttgtt

SEQ ID NO: 722900 - DNA, 13 bp, C. elegans
tacacatttttgg

SEQ ID NO: 722901 - DNA, 13 bp, C. elegans
tacacgaaaaaat

SEQ ID NO: 722902 - DNA, 13 bp, C. elegans
tacacgtggacaa

SEQ ID NO: 722903 - DNA, 13 bp, C. elegans
tacacgttttttt

SEQ ID NO: 722904 - DNA, 13 bp, C. elegans
tacactcaaaata

SEQ ID NO: 722905 - DNA, 13 bp, C. elegans
tacacttataata

SEQ ID NO: 722906 - DNA, 13 bp, C. elegans
tacactttttata

SEQ ID NO: 722907 - DNA, 13 bp, C. elegans
tacactttttcat

SEQ ID NO: 722908 - DNA, 13 bp, C. elegans
tacagaaaatgaa

SEQ ID NO: 722909 - DNA, 13 bp, C. elegans
tacagaaaattct

SEQ ID NO: 722910 - DNA, 13 bp, C. elegans
tacagaaaattga

SEQ ID NO: 722911 - DNA, 13 bp, C. elegans
tacagaaccccta

SEQ ID NO: 722912 - DNA, 13 bp, C. elegans
tacagaattactg

SEQ ID NO: 722913 - DNA, 13 bp, C. elegans
tacagaccgtttt

SEQ ID NO: 722914 - DNA, 28 bp, C. elegans
tacagagagtgtagatagttagagagtg

SEQ ID NO: 722915 - DNA, 13 bp, C. elegans
tacaggaacacaa

SEQ ID NO: 722916 - DNA, 13 bp, C. elegans
tacagtaacccaa

SEQ ID NO: 722917 - DNA, 13 bp, C. elegans
tacagtaacccac

SEQ ID NO: 722918 - DNA, 13 bp, C. elegans
tacagtaacccat

SEQ ID NO: 722919 - DNA, 13 bp, C. elegans
tacagtaaccccg

SEQ ID NO: 722920 - DNA, 13 bp, C. elegans
tacagtaaccctg

SEQ ID NO: 722921 - DNA, 13 bp, C. elegans
tacagtaaccggt

SEQ ID NO: 722922 - DNA, 13 bp, C. elegans
tacagtaaccttc

SEQ ID NO: 722923 - DNA, 13 bp, C. elegans
tacagtaagaaaa

SEQ ID NO: 722924 - DNA, 13 bp, C. elegans
tacagtaatccaa

SEQ ID NO: 722925 - DNA, 13 bp, C. elegans
tacagtaatccgt

SEQ ID NO: 722926 - DNA, 13 bp, C. elegans
tacagtaatccta

SEQ ID NO: 722927 - DNA, 13 bp, C. elegans
tacagtaatcctc

SEQ ID NO: 722928 - DNA, 13 bp, C. elegans
tacagtaatcctt

SEQ ID NO: 722929 - DNA, 14 bp, C. elegans
tacagtaatccttc

SEQ ID NO: 722930 - DNA, 13 bp, C. elegans
tacagtaatctca

SEQ ID NO: 722931 - DNA, 13 bp, C. elegans
tacagtaatcttc

SEQ ID NO: 722932 - DNA, 13 bp, C. elegans
tacagtaattctt

SEQ ID NO: 722933 - DNA, 13 bp, C. elegans
tacagtacccatt

SEQ ID NO: 722934 - DNA, 13 bp, C. elegans
tacagtaccccaa

SEQ ID NO: 722935 - DNA, 13 bp, C. elegans
tacagtacccccg

SEQ ID NO: 722936 - DNA, 13 bp, C. elegans
tacagtaccccgg

SEQ ID NO: 722937 - DNA, 13 bp, C. elegans
tacagtaccccta

SEQ ID NO: 722938 - DNA, 13 bp, C. elegans
tacagtacccctc

SEQ ID NO: 722939 - DNA, 13 bp, C. elegans
tacagtacccctg

SEQ ID NO: 722940 - DNA, 13 bp, C. elegans
tacagtacccctt

SEQ ID NO: 722941 - DNA, 13 bp, C. elegans
tacagtaccctaa

SEQ ID NO: 722942 - DNA, 13 bp, C. elegans
tacagtaccctag

SEQ ID NO: 722943 - DNA, 13 bp, C. elegans
tacagtacccttg

SEQ ID NO: 722944 - DNA, 13 bp, C. elegans
tacagtactacta

SEQ ID NO: 722945 - DNA, 13 bp, C. elegans
tacagtagtaatt

SEQ ID NO: 722946 - DNA, 13 bp, C. elegans
tacagtagtcatt

SEQ ID NO: 722947 - DNA, 13 bp, C. elegans
tacagtagtcctt

SEQ ID NO: 722948 - DNA, 13 bp, C. elegans
tacagtagtctta

SEQ ID NO: 722949 - DNA, 13 bp, C. elegans
tacagtagtttca

SEQ ID NO: 722950 - DNA, 13 bp, C. elegans
tacagtatccatt

SEQ ID NO: 722951 - DNA, 13 bp, C. elegans
tacagtatccttt

SEQ ID NO: 722952 - DNA, 13 bp, C. elegans
tacagtattaatt

SEQ ID NO: 722953 - DNA, 13 bp, C. elegans
tacagtatttatt

SEQ ID NO: 722954 - DNA, 13 bp, C. elegans
tacagtatttctt

SEQ ID NO: 722955 - DNA, 13 bp, C. elegans
tacagtcaaaaag

SEQ ID NO: 722956 - DNA, 13 bp, C. elegans
tacagtgctcttt

SEQ ID NO: 722957 - DNA, 30 bp, C. elegans
tacagtgctggccaaaaagatatccacttt

SEQ ID NO: 722958 - DNA, 16 bp, C. elegans
tacagtgtgggaaagt

SEQ ID NO: 722959 - DNA, 13 bp, C. elegans
tacagttatattt

SEQ ID NO: 722960 - DNA, 13 bp, C. elegans
tacagtttaattt

SEQ ID NO: 722961 - DNA, 13 bp, C. elegans
tacagtttcacaa

SEQ ID NO: 722962 - DNA, 13 bp, C. elegans
tacagtttcttag

SEQ ID NO: 722963 - DNA, 13 bp, C. elegans
tacagttttaaaa

SEQ ID NO: 722964 - DNA, 13 bp, C. elegans
tacagttttgaaa

SEQ ID NO: 722965 - DNA, 13 bp, C. elegans
tacataaacattt

SEQ ID NO: 722966 - DNA, 13 bp, C. elegans
tacataaattgtt

SEQ ID NO: 722967 - DNA, 13 bp, C. elegans
tacataattgaaa

SEQ ID NO: 722968 - DNA, 13 bp, C. elegans
tacataattttct

SEQ ID NO: 722969 - DNA, 13 bp, C. elegans
tacatataatttc

SEQ ID NO: 722970 - DNA, 13 bp, C. elegans
tacatatacatat

SEQ ID NO: 722971 - DNA, 13 bp, C. elegans
tacatatagattt

SEQ ID NO: 722972 - DNA, 13 bp, C. elegans
tacatatatttca

SEQ ID NO: 722973 - DNA, 13 bp, C. elegans
tacatatatttct

SEQ ID NO: 722974 - DNA, 13 bp, C. elegans
tacatatgtacat

SEQ ID NO: 722975 - DNA, 13 bp, C. elegans
tacatatgttttt

SEQ ID NO: 722976 - DNA, 13 bp, C. elegans
tacatattatttc

SEQ ID NO: 722977 - DNA, 13 bp, C. elegans
tacatattctgaa

SEQ ID NO: 722978 - DNA, 13 bp, C. elegans
tacatattttcat

SEQ ID NO: 722979 - DNA, 13 bp, C. elegans
tacatattttgtt

SEQ ID NO: 722980 - DNA, 13 bp, C. elegans
tacatatttttca

SEQ ID NO: 722981 - DNA, 13 bp, C. elegans
tacatcaaaaatt

SEQ ID NO: 722982 - DNA, 13 bp, C. elegans
tacatcaaaatat

SEQ ID NO: 722983 - DNA, 13 bp, C. elegans
tacatcaattttg

SEQ ID NO: 722984 - DNA, 13 bp, C. elegans
tacatcatatttg

SEQ ID NO: 722985 - DNA, 13 bp, C. elegans
tacatgaaaatct

SEQ ID NO: 722986 - DNA, 13 bp, C. elegans
tacattattttga

SEQ ID NO: 722987 - DNA, 13 bp, C. elegans
tacattcaaaaat

SEQ ID NO: 722988 - DNA, 13 bp, C. elegans
tacattccaattt

SEQ ID NO: 722989 - DNA, 13 bp, C. elegans
tacattgaaattc

SEQ ID NO: 722990 - DNA, 13 bp, C. elegans
tacattggaaaaa

SEQ ID NO: 722991 - DNA, 13 bp, C. elegans
tacatttatacat

SEQ ID NO: 722992 - DNA, 13 bp, C. elegans
tacatttcaaata

SEQ ID NO: 722993 - DNA, 13 bp, C. elegans
tacatttcacaaa

SEQ ID NO: 722994 - DNA, 13 bp, C. elegans
tacatttctaaac

SEQ ID NO: 722995 - DNA, 13 bp, C. elegans
tacatttctatat

SEQ ID NO: 722996 - DNA, 13 bp, C. elegans
tacatttctcaaa

SEQ ID NO: 722997 - DNA, 13 bp, C. elegans
tacatttgaaaaa

SEQ ID NO: 722998 - DNA, 13 bp, C. elegans
tacattttaccag

SEQ ID NO: 722999 - DNA, 13 bp, C. elegans
tacattttatttg

SEQ ID NO: 723000 - DNA, 13 bp, C. elegans
tacattttcaatt

SEQ ID NO: 723001 - DNA, 13 bp, C. elegans
tacattttcacat

SEQ ID NO: 723002 - DNA, 13 bp, C. elegans
tacattttcagat

SEQ ID NO: 723003 - DNA, 13 bp, C. elegans
tacattttcatat

SEQ ID NO: 723004 - DNA, 13 bp, C. elegans
tacattttctaat

SEQ ID NO: 723005 - DNA, 13 bp, C. elegans
tacattttctccc

SEQ ID NO: 723006 - DNA, 13 bp, C. elegans
tacattttctgta

SEQ ID NO: 723007 - DNA, 13 bp, C. elegans
tacattttctgtt

SEQ ID NO: 723008 - DNA, 13 bp, C. elegans
tacattttgcaac

SEQ ID NO: 723009 - DNA, 13 bp, C. elegans
tacattttggaaa

SEQ ID NO: 723010 - DNA, 13 bp, C. elegans
tacatttttaatg

SEQ ID NO: 723011 - DNA, 13 bp, C. elegans
tacatttttcaaa

SEQ ID NO: 723012 - DNA, 13 bp, C. elegans
tacatttttcaat

SEQ ID NO: 723013 - DNA, 13 bp, C. elegans
tacatttttcgaa

SEQ ID NO: 723014 - DNA, 13 bp, C. elegans
tacatttttgaaa

SEQ ID NO: 723015 - DNA, 13 bp, C. elegans
tacatttttggat

SEQ ID NO: 723016 - DNA, 13 bp, C. elegans
tacattttttgta

SEQ ID NO: 723017 - DNA, 13 bp, C. elegans
taccaaaaaagtt

SEQ ID NO: 723018 - DNA, 13 bp, C. elegans
taccaaaaagtat

SEQ ID NO: 723019 - DNA, 13 bp, C. elegans
taccaaaattcca

SEQ ID NO: 723020 - DNA, 13 bp, C. elegans
taccaaaattgtg

SEQ ID NO: 723021 - DNA, 13 bp, C. elegans
taccaaaattttt

SEQ ID NO: 723022 - DNA, 13 bp, C. elegans
taccaaatatcat

SEQ ID NO: 723023 - DNA, 13 bp, C. elegans
taccaaatttcgt

SEQ ID NO: 723024 - DNA, 13 bp, C. elegans
taccaaattttaa

SEQ ID NO: 723025 - DNA, 13 bp, C. elegans
taccaacaacatc

SEQ ID NO: 723026 - DNA, 13 bp, C. elegans
taccaacaatatt

SEQ ID NO: 723027 - DNA, 13 bp, C. elegans
taccaactaccac

SEQ ID NO: 723028 - DNA, 13 bp, C. elegans
taccaactatgct

SEQ ID NO: 723029 - DNA, 13 bp, C. elegans
taccaataatctt

SEQ ID NO: 723030 - DNA, 13 bp, C. elegans
taccattctctcc

SEQ ID NO: 723031 - DNA, 13 bp, C. elegans
tacccaaaattaa

SEQ ID NO: 723032 - DNA, 15 bp, C. elegans
tacccaacagttgca

SEQ ID NO: 723033 - DNA, 13 bp, C. elegans
tacccattttcaa

SEQ ID NO: 723034 - DNA, 13 bp, C. elegans
taccgaaaaaata

SEQ ID NO: 723035 - DNA, 13 bp, C. elegans
taccgaaatctgg

SEQ ID NO: 723036 - DNA, 13 bp, C. elegans
taccgatttgccg

SEQ ID NO: 723037 - DNA, 13 bp, C. elegans
taccgatttttga

SEQ ID NO: 723038 - DNA, 13 bp, C. elegans
taccgcatttttt

SEQ ID NO: 723039 - DNA, 13 bp, C. elegans
taccgtaacctac

SEQ ID NO: 723040 - DNA, 13 bp, C. elegans
taccgtaatttta

SEQ ID NO: 723041 - DNA, 13 bp, C. elegans
taccgtatcaatc

SEQ ID NO: 723042 - DNA, 13 bp, C. elegans
taccgtattattt

SEQ ID NO: 723043 - DNA, 13 bp, C. elegans
taccgtatttcct

SEQ ID NO: 723044 - DNA, 13 bp, C. elegans
taccgtatttttt

SEQ ID NO: 723045 - DNA, 13 bp, C. elegans
tacctaaaaattc

SEQ ID NO: 723046 - DNA, 13 bp, C. elegans
tacctacctacct

SEQ ID NO: 723047 - DNA, 13 bp, C. elegans
tacctagttttat

SEQ ID NO: 723048 - DNA, 13 bp, C. elegans
tacctcatctttt

SEQ ID NO: 723049 - DNA, 13 bp, C. elegans
tacctgaaaaatc

SEQ ID NO: 723050 - DNA, 13 bp, C. elegans
tacctgcctacaa

SEQ ID NO: 723051 - DNA, 13 bp, C. elegans
taccttctcattg

SEQ ID NO: 723052 - DNA, 13 bp, C. elegans
taccttgacttga

SEQ ID NO: 723053 - DNA, 13 bp, C. elegans
taccttgcctacc

SEQ ID NO: 723054 - DNA, 13 bp, C. elegans
tacctttcaaaaa

SEQ ID NO: 723055 - DNA, 13 bp, C. elegans
taccttttctcat

SEQ ID NO: 723056 - DNA, 13 bp, C. elegans
tacgaaaaaatca

SEQ ID NO: 723057 - DNA, 13 bp, C. elegans
tacgaaaaatcta

SEQ ID NO: 723058 - DNA, 13 bp, C. elegans
tacgaaattcatt

SEQ ID NO: 723059 - DNA, 13 bp, C. elegans
tacgaaattcgaa

SEQ ID NO: 723060 - DNA, 13 bp, C. elegans
tacgaaattcggt

SEQ ID NO: 723061 - DNA, 13 bp, C. elegans
tacgaaattttaa

SEQ ID NO: 723062 - DNA, 13 bp, C. elegans
tacgaattttgaa

SEQ ID NO: 723063 - DNA, 13 bp, C. elegans
tacgaatttttcg

SEQ ID NO: 723064 - DNA, 13 bp, C. elegans
tacgacaatttgc

SEQ ID NO: 723065 - DNA, 13 bp, C. elegans
tacgactacatat

SEQ ID NO: 723066 - DNA, 13 bp, C. elegans
tacgagaacacaa

SEQ ID NO: 723067 - DNA, 13 bp, C. elegans
tacgagatatttc

SEQ ID NO: 723068 - DNA, 13 bp, C. elegans
tacgagatatttg

SEQ ID NO: 723069 - DNA, 13 bp, C. elegans
tacgagctcgatt

SEQ ID NO: 723070 - DNA, 13 bp, C. elegans
tacgagctgaata

SEQ ID NO: 723071 - DNA, 13 bp, C. elegans
tacgatgaaaaaa

SEQ ID NO: 723072 - DNA, 13 bp, C. elegans
tacgatttatttt

SEQ ID NO: 723073 - DNA, 13 bp, C. elegans
tacgattttggag

SEQ ID NO: 723074 - DNA, 13 bp, C. elegans
tacgatttttcag

SEQ ID NO: 723075 - DNA, 13 bp, C. elegans
tacgatttttgaa

SEQ ID NO: 723076 - DNA, 13 bp, C. elegans
tacgatttttgtt

SEQ ID NO: 723077 - DNA, 13 bp, C. elegans
tacgattttttat

SEQ ID NO: 723078 - DNA, 13 bp, C. elegans
tacgcattttttt

SEQ ID NO: 723079 - DNA, 13 bp, C. elegans
tacgcctacgcct

SEQ ID NO: 723080 - DNA, 13 bp, C. elegans
tacggaaaatact

SEQ ID NO: 723081 - DNA, 27 bp, C. elegans
tacggaccccctcaaagacttcccttg

SEQ ID NO: 723082 - DNA, 16 bp, C. elegans
tacggtaccaggtctc

SEQ ID NO: 723083 - DNA, 13 bp, C. elegans
tacggtagatttt

SEQ ID NO: 723084 - DNA, 15 bp, C. elegans
tacggtagcgccaaa

SEQ ID NO: 723085 - DNA, 13 bp, C. elegans
tacggtagtttta

SEQ ID NO: 723086 - DNA, 13 bp, C. elegans
tacggtattaaat

SEQ ID NO: 723087 - DNA, 13 bp, C. elegans
tacggtattctca

SEQ ID NO: 723088 - DNA, 13 bp, C. elegans
tacgtgcctcttg

SEQ ID NO: 723089 - DNA, 13 bp, C. elegans
tacgttttcaatt

SEQ ID NO: 723090 - DNA, 13 bp, C. elegans
tactaatagtaag

SEQ ID NO: 723091 - DNA, 13 bp, C. elegans
tactacagtaatc

SEQ ID NO: 723092 - DNA, 13 bp, C. elegans
tactacagtatcc

SEQ ID NO: 723093 - DNA, 13 bp, C. elegans
tactaccaaattg

SEQ ID NO: 723094 - DNA, 13 bp, C. elegans
tactactacaact

SEQ ID NO: 723095 - DNA, 13 bp, C. elegans
tactactactaca

SEQ ID NO: 723096 - DNA, 13 bp, C. elegans
tactactactact

SEQ ID NO: 723097 - DNA, 13 bp, C. elegans
tactactactatt

SEQ ID NO: 723098 - DNA, 13 bp, C. elegans
tactacttttgaa

SEQ ID NO: 723099 - DNA, 13 bp, C. elegans
tactattagtagt

SEQ ID NO: 723100 - DNA, 13 bp, C. elegans
tactattctcaat

SEQ ID NO: 723101 - DNA, 13 bp, C. elegans
tactatttcaaaa

SEQ ID NO: 723102 - DNA, 13 bp, C. elegans
tactattttccaa

SEQ ID NO: 723103 - DNA, 13 bp, C. elegans
tactatttttcag

SEQ ID NO: 723104 - DNA, 13 bp, C. elegans
tactatttttgaa

SEQ ID NO: 723105 - DNA, 13 bp, C. elegans
tactcaaaaagtc

SEQ ID NO: 723106 - DNA, 13 bp, C. elegans
tactcaaaaagtt

SEQ ID NO: 723107 - DNA, 13 bp, C. elegans
tactcaaaatgtg

SEQ ID NO: 723108 - DNA, 13 bp, C. elegans
tactcaagaaaaa

SEQ ID NO: 723109 - DNA, 13 bp, C. elegans
tactcactatcag

SEQ ID NO: 723110 - DNA, 13 bp, C. elegans
tactcatattctg

SEQ ID NO: 723111 - DNA, 13 bp, C. elegans
tactcatttgaaa

SEQ ID NO: 723112 - DNA, 13 bp, C. elegans
tactcattttgaa

SEQ ID NO: 723113 - DNA, 13 bp, C. elegans
tactccaccttta

SEQ ID NO: 723114 - DNA, 13 bp, C. elegans
tactccacctttg

SEQ ID NO: 723115 - DNA, 13 bp, C. elegans
tactccttcttta

SEQ ID NO: 723116 - DNA, 13 bp, C. elegans
tactcgaaaattc

SEQ ID NO: 723117 - DNA, 13 bp, C. elegans
tactcgtcttctc

SEQ ID NO: 723118 - DNA, 13 bp, C. elegans
tactcgttttctt

SEQ ID NO: 723119 - DNA, 13 bp, C. elegans
tactcttcaaaat

SEQ ID NO: 723120 - DNA, 13 bp, C. elegans
tactgaaaaatat

SEQ ID NO: 723121 - DNA, 13 bp, C. elegans
tactgaaaagttt

SEQ ID NO: 723122 - DNA, 13 bp, C. elegans
tactgaaaataat

SEQ ID NO: 723123 - DNA, 13 bp, C. elegans
tactgaaacagtt

SEQ ID NO: 723124 - DNA, 13 bp, C. elegans
tactgaagtttga

SEQ ID NO: 723125 - DNA, 13 bp, C. elegans
tactgaattctga

SEQ ID NO: 723126 - DNA, 13 bp, C. elegans
tactgccaaaatt

SEQ ID NO: 723127 - DNA, 13 bp, C. elegans
tactgctcctgta

SEQ ID NO: 723128 - DNA, 13 bp, C. elegans
tactggaaaaaat

SEQ ID NO: 723129 - DNA, 13 bp, C. elegans
tactggaaaatca

SEQ ID NO: 723130 - DNA, 13 bp, C. elegans
tactggaatattg

SEQ ID NO: 723131 - DNA, 13 bp, C. elegans
tactggagactgc

SEQ ID NO: 723132 - DNA, 13 bp, C. elegans
tactggcaaaaaa

SEQ ID NO: 723133 - DNA, 13 bp, C. elegans
tactggtctaact

SEQ ID NO: 723134 - DNA, 13 bp, C. elegans
tactgtaacaaaa

SEQ ID NO: 723135 - DNA, 13 bp, C. elegans
tactgtaacttca

SEQ ID NO: 723136 - DNA, 13 bp, C. elegans
tactgtaaggata

SEQ ID NO: 723137 - DNA, 13 bp, C. elegans
tactgtaatttcg

SEQ ID NO: 723138 - DNA, 13 bp, C. elegans
tactgtaattttt

SEQ ID NO: 723139 - DNA, 13 bp, C. elegans
tactgtacatttt

SEQ ID NO: 723140 - DNA, 13 bp, C. elegans
tactgtacttttc

SEQ ID NO: 723141 - DNA, 13 bp, C. elegans
tactgtacttttg

SEQ ID NO: 723142 - DNA, 13 bp, C. elegans
tactgtagatatt

SEQ ID NO: 723143 - DNA, 13 bp, C. elegans
tactgtagatgta

SEQ ID NO: 723144 - DNA, 13 bp, C. elegans
tactgtagattta

SEQ ID NO: 723145 - DNA, 13 bp, C. elegans
tactgtagatttc

SEQ ID NO: 723146 - DNA, 13 bp, C. elegans
tactgtagcactg

SEQ ID NO: 723147 - DNA, 13 bp, C. elegans
tactgtagcccca

SEQ ID NO: 723148 - DNA, 13 bp, C. elegans
tactgtagctttc

SEQ ID NO: 723149 - DNA, 13 bp, C. elegans
tactgtagtaata

SEQ ID NO: 723150 - DNA, 13 bp, C. elegans
tactgtagtttta

SEQ ID NO: 723151 - DNA, 13 bp, C. elegans
tactgtagttttt

SEQ ID NO: 723152 - DNA, 13 bp, C. elegans
tactgtatttttg

SEQ ID NO: 723153 - DNA, 13 bp, C. elegans
tactgtcaaattt

SEQ ID NO: 723154 - DNA, 13 bp, C. elegans
tactgtttcagtg

SEQ ID NO: 723155 - DNA, 13 bp, C. elegans
tactgtttcatat

SEQ ID NO: 723156 - DNA, 13 bp, C. elegans
tactgtttcattg

SEQ ID NO: 723157 - DNA, 13 bp, C. elegans
tactgtttgatct

SEQ ID NO: 723158 - DNA, 13 bp, C. elegans
tacttacttactt

SEQ ID NO: 723159 - DNA, 13 bp, C. elegans
tacttatctgaaa

SEQ ID NO: 723160 - DNA, 13 bp, C. elegans
tacttatgtttca

SEQ ID NO: 723161 - DNA, 13 bp, C. elegans
tacttattttcag

SEQ ID NO: 723162 - DNA, 13 bp, C. elegans
tacttattttgaa

SEQ ID NO: 723163 - DNA, 13 bp, C. elegans
tacttcaaacatt

SEQ ID NO: 723164 - DNA, 13 bp, C. elegans
tacttcaacttct

SEQ ID NO: 723165 - DNA, 13 bp, C. elegans
tacttcagattaa

SEQ ID NO: 723166 - DNA, 13 bp, C. elegans
tacttctacagta

SEQ ID NO: 723167 - DNA, 13 bp, C. elegans
tacttctcaaaaa

SEQ ID NO: 723168 - DNA, 13 bp, C. elegans
tacttctcttcat

SEQ ID NO: 723169 - DNA, 13 bp, C. elegans
tacttcttacact

SEQ ID NO: 723170 - DNA, 13 bp, C. elegans
tacttgaaaaatt

SEQ ID NO: 723171 - DNA, 13 bp, C. elegans
tacttgaaaagtt

SEQ ID NO: 723172 - DNA, 13 bp, C. elegans
tacttgaaaatat

SEQ ID NO: 723173 - DNA, 13 bp, C. elegans
tacttgaaatttg

SEQ ID NO: 723174 - DNA, 13 bp, C. elegans
tacttgattttta

SEQ ID NO: 723175 - DNA, 13 bp, C. elegans
tacttgtgtatta

SEQ ID NO: 723176 - DNA, 13 bp, C. elegans
tacttgttcaaaa

SEQ ID NO: 723177 - DNA, 13 bp, C. elegans
tactttaaaagta

SEQ ID NO: 723178 - DNA, 13 bp, C. elegans
tactttaatcaaa

SEQ ID NO: 723179 - DNA, 13 bp, C. elegans
tactttagattaa

SEQ ID NO: 723180 - DNA, 13 bp, C. elegans
tactttatcaaaa

SEQ ID NO: 723181 - DNA, 13 bp, C. elegans
tactttattttga

SEQ ID NO: 723182 - DNA, 13 bp, C. elegans
tactttcaaaatt

SEQ ID NO: 723183 - DNA, 13 bp, C. elegans
tactttcaaagtt

SEQ ID NO: 723184 - DNA, 13 bp, C. elegans
tactttcaaatga

SEQ ID NO: 723185 - DNA, 13 bp, C. elegans
tactttcagataa

SEQ ID NO: 723186 - DNA, 13 bp, C. elegans
tactttcagtttt

SEQ ID NO: 723187 - DNA, 13 bp, C. elegans
tactttcgaaaaa

SEQ ID NO: 723188 - DNA, 13 bp, C. elegans
tactttctttcaa

SEQ ID NO: 723189 - DNA, 13 bp, C. elegans
tactttgaaaaat

SEQ ID NO: 723190 - DNA, 13 bp, C. elegans
tactttgcaaaaa

SEQ ID NO: 723191 - DNA, 13 bp, C. elegans
tactttggaaaaa

SEQ ID NO: 723192 - DNA, 13 bp, C. elegans
tactttgtcattt

SEQ ID NO: 723193 - DNA, 13 bp, C. elegans
tactttgttcaaa

SEQ ID NO: 723194 - DNA, 13 bp, C. elegans
tactttgtttaga

SEQ ID NO: 723195 - DNA, 13 bp, C. elegans
tacttttagaatt

SEQ ID NO: 723196 - DNA, 13 bp, C. elegans
tacttttcaaatt

SEQ ID NO: 723197 - DNA, 13 bp, C. elegans
tacttttcacaaa

SEQ ID NO: 723198 - DNA, 13 bp, C. elegans
tacttttccaatt

SEQ ID NO: 723199 - DNA, 13 bp, C. elegans
tacttttcgagca

SEQ ID NO: 723200 - DNA, 13 bp, C. elegans
tacttttcgatgc

SEQ ID NO: 723201 - DNA, 13 bp, C. elegans
tacttttctggcg

SEQ ID NO: 723202 - DNA, 13 bp, C. elegans
tacttttgaaaaa

SEQ ID NO: 723203 - DNA, 13 bp, C. elegans
tacttttgccgaa

SEQ ID NO: 723204 - DNA, 13 bp, C. elegans
tacttttgtgtat

SEQ ID NO: 723205 - DNA, 13 bp, C. elegans
tactttttatcaa

SEQ ID NO: 723206 - DNA, 13 bp, C. elegans
tactttttcaaaa

SEQ ID NO: 723207 - DNA, 13 bp, C. elegans
tactttttcacct

SEQ ID NO: 723208 - DNA, 13 bp, C. elegans
tactttttcggaa

SEQ ID NO: 723209 - DNA, 13 bp, C. elegans
tactttttctggt

SEQ ID NO: 723210 - DNA, 13 bp, C. elegans
tactttttgaaaa

SEQ ID NO: 723211 - DNA, 13 bp, C. elegans
tactttttgaaac

SEQ ID NO: 723212 - DNA, 13 bp, C. elegans
tactttttgaatt

SEQ ID NO: 723213 - DNA, 13 bp, C. elegans
tactttttgatgt

SEQ ID NO: 723214 - DNA, 13 bp, C. elegans
tactttttgcatt

SEQ ID NO: 723215 - DNA, 13 bp, C. elegans
tactttttggaat

SEQ ID NO: 723216 - DNA, 13 bp, C. elegans
tacttttttcaca

SEQ ID NO: 723217 - DNA, 13 bp, C. elegans
tacttttttccaa

SEQ ID NO: 723218 - DNA, 13 bp, C. elegans
tacttttttctcg

SEQ ID NO: 723219 - DNA, 13 bp, C. elegans
tactttttttgca

SEQ ID NO: 723220 - DNA, 13 bp, C. elegans
tagaaaaaaacgt

SEQ ID NO: 723221 - DNA, 13 bp, C. elegans
tagaaaaaagttt

SEQ ID NO: 723222 - DNA, 13 bp, C. elegans
tagaaaaacaatt

SEQ ID NO: 723223 - DNA, 13 bp, C. elegans
tagaaaaacggaa

SEQ ID NO: 723224 - DNA, 13 bp, C. elegans
tagaaaaacttca

SEQ ID NO: 723225 - DNA, 13 bp, C. elegans
tagaaaaactttt

SEQ ID NO: 723226 - DNA, 13 bp, C. elegans
tagaaaaagcgaa

SEQ ID NO: 723227 - DNA, 13 bp, C. elegans
tagaaaacaacat

SEQ ID NO: 723228 - DNA, 13 bp, C. elegans
tagaaaacttcaa

SEQ ID NO: 723229 - DNA, 13 bp, C. elegans
tagaaaagttatt

SEQ ID NO: 723230 - DNA, 13 bp, C. elegans
tagaaaatacttt

SEQ ID NO: 723231 - DNA, 13 bp, C. elegans
tagaaaatcaaat

SEQ ID NO: 723232 - DNA, 13 bp, C. elegans
tagaaaatcaatt

SEQ ID NO: 723233 - DNA, 13 bp, C. elegans
tagaaaatcgatt

SEQ ID NO: 723234 - DNA, 13 bp, C. elegans
tagaaaatcgttt

SEQ ID NO: 723235 - DNA, 13 bp, C. elegans
tagaaaatgtatt

SEQ ID NO: 723236 - DNA, 13 bp, C. elegans
tagaaaattcgaa

SEQ ID NO: 723237 - DNA, 13 bp, C. elegans
tagaaaattctag

SEQ ID NO: 723238 - DNA, 13 bp, C. elegans
tagaaaattggaa

SEQ ID NO: 723239 - DNA, 13 bp, C. elegans
tagaaaattgttt

SEQ ID NO: 723240 - DNA, 13 bp, C. elegans
tagaaaattttca

SEQ ID NO: 723241 - DNA, 13 bp, C. elegans
tagaaaatttttc

SEQ ID NO: 723242 - DNA, 13 bp, C. elegans
tagaaacaacttt

SEQ ID NO: 723243 - DNA, 13 bp, C. elegans
tagaaacaataat

SEQ ID NO: 723244 - DNA, 13 bp, C. elegans
tagaaacaatatt

SEQ ID NO: 723245 - DNA, 13 bp, C. elegans
tagaaacaatttt

SEQ ID NO: 723246 - DNA, 13 bp, C. elegans
tagaaacatttat

SEQ ID NO: 723247 - DNA, 13 bp, C. elegans
tagaaacattttc

SEQ ID NO: 723248 - DNA, 13 bp, C. elegans
tagaaacttctag

SEQ ID NO: 723249 - DNA, 13 bp, C. elegans
tagaaacttctgg

SEQ ID NO: 723250 - DNA, 13 bp, C. elegans
tagaaatagaatt

SEQ ID NO: 723251 - DNA, 13 bp, C. elegans
tagaaatcacaaa

SEQ ID NO: 723252 - DNA, 13 bp, C. elegans
tagaaatcagaaa

SEQ ID NO: 723253 - DNA, 13 bp, C. elegans
tagaaatctggaa

SEQ ID NO: 723254 - DNA, 13 bp, C. elegans
tagaaatgcaaaa

SEQ ID NO: 723255 - DNA, 13 bp, C. elegans
tagaaatggaaat

SEQ ID NO: 723256 - DNA, 13 bp, C. elegans
tagaaatgttcat

SEQ ID NO: 723257 - DNA, 13 bp, C. elegans
tagaaatgttgtg

SEQ ID NO: 723258 - DNA, 13 bp, C. elegans
tagaaatgtttaa

SEQ ID NO: 723259 - DNA, 13 bp, C. elegans
tagaaattatgaa

SEQ ID NO: 723260 - DNA, 13 bp, C. elegans
tagaaattcaatt

SEQ ID NO: 723261 - DNA, 13 bp, C. elegans
tagaaattcggtt

SEQ ID NO: 723262 - DNA, 13 bp, C. elegans
tagaaattgaatt

SEQ ID NO: 723263 - DNA, 13 bp, C. elegans
tagaaattgataa

SEQ ID NO: 723264 - DNA, 13 bp, C. elegans
tagaaatttcaca

SEQ ID NO: 723265 - DNA, 13 bp, C. elegans
tagaaatttccag

SEQ ID NO: 723266 - DNA, 13 bp, C. elegans
tagaaatttgaat

SEQ ID NO: 723267 - DNA, 13 bp, C. elegans
tagaaatttggaa

SEQ ID NO: 723268 - DNA, 13 bp, C. elegans
tagaaatttggat

SEQ ID NO: 723269 - DNA, 13 bp, C. elegans
tagaacaaaattt

SEQ ID NO: 723270 - DNA, 13 bp, C. elegans
tagaacaaatttt

SEQ ID NO: 723271 - DNA, 13 bp, C. elegans
tagaacaatttga

SEQ ID NO: 723272 - DNA, 13 bp, C. elegans
tagaacacatttt

SEQ ID NO: 723273 - DNA, 13 bp, C. elegans
tagaacacttttt

SEQ ID NO: 723274 - DNA, 15 bp, C. elegans
tagaaccttctggaa

SEQ ID NO: 723275 - DNA, 13 bp, C. elegans
tagaacctttttt

SEQ ID NO: 723276 - DNA, 13 bp, C. elegans
tagaactttctag

SEQ ID NO: 723277 - DNA, 13 bp, C. elegans
tagaagaaatacg

SEQ ID NO: 723278 - DNA, 13 bp, C. elegans
tagaagaaatttc

SEQ ID NO: 723279 - DNA, 13 bp, C. elegans
tagaagcacacaa

SEQ ID NO: 723280 - DNA, 13 bp, C. elegans
tagaaggagtttt

SEQ ID NO: 723281 - DNA, 13 bp, C. elegans
tagaagttggcaa

SEQ ID NO: 723282 - DNA, 13 bp, C. elegans
tagaagtttcaga

SEQ ID NO: 723283 - DNA, 13 bp, C. elegans
tagaagtttttaa

SEQ ID NO: 723284 - DNA, 13 bp, C. elegans
tagaataaacttt

SEQ ID NO: 723285 - DNA, 13 bp, C. elegans
tagaatatcaaaa

SEQ ID NO: 723286 - DNA, 13 bp, C. elegans
tagaatatgaaat

SEQ ID NO: 723287 - DNA, 13 bp, C. elegans
tagaatattctga

SEQ ID NO: 723288 - DNA, 13 bp, C. elegans
tagaatcaaaaag

SEQ ID NO: 723289 - DNA, 13 bp, C. elegans
tagaatcgaaaaa

SEQ ID NO: 723290 - DNA, 13 bp, C. elegans
tagaatgttctgg

SEQ ID NO: 723291 - DNA, 13 bp, C. elegans
tagaattcaaaaa

SEQ ID NO: 723292 - DNA, 13 bp, C. elegans
tagaattccaaaa

SEQ ID NO: 723293 - DNA, 13 bp, C. elegans
tagaattgaaatt

SEQ ID NO: 723294 - DNA, 13 bp, C. elegans
tagaatttcaaat

SEQ ID NO: 723295 - DNA, 13 bp, C. elegans
tagaatttcgata

SEQ ID NO: 723296 - DNA, 13 bp, C. elegans
tagaatttgaaat

SEQ ID NO: 723297 - DNA, 13 bp, C. elegans
tagaatttggaat

SEQ ID NO: 723298 - DNA, 13 bp, C. elegans
tagaatttggttt

SEQ ID NO: 723299 - DNA, 13 bp, C. elegans
tagaatttgtatt

SEQ ID NO: 723300 - DNA, 13 bp, C. elegans
tagaattttccag

SEQ ID NO: 723301 - DNA, 13 bp, C. elegans
tagaattttgaaa

SEQ ID NO: 723302 - DNA, 13 bp, C. elegans
tagaattttgaag

SEQ ID NO: 723303 - DNA, 13 bp, C. elegans
tagaattttgcaa

SEQ ID NO: 723304 - DNA, 13 bp, C. elegans
tagaattttgtgt

SEQ ID NO: 723305 - DNA, 13 bp, C. elegans
tagaatttttcaa

SEQ ID NO: 723306 - DNA, 13 bp, C. elegans
tagaatttttcac

SEQ ID NO: 723307 - DNA, 13 bp, C. elegans
tagacagtttttt

SEQ ID NO: 723308 - DNA, 13 bp, C. elegans
tagacattttgaa

SEQ ID NO: 723309 - DNA, 13 bp, C. elegans
tagacgacaattt

SEQ ID NO: 723310 - DNA, 13 bp, C. elegans
tagacttccaaaa

SEQ ID NO: 723311 - DNA, 13 bp, C. elegans
tagagaattttca

SEQ ID NO: 723312 - DNA, 13 bp, C. elegans
tagagacgcagac

SEQ ID NO: 723313 - DNA, 13 bp, C. elegans
tagagatggaaaa

SEQ ID NO: 723314 - DNA, 13 bp, C. elegans
tagagattttcaa

SEQ ID NO: 723315 - DNA, 13 bp, C. elegans
tagagcacatttg

SEQ ID NO: 723316 - DNA, 13 bp, C. elegans
tagagcaccaaaa

SEQ ID NO: 723317 - DNA, 13 bp, C. elegans
tagagccaaatgc

SEQ ID NO: 723318 - DNA, 13 bp, C. elegans
tagagcgcacttt

SEQ ID NO: 723319 - DNA, 13 bp, C. elegans
tagagcttctctc

SEQ ID NO: 723320 - DNA, 13 bp, C. elegans
tagataaaacatt

SEQ ID NO: 723321 - DNA, 13 bp, C. elegans
tagataatttcca

SEQ ID NO: 723322 - DNA, 13 bp, C. elegans
tagataccgtatt

SEQ ID NO: 723323 - DNA, 13 bp, C. elegans
tagatactgtaac

SEQ ID NO: 723324 - DNA, 13 bp, C. elegans
tagatatgtcaaa

SEQ ID NO: 723325 - DNA, 13 bp, C. elegans
tagatattcaaaa

SEQ ID NO: 723326 - DNA, 13 bp, C. elegans
tagatattgaatt

SEQ ID NO: 723327 - DNA, 13 bp, C. elegans
tagatattttttc

SEQ ID NO: 723328 - DNA, 13 bp, C. elegans
tagatcaaaacgt

SEQ ID NO: 723329 - DNA, 13 bp, C. elegans
tagatcaaatcgt

SEQ ID NO: 723330 - DNA, 13 bp, C. elegans
tagatcaagccaa

SEQ ID NO: 723331 - DNA, 13 bp, C. elegans
tagatcacaattt

SEQ ID NO: 723332 - DNA, 13 bp, C. elegans
tagatctgaaatt

SEQ ID NO: 723333 - DNA, 13 bp, C. elegans
tagatcttcaaaa

SEQ ID NO: 723334 - DNA, 13 bp, C. elegans
tagatcttgtttt

SEQ ID NO: 723335 - DNA, 13 bp, C. elegans
tagatgaaaattt

SEQ ID NO: 723336 - DNA, 13 bp, C. elegans
tagattacaaaaa

SEQ ID NO: 723337 - DNA, 13 bp, C. elegans
tagattactgtag

SEQ ID NO: 723338 - DNA, 13 bp, C. elegans
tagattattcaaa

SEQ ID NO: 723339 - DNA, 13 bp, C. elegans
tagattcaaaaaa

SEQ ID NO: 723340 - DNA, 13 bp, C. elegans
tagattcaaaaat

SEQ ID NO: 723341 - DNA, 13 bp, C. elegans
tagattcaaattt

SEQ ID NO: 723342 - DNA, 13 bp, C. elegans
tagattcacaaag

SEQ ID NO: 723343 - DNA, 13 bp, C. elegans
tagattgtagttt

SEQ ID NO: 723344 - DNA, 13 bp, C. elegans
tagatttacgaag

SEQ ID NO: 723345 - DNA, 13 bp, C. elegans
tagatttatcaaa

SEQ ID NO: 723346 - DNA, 13 bp, C. elegans
tagatttcaaaat

SEQ ID NO: 723347 - DNA, 13 bp, C. elegans
tagatttcatttt

SEQ ID NO: 723348 - DNA, 13 bp, C. elegans
tagatttccaatt

SEQ ID NO: 723349 - DNA, 13 bp, C. elegans
tagatttccagaa

SEQ ID NO: 723350 - DNA, 13 bp, C. elegans
tagatttggaaaa

SEQ ID NO: 723351 - DNA, 13 bp, C. elegans
tagattttatatg

SEQ ID NO: 723352 - DNA, 13 bp, C. elegans
tagattttcagac

SEQ ID NO: 723353 - DNA, 13 bp, C. elegans
tagattttcagat

SEQ ID NO: 723354 - DNA, 13 bp, C. elegans
tagattttcagtc

SEQ ID NO: 723355 - DNA, 13 bp, C. elegans
tagattttctatt

SEQ ID NO: 723356 - DNA, 13 bp, C. elegans
tagattttctgaa

SEQ ID NO: 723357 - DNA, 13 bp, C. elegans
tagattttgaagt

SEQ ID NO: 723358 - DNA, 13 bp, C. elegans
tagattttgcaaa

SEQ ID NO: 723359 - DNA, 13 bp, C. elegans
tagattttgtgaa

SEQ ID NO: 723360 - DNA, 13 bp, C. elegans
tagatttttacaa

SEQ ID NO: 723361 - DNA, 13 bp, C. elegans
tagatttttcatt

SEQ ID NO: 723362 - DNA, 13 bp, C. elegans
tagatttttccaa

SEQ ID NO: 723363 - DNA, 13 bp, C. elegans
tagatttttttca

SEQ ID NO: 723364 - DNA, 13 bp, C. elegans
tagatttttttcg

SEQ ID NO: 723365 - DNA, 13 bp, C. elegans
tagcaaaaagttg

SEQ ID NO: 723366 - DNA, 13 bp, C. elegans
tagcaaaatttgg

SEQ ID NO: 723367 - DNA, 13 bp, C. elegans
tagcagacccaaa

SEQ ID NO: 723368 - DNA, 13 bp, C. elegans
tagcagccgacat

SEQ ID NO: 723369 - DNA, 13 bp, C. elegans
tagcatattttaa

SEQ ID NO: 723370 - DNA, 13 bp, C. elegans
tagcatttttcag

SEQ ID NO: 723371 - DNA, 13 bp, C. elegans
tagccaaaattcg

SEQ ID NO: 723372 - DNA, 13 bp, C. elegans
tagccaatatggg

SEQ ID NO: 723373 - DNA, 13 bp, C. elegans
tagccaattttta

SEQ ID NO: 723374 - DNA, 13 bp, C. elegans
tagccaatttttt

SEQ ID NO: 723375 - DNA, 13 bp, C. elegans
tagccgaaaatta

SEQ ID NO: 723376 - DNA, 14 bp, C. elegans
tagccgatttagcc

SEQ ID NO: 723377 - DNA, 13 bp, C. elegans
tagccgattttgg

SEQ ID NO: 723378 - DNA, 13 bp, C. elegans
tagcctcacccaa

SEQ ID NO: 723379 - DNA, 13 bp, C. elegans
tagccttttttga

SEQ ID NO: 723380 - DNA, 13 bp, C. elegans
tagcgttcagaaa

SEQ ID NO: 723381 - DNA, 13 bp, C. elegans
tagctaaataatt

SEQ ID NO: 723382 - DNA, 13 bp, C. elegans
tagctaaatttca

SEQ ID NO: 723383 - DNA, 13 bp, C. elegans
tagctcaaaatgt

SEQ ID NO: 723384 - DNA, 13 bp, C. elegans
tagctcaaatttc

SEQ ID NO: 723385 - DNA, 13 bp, C. elegans
tagctcaattttt

SEQ ID NO: 723386 - DNA, 13 bp, C. elegans
tagcttaattttt

SEQ ID NO: 723387 - DNA, 13 bp, C. elegans
tagcttatttttg

SEQ ID NO: 723388 - DNA, 13 bp, C. elegans
tagcttcaaaagt

SEQ ID NO: 723389 - DNA, 13 bp, C. elegans
tagcttcaaaatt

SEQ ID NO: 723390 - DNA, 13 bp, C. elegans
tagcttctggagg

SEQ ID NO: 723391 - DNA, 13 bp, C. elegans
tagctttaaaaat

SEQ ID NO: 723392 - DNA, 13 bp, C. elegans
tagctttaaaact

SEQ ID NO: 723393 - DNA, 13 bp, C. elegans
tagctttaaaatt

SEQ ID NO: 723394 - DNA, 13 bp, C. elegans
tagctttaaattt

SEQ ID NO: 723395 - DNA, 13 bp, C. elegans
tagcttttcaaaa

SEQ ID NO: 723396 - DNA, 13 bp, C. elegans
tagcttttttgga

SEQ ID NO: 723397 - DNA, 13 bp, C. elegans
taggaaatttgaa

SEQ ID NO: 723398 - DNA, 13 bp, C. elegans
taggaatactgta

SEQ ID NO: 723399 - DNA, 13 bp, C. elegans
taggatattttta

SEQ ID NO: 723400 - DNA, 13 bp, C. elegans
taggattattgta

SEQ ID NO: 723401 - DNA, 13 bp, C. elegans
taggattttcaaa

SEQ ID NO: 723402 - DNA, 13 bp, C. elegans
taggcacaaaaat

SEQ ID NO: 723403 - DNA, 13 bp, C. elegans
taggcacgtagac

SEQ ID NO: 723404 - DNA, 13 bp, C. elegans
taggccaccaagt

SEQ ID NO: 723405 - DNA, 13 bp, C. elegans
taggccacgccca

SEQ ID NO: 723406 - DNA, 13 bp, C. elegans
taggctcaggatt

SEQ ID NO: 723407 - DNA, 13 bp, C. elegans
taggctccgcctc

SEQ ID NO: 723408 - DNA, 13 bp, C. elegans
taggctttttttc

SEQ ID NO: 723409 - DNA, 13 bp, C. elegans
tagggctcccagc

SEQ ID NO: 723410 - DNA, 13 bp, C. elegans
tagggctcccatg

SEQ ID NO: 723411 - DNA, 13 bp, C. elegans
tagggcttccatg

SEQ ID NO: 723412 - DNA, 13 bp, C. elegans
taggggtattgta

SEQ ID NO: 723413 - DNA, 13 bp, C. elegans
taggggtgcaata

SEQ ID NO: 723414 - DNA, 13 bp, C. elegans
taggtatttaaaa

SEQ ID NO: 723415 - DNA, 13 bp, C. elegans
taggtgaaaaatg

SEQ ID NO: 723416 - DNA, 13 bp, C. elegans
taggttttcattt

SEQ ID NO: 723417 - DNA, 13 bp, C. elegans
taggttttgcaaa

SEQ ID NO: 723418 - DNA, 13 bp, C. elegans
taggtttttcata

SEQ ID NO: 723419 - DNA, 13 bp, C. elegans
taggttttttcta

SEQ ID NO: 723420 - DNA, 13 bp, C. elegans
tagtaaaacattt

SEQ ID NO: 723421 - DNA, 17 bp, C. elegans
tagtaagctcaaagtca

SEQ ID NO: 723422 - DNA, 13 bp, C. elegans
tagtaagttatat

SEQ ID NO: 723423 - DNA, 13 bp, C. elegans
tagtaagttcttt

SEQ ID NO: 723424 - DNA, 13 bp, C. elegans
tagtaatagtagt

SEQ ID NO: 723425 - DNA, 13 bp, C. elegans
tagtaatttaaag

SEQ ID NO: 723426 - DNA, 13 bp, C. elegans
tagtacaattttt

SEQ ID NO: 723427 - DNA, 13 bp, C. elegans
tagtacacaatgt

SEQ ID NO: 723428 - DNA, 13 bp, C. elegans
tagtacatatatt

SEQ ID NO: 723429 - DNA, 13 bp, C. elegans
tagtacatcaaaa

SEQ ID NO: 723430 - DNA, 13 bp, C. elegans
tagtactctttaa

SEQ ID NO: 723431 - DNA, 13 bp, C. elegans
tagtactgtagtg

SEQ ID NO: 723432 - DNA, 13 bp, C. elegans
tagtagattttcc

SEQ ID NO: 723433 - DNA, 13 bp, C. elegans
tagtagttaatta

SEQ ID NO: 723434 - DNA, 13 bp, C. elegans
tagtatcaaaaat

SEQ ID NO: 723435 - DNA, 13 bp, C. elegans
tagtatcattttt

SEQ ID NO: 723436 - DNA, 13 bp, C. elegans
tagtcaatttttt

SEQ ID NO: 723437 - DNA, 13 bp, C. elegans
tagtcagaaaatt

SEQ ID NO: 723438 - DNA, 13 bp, C. elegans
tagtcatttttaa

SEQ ID NO: 723439 - DNA, 13 bp, C. elegans
tagtcatttttga

SEQ ID NO: 723440 - DNA, 13 bp, C. elegans
tagtcattttttg

SEQ ID NO: 723441 - DNA, 13 bp, C. elegans
tagtcgaaaaatc

SEQ ID NO: 723442 - DNA, 13 bp, C. elegans
tagtcgaattttt

SEQ ID NO: 723443 - DNA, 13 bp, C. elegans
tagtcgacggaga

SEQ ID NO: 723444 - DNA, 13 bp, C. elegans
tagtcttgcagcc

SEQ ID NO: 723445 - DNA, 13 bp, C. elegans
tagtgaaaaattg

SEQ ID NO: 723446 - DNA, 13 bp, C. elegans
tagtgaaacagta

SEQ ID NO: 723447 - DNA, 13 bp, C. elegans
tagtgaatgcaaa

SEQ ID NO: 723448 - DNA, 13 bp, C. elegans
tagtgattttgat

SEQ ID NO: 723449 - DNA, 13 bp, C. elegans
tagtgcaaaatat

SEQ ID NO: 723450 - DNA, 13 bp, C. elegans
tagtgtcggaaaa

SEQ ID NO: 723451 - DNA, 13 bp, C. elegans
tagtgttgaaaaa

SEQ ID NO: 723452 - DNA, 13 bp, C. elegans
tagttaaaaatca

SEQ ID NO: 723453 - DNA, 13 bp, C. elegans
tagttaaaagttt

SEQ ID NO: 723454 - DNA, 13 bp, C. elegans
tagttacagaaaa

SEQ ID NO: 723455 - DNA, 13 bp, C. elegans
tagttagttttaa

SEQ ID NO: 723456 - DNA, 13 bp, C. elegans
tagttatggaaaa

SEQ ID NO: 723457 - DNA, 13 bp, C. elegans
tagttattgaaaa

SEQ ID NO: 723458 - DNA, 13 bp, C. elegans
tagttattgaaat

SEQ ID NO: 723459 - DNA, 13 bp, C. elegans
tagttcaaaatat

SEQ ID NO: 723460 - DNA, 13 bp, C. elegans
tagttcaaattga

SEQ ID NO: 723461 - DNA, 13 bp, C. elegans
tagttcatgaaaa

SEQ ID NO: 723462 - DNA, 13 bp, C. elegans
tagttgaaaacaa

SEQ ID NO: 723463 - DNA, 13 bp, C. elegans
tagttgaaaagtt

SEQ ID NO: 723464 - DNA, 13 bp, C. elegans
tagttgaaaatat

SEQ ID NO: 723465 - DNA, 13 bp, C. elegans
tagttgaaaatgt

SEQ ID NO: 723466 - DNA, 13 bp, C. elegans
tagttgaataaat

SEQ ID NO: 723467 - DNA, 13 bp, C. elegans
tagttgacaaaat

SEQ ID NO: 723468 - DNA, 13 bp, C. elegans
tagttgacaattt

SEQ ID NO: 723469 - DNA, 13 bp, C. elegans
tagttgataattt

SEQ ID NO: 723470 - DNA, 13 bp, C. elegans
tagtttaacaaaa

SEQ ID NO: 723471 - DNA, 13 bp, C. elegans
tagtttcaaattt

SEQ ID NO: 723472 - DNA, 13 bp, C. elegans
tagtttcaagcca

SEQ ID NO: 723473 - DNA, 13 bp, C. elegans
tagtttcaataaa

SEQ ID NO: 723474 - DNA, 13 bp, C. elegans
tagtttcaatttt

SEQ ID NO: 723475 - DNA, 13 bp, C. elegans
tagtttcttgaaa

SEQ ID NO: 723476 - DNA, 13 bp, C. elegans
tagtttgaaaaca

SEQ ID NO: 723477 - DNA, 13 bp, C. elegans
tagtttgagaaaa

SEQ ID NO: 723478 - DNA, 13 bp, C. elegans
tagtttgaggaaa

SEQ ID NO: 723479 - DNA, 13 bp, C. elegans
tagtttgcaaaaa

SEQ ID NO: 723480 - DNA, 13 bp, C. elegans
tagtttgcacatg

SEQ ID NO: 723481 - DNA, 13 bp, C. elegans
tagtttggaaaaa

SEQ ID NO: 723482 - DNA, 13 bp, C. elegans
tagtttgtgaaat

SEQ ID NO: 723483 - DNA, 13 bp, C. elegans
tagttttaattga

SEQ ID NO: 723484 - DNA, 13 bp, C. elegans
tagttttacagtt

SEQ ID NO: 723485 - DNA, 13 bp, C. elegans
tagttttcaaatt

SEQ ID NO: 723486 - DNA, 13 bp, C. elegans
tagttttcaattt

SEQ ID NO: 723487 - DNA, 13 bp, C. elegans
tagttttcagttt

SEQ ID NO: 723488 - DNA, 13 bp, C. elegans
tagttttccaatt

SEQ ID NO: 723489 - DNA, 13 bp, C. elegans
tagttttccattt

SEQ ID NO: 723490 - DNA, 13 bp, C. elegans
tagttttctattg

SEQ ID NO: 723491 - DNA, 13 bp, C. elegans
tagttttctttaa

SEQ ID NO: 723492 - DNA, 13 bp, C. elegans
tagttttgaaaaa

SEQ ID NO: 723493 - DNA, 13 bp, C. elegans
tagttttgaacat

SEQ ID NO: 723494 - DNA, 13 bp, C. elegans
tagttttgaagtt

SEQ ID NO: 723495 - DNA, 13 bp, C. elegans
tagttttgagaaa

SEQ ID NO: 723496 - DNA, 13 bp, C. elegans
tagttttgataaa

SEQ ID NO: 723497 - DNA, 13 bp, C. elegans
tagttttgcaaat

SEQ ID NO: 723498 - DNA, 13 bp, C. elegans
tagttttggatca

SEQ ID NO: 723499 - DNA, 13 bp, C. elegans
tagttttgtacaa

SEQ ID NO: 723500 - DNA, 13 bp, C. elegans
tagtttttaatca

SEQ ID NO: 723501 - DNA, 13 bp, C. elegans
tagtttttagtct

SEQ ID NO: 723502 - DNA, 13 bp, C. elegans
tagtttttatgaa

SEQ ID NO: 723503 - DNA, 13 bp, C. elegans
tagtttttcaact

SEQ ID NO: 723504 - DNA, 13 bp, C. elegans
tagtttttcaatt

SEQ ID NO: 723505 - DNA, 13 bp, C. elegans
tagtttttcatat

SEQ ID NO: 723506 - DNA, 13 bp, C. elegans
tagtttttcatca

SEQ ID NO: 723507 - DNA, 13 bp, C. elegans
tagtttttccaaa

SEQ ID NO: 723508 - DNA, 13 bp, C. elegans
tagtttttcgaat

SEQ ID NO: 723509 - DNA, 13 bp, C. elegans
tagtttttgaaaa

SEQ ID NO: 723510 - DNA, 13 bp, C. elegans
tagtttttgaaat

SEQ ID NO: 723511 - DNA, 13 bp, C. elegans
tagtttttgagaa

SEQ ID NO: 723512 - DNA, 13 bp, C. elegans
tagtttttgagca

SEQ ID NO: 723513 - DNA, 13 bp, C. elegans
tagtttttgatgg

SEQ ID NO: 723514 - DNA, 13 bp, C. elegans
tagtttttgtaaa

SEQ ID NO: 723515 - DNA, 13 bp, C. elegans
tataaaaagagcc

SEQ ID NO: 723516 - DNA, 13 bp, C. elegans
tataaaaagtatg

SEQ ID NO: 723517 - DNA, 13 bp, C. elegans
tataaaaagtttg

SEQ ID NO: 723518 - DNA, 13 bp, C. elegans
tataaaaatggat

SEQ ID NO: 723519 - DNA, 13 bp, C. elegans
tataaaaattctg

SEQ ID NO: 723520 - DNA, 13 bp, C. elegans
tataaaacattca

SEQ ID NO: 723521 - DNA, 13 bp, C. elegans
tataaaactattc

SEQ ID NO: 723522 - DNA, 13 bp, C. elegans
tataaaactgaat

SEQ ID NO: 723523 - DNA, 13 bp, C. elegans
tataaaactgtaa

SEQ ID NO: 723524 - DNA, 13 bp, C. elegans
tataaaatcagag

SEQ ID NO: 723525 - DNA, 13 bp, C. elegans
tataaaattgcaa

SEQ ID NO: 723526 - DNA, 13 bp, C. elegans
tataaaatttcag

SEQ ID NO: 723527 - DNA, 13 bp, C. elegans
tataaaatttcga

SEQ ID NO: 723528 - DNA, 13 bp, C. elegans
tataaacatttga

SEQ ID NO: 723529 - DNA, 13 bp, C. elegans
tataaacttgttt

SEQ ID NO: 723530 - DNA, 13 bp, C. elegans
tataaacttttga

SEQ ID NO: 723531 - DNA, 13 bp, C. elegans
tataaatgcattt

SEQ ID NO: 723532 - DNA, 13 bp, C. elegans
tataaatgttcat

SEQ ID NO: 723533 - DNA, 13 bp, C. elegans
tataaatgttgtt

SEQ ID NO: 723534 - DNA, 13 bp, C. elegans
tataaattcccaa

SEQ ID NO: 723535 - DNA, 13 bp, C. elegans
tataaattcttca

SEQ ID NO: 723536 - DNA, 13 bp, C. elegans
tataaattgttca

SEQ ID NO: 723537 - DNA, 13 bp, C. elegans
tataaattgttga

SEQ ID NO: 723538 - DNA, 13 bp, C. elegans
tataactcaaatt

SEQ ID NO: 723539 - DNA, 13 bp, C. elegans
tataactttgaaa

SEQ ID NO: 723540 - DNA, 13 bp, C. elegans
tataagcttataa

SEQ ID NO: 723541 - DNA, 13 bp, C. elegans
tataagtaatgat

SEQ ID NO: 723542 - DNA, 13 bp, C. elegans
tataagttcaaaa

SEQ ID NO: 723543 - DNA, 13 bp, C. elegans
tataagtttttga

SEQ ID NO: 723544 - DNA, 13 bp, C. elegans
tataatattcttg

SEQ ID NO: 723545 - DNA, 13 bp, C. elegans
tataatatttggt

SEQ ID NO: 723546 - DNA, 13 bp, C. elegans
tataatgatccaa

SEQ ID NO: 723547 - DNA, 13 bp, C. elegans
tataatggaaaat

SEQ ID NO: 723548 - DNA, 13 bp, C. elegans
tataatgtttcaa

SEQ ID NO: 723549 - DNA, 13 bp, C. elegans
tataatttcttca

SEQ ID NO: 723550 - DNA, 13 bp, C. elegans
tataattttatcg

SEQ ID NO: 723551 - DNA, 13 bp, C. elegans
tataattttgaac

SEQ ID NO: 723552 - DNA, 13 bp, C. elegans
tatacaaaacatt

SEQ ID NO: 723553 - DNA, 13 bp, C. elegans
tatacaaatgttt

SEQ ID NO: 723554 - DNA, 13 bp, C. elegans
tatacaagtttta

SEQ ID NO: 723555 - DNA, 13 bp, C. elegans
tatacaatttttg

SEQ ID NO: 723556 - DNA, 13 bp, C. elegans
tatacagaaaact

SEQ ID NO: 723557 - DNA, 13 bp, C. elegans
tatacatatgtat

SEQ ID NO: 723558 - DNA, 13 bp, C. elegans
tatacattttcca

SEQ ID NO: 723559 - DNA, 13 bp, C. elegans
tatacatttttga

SEQ ID NO: 723560 - DNA, 13 bp, C. elegans
tataccaaaaact

SEQ ID NO: 723561 - DNA, 13 bp, C. elegans
tataccaaaattt

SEQ ID NO: 723562 - DNA, 13 bp, C. elegans
tatacccaaaatt

SEQ ID NO: 723563 - DNA, 13 bp, C. elegans
tatacctccgatg

SEQ ID NO: 723564 - DNA, 13 bp, C. elegans
tatactatagttt

SEQ ID NO: 723565 - DNA, 13 bp, C. elegans
tatactcaaaatg

SEQ ID NO: 723566 - DNA, 13 bp, C. elegans
tatactcatttca

SEQ ID NO: 723567 - DNA, 13 bp, C. elegans
tatactctaaaaa

SEQ ID NO: 723568 - DNA, 13 bp, C. elegans
tatactttgattg

SEQ ID NO: 723569 - DNA, 13 bp, C. elegans
tatagaaaacagt

SEQ ID NO: 723570 - DNA, 13 bp, C. elegans
tatagaaaattct

SEQ ID NO: 723571 - DNA, 13 bp, C. elegans
tatagaaaattga

SEQ ID NO: 723572 - DNA, 13 bp, C. elegans
tatagaagatttt

SEQ ID NO: 723573 - DNA, 13 bp, C. elegans
tatagaatttcag

SEQ ID NO: 723574 - DNA, 13 bp, C. elegans
tatagactcaaaa

SEQ ID NO: 723575 - DNA, 13 bp, C. elegans
tataggaaatttt

SEQ ID NO: 723576 - DNA, 13 bp, C. elegans
tatagtagaacct

SEQ ID NO: 723577 - DNA, 13 bp, C. elegans
tatagtgtttgaa

SEQ ID NO: 723578 - DNA, 13 bp, C. elegans
tatagttttcaaa

SEQ ID NO: 723579 - DNA, 13 bp, C. elegans
tatataatttgca

SEQ ID NO: 723580 - DNA, 13 bp, C. elegans
tatatacatatgt

SEQ ID NO: 723581 - DNA, 13 bp, C. elegans
tatatactttttg

SEQ ID NO: 723582 - DNA, 20 bp, C. elegans
tatatataaagcgcttattc

SEQ ID NO: 723583 - DNA, 13 bp, C. elegans
tatatatcatgtt

SEQ ID NO: 723584 - DNA, 13 bp, C. elegans
tatatatgctttt

SEQ ID NO: 723585 - DNA, 13 bp, C. elegans
tatatatgtgtat

SEQ ID NO: 723586 - DNA, 13 bp, C. elegans
tatatatgtgtgt

SEQ ID NO: 723587 - DNA, 13 bp, C. elegans
tatatattttgca

SEQ ID NO: 723588 - DNA, 13 bp, C. elegans
tatatcaaaacat

SEQ ID NO: 723589 - DNA, 13 bp, C. elegans
tatatcacaaaat

SEQ ID NO: 723590 - DNA, 14 bp, C. elegans
tatatcgattttta

SEQ ID NO: 723591 - DNA, 13 bp, C. elegans
tatatcgtattgt

SEQ ID NO: 723592 - DNA, 13 bp, C. elegans
tatatctacaaaa

SEQ ID NO: 723593 - DNA, 13 bp, C. elegans
tatatctttgttg

SEQ ID NO: 723594 - DNA, 13 bp, C. elegans
tatatgaaacatt

SEQ ID NO: 723595 - DNA, 13 bp, C. elegans
tatatgaagtttt

SEQ ID NO: 723596 - DNA, 13 bp, C. elegans
tatatgattttcc

SEQ ID NO: 723597 - DNA, 13 bp, C. elegans
tatatgcctactt

SEQ ID NO: 723598 - DNA, 13 bp, C. elegans
tatatgtacataa

SEQ ID NO: 723599 - DNA, 13 bp, C. elegans
tatatgtatatga

SEQ ID NO: 723600 - DNA, 14 bp, C. elegans
tatatgtatatgaa

SEQ ID NO: 723601 - DNA, 13 bp, C. elegans
tatatgtatgtat

SEQ ID NO: 723602 - DNA, 13 bp, C. elegans
tatatgtatgtgt

SEQ ID NO: 723603 - DNA, 13 bp, C. elegans
tatatgtgtaaaa

SEQ ID NO: 723604 - DNA, 13 bp, C. elegans
tatatgttatatg

SEQ ID NO: 723605 - DNA, 13 bp, C. elegans
tatatgtttgaat

SEQ ID NO: 723606 - DNA, 13 bp, C. elegans
tatatgttttcaa

SEQ ID NO: 723607 - DNA, 13 bp, C. elegans
tatattcaaagaa

SEQ ID NO: 723608 - DNA, 13 bp, C. elegans
tatattcaatttc

SEQ ID NO: 723609 - DNA, 13 bp, C. elegans
tatattcagtttt

SEQ ID NO: 723610 - DNA, 13 bp, C. elegans
tatattcatttca

SEQ ID NO: 723611 - DNA, 13 bp, C. elegans
tatattccaaaaa

SEQ ID NO: 723612 - DNA, 13 bp, C. elegans
tatattctagttt

SEQ ID NO: 723613 - DNA, 13 bp, C. elegans
tatattctttcaa

SEQ ID NO: 723614 - DNA, 13 bp, C. elegans
tatattgataaga

SEQ ID NO: 723615 - DNA, 13 bp, C. elegans
tatattgatatct

SEQ ID NO: 723616 - DNA, 13 bp, C. elegans
tatattgatgaga

SEQ ID NO: 723617 - DNA, 13 bp, C. elegans
tatattgcaattt

SEQ ID NO: 723618 - DNA, 13 bp, C. elegans
tatatttacgaga

SEQ ID NO: 723619 - DNA, 13 bp, C. elegans
tatatttattccc

SEQ ID NO: 723620 - DNA, 13 bp, C. elegans
tatatttcaaatg

SEQ ID NO: 723621 - DNA, 13 bp, C. elegans
tatatttcaactt

SEQ ID NO: 723622 - DNA, 13 bp, C. elegans
tatatttcatttg

SEQ ID NO: 723623 - DNA, 13 bp, C. elegans
tatatttccaaat

SEQ ID NO: 723624 - DNA, 13 bp, C. elegans
tatatttcgaaat

SEQ ID NO: 723625 - DNA, 13 bp, C. elegans
tatatttctacat

SEQ ID NO: 723626 - DNA, 13 bp, C. elegans
tatatttctgatt

SEQ ID NO: 723627 - DNA, 13 bp, C. elegans
tatatttgactat

SEQ ID NO: 723628 - DNA, 13 bp, C. elegans
tatattttcgatt

SEQ ID NO: 723629 - DNA, 13 bp, C. elegans
tatattttctgta

SEQ ID NO: 723630 - DNA, 13 bp, C. elegans
tatattttggtag

SEQ ID NO: 723631 - DNA, 13 bp, C. elegans
tatattttgttca

SEQ ID NO: 723632 - DNA, 13 bp, C. elegans
tatatttttccag

SEQ ID NO: 723633 - DNA, 13 bp, C. elegans
tatatttttctga

SEQ ID NO: 723634 - DNA, 13 bp, C. elegans
tatatttttctgg

SEQ ID NO: 723635 - DNA, 13 bp, C. elegans
tatcaaaaaactt

SEQ ID NO: 723636 - DNA, 13 bp, C. elegans
tatcaaaaaattg

SEQ ID NO: 723637 - DNA, 13 bp, C. elegans
tatcaaaaacatt

SEQ ID NO: 723638 - DNA, 13 bp, C. elegans
tatcaaaaactca

SEQ ID NO: 723639 - DNA, 13 bp, C. elegans
tatcaaaaactga

SEQ ID NO: 723640 - DNA, 13 bp, C. elegans
tatcaaaaagaga

SEQ ID NO: 723641 - DNA, 13 bp, C. elegans
tatcaaaaagatt

SEQ ID NO: 723642 - DNA, 13 bp, C. elegans
tatcaaaaagtag

SEQ ID NO: 723643 - DNA, 13 bp, C. elegans
tatcaaaaagttt

SEQ ID NO: 723644 - DNA, 13 bp, C. elegans
tatcaaaaatctg

SEQ ID NO: 723645 - DNA, 13 bp, C. elegans
tatcaaaacatgt

SEQ ID NO: 723646 - DNA, 13 bp, C. elegans
tatcaaaacttca

SEQ ID NO: 723647 - DNA, 13 bp, C. elegans
tatcaaaacttga

SEQ ID NO: 723648 - DNA, 13 bp, C. elegans
tatcaaaactttc

SEQ ID NO: 723649 - DNA, 13 bp, C. elegans
tatcaaaagttca

SEQ ID NO: 723650 - DNA, 13 bp, C. elegans
tatcaaaagttta

SEQ ID NO: 723651 - DNA, 13 bp, C. elegans
tatcaaaatagaa

SEQ ID NO: 723652 - DNA, 13 bp, C. elegans
tatcaaaatattg

SEQ ID NO: 723653 - DNA, 13 bp, C. elegans
tatcaaaatgata

SEQ ID NO: 723654 - DNA, 13 bp, C. elegans
tatcaaaatgttt

SEQ ID NO: 723655 - DNA, 13 bp, C. elegans
tatcaaaattgaa

SEQ ID NO: 723656 - DNA, 13 bp, C. elegans
tatcaaagtttca

SEQ ID NO: 723657 - DNA, 13 bp, C. elegans
tatcaaatagttt

SEQ ID NO: 723658 - DNA, 13 bp, C. elegans
tatcaaattgaaa

SEQ ID NO: 723659 - DNA, 13 bp, C. elegans
tatcaaattgaat

SEQ ID NO: 723660 - DNA, 13 bp, C. elegans
tatcaaattgttt

SEQ ID NO: 723661 - DNA, 13 bp, C. elegans
tatcaaattttca

SEQ ID NO: 723662 - DNA, 13 bp, C. elegans
tatcaacaaattt

SEQ ID NO: 723663 - DNA, 13 bp, C. elegans
tatcaactacaaa

SEQ ID NO: 723664 - DNA, 13 bp, C. elegans
tatcaactatttt

SEQ ID NO: 723665 - DNA, 13 bp, C. elegans
tatcaactgataa

SEQ ID NO: 723666 - DNA, 13 bp, C. elegans
tatcaactttcaa

SEQ ID NO: 723667 - DNA, 13 bp, C. elegans
tatcaactttgtt

SEQ ID NO: 723668 - DNA, 13 bp, C. elegans
tatcaacttttca

SEQ ID NO: 723669 - DNA, 13 bp, C. elegans
tatcaagaaatca

SEQ ID NO: 723670 - DNA, 13 bp, C. elegans
tatcaataaattg

SEQ ID NO: 723671 - DNA, 13 bp, C. elegans
tatcaatatcaat

SEQ ID NO: 723672 - DNA, 13 bp, C. elegans
tatcaatatcttt

SEQ ID NO: 723673 - DNA, 13 bp, C. elegans
tatcaatgaaaat

SEQ ID NO: 723674 - DNA, 13 bp, C. elegans
tatcaatgatttt

SEQ ID NO: 723675 - DNA, 13 bp, C. elegans
tatcaatggaaaa

SEQ ID NO: 723676 - DNA, 13 bp, C. elegans
tatcaatgtcaaa

SEQ ID NO: 723677 - DNA, 13 bp, C. elegans
tatcaatgttttt

SEQ ID NO: 723678 - DNA, 13 bp, C. elegans
tatcaattatcac

SEQ ID NO: 723679 - DNA, 13 bp, C. elegans
tatcaattcaaat

SEQ ID NO: 723680 - DNA, 13 bp, C. elegans
tatcaattgaaaa

SEQ ID NO: 723681 - DNA, 13 bp, C. elegans
tatcaattgttat

SEQ ID NO: 723682 - DNA, 13 bp, C. elegans
tatcaatttagtt

SEQ ID NO: 723683 - DNA, 13 bp, C. elegans
tatcaatttcatt

SEQ ID NO: 723684 - DNA, 13 bp, C. elegans
tatcaatttctaa

SEQ ID NO: 723685 - DNA, 13 bp, C. elegans
tatcaatttctca

SEQ ID NO: 723686 - DNA, 13 bp, C. elegans
tatcaatttgaaa

SEQ ID NO: 723687 - DNA, 13 bp, C. elegans
tatcaattttcag

SEQ ID NO: 723688 - DNA, 13 bp, C. elegans
tatcaattttcat

SEQ ID NO: 723689 - DNA, 13 bp, C. elegans
tatcacaaaatta

SEQ ID NO: 723690 - DNA, 13 bp, C. elegans
tatcacaaaattt

SEQ ID NO: 723691 - DNA, 13 bp, C. elegans
tatcacaaatttc

SEQ ID NO: 723692 - DNA, 13 bp, C. elegans
tatcacaattgtt

SEQ ID NO: 723693 - DNA, 13 bp, C. elegans
tatcacaatttca

SEQ ID NO: 723694 - DNA, 13 bp, C. elegans
tatcacaattttc

SEQ ID NO: 723695 - DNA, 13 bp, C. elegans
tatcacacacaca

SEQ ID NO: 723696 - DNA, 13 bp, C. elegans
tatcactaatttt

SEQ ID NO: 723697 - DNA, 13 bp, C. elegans
tatcactgaaaaa

SEQ ID NO: 723698 - DNA, 13 bp, C. elegans
tatcactgataag

SEQ ID NO: 723699 - DNA, 13 bp, C. elegans
tatcacttcaaaa

SEQ ID NO: 723700 - DNA, 13 bp, C. elegans
tatcactttcaaa

SEQ ID NO: 723701 - DNA, 13 bp, C. elegans
tatcactttttca

SEQ ID NO: 723702 - DNA, 13 bp, C. elegans
tatcactttttgt

SEQ ID NO: 723703 - DNA, 13 bp, C. elegans
tatcagaaaagtt

SEQ ID NO: 723704 - DNA, 13 bp, C. elegans
tatcagaaaattt

SEQ ID NO: 723705 - DNA, 13 bp, C. elegans
tatcagaaatatg

SEQ ID NO: 723706 - DNA, 13 bp, C. elegans
tatcagagaaaaa

SEQ ID NO: 723707 - DNA, 13 bp, C. elegans
tatcaggaatcaa

SEQ ID NO: 723708 - DNA, 29 bp, C. elegans
tatcaggttgtcccataagtttttgtact

SEQ ID NO: 723709 - DNA, 13 bp, C. elegans
tatcagtcttgca

SEQ ID NO: 723710 - DNA, 13 bp, C. elegans
tatcagttaattt

SEQ ID NO: 723711 - DNA, 13 bp, C. elegans
tatcagtttttgt

SEQ ID NO: 723712 - DNA, 13 bp, C. elegans
tatcataattttc

SEQ ID NO: 723713 - DNA, 13 bp, C. elegans
tatcatattgaaa

SEQ ID NO: 723714 - DNA, 13 bp, C. elegans
tatcatatttgtg

SEQ ID NO: 723715 - DNA, 13 bp, C. elegans
tatcatcaatttc

SEQ ID NO: 723716 - DNA, 13 bp, C. elegans
tatcatcatcatc

SEQ ID NO: 723717 - DNA, 13 bp, C. elegans
tatcatcatttat

SEQ ID NO: 723718 - DNA, 13 bp, C. elegans
tatcatgaaaatt

SEQ ID NO: 723719 - DNA, 13 bp, C. elegans
tatcatgtttatt

SEQ ID NO: 723720 - DNA, 13 bp, C. elegans
tatcattaactct

SEQ ID NO: 723721 - DNA, 13 bp, C. elegans
tatcattacttat

SEQ ID NO: 723722 - DNA, 13 bp, C. elegans
tatcattatcatc

SEQ ID NO: 723723 - DNA, 13 bp, C. elegans
tatcattattttg

SEQ ID NO: 723724 - DNA, 13 bp, C. elegans
tatcattctgaaa

SEQ ID NO: 723725 - DNA, 13 bp, C. elegans
tatcatttcagaa

SEQ ID NO: 723726 - DNA, 13 bp, C. elegans
tatcattttaact

SEQ ID NO: 723727 - DNA, 13 bp, C. elegans
tatcattttctca

SEQ ID NO: 723728 - DNA, 13 bp, C. elegans
tatcatttttagt

SEQ ID NO: 723729 - DNA, 13 bp, C. elegans
tatcatttttgta

SEQ ID NO: 723730 - DNA, 13 bp, C. elegans
tatccaaaatttc

SEQ ID NO: 723731 - DNA, 13 bp, C. elegans
tatccaatttaat

SEQ ID NO: 723732 - DNA, 13 bp, C. elegans
tatccaatttcaa

SEQ ID NO: 723733 - DNA, 13 bp, C. elegans
tatccatcaccaa

SEQ ID NO: 723734 - DNA, 13 bp, C. elegans
tatccattttttg

SEQ ID NO: 723735 - DNA, 13 bp, C. elegans
tatcccaattttt

SEQ ID NO: 723736 - DNA, 13 bp, C. elegans
tatcccatgctca

SEQ ID NO: 723737 - DNA, 13 bp, C. elegans
tatccgaaaactt

SEQ ID NO: 723738 - DNA, 14 bp, C. elegans
tatccgaacgagta

SEQ ID NO: 723739 - DNA, 13 bp, C. elegans
tatccgaattgat

SEQ ID NO: 723740 - DNA, 13 bp, C. elegans
tatccggcaattt

SEQ ID NO: 723741 - DNA, 13 bp, C. elegans
tatccgtttttct

SEQ ID NO: 723742 - DNA, 13 bp, C. elegans
tatcctcacttct

SEQ ID NO: 723743 - DNA, 13 bp, C. elegans
tatccttacagta

SEQ ID NO: 723744 - DNA, 13 bp, C. elegans
tatcgaaaaaacg

SEQ ID NO: 723745 - DNA, 13 bp, C. elegans
tatcgaaaagttt

SEQ ID NO: 723746 - DNA, 13 bp, C. elegans
tatcgaaaatatt

SEQ ID NO: 723747 - DNA, 13 bp, C. elegans
tatcgaaacattt

SEQ ID NO: 723748 - DNA, 13 bp, C. elegans
tatcgaaataaaa

SEQ ID NO: 723749 - DNA, 13 bp, C. elegans
tatcgaattttat

SEQ ID NO: 723750 - DNA, 13 bp, C. elegans
tatcgaattttct

SEQ ID NO: 723751 - DNA, 13 bp, C. elegans
tatcgacttgaaa

SEQ ID NO: 723752 - DNA, 13 bp, C. elegans
tatcgactttttg

SEQ ID NO: 723753 - DNA, 13 bp, C. elegans
tatcgatcgattt

SEQ ID NO: 723754 - DNA, 13 bp, C. elegans
tatcgatttatcg

SEQ ID NO: 723755 - DNA, 13 bp, C. elegans
tatcgattttaag

SEQ ID NO: 723756 - DNA, 13 bp, C. elegans
tatcgattttcaa

SEQ ID NO: 723757 - DNA, 13 bp, C. elegans
tatcgattttcgg

SEQ ID NO: 723758 - DNA, 14 bp, C. elegans
tatcgattttctgt

SEQ ID NO: 723759 - DNA, 13 bp, C. elegans
tatcgattttctt

SEQ ID NO: 723760 - DNA, 13 bp, C. elegans
tatcgatttttaa

SEQ ID NO: 723761 - DNA, 13 bp, C. elegans
tatcgatttttat

SEQ ID NO: 723762 - DNA, 13 bp, C. elegans
tatcgatttttcg

SEQ ID NO: 723763 - DNA, 13 bp, C. elegans
tatcgcgtttttg

SEQ ID NO: 723764 - DNA, 13 bp, C. elegans
tatcggcaaattg

SEQ ID NO: 723765 - DNA, 13 bp, C. elegans
tatcgtatttcct

SEQ ID NO: 723766 - DNA, 13 bp, C. elegans
tatcgtcaatggg

SEQ ID NO: 723767 - DNA, 13 bp, C. elegans
tatcgttttctag

SEQ ID NO: 723768 - DNA, 13 bp, C. elegans
tatctaaagaaaa

SEQ ID NO: 723769 - DNA, 13 bp, C. elegans
tatctacaaaaat

SEQ ID NO: 723770 - DNA, 13 bp, C. elegans
tatctacaaaatg

SEQ ID NO: 723771 - DNA, 13 bp, C. elegans
tatctacactctc

SEQ ID NO: 723772 - DNA, 13 bp, C. elegans
tatctacatattt

SEQ ID NO: 723773 - DNA, 13 bp, C. elegans
tatctagagacac

SEQ ID NO: 723774 - DNA, 13 bp, C. elegans
tatctattcaaaa

SEQ ID NO: 723775 - DNA, 13 bp, C. elegans
tatctattcaaat

SEQ ID NO: 723776 - DNA, 13 bp, C. elegans
tatctattctctc

SEQ ID NO: 723777 - DNA, 13 bp, C. elegans
tatctcaaaaact

SEQ ID NO: 723778 - DNA, 13 bp, C. elegans
tatctcaaatttt

SEQ ID NO: 723779 - DNA, 13 bp, C. elegans
tatctcaaccacc

SEQ ID NO: 723780 - DNA, 13 bp, C. elegans
tatctcaattatt

SEQ ID NO: 723781 - DNA, 13 bp, C. elegans
tatctcagttatc

SEQ ID NO: 723782 - DNA, 13 bp, C. elegans
tatctcatttaat

SEQ ID NO: 723783 - DNA, 14 bp, C. elegans
tatctccgcgggga

SEQ ID NO: 723784 - DNA, 13 bp, C. elegans
tatctctatctct

SEQ ID NO: 723785 - DNA, 13 bp, C. elegans
tatctcttcaaaa

SEQ ID NO: 723786 - DNA, 13 bp, C. elegans
tatctcttcaaat

SEQ ID NO: 723787 - DNA, 13 bp, C. elegans
tatctgaaaaatt

SEQ ID NO: 723788 - DNA, 13 bp, C. elegans
tatctgaaaatct

SEQ ID NO: 723789 - DNA, 13 bp, C. elegans
tatctgaaaatgg

SEQ ID NO: 723790 - DNA, 13 bp, C. elegans
tatctgaaacagt

SEQ ID NO: 723791 - DNA, 13 bp, C. elegans
tatctgattttta

SEQ ID NO: 723792 - DNA, 13 bp, C. elegans
tatctggcaaatc

SEQ ID NO: 723793 - DNA, 13 bp, C. elegans
tatctgtaatttt

SEQ ID NO: 723794 - DNA, 13 bp, C. elegans
tatctgttcttat

SEQ ID NO: 723795 - DNA, 13 bp, C. elegans
tatcttcaaaaaa

SEQ ID NO: 723796 - DNA, 13 bp, C. elegans
tatcttcaaaatc

SEQ ID NO: 723797 - DNA, 13 bp, C. elegans
tatcttcaaaatg

SEQ ID NO: 723798 - DNA, 13 bp, C. elegans
tatcttcaaaatt

SEQ ID NO: 723799 - DNA, 13 bp, C. elegans
tatcttcaaactg

SEQ ID NO: 723800 - DNA, 13 bp, C. elegans
tatcttccaaaaa

SEQ ID NO: 723801 - DNA, 13 bp, C. elegans
tatcttccaatcg

SEQ ID NO: 723802 - DNA, 13 bp, C. elegans
tatcttctgttct

SEQ ID NO: 723803 - DNA, 13 bp, C. elegans
tatcttgaaaatt

SEQ ID NO: 723804 - DNA, 13 bp, C. elegans
tatcttgaatttt

SEQ ID NO: 723805 - DNA, 13 bp, C. elegans
tatcttgagaaaa

SEQ ID NO: 723806 - DNA, 13 bp, C. elegans
tatcttgtcaaaa

SEQ ID NO: 723807 - DNA, 13 bp, C. elegans
tatctttaaaact

SEQ ID NO: 723808 - DNA, 13 bp, C. elegans
tatctttgaaaat

SEQ ID NO: 723809 - DNA, 13 bp, C. elegans
tatcttttcaaaa

SEQ ID NO: 723810 - DNA, 13 bp, C. elegans
tatcttttcaaat

SEQ ID NO: 723811 - DNA, 13 bp, C. elegans
tatctttttgaat

SEQ ID NO: 723812 - DNA, 13 bp, C. elegans
tatctttttggaa

SEQ ID NO: 723813 - DNA, 13 bp, C. elegans
tatgaaaaacaat

SEQ ID NO: 723814 - DNA, 13 bp, C. elegans
tatgaaaaatcaa

SEQ ID NO: 723815 - DNA, 13 bp, C. elegans
tatgaaaaatcgg

SEQ ID NO: 723816 - DNA, 13 bp, C. elegans
tatgaaaaattca

SEQ ID NO: 723817 - DNA, 13 bp, C. elegans
tatgaaaacagaa

SEQ ID NO: 723818 - DNA, 13 bp, C. elegans
tatgaaaacattt

SEQ ID NO: 723819 - DNA, 13 bp, C. elegans
tatgaaaaccaaa

SEQ ID NO: 723820 - DNA, 13 bp, C. elegans
tatgaaaagtttt

SEQ ID NO: 723821 - DNA, 13 bp, C. elegans
tatgaaaatatct

SEQ ID NO: 723822 - DNA, 13 bp, C. elegans
tatgaaaatgtta

SEQ ID NO: 723823 - DNA, 13 bp, C. elegans
tatgaaaattgtt

SEQ ID NO: 723824 - DNA, 13 bp, C. elegans
tatgaaacagaaa

SEQ ID NO: 723825 - DNA, 13 bp, C. elegans
tatgaaacagcaa

SEQ ID NO: 723826 - DNA, 13 bp, C. elegans
tatgaaacattaa

SEQ ID NO: 723827 - DNA, 13 bp, C. elegans
tatgaaactgtaa

SEQ ID NO: 723828 - DNA, 13 bp, C. elegans
tatgaaacttaaa

SEQ ID NO: 723829 - DNA, 13 bp, C. elegans
tatgaaagaattt

SEQ ID NO: 723830 - DNA, 13 bp, C. elegans
tatgaaatcagtc

SEQ ID NO: 723831 - DNA, 13 bp, C. elegans
tatgaaattcaat

SEQ ID NO: 723832 - DNA, 13 bp, C. elegans
tatgaaattcgat

SEQ ID NO: 723833 - DNA, 13 bp, C. elegans
tatgaaattcgtt

SEQ ID NO: 723834 - DNA, 13 bp, C. elegans
tatgaaattgaaa

SEQ ID NO: 723835 - DNA, 13 bp, C. elegans
tatgaaattgatt

SEQ ID NO: 723836 - DNA, 13 bp, C. elegans
tatgaaatttgac

SEQ ID NO: 723837 - DNA, 13 bp, C. elegans
tatgaaattttca

SEQ ID NO: 723838 - DNA, 13 bp, C. elegans
tatgaaattttgt

SEQ ID NO: 723839 - DNA, 13 bp, C. elegans
tatgaacatttga

SEQ ID NO: 723840 - DNA, 13 bp, C. elegans
tatgaactaactt

SEQ ID NO: 723841 - DNA, 13 bp, C. elegans
tatgaactgtttt

SEQ ID NO: 723842 - DNA, 13 bp, C. elegans
tatgaacttgaaa

SEQ ID NO: 723843 - DNA, 13 bp, C. elegans
tatgaagcaaaaa

SEQ ID NO: 723844 - DNA, 13 bp, C. elegans
tatgaagtcattc

SEQ ID NO: 723845 - DNA, 13 bp, C. elegans
tatgaatagtttt

SEQ ID NO: 723846 - DNA, 13 bp, C. elegans
tatgaatatgaat

SEQ ID NO: 723847 - DNA, 13 bp, C. elegans
tatgaatatttca

SEQ ID NO: 723848 - DNA, 13 bp, C. elegans
tatgaatcatttt

SEQ ID NO: 723849 - DNA, 13 bp, C. elegans
tatgaattcaaat

SEQ ID NO: 723850 - DNA, 13 bp, C. elegans
tatgaatttcccg

SEQ ID NO: 723851 - DNA, 13 bp, C. elegans
tatgaatttctaa

SEQ ID NO: 723852 - DNA, 13 bp, C. elegans
tatgaatttgaaa

SEQ ID NO: 723853 - DNA, 13 bp, C. elegans
tatgaatttgaat

SEQ ID NO: 723854 - DNA, 13 bp, C. elegans
tatgaattttgaa

SEQ ID NO: 723855 - DNA, 13 bp, C. elegans
tatgaatttttct

SEQ ID NO: 723856 - DNA, 13 bp, C. elegans
tatgacagttttt

SEQ ID NO: 723857 - DNA, 13 bp, C. elegans
tatgacgtcactt

SEQ ID NO: 723858 - DNA, 13 bp, C. elegans
tatgacgtcatca

SEQ ID NO: 723859 - DNA, 13 bp, C. elegans
tatgacttgaaaa

SEQ ID NO: 723860 - DNA, 13 bp, C. elegans
tatgagaattttt

SEQ ID NO: 723861 - DNA, 13 bp, C. elegans
tatgagattttaa

SEQ ID NO: 723862 - DNA, 13 bp, C. elegans
tatgagcaattgg

SEQ ID NO: 723863 - DNA, 13 bp, C. elegans
tatgagccaagtt

SEQ ID NO: 723864 - DNA, 13 bp, C. elegans
tatgagcgaaatt

SEQ ID NO: 723865 - DNA, 13 bp, C. elegans
tatgagtgaaaaa

SEQ ID NO: 723866 - DNA, 13 bp, C. elegans
tatgatatagcta

SEQ ID NO: 723867 - DNA, 13 bp, C. elegans
tatgatattcaat

SEQ ID NO: 723868 - DNA, 13 bp, C. elegans
tatgatatttgat

SEQ ID NO: 723869 - DNA, 13 bp, C. elegans
tatgatattttgg

SEQ ID NO: 723870 - DNA, 13 bp, C. elegans
tatgatcaatttt

SEQ ID NO: 723871 - DNA, 13 bp, C. elegans
tatgatgatattt

SEQ ID NO: 723872 - DNA, 13 bp, C. elegans
tatgatgatgatg

SEQ ID NO: 723873 - DNA, 13 bp, C. elegans
tatgatgtttcaa

SEQ ID NO: 723874 - DNA, 13 bp, C. elegans
tatgatgtttgaa

SEQ ID NO: 723875 - DNA, 13 bp, C. elegans
tatgattactgta

SEQ ID NO: 723876 - DNA, 13 bp, C. elegans
tatgattatgatg

SEQ ID NO: 723877 - DNA, 13 bp, C. elegans
tatgattatttga

SEQ ID NO: 723878 - DNA, 13 bp, C. elegans
tatgattcttcat

SEQ ID NO: 723879 - DNA, 13 bp, C. elegans
tatgattggaaaa

SEQ ID NO: 723880 - DNA, 13 bp, C. elegans
tatgattttatga

SEQ ID NO: 723881 - DNA, 13 bp, C. elegans
tatgattttctat

SEQ ID NO: 723882 - DNA, 13 bp, C. elegans
tatgattttctca

SEQ ID NO: 723883 - DNA, 14 bp, C. elegans
tatgatttttcaaa

SEQ ID NO: 723884 - DNA, 13 bp, C. elegans
tatgatttttgac

SEQ ID NO: 723885 - DNA, 13 bp, C. elegans
tatgcaaaattaa

SEQ ID NO: 723886 - DNA, 13 bp, C. elegans
tatgcaaatttct

SEQ ID NO: 723887 - DNA, 13 bp, C. elegans
tatgcaacaaaaa

SEQ ID NO: 723888 - DNA, 13 bp, C. elegans
tatgcatattttt

SEQ ID NO: 723889 - DNA, 13 bp, C. elegans
tatgcatttttaa

SEQ ID NO: 723890 - DNA, 13 bp, C. elegans
tatgccaaatttc

SEQ ID NO: 723891 - DNA, 13 bp, C. elegans
tatgcctgcctac

SEQ ID NO: 723892 - DNA, 13 bp, C. elegans
tatgctacaaaaa

SEQ ID NO: 723893 - DNA, 13 bp, C. elegans
tatgctcattttt

SEQ ID NO: 723894 - DNA, 13 bp, C. elegans
tatgctcctttaa

SEQ ID NO: 723895 - DNA, 13 bp, C. elegans
tatgctgaaattg

SEQ ID NO: 723896 - DNA, 13 bp, C. elegans
tatgctgcattta

SEQ ID NO: 723897 - DNA, 13 bp, C. elegans
tatgcttcaaaat

SEQ ID NO: 723898 - DNA, 13 bp, C. elegans
tatgcttcttctt

SEQ ID NO: 723899 - DNA, 13 bp, C. elegans
tatgctttgaaaa

SEQ ID NO: 723900 - DNA, 13 bp, C. elegans
tatgcttttgaaa

SEQ ID NO: 723901 - DNA, 13 bp, C. elegans
tatggaaaaaaac

SEQ ID NO: 723902 - DNA, 13 bp, C. elegans
tatggaaaacttt

SEQ ID NO: 723903 - DNA, 13 bp, C. elegans
tatggaaaatatt

SEQ ID NO: 723904 - DNA, 13 bp, C. elegans
tatggaaaattga

SEQ ID NO: 723905 - DNA, 13 bp, C. elegans
tatggaaatgttt

SEQ ID NO: 723906 - DNA, 13 bp, C. elegans
tatggaaattcaa

SEQ ID NO: 723907 - DNA, 13 bp, C. elegans
tatggaaattgga

SEQ ID NO: 723908 - DNA, 13 bp, C. elegans
tatggaagttcaa

SEQ ID NO: 723909 - DNA, 13 bp, C. elegans
tatggaatttcaa

SEQ ID NO: 723910 - DNA, 13 bp, C. elegans
tatggaatttgaa

SEQ ID NO: 723911 - DNA, 13 bp, C. elegans
tatggagaacaaa

SEQ ID NO: 723912 - DNA, 13 bp, C. elegans
tatggataagaaa

SEQ ID NO: 723913 - DNA, 13 bp, C. elegans
tatggcaaaaaat

SEQ ID NO: 723914 - DNA, 13 bp, C. elegans
tatggcaaagtga

SEQ ID NO: 723915 - DNA, 13 bp, C. elegans
tatggcaattcaa

SEQ ID NO: 723916 - DNA, 13 bp, C. elegans
tatggcgggaaat

SEQ ID NO: 723917 - DNA, 14 bp, C. elegans
tatggctacaagaa

SEQ ID NO: 723918 - DNA, 13 bp, C. elegans
tatgggaaatatt

SEQ ID NO: 723919 - DNA, 13 bp, C. elegans
tatgggtgtcatt

SEQ ID NO: 723920 - DNA, 13 bp, C. elegans
tatggtaacacgt

SEQ ID NO: 723921 - DNA, 13 bp, C. elegans
tatggtgcatcga

SEQ ID NO: 723922 - DNA, 13 bp, C. elegans
tatggttttcaaa

SEQ ID NO: 723923 - DNA, 13 bp, C. elegans
tatgtaattagtt

SEQ ID NO: 723924 - DNA, 13 bp, C. elegans
tatgtacataaat

SEQ ID NO: 723925 - DNA, 13 bp, C. elegans
tatgtacatacat

SEQ ID NO: 723926 - DNA, 13 bp, C. elegans
tatgtacatattt

SEQ ID NO: 723927 - DNA, 13 bp, C. elegans
tatgtacctttaa

SEQ ID NO: 723928 - DNA, 13 bp, C. elegans
tatgtagatctac

SEQ ID NO: 723929 - DNA, 13 bp, C. elegans
tatgtatatacat

SEQ ID NO: 723930 - DNA, 13 bp, C. elegans
tatgtatatgaat

SEQ ID NO: 723931 - DNA, 13 bp, C. elegans
tatgtatcataaa

SEQ ID NO: 723932 - DNA, 13 bp, C. elegans
tatgtatgctttt

SEQ ID NO: 723933 - DNA, 13 bp, C. elegans
tatgtatgtacca

SEQ ID NO: 723934 - DNA, 13 bp, C. elegans
tatgtatgtactt

SEQ ID NO: 723935 - DNA, 13 bp, C. elegans
tatgtatgtagtt

SEQ ID NO: 723936 - DNA, 13 bp, C. elegans
tatgtatgtataa

SEQ ID NO: 723937 - DNA, 13 bp, C. elegans
tatgtatgtgaaa

SEQ ID NO: 723938 - DNA, 13 bp, C. elegans
tatgtatgtgtgt

SEQ ID NO: 723939 - DNA, 13 bp, C. elegans
tatgtattacatt

SEQ ID NO: 723940 - DNA, 13 bp, C. elegans
tatgtattcagtc

SEQ ID NO: 723941 - DNA, 13 bp, C. elegans
tatgtatttcaat

SEQ ID NO: 723942 - DNA, 13 bp, C. elegans
tatgtattttcat

SEQ ID NO: 723943 - DNA, 13 bp, C. elegans
tatgtattttcta

SEQ ID NO: 723944 - DNA, 13 bp, C. elegans
tatgtattttgca

SEQ ID NO: 723945 - DNA, 13 bp, C. elegans
tatgtcattttgt

SEQ ID NO: 723946 - DNA, 13 bp, C. elegans
tatgtcatttttc

SEQ ID NO: 723947 - DNA, 13 bp, C. elegans
tatgtgaaaattc

SEQ ID NO: 723948 - DNA, 13 bp, C. elegans
tatgtgcctttaa

SEQ ID NO: 723949 - DNA, 13 bp, C. elegans
tatgtgcgccttt

SEQ ID NO: 723950 - DNA, 13 bp, C. elegans
tatgtgtatgtgt

SEQ ID NO: 723951 - DNA, 13 bp, C. elegans
tatgtgtattcgg

SEQ ID NO: 723952 - DNA, 13 bp, C. elegans
tatgtgtttttca

SEQ ID NO: 723953 - DNA, 13 bp, C. elegans
tatgttaatttca

SEQ ID NO: 723954 - DNA, 13 bp, C. elegans
tatgttacaaaaa

SEQ ID NO: 723955 - DNA, 13 bp, C. elegans
tatgttagttgaa

SEQ ID NO: 723956 - DNA, 13 bp, C. elegans
tatgttatttgaa

SEQ ID NO: 723957 - DNA, 13 bp, C. elegans
tatgttcaaaaat

SEQ ID NO: 723958 - DNA, 13 bp, C. elegans
tatgttcaatttg

SEQ ID NO: 723959 - DNA, 13 bp, C. elegans
tatgttcatttat

SEQ ID NO: 723960 - DNA, 13 bp, C. elegans
tatgttcttcaaa

SEQ ID NO: 723961 - DNA, 13 bp, C. elegans
tatgttgataaaa

SEQ ID NO: 723962 - DNA, 13 bp, C. elegans
tatgttggaaaaa

SEQ ID NO: 723963 - DNA, 13 bp, C. elegans
tatgtttaaattg

SEQ ID NO: 723964 - DNA, 13 bp, C. elegans
tatgtttagaaaa

SEQ ID NO: 723965 - DNA, 13 bp, C. elegans
tatgtttgaatca

SEQ ID NO: 723966 - DNA, 13 bp, C. elegans
tatgttttagaaa

SEQ ID NO: 723967 - DNA, 13 bp, C. elegans
tatgttttatgaa

SEQ ID NO: 723968 - DNA, 13 bp, C. elegans
tatgttttcatgt

SEQ ID NO: 723969 - DNA, 13 bp, C. elegans
tatgtttttcact

SEQ ID NO: 723970 - DNA, 13 bp, C. elegans
tattaaaaaccac

SEQ ID NO: 723971 - DNA, 13 bp, C. elegans
tattaaacagttt

SEQ ID NO: 723972 - DNA, 13 bp, C. elegans
tattaaactttga

SEQ ID NO: 723973 - DNA, 13 bp, C. elegans
tattaaagatgga

SEQ ID NO: 723974 - DNA, 13 bp, C. elegans
tattaaattttgg

SEQ ID NO: 723975 - DNA, 13 bp, C. elegans
tattaagtactat

SEQ ID NO: 723976 - DNA, 13 bp, C. elegans
tattaatggaaaa

SEQ ID NO: 723977 - DNA, 13 bp, C. elegans
tattaatgttgat

SEQ ID NO: 723978 - DNA, 13 bp, C. elegans
tattacaactttt

SEQ ID NO: 723979 - DNA, 13 bp, C. elegans
tattacacaacat

SEQ ID NO: 723980 - DNA, 13 bp, C. elegans
tattacacaattt

SEQ ID NO: 723981 - DNA, 13 bp, C. elegans
tattacacattcg

SEQ ID NO: 723982 - DNA, 13 bp, C. elegans
tattacattttgt

SEQ ID NO: 723983 - DNA, 13 bp, C. elegans
tattactcaaaaa

SEQ ID NO: 723984 - DNA, 13 bp, C. elegans
tattactgaaaat

SEQ ID NO: 723985 - DNA, 13 bp, C. elegans
tattactgtttta

SEQ ID NO: 723986 - DNA, 13 bp, C. elegans
tattacttcaaaa

SEQ ID NO: 723987 - DNA, 13 bp, C. elegans
tattagtcttgca

SEQ ID NO: 723988 - DNA, 13 bp, C. elegans
tattagttgaaat

SEQ ID NO: 723989 - DNA, 13 bp, C. elegans
tattagtttgaaa

SEQ ID NO: 723990 - DNA, 13 bp, C. elegans
tattagttttcaa

SEQ ID NO: 723991 - DNA, 13 bp, C. elegans
tattatacatttg

SEQ ID NO: 723992 - DNA, 13 bp, C. elegans
tattatacgaaaa

SEQ ID NO: 723993 - DNA, 13 bp, C. elegans
tattatcaaccat

SEQ ID NO: 723994 - DNA, 13 bp, C. elegans
tattatcacaaaa

SEQ ID NO: 723995 - DNA, 13 bp, C. elegans
tattatccaaaaa

SEQ ID NO: 723996 - DNA, 13 bp, C. elegans
tattatcgatttt

SEQ ID NO: 723997 - DNA, 13 bp, C. elegans
tattatgaaattc

SEQ ID NO: 723998 - DNA, 13 bp, C. elegans
tattatgatccaa

SEQ ID NO: 723999 - DNA, 13 bp, C. elegans
tattatggggtta

SEQ ID NO: 724000 - DNA, 13 bp, C. elegans
tattattactgtt

SEQ ID NO: 724001 - DNA, 13 bp, C. elegans
tattattcaaact

SEQ ID NO: 724002 - DNA, 13 bp, C. elegans
tattattcaaatg

SEQ ID NO: 724003 - DNA, 13 bp, C. elegans
tattattccaatt

SEQ ID NO: 724004 - DNA, 13 bp, C. elegans
tattattcgaaaa

SEQ ID NO: 724005 - DNA, 13 bp, C. elegans
tattattgttgaa

SEQ ID NO: 724006 - DNA, 13 bp, C. elegans
tattatttcaatc

SEQ ID NO: 724007 - DNA, 13 bp, C. elegans
tattatttcagaa

SEQ ID NO: 724008 - DNA, 13 bp, C. elegans
tattattttggaa

SEQ ID NO: 724009 - DNA, 13 bp, C. elegans
tattatttttcag

SEQ ID NO: 724010 - DNA, 13 bp, C. elegans
tattcaaaaaact

SEQ ID NO: 724011 - DNA, 13 bp, C. elegans
tattcaaaaaatc

SEQ ID NO: 724012 - DNA, 13 bp, C. elegans
tattcaaaaactg

SEQ ID NO: 724013 - DNA, 13 bp, C. elegans
tattcaaaaatct

SEQ ID NO: 724014 - DNA, 13 bp, C. elegans
tattcaaaaattg

SEQ ID NO: 724015 - DNA, 13 bp, C. elegans
tattcaaaacctt

SEQ ID NO: 724016 - DNA, 13 bp, C. elegans
tattcaaaactaa

SEQ ID NO: 724017 - DNA, 13 bp, C. elegans
tattcaaaagaaa

SEQ ID NO: 724018 - DNA, 13 bp, C. elegans
tattcaaaagtat

SEQ ID NO: 724019 - DNA, 13 bp, C. elegans
tattcaaaatgtt

SEQ ID NO: 724020 - DNA, 13 bp, C. elegans
tattcaaacattt

SEQ ID NO: 724021 - DNA, 13 bp, C. elegans
tattcaaactatt

SEQ ID NO: 724022 - DNA, 13 bp, C. elegans
tattcaaactgaa

SEQ ID NO: 724023 - DNA, 13 bp, C. elegans
tattcaaactgtt

SEQ ID NO: 724024 - DNA, 13 bp, C. elegans
tattcaaacttca

SEQ ID NO: 724025 - DNA, 13 bp, C. elegans
tattcaaacttcc

SEQ ID NO: 724026 - DNA, 13 bp, C. elegans
tattcaaactttt

SEQ ID NO: 724027 - DNA, 13 bp, C. elegans
tattcaaagaaaa

SEQ ID NO: 724028 - DNA, 13 bp, C. elegans
tattcaaagtttt

SEQ ID NO: 724029 - DNA, 13 bp, C. elegans
tattcaaattgaa

SEQ ID NO: 724030 - DNA, 13 bp, C. elegans
tattcaaattgtt

SEQ ID NO: 724031 - DNA, 14 bp, C. elegans
tattcaaattttga

SEQ ID NO: 724032 - DNA, 13 bp, C. elegans
tattcaacaaaac

SEQ ID NO: 724033 - DNA, 13 bp, C. elegans
tattcaacaaatt

SEQ ID NO: 724034 - DNA, 13 bp, C. elegans
tattcaacaactt

SEQ ID NO: 724035 - DNA, 13 bp, C. elegans
tattcaacagaaa

SEQ ID NO: 724036 - DNA, 13 bp, C. elegans
tattcaacagttt

SEQ ID NO: 724037 - DNA, 13 bp, C. elegans
tattcaaccaaaa

SEQ ID NO: 724038 - DNA, 13 bp, C. elegans
tattcaactgaaa

SEQ ID NO: 724039 - DNA, 13 bp, C. elegans
tattcaagaaaat

SEQ ID NO: 724040 - DNA, 13 bp, C. elegans
tattcaagaaatt

SEQ ID NO: 724041 - DNA, 13 bp, C. elegans
tattcaagatttt

SEQ ID NO: 724042 - DNA, 13 bp, C. elegans
tattcaaggtttt

SEQ ID NO: 724043 - DNA, 13 bp, C. elegans
tattcaagtattt

SEQ ID NO: 724044 - DNA, 13 bp, C. elegans
tattcaagtttta

SEQ ID NO: 724045 - DNA, 13 bp, C. elegans
tattcaatcaaaa

SEQ ID NO: 724046 - DNA, 13 bp, C. elegans
tattcaatcaatt

SEQ ID NO: 724047 - DNA, 13 bp, C. elegans
tattcaatcattt

SEQ ID NO: 724048 - DNA, 13 bp, C. elegans
tattcaatgtttt

SEQ ID NO: 724049 - DNA, 13 bp, C. elegans
tattcaattcatt

SEQ ID NO: 724050 - DNA, 13 bp, C. elegans
tattcaattgaat

SEQ ID NO: 724051 - DNA, 13 bp, C. elegans
tattcaattgatt

SEQ ID NO: 724052 - DNA, 13 bp, C. elegans
tattcaattgttt

SEQ ID NO: 724053 - DNA, 13 bp, C. elegans
tattcaatttcag

SEQ ID NO: 724054 - DNA, 13 bp, C. elegans
tattcaatttcca

SEQ ID NO: 724055 - DNA, 13 bp, C. elegans
tattcacaaattt

SEQ ID NO: 724056 - DNA, 13 bp, C. elegans
tattcacgtgaaa

SEQ ID NO: 724057 - DNA, 13 bp, C. elegans
tattcactttgtt

SEQ ID NO: 724058 - DNA, 13 bp, C. elegans
tattcagaaaaat

SEQ ID NO: 724059 - DNA, 13 bp, C. elegans
tattcagaaacaa

SEQ ID NO: 724060 - DNA, 13 bp, C. elegans
tattcagattttt

SEQ ID NO: 724061 - DNA, 13 bp, C. elegans
tattcagctatca

SEQ ID NO: 724062 - DNA, 13 bp, C. elegans
tattcagtatttt

SEQ ID NO: 724063 - DNA, 13 bp, C. elegans
tattcagttattt

SEQ ID NO: 724064 - DNA, 13 bp, C. elegans
tattcagttcaaa

SEQ ID NO: 724065 - DNA, 13 bp, C. elegans
tattcagttgttt

SEQ ID NO: 724066 - DNA, 13 bp, C. elegans
tattcagtttgct

SEQ ID NO: 724067 - DNA, 13 bp, C. elegans
tattcataatttc

SEQ ID NO: 724068 - DNA, 13 bp, C. elegans
tattcatcaaaaa

SEQ ID NO: 724069 - DNA, 13 bp, C. elegans
tattcatcaattt

SEQ ID NO: 724070 - DNA, 13 bp, C. elegans
tattcatgaattt

SEQ ID NO: 724071 - DNA, 13 bp, C. elegans
tattcatgcattt

SEQ ID NO: 724072 - DNA, 13 bp, C. elegans
tattcattcaaat

SEQ ID NO: 724073 - DNA, 13 bp, C. elegans
tattcattccaaa

SEQ ID NO: 724074 - DNA, 13 bp, C. elegans
tattcattctaaa

SEQ ID NO: 724075 - DNA, 13 bp, C. elegans
tattcatttttag

SEQ ID NO: 724076 - DNA, 13 bp, C. elegans
tattcatttttcg

SEQ ID NO: 724077 - DNA, 13 bp, C. elegans
tattccaaaaatt

SEQ ID NO: 724078 - DNA, 13 bp, C. elegans
tattccaaaacaa

SEQ ID NO: 724079 - DNA, 13 bp, C. elegans
tattccaaaacat

SEQ ID NO: 724080 - DNA, 13 bp, C. elegans
tattccaaaatta

SEQ ID NO: 724081 - DNA, 13 bp, C. elegans
tattccaaaattc

SEQ ID NO: 724082 - DNA, 13 bp, C. elegans
tattccaaaattt

SEQ ID NO: 724083 - DNA, 13 bp, C. elegans
tattccaaactct

SEQ ID NO: 724084 - DNA, 13 bp, C. elegans
tattccaaataaa

SEQ ID NO: 724085 - DNA, 13 bp, C. elegans
tattccaaatatt

SEQ ID NO: 724086 - DNA, 13 bp, C. elegans
tattccaaattaa

SEQ ID NO: 724087 - DNA, 13 bp, C. elegans
tattccaaatttg

SEQ ID NO: 724088 - DNA, 13 bp, C. elegans
tattccaacaaaa

SEQ ID NO: 724089 - DNA, 13 bp, C. elegans
tattccaactttt

SEQ ID NO: 724090 - DNA, 13 bp, C. elegans
tattccaataaaa

SEQ ID NO: 724091 - DNA, 13 bp, C. elegans
tattccaattgtt

SEQ ID NO: 724092 - DNA, 13 bp, C. elegans
tattccaatttca

SEQ ID NO: 724093 - DNA, 13 bp, C. elegans
tattccagaattt

SEQ ID NO: 724094 - DNA, 13 bp, C. elegans
tattccatttaaa

SEQ ID NO: 724095 - DNA, 13 bp, C. elegans
tattccatttgaa

SEQ ID NO: 724096 - DNA, 13 bp, C. elegans
tattccattttcc

SEQ ID NO: 724097 - DNA, 13 bp, C. elegans
tattcccatcatt

SEQ ID NO: 724098 - DNA, 13 bp, C. elegans
tattccctaattg

SEQ ID NO: 724099 - DNA, 13 bp, C. elegans
tattcctacagta

SEQ ID NO: 724100 - DNA, 13 bp, C. elegans
tattcctcaaatt

SEQ ID NO: 724101 - DNA, 13 bp, C. elegans
tattcctttctca

SEQ ID NO: 724102 - DNA, 13 bp, C. elegans
tattcgaaaagaa

SEQ ID NO: 724103 - DNA, 13 bp, C. elegans
tattcgaaaataa

SEQ ID NO: 724104 - DNA, 13 bp, C. elegans
tattcgaaagaaa

SEQ ID NO: 724105 - DNA, 13 bp, C. elegans
tattcgaagaaaa

SEQ ID NO: 724106 - DNA, 13 bp, C. elegans
tattcgaataaat

SEQ ID NO: 724107 - DNA, 13 bp, C. elegans
tattcgaatacat

SEQ ID NO: 724108 - DNA, 13 bp, C. elegans
tattcgacatttt

SEQ ID NO: 724109 - DNA, 13 bp, C. elegans
tattcgataaaaa

SEQ ID NO: 724110 - DNA, 13 bp, C. elegans
tattcggaatcag

SEQ ID NO: 724111 - DNA, 13 bp, C. elegans
tattctaaaaatg

SEQ ID NO: 724112 - DNA, 13 bp, C. elegans
tattctaaacttt

SEQ ID NO: 724113 - DNA, 13 bp, C. elegans
tattctaacattt

SEQ ID NO: 724114 - DNA, 13 bp, C. elegans
tattctactggct

SEQ ID NO: 724115 - DNA, 13 bp, C. elegans
tattctagcaatt

SEQ ID NO: 724116 - DNA, 13 bp, C. elegans
tattctatcaaaa

SEQ ID NO: 724117 - DNA, 13 bp, C. elegans
tattctattgaaa

SEQ ID NO: 724118 - DNA, 13 bp, C. elegans
tattctcactgaa

SEQ ID NO: 724119 - DNA, 13 bp, C. elegans
tattctcagaaat

SEQ ID NO: 724120 - DNA, 13 bp, C. elegans
tattctcgaattt

SEQ ID NO: 724121 - DNA, 13 bp, C. elegans
tattctctattag

SEQ ID NO: 724122 - DNA, 13 bp, C. elegans
tattctcttcaaa

SEQ ID NO: 724123 - DNA, 13 bp, C. elegans
tattctgaacatt

SEQ ID NO: 724124 - DNA, 13 bp, C. elegans
tattctgatttta

SEQ ID NO: 724125 - DNA, 13 bp, C. elegans
tattctggaatgt

SEQ ID NO: 724126 - DNA, 13 bp, C. elegans
tattctggtcatt

SEQ ID NO: 724127 - DNA, 13 bp, C. elegans
tattcttcaaaaa

SEQ ID NO: 724128 - DNA, 13 bp, C. elegans
tattcttcaaaat

SEQ ID NO: 724129 - DNA, 13 bp, C. elegans
tattcttccaaaa

SEQ ID NO: 724130 - DNA, 13 bp, C. elegans
tattcttggaata

SEQ ID NO: 724131 - DNA, 13 bp, C. elegans
tattctttcaaaa

SEQ ID NO: 724132 - DNA, 13 bp, C. elegans
tattctttcaaat

SEQ ID NO: 724133 - DNA, 13 bp, C. elegans
tattctttgaaaa

SEQ ID NO: 724134 - DNA, 13 bp, C. elegans
tattctttgcgtt

SEQ ID NO: 724135 - DNA, 13 bp, C. elegans
tattcttttcaaa

SEQ ID NO: 724136 - DNA, 13 bp, C. elegans
tattcttttgaat

SEQ ID NO: 724137 - DNA, 13 bp, C. elegans
tattcttttggaa

SEQ ID NO: 724138 - DNA, 13 bp, C. elegans
tattgaaaaacca

SEQ ID NO: 724139 - DNA, 13 bp, C. elegans
tattgaaaaacct

SEQ ID NO: 724140 - DNA, 13 bp, C. elegans
tattgaaaaactg

SEQ ID NO: 724141 - DNA, 13 bp, C. elegans
tattgaaaaatcg

SEQ ID NO: 724142 - DNA, 13 bp, C. elegans
tattgaaaacatt

SEQ ID NO: 724143 - DNA, 13 bp, C. elegans
tattgaaaacgat

SEQ ID NO: 724144 - DNA, 13 bp, C. elegans
tattgaaaatcac

SEQ ID NO: 724145 - DNA, 13 bp, C. elegans
tattgaaaatgaa

SEQ ID NO: 724146 - DNA, 13 bp, C. elegans
tattgaaaatgtt

SEQ ID NO: 724147 - DNA, 13 bp, C. elegans
tattgaaaattgg

SEQ ID NO: 724148 - DNA, 13 bp, C. elegans
tattgaaaatttc

SEQ ID NO: 724149 - DNA, 13 bp, C. elegans
tattgaaacaaaa

SEQ ID NO: 724150 - DNA, 13 bp, C. elegans
tattgaaactgat

SEQ ID NO: 724151 - DNA, 13 bp, C. elegans
tattgaaactgta

SEQ ID NO: 724152 - DNA, 13 bp, C. elegans
tattgaaacttct

SEQ ID NO: 724153 - DNA, 13 bp, C. elegans
tattgaaagttat

SEQ ID NO: 724154 - DNA, 13 bp, C. elegans
tattgaaatcaat

SEQ ID NO: 724155 - DNA, 13 bp, C. elegans
tattgaaattagt

SEQ ID NO: 724156 - DNA, 13 bp, C. elegans
tattgaaattcaa

SEQ ID NO: 724157 - DNA, 13 bp, C. elegans
tattgaaattgat

SEQ ID NO: 724158 - DNA, 13 bp, C. elegans
tattgaaatttct

SEQ ID NO: 724159 - DNA, 13 bp, C. elegans
tattgaaatttgt

SEQ ID NO: 724160 - DNA, 13 bp, C. elegans
tattgaaattttg

SEQ ID NO: 724161 - DNA, 13 bp, C. elegans
tattgaacaacat

SEQ ID NO: 724162 - DNA, 13 bp, C. elegans
tattgaacaattt

SEQ ID NO: 724163 - DNA, 14 bp, C. elegans
tattgaacaatttt

SEQ ID NO: 724164 - DNA, 13 bp, C. elegans
tattgaacatttt

SEQ ID NO: 724165 - DNA, 13 bp, C. elegans
tattgaacttttg

SEQ ID NO: 724166 - DNA, 13 bp, C. elegans
tattgaagaaaat

SEQ ID NO: 724167 - DNA, 13 bp, C. elegans
tattgaagaattt

SEQ ID NO: 724168 - DNA, 13 bp, C. elegans
tattgaagatgtt

SEQ ID NO: 724169 - DNA, 13 bp, C. elegans
tattgaagttgaa

SEQ ID NO: 724170 - DNA, 13 bp, C. elegans
tattgaatgttta

SEQ ID NO: 724171 - DNA, 13 bp, C. elegans
tattgaattgaat

SEQ ID NO: 724172 - DNA, 13 bp, C. elegans
tattgagaaaaat

SEQ ID NO: 724173 - DNA, 13 bp, C. elegans
tattgagaagaaa

SEQ ID NO: 724174 - DNA, 13 bp, C. elegans
tattgagatattt

SEQ ID NO: 724175 - DNA, 13 bp, C. elegans
tattgagtttgaa

SEQ ID NO: 724176 - DNA, 13 bp, C. elegans
tattgataagaaa

SEQ ID NO: 724177 - DNA, 13 bp, C. elegans
tattgataattca

SEQ ID NO: 724178 - DNA, 13 bp, C. elegans
tattgatattttc

SEQ ID NO: 724179 - DNA, 13 bp, C. elegans
tattgatgaaaaa

SEQ ID NO: 724180 - DNA, 13 bp, C. elegans
tattgattcaaaa

SEQ ID NO: 724181 - DNA, 13 bp, C. elegans
tattgattgaaac

SEQ ID NO: 724182 - DNA, 13 bp, C. elegans
tattgatttcaat

SEQ ID NO: 724183 - DNA, 13 bp, C. elegans
tattgatttctat

SEQ ID NO: 724184 - DNA, 13 bp, C. elegans
tattgattttacg

SEQ ID NO: 724185 - DNA, 13 bp, C. elegans
tattgattttagg

SEQ ID NO: 724186 - DNA, 13 bp, C. elegans
tattgattttcag

SEQ ID NO: 724187 - DNA, 13 bp, C. elegans
tattgattttccg

SEQ ID NO: 724188 - DNA, 13 bp, C. elegans
tattgattttcga

SEQ ID NO: 724189 - DNA, 13 bp, C. elegans
tattgatttttac

SEQ ID NO: 724190 - DNA, 13 bp, C. elegans
tattgatttttcg

SEQ ID NO: 724191 - DNA, 13 bp, C. elegans
tattgcaaaaatg

SEQ ID NO: 724192 - DNA, 13 bp, C. elegans
tattgcaaaactt

SEQ ID NO: 724193 - DNA, 13 bp, C. elegans
tattgcaaataat

SEQ ID NO: 724194 - DNA, 13 bp, C. elegans
tattgcaattttg

SEQ ID NO: 724195 - DNA, 13 bp, C. elegans
tattgcaattttt

SEQ ID NO: 724196 - DNA, 13 bp, C. elegans
tattgcacatttt

SEQ ID NO: 724197 - DNA, 13 bp, C. elegans
tattgcatacttt

SEQ ID NO: 724198 - DNA, 13 bp, C. elegans
tattgcatgtttc

SEQ ID NO: 724199 - DNA, 13 bp, C. elegans
tattgcatttttg

SEQ ID NO: 724200 - DNA, 13 bp, C. elegans
tattgccaaaaaa

SEQ ID NO: 724201 - DNA, 13 bp, C. elegans
tattgccagtttt

SEQ ID NO: 724202 - DNA, 13 bp, C. elegans
tattgctctaaat

SEQ ID NO: 724203 - DNA, 13 bp, C. elegans
tattgcttttaaa

SEQ ID NO: 724204 - DNA, 13 bp, C. elegans
tattgcttttata

SEQ ID NO: 724205 - DNA, 13 bp, C. elegans
tattggaaaaaca

SEQ ID NO: 724206 - DNA, 13 bp, C. elegans
tattggaaaataa

SEQ ID NO: 724207 - DNA, 13 bp, C. elegans
tattggaaaatat

SEQ ID NO: 724208 - DNA, 13 bp, C. elegans
tattggaaaatgg

SEQ ID NO: 724209 - DNA, 13 bp, C. elegans
tattggaaataaa

SEQ ID NO: 724210 - DNA, 13 bp, C. elegans
tattggaaatgaa

SEQ ID NO: 724211 - DNA, 13 bp, C. elegans
tattggaacattt

SEQ ID NO: 724212 - DNA, 13 bp, C. elegans
tattggaagaaaa

SEQ ID NO: 724213 - DNA, 13 bp, C. elegans
tattggaatattt

SEQ ID NO: 724214 - DNA, 13 bp, C. elegans
tattggagaaaat

SEQ ID NO: 724215 - DNA, 13 bp, C. elegans
tattggattagaa

SEQ ID NO: 724216 - DNA, 13 bp, C. elegans
tattggattcaag

SEQ ID NO: 724217 - DNA, 13 bp, C. elegans
tattggcagaaaa

SEQ ID NO: 724218 - DNA, 13 bp, C. elegans
tattggggaaaaa

SEQ ID NO: 724219 - DNA, 13 bp, C. elegans
tattggttttctg

SEQ ID NO: 724220 - DNA, 13 bp, C. elegans
tattgtaacattt

SEQ ID NO: 724221 - DNA, 13 bp, C. elegans
tattgtacaattt

SEQ ID NO: 724222 - DNA, 13 bp, C. elegans
tattgtagaaata

SEQ ID NO: 724223 - DNA, 13 bp, C. elegans
tattgtatcggaa

SEQ ID NO: 724224 - DNA, 13 bp, C. elegans
tattgtatgaaaa

SEQ ID NO: 724225 - DNA, 13 bp, C. elegans
tattgtattcatt

SEQ ID NO: 724226 - DNA, 13 bp, C. elegans
tattgtatttcaa

SEQ ID NO: 724227 - DNA, 13 bp, C. elegans
tattgtatttcac

SEQ ID NO: 724228 - DNA, 13 bp, C. elegans
tattgtcaatttt

SEQ ID NO: 724229 - DNA, 13 bp, C. elegans
tattgtcatttta

SEQ ID NO: 724230 - DNA, 13 bp, C. elegans
tattgtctttcat

SEQ ID NO: 724231 - DNA, 13 bp, C. elegans
tattgtgaataaa

SEQ ID NO: 724232 - DNA, 13 bp, C. elegans
tattgtgccaaaa

SEQ ID NO: 724233 - DNA, 13 bp, C. elegans
tattgttaacttt

SEQ ID NO: 724234 - DNA, 13 bp, C. elegans
tattgttcagttt

SEQ ID NO: 724235 - DNA, 13 bp, C. elegans
tattgttccaatt

SEQ ID NO: 724236 - DNA, 13 bp, C. elegans
tattgtttcaaaa

SEQ ID NO: 724237 - DNA, 13 bp, C. elegans
tattgtttcaaac

SEQ ID NO: 724238 - DNA, 13 bp, C. elegans
tattgtttcacaa

SEQ ID NO: 724239 - DNA, 13 bp, C. elegans
tattgtttcagtt

SEQ ID NO: 724240 - DNA, 13 bp, C. elegans
tattgtttctaaa

SEQ ID NO: 724241 - DNA, 13 bp, C. elegans
tattgttttaaac

SEQ ID NO: 724242 - DNA, 13 bp, C. elegans
tattgtttttgca

SEQ ID NO: 724243 - DNA, 13 bp, C. elegans
tatttaaatacag

SEQ ID NO: 724244 - DNA, 13 bp, C. elegans
tatttaaatgtgt

SEQ ID NO: 724245 - DNA, 13 bp, C. elegans
tatttaaattcca

SEQ ID NO: 724246 - DNA, 13 bp, C. elegans
tatttaacaacaa

SEQ ID NO: 724247 - DNA, 13 bp, C. elegans
tatttaatttgca

SEQ ID NO: 724248 - DNA, 13 bp, C. elegans
tatttaattttcg

SEQ ID NO: 724249 - DNA, 13 bp, C. elegans
tatttacacaaaa

SEQ ID NO: 724250 - DNA, 13 bp, C. elegans
tatttacacattt

SEQ ID NO: 724251 - DNA, 13 bp, C. elegans
tatttacatttca

SEQ ID NO: 724252 - DNA, 13 bp, C. elegans
tatttaccattaa

SEQ ID NO: 724253 - DNA, 13 bp, C. elegans
tatttacgatatg

SEQ ID NO: 724254 - DNA, 13 bp, C. elegans
tatttacggaaaa

SEQ ID NO: 724255 - DNA, 13 bp, C. elegans
tatttagaaaatg

SEQ ID NO: 724256 - DNA, 13 bp, C. elegans
tatttagaacaaa

SEQ ID NO: 724257 - DNA, 13 bp, C. elegans
tatttatcagttt

SEQ ID NO: 724258 - DNA, 13 bp, C. elegans
tatttatcgattt

SEQ ID NO: 724259 - DNA, 13 bp, C. elegans
tatttatgacttt

SEQ ID NO: 724260 - DNA, 13 bp, C. elegans
tatttatgtgaaa

SEQ ID NO: 724261 - DNA, 13 bp, C. elegans
tatttattcaaag

SEQ ID NO: 724262 - DNA, 13 bp, C. elegans
tatttattcagtt

SEQ ID NO: 724263 - DNA, 13 bp, C. elegans
tatttattcccaa

SEQ ID NO: 724264 - DNA, 13 bp, C. elegans
tatttattgcaaa

SEQ ID NO: 724265 - DNA, 13 bp, C. elegans
tatttatttacca

SEQ ID NO: 724266 - DNA, 13 bp, C. elegans
tatttatttgact

SEQ ID NO: 724267 - DNA, 13 bp, C. elegans
tatttattttcag

SEQ ID NO: 724268 - DNA, 13 bp, C. elegans
tatttcaaaaaac

SEQ ID NO: 724269 - DNA, 13 bp, C. elegans
tatttcaaaaact

SEQ ID NO: 724270 - DNA, 13 bp, C. elegans
tatttcaaaagtg

SEQ ID NO: 724271 - DNA, 13 bp, C. elegans
tatttcaaacaaa

SEQ ID NO: 724272 - DNA, 13 bp, C. elegans
tatttcaaacttc

SEQ ID NO: 724273 - DNA, 13 bp, C. elegans
tatttcaaagaat

SEQ ID NO: 724274 - DNA, 13 bp, C. elegans
tatttcaaagatt

SEQ ID NO: 724275 - DNA, 13 bp, C. elegans
tatttcaaagctt

SEQ ID NO: 724276 - DNA, 13 bp, C. elegans
tatttcaaatatc

SEQ ID NO: 724277 - DNA, 13 bp, C. elegans
tatttcaaatgta

SEQ ID NO: 724278 - DNA, 13 bp, C. elegans
tatttcaaatgtt

SEQ ID NO: 724279 - DNA, 13 bp, C. elegans
tatttcaagaaaa

SEQ ID NO: 724280 - DNA, 13 bp, C. elegans
tatttcaagttaa

SEQ ID NO: 724281 - DNA, 13 bp, C. elegans
tatttcaagttat

SEQ ID NO: 724282 - DNA, 13 bp, C. elegans
tatttcaattcta

SEQ ID NO: 724283 - DNA, 13 bp, C. elegans
tatttcaattgtt

SEQ ID NO: 724284 - DNA, 13 bp, C. elegans
tatttcaatttcc

SEQ ID NO: 724285 - DNA, 13 bp, C. elegans
tatttcacaaatt

SEQ ID NO: 724286 - DNA, 13 bp, C. elegans
tatttcacaattt

SEQ ID NO: 724287 - DNA, 13 bp, C. elegans
tatttcacattta

SEQ ID NO: 724288 - DNA, 13 bp, C. elegans
tatttcactctct

SEQ ID NO: 724289 - DNA, 13 bp, C. elegans
tatttcagaatat

SEQ ID NO: 724290 - DNA, 13 bp, C. elegans
tatttcagaattt

SEQ ID NO: 724291 - DNA, 13 bp, C. elegans
tatttcagattat

SEQ ID NO: 724292 - DNA, 13 bp, C. elegans
tatttcagatttt

SEQ ID NO: 724293 - DNA, 13 bp, C. elegans
tatttcagcttaa

SEQ ID NO: 724294 - DNA, 13 bp, C. elegans
tatttcagtaatt

SEQ ID NO: 724295 - DNA, 13 bp, C. elegans
tatttcagtgatc

SEQ ID NO: 724296 - DNA, 13 bp, C. elegans
tatttcagtttat

SEQ ID NO: 724297 - DNA, 13 bp, C. elegans
tatttcagtttct

SEQ ID NO: 724298 - DNA, 13 bp, C. elegans
tatttcatcaaaa

SEQ ID NO: 724299 - DNA, 13 bp, C. elegans
tatttcatcaata

SEQ ID NO: 724300 - DNA, 13 bp, C. elegans
tatttcatgtaac

SEQ ID NO: 724301 - DNA, 13 bp, C. elegans
tatttcattagaa

SEQ ID NO: 724302 - DNA, 13 bp, C. elegans
tatttcattcgtt

SEQ ID NO: 724303 - DNA, 13 bp, C. elegans
tatttcatttcca

SEQ ID NO: 724304 - DNA, 13 bp, C. elegans
tatttccaaattt

SEQ ID NO: 724305 - DNA, 13 bp, C. elegans
tatttccaattaa

SEQ ID NO: 724306 - DNA, 13 bp, C. elegans
tatttccaattta

SEQ ID NO: 724307 - DNA, 13 bp, C. elegans
tatttccaatttc

SEQ ID NO: 724308 - DNA, 13 bp, C. elegans
tatttccacaaaa

SEQ ID NO: 724309 - DNA, 13 bp, C. elegans
tatttccgaaaaa

SEQ ID NO: 724310 - DNA, 13 bp, C. elegans
tatttccgttttc

SEQ ID NO: 724311 - DNA, 13 bp, C. elegans
tatttcctcaatt

SEQ ID NO: 724312 - DNA, 13 bp, C. elegans
tatttcctgtttc

SEQ ID NO: 724313 - DNA, 13 bp, C. elegans
tatttcctttgaa

SEQ ID NO: 724314 - DNA, 13 bp, C. elegans
tatttcgaaaaaa

SEQ ID NO: 724315 - DNA, 13 bp, C. elegans
tatttcgaaaatt

SEQ ID NO: 724316 - DNA, 13 bp, C. elegans
tatttcgaaagtt

SEQ ID NO: 724317 - DNA, 13 bp, C. elegans
tatttcgaaatat

SEQ ID NO: 724318 - DNA, 13 bp, C. elegans
tatttcgacaaaa

SEQ ID NO: 724319 - DNA, 13 bp, C. elegans
tatttcgagtcaa

SEQ ID NO: 724320 - DNA, 13 bp, C. elegans
tatttcgatttct

SEQ ID NO: 724321 - DNA, 13 bp, C. elegans
tatttcgatttga

SEQ ID NO: 724322 - DNA, 13 bp, C. elegans
tatttcgcaatat

SEQ ID NO: 724323 - DNA, 13 bp, C. elegans
tatttcgcaattt

SEQ ID NO: 724324 - DNA, 14 bp, C. elegans
tatttcgcatggtt

SEQ ID NO: 724325 - DNA, 13 bp, C. elegans
tatttcgcatttt

SEQ ID NO: 724326 - DNA, 13 bp, C. elegans
tatttcgttaatt

SEQ ID NO: 724327 - DNA, 13 bp, C. elegans
tatttctaacatt

SEQ ID NO: 724328 - DNA, 13 bp, C. elegans
tatttctacgatt

SEQ ID NO: 724329 - DNA, 13 bp, C. elegans
tatttctagaaaa

SEQ ID NO: 724330 - DNA, 13 bp, C. elegans
tatttctatcaaa

SEQ ID NO: 724331 - DNA, 13 bp, C. elegans
tatttctatttga

SEQ ID NO: 724332 - DNA, 13 bp, C. elegans
tatttctcacaat

SEQ ID NO: 724333 - DNA, 13 bp, C. elegans
tatttctcagttt

SEQ ID NO: 724334 - DNA, 13 bp, C. elegans
tatttctccaaat

SEQ ID NO: 724335 - DNA, 13 bp, C. elegans
tatttctcgattt

SEQ ID NO: 724336 - DNA, 13 bp, C. elegans
tatttctctacaa

SEQ ID NO: 724337 - DNA, 13 bp, C. elegans
tatttctctcaag

SEQ ID NO: 724338 - DNA, 13 bp, C. elegans
tatttctgaaact

SEQ ID NO: 724339 - DNA, 13 bp, C. elegans
tatttctgaagaa

SEQ ID NO: 724340 - DNA, 13 bp, C. elegans
tatttctgaattt

SEQ ID NO: 724341 - DNA, 13 bp, C. elegans
tatttctgatcat

SEQ ID NO: 724342 - DNA, 13 bp, C. elegans
tatttctgatgtt

SEQ ID NO: 724343 - DNA, 13 bp, C. elegans
tatttctgcaatt

SEQ ID NO: 724344 - DNA, 13 bp, C. elegans
tatttctgccaac

SEQ ID NO: 724345 - DNA, 13 bp, C. elegans
tatttctggattt

SEQ ID NO: 724346 - DNA, 13 bp, C. elegans
tatttctgtaact

SEQ ID NO: 724347 - DNA, 13 bp, C. elegans
tatttctgtatta

SEQ ID NO: 724348 - DNA, 13 bp, C. elegans
tatttctgtgaaa

SEQ ID NO: 724349 - DNA, 13 bp, C. elegans
tatttctgttaaa

SEQ ID NO: 724350 - DNA, 13 bp, C. elegans
tatttctgttgaa

SEQ ID NO: 724351 - DNA, 13 bp, C. elegans
tatttcttccaaa

SEQ ID NO: 724352 - DNA, 13 bp, C. elegans
tatttcttcgaga

SEQ ID NO: 724353 - DNA, 13 bp, C. elegans
tatttcttgtaat

SEQ ID NO: 724354 - DNA, 13 bp, C. elegans
tatttcttgtcat

SEQ ID NO: 724355 - DNA, 13 bp, C. elegans
tatttcttgtggc

SEQ ID NO: 724356 - DNA, 13 bp, C. elegans
tatttctttgaaa

SEQ ID NO: 724357 - DNA, 13 bp, C. elegans
tatttctttgaat

SEQ ID NO: 724358 - DNA, 13 bp, C. elegans
tatttgaaaacat

SEQ ID NO: 724359 - DNA, 13 bp, C. elegans
tatttgaaaagtt

SEQ ID NO: 724360 - DNA, 13 bp, C. elegans
tatttgaaaatgt

SEQ ID NO: 724361 - DNA, 13 bp, C. elegans
tatttgaaacatt

SEQ ID NO: 724362 - DNA, 13 bp, C. elegans
tatttgaagaaaa

SEQ ID NO: 724363 - DNA, 13 bp, C. elegans
tatttgaaggaaa

SEQ ID NO: 724364 - DNA, 13 bp, C. elegans
tatttgaatattc

SEQ ID NO: 724365 - DNA, 13 bp, C. elegans
tatttgaatattg

SEQ ID NO: 724366 - DNA, 13 bp, C. elegans
tatttgaatttga

SEQ ID NO: 724367 - DNA, 13 bp, C. elegans
tatttgacagctt

SEQ ID NO: 724368 - DNA, 13 bp, C. elegans
tatttgacatttt

SEQ ID NO: 724369 - DNA, 13 bp, C. elegans
tatttgacgcgcg

SEQ ID NO: 724370 - DNA, 13 bp, C. elegans
tatttgagaagaa

SEQ ID NO: 724371 - DNA, 13 bp, C. elegans
tatttgagatttc

SEQ ID NO: 724372 - DNA, 13 bp, C. elegans
tatttgagcttga

SEQ ID NO: 724373 - DNA, 13 bp, C. elegans
tatttgatcaatt

SEQ ID NO: 724374 - DNA, 13 bp, C. elegans
tatttgattcaat

SEQ ID NO: 724375 - DNA, 13 bp, C. elegans
tatttgcaaaaaa

SEQ ID NO: 724376 - DNA, 13 bp, C. elegans
tatttgcactttt

SEQ ID NO: 724377 - DNA, 13 bp, C. elegans
tatttgccggaaa

SEQ ID NO: 724378 - DNA, 13 bp, C. elegans
tatttgctcattt

SEQ ID NO: 724379 - DNA, 13 bp, C. elegans
tatttgctttaaa

SEQ ID NO: 724380 - DNA, 13 bp, C. elegans
tatttggaaaaaa

SEQ ID NO: 724381 - DNA, 13 bp, C. elegans
tatttggaaacat

SEQ ID NO: 724382 - DNA, 13 bp, C. elegans
tatttggaaagta

SEQ ID NO: 724383 - DNA, 13 bp, C. elegans
tatttggaaattt

SEQ ID NO: 724384 - DNA, 13 bp, C. elegans
tatttggaacaat

SEQ ID NO: 724385 - DNA, 13 bp, C. elegans
tatttggaagttt

SEQ ID NO: 724386 - DNA, 13 bp, C. elegans
tatttggacattt

SEQ ID NO: 724387 - DNA, 13 bp, C. elegans
tatttggcaattt

SEQ ID NO: 724388 - DNA, 13 bp, C. elegans
tatttggcggcaa

SEQ ID NO: 724389 - DNA, 13 bp, C. elegans
tatttgggaattt

SEQ ID NO: 724390 - DNA, 13 bp, C. elegans
tatttggttgtgc

SEQ ID NO: 724391 - DNA, 13 bp, C. elegans
tatttgtaacttt

SEQ ID NO: 724392 - DNA, 13 bp, C. elegans
tatttgtattgaa

SEQ ID NO: 724393 - DNA, 13 bp, C. elegans
tatttgtcaaaaa

SEQ ID NO: 724394 - DNA, 13 bp, C. elegans
tatttgtgaagtt

SEQ ID NO: 724395 - DNA, 13 bp, C. elegans
tatttgtgcaaaa

SEQ ID NO: 724396 - DNA, 13 bp, C. elegans
tatttgttccaaa

SEQ ID NO: 724397 - DNA, 13 bp, C. elegans
tatttgttgaaaa

SEQ ID NO: 724398 - DNA, 13 bp, C. elegans
tatttgttggaaa

SEQ ID NO: 724399 - DNA, 13 bp, C. elegans
tatttgttgtaaa

SEQ ID NO: 724400 - DNA, 13 bp, C. elegans
tatttgtttcaaa

SEQ ID NO: 724401 - DNA, 13 bp, C. elegans
tatttgtttgaaa

SEQ ID NO: 724402 - DNA, 13 bp, C. elegans
tatttgttttcca

SEQ ID NO: 724403 - DNA, 13 bp, C. elegans
tattttaaacatc

SEQ ID NO: 724404 - DNA, 13 bp, C. elegans
tattttaaatctg

SEQ ID NO: 724405 - DNA, 13 bp, C. elegans
tattttaaattcc

SEQ ID NO: 724406 - DNA, 13 bp, C. elegans
tattttaagcaaa

SEQ ID NO: 724407 - DNA, 13 bp, C. elegans
tattttaatcgaa

SEQ ID NO: 724408 - DNA, 13 bp, C. elegans
tattttagaactt

SEQ ID NO: 724409 - DNA, 13 bp, C. elegans
tattttagttgaa

SEQ ID NO: 724410 - DNA, 13 bp, C. elegans
tattttatagcaa

SEQ ID NO: 724411 - DNA, 13 bp, C. elegans
tattttatcagtt

SEQ ID NO: 724412 - DNA, 13 bp, C. elegans
tattttatgattc

SEQ ID NO: 724413 - DNA, 13 bp, C. elegans
tattttatgccta

SEQ ID NO: 724414 - DNA, 13 bp, C. elegans
tattttattcaag

SEQ ID NO: 724415 - DNA, 13 bp, C. elegans
tattttattgact

SEQ ID NO: 724416 - DNA, 13 bp, C. elegans
tattttattgcaa

SEQ ID NO: 724417 - DNA, 13 bp, C. elegans
tattttcaaaaac

SEQ ID NO: 724418 - DNA, 13 bp, C. elegans
tattttcaaaacc

SEQ ID NO: 724419 - DNA, 13 bp, C. elegans
tattttcaaaatc

SEQ ID NO: 724420 - DNA, 13 bp, C. elegans
tattttcaaatca

SEQ ID NO: 724421 - DNA, 13 bp, C. elegans
tattttcaagaaa

SEQ ID NO: 724422 - DNA, 13 bp, C. elegans
tattttcaagaag

SEQ ID NO: 724423 - DNA, 13 bp, C. elegans
tattttcaattca

SEQ ID NO: 724424 - DNA, 13 bp, C. elegans
tattttcacttga

SEQ ID NO: 724425 - DNA, 13 bp, C. elegans
tattttcagaaaa

SEQ ID NO: 724426 - DNA, 13 bp, C. elegans
tattttcagcatt

SEQ ID NO: 724427 - DNA, 13 bp, C. elegans
tattttcagtatt

SEQ ID NO: 724428 - DNA, 13 bp, C. elegans
tattttcagttta

SEQ ID NO: 724429 - DNA, 13 bp, C. elegans
tattttcatgtaa

SEQ ID NO: 724430 - DNA, 13 bp, C. elegans
tattttcattgaa

SEQ ID NO: 724431 - DNA, 13 bp, C. elegans
tattttccaaaaa

SEQ ID NO: 724432 - DNA, 13 bp, C. elegans
tattttccaactt

SEQ ID NO: 724433 - DNA, 13 bp, C. elegans
tattttccaatat

SEQ ID NO: 724434 - DNA, 13 bp, C. elegans
tattttccacagt

SEQ ID NO: 724435 - DNA, 13 bp, C. elegans
tattttccactaa

SEQ ID NO: 724436 - DNA, 13 bp, C. elegans
tattttcccactt

SEQ ID NO: 724437 - DNA, 13 bp, C. elegans
tattttcccgttt

SEQ ID NO: 724438 - DNA, 13 bp, C. elegans
tattttccgatta

SEQ ID NO: 724439 - DNA, 13 bp, C. elegans
tattttccgattt

SEQ ID NO: 724440 - DNA, 13 bp, C. elegans
tattttcctagtt

SEQ ID NO: 724441 - DNA, 13 bp, C. elegans
tattttcgaaaaa

SEQ ID NO: 724442 - DNA, 13 bp, C. elegans
tattttcgaagtt

SEQ ID NO: 724443 - DNA, 13 bp, C. elegans
tattttcgagtat

SEQ ID NO: 724444 - DNA, 13 bp, C. elegans
tattttcgccgaa

SEQ ID NO: 724445 - DNA, 13 bp, C. elegans
tattttcggcatt

SEQ ID NO: 724446 - DNA, 13 bp, C. elegans
tattttctaaact

SEQ ID NO: 724447 - DNA, 13 bp, C. elegans
tattttctaacaa

SEQ ID NO: 724448 - DNA, 13 bp, C. elegans
tattttctacaag

SEQ ID NO: 724449 - DNA, 13 bp, C. elegans
tattttctagtaa

SEQ ID NO: 724450 - DNA, 13 bp, C. elegans
tattttctccaaa

SEQ ID NO: 724451 - DNA, 13 bp, C. elegans
tattttctctgaa

SEQ ID NO: 724452 - DNA, 13 bp, C. elegans
tattttctgataa

SEQ ID NO: 724453 - DNA, 13 bp, C. elegans
tattttctgcatt

SEQ ID NO: 724454 - DNA, 13 bp, C. elegans
tattttctggaat

SEQ ID NO: 724455 - DNA, 13 bp, C. elegans
tattttctgtaaa

SEQ ID NO: 724456 - DNA, 13 bp, C. elegans
tattttctgtaat

SEQ ID NO: 724457 - DNA, 13 bp, C. elegans
tattttcttcaaa

SEQ ID NO: 724458 - DNA, 13 bp, C. elegans
tattttcttccaa

SEQ ID NO: 724459 - DNA, 13 bp, C. elegans
tattttcttgaaa

SEQ ID NO: 724460 - DNA, 13 bp, C. elegans
tattttgaaaact

SEQ ID NO: 724461 - DNA, 13 bp, C. elegans
tattttgaaaagt

SEQ ID NO: 724462 - DNA, 13 bp, C. elegans
tattttgaaaatg

SEQ ID NO: 724463 - DNA, 13 bp, C. elegans
tattttgaaagtt

SEQ ID NO: 724464 - DNA, 13 bp, C. elegans
tattttgaagact

SEQ ID NO: 724465 - DNA, 13 bp, C. elegans
tattttgaagtaa

SEQ ID NO: 724466 - DNA, 13 bp, C. elegans
tattttgaagttg

SEQ ID NO: 724467 - DNA, 13 bp, C. elegans
tattttgaatgaa

SEQ ID NO: 724468 - DNA, 13 bp, C. elegans
tattttgaattac

SEQ ID NO: 724469 - DNA, 13 bp, C. elegans
tattttgaattca

SEQ ID NO: 724470 - DNA, 13 bp, C. elegans
tattttgacaatt

SEQ ID NO: 724471 - DNA, 13 bp, C. elegans
tattttgagaatt

SEQ ID NO: 724472 - DNA, 13 bp, C. elegans
tattttgagtata

SEQ ID NO: 724473 - DNA, 13 bp, C. elegans
tattttgagtgta

SEQ ID NO: 724474 - DNA, 13 bp, C. elegans
tattttgagttga

SEQ ID NO: 724475 - DNA, 13 bp, C. elegans
tattttgatgaga

SEQ ID NO: 724476 - DNA, 13 bp, C. elegans
tattttgatgctt

SEQ ID NO: 724477 - DNA, 13 bp, C. elegans
tattttgatttca

SEQ ID NO: 724478 - DNA, 13 bp, C. elegans
tattttgcatatt

SEQ ID NO: 724479 - DNA, 13 bp, C. elegans
tattttgccagtt

SEQ ID NO: 724480 - DNA, 13 bp, C. elegans
tattttgcggaaa

SEQ ID NO: 724481 - DNA, 13 bp, C. elegans
tattttgctcatt

SEQ ID NO: 724482 - DNA, 13 bp, C. elegans
tattttgcttcaa

SEQ ID NO: 724483 - DNA, 13 bp, C. elegans
tattttggaaatt

SEQ ID NO: 724484 - DNA, 13 bp, C. elegans
tattttggaactt

SEQ ID NO: 724485 - DNA, 13 bp, C. elegans
tattttggaagct

SEQ ID NO: 724486 - DNA, 13 bp, C. elegans
tattttggcattt

SEQ ID NO: 724487 - DNA, 13 bp, C. elegans
tattttgtagaaa

SEQ ID NO: 724488 - DNA, 13 bp, C. elegans
tattttgtagaat

SEQ ID NO: 724489 - DNA, 13 bp, C. elegans
tattttgtcaaaa

SEQ ID NO: 724490 - DNA, 13 bp, C. elegans
tattttgtcagct

SEQ ID NO: 724491 - DNA, 13 bp, C. elegans
tattttgtcagtt

SEQ ID NO: 724492 - DNA, 13 bp, C. elegans
tattttgtcatgt

SEQ ID NO: 724493 - DNA, 13 bp, C. elegans
tattttgtcgaaa

SEQ ID NO: 724494 - DNA, 13 bp, C. elegans
tattttgtctaaa

SEQ ID NO: 724495 - DNA, 13 bp, C. elegans
tattttgtgtcaa

SEQ ID NO: 724496 - DNA, 13 bp, C. elegans
tattttgttcaat

SEQ ID NO: 724497 - DNA, 13 bp, C. elegans
tattttgttgcaa

SEQ ID NO: 724498 - DNA, 13 bp, C. elegans
tattttgttggaa

SEQ ID NO: 724499 - DNA, 13 bp, C. elegans
tattttgtttcaa

SEQ ID NO: 724500 - DNA, 13 bp, C. elegans
tatttttaaagtc

SEQ ID NO: 724501 - DNA, 13 bp, C. elegans
tatttttaactga

SEQ ID NO: 724502 - DNA, 13 bp, C. elegans
tatttttaagtct

SEQ ID NO: 724503 - DNA, 13 bp, C. elegans
tatttttagagat

SEQ ID NO: 724504 - DNA, 13 bp, C. elegans
tatttttagcgca

SEQ ID NO: 724505 - DNA, 13 bp, C. elegans
tatttttagtgca

SEQ ID NO: 724506 - DNA, 13 bp, C. elegans
tatttttatcacc

SEQ ID NO: 724507 - DNA, 13 bp, C. elegans
tatttttattcag

SEQ ID NO: 724508 - DNA, 13 bp, C. elegans
tatttttattcga

SEQ ID NO: 724509 - DNA, 13 bp, C. elegans
tatttttcaaact

SEQ ID NO: 724510 - DNA, 13 bp, C. elegans
tatttttcaccga

SEQ ID NO: 724511 - DNA, 13 bp, C. elegans
tatttttcagcaa

SEQ ID NO: 724512 - DNA, 13 bp, C. elegans
tatttttcatcaa

SEQ ID NO: 724513 - DNA, 14 bp, C. elegans
tatttttcattgaa

SEQ ID NO: 724514 - DNA, 13 bp, C. elegans
tatttttccaaaa

SEQ ID NO: 724515 - DNA, 13 bp, C. elegans
tatttttccaact

SEQ ID NO: 724516 - DNA, 13 bp, C. elegans
tatttttccacat

SEQ ID NO: 724517 - DNA, 13 bp, C. elegans
tatttttcccaga

SEQ ID NO: 724518 - DNA, 13 bp, C. elegans
tatttttccgata

SEQ ID NO: 724519 - DNA, 13 bp, C. elegans
tatttttccggtt

SEQ ID NO: 724520 - DNA, 13 bp, C. elegans
tatttttcctgta

SEQ ID NO: 724521 - DNA, 13 bp, C. elegans
tatttttcgaaat

SEQ ID NO: 724522 - DNA, 13 bp, C. elegans
tatttttcgagat

SEQ ID NO: 724523 - DNA, 13 bp, C. elegans
tatttttcgagtt

SEQ ID NO: 724524 - DNA, 13 bp, C. elegans
tatttttcgatgg

SEQ ID NO: 724525 - DNA, 13 bp, C. elegans
tatttttcgtctg

SEQ ID NO: 724526 - DNA, 13 bp, C. elegans
tatttttctaaac

SEQ ID NO: 724527 - DNA, 13 bp, C. elegans
tatttttctccac

SEQ ID NO: 724528 - DNA, 13 bp, C. elegans
tatttttctgaca

SEQ ID NO: 724529 - DNA, 13 bp, C. elegans
tatttttctgtaa

SEQ ID NO: 724530 - DNA, 13 bp, C. elegans
tatttttcttgaa

SEQ ID NO: 724531 - DNA, 13 bp, C. elegans
tatttttgaaaca

SEQ ID NO: 724532 - DNA, 13 bp, C. elegans
tatttttgaacaa

SEQ ID NO: 724533 - DNA, 13 bp, C. elegans
tatttttgaacga

SEQ ID NO: 724534 - DNA, 13 bp, C. elegans
tatttttgaagca

SEQ ID NO: 724535 - DNA, 13 bp, C. elegans
tatttttgaatag

SEQ ID NO: 724536 - DNA, 13 bp, C. elegans
tatttttgacaat

SEQ ID NO: 724537 - DNA, 13 bp, C. elegans
tatttttgactat

SEQ ID NO: 724538 - DNA, 13 bp, C. elegans
tatttttgatcta

SEQ ID NO: 724539 - DNA, 13 bp, C. elegans
tatttttgcaatt

SEQ ID NO: 724540 - DNA, 13 bp, C. elegans
tatttttgcattc

SEQ ID NO: 724541 - DNA, 13 bp, C. elegans
tatttttgcctat

SEQ ID NO: 724542 - DNA, 13 bp, C. elegans
tatttttgcgatt

SEQ ID NO: 724543 - DNA, 13 bp, C. elegans
tatttttgctaaa

SEQ ID NO: 724544 - DNA, 13 bp, C. elegans
tatttttgctcat

SEQ ID NO: 724545 - DNA, 13 bp, C. elegans
tatttttgctcga

SEQ ID NO: 724546 - DNA, 13 bp, C. elegans
tatttttgctgta

SEQ ID NO: 724547 - DNA, 13 bp, C. elegans
tatttttgcttga

SEQ ID NO: 724548 - DNA, 13 bp, C. elegans
tatttttggaaaa

SEQ ID NO: 724549 - DNA, 13 bp, C. elegans
tatttttggaaat

SEQ ID NO: 724550 - DNA, 13 bp, C. elegans
tatttttggaaca

SEQ ID NO: 724551 - DNA, 13 bp, C. elegans
tatttttggaact

SEQ ID NO: 724552 - DNA, 13 bp, C. elegans
tatttttggagct

SEQ ID NO: 724553 - DNA, 13 bp, C. elegans
tatttttggctat

SEQ ID NO: 724554 - DNA, 13 bp, C. elegans
tatttttgtatca

SEQ ID NO: 724555 - DNA, 13 bp, C. elegans
tattttttaacga

SEQ ID NO: 724556 - DNA, 13 bp, C. elegans
tattttttcaaca

SEQ ID NO: 724557 - DNA, 13 bp, C. elegans
tattttttccaaa

SEQ ID NO: 724558 - DNA, 13 bp, C. elegans
tattttttcgata

SEQ ID NO: 724559 - DNA, 13 bp, C. elegans
tattttttcgcaa

SEQ ID NO: 724560 - DNA, 13 bp, C. elegans
tattttttcgctg

SEQ ID NO: 724561 - DNA, 13 bp, C. elegans
tattttttcgggt

SEQ ID NO: 724562 - DNA, 13 bp, C. elegans
tattttttctacg

SEQ ID NO: 724563 - DNA, 14 bp, C. elegans
tattttttgcatat

SEQ ID NO: 724564 - DNA, 13 bp, C. elegans
tattttttgctaa

SEQ ID NO: 724565 - DNA, 13 bp, C. elegans
tattttttgggaa

SEQ ID NO: 724566 - DNA, 13 bp, C. elegans
tatttttttcaga

SEQ ID NO: 724567 - DNA, 13 bp, C. elegans
tatttttttccgg

SEQ ID NO: 724568 - DNA, 13 bp, C. elegans
tatttttttgacc

SEQ ID NO: 724569 - DNA, 13 bp, C. elegans
tatttttttgcaa

SEQ ID NO: 724570 - DNA, 13 bp, C. elegans
tcaaaaaaaagtt

SEQ ID NO: 724571 - DNA, 13 bp, C. elegans
tcaaaaaaaattg

SEQ ID NO: 724572 - DNA, 13 bp, C. elegans
tcaaaaaaacatg

SEQ ID NO: 724573 - DNA, 13 bp, C. elegans
tcaaaaaaagtgg

SEQ ID NO: 724574 - DNA, 13 bp, C. elegans
tcaaaaaaatatg

SEQ ID NO: 724575 - DNA, 13 bp, C. elegans
tcaaaaaaatgtt

SEQ ID NO: 724576 - DNA, 13 bp, C. elegans
tcaaaaaaatttc

SEQ ID NO: 724577 - DNA, 13 bp, C. elegans
tcaaaaaacaatg

SEQ ID NO: 724578 - DNA, 13 bp, C. elegans
tcaaaaaacattt

SEQ ID NO: 724579 - DNA, 13 bp, C. elegans
tcaaaaaaccgaa

SEQ ID NO: 724580 - DNA, 13 bp, C. elegans
tcaaaaaacgcga

SEQ ID NO: 724581 - DNA, 13 bp, C. elegans
tcaaaaaacgtca

SEQ ID NO: 724582 - DNA, 13 bp, C. elegans
tcaaaaaactatc

SEQ ID NO: 724583 - DNA, 13 bp, C. elegans
tcaaaaaactcga

SEQ ID NO: 724584 - DNA, 13 bp, C. elegans
tcaaaaaactgaa

SEQ ID NO: 724585 - DNA, 13 bp, C. elegans
tcaaaaaactgat

SEQ ID NO: 724586 - DNA, 13 bp, C. elegans
tcaaaaaactgct

SEQ ID NO: 724587 - DNA, 13 bp, C. elegans
tcaaaaaactgtt

SEQ ID NO: 724588 - DNA, 13 bp, C. elegans
tcaaaaaacttca

SEQ ID NO: 724589 - DNA, 13 bp, C. elegans
tcaaaaaacttcc

SEQ ID NO: 724590 - DNA, 13 bp, C. elegans
tcaaaaaactttt

SEQ ID NO: 724591 - DNA, 13 bp, C. elegans
tcaaaaaagtcaa

SEQ ID NO: 724592 - DNA, 13 bp, C. elegans
tcaaaaaagtcta

SEQ ID NO: 724593 - DNA, 13 bp, C. elegans
tcaaaaaagtgat

SEQ ID NO: 724594 - DNA, 13 bp, C. elegans
tcaaaaaagtttc

SEQ ID NO: 724595 - DNA, 13 bp, C. elegans
tcaaaaaagtttg

SEQ ID NO: 724596 - DNA, 13 bp, C. elegans
tcaaaaaatactt

SEQ ID NO: 724597 - DNA, 13 bp, C. elegans
tcaaaaaatagct

SEQ ID NO: 724598 - DNA, 13 bp, C. elegans
tcaaaaaatattg

SEQ ID NO: 724599 - DNA, 13 bp, C. elegans
tcaaaaaatcagt

SEQ ID NO: 724600 - DNA, 13 bp, C. elegans
tcaaaaaatcatt

SEQ ID NO: 724601 - DNA, 13 bp, C. elegans
tcaaaaaatcgaa

SEQ ID NO: 724602 - DNA, 13 bp, C. elegans
tcaaaaaatctga

SEQ ID NO: 724603 - DNA, 13 bp, C. elegans
tcaaaaaatcttt

SEQ ID NO: 724604 - DNA, 13 bp, C. elegans
tcaaaaaatgaag

SEQ ID NO: 724605 - DNA, 13 bp, C. elegans
tcaaaaaatgatc

SEQ ID NO: 724606 - DNA, 13 bp, C. elegans
tcaaaaaatgcat

SEQ ID NO: 724607 - DNA, 13 bp, C. elegans
tcaaaaaatggtt

SEQ ID NO: 724608 - DNA, 13 bp, C. elegans
tcaaaaaatgtta

SEQ ID NO: 724609 - DNA, 13 bp, C. elegans
tcaaaaaatgttc

SEQ ID NO: 724610 - DNA, 13 bp, C. elegans
tcaaaaaatgttt

SEQ ID NO: 724611 - DNA, 13 bp, C. elegans
tcaaaaaattact

SEQ ID NO: 724612 - DNA, 13 bp, C. elegans
tcaaaaaattatc

SEQ ID NO: 724613 - DNA, 13 bp, C. elegans
tcaaaaaattctt

SEQ ID NO: 724614 - DNA, 13 bp, C. elegans
tcaaaaaattgag

SEQ ID NO: 724615 - DNA, 13 bp, C. elegans
tcaaaaaattgcc

SEQ ID NO: 724616 - DNA, 13 bp, C. elegans
tcaaaaaatttca

SEQ ID NO: 724617 - DNA, 13 bp, C. elegans
tcaaaaaattttc

SEQ ID NO: 724618 - DNA, 13 bp, C. elegans
tcaaaaacaaagt

SEQ ID NO: 724619 - DNA, 13 bp, C. elegans
tcaaaaacagtta

SEQ ID NO: 724620 - DNA, 13 bp, C. elegans
tcaaaaacattct

SEQ ID NO: 724621 - DNA, 13 bp, C. elegans
tcaaaaaccatca

SEQ ID NO: 724622 - DNA, 13 bp, C. elegans
tcaaaaaccatta

SEQ ID NO: 724623 - DNA, 13 bp, C. elegans
tcaaaaacccaat

SEQ ID NO: 724624 - DNA, 13 bp, C. elegans
tcaaaaacctcca

SEQ ID NO: 724625 - DNA, 13 bp, C. elegans
tcaaaaaccttca

SEQ ID NO: 724626 - DNA, 13 bp, C. elegans
tcaaaaacctttc

SEQ ID NO: 724627 - DNA, 13 bp, C. elegans
tcaaaaacgaatt

SEQ ID NO: 724628 - DNA, 13 bp, C. elegans
tcaaaaacgcaaa

SEQ ID NO: 724629 - DNA, 13 bp, C. elegans
tcaaaaactatta

SEQ ID NO: 724630 - DNA, 13 bp, C. elegans
tcaaaaactcaga

SEQ ID NO: 724631 - DNA, 13 bp, C. elegans
tcaaaaactctca

SEQ ID NO: 724632 - DNA, 13 bp, C. elegans
tcaaaaactcttt

SEQ ID NO: 724633 - DNA, 13 bp, C. elegans
tcaaaaactgata

SEQ ID NO: 724634 - DNA, 13 bp, C. elegans
tcaaaaactgtat

SEQ ID NO: 724635 - DNA, 13 bp, C. elegans
tcaaaaactgttc

SEQ ID NO: 724636 - DNA, 13 bp, C. elegans
tcaaaaacttcaa

SEQ ID NO: 724637 - DNA, 13 bp, C. elegans
tcaaaaacttcag

SEQ ID NO: 724638 - DNA, 13 bp, C. elegans
tcaaaaacttcca

SEQ ID NO: 724639 - DNA, 13 bp, C. elegans
tcaaaaacttctg

SEQ ID NO: 724640 - DNA, 13 bp, C. elegans
tcaaaaacttgaa

SEQ ID NO: 724641 - DNA, 13 bp, C. elegans
tcaaaaacttgtg

SEQ ID NO: 724642 - DNA, 13 bp, C. elegans
tcaaaaacttgtt

SEQ ID NO: 724643 - DNA, 13 bp, C. elegans
tcaaaaactttgt

SEQ ID NO: 724644 - DNA, 13 bp, C. elegans
tcaaaaacttttc

SEQ ID NO: 724645 - DNA, 14 bp, C. elegans
tcaaaaactttttg

SEQ ID NO: 724646 - DNA, 13 bp, C. elegans
tcaaaaagaattc

SEQ ID NO: 724647 - DNA, 13 bp, C. elegans
tcaaaaagatcaa

SEQ ID NO: 724648 - DNA, 13 bp, C. elegans
tcaaaaagatgaa

SEQ ID NO: 724649 - DNA, 13 bp, C. elegans
tcaaaaagattga

SEQ ID NO: 724650 - DNA, 13 bp, C. elegans
tcaaaaagcaaag

SEQ ID NO: 724651 - DNA, 13 bp, C. elegans
tcaaaaagcaatg

SEQ ID NO: 724652 - DNA, 13 bp, C. elegans
tcaaaaagctcaa

SEQ ID NO: 724653 - DNA, 13 bp, C. elegans
tcaaaaagcttct

SEQ ID NO: 724654 - DNA, 13 bp, C. elegans
tcaaaaagcttta

SEQ ID NO: 724655 - DNA, 13 bp, C. elegans
tcaaaaaggaatt

SEQ ID NO: 724656 - DNA, 13 bp, C. elegans
tcaaaaaggcaca

SEQ ID NO: 724657 - DNA, 13 bp, C. elegans
tcaaaaagggaaa

SEQ ID NO: 724658 - DNA, 13 bp, C. elegans
tcaaaaagtcaaa

SEQ ID NO: 724659 - DNA, 13 bp, C. elegans
tcaaaaagtcaag

SEQ ID NO: 724660 - DNA, 13 bp, C. elegans
tcaaaaagtcttt

SEQ ID NO: 724661 - DNA, 13 bp, C. elegans
tcaaaaagtgaaa

SEQ ID NO: 724662 - DNA, 13 bp, C. elegans
tcaaaaagtgaca

SEQ ID NO: 724663 - DNA, 13 bp, C. elegans
tcaaaaagtgcag

SEQ ID NO: 724664 - DNA, 13 bp, C. elegans
tcaaaaagtgctc

SEQ ID NO: 724665 - DNA, 13 bp, C. elegans
tcaaaaagtgtat

SEQ ID NO: 724666 - DNA, 13 bp, C. elegans
tcaaaaagtgtgt

SEQ ID NO: 724667 - DNA, 13 bp, C. elegans
tcaaaaagttaat

SEQ ID NO: 724668 - DNA, 13 bp, C. elegans
tcaaaaagttcga

SEQ ID NO: 724669 - DNA, 13 bp, C. elegans
tcaaaaagttcta

SEQ ID NO: 724670 - DNA, 13 bp, C. elegans
tcaaaaagttgct

SEQ ID NO: 724671 - DNA, 13 bp, C. elegans
tcaaaaagttgta

SEQ ID NO: 724672 - DNA, 13 bp, C. elegans
tcaaaaagttgtc

SEQ ID NO: 724673 - DNA, 13 bp, C. elegans
tcaaaaagttttc

SEQ ID NO: 724674 - DNA, 13 bp, C. elegans
tcaaaaataaagt

SEQ ID NO: 724675 - DNA, 13 bp, C. elegans
tcaaaaatacatt

SEQ ID NO: 724676 - DNA, 13 bp, C. elegans
tcaaaaatacgca

SEQ ID NO: 724677 - DNA, 13 bp, C. elegans
tcaaaaatactga

SEQ ID NO: 724678 - DNA, 13 bp, C. elegans
tcaaaaatagact

SEQ ID NO: 724679 - DNA, 13 bp, C. elegans
tcaaaaatatcac

SEQ ID NO: 724680 - DNA, 13 bp, C. elegans
tcaaaaatatcta

SEQ ID NO: 724681 - DNA, 13 bp, C. elegans
tcaaaaatattcc

SEQ ID NO: 724682 - DNA, 13 bp, C. elegans
tcaaaaatatttc

SEQ ID NO: 724683 - DNA, 13 bp, C. elegans
tcaaaaatcacag

SEQ ID NO: 724684 - DNA, 13 bp, C. elegans
tcaaaaatcattg

SEQ ID NO: 724685 - DNA, 13 bp, C. elegans
tcaaaaatccaat

SEQ ID NO: 724686 - DNA, 13 bp, C. elegans
tcaaaaatccagt

SEQ ID NO: 724687 - DNA, 13 bp, C. elegans
tcaaaaatcgaaa

SEQ ID NO: 724688 - DNA, 13 bp, C. elegans
tcaaaaatcgagc

SEQ ID NO: 724689 - DNA, 13 bp, C. elegans
tcaaaaatcgata

SEQ ID NO: 724690 - DNA, 14 bp, C. elegans
tcaaaaatcgataa

SEQ ID NO: 724691 - DNA, 13 bp, C. elegans
tcaaaaatcggcg

SEQ ID NO: 724692 - DNA, 13 bp, C. elegans
tcaaaaatcgtga

SEQ ID NO: 724693 - DNA, 13 bp, C. elegans
tcaaaaatctata

SEQ ID NO: 724694 - DNA, 13 bp, C. elegans
tcaaaaatctatt

SEQ ID NO: 724695 - DNA, 13 bp, C. elegans
tcaaaaatctgca

SEQ ID NO: 724696 - DNA, 13 bp, C. elegans
tcaaaaatcttca

SEQ ID NO: 724697 - DNA, 13 bp, C. elegans
tcaaaaatcttga

SEQ ID NO: 724698 - DNA, 14 bp, C. elegans
tcaaaaatcttttt

SEQ ID NO: 724699 - DNA, 13 bp, C. elegans
tcaaaaatgaaat

SEQ ID NO: 724700 - DNA, 13 bp, C. elegans
tcaaaaatgaaca

SEQ ID NO: 724701 - DNA, 13 bp, C. elegans
tcaaaaatgaatt

SEQ ID NO: 724702 - DNA, 13 bp, C. elegans
tcaaaaatgagca

SEQ ID NO: 724703 - DNA, 13 bp, C. elegans
tcaaaaatgatga

SEQ ID NO: 724704 - DNA, 13 bp, C. elegans
tcaaaaatgctcc

SEQ ID NO: 724705 - DNA, 13 bp, C. elegans
tcaaaaatgctct

SEQ ID NO: 724706 - DNA, 13 bp, C. elegans
tcaaaaatggatt

SEQ ID NO: 724707 - DNA, 13 bp, C. elegans
tcaaaaatggcaa

SEQ ID NO: 724708 - DNA, 13 bp, C. elegans
tcaaaaatgggaa

SEQ ID NO: 724709 - DNA, 13 bp, C. elegans
tcaaaaatgtaaa

SEQ ID NO: 724710 - DNA, 13 bp, C. elegans
tcaaaaatgtaat

SEQ ID NO: 724711 - DNA, 13 bp, C. elegans
tcaaaaatgtatg

SEQ ID NO: 724712 - DNA, 13 bp, C. elegans
tcaaaaatgtgtt

SEQ ID NO: 724713 - DNA, 13 bp, C. elegans
tcaaaaatgttaa

SEQ ID NO: 724714 - DNA, 13 bp, C. elegans
tcaaaaatgttat

SEQ ID NO: 724715 - DNA, 13 bp, C. elegans
tcaaaaatgttca

SEQ ID NO: 724716 - DNA, 13 bp, C. elegans
tcaaaaatgtttc

SEQ ID NO: 724717 - DNA, 13 bp, C. elegans
tcaaaaattagga

SEQ ID NO: 724718 - DNA, 13 bp, C. elegans
tcaaaaattatcc

SEQ ID NO: 724719 - DNA, 14 bp, C. elegans
tcaaaaattcaatt

SEQ ID NO: 724720 - DNA, 13 bp, C. elegans
tcaaaaattcaca

SEQ ID NO: 724721 - DNA, 13 bp, C. elegans
tcaaaaattcaga

SEQ ID NO: 724722 - DNA, 13 bp, C. elegans
tcaaaaattcagt

SEQ ID NO: 724723 - DNA, 13 bp, C. elegans
tcaaaaattcata

SEQ ID NO: 724724 - DNA, 13 bp, C. elegans
tcaaaaattccac

SEQ ID NO: 724725 - DNA, 13 bp, C. elegans
tcaaaaattccgg

SEQ ID NO: 724726 - DNA, 13 bp, C. elegans
tcaaaaattcgat

SEQ ID NO: 724727 - DNA, 13 bp, C. elegans
tcaaaaattctca

SEQ ID NO: 724728 - DNA, 13 bp, C. elegans
tcaaaaattcttt

SEQ ID NO: 724729 - DNA, 13 bp, C. elegans
tcaaaaattgaaa

SEQ ID NO: 724730 - DNA, 13 bp, C. elegans
tcaaaaattgaca

SEQ ID NO: 724731 - DNA, 13 bp, C. elegans
tcaaaaattgaga

SEQ ID NO: 724732 - DNA, 13 bp, C. elegans
tcaaaaattgcaa

SEQ ID NO: 724733 - DNA, 13 bp, C. elegans
tcaaaaattgcat

SEQ ID NO: 724734 - DNA, 13 bp, C. elegans
tcaaaaattgcca

SEQ ID NO: 724735 - DNA, 13 bp, C. elegans
tcaaaaattggaa

SEQ ID NO: 724736 - DNA, 13 bp, C. elegans
tcaaaaattggat

SEQ ID NO: 724737 - DNA, 13 bp, C. elegans
tcaaaaattggtt

SEQ ID NO: 724738 - DNA, 13 bp, C. elegans
tcaaaaattgtca

SEQ ID NO: 724739 - DNA, 13 bp, C. elegans
tcaaaaattgtga

SEQ ID NO: 724740 - DNA, 13 bp, C. elegans
tcaaaaattgtgg

SEQ ID NO: 724741 - DNA, 13 bp, C. elegans
tcaaaaattgttg

SEQ ID NO: 724742 - DNA, 13 bp, C. elegans
tcaaaaatttcaa

SEQ ID NO: 724743 - DNA, 13 bp, C. elegans
tcaaaaatttcag

SEQ ID NO: 724744 - DNA, 13 bp, C. elegans
tcaaaaatttcgg

SEQ ID NO: 724745 - DNA, 13 bp, C. elegans
tcaaaaatttctt

SEQ ID NO: 724746 - DNA, 13 bp, C. elegans
tcaaaaatttgac

SEQ ID NO: 724747 - DNA, 13 bp, C. elegans
tcaaaaattttgc

SEQ ID NO: 724748 - DNA, 13 bp, C. elegans
tcaaaacaaagtt

SEQ ID NO: 724749 - DNA, 13 bp, C. elegans
tcaaaacaagaat

SEQ ID NO: 724750 - DNA, 13 bp, C. elegans
tcaaaacaatcat

SEQ ID NO: 724751 - DNA, 13 bp, C. elegans
tcaaaacaattat

SEQ ID NO: 724752 - DNA, 13 bp, C. elegans
tcaaaacaattga

SEQ ID NO: 724753 - DNA, 13 bp, C. elegans
tcaaaacacttca

SEQ ID NO: 724754 - DNA, 13 bp, C. elegans
tcaaaacatagaa

SEQ ID NO: 724755 - DNA, 13 bp, C. elegans
tcaaaacatgtat

SEQ ID NO: 724756 - DNA, 13 bp, C. elegans
tcaaaacattgaa

SEQ ID NO: 724757 - DNA, 13 bp, C. elegans
tcaaaacatttcc

SEQ ID NO: 724758 - DNA, 13 bp, C. elegans
tcaaaacatttct

SEQ ID NO: 724759 - DNA, 13 bp, C. elegans
tcaaaacatttta

SEQ ID NO: 724760 - DNA, 13 bp, C. elegans
tcaaaacattttg

SEQ ID NO: 724761 - DNA, 13 bp, C. elegans
tcaaaaccaattt

SEQ ID NO: 724762 - DNA, 13 bp, C. elegans
tcaaaacctgaaa

SEQ ID NO: 724763 - DNA, 13 bp, C. elegans
tcaaaacgatttt

SEQ ID NO: 724764 - DNA, 13 bp, C. elegans
tcaaaacgtcagc

SEQ ID NO: 724765 - DNA, 13 bp, C. elegans
tcaaaacgttcaa

SEQ ID NO: 724766 - DNA, 13 bp, C. elegans
tcaaaactaaatt

SEQ ID NO: 724767 - DNA, 13 bp, C. elegans
tcaaaactaactt

SEQ ID NO: 724768 - DNA, 13 bp, C. elegans
tcaaaactacaat

SEQ ID NO: 724769 - DNA, 13 bp, C. elegans
tcaaaactatatt

SEQ ID NO: 724770 - DNA, 13 bp, C. elegans
tcaaaactattat

SEQ ID NO: 724771 - DNA, 13 bp, C. elegans
tcaaaactattct

SEQ ID NO: 724772 - DNA, 13 bp, C. elegans
tcaaaactcgccg

SEQ ID NO: 724773 - DNA, 13 bp, C. elegans
tcaaaactctcaa

SEQ ID NO: 724774 - DNA, 13 bp, C. elegans
tcaaaactctgaa

SEQ ID NO: 724775 - DNA, 13 bp, C. elegans
tcaaaactgaact

SEQ ID NO: 724776 - DNA, 13 bp, C. elegans
tcaaaactggaaa

SEQ ID NO: 724777 - DNA, 13 bp, C. elegans
tcaaaactgtttt

SEQ ID NO: 724778 - DNA, 13 bp, C. elegans
tcaaaacttcaat

SEQ ID NO: 724779 - DNA, 13 bp, C. elegans
tcaaaacttcatt

SEQ ID NO: 724780 - DNA, 13 bp, C. elegans
tcaaaacttccag

SEQ ID NO: 724781 - DNA, 13 bp, C. elegans
tcaaaacttgata

SEQ ID NO: 724782 - DNA, 13 bp, C. elegans
tcaaaactttcaa

SEQ ID NO: 724783 - DNA, 13 bp, C. elegans
tcaaaactttgtc

SEQ ID NO: 724784 - DNA, 13 bp, C. elegans
tcaaaactttgtt

SEQ ID NO: 724785 - DNA, 13 bp, C. elegans
tcaaaacttttat

SEQ ID NO: 724786 - DNA, 13 bp, C. elegans
tcaaaacttttct

SEQ ID NO: 724787 - DNA, 13 bp, C. elegans
tcaaaactttttc

SEQ ID NO: 724788 - DNA, 13 bp, C. elegans
tcaaaactttttg

SEQ ID NO: 724789 - DNA, 13 bp, C. elegans
tcaaaagaatcaa

SEQ ID NO: 724790 - DNA, 13 bp, C. elegans
tcaaaagtaatct

SEQ ID NO: 724791 - DNA, 14 bp, C. elegans
tcaaaagtatggga

SEQ ID NO: 724792 - DNA, 13 bp, C. elegans
tcaaaagtgaaaa

SEQ ID NO: 724793 - DNA, 13 bp, C. elegans
tcaaaagtgcgaa

SEQ ID NO: 724794 - DNA, 13 bp, C. elegans
tcaaaagtgcttt

SEQ ID NO: 724795 - DNA, 13 bp, C. elegans
tcaaaagtgtcaa

SEQ ID NO: 724796 - DNA, 13 bp, C. elegans
tcaaaagtgttca

SEQ ID NO: 724797 - DNA, 13 bp, C. elegans
tcaaaagttaaat

SEQ ID NO: 724798 - DNA, 13 bp, C. elegans
tcaaaagttataa

SEQ ID NO: 724799 - DNA, 13 bp, C. elegans
tcaaaagttgaaa

SEQ ID NO: 724800 - DNA, 13 bp, C. elegans
tcaaaagttggaa

SEQ ID NO: 724801 - DNA, 13 bp, C. elegans
tcaaaagtttcat

SEQ ID NO: 724802 - DNA, 13 bp, C. elegans
tcaaaagtttcta

SEQ ID NO: 724803 - DNA, 13 bp, C. elegans
tcaaaagtttgca

SEQ ID NO: 724804 - DNA, 13 bp, C. elegans
tcaaaagtttgtt

SEQ ID NO: 724805 - DNA, 13 bp, C. elegans
tcaaaagttttat

SEQ ID NO: 724806 - DNA, 13 bp, C. elegans
tcaaaagttttca

SEQ ID NO: 724807 - DNA, 13 bp, C. elegans
tcaaaagttttta

SEQ ID NO: 724808 - DNA, 13 bp, C. elegans
tcaaaataaatgc

SEQ ID NO: 724809 - DNA, 13 bp, C. elegans
tcaaaataacttt

SEQ ID NO: 724810 - DNA, 13 bp, C. elegans
tcaaaatacattt

SEQ ID NO: 724811 - DNA, 13 bp, C. elegans
tcaaaatagagaa

SEQ ID NO: 724812 - DNA, 13 bp, C. elegans
tcaaaatagtaaa

SEQ ID NO: 724813 - DNA, 13 bp, C. elegans
tcaaaatagtcaa

SEQ ID NO: 724814 - DNA, 13 bp, C. elegans
tcaaaatatatca

SEQ ID NO: 724815 - DNA, 13 bp, C. elegans
tcaaaatatcatt

SEQ ID NO: 724816 - DNA, 13 bp, C. elegans
tcaaaatatcgaa

SEQ ID NO: 724817 - DNA, 13 bp, C. elegans
tcaaaatatgttt

SEQ ID NO: 724818 - DNA, 13 bp, C. elegans
tcaaaatattaca

SEQ ID NO: 724819 - DNA, 13 bp, C. elegans
tcaaaatattcca

SEQ ID NO: 724820 - DNA, 13 bp, C. elegans
tcaaaatattctt

SEQ ID NO: 724821 - DNA, 13 bp, C. elegans
tcaaaatattgaa

SEQ ID NO: 724822 - DNA, 13 bp, C. elegans
tcaaaatattgta

SEQ ID NO: 724823 - DNA, 13 bp, C. elegans
tcaaaatatttca

SEQ ID NO: 724824 - DNA, 13 bp, C. elegans
tcaaaatatttcg

SEQ ID NO: 724825 - DNA, 13 bp, C. elegans
tcaaaatatttga

SEQ ID NO: 724826 - DNA, 13 bp, C. elegans
tcaaaatcaacat

SEQ ID NO: 724827 - DNA, 13 bp, C. elegans
tcaaaatcaatat

SEQ ID NO: 724828 - DNA, 13 bp, C. elegans
tcaaaatcaatta

SEQ ID NO: 724829 - DNA, 13 bp, C. elegans
tcaaaatcaattt

SEQ ID NO: 724830 - DNA, 14 bp, C. elegans
tcaaaatcaatttt

SEQ ID NO: 724831 - DNA, 13 bp, C. elegans
tcaaaatcacttg

SEQ ID NO: 724832 - DNA, 13 bp, C. elegans
tcaaaatcagaat

SEQ ID NO: 724833 - DNA, 13 bp, C. elegans
tcaaaatccaaat

SEQ ID NO: 724834 - DNA, 13 bp, C. elegans
tcaaaatcccatt

SEQ ID NO: 724835 - DNA, 13 bp, C. elegans
tcaaaatcgaatt

SEQ ID NO: 724836 - DNA, 13 bp, C. elegans
tcaaaatcggaaa

SEQ ID NO: 724837 - DNA, 13 bp, C. elegans
tcaaaatcgtcca

SEQ ID NO: 724838 - DNA, 13 bp, C. elegans
tcaaaatctataa

SEQ ID NO: 724839 - DNA, 13 bp, C. elegans
tcaaaatctcaaa

SEQ ID NO: 724840 - DNA, 13 bp, C. elegans
tcaaaatctcata

SEQ ID NO: 724841 - DNA, 13 bp, C. elegans
tcaaaatctcatt

SEQ ID NO: 724842 - DNA, 13 bp, C. elegans
tcaaaatctcgaa

SEQ ID NO: 724843 - DNA, 13 bp, C. elegans
tcaaaatctctat

SEQ ID NO: 724844 - DNA, 13 bp, C. elegans
tcaaaatctgaag

SEQ ID NO: 724845 - DNA, 13 bp, C. elegans
tcaaaatctgatt

SEQ ID NO: 724846 - DNA, 13 bp, C. elegans
tcaaaatctggaa

SEQ ID NO: 724847 - DNA, 13 bp, C. elegans
tcaaaatctgttc

SEQ ID NO: 724848 - DNA, 13 bp, C. elegans
tcaaaatcttctg

SEQ ID NO: 724849 - DNA, 14 bp, C. elegans
tcaaaatcttctgt

SEQ ID NO: 724850 - DNA, 13 bp, C. elegans
tcaaaatcttgca

SEQ ID NO: 724851 - DNA, 13 bp, C. elegans
tcaaaatctttga

SEQ ID NO: 724852 - DNA, 13 bp, C. elegans
tcaaaatgaaact

SEQ ID NO: 724853 - DNA, 13 bp, C. elegans
tcaaaatgaaagt

SEQ ID NO: 724854 - DNA, 13 bp, C. elegans
tcaaaatgaaatt

SEQ ID NO: 724855 - DNA, 13 bp, C. elegans
tcaaaatgaatgt

SEQ ID NO: 724856 - DNA, 13 bp, C. elegans
tcaaaatgacata

SEQ ID NO: 724857 - DNA, 13 bp, C. elegans
tcaaaatgacccc

SEQ ID NO: 724858 - DNA, 13 bp, C. elegans
tcaaaatgagaaa

SEQ ID NO: 724859 - DNA, 13 bp, C. elegans
tcaaaatgatcaa

SEQ ID NO: 724860 - DNA, 13 bp, C. elegans
tcaaaatgcaaaa

SEQ ID NO: 724861 - DNA, 13 bp, C. elegans
tcaaaatgcaatt

SEQ ID NO: 724862 - DNA, 13 bp, C. elegans
tcaaaatgcattt

SEQ ID NO: 724863 - DNA, 13 bp, C. elegans
tcaaaatgctcaa

SEQ ID NO: 724864 - DNA, 13 bp, C. elegans
tcaaaatgggcaa

SEQ ID NO: 724865 - DNA, 13 bp, C. elegans
tcaaaatgtaaaa

SEQ ID NO: 724866 - DNA, 13 bp, C. elegans
tcaaaatgtaatt

SEQ ID NO: 724867 - DNA, 13 bp, C. elegans
tcaaaatgtctaa

SEQ ID NO: 724868 - DNA, 13 bp, C. elegans
tcaaaatgtcttt

SEQ ID NO: 724869 - DNA, 13 bp, C. elegans
tcaaaatgtgatt

SEQ ID NO: 724870 - DNA, 13 bp, C. elegans
tcaaaatgtgcat

SEQ ID NO: 724871 - DNA, 13 bp, C. elegans
tcaaaatgttcga

SEQ ID NO: 724872 - DNA, 13 bp, C. elegans
tcaaaatgttgat

SEQ ID NO: 724873 - DNA, 13 bp, C. elegans
tcaaaatgtttca

SEQ ID NO: 724874 - DNA, 13 bp, C. elegans
tcaaaatgtttga

SEQ ID NO: 724875 - DNA, 13 bp, C. elegans
tcaaaattaaaag

SEQ ID NO: 724876 - DNA, 13 bp, C. elegans
tcaaaattaatca

SEQ ID NO: 724877 - DNA, 13 bp, C. elegans
tcaaaattacatt

SEQ ID NO: 724878 - DNA, 13 bp, C. elegans
tcaaaattatagt

SEQ ID NO: 724879 - DNA, 13 bp, C. elegans
tcaaaattatcga

SEQ ID NO: 724880 - DNA, 13 bp, C. elegans
tcaaaattatgaa

SEQ ID NO: 724881 - DNA, 13 bp, C. elegans
tcaaaattatggt

SEQ ID NO: 724882 - DNA, 13 bp, C. elegans
tcaaaattcaaac

SEQ ID NO: 724883 - DNA, 13 bp, C. elegans
tcaaaattcaaat

SEQ ID NO: 724884 - DNA, 13 bp, C. elegans
tcaaaattcaact

SEQ ID NO: 724885 - DNA, 13 bp, C. elegans
tcaaaattcaaga

SEQ ID NO: 724886 - DNA, 13 bp, C. elegans
tcaaaattcagtt

SEQ ID NO: 724887 - DNA, 13 bp, C. elegans
tcaaaattcatat

SEQ ID NO: 724888 - DNA, 13 bp, C. elegans
tcaaaattccaaa

SEQ ID NO: 724889 - DNA, 13 bp, C. elegans
tcaaaattccaca

SEQ ID NO: 724890 - DNA, 13 bp, C. elegans
tcaaaattccagc

SEQ ID NO: 724891 - DNA, 13 bp, C. elegans
tcaaaattcctct

SEQ ID NO: 724892 - DNA, 13 bp, C. elegans
tcaaaattcgaaa

SEQ ID NO: 724893 - DNA, 13 bp, C. elegans
tcaaaattcgaca

SEQ ID NO: 724894 - DNA, 13 bp, C. elegans
tcaaaattctcca

SEQ ID NO: 724895 - DNA, 13 bp, C. elegans
tcaaaattctgaa

SEQ ID NO: 724896 - DNA, 13 bp, C. elegans
tcaaaattctgta

SEQ ID NO: 724897 - DNA, 13 bp, C. elegans
tcaaaattcttaa

SEQ ID NO: 724898 - DNA, 13 bp, C. elegans
tcaaaattctttg

SEQ ID NO: 724899 - DNA, 13 bp, C. elegans
tcaaaattgaaaa

SEQ ID NO: 724900 - DNA, 13 bp, C. elegans
tcaaaattgaaga

SEQ ID NO: 724901 - DNA, 13 bp, C. elegans
tcaaaattgatct

SEQ ID NO: 724902 - DNA, 13 bp, C. elegans
tcaaaattgcatt

SEQ ID NO: 724903 - DNA, 13 bp, C. elegans
tcaaaattggaaa

SEQ ID NO: 724904 - DNA, 13 bp, C. elegans
tcaaaattggatg

SEQ ID NO: 724905 - DNA, 13 bp, C. elegans
tcaaaattggcaa

SEQ ID NO: 724906 - DNA, 13 bp, C. elegans
tcaaaattggtaa

SEQ ID NO: 724907 - DNA, 13 bp, C. elegans
tcaaaatttaagt

SEQ ID NO: 724908 - DNA, 13 bp, C. elegans
tcaaaatttcaac

SEQ ID NO: 724909 - DNA, 13 bp, C. elegans
tcaaaatttcaag

SEQ ID NO: 724910 - DNA, 13 bp, C. elegans
tcaaaatttcact

SEQ ID NO: 724911 - DNA, 13 bp, C. elegans
tcaaaatttcaga

SEQ ID NO: 724912 - DNA, 13 bp, C. elegans
tcaaaatttccga

SEQ ID NO: 724913 - DNA, 13 bp, C. elegans
tcaaaatttcgga

SEQ ID NO: 724914 - DNA, 13 bp, C. elegans
tcaaaatttctgt

SEQ ID NO: 724915 - DNA, 13 bp, C. elegans
tcaaaatttgaaa

SEQ ID NO: 724916 - DNA, 13 bp, C. elegans
tcaaaatttgaat

SEQ ID NO: 724917 - DNA, 13 bp, C. elegans
tcaaaatttgagc

SEQ ID NO: 724918 - DNA, 13 bp, C. elegans
tcaaaatttgcac

SEQ ID NO: 724919 - DNA, 13 bp, C. elegans
tcaaaatttgcca

SEQ ID NO: 724920 - DNA, 13 bp, C. elegans
tcaaaatttggac

SEQ ID NO: 724921 - DNA, 13 bp, C. elegans
tcaaaattttcat

SEQ ID NO: 724922 - DNA, 13 bp, C. elegans
tcaaaattttcca

SEQ ID NO: 724923 - DNA, 13 bp, C. elegans
tcaaaattttgaa

SEQ ID NO: 724924 - DNA, 13 bp, C. elegans
tcaaaatttttca

SEQ ID NO: 724925 - DNA, 13 bp, C. elegans
tcaaaattttttc

SEQ ID NO: 724926 - DNA, 13 bp, C. elegans
tcaaaattttttg

SEQ ID NO: 724927 - DNA, 14 bp, C. elegans
tcaaaattttttgt

SEQ ID NO: 724928 - DNA, 13 bp, C. elegans
tcaaacaaaaagt

SEQ ID NO: 724929 - DNA, 13 bp, C. elegans
tcaaacaaaactt

SEQ ID NO: 724930 - DNA, 13 bp, C. elegans
tcaaacaaattat

SEQ ID NO: 724931 - DNA, 13 bp, C. elegans
tcaaacaactttt

SEQ ID NO: 724932 - DNA, 13 bp, C. elegans
tcaaacaatattt

SEQ ID NO: 724933 - DNA, 13 bp, C. elegans
tcaaacaatgatt

SEQ ID NO: 724934 - DNA, 13 bp, C. elegans
tcaaacaattatt

SEQ ID NO: 724935 - DNA, 13 bp, C. elegans
tcaaacaatttaa

SEQ ID NO: 724936 - DNA, 13 bp, C. elegans
tcaaacaatttcc

SEQ ID NO: 724937 - DNA, 13 bp, C. elegans
tcaaacaattttc

SEQ ID NO: 724938 - DNA, 13 bp, C. elegans
tcaaacaattttg

SEQ ID NO: 724939 - DNA, 13 bp, C. elegans
tcaaacagttttc

SEQ ID NO: 724940 - DNA, 13 bp, C. elegans
tcaaacattgaaa

SEQ ID NO: 724941 - DNA, 13 bp, C. elegans
tcaaacatttaaa

SEQ ID NO: 724942 - DNA, 13 bp, C. elegans
tcaaacatttcaa

SEQ ID NO: 724943 - DNA, 13 bp, C. elegans
tcaaacatttcta

SEQ ID NO: 724944 - DNA, 13 bp, C. elegans
tcaaacatttgga

SEQ ID NO: 724945 - DNA, 13 bp, C. elegans
tcaaacattttcg

SEQ ID NO: 724946 - DNA, 13 bp, C. elegans
tcaaacattttct

SEQ ID NO: 724947 - DNA, 13 bp, C. elegans
tcaaacatttttg

SEQ ID NO: 724948 - DNA, 13 bp, C. elegans
tcaaaccaaaact

SEQ ID NO: 724949 - DNA, 13 bp, C. elegans
tcaaaccaatatc

SEQ ID NO: 724950 - DNA, 13 bp, C. elegans
tcaaaccaatatt

SEQ ID NO: 724951 - DNA, 13 bp, C. elegans
tcaaaccgaaatt

SEQ ID NO: 724952 - DNA, 13 bp, C. elegans
tcaaacctaaaac

SEQ ID NO: 724953 - DNA, 13 bp, C. elegans
tcaaacgaaaatt

SEQ ID NO: 724954 - DNA, 13 bp, C. elegans
tcaaacgttgaat

SEQ ID NO: 724955 - DNA, 13 bp, C. elegans
tcaaacgttttca

SEQ ID NO: 724956 - DNA, 13 bp, C. elegans
tcaaactaaaatg

SEQ ID NO: 724957 - DNA, 13 bp, C. elegans
tcaaactaatatt

SEQ ID NO: 724958 - DNA, 13 bp, C. elegans
tcaaactcaaaat

SEQ ID NO: 724959 - DNA, 13 bp, C. elegans
tcaaactccgccc

SEQ ID NO: 724960 - DNA, 13 bp, C. elegans
tcaaactgaacaa

SEQ ID NO: 724961 - DNA, 13 bp, C. elegans
tcaaactgtttta

SEQ ID NO: 724962 - DNA, 13 bp, C. elegans
tcaaacttcaatc

SEQ ID NO: 724963 - DNA, 13 bp, C. elegans
tcaaacttcattt

SEQ ID NO: 724964 - DNA, 13 bp, C. elegans
tcaaacttctaaa

SEQ ID NO: 724965 - DNA, 13 bp, C. elegans
tcaaacttgattt

SEQ ID NO: 724966 - DNA, 13 bp, C. elegans
tcaaactttaatt

SEQ ID NO: 724967 - DNA, 13 bp, C. elegans
tcaaactttagtt

SEQ ID NO: 724968 - DNA, 13 bp, C. elegans
tcaaactttcact

SEQ ID NO: 724969 - DNA, 13 bp, C. elegans
tcaaactttcttt

SEQ ID NO: 724970 - DNA, 13 bp, C. elegans
tcaaactttggca

SEQ ID NO: 724971 - DNA, 13 bp, C. elegans
tcaaactttggtt

SEQ ID NO: 724972 - DNA, 13 bp, C. elegans
tcaaacttttaga

SEQ ID NO: 724973 - DNA, 13 bp, C. elegans
tcaaacttttcag

SEQ ID NO: 724974 - DNA, 13 bp, C. elegans
tcaaacttttgaa

SEQ ID NO: 724975 - DNA, 13 bp, C. elegans
tcaaacttttggt

SEQ ID NO: 724976 - DNA, 13 bp, C. elegans
tcaaacttttgtg

SEQ ID NO: 724977 - DNA, 13 bp, C. elegans
tcaaactttttct

SEQ ID NO: 724978 - DNA, 13 bp, C. elegans
tcaaagaaaaatt

SEQ ID NO: 724979 - DNA, 13 bp, C. elegans
tcaaagaaaatgt

SEQ ID NO: 724980 - DNA, 13 bp, C. elegans
tcaaagaaaattc

SEQ ID NO: 724981 - DNA, 13 bp, C. elegans
tcaaagaaatatt

SEQ ID NO: 724982 - DNA, 13 bp, C. elegans
tcaaagaaatcaa

SEQ ID NO: 724983 - DNA, 13 bp, C. elegans
tcaaagaacattt

SEQ ID NO: 724984 - DNA, 13 bp, C. elegans
tcaaagaagaaat

SEQ ID NO: 724985 - DNA, 13 bp, C. elegans
tcaaagaagtttt

SEQ ID NO: 724986 - DNA, 13 bp, C. elegans
tcaaagaataaac

SEQ ID NO: 724987 - DNA, 13 bp, C. elegans
tcaaagaattact

SEQ ID NO: 724988 - DNA, 13 bp, C. elegans
tcaaagacaacag

SEQ ID NO: 724989 - DNA, 13 bp, C. elegans
tcaaagactacaa

SEQ ID NO: 724990 - DNA, 13 bp, C. elegans
tcaaagagaaata

SEQ ID NO: 724991 - DNA, 13 bp, C. elegans
tcaaagagaaggt

SEQ ID NO: 724992 - DNA, 13 bp, C. elegans
tcaaagagcaaaa

SEQ ID NO: 724993 - DNA, 13 bp, C. elegans
tcaaagagccgaa

SEQ ID NO: 724994 - DNA, 14 bp, C. elegans
tcaaagagctccaa

SEQ ID NO: 724995 - DNA, 13 bp, C. elegans
tcaaagatcggaa

SEQ ID NO: 724996 - DNA, 13 bp, C. elegans
tcaaagattttaa

SEQ ID NO: 724997 - DNA, 13 bp, C. elegans
tcaaagattttct

SEQ ID NO: 724998 - DNA, 13 bp, C. elegans
tcaaagcctaagc

SEQ ID NO: 724999 - DNA, 13 bp, C. elegans
tcaaagctaaaaa

SEQ ID NO: 725000 - DNA, 13 bp, C. elegans
tcaaagctctcgg

SEQ ID NO: 725001 - DNA, 13 bp, C. elegans
tcaaagctgcaaa

SEQ ID NO: 725002 - DNA, 13 bp, C. elegans
tcaaaggaacagt

SEQ ID NO: 725003 - DNA, 13 bp, C. elegans
tcaaagtagagca

SEQ ID NO: 725004 - DNA, 13 bp, C. elegans
tcaaagtcaaaaa

SEQ ID NO: 725005 - DNA, 13 bp, C. elegans
tcaaagtgaaact

SEQ ID NO: 725006 - DNA, 13 bp, C. elegans
tcaaagtgaacaa

SEQ ID NO: 725007 - DNA, 13 bp, C. elegans
tcaaagtgatttt

SEQ ID NO: 725008 - DNA, 13 bp, C. elegans
tcaaagtgcaaaa

SEQ ID NO: 725009 - DNA, 13 bp, C. elegans
tcaaagttaaaaa

SEQ ID NO: 725010 - DNA, 13 bp, C. elegans
tcaaagttaaaat

SEQ ID NO: 725011 - DNA, 13 bp, C. elegans
tcaaagttaaaga

SEQ ID NO: 725012 - DNA, 13 bp, C. elegans
tcaaagttcaaac

SEQ ID NO: 725013 - DNA, 13 bp, C. elegans
tcaaagttctcaa

SEQ ID NO: 725014 - DNA, 13 bp, C. elegans
tcaaagttctgaa

SEQ ID NO: 725015 - DNA, 13 bp, C. elegans
tcaaagttctgga

SEQ ID NO: 725016 - DNA, 13 bp, C. elegans
tcaaagttctttt

SEQ ID NO: 725017 - DNA, 13 bp, C. elegans
tcaaagttgaaga

SEQ ID NO: 725018 - DNA, 13 bp, C. elegans
tcaaagttggaaa

SEQ ID NO: 725019 - DNA, 13 bp, C. elegans
tcaaagttgttgc

SEQ ID NO: 725020 - DNA, 13 bp, C. elegans
tcaaagtttattt

SEQ ID NO: 725021 - DNA, 13 bp, C. elegans
tcaaagtttccag

SEQ ID NO: 725022 - DNA, 13 bp, C. elegans
tcaaagtttgtat

SEQ ID NO: 725023 - DNA, 13 bp, C. elegans
tcaaagttttaat

SEQ ID NO: 725024 - DNA, 13 bp, C. elegans
tcaaagttttaga

SEQ ID NO: 725025 - DNA, 13 bp, C. elegans
tcaaagttttata

SEQ ID NO: 725026 - DNA, 13 bp, C. elegans
tcaaagttttttt

SEQ ID NO: 725027 - DNA, 13 bp, C. elegans
tcaaataaaatgc

SEQ ID NO: 725028 - DNA, 13 bp, C. elegans
tcaaataaaattc

SEQ ID NO: 725029 - DNA, 13 bp, C. elegans
tcaaataaaattg

SEQ ID NO: 725030 - DNA, 13 bp, C. elegans
tcaaataacattt

SEQ ID NO: 725031 - DNA, 13 bp, C. elegans
tcaaataagtttt

SEQ ID NO: 725032 - DNA, 13 bp, C. elegans
tcaaataatattg

SEQ ID NO: 725033 - DNA, 13 bp, C. elegans
tcaaataatgttt

SEQ ID NO: 725034 - DNA, 13 bp, C. elegans
tcaaataattcaa

SEQ ID NO: 725035 - DNA, 13 bp, C. elegans
tcaaatacttgaa

SEQ ID NO: 725036 - DNA, 13 bp, C. elegans
tcaaatactttta

SEQ ID NO: 725037 - DNA, 13 bp, C. elegans
tcaaatagatttt

SEQ ID NO: 725038 - DNA, 13 bp, C. elegans
tcaaatagtattg

SEQ ID NO: 725039 - DNA, 13 bp, C. elegans
tcaaatagtgcct

SEQ ID NO: 725040 - DNA, 13 bp, C. elegans
tcaaatagttaaa

SEQ ID NO: 725041 - DNA, 13 bp, C. elegans
tcaaatagtttca

SEQ ID NO: 725042 - DNA, 13 bp, C. elegans
tcaaatatctcaa

SEQ ID NO: 725043 - DNA, 13 bp, C. elegans
tcaaatatctgaa

SEQ ID NO: 725044 - DNA, 13 bp, C. elegans
tcaaatatgaata

SEQ ID NO: 725045 - DNA, 13 bp, C. elegans
tcaaatatgatgt

SEQ ID NO: 725046 - DNA, 13 bp, C. elegans
tcaaatatgattt

SEQ ID NO: 725047 - DNA, 13 bp, C. elegans
tcaaatatgcaaa

SEQ ID NO: 725048 - DNA, 13 bp, C. elegans
tcaaatatggttg

SEQ ID NO: 725049 - DNA, 13 bp, C. elegans
tcaaatattacaa

SEQ ID NO: 725050 - DNA, 13 bp, C. elegans
tcaaatattcatt

SEQ ID NO: 725051 - DNA, 13 bp, C. elegans
tcaaatattcgtt

SEQ ID NO: 725052 - DNA, 13 bp, C. elegans
tcaaatattctaa

SEQ ID NO: 725053 - DNA, 13 bp, C. elegans
tcaaatattctat

SEQ ID NO: 725054 - DNA, 13 bp, C. elegans
tcaaatattcttc

SEQ ID NO: 725055 - DNA, 13 bp, C. elegans
tcaaatattgaca

SEQ ID NO: 725056 - DNA, 13 bp, C. elegans
tcaaatattgcaa

SEQ ID NO: 725057 - DNA, 13 bp, C. elegans
tcaaatatttcca

SEQ ID NO: 725058 - DNA, 13 bp, C. elegans
tcaaatatttctc

SEQ ID NO: 725059 - DNA, 13 bp, C. elegans
tcaaatatttctt

SEQ ID NO: 725060 - DNA, 13 bp, C. elegans
tcaaatatttgaa

SEQ ID NO: 725061 - DNA, 13 bp, C. elegans
tcaaatatttgta

SEQ ID NO: 725062 - DNA, 13 bp, C. elegans
tcaaatatttttc

SEQ ID NO: 725063 - DNA, 14 bp, C. elegans
tcaaatatttttcc

SEQ ID NO: 725064 - DNA, 13 bp, C. elegans
tcaaatcaaaatc

SEQ ID NO: 725065 - DNA, 13 bp, C. elegans
tcaaatcaaagct

SEQ ID NO: 725066 - DNA, 13 bp, C. elegans
tcaaatcaaatca

SEQ ID NO: 725067 - DNA, 13 bp, C. elegans
tcaaatcaacttt

SEQ ID NO: 725068 - DNA, 13 bp, C. elegans
tcaaatcacattt

SEQ ID NO: 725069 - DNA, 13 bp, C. elegans
tcaaatcactttt

SEQ ID NO: 725070 - DNA, 13 bp, C. elegans
tcaaatcatattt

SEQ ID NO: 725071 - DNA, 13 bp, C. elegans
tcaaatcatcaaa

SEQ ID NO: 725072 - DNA, 13 bp, C. elegans
tcaaatcatgttt

SEQ ID NO: 725073 - DNA, 13 bp, C. elegans
tcaaatcattttg

SEQ ID NO: 725074 - DNA, 13 bp, C. elegans
tcaaatcattttt

SEQ ID NO: 725075 - DNA, 13 bp, C. elegans
tcaaatccatttt

SEQ ID NO: 725076 - DNA, 13 bp, C. elegans
tcaaatcctaaaa

SEQ ID NO: 725077 - DNA, 13 bp, C. elegans
tcaaatcgaaaat

SEQ ID NO: 725078 - DNA, 13 bp, C. elegans
tcaaatcgaattt

SEQ ID NO: 725079 - DNA, 13 bp, C. elegans
tcaaatctaaaat

SEQ ID NO: 725080 - DNA, 13 bp, C. elegans
tcaaatctaaatt

SEQ ID NO: 725081 - DNA, 13 bp, C. elegans
tcaaatctcaaaa

SEQ ID NO: 725082 - DNA, 13 bp, C. elegans
tcaaatctttcaa

SEQ ID NO: 725083 - DNA, 13 bp, C. elegans
tcaaatcttttct

SEQ ID NO: 725084 - DNA, 13 bp, C. elegans
tcaaatctttttc

SEQ ID NO: 725085 - DNA, 13 bp, C. elegans
tcaaatgaaaaac

SEQ ID NO: 725086 - DNA, 13 bp, C. elegans
tcaaatgaaaaag

SEQ ID NO: 725087 - DNA, 13 bp, C. elegans
tcaaatgaaaaat

SEQ ID NO: 725088 - DNA, 13 bp, C. elegans
tcaaatgaaagac

SEQ ID NO: 725089 - DNA, 13 bp, C. elegans
tcaaatgaaagat

SEQ ID NO: 725090 - DNA, 13 bp, C. elegans
tcaaatgaacgaa

SEQ ID NO: 725091 - DNA, 13 bp, C. elegans
tcaaatgacaaaa

SEQ ID NO: 725092 - DNA, 13 bp, C. elegans
tcaaatgacagaa

SEQ ID NO: 725093 - DNA, 13 bp, C. elegans
tcaaatgactact

SEQ ID NO: 725094 - DNA, 13 bp, C. elegans
tcaaatgagaatt

SEQ ID NO: 725095 - DNA, 13 bp, C. elegans
tcaaatgagtata

SEQ ID NO: 725096 - DNA, 13 bp, C. elegans
tcaaatgatattt

SEQ ID NO: 725097 - DNA, 13 bp, C. elegans
tcaaatgattatt

SEQ ID NO: 725098 - DNA, 13 bp, C. elegans
tcaaatgattttt

SEQ ID NO: 725099 - DNA, 13 bp, C. elegans
tcaaatggaaaaa

SEQ ID NO: 725100 - DNA, 13 bp, C. elegans
tcaaatgtataat

SEQ ID NO: 725101 - DNA, 13 bp, C. elegans
tcaaatgttcaac

SEQ ID NO: 725102 - DNA, 13 bp, C. elegans
tcaaatgttcaag

SEQ ID NO: 725103 - DNA, 13 bp, C. elegans
tcaaatgttcata

SEQ ID NO: 725104 - DNA, 13 bp, C. elegans
tcaaatgtttctc

SEQ ID NO: 725105 - DNA, 13 bp, C. elegans
tcaaatgtttgca

SEQ ID NO: 725106 - DNA, 13 bp, C. elegans
tcaaatgttttta

SEQ ID NO: 725107 - DNA, 13 bp, C. elegans
tcaaattaacgga

SEQ ID NO: 725108 - DNA, 13 bp, C. elegans
tcaaattacaatt

SEQ ID NO: 725109 - DNA, 13 bp, C. elegans
tcaaattacattt

SEQ ID NO: 725110 - DNA, 13 bp, C. elegans
tcaaattatcgat

SEQ ID NO: 725111 - DNA, 13 bp, C. elegans
tcaaattattgaa

SEQ ID NO: 725112 - DNA, 13 bp, C. elegans
tcaaattcaaata

SEQ ID NO: 725113 - DNA, 13 bp, C. elegans
tcaaattcaagtt

SEQ ID NO: 725114 - DNA, 13 bp, C. elegans
tcaaattcaattc

SEQ ID NO: 725115 - DNA, 14 bp, C. elegans
tcaaattcaatttg

SEQ ID NO: 725116 - DNA, 13 bp, C. elegans
tcaaattcagaaa

SEQ ID NO: 725117 - DNA, 13 bp, C. elegans
tcaaattcagctc

SEQ ID NO: 725118 - DNA, 13 bp, C. elegans
tcaaattcatttt

SEQ ID NO: 725119 - DNA, 13 bp, C. elegans
tcaaattccaaaa

SEQ ID NO: 725120 - DNA, 13 bp, C. elegans
tcaaattcccaaa

SEQ ID NO: 725121 - DNA, 13 bp, C. elegans
tcaaattcgaatt

SEQ ID NO: 725122 - DNA, 13 bp, C. elegans
tcaaattcggaaa

SEQ ID NO: 725123 - DNA, 13 bp, C. elegans
tcaaattcgtatt

SEQ ID NO: 725124 - DNA, 13 bp, C. elegans
tcaaattctaaat

SEQ ID NO: 725125 - DNA, 13 bp, C. elegans
tcaaattctaatt

SEQ ID NO: 725126 - DNA, 13 bp, C. elegans
tcaaattctcaat

SEQ ID NO: 725127 - DNA, 13 bp, C. elegans
tcaaattctcgtt

SEQ ID NO: 725128 - DNA, 13 bp, C. elegans
tcaaattctctga

SEQ ID NO: 725129 - DNA, 13 bp, C. elegans
tcaaattgagaaa

SEQ ID NO: 725130 - DNA, 13 bp, C. elegans
tcaaattgagaat

SEQ ID NO: 725131 - DNA, 13 bp, C. elegans
tcaaattgagatt

SEQ ID NO: 725132 - DNA, 13 bp, C. elegans
tcaaattgatttt

SEQ ID NO: 725133 - DNA, 13 bp, C. elegans
tcaaattgcaaaa

SEQ ID NO: 725134 - DNA, 13 bp, C. elegans
tcaaattgcaatt

SEQ ID NO: 725135 - DNA, 13 bp, C. elegans
tcaaattgccgaa

SEQ ID NO: 725136 - DNA, 13 bp, C. elegans
tcaaattgtaaaa

SEQ ID NO: 725137 - DNA, 13 bp, C. elegans
tcaaattgtagaa

SEQ ID NO: 725138 - DNA, 13 bp, C. elegans
tcaaattgttaaa

SEQ ID NO: 725139 - DNA, 13 bp, C. elegans
tcaaattgttcag

SEQ ID NO: 725140 - DNA, 13 bp, C. elegans
tcaaattgtttaa

SEQ ID NO: 725141 - DNA, 13 bp, C. elegans
tcaaattgttttc

SEQ ID NO: 725142 - DNA, 13 bp, C. elegans
tcaaattgttttg

SEQ ID NO: 725143 - DNA, 13 bp, C. elegans
tcaaatttacttt

SEQ ID NO: 725144 - DNA, 13 bp, C. elegans
tcaaatttagaaa

SEQ ID NO: 725145 - DNA, 13 bp, C. elegans
tcaaatttaggtt

SEQ ID NO: 725146 - DNA, 13 bp, C. elegans
tcaaatttatatg

SEQ ID NO: 725147 - DNA, 13 bp, C. elegans
tcaaatttattca

SEQ ID NO: 725148 - DNA, 13 bp, C. elegans
tcaaatttatttc

SEQ ID NO: 725149 - DNA, 13 bp, C. elegans
tcaaatttcaagt

SEQ ID NO: 725150 - DNA, 13 bp, C. elegans
tcaaatttcaatg

SEQ ID NO: 725151 - DNA, 13 bp, C. elegans
tcaaatttcaatt

SEQ ID NO: 725152 - DNA, 13 bp, C. elegans
tcaaatttcacat

SEQ ID NO: 725153 - DNA, 13 bp, C. elegans
tcaaatttcatta

SEQ ID NO: 725154 - DNA, 13 bp, C. elegans
tcaaatttccaat

SEQ ID NO: 725155 - DNA, 13 bp, C. elegans
tcaaatttcggaa

SEQ ID NO: 725156 - DNA, 13 bp, C. elegans
tcaaatttctagg

SEQ ID NO: 725157 - DNA, 13 bp, C. elegans
tcaaatttctagt

SEQ ID NO: 725158 - DNA, 13 bp, C. elegans
tcaaatttctcaa

SEQ ID NO: 725159 - DNA, 13 bp, C. elegans
tcaaatttctcat

SEQ ID NO: 725160 - DNA, 13 bp, C. elegans
tcaaatttctctc

SEQ ID NO: 725161 - DNA, 13 bp, C. elegans
tcaaatttctgtt

SEQ ID NO: 725162 - DNA, 13 bp, C. elegans
tcaaatttcttga

SEQ ID NO: 725163 - DNA, 13 bp, C. elegans
tcaaatttcttta

SEQ ID NO: 725164 - DNA, 13 bp, C. elegans
tcaaatttgaaat

SEQ ID NO: 725165 - DNA, 13 bp, C. elegans
tcaaatttgaatt

SEQ ID NO: 725166 - DNA, 13 bp, C. elegans
tcaaatttgagat

SEQ ID NO: 725167 - DNA, 13 bp, C. elegans
tcaaatttgataa

SEQ ID NO: 725168 - DNA, 13 bp, C. elegans
tcaaatttgatat

SEQ ID NO: 725169 - DNA, 13 bp, C. elegans
tcaaatttgcact

SEQ ID NO: 725170 - DNA, 13 bp, C. elegans
tcaaatttggaag

SEQ ID NO: 725171 - DNA, 13 bp, C. elegans
tcaaatttgtatg

SEQ ID NO: 725172 - DNA, 13 bp, C. elegans
tcaaatttgtgaa

SEQ ID NO: 725173 - DNA, 13 bp, C. elegans
tcaaattttaact

SEQ ID NO: 725174 - DNA, 13 bp, C. elegans
tcaaattttaagc

SEQ ID NO: 725175 - DNA, 13 bp, C. elegans
tcaaattttacat

SEQ ID NO: 725176 - DNA, 13 bp, C. elegans
tcaaattttcact

SEQ ID NO: 725177 - DNA, 13 bp, C. elegans
tcaaattttcagc

SEQ ID NO: 725178 - DNA, 13 bp, C. elegans
tcaaattttcgga

SEQ ID NO: 725179 - DNA, 13 bp, C. elegans
tcaaattttcgtt

SEQ ID NO: 725180 - DNA, 13 bp, C. elegans
tcaaattttctga

SEQ ID NO: 725181 - DNA, 13 bp, C. elegans
tcaaattttctgt

SEQ ID NO: 725182 - DNA, 13 bp, C. elegans
tcaaattttgaaa

SEQ ID NO: 725183 - DNA, 13 bp, C. elegans
tcaaattttgaac

SEQ ID NO: 725184 - DNA, 13 bp, C. elegans
tcaaattttgatg

SEQ ID NO: 725185 - DNA, 13 bp, C. elegans
tcaaattttgatt

SEQ ID NO: 725186 - DNA, 13 bp, C. elegans
tcaaattttggaa

SEQ ID NO: 725187 - DNA, 13 bp, C. elegans
tcaaattttgtta

SEQ ID NO: 725188 - DNA, 13 bp, C. elegans
tcaaatttttaca

SEQ ID NO: 725189 - DNA, 13 bp, C. elegans
tcaaatttttaga

SEQ ID NO: 725190 - DNA, 13 bp, C. elegans
tcaaatttttagt

SEQ ID NO: 725191 - DNA, 13 bp, C. elegans
tcaaatttttcag

SEQ ID NO: 725192 - DNA, 13 bp, C. elegans
tcaaatttttgat

SEQ ID NO: 725193 - DNA, 13 bp, C. elegans
tcaaattttttcc

SEQ ID NO: 725194 - DNA, 13 bp, C. elegans
tcaaattttttgt

SEQ ID NO: 725195 - DNA, 13 bp, C. elegans
tcaaatttttttg

SEQ ID NO: 725196 - DNA, 13 bp, C. elegans
tcaacaaaaaagc

SEQ ID NO: 725197 - DNA, 13 bp, C. elegans
tcaacaaaaaatg

SEQ ID NO: 725198 - DNA, 13 bp, C. elegans
tcaacaaaaatct

SEQ ID NO: 725199 - DNA, 13 bp, C. elegans
tcaacaaaacatt

SEQ ID NO: 725200 - DNA, 13 bp, C. elegans
tcaacaaaatttg

SEQ ID NO: 725201 - DNA, 13 bp, C. elegans
tcaacaaacaatt

SEQ ID NO: 725202 - DNA, 13 bp, C. elegans
tcaacaaacattt

SEQ ID NO: 725203 - DNA, 13 bp, C. elegans
tcaacaaataatt

SEQ ID NO: 725204 - DNA, 13 bp, C. elegans
tcaacaaatcaat

SEQ ID NO: 725205 - DNA, 13 bp, C. elegans
tcaacaaatgaaa

SEQ ID NO: 725206 - DNA, 13 bp, C. elegans
tcaacaaattatt

SEQ ID NO: 725207 - DNA, 13 bp, C. elegans
tcaacaaattcag

SEQ ID NO: 725208 - DNA, 13 bp, C. elegans
tcaacaaattgtt

SEQ ID NO: 725209 - DNA, 13 bp, C. elegans
tcaacaaatttag

SEQ ID NO: 725210 - DNA, 13 bp, C. elegans
tcaacaaatttcc

SEQ ID NO: 725211 - DNA, 13 bp, C. elegans
tcaacaacatttt

SEQ ID NO: 725212 - DNA, 13 bp, C. elegans
tcaacaactttat

SEQ ID NO: 725213 - DNA, 13 bp, C. elegans
tcaacaactttca

SEQ ID NO: 725214 - DNA, 13 bp, C. elegans
tcaacaacttttt

SEQ ID NO: 725215 - DNA, 13 bp, C. elegans
tcaacaagaaatt

SEQ ID NO: 725216 - DNA, 13 bp, C. elegans
tcaacaagttttc

SEQ ID NO: 725217 - DNA, 13 bp, C. elegans
tcaacaagttttt

SEQ ID NO: 725218 - DNA, 13 bp, C. elegans
tcaacaatattat

SEQ ID NO: 725219 - DNA, 13 bp, C. elegans
tcaacaattattt

SEQ ID NO: 725220 - DNA, 13 bp, C. elegans
tcaacaattgaat

SEQ ID NO: 725221 - DNA, 13 bp, C. elegans
tcaacaattgttt

SEQ ID NO: 725222 - DNA, 13 bp, C. elegans
tcaacaattttat

SEQ ID NO: 725223 - DNA, 13 bp, C. elegans
tcaacaattttcc

SEQ ID NO: 725224 - DNA, 13 bp, C. elegans
tcaacaattttta

SEQ ID NO: 725225 - DNA, 13 bp, C. elegans
tcaacaatttttg

SEQ ID NO: 725226 - DNA, 13 bp, C. elegans
tcaacacaaaaag

SEQ ID NO: 725227 - DNA, 13 bp, C. elegans
tcaacacattttc

SEQ ID NO: 725228 - DNA, 13 bp, C. elegans
tcaacacgaaatt

SEQ ID NO: 725229 - DNA, 13 bp, C. elegans
tcaacacgacaaa

SEQ ID NO: 725230 - DNA, 13 bp, C. elegans
tcaacactgaaaa

SEQ ID NO: 725231 - DNA, 13 bp, C. elegans
tcaacagattttg

SEQ ID NO: 725232 - DNA, 13 bp, C. elegans
tcaacagcaaaaa

SEQ ID NO: 725233 - DNA, 13 bp, C. elegans
tcaacagcaaaat

SEQ ID NO: 725234 - DNA, 13 bp, C. elegans
tcaacatttcaaa

SEQ ID NO: 725235 - DNA, 13 bp, C. elegans
tcaacatttcaac

SEQ ID NO: 725236 - DNA, 13 bp, C. elegans
tcaacatttctaa

SEQ ID NO: 725237 - DNA, 13 bp, C. elegans
tcaacattttcca

SEQ ID NO: 725238 - DNA, 13 bp, C. elegans
tcaacatttttag

SEQ ID NO: 725239 - DNA, 13 bp, C. elegans
tcaacatttttca

SEQ ID NO: 725240 - DNA, 13 bp, C. elegans
tcaacatttttgc

SEQ ID NO: 725241 - DNA, 13 bp, C. elegans
tcaaccaaaaatc

SEQ ID NO: 725242 - DNA, 13 bp, C. elegans
tcaaccaactttt

SEQ ID NO: 725243 - DNA, 13 bp, C. elegans
tcaaccaattaaa

SEQ ID NO: 725244 - DNA, 13 bp, C. elegans
tcaaccaattttt

SEQ ID NO: 725245 - DNA, 13 bp, C. elegans
tcaaccattttct

SEQ ID NO: 725246 - DNA, 13 bp, C. elegans
tcaacccaaaaat

SEQ ID NO: 725247 - DNA, 13 bp, C. elegans
tcaacccagtttt

SEQ ID NO: 725248 - DNA, 13 bp, C. elegans
tcaacctcactca

SEQ ID NO: 725249 - DNA, 13 bp, C. elegans
tcaaccttaaaaa

SEQ ID NO: 725250 - DNA, 13 bp, C. elegans
tcaacgaaaaact

SEQ ID NO: 725251 - DNA, 13 bp, C. elegans
tcaacgagtttcc

SEQ ID NO: 725252 - DNA, 13 bp, C. elegans
tcaacgatttatt

SEQ ID NO: 725253 - DNA, 13 bp, C. elegans
tcaacgttttggt

SEQ ID NO: 725254 - DNA, 13 bp, C. elegans
tcaactaaaaatc

SEQ ID NO: 725255 - DNA, 13 bp, C. elegans
tcaactaaaaatt

SEQ ID NO: 725256 - DNA, 13 bp, C. elegans
tcaactaaaattt

SEQ ID NO: 725257 - DNA, 13 bp, C. elegans
tcaactaactttt

SEQ ID NO: 725258 - DNA, 13 bp, C. elegans
tcaactaatttcg

SEQ ID NO: 725259 - DNA, 13 bp, C. elegans
tcaactaatttta

SEQ ID NO: 725260 - DNA, 13 bp, C. elegans
tcaactaattttt

SEQ ID NO: 725261 - DNA, 13 bp, C. elegans
tcaactacaaagt

SEQ ID NO: 725262 - DNA, 14 bp, C. elegans
tcaactatcaaaat

SEQ ID NO: 725263 - DNA, 13 bp, C. elegans
tcaactattgaaa

SEQ ID NO: 725264 - DNA, 13 bp, C. elegans
tcaactattttat

SEQ ID NO: 725265 - DNA, 13 bp, C. elegans
tcaactcaaaaat

SEQ ID NO: 725266 - DNA, 13 bp, C. elegans
tcaactcgaattt

SEQ ID NO: 725267 - DNA, 13 bp, C. elegans
tcaactctcaaaa

SEQ ID NO: 725268 - DNA, 15 bp, C. elegans
tcaactctccaccac

SEQ ID NO: 725269 - DNA, 13 bp, C. elegans
tcaactgaaaaat

SEQ ID NO: 725270 - DNA, 13 bp, C. elegans
tcaactgaaaact

SEQ ID NO: 725271 - DNA, 13 bp, C. elegans
tcaactgaaaatt

SEQ ID NO: 725272 - DNA, 13 bp, C. elegans
tcaactgaaatat

SEQ ID NO: 725273 - DNA, 13 bp, C. elegans
tcaactgaaatgt

SEQ ID NO: 725274 - DNA, 13 bp, C. elegans
tcaactgaattca

SEQ ID NO: 725275 - DNA, 13 bp, C. elegans
tcaactgacaaaa

SEQ ID NO: 725276 - DNA, 13 bp, C. elegans
tcaactgatttca

SEQ ID NO: 725277 - DNA, 13 bp, C. elegans
tcaactgatttcg

SEQ ID NO: 725278 - DNA, 13 bp, C. elegans
tcaactggaaaaa

SEQ ID NO: 725279 - DNA, 13 bp, C. elegans
tcaactggcaaaa

SEQ ID NO: 725280 - DNA, 13 bp, C. elegans
tcaactgtacgtc

SEQ ID NO: 725281 - DNA, 13 bp, C. elegans
tcaactgttttaa

SEQ ID NO: 725282 - DNA, 13 bp, C. elegans
tcaacttaatttt

SEQ ID NO: 725283 - DNA, 13 bp, C. elegans
tcaacttacaaaa

SEQ ID NO: 725284 - DNA, 13 bp, C. elegans
tcaacttcaaaat

SEQ ID NO: 725285 - DNA, 13 bp, C. elegans
tcaacttcaattt

SEQ ID NO: 725286 - DNA, 13 bp, C. elegans
tcaacttcatttt

SEQ ID NO: 725287 - DNA, 13 bp, C. elegans
tcaacttccaaaa

SEQ ID NO: 725288 - DNA, 13 bp, C. elegans
tcaacttccgttg

SEQ ID NO: 725289 - DNA, 13 bp, C. elegans
tcaacttcgacaa

SEQ ID NO: 725290 - DNA, 13 bp, C. elegans
tcaacttctcaaa

SEQ ID NO: 725291 - DNA, 13 bp, C. elegans
tcaacttgccgga

SEQ ID NO: 725292 - DNA, 13 bp, C. elegans
tcaactttaataa

SEQ ID NO: 725293 - DNA, 13 bp, C. elegans
tcaactttacaaa

SEQ ID NO: 725294 - DNA, 13 bp, C. elegans
tcaactttcgaaa

SEQ ID NO: 725295 - DNA, 13 bp, C. elegans
tcaactttgaaaa

SEQ ID NO: 725296 - DNA, 13 bp, C. elegans
tcaacttttaaaa

SEQ ID NO: 725297 - DNA, 13 bp, C. elegans
tcaacttttaatg

SEQ ID NO: 725298 - DNA, 13 bp, C. elegans
tcaacttttcaac

SEQ ID NO: 725299 - DNA, 13 bp, C. elegans
tcaacttttcaga

SEQ ID NO: 725300 - DNA, 13 bp, C. elegans
tcaacttttcatg

SEQ ID NO: 725301 - DNA, 13 bp, C. elegans
tcaacttttcatt

SEQ ID NO: 725302 - DNA, 13 bp, C. elegans
tcaacttttccaa

SEQ ID NO: 725303 - DNA, 13 bp, C. elegans
tcaacttttcgat

SEQ ID NO: 725304 - DNA, 13 bp, C. elegans
tcaacttttgaat

SEQ ID NO: 725305 - DNA, 13 bp, C. elegans
tcaactttttcag

SEQ ID NO: 725306 - DNA, 13 bp, C. elegans
tcaactttttgct

SEQ ID NO: 725307 - DNA, 13 bp, C. elegans
tcaactttttgtg

SEQ ID NO: 725308 - DNA, 13 bp, C. elegans
tcaactttttgtt

SEQ ID NO: 725309 - DNA, 13 bp, C. elegans
tcaacttttttgg

SEQ ID NO: 725310 - DNA, 13 bp, C. elegans
tcaagaaaaatga

SEQ ID NO: 725311 - DNA, 13 bp, C. elegans
tcaagaaaaatgc

SEQ ID NO: 725312 - DNA, 13 bp, C. elegans
tcaagaaaacaat

SEQ ID NO: 725313 - DNA, 13 bp, C. elegans
tcaagaaaataga

SEQ ID NO: 725314 - DNA, 13 bp, C. elegans
tcaagaaaatgaa

SEQ ID NO: 725315 - DNA, 13 bp, C. elegans
tcaagaaaattgg

SEQ ID NO: 725316 - DNA, 13 bp, C. elegans
tcaagaaaattta

SEQ ID NO: 725317 - DNA, 13 bp, C. elegans
tcaagaaacaaat

SEQ ID NO: 725318 - DNA, 13 bp, C. elegans
tcaagaaacaaga

SEQ ID NO: 725319 - DNA, 13 bp, C. elegans
tcaagaaacatat

SEQ ID NO: 725320 - DNA, 13 bp, C. elegans
tcaagaaacttct

SEQ ID NO: 725321 - DNA, 13 bp, C. elegans
tcaagaaactttc

SEQ ID NO: 725322 - DNA, 13 bp, C. elegans
tcaagaaatcaaa

SEQ ID NO: 725323 - DNA, 13 bp, C. elegans
tcaagaaatgaaa

SEQ ID NO: 725324 - DNA, 13 bp, C. elegans
tcaagaaattcaa

SEQ ID NO: 725325 - DNA, 13 bp, C. elegans
tcaagaaattcgt

SEQ ID NO: 725326 - DNA, 13 bp, C. elegans
tcaagaaattttg

SEQ ID NO: 725327 - DNA, 13 bp, C. elegans
tcaagaagaaaat

SEQ ID NO: 725328 - DNA, 13 bp, C. elegans
tcaagaagaaatt

SEQ ID NO: 725329 - DNA, 13 bp, C. elegans
tcaagaagcttgc

SEQ ID NO: 725330 - DNA, 13 bp, C. elegans
tcaagaagtttca

SEQ ID NO: 725331 - DNA, 13 bp, C. elegans
tcaagaagtttcc

SEQ ID NO: 725332 - DNA, 13 bp, C. elegans
tcaagaagttttt

SEQ ID NO: 725333 - DNA, 13 bp, C. elegans
tcaagaataattc

SEQ ID NO: 725334 - DNA, 13 bp, C. elegans
tcaagaattcaga

SEQ ID NO: 725335 - DNA, 13 bp, C. elegans
tcaagaatttcaa

SEQ ID NO: 725336 - DNA, 13 bp, C. elegans
tcaagaatttcag

SEQ ID NO: 725337 - DNA, 13 bp, C. elegans
tcaagaattttct

SEQ ID NO: 725338 - DNA, 13 bp, C. elegans
tcaagaattttta

SEQ ID NO: 725339 - DNA, 13 bp, C. elegans
tcaagacaaattt

SEQ ID NO: 725340 - DNA, 13 bp, C. elegans
tcaagagaaaaat

SEQ ID NO: 725341 - DNA, 13 bp, C. elegans
tcaagagctttca

SEQ ID NO: 725342 - DNA, 13 bp, C. elegans
tcaagataaacaa

SEQ ID NO: 725343 - DNA, 13 bp, C. elegans
tcaagatgagatg

SEQ ID NO: 725344 - DNA, 13 bp, C. elegans
tcaagattcaaaa

SEQ ID NO: 725345 - DNA, 13 bp, C. elegans
tcaagattttctc

SEQ ID NO: 725346 - DNA, 13 bp, C. elegans
tcaagatttttct

SEQ ID NO: 725347 - DNA, 13 bp, C. elegans
tcaagatttttga

SEQ ID NO: 725348 - DNA, 13 bp, C. elegans
tcaagatttttgt

SEQ ID NO: 725349 - DNA, 13 bp, C. elegans
tcaagcaaaaaac

SEQ ID NO: 725350 - DNA, 13 bp, C. elegans
tcaagcagaaaaa

SEQ ID NO: 725351 - DNA, 13 bp, C. elegans
tcaagccaaaaat

SEQ ID NO: 725352 - DNA, 13 bp, C. elegans
tcaagccaaaata

SEQ ID NO: 725353 - DNA, 13 bp, C. elegans
tcaagccaaaatg

SEQ ID NO: 725354 - DNA, 13 bp, C. elegans
tcaagccagaaat

SEQ ID NO: 725355 - DNA, 13 bp, C. elegans
tcaagccattttt

SEQ ID NO: 725356 - DNA, 13 bp, C. elegans
tcaagcccagttt

SEQ ID NO: 725357 - DNA, 13 bp, C. elegans
tcaagcctaccaa

SEQ ID NO: 725358 - DNA, 13 bp, C. elegans
tcaagctgaaatg

SEQ ID NO: 725359 - DNA, 13 bp, C. elegans
tcaagctgacgtt

SEQ ID NO: 725360 - DNA, 13 bp, C. elegans
tcaaggaaaattt

SEQ ID NO: 725361 - DNA, 13 bp, C. elegans
tcaaggtgctcac

SEQ ID NO: 725362 - DNA, 13 bp, C. elegans
tcaagtaaacaaa

SEQ ID NO: 725363 - DNA, 13 bp, C. elegans
tcaagtaattttt

SEQ ID NO: 725364 - DNA, 13 bp, C. elegans
tcaagtataaaac

SEQ ID NO: 725365 - DNA, 13 bp, C. elegans
tcaagtcaaaaag

SEQ ID NO: 725366 - DNA, 13 bp, C. elegans
tcaagtcaaaatt

SEQ ID NO: 725367 - DNA, 13 bp, C. elegans
tcaagtcaaattt

SEQ ID NO: 725368 - DNA, 13 bp, C. elegans
tcaagtcttgaaa

SEQ ID NO: 725369 - DNA, 13 bp, C. elegans
tcaagtgtttttg

SEQ ID NO: 725370 - DNA, 13 bp, C. elegans
tcaagtgtttttt

SEQ ID NO: 725371 - DNA, 13 bp, C. elegans
tcaagttaaaaag

SEQ ID NO: 725372 - DNA, 13 bp, C. elegans
tcaagttcaagtt

SEQ ID NO: 725373 - DNA, 13 bp, C. elegans
tcaagttctactt

SEQ ID NO: 725374 - DNA, 13 bp, C. elegans
tcaagttgaaaac

SEQ ID NO: 725375 - DNA, 13 bp, C. elegans
tcaagttgaaata

SEQ ID NO: 725376 - DNA, 13 bp, C. elegans
tcaagtttaaaaa

SEQ ID NO: 725377 - DNA, 13 bp, C. elegans
tcaagtttataaa

SEQ ID NO: 725378 - DNA, 13 bp, C. elegans
tcaagtttatatt

SEQ ID NO: 725379 - DNA, 13 bp, C. elegans
tcaagtttattga

SEQ ID NO: 725380 - DNA, 13 bp, C. elegans
tcaagtttctcaa

SEQ ID NO: 725381 - DNA, 13 bp, C. elegans
tcaagttttaaaa

SEQ ID NO: 725382 - DNA, 13 bp, C. elegans
tcaagttttataa

SEQ ID NO: 725383 - DNA, 13 bp, C. elegans
tcaagttttattt

SEQ ID NO: 725384 - DNA, 13 bp, C. elegans
tcaagttttcagt

SEQ ID NO: 725385 - DNA, 13 bp, C. elegans
tcaagttttcatt

SEQ ID NO: 725386 - DNA, 13 bp, C. elegans
tcaagttttctga

SEQ ID NO: 725387 - DNA, 13 bp, C. elegans
tcaagttttcttg

SEQ ID NO: 725388 - DNA, 13 bp, C. elegans
tcaagttttgatt

SEQ ID NO: 725389 - DNA, 13 bp, C. elegans
tcaagtttttatc

SEQ ID NO: 725390 - DNA, 13 bp, C. elegans
tcaagtttttcaa

SEQ ID NO: 725391 - DNA, 13 bp, C. elegans
tcaagtttttgag

SEQ ID NO: 725392 - DNA, 13 bp, C. elegans
tcaagttttttat

SEQ ID NO: 725393 - DNA, 13 bp, C. elegans
tcaagttttttca

SEQ ID NO: 725394 - DNA, 13 bp, C. elegans
tcaataaaaacga

SEQ ID NO: 725395 - DNA, 13 bp, C. elegans
tcaataaaaactt

SEQ ID NO: 725396 - DNA, 13 bp, C. elegans
tcaataaaactgt

SEQ ID NO: 725397 - DNA, 13 bp, C. elegans
tcaataaaatatc

SEQ ID NO: 725398 - DNA, 13 bp, C. elegans
tcaataaaatcat

SEQ ID NO: 725399 - DNA, 13 bp, C. elegans
tcaataaaatcca

SEQ ID NO: 725400 - DNA, 13 bp, C. elegans
tcaataaacatat

SEQ ID NO: 725401 - DNA, 13 bp, C. elegans
tcaataaagtttc

SEQ ID NO: 725402 - DNA, 13 bp, C. elegans
tcaataaatcata

SEQ ID NO: 725403 - DNA, 13 bp, C. elegans
tcaataaatcgaa

SEQ ID NO: 725404 - DNA, 13 bp, C. elegans
tcaataaatgttt

SEQ ID NO: 725405 - DNA, 13 bp, C. elegans
tcaataaatttca

SEQ ID NO: 725406 - DNA, 13 bp, C. elegans
tcaataaatttcg

SEQ ID NO: 725407 - DNA, 13 bp, C. elegans
tcaataacttttc

SEQ ID NO: 725408 - DNA, 13 bp, C. elegans
tcaataacttttg

SEQ ID NO: 725409 - DNA, 13 bp, C. elegans
tcaataagaaatt

SEQ ID NO: 725410 - DNA, 13 bp, C. elegans
tcaataattcttt

SEQ ID NO: 725411 - DNA, 13 bp, C. elegans
tcaataattgaaa

SEQ ID NO: 725412 - DNA, 13 bp, C. elegans
tcaataatttcca

SEQ ID NO: 725413 - DNA, 13 bp, C. elegans
tcaataatttcga

SEQ ID NO: 725414 - DNA, 13 bp, C. elegans
tcaataattttcg

SEQ ID NO: 725415 - DNA, 13 bp, C. elegans
tcaataatttttc

SEQ ID NO: 725416 - DNA, 13 bp, C. elegans
tcaatacacaaca

SEQ ID NO: 725417 - DNA, 13 bp, C. elegans
tcaatacacattt

SEQ ID NO: 725418 - DNA, 13 bp, C. elegans
tcaatacactttt

SEQ ID NO: 725419 - DNA, 13 bp, C. elegans
tcaatacattttt

SEQ ID NO: 725420 - DNA, 13 bp, C. elegans
tcaatactatttc

SEQ ID NO: 725421 - DNA, 13 bp, C. elegans
tcaatagaatttt

SEQ ID NO: 725422 - DNA, 13 bp, C. elegans
tcaatagagcgca

SEQ ID NO: 725423 - DNA, 13 bp, C. elegans
tcaatagagcgcg

SEQ ID NO: 725424 - DNA, 13 bp, C. elegans
tcaatagtttgaa

SEQ ID NO: 725425 - DNA, 15 bp, C. elegans
tcaatatatttctga

SEQ ID NO: 725426 - DNA, 13 bp, C. elegans
tcaatatatttga

SEQ ID NO: 725427 - DNA, 13 bp, C. elegans
tcaatatcaactt

SEQ ID NO: 725428 - DNA, 13 bp, C. elegans
tcaatatcttctg

SEQ ID NO: 725429 - DNA, 13 bp, C. elegans
tcaatattctgaa

SEQ ID NO: 725430 - DNA, 13 bp, C. elegans
tcaatattgattt

SEQ ID NO: 725431 - DNA, 13 bp, C. elegans
tcaatatttcaaa

SEQ ID NO: 725432 - DNA, 13 bp, C. elegans
tcaatatttccag

SEQ ID NO: 725433 - DNA, 13 bp, C. elegans
tcaatatttcgaa

SEQ ID NO: 725434 - DNA, 13 bp, C. elegans
tcaatatttgaac

SEQ ID NO: 725435 - DNA, 13 bp, C. elegans
tcaatatttgtta

SEQ ID NO: 725436 - DNA, 13 bp, C. elegans
tcaatattttcaa

SEQ ID NO: 725437 - DNA, 13 bp, C. elegans
tcaatattttcta

SEQ ID NO: 725438 - DNA, 13 bp, C. elegans
tcaatattttgaa

SEQ ID NO: 725439 - DNA, 13 bp, C. elegans
tcaatatttttga

SEQ ID NO: 725440 - DNA, 14 bp, C. elegans
tcaatatttttgtt

SEQ ID NO: 725441 - DNA, 13 bp, C. elegans
tcaatcaaaaatc

SEQ ID NO: 725442 - DNA, 13 bp, C. elegans
tcaatcaaaactc

SEQ ID NO: 725443 - DNA, 13 bp, C. elegans
tcaatcaaataat

SEQ ID NO: 725444 - DNA, 13 bp, C. elegans
tcaatcaaatatt

SEQ ID NO: 725445 - DNA, 13 bp, C. elegans
tcaatcaaatcaa

SEQ ID NO: 725446 - DNA, 13 bp, C. elegans
tcaatcaaattga

SEQ ID NO: 725447 - DNA, 13 bp, C. elegans
tcaatcaacgaaa

SEQ ID NO: 725448 - DNA, 13 bp, C. elegans
tcaatcaataatt

SEQ ID NO: 725449 - DNA, 13 bp, C. elegans
tcaatcaatattt

SEQ ID NO: 725450 - DNA, 13 bp, C. elegans
tcaatcaatcaaa

SEQ ID NO: 725451 - DNA, 13 bp, C. elegans
tcaatcaatcaat

SEQ ID NO: 725452 - DNA, 13 bp, C. elegans
tcaatcaattcaa

SEQ ID NO: 725453 - DNA, 13 bp, C. elegans
tcaatcacttttt

SEQ ID NO: 725454 - DNA, 13 bp, C. elegans
tcaatcagttttt

SEQ ID NO: 725455 - DNA, 13 bp, C. elegans
tcaatcattcaaa

SEQ ID NO: 725456 - DNA, 13 bp, C. elegans
tcaatcatttctt

SEQ ID NO: 725457 - DNA, 13 bp, C. elegans
tcaatcatttttc

SEQ ID NO: 725458 - DNA, 13 bp, C. elegans
tcaatcgaaaatt

SEQ ID NO: 725459 - DNA, 13 bp, C. elegans
tcaatcgtttttc

SEQ ID NO: 725460 - DNA, 13 bp, C. elegans
tcaatctcaaaaa

SEQ ID NO: 725461 - DNA, 13 bp, C. elegans
tcaatctcatttt

SEQ ID NO: 725462 - DNA, 13 bp, C. elegans
tcaatctgaaaat

SEQ ID NO: 725463 - DNA, 13 bp, C. elegans
tcaatctgaaatt

SEQ ID NO: 725464 - DNA, 13 bp, C. elegans
tcaatctgttttt

SEQ ID NO: 725465 - DNA, 13 bp, C. elegans
tcaatcttcaaat

SEQ ID NO: 725466 - DNA, 13 bp, C. elegans
tcaatcttccaaa

SEQ ID NO: 725467 - DNA, 13 bp, C. elegans
tcaatctttaaaa

SEQ ID NO: 725468 - DNA, 13 bp, C. elegans
tcaatgaaaaaac

SEQ ID NO: 725469 - DNA, 13 bp, C. elegans
tcaatgaaaaatc

SEQ ID NO: 725470 - DNA, 13 bp, C. elegans
tcaatgaaaatta

SEQ ID NO: 725471 - DNA, 13 bp, C. elegans
tcaatgaaaattg

SEQ ID NO: 725472 - DNA, 13 bp, C. elegans
tcaatgaaattgt

SEQ ID NO: 725473 - DNA, 13 bp, C. elegans
tcaatgaaatttg

SEQ ID NO: 725474 - DNA, 13 bp, C. elegans
tcaatgacttttt

SEQ ID NO: 725475 - DNA, 13 bp, C. elegans
tcaatgagaaaga

SEQ ID NO: 725476 - DNA, 13 bp, C. elegans
tcaatgagtattt

SEQ ID NO: 725477 - DNA, 13 bp, C. elegans
tcaatgagtgttt

SEQ ID NO: 725478 - DNA, 13 bp, C. elegans
tcaatgatttatt

SEQ ID NO: 725479 - DNA, 13 bp, C. elegans
tcaatgatttgaa

SEQ ID NO: 725480 - DNA, 13 bp, C. elegans
tcaatgattttat

SEQ ID NO: 725481 - DNA, 13 bp, C. elegans
tcaatgattttca

SEQ ID NO: 725482 - DNA, 13 bp, C. elegans
tcaatgcaaaaaa

SEQ ID NO: 725483 - DNA, 13 bp, C. elegans
tcaatgcaaaaat

SEQ ID NO: 725484 - DNA, 13 bp, C. elegans
tcaatgcaaaatt

SEQ ID NO: 725485 - DNA, 13 bp, C. elegans
tcaatgctttgaa

SEQ ID NO: 725486 - DNA, 13 bp, C. elegans
tcaatggaaaaat

SEQ ID NO: 725487 - DNA, 13 bp, C. elegans
tcaatggaaaatt

SEQ ID NO: 725488 - DNA, 13 bp, C. elegans
tcaatgggtaata

SEQ ID NO: 725489 - DNA, 13 bp, C. elegans
tcaatgtaattga

SEQ ID NO: 725490 - DNA, 13 bp, C. elegans
tcaatgtatttta

SEQ ID NO: 725491 - DNA, 13 bp, C. elegans
tcaatgtattttc

SEQ ID NO: 725492 - DNA, 13 bp, C. elegans
tcaatgtattttt

SEQ ID NO: 725493 - DNA, 13 bp, C. elegans
tcaatgtcatcaa

SEQ ID NO: 725494 - DNA, 13 bp, C. elegans
tcaatgtgaaaaa

SEQ ID NO: 725495 - DNA, 13 bp, C. elegans
tcaatgtgttttt

SEQ ID NO: 725496 - DNA, 13 bp, C. elegans
tcaatgttcaata

SEQ ID NO: 725497 - DNA, 13 bp, C. elegans
tcaatgtttaatt

SEQ ID NO: 725498 - DNA, 13 bp, C. elegans
tcaatgtttccta

SEQ ID NO: 725499 - DNA, 13 bp, C. elegans
tcaatgtttcgaa

SEQ ID NO: 725500 - DNA, 13 bp, C. elegans
tcaatgttttctt

SEQ ID NO: 725501 - DNA, 13 bp, C. elegans
tcaatgtttttca

SEQ ID NO: 725502 - DNA, 13 bp, C. elegans
tcaattaaatgtt

SEQ ID NO: 725503 - DNA, 13 bp, C. elegans
tcaattaacaatt

SEQ ID NO: 725504 - DNA, 13 bp, C. elegans
tcaattactaaaa

SEQ ID NO: 725505 - DNA, 13 bp, C. elegans
tcaattatcattt

SEQ ID NO: 725506 - DNA, 13 bp, C. elegans
tcaattatgaatt

SEQ ID NO: 725507 - DNA, 13 bp, C. elegans
tcaattattattc

SEQ ID NO: 725508 - DNA, 13 bp, C. elegans
tcaattattctaa

SEQ ID NO: 725509 - DNA, 13 bp, C. elegans
tcaattattgaaa

SEQ ID NO: 725510 - DNA, 13 bp, C. elegans
tcaattattgttt

SEQ ID NO: 725511 - DNA, 13 bp, C. elegans
tcaattatttcaa

SEQ ID NO: 725512 - DNA, 13 bp, C. elegans
tcaattatttcga

SEQ ID NO: 725513 - DNA, 13 bp, C. elegans
tcaattatttcta

SEQ ID NO: 725514 - DNA, 13 bp, C. elegans
tcaattatttgaa

SEQ ID NO: 725515 - DNA, 13 bp, C. elegans
tcaattatttgtt

SEQ ID NO: 725516 - DNA, 13 bp, C. elegans
tcaattcaaaaac

SEQ ID NO: 725517 - DNA, 13 bp, C. elegans
tcaattcaaaaat

SEQ ID NO: 725518 - DNA, 13 bp, C. elegans
tcaattcaaaatc

SEQ ID NO: 725519 - DNA, 13 bp, C. elegans
tcaattcaaatca

SEQ ID NO: 725520 - DNA, 13 bp, C. elegans
tcaattcaaattt

SEQ ID NO: 725521 - DNA, 13 bp, C. elegans
tcaattcaagatt

SEQ ID NO: 725522 - DNA, 13 bp, C. elegans
tcaattcaagttt

SEQ ID NO: 725523 - DNA, 13 bp, C. elegans
tcaattcaatcca

SEQ ID NO: 725524 - DNA, 13 bp, C. elegans
tcaattcaattca

SEQ ID NO: 725525 - DNA, 13 bp, C. elegans
tcaattcaattta

SEQ ID NO: 725526 - DNA, 13 bp, C. elegans
tcaattcattatt

SEQ ID NO: 725527 - DNA, 13 bp, C. elegans
tcaattcatttca

SEQ ID NO: 725528 - DNA, 13 bp, C. elegans
tcaattcattttc

SEQ ID NO: 725529 - DNA, 13 bp, C. elegans
tcaattccaaaaa

SEQ ID NO: 725530 - DNA, 13 bp, C. elegans
tcaattccatctt

SEQ ID NO: 725531 - DNA, 13 bp, C. elegans
tcaattccatttt

SEQ ID NO: 725532 - DNA, 13 bp, C. elegans
tcaattcggatga

SEQ ID NO: 725533 - DNA, 13 bp, C. elegans
tcaattctcaaaa

SEQ ID NO: 725534 - DNA, 13 bp, C. elegans
tcaattctcattt

SEQ ID NO: 725535 - DNA, 13 bp, C. elegans
tcaattctcgaaa

SEQ ID NO: 725536 - DNA, 13 bp, C. elegans
tcaattctctgaa

SEQ ID NO: 725537 - DNA, 13 bp, C. elegans
tcaattctggaaa

SEQ ID NO: 725538 - DNA, 13 bp, C. elegans
tcaattcttcaat

SEQ ID NO: 725539 - DNA, 13 bp, C. elegans
tcaattcttcttc

SEQ ID NO: 725540 - DNA, 13 bp, C. elegans
tcaattcttgcaa

SEQ ID NO: 725541 - DNA, 13 bp, C. elegans
tcaattctttgaa

SEQ ID NO: 725542 - DNA, 13 bp, C. elegans
tcaattcttttca

SEQ ID NO: 725543 - DNA, 13 bp, C. elegans
tcaattgaaaaat

SEQ ID NO: 725544 - DNA, 13 bp, C. elegans
tcaattgaaagtt

SEQ ID NO: 725545 - DNA, 13 bp, C. elegans
tcaattgaaattt

SEQ ID NO: 725546 - DNA, 13 bp, C. elegans
tcaattgaacaaa

SEQ ID NO: 725547 - DNA, 13 bp, C. elegans
tcaattgagaaat

SEQ ID NO: 725548 - DNA, 13 bp, C. elegans
tcaattgagcttt

SEQ ID NO: 725549 - DNA, 13 bp, C. elegans
tcaattgataaaa

SEQ ID NO: 725550 - DNA, 13 bp, C. elegans
tcaattgatgaaa

SEQ ID NO: 725551 - DNA, 13 bp, C. elegans
tcaattgattttt

SEQ ID NO: 725552 - DNA, 13 bp, C. elegans
tcaattggatgct

SEQ ID NO: 725553 - DNA, 13 bp, C. elegans
tcaattggttcca

SEQ ID NO: 725554 - DNA, 13 bp, C. elegans
tcaattgtgcact

SEQ ID NO: 725555 - DNA, 13 bp, C. elegans
tcaattgttgttt

SEQ ID NO: 725556 - DNA, 13 bp, C. elegans
tcaattgtttgaa

SEQ ID NO: 725557 - DNA, 13 bp, C. elegans
tcaattgttttca

SEQ ID NO: 725558 - DNA, 13 bp, C. elegans
tcaattgttttga

SEQ ID NO: 725559 - DNA, 13 bp, C. elegans
tcaattgtttttc

SEQ ID NO: 725560 - DNA, 13 bp, C. elegans
tcaatttaaaaca

SEQ ID NO: 725561 - DNA, 13 bp, C. elegans
tcaatttagaaat

SEQ ID NO: 725562 - DNA, 13 bp, C. elegans
tcaatttatcaaa

SEQ ID NO: 725563 - DNA, 13 bp, C. elegans
tcaatttatcaat

SEQ ID NO: 725564 - DNA, 13 bp, C. elegans
tcaatttatcgat

SEQ ID NO: 725565 - DNA, 13 bp, C. elegans
tcaatttatgagg

SEQ ID NO: 725566 - DNA, 13 bp, C. elegans
tcaatttatgatt

SEQ ID NO: 725567 - DNA, 13 bp, C. elegans
tcaatttatttgt

SEQ ID NO: 725568 - DNA, 13 bp, C. elegans
tcaatttcaaaga

SEQ ID NO: 725569 - DNA, 13 bp, C. elegans
tcaatttcaactt

SEQ ID NO: 725570 - DNA, 13 bp, C. elegans
tcaatttcaagat

SEQ ID NO: 725571 - DNA, 13 bp, C. elegans
tcaatttcaagtt

SEQ ID NO: 725572 - DNA, 13 bp, C. elegans
tcaatttcaatat

SEQ ID NO: 725573 - DNA, 13 bp, C. elegans
tcaatttcaatca

SEQ ID NO: 725574 - DNA, 13 bp, C. elegans
tcaatttcaatgt

SEQ ID NO: 725575 - DNA, 13 bp, C. elegans
tcaatttcacatt

SEQ ID NO: 725576 - DNA, 13 bp, C. elegans
tcaatttcagaaa

SEQ ID NO: 725577 - DNA, 13 bp, C. elegans
tcaatttcattta

SEQ ID NO: 725578 - DNA, 13 bp, C. elegans
tcaatttccaaat

SEQ ID NO: 725579 - DNA, 13 bp, C. elegans
tcaatttccatta

SEQ ID NO: 725580 - DNA, 13 bp, C. elegans
tcaatttccattt

SEQ ID NO: 725581 - DNA, 13 bp, C. elegans
tcaatttcctctt

SEQ ID NO: 725582 - DNA, 13 bp, C. elegans
tcaatttccttca

SEQ ID NO: 725583 - DNA, 13 bp, C. elegans
tcaatttcgaaat

SEQ ID NO: 725584 - DNA, 13 bp, C. elegans
tcaatttcgccaa

SEQ ID NO: 725585 - DNA, 13 bp, C. elegans
tcaatttcggtaa

SEQ ID NO: 725586 - DNA, 13 bp, C. elegans
tcaatttcgtgga

SEQ ID NO: 725587 - DNA, 13 bp, C. elegans
tcaatttctcaaa

SEQ ID NO: 725588 - DNA, 13 bp, C. elegans
tcaatttctctat

SEQ ID NO: 725589 - DNA, 13 bp, C. elegans
tcaatttctctga

SEQ ID NO: 725590 - DNA, 13 bp, C. elegans
tcaatttctgaaa

SEQ ID NO: 725591 - DNA, 13 bp, C. elegans
tcaatttctgcaa

SEQ ID NO: 725592 - DNA, 13 bp, C. elegans
tcaatttgaaaac

SEQ ID NO: 725593 - DNA, 13 bp, C. elegans
tcaatttgaaaat

SEQ ID NO: 725594 - DNA, 13 bp, C. elegans
tcaatttgaaatc

SEQ ID NO: 725595 - DNA, 13 bp, C. elegans
tcaatttgaacaa

SEQ ID NO: 725596 - DNA, 13 bp, C. elegans
tcaatttgaactt

SEQ ID NO: 725597 - DNA, 13 bp, C. elegans
tcaatttgaagtt

SEQ ID NO: 725598 - DNA, 13 bp, C. elegans
tcaatttgaatat

SEQ ID NO: 725599 - DNA, 13 bp, C. elegans
tcaatttgaatgt

SEQ ID NO: 725600 - DNA, 13 bp, C. elegans
tcaatttgacacc

SEQ ID NO: 725601 - DNA, 13 bp, C. elegans
tcaatttgagaat

SEQ ID NO: 725602 - DNA, 13 bp, C. elegans
tcaatttgataaa

SEQ ID NO: 725603 - DNA, 13 bp, C. elegans
tcaatttgattga

SEQ ID NO: 725604 - DNA, 13 bp, C. elegans
tcaatttgcaatt

SEQ ID NO: 725605 - DNA, 13 bp, C. elegans
tcaatttgccgat

SEQ ID NO: 725606 - DNA, 13 bp, C. elegans
tcaatttgtaaat

SEQ ID NO: 725607 - DNA, 13 bp, C. elegans
tcaatttgtacaa

SEQ ID NO: 725608 - DNA, 13 bp, C. elegans
tcaatttgttata

SEQ ID NO: 725609 - DNA, 13 bp, C. elegans
tcaatttgttgtt

SEQ ID NO: 725610 - DNA, 13 bp, C. elegans
tcaatttgtttcc

SEQ ID NO: 725611 - DNA, 13 bp, C. elegans
tcaattttaacaa

SEQ ID NO: 725612 - DNA, 13 bp, C. elegans
tcaattttaatcg

SEQ ID NO: 725613 - DNA, 13 bp, C. elegans
tcaattttaattg

SEQ ID NO: 725614 - DNA, 13 bp, C. elegans
tcaattttaccaa

SEQ ID NO: 725615 - DNA, 13 bp, C. elegans
tcaattttagata

SEQ ID NO: 725616 - DNA, 13 bp, C. elegans
tcaattttatatg

SEQ ID NO: 725617 - DNA, 13 bp, C. elegans
tcaattttatgac

SEQ ID NO: 725618 - DNA, 13 bp, C. elegans
tcaattttcaaaa

SEQ ID NO: 725619 - DNA, 13 bp, C. elegans
tcaattttcaaac

SEQ ID NO: 725620 - DNA, 13 bp, C. elegans
tcaattttcaaat

SEQ ID NO: 725621 - DNA, 13 bp, C. elegans
tcaattttcaatc

SEQ ID NO: 725622 - DNA, 13 bp, C. elegans
tcaattttcaatg

SEQ ID NO: 725623 - DNA, 13 bp, C. elegans
tcaattttcatca

SEQ ID NO: 725624 - DNA, 14 bp, C. elegans
tcaattttccaata

SEQ ID NO: 725625 - DNA, 13 bp, C. elegans
tcaattttccata

SEQ ID NO: 725626 - DNA, 13 bp, C. elegans
tcaattttcctaa

SEQ ID NO: 725627 - DNA, 13 bp, C. elegans
tcaattttcctca

SEQ ID NO: 725628 - DNA, 13 bp, C. elegans
tcaattttcgtct

SEQ ID NO: 725629 - DNA, 13 bp, C. elegans
tcaattttctaca

SEQ ID NO: 725630 - DNA, 13 bp, C. elegans
tcaattttctata

SEQ ID NO: 725631 - DNA, 13 bp, C. elegans
tcaattttctcga

SEQ ID NO: 725632 - DNA, 13 bp, C. elegans
tcaattttctgtc

SEQ ID NO: 725633 - DNA, 13 bp, C. elegans
tcaattttcttaa

SEQ ID NO: 725634 - DNA, 13 bp, C. elegans
tcaattttcttca

SEQ ID NO: 725635 - DNA, 13 bp, C. elegans
tcaattttgaatt

SEQ ID NO: 725636 - DNA, 13 bp, C. elegans
tcaattttgacaa

SEQ ID NO: 725637 - DNA, 13 bp, C. elegans
tcaattttgagaa

SEQ ID NO: 725638 - DNA, 13 bp, C. elegans
tcaattttgatag

SEQ ID NO: 725639 - DNA, 13 bp, C. elegans
tcaattttgattt

SEQ ID NO: 725640 - DNA, 13 bp, C. elegans
tcaattttgctcc

SEQ ID NO: 725641 - DNA, 13 bp, C. elegans
tcaattttgtcaa

SEQ ID NO: 725642 - DNA, 13 bp, C. elegans
tcaattttgtgta

SEQ ID NO: 725643 - DNA, 13 bp, C. elegans
tcaattttgttta

SEQ ID NO: 725644 - DNA, 13 bp, C. elegans
tcaatttttacat

SEQ ID NO: 725645 - DNA, 13 bp, C. elegans
tcaatttttactc

SEQ ID NO: 725646 - DNA, 13 bp, C. elegans
tcaatttttagaa

SEQ ID NO: 725647 - DNA, 13 bp, C. elegans
tcaatttttatac

SEQ ID NO: 725648 - DNA, 13 bp, C. elegans
tcaatttttatga

SEQ ID NO: 725649 - DNA, 13 bp, C. elegans
tcaatttttatgc

SEQ ID NO: 725650 - DNA, 13 bp, C. elegans
tcaatttttcatc

SEQ ID NO: 725651 - DNA, 13 bp, C. elegans
tcaatttttccaa

SEQ ID NO: 725652 - DNA, 13 bp, C. elegans
tcaatttttccca

SEQ ID NO: 725653 - DNA, 13 bp, C. elegans
tcaatttttccga

SEQ ID NO: 725654 - DNA, 13 bp, C. elegans
tcaatttttccta

SEQ ID NO: 725655 - DNA, 13 bp, C. elegans
tcaatttttcgat

SEQ ID NO: 725656 - DNA, 13 bp, C. elegans
tcaatttttcgcc

SEQ ID NO: 725657 - DNA, 13 bp, C. elegans
tcaatttttcgct

SEQ ID NO: 725658 - DNA, 13 bp, C. elegans
tcaatttttctcg

SEQ ID NO: 725659 - DNA, 13 bp, C. elegans
tcaatttttgcaa

SEQ ID NO: 725660 - DNA, 13 bp, C. elegans
tcaatttttgtat

SEQ ID NO: 725661 - DNA, 14 bp, C. elegans
tcaatttttgttat

SEQ ID NO: 725662 - DNA, 13 bp, C. elegans
tcaattttttcca

SEQ ID NO: 725663 - DNA, 13 bp, C. elegans
tcaattttttccg

SEQ ID NO: 725664 - DNA, 13 bp, C. elegans
tcaattttttctg

SEQ ID NO: 725665 - DNA, 13 bp, C. elegans
tcaattttttgat

SEQ ID NO: 725666 - DNA, 13 bp, C. elegans
tcaatttttttga

SEQ ID NO: 725667 - DNA, 13 bp, C. elegans
tcacaaaaaatct

SEQ ID NO: 725668 - DNA, 13 bp, C. elegans
tcacaaaaaatgg

SEQ ID NO: 725669 - DNA, 13 bp, C. elegans
tcacaaaaatatt

SEQ ID NO: 725670 - DNA, 13 bp, C. elegans
tcacaaaaattgc

SEQ ID NO: 725671 - DNA, 13 bp, C. elegans
tcacaaaacttca

SEQ ID NO: 725672 - DNA, 13 bp, C. elegans
tcacaaaataatt

SEQ ID NO: 725673 - DNA, 13 bp, C. elegans
tcacaaaatattt

SEQ ID NO: 725674 - DNA, 13 bp, C. elegans
tcacaaaatcaat

SEQ ID NO: 725675 - DNA, 13 bp, C. elegans
tcacaaaatcgat

SEQ ID NO: 725676 - DNA, 13 bp, C. elegans
tcacaaaatctca

SEQ ID NO: 725677 - DNA, 13 bp, C. elegans
tcacaaaatgaaa

SEQ ID NO: 725678 - DNA, 13 bp, C. elegans
tcacaaaattaat

SEQ ID NO: 725679 - DNA, 13 bp, C. elegans
tcacaaaattatt

SEQ ID NO: 725680 - DNA, 13 bp, C. elegans
tcacaaaatttaa

SEQ ID NO: 725681 - DNA, 13 bp, C. elegans
tcacaaactacaa

SEQ ID NO: 725682 - DNA, 13 bp, C. elegans
tcacaaactgtat

SEQ ID NO: 725683 - DNA, 13 bp, C. elegans
tcacaaactttat

SEQ ID NO: 725684 - DNA, 13 bp, C. elegans
tcacaaactttcc

SEQ ID NO: 725685 - DNA, 13 bp, C. elegans
tcacaaattccaa

SEQ ID NO: 725686 - DNA, 13 bp, C. elegans
tcacaaatttcca

SEQ ID NO: 725687 - DNA, 13 bp, C. elegans
tcacaaatttgtt

SEQ ID NO: 725688 - DNA, 13 bp, C. elegans
tcacaaattttca

SEQ ID NO: 725689 - DNA, 13 bp, C. elegans
tcacaacatttct

SEQ ID NO: 725690 - DNA, 13 bp, C. elegans
tcacaacattttc

SEQ ID NO: 725691 - DNA, 13 bp, C. elegans
tcacaacattttg

SEQ ID NO: 725692 - DNA, 13 bp, C. elegans
tcacaacttttct

SEQ ID NO: 725693 - DNA, 13 bp, C. elegans
tcacaacttttta

SEQ ID NO: 725694 - DNA, 13 bp, C. elegans
tcacaagttcaca

SEQ ID NO: 725695 - DNA, 13 bp, C. elegans
tcacaatgttttt

SEQ ID NO: 725696 - DNA, 13 bp, C. elegans
tcacaattaattt

SEQ ID NO: 725697 - DNA, 13 bp, C. elegans
tcacaattgaaat

SEQ ID NO: 725698 - DNA, 13 bp, C. elegans
tcacaatttctgc

SEQ ID NO: 725699 - DNA, 13 bp, C. elegans
tcacaatttcttt

SEQ ID NO: 725700 - DNA, 13 bp, C. elegans
tcacaatttgttc

SEQ ID NO: 725701 - DNA, 13 bp, C. elegans
tcacaattttccg

SEQ ID NO: 725702 - DNA, 13 bp, C. elegans
tcacaattttcgg

SEQ ID NO: 725703 - DNA, 13 bp, C. elegans
tcacaattttctg

SEQ ID NO: 725704 - DNA, 13 bp, C. elegans
tcacaattttctt

SEQ ID NO: 725705 - DNA, 13 bp, C. elegans
tcacaatttttaa

SEQ ID NO: 725706 - DNA, 13 bp, C. elegans
tcacaatttttac

SEQ ID NO: 725707 - DNA, 13 bp, C. elegans
tcacaatttttgg

SEQ ID NO: 725708 - DNA, 13 bp, C. elegans
tcacaattttttc

SEQ ID NO: 725709 - DNA, 13 bp, C. elegans
tcacacaaaattc

SEQ ID NO: 725710 - DNA, 13 bp, C. elegans
tcacacactacaa

SEQ ID NO: 725711 - DNA, 13 bp, C. elegans
tcacacactctct

SEQ ID NO: 725712 - DNA, 13 bp, C. elegans
tcacacagaaaaa

SEQ ID NO: 725713 - DNA, 13 bp, C. elegans
tcacacatttttt

SEQ ID NO: 725714 - DNA, 13 bp, C. elegans
tcacactaaaaat

SEQ ID NO: 725715 - DNA, 13 bp, C. elegans
tcacactacaaac

SEQ ID NO: 725716 - DNA, 13 bp, C. elegans
tcacactggattt

SEQ ID NO: 725717 - DNA, 13 bp, C. elegans
tcacactttttta

SEQ ID NO: 725718 - DNA, 13 bp, C. elegans
tcacacttttttc

SEQ ID NO: 725719 - DNA, 13 bp, C. elegans
tcacacttttttg

SEQ ID NO: 725720 - DNA, 13 bp, C. elegans
tcacagaaaaact

SEQ ID NO: 725721 - DNA, 13 bp, C. elegans
tcacagaaaattg

SEQ ID NO: 725722 - DNA, 13 bp, C. elegans
tcacagaagaaac

SEQ ID NO: 725723 - DNA, 13 bp, C. elegans
tcacagattttta

SEQ ID NO: 725724 - DNA, 13 bp, C. elegans
tcacagcaaaaaa

SEQ ID NO: 725725 - DNA, 13 bp, C. elegans
tcacagttttacg

SEQ ID NO: 725726 - DNA, 13 bp, C. elegans
tcacagttttcaa

SEQ ID NO: 725727 - DNA, 13 bp, C. elegans
tcacatattttat

SEQ ID NO: 725728 - DNA, 13 bp, C. elegans
tcacatcaatttt

SEQ ID NO: 725729 - DNA, 13 bp, C. elegans
tcacatctatatt

SEQ ID NO: 725730 - DNA, 13 bp, C. elegans
tcacatggaagcc

SEQ ID NO: 725731 - DNA, 13 bp, C. elegans
tcacattacaaaa

SEQ ID NO: 725732 - DNA, 13 bp, C. elegans
tcacattattttc

SEQ ID NO: 725733 - DNA, 13 bp, C. elegans
tcacattcaaatt

SEQ ID NO: 725734 - DNA, 13 bp, C. elegans
tcacattgttttt

SEQ ID NO: 725735 - DNA, 13 bp, C. elegans
tcacatttaaatt

SEQ ID NO: 725736 - DNA, 13 bp, C. elegans
tcacatttatcaa

SEQ ID NO: 725737 - DNA, 13 bp, C. elegans
tcacatttcaaaa

SEQ ID NO: 725738 - DNA, 13 bp, C. elegans
tcacatttctcaa

SEQ ID NO: 725739 - DNA, 13 bp, C. elegans
tcacatttgaaat

SEQ ID NO: 725740 - DNA, 13 bp, C. elegans
tcacattttatca

SEQ ID NO: 725741 - DNA, 13 bp, C. elegans
tcacattttcact

SEQ ID NO: 725742 - DNA, 13 bp, C. elegans
tcacattttccag

SEQ ID NO: 725743 - DNA, 13 bp, C. elegans
tcacattttgttt

SEQ ID NO: 725744 - DNA, 13 bp, C. elegans
tcacatttttaag

SEQ ID NO: 725745 - DNA, 13 bp, C. elegans
tcacatttttcac

SEQ ID NO: 725746 - DNA, 13 bp, C. elegans
tcacatttttcag

SEQ ID NO: 725747 - DNA, 13 bp, C. elegans
tcacatttttcca

SEQ ID NO: 725748 - DNA, 13 bp, C. elegans
tcacatttttcga

SEQ ID NO: 725749 - DNA, 13 bp, C. elegans
tcacatttttctg

SEQ ID NO: 725750 - DNA, 13 bp, C. elegans
tcacattttttgg

SEQ ID NO: 725751 - DNA, 13 bp, C. elegans
tcacattttttgt

SEQ ID NO: 725752 - DNA, 13 bp, C. elegans
tcacatttttttg

SEQ ID NO: 725753 - DNA, 13 bp, C. elegans
tcaccaaaaaact

SEQ ID NO: 725754 - DNA, 13 bp, C. elegans
tcaccaaaaatga

SEQ ID NO: 725755 - DNA, 13 bp, C. elegans
tcaccaaataatt

SEQ ID NO: 725756 - DNA, 13 bp, C. elegans
tcaccaaatttta

SEQ ID NO: 725757 - DNA, 13 bp, C. elegans
tcaccaattgttt

SEQ ID NO: 725758 - DNA, 13 bp, C. elegans
tcaccaattttca

SEQ ID NO: 725759 - DNA, 13 bp, C. elegans
tcaccaatttttc

SEQ ID NO: 725760 - DNA, 13 bp, C. elegans
tcaccactttttc

SEQ ID NO: 725761 - DNA, 13 bp, C. elegans
tcaccactttttg

SEQ ID NO: 725762 - DNA, 13 bp, C. elegans
tcaccataattct

SEQ ID NO: 725763 - DNA, 13 bp, C. elegans
tcaccatttttca

SEQ ID NO: 725764 - DNA, 13 bp, C. elegans
tcacccaaaaatc

SEQ ID NO: 725765 - DNA, 13 bp, C. elegans
tcacccaaaacat

SEQ ID NO: 725766 - DNA, 13 bp, C. elegans
tcacccaattttc

SEQ ID NO: 725767 - DNA, 13 bp, C. elegans
tcaccgaaaaatc

SEQ ID NO: 725768 - DNA, 13 bp, C. elegans
tcaccgttcctcc

SEQ ID NO: 725769 - DNA, 13 bp, C. elegans
tcacctaaaaata

SEQ ID NO: 725770 - DNA, 13 bp, C. elegans
tcacctaaaaatt

SEQ ID NO: 725771 - DNA, 13 bp, C. elegans
tcacctaaaataa

SEQ ID NO: 725772 - DNA, 13 bp, C. elegans
tcacctattttca

SEQ ID NO: 725773 - DNA, 13 bp, C. elegans
tcacctatttttc

SEQ ID NO: 725774 - DNA, 13 bp, C. elegans
tcacctgacactt

SEQ ID NO: 725775 - DNA, 13 bp, C. elegans
tcacgagttcaag

SEQ ID NO: 725776 - DNA, 13 bp, C. elegans
tcacgattttctt

SEQ ID NO: 725777 - DNA, 13 bp, C. elegans
tcacgattttttt

SEQ ID NO: 725778 - DNA, 13 bp, C. elegans
tcacggatttctg

SEQ ID NO: 725779 - DNA, 13 bp, C. elegans
tcacgtctcccag

SEQ ID NO: 725780 - DNA, 13 bp, C. elegans
tcacgtggaaatg

SEQ ID NO: 725781 - DNA, 13 bp, C. elegans
tcacgttttcttt

SEQ ID NO: 725782 - DNA, 13 bp, C. elegans
tcactaattttct

SEQ ID NO: 725783 - DNA, 13 bp, C. elegans
tcactaggtcttc

SEQ ID NO: 725784 - DNA, 13 bp, C. elegans
tcactataaaatt

SEQ ID NO: 725785 - DNA, 13 bp, C. elegans
tcactatcatttt

SEQ ID NO: 725786 - DNA, 13 bp, C. elegans
tcactatttcagt

SEQ ID NO: 725787 - DNA, 13 bp, C. elegans
tcactattttgaa

SEQ ID NO: 725788 - DNA, 13 bp, C. elegans
tcactcaaaaaac

SEQ ID NO: 725789 - DNA, 13 bp, C. elegans
tcactcaaaaacc

SEQ ID NO: 725790 - DNA, 13 bp, C. elegans
tcactcaaaaatg

SEQ ID NO: 725791 - DNA, 13 bp, C. elegans
tcactcaaaattt

SEQ ID NO: 725792 - DNA, 13 bp, C. elegans
tcactcacaaaaa

SEQ ID NO: 725793 - DNA, 13 bp, C. elegans
tcactcacttttt

SEQ ID NO: 725794 - DNA, 13 bp, C. elegans
tcactcatttgcg

SEQ ID NO: 725795 - DNA, 13 bp, C. elegans
tcactcattttct

SEQ ID NO: 725796 - DNA, 13 bp, C. elegans
tcactcgatatgc

SEQ ID NO: 725797 - DNA, 13 bp, C. elegans
tcactcgttttct

SEQ ID NO: 725798 - DNA, 13 bp, C. elegans
tcactcgtttttc

SEQ ID NO: 725799 - DNA, 13 bp, C. elegans
tcactctctcact

SEQ ID NO: 725800 - DNA, 13 bp, C. elegans
tcactctttttgg

SEQ ID NO: 725801 - DNA, 13 bp, C. elegans
tcactgaaaaatc

SEQ ID NO: 725802 - DNA, 13 bp, C. elegans
tcactgaaattca

SEQ ID NO: 725803 - DNA, 13 bp, C. elegans
tcactgaaattga

SEQ ID NO: 725804 - DNA, 13 bp, C. elegans
tcactgattttct

SEQ ID NO: 725805 - DNA, 13 bp, C. elegans
tcactgttcaatt

SEQ ID NO: 725806 - DNA, 13 bp, C. elegans
tcactgtttcata

SEQ ID NO: 725807 - DNA, 13 bp, C. elegans
tcacttacaaaaa

SEQ ID NO: 725808 - DNA, 13 bp, C. elegans
tcacttcaaaaat

SEQ ID NO: 725809 - DNA, 13 bp, C. elegans
tcacttcaatttt

SEQ ID NO: 725810 - DNA, 13 bp, C. elegans
tcacttcattttc

SEQ ID NO: 725811 - DNA, 13 bp, C. elegans
tcacttccaattt

SEQ ID NO: 725812 - DNA, 13 bp, C. elegans
tcacttgaatttt

SEQ ID NO: 725813 - DNA, 13 bp, C. elegans
tcactttaaaaaa

SEQ ID NO: 725814 - DNA, 13 bp, C. elegans
tcactttaaaaat

SEQ ID NO: 725815 - DNA, 13 bp, C. elegans
tcactttatttca

SEQ ID NO: 725816 - DNA, 13 bp, C. elegans
tcactttcaagtt

SEQ ID NO: 725817 - DNA, 13 bp, C. elegans
tcactttcacatt

SEQ ID NO: 725818 - DNA, 13 bp, C. elegans
tcactttcttcat

SEQ ID NO: 725819 - DNA, 13 bp, C. elegans
tcactttgaaatt

SEQ ID NO: 725820 - DNA, 13 bp, C. elegans
tcactttgatatt

SEQ ID NO: 725821 - DNA, 13 bp, C. elegans
tcactttgttctg

SEQ ID NO: 725822 - DNA, 13 bp, C. elegans
tcactttgttttg

SEQ ID NO: 725823 - DNA, 13 bp, C. elegans
tcacttttaaaaa

SEQ ID NO: 725824 - DNA, 13 bp, C. elegans
tcacttttcaaaa

SEQ ID NO: 725825 - DNA, 13 bp, C. elegans
tcacttttcaaag

SEQ ID NO: 725826 - DNA, 13 bp, C. elegans
tcacttttcactt

SEQ ID NO: 725827 - DNA, 13 bp, C. elegans
tcacttttcagtg

SEQ ID NO: 725828 - DNA, 13 bp, C. elegans
tcacttttccaaa

SEQ ID NO: 725829 - DNA, 13 bp, C. elegans
tcacttttctgat

SEQ ID NO: 725830 - DNA, 13 bp, C. elegans
tcacttttcttca

SEQ ID NO: 725831 - DNA, 13 bp, C. elegans
tcactttttcaac

SEQ ID NO: 725832 - DNA, 13 bp, C. elegans
tcactttttcagt

SEQ ID NO: 725833 - DNA, 13 bp, C. elegans
tcactttttcata

SEQ ID NO: 725834 - DNA, 13 bp, C. elegans
tcactttttcatc

SEQ ID NO: 725835 - DNA, 13 bp, C. elegans
tcactttttgaat

SEQ ID NO: 725836 - DNA, 13 bp, C. elegans
tcactttttgttc

SEQ ID NO: 725837 - DNA, 13 bp, C. elegans
tcacttttttcgt

SEQ ID NO: 725838 - DNA, 13 bp, C. elegans
tcacttttttgat

SEQ ID NO: 725839 - DNA, 13 bp, C. elegans
tcagaaaaaaact

SEQ ID NO: 725840 - DNA, 13 bp, C. elegans
tcagaaaaaagtt

SEQ ID NO: 725841 - DNA, 13 bp, C. elegans
tcagaaaaaatca

SEQ ID NO: 725842 - DNA, 13 bp, C. elegans
tcagaaaaactgc

SEQ ID NO: 725843 - DNA, 13 bp, C. elegans
tcagaaaaagtgt

SEQ ID NO: 725844 - DNA, 13 bp, C. elegans
tcagaaaaatcaa

SEQ ID NO: 725845 - DNA, 13 bp, C. elegans
tcagaaaaatcac

SEQ ID NO: 725846 - DNA, 13 bp, C. elegans
tcagaaaaatggc

SEQ ID NO: 725847 - DNA, 13 bp, C. elegans
tcagaaaaatgtt

SEQ ID NO: 725848 - DNA, 13 bp, C. elegans
tcagaaaacacaa

SEQ ID NO: 725849 - DNA, 13 bp, C. elegans
tcagaaaaccaat

SEQ ID NO: 725850 - DNA, 13 bp, C. elegans
tcagaaaactcaa

SEQ ID NO: 725851 - DNA, 13 bp, C. elegans
tcagaaaacttaa

SEQ ID NO: 725852 - DNA, 13 bp, C. elegans
tcagaaaacttga

SEQ ID NO: 725853 - DNA, 13 bp, C. elegans
tcagaaaactttc

SEQ ID NO: 725854 - DNA, 13 bp, C. elegans
tcagaaaatatat

SEQ ID NO: 725855 - DNA, 13 bp, C. elegans
tcagaaaatcgat

SEQ ID NO: 725856 - DNA, 13 bp, C. elegans
tcagaaaatctaa

SEQ ID NO: 725857 - DNA, 13 bp, C. elegans
tcagaaaatggaa

SEQ ID NO: 725858 - DNA, 13 bp, C. elegans
tcagaaaatggat

SEQ ID NO: 725859 - DNA, 13 bp, C. elegans
tcagaaaattaac

SEQ ID NO: 725860 - DNA, 13 bp, C. elegans
tcagaaaattcta

SEQ ID NO: 725861 - DNA, 13 bp, C. elegans
tcagaaaattttg

SEQ ID NO: 725862 - DNA, 13 bp, C. elegans
tcagaaaccagaa

SEQ ID NO: 725863 - DNA, 13 bp, C. elegans
tcagaaacttcca

SEQ ID NO: 725864 - DNA, 13 bp, C. elegans
tcagaaactttct

SEQ ID NO: 725865 - DNA, 13 bp, C. elegans
tcagaaactttta

SEQ ID NO: 725866 - DNA, 13 bp, C. elegans
tcagaaagaaaat

SEQ ID NO: 725867 - DNA, 13 bp, C. elegans
tcagaaaggaaat

SEQ ID NO: 725868 - DNA, 13 bp, C. elegans
tcagaaagtttca

SEQ ID NO: 725869 - DNA, 13 bp, C. elegans
tcagaaatatttc

SEQ ID NO: 725870 - DNA, 13 bp, C. elegans
tcagaaatatttt

SEQ ID NO: 725871 - DNA, 13 bp, C. elegans
tcagaaatcattt

SEQ ID NO: 725872 - DNA, 13 bp, C. elegans
tcagaaatgtatt

SEQ ID NO: 725873 - DNA, 13 bp, C. elegans
tcagaaatgttga

SEQ ID NO: 725874 - DNA, 13 bp, C. elegans
tcagaaattatca

SEQ ID NO: 725875 - DNA, 13 bp, C. elegans
tcagaaattggaa

SEQ ID NO: 725876 - DNA, 13 bp, C. elegans
tcagaaatttaat

SEQ ID NO: 725877 - DNA, 13 bp, C. elegans
tcagaaatttatt

SEQ ID NO: 725878 - DNA, 13 bp, C. elegans
tcagaaatttcca

SEQ ID NO: 725879 - DNA, 13 bp, C. elegans
tcagaaatttgaa

SEQ ID NO: 725880 - DNA, 13 bp, C. elegans
tcagaaatttttg

SEQ ID NO: 725881 - DNA, 13 bp, C. elegans
tcagaactttcca

SEQ ID NO: 725882 - DNA, 13 bp, C. elegans
tcagaactttgaa

SEQ ID NO: 725883 - DNA, 13 bp, C. elegans
tcagaagcttcta

SEQ ID NO: 725884 - DNA, 13 bp, C. elegans
tcagaagttcaaa

SEQ ID NO: 725885 - DNA, 13 bp, C. elegans
tcagaagtttcaa

SEQ ID NO: 725886 - DNA, 13 bp, C. elegans
tcagaagtttcag

SEQ ID NO: 725887 - DNA, 13 bp, C. elegans
tcagaagtttctc

SEQ ID NO: 725888 - DNA, 13 bp, C. elegans
tcagaagtttttg

SEQ ID NO: 725889 - DNA, 13 bp, C. elegans
tcagaatatattg

SEQ ID NO: 725890 - DNA, 13 bp, C. elegans
tcagaatattcta

SEQ ID NO: 725891 - DNA, 13 bp, C. elegans
tcagaatattgtg

SEQ ID NO: 725892 - DNA, 13 bp, C. elegans
tcagaatcaaaaa

SEQ ID NO: 725893 - DNA, 13 bp, C. elegans
tcagaatcagaat

SEQ ID NO: 725894 - DNA, 13 bp, C. elegans
tcagaattaattt

SEQ ID NO: 725895 - DNA, 13 bp, C. elegans
tcagaattgaaaa

SEQ ID NO: 725896 - DNA, 13 bp, C. elegans
tcagaatttaaat

SEQ ID NO: 725897 - DNA, 13 bp, C. elegans
tcagaatttattt

SEQ ID NO: 725898 - DNA, 13 bp, C. elegans
tcagaatttcaac

SEQ ID NO: 725899 - DNA, 13 bp, C. elegans
tcagaatttcaat

SEQ ID NO: 725900 - DNA, 13 bp, C. elegans
tcagaatttcgat

SEQ ID NO: 725901 - DNA, 13 bp, C. elegans
tcagaattttaga

SEQ ID NO: 725902 - DNA, 13 bp, C. elegans
tcagaattttctt

SEQ ID NO: 725903 - DNA, 13 bp, C. elegans
tcagaattttgtg

SEQ ID NO: 725904 - DNA, 13 bp, C. elegans
tcagaatttttta

SEQ ID NO: 725905 - DNA, 13 bp, C. elegans
tcagaattttttc

SEQ ID NO: 725906 - DNA, 13 bp, C. elegans
tcagacaaaaatt

SEQ ID NO: 725907 - DNA, 13 bp, C. elegans
tcagacaaatttc

SEQ ID NO: 725908 - DNA, 13 bp, C. elegans
tcagacagaaatt

SEQ ID NO: 725909 - DNA, 13 bp, C. elegans
tcagacattttca

SEQ ID NO: 725910 - DNA, 13 bp, C. elegans
tcagacatttttc

SEQ ID NO: 725911 - DNA, 13 bp, C. elegans
tcagactacaaac

SEQ ID NO: 725912 - DNA, 13 bp, C. elegans
tcagagaaaaatt

SEQ ID NO: 725913 - DNA, 13 bp, C. elegans
tcagagaaaatat

SEQ ID NO: 725914 - DNA, 13 bp, C. elegans
tcagagaaacaaa

SEQ ID NO: 725915 - DNA, 13 bp, C. elegans
tcagagactacaa

SEQ ID NO: 725916 - DNA, 13 bp, C. elegans
tcagagctcattt

SEQ ID NO: 725917 - DNA, 13 bp, C. elegans
tcagagctccaag

SEQ ID NO: 725918 - DNA, 13 bp, C. elegans
tcagatagaacaa

SEQ ID NO: 725919 - DNA, 13 bp, C. elegans
tcagatatttgaa

SEQ ID NO: 725920 - DNA, 13 bp, C. elegans
tcagatattttga

SEQ ID NO: 725921 - DNA, 13 bp, C. elegans
tcagatcaatgga

SEQ ID NO: 725922 - DNA, 13 bp, C. elegans
tcagatctcatct

SEQ ID NO: 725923 - DNA, 13 bp, C. elegans
tcagatgaagtgg

SEQ ID NO: 725924 - DNA, 13 bp, C. elegans
tcagatgtatgat

SEQ ID NO: 725925 - DNA, 13 bp, C. elegans
tcagatgtttgaa

SEQ ID NO: 725926 - DNA, 13 bp, C. elegans
tcagattccaaaa

SEQ ID NO: 725927 - DNA, 13 bp, C. elegans
tcagatttaattt

SEQ ID NO: 725928 - DNA, 13 bp, C. elegans
tcagatttatttc

SEQ ID NO: 725929 - DNA, 13 bp, C. elegans
tcagatttcaaat

SEQ ID NO: 725930 - DNA, 13 bp, C. elegans
tcagatttgaata

SEQ ID NO: 725931 - DNA, 13 bp, C. elegans
tcagattttattt

SEQ ID NO: 725932 - DNA, 13 bp, C. elegans
tcagattttcaat

SEQ ID NO: 725933 - DNA, 13 bp, C. elegans
tcagattttcaca

SEQ ID NO: 725934 - DNA, 13 bp, C. elegans
tcagattttcagg

SEQ ID NO: 725935 - DNA, 13 bp, C. elegans
tcagattttgaaa

SEQ ID NO: 725936 - DNA, 13 bp, C. elegans
tcagattttttcc

SEQ ID NO: 725937 - DNA, 13 bp, C. elegans
tcagatttttttg

SEQ ID NO: 725938 - DNA, 13 bp, C. elegans
tcagcaaaaaatt

SEQ ID NO: 725939 - DNA, 13 bp, C. elegans
tcagcaaaaataa

SEQ ID NO: 725940 - DNA, 13 bp, C. elegans
tcagcaaaaattg

SEQ ID NO: 725941 - DNA, 13 bp, C. elegans
tcagcaaaattct

SEQ ID NO: 725942 - DNA, 13 bp, C. elegans
tcagcaaaatttc

SEQ ID NO: 725943 - DNA, 13 bp, C. elegans
tcagcaaattgaa

SEQ ID NO: 725944 - DNA, 13 bp, C. elegans
tcagcaaattttt

SEQ ID NO: 725945 - DNA, 13 bp, C. elegans
tcagcaatatttt

SEQ ID NO: 725946 - DNA, 13 bp, C. elegans
tcagcaatttaaa

SEQ ID NO: 725947 - DNA, 13 bp, C. elegans
tcagcaatttcca

SEQ ID NO: 725948 - DNA, 13 bp, C. elegans
tcagcaatttgcc

SEQ ID NO: 725949 - DNA, 13 bp, C. elegans
tcagcaattttct

SEQ ID NO: 725950 - DNA, 13 bp, C. elegans
tcagcaattttta

SEQ ID NO: 725951 - DNA, 13 bp, C. elegans
tcagcaatttttg

SEQ ID NO: 725952 - DNA, 13 bp, C. elegans
tcagcagaaaaaa

SEQ ID NO: 725953 - DNA, 13 bp, C. elegans
tcagcatcttcga

SEQ ID NO: 725954 - DNA, 13 bp, C. elegans
tcagcatttaaaa

SEQ ID NO: 725955 - DNA, 13 bp, C. elegans
tcagccaaatttg

SEQ ID NO: 725956 - DNA, 13 bp, C. elegans
tcagccaattttt

SEQ ID NO: 725957 - DNA, 14 bp, C. elegans
tcagccgtttcttt

SEQ ID NO: 725958 - DNA, 13 bp, C. elegans
tcagcgaaaaatt

SEQ ID NO: 725959 - DNA, 13 bp, C. elegans
tcagcgatttgct

SEQ ID NO: 725960 - DNA, 13 bp, C. elegans
tcagcggctggaa

SEQ ID NO: 725961 - DNA, 13 bp, C. elegans
tcagctaaaaact

SEQ ID NO: 725962 - DNA, 13 bp, C. elegans
tcagctaatttca

SEQ ID NO: 725963 - DNA, 13 bp, C. elegans
tcagctaattttc

SEQ ID NO: 725964 - DNA, 13 bp, C. elegans
tcagctcaaaaac

SEQ ID NO: 725965 - DNA, 13 bp, C. elegans
tcagctccaaaag

SEQ ID NO: 725966 - DNA, 13 bp, C. elegans
tcagctctcttct

SEQ ID NO: 725967 - DNA, 13 bp, C. elegans
tcagctctttttt

SEQ ID NO: 725968 - DNA, 13 bp, C. elegans
tcagctgaaaaaa

SEQ ID NO: 725969 - DNA, 13 bp, C. elegans
tcagctgaaaatt

SEQ ID NO: 725970 - DNA, 13 bp, C. elegans
tcagctgaaattc

SEQ ID NO: 725971 - DNA, 13 bp, C. elegans
tcagcttctcctt

SEQ ID NO: 725972 - DNA, 13 bp, C. elegans
tcagcttgaaatc

SEQ ID NO: 725973 - DNA, 13 bp, C. elegans
tcagctttattaa

SEQ ID NO: 725974 - DNA, 13 bp, C. elegans
tcagctttcaaaa

SEQ ID NO: 725975 - DNA, 13 bp, C. elegans
tcagcttttgaaa

SEQ ID NO: 725976 - DNA, 13 bp, C. elegans
tcagctttttctg

SEQ ID NO: 725977 - DNA, 13 bp, C. elegans
tcaggaaaaaacc

SEQ ID NO: 725978 - DNA, 13 bp, C. elegans
tcaggaaaagtgt

SEQ ID NO: 725979 - DNA, 13 bp, C. elegans
tcaggaaaatcga

SEQ ID NO: 725980 - DNA, 14 bp, C. elegans
tcaggaaatgagaa

SEQ ID NO: 725981 - DNA, 13 bp, C. elegans
tcaggagaaaatt

SEQ ID NO: 725982 - DNA, 13 bp, C. elegans
tcaggattaggct

SEQ ID NO: 725983 - DNA, 13 bp, C. elegans
tcaggattttgag

SEQ ID NO: 725984 - DNA, 13 bp, C. elegans
tcaggcaatttgc

SEQ ID NO: 725985 - DNA, 13 bp, C. elegans
tcaggctaaaagt

SEQ ID NO: 725986 - DNA, 13 bp, C. elegans
tcaggctgcacca

SEQ ID NO: 725987 - DNA, 13 bp, C. elegans
tcaggcttaggct

SEQ ID NO: 725988 - DNA, 13 bp, C. elegans
tcaggctttggcg

SEQ ID NO: 725989 - DNA, 13 bp, C. elegans
tcaggcttttttt

SEQ ID NO: 725990 - DNA, 17 bp, C. elegans
tcaggtacactgcctgg

SEQ ID NO: 725991 - DNA, 13 bp, C. elegans
tcaggtttatttt

SEQ ID NO: 725992 - DNA, 13 bp, C. elegans
tcagtaaaatttt

SEQ ID NO: 725993 - DNA, 13 bp, C. elegans
tcagtagagcgcg

SEQ ID NO: 725994 - DNA, 13 bp, C. elegans
tcagtatttttca

SEQ ID NO: 725995 - DNA, 13 bp, C. elegans
tcagtatttttga

SEQ ID NO: 725996 - DNA, 13 bp, C. elegans
tcagtcaaaaact

SEQ ID NO: 725997 - DNA, 13 bp, C. elegans
tcagtcaaaattt

SEQ ID NO: 725998 - DNA, 13 bp, C. elegans
tcagtcaaatatt

SEQ ID NO: 725999 - DNA, 13 bp, C. elegans
tcagtcaagtttt

SEQ ID NO: 726000 - DNA, 13 bp, C. elegans
tcagtcagaaaaa

SEQ ID NO: 726001 - DNA, 13 bp, C. elegans
tcagtcatttttc

SEQ ID NO: 726002 - DNA, 13 bp, C. elegans
tcagtccaatttt

SEQ ID NO: 726003 - DNA, 13 bp, C. elegans
tcagtctattgaa

SEQ ID NO: 726004 - DNA, 13 bp, C. elegans
tcagtcttttttc

SEQ ID NO: 726005 - DNA, 13 bp, C. elegans
tcagtgaaaaaaa

SEQ ID NO: 726006 - DNA, 13 bp, C. elegans
tcagtgaaaaaag

SEQ ID NO: 726007 - DNA, 13 bp, C. elegans
tcagtgaaaaact

SEQ ID NO: 726008 - DNA, 13 bp, C. elegans
tcagtgaaaatca

SEQ ID NO: 726009 - DNA, 13 bp, C. elegans
tcagtgaaaattt

SEQ ID NO: 726010 - DNA, 13 bp, C. elegans
tcagtgacttttt

SEQ ID NO: 726011 - DNA, 13 bp, C. elegans
tcagtgattttca

SEQ ID NO: 726012 - DNA, 13 bp, C. elegans
tcagtgcaatttc

SEQ ID NO: 726013 - DNA, 13 bp, C. elegans
tcagtgctttttt

SEQ ID NO: 726014 - DNA, 13 bp, C. elegans
tcagtggaaaatc

SEQ ID NO: 726015 - DNA, 13 bp, C. elegans
tcagtgtagtttt

SEQ ID NO: 726016 - DNA, 13 bp, C. elegans
tcagtgtgttttt

SEQ ID NO: 726017 - DNA, 13 bp, C. elegans
tcagtgtttcaat

SEQ ID NO: 726018 - DNA, 13 bp, C. elegans
tcagtgttttagc

SEQ ID NO: 726019 - DNA, 13 bp, C. elegans
tcagttaaaaaaa

SEQ ID NO: 726020 - DNA, 13 bp, C. elegans
tcagttaaagttt

SEQ ID NO: 726021 - DNA, 13 bp, C. elegans
tcagttcaaaatt

SEQ ID NO: 726022 - DNA, 13 bp, C. elegans
tcagttcaaattt

SEQ ID NO: 726023 - DNA, 13 bp, C. elegans
tcagttcaacttt

SEQ ID NO: 726024 - DNA, 13 bp, C. elegans
tcagttcattttc

SEQ ID NO: 726025 - DNA, 13 bp, C. elegans
tcagttcattttt

SEQ ID NO: 726026 - DNA, 13 bp, C. elegans
tcagttccaaaaa

SEQ ID NO: 726027 - DNA, 13 bp, C. elegans
tcagttcttgaaa

SEQ ID NO: 726028 - DNA, 13 bp, C. elegans
tcagttgaaaatc

SEQ ID NO: 726029 - DNA, 13 bp, C. elegans
tcagttgaacaaa

SEQ ID NO: 726030 - DNA, 13 bp, C. elegans
tcagttgctcatt

SEQ ID NO: 726031 - DNA, 13 bp, C. elegans
tcagttgttcttt

SEQ ID NO: 726032 - DNA, 13 bp, C. elegans
tcagtttaaaaaa

SEQ ID NO: 726033 - DNA, 13 bp, C. elegans
tcagtttaaaggc

SEQ ID NO: 726034 - DNA, 13 bp, C. elegans
tcagtttcaattt

SEQ ID NO: 726035 - DNA, 13 bp, C. elegans
tcagtttcagttt

SEQ ID NO: 726036 - DNA, 13 bp, C. elegans
tcagtttgaaatt

SEQ ID NO: 726037 - DNA, 13 bp, C. elegans
tcagtttgaactt

SEQ ID NO: 726038 - DNA, 13 bp, C. elegans
tcagttttaataa

SEQ ID NO: 726039 - DNA, 13 bp, C. elegans
tcagttttaattt

SEQ ID NO: 726040 - DNA, 13 bp, C. elegans
tcagttttattga

SEQ ID NO: 726041 - DNA, 13 bp, C. elegans
tcagttttattgt

SEQ ID NO: 726042 - DNA, 13 bp, C. elegans
tcagttttcaatt

SEQ ID NO: 726043 - DNA, 13 bp, C. elegans
tcagttttgaatt

SEQ ID NO: 726044 - DNA, 13 bp, C. elegans
tcagtttttacct

SEQ ID NO: 726045 - DNA, 13 bp, C. elegans
tcagtttttatca

SEQ ID NO: 726046 - DNA, 13 bp, C. elegans
tcagtttttcaag

SEQ ID NO: 726047 - DNA, 13 bp, C. elegans
tcagtttttcatt

SEQ ID NO: 726048 - DNA, 13 bp, C. elegans
tcagtttttccag

SEQ ID NO: 726049 - DNA, 13 bp, C. elegans
tcagtttttccat

SEQ ID NO: 726050 - DNA, 13 bp, C. elegans
tcagtttttcgat

SEQ ID NO: 726051 - DNA, 13 bp, C. elegans
tcagtttttgaat

SEQ ID NO: 726052 - DNA, 13 bp, C. elegans
tcagtttttgcaa

SEQ ID NO: 726053 - DNA, 13 bp, C. elegans
tcagtttttgcca

SEQ ID NO: 726054 - DNA, 13 bp, C. elegans
tcagtttttggaa

SEQ ID NO: 726055 - DNA, 13 bp, C. elegans
tcagttttttgaa

SEQ ID NO: 726056 - DNA, 13 bp, C. elegans
tcagttttttgtg

SEQ ID NO: 726057 - DNA, 13 bp, C. elegans
tcagtttttttga

SEQ ID NO: 726058 - DNA, 13 bp, C. elegans
tcataaaaatcta

SEQ ID NO: 726059 - DNA, 13 bp, C. elegans
tcataaaaatgtt

SEQ ID NO: 726060 - DNA, 13 bp, C. elegans
tcataaaacttat

SEQ ID NO: 726061 - DNA, 13 bp, C. elegans
tcataaaatctga

SEQ ID NO: 726062 - DNA, 13 bp, C. elegans
tcataaaatgaat

SEQ ID NO: 726063 - DNA, 13 bp, C. elegans
tcataaaattctt

SEQ ID NO: 726064 - DNA, 13 bp, C. elegans
tcataaaattgga

SEQ ID NO: 726065 - DNA, 13 bp, C. elegans
tcataaaatttga

SEQ ID NO: 726066 - DNA, 13 bp, C. elegans
tcataaactattt

SEQ ID NO: 726067 - DNA, 13 bp, C. elegans
tcataaacttgaa

SEQ ID NO: 726068 - DNA, 13 bp, C. elegans
tcataaatctcaa

SEQ ID NO: 726069 - DNA, 13 bp, C. elegans
tcataaatgtatt

SEQ ID NO: 726070 - DNA, 13 bp, C. elegans
tcataacttcaaa

SEQ ID NO: 726071 - DNA, 13 bp, C. elegans
tcataacttggct

SEQ ID NO: 726072 - DNA, 13 bp, C. elegans
tcataactttgct

SEQ ID NO: 726073 - DNA, 13 bp, C. elegans
tcataagaaattt

SEQ ID NO: 726074 - DNA, 13 bp, C. elegans
tcataagacggaa

SEQ ID NO: 726075 - DNA, 13 bp, C. elegans
tcataagtatttt

SEQ ID NO: 726076 - DNA, 13 bp, C. elegans
tcataagttgtta

SEQ ID NO: 726077 - DNA, 13 bp, C. elegans
tcataatcatcat

SEQ ID NO: 726078 - DNA, 13 bp, C. elegans
tcataatgagact

SEQ ID NO: 726079 - DNA, 13 bp, C. elegans
tcataatgttttt

SEQ ID NO: 726080 - DNA, 13 bp, C. elegans
tcataattcaaaa

SEQ ID NO: 726081 - DNA, 13 bp, C. elegans
tcataattctcaa

SEQ ID NO: 726082 - DNA, 13 bp, C. elegans
tcataattgtttt

SEQ ID NO: 726083 - DNA, 13 bp, C. elegans
tcataatttcaaa

SEQ ID NO: 726084 - DNA, 13 bp, C. elegans
tcataatttccag

SEQ ID NO: 726085 - DNA, 13 bp, C. elegans
tcataatttgaaa

SEQ ID NO: 726086 - DNA, 13 bp, C. elegans
tcataattttctg

SEQ ID NO: 726087 - DNA, 13 bp, C. elegans
tcatacaaatttt

SEQ ID NO: 726088 - DNA, 13 bp, C. elegans
tcatacagttttc

SEQ ID NO: 726089 - DNA, 13 bp, C. elegans
tcatacttttctc

SEQ ID NO: 726090 - DNA, 13 bp, C. elegans
tcatagaatttgt

SEQ ID NO: 726091 - DNA, 13 bp, C. elegans
tcatagattttct

SEQ ID NO: 726092 - DNA, 13 bp, C. elegans
tcatagattttta

SEQ ID NO: 726093 - DNA, 13 bp, C. elegans
tcatagttttatt

SEQ ID NO: 726094 - DNA, 13 bp, C. elegans
tcatagttttttc

SEQ ID NO: 726095 - DNA, 13 bp, C. elegans
tcatataattttc

SEQ ID NO: 726096 - DNA, 13 bp, C. elegans
tcatatcaaaatt

SEQ ID NO: 726097 - DNA, 13 bp, C. elegans
tcatatcatatca

SEQ ID NO: 726098 - DNA, 13 bp, C. elegans
tcatatctcaatt

SEQ ID NO: 726099 - DNA, 13 bp, C. elegans
tcatatctcattt

SEQ ID NO: 726100 - DNA, 13 bp, C. elegans
tcatatctgaaaa

SEQ ID NO: 726101 - DNA, 13 bp, C. elegans
tcatatcttcaaa

SEQ ID NO: 726102 - DNA, 13 bp, C. elegans
tcatatgaataaa

SEQ ID NO: 726103 - DNA, 13 bp, C. elegans
tcatatgtaaaaa

SEQ ID NO: 726104 - DNA, 13 bp, C. elegans
tcatatgttatca

SEQ ID NO: 726105 - DNA, 13 bp, C. elegans
tcatattacattt

SEQ ID NO: 726106 - DNA, 13 bp, C. elegans
tcatattatttac

SEQ ID NO: 726107 - DNA, 13 bp, C. elegans
tcatattattttg

SEQ ID NO: 726108 - DNA, 13 bp, C. elegans
tcatattcagaaa

SEQ ID NO: 726109 - DNA, 13 bp, C. elegans
tcatattccaatt

SEQ ID NO: 726110 - DNA, 13 bp, C. elegans
tcatattctaaat

SEQ ID NO: 726111 - DNA, 13 bp, C. elegans
tcatattgaaact

SEQ ID NO: 726112 - DNA, 13 bp, C. elegans
tcatatttcaaac

SEQ ID NO: 726113 - DNA, 13 bp, C. elegans
tcatatttcaaag

SEQ ID NO: 726114 - DNA, 13 bp, C. elegans
tcatatttcaatt

SEQ ID NO: 726115 - DNA, 13 bp, C. elegans
tcatatttgaaca

SEQ ID NO: 726116 - DNA, 13 bp, C. elegans
tcatattttaaac

SEQ ID NO: 726117 - DNA, 13 bp, C. elegans
tcatattttactc

SEQ ID NO: 726118 - DNA, 13 bp, C. elegans
tcatattttatgg

SEQ ID NO: 726119 - DNA, 13 bp, C. elegans
tcatattttcaat

SEQ ID NO: 726120 - DNA, 13 bp, C. elegans
tcatattttcaca

SEQ ID NO: 726121 - DNA, 13 bp, C. elegans
tcatattttgata

SEQ ID NO: 726122 - DNA, 13 bp, C. elegans
tcatattttgatt

SEQ ID NO: 726123 - DNA, 13 bp, C. elegans
tcatattttgcca

SEQ ID NO: 726124 - DNA, 13 bp, C. elegans
tcatattttgttc
